United States Patent 7,341,835 (METHODS OF ANALYSIS OF ALTERNATIVE SPLICING IN MOUSE) - sequence listing, part 11

SEQ ID NO: 398670 - DNA, 25 bp, Mus musculus
tttgtttccccagatcctgtcttcc

SEQ ID NO: 398671 - DNA, 25 bp, Mus musculus
tttgtttcgggacaactgccactcc

SEQ ID NO: 398672 - DNA, 25 bp, Mus musculus
tttgtttgaggaagctcacaagatg

SEQ ID NO: 398673 - DNA, 25 bp, Mus musculus
tttgtttgcaatcaattatactgga

SEQ ID NO: 398674 - DNA, 25 bp, Mus musculus
tttgtttgctcgctcgggcaaagtc

SEQ ID NO: 398675 - DNA, 25 bp, Mus musculus
tttgtttggtgctcctaaaaggaga

SEQ ID NO: 398676 - DNA, 25 bp, Mus musculus
tttgtttggtgttaggcaggaacag

SEQ ID NO: 398677 - DNA, 25 bp, Mus musculus
tttgttttacagcatgtacattgcc

SEQ ID NO: 398678 - DNA, 25 bp, Mus musculus
tttgttttacagcctttcccatggt

SEQ ID NO: 398679 - DNA, 25 bp, Mus musculus
tttgttttccagccaaatagaggag

SEQ ID NO: 398680 - DNA, 25 bp, Mus musculus
tttgttttggttggtatgctgtaca

SEQ ID NO: 398681 - DNA, 25 bp, Mus musculus
tttgtttttctggatcttgtttcct

SEQ ID NO: 398682 - DNA, 25 bp, Mus musculus
ttttaaaaaagtcgagcctgttgac

SEQ ID NO: 398683 - DNA, 25 bp, Mus musculus
ttttaaaaattgttgcttcctgttt

SEQ ID NO: 398684 - DNA, 25 bp, Mus musculus
ttttaaaactatcacttgtggaaga

SEQ ID NO: 398685 - DNA, 25 bp, Mus musculus
ttttaaaactttgctgcgagacaaa

SEQ ID NO: 398686 - DNA, 25 bp, Mus musculus
ttttaaaataatccaaggaagaatt

SEQ ID NO: 398687 - DNA, 25 bp, Mus musculus
ttttaaaataatcctgtcaaggtat

SEQ ID NO: 398688 - DNA, 25 bp, Mus musculus
ttttaaactaggtcgatccttcggg

SEQ ID NO: 398689 - DNA, 25 bp, Mus musculus
ttttaaagagacaggacctgataga

SEQ ID NO: 398690 - DNA, 25 bp, Mus musculus
ttttaaagagttgattccagaattc

SEQ ID NO: 398691 - DNA, 25 bp, Mus musculus
ttttaaagcatgcgcagatgacagg

SEQ ID NO: 398692 - DNA, 25 bp, Mus musculus
ttttaaagcatgggcagtagctcgt

SEQ ID NO: 398693 - DNA, 25 bp, Mus musculus
ttttaaagctgccatccatccagac

SEQ ID NO: 398694 - DNA, 25 bp, Mus musculus
ttttaaagtttgaggtgggatgtgt

SEQ ID NO: 398695 - DNA, 25 bp, Mus musculus
ttttaaataggttgtaggaagtgtc

SEQ ID NO: 398696 - DNA, 25 bp, Mus musculus
ttttaaatggggctctctaagtacc

SEQ ID NO: 398697 - DNA, 25 bp, Mus musculus
ttttaaatttcagattttatcatgt

SEQ ID NO: 398698 - DNA, 25 bp, Mus musculus
ttttaacaaggtgaactgaagattt

SEQ ID NO: 398699 - DNA, 25 bp, Mus musculus
ttttaaccagaaaggtgatctgtaa

SEQ ID NO: 398700 - DNA, 25 bp, Mus musculus
ttttaaccatagcatgctggagaag

SEQ ID NO: 398701 - DNA, 25 bp, Mus musculus
ttttaacctttggtgctttacatgg

SEQ ID NO: 398702 - DNA, 25 bp, Mus musculus
ttttaactgcattttaggagtgcat

SEQ ID NO: 398703 - DNA, 25 bp, Mus musculus
ttttaacttaatgtttgaaatgccc

SEQ ID NO: 398704 - DNA, 25 bp, Mus musculus
ttttaacttcagcaaggaccataat

SEQ ID NO: 398705 - DNA, 25 bp, Mus musculus
ttttaagaaacggagccagctgtgg

SEQ ID NO: 398706 - DNA, 25 bp, Mus musculus
ttttaagaagatttaccactcggcc

SEQ ID NO: 398707 - DNA, 25 bp, Mus musculus
ttttaagagagattcctttctcctt

SEQ ID NO: 398708 - DNA, 25 bp, Mus musculus
ttttaagagaggatttaacagtgcg

SEQ ID NO: 398709 - DNA, 25 bp, Mus musculus
ttttaagagaggtggctttgcagct

SEQ ID NO: 398710 - DNA, 25 bp, Mus musculus
ttttaagatgaaaatacttggaaaa

SEQ ID NO: 398711 - DNA, 25 bp, Mus musculus
ttttaagccagaacgctttaccgtg

SEQ ID NO: 398712 - DNA, 25 bp, Mus musculus
ttttaagccagagttgtaagcttga

SEQ ID NO: 398713 - DNA, 25 bp, Mus musculus
ttttaaggctgtctgatcccacagc

SEQ ID NO: 398714 - DNA, 25 bp, Mus musculus
ttttaatacagatactgggagtcct

SEQ ID NO: 398715 - DNA, 25 bp, Mus musculus
ttttaatacagatacttgtggcaat

SEQ ID NO: 398716 - DNA, 25 bp, Mus musculus
ttttaatcaagtacggcgagctcct

SEQ ID NO: 398717 - DNA, 25 bp, Mus musculus
ttttaatcaagtgctaccggactgg

SEQ ID NO: 398718 - DNA, 25 bp, Mus musculus
ttttaatcagttcaagtctgttatc

SEQ ID NO: 398719 - DNA, 25 bp, Mus musculus
ttttaatctgaaggggagaaaactg

SEQ ID NO: 398720 - DNA, 25 bp, Mus musculus
ttttaatgagctacccatgacatca

SEQ ID NO: 398721 - DNA, 25 bp, Mus musculus
ttttaatgatgaggtccttctgtag

SEQ ID NO: 398722 - DNA, 25 bp, Mus musculus
ttttaatggaacagatggcagtgaa

SEQ ID NO: 398723 - DNA, 25 bp, Mus musculus
ttttaatggggcccaaattcattgg

SEQ ID NO: 398724 - DNA, 25 bp, Mus musculus
ttttaattcagttgaaaagggcagg

SEQ ID NO: 398725 - DNA, 25 bp, Mus musculus
ttttaatttctctttcctctctctg

SEQ ID NO: 398726 - DNA, 25 bp, Mus musculus
ttttacaaaaggtcacaaccatgtc

SEQ ID NO: 398727 - DNA, 25 bp, Mus musculus
ttttacaaatggtattctctgaaaa

SEQ ID NO: 398728 - DNA, 25 bp, Mus musculus
ttttacaaatgttatccaagcatta

SEQ ID NO: 398729 - DNA, 25 bp, Mus musculus
ttttacaacaaaaggccaactactc

SEQ ID NO: 398730 - DNA, 25 bp, Mus musculus
ttttacaaggaagggcaaatgactt

SEQ ID NO: 398731 - DNA, 25 bp, Mus musculus
ttttacaataagagaccagcaccat

SEQ ID NO: 398732 - DNA, 25 bp, Mus musculus
ttttacaatgcagagactgatgaag

SEQ ID NO: 398733 - DNA, 25 bp, Mus musculus
ttttacaatgcagagagtgacctca

SEQ ID NO: 398734 - DNA, 25 bp, Mus musculus
ttttacacactccctgtcctgttag

SEQ ID NO: 398735 - DNA, 25 bp, Mus musculus
ttttacagggcaagcttgatgcttg

SEQ ID NO: 398736 - DNA, 25 bp, Mus musculus
ttttacataatccccagatgcagat

SEQ ID NO: 398737 - DNA, 25 bp, Mus musculus
ttttacataatcggggtctaatgga

SEQ ID NO: 398738 - DNA, 25 bp, Mus musculus
ttttacatactcaagctaccactac

SEQ ID NO: 398739 - DNA, 25 bp, Mus musculus
ttttacatattgcaagacgacaagg

SEQ ID NO: 398740 - DNA, 25 bp, Mus musculus
ttttacattgcaatggatgagtttc

SEQ ID NO: 398741 - DNA, 25 bp, Mus musculus
ttttacatttgtcataatccttcaa

SEQ ID NO: 398742 - DNA, 25 bp, Mus musculus
ttttaccggcactgggcactgaaag

SEQ ID NO: 398743 - DNA, 25 bp, Mus musculus
ttttacctattcatcgctccaccca

SEQ ID NO: 398744 - DNA, 25 bp, Mus musculus
ttttacctcaacagagaataggtga

SEQ ID NO: 398745 - DNA, 25 bp, Mus musculus
ttttacctcaacagggattctgaag

SEQ ID NO: 398746 - DNA, 25 bp, Mus musculus
ttttacctccgcacatccgtgaaga

SEQ ID NO: 398747 - DNA, 25 bp, Mus musculus
ttttacgccccgcaagactttcctt

SEQ ID NO: 398748 - DNA, 25 bp, Mus musculus
ttttacggagccagccatgagaagt

SEQ ID NO: 398749 - DNA, 25 bp, Mus musculus
ttttacggagccagttttataggta

SEQ ID NO: 398750 - DNA, 25 bp, Mus musculus
ttttacggagtaagccatgagaagt

SEQ ID NO: 398751 - DNA, 25 bp, Mus musculus
ttttactaaagttgttcaaggcctg

SEQ ID NO: 398752 - DNA, 25 bp, Mus musculus
ttttactaagagatgtggctttggg

SEQ ID NO: 398753 - DNA, 25 bp, Mus musculus
ttttactaatcaggattgtcttgcc

SEQ ID NO: 398754 - DNA, 25 bp, Mus musculus
ttttactatagccccagcgggaaga

SEQ ID NO: 398755 - DNA, 25 bp, Mus musculus
ttttactccagatggcagactttct

SEQ ID NO: 398756 - DNA, 25 bp, Mus musculus
ttttactccagccctggctgtccta

SEQ ID NO: 398757 - DNA, 25 bp, Mus musculus
ttttactccagccctggctgtcctg

SEQ ID NO: 398758 - DNA, 25 bp, Mus musculus
ttttactcggaccaacatatgctac

SEQ ID NO: 398759 - DNA, 25 bp, Mus musculus
ttttactgatgaattcctggcgcag

SEQ ID NO: 398760 - DNA, 25 bp, Mus musculus
ttttactgatgggcatccaacacct

SEQ ID NO: 398761 - DNA, 25 bp, Mus musculus
ttttactgtgaacagtatgtctgga

SEQ ID NO: 398762 - DNA, 25 bp, Mus musculus
ttttactgtggaagtgtggattctt

SEQ ID NO: 398763 - DNA, 25 bp, Mus musculus
ttttactgtggaagtgtggcttctt

SEQ ID NO: 398764 - DNA, 25 bp, Mus musculus
ttttacttaaatcgggagagtgtgc

SEQ ID NO: 398765 - DNA, 25 bp, Mus musculus
ttttacttcgcggagtgctctctgg

SEQ ID NO: 398766 - DNA, 25 bp, Mus musculus
ttttagaaagggggagctggtgacg

SEQ ID NO: 398767 - DNA, 25 bp, Mus musculus
ttttagaaccccggtggcgacagac

SEQ ID NO: 398768 - DNA, 25 bp, Mus musculus
ttttagaactaagaaataaagattt

SEQ ID NO: 398769 - DNA, 25 bp, Mus musculus
ttttagaactaagtagcaacccagc

SEQ ID NO: 398770 - DNA, 25 bp, Mus musculus
ttttagaagataggttaagagcagg

SEQ ID NO: 398771 - DNA, 25 bp, Mus musculus
ttttagaagcatggtcttagaaatg

SEQ ID NO: 398772 - DNA, 25 bp, Mus musculus
ttttagaaggccccaggacacattt

SEQ ID NO: 398773 - DNA, 25 bp, Mus musculus
ttttagacatagtagcaacccagct

SEQ ID NO: 398774 - DNA, 25 bp, Mus musculus
ttttagagatccctctgagaccacc

SEQ ID NO: 398775 - DNA, 25 bp, Mus musculus
ttttagagatgaggctggaggggta

SEQ ID NO: 398776 - DNA, 25 bp, Mus musculus
ttttagataagagttgtagtgcaag

SEQ ID NO: 398777 - DNA, 25 bp, Mus musculus
ttttagataagtatgaattacttct

SEQ ID NO: 398778 - DNA, 25 bp, Mus musculus
ttttagatatgcttggcctgtggag

SEQ ID NO: 398779 - DNA, 25 bp, Mus musculus
ttttagatctgcctcactagtagcc

SEQ ID NO: 398780 - DNA, 25 bp, Mus musculus
ttttagatgatcagagtggtaagaa

SEQ ID NO: 398781 - DNA, 25 bp, Mus musculus
ttttagccaccaggacacagaatgt

SEQ ID NO: 398782 - DNA, 25 bp, Mus musculus
ttttagcccagatagtcgccacatc

SEQ ID NO: 398783 - DNA, 25 bp, Mus musculus
ttttagcgttctccacccatgagga

SEQ ID NO: 398784 - DNA, 25 bp, Mus musculus
ttttaggactcagctccatgtctat

SEQ ID NO: 398785 - DNA, 25 bp, Mus musculus
ttttaggactcaggtctggctgtgc

SEQ ID NO: 398786 - DNA, 25 bp, Mus musculus
ttttaggaggtatcttgatgtggtt

SEQ ID NO: 398787 - DNA, 25 bp, Mus musculus
ttttaggattatagatcctggcagc

SEQ ID NO: 398788 - DNA, 25 bp, Mus musculus
ttttaggtgtaagcccatctgctgg

SEQ ID NO: 398789 - DNA, 25 bp, Mus musculus
ttttagtagcagaggtaactcagca

SEQ ID NO: 398790 - DNA, 25 bp, Mus musculus
ttttagtaggaagggcatttgtgta

SEQ ID NO: 398791 - DNA, 25 bp, Mus musculus
ttttagtccttgccctgccgaagat

SEQ ID NO: 398792 - DNA, 25 bp, Mus musculus
ttttagttaaaggtctctgtgttgg

SEQ ID NO: 398793 - DNA, 25 bp, Mus musculus
ttttataaaagatctgcagtgggtc

SEQ ID NO: 398794 - DNA, 25 bp, Mus musculus
ttttataaacagacatttccactgg

SEQ ID NO: 398795 - DNA, 25 bp, Mus musculus
ttttataaaggcagctgctgggatc

SEQ ID NO: 398796 - DNA, 25 bp, Mus musculus
ttttataacaaactggatgcagaga

SEQ ID NO: 398797 - DNA, 25 bp, Mus musculus
ttttatacaggactgacagacgaag

SEQ ID NO: 398798 - DNA, 25 bp, Mus musculus
ttttatagaccagtttgaatattcc

SEQ ID NO: 398799 - DNA, 25 bp, Mus musculus
ttttatatccacgataattttattc

SEQ ID NO: 398800 - DNA, 25 bp, Mus musculus
ttttatcccagaaatgtgaatcctc

SEQ ID NO: 398801 - DNA, 25 bp, Mus musculus
ttttatcccaggtgtgccattttga

SEQ ID NO: 398802 - DNA, 25 bp, Mus musculus
ttttatccccatggaaagggctgtg

SEQ ID NO: 398803 - DNA, 25 bp, Mus musculus
ttttatcctggtctctaataaagaa

SEQ ID NO: 398804 - DNA, 25 bp, Mus musculus
ttttatcctgtggtgtgagtgttga

SEQ ID NO: 398805 - DNA, 25 bp, Mus musculus
ttttatctataccagataaaaacta

SEQ ID NO: 398806 - DNA, 25 bp, Mus musculus
ttttatctcaggtgacataaatctt

SEQ ID NO: 398807 - DNA, 25 bp, Mus musculus
ttttatctgaaaggcttacctctaa

SEQ ID NO: 398808 - DNA, 25 bp, Mus musculus
ttttatctgaaagtggtcccaaacc

SEQ ID NO: 398809 - DNA, 25 bp, Mus musculus
ttttatgaaagcagggcttacatac

SEQ ID NO: 398810 - DNA, 25 bp, Mus musculus
ttttatgagcagggcgatgaagaag

SEQ ID NO: 398811 - DNA, 25 bp, Mus musculus
ttttatgatgagtgtaaaagaagat

SEQ ID NO: 398812 - DNA, 25 bp, Mus musculus
ttttatgatgagtgtttatcaccag

SEQ ID NO: 398813 - DNA, 25 bp, Mus musculus
ttttatgccaaaggctttaacagaa

SEQ ID NO: 398814 - DNA, 25 bp, Mus musculus
ttttatgcgaaattcaacatggcca

SEQ ID NO: 398815 - DNA, 25 bp, Mus musculus
ttttatgctgactgacccttcctac

SEQ ID NO: 398816 - DNA, 25 bp, Mus musculus
ttttatgctgactggtgtcgtttca

SEQ ID NO: 398817 - DNA, 25 bp, Mus musculus
ttttatgctttaggtgaaggcgata

SEQ ID NO: 398818 - DNA, 25 bp, Mus musculus
ttttatggtccaacgacctgagccc

SEQ ID NO: 398819 - DNA, 25 bp, Mus musculus
ttttatgtggggagagaaaagaaac

SEQ ID NO: 398820 - DNA, 25 bp, Mus musculus
ttttattaagctctgattcaatgaa

SEQ ID NO: 398821 - DNA, 25 bp, Mus musculus
ttttattaaggtggccatgcagatg

SEQ ID NO: 398822 - DNA, 25 bp, Mus musculus
ttttattcaggccacgcaacgggaa

SEQ ID NO: 398823 - DNA, 25 bp, Mus musculus
ttttattcagggatgtgaaatgatc

SEQ ID NO: 398824 - DNA, 25 bp, Mus musculus
ttttattcatccaacaactatttgg

SEQ ID NO: 398825 - DNA, 25 bp, Mus musculus
ttttattcatcccagaaggaagaat

SEQ ID NO: 398826 - DNA, 25 bp, Mus musculus
ttttattcatgcttaggtggagaaa

SEQ ID NO: 398827 - DNA, 25 bp, Mus musculus
ttttattcatttttctggatatgcc

SEQ ID NO: 398828 - DNA, 25 bp, Mus musculus
ttttattcctacgccagagatgcga

SEQ ID NO: 398829 - DNA, 25 bp, Mus musculus
ttttattcctacggatctcatagaa

SEQ ID NO: 398830 - DNA, 25 bp, Mus musculus
ttttattctgagcggtatcaagtta

SEQ ID NO: 398831 - DNA, 25 bp, Mus musculus
ttttatttctggaagctttgcaaaa

SEQ ID NO: 398832 - DNA, 25 bp, Mus musculus
ttttcaaaaaagaatatgatgctgt

SEQ ID NO: 398833 - DNA, 25 bp, Mus musculus
ttttcaaaaataattggtttggatt

SEQ ID NO: 398834 - DNA, 25 bp, Mus musculus
ttttcaaagattcaaggaagcctgg

SEQ ID NO: 398835 - DNA, 25 bp, Mus musculus
ttttcaaagcagttgaaaactgaac

SEQ ID NO: 398836 - DNA, 25 bp, Mus musculus
ttttcaaaggagcggatttccattt

SEQ ID NO: 398837 - DNA, 25 bp, Mus musculus
ttttcaaataagaatgaagagcatg

SEQ ID NO: 398838 - DNA, 25 bp, Mus musculus
ttttcaacaacaggcatgttacatg

SEQ ID NO: 398839 - DNA, 25 bp, Mus musculus
ttttcaacagattttgttcctggca

SEQ ID NO: 398840 - DNA, 25 bp, Mus musculus
ttttcaagaaatattatgctgaagt

SEQ ID NO: 398841 - DNA, 25 bp, Mus musculus
ttttcaagaaatgtatctttccgac

SEQ ID NO: 398842 - DNA, 25 bp, Mus musculus
ttttcaagatcaagcttctcttgca

SEQ ID NO: 398843 - DNA, 25 bp, Mus musculus
ttttcaagcccagctactaaaggag

SEQ ID NO: 398844 - DNA, 25 bp, Mus musculus
ttttcaagccctggtaacccatagt

SEQ ID NO: 398845 - DNA, 25 bp, Mus musculus
ttttcaagccctggtgtctcttgct

SEQ ID NO: 398846 - DNA, 25 bp, Mus musculus
ttttcaaggagaggtctggtccatc

SEQ ID NO: 398847 - DNA, 25 bp, Mus musculus
ttttcaaggagaggttgctatggtg

SEQ ID NO: 398848 - DNA, 25 bp, Mus musculus
ttttcaataatggactcccttttat

SEQ ID NO: 398849 - DNA, 25 bp, Mus musculus
ttttcaatcccagttacatttcaac

SEQ ID NO: 398850 - DNA, 25 bp, Mus musculus
ttttcaatcccagttatcttgacga

SEQ ID NO: 398851 - DNA, 25 bp, Mus musculus
ttttcaatgggaaagcgagcttgcc

SEQ ID NO: 398852 - DNA, 25 bp, Mus musculus
ttttcacaaatttatcctgtagtat

SEQ ID NO: 398853 - DNA, 25 bp, Mus musculus
ttttcacactgacttgaattttatg

SEQ ID NO: 398854 - DNA, 25 bp, Mus musculus
ttttcacagcctgtgaccatctttg

SEQ ID NO: 398855 - DNA, 25 bp, Mus musculus
ttttcacagtctttcaggcatgctg

SEQ ID NO: 398856 - DNA, 25 bp, Mus musculus
ttttcaccaagacacacccgcagtg

SEQ ID NO: 398857 - DNA, 25 bp, Mus musculus
ttttcaccaagacacaggggaagtc

SEQ ID NO: 398858 - DNA, 25 bp, Mus musculus
ttttcaccccaggcttacagttcct

SEQ ID NO: 398859 - DNA, 25 bp, Mus musculus
ttttcacctatctgggggcacctga

SEQ ID NO: 398860 - DNA, 25 bp, Mus musculus
ttttcacctgatagcatgtggcatg

SEQ ID NO: 398861 - DNA, 25 bp, Mus musculus
ttttcacgtctctggacaagccctc

SEQ ID NO: 398862 - DNA, 25 bp, Mus musculus
ttttcacgtggagcctgacagcagc

SEQ ID NO: 398863 - DNA, 25 bp, Mus musculus
ttttcacgtgggcgggccaggctgt

SEQ ID NO: 398864 - DNA, 25 bp, Mus musculus
ttttcagaaagtaaacgaagcaaaa

SEQ ID NO: 398865 - DNA, 25 bp, Mus musculus
ttttcagaaccagcctgggcccgaa

SEQ ID NO: 398866 - DNA, 25 bp, Mus musculus
ttttcagaaccagctttgaatggca

SEQ ID NO: 398867 - DNA, 25 bp, Mus musculus
ttttcagaagattcagatggggctg

SEQ ID NO: 398868 - DNA, 25 bp, Mus musculus
ttttcagaatatagagtcatggatg

SEQ ID NO: 398869 - DNA, 25 bp, Mus musculus
ttttcagacagctggttcgatgccc

SEQ ID NO: 398870 - DNA, 25 bp, Mus musculus
ttttcagaccaatacccacaggtcc

SEQ ID NO: 398871 - DNA, 25 bp, Mus musculus
ttttcagagctagaggatgtggaga

SEQ ID NO: 398872 - DNA, 25 bp, Mus musculus
ttttcagagttggaaacaacttcct

SEQ ID NO: 398873 - DNA, 25 bp, Mus musculus
ttttcagcggctcaggatggcctca

SEQ ID NO: 398874 - DNA, 25 bp, Mus musculus
ttttcagcggctcaggccctgccca

SEQ ID NO: 398875 - DNA, 25 bp, Mus musculus
ttttcagctatggaccgtcacgacg

SEQ ID NO: 398876 - DNA, 25 bp, Mus musculus
ttttcagctgtaatggtgcgtctaa

SEQ ID NO: 398877 - DNA, 25 bp, Mus musculus
ttttcaggatgacttgattatcttt

SEQ ID NO: 398878 - DNA, 25 bp, Mus musculus
ttttcaggcaaaagcgagcggagct

SEQ ID NO: 398879 - DNA, 25 bp, Mus musculus
ttttcagtcagatatactttattaa

SEQ ID NO: 398880 - DNA, 25 bp, Mus musculus
ttttcagtctaagtgtacacaggag

SEQ ID NO: 398881 - DNA, 25 bp, Mus musculus
ttttcatacagataaaaattattct

SEQ ID NO: 398882 - DNA, 25 bp, Mus musculus
ttttcataccagctgcttttatggt

SEQ ID NO: 398883 - DNA, 25 bp, Mus musculus
ttttcataggttggatgatacatgg

SEQ ID NO: 398884 - DNA, 25 bp, Mus musculus
ttttcatcatgggaggtgaggctct

SEQ ID NO: 398885 - DNA, 25 bp, Mus musculus
ttttcatcatggtcctccaggagga

SEQ ID NO: 398886 - DNA, 25 bp, Mus musculus
ttttcatccaggtggatcgcactcg

SEQ ID NO: 398887 - DNA, 25 bp, Mus musculus
ttttcatctctgagaacagaggcgt

SEQ ID NO: 398888 - DNA, 25 bp, Mus musculus
ttttcatctggagactgctcatctg

SEQ ID NO: 398889 - DNA, 25 bp, Mus musculus
ttttcatctggagagtctgcaggag

SEQ ID NO: 398890 - DNA, 25 bp, Mus musculus
ttttcatgatcatccagtcctcgct

SEQ ID NO: 398891 - DNA, 25 bp, Mus musculus
ttttcatggaagtgtgtgatgactg

SEQ ID NO: 398892 - DNA, 25 bp, Mus musculus
ttttcatggataaaggtgctggaga

SEQ ID NO: 398893 - DNA, 25 bp, Mus musculus
ttttcatggattcactagggaagga

SEQ ID NO: 398894 - DNA, 25 bp, Mus musculus
ttttcattaaaagctccaggtctgg

SEQ ID NO: 398895 - DNA, 25 bp, Mus musculus
ttttcattataagaacaacaaaacc

SEQ ID NO: 398896 - DNA, 25 bp, Mus musculus
ttttcattataagcatgatcgggag

SEQ ID NO: 398897 - DNA, 25 bp, Mus musculus
ttttcattccatagtgagttcttag

SEQ ID NO: 398898 - DNA, 25 bp, Mus musculus
ttttcattccattgtgagttcttag

SEQ ID NO: 398899 - DNA, 25 bp, Mus musculus
ttttcatttcaagatgtgcccttcc

SEQ ID NO: 398900 - DNA, 25 bp, Mus musculus
ttttccaacgccgagatgactgacc

SEQ ID NO: 398901 - DNA, 25 bp, Mus musculus
ttttccaagcagggaccaggataat

SEQ ID NO: 398902 - DNA, 25 bp, Mus musculus
ttttccaagcagttactgctgacct

SEQ ID NO: 398903 - DNA, 25 bp, Mus musculus
ttttccaatatggctttatcctctt

SEQ ID NO: 398904 - DNA, 25 bp, Mus musculus
ttttccaatcattagcaatcgtgga

SEQ ID NO: 398905 - DNA, 25 bp, Mus musculus
ttttccaatcattagggagctgtcc

SEQ ID NO: 398906 - DNA, 25 bp, Mus musculus
ttttccacaatacgcgccccctgta

SEQ ID NO: 398907 - DNA, 25 bp, Mus musculus
ttttccacacagttgaaaagggcag

SEQ ID NO: 398908 - DNA, 25 bp, Mus musculus
ttttccacctgtcagacccgccagg

SEQ ID NO: 398909 - DNA, 25 bp, Mus musculus
ttttccacggaagagtaaagacatt

SEQ ID NO: 398910 - DNA, 25 bp, Mus musculus
ttttccactatagtgagttctctgg

SEQ ID NO: 398911 - DNA, 25 bp, Mus musculus
ttttccagaagaccagtttcccaac

SEQ ID NO: 398912 - DNA, 25 bp, Mus musculus
ttttccagcaaagaattgggatatg

SEQ ID NO: 398913 - DNA, 25 bp, Mus musculus
ttttccagcaaaggtttagaccctc

SEQ ID NO: 398914 - DNA, 25 bp, Mus musculus
ttttccagcaagtggaacacatttc

SEQ ID NO: 398915 - DNA, 25 bp, Mus musculus
ttttccatcaagatcagagacacca

SEQ ID NO: 398916 - DNA, 25 bp, Mus musculus
ttttccattgggtcaggatcatgtc

SEQ ID NO: 398917 - DNA, 25 bp, Mus musculus
ttttccatttcaaggtctcaaaaga

SEQ ID NO: 398918 - DNA, 25 bp, Mus musculus
ttttcccaccaagcccacaaggccc

SEQ ID NO: 398919 - DNA, 25 bp, Mus musculus
ttttcccatcaacctgctgtcctgg

SEQ ID NO: 398920 - DNA, 25 bp, Mus musculus
ttttccccaaggcaagtcttggaag

SEQ ID NO: 398921 - DNA, 25 bp, Mus musculus
ttttccccaaggctagcttccgatc

SEQ ID NO: 398922 - DNA, 25 bp, Mus musculus
ttttcccccctcaagatcggcttcc

SEQ ID NO: 398923 - DNA, 25 bp, Mus musculus
ttttcccctgaagcattgaaaaagg

SEQ ID NO: 398924 - DNA, 25 bp, Mus musculus
ttttcccctgaagccaatcatctgg

SEQ ID NO: 398925 - DNA, 25 bp, Mus musculus
ttttccccttctgttgtactttgac

SEQ ID NO: 398926 - DNA, 25 bp, Mus musculus
ttttcccgagccaggatcttgtgct

SEQ ID NO: 398927 - DNA, 25 bp, Mus musculus
ttttcccgagtccagattgaacaca

SEQ ID NO: 398928 - DNA, 25 bp, Mus musculus
ttttcccgagtccaggccgacgtgg

SEQ ID NO: 398929 - DNA, 25 bp, Mus musculus
ttttccctcagaatgggtcagcccg

SEQ ID NO: 398930 - DNA, 25 bp, Mus musculus
ttttccctctagtggaaacaagttg

SEQ ID NO: 398931 - DNA, 25 bp, Mus musculus
ttttccctctagttgtgagcggcca

SEQ ID NO: 398932 - DNA, 25 bp, Mus musculus
ttttcctacagagagaacctggagg

SEQ ID NO: 398933 - DNA, 25 bp, Mus musculus
ttttcctagctgggctatggagtta

SEQ ID NO: 398934 - DNA, 25 bp, Mus musculus
ttttcctcagagcccagatgcccat

SEQ ID NO: 398935 - DNA, 25 bp, Mus musculus
ttttcctcagattgtctaaagccac

SEQ ID NO: 398936 - DNA, 25 bp, Mus musculus
ttttcctcaggcgcagacactcagt

SEQ ID NO: 398937 - DNA, 25 bp, Mus musculus
ttttcctcatggctgtgacattgag

SEQ ID NO: 398938 - DNA, 25 bp, Mus musculus
ttttcctccaaagatccattactaa

SEQ ID NO: 398939 - DNA, 25 bp, Mus musculus
ttttcctccaaaggagctctcaagt

SEQ ID NO: 398940 - DNA, 25 bp, Mus musculus
ttttcctccctatctgagctcttcc

SEQ ID NO: 398941 - DNA, 25 bp, Mus musculus
ttttcctctagacacctttctctcc

SEQ ID NO: 398942 - DNA, 25 bp, Mus musculus
ttttcctgaaagctttggatagatc

SEQ ID NO: 398943 - DNA, 25 bp, Mus musculus
ttttcctgaaagttaaatcggagat

SEQ ID NO: 398944 - DNA, 25 bp, Mus musculus
ttttcctgaagataggacgggagaa

SEQ ID NO: 398945 - DNA, 25 bp, Mus musculus
ttttcctgagagtttggattcgagt

SEQ ID NO: 398946 - DNA, 25 bp, Mus musculus
ttttcctgatcagggctccagtggt

SEQ ID NO: 398947 - DNA, 25 bp, Mus musculus
ttttcctgatcaggtaatgtatgtg

SEQ ID NO: 398948 - DNA, 25 bp, Mus musculus
ttttcctgggcacagaccgcgggac

SEQ ID NO: 398949 - DNA, 25 bp, Mus musculus
ttttcctgtgtcccgtgtcacaatg

SEQ ID NO: 398950 - DNA, 25 bp, Mus musculus
ttttcctttatagaggacaaggaat

SEQ ID NO: 398951 - DNA, 25 bp, Mus musculus
ttttcctttgagtccatcagcagtg

SEQ ID NO: 398952 - DNA, 25 bp, Mus musculus
ttttcctttggaaaagttgctgtgg

SEQ ID NO: 398953 - DNA, 25 bp, Mus musculus
ttttcgaactacttaaagaaagatc

SEQ ID NO: 398954 - DNA, 25 bp, Mus musculus
ttttcgacagtgcgaaaattttgcc

SEQ ID NO: 398955 - DNA, 25 bp, Mus musculus
ttttcgacctgcagctttcctgcct

SEQ ID NO: 398956 - DNA, 25 bp, Mus musculus
ttttcgacctgcagggattgctgat

SEQ ID NO: 398957 - DNA, 25 bp, Mus musculus
ttttcgatgagatggcggatccaga

SEQ ID NO: 398958 - DNA, 25 bp, Mus musculus
ttttcgatgaggctgaattgcatca

SEQ ID NO: 398959 - DNA, 25 bp, Mus musculus
ttttcgcccaagaaggtggagtttg

SEQ ID NO: 398960 - DNA, 25 bp, Mus musculus
ttttcgcttgtggggaatgtttttg

SEQ ID NO: 398961 - DNA, 25 bp, Mus musculus
ttttcggaagacagcgtggaagatg

SEQ ID NO: 398962 - DNA, 25 bp, Mus musculus
ttttcggcaaggatgagccccaaga

SEQ ID NO: 398963 - DNA, 25 bp, Mus musculus
ttttcggcaagggcgtctactgggc

SEQ ID NO: 398964 - DNA, 25 bp, Mus musculus
ttttcggcgtggttgagaacaaaaa

SEQ ID NO: 398965 - DNA, 25 bp, Mus musculus
ttttcggctggacgtcgactgtgtc

SEQ ID NO: 398966 - DNA, 25 bp, Mus musculus
ttttcgtcagtgtggtgatttacaa

SEQ ID NO: 398967 - DNA, 25 bp, Mus musculus
ttttctaacaggtctggattttact

SEQ ID NO: 398968 - DNA, 25 bp, Mus musculus
ttttctaacctggagaatgccctgg

SEQ ID NO: 398969 - DNA, 25 bp, Mus musculus
ttttctaagagaacggtcatcaaag

SEQ ID NO: 398970 - DNA, 25 bp, Mus musculus
ttttctaagtcgcaggtagaatgga

SEQ ID NO: 398971 - DNA, 25 bp, Mus musculus
ttttctacagctctcaacctacgac

SEQ ID NO: 398972 - DNA, 25 bp, Mus musculus
ttttctagcacttgtgcttccaata

SEQ ID NO: 398973 - DNA, 25 bp, Mus musculus
ttttctagtgactggggaattgatg

SEQ ID NO: 398974 - DNA, 25 bp, Mus musculus
ttttctcaaattaaatccaagttaa

SEQ ID NO: 398975 - DNA, 25 bp, Mus musculus
ttttctcaatttcaagtcagaagac

SEQ ID NO: 398976 - DNA, 25 bp, Mus musculus
ttttctcacaaacattaaccaggtc

SEQ ID NO: 398977 - DNA, 25 bp, Mus musculus
ttttctcacaataggtgaccttcag

SEQ ID NO: 398978 - DNA, 25 bp, Mus musculus
ttttctcacagcatggtctgagacg

SEQ ID NO: 398979 - DNA, 25 bp, Mus musculus
ttttctcacatcttggaggaggaac

SEQ ID NO: 398980 - DNA, 25 bp, Mus musculus
ttttctcacccccagcccagccaag

SEQ ID NO: 398981 - DNA, 25 bp, Mus musculus
ttttctcacccccagctccaaccct

SEQ ID NO: 398982 - DNA, 25 bp, Mus musculus
ttttctcacgaaaagatcctgagca

SEQ ID NO: 398983 - DNA, 25 bp, Mus musculus
ttttctcaggacagcatcccagcct

SEQ ID NO: 398984 - DNA, 25 bp, Mus musculus
ttttctcaggagaaccagacttggg

SEQ ID NO: 398985 - DNA, 25 bp, Mus musculus
ttttctccagaaggtcgcttatacc

SEQ ID NO: 398986 - DNA, 25 bp, Mus musculus
ttttctccagatgacttcttgggtc

SEQ ID NO: 398987 - DNA, 25 bp, Mus musculus
ttttctccaggaaggaactcaagtt

SEQ ID NO: 398988 - DNA, 25 bp, Mus musculus
ttttctcctatggctgtcttcagac

SEQ ID NO: 398989 - DNA, 25 bp, Mus musculus
ttttctcctatgggtatggccgaat

SEQ ID NO: 398990 - DNA, 25 bp, Mus musculus
ttttctctagatccatttgggctta

SEQ ID NO: 398991 - DNA, 25 bp, Mus musculus
ttttctctaggcaagaatcaaaaga

SEQ ID NO: 398992 - DNA, 25 bp, Mus musculus
ttttctctgagcaaagaacgttcta

SEQ ID NO: 398993 - DNA, 25 bp, Mus musculus
ttttctctgcagtcaatcgcaggcc

SEQ ID NO: 398994 - DNA, 25 bp, Mus musculus
ttttctctgcgcagatgttgatgag

SEQ ID NO: 398995 - DNA, 25 bp, Mus musculus
ttttctctgtctcggggaaaggttg

SEQ ID NO: 398996 - DNA, 25 bp, Mus musculus
ttttctctgtctcggggtgacaata

SEQ ID NO: 398997 - DNA, 25 bp, Mus musculus
ttttctgaagagacttgcctttcat

SEQ ID NO: 398998 - DNA, 25 bp, Mus musculus
ttttctgaagagatacaaggggact

SEQ ID NO: 398999 - DNA, 25 bp, Mus musculus
ttttctgaagaggcttatccatgac

SEQ ID NO: 399000 - DNA, 25 bp, Mus musculus
ttttctgaaggtgtagaagccacag

SEQ ID NO: 399001 - DNA, 25 bp, Mus musculus
ttttctgaatcacggagtcaaagtg

SEQ ID NO: 399002 - DNA, 25 bp, Mus musculus
ttttctgaatcacgtgtcgagtgtc

SEQ ID NO: 399003 - DNA, 25 bp, Mus musculus
ttttctgaggagggtgtaaaagaag

SEQ ID NO: 399004 - DNA, 25 bp, Mus musculus
ttttctgagtggtccaagccggccc

SEQ ID NO: 399005 - DNA, 25 bp, Mus musculus
ttttctgccagattcaagaacctgg

SEQ ID NO: 399006 - DNA, 25 bp, Mus musculus
ttttctgctgtatttcccacaggtt

SEQ ID NO: 399007 - DNA, 25 bp, Mus musculus
ttttctgctgtatttctcacagatc

SEQ ID NO: 399008 - DNA, 25 bp, Mus musculus
ttttctggagtgacactagcagact

SEQ ID NO: 399009 - DNA, 25 bp, Mus musculus
ttttctggataagagtgcctcgggc

SEQ ID NO: 399010 - DNA, 25 bp, Mus musculus
ttttctggataagcccacctggaag

SEQ ID NO: 399011 - DNA, 25 bp, Mus musculus
ttttctggataaggtgcttctgtgt

SEQ ID NO: 399012 - DNA, 25 bp, Mus musculus
ttttctggatgagaattggcaaggt

SEQ ID NO: 399013 - DNA, 25 bp, Mus musculus
ttttctggcattgatggtttgtctt

SEQ ID NO: 399014 - DNA, 25 bp, Mus musculus
ttttctggcattggatctactgctg

SEQ ID NO: 399015 - DNA, 25 bp, Mus musculus
ttttctggggttgcctaggtgaggc

SEQ ID NO: 399016 - DNA, 25 bp, Mus musculus
ttttctgtagcgctggcgtggatgc

SEQ ID NO: 399017 - DNA, 25 bp, Mus musculus
ttttctgtcaagacaccatgattcc

SEQ ID NO: 399018 - DNA, 25 bp, Mus musculus
ttttctgtcagaagccacattgaat

SEQ ID NO: 399019 - DNA, 25 bp, Mus musculus
ttttctgtgaaggcgttaagatcat

SEQ ID NO: 399020 - DNA, 25 bp, Mus musculus
ttttctgtgagtcagaaccatctgg

SEQ ID NO: 399021 - DNA, 25 bp, Mus musculus
ttttctgtggggaagaattcttgaa

SEQ ID NO: 399022 - DNA, 25 bp, Mus musculus
ttttcttagcggcggactggtgcag

SEQ ID NO: 399023 - DNA, 25 bp, Mus musculus
ttttcttagcggcgggagtctatcc

SEQ ID NO: 399024 - DNA, 25 bp, Mus musculus
ttttcttagcggcgggtactatacc

SEQ ID NO: 399025 - DNA, 25 bp, Mus musculus
ttttcttatatgggagagtcagtcg

SEQ ID NO: 399026 - DNA, 25 bp, Mus musculus
ttttcttcagacggtttctctagag

SEQ ID NO: 399027 - DNA, 25 bp, Mus musculus
ttttcttcagcagatgatgcccgcc

SEQ ID NO: 399028 - DNA, 25 bp, Mus musculus
ttttcttccacagtgcctccggagc

SEQ ID NO: 399029 - DNA, 25 bp, Mus musculus
ttttcttcccagccggttccagcct

SEQ ID NO: 399030 - DNA, 25 bp, Mus musculus
ttttcttctgatgagctgggaagtc

SEQ ID NO: 399031 - DNA, 25 bp, Mus musculus
ttttcttctggcggcatcgctgtcc

SEQ ID NO: 399032 - DNA, 25 bp, Mus musculus
ttttcttgaataggtattgataaat

SEQ ID NO: 399033 - DNA, 25 bp, Mus musculus
ttttcttgagcgttggtgatgactg

SEQ ID NO: 399034 - DNA, 25 bp, Mus musculus
ttttcttgagtgattccacacaaga

SEQ ID NO: 399035 - DNA, 25 bp, Mus musculus
ttttcttggggacagtgaaatgctg

SEQ ID NO: 399036 - DNA, 25 bp, Mus musculus
ttttcttggggctccagccttcccc

SEQ ID NO: 399037 - DNA, 25 bp, Mus musculus
ttttcttgtgcaaactgggatggat

SEQ ID NO: 399038 - DNA, 25 bp, Mus musculus
ttttctttactgaatataagtacca

SEQ ID NO: 399039 - DNA, 25 bp, Mus musculus
ttttctttagattgtcccagttgtg

SEQ ID NO: 399040 - DNA, 25 bp, Mus musculus
ttttctttccaacaaagcctacaca

SEQ ID NO: 399041 - DNA, 25 bp, Mus musculus
ttttctttccaacaacctgcatcat

SEQ ID NO: 399042 - DNA, 25 bp, Mus musculus
ttttctttggagcagtggccgtgcc

SEQ ID NO: 399043 - DNA, 25 bp, Mus musculus
ttttctttgggcagctgctcgccct

SEQ ID NO: 399044 - DNA, 25 bp, Mus musculus
ttttctttgttcaggagtttaatct

SEQ ID NO: 399045 - DNA, 25 bp, Mus musculus
ttttgaaaaagaatatatttgaaat

SEQ ID NO: 399046 - DNA, 25 bp, Mus musculus
ttttgaaaaaggtgactcatttttc

SEQ ID NO: 399047 - DNA, 25 bp, Mus musculus
ttttgaaacaggtgttctggctgat

SEQ ID NO: 399048 - DNA, 25 bp, Mus musculus
ttttgaaagtaagcgtttcaagggt

SEQ ID NO: 399049 - DNA, 25 bp, Mus musculus
ttttgaacaaggaagctcggattct

SEQ ID NO: 399050 - DNA, 25 bp, Mus musculus
ttttgaaccgctcccattttcgcca

SEQ ID NO: 399051 - DNA, 25 bp, Mus musculus
ttttgaacgaggaggctgtgtctgc

SEQ ID NO: 399052 - DNA, 25 bp, Mus musculus
ttttgaacttgatcgtactcgacct

SEQ ID NO: 399053 - DNA, 25 bp, Mus musculus
ttttgaacttggatgtccagaggcg

SEQ ID NO: 399054 - DNA, 25 bp, Mus musculus
ttttgaagaagcagaaaagtataaa

SEQ ID NO: 399055 - DNA, 25 bp, Mus musculus
ttttgaagagctacagacagtcgag

SEQ ID NO: 399056 - DNA, 25 bp, Mus musculus
ttttgaagcactaggttcacgctaa

SEQ ID NO: 399057 - DNA, 25 bp, Mus musculus
ttttgaagtaaaaggcaaccagata

SEQ ID NO: 399058 - DNA, 25 bp, Mus musculus
ttttgaatatccagggttctctgac

SEQ ID NO: 399059 - DNA, 25 bp, Mus musculus
ttttgaattgtaatgtggagctgcc

SEQ ID NO: 399060 - DNA, 25 bp, Mus musculus
ttttgacaaagagcctgactctgat

SEQ ID NO: 399061 - DNA, 25 bp, Mus musculus
ttttgacaagaagcagacaggcagc

SEQ ID NO: 399062 - DNA, 25 bp, Mus musculus
ttttgacaaggaccatggcggggca

SEQ ID NO: 399063 - DNA, 25 bp, Mus musculus
ttttgacacttaagggctacttgat

SEQ ID NO: 399064 - DNA, 25 bp, Mus musculus
ttttgacagacagaatgtactttcc

SEQ ID NO: 399065 - DNA, 25 bp, Mus musculus
ttttgaccactgcagtctctctctc

SEQ ID NO: 399066 - DNA, 25 bp, Mus musculus
ttttgaccttggacttcctggacac

SEQ ID NO: 399067 - DNA, 25 bp, Mus musculus
ttttgagaaggtcatcttggaagat

SEQ ID NO: 399068 - DNA, 25 bp, Mus musculus
ttttgagaatgctctggcttctcct

SEQ ID NO: 399069 - DNA, 25 bp, Mus musculus
ttttgagacaaaagatgtattccag

SEQ ID NO: 399070 - DNA, 25 bp, Mus musculus
ttttgagaggggcaggtggcagctc

SEQ ID NO: 399071 - DNA, 25 bp, Mus musculus
ttttgagagtagtataagaaagacc

SEQ ID NO: 399072 - DNA, 25 bp, Mus musculus
ttttgagagtattattggcatttac

SEQ ID NO: 399073 - DNA, 25 bp, Mus musculus
ttttgagatgtccatatgtggttga

SEQ ID NO: 399074 - DNA, 25 bp, Mus musculus
ttttgagcaaaggagaagcgctacc

SEQ ID NO: 399075 - DNA, 25 bp, Mus musculus
ttttgagcaggtagaagagaactgg

SEQ ID NO: 399076 - DNA, 25 bp, Mus musculus
ttttgaggaaagcgaatctccccga

SEQ ID NO: 399077 - DNA, 25 bp, Mus musculus
ttttgaggctaagacccttcgggaa

SEQ ID NO: 399078 - DNA, 25 bp, Mus musculus
ttttgaggctatcagtgacgaggag

SEQ ID NO: 399079 - DNA, 25 bp, Mus musculus
ttttgagtagcagtgagcgtcctgg

SEQ ID NO: 399080 - DNA, 25 bp, Mus musculus
ttttgagtatccggacaattccatc

SEQ ID NO: 399081 - DNA, 25 bp, Mus musculus
ttttgagtctacaggtttgtacagc

SEQ ID NO: 399082 - DNA, 25 bp, Mus musculus
ttttgagtgttttctctcttttatt

SEQ ID NO: 399083 - DNA, 25 bp, Mus musculus
ttttgatacacagagagcgatacac

SEQ ID NO: 399084 - DNA, 25 bp, Mus musculus
ttttgatacacagagatatagtgct

SEQ ID NO: 399085 - DNA, 25 bp, Mus musculus
ttttgatacagtcaccaaggagctg

SEQ ID NO: 399086 - DNA, 25 bp, Mus musculus
ttttgataggacagaacaccaccca

SEQ ID NO: 399087 - DNA, 25 bp, Mus musculus
ttttgataggacagtgttcttcaca

SEQ ID NO: 399088 - DNA, 25 bp, Mus musculus
ttttgatataaaggttttaaatgca

SEQ ID NO: 399089 - DNA, 25 bp, Mus musculus
ttttgatgactaccatcatcgagaa

SEQ ID NO: 399090 - DNA, 25 bp, Mus musculus
ttttgatgagaaaggaaatttcttg

SEQ ID NO: 399091 - DNA, 25 bp, Mus musculus
ttttgatgcagctatgaaggggctg

SEQ ID NO: 399092 - DNA, 25 bp, Mus musculus
ttttgatggagcctgaaacatttga

SEQ ID NO: 399093 - DNA, 25 bp, Mus musculus
ttttgatttcctgtcccctgaactg

SEQ ID NO: 399094 - DNA, 25 bp, Mus musculus
ttttgcagagattgagaagcattga

SEQ ID NO: 399095 - DNA, 25 bp, Mus musculus
ttttgcagagctttgggaccatctg

SEQ ID NO: 399096 - DNA, 25 bp, Mus musculus
ttttgcagaggtttcctggcagaac

SEQ ID NO: 399097 - DNA, 25 bp, Mus musculus
ttttgcagagttctctgtcattgag

SEQ ID NO: 399098 - DNA, 25 bp, Mus musculus
ttttgcagatggagggaagactccc

SEQ ID NO: 399099 - DNA, 25 bp, Mus musculus
ttttgcagatggtagaaggacaaga

SEQ ID NO: 399100 - DNA, 25 bp, Mus musculus
ttttgcagttcaggtttgctgtctt

SEQ ID NO: 399101 - DNA, 25 bp, Mus musculus
ttttgcataggtgcctctcctttcc

SEQ ID NO: 399102 - DNA, 25 bp, Mus musculus
ttttgcattctcagcatggtgagac

SEQ ID NO: 399103 - DNA, 25 bp, Mus musculus
ttttgccaaaggtgttttacatgag

SEQ ID NO: 399104 - DNA, 25 bp, Mus musculus
ttttgccaagcagatgaaggggctg

SEQ ID NO: 399105 - DNA, 25 bp, Mus musculus
ttttgccaagcaggtaattaataat

SEQ ID NO: 399106 - DNA, 25 bp, Mus musculus
ttttgccagggagatgccattgggt

SEQ ID NO: 399107 - DNA, 25 bp, Mus musculus
ttttgccagttgcaagtattcccct

SEQ ID NO: 399108 - DNA, 25 bp, Mus musculus
ttttgcccacctggctggtttggac

SEQ ID NO: 399109 - DNA, 25 bp, Mus musculus
ttttgcccacctggtacccaggata

SEQ ID NO: 399110 - DNA, 25 bp, Mus musculus
ttttgcccccaaagatcatccagct

SEQ ID NO: 399111 - DNA, 25 bp, Mus musculus
ttttgcccccaaagctcctgtgcca

SEQ ID NO: 399112 - DNA, 25 bp, Mus musculus
ttttgccctgcactcctgggcatcc

SEQ ID NO: 399113 - DNA, 25 bp, Mus musculus
ttttgccctgggctacggcgtgtgc

SEQ ID NO: 399114 - DNA, 25 bp, Mus musculus
ttttgccgatcagaaccagtttgac

SEQ ID NO: 399115 - DNA, 25 bp, Mus musculus
ttttgccgatcagctatatttctct

SEQ ID NO: 399116 - DNA, 25 bp, Mus musculus
ttttgccgttgcaagatcgatgatg

SEQ ID NO: 399117 - DNA, 25 bp, Mus musculus
ttttgcctaatttggctgagtatga

SEQ ID NO: 399118 - DNA, 25 bp, Mus musculus
ttttgcctagcttctgaagttgtaa

SEQ ID NO: 399119 - DNA, 25 bp, Mus musculus
ttttgcctcaggtgacactggagct

SEQ ID NO: 399120 - DNA, 25 bp, Mus musculus
ttttgcctgaatcgcccaagagcct

SEQ ID NO: 399121 - DNA, 25 bp, Mus musculus
ttttgcctgtagagacagctgcatc

SEQ ID NO: 399122 - DNA, 25 bp, Mus musculus
ttttgcgacttggacctttgggcga

SEQ ID NO: 399123 - DNA, 25 bp, Mus musculus
ttttgcgcaacgaaaaattcatttg

SEQ ID NO: 399124 - DNA, 25 bp, Mus musculus
ttttgcgcaacgaatcctgactgtt

SEQ ID NO: 399125 - DNA, 25 bp, Mus musculus
ttttgcggagatgcggcattccaaa

SEQ ID NO: 399126 - DNA, 25 bp, Mus musculus
ttttgcggagtcactatttagaagc

SEQ ID NO: 399127 - DNA, 25 bp, Mus musculus
ttttgctagaggtagaagagccaca

SEQ ID NO: 399128 - DNA, 25 bp, Mus musculus
ttttgctatgctcagcacattgcaa

SEQ ID NO: 399129 - DNA, 25 bp, Mus musculus
ttttgctcacctgcggcttgggtga

SEQ ID NO: 399130 - DNA, 25 bp, Mus musculus
ttttgctctgatggttggcactgga

SEQ ID NO: 399131 - DNA, 25 bp, Mus musculus
ttttgctgagagtgtgtgactccct

SEQ ID NO: 399132 - DNA, 25 bp, Mus musculus
ttttgctggccagcagtgacgcgcc

SEQ ID NO: 399133 - DNA, 25 bp, Mus musculus
ttttgctggtggtggcatcgtttgc

SEQ ID NO: 399134 - DNA, 25 bp, Mus musculus
ttttgctggtggtgttcagacagta

SEQ ID NO: 399135 - DNA, 25 bp, Mus musculus
ttttgcttaggtcttgtctgtattc

SEQ ID NO: 399136 - DNA, 25 bp, Mus musculus
ttttgctttgatgaaaaaacaaaaa

SEQ ID NO: 399137 - DNA, 25 bp, Mus musculus
ttttgctttggatggtatgccttac

SEQ ID NO: 399138 - DNA, 25 bp, Mus musculus
ttttgctttgtttacagacctgcag

SEQ ID NO: 399139 - DNA, 25 bp, Mus musculus
ttttggaaaaacagggcttcaagca

SEQ ID NO: 399140 - DNA, 25 bp, Mus musculus
ttttggaaagaaagatgcaccaaca

SEQ ID NO: 399141 - DNA, 25 bp, Mus musculus
ttttggaaaggtttttcttgatatt

SEQ ID NO: 399142 - DNA, 25 bp, Mus musculus
ttttggaactagagttggtgacaca

SEQ ID NO: 399143 - DNA, 25 bp, Mus musculus
ttttggaactaggtgcaagaatatt

SEQ ID NO: 399144 - DNA, 25 bp, Mus musculus
ttttggaagaagacgtcaaactccg

SEQ ID NO: 399145 - DNA, 25 bp, Mus musculus
ttttggaagaagtcagttaaggagg

SEQ ID NO: 399146 - DNA, 25 bp, Mus musculus
ttttggaagatgtcggtcaataggc

SEQ ID NO: 399147 - DNA, 25 bp, Mus musculus
ttttggaaggaggccatgtcatgat

SEQ ID NO: 399148 - DNA, 25 bp, Mus musculus
ttttggaaggtgcctctcctttccc

SEQ ID NO: 399149 - DNA, 25 bp, Mus musculus
ttttggaagtgaagtttggtgagcg

SEQ ID NO: 399150 - DNA, 25 bp, Mus musculus
ttttggaatgagagacatgtctaca

SEQ ID NO: 399151 - DNA, 25 bp, Mus musculus
ttttggacagtgagctggtgacccc

SEQ ID NO: 399152 - DNA, 25 bp, Mus musculus
ttttggacatggactgaagccctta

SEQ ID NO: 399153 - DNA, 25 bp, Mus musculus
ttttggacatggcccttagatgttg

SEQ ID NO: 399154 - DNA, 25 bp, Mus musculus
ttttggacggccagggggtggcacc

SEQ ID NO: 399155 - DNA, 25 bp, Mus musculus
ttttggactgggttttgccaggtgt

SEQ ID NO: 399156 - DNA, 25 bp, Mus musculus
ttttggactggtttggtgttcatca

SEQ ID NO: 399157 - DNA, 25 bp, Mus musculus
ttttggagatctgagcacagccagc

SEQ ID NO: 399158 - DNA, 25 bp, Mus musculus
ttttggagatctgagccatggattt

SEQ ID NO: 399159 - DNA, 25 bp, Mus musculus
ttttggagattggggcctgtgtttt

SEQ ID NO: 399160 - DNA, 25 bp, Mus musculus
ttttggaggagtgggatcgagtggg

SEQ ID NO: 399161 - DNA, 25 bp, Mus musculus
ttttggagtaacagctagaaattgc

SEQ ID NO: 399162 - DNA, 25 bp, Mus musculus
ttttggatatggggtgcttcgagtg

SEQ ID NO: 399163 - DNA, 25 bp, Mus musculus
ttttggattcagacgatgtcatgat

SEQ ID NO: 399164 - DNA, 25 bp, Mus musculus
ttttggcaacgaaaggtctccgggc

SEQ ID NO: 399165 - DNA, 25 bp, Mus musculus
ttttggcaaggagaggccagctgag

SEQ ID NO: 399166 - DNA, 25 bp, Mus musculus
ttttggcaatctatgattcctgtgt

SEQ ID NO: 399167 - DNA, 25 bp, Mus musculus
ttttggccaaagttatctccctagg

SEQ ID NO: 399168 - DNA, 25 bp, Mus musculus
ttttggccaagatccccagcctcag

SEQ ID NO: 399169 - DNA, 25 bp, Mus musculus
ttttggccctgagatgacaaatcct

SEQ ID NO: 399170 - DNA, 25 bp, Mus musculus
ttttggccgcaggttctctccacta

SEQ ID NO: 399171 - DNA, 25 bp, Mus musculus
ttttggcctatgcaggagggagcct

SEQ ID NO: 399172 - DNA, 25 bp, Mus musculus
ttttggcctatgcaggtgtgctgat

SEQ ID NO: 399173 - DNA, 25 bp, Mus musculus
ttttggctttcgcagagcagtcctc

SEQ ID NO: 399174 - DNA, 25 bp, Mus musculus
ttttggctttcgcagagctgctctt

SEQ ID NO: 399175 - DNA, 25 bp, Mus musculus
ttttgggaaagcttcaccacgacca

SEQ ID NO: 399176 - DNA, 25 bp, Mus musculus
ttttgggagacagagatcctgagga

SEQ ID NO: 399177 - DNA, 25 bp, Mus musculus
ttttgggattttagttctcaaataa

SEQ ID NO: 399178 - DNA, 25 bp, Mus musculus
ttttgggattttatcgcatcatatt

SEQ ID NO: 399179 - DNA, 25 bp, Mus musculus
ttttgggttaccgagagcttttgct

SEQ ID NO: 399180 - DNA, 25 bp, Mus musculus
ttttgggtttgcttctcccttccag

SEQ ID NO: 399181 - DNA, 25 bp, Mus musculus
ttttggtaatagaggatctgagaaa

SEQ ID NO: 399182 - DNA, 25 bp, Mus musculus
ttttggtagagggacagtgtcttgg

SEQ ID NO: 399183 - DNA, 25 bp, Mus musculus
ttttggtcacttgctgagatatggg

SEQ ID NO: 399184 - DNA, 25 bp, Mus musculus
ttttggtcatgaagaagcagaattc

SEQ ID NO: 399185 - DNA, 25 bp, Mus musculus
ttttggtcatgaagacatgtttaaa

SEQ ID NO: 399186 - DNA, 25 bp, Mus musculus
ttttggtctgtgagcatccctcacg

SEQ ID NO: 399187 - DNA, 25 bp, Mus musculus
ttttggtgaaaagtgaagatgccat

SEQ ID NO: 399188 - DNA, 25 bp, Mus musculus
ttttggtggcaagcttggcgcccgt

SEQ ID NO: 399189 - DNA, 25 bp, Mus musculus
ttttggttataactgacaggtataa

SEQ ID NO: 399190 - DNA, 25 bp, Mus musculus
ttttggttccttgagatacgacatt

SEQ ID NO: 399191 - DNA, 25 bp, Mus musculus
ttttggtttttggtgaatgaatata

SEQ ID NO: 399192 - DNA, 25 bp, Mus musculus
ttttgtaacagttggatgaaaaatc

SEQ ID NO: 399193 - DNA, 25 bp, Mus musculus
ttttgtagaggagctccaagtatgt

SEQ ID NO: 399194 - DNA, 25 bp, Mus musculus
ttttgtagccgaagcagatccacaa

SEQ ID NO: 399195 - DNA, 25 bp, Mus musculus
ttttgtagctgggattgacttctaa

SEQ ID NO: 399196 - DNA, 25 bp, Mus musculus
ttttgtcaagacaatggattctgaa

SEQ ID NO: 399197 - DNA, 25 bp, Mus musculus
ttttgtcaaggactgtgaattggag

SEQ ID NO: 399198 - DNA, 25 bp, Mus musculus
ttttgtcaaggatggtgaggaagaa

SEQ ID NO: 399199 - DNA, 25 bp, Mus musculus
ttttgtccgccagggttcggcagac

SEQ ID NO: 399200 - DNA, 25 bp, Mus musculus
ttttgtcgaagacggggacattaca

SEQ ID NO: 399201 - DNA, 25 bp, Mus musculus
ttttgtcgttcggtgctcgtagctc

SEQ ID NO: 399202 - DNA, 25 bp, Mus musculus
ttttgtctacaggcttcctgaagaa

SEQ ID NO: 399203 - DNA, 25 bp, Mus musculus
ttttgtgaagagtacccagtattac

SEQ ID NO: 399204 - DNA, 25 bp, Mus musculus
ttttgtgaagatcatcacagttgag

SEQ ID NO: 399205 - DNA, 25 bp, Mus musculus
ttttgtgaagcctggatggtggagt

SEQ ID NO: 399206 - DNA, 25 bp, Mus musculus
ttttgtgaaggacaaggctacactc

SEQ ID NO: 399207 - DNA, 25 bp, Mus musculus
ttttgtgcagagattaagcacatga

SEQ ID NO: 399208 - DNA, 25 bp, Mus musculus
ttttgtgcagcttacctgtggttct

SEQ ID NO: 399209 - DNA, 25 bp, Mus musculus
ttttgtgcaggatctgctgatgatg

SEQ ID NO: 399210 - DNA, 25 bp, Mus musculus
ttttgtgccgcaggtcgagatttca

SEQ ID NO: 399211 - DNA, 25 bp, Mus musculus
ttttgtgctcgattacgctcgattt

SEQ ID NO: 399212 - DNA, 25 bp, Mus musculus
ttttgtggaagagagtccagaaaac

SEQ ID NO: 399213 - DNA, 25 bp, Mus musculus
ttttgtggaagcgatggtgaatgag

SEQ ID NO: 399214 - DNA, 25 bp, Mus musculus
ttttgtggacaggttggtttaatga

SEQ ID NO: 399215 - DNA, 25 bp, Mus musculus
ttttgtggacagtatttttgaacaa

SEQ ID NO: 399216 - DNA, 25 bp, Mus musculus
ttttgtggagccccgcaatctgtgt

SEQ ID NO: 399217 - DNA, 25 bp, Mus musculus
ttttgtgtggttcatttttataagt

SEQ ID NO: 399218 - DNA, 25 bp, Mus musculus
ttttgttaaaggctgatgaaccaat

SEQ ID NO: 399219 - DNA, 25 bp, Mus musculus
ttttgttaaggaaattaagcgagag

SEQ ID NO: 399220 - DNA, 25 bp, Mus musculus
ttttgttacagactagcttcctttt

SEQ ID NO: 399221 - DNA, 25 bp, Mus musculus
ttttgttatgccagtcaggatttgc

SEQ ID NO: 399222 - DNA, 25 bp, Mus musculus
ttttgttcagaacgatcatccagcc

SEQ ID NO: 399223 - DNA, 25 bp, Mus musculus
ttttgttcccattccttcaaaaaga

SEQ ID NO: 399224 - DNA, 25 bp, Mus musculus
ttttgttccgtgagggaaaagaaga

SEQ ID NO: 399225 - DNA, 25 bp, Mus musculus
ttttgttgcctcagatttcttgacc

SEQ ID NO: 399226 - DNA, 25 bp, Mus musculus
ttttgttgctttcccagcactatgg

SEQ ID NO: 399227 - DNA, 25 bp, Mus musculus
ttttgttggaggtccagatggccat

SEQ ID NO: 399228 - DNA, 25 bp, Mus musculus
ttttgtttcggaagacaacatggcc

SEQ ID NO: 399229 - DNA, 25 bp, Mus musculus
ttttgtttcggacaggccaggaggg

SEQ ID NO: 399230 - DNA, 25 bp, Mus musculus
ttttgtttcgggacaactgccactc

SEQ ID NO: 399231 - DNA, 25 bp, Mus musculus
ttttgttttggttggtatgctgtac

SEQ ID NO: 399232 - DNA, 25 bp, Mus musculus
ttttgttttgttatgaatgcaggaa

SEQ ID NO: 399233 - DNA, 25 bp, Mus musculus
tttttaaaaagtgtgttcaaagcaa

SEQ ID NO: 399234 - DNA, 25 bp, Mus musculus
tttttaaaataatccaaggaagaat

SEQ ID NO: 399235 - DNA, 25 bp, Mus musculus
tttttaaaataatcctgtcaaggta

SEQ ID NO: 399236 - DNA, 25 bp, Mus musculus
tttttaaactaggtcgatccttcgg

SEQ ID NO: 399237 - DNA, 25 bp, Mus musculus
tttttaacaaggtgaactgaagatt

SEQ ID NO: 399238 - DNA, 25 bp, Mus musculus
tttttaacagaagcaaacccaaagc

SEQ ID NO: 399239 - DNA, 25 bp, Mus musculus
tttttaacagattagttcataaagg

SEQ ID NO: 399240 - DNA, 25 bp, Mus musculus
tttttaaccatagcatgctggagaa

SEQ ID NO: 399241 - DNA, 25 bp, Mus musculus
tttttaagaaacggagccagctgtg

SEQ ID NO: 399242 - DNA, 25 bp, Mus musculus
tttttaagaggcaagaaacaaaaga

SEQ ID NO: 399243 - DNA, 25 bp, Mus musculus
tttttaatagatggagagcatccca

SEQ ID NO: 399244 - DNA, 25 bp, Mus musculus
tttttaatcagtctgttatctccta

SEQ ID NO: 399245 - DNA, 25 bp, Mus musculus
tttttaatctgaaggggagaaaact

SEQ ID NO: 399246 - DNA, 25 bp, Mus musculus
tttttaatgagctacccatgacatc

SEQ ID NO: 399247 - DNA, 25 bp, Mus musculus
tttttaatgatgaggtccttctgta

SEQ ID NO: 399248 - DNA, 25 bp, Mus musculus
tttttaatggaacagatggcagtga

SEQ ID NO: 399249 - DNA, 25 bp, Mus musculus
tttttaatggggcccaaattcattg

SEQ ID NO: 399250 - DNA, 25 bp, Mus musculus
tttttaatttctctttcctctctct

SEQ ID NO: 399251 - DNA, 25 bp, Mus musculus
tttttacaaagtgattggagttgtg

SEQ ID NO: 399252 - DNA, 25 bp, Mus musculus
tttttacaaatggtattctctgaaa

SEQ ID NO: 399253 - DNA, 25 bp, Mus musculus
tttttacaaatgttatccaagcatt

SEQ ID NO: 399254 - DNA, 25 bp, Mus musculus
tttttacaaggcatcaaggagtcct

SEQ ID NO: 399255 - DNA, 25 bp, Mus musculus
tttttacagggcaagcttgatgctt

SEQ ID NO: 399256 - DNA, 25 bp, Mus musculus
tttttacataatccccagatgcaga

SEQ ID NO: 399257 - DNA, 25 bp, Mus musculus
tttttacataatcggggtctaatgg

SEQ ID NO: 399258 - DNA, 25 bp, Mus musculus
tttttacctccgcacatccgtgaag

SEQ ID NO: 399259 - DNA, 25 bp, Mus musculus
tttttactaaagttgttcaaggcct

SEQ ID NO: 399260 - DNA, 25 bp, Mus musculus
tttttactaatcaggattgtcttgc

SEQ ID NO: 399261 - DNA, 25 bp, Mus musculus
tttttactgatgaattcctggcgca

SEQ ID NO: 399262 - DNA, 25 bp, Mus musculus
tttttactgatgggcatccaacacc

SEQ ID NO: 399263 - DNA, 25 bp, Mus musculus
tttttactgtggaagtgtggattct

SEQ ID NO: 399264 - DNA, 25 bp, Mus musculus
tttttactgtggaagtgtggcttct

SEQ ID NO: 399265 - DNA, 25 bp, Mus musculus
tttttacttcgcggagtgctctctg

SEQ ID NO: 399266 - DNA, 25 bp, Mus musculus
tttttagaaccccggtggcgacaga

SEQ ID NO: 399267 - DNA, 25 bp, Mus musculus
tttttagaagcatggtcttagaaat

SEQ ID NO: 399268 - DNA, 25 bp, Mus musculus
tttttagatatgcttggcctgtgga

SEQ ID NO: 399269 - DNA, 25 bp, Mus musculus
tttttagcgttctccacccatgagg

SEQ ID NO: 399270 - DNA, 25 bp, Mus musculus
tttttaggaggtatcttgatgtggt

SEQ ID NO: 399271 - DNA, 25 bp, Mus musculus
tttttataaaggcagctgctgggat

SEQ ID NO: 399272 - DNA, 25 bp, Mus musculus
tttttatcagccatcgtctagagaa

SEQ ID NO: 399273 - DNA, 25 bp, Mus musculus
tttttatccccatggaaagggctgt

SEQ ID NO: 399274 - DNA, 25 bp, Mus musculus
tttttatctgaaaggcttacctcta

SEQ ID NO: 399275 - DNA, 25 bp, Mus musculus
tttttatctgaaagtggtcccaaac

SEQ ID NO: 399276 - DNA, 25 bp, Mus musculus
tttttatgaaagcagggcttacata

SEQ ID NO: 399277 - DNA, 25 bp, Mus musculus
tttttatgcgaaattcaacatggcc

SEQ ID NO: 399278 - DNA, 25 bp, Mus musculus
tttttatgctgactgacccttccta

SEQ ID NO: 399279 - DNA, 25 bp, Mus musculus
tttttatgctgactggtgtcgtttc

SEQ ID NO: 399280 - DNA, 25 bp, Mus musculus
tttttatgttgagctaccaatatga

SEQ ID NO: 399281 - DNA, 25 bp, Mus musculus
tttttattaagctctgattcaatga

SEQ ID NO: 399282 - DNA, 25 bp, Mus musculus
tttttattaaggtggccatgcagat

SEQ ID NO: 399283 - DNA, 25 bp, Mus musculus
tttttattcaggccacgcaacggga

SEQ ID NO: 399284 - DNA, 25 bp, Mus musculus
tttttattcagggatgtgaaatgat

SEQ ID NO: 399285 - DNA, 25 bp, Mus musculus
tttttcaaggaagagaagtggtggc

SEQ ID NO: 399286 - DNA, 25 bp, Mus musculus
tttttcaaggagaggtctggtccat

SEQ ID NO: 399287 - DNA, 25 bp, Mus musculus
tttttcaaggagaggttgctatggt

SEQ ID NO: 399288 - DNA, 25 bp, Mus musculus
tttttcacagatcactggtgttatc

SEQ ID NO: 399289 - DNA, 25 bp, Mus musculus
tttttcaccccaggcttacagttcc

SEQ ID NO: 399290 - DNA, 25 bp, Mus musculus
tttttcacctatctgggggcacctg

SEQ ID NO: 399291 - DNA, 25 bp, Mus musculus
tttttcagaaagtaaacgaagcaaa

SEQ ID NO: 399292 - DNA, 25 bp, Mus musculus
tttttcagaaccagcctgggcccga

SEQ ID NO: 399293 - DNA, 25 bp, Mus musculus
tttttcagaaccagctttgaatggc

SEQ ID NO: 399294 - DNA, 25 bp, Mus musculus
tttttcagaatatagagtcatggat

SEQ ID NO: 399295 - DNA, 25 bp, Mus musculus
tttttcagagatcccgcccggagtg

SEQ ID NO: 399296 - DNA, 25 bp, Mus musculus
tttttcagctatggaccgtcacgac

SEQ ID NO: 399297 - DNA, 25 bp, Mus musculus
tttttcaggatgacttgattatctt

SEQ ID NO: 399298 - DNA, 25 bp, Mus musculus
tttttcatacagataaaaattattc

SEQ ID NO: 399299 - DNA, 25 bp, Mus musculus
tttttcatggaagtgtgtgatgact

SEQ ID NO: 399300 - DNA, 25 bp, Mus musculus
tttttcattaaaagctccaggtctg

SEQ ID NO: 399301 - DNA, 25 bp, Mus musculus
tttttcattccaatgtgagttctta

SEQ ID NO: 399302 - DNA, 25 bp, Mus musculus
tttttcattccattgtgagttctta

SEQ ID NO: 399303 - DNA, 25 bp, Mus musculus
tttttccaaggagtgtggggccgac

SEQ ID NO: 399304 - DNA, 25 bp, Mus musculus
tttttccactatagtgagttctctg

SEQ ID NO: 399305 - DNA, 25 bp, Mus musculus
tttttccatttcaaggtctcaaaag

SEQ ID NO: 399306 - DNA, 25 bp, Mus musculus
tttttcccagatgcattacacggag

SEQ ID NO: 399307 - DNA, 25 bp, Mus musculus
tttttcccaggaccagatagcatct

SEQ ID NO: 399308 - DNA, 25 bp, Mus musculus
tttttcccaggcttggatttagaac

SEQ ID NO: 399309 - DNA, 25 bp, Mus musculus
tttttcccccctcaagatcggcttc

SEQ ID NO: 399310 - DNA, 25 bp, Mus musculus
tttttcctaactcttggcaagtatg

SEQ ID NO: 399311 - DNA, 25 bp, Mus musculus
tttttcctcagagcccagatgccca

SEQ ID NO: 399312 - DNA, 25 bp, Mus musculus
tttttcctccaaagatccattacta

SEQ ID NO: 399313 - DNA, 25 bp, Mus musculus
tttttcctccaaaggagctctcaag

SEQ ID NO: 399314 - DNA, 25 bp, Mus musculus
tttttcctccctatctgagctcttc

SEQ ID NO: 399315 - DNA, 25 bp, Mus musculus
tttttcctgatcagggctccagtgg

SEQ ID NO: 399316 - DNA, 25 bp, Mus musculus
tttttcctgatcaggtaatgtatgt

SEQ ID NO: 399317 - DNA, 25 bp, Mus musculus
tttttcctgtgtcccgtgtcacaat

SEQ ID NO: 399318 - DNA, 25 bp, Mus musculus
tttttcgacctgcagctttcctgcc

SEQ ID NO: 399319 - DNA, 25 bp, Mus musculus
tttttcgacctgcagggattgctga

SEQ ID NO: 399320 - DNA, 25 bp, Mus musculus
tttttcgatgagatggcggatccag

SEQ ID NO: 399321 - DNA, 25 bp, Mus musculus
tttttcgatgaggctgaattgcatc

SEQ ID NO: 399322 - DNA, 25 bp, Mus musculus
tttttcggaagacagcgtggaagat

SEQ ID NO: 399323 - DNA, 25 bp, Mus musculus
tttttcgtcagtgtggtgatttaca

SEQ ID NO: 399324 - DNA, 25 bp, Mus musculus
tttttctaagagaacggtcatcaaa

SEQ ID NO: 399325 - DNA, 25 bp, Mus musculus
tttttctcaggtgccttcagtcaag

SEQ ID NO: 399326 - DNA, 25 bp, Mus musculus
tttttctcagtaccaacaaaagcaa

SEQ ID NO: 399327 - DNA, 25 bp, Mus musculus
tttttctgctgtatttcccacaggt

SEQ ID NO: 399328 - DNA, 25 bp, Mus musculus
tttttctgctgtatttctcacagat

SEQ ID NO: 399329 - DNA, 25 bp, Mus musculus
tttttctgtgaaggcgttaagatca

SEQ ID NO: 399330 - DNA, 25 bp, Mus musculus
tttttcttgaataggtattgataaa

SEQ ID NO: 399331 - DNA, 25 bp, Mus musculus
tttttgaaacaggtgttctggctga

SEQ ID NO: 399332 - DNA, 25 bp, Mus musculus
tttttgaaagtaagcgtttcaaggg

SEQ ID NO: 399333 - DNA, 25 bp, Mus musculus
tttttgaacaaggaagctcggattc

SEQ ID NO: 399334 - DNA, 25 bp, Mus musculus
tttttgaaccgctcccattttcgcc

SEQ ID NO: 399335 - DNA, 25 bp, Mus musculus
tttttgaacgaggaggctgtgtctg

SEQ ID NO: 399336 - DNA, 25 bp, Mus musculus
tttttgaagaagcagaaaagtataa

SEQ ID NO: 399337 - DNA, 25 bp, Mus musculus
tttttgaagagctacagacagtcga

SEQ ID NO: 399338 - DNA, 25 bp, Mus musculus
tttttgacagacagaatgtactttc

SEQ ID NO: 399339 - DNA, 25 bp, Mus musculus
tttttgacagaccagccacaccatg

SEQ ID NO: 399340 - DNA, 25 bp, Mus musculus
tttttgacagagctgtcgcagctta

SEQ ID NO: 399341 - DNA, 25 bp, Mus musculus
tttttgacagcctcattaacttcgt

SEQ ID NO: 399342 - DNA, 25 bp, Mus musculus
tttttgagacaaaagatgtattcca

SEQ ID NO: 399343 - DNA, 25 bp, Mus musculus
tttttgagagtagtataagaaagac

SEQ ID NO: 399344 - DNA, 25 bp, Mus musculus
tttttgagagtattattggcattta

SEQ ID NO: 399345 - DNA, 25 bp, Mus musculus
tttttgagcagacctgggcccagtg

SEQ ID NO: 399346 - DNA, 25 bp, Mus musculus
tttttgagcaggtcacaaacctaca

SEQ ID NO: 399347 - DNA, 25 bp, Mus musculus
tttttgagtatccggacaattccat

SEQ ID NO: 399348 - DNA, 25 bp, Mus musculus
tttttgatgagaaaggaaatttctt

SEQ ID NO: 399349 - DNA, 25 bp, Mus musculus
tttttgccaagcagatgaaggggct

SEQ ID NO: 399350 - DNA, 25 bp, Mus musculus
tttttgccaagcaggtaattaataa

SEQ ID NO: 399351 - DNA, 25 bp, Mus musculus
tttttgcctcaggtgacactggagc

SEQ ID NO: 399352 - DNA, 25 bp, Mus musculus
tttttgcgacttggacctttgggcg

SEQ ID NO: 399353 - DNA, 25 bp, Mus musculus
tttttgcttaggtcttgtctgtatt

SEQ ID NO: 399354 - DNA, 25 bp, Mus musculus
tttttgctttgatgaaaaaacaaaa

SEQ ID NO: 399355 - DNA, 25 bp, Mus musculus
tttttgctttggatggtatgcctta

SEQ ID NO: 399356 - DNA, 25 bp, Mus musculus
tttttggaaaaacagggcttcaagc

SEQ ID NO: 399357 - DNA, 25 bp, Mus musculus
tttttggacagtgagctggtgaccc

SEQ ID NO: 399358 - DNA, 25 bp, Mus musculus
tttttggattcagacgatgtcatga

SEQ ID NO: 399359 - DNA, 25 bp, Mus musculus
tttttggccgcaggttctctccact

SEQ ID NO: 399360 - DNA, 25 bp, Mus musculus
tttttggccggacgagcaatgggaa

SEQ ID NO: 399361 - DNA, 25 bp, Mus musculus
tttttgtggagccccgcaatctgtg

SEQ ID NO: 399362 - DNA, 25 bp, Mus musculus
tttttgtgtggttcatttttataag

SEQ ID NO: 399363 - DNA, 25 bp, Mus musculus
tttttgttgcctcagatttcttgac

SEQ ID NO: 399364 - DNA, 25 bp, Mus musculus
tttttgttggaggtccagatggcca

SEQ ID NO: 399365 - DNA, 25 bp, Mus musculus
ttttttaaccatagcatgctggaga

SEQ ID NO: 399366 - DNA, 25 bp, Mus musculus
ttttttaagaaacggagccagctgt

SEQ ID NO: 399367 - DNA, 25 bp, Mus musculus
ttttttacaaatggtattctctgaa

SEQ ID NO: 399368 - DNA, 25 bp, Mus musculus
ttttttacaaatgttatccaagcat

SEQ ID NO: 399369 - DNA, 25 bp, Mus musculus
ttttttacaggagaaaccctgtgga

SEQ ID NO: 399370 - DNA, 25 bp, Mus musculus
ttttttacagggcaagcttgatgct

SEQ ID NO: 399371 - DNA, 25 bp, Mus musculus
ttttttacctccgcacatccgtgaa

SEQ ID NO: 399372 - DNA, 25 bp, Mus musculus
ttttttactgatgaattcctggcgc

SEQ ID NO: 399373 - DNA, 25 bp, Mus musculus
ttttttactgatgggcatccaacac

SEQ ID NO: 399374 - DNA, 25 bp, Mus musculus
ttttttatcagccatcgtctagaga

SEQ ID NO: 399375 - DNA, 25 bp, Mus musculus
ttttttattaagctctgattcaatg

SEQ ID NO: 399376 - DNA, 25 bp, Mus musculus
ttttttattaaggtggccatgcaga

SEQ ID NO: 399377 - DNA, 25 bp, Mus musculus
ttttttcaagctatcagagatgcct

SEQ ID NO: 399378 - DNA, 25 bp, Mus musculus
ttttttcaaggatgttaattatgaa

SEQ ID NO: 399379 - DNA, 25 bp, Mus musculus
ttttttcagagatcccgcccggagt

SEQ ID NO: 399380 - DNA, 25 bp, Mus musculus
ttttttcaggatgacttgattatct

SEQ ID NO: 399381 - DNA, 25 bp, Mus musculus
ttttttcattaaaagctccaggtct

SEQ ID NO: 399382 - DNA, 25 bp, Mus musculus
ttttttcccagatgcattacacgga

SEQ ID NO: 399383 - DNA, 25 bp, Mus musculus
ttttttcccaggaccagatagcatc

SEQ ID NO: 399384 - DNA, 25 bp, Mus musculus
ttttttcctccaaagatccattact

SEQ ID NO: 399385 - DNA, 25 bp, Mus musculus
ttttttcctccaaaggagctctcaa

SEQ ID NO: 399386 - DNA, 25 bp, Mus musculus
ttttttcctgatcagggctccagtg

SEQ ID NO: 399387 - DNA, 25 bp, Mus musculus
ttttttcctgatcaggtaatgtatg

SEQ ID NO: 399388 - DNA, 25 bp, Mus musculus
ttttttgaaacaggtgttctggctg

SEQ ID NO: 399389 - DNA, 25 bp, Mus musculus
ttttttgaacaaggaagctcggatt

SEQ ID NO: 399390 - DNA, 25 bp, Mus musculus
ttttttgaaggagcacatggatgaa

SEQ ID NO: 399391 - DNA, 25 bp, Mus musculus
ttttttgaaggattcactagcaaaa

SEQ ID NO: 399392 - DNA, 25 bp, Mus musculus
ttttttgagacaaaagatgtattcc

SEQ ID NO: 399393 - DNA, 25 bp, Mus musculus
ttttttgcaggcatcacagactgcc

SEQ ID NO: 399394 - DNA, 25 bp, Mus musculus
ttttttgccaagcagatgaaggggc

SEQ ID NO: 399395 - DNA, 25 bp, Mus musculus
ttttttgccaagcaggtaattaata

SEQ ID NO: 399396 - DNA, 25 bp, Mus musculus
ttttttgctctctggagccaattaa

SEQ ID NO: 399397 - DNA, 25 bp, Mus musculus
ttttttgcttaggtcttgtctgtat

SEQ ID NO: 399398 - DNA, 25 bp, Mus musculus
ttttttggccggacgagcaatggga

SEQ ID NO: 399399 - DNA, 25 bp, Mus musculus
tttttttaaccatagcatgctggag

SEQ ID NO: 399400 - DNA, 25 bp, Mus musculus
tttttttactgatgaattcctggcg

SEQ ID NO: 399401 - DNA, 25 bp, Mus musculus
tttttttactgatgggcatccaaca

SEQ ID NO: 399402 - DNA, 25 bp, Mus musculus
tttttttattaagctctgattcaat

SEQ ID NO: 399403 - DNA, 25 bp, Mus musculus
tttttttattaaggtggccatgcag

SEQ ID NO: 399404 - DNA, 25 bp, Mus musculus
tttttttattgagtctcatgtagac

SEQ ID NO: 399405 - DNA, 25 bp, Mus musculus
tttttttcccagatgcattacacgg

SEQ ID NO: 399406 - DNA, 25 bp, Mus musculus
tttttttcccaggaccagatagcat

SEQ ID NO: 399407 - DNA, 25 bp, Mus musculus
tttttttcctactcactgtgtgctg

SEQ ID NO: 399408 - DNA, 25 bp, Mus musculus
tttttttctatctgcccgcggtatt

SEQ ID NO: 399409 - DNA, 25 bp, Mus musculus
tttttttgcttaggtcttgtctgta

SEQ ID NO: 399410 - DNA, 25 bp, Mus musculus
tttttttggccggacgagcaatggg

SEQ ID NO: 399411 - DNA, 25 bp, Mus musculus
ttttttttaaccatagcatgctgga

SEQ ID NO: 399412 - DNA, 25 bp, Mus musculus
ttttttttattgagtctcatgtaga

SEQ ID NO: 399413 - DNA, 25 bp, Mus musculus
tttttttttaaccatagcatgctgg

SEQ ID NO: 399414 - DNA, 25 bp, Mus musculus
aaaaaacaatgccaacagcccagcg

SEQ ID NO: 399415 - DNA, 25 bp, Mus musculus
aaaaaacgttaggagccagtgctag

SEQ ID NO: 399416 - DNA, 25 bp, Mus musculus
aaaaaactccatccctttgctggag

SEQ ID NO: 399417 - DNA, 25 bp, Mus musculus
aaaaaactttgagatacgccacctg

SEQ ID NO: 399418 - DNA, 25 bp, Mus musculus
aaaaaagagctgagagtggagacga

SEQ ID NO: 399419 - DNA, 25 bp, Mus musculus
aaaaaagatgctaagagtctacgac

SEQ ID NO: 399420 - DNA, 25 bp, Mus musculus
aaaaaagatggacttatggagtagg

SEQ ID NO: 399421 - DNA, 25 bp, Mus musculus
aaaaaagccactcagattcctggct

SEQ ID NO: 399422 - DNA, 25 bp, Mus musculus
aaaaaagccatcctgggcccagagt

SEQ ID NO: 399423 - DNA, 25 bp, Mus musculus
aaaaaagcccctgcgcattgatccg

SEQ ID NO: 399424 - DNA, 25 bp, Mus musculus
aaaaaagctgtcttcagggcactaa

SEQ ID NO: 399425 - DNA, 25 bp, Mus musculus
aaaaaaggagctgctatcagatgcc

SEQ ID NO: 399426 - DNA, 25 bp, Mus musculus
aaaaaaggcggctacagggtgatgc

SEQ ID NO: 399427 - DNA, 25 bp, Mus musculus
aaaaaagtggccagtcacgcaccat

SEQ ID NO: 399428 - DNA, 25 bp, Mus musculus
aaaaaagtttctcaagtcgcagctg

SEQ ID NO: 399429 - DNA, 25 bp, Mus musculus
aaaaaataccaccaaagatgtgtgc

SEQ ID NO: 399430 - DNA, 25 bp, Mus musculus
aaaaaatactcttgacgcatgaaaa

SEQ ID NO: 399431 - DNA, 25 bp, Mus musculus
aaaaaatatctcctgccagtgggga

SEQ ID NO: 399432 - DNA, 25 bp, Mus musculus
aaaaaatcagtactcgtggccatcc

SEQ ID NO: 399433 - DNA, 25 bp, Mus musculus
aaaaaatcgcctgtgtcctccctga

SEQ ID NO: 399434 - DNA, 25 bp, Mus musculus
aaaaaatgcaccttgacgcacgacg

SEQ ID NO: 399435 - DNA, 25 bp, Mus musculus
aaaaaatgtttcagcttcgtgcatt

SEQ ID NO: 399436 - DNA, 25 bp, Mus musculus
aaaaacaggctcgaaaggctcagcg

SEQ ID NO: 399437 - DNA, 25 bp, Mus musculus
aaaaacccaatcagacaagtgcccg

SEQ ID NO: 399438 - DNA, 25 bp, Mus musculus
aaaaaccgacttgtgatatggacta

SEQ ID NO: 399439 - DNA, 25 bp, Mus musculus
aaaaaccgagaggaactcagttgca

SEQ ID NO: 399440 - DNA, 25 bp, Mus musculus
aaaaaccgtttgcacagaaagcagc

SEQ ID NO: 399441 - DNA, 25 bp, Mus musculus
aaaaacgtctctctccagtggctgg

SEQ ID NO: 399442 - DNA, 25 bp, Mus musculus
aaaaacgttgttcccatctgccagc

SEQ ID NO: 399443 - DNA, 25 bp, Mus musculus
aaaaactttgccattgtgggcgcca

SEQ ID NO: 399444 - DNA, 25 bp, Mus musculus
aaaaagacatcatcaggcctggagc

SEQ ID NO: 399445 - DNA, 25 bp, Mus musculus
aaaaagacgctagggcttcggcaag

SEQ ID NO: 399446 - DNA, 25 bp, Mus musculus
aaaaagactgcctacgagctgctgg

SEQ ID NO: 399447 - DNA, 25 bp, Mus musculus
aaaaagagaccgtccatattcccag

SEQ ID NO: 399448 - DNA, 25 bp, Mus musculus
aaaaagagccacctacagagagaat

SEQ ID NO: 399449 - DNA, 25 bp, Mus musculus
aaaaagagccgccatgtgtgggcca

SEQ ID NO: 399450 - DNA, 25 bp, Mus musculus
aaaaagatgtccctatatgatgacc

SEQ ID NO: 399451 - DNA, 25 bp, Mus musculus
aaaaagcaagtgagccccgagagct

SEQ ID NO: 399452 - DNA, 25 bp, Mus musculus
aaaaagcccctattgatgtcacatc

SEQ ID NO: 399453 - DNA, 25 bp, Mus musculus
aaaaagccgtgctggattctagccc

SEQ ID NO: 399454 - DNA, 25 bp, Mus musculus
aaaaagcctgctcttcgctgttgcc

SEQ ID NO: 399455 - DNA, 25 bp, Mus musculus
aaaaagcgagatgccctggctgcag

SEQ ID NO: 399456 - DNA, 25 bp, Mus musculus
aaaaagcgtgtttgggcatcaggcc

SEQ ID NO: 399457 - DNA, 25 bp, Mus musculus
aaaaagctagcttagtctgctgagg

SEQ ID NO: 399458 - DNA, 25 bp, Mus musculus
aaaaagctcatgttacaattacttg

SEQ ID NO: 399459 - DNA, 25 bp, Mus musculus
aaaaagctggtgatcaacggtggca

SEQ ID NO: 399460 - DNA, 25 bp, Mus musculus
aaaaaggagaacagaaagactcagt

SEQ ID NO: 399461 - DNA, 25 bp, Mus musculus
aaaaaggagcgtatgatttcagtta

SEQ ID NO: 399462 - DNA, 25 bp, Mus musculus
aaaaaggtgcgctgtggatcaagac

SEQ ID NO: 399463 - DNA, 25 bp, Mus musculus
aaaaagtgaccatgccttcaccagc

SEQ ID NO: 399464 - DNA, 25 bp, Mus musculus
aaaaagttggctggttctgagctct

SEQ ID NO: 399465 - DNA, 25 bp, Mus musculus
aaaaagtttccagtgcagggttgca

SEQ ID NO: 399466 - DNA, 25 bp, Mus musculus
aaaaataagcatggacaaatgtccc

SEQ ID NO: 399467 - DNA, 25 bp, Mus musculus
aaaaatacaaaaggacaggtgctgt

SEQ ID NO: 399468 - DNA, 25 bp, Mus musculus
aaaaatacatgcgtcaggacctccg

SEQ ID NO: 399469 - DNA, 25 bp, Mus musculus
aaaaatatcttgaaaggcctggaag

SEQ ID NO: 399470 - DNA, 25 bp, Mus musculus
aaaaatcatgtggttactactaggc

SEQ ID NO: 399471 - DNA, 25 bp, Mus musculus
aaaaatccctggaagcagtgatctg

SEQ ID NO: 399472 - DNA, 25 bp, Mus musculus
aaaaatcgttctgcgaggagtgacc

SEQ ID NO: 399473 - DNA, 25 bp, Mus musculus
aaaaatctagtgaacgccgaccgct

SEQ ID NO: 399474 - DNA, 25 bp, Mus musculus
aaaaatctgatggaagatggcctcc

SEQ ID NO: 399475 - DNA, 25 bp, Mus musculus
aaaaatctttgcagacctgatagtc

SEQ ID NO: 399476 - DNA, 25 bp, Mus musculus
aaaaattgccgaggtgtgctgtacc

SEQ ID NO: 399477 - DNA, 25 bp, Mus musculus
aaaacaaaactagtgacctcaggca

SEQ ID NO: 399478 - DNA, 25 bp, Mus musculus
aaaacaaagcgaagctctagggagc

SEQ ID NO: 399479 - DNA, 25 bp, Mus musculus
aaaacaacttgttcagagtccatgg

SEQ ID NO: 399480 - DNA, 25 bp, Mus musculus
aaaacaccgctgaagatggcgagcc

SEQ ID NO: 399481 - DNA, 25 bp, Mus musculus
aaaacacggcttgctcaggcttgac

SEQ ID NO: 399482 - DNA, 25 bp, Mus musculus
aaaacacgtgtaagtgccacagccg

SEQ ID NO: 399483 - DNA, 25 bp, Mus musculus
aaaacacgttcctgattgcatagcc

SEQ ID NO: 399484 - DNA, 25 bp, Mus musculus
aaaacactggcactggaacatctcg

SEQ ID NO: 399485 - DNA, 25 bp, Mus musculus
aaaacacttcctgacaagcctgagg

SEQ ID NO: 399486 - DNA, 25 bp, Mus musculus
aaaacagacaacttgctctaactcc

SEQ ID NO: 399487 - DNA, 25 bp, Mus musculus
aaaacagcgactacagtaaggaacg

SEQ ID NO: 399488 - DNA, 25 bp, Mus musculus
aaaacagcgcctggcttgggaaggc

SEQ ID NO: 399489 - DNA, 25 bp, Mus musculus
aaaacagtacgagttatccggcagg

SEQ ID NO: 399490 - DNA, 25 bp, Mus musculus
aaaacatagtcatcctctgcccctg

SEQ ID NO: 399491 - DNA, 25 bp, Mus musculus
aaaacatctcctgcacggtggtggg

SEQ ID NO: 399492 - DNA, 25 bp, Mus musculus
aaaacatctgaagtatgggacgccc

SEQ ID NO: 399493 - DNA, 25 bp, Mus musculus
aaaacatgaagcttgcccctcgagg

SEQ ID NO: 399494 - DNA, 25 bp, Mus musculus
aaaacatgaatggaattggattgct

SEQ ID NO: 399495 - DNA, 25 bp, Mus musculus
aaaacatgagcttaaaccgcctatg

SEQ ID NO: 399496 - DNA, 25 bp, Mus musculus
aaaacatgctgacagagacccgggc

SEQ ID NO: 399497 - DNA, 25 bp, Mus musculus
aaaaccaatggtgtatatctatgtc

SEQ ID NO: 399498 - DNA, 25 bp, Mus musculus
aaaaccacatttcccagtagcaccg

SEQ ID NO: 399499 - DNA, 25 bp, Mus musculus
aaaaccactctgagcgcgcgtggga

SEQ ID NO: 399500 - DNA, 25 bp, Mus musculus
aaaaccagaaatggcgtggaccaga

SEQ ID NO: 399501 - DNA, 25 bp, Mus musculus
aaaaccagcctggagctatgaagac

SEQ ID NO: 399502 - DNA, 25 bp, Mus musculus
aaaaccaggcacactgctgaatcag

SEQ ID NO: 399503 - DNA, 25 bp, Mus musculus
aaaacccagtcattatctcaagtgg

SEQ ID NO: 399504 - DNA, 25 bp, Mus musculus
aaaacccatcaccttaagcaccgag

SEQ ID NO: 399505 - DNA, 25 bp, Mus musculus
aaaacccccagacgaagatggcacg

SEQ ID NO: 399506 - DNA, 25 bp, Mus musculus
aaaacccctggatcttttggtgcag

SEQ ID NO: 399507 - DNA, 25 bp, Mus musculus
aaaaccctcttgacctcatggacca

SEQ ID NO: 399508 - DNA, 25 bp, Mus musculus
aaaaccgtggtcagcgaacagtgca

SEQ ID NO: 399509 - DNA, 25 bp, Mus musculus
aaaacctcaagcgtgtggccaatga

SEQ ID NO: 399510 - DNA, 25 bp, Mus musculus
aaaacctgcaagtgtgtggtccgcg

SEQ ID NO: 399511 - DNA, 25 bp, Mus musculus
aaaacctgcgggaaagccaagtgct

SEQ ID NO: 399512 - DNA, 25 bp, Mus musculus
aaaacctgctagtgtttggtgtgcc

SEQ ID NO: 399513 - DNA, 25 bp, Mus musculus
aaaacctgctggagttgtcgcgtgc

SEQ ID NO: 399514 - DNA, 25 bp, Mus musculus
aaaacctggcgcttgtcctaagccg

SEQ ID NO: 399515 - DNA, 25 bp, Mus musculus
aaaacgaggcatttgagccttggag

SEQ ID NO: 399516 - DNA, 25 bp, Mus musculus
aaaacggccgctgtgtgagagtcca

SEQ ID NO: 399517 - DNA, 25 bp, Mus musculus
aaaacgggatcattcgcggctacca

SEQ ID NO: 399518 - DNA, 25 bp, Mus musculus
aaaacgtcatagaagatttcaggca

SEQ ID NO: 399519 - DNA, 25 bp, Mus musculus
aaaacgtccttcagcatggtgcccc

SEQ ID NO: 399520 - DNA, 25 bp, Mus musculus
aaaacgtgcattcctcagacgctgg

SEQ ID NO: 399521 - DNA, 25 bp, Mus musculus
aaaacgtgcctgatgcaaagcggcc

SEQ ID NO: 399522 - DNA, 25 bp, Mus musculus
aaaacgtgtgtctaggaggcagcag

SEQ ID NO: 399523 - DNA, 25 bp, Mus musculus
aaaactactctgaagacttgccgcg

SEQ ID NO: 399524 - DNA, 25 bp, Mus musculus
aaaactcaaggaaatgatggctgcc

SEQ ID NO: 399525 - DNA, 25 bp, Mus musculus
aaaactcgcggagggtcagctgctg

SEQ ID NO: 399526 - DNA, 25 bp, Mus musculus
aaaactctgctgctacagtcacggg

SEQ ID NO: 399527 - DNA, 25 bp, Mus musculus
aaaactgaacagcaccactcacttg

SEQ ID NO: 399528 - DNA, 25 bp, Mus musculus
aaaactgagtgcagaagcagcctgc

SEQ ID NO: 399529 - DNA, 25 bp, Mus musculus
aaaactgattactttagcatcaaaa

SEQ ID NO: 399530 - DNA, 25 bp, Mus musculus
aaaactgctcagagacagtggacct

SEQ ID NO: 399531 - DNA, 25 bp, Mus musculus
aaaactgcttgcgtgttgcataggt

SEQ ID NO: 399532 - DNA, 25 bp, Mus musculus
aaaactggaatctgggctccccaca

SEQ ID NO: 399533 - DNA, 25 bp, Mus musculus
aaaactggacacctcatagatgatg

SEQ ID NO: 399534 - DNA, 25 bp, Mus musculus
aaaactggcttttctgaacctgcgc

SEQ ID NO: 399535 - DNA, 25 bp, Mus musculus
aaaactggtcagaaggcagagccgg

SEQ ID NO: 399536 - DNA, 25 bp, Mus musculus
aaaactggtcgctgtctacgggtgg

SEQ ID NO: 399537 - DNA, 25 bp, Mus musculus
aaaactgtactgcatgagggcagcc

SEQ ID NO: 399538 - DNA, 25 bp, Mus musculus
aaaacttaggtgatggaattctgga

SEQ ID NO: 399539 - DNA, 25 bp, Mus musculus
aaaacttcagcaactcccaggagca

SEQ ID NO: 399540 - DNA, 25 bp, Mus musculus
aaaacttctgctcttcatctgtgga

SEQ ID NO: 399541 - DNA, 25 bp, Mus musculus
aaaacttggctagctcacttgagac

SEQ ID NO: 399542 - DNA, 25 bp, Mus musculus
aaaactttcgccctggatgtcagcg

SEQ ID NO: 399543 - DNA, 25 bp, Mus musculus
aaaacttttcggaggctgcttcaga

SEQ ID NO: 399544 - DNA, 25 bp, Mus musculus
aaaagaaaattgactctcccgccag

SEQ ID NO: 399545 - DNA, 25 bp, Mus musculus
aaaagaaacatctcatgtcatgagg

SEQ ID NO: 399546 - DNA, 25 bp, Mus musculus
aaaagaaactacagccatcacaatg

SEQ ID NO: 399547 - DNA, 25 bp, Mus musculus
aaaagaaagctctgtggctcctgcc

SEQ ID NO: 399548 - DNA, 25 bp, Mus musculus
aaaagaacttgcaacccacagagga

SEQ ID NO: 399549 - DNA, 25 bp, Mus musculus
aaaagaaggcagagtcgggactaag

SEQ ID NO: 399550 - DNA, 25 bp, Mus musculus
aaaagaagtcttaagcccagctgca

SEQ ID NO: 399551 - DNA, 25 bp, Mus musculus
aaaagaatggaatctcaaccccgag

SEQ ID NO: 399552 - DNA, 25 bp, Mus musculus
aaaagaccaccatggaagaccacag

SEQ ID NO: 399553 - DNA, 25 bp, Mus musculus
aaaagaccgtttacagccaggcgag

SEQ ID NO: 399554 - DNA, 25 bp, Mus musculus
aaaagacgatctttattcagattcc

SEQ ID NO: 399555 - DNA, 25 bp, Mus musculus
aaaagactcctgaggtgttccgatg

SEQ ID NO: 399556 - DNA, 25 bp, Mus musculus
aaaagacttacttgtgtatgtacct

SEQ ID NO: 399557 - DNA, 25 bp, Mus musculus
aaaagagaacttgtgggcgaccatg

SEQ ID NO: 399558 - DNA, 25 bp, Mus musculus
aaaagagacgcacgcaagaggaagc

SEQ ID NO: 399559 - DNA, 25 bp, Mus musculus
aaaagagtccttcggtctcaaggca

SEQ ID NO: 399560 - DNA, 25 bp, Mus musculus
aaaagagtctgacagcgtcctgcgg

SEQ ID NO: 399561 - DNA, 25 bp, Mus musculus
aaaagatcaggagttgcctctggcc

SEQ ID NO: 399562 - DNA, 25 bp, Mus musculus
aaaagatcctgaaggcgctcaacag

SEQ ID NO: 399563 - DNA, 25 bp, Mus musculus
aaaagatgacattggcacaggccgg

SEQ ID NO: 399564 - DNA, 25 bp, Mus musculus
aaaagatggcgttcgtcggcttcaa

SEQ ID NO: 399565 - DNA, 25 bp, Mus musculus
aaaagattcggcagttcaaaagcaa

SEQ ID NO: 399566 - DNA, 25 bp, Mus musculus
aaaagcaccccacacattgtatggg

SEQ ID NO: 399567 - DNA, 25 bp, Mus musculus
aaaagcaccgtgtgaaactgaccac

SEQ ID NO: 399568 - DNA, 25 bp, Mus musculus
aaaagcagatggtgtaattctgagg

SEQ ID NO: 399569 - DNA, 25 bp, Mus musculus
aaaagcagtgaggtagcatgtttcc

SEQ ID NO: 399570 - DNA, 25 bp, Mus musculus
aaaagccaatcagtgtgggtatggg

SEQ ID NO: 399571 - DNA, 25 bp, Mus musculus
aaaagccacattgcagtctgaacca

SEQ ID NO: 399572 - DNA, 25 bp, Mus musculus
aaaagccagcctcacacacatggga

SEQ ID NO: 399573 - DNA, 25 bp, Mus musculus
aaaagccattgttatgattccttcg

SEQ ID NO: 399574 - DNA, 25 bp, Mus musculus
aaaagcctcaccaggccaaaggtgg

SEQ ID NO: 399575 - DNA, 25 bp, Mus musculus
aaaagcctccgatctgagccctggt

SEQ ID NO: 399576 - DNA, 25 bp, Mus musculus
aaaagcctctaagaggtgagctggg

SEQ ID NO: 399577 - DNA, 25 bp, Mus musculus
aaaagccttcatcacaagtactcgg

SEQ ID NO: 399578 - DNA, 25 bp, Mus musculus
aaaagccttggcctgccggagcatc

SEQ ID NO: 399579 - DNA, 25 bp, Mus musculus
aaaagcgaagggaacctgagagcca

SEQ ID NO: 399580 - DNA, 25 bp, Mus musculus
aaaagcgaccgagataagagtggac

SEQ ID NO: 399581 - DNA, 25 bp, Mus musculus
aaaagcgcgctaagcctcctgggat

SEQ ID NO: 399582 - DNA, 25 bp, Mus musculus
aaaagcgggtcctccaccaagatgg

SEQ ID NO: 399583 - DNA, 25 bp, Mus musculus
aaaagcgtctgaatccctgcaagca

SEQ ID NO: 399584 - DNA, 25 bp, Mus musculus
aaaagctacgagttgcctgatgggc

SEQ ID NO: 399585 - DNA, 25 bp, Mus musculus
aaaagctccttcaaactgaatgacc

SEQ ID NO: 399586 - DNA, 25 bp, Mus musculus
aaaagctctctggtattcttcagga

SEQ ID NO: 399587 - DNA, 25 bp, Mus musculus
aaaagctctgctaccacgtcttggg

SEQ ID NO: 399588 - DNA, 25 bp, Mus musculus
aaaagcttccagacgtactgtccgg

SEQ ID NO: 399589 - DNA, 25 bp, Mus musculus
aaaagcttggtcctcctgtgacggg

SEQ ID NO: 399590 - DNA, 25 bp, Mus musculus
aaaaggaacatgctgctgacggccc

SEQ ID NO: 399591 - DNA, 25 bp, Mus musculus
aaaaggacaccagaagttaaccatg

SEQ ID NO: 399592 - DNA, 25 bp, Mus musculus
aaaaggacctgtgctgtcacctgac

SEQ ID NO: 399593 - DNA, 25 bp, Mus musculus
aaaaggaggcttagagagttctgac

SEQ ID NO: 399594 - DNA, 25 bp, Mus musculus
aaaaggagtcttgttctcagcggag

SEQ ID NO: 399595 - DNA, 25 bp, Mus musculus
aaaaggatcctggagtctcagcggc

SEQ ID NO: 399596 - DNA, 25 bp, Mus musculus
aaaaggatgagtcctaagcctgaac

SEQ ID NO: 399597 - DNA, 25 bp, Mus musculus
aaaaggattcttctatggctacacg

SEQ ID NO: 399598 - DNA, 25 bp, Mus musculus
aaaaggatttcctgcccgactcaga

SEQ ID NO: 399599 - DNA, 25 bp, Mus musculus
aaaaggcagatagaaatccatgctt

SEQ ID NO: 399600 - DNA, 25 bp, Mus musculus
aaaaggcccggaatccagaggactg

SEQ ID NO: 399601 - DNA, 25 bp, Mus musculus
aaaaggcctgtggtatcctggagca

SEQ ID NO: 399602 - DNA, 25 bp, Mus musculus
aaaaggctctttgcaagggctctgg

SEQ ID NO: 399603 - DNA, 25 bp, Mus musculus
aaaagggatgcctatgtgagccgcc

SEQ ID NO: 399604 - DNA, 25 bp, Mus musculus
aaaagggccacaagctactgacgga

SEQ ID NO: 399605 - DNA, 25 bp, Mus musculus
aaaagggccccttgcaaagctgaag

SEQ ID NO: 399606 - DNA, 25 bp, Mus musculus
aaaagggccgtcacagaagctttca

SEQ ID NO: 399607 - DNA, 25 bp, Mus musculus
aaaagggccttaaaagctgctgcag

SEQ ID NO: 399608 - DNA, 25 bp, Mus musculus
aaaagggctgacaagtactgggagt

SEQ ID NO: 399609 - DNA, 25 bp, Mus musculus
aaaagggtgacaagactccaggcag

SEQ ID NO: 399610 - DNA, 25 bp, Mus musculus
aaaaggtaggctctcatcccaatga

SEQ ID NO: 399611 - DNA, 25 bp, Mus musculus
aaaaggtcagtcaactccaagaggg

SEQ ID NO: 399612 - DNA, 25 bp, Mus musculus
aaaaggtgtttggtggctcagtagc

SEQ ID NO: 399613 - DNA, 25 bp, Mus musculus
aaaaggttactctctcagtgctcag

SEQ ID NO: 399614 - DNA, 25 bp, Mus musculus
aaaaggttcatggtctgtgtcacag

SEQ ID NO: 399615 - DNA, 25 bp, Mus musculus
aaaaggttgaacagcggactctgcc

SEQ ID NO: 399616 - DNA, 25 bp, Mus musculus
aaaagtaaatccaattcctcagcgg

SEQ ID NO: 399617 - DNA, 25 bp, Mus musculus
aaaagtaccaatcctgctgtcagag

SEQ ID NO: 399618 - DNA, 25 bp, Mus musculus
aaaagtagccatctcactgctccag

SEQ ID NO: 399619 - DNA, 25 bp, Mus musculus
aaaagtagtgcccaaaagctgtgcc

SEQ ID NO: 399620 - DNA, 25 bp, Mus musculus
aaaagtagttttcagatcaccagcg

SEQ ID NO: 399621 - DNA, 25 bp, Mus musculus
aaaagtatgcaaactccaggtccag

SEQ ID NO: 399622 - DNA, 25 bp, Mus musculus
aaaagtatgcatcctgtttccagta

SEQ ID NO: 399623 - DNA, 25 bp, Mus musculus
aaaagtatggcatcaacacagatcc

SEQ ID NO: 399624 - DNA, 25 bp, Mus musculus
aaaagtattctgagctgacagctgc

SEQ ID NO: 399625 - DNA, 25 bp, Mus musculus
aaaagtcaattttgtatgagccgcg

SEQ ID NO: 399626 - DNA, 25 bp, Mus musculus
aaaagtcactgtctctcccgaagga

SEQ ID NO: 399627 - DNA, 25 bp, Mus musculus
aaaagtcagcgttcccagagagtgg

SEQ ID NO: 399628 - DNA, 25 bp, Mus musculus
aaaagtcagggcagcgcctcttgac

SEQ ID NO: 399629 - DNA, 25 bp, Mus musculus
aaaagtcccagctgactctcagaag

SEQ ID NO: 399630 - DNA, 25 bp, Mus musculus
aaaagtctagaagctctgcataggg

SEQ ID NO: 399631 - DNA, 25 bp, Mus musculus
aaaagtgaattttgaccagggtcag

SEQ ID NO: 399632 - DNA, 25 bp, Mus musculus
aaaagtgagaccaacaggagtcctg

SEQ ID NO: 399633 - DNA, 25 bp, Mus musculus
aaaagtggcaagcaccagagggtac

SEQ ID NO: 399634 - DNA, 25 bp, Mus musculus
aaaagtggcagttctcaatgagcgc

SEQ ID NO: 399635 - DNA, 25 bp, Mus musculus
aaaagtggcttctgagtaagacagc

SEQ ID NO: 399636 - DNA, 25 bp, Mus musculus
aaaagtgggcacagcgttcattcag

SEQ ID NO: 399637 - DNA, 25 bp, Mus musculus
aaaagtgtctcacattcccagcagc

SEQ ID NO: 399638 - DNA, 25 bp, Mus musculus
aaaagtgttcatttgtacctcccat

SEQ ID NO: 399639 - DNA, 25 bp, Mus musculus
aaaagttaccagctggaacattggg

SEQ ID NO: 399640 - DNA, 25 bp, Mus musculus
aaaagttaccttatccaaatgagag

SEQ ID NO: 399641 - DNA, 25 bp, Mus musculus
aaaagttgaaccctagaagagctct

SEQ ID NO: 399642 - DNA, 25 bp, Mus musculus
aaaagttgcagtcgtacttaggcag

SEQ ID NO: 399643 - DNA, 25 bp, Mus musculus
aaaagttgctagtagacagatggtc

SEQ ID NO: 399644 - DNA, 25 bp, Mus musculus
aaaagttgtgttgttgagaccgtct

SEQ ID NO: 399645 - DNA, 25 bp, Mus musculus
aaaagttgttgcaggctgaccgcgc

SEQ ID NO: 399646 - DNA, 25 bp, Mus musculus
aaaagtttgcccctgagctcctgga

SEQ ID NO: 399647 - DNA, 25 bp, Mus musculus
aaaataaaattatgccgtcgcgagg

SEQ ID NO: 399648 - DNA, 25 bp, Mus musculus
aaaataaaggagaagcagctctagt

SEQ ID NO: 399649 - DNA, 25 bp, Mus musculus
aaaataacacgatggctgctgaggc

SEQ ID NO: 399650 - DNA, 25 bp, Mus musculus
aaaataatctatgtgggctctgcag

SEQ ID NO: 399651 - DNA, 25 bp, Mus musculus
aaaatacaggcccagatagaccgct

SEQ ID NO: 399652 - DNA, 25 bp, Mus musculus
aaaatactcattgggtcgggctggc

SEQ ID NO: 399653 - DNA, 25 bp, Mus musculus
aaaatactgctctcgcttcaagggc

SEQ ID NO: 399654 - DNA, 25 bp, Mus musculus
aaaatagtaaacaccaaccaagatg

SEQ ID NO: 399655 - DNA, 25 bp, Mus musculus
aaaatagttgcacggctctggtcag

SEQ ID NO: 399656 - DNA, 25 bp, Mus musculus
aaaatatgaagtgtgagagcaggcc

SEQ ID NO: 399657 - DNA, 25 bp, Mus musculus
aaaatatgcattctggttgggacac

SEQ ID NO: 399658 - DNA, 25 bp, Mus musculus
aaaatatgctgacgacagggagcgc

SEQ ID NO: 399659 - DNA, 25 bp, Mus musculus
aaaatcaacagagcggatcccagcg

SEQ ID NO: 399660 - DNA, 25 bp, Mus musculus
aaaatcacactgttgggcatttggg

SEQ ID NO: 399661 - DNA, 25 bp, Mus musculus
aaaatcaccagcgtcacgtccgtgg

SEQ ID NO: 399662 - DNA, 25 bp, Mus musculus
aaaatcagaaaatacagcccgggca

SEQ ID NO: 399663 - DNA, 25 bp, Mus musculus
aaaatcatatatcgagactgctaag

SEQ ID NO: 399664 - DNA, 25 bp, Mus musculus
aaaatcattcgtggtttctgtcact

SEQ ID NO: 399665 - DNA, 25 bp, Mus musculus
aaaatccaagccgatgtgtccgagg

SEQ ID NO: 399666 - DNA, 25 bp, Mus musculus
aaaatcccctctctatgataactgc

SEQ ID NO: 399667 - DNA, 25 bp, Mus musculus
aaaatccgttccctctgagtagtgg

SEQ ID NO: 399668 - DNA, 25 bp, Mus musculus
aaaatcctgtggcagctgggaaccc

SEQ ID NO: 399669 - DNA, 25 bp, Mus musculus
aaaatcgacctccttgatcggaagg

SEQ ID NO: 399670 - DNA, 25 bp, Mus musculus
aaaatcgctgacttgggctgccctc

SEQ ID NO: 399671 - DNA, 25 bp, Mus musculus
aaaatctattgctatcaccatgatg

SEQ ID NO: 399672 - DNA, 25 bp, Mus musculus
aaaatctgtttgaaggcatgatatg

SEQ ID NO: 399673 - DNA, 25 bp, Mus musculus
aaaatctttgcaaaggccggcctgg

SEQ ID NO: 399674 - DNA, 25 bp, Mus musculus
aaaatgaagccagccggtacagacc

SEQ ID NO: 399675 - DNA, 25 bp, Mus musculus
aaaatgagcgaactggaggaagact

SEQ ID NO: 399676 - DNA, 25 bp, Mus musculus
aaaatgatcaacttatccgagccag

SEQ ID NO: 399677 - DNA, 25 bp, Mus musculus
aaaatgatctggatgctgaccgtgc

SEQ ID NO: 399678 - DNA, 25 bp, Mus musculus
aaaatgcagctggtgggtcctctga

SEQ ID NO: 399679 - DNA, 25 bp, Mus musculus
aaaatgccacctgcgattggagggc

SEQ ID NO: 399680 - DNA, 25 bp, Mus musculus
aaaatgcccagcaaggtgaagcctg

SEQ ID NO: 399681 - DNA, 25 bp, Mus musculus
aaaatgctgagtcgctcctggaggc

SEQ ID NO: 399682 - DNA, 25 bp, Mus musculus
aaaatgctgctcttgggagtgaacc

SEQ ID NO: 399683 - DNA, 25 bp, Mus musculus
aaaatgctgtttcctctactgccca

SEQ ID NO: 399684 - DNA, 25 bp, Mus musculus
aaaatggactcagtgtgcgcgctcc

SEQ ID NO: 399685 - DNA, 25 bp, Mus musculus
aaaatggaggttgtgattctcctgc

SEQ ID NO: 399686 - DNA, 25 bp, Mus musculus
aaaatggccatcttttcaccacatg

SEQ ID NO: 399687 - DNA, 25 bp, Mus musculus
aaaatggccttactgcctgggagca

SEQ ID NO: 399688 - DNA, 25 bp, Mus musculus
aaaatggtacaggaggctgtgtccc

SEQ ID NO: 399689 - DNA, 25 bp, Mus musculus
aaaatggtattcgagtcggtggtcg

SEQ ID NO: 399690 - DNA, 25 bp, Mus musculus
aaaatggtgatcagcgtggtcctcc

SEQ ID NO: 399691 - DNA, 25 bp, Mus musculus
aaaatgtagtttggtagactgctcc

SEQ ID NO: 399692 - DNA, 25 bp, Mus musculus
aaaatgtcccgacagctccccttga

SEQ ID NO: 399693 - DNA, 25 bp, Mus musculus
aaaatgtctaatagtctccagagcg

SEQ ID NO: 399694 - DNA, 25 bp, Mus musculus
aaaatgtctcagagcaaccgggagc

SEQ ID NO: 399695 - DNA, 25 bp, Mus musculus
aaaatgtggattaagctacggtctc

SEQ ID NO: 399696 - DNA, 25 bp, Mus musculus
aaaatgttgcggagccagtctcagc

SEQ ID NO: 399697 - DNA, 25 bp, Mus musculus
aaaattaaatttcaagctggagaga

SEQ ID NO: 399698 - DNA, 25 bp, Mus musculus
aaaattagatgtcttctgcacggac

SEQ ID NO: 399699 - DNA, 25 bp, Mus musculus
aaaattcaggctagcttccgtggac

SEQ ID NO: 399700 - DNA, 25 bp, Mus musculus
aaaattccgtacctgtgcatgcctg

SEQ ID NO: 399701 - DNA, 25 bp, Mus musculus
aaaattcctgaagcagtaccggcgg

SEQ ID NO: 399702 - DNA, 25 bp, Mus musculus
aaaattcctgtatgacatgtcctgc

SEQ ID NO: 399703 - DNA, 25 bp, Mus musculus
aaaattcggagtggcaagctggcgc

SEQ ID NO: 399704 - DNA, 25 bp, Mus musculus
aaaattctcagaccagctgggcctg

SEQ ID NO: 399705 - DNA, 25 bp, Mus musculus
aaaattgagatggacaagcgccagc

SEQ ID NO: 399706 - DNA, 25 bp, Mus musculus
aaaattgcaaccaccgagacgtttg

SEQ ID NO: 399707 - DNA, 25 bp, Mus musculus
aaaattgctaacatggagggctgga

SEQ ID NO: 399708 - DNA, 25 bp, Mus musculus
aaaattgtatgagttatccggcagg

SEQ ID NO: 399709 - DNA, 25 bp, Mus musculus
aaaatttggtgttatgggaagccag

SEQ ID NO: 399710 - DNA, 25 bp, Mus musculus
aaacaaaattctacctgccccgctg

SEQ ID NO: 399711 - DNA, 25 bp, Mus musculus
aaacaaagctcatcaacatttcggg

SEQ ID NO: 399712 - DNA, 25 bp, Mus musculus
aaacaaagttcagtggcgagcagca

SEQ ID NO: 399713 - DNA, 25 bp, Mus musculus
aaacaacaaactcgtaggctggcgc

SEQ ID NO: 399714 - DNA, 25 bp, Mus musculus
aaacaaccgcagtggtgctggcagc

SEQ ID NO: 399715 - DNA, 25 bp, Mus musculus
aaacaacgccttcagagtctaccgg

SEQ ID NO: 399716 - DNA, 25 bp, Mus musculus
aaacaagagcgagcggttcctgcta

SEQ ID NO: 399717 - DNA, 25 bp, Mus musculus
aaacaagcctcttgctgctcgaccc

SEQ ID NO: 399718 - DNA, 25 bp, Mus musculus
aaacaagggcgggaacaacttgctg

SEQ ID NO: 399719 - DNA, 25 bp, Mus musculus
aaacaagtgcaggtgttcgcgggca

SEQ ID NO: 399720 - DNA, 25 bp, Mus musculus
aaacaagtgttttcgaggtgagcaa

SEQ ID NO: 399721 - DNA, 25 bp, Mus musculus
aaacaagttacgatgctcaccggga

SEQ ID NO: 399722 - DNA, 25 bp, Mus musculus
aaacaatccagaaaacgccaagcac

SEQ ID NO: 399723 - DNA, 25 bp, Mus musculus
aaacaatggcccgagtctaatggga

SEQ ID NO: 399724 - DNA, 25 bp, Mus musculus
aaacaatggtgatgatgtggacccc

SEQ ID NO: 399725 - DNA, 25 bp, Mus musculus
aaacaattccagctttctgctgcag

SEQ ID NO: 399726 - DNA, 25 bp, Mus musculus
aaacaattcctggagcggagggcca

SEQ ID NO: 399727 - DNA, 25 bp, Mus musculus
aaacaattgaggaatatgccatatg

SEQ ID NO: 399728 - DNA, 25 bp, Mus musculus
aaacacacaagctgctgcggaggac

SEQ ID NO: 399729 - DNA, 25 bp, Mus musculus
aaacacagcctggaagtgggacacc

SEQ ID NO: 399730 - DNA, 25 bp, Mus musculus
aaacacagtgtcgaaggagtgcaga

SEQ ID NO: 399731 - DNA, 25 bp, Mus musculus
aaacaccagcactgtcccgggcata

SEQ ID NO: 399732 - DNA, 25 bp, Mus musculus
aaacacgctcctcctgcttgtgcag

SEQ ID NO: 399733 - DNA, 25 bp, Mus musculus
aaacacgtctggtctcctgctagag

SEQ ID NO: 399734 - DNA, 25 bp, Mus musculus
aaacactggctcttaggctccctgg

SEQ ID NO: 399735 - DNA, 25 bp, Mus musculus
aaacactggttcttcctatggtcaa

SEQ ID NO: 399736 - DNA, 25 bp, Mus musculus
aaacacttgctttgcttcttgggag

SEQ ID NO: 399737 - DNA, 25 bp, Mus musculus
aaacagaaggttttccctgtgctgt

SEQ ID NO: 399738 - DNA, 25 bp, Mus musculus
aaacagacggcaagagcaccgctgt

SEQ ID NO: 399739 - DNA, 25 bp, Mus musculus
aaacagagtgtgaagatgccctggc

SEQ ID NO: 399740 - DNA, 25 bp, Mus musculus
aaacagatctggtgtctctcatgga

SEQ ID NO: 399741 - DNA, 25 bp, Mus musculus
aaacagatgcctcagttactaccgt

SEQ ID NO: 399742 - DNA, 25 bp, Mus musculus
aaacagatgtttcttggaacgcagc

SEQ ID NO: 399743 - DNA, 25 bp, Mus musculus
aaacagcatacatgcgagccagcca

SEQ ID NO: 399744 - DNA, 25 bp, Mus musculus
aaacagcatctttgtggtccccacc

SEQ ID NO: 399745 - DNA, 25 bp, Mus musculus
aaacagcatggaagtagcagacaca

SEQ ID NO: 399746 - DNA, 25 bp, Mus musculus
aaacagccaacccatgagagtcgta

SEQ ID NO: 399747 - DNA, 25 bp, Mus musculus
aaacagctgtgtgcccgaggctcga

SEQ ID NO: 399748 - DNA, 25 bp, Mus musculus
aaacagcttcagatacgcagccccg

SEQ ID NO: 399749 - DNA, 25 bp, Mus musculus
aaacagcttggtgcttgtgagagga

SEQ ID NO: 399750 - DNA, 25 bp, Mus musculus
aaacaggctttggtctcattatcag

SEQ ID NO: 399751 - DNA, 25 bp, Mus musculus
aaacagggctcttccatgaccaggc

SEQ ID NO: 399752 - DNA, 25 bp, Mus musculus
aaacaggtgaatgagcagtgcccca

SEQ ID NO: 399753 - DNA, 25 bp, Mus musculus
aaacaggtgtctggccctgagcgca

SEQ ID NO: 399754 - DNA, 25 bp, Mus musculus
aaacagtgacaggaaggctttgcca

SEQ ID NO: 399755 - DNA, 25 bp, Mus musculus
aaacagtggcctgctacttggttac

SEQ ID NO: 399756 - DNA, 25 bp, Mus musculus
aaacagtgggaaagcgactccgctg

SEQ ID NO: 399757 - DNA, 25 bp, Mus musculus
aaacagtgtgggaagcaagtccagc

SEQ ID NO: 399758 - DNA, 25 bp, Mus musculus
aaacagttagcgcaagacacgggac

SEQ ID NO: 399759 - DNA, 25 bp, Mus musculus
aaacatacccctagatgaaagccgg

SEQ ID NO: 399760 - DNA, 25 bp, Mus musculus
aaacatacttgatcagcctgccggg

SEQ ID NO: 399761 - DNA, 25 bp, Mus musculus
aaacatagatcaacagccgcctcag

SEQ ID NO: 399762 - DNA, 25 bp, Mus musculus
aaacatcattgtacattcagtgcca

SEQ ID NO: 399763 - DNA, 25 bp, Mus musculus
aaacatctggatctccctgggcagc

SEQ ID NO: 399764 - DNA, 25 bp, Mus musculus
aaacatcttcctccgcggcctagtg

SEQ ID NO: 399765 - DNA, 25 bp, Mus musculus
aaacatgatggaggaaagcgtgaat

SEQ ID NO: 399766 - DNA, 25 bp, Mus musculus
aaacatgcagcggtaataagccaga

SEQ ID NO: 399767 - DNA, 25 bp, Mus musculus
aaacatgcgcacacagcaattgtgg

SEQ ID NO: 399768 - DNA, 25 bp, Mus musculus
aaacatggtgagcaatgcctgggca

SEQ ID NO: 399769 - DNA, 25 bp, Mus musculus
aaacatggtggtagaccttcccagg

SEQ ID NO: 399770 - DNA, 25 bp, Mus musculus
aaacatgttctaagccaggcattgg

SEQ ID NO: 399771 - DNA, 25 bp, Mus musculus
aaacattgaacctgaagacccagcg

SEQ ID NO: 399772 - DNA, 25 bp, Mus musculus
aaaccaaactcatgaccaggtcaaa

SEQ ID NO: 399773 - DNA, 25 bp, Mus musculus
aaaccaacagggtaaaagcagcact

SEQ ID NO: 399774 - DNA, 25 bp, Mus musculus
aaaccaaccggtggtcagcagggca

SEQ ID NO: 399775 - DNA, 25 bp, Mus musculus
aaaccaagatgcagggcctgcctgt

SEQ ID NO: 399776 - DNA, 25 bp, Mus musculus
aaaccaagcaggcactgggctggaa

SEQ ID NO: 399777 - DNA, 25 bp, Mus musculus
aaaccaagggcaggagagtgactct

SEQ ID NO: 399778 - DNA, 25 bp, Mus musculus
aaaccaagtttcatgaatgtgccca

SEQ ID NO: 399779 - DNA, 25 bp, Mus musculus
aaaccacagcaagtactggtgtgtc

SEQ ID NO: 399780 - DNA, 25 bp, Mus musculus
aaaccaccagcaaccaagacagatt

SEQ ID NO: 399781 - DNA, 25 bp, Mus musculus
aaaccactgcccgagatgggtcgct

SEQ ID NO: 399782 - DNA, 25 bp, Mus musculus
aaaccagaatgggaagcgcaggact

SEQ ID NO: 399783 - DNA, 25 bp, Mus musculus
aaaccagagatcctcacctcgggag

SEQ ID NO: 399784 - DNA, 25 bp, Mus musculus
aaaccagagctggagagcattccca

SEQ ID NO: 399785 - DNA, 25 bp, Mus musculus
aaaccagtccaagtcacagtcttag

SEQ ID NO: 399786 - DNA, 25 bp, Mus musculus
aaaccataaattgctcctgacagga

SEQ ID NO: 399787 - DNA, 25 bp, Mus musculus
aaaccatctctagggcagggcctgg

SEQ ID NO: 399788 - DNA, 25 bp, Mus musculus
aaaccatctcttcccctagcacacg

SEQ ID NO: 399789 - DNA, 25 bp, Mus musculus
aaaccatgggagcttctgcctcagc

SEQ ID NO: 399790 - DNA, 25 bp, Mus musculus
aaaccatggtgagaaccctgagctc

SEQ ID NO: 399791 - DNA, 25 bp, Mus musculus
aaaccattgagtaaatcggcctgcc

SEQ ID NO: 399792 - DNA, 25 bp, Mus musculus
aaacccacactgacacgcggtgtgt

SEQ ID NO: 399793 - DNA, 25 bp, Mus musculus
aaacccactttgaatcatgctgaat

SEQ ID NO: 399794 - DNA, 25 bp, Mus musculus
aaacccagagggtacatcattgccc

SEQ ID NO: 399795 - DNA, 25 bp, Mus musculus
aaacccagcacagaaggagtcacgg

SEQ ID NO: 399796 - DNA, 25 bp, Mus musculus
aaacccagcctgtgaacattagcaa

SEQ ID NO: 399797 - DNA, 25 bp, Mus musculus
aaaccccgtttttgatgatgaggag

SEQ ID NO: 399798 - DNA, 25 bp, Mus musculus
aaacccggtggtgggcagtctgaca

SEQ ID NO: 399799 - DNA, 25 bp, Mus musculus
aaaccctgcaagatgtgtgaggccc

SEQ ID NO: 399800 - DNA, 25 bp, Mus musculus
aaaccctgggatttgtgtgacagca

SEQ ID NO: 399801 - DNA, 25 bp, Mus musculus
aaaccgcatctgcttgtcctcaaca

SEQ ID NO: 399802 - DNA, 25 bp, Mus musculus
aaaccgccagtagccaagatcgctg

SEQ ID NO: 399803 - DNA, 25 bp, Mus musculus
aaaccgcctgctggttggatgtcca

SEQ ID NO: 399804 - DNA, 25 bp, Mus musculus
aaaccgccttcagtgcttgctggct

SEQ ID NO: 399805 - DNA, 25 bp, Mus musculus
aaaccgctttttgatgcgggccagg

SEQ ID NO: 399806 - DNA, 25 bp, Mus musculus
aaaccggacaagatggcggcgaagc

SEQ ID NO: 399807 - DNA, 25 bp, Mus musculus
aaaccggacattcagccttggcaag

SEQ ID NO: 399808 - DNA, 25 bp, Mus musculus
aaaccggcgtagaggcaaaaatgag

SEQ ID NO: 399809 - DNA, 25 bp, Mus musculus
aaacctaatgtgtatgccacccggg

SEQ ID NO: 399810 - DNA, 25 bp, Mus musculus
aaacctccatgggtcccgtgtagag

SEQ ID NO: 399811 - DNA, 25 bp, Mus musculus
aaacctgagcctgaagatcctcggg

SEQ ID NO: 399812 - DNA, 25 bp, Mus musculus
aaacctgggcatgcgcatgtgcgac

SEQ ID NO: 399813 - DNA, 25 bp, Mus musculus
aaacctgggccaaggtgtccaagca

SEQ ID NO: 399814 - DNA, 25 bp, Mus musculus
aaacctgtgctccttcattgaaata

SEQ ID NO: 399815 - DNA, 25 bp, Mus musculus
aaacctgttcgtgatgtagcctcca

SEQ ID NO: 399816 - DNA, 25 bp, Mus musculus
aaaccttagaatccttggacttgag

SEQ ID NO: 399817 - DNA, 25 bp, Mus musculus
aaaccttaggatgagagagcggcac

SEQ ID NO: 399818 - DNA, 25 bp, Mus musculus
aaaccttccagaaacatgacttttg

SEQ ID NO: 399819 - DNA, 25 bp, Mus musculus
aaaccttctctggttgtcagccaac

SEQ ID NO: 399820 - DNA, 25 bp, Mus musculus
aaaccttgtgttgacttacctcgtg

SEQ ID NO: 399821 - DNA, 25 bp, Mus musculus
aaaccttgttgacggctctgcctga

SEQ ID NO: 399822 - DNA, 25 bp, Mus musculus
aaacctttagccatgaactgtcaga

SEQ ID NO: 399823 - DNA, 25 bp, Mus musculus
aaacgaagcggaaactagagcctgg

SEQ ID NO: 399824 - DNA, 25 bp, Mus musculus
aaacgaaggtgtagtatatggctgg

SEQ ID NO: 399825 - DNA, 25 bp, Mus musculus
aaacgagagctttgggcccttgcag

SEQ ID NO: 399826 - DNA, 25 bp, Mus musculus
aaacgatctgtttgtgacctcacac

SEQ ID NO: 399827 - DNA, 25 bp, Mus musculus
aaacgatgacaatccaatgggcggc

SEQ ID NO: 399828 - DNA, 25 bp, Mus musculus
aaacgatgcaagaacccaggcgagt

SEQ ID NO: 399829 - DNA, 25 bp, Mus musculus
aaacgatggagctagacagatgggc

SEQ ID NO: 399830 - DNA, 25 bp, Mus musculus
aaacgatgtgtctgactcgtggccc

SEQ ID NO: 399831 - DNA, 25 bp, Mus musculus
aaacgcacagcaagtcacccgaaca

SEQ ID NO: 399832 - DNA, 25 bp, Mus musculus
aaacgcagactccattccttccatg

SEQ ID NO: 399833 - DNA, 25 bp, Mus musculus
aaacgccttcctagacggttgcagg

SEQ ID NO: 399834 - DNA, 25 bp, Mus musculus
aaacgctccgagtgattgccaaggc

SEQ ID NO: 399835 - DNA, 25 bp, Mus musculus
aaacgctggcattacttcagacggg

SEQ ID NO: 399836 - DNA, 25 bp, Mus musculus
aaacgctggtttgtcctcaggcggg

SEQ ID NO: 399837 - DNA, 25 bp, Mus musculus
aaacggaactggcttatgggtcacg

SEQ ID NO: 399838 - DNA, 25 bp, Mus musculus
aaacggagagtctgcagagagccca

SEQ ID NO: 399839 - DNA, 25 bp, Mus musculus
aaacggagatttggagcgcatgcgc

SEQ ID NO: 399840 - DNA, 25 bp, Mus musculus
aaacggaggtgaaggcggcatcatc

SEQ ID NO: 399841 - DNA, 25 bp, Mus musculus
aaacggagtcgcctccggtgctgcc

SEQ ID NO: 399842 - DNA, 25 bp, Mus musculus
aaacggatgaagacgctggactgca

SEQ ID NO: 399843 - DNA, 25 bp, Mus musculus
aaacggcagtgcaaaagctgcaggc

SEQ ID NO: 399844 - DNA, 25 bp, Mus musculus
aaacggccagtttgaacattgtaca

SEQ ID NO: 399845 - DNA, 25 bp, Mus musculus
aaacggcctaggttcaggctgcctg

SEQ ID NO: 399846 - DNA, 25 bp, Mus musculus
aaacgggtccacgaaggcttctgat

SEQ ID NO: 399847 - DNA, 25 bp, Mus musculus
aaacggtcatttactggctggcaga

SEQ ID NO: 399848 - DNA, 25 bp, Mus musculus
aaacggtgactctttgcaggctggc

SEQ ID NO: 399849 - DNA, 25 bp, Mus musculus
aaacgtaccacacctacatccatgg

SEQ ID NO: 399850 - DNA, 25 bp, Mus musculus
aaacgtacgcgtggaactgtgtgac

SEQ ID NO: 399851 - DNA, 25 bp, Mus musculus
aaacgtcagctgtttcttaggctgc

SEQ ID NO: 399852 - DNA, 25 bp, Mus musculus
aaacgtcagtgtctttgttgccaag

SEQ ID NO: 399853 - DNA, 25 bp, Mus musculus
aaacgtcctctaaagcgtgccaggg

SEQ ID NO: 399854 - DNA, 25 bp, Mus musculus
aaacgtcggcagaaaatggctcggc

SEQ ID NO: 399855 - DNA, 25 bp, Mus musculus
aaacgtctgcggctgtttgaactgc

SEQ ID NO: 399856 - DNA, 25 bp, Mus musculus
aaacgtggactaggaggaggctcaa

SEQ ID NO: 399857 - DNA, 25 bp, Mus musculus
aaactaagccctttgcaatgccccg

SEQ ID NO: 399858 - DNA, 25 bp, Mus musculus
aaactacataggatgaatttgaccc

SEQ ID NO: 399859 - DNA, 25 bp, Mus musculus
aaactacatgtttctctacaagcag

SEQ ID NO: 399860 - DNA, 25 bp, Mus musculus
aaactacgggcgactcttcttcacg

SEQ ID NO: 399861 - DNA, 25 bp, Mus musculus
aaactacgttgtctacctgggtcag

SEQ ID NO: 399862 - DNA, 25 bp, Mus musculus
aaactagttgtggatgcaggcgctc

SEQ ID NO: 399863 - DNA, 25 bp, Mus musculus
aaactatgttcccagagccgtgctg

SEQ ID NO: 399864 - DNA, 25 bp, Mus musculus
aaactcaaagacgagggctgccggg

SEQ ID NO: 399865 - DNA, 25 bp, Mus musculus
aaactcagcgttttgccaggcaggc

SEQ ID NO: 399866 - DNA, 25 bp, Mus musculus
aaactccagctaccaagaggatgct

SEQ ID NO: 399867 - DNA, 25 bp, Mus musculus
aaactccaggtgagcgagaatgcac

SEQ ID NO: 399868 - DNA, 25 bp, Mus musculus
aaactccgagtcatgcgaatgcgcg

SEQ ID NO: 399869 - DNA, 25 bp, Mus musculus
aaactcgtgcgcttggacatgacct

SEQ ID NO: 399870 - DNA, 25 bp, Mus musculus
aaactctagaggctcagtgcacaca

SEQ ID NO: 399871 - DNA, 25 bp, Mus musculus
aaactctcccatccctggtaggact

SEQ ID NO: 399872 - DNA, 25 bp, Mus musculus
aaactctgggagattctcctgttga

SEQ ID NO: 399873 - DNA, 25 bp, Mus musculus
aaactctgtggattgggtcctggaa

SEQ ID NO: 399874 - DNA, 25 bp, Mus musculus
aaactcttaacacctgaagaggttg

SEQ ID NO: 399875 - DNA, 25 bp, Mus musculus
aaactgaagcccgatattcaggatc

SEQ ID NO: 399876 - DNA, 25 bp, Mus musculus
aaactgaggcacatgggctccaagc

SEQ ID NO: 399877 - DNA, 25 bp, Mus musculus
aaactgaggcagtgatgcagacagg

SEQ ID NO: 399878 - DNA, 25 bp, Mus musculus
aaactgagggtccatgcccagcatg

SEQ ID NO: 399879 - DNA, 25 bp, Mus musculus
aaactgatcccacgcccacattatt

SEQ ID NO: 399880 - DNA, 25 bp, Mus musculus
aaactgcacctgaggagatatgtca

SEQ ID NO: 399881 - DNA, 25 bp, Mus musculus
aaactgcagcttggaggcgcccctg

SEQ ID NO: 399882 - DNA, 25 bp, Mus musculus
aaactgcagtagtgtctcggacctg

SEQ ID NO: 399883 - DNA, 25 bp, Mus musculus
aaactgccagtagtctatttttagg

SEQ ID NO: 399884 - DNA, 25 bp, Mus musculus
aaactgcgcatgctggaccttcgag

SEQ ID NO: 399885 - DNA, 25 bp, Mus musculus
aaactgctcaacaagtgctccgccg

SEQ ID NO: 399886 - DNA, 25 bp, Mus musculus
aaactgctgttttggagatctgtgc

SEQ ID NO: 399887 - DNA, 25 bp, Mus musculus
aaactggagcatgcccgcactaagg

SEQ ID NO: 399888 - DNA, 25 bp, Mus musculus
aaactggcttctgatttgtcttccg

SEQ ID NO: 399889 - DNA, 25 bp, Mus musculus
aaactgtaacgcaaaacggagctca

SEQ ID NO: 399890 - DNA, 25 bp, Mus musculus
aaactgtaccagagcggatgcaccg

SEQ ID NO: 399891 - DNA, 25 bp, Mus musculus
aaactgtaccagctcgtcatagaca

SEQ ID NO: 399892 - DNA, 25 bp, Mus musculus
aaactgtcgataacgctcgtgggca

SEQ ID NO: 399893 - DNA, 25 bp, Mus musculus
aaactgtctggagtgcaatggcccc

SEQ ID NO: 399894 - DNA, 25 bp, Mus musculus
aaactgtgggaccatggcatgcaac

SEQ ID NO: 399895 - DNA, 25 bp, Mus musculus
aaactgtgttccctcacaggtatgg

SEQ ID NO: 399896 - DNA, 25 bp, Mus musculus
aaactgttgacgatccctggtaggg

SEQ ID NO: 399897 - DNA, 25 bp, Mus musculus
aaactgttgtcggagaggaatcacc

SEQ ID NO: 399898 - DNA, 25 bp, Mus musculus
aaacttatgaaggatatcggctgcc

SEQ ID NO: 399899 - DNA, 25 bp, Mus musculus
aaacttcacctgtgcaaggagaatg

SEQ ID NO: 399900 - DNA, 25 bp, Mus musculus
aaacttcagttcgactatgtggacc

SEQ ID NO: 399901 - DNA, 25 bp, Mus musculus
aaacttcctgaggattgaggccagc

SEQ ID NO: 399902 - DNA, 25 bp, Mus musculus
aaacttcgaagatccgctcctggga

SEQ ID NO: 399903 - DNA, 25 bp, Mus musculus
aaacttcgtgaattcgcctcgggcg

SEQ ID NO: 399904 - DNA, 25 bp, Mus musculus
aaacttgtcaggagtgtcggcagac

SEQ ID NO: 399905 - DNA, 25 bp, Mus musculus
aaactttacaattgctgctgtgcca

SEQ ID NO: 399906 - DNA, 25 bp, Mus musculus
aaactttgcatgaggctaaatctga

SEQ ID NO: 399907 - DNA, 25 bp, Mus musculus
aaactttgtcggctgcgctgaaggc

SEQ ID NO: 399908 - DNA, 25 bp, Mus musculus
aaagaaaaaaccaagctgcagaagc

SEQ ID NO: 399909 - DNA, 25 bp, Mus musculus
aaagaaaaaagcctccgatctgagc

SEQ ID NO: 399910 - DNA, 25 bp, Mus musculus
aaagaaaagcatgggagtctacctc

SEQ ID NO: 399911 - DNA, 25 bp, Mus musculus
aaagaaaatctgtgtgcgctgatcc

SEQ ID NO: 399912 - DNA, 25 bp, Mus musculus
aaagaaagctgtgctagcgcctgca

SEQ ID NO: 399913 - DNA, 25 bp, Mus musculus
aaagaaaggctttatgttgctcaca

SEQ ID NO: 399914 - DNA, 25 bp, Mus musculus
aaagaaaggtgcttgctctcaggcg

SEQ ID NO: 399915 - DNA, 25 bp, Mus musculus
aaagaaagtctactctaggctcagg

SEQ ID NO: 399916 - DNA, 25 bp, Mus musculus
aaagaaagttctggtggcacctcca

SEQ ID NO: 399917 - DNA, 25 bp, Mus musculus
aaagaaataatgactgccagccctg

SEQ ID NO: 399918 - DNA, 25 bp, Mus musculus
aaagaaatacagtcaaccaagtgct

SEQ ID NO: 399919 - DNA, 25 bp, Mus musculus
aaagaaatcctcaccctgtttcctg

SEQ ID NO: 399920 - DNA, 25 bp, Mus musculus
aaagaaatcggttgactggttgcct

SEQ ID NO: 399921 - DNA, 25 bp, Mus musculus
aaagaacaggacgaaagagcaggaa

SEQ ID NO: 399922 - DNA, 25 bp, Mus musculus
aaagaaccaccattagaaacatagt

SEQ ID NO: 399923 - DNA, 25 bp, Mus musculus
aaagaacgccatgccagaatagaag

SEQ ID NO: 399924 - DNA, 25 bp, Mus musculus
aaagaacgcgtgctgatacctgtca

SEQ ID NO: 399925 - DNA, 25 bp, Mus musculus
aaagaacgttctgggcattctacag

SEQ ID NO: 399926 - DNA, 25 bp, Mus musculus
aaagaactggtttgctgtgagcacc

SEQ ID NO: 399927 - DNA, 25 bp, Mus musculus
aaagaagaaaatgccctcgagggag

SEQ ID NO: 399928 - DNA, 25 bp, Mus musculus
aaagaagatcaagccgcacatgcgg

SEQ ID NO: 399929 - DNA, 25 bp, Mus musculus
aaagaagcatcttgagttggagaag

SEQ ID NO: 399930 - DNA, 25 bp, Mus musculus
aaagaagcgaaggactcggtctgcc

SEQ ID NO: 399931 - DNA, 25 bp, Mus musculus
aaagaagcgggcatgtacccaggca

SEQ ID NO: 399932 - DNA, 25 bp, Mus musculus
aaagaagggatcgtagctctgcgca

SEQ ID NO: 399933 - DNA, 25 bp, Mus musculus
aaagaagtaacctctgagcagccac

SEQ ID NO: 399934 - DNA, 25 bp, Mus musculus
aaagaagtcatctgcccctgggaga

SEQ ID NO: 399935 - DNA, 25 bp, Mus musculus
aaagaagtctgcgagtccatctgcc

SEQ ID NO: 399936 - DNA, 25 bp, Mus musculus
aaagaagtgtttatccaggaactgg

SEQ ID NO: 399937 - DNA, 25 bp, Mus musculus
aaagaagttgttgttgtagccacag

SEQ ID NO: 399938 - DNA, 25 bp, Mus musculus
aaagaatatcttccttctggtccac

SEQ ID NO: 399939 - DNA, 25 bp, Mus musculus
aaagaatcatcgtgaaggacctcgc

SEQ ID NO: 399940 - DNA, 25 bp, Mus musculus
aaagaatcccggctgaaccaggagc

SEQ ID NO: 399941 - DNA, 25 bp, Mus musculus
aaagaatcggcggagcaaaacctgc

SEQ ID NO: 399942 - DNA, 25 bp, Mus musculus
aaagaatgctgactttttattccct

SEQ ID NO: 399943 - DNA, 25 bp, Mus musculus
aaagaatggctgtctcaagggctcc

SEQ ID NO: 399944 - DNA, 25 bp, Mus musculus
aaagacaaaagggagctgagccggt

SEQ ID NO: 399945 - DNA, 25 bp, Mus musculus
aaagacaacattcgccaggagccct

SEQ ID NO: 399946 - DNA, 25 bp, Mus musculus
aaagacaacggcttactggtcccag

SEQ ID NO: 399947 - DNA, 25 bp, Mus musculus
aaagacagccgactcctacaagttg

SEQ ID NO: 399948 - DNA, 25 bp, Mus musculus
aaagacagctctagaccgggaaaag

SEQ ID NO: 399949 - DNA, 25 bp, Mus musculus
aaagacattttataagaccgcggat

SEQ ID NO: 399950 - DNA, 25 bp, Mus musculus
aaagaccaaagctgacaaactccag

SEQ ID NO: 399951 - DNA, 25 bp, Mus musculus
aaagaccaacgggtgtcctggcaga

SEQ ID NO: 399952 - DNA, 25 bp, Mus musculus
aaagaccatggtgcactgtgcgggc

SEQ ID NO: 399953 - DNA, 25 bp, Mus musculus
aaagacccgcctgccagatgaggat

SEQ ID NO: 399954 - DNA, 25 bp, Mus musculus
aaagacctgactcattcccagatgg

SEQ ID NO: 399955 - DNA, 25 bp, Mus musculus
aaagacctgtccattgctgccgtgg

SEQ ID NO: 399956 - DNA, 25 bp, Mus musculus
aaagaccttcccatctacaccagga

SEQ ID NO: 399957 - DNA, 25 bp, Mus musculus
aaagacggaccagttcttggcttca

SEQ ID NO: 399958 - DNA, 25 bp, Mus musculus
aaagacggagttgcttcctaaggca

SEQ ID NO: 399959 - DNA, 25 bp, Mus musculus
aaagacgggcgctccctgtgtgaga

SEQ ID NO: 399960 - DNA, 25 bp, Mus musculus
aaagacggtgcaggacagaactagc

SEQ ID NO: 399961 - DNA, 25 bp, Mus musculus
aaagactactggttacctgccaagg

SEQ ID NO: 399962 - DNA, 25 bp, Mus musculus
aaagactacttccatcgtggtgcca

SEQ ID NO: 399963 - DNA, 25 bp, Mus musculus
aaagactatccagctcaatgtcacc

SEQ ID NO: 399964 - DNA, 25 bp, Mus musculus
aaagactctgccttccgtgccgttg

SEQ ID NO: 399965 - DNA, 25 bp, Mus musculus
aaagactggcatttctagcatggca

SEQ ID NO: 399966 - DNA, 25 bp, Mus musculus
aaagactgtcagcacttggcccaat

SEQ ID NO: 399967 - DNA, 25 bp, Mus musculus
aaagacttgttgatctagccttgcc

SEQ ID NO: 399968 - DNA, 25 bp, Mus musculus
aaagagagacctatgttcccgccct

SEQ ID NO: 399969 - DNA, 25 bp, Mus musculus
aaagagagatctccaaagcccaggc

SEQ ID NO: 399970 - DNA, 25 bp, Mus musculus
aaagagagcttttctgttgctagcc

SEQ ID NO: 399971 - DNA, 25 bp, Mus musculus
aaagagagggcaagaaggccagccc

SEQ ID NO: 399972 - DNA, 25 bp, Mus musculus
aaagagatcagcagcaacacggagc

SEQ ID NO: 399973 - DNA, 25 bp, Mus musculus
aaagagatccaagtccgccaagaag

SEQ ID NO: 399974 - DNA, 25 bp, Mus musculus
aaagagatccgacgatgccgaaggc

SEQ ID NO: 399975 - DNA, 25 bp, Mus musculus
aaagagatgcatcttctggaacagc

SEQ ID NO: 399976 - DNA, 25 bp, Mus musculus
aaagagcaaatgaagagagcctggc

SEQ ID NO: 399977 - DNA, 25 bp, Mus musculus
aaagagcaagcgatagactcgtcga

SEQ ID NO: 399978 - DNA, 25 bp, Mus musculus
aaagagcacgtggatgacgacccca

SEQ ID NO: 399979 - DNA, 25 bp, Mus musculus
aaagagcagtaagcatttttgcaag

SEQ ID NO: 399980 - DNA, 25 bp, Mus musculus
aaagagccagtcatctaaatacatg

SEQ ID NO: 399981 - DNA, 25 bp, Mus musculus
aaagagcttcaccttctaccggcgg

SEQ ID NO: 399982 - DNA, 25 bp, Mus musculus
aaagaggaacacattcatatctcca

SEQ ID NO: 399983 - DNA, 25 bp, Mus musculus
aaagaggagcttgccaagaagtgtg

SEQ ID NO: 399984 - DNA, 25 bp, Mus musculus
aaagaggcagttcccggtgacattc

SEQ ID NO: 399985 - DNA, 25 bp, Mus musculus
aaagaggcggaaagctgcgactgtc

SEQ ID NO: 399986 - DNA, 25 bp, Mus musculus
aaagaggctgtctgcttcatccccg

SEQ ID NO: 399987 - DNA, 25 bp, Mus musculus
aaagaggtatccttcgctactcgag

SEQ ID NO: 399988 - DNA, 25 bp, Mus musculus
aaagaggtggcccttcaaagctgga

SEQ ID NO: 399989 - DNA, 25 bp, Mus musculus
aaagagtctgcctatcgcttcaggg

SEQ ID NO: 399990 - DNA, 25 bp, Mus musculus
aaagagtgtctcagcgcaagtgccc

SEQ ID NO: 399991 - DNA, 25 bp, Mus musculus
aaagagttcaccatgacttgccggg

SEQ ID NO: 399992 - DNA, 25 bp, Mus musculus
aaagagttcgttgctcgagtgcgag

SEQ ID NO: 399993 - DNA, 25 bp, Mus musculus
aaagagtttggcacagagtggcaca

SEQ ID NO: 399994 - DNA, 25 bp, Mus musculus
aaagagtttgtgcagcgcttccgag

SEQ ID NO: 399995 - DNA, 25 bp, Mus musculus
aaagataagactgctaccgtagcat

SEQ ID NO: 399996 - DNA, 25 bp, Mus musculus
aaagataccatctattgccactggg

SEQ ID NO: 399997 - DNA, 25 bp, Mus musculus
aaagatcaacagacgggctgattcc

SEQ ID NO: 399998 - DNA, 25 bp, Mus musculus
aaagatcaatgaccacagggccgtg

SEQ ID NO: 399999 - DNA, 25 bp, Mus musculus
aaagatcagattccgcctgtccgtc

SEQ ID NO: 400000 - DNA, 25 bp, Mus musculus
aaagatcctgatgtgaaggccgggc

SEQ ID NO: 400001 - DNA, 25 bp, Mus musculus
aaagatctcatctcccgcttccgtg

SEQ ID NO: 400002 - DNA, 25 bp, Mus musculus
aaagatctgccaatgaccggcctga

SEQ ID NO: 400003 - DNA, 25 bp, Mus musculus
aaagatctgctcaggtccaagccca

SEQ ID NO: 400004 - DNA, 25 bp, Mus musculus
aaagatcttaacatacgcgactcag

SEQ ID NO: 400005 - DNA, 25 bp, Mus musculus
aaagatgaattctgtgatgatggac

SEQ ID NO: 400006 - DNA, 25 bp, Mus musculus
aaagatgacggcaggagacaactcc

SEQ ID NO: 400007 - DNA, 25 bp, Mus musculus
aaagatgactctttcagtatactcc

SEQ ID NO: 400008 - DNA, 25 bp, Mus musculus
aaagatgactgggaatgcggactgc

SEQ ID NO: 400009 - DNA, 25 bp, Mus musculus
aaagatgagatgatgcgagaggccc

SEQ ID NO: 400010 - DNA, 25 bp, Mus musculus
aaagatgagctgctgggagctaccc

SEQ ID NO: 400011 - DNA, 25 bp, Mus musculus
aaagatgaggttcttccagggccgc

SEQ ID NO: 400012 - DNA, 25 bp, Mus musculus
aaagatgcccttttgcgacaccgag

SEQ ID NO: 400013 - DNA, 25 bp, Mus musculus
aaagatgctgaaactcgttctgtgg

SEQ ID NO: 400014 - DNA, 25 bp, Mus musculus
aaagatgtcctgcagtcagtgtccg

SEQ ID NO: 400015 - DNA, 25 bp, Mus musculus
aaagatgtgtgcatttttgttcacc

SEQ ID NO: 400016 - DNA, 25 bp, Mus musculus
aaagatttcaggagctattggaccc

SEQ ID NO: 400017 - DNA, 25 bp, Mus musculus
aaagatttctccatgtgtgtactgg

SEQ ID NO: 400018 - DNA, 25 bp, Mus musculus
aaagattttgtcgtcattccctggg

SEQ ID NO: 400019 - DNA, 25 bp, Mus musculus
aaagcaaattcttcagctagtcagg

SEQ ID NO: 400020 - DNA, 25 bp, Mus musculus
aaagcaacgtggctttcccagcctc

SEQ ID NO: 400021 - DNA, 25 bp, Mus musculus
aaagcaagagaggatgccaggaccc

SEQ ID NO: 400022 - DNA, 25 bp, Mus musculus
aaagcaagagctgttcgagataccc

SEQ ID NO: 400023 - DNA, 25 bp, Mus musculus
aaagcaagcatacaaggaggagtct

SEQ ID NO: 400024 - DNA, 25 bp, Mus musculus
aaagcaaggacctctagcccatatg

SEQ ID NO: 400025 - DNA, 25 bp, Mus musculus
aaagcacactcaaactcacggcagt

SEQ ID NO: 400026 - DNA, 25 bp, Mus musculus
aaagcacagaacttcctacagcacc

SEQ ID NO: 400027 - DNA, 25 bp, Mus musculus
aaagcacggatcagacatcacccgg

SEQ ID NO: 400028 - DNA, 25 bp, Mus musculus
aaagcactagctattcccattgaca

SEQ ID NO: 400029 - DNA, 25 bp, Mus musculus
aaagcagacgctccatacctggcgg

SEQ ID NO: 400030 - DNA, 25 bp, Mus musculus
aaagcagagttggtcccatacctct

SEQ ID NO: 400031 - DNA, 25 bp, Mus musculus
aaagcagcagcttttgggcaccggg

SEQ ID NO: 400032 - DNA, 25 bp, Mus musculus
aaagcagccactaccctgggattga

SEQ ID NO: 400033 - DNA, 25 bp, Mus musculus
aaagcagccctcttctttttgtggg

SEQ ID NO: 400034 - DNA, 25 bp, Mus musculus
aaagcagcgacttgggtgggatcct

SEQ ID NO: 400035 - DNA, 25 bp, Mus musculus
aaagcagcgtcagtggattggcccc

SEQ ID NO: 400036 - DNA, 25 bp, Mus musculus
aaagcaggcagtatggtgaggcatc

SEQ ID NO: 400037 - DNA, 25 bp, Mus musculus
aaagcaggccgagaaggcactctga

SEQ ID NO: 400038 - DNA, 25 bp, Mus musculus
aaagcaggcggcaggtgtaaacgaa

SEQ ID NO: 400039 - DNA, 25 bp, Mus musculus
aaagcaggtcggtacttgtggccca

SEQ ID NO: 400040 - DNA, 25 bp, Mus musculus
aaagcaggttgcctttataatcaac

SEQ ID NO: 400041 - DNA, 25 bp, Mus musculus
aaagcaggttttccactcttatggc

SEQ ID NO: 400042 - DNA, 25 bp, Mus musculus
aaagcagtagcgttgtttgacagcc

SEQ ID NO: 400043 - DNA, 25 bp, Mus musculus
aaagcagtgccacccttgtcctggg

SEQ ID NO: 400044 - DNA, 25 bp, Mus musculus
aaagcagttccctgtcacctgtgag

SEQ ID NO: 400045 - DNA, 25 bp, Mus musculus
aaagcatcagcaggtgggcggacat

SEQ ID NO: 400046 - DNA, 25 bp, Mus musculus
aaagcatcgtcctccagttgggcca

SEQ ID NO: 400047 - DNA, 25 bp, Mus musculus
aaagcattgcgcactaacccgggat

SEQ ID NO: 400048 - DNA, 25 bp, Mus musculus
aaagcattggaaaaggcactgcacg

SEQ ID NO: 400049 - DNA, 25 bp, Mus musculus
aaagcattggccgatgccacctcga

SEQ ID NO: 400050 - DNA, 25 bp, Mus musculus
aaagccaacaggtgtgctgagaggc

SEQ ID NO: 400051 - DNA, 25 bp, Mus musculus
aaagccaagatagcagagcgctgcc

SEQ ID NO: 400052 - DNA, 25 bp, Mus musculus
aaagccaagtcgagtgccaagaggg

SEQ ID NO: 400053 - DNA, 25 bp, Mus musculus
aaagccaagtgttgagacacacact

SEQ ID NO: 400054 - DNA, 25 bp, Mus musculus
aaagccacaggactcaccaacagaa

SEQ ID NO: 400055 - DNA, 25 bp, Mus musculus
aaagccaccgactgtgtgggtcacg

SEQ ID NO: 400056 - DNA, 25 bp, Mus musculus
aaagccacgtgggatgcaagaaatg

SEQ ID NO: 400057 - DNA, 25 bp, Mus musculus
aaagccagaattgcacaggaaggtg

SEQ ID NO: 400058 - DNA, 25 bp, Mus musculus
aaagccagagaattgtaacagggaa

SEQ ID NO: 400059 - DNA, 25 bp, Mus musculus
aaagccaggtgagcgcaaacgtcta

SEQ ID NO: 400060 - DNA, 25 bp, Mus musculus
aaagccatcaaatcgaaagctgcgg

SEQ ID NO: 400061 - DNA, 25 bp, Mus musculus
aaagccatcaccaaggctcagaaaa

SEQ ID NO: 400062 - DNA, 25 bp, Mus musculus
aaagccattacagatgtcaccagga

SEQ ID NO: 400063 - DNA, 25 bp, Mus musculus
aaagcccaagtagtccagatcatgg

SEQ ID NO: 400064 - DNA, 25 bp, Mus musculus
aaagcccagcttgttacatccctga

SEQ ID NO: 400065 - DNA, 25 bp, Mus musculus
aaagccccaaggtgatgacgaggaa

SEQ ID NO: 400066 - DNA, 25 bp, Mus musculus
aaagccccagatgggccagcggaag

SEQ ID NO: 400067 - DNA, 25 bp, Mus musculus
aaagccccgcccagtcgtgtgtaat

SEQ ID NO: 400068 - DNA, 25 bp, Mus musculus
aaagcccctatggttctaatcagcg

SEQ ID NO: 400069 - DNA, 25 bp, Mus musculus
aaagcccctgtattcaccgaggtgg

SEQ ID NO: 400070 - DNA, 25 bp, Mus musculus
aaagcccggcccattacatctgagg

SEQ ID NO: 400071 - DNA, 25 bp, Mus musculus
aaagccctctcttgtgtgtgcaccg

SEQ ID NO: 400072 - DNA, 25 bp, Mus musculus
aaagccctgcgatgccaaggtggac

SEQ ID NO: 400073 - DNA, 25 bp, Mus musculus
aaagccctggctgtcgctctgagct

SEQ ID NO: 400074 - DNA, 25 bp, Mus musculus
aaagccctgggatcgattatgtaca

SEQ ID NO: 400075 - DNA, 25 bp, Mus musculus
aaagcccttgattggatctgactgg

SEQ ID NO: 400076 - DNA, 25 bp, Mus musculus
aaagccgatagcactcactctctga

SEQ ID NO: 400077 - DNA, 25 bp, Mus musculus
aaagccgccgtttgcttctccaggt

SEQ ID NO: 400078 - DNA, 25 bp, Mus musculus
aaagccgctgagtttccagaagccg

SEQ ID NO: 400079 - DNA, 25 bp, Mus musculus
aaagccggctccatcagctaacgga

SEQ ID NO: 400080 - DNA, 25 bp, Mus musculus
aaagccgggtttctggtcacagcca

SEQ ID NO: 400081 - DNA, 25 bp, Mus musculus
aaagccggttcatcgtgcttgcccc

SEQ ID NO: 400082 - DNA, 25 bp, Mus musculus
aaagcctaatgctctcggtgctgca

SEQ ID NO: 400083 - DNA, 25 bp, Mus musculus
aaagcctccgtctaattacttacag

SEQ ID NO: 400084 - DNA, 25 bp, Mus musculus
aaagcctcgcttctcttggttggaa

SEQ ID NO: 400085 - DNA, 25 bp, Mus musculus
aaagcctgcaggatggacttcgtca

SEQ ID NO: 400086 - DNA, 25 bp, Mus musculus
aaagcctgcctcagtggattcaccc

SEQ ID NO: 400087 - DNA, 25 bp, Mus musculus
aaagccttaacatcagggtcaggag

SEQ ID NO: 400088 - DNA, 25 bp, Mus musculus
aaagccttcattacagtcctggaga

SEQ ID NO: 400089 - DNA, 25 bp, Mus musculus
aaagccttctggcaagaatcttagg

SEQ ID NO: 400090 - DNA, 25 bp, Mus musculus
aaagccttggctattctcagtgtgg

SEQ ID NO: 400091 - DNA, 25 bp, Mus musculus
aaagcgaagctgtatccgttgtgca

SEQ ID NO: 400092 - DNA, 25 bp, Mus musculus
aaagcgacaaccagcccaaaagaag

SEQ ID NO: 400093 - DNA, 25 bp, Mus musculus
aaagcgctacgcattaactggacag

SEQ ID NO: 400094 - DNA, 25 bp, Mus musculus
aaagcggcctctcaaccagagtggg

SEQ ID NO: 400095 - DNA, 25 bp, Mus musculus
aaagcgtaagcacggactggaccct

SEQ ID NO: 400096 - DNA, 25 bp, Mus musculus
aaagcgtccgcagcgtgttcaagga

SEQ ID NO: 400097 - DNA, 25 bp, Mus musculus
aaagcgtccttcaagccagctgagg

SEQ ID NO: 400098 - DNA, 25 bp, Mus musculus
aaagctaaaatgtttcctgtgtggc

SEQ ID NO: 400099 - DNA, 25 bp, Mus musculus
aaagctactgataatactttggaag

SEQ ID NO: 400100 - DNA, 25 bp, Mus musculus
aaagctcagaattcccgtgacatca

SEQ ID NO: 400101 - DNA, 25 bp, Mus musculus
aaagctcagacagccttgcacgagc

SEQ ID NO: 400102 - DNA, 25 bp, Mus musculus
aaagctcccttcagacacagtcgct

SEQ ID NO: 400103 - DNA, 25 bp, Mus musculus
aaagctccgggcagacacaatgtgt

SEQ ID NO: 400104 - DNA, 25 bp, Mus musculus
aaagctcctgtgaaccatggcttgg

SEQ ID NO: 400105 - DNA, 25 bp, Mus musculus
aaagctcggaaaactggcactacca

SEQ ID NO: 400106 - DNA, 25 bp, Mus musculus
aaagctctgggtttgtctgcctctg

SEQ ID NO: 400107 - DNA, 25 bp, Mus musculus
aaagctctttgggtaccggccactg

SEQ ID NO: 400108 - DNA, 25 bp, Mus musculus
aaagctgaaggcgacaatggatgca

SEQ ID NO: 400109 - DNA, 25 bp, Mus musculus
aaagctgactctgggcacttcaaaa

SEQ ID NO: 400110 - DNA, 25 bp, Mus musculus
aaagctgactgccaaggattttgca

SEQ ID NO: 400111 - DNA, 25 bp, Mus musculus
aaagctgcaagcagagctgctctag

SEQ ID NO: 400112 - DNA, 25 bp, Mus musculus
aaagctgcatttgaacctggtctcc

SEQ ID NO: 400113 - DNA, 25 bp, Mus musculus
aaagctgccactcggtcgttttgac

SEQ ID NO: 400114 - DNA, 25 bp, Mus musculus
aaagctgcgagctggcctgtccttg

SEQ ID NO: 400115 - DNA, 25 bp, Mus musculus
aaagctgcgctttgacatcgaggga

SEQ ID NO: 400116 - DNA, 25 bp, Mus musculus
aaagctggagcttatgtcccatctg

SEQ ID NO: 400117 - DNA, 25 bp, Mus musculus
aaagctggcaaagcgtaacgcagca

SEQ ID NO: 400118 - DNA, 25 bp, Mus musculus
aaagctggctgggaagtttatctag

SEQ ID NO: 400119 - DNA, 25 bp, Mus musculus
aaagctggtgccagatataatggcc

SEQ ID NO: 400120 - DNA, 25 bp, Mus musculus
aaagctggtttacaggcaggattcc

SEQ ID NO: 400121 - DNA, 25 bp, Mus musculus
aaagctgtagctgaggaaacccgag

SEQ ID NO: 400122 - DNA, 25 bp, Mus musculus
aaagctgtcaattccggagcggtgc

SEQ ID NO: 400123 - DNA, 25 bp, Mus musculus
aaagctgtccttaccactcaagcga

SEQ ID NO: 400124 - DNA, 25 bp, Mus musculus
aaagctgtgcgacgtcctcactgac

SEQ ID NO: 400125 - DNA, 25 bp, Mus musculus
aaagctgtggaactgctggatcgca

SEQ ID NO: 400126 - DNA, 25 bp, Mus musculus
aaagctgtggctagggcttcctaca

SEQ ID NO: 400127 - DNA, 25 bp, Mus musculus
aaagctgtttctgccgaggcctgcg

SEQ ID NO: 400128 - DNA, 25 bp, Mus musculus
aaagcttatcggataatgccaccgc

SEQ ID NO: 400129 - DNA, 25 bp, Mus musculus
aaagcttccaggaggagtgaggcca

SEQ ID NO: 400130 - DNA, 25 bp, Mus musculus
aaagcttgacttgagggagcagaga

SEQ ID NO: 400131 - DNA, 25 bp, Mus musculus
aaagcttgtcattctcacagatacc

SEQ ID NO: 400132 - DNA, 25 bp, Mus musculus
aaagcttgttacgtagggacccatg

SEQ ID NO: 400133 - DNA, 25 bp, Mus musculus
aaagctttgaagatgtcggccactc

SEQ ID NO: 400134 - DNA, 25 bp, Mus musculus
aaagctttgtgtagccctcggtgga

SEQ ID NO: 400135 - DNA, 25 bp, Mus musculus
aaagcttttggcacagccggcaggc

SEQ ID NO: 400136 - DNA, 25 bp, Mus musculus
aaaggaacttcagtggcctctcggg

SEQ ID NO: 400137 - DNA, 25 bp, Mus musculus
aaaggaacttcccatcaggctcaga

SEQ ID NO: 400138 - DNA, 25 bp, Mus musculus
aaaggaagcctagcatgttcgagaa

SEQ ID NO: 400139 - DNA, 25 bp, Mus musculus
aaaggaaggtccgatgctagccctc

SEQ ID NO: 400140 - DNA, 25 bp, Mus musculus
aaaggaatccccatcaagcacggag

SEQ ID NO: 400141 - DNA, 25 bp, Mus musculus
aaaggaatcctgtctgcctggagca

SEQ ID NO: 400142 - DNA, 25 bp, Mus musculus
aaaggaatttccaccggcaatgaag

SEQ ID NO: 400143 - DNA, 25 bp, Mus musculus
aaaggacatacctgccccagaggtg

SEQ ID NO: 400144 - DNA, 25 bp, Mus musculus
aaaggacatgctctccctgggagtt

SEQ ID NO: 400145 - DNA, 25 bp, Mus musculus
aaaggacccgatgaccaaaaggatg

SEQ ID NO: 400146 - DNA, 25 bp, Mus musculus
aaaggaccgcactgactgaccatgc

SEQ ID NO: 400147 - DNA, 25 bp, Mus musculus
aaaggacgtccaccatgtagatgca

SEQ ID NO: 400148 - DNA, 25 bp, Mus musculus
aaaggactcgtgttccagagagaca

SEQ ID NO: 400149 - DNA, 25 bp, Mus musculus
aaaggactggcaaccacactgtgaa

SEQ ID NO: 400150 - DNA, 25 bp, Mus musculus
aaaggacttgctggaccagacagca

SEQ ID NO: 400151 - DNA, 25 bp, Mus musculus
aaaggagagcttgcatctgacctcc

SEQ ID NO: 400152 - DNA, 25 bp, Mus musculus
aaaggagaggttgcgctcccgctgc

SEQ ID NO: 400153 - DNA, 25 bp, Mus musculus
aaaggagatagaagcctcttaaggc

SEQ ID NO: 400154 - DNA, 25 bp, Mus musculus
aaaggagcctcagaagcactgctgg

SEQ ID NO: 400155 - DNA, 25 bp, Mus musculus
aaaggagctcccagttcccaagctg

SEQ ID NO: 400156 - DNA, 25 bp, Mus musculus
aaaggaggctgtgagcctgctctgc

SEQ ID NO: 400157 - DNA, 25 bp, Mus musculus
aaaggaggtgccagatctgccagca

SEQ ID NO: 400158 - DNA, 25 bp, Mus musculus
aaaggagtctctcccacgacgacga

SEQ ID NO: 400159 - DNA, 25 bp, Mus musculus
aaaggagtgtgtagctttgtaccca

SEQ ID NO: 400160 - DNA, 25 bp, Mus musculus
aaaggagttcagtggacagcgattc

SEQ ID NO: 400161 - DNA, 25 bp, Mus musculus
aaaggagttcccagacacaagacgt

SEQ ID NO: 400162 - DNA, 25 bp, Mus musculus
aaaggatagaactgatggcccaccc

SEQ ID NO: 400163 - DNA, 25 bp, Mus musculus
aaaggatcctgggacgttcacacgc

SEQ ID NO: 400164 - DNA, 25 bp, Mus musculus
aaaggatcggatatggctgggctac

SEQ ID NO: 400165 - DNA, 25 bp, Mus musculus
aaaggatgaaagaagcccctcagac

SEQ ID NO: 400166 - DNA, 25 bp, Mus musculus
aaaggatgcacaccaaagggcgcac

SEQ ID NO: 400167 - DNA, 25 bp, Mus musculus
aaaggatgcttgaggccaagcctgg

SEQ ID NO: 400168 - DNA, 25 bp, Mus musculus
aaaggatggcttctgctgggattcc

SEQ ID NO: 400169 - DNA, 25 bp, Mus musculus
aaaggattccaagcctgctggaggg

SEQ ID NO: 400170 - DNA, 25 bp, Mus musculus
aaaggattctgtcattgctgggcca

SEQ ID NO: 400171 - DNA, 25 bp, Mus musculus
aaaggattttgcaggccaacaatag

SEQ ID NO: 400172 - DNA, 25 bp, Mus musculus
aaaggcaacgtgcttctgagctcag

SEQ ID NO: 400173 - DNA, 25 bp, Mus musculus
aaaggcacccctcacagcagtagtg

SEQ ID NO: 400174 - DNA, 25 bp, Mus musculus
aaaggcacctcctccgagttcgaag

SEQ ID NO: 400175 - DNA, 25 bp, Mus musculus
aaaggcagacctgagtcaaccccta

SEQ ID NO: 400176 - DNA, 25 bp, Mus musculus
aaaggcagccttcatattagtttgc

SEQ ID NO: 400177 - DNA, 25 bp, Mus musculus
aaaggcagctgggtgtctggctaca

SEQ ID NO: 400178 - DNA, 25 bp, Mus musculus
aaaggcagtctggacaccatgctgg

SEQ ID NO: 400179 - DNA, 25 bp, Mus musculus
aaaggccactgtttcccctagagag

SEQ ID NO: 400180 - DNA, 25 bp, Mus musculus
aaaggccagcaaagtcaagagaagt

SEQ ID NO: 400181 - DNA, 25 bp, Mus musculus
aaaggccagggtccagttctgtctg

SEQ ID NO: 400182 - DNA, 25 bp, Mus musculus
aaaggccatcagttctgtgaggcga

SEQ ID NO: 400183 - DNA, 25 bp, Mus musculus
aaaggcccaggccatttctgaaggt

SEQ ID NO: 400184 - DNA, 25 bp, Mus musculus
aaaggcccccggatgcctctgggct

SEQ ID NO: 400185 - DNA, 25 bp, Mus musculus
aaaggcccgcagcacaaagagttgg

SEQ ID NO: 400186 - DNA, 25 bp, Mus musculus
aaaggccgactgtacccatgagagg

SEQ ID NO: 400187 - DNA, 25 bp, Mus musculus
aaaggcctaggcaagcatggaccct

SEQ ID NO: 400188 - DNA, 25 bp, Mus musculus
aaaggcctatcattccccagacggc

SEQ ID NO: 400189 - DNA, 25 bp, Mus musculus
aaaggcctcagagcaaagagcactc

SEQ ID NO: 400190 - DNA, 25 bp, Mus musculus
aaaggcctgacctatcttcgggaga

SEQ ID NO: 400191 - DNA, 25 bp, Mus musculus
aaaggcggagctatgaagccgaccc

SEQ ID NO: 400192 - DNA, 25 bp, Mus musculus
aaaggcggcccctgtgaagaccagg

SEQ ID NO: 400193 - DNA, 25 bp, Mus musculus
aaaggcgtgcatcactgtgtcctga

SEQ ID NO: 400194 - DNA, 25 bp, Mus musculus
aaaggcgtgcctgtaacttgggagt

SEQ ID NO: 400195 - DNA, 25 bp, Mus musculus
aaaggctcaaccacttctgaggaaa

SEQ ID NO: 400196 - DNA, 25 bp, Mus musculus
aaaggctccagggttcgacaagcgc

SEQ ID NO: 400197 - DNA, 25 bp, Mus musculus
aaaggcttcaaaggagacaccccag

SEQ ID NO: 400198 - DNA, 25 bp, Mus musculus
aaaggcttgaaacagtgcggttcca

SEQ ID NO: 400199 - DNA, 25 bp, Mus musculus
aaaggcttttcttctcaataggaca

SEQ ID NO: 400200 - DNA, 25 bp, Mus musculus
aaagggaacttccacagatggcaga

SEQ ID NO: 400201 - DNA, 25 bp, Mus musculus
aaagggacatctccttgcagtgtga

SEQ ID NO: 400202 - DNA, 25 bp, Mus musculus
aaagggaccaagtccagccatccca

SEQ ID NO: 400203 - DNA, 25 bp, Mus musculus
aaagggacctgtgcggcgcccagca

SEQ ID NO: 400204 - DNA, 25 bp, Mus musculus
aaagggagtccacgtgcagtcaagt

SEQ ID NO: 400205 - DNA, 25 bp, Mus musculus
aaagggagtcccaattgtgtgcggc

SEQ ID NO: 400206 - DNA, 25 bp, Mus musculus
aaagggatccgattgtggccctgcc

SEQ ID NO: 400207 - DNA, 25 bp, Mus musculus
aaagggccaagctatctcagagatg

SEQ ID NO: 400208 - DNA, 25 bp, Mus musculus
aaagggcgaagcatgtaggactcag

SEQ ID NO: 400209 - DNA, 25 bp, Mus musculus
aaagggctccctgcatggtgacaag

SEQ ID NO: 400210 - DNA, 25 bp, Mus musculus
aaagggtccgctatcacgggcggct

SEQ ID NO: 400211 - DNA, 25 bp, Mus musculus
aaagggtggtttctccagtgcccag

SEQ ID NO: 400212 - DNA, 25 bp, Mus musculus
aaagggttaacctgttgtgcagcag

SEQ ID NO: 400213 - DNA, 25 bp, Mus musculus
aaagggttttgcagaccggccagag

SEQ ID NO: 400214 - DNA, 25 bp, Mus musculus
aaaggtacggtgatgcatggactgc

SEQ ID NO: 400215 - DNA, 25 bp, Mus musculus
aaaggtatccagtcatttccgtgtg

SEQ ID NO: 400216 - DNA, 25 bp, Mus musculus
aaaggtattcccatgagcctcctgg

SEQ ID NO: 400217 - DNA, 25 bp, Mus musculus
aaaggtcctgtgtcgagatggtccc

SEQ ID NO: 400218 - DNA, 25 bp, Mus musculus
aaaggtgacctttaccctcacagcg

SEQ ID NO: 400219 - DNA, 25 bp, Mus musculus
aaaggtgcatgctactaattctggc

SEQ ID NO: 400220 - DNA, 25 bp, Mus musculus
aaaggtgccaatccacagcctggtg

SEQ ID NO: 400221 - DNA, 25 bp, Mus musculus
aaaggtgcccgtatcttgcctggct

SEQ ID NO: 400222 - DNA, 25 bp, Mus musculus
aaaggtggacctacaccaagtgccg

SEQ ID NO: 400223 - DNA, 25 bp, Mus musculus
aaaggtgggccttgctgaaagtcaa

SEQ ID NO: 400224 - DNA, 25 bp, Mus musculus
aaaggtggtgtttgaggctgattcc

SEQ ID NO: 400225 - DNA, 25 bp, Mus musculus
aaaggtgtcatctctcctgggcaag

SEQ ID NO: 400226 - DNA, 25 bp, Mus musculus
aaaggtgtctgttattgctgccaca

SEQ ID NO: 400227 - DNA, 25 bp, Mus musculus
aaaggtgtggcttccgcaataccga

SEQ ID NO: 400228 - DNA, 25 bp, Mus musculus
aaaggttcagtttcggaagccagcg

SEQ ID NO: 400229 - DNA, 25 bp, Mus musculus
aaaggttctcgcaagcaattgaaga

SEQ ID NO: 400230 - DNA, 25 bp, Mus musculus
aaaggttctcgggatatctagcacc

SEQ ID NO: 400231 - DNA, 25 bp, Mus musculus
aaaggttggacctcgcctgagggat

SEQ ID NO: 400232 - DNA, 25 bp, Mus musculus
aaaggtttccgcaaaatctgcgcgg

SEQ ID NO: 400233 - DNA, 25 bp, Mus musculus
aaagtaactagtccagagaaagctg

SEQ ID NO: 400234 - DNA, 25 bp, Mus musculus
aaagtaagaagccacgacaccgctc

SEQ ID NO: 400235 - DNA, 25 bp, Mus musculus
aaagtacaagccctgttgcctggaa

SEQ ID NO: 400236 - DNA, 25 bp, Mus musculus
aaagtacaggcaagcgtcttccggg

SEQ ID NO: 400237 - DNA, 25 bp, Mus musculus
aaagtacccatgaaggtcgcctgga

SEQ ID NO: 400238 - DNA, 25 bp, Mus musculus
aaagtaccttgtttgcacccactgg

SEQ ID NO: 400239 - DNA, 25 bp, Mus musculus
aaagtactaatggaggcctgcccct

SEQ ID NO: 400240 - DNA, 25 bp, Mus musculus
aaagtactacttcccggtgcgcgag

SEQ ID NO: 400241 - DNA, 25 bp, Mus musculus
aaagtagacacgctgcgcttggcca

SEQ ID NO: 400242 - DNA, 25 bp, Mus musculus
aaagtagcattctgcaccagtgccc

SEQ ID NO: 400243 - DNA, 25 bp, Mus musculus
aaagtaggcacttgatatatctatc

SEQ ID NO: 400244 - DNA, 25 bp, Mus musculus
aaagtagtctcttgtatgggtctga

SEQ ID NO: 400245 - DNA, 25 bp, Mus musculus
aaagtataaacctggtgcctggcag

SEQ ID NO: 400246 - DNA, 25 bp, Mus musculus
aaagtatacgactcactgctggcgc

SEQ ID NO: 400247 - DNA, 25 bp, Mus musculus
aaagtatagacaggcctagaccagg

SEQ ID NO: 400248 - DNA, 25 bp, Mus musculus
aaagtatcgcattccatgacgcagg

SEQ ID NO: 400249 - DNA, 25 bp, Mus musculus
aaagtatgcggatggtaaagccacg

SEQ ID NO: 400250 - DNA, 25 bp, Mus musculus
aaagtattttatgcccaaggccgag

SEQ ID NO: 400251 - DNA, 25 bp, Mus musculus
aaagtcatctacaggccaactaggg

SEQ ID NO: 400252 - DNA, 25 bp, Mus musculus
aaagtcatctcagctccggtgtcag

SEQ ID NO: 400253 - DNA, 25 bp, Mus musculus
aaagtcatggcttgcccaaggctcc

SEQ ID NO: 400254 - DNA, 25 bp, Mus musculus
aaagtcccaaagtgtcgcgcggagc

SEQ ID NO: 400255 - DNA, 25 bp, Mus musculus
aaagtccgagatggctatgcgtccc

SEQ ID NO: 400256 - DNA, 25 bp, Mus musculus
aaagtccgggacataccattgccag

SEQ ID NO: 400257 - DNA, 25 bp, Mus musculus
aaagtccgtagagatttggccaccg

SEQ ID NO: 400258 - DNA, 25 bp, Mus musculus
aaagtcctactccagcagccgagag

SEQ ID NO: 400259 - DNA, 25 bp, Mus musculus
aaagtcctgctcctgtgatccaaag

SEQ ID NO: 400260 - DNA, 25 bp, Mus musculus
aaagtcctggcatttgatctgaccg

SEQ ID NO: 400261 - DNA, 25 bp, Mus musculus
aaagtcctgggcctcgtgcagcaca

SEQ ID NO: 400262 - DNA, 25 bp, Mus musculus
aaagtccttgtagcttcagaaccgg

SEQ ID NO: 400263 - DNA, 25 bp, Mus musculus
aaagtcgaacatggtgcgaccgtcg

SEQ ID NO: 400264 - DNA, 25 bp, Mus musculus
aaagtcgagccctcttcaagaacag

SEQ ID NO: 400265 - DNA, 25 bp, Mus musculus
aaagtcgaggcctccattgagccag

SEQ ID NO: 400266 - DNA, 25 bp, Mus musculus
aaagtcgccttctctgccctgagga

SEQ ID NO: 400267 - DNA, 25 bp, Mus musculus
aaagtcggcctcctgctcctgagga

SEQ ID NO: 400268 - DNA, 25 bp, Mus musculus
aaagtctacgtgtacccgcagcaga

SEQ ID NO: 400269 - DNA, 25 bp, Mus musculus
aaagtctactgggacctagcaggcc

SEQ ID NO: 400270 - DNA, 25 bp, Mus musculus
aaagtctccggcacgttgcgtagcg

SEQ ID NO: 400271 - DNA, 25 bp, Mus musculus
aaagtctcctgctttcactgcggtc

SEQ ID NO: 400272 - DNA, 25 bp, Mus musculus
aaagtctgggacacatggcgacgga

SEQ ID NO: 400273 - DNA, 25 bp, Mus musculus
aaagtctgtctttatggaggagagg

SEQ ID NO: 400274 - DNA, 25 bp, Mus musculus
aaagtcttaaggcatggcatttacc

SEQ ID NO: 400275 - DNA, 25 bp, Mus musculus
aaagtcttgaatggctcccagcggg

SEQ ID NO: 400276 - DNA, 25 bp, Mus musculus
aaagtctttgacctccagctgcaca

SEQ ID NO: 400277 - DNA, 25 bp, Mus musculus
aaagtctttgctggagggtgccgcc

SEQ ID NO: 400278 - DNA, 25 bp, Mus musculus
aaagtgaacatgaagagcggcctgc

SEQ ID NO: 400279 - DNA, 25 bp, Mus musculus
aaagtgaatgaagtggtcccagatg

SEQ ID NO: 400280 - DNA, 25 bp, Mus musculus
aaagtgaccaccatttctgcggcgg

SEQ ID NO: 400281 - DNA, 25 bp, Mus musculus
aaagtgactactacgctccgggagg

SEQ ID NO: 400282 - DNA, 25 bp, Mus musculus
aaagtgatctttccgagacaggacg

SEQ ID NO: 400283 - DNA, 25 bp, Mus musculus
aaagtgcacatcctgcggctctcag

SEQ ID NO: 400284 - DNA, 25 bp, Mus musculus
aaagtgcagccttactgcttcaggc

SEQ ID NO: 400285 - DNA, 25 bp, Mus musculus
aaagtgcagctaactgggtctgagg

SEQ ID NO: 400286 - DNA, 25 bp, Mus musculus
aaagtgcaggcggaactcagccagt

SEQ ID NO: 400287 - DNA, 25 bp, Mus musculus
aaagtgcatagacaagggccgctcc

SEQ ID NO: 400288 - DNA, 25 bp, Mus musculus
aaagtgcatcttcaggtggctagcc

SEQ ID NO: 400289 - DNA, 25 bp, Mus musculus
aaagtgcgtcctcttcaagcctgcg

SEQ ID NO: 400290 - DNA, 25 bp, Mus musculus
aaagtgctctgtctcttgcctgtag

SEQ ID NO: 400291 - DNA, 25 bp, Mus musculus
aaagtgctgtgggtttgagatctcc

SEQ ID NO: 400292 - DNA, 25 bp, Mus musculus
aaagtgcttgtccttcgctcgatga

SEQ ID NO: 400293 - DNA, 25 bp, Mus musculus
aaagtggaaggtcgagtctcatcag

SEQ ID NO: 400294 - DNA, 25 bp, Mus musculus
aaagtggcagcctttcgagcgaaag

SEQ ID NO: 400295 - DNA, 25 bp, Mus musculus
aaagtggccgctacttgcagcaaga

SEQ ID NO: 400296 - DNA, 25 bp, Mus musculus
aaagtggctgttttatcactaaggc

SEQ ID NO: 400297 - DNA, 25 bp, Mus musculus
aaagtgggctaccttgtctacgcgg

SEQ ID NO: 400298 - DNA, 25 bp, Mus musculus
aaagtgggggcaagctcagccaagc

SEQ ID NO: 400299 - DNA, 25 bp, Mus musculus
aaagtggtcatcaaccagggcagcc

SEQ ID NO: 400300 - DNA, 25 bp, Mus musculus
aaagtggtcgttcaccgcatgcaag

SEQ ID NO: 400301 - DNA, 25 bp, Mus musculus
aaagtggtctccgacgtcctgaagg

SEQ ID NO: 400302 - DNA, 25 bp, Mus musculus
aaagtgtgggagtcgacagagaccc

SEQ ID NO: 400303 - DNA, 25 bp, Mus musculus
aaagtgttccccaggcgccacaaca

SEQ ID NO: 400304 - DNA, 25 bp, Mus musculus
aaagttacctgcatgggcctggcct

SEQ ID NO: 400305 - DNA, 25 bp, Mus musculus
aaagttccaggccagaaagacgctg

SEQ ID NO: 400306 - DNA, 25 bp, Mus musculus
aaagttcccagtggctagctccaac

SEQ ID NO: 400307 - DNA, 25 bp, Mus musculus
aaagttctaggcctgttcagagaca

SEQ ID NO: 400308 - DNA, 25 bp, Mus musculus
aaagttctatgacctagtctttggg

SEQ ID NO: 400309 - DNA, 25 bp, Mus musculus
aaagttctcacggacacatcggctg

SEQ ID NO: 400310 - DNA, 25 bp, Mus musculus
aaagttctccatagacactgctggc

SEQ ID NO: 400311 - DNA, 25 bp, Mus musculus
aaagttctctcttgcactctgaagg

SEQ ID NO: 400312 - DNA, 25 bp, Mus musculus
aaagttgcacctggcggccagtggt

SEQ ID NO: 400313 - DNA, 25 bp, Mus musculus
aaagttggcatttcttggtcctccg

SEQ ID NO: 400314 - DNA, 25 bp, Mus musculus
aaagttggctttagcattgctgacc

SEQ ID NO: 400315 - DNA, 25 bp, Mus musculus
aaagttgggttttgccagatcgtgc

SEQ ID NO: 400316 - DNA, 25 bp, Mus musculus
aaagttgtgggaagtcgctgtcgcc

SEQ ID NO: 400317 - DNA, 25 bp, Mus musculus
aaagtttacacaagctggtgcccag

SEQ ID NO: 400318 - DNA, 25 bp, Mus musculus
aaagtttagcagtgctgcccttggg

SEQ ID NO: 400319 - DNA, 25 bp, Mus musculus
aaagtttattcgcaagacccgtgag

SEQ ID NO: 400320 - DNA, 25 bp, Mus musculus
aaagtttctgctataacctgctgcg

SEQ ID NO: 400321 - DNA, 25 bp, Mus musculus
aaagttttccttgccgagtgctaca

SEQ ID NO: 400322 - DNA, 25 bp, Mus musculus
aaagttttgctcttgtcaaccacag

SEQ ID NO: 400323 - DNA, 25 bp, Mus musculus
aaataaaagtcatgccaggccgtac

SEQ ID NO: 400324 - DNA, 25 bp, Mus musculus
aaataaagcatattaaagtacagtg

SEQ ID NO: 400325 - DNA, 25 bp, Mus musculus
aaataaaggcatccaccgtgtgctg

SEQ ID NO: 400326 - DNA, 25 bp, Mus musculus
aaataaatggagacagacttctggc

SEQ ID NO: 400327 - DNA, 25 bp, Mus musculus
aaataacccaaatctgatgaatcgg

SEQ ID NO: 400328 - DNA, 25 bp, Mus musculus
aaataagcagccgttcgcgatggat

SEQ ID NO: 400329 - DNA, 25 bp, Mus musculus
aaataagcctgggaatggagagact

SEQ ID NO: 400330 - DNA, 25 bp, Mus musculus
aaataaggaggccaatgcagtgctg

SEQ ID NO: 400331 - DNA, 25 bp, Mus musculus
aaataagtatggactgctggcgcgc

SEQ ID NO: 400332 - DNA, 25 bp, Mus musculus
aaataagtgtgatgacctagaccgg

SEQ ID NO: 400333 - DNA, 25 bp, Mus musculus
aaataataacgtgctacccgacctg

SEQ ID NO: 400334 - DNA, 25 bp, Mus musculus
aaataattccatcagcggcctagac

SEQ ID NO: 400335 - DNA, 25 bp, Mus musculus
aaataattcccaatgtgccagaggc

SEQ ID NO: 400336 - DNA, 25 bp, Mus musculus
aaatacaagcttgacaattccttcc

SEQ ID NO: 400337 - DNA, 25 bp, Mus musculus
aaatacaagttcacaccagctgcgg

SEQ ID NO: 400338 - DNA, 25 bp, Mus musculus
aaatacatcccatgcctggcttgcc

SEQ ID NO: 400339 - DNA, 25 bp, Mus musculus
aaatacatccctgtacttgcacgtg

SEQ ID NO: 400340 - DNA, 25 bp, Mus musculus
aaataccaaagtctccgaggtctcg

SEQ ID NO: 400341 - DNA, 25 bp, Mus musculus
aaataccagcatccatatgtgtctg

SEQ ID NO: 400342 - DNA, 25 bp, Mus musculus
aaatacccaaggagtgaaccggctg

SEQ ID NO: 400343 - DNA, 25 bp, Mus musculus
aaataccctagtggatctggcaaag

SEQ ID NO: 400344 - DNA, 25 bp, Mus musculus
aaataccttatcttgtctgtcccag

SEQ ID NO: 400345 - DNA, 25 bp, Mus musculus
aaatacgaaggcaaatggaggctcc

SEQ ID NO: 400346 - DNA, 25 bp, Mus musculus
aaatacgtttgagccctgacccatg

SEQ ID NO: 400347 - DNA, 25 bp, Mus musculus
aaatactagcccatgttggccgccg

SEQ ID NO: 400348 - DNA, 25 bp, Mus musculus
aaatactagtaacctggcaccacag

SEQ ID NO: 400349 - DNA, 25 bp, Mus musculus
aaatactagtcctcaggagagccag

SEQ ID NO: 400350 - DNA, 25 bp, Mus musculus
aaatactgcaccactgccgctgtgc

SEQ ID NO: 400351 - DNA, 25 bp, Mus musculus
aaatactgcatgctggtttcccagg

SEQ ID NO: 400352 - DNA, 25 bp, Mus musculus
aaatactgccatgaatcctggtgcc

SEQ ID NO: 400353 - DNA, 25 bp, Mus musculus
aaatactggcttccgttcacctccg

SEQ ID NO: 400354 - DNA, 25 bp, Mus musculus
aaatagaaagtcaagggtccatgcc

SEQ ID NO: 400355 - DNA, 25 bp, Mus musculus
aaatagaaggtgacagttgcctccc

SEQ ID NO: 400356 - DNA, 25 bp, Mus musculus
aaatagagtttgatggtgccggtcc

SEQ ID NO: 400357 - DNA, 25 bp, Mus musculus
aaatagatcgtctgttgagaggctc

SEQ ID NO: 400358 - DNA, 25 bp, Mus musculus
aaatagcaggaacgccatgtcccgg

SEQ ID NO: 400359 - DNA, 25 bp, Mus musculus
aaatagcgactattgctgaagaagc

SEQ ID NO: 400360 - DNA, 25 bp, Mus musculus
aaataggaaatgcagctcggagccc

SEQ ID NO: 400361 - DNA, 25 bp, Mus musculus
aaatagggtccagaggagttccacg

SEQ ID NO: 400362 - DNA, 25 bp, Mus musculus
aaataggtctgagctcacagtgaga

SEQ ID NO: 400363 - DNA, 25 bp, Mus musculus
aaatagtcctcagatcggccctcag

SEQ ID NO: 400364 - DNA, 25 bp, Mus musculus
aaatagtgaggataaggctctaccc

SEQ ID NO: 400365 - DNA, 25 bp, Mus musculus
aaatagttaaccagcagccaagtcg

SEQ ID NO: 400366 - DNA, 25 bp, Mus musculus
aaatagttgctaacacctactgccg

SEQ ID NO: 400367 - DNA, 25 bp, Mus musculus
aaatataaatacacagcctctgtcc

SEQ ID NO: 400368 - DNA, 25 bp, Mus musculus
aaatatacagtaagaatacacgcgg

SEQ ID NO: 400369 - DNA, 25 bp, Mus musculus
aaatatagtgtagcaacccagctgg

SEQ ID NO: 400370 - DNA, 25 bp, Mus musculus
aaatatatgagcacaacgaagcggc

SEQ ID NO: 400371 - DNA, 25 bp, Mus musculus
aaatatcatccacaagacggcgggc

SEQ ID NO: 400372 - DNA, 25 bp, Mus musculus
aaatatcgagcccagacctcgctta

SEQ ID NO: 400373 - DNA, 25 bp, Mus musculus
aaatatctgtaatctttgttccagg

SEQ ID NO: 400374 - DNA, 25 bp, Mus musculus
aaatatgacgaggacgccaaacggc

SEQ ID NO: 400375 - DNA, 25 bp, Mus musculus
aaatatgagatataccaggcccctg

SEQ ID NO: 400376 - DNA, 25 bp, Mus musculus
aaatatgaggagtttgtgcgcctcc

SEQ ID NO: 400377 - DNA, 25 bp, Mus musculus
aaatatgagggccactggtacccgg

SEQ ID NO: 400378 - DNA, 25 bp, Mus musculus
aaatatgcaagctgtgaaaatccac

SEQ ID NO: 400379 - DNA, 25 bp, Mus musculus
aaatatgcctgggtgctggacaagc

SEQ ID NO: 400380 - DNA, 25 bp, Mus musculus
aaatatggcccttgtcacctaggag

SEQ ID NO: 400381 - DNA, 25 bp, Mus musculus
aaatatgtctggctgagggatctgc

SEQ ID NO: 400382 - DNA, 25 bp, Mus musculus
aaatatgttcctctgttgatgcagc

SEQ ID NO: 400383 - DNA, 25 bp, Mus musculus
aaatattcttctgggtgaggatggc

SEQ ID NO: 400384 - DNA, 25 bp, Mus musculus
aaatatttcatatgcgggatacctg

SEQ ID NO: 400385 - DNA, 25 bp, Mus musculus
aaatatttgcggctaccccagctgg

SEQ ID NO: 400386 - DNA, 25 bp, Mus musculus
aaatcaacgtggagatggatgccgc

SEQ ID NO: 400387 - DNA, 25 bp, Mus musculus
aaatcaactggcctccaagactggg

SEQ ID NO: 400388 - DNA, 25 bp, Mus musculus
aaatcaagacggatgagtgaggccc

SEQ ID NO: 400389 - DNA, 25 bp, Mus musculus
aaatcaagttcgtcggtgccaggga

SEQ ID NO: 400390 - DNA, 25 bp, Mus musculus
aaatcaataccgtggatatctcgca

SEQ ID NO: 400391 - DNA, 25 bp, Mus musculus
aaatcacccgttgtcactgtgtctg

SEQ ID NO: 400392 - DNA, 25 bp, Mus musculus
aaatcaccttttgggagctttggct

SEQ ID NO: 400393 - DNA, 25 bp, Mus musculus
aaatcagaagaaaagtattagctac

SEQ ID NO: 400394 - DNA, 25 bp, Mus musculus
aaatcagcccttggaaggttgtcca

SEQ ID NO: 400395 - DNA, 25 bp, Mus musculus
aaatcagcgttcgtggcttagccgg

SEQ ID NO: 400396 - DNA, 25 bp, Mus musculus
aaatcatccagacacggagaccgga

SEQ ID NO: 400397 - DNA, 25 bp, Mus musculus
aaatcatccatcagctgtcaacgtg

SEQ ID NO: 400398 - DNA, 25 bp, Mus musculus
aaatcatgaaaaactactggcctgg

SEQ ID NO: 400399 - DNA, 25 bp, Mus musculus
aaatcatgaggcgagttctccggaa

SEQ ID NO: 400400 - DNA, 25 bp, Mus musculus
aaatcatgtacaactccaagcggag

SEQ ID NO: 400401 - DNA, 25 bp, Mus musculus
aaatcatgtttttgtaccggctgga

SEQ ID NO: 400402 - DNA, 25 bp, Mus musculus
aaatccaaactgagggcacaagccg

SEQ ID NO: 400403 - DNA, 25 bp, Mus musculus
aaatccacttttcgccatttcaaag

SEQ ID NO: 400404 - DNA, 25 bp, Mus musculus
aaatccagatggagacgtgagccct

SEQ ID NO: 400405 - DNA, 25 bp, Mus musculus
aaatccattcaatcaacagaccatg

SEQ ID NO: 400406 - DNA, 25 bp, Mus musculus
aaatcccagccttttcacctcgttg

SEQ ID NO: 400407 - DNA, 25 bp, Mus musculus
aaatcccaggcgagagcgtcttcgt

SEQ ID NO: 400408 - DNA, 25 bp, Mus musculus
aaatcccgctggtcgtctatggctg

SEQ ID NO: 400409 - DNA, 25 bp, Mus musculus
aaatccgaccagagcgccttgaagg

SEQ ID NO: 400410 - DNA, 25 bp, Mus musculus
aaatccgatatgacttctaagttgc

SEQ ID NO: 400411 - DNA, 25 bp, Mus musculus
aaatccgggtaaggcatgtgctgac

SEQ ID NO: 400412 - DNA, 25 bp, Mus musculus
aaatccgtcatggactgtgggctgc

SEQ ID NO: 400413 - DNA, 25 bp, Mus musculus
aaatccgtgacctggagatggtgcc

SEQ ID NO: 400414 - DNA, 25 bp, Mus musculus
aaatccgtgtggctccagactgcag

SEQ ID NO: 400415 - DNA, 25 bp, Mus musculus
aaatcctacctggagcggagcgtca

SEQ ID NO: 400416 - DNA, 25 bp, Mus musculus
aaatcctcagtaagctgcgcctgga

SEQ ID NO: 400417 - DNA, 25 bp, Mus musculus
aaatcctgaggcgttgcagagaacg

SEQ ID NO: 400418 - DNA, 25 bp, Mus musculus
aaatcctgcttcagtgatgtccgca

SEQ ID NO: 400419 - DNA, 25 bp, Mus musculus
aaatcctgtaagtctcccggacaag

SEQ ID NO: 400420 - DNA, 25 bp, Mus musculus
aaatcctgtcttaacctgggtagcg

SEQ ID NO: 400421 - DNA, 25 bp, Mus musculus
aaatccttccgccttagacgcagag

SEQ ID NO: 400422 - DNA, 25 bp, Mus musculus
aaatccttcttggaacagagctggg

SEQ ID NO: 400423 - DNA, 25 bp, Mus musculus
aaatcctttcctaactggcctcgtg

SEQ ID NO: 400424 - DNA, 25 bp, Mus musculus
aaatcgagcgaagatggcagcccga

SEQ ID NO: 400425 - DNA, 25 bp, Mus musculus
aaatcgatggctagaagttagtggc

SEQ ID NO: 400426 - DNA, 25 bp, Mus musculus
aaatcgatttgtgtggttctcccta

SEQ ID NO: 400427 - DNA, 25 bp, Mus musculus
aaatcgccaggaaaacgcaggtcgc

SEQ ID NO: 400428 - DNA, 25 bp, Mus musculus
aaatcgctggacctgcattggagac

SEQ ID NO: 400429 - DNA, 25 bp, Mus musculus
aaatcgctgtcagtggcatgaccca

SEQ ID NO: 400430 - DNA, 25 bp, Mus musculus
aaatcggcttcggtttcagttggag

SEQ ID NO: 400431 - DNA, 25 bp, Mus musculus
aaatcgtaatgctaagtctagagaa

SEQ ID NO: 400432 - DNA, 25 bp, Mus musculus
aaatcgtgagtggaccttgctggca

SEQ ID NO: 400433 - DNA, 25 bp, Mus musculus
aaatcgtggcaaagaatgcgcgggc

SEQ ID NO: 400434 - DNA, 25 bp, Mus musculus
aaatcgtgtgtggtgtaccagctca

SEQ ID NO: 400435 - DNA, 25 bp, Mus musculus
aaatcgttcacaatatgctcgccta

SEQ ID NO: 400436 - DNA, 25 bp, Mus musculus
aaatcgttgggcactctgcgcaagg

SEQ ID NO: 400437 - DNA, 25 bp, Mus musculus
aaatctacatcgttctccgcaagcg

SEQ ID NO: 400438 - DNA, 25 bp, Mus musculus
aaatctaccagatcagcaaaacaat

SEQ ID NO: 400439 - DNA, 25 bp, Mus musculus
aaatctatgtgttgcagctgctggc

SEQ ID NO: 400440 - DNA, 25 bp, Mus musculus
aaatctcattccaacgttagggctg

SEQ ID NO: 400441 - DNA, 25 bp, Mus musculus
aaatctcccgacttctgtgagcgcg

SEQ ID NO: 400442 - DNA, 25 bp, Mus musculus
aaatctccgattcctctgggtgaag

SEQ ID NO: 400443 - DNA, 25 bp, Mus musculus
aaatctcgaatcacttttttctcag

SEQ ID NO: 400444 - DNA, 25 bp, Mus musculus
aaatctctatacagtgggtggctcc

SEQ ID NO: 400445 - DNA, 25 bp, Mus musculus
aaatctctgaccacatcaccctgga

SEQ ID NO: 400446 - DNA, 25 bp, Mus musculus
aaatctggactactagaaaacatgg

SEQ ID NO: 400447 - DNA, 25 bp, Mus musculus
aaatctggagttcttcgagctagcc

SEQ ID NO: 400448 - DNA, 25 bp, Mus musculus
aaatctggttgacgcagtctgcggc

SEQ ID NO: 400449 - DNA, 25 bp, Mus musculus
aaatctgtattctggaggctctgac

SEQ ID NO: 400450 - DNA, 25 bp, Mus musculus
aaatcttcgtggagtggtggaccag

SEQ ID NO: 400451 - DNA, 25 bp, Mus musculus
aaatcttgtggttcttatcactgtc

SEQ ID NO: 400452 - DNA, 25 bp, Mus musculus
aaatgaaagctttggacctctgcag

SEQ ID NO: 400453 - DNA, 25 bp, Mus musculus
aaatgaaatcactgagctgacccgg

SEQ ID NO: 400454 - DNA, 25 bp, Mus musculus
aaatgaaatccagcagagacgaggc

SEQ ID NO: 400455 - DNA, 25 bp, Mus musculus
aaatgaactggaggatgtggacacc

SEQ ID NO: 400456 - DNA, 25 bp, Mus musculus
aaatgaacttctacgggctacacgg

SEQ ID NO: 400457 - DNA, 25 bp, Mus musculus
aaatgaagcgaaagtggcctggcac

SEQ ID NO: 400458 - DNA, 25 bp, Mus musculus
aaatgacagcagaccaaggccttta

SEQ ID NO: 400459 - DNA, 25 bp, Mus musculus
aaatgaccagcagattcgggaaggc

SEQ ID NO: 400460 - DNA, 25 bp, Mus musculus
aaatgacccttctagggcaggccag

SEQ ID NO: 400461 - DNA, 25 bp, Mus musculus
aaatgaccggacctcgttgcatcga

SEQ ID NO: 400462 - DNA, 25 bp, Mus musculus
aaatgacctgcatgggttaccctgg

SEQ ID NO: 400463 - DNA, 25 bp, Mus musculus
aaatgacgttgagttgctgatccag

SEQ ID NO: 400464 - DNA, 25 bp, Mus musculus
aaatgactccccacagttgtcctga

SEQ ID NO: 400465 - DNA, 25 bp, Mus musculus
aaatgactgtcttttgggatgccac

SEQ ID NO: 400466 - DNA, 25 bp, Mus musculus
aaatgaggctgacaatcccgtgccg

SEQ ID NO: 400467 - DNA, 25 bp, Mus musculus
aaatgagggccaatactgagaactg

SEQ ID NO: 400468 - DNA, 25 bp, Mus musculus
aaatgagggccaatcttctgtgaca

SEQ ID NO: 400469 - DNA, 25 bp, Mus musculus
aaatgagtcagcatacagccccgct

SEQ ID NO: 400470 - DNA, 25 bp, Mus musculus
aaatgatagcagtgacgaagtcggc

SEQ ID NO: 400471 - DNA, 25 bp, Mus musculus
aaatgatctcctctccgttcaggga

SEQ ID NO: 400472 - DNA, 25 bp, Mus musculus
aaatgatggcctgcaccaaaggctg

SEQ ID NO: 400473 - DNA, 25 bp, Mus musculus
aaatgcaatactctttcagcatggg

SEQ ID NO: 400474 - DNA, 25 bp, Mus musculus
aaatgcacatacctgctgggcacca

SEQ ID NO: 400475 - DNA, 25 bp, Mus musculus
aaatgcaccagggtttcggcctcag

SEQ ID NO: 400476 - DNA, 25 bp, Mus musculus
aaatgcacgtttctgaggctcagga

SEQ ID NO: 400477 - DNA, 25 bp, Mus musculus
aaatgcatccacaaaaggcggccag

SEQ ID NO: 400478 - DNA, 25 bp, Mus musculus
aaatgcatcttctgtagacaccggg

SEQ ID NO: 400479 - DNA, 25 bp, Mus musculus
aaatgccaagaagccagtaaatcac

SEQ ID NO: 400480 - DNA, 25 bp, Mus musculus
aaatgccagtcggtgctgccggtgc

SEQ ID NO: 400481 - DNA, 25 bp, Mus musculus
aaatgccagttcgtcgggctgggca

SEQ ID NO: 400482 - DNA, 25 bp, Mus musculus
aaatgccataacgagctggtccggc

SEQ ID NO: 400483 - DNA, 25 bp, Mus musculus
aaatgccatcttttgcctggcatgg

SEQ ID NO: 400484 - DNA, 25 bp, Mus musculus
aaatgcctaagatggtgcctggaac

SEQ ID NO: 400485 - DNA, 25 bp, Mus musculus
aaatgcctacatgcagagcaagcgg

SEQ ID NO: 400486 - DNA, 25 bp, Mus musculus
aaatgcctatcaggtaggtagcccc

SEQ ID NO: 400487 - DNA, 25 bp, Mus musculus
aaatgcctgctgtctcaagtgtcgg

SEQ ID NO: 400488 - DNA, 25 bp, Mus musculus
aaatgcctggagtctatgcgtcaag

SEQ ID NO: 400489 - DNA, 25 bp, Mus musculus
aaatgcgccctgtgcctcaaagagt

SEQ ID NO: 400490 - DNA, 25 bp, Mus musculus
aaatgcgccggctagtttctcctca

SEQ ID NO: 400491 - DNA, 25 bp, Mus musculus
aaatgcgtgcagatcgctcgcgagg

SEQ ID NO: 400492 - DNA, 25 bp, Mus musculus
aaatgctaagcatccaaatgggcgt

SEQ ID NO: 400493 - DNA, 25 bp, Mus musculus
aaatgctcttaaagctggcccatgc

SEQ ID NO: 400494 - DNA, 25 bp, Mus musculus
aaatgctgccatccgagactgtgac

SEQ ID NO: 400495 - DNA, 25 bp, Mus musculus
aaatgctgtggcagtggctgttaca

SEQ ID NO: 400496 - DNA, 25 bp, Mus musculus
aaatgcttatttgaatatgtccggg

SEQ ID NO: 400497 - DNA, 25 bp, Mus musculus
aaatgcttcaaatggtcctccaggg

SEQ ID NO: 400498 - DNA, 25 bp, Mus musculus
aaatgcttgtgtcctgctgtcccag

SEQ ID NO: 400499 - DNA, 25 bp, Mus musculus
aaatggaacgtctgtgaccctcgag

SEQ ID NO: 400500 - DNA, 25 bp, Mus musculus
aaatggaagctaaggagttggagcc

SEQ ID NO: 400501 - DNA, 25 bp, Mus musculus
aaatggaatttcaacgcaggcgagg

SEQ ID NO: 400502 - DNA, 25 bp, Mus musculus
aaatggaggctcctcgctcaggaac

SEQ ID NO: 400503 - DNA, 25 bp, Mus musculus
aaatggagggctctttcggctcacc

SEQ ID NO: 400504 - DNA, 25 bp, Mus musculus
aaatggagtgtttcaggcttggacg

SEQ ID NO: 400505 - DNA, 25 bp, Mus musculus
aaatggatccataagctgcagcagc

SEQ ID NO: 400506 - DNA, 25 bp, Mus musculus
aaatggatgtcactagctgacctcc

SEQ ID NO: 400507 - DNA, 25 bp, Mus musculus
aaatggattggccaaccagggcaac

SEQ ID NO: 400508 - DNA, 25 bp, Mus musculus
aaatggcagccgcacttcttgcagc

SEQ ID NO: 400509 - DNA, 25 bp, Mus musculus
aaatggcagcctggttcactgctgg

SEQ ID NO: 400510 - DNA, 25 bp, Mus musculus
aaatggcatttcttcctcgtgggtg

SEQ ID NO: 400511 - DNA, 25 bp, Mus musculus
aaatggccacatttctgcagcacgc

SEQ ID NO: 400512 - DNA, 25 bp, Mus musculus
aaatggccctgtggacagtgctcgc

SEQ ID NO: 400513 - DNA, 25 bp, Mus musculus
aaatggccgttggaactgctcagcg

SEQ ID NO: 400514 - DNA, 25 bp, Mus musculus
aaatggctatctgtgaagcctgtca

SEQ ID NO: 400515 - DNA, 25 bp, Mus musculus
aaatggctatgctttgtatcttcgc

SEQ ID NO: 400516 - DNA, 25 bp, Mus musculus
aaatggctcgtctggcgagctggcc

SEQ ID NO: 400517 - DNA, 25 bp, Mus musculus
aaatggctgacaaaggtaaccagac

SEQ ID NO: 400518 - DNA, 25 bp, Mus musculus
aaatggctgcaaagacaagtccgtg

SEQ ID NO: 400519 - DNA, 25 bp, Mus musculus
aaatggcttagaaaaatagtgccgg

SEQ ID NO: 400520 - DNA, 25 bp, Mus musculus
aaatggcttctacgtaccagatcag

SEQ ID NO: 400521 - DNA, 25 bp, Mus musculus
aaatgggactacatctgtcaccagc

SEQ ID NO: 400522 - DNA, 25 bp, Mus musculus
aaatgggagacgtcacagttttgct

SEQ ID NO: 400523 - DNA, 25 bp, Mus musculus
aaatgggtactctccggtgctgcca

SEQ ID NO: 400524 - DNA, 25 bp, Mus musculus
aaatggtcacgcctaaggaatggtc

SEQ ID NO: 400525 - DNA, 25 bp, Mus musculus
aaatggtcattctccccagctctga

SEQ ID NO: 400526 - DNA, 25 bp, Mus musculus
aaatggtccctggagcttagaagcc

SEQ ID NO: 400527 - DNA, 25 bp, Mus musculus
aaatggtcgatgtttgccacgtgca

SEQ ID NO: 400528 - DNA, 25 bp, Mus musculus
aaatggtcgccaagcagaggatccg

SEQ ID NO: 400529 - DNA, 25 bp, Mus musculus
aaatggtgaccataagctgctgggc

SEQ ID NO: 400530 - DNA, 25 bp, Mus musculus
aaatggtgctccatatgctgctagc

SEQ ID NO: 400531 - DNA, 25 bp, Mus musculus
aaatggtttttcattggtgcggctg

SEQ ID NO: 400532 - DNA, 25 bp, Mus musculus
aaatgtaatatttctcttctgccaa

SEQ ID NO: 400533 - DNA, 25 bp, Mus musculus
aaatgtagacatatctcttggcacc

SEQ ID NO: 400534 - DNA, 25 bp, Mus musculus
aaatgtagcccgattgccaaagagc

SEQ ID NO: 400535 - DNA, 25 bp, Mus musculus
aaatgtatcccgtgctgagcctcca

SEQ ID NO: 400536 - DNA, 25 bp, Mus musculus
aaatgtatctacaacacggccggtg

SEQ ID NO: 400537 - DNA, 25 bp, Mus musculus
aaatgtccggtcgttgccatcacag

SEQ ID NO: 400538 - DNA, 25 bp, Mus musculus
aaatgtcctatgcttccagagtcgg

SEQ ID NO: 400539 - DNA, 25 bp, Mus musculus
aaatgtccttgttgatggcaatcca

SEQ ID NO: 400540 - DNA, 25 bp, Mus musculus
aaatgtcgtatagcttatcagtgga

SEQ ID NO: 400541 - DNA, 25 bp, Mus musculus
aaatgtcgtctttattgtcctggag

SEQ ID NO: 400542 - DNA, 25 bp, Mus musculus
aaatgtctctatgtacctccgcgtg

SEQ ID NO: 400543 - DNA, 25 bp, Mus musculus
aaatgtcttcctagtataccgcacg

SEQ ID NO: 400544 - DNA, 25 bp, Mus musculus
aaatgtgacagaagagacacgctgc

SEQ ID NO: 400545 - DNA, 25 bp, Mus musculus
aaatgtgaccttcatcggctagaag

SEQ ID NO: 400546 - DNA, 25 bp, Mus musculus
aaatgtgagggctgagacgagtcct

SEQ ID NO: 400547 - DNA, 25 bp, Mus musculus
aaatgtgcagctgagagtccagggc

SEQ ID NO: 400548 - DNA, 25 bp, Mus musculus
aaatgtgcctctgctcccctgaata

SEQ ID NO: 400549 - DNA, 25 bp, Mus musculus
aaatgtggaaagacactgacctctg

SEQ ID NO: 400550 - DNA, 25 bp, Mus musculus
aaatgtggccacagatttgggtgcc

SEQ ID NO: 400551 - DNA, 25 bp, Mus musculus
aaatgtggtactgatgcccgtgagc

SEQ ID NO: 400552 - DNA, 25 bp, Mus musculus
aaatgtgtaagactctggaactgcc

SEQ ID NO: 400553 - DNA, 25 bp, Mus musculus
aaatgtgtacacttcccatgggacc

SEQ ID NO: 400554 - DNA, 25 bp, Mus musculus
aaatgtgtccatggaaaaggtccca

SEQ ID NO: 400555 - DNA, 25 bp, Mus musculus
aaatgtgtcccatactggcccgagg

SEQ ID NO: 400556 - DNA, 25 bp, Mus musculus
aaatgtgtctggtctacgcttcgaa

SEQ ID NO: 400557 - DNA, 25 bp, Mus musculus
aaatgtgtgacttgtctcatgcggg

SEQ ID NO: 400558 - DNA, 25 bp, Mus musculus
aaatgtgtgatccatggcctgtccc

SEQ ID NO: 400559 - DNA, 25 bp, Mus musculus
aaatgttagtctgggcagtggtgcc

SEQ ID NO: 400560 - DNA, 25 bp, Mus musculus
aaatgttcccctattgctgggtttg

SEQ ID NO: 400561 - DNA, 25 bp, Mus musculus
aaatgttcgttttccagatggccag

SEQ ID NO: 400562 - DNA, 25 bp, Mus musculus
aaatgttctgtagacttgccaatag

SEQ ID NO: 400563 - DNA, 25 bp, Mus musculus
aaatgtttgattcccttactgcttg

SEQ ID NO: 400564 - DNA, 25 bp, Mus musculus
aaatgtttgctgtacaatgaggcac

SEQ ID NO: 400565 - DNA, 25 bp, Mus musculus
aaattaaacgagcaagcggccgagc

SEQ ID NO: 400566 - DNA, 25 bp, Mus musculus
aaattactgtcatggagagtgcccc

SEQ ID NO: 400567 - DNA, 25 bp, Mus musculus
aaattagagcgctccgttccgtggt

SEQ ID NO: 400568 - DNA, 25 bp, Mus musculus
aaattagtcctgctacaatcagtgg

SEQ ID NO: 400569 - DNA, 25 bp, Mus musculus
aaattatccgatgcttctcccgcgg

SEQ ID NO: 400570 - DNA, 25 bp, Mus musculus
aaattatgtttctgaggccaccgac

SEQ ID NO: 400571 - DNA, 25 bp, Mus musculus
aaattcaaaactgcacgccctgtgg

SEQ ID NO: 400572 - DNA, 25 bp, Mus musculus
aaattcactctccttgcccgagctt

SEQ ID NO: 400573 - DNA, 25 bp, Mus musculus
aaattcatcataccctgtcggttac

SEQ ID NO: 400574 - DNA, 25 bp, Mus musculus
aaattcatcgtcctcgcccaagaag

SEQ ID NO: 400575 - DNA, 25 bp, Mus musculus
aaattcatgatcgttggaggctcca

SEQ ID NO: 400576 - DNA, 25 bp, Mus musculus
aaattcatggcggacactgacctgg

SEQ ID NO: 400577 - DNA, 25 bp, Mus musculus
aaattccaacgaggtgtgtgcagcc

SEQ ID NO: 400578 - DNA, 25 bp, Mus musculus
aaattcccaacattcccattttgtg

SEQ ID NO: 400579 - DNA, 25 bp, Mus musculus
aaattccctctggactctgcgcgag

SEQ ID NO: 400580 - DNA, 25 bp, Mus musculus
aaattccgagtacctgcagttggcc

SEQ ID NO: 400581 - DNA, 25 bp, Mus musculus
aaattcctagaagggtgcatgcagc

SEQ ID NO: 400582 - DNA, 25 bp, Mus musculus
aaattcctcacggtgttggaactag

SEQ ID NO: 400583 - DNA, 25 bp, Mus musculus
aaattcgagtgacaagcctgtagcc

SEQ ID NO: 400584 - DNA, 25 bp, Mus musculus
aaattctctagccttctgaccgcag

SEQ ID NO: 400585 - DNA, 25 bp, Mus musculus
aaattctggagctggtgcacgacca

SEQ ID NO: 400586 - DNA, 25 bp, Mus musculus
aaattctgttccaacaacctaatgc

SEQ ID NO: 400587 - DNA, 25 bp, Mus musculus
aaattcttcaggcatgggcagggac

SEQ ID NO: 400588 - DNA, 25 bp, Mus musculus
aaattgaacagaaagctttgagatc

SEQ ID NO: 400589 - DNA, 25 bp, Mus musculus
aaattgacaacagcaggagatcggc

SEQ ID NO: 400590 - DNA, 25 bp, Mus musculus
aaattgaccttgtccgaagtgaccg

SEQ ID NO: 400591 - DNA, 25 bp, Mus musculus
aaattgactttgtcccagtccagcc

SEQ ID NO: 400592 - DNA, 25 bp, Mus musculus
aaattgagagcgacacgggaacctg

SEQ ID NO: 400593 - DNA, 25 bp, Mus musculus
aaattgataccgcagagatcgcccg

SEQ ID NO: 400594 - DNA, 25 bp, Mus musculus
aaattgcacagctagaatcatgtcc

SEQ ID NO: 400595 - DNA, 25 bp, Mus musculus
aaattgcatttcttgcggcgcacgg

SEQ ID NO: 400596 - DNA, 25 bp, Mus musculus
aaattgccacgggacatgggaggct

SEQ ID NO: 400597 - DNA, 25 bp, Mus musculus
aaattgctacgtatctgaggctggc

SEQ ID NO: 400598 - DNA, 25 bp, Mus musculus
aaattgctgctaaagatgggtgcca

SEQ ID NO: 400599 - DNA, 25 bp, Mus musculus
aaattggaggtgttcgtcccacgcg

SEQ ID NO: 400600 - DNA, 25 bp, Mus musculus
aaattgggcgcacccttggcagaca

SEQ ID NO: 400601 - DNA, 25 bp, Mus musculus
aaattgtaaccacaacttctgtatc

SEQ ID NO: 400602 - DNA, 25 bp, Mus musculus
aaattgtcctttgggcagccgccta

SEQ ID NO: 400603 - DNA, 25 bp, Mus musculus
aaattgtgcggagctttggaaccct

SEQ ID NO: 400604 - DNA, 25 bp, Mus musculus
aaattgttatgaaccatggcccagc

SEQ ID NO: 400605 - DNA, 25 bp, Mus musculus
aaatttaagcctgcagtcgtctgga

SEQ ID NO: 400606 - DNA, 25 bp, Mus musculus
aaatttcaagatcaagggcctccag

SEQ ID NO: 400607 - DNA, 25 bp, Mus musculus
aaatttcgactgaaggtcaccagcc

SEQ ID NO: 400608 - DNA, 25 bp, Mus musculus
aaatttgaaggacatacgagggcct

SEQ ID NO: 400609 - DNA, 25 bp, Mus musculus
aaatttggacatggtgaagtttctg

SEQ ID NO: 400610 - DNA, 25 bp, Mus musculus
aaatttggcaccagcacaacacggg

SEQ ID NO: 400611 - DNA, 25 bp, Mus musculus
aaatttgtacaacctgcctctgaag

SEQ ID NO: 400612 - DNA, 25 bp, Mus musculus
aaatttgtgactgtggctctgaagc

SEQ ID NO: 400613 - DNA, 25 bp, Mus musculus
aaattttggccccacaggcattggg

SEQ ID NO: 400614 - DNA, 25 bp, Mus musculus
aacaaaaatcagatgcagagtgagc

SEQ ID NO: 400615 - DNA, 25 bp, Mus musculus
aacaaaagctcccttggcatcagaa

SEQ ID NO: 400616 - DNA, 25 bp, Mus musculus
aacaaacgaatcaaacaaggcaatg

SEQ ID NO: 400617 - DNA, 25 bp, Mus musculus
aacaaagaatgtaccccgcagtgca

SEQ ID NO: 400618 - DNA, 25 bp, Mus musculus
aacaaagccttgtatgtcagctcac

SEQ ID NO: 400619 - DNA, 25 bp, Mus musculus
aacaaagcggcagtgttcttgctac

SEQ ID NO: 400620 - DNA, 25 bp, Mus musculus
aacaaaggactgtggctcagtagag

SEQ ID NO: 400621 - DNA, 25 bp, Mus musculus
aacaaaggtattgtaccctgctgcc

SEQ ID NO: 400622 - DNA, 25 bp, Mus musculus
aacaaagtttgacagaagtctctgg

SEQ ID NO: 400623 - DNA, 25 bp, Mus musculus
aacaaattatactgtgggccccgca

SEQ ID NO: 400624 - DNA, 25 bp, Mus musculus
aacaaattggattcttctgatcccc

SEQ ID NO: 400625 - DNA, 25 bp, Mus musculus
aacaacacattcaaggccagtcccg

SEQ ID NO: 400626 - DNA, 25 bp, Mus musculus
aacaacacggagttctgtgctttgc

SEQ ID NO: 400627 - DNA, 25 bp, Mus musculus
aacaacatgctgtgcgctggagaca

SEQ ID NO: 400628 - DNA, 25 bp, Mus musculus
aacaaccgtcggagccagagcttta

SEQ ID NO: 400629 - DNA, 25 bp, Mus musculus
aacaacctcaattgccaggaaagga

SEQ ID NO: 400630 - DNA, 25 bp, Mus musculus
aacaacctgcgggtgcactacaaag

SEQ ID NO: 400631 - DNA, 25 bp, Mus musculus
aacaacctggtagagagtggccacc

SEQ ID NO: 400632 - DNA, 25 bp, Mus musculus
aacaactctcactgcactgtcggga

SEQ ID NO: 400633 - DNA, 25 bp, Mus musculus
aacaactggagctgggaggaagccc

SEQ ID NO: 400634 - DNA, 25 bp, Mus musculus
aacaacttgctggtcatctctgtgg

SEQ ID NO: 400635 - DNA, 25 bp, Mus musculus
aacaagaacattggagtgggctctc

SEQ ID NO: 400636 - DNA, 25 bp, Mus musculus
aacaagaactttgagcgcctgcgca

SEQ ID NO: 400637 - DNA, 25 bp, Mus musculus
aacaagaagacatgggaatttatcc

SEQ ID NO: 400638 - DNA, 25 bp, Mus musculus
aacaagaagcttctgcgtgcgggca

SEQ ID NO: 400639 - DNA, 25 bp, Mus musculus
aacaagagactctaattctaggctc

SEQ ID NO: 400640 - DNA, 25 bp, Mus musculus
aacaagaggctatagttgacccgcc

SEQ ID NO: 400641 - DNA, 25 bp, Mus musculus
aacaagatgctctgtggcagggcct

SEQ ID NO: 400642 - DNA, 25 bp, Mus musculus
aacaagcaccctatgggaggagtcc

SEQ ID NO: 400643 - DNA, 25 bp, Mus musculus
aacaagcagaggctgctgcggctcc

SEQ ID NO: 400644 - DNA, 25 bp, Mus musculus
aacaagcccttgtacgtagcctgta

SEQ ID NO: 400645 - DNA, 25 bp, Mus musculus
aacaagcctgcctacgagatcaaca

SEQ ID NO: 400646 - DNA, 25 bp, Mus musculus
aacaagcctttgaccctgtcttcct

SEQ ID NO: 400647 - DNA, 25 bp, Mus musculus
aacaagctcgtgtccaaggacggca

SEQ ID NO: 400648 - DNA, 25 bp, Mus musculus
aacaagctgggcagggatcatcccc

SEQ ID NO: 400649 - DNA, 25 bp, Mus musculus
aacaagctgggctacgtgagcgtca

SEQ ID NO: 400650 - DNA, 25 bp, Mus musculus
aacaaggcccgcgaatgttgggagc

SEQ ID NO: 400651 - DNA, 25 bp, Mus musculus
aacaagggtccatcctacggcatga

SEQ ID NO: 400652 - DNA, 25 bp, Mus musculus
aacaagtacctgacagccgaggcgt

SEQ ID NO: 400653 - DNA, 25 bp, Mus musculus
aacaagtcatcgagtatgcccggca

SEQ ID NO: 400654 - DNA, 25 bp, Mus musculus
aacaagtcccatcaaatctggccgg

SEQ ID NO: 400655 - DNA, 25 bp, Mus musculus
aacaagtgcaagacccctgtgagga

SEQ ID NO: 400656 - DNA, 25 bp, Mus musculus
aacaagtgtgttatcctggccttgg

SEQ ID NO: 400657 - DNA, 25 bp, Mus musculus
aacaagttgggcagtcgctcctatg

SEQ ID NO: 400658 - DNA, 25 bp, Mus musculus
aacaataactttagccgcctggcgg

SEQ ID NO: 400659 - DNA, 25 bp, Mus musculus
aacaataatgtgtcttccagtgagc

SEQ ID NO: 400660 - DNA, 25 bp, Mus musculus
aacaatactgatacatgtttgccag

SEQ ID NO: 400661 - DNA, 25 bp, Mus musculus
aacaatagcgccatcgacagcggga

SEQ ID NO: 400662 - DNA, 25 bp, Mus musculus
aacaatatttggtgcagtaacgtac

SEQ ID NO: 400663 - DNA, 25 bp, Mus musculus
aacaatctctctggctgagcagcgg

SEQ ID NO: 400664 - DNA, 25 bp, Mus musculus
aacaatctgtccaggagttgcccgg

SEQ ID NO: 400665 - DNA, 25 bp, Mus musculus
aacaatctgttgctgaaggcccgtc

SEQ ID NO: 400666 - DNA, 25 bp, Mus musculus
aacaatgcttccctttaatacagtc

SEQ ID NO: 400667 - DNA, 25 bp, Mus musculus
aacaatggccacagtgtgttctgct

SEQ ID NO: 400668 - DNA, 25 bp, Mus musculus
aacaatgggcatttcggtcaggaca

SEQ ID NO: 400669 - DNA, 25 bp, Mus musculus
aacaatgtctgcgtgcatgcacccg

SEQ ID NO: 400670 - DNA, 25 bp, Mus musculus
aacaatgtgcttgggcttttgaaga

SEQ ID NO: 400671 - DNA, 25 bp, Mus musculus
aacaattcagggactcggcgagcat

SEQ ID NO: 400672 - DNA, 25 bp, Mus musculus
aacaatttcctcttcgcgcagtgcg

SEQ ID NO: 400673 - DNA, 25 bp, Mus musculus
aacacaaatgtgaagcgacgggctc

SEQ ID NO: 400674 - DNA, 25 bp, Mus musculus
aacacaaatgttcatgatctcagca

SEQ ID NO: 400675 - DNA, 25 bp, Mus musculus
aacacaaggatcagcgacccagaat

SEQ ID NO: 400676 - DNA, 25 bp, Mus musculus
aacacacagggcctagtgccaggca

SEQ ID NO: 400677 - DNA, 25 bp, Mus musculus
aacacactggttctgagggacgtgc

SEQ ID NO: 400678 - DNA, 25 bp, Mus musculus
aacacagaatggaagcaaaggtccc

SEQ ID NO: 400679 - DNA, 25 bp, Mus musculus
aacacaggcgttctcacggtggcag

SEQ ID NO: 400680 - DNA, 25 bp, Mus musculus
aacacagtgatggtgaggaaaccac

SEQ ID NO: 400681 - DNA, 25 bp, Mus musculus
aacacagtggaaagcctcaagaggc

SEQ ID NO: 400682 - DNA, 25 bp, Mus musculus
aacacagtgtgtgaagagtgcccag

SEQ ID NO: 400683 - DNA, 25 bp, Mus musculus
aacacagtgtgtgatttctggcaga

SEQ ID NO: 400684 - DNA, 25 bp, Mus musculus
aacacagttgggaccctgcctaggg

SEQ ID NO: 400685 - DNA, 25 bp, Mus musculus
aacacataccaggtcagggagggcc

SEQ ID NO: 400686 - DNA, 25 bp, Mus musculus
aacacatacgtcatcggcctgctgg

SEQ ID NO: 400687 - DNA, 25 bp, Mus musculus
aacacatgagctttattctttataa

SEQ ID NO: 400688 - DNA, 25 bp, Mus musculus
aacacatgtgatggctggagctcca

SEQ ID NO: 400689 - DNA, 25 bp, Mus musculus
aacacatgtgctgggtctgctggca

SEQ ID NO: 400690 - DNA, 25 bp, Mus musculus
aacacattgctgagactgagtcgcc

SEQ ID NO: 400691 - DNA, 25 bp, Mus musculus
aacacatttcagtaacagaagatga

SEQ ID NO: 400692 - DNA, 25 bp, Mus musculus
aacaccaagtcaattgcagagggag

SEQ ID NO: 400693 - DNA, 25 bp, Mus musculus
aacaccagaagagaagacgcggcag

SEQ ID NO: 400694 - DNA, 25 bp, Mus musculus
aacaccaggtatttcaggagacgcc

SEQ ID NO: 400695 - DNA, 25 bp, Mus musculus
aacaccaggtggctgtccaaatgac

SEQ ID NO: 400696 - DNA, 25 bp, Mus musculus
aacaccaggttccactggagtcagg

SEQ ID NO: 400697 - DNA, 25 bp, Mus musculus
aacaccatggacgtcttcaagaaag

SEQ ID NO: 400698 - DNA, 25 bp, Mus musculus
aacaccatgggtaagagatctgacc

SEQ ID NO: 400699 - DNA, 25 bp, Mus musculus
aacacccaggcggagcttctggctg

SEQ ID NO: 400700 - DNA, 25 bp, Mus musculus
aacacccggttttcacatggcaaag

SEQ ID NO: 400701 - DNA, 25 bp, Mus musculus
aacaccctcgtgtgtgtgcagaaag

SEQ ID NO: 400702 - DNA, 25 bp, Mus musculus
aacaccctggttgagtagtcttcgg

SEQ ID NO: 400703 - DNA, 25 bp, Mus musculus
aacaccgagactgcttttacctctg

SEQ ID NO: 400704 - DNA, 25 bp, Mus musculus
aacacctgggcatcgctgtatgcag

SEQ ID NO: 400705 - DNA, 25 bp, Mus musculus
aacaccttcgtgcatgagcccttgg

SEQ ID NO: 400706 - DNA, 25 bp, Mus musculus
aacaccttgtgtactggcgactgcg

SEQ ID NO: 400707 - DNA, 25 bp, Mus musculus
aacacgaattggagaaccggacaca

SEQ ID NO: 400708 - DNA, 25 bp, Mus musculus
aacacgaggcctccacacagtgtaa

SEQ ID NO: 400709 - DNA, 25 bp, Mus musculus
aacacgcccattgtggtttaaccag

SEQ ID NO: 400710 - DNA, 25 bp, Mus musculus
aacacgccccgtgagcgggtagagc

SEQ ID NO: 400711 - DNA, 25 bp, Mus musculus
aacacgccgcacctgtcggatgaag

SEQ ID NO: 400712 - DNA, 25 bp, Mus musculus
aacacgcgctgcgctgactgcggag

SEQ ID NO: 400713 - DNA, 25 bp, Mus musculus
aacacgcttagggactggattggaa

SEQ ID NO: 400714 - DNA, 25 bp, Mus musculus
aacacgcttgcaccaaagaaggcgg

SEQ ID NO: 400715 - DNA, 25 bp, Mus musculus
aacacgggttcttgggcgtgtgctc

SEQ ID NO: 400716 - DNA, 25 bp, Mus musculus
aacacgtaggtgtccttgagagcca

SEQ ID NO: 400717 - DNA, 25 bp, Mus musculus
aacacgtggcgtgccttcgatggcc

SEQ ID NO: 400718 - DNA, 25 bp, Mus musculus
aacactacatgaaggtattgtttca

SEQ ID NO: 400719 - DNA, 25 bp, Mus musculus
aacactaccggtccggctacagtgc

SEQ ID NO: 400720 - DNA, 25 bp, Mus musculus
aacactcaggagtacagcaaggcca

SEQ ID NO: 400721 - DNA, 25 bp, Mus musculus
aacactctaagctctatatgtccca

SEQ ID NO: 400722 - DNA, 25 bp, Mus musculus
aacactctactaactacatttccag

SEQ ID NO: 400723 - DNA, 25 bp, Mus musculus
aacactctcggatgccaatagtcgg

SEQ ID NO: 400724 - DNA, 25 bp, Mus musculus
aacactctggagtacttctgctgca

SEQ ID NO: 400725 - DNA, 25 bp, Mus musculus
aacactgacggtgagattggtaatg

SEQ ID NO: 400726 - DNA, 25 bp, Mus musculus
aacactgagagtgcagacagcggca

SEQ ID NO: 400727 - DNA, 25 bp, Mus musculus
aacactgctctttgcccatcgatga

SEQ ID NO: 400728 - DNA, 25 bp, Mus musculus
aacactggagtgtttgctccatgcc

SEQ ID NO: 400729 - DNA, 25 bp, Mus musculus
aacactgtaatgctcagaagggcca

SEQ ID NO: 400730 - DNA, 25 bp, Mus musculus
aacactgtgggcagcttcctgtgca

SEQ ID NO: 400731 - DNA, 25 bp, Mus musculus
aacactgttctttgctgctggctcc

SEQ ID NO: 400732 - DNA, 25 bp, Mus musculus
aacacttaaccacagagagaacacc

SEQ ID NO: 400733 - DNA, 25 bp, Mus musculus
aacacttagtggacctgcatacgca

SEQ ID NO: 400734 - DNA, 25 bp, Mus musculus
aacacttgaaagctgttggcggcga

SEQ ID NO: 400735 - DNA, 25 bp, Mus musculus
aacacttgtggccaattggtagcaa

SEQ ID NO: 400736 - DNA, 25 bp, Mus musculus
aacactttcagggatgattgcccca

SEQ ID NO: 400737 - DNA, 25 bp, Mus musculus
aacagaacaaggagttggcaccagc

SEQ ID NO: 400738 - DNA, 25 bp, Mus musculus
aacagaagaatgagggcccgtgcag

SEQ ID NO: 400739 - DNA, 25 bp, Mus musculus
aacagaagctgtcgtggttaaccct

SEQ ID NO: 400740 - DNA, 25 bp, Mus musculus
aacagaataggagccctggagcagc

SEQ ID NO: 400741 - DNA, 25 bp, Mus musculus
aacagactgtggagagccttttggg

SEQ ID NO: 400742 - DNA, 25 bp, Mus musculus
aacagagatgttcctgaatgaaagc

SEQ ID NO: 400743 - DNA, 25 bp, Mus musculus
aacagagcccgtgtcgtagagttgg

SEQ ID NO: 400744 - DNA, 25 bp, Mus musculus
aacagagcgtgtcccgtaatcgaga

SEQ ID NO: 400745 - DNA, 25 bp, Mus musculus
aacagagctcaccatttgaatcata

SEQ ID NO: 400746 - DNA, 25 bp, Mus musculus
aacagagctgttagagacttcaaga

SEQ ID NO: 400747 - DNA, 25 bp, Mus musculus
aacagaggcttcttctacaatccaa

SEQ ID NO: 400748 - DNA, 25 bp, Mus musculus
aacagagtgtgtggctgcatcccgc

SEQ ID NO: 400749 - DNA, 25 bp, Mus musculus
aacagagtgttctgagcgtcaacac

SEQ ID NO: 400750 - DNA, 25 bp, Mus musculus
aacagagttcttgttctttcagggt

SEQ ID NO: 400751 - DNA, 25 bp, Mus musculus
aacagatattttttagggatccatg

SEQ ID NO: 400752 - DNA, 25 bp, Mus musculus
aacagatcctggctctagaggcgga

SEQ ID NO: 400753 - DNA, 25 bp, Mus musculus
aacagatgcaccctgaaagccatag

SEQ ID NO: 400754 - DNA, 25 bp, Mus musculus
aacagattgaatctcaaagggtcac

SEQ ID NO: 400755 - DNA, 25 bp, Mus musculus
aacagattgcggtggccatcacaga

SEQ ID NO: 400756 - DNA, 25 bp, Mus musculus
aacagattgtatgctgtccacaggg

SEQ ID NO: 400757 - DNA, 25 bp, Mus musculus
aacagcacagggagatattggacac

SEQ ID NO: 400758 - DNA, 25 bp, Mus musculus
aacagcactgtggagatcgtgaccc

SEQ ID NO: 400759 - DNA, 25 bp, Mus musculus
aacagcagagtgagtgccccaaggt

SEQ ID NO: 400760 - DNA, 25 bp, Mus musculus
aacagcagggagatgccagaggctc

SEQ ID NO: 400761 - DNA, 25 bp, Mus musculus
aacagcagggcctatccgatcagga

SEQ ID NO: 400762 - DNA, 25 bp, Mus musculus
aacagcatcgttgtggcccaagtgg

SEQ ID NO: 400763 - DNA, 25 bp, Mus musculus
aacagcattttgtatcagcgtggca

SEQ ID NO: 400764 - DNA, 25 bp, Mus musculus
aacagccaatgagaaatgtttcgga

SEQ ID NO: 400765 - DNA, 25 bp, Mus musculus
aacagccatgagtttagttccaggg

SEQ ID NO: 400766 - DNA, 25 bp, Mus musculus
aacagcccagctcgcccgaggaagg

SEQ ID NO: 400767 - DNA, 25 bp, Mus musculus
aacagccctaccagtgagaccacta

SEQ ID NO: 400768 - DNA, 25 bp, Mus musculus
aacagccgctgacaaagaaaaacca

SEQ ID NO: 400769 - DNA, 25 bp, Mus musculus
aacagcctgatgttcggcacctcgg

SEQ ID NO: 400770 - DNA, 25 bp, Mus musculus
aacagcctgcagtcagagaccgtgc

SEQ ID NO: 400771 - DNA, 25 bp, Mus musculus
aacagcctgccttttctctaaatag

SEQ ID NO: 400772 - DNA, 25 bp, Mus musculus
aacagcctgctttctactaaaaggg

SEQ ID NO: 400773 - DNA, 25 bp, Mus musculus
aacagcctgtgtccaaagagtgtcc

SEQ ID NO: 400774 - DNA, 25 bp, Mus musculus
aacagccttcggttttggtccagag

SEQ ID NO: 400775 - DNA, 25 bp, Mus musculus
aacagcgcgggctacaaggttctca

SEQ ID NO: 400776 - DNA, 25 bp, Mus musculus
aacagcgggcacgtcaattcctagg

SEQ ID NO: 400777 - DNA, 25 bp, Mus musculus
aacagctacgaggatgccaaggcct

SEQ ID NO: 400778 - DNA, 25 bp, Mus musculus
aacagctacttaaaatttgcattgg

SEQ ID NO: 400779 - DNA, 25 bp, Mus musculus
aacagctataatgtgcgccgcacgg

SEQ ID NO: 400780 - DNA, 25 bp, Mus musculus
aacagctcgtgctgggtgcctcaca

SEQ ID NO: 400781 - DNA, 25 bp, Mus musculus
aacagctggttcttttggccttcca

SEQ ID NO: 400782 - DNA, 25 bp, Mus musculus
aacagcttctggtgggtactacggg

SEQ ID NO: 400783 - DNA, 25 bp, Mus musculus
aacagcttgcccagtttcttgaggc

SEQ ID NO: 400784 - DNA, 25 bp, Mus musculus
aacaggaaatcatattctttcttcc

SEQ ID NO: 400785 - DNA, 25 bp, Mus musculus
aacaggaccagaccaccgactggag

SEQ ID NO: 400786 - DNA, 25 bp, Mus musculus
aacaggactctgatctgcgctccga

SEQ ID NO: 400787 - DNA, 25 bp, Mus musculus
aacaggactttgctacgacactcgg

SEQ ID NO: 400788 - DNA, 25 bp, Mus musculus
aacaggagggctagggacttgctca

SEQ ID NO: 400789 - DNA, 25 bp, Mus musculus
aacaggagtttcagagcaagcagca

SEQ ID NO: 400790 - DNA, 25 bp, Mus musculus
aacaggattggtttcctggcagccg

SEQ ID NO: 400791 - DNA, 25 bp, Mus musculus
aacaggcagaaactcacgacaaggg

SEQ ID NO: 400792 - DNA, 25 bp, Mus musculus
aacaggcaggatccccatctggttg

SEQ ID NO: 400793 - DNA, 25 bp, Mus musculus
aacaggcagtgcgatcgaggctgaa

SEQ ID NO: 400794 - DNA, 25 bp, Mus musculus
aacaggccatctagccttctccttg

SEQ ID NO: 400795 - DNA, 25 bp, Mus musculus
aacaggccccgatgctcgtttggag

SEQ ID NO: 400796 - DNA, 25 bp, Mus musculus
aacaggccccgccagagcgggtctt

SEQ ID NO: 400797 - DNA, 25 bp, Mus musculus
aacaggccctctattagctcagaag

SEQ ID NO: 400798 - DNA, 25 bp, Mus musculus
aacaggccgtggaaatgaaggtgct

SEQ ID NO: 400799 - DNA, 25 bp, Mus musculus
aacaggctgtattcgctatgccgga

SEQ ID NO: 400800 - DNA, 25 bp, Mus musculus
aacagggatctgacagcttatgaat

SEQ ID NO: 400801 - DNA, 25 bp, Mus musculus
aacagggattgctgggagtctgcca

SEQ ID NO: 400802 - DNA, 25 bp, Mus musculus
aacagggcgcccaagttctgagaag

SEQ ID NO: 400803 - DNA, 25 bp, Mus musculus
aacagggtaatgaggcccgcatcca

SEQ ID NO: 400804 - DNA, 25 bp, Mus musculus
aacagggtcctgcatctatagaaca

SEQ ID NO: 400805 - DNA, 25 bp, Mus musculus
aacagggtctcttggtgtgaggccc

SEQ ID NO: 400806 - DNA, 25 bp, Mus musculus
aacagggtctgggtctagtcaagaa

SEQ ID NO: 400807 - DNA, 25 bp, Mus musculus
aacaggtgcataaatggcttctacg

SEQ ID NO: 400808 - DNA, 25 bp, Mus musculus
aacaggtgggcctctgatgtcctgg

SEQ ID NO: 400809 - DNA, 25 bp, Mus musculus
aacaggttccccaatgagctggaga

SEQ ID NO: 400810 - DNA, 25 bp, Mus musculus
aacaggttggcccaggtctgcaatc

SEQ ID NO: 400811 - DNA, 25 bp, Mus musculus
aacagtaacaaagcgtgcgttcgag

SEQ ID NO: 400812 - DNA, 25 bp, Mus musculus
aacagtactacatgggagcggaggc

SEQ ID NO: 400813 - DNA, 25 bp, Mus musculus
aacagtattctatgctggccagggc

SEQ ID NO: 400814 - DNA, 25 bp, Mus musculus
aacagtcagagcttcacccatgggc

SEQ ID NO: 400815 - DNA, 25 bp, Mus musculus
aacagtcctctctactctttggtca

SEQ ID NO: 400816 - DNA, 25 bp, Mus musculus
aacagtcggagaagctgcggacact

SEQ ID NO: 400817 - DNA, 25 bp, Mus musculus
aacagtctctggagttctgccggca

SEQ ID NO: 400818 - DNA, 25 bp, Mus musculus
aacagtcttgcatctccagaaagaa

SEQ ID NO: 400819 - DNA, 25 bp, Mus musculus
aacagtgaagacgtagccagagctc

SEQ ID NO: 400820 - DNA, 25 bp, Mus musculus
aacagtgcagtgttgcccattagca

SEQ ID NO: 400821 - DNA, 25 bp, Mus musculus
aacagtgctggcttcaatggtggac

SEQ ID NO: 400822 - DNA, 25 bp, Mus musculus
aacagtggtcttagttttgaggagc

SEQ ID NO: 400823 - DNA, 25 bp, Mus musculus
aacagtgtcagacgctttgagcagc

SEQ ID NO: 400824 - DNA, 25 bp, Mus musculus
aacagtgtgcctatgagtgcccaga

SEQ ID NO: 400825 - DNA, 25 bp, Mus musculus
aacagtgtggcaagctacgagaacc

SEQ ID NO: 400826 - DNA, 25 bp, Mus musculus
aacagttccatgtgggtctagccca

SEQ ID NO: 400827 - DNA, 25 bp, Mus musculus
aacagttccgcctggtgcacgtgga

SEQ ID NO: 400828 - DNA, 25 bp, Mus musculus
aacagttctgcaggtcaccacggga

SEQ ID NO: 400829 - DNA, 25 bp, Mus musculus
aacagtttgggctgattgaagcagg

SEQ ID NO: 400830 - DNA, 25 bp, Mus musculus
aacataaactagctccctgtgctgg

SEQ ID NO: 400831 - DNA, 25 bp, Mus musculus
aacataagctgcactgtcgctcact

SEQ ID NO: 400832 - DNA, 25 bp, Mus musculus
aacataagcttccttcgcccagtgg

SEQ ID NO: 400833 - DNA, 25 bp, Mus musculus
aacatagtgccgtgctgctgaagag

SEQ ID NO: 400834 - DNA, 25 bp, Mus musculus
aacatattggcgatgcacacctgga

SEQ ID NO: 400835 - DNA, 25 bp, Mus musculus
aacatcaccatgtcacgggaggcag

SEQ ID NO: 400836 - DNA, 25 bp, Mus musculus
aacatcaccgtcttggcaccaggaa

SEQ ID NO: 400837 - DNA, 25 bp, Mus musculus
aacatcacgcctgttgtggacggca

SEQ ID NO: 400838 - DNA, 25 bp, Mus musculus
aacatcacgtggtctgagctcagcg

SEQ ID NO: 400839 - DNA, 25 bp, Mus musculus
aacatcatctcacagggcttcggca

SEQ ID NO: 400840 - DNA, 25 bp, Mus musculus
aacatcatggacactcctgtttctg

SEQ ID NO: 400841 - DNA, 25 bp, Mus musculus
aacatcatggctgccagaggctgca

SEQ ID NO: 400842 - DNA, 25 bp, Mus musculus
aacatccagatgtacgaccgggtga

SEQ ID NO: 400843 - DNA, 25 bp, Mus musculus
aacatccatcgaagacacaggtgcc

SEQ ID NO: 400844 - DNA, 25 bp, Mus musculus
aacatccgggagatgctgatggcgc

SEQ ID NO: 400845 - DNA, 25 bp, Mus musculus
aacatcctggtgctggtaatcctgg

SEQ ID NO: 400846 - DNA, 25 bp, Mus musculus
aacatccttcctagtcgcccgtttg

SEQ ID NO: 400847 - DNA, 25 bp, Mus musculus
aacatccttggtgaacgtcgtgccc

SEQ ID NO: 400848 - DNA, 25 bp, Mus musculus
aacatcgggaagcatcgagagctgc

SEQ ID NO: 400849 - DNA, 25 bp, Mus musculus
aacatcgtgggtgtgtgtgactcca

SEQ ID NO: 400850 - DNA, 25 bp, Mus musculus
aacatcgtggttcatttggccctca

SEQ ID NO: 400851 - DNA, 25 bp, Mus musculus
aacatctccagctccatgggtcgag

SEQ ID NO: 400852 - DNA, 25 bp, Mus musculus
aacatctgcacagaggtgatggcac

SEQ ID NO: 400853 - DNA, 25 bp, Mus musculus
aacatctgcactcaggacagccgga

SEQ ID NO: 400854 - DNA, 25 bp, Mus musculus
aacatctggctgtcggtggaggacc

SEQ ID NO: 400855 - DNA, 25 bp, Mus musculus
aacatctgtagcaatttccctgaac

SEQ ID NO: 400856 - DNA, 25 bp, Mus musculus
aacatcttaatcgacctgagccgcg

SEQ ID NO: 400857 - DNA, 25 bp, Mus musculus
aacatgaagatccaactctgatttc

SEQ ID NO: 400858 - DNA, 25 bp, Mus musculus
aacatgaagtttgagacgggcgcct

SEQ ID NO: 400859 - DNA, 25 bp, Mus musculus
aacatgacagtggtgctgctgacct

SEQ ID NO: 400860 - DNA, 25 bp, Mus musculus
aacatgagctgtggtggcccttcat

SEQ ID NO: 400861 - DNA, 25 bp, Mus musculus
aacatgatctgccaacaaggagcca

SEQ ID NO: 400862 - DNA, 25 bp, Mus musculus
aacatgattggttactgagggagcc

SEQ ID NO: 400863 - DNA, 25 bp, Mus musculus
aacatgcaggtgtaggttcagagcg

SEQ ID NO: 400864 - DNA, 25 bp, Mus musculus
aacatgcatgtactctcaggaaggg

SEQ ID NO: 400865 - DNA, 25 bp, Mus musculus
aacatgccaatgagactgcctgcca

SEQ ID NO: 400866 - DNA, 25 bp, Mus musculus
aacatgcggctgtcgcaactgaagc

SEQ ID NO: 400867 - DNA, 25 bp, Mus musculus
aacatgcgtgattagccttcctaaa

SEQ ID NO: 400868 - DNA, 25 bp, Mus musculus
aacatggacggagccttcttggtgc

SEQ ID NO: 400869 - DNA, 25 bp, Mus musculus
aacatggagactattgggaagacgc

SEQ ID NO: 400870 - DNA, 25 bp, Mus musculus
aacatggcagtagactttgcagggc

SEQ ID NO: 400871 - DNA, 25 bp, Mus musculus
aacatggtcccatatcccgattagc

SEQ ID NO: 400872 - DNA, 25 bp, Mus musculus
aacatgtacctgaactttgccgaga

SEQ ID NO: 400873 - DNA, 25 bp, Mus musculus
aacatgtaccttactcgagagcggc

SEQ ID NO: 400874 - DNA, 25 bp, Mus musculus
aacatgtcaaagctacgtgggccca

SEQ ID NO: 400875 - DNA, 25 bp, Mus musculus
aacatgttcaccttgtgcagcggca

SEQ ID NO: 400876 - DNA, 25 bp, Mus musculus
aacatgttcgctatggaccagggca

SEQ ID NO: 400877 - DNA, 25 bp, Mus musculus
aacattaccctgtggcgatcaccgg

SEQ ID NO: 400878 - DNA, 25 bp, Mus musculus
aacattatgtgctggctggctctcc

SEQ ID NO: 400879 - DNA, 25 bp, Mus musculus
aacattccggagaacctgcctgtgg

SEQ ID NO: 400880 - DNA, 25 bp, Mus musculus
aacattctggatactctgaggcggc

SEQ ID NO: 400881 - DNA, 25 bp, Mus musculus
aacattctgggctgccatgagggct

SEQ ID NO: 400882 - DNA, 25 bp, Mus musculus
aacattctggtaccctgcgtgctca

SEQ ID NO: 400883 - DNA, 25 bp, Mus musculus
aacattgagctttttatttggccca

SEQ ID NO: 400884 - DNA, 25 bp, Mus musculus
aacattgctcgcgtggtgccccatg

SEQ ID NO: 400885 - DNA, 25 bp, Mus musculus
aacattgctgccatcactgaatcgg

SEQ ID NO: 400886 - DNA, 25 bp, Mus musculus
aacattgggtttcgtctgggctgac

SEQ ID NO: 400887 - DNA, 25 bp, Mus musculus
aacatttcccatagccttcacttgg

SEQ ID NO: 400888 - DNA, 25 bp, Mus musculus
aacattttgatgtcgctgtgccagc

SEQ ID NO: 400889 - DNA, 25 bp, Mus musculus
aaccaaaagtcagtgacaacatgac

SEQ ID NO: 400890 - DNA, 25 bp, Mus musculus
aaccaaagcatgaaagacggccgtg

SEQ ID NO: 400891 - DNA, 25 bp, Mus musculus
aaccaacgacgtgaaggaatcccag

SEQ ID NO: 400892 - DNA, 25 bp, Mus musculus
aaccaactaggcgagagacaactgc

SEQ ID NO: 400893 - DNA, 25 bp, Mus musculus
aaccaagaaagcctggctgccagca

SEQ ID NO: 400894 - DNA, 25 bp, Mus musculus
aaccaaggaagaaggctatggaaag

SEQ ID NO: 400895 - DNA, 25 bp, Mus musculus
aaccaaggagttggactgggccaca

SEQ ID NO: 400896 - DNA, 25 bp, Mus musculus
aaccaatgggtagctcgtgggctcc

SEQ ID NO: 400897 - DNA, 25 bp, Mus musculus
aaccaattgctgtccttcaggccag

SEQ ID NO: 400898 - DNA, 25 bp, Mus musculus
aaccacacgacttttgctgccagga

SEQ ID NO: 400899 - DNA, 25 bp, Mus musculus
aaccacacttcacaatcttacaggg

SEQ ID NO: 400900 - DNA, 25 bp, Mus musculus
aaccaccctgggtggaaggcacacg

SEQ ID NO: 400901 - DNA, 25 bp, Mus musculus
aaccaccgtggtcatgctagagaga

SEQ ID NO: 400902 - DNA, 25 bp, Mus musculus
aaccacgggccaagtaagacacagg

SEQ ID NO: 400903 - DNA, 25 bp, Mus musculus
aaccacttctgttcgggtcatggaa

SEQ ID NO: 400904 - DNA, 25 bp, Mus musculus
aaccagaatgaaaggcctacagcag

SEQ ID NO: 400905 - DNA, 25 bp, Mus musculus
aaccagacctggcatgagagcgaga

SEQ ID NO: 400906 - DNA, 25 bp, Mus musculus
aaccagagactgaaagggcggagcc

SEQ ID NO: 400907 - DNA, 25 bp, Mus musculus
aaccagaggctatcacttgggcacc

SEQ ID NO: 400908 - DNA, 25 bp, Mus musculus
aaccagatggtggagcaagagagcc

SEQ ID NO: 400909 - DNA, 25 bp, Mus musculus
aaccagcgtgaagctctaaatcgag

SEQ ID NO: 400910 - DNA, 25 bp, Mus musculus
aaccagctcttgttggtgagcagca

SEQ ID NO: 400911 - DNA, 25 bp, Mus musculus
aaccagctgaaggtgactcctgggt

SEQ ID NO: 400912 - DNA, 25 bp, Mus musculus
aaccagcttccggaggagttcagca

SEQ ID NO: 400913 - DNA, 25 bp, Mus musculus
aaccaggaccccttgctggaggaca

SEQ ID NO: 400914 - DNA, 25 bp, Mus musculus
aaccaggcaacaaccagaagccaga

SEQ ID NO: 400915 - DNA, 25 bp, Mus musculus
aaccaggcgtttcaaggcctccctg

SEQ ID NO: 400916 - DNA, 25 bp, Mus musculus
aaccagggggaatgtctagaaggct

SEQ ID NO: 400917 - DNA, 25 bp, Mus musculus
aaccagggtgcggtagcatattctt

SEQ ID NO: 400918 - DNA, 25 bp, Mus musculus
aaccagtcatgtccacctcagtggg

SEQ ID NO: 400919 - DNA, 25 bp, Mus musculus
aaccagtgctaaagacgtctcacat

SEQ ID NO: 400920 - DNA, 25 bp, Mus musculus
aaccagttttgcctctattgagcga

SEQ ID NO: 400921 - DNA, 25 bp, Mus musculus
aaccatcacagtgggtgtgtcccca

SEQ ID NO: 400922 - DNA, 25 bp, Mus musculus
aaccatcagatggagggcctggcct

SEQ ID NO: 400923 - DNA, 25 bp, Mus musculus
aaccatccatcctgagtggcatggg

SEQ ID NO: 400924 - DNA, 25 bp, Mus musculus
aaccatcgagaggagcatcgctgtg

SEQ ID NO: 400925 - DNA, 25 bp, Mus musculus
aaccatcgaggtgtctgttccagga

SEQ ID NO: 400926 - DNA, 25 bp, Mus musculus
aaccatgcagttccagagggacgtc

SEQ ID NO: 400927 - DNA, 25 bp, Mus musculus
aaccatgcgcaaccatttactgagc

SEQ ID NO: 400928 - DNA, 25 bp, Mus musculus
aaccatggtgcgcactgagggtcca

SEQ ID NO: 400929 - DNA, 25 bp, Mus musculus
aaccatgtcctgtgagtcttgcctg

SEQ ID NO: 400930 - DNA, 25 bp, Mus musculus
aaccatgtgtccctctgtcaggaga

SEQ ID NO: 400931 - DNA, 25 bp, Mus musculus
aaccatgtgtgggtcggcactgaga

SEQ ID NO: 400932 - DNA, 25 bp, Mus musculus
aaccattcaggagaaagccatgttc

SEQ ID NO: 400933 - DNA, 25 bp, Mus musculus
aaccattttatttcagccaaagatg

SEQ ID NO: 400934 - DNA, 25 bp, Mus musculus
aacccaagaagatggccagtctcgg

SEQ ID NO: 400935 - DNA, 25 bp, Mus musculus
aacccaagggtactgagccagcagt

SEQ ID NO: 400936 - DNA, 25 bp, Mus musculus
aacccaagtgtctgtcatggtggca

SEQ ID NO: 400937 - DNA, 25 bp, Mus musculus
aacccacagtcctagtactgtccat

SEQ ID NO: 400938 - DNA, 25 bp, Mus musculus
aacccacccgcaagtcagagctttg

SEQ ID NO: 400939 - DNA, 25 bp, Mus musculus
aacccactgatgagctaaccaagga

SEQ ID NO: 400940 - DNA, 25 bp, Mus musculus
aacccactggtgttttgcttttgag

SEQ ID NO: 400941 - DNA, 25 bp, Mus musculus
aacccactgtggaaataactatgcc

SEQ ID NO: 400942 - DNA, 25 bp, Mus musculus
aacccagaagtacgatggcctccga

SEQ ID NO: 400943 - DNA, 25 bp, Mus musculus
aacccagaagttgagaggcagagcc

SEQ ID NO: 400944 - DNA, 25 bp, Mus musculus
aacccagatgacctgcaagaggcca

SEQ ID NO: 400945 - DNA, 25 bp, Mus musculus
aacccagctgacagcatagagggcc

SEQ ID NO: 400946 - DNA, 25 bp, Mus musculus
aacccagctgcctggtggaatcgca

SEQ ID NO: 400947 - DNA, 25 bp, Mus musculus
aacccaggcgtttgccgcggcggat

SEQ ID NO: 400948 - DNA, 25 bp, Mus musculus
aacccagggcttgctagccagatcg

SEQ ID NO: 400949 - DNA, 25 bp, Mus musculus
aacccagggctttgatgcagtctct

SEQ ID NO: 400950 - DNA, 25 bp, Mus musculus
aacccagtcgggagctagtgggctc

SEQ ID NO: 400951 - DNA, 25 bp, Mus musculus
aacccagtgctcttagcaccgaagt

SEQ ID NO: 400952 - DNA, 25 bp, Mus musculus
aacccatcccggtgctactgtggaa

SEQ ID NO: 400953 - DNA, 25 bp, Mus musculus
aacccatgcctgttagggaagcaaa

SEQ ID NO: 400954 - DNA, 25 bp, Mus musculus
aacccatgtttgtcttgtggccttg

SEQ ID NO: 400955 - DNA, 25 bp, Mus musculus
aaccccaaaggtactgcggcattgc

SEQ ID NO: 400956 - DNA, 25 bp, Mus musculus
aaccccactgtggtgctgactgaca

SEQ ID NO: 400957 - DNA, 25 bp, Mus musculus
aaccccagctctcattcaagaggaa

SEQ ID NO: 400958 - DNA, 25 bp, Mus musculus
aaccccatggtcaatgctggtgcca

SEQ ID NO: 400959 - DNA, 25 bp, Mus musculus
aaccccgtggatctgaggctagcga

SEQ ID NO: 400960 - DNA, 25 bp, Mus musculus
aacccgaggcttcgtctcggactcg

SEQ ID NO: 400961 - DNA, 25 bp, Mus musculus
aacccgagtgctttcctttgacgag

SEQ ID NO: 400962 - DNA, 25 bp, Mus musculus
aacccgcggcatgcacagtgtgatg

SEQ ID NO: 400963 - DNA, 25 bp, Mus musculus
aacccgctgctctacacgtggagga

SEQ ID NO: 400964 - DNA, 25 bp, Mus musculus
aacccggccgctgattcttttgaca

SEQ ID NO: 400965 - DNA, 25 bp, Mus musculus
aacccgtcgggctgagtatgaaact

SEQ ID NO: 400966 - DNA, 25 bp, Mus musculus
aacccgttcatttaagtattcagca

SEQ ID NO: 400967 - DNA, 25 bp, Mus musculus
aaccctatgccaactgggccttggg

SEQ ID NO: 400968 - DNA, 25 bp, Mus musculus
aaccctctggatggttcagtgctga

SEQ ID NO: 400969 - DNA, 25 bp, Mus musculus
aaccctcttgcctcaaagctgtgcg

SEQ ID NO: 400970 - DNA, 25 bp, Mus musculus
aaccctgaccttggagacagtgcct

SEQ ID NO: 400971 - DNA, 25 bp, Mus musculus
aaccctgagctttgcatatttttgc

SEQ ID NO: 400972 - DNA, 25 bp, Mus musculus
aaccctgatctcttgagtttttaga

SEQ ID NO: 400973 - DNA, 25 bp, Mus musculus
aaccctgccgctggagattcaagga

SEQ ID NO: 400974 - DNA, 25 bp, Mus musculus
aaccctggagtcgaagaacatctgc

SEQ ID NO: 400975 - DNA, 25 bp, Mus musculus
aaccctgtcacacttatccagtggg

SEQ ID NO: 400976 - DNA, 25 bp, Mus musculus
aaccctgtccagaggattcctgact

SEQ ID NO: 400977 - DNA, 25 bp, Mus musculus
aaccctgtgtttgtggaatgctaga

SEQ ID NO: 400978 - DNA, 25 bp, Mus musculus
aacccttgccggcatggatatggcc

SEQ ID NO: 400979 - DNA, 25 bp, Mus musculus
aaccgaagatgtattatgggaagac

SEQ ID NO: 400980 - DNA, 25 bp, Mus musculus
aaccgacgcggattctgggttggct

SEQ ID NO: 400981 - DNA, 25 bp, Mus musculus
aaccgactccagttgctgcagtagc

SEQ ID NO: 400982 - DNA, 25 bp, Mus musculus
aaccgaggtcactgcaattggagcc

SEQ ID NO: 400983 - DNA, 25 bp, Mus musculus
aaccgcagtctgcagcgtccgggta

SEQ ID NO: 400984 - DNA, 25 bp, Mus musculus
aaccgcctatgttcttatagcacag

SEQ ID NO: 400985 - DNA, 25 bp, Mus musculus
aaccgcgggctttgcaatggcaacc

SEQ ID NO: 400986 - DNA, 25 bp, Mus musculus
aaccgcgtagccatccggtggcgca

SEQ ID NO: 400987 - DNA, 25 bp, Mus musculus
aaccggaagcgatcgccttcgggca

SEQ ID NO: 400988 - DNA, 25 bp, Mus musculus
aaccggatgctgcactaaagagctg

SEQ ID NO: 400989 - DNA, 25 bp, Mus musculus
aaccgggaatcagctatcaagggca

SEQ ID NO: 400990 - DNA, 25 bp, Mus musculus
aaccgtatgtggtaccccattgcca

SEQ ID NO: 400991 - DNA, 25 bp, Mus musculus
aaccgtcagctctgttcccagatga

SEQ ID NO: 400992 - DNA, 25 bp, Mus musculus
aaccgtcgggcgctgcaagactttc

SEQ ID NO: 400993 - DNA, 25 bp, Mus musculus
aaccgtctgtaaatgtggagcaccc

SEQ ID NO: 400994 - DNA, 25 bp, Mus musculus
aaccgttgaaatgcataacctgcaa

SEQ ID NO: 400995 - DNA, 25 bp, Mus musculus
aaccgtttgagagacatgagtgccc

SEQ ID NO: 400996 - DNA, 25 bp, Mus musculus
aacctaagcagacgcacgagcacag

SEQ ID NO: 400997 - DNA, 25 bp, Mus musculus
aacctaagcttccaggtatccagcc

SEQ ID NO: 400998 - DNA, 25 bp, Mus musculus
aacctaccactcacagcatggtcta

SEQ ID NO: 400999 - DNA, 25 bp, Mus musculus
aacctactccatctgcgcaaggtgc

SEQ ID NO: 401000 - DNA, 25 bp, Mus musculus
aacctagtgtggctgaatggcatgc

SEQ ID NO: 401001 - DNA, 25 bp, Mus musculus
aacctataatgtgtggacccattac

SEQ ID NO: 401002 - DNA, 25 bp, Mus musculus
aacctcatcaagatctgggcctgga

SEQ ID NO: 401003 - DNA, 25 bp, Mus musculus
aacctccaagtgagacttgtgcctg

SEQ ID NO: 401004 - DNA, 25 bp, Mus musculus
aacctccaggtctgcgtgggcagtc

SEQ ID NO: 401005 - DNA, 25 bp, Mus musculus
aacctccatacgacccacgggatgg

SEQ ID NO: 401006 - DNA, 25 bp, Mus musculus
aacctcccatgtctggcaaggcgga

SEQ ID NO: 401007 - DNA, 25 bp, Mus musculus
aacctccctttcaggcaagggtgct

SEQ ID NO: 401008 - DNA, 25 bp, Mus musculus
aacctcctgctgagagctggactcc

SEQ ID NO: 401009 - DNA, 25 bp, Mus musculus
aacctcgtgttgctacacagaagac

SEQ ID NO: 401010 - DNA, 25 bp, Mus musculus
aacctctatccgagccgcggcgagg

SEQ ID NO: 401011 - DNA, 25 bp, Mus musculus
aacctctgcttttgacgtgctggaa

SEQ ID NO: 401012 - DNA, 25 bp, Mus musculus
aacctctttcgactggactggcgca

SEQ ID NO: 401013 - DNA, 25 bp, Mus musculus
aacctgagggaacccagcggtcttg

SEQ ID NO: 401014 - DNA, 25 bp, Mus musculus
aacctgatcggtgcgctgaagacca

SEQ ID NO: 401015 - DNA, 25 bp, Mus musculus
aacctgattgagtgcaacttggacc

SEQ ID NO: 401016 - DNA, 25 bp, Mus musculus
aacctgcaaatctacggagtcctgg

SEQ ID NO: 401017 - DNA, 25 bp, Mus musculus
aacctgcaccttgaggagacgctgg

SEQ ID NO: 401018 - DNA, 25 bp, Mus musculus
aacctgcacgcgattcgggctctgt

SEQ ID NO: 401019 - DNA, 25 bp, Mus musculus
aacctgcagcagaattgagtcaccc

SEQ ID NO: 401020 - DNA, 25 bp, Mus musculus
aacctgccaggtgggcgctctcaga

SEQ ID NO: 401021 - DNA, 25 bp, Mus musculus
aacctgccatgtagcagcggcttca

SEQ ID NO: 401022 - DNA, 25 bp, Mus musculus
aacctgccctgtttgcaagcctcag

SEQ ID NO: 401023 - DNA, 25 bp, Mus musculus
aacctgcggttttctactgagggca

SEQ ID NO: 401024 - DNA, 25 bp, Mus musculus
aacctgctagcacgtgtggtcggcc

SEQ ID NO: 401025 - DNA, 25 bp, Mus musculus
aacctgctgcggagcaattctagga

SEQ ID NO: 401026 - DNA, 25 bp, Mus musculus
aacctgctgggtcccgcctgcattt

SEQ ID NO: 401027 - DNA, 25 bp, Mus musculus
aacctggaaggcaacgtgtccctga

SEQ ID NO: 401028 - DNA, 25 bp, Mus musculus
aacctggaccatgtatgaaagggcc

SEQ ID NO: 401029 - DNA, 25 bp, Mus musculus
aacctggacgactggatcttagaac

SEQ ID NO: 401030 - DNA, 25 bp, Mus musculus
aacctggagaggactcgaatgcgcc

SEQ ID NO: 401031 - DNA, 25 bp, Mus musculus
aacctggagtcaggccccagtgctg

SEQ ID NO: 401032 - DNA, 25 bp, Mus musculus
aacctggagtcccttggctggctga

SEQ ID NO: 401033 - DNA, 25 bp, Mus musculus
aacctggcggacatcaatgacgtga

SEQ ID NO: 401034 - DNA, 25 bp, Mus musculus
aacctggctggcctacgtgacctga

SEQ ID NO: 401035 - DNA, 25 bp, Mus musculus
aacctgggaggcgacttctggaact

SEQ ID NO: 401036 - DNA, 25 bp, Mus musculus
aacctgggcctgtggagagcatcca

SEQ ID NO: 401037 - DNA, 25 bp, Mus musculus
aacctgggctccttgcagttggaag

SEQ ID NO: 401038 - DNA, 25 bp, Mus musculus
aacctgtatcctcgcaagggccgta

SEQ ID NO: 401039 - DNA, 25 bp, Mus musculus
aacctgtggacagacatgaccctcg

SEQ ID NO: 401040 - DNA, 25 bp, Mus musculus
aaccttacagcactcgcccgtggga

SEQ ID NO: 401041 - DNA, 25 bp, Mus musculus
aaccttacaggtcgttgccagagaa

SEQ ID NO: 401042 - DNA, 25 bp, Mus musculus
aaccttagcacaactctggctcggg

SEQ ID NO: 401043 - DNA, 25 bp, Mus musculus
aaccttccagacaggctacaagacg

SEQ ID NO: 401044 - DNA, 25 bp, Mus musculus
aaccttcgcaagttcctgggaggca

SEQ ID NO: 401045 - DNA, 25 bp, Mus musculus
aaccttctgcagattggcaggctca

SEQ ID NO: 401046 - DNA, 25 bp, Mus musculus
aaccttgttgctgactgagatctcg

SEQ ID NO: 401047 - DNA, 25 bp, Mus musculus
aacctttagctgctgccctaaggga

SEQ ID NO: 401048 - DNA, 25 bp, Mus musculus
aacgaaaagggcacgctgaagagga

SEQ ID NO: 401049 - DNA, 25 bp, Mus musculus
aacgaactctcagtggcggtggtgc

SEQ ID NO: 401050 - DNA, 25 bp, Mus musculus
aacgaatctgaagtgaaccgcggcg

SEQ ID NO: 401051 - DNA, 25 bp, Mus musculus
aacgaattggatttgcagctgagca

SEQ ID NO: 401052 - DNA, 25 bp, Mus musculus
aacgacagtggcgtcatcttccgag

SEQ ID NO: 401053 - DNA, 25 bp, Mus musculus
aacgacgacttcagctggcagcagt

SEQ ID NO: 401054 - DNA, 25 bp, Mus musculus
aacgacggccgcattgactttgatg

SEQ ID NO: 401055 - DNA, 25 bp, Mus musculus
aacgagaagaaaccgctgcaggagc

SEQ ID NO: 401056 - DNA, 25 bp, Mus musculus
aacgagaatgggacctgcagcttgc

SEQ ID NO: 401057 - DNA, 25 bp, Mus musculus
aacgagacgcttcgcttggcaatga

SEQ ID NO: 401058 - DNA, 25 bp, Mus musculus
aacgagatcgttcggcatggacgca

SEQ ID NO: 401059 - DNA, 25 bp, Mus musculus
aacgagcacttggaggtcactgaac

SEQ ID NO: 401060 - DNA, 25 bp, Mus musculus
aacgagggctacgtgaactccgaca

SEQ ID NO: 401061 - DNA, 25 bp, Mus musculus
aacgaggttaccagagcatcttcca

SEQ ID NO: 401062 - DNA, 25 bp, Mus musculus
aacgagtgcggatttgtaaccaggc

SEQ ID NO: 401063 - DNA, 25 bp, Mus musculus
aacgagttcctatgttggtgccagc

SEQ ID NO: 401064 - DNA, 25 bp, Mus musculus
aacgagttgctcgtgttcagtacca

SEQ ID NO: 401065 - DNA, 25 bp, Mus musculus
aacgataatgagctaacatgatgcc

SEQ ID NO: 401066 - DNA, 25 bp, Mus musculus
aacgatatcctcctggttcacagag

SEQ ID NO: 401067 - DNA, 25 bp, Mus musculus
aacgatcccagccatgtgctcaagg

SEQ ID NO: 401068 - DNA, 25 bp, Mus musculus
aacgatgggcctgtgactatagagc

SEQ ID NO: 401069 - DNA, 25 bp, Mus musculus
aacgattcaaagaggtgatctctcc

SEQ ID NO: 401070 - DNA, 25 bp, Mus musculus
aacgcagcccttggagagttctgtc

SEQ ID NO: 401071 - DNA, 25 bp, Mus musculus
aacgcagttccacagttgaaaatga

SEQ ID NO: 401072 - DNA, 25 bp, Mus musculus
aacgcagttccctctcatcctgtgg

SEQ ID NO: 401073 - DNA, 25 bp, Mus musculus
aacgcatctcggtgacagcgacgtg

SEQ ID NO: 401074 - DNA, 25 bp, Mus musculus
aacgcatgcgttaactctccagagg

SEQ ID NO: 401075 - DNA, 25 bp, Mus musculus
aacgccaagcactggattctgtccc

SEQ ID NO: 401076 - DNA, 25 bp, Mus musculus
aacgccacaaatacatgctgctgag

SEQ ID NO: 401077 - DNA, 25 bp, Mus musculus
aacgccaccggcaagctgtgatttg

SEQ ID NO: 401078 - DNA, 25 bp, Mus musculus
aacgccatggtgatacgactctgaa

SEQ ID NO: 401079 - DNA, 25 bp, Mus musculus
aacgcccgaaggagaaccaaggcat

SEQ ID NO: 401080 - DNA, 25 bp, Mus musculus
aacgccgtgtgtgcgcagcctttgc

SEQ ID NO: 401081 - DNA, 25 bp, Mus musculus
aacgccttcgcctagggctacttgg

SEQ ID NO: 401082 - DNA, 25 bp, Mus musculus
aacgccttgtactttgtgcgcgcaa

SEQ ID NO: 401083 - DNA, 25 bp, Mus musculus
aacgcgaagtctgtggtgcgcttgc

SEQ ID NO: 401084 - DNA, 25 bp, Mus musculus
aacgcggcttctggtatgatgttga

SEQ ID NO: 401085 - DNA, 25 bp, Mus musculus
aacgcgtccagtaaggaggagccca

SEQ ID NO: 401086 - DNA, 25 bp, Mus musculus
aacgcgtctctgctccttggatacg

SEQ ID NO: 401087 - DNA, 25 bp, Mus musculus
aacgcgtgcgctctgggtaaactga

SEQ ID NO: 401088 - DNA, 25 bp, Mus musculus
aacgcgttgcatctcgccaggcctg

SEQ ID NO: 401089 - DNA, 25 bp, Mus musculus
aacgctccctagcagggctgagaaa

SEQ ID NO: 401090 - DNA, 25 bp, Mus musculus
aacgctcgcagaaatggtagtacca

SEQ ID NO: 401091 - DNA, 25 bp, Mus musculus
aacgctctggtgtcgcatctgctgg

SEQ ID NO: 401092 - DNA, 25 bp, Mus musculus
aacgctgcatgttctcgtgacagtg

SEQ ID NO: 401093 - DNA, 25 bp, Mus musculus
aacgctgcccagcttggatgctgag

SEQ ID NO: 401094 - DNA, 25 bp, Mus musculus
aacgctgcgccgtctgcaggcgctt

SEQ ID NO: 401095 - DNA, 25 bp, Mus musculus
aacgctgctcttgctggtggcggcc

SEQ ID NO: 401096 - DNA, 25 bp, Mus musculus
aacgctggcctcctttgggactaag

SEQ ID NO: 401097 - DNA, 25 bp, Mus musculus
aacgctgtgcctaagccttgaatga

SEQ ID NO: 401098 - DNA, 25 bp, Mus musculus
aacgcttcagctcacccctgattga

SEQ ID NO: 401099 - DNA, 25 bp, Mus musculus
aacgcttcctggactctcgcttagg

SEQ ID NO: 401100 - DNA, 25 bp, Mus musculus
aacgctttgtgtccagcccagagga

SEQ ID NO: 401101 - DNA, 25 bp, Mus musculus
aacggaaatccgcagaggcgaaggg

SEQ ID NO: 401102 - DNA, 25 bp, Mus musculus
aacggaggttccacaagagaaagag

SEQ ID NO: 401103 - DNA, 25 bp, Mus musculus
aacggataatgacccagttcgcacc

SEQ ID NO: 401104 - DNA, 25 bp, Mus musculus
aacggcaaggctggatctcaaggac

SEQ ID NO: 401105 - DNA, 25 bp, Mus musculus
aacggcaaggtgtggagcgtggcaa

SEQ ID NO: 401106 - DNA, 25 bp, Mus musculus
aacggcacgcgggacgcataattgg

SEQ ID NO: 401107 - DNA, 25 bp, Mus musculus
aacggcattgaggacgagtcacacg

SEQ ID NO: 401108 - DNA, 25 bp, Mus musculus
aacggcggccactcgtacatgggtg

SEQ ID NO: 401109 - DNA, 25 bp, Mus musculus
aacggctgaggaacatcgaacgcat

SEQ ID NO: 401110 - DNA, 25 bp, Mus musculus
aacggcttgggcatcttggcataag

SEQ ID NO: 401111 - DNA, 25 bp, Mus musculus
aacgggaccctgcacctatagcaaa

SEQ ID NO: 401112 - DNA, 25 bp, Mus musculus
aacgggacggatgctgcctttctgg

SEQ ID NO: 401113 - DNA, 25 bp, Mus musculus
aacgggacttccatcgcatgcatca

SEQ ID NO: 401114 - DNA, 25 bp, Mus musculus
aacgggatgaggtacaagctgctgc

SEQ ID NO: 401115 - DNA, 25 bp, Mus musculus
aacgggcatctggtgagctgtgaca

SEQ ID NO: 401116 - DNA, 25 bp, Mus musculus
aacgggtcacccctatggcgtctgg

SEQ ID NO: 401117 - DNA, 25 bp, Mus musculus
aacggtacttactgatggcctggac

SEQ ID NO: 401118 - DNA, 25 bp, Mus musculus
aacggtcacagctcatgatggaggc

SEQ ID NO: 401119 - DNA, 25 bp, Mus musculus
aacggtcacccataagccatgcagc

SEQ ID NO: 401120 - DNA, 25 bp, Mus musculus
aacggtctaaaaagcatctgccgcc

SEQ ID NO: 401121 - DNA, 25 bp, Mus musculus
aacggtggaggtagcccatgagccc

SEQ ID NO: 401122 - DNA, 25 bp, Mus musculus
aacgtaaagggaatggccagctgca

SEQ ID NO: 401123 - DNA, 25 bp, Mus musculus
aacgtactttgacacatctaaattg

SEQ ID NO: 401124 - DNA, 25 bp, Mus musculus
aacgtatggtagaggcacgcctggc

SEQ ID NO: 401125 - DNA, 25 bp, Mus musculus
aacgtcctagatgtggatgagcccc

SEQ ID NO: 401126 - DNA, 25 bp, Mus musculus
aacgtctgcggtgattggtgagcca

SEQ ID NO: 401127 - DNA, 25 bp, Mus musculus
aacgtcttggtgaatgcatctgggc

SEQ ID NO: 401128 - DNA, 25 bp, Mus musculus
aacgtgaccctccaagtggccaatg

SEQ ID NO: 401129 - DNA, 25 bp, Mus musculus
aacgtgagagtgtctaacgggagcc

SEQ ID NO: 401130 - DNA, 25 bp, Mus musculus
aacgtgatcttcagaggcagcgcgc

SEQ ID NO: 401131 - DNA, 25 bp, Mus musculus
aacgtgccagtgagtaagatggcga

SEQ ID NO: 401132 - DNA, 25 bp, Mus musculus
aacgtgcccagttcttctcatgagg

SEQ ID NO: 401133 - DNA, 25 bp, Mus musculus
aacgtgccccatttcttccagaagg

SEQ ID NO: 401134 - DNA, 25 bp, Mus musculus
aacgtgcggagacaggtgcagcatg

SEQ ID NO: 401135 - DNA, 25 bp, Mus musculus
aacgtgctggcctgggatcaggaaa

SEQ ID NO: 401136 - DNA, 25 bp, Mus musculus
aacgtggccacctttccatagttgg

SEQ ID NO: 401137 - DNA, 25 bp, Mus musculus
aacgtgggtcgcttcacagaggaga

SEQ ID NO: 401138 - DNA, 25 bp, Mus musculus
aacgtggtaccccagttagacatgg

SEQ ID NO: 401139 - DNA, 25 bp, Mus musculus
aacgtgtacctatttgctgctgctg

SEQ ID NO: 401140 - DNA, 25 bp, Mus musculus
aacgtgtccggataaacttcagcaa

SEQ ID NO: 401141 - DNA, 25 bp, Mus musculus
aacgtgtgctaggtatgcaggtgac

SEQ ID NO: 401142 - DNA, 25 bp, Mus musculus
aacgttagccctgtccttggaggat

SEQ ID NO: 401143 - DNA, 25 bp, Mus musculus
aacgtttgagcagagcacctgggca

SEQ ID NO: 401144 - DNA, 25 bp, Mus musculus
aacgtttgcgcatgttcaaggtcag

SEQ ID NO: 401145 - DNA, 25 bp, Mus musculus
aacgtttggctatactctgctggca

SEQ ID NO: 401146 - DNA, 25 bp, Mus musculus
aactaaaagagtctcagctgccagc

SEQ ID NO: 401147 - DNA, 25 bp, Mus musculus
aactaaactaatgaagcactgcacg

SEQ ID NO: 401148 - DNA, 25 bp, Mus musculus
aactaacagtgtatccccgaggagg

SEQ ID NO: 401149 - DNA, 25 bp, Mus musculus
aactaacggattttgctgcagcgca

SEQ ID NO: 401150 - DNA, 25 bp, Mus musculus
aactaagcagtaccatagccccagg

SEQ ID NO: 401151 - DNA, 25 bp, Mus musculus
aactacaagaccatcggcgtgagcg

SEQ ID NO: 401152 - DNA, 25 bp, Mus musculus
aactacacagctctcaactcaacgg

SEQ ID NO: 401153 - DNA, 25 bp, Mus musculus
aactaccaatgatttctcagaagca

SEQ ID NO: 401154 - DNA, 25 bp, Mus musculus
aactaccagaggatgtggacccaac

SEQ ID NO: 401155 - DNA, 25 bp, Mus musculus
aactaccatcggacctgtcctggga

SEQ ID NO: 401156 - DNA, 25 bp, Mus musculus
aactacccatgtctccctaggtctt

SEQ ID NO: 401157 - DNA, 25 bp, Mus musculus
aactaccgctactacctggaggaga

SEQ ID NO: 401158 - DNA, 25 bp, Mus musculus
aactacctcgtgtttgcaacaagcc

SEQ ID NO: 401159 - DNA, 25 bp, Mus musculus
aactacctgcaggaagccggccatg

SEQ ID NO: 401160 - DNA, 25 bp, Mus musculus
aactacctgcttgacctggagagag

SEQ ID NO: 401161 - DNA, 25 bp, Mus musculus
aactacgtaagcctggtgaagccca

SEQ ID NO: 401162 - DNA, 25 bp, Mus musculus
aactactggccattggtaagacccg

SEQ ID NO: 401163 - DNA, 25 bp, Mus musculus
aactacttggatgtggcattctgca

SEQ ID NO: 401164 - DNA, 25 bp, Mus musculus
aactactttgagagcacggatggcc

SEQ ID NO: 401165 - DNA, 25 bp, Mus musculus
aactagaacccaacctgtttgctga

SEQ ID NO: 401166 - DNA, 25 bp, Mus musculus
aactagagcgagaaacagagcttcg

SEQ ID NO: 401167 - DNA, 25 bp, Mus musculus
aactagatcggcttcgcggactaca

SEQ ID NO: 401168 - DNA, 25 bp, Mus musculus
aactagcagtgtgtcctgaggccca

SEQ ID NO: 401169 - DNA, 25 bp, Mus musculus
aactagcttggctggtctggatcag

SEQ ID NO: 401170 - DNA, 25 bp, Mus musculus
aactaggatgcctcagatagggaac

SEQ ID NO: 401171 - DNA, 25 bp, Mus musculus
aactaggctatgagggaggcttacc

SEQ ID NO: 401172 - DNA, 25 bp, Mus musculus
aactagggtgtttgttgcttgccaa

SEQ ID NO: 401173 - DNA, 25 bp, Mus musculus
aactagtgaggctggagtctgagaa

SEQ ID NO: 401174 - DNA, 25 bp, Mus musculus
aactagtggaagactatagggtcac

SEQ ID NO: 401175 - DNA, 25 bp, Mus musculus
aactatatcaagtcgctgaccgcca

SEQ ID NO: 401176 - DNA, 25 bp, Mus musculus
aactatcagatgcaggtctcccgtc

SEQ ID NO: 401177 - DNA, 25 bp, Mus musculus
aactatcctttcaaaagtcaggcag

SEQ ID NO: 401178 - DNA, 25 bp, Mus musculus
aactatctaatcagtctgtgcctgg

SEQ ID NO: 401179 - DNA, 25 bp, Mus musculus
aactatgaactagctgtggccctct

SEQ ID NO: 401180 - DNA, 25 bp, Mus musculus
aactatggagtcaaatctgtgggcc

SEQ ID NO: 401181 - DNA, 25 bp, Mus musculus
aactatttcgatagctgctgcctgg

SEQ ID NO: 401182 - DNA, 25 bp, Mus musculus
aactatttgacgatgacgattcagg

SEQ ID NO: 401183 - DNA, 25 bp, Mus musculus
aactcaacctaggacttctgcaaga

SEQ ID NO: 401184 - DNA, 25 bp, Mus musculus
aactcaagatatgtgtcgataggac

SEQ ID NO: 401185 - DNA, 25 bp, Mus musculus
aactcacaacttactctgcaccaga

SEQ ID NO: 401186 - DNA, 25 bp, Mus musculus
aactcactctgtacagaccctggtt

SEQ ID NO: 401187 - DNA, 25 bp, Mus musculus
aactcactgtgcatcatagaattca

SEQ ID NO: 401188 - DNA, 25 bp, Mus musculus
aactcagagccctcacacagggaga

SEQ ID NO: 401189 - DNA, 25 bp, Mus musculus
aactcagattggtctggcagtggca

SEQ ID NO: 401190 - DNA, 25 bp, Mus musculus
aactcaggatttttagtctttccag

SEQ ID NO: 401191 - DNA, 25 bp, Mus musculus
aactcaggcttgatctgttcgggca

SEQ ID NO: 401192 - DNA, 25 bp, Mus musculus
aactcaggtcatgaggcttgccgac

SEQ ID NO: 401193 - DNA, 25 bp, Mus musculus
aactcaggtctcttggtggaaaggc

SEQ ID NO: 401194 - DNA, 25 bp, Mus musculus
aactcagtgcaggtcatcttaggca

SEQ ID NO: 401195 - DNA, 25 bp, Mus musculus
aactcataatacctcagtggcggac

SEQ ID NO: 401196 - DNA, 25 bp, Mus musculus
aactcatactgagaagtccgtgctc

SEQ ID NO: 401197 - DNA, 25 bp, Mus musculus
aactcattactttctcctggtgatg

SEQ ID NO: 401198 - DNA, 25 bp, Mus musculus
aactcattcttagcaagagcagcag

SEQ ID NO: 401199 - DNA, 25 bp, Mus musculus
aactcattgaagaacgccggagcca

SEQ ID NO: 401200 - DNA, 25 bp, Mus musculus
aactcattgttttcaggtaatggaa

SEQ ID NO: 401201 - DNA, 25 bp, Mus musculus
aactccaggcggaggaggatcttgc

SEQ ID NO: 401202 - DNA, 25 bp, Mus musculus
aactccatcattggcgacgggccga

SEQ ID NO: 401203 - DNA, 25 bp, Mus musculus
aactccatccacacctggagggtgg

SEQ ID NO: 401204 - DNA, 25 bp, Mus musculus
aactccatctcatctgcgggggacc

SEQ ID NO: 401205 - DNA, 25 bp, Mus musculus
aactccgtcaccaagtgtgaaggca

SEQ ID NO: 401206 - DNA, 25 bp, Mus musculus
aactcctaagagctccgggatgggc

SEQ ID NO: 401207 - DNA, 25 bp, Mus musculus
aactcctggaagaccttaggtggat

SEQ ID NO: 401208 - DNA, 25 bp, Mus musculus
aactcctggaagtgatgagctggca

SEQ ID NO: 401209 - DNA, 25 bp, Mus musculus
aactcctgggcatgcatctgaatga

SEQ ID NO: 401210 - DNA, 25 bp, Mus musculus
aactcctttgtacgctagaacctgg

SEQ ID NO: 401211 - DNA, 25 bp, Mus musculus
aactcgaagaccagtgctgaggccc

SEQ ID NO: 401212 - DNA, 25 bp, Mus musculus
aactcgattgccaccgagagaggcc

SEQ ID NO: 401213 - DNA, 25 bp, Mus musculus
aactcgcagagggaagcaagtgacc

SEQ ID NO: 401214 - DNA, 25 bp, Mus musculus
aactcgcatcactggaagatgctga

SEQ ID NO: 401215 - DNA, 25 bp, Mus musculus
aactcgcttgaactcagtacagaag

SEQ ID NO: 401216 - DNA, 25 bp, Mus musculus
aactcggacttatgtgatgctggcc

SEQ ID NO: 401217 - DNA, 25 bp, Mus musculus
aactcggccaaaagcaggtgattcc

SEQ ID NO: 401218 - DNA, 25 bp, Mus musculus
aactcgggatgatgagaggcctcac

SEQ ID NO: 401219 - DNA, 25 bp, Mus musculus
aactcgggatgggagatactattga

SEQ ID NO: 401220 - DNA, 25 bp, Mus musculus
aactcggtatatcagcacggagctg

SEQ ID NO: 401221 - DNA, 25 bp, Mus musculus
aactcggtgctgttcatgtgttacg

SEQ ID NO: 401222 - DNA, 25 bp, Mus musculus
aactcgtaagattgccaagttgctg

SEQ ID NO: 401223 - DNA, 25 bp, Mus musculus
aactcgtgaatgaaaagggatccca

SEQ ID NO: 401224 - DNA, 25 bp, Mus musculus
aactcgtgggtgacacttctagaga

SEQ ID NO: 401225 - DNA, 25 bp, Mus musculus
aactctatgaggtacagggtgggcc

SEQ ID NO: 401226 - DNA, 25 bp, Mus musculus
aactctcagggctacatgagcgcgt

SEQ ID NO: 401227 - DNA, 25 bp, Mus musculus
aactctcgcgcctggcaagctcgag

SEQ ID NO: 401228 - DNA, 25 bp, Mus musculus
aactctgagagcttgctggagcccc

SEQ ID NO: 401229 - DNA, 25 bp, Mus musculus
aactctgcaggagtattggcgctcc

SEQ ID NO: 401230 - DNA, 25 bp, Mus musculus
aactctgcatcaactacttaggagg

SEQ ID NO: 401231 - DNA, 25 bp, Mus musculus
aactctgccttgtgggtgggtgtca

SEQ ID NO: 401232 - DNA, 25 bp, Mus musculus
aactctgcgtgaagtgtttaccact

SEQ ID NO: 401233 - DNA, 25 bp, Mus musculus
aactctggactgctcacattacacg

SEQ ID NO: 401234 - DNA, 25 bp, Mus musculus
aactctggagaagatccgtcctgtg

SEQ ID NO: 401235 - DNA, 25 bp, Mus musculus
aactctgggaaatgaactgcctgcc

SEQ ID NO: 401236 - DNA, 25 bp, Mus musculus
aactctgggactgagggcgtatgcc

SEQ ID NO: 401237 - DNA, 25 bp, Mus musculus
aactctgggccaacaagggagggct

SEQ ID NO: 401238 - DNA, 25 bp, Mus musculus
aactctgtccggcagcctcgggcct

SEQ ID NO: 401239 - DNA, 25 bp, Mus musculus
aactctgtggccatgcgcatcgtga

SEQ ID NO: 401240 - DNA, 25 bp, Mus musculus
aactcttacacgcattcacgaccgg

SEQ ID NO: 401241 - DNA, 25 bp, Mus musculus
aactcttagtcccagccagcagtcg

SEQ ID NO: 401242 - DNA, 25 bp, Mus musculus
aactcttcactcaatccgtccttgg

SEQ ID NO: 401243 - DNA, 25 bp, Mus musculus
aactcttttagaggcagtgtggcta

SEQ ID NO: 401244 - DNA, 25 bp, Mus musculus
aactgaaaaccctcctggcaattgg

SEQ ID NO: 401245 - DNA, 25 bp, Mus musculus
aactgaaatgtttagatcttagagc

SEQ ID NO: 401246 - DNA, 25 bp, Mus musculus
aactgaacaaggacccacacatggg

SEQ ID NO: 401247 - DNA, 25 bp, Mus musculus
aactgaactccagtctggaaacagc

SEQ ID NO: 401248 - DNA, 25 bp, Mus musculus
aactgaagcctaaggagtcggtgct

SEQ ID NO: 401249 - DNA, 25 bp, Mus musculus
aactgacaacgtggtccttggccaa

SEQ ID NO: 401250 - DNA, 25 bp, Mus musculus
aactgacaatgccaacgtgctgctg

SEQ ID NO: 401251 - DNA, 25 bp, Mus musculus
aactgacaggatgtggccgtggcca

SEQ ID NO: 401252 - DNA, 25 bp, Mus musculus
aactgagatttcagcccggcagcct

SEQ ID NO: 401253 - DNA, 25 bp, Mus musculus
aactgaggaagtatattcagctggc

SEQ ID NO: 401254 - DNA, 25 bp, Mus musculus
aactgaggcccacatttgagatggc

SEQ ID NO: 401255 - DNA, 25 bp, Mus musculus
aactgagttatatggagcaagctcc

SEQ ID NO: 401256 - DNA, 25 bp, Mus musculus
aactgatccctgtattgcctatgac

SEQ ID NO: 401257 - DNA, 25 bp, Mus musculus
aactgatctatcatgcgattgctaa

SEQ ID NO: 401258 - DNA, 25 bp, Mus musculus
aactgatgacagcagaacgcaggcc

SEQ ID NO: 401259 - DNA, 25 bp, Mus musculus
aactgatttctctgaaagccttcag

SEQ ID NO: 401260 - DNA, 25 bp, Mus musculus
aactgcaagtggaggtatcgagaac

SEQ ID NO: 401261 - DNA, 25 bp, Mus musculus
aactgcacgtggtgttcatgtgaca

SEQ ID NO: 401262 - DNA, 25 bp, Mus musculus
aactgcagagattgggcgagacgtc

SEQ ID NO: 401263 - DNA, 25 bp, Mus musculus
aactgcagcaagaccgtgagtccag

SEQ ID NO: 401264 - DNA, 25 bp, Mus musculus
aactgcagtgctctttcactgaagg

SEQ ID NO: 401265 - DNA, 25 bp, Mus musculus
aactgcatggaggacgagaccgtca

SEQ ID NO: 401266 - DNA, 25 bp, Mus musculus
aactgcatttgcttaatcacggtag

SEQ ID NO: 401267 - DNA, 25 bp, Mus musculus
aactgccctgagactcctaatgcca

SEQ ID NO: 401268 - DNA, 25 bp, Mus musculus
aactgcctgtattagattaggtacc

SEQ ID NO: 401269 - DNA, 25 bp, Mus musculus
aactgccttctcctgtcaggccggg

SEQ ID NO: 401270 - DNA, 25 bp, Mus musculus
aactgcgcctgttggttagagctgc

SEQ ID NO: 401271 - DNA, 25 bp, Mus musculus
aactgcgcggcgttatacaaatggg

SEQ ID NO: 401272 - DNA, 25 bp, Mus musculus
aactgcggaggaagcacaaggacct

SEQ ID NO: 401273 - DNA, 25 bp, Mus musculus
aactgcgggagtggcttgagacaac

SEQ ID NO: 401274 - DNA, 25 bp, Mus musculus
aactgcgtaaccttcaggagctcgg

SEQ ID NO: 401275 - DNA, 25 bp, Mus musculus
aactgcgtctgaatgtcgatgaggc

SEQ ID NO: 401276 - DNA, 25 bp, Mus musculus
aactgctctaggctctgagcttgca

SEQ ID NO: 401277 - DNA, 25 bp, Mus musculus
aactgctctatctgctaccactggg

SEQ ID NO: 401278 - DNA, 25 bp, Mus musculus
aactgctgacctgggcatcttggaa

SEQ ID NO: 401279 - DNA, 25 bp, Mus musculus
aactgctgcctgaacacatttcgga

SEQ ID NO: 401280 - DNA, 25 bp, Mus musculus
aactgctgctagatgttggcctcca

SEQ ID NO: 401281 - DNA, 25 bp, Mus musculus
aactgctggccgtatgaccttgaca

SEQ ID NO: 401282 - DNA, 25 bp, Mus musculus
aactgctgtcagtagtgatccagcc

SEQ ID NO: 401283 - DNA, 25 bp, Mus musculus
aactgctgtgcctgtcactgtaaca

SEQ ID NO: 401284 - DNA, 25 bp, Mus musculus
aactgcttgggcatcgtaaccaaat

SEQ ID NO: 401285 - DNA, 25 bp, Mus musculus
aactggaaacttagtgatggacgtc

SEQ ID NO: 401286 - DNA, 25 bp, Mus musculus
aactggaacagcgaagacaccgtac

SEQ ID NO: 401287 - DNA, 25 bp, Mus musculus
aactggaagattgcttctttacggc

SEQ ID NO: 401288 - DNA, 25 bp, Mus musculus
aactggaagcggttttgttcctctg

SEQ ID NO: 401289 - DNA, 25 bp, Mus musculus
aactggaagtgctaaaggacgagct

SEQ ID NO: 401290 - DNA, 25 bp, Mus musculus
aactggacaaggtgccgtttgccgg

SEQ ID NO: 401291 - DNA, 25 bp, Mus musculus
aactggaccccgagaggatgggctc

SEQ ID NO: 401292 - DNA, 25 bp, Mus musculus
aactggagaggagaaaatcggagaa

SEQ ID NO: 401293 - DNA, 25 bp, Mus musculus
aactggagtaggtcgtgtacttgga

SEQ ID NO: 401294 - DNA, 25 bp, Mus musculus
aactggagttaacatgatttggagc

SEQ ID NO: 401295 - DNA, 25 bp, Mus musculus
aactggagtttttaccctaatgcag

SEQ ID NO: 401296 - DNA, 25 bp, Mus musculus
aactggatcagcgtctctttagccg

SEQ ID NO: 401297 - DNA, 25 bp, Mus musculus
aactggatgctcagtgtcgctggca

SEQ ID NO: 401298 - DNA, 25 bp, Mus musculus
aactggattatcgtgcacatggagg

SEQ ID NO: 401299 - DNA, 25 bp, Mus musculus
aactggatttggagaccttggcacc

SEQ ID NO: 401300 - DNA, 25 bp, Mus musculus
aactggcaggactttctcaaggaca

SEQ ID NO: 401301 - DNA, 25 bp, Mus musculus
aactggcctcggtgtcaagggagcc

SEQ ID NO: 401302 - DNA, 25 bp, Mus musculus
aactggcgtcggaatgacaaggctc

SEQ ID NO: 401303 - DNA, 25 bp, Mus musculus
aactggctccttagctgggtctgca

SEQ ID NO: 401304 - DNA, 25 bp, Mus musculus
aactggcttccagaatgactctaac

SEQ ID NO: 401305 - DNA, 25 bp, Mus musculus
aactgggacttctccagcctcagcg

SEQ ID NO: 401306 - DNA, 25 bp, Mus musculus
aactgggagctctataatcaagggc

SEQ ID NO: 401307 - DNA, 25 bp, Mus musculus
aactgggatcgctatcaagatactg

SEQ ID NO: 401308 - DNA, 25 bp, Mus musculus
aactgggcatccgaccttgtgacat

SEQ ID NO: 401309 - DNA, 25 bp, Mus musculus
aactgggccaagagttgcttgtcgc

SEQ ID NO: 401310 - DNA, 25 bp, Mus musculus
aactgggccactgggtgacgacgcc

SEQ ID NO: 401311 - DNA, 25 bp, Mus musculus
aactggtagagagcagcctggccaa

SEQ ID NO: 401312 - DNA, 25 bp, Mus musculus
aactggtattgaagggaggcccata

SEQ ID NO: 401313 - DNA, 25 bp, Mus musculus
aactggtgcacatgattggctgggc

SEQ ID NO: 401314 - DNA, 25 bp, Mus musculus
aactggtgcttctgtggacttggcc

SEQ ID NO: 401315 - DNA, 25 bp, Mus musculus
aactggttgttctgggcatcgctgc

SEQ ID NO: 401316 - DNA, 25 bp, Mus musculus
aactgtacatagaccgaggtgggca

SEQ ID NO: 401317 - DNA, 25 bp, Mus musculus
aactgtcaataagtgaggtgggtac

SEQ ID NO: 401318 - DNA, 25 bp, Mus musculus
aactgtcaggatcggcacttagtgg

SEQ ID NO: 401319 - DNA, 25 bp, Mus musculus
aactgtcttggtaggtaaccttcag

SEQ ID NO: 401320 - DNA, 25 bp, Mus musculus
aactgtgacatctactcctcggtgg

SEQ ID NO: 401321 - DNA, 25 bp, Mus musculus
aactgtgacattcccgcatcgctgg

SEQ ID NO: 401322 - DNA, 25 bp, Mus musculus
aactgtgaggtgaggcagagtggcc

SEQ ID NO: 401323 - DNA, 25 bp, Mus musculus
aactgtgaggttggaatgcttcgcc

SEQ ID NO: 401324 - DNA, 25 bp, Mus musculus
aactgtgcagacattggtgtcctaa

SEQ ID NO: 401325 - DNA, 25 bp, Mus musculus
aactgtgcataagtcagcggagggc

SEQ ID NO: 401326 - DNA, 25 bp, Mus musculus
aactgtgcggtcatgcacaacctgc

SEQ ID NO: 401327 - DNA, 25 bp, Mus musculus
aactgtggccgtgatccaggtggcc

SEQ ID NO: 401328 - DNA, 25 bp, Mus musculus
aactgtggccttaagctaattgctc

SEQ ID NO: 401329 - DNA, 25 bp, Mus musculus
aactgtgggtgctaccagaggaacc

SEQ ID NO: 401330 - DNA, 25 bp, Mus musculus
aactgtgtaaaactctcgcctggaa

SEQ ID NO: 401331 - DNA, 25 bp, Mus musculus
aactgtgtcacggagctggcttccc

SEQ ID NO: 401332 - DNA, 25 bp, Mus musculus
aactgtgtgctagcgggcgcaggta

SEQ ID NO: 401333 - DNA, 25 bp, Mus musculus
aactgtgtgggtgaacgcaaccacc

SEQ ID NO: 401334 - DNA, 25 bp, Mus musculus
aactgttatgtttcgaggcccacgg

SEQ ID NO: 401335 - DNA, 25 bp, Mus musculus
aactgttcgccggagacattgtgat

SEQ ID NO: 401336 - DNA, 25 bp, Mus musculus
aactgttggtgcgtgcaagcctcac

SEQ ID NO: 401337 - DNA, 25 bp, Mus musculus
aactgtttccacagcggttcccgcg

SEQ ID NO: 401338 - DNA, 25 bp, Mus musculus
aactgtttctacatttctcctggag

SEQ ID NO: 401339 - DNA, 25 bp, Mus musculus
aactgtttgcgctgacacccatgga

SEQ ID NO: 401340 - DNA, 25 bp, Mus musculus
aactgtttggtcagtgagcactcgc

SEQ ID NO: 401341 - DNA, 25 bp, Mus musculus
aacttaaaactcacatgcctcagca

SEQ ID NO: 401342 - DNA, 25 bp, Mus musculus
aacttaaacggaaagatgtgccagc

SEQ ID NO: 401343 - DNA, 25 bp, Mus musculus
aacttaagaatgagcaagtctccct

SEQ ID NO: 401344 - DNA, 25 bp, Mus musculus
aacttaatgtggaagcgctacctgg

SEQ ID NO: 401345 - DNA, 25 bp, Mus musculus
aacttacggaagcacccacgatgga

SEQ ID NO: 401346 - DNA, 25 bp, Mus musculus
aacttagaaatggttgcctctgctg

SEQ ID NO: 401347 - DNA, 25 bp, Mus musculus
aacttagactctgaccaaggccttg

SEQ ID NO: 401348 - DNA, 25 bp, Mus musculus
aacttagatctaacggtggtaggat

SEQ ID NO: 401349 - DNA, 25 bp, Mus musculus
aacttcaacatctgcctggagcggg

SEQ ID NO: 401350 - DNA, 25 bp, Mus musculus
aacttcagacggtggaaggccagcc

SEQ ID NO: 401351 - DNA, 25 bp, Mus musculus
aacttcagctggaactgggtggccg

SEQ ID NO: 401352 - DNA, 25 bp, Mus musculus
aacttccaggagtatgtcgccttcc

SEQ ID NO: 401353 - DNA, 25 bp, Mus musculus
aacttccagggcaagcgatgcgagc

SEQ ID NO: 401354 - DNA, 25 bp, Mus musculus
aacttcccatcaggctcagagcagg

SEQ ID NO: 401355 - DNA, 25 bp, Mus musculus
aacttcccgacaaatggcagcacga

SEQ ID NO: 401356 - DNA, 25 bp, Mus musculus
aacttcccgtacagcaatggtgccg

SEQ ID NO: 401357 - DNA, 25 bp, Mus musculus
aacttcctacagaataccgcgcggg

SEQ ID NO: 401358 - DNA, 25 bp, Mus musculus
aacttcgagggcaaggtaccaatga

SEQ ID NO: 401359 - DNA, 25 bp, Mus musculus
aacttcgtgggcttccgcatgtaca

SEQ ID NO: 401360 - DNA, 25 bp, Mus musculus
aacttcgtgtccagaagcgcaggca

SEQ ID NO: 401361 - DNA, 25 bp, Mus musculus
aacttcgtgtcgcaagagctcaagg

SEQ ID NO: 401362 - DNA, 25 bp, Mus musculus
aacttctcatgctcagaggaggcga

SEQ ID NO: 401363 - DNA, 25 bp, Mus musculus
aacttctcccctgaggagggcggca

SEQ ID NO: 401364 - DNA, 25 bp, Mus musculus
aacttctcctggtctcaaatatttg

SEQ ID NO: 401365 - DNA, 25 bp, Mus musculus
aacttctggttctccactgtccaca

SEQ ID NO: 401366 - DNA, 25 bp, Mus musculus
aacttctttcatccttcagctgaag

SEQ ID NO: 401367 - DNA, 25 bp, Mus musculus
aacttctttcgaggcgggaggcgct

SEQ ID NO: 401368 - DNA, 25 bp, Mus musculus
aacttgaaagataagaaggccctgc

SEQ ID NO: 401369 - DNA, 25 bp, Mus musculus
aacttgaaagcatcctgttgatact

SEQ ID NO: 401370 - DNA, 25 bp, Mus musculus
aacttgaaatctagagagagcctgc

SEQ ID NO: 401371 - DNA, 25 bp, Mus musculus
aacttgagccatctcagtgctgccg

SEQ ID NO: 401372 - DNA, 25 bp, Mus musculus
aacttgataggtcgctctccgcctg

SEQ ID NO: 401373 - DNA, 25 bp, Mus musculus
aacttgatctccttatccccttagg

SEQ ID NO: 401374 - DNA, 25 bp, Mus musculus
aacttgcaagaacatccataacctg

SEQ ID NO: 401375 - DNA, 25 bp, Mus musculus
aacttgcagcaagtgagggtgccca

SEQ ID NO: 401376 - DNA, 25 bp, Mus musculus
aacttgccaaatgccgaggtggacc

SEQ ID NO: 401377 - DNA, 25 bp, Mus musculus
aacttgccagcactgcttggagtca

SEQ ID NO: 401378 - DNA, 25 bp, Mus musculus
aacttgcggacgaacttgcggagcc

SEQ ID NO: 401379 - DNA, 25 bp, Mus musculus
aacttgcgggagtcaggtctctctt

SEQ ID NO: 401380 - DNA, 25 bp, Mus musculus
aacttgctatttaacagaggatgcc

SEQ ID NO: 401381 - DNA, 25 bp, Mus musculus
aacttggaagtgtggcgaagcctca

SEQ ID NO: 401382 - DNA, 25 bp, Mus musculus
aacttggatctggagtatagtacaa

SEQ ID NO: 401383 - DNA, 25 bp, Mus musculus
aacttggccttcatgtactgttcaa

SEQ ID NO: 401384 - DNA, 25 bp, Mus musculus
aacttggctactccctgccgtgtgt

SEQ ID NO: 401385 - DNA, 25 bp, Mus musculus
aacttgggtactgcgtgtgtgtgcc

SEQ ID NO: 401386 - DNA, 25 bp, Mus musculus
aacttggtatcctttggcggactca

SEQ ID NO: 401387 - DNA, 25 bp, Mus musculus
aacttgtcagatttcacccggcggg

SEQ ID NO: 401388 - DNA, 25 bp, Mus musculus
aacttgtcagtgagatgacccagca

SEQ ID NO: 401389 - DNA, 25 bp, Mus musculus
aacttgtgaacctccggtgtcagcc

SEQ ID NO: 401390 - DNA, 25 bp, Mus musculus
aacttgtgggaactatggatcggcc

SEQ ID NO: 401391 - DNA, 25 bp, Mus musculus
aacttgtgggtctcttgctgctcat

SEQ ID NO: 401392 - DNA, 25 bp, Mus musculus
aacttgttagtcttccgtgtgtcat

SEQ ID NO: 401393 - DNA, 25 bp, Mus musculus
aactttacagaaagtcaggagcggg

SEQ ID NO: 401394 - DNA, 25 bp, Mus musculus
aactttatctttgggtccagtggca

SEQ ID NO: 401395 - DNA, 25 bp, Mus musculus
aactttatgcctccgtgtgtgccca

SEQ ID NO: 401396 - DNA, 25 bp, Mus musculus
aactttatgtgcagccagactggga

SEQ ID NO: 401397 - DNA, 25 bp, Mus musculus
aactttcacagggtgccaatggctg

SEQ ID NO: 401398 - DNA, 25 bp, Mus musculus
aactttcacccggactcggaggctg

SEQ ID NO: 401399 - DNA, 25 bp, Mus musculus
aactttcgctactttctggcccaga

SEQ ID NO: 401400 - DNA, 25 bp, Mus musculus
aactttctacatggaaggccccaca

SEQ ID NO: 401401 - DNA, 25 bp, Mus musculus
aactttctcatcatgggccgcaagg

SEQ ID NO: 401402 - DNA, 25 bp, Mus musculus
aactttgaaagcgtgtcgcccgcca

SEQ ID NO: 401403 - DNA, 25 bp, Mus musculus
aactttgactgctactctggtggcc

SEQ ID NO: 401404 - DNA, 25 bp, Mus musculus
aactttgcatgctaggattggtgag

SEQ ID NO: 401405 - DNA, 25 bp, Mus musculus
aactttgtgcagcttcggtcagacc

SEQ ID NO: 401406 - DNA, 25 bp, Mus musculus
aacttttacaaactctgtgcagctg

SEQ ID NO: 401407 - DNA, 25 bp, Mus musculus
aacttttacaagcagaccatggacc

SEQ ID NO: 401408 - DNA, 25 bp, Mus musculus
aacttttatgtcaatcaggcaggct

SEQ ID NO: 401409 - DNA, 25 bp, Mus musculus
aagaaaacagaaatatcttcctggg

SEQ ID NO: 401410 - DNA, 25 bp, Mus musculus
aagaaaatcgatcacttcccagaag

SEQ ID NO: 401411 - DNA, 25 bp, Mus musculus
aagaaaatgggacacaactcgacag

SEQ ID NO: 401412 - DNA, 25 bp, Mus musculus
aagaaacaatcacttcgctcatggg

SEQ ID NO: 401413 - DNA, 25 bp, Mus musculus
aagaaaccaagcaggcactgggctg

SEQ ID NO: 401414 - DNA, 25 bp, Mus musculus
aagaaacgtgtctgccgctcgtctc

SEQ ID NO: 401415 - DNA, 25 bp, Mus musculus
aagaaagaatatccacgcgtgtacg

SEQ ID NO: 401416 - DNA, 25 bp, Mus musculus
aagaaagactttcacggcttccagc

SEQ ID NO: 401417 - DNA, 25 bp, Mus musculus
aagaaagagccgcagacgctggtca

SEQ ID NO: 401418 - DNA, 25 bp, Mus musculus
aagaaagagcttgttatgagcgggc

SEQ ID NO: 401419 - DNA, 25 bp, Mus musculus
aagaaagcttctagcggcatcccag

SEQ ID NO: 401420 - DNA, 25 bp, Mus musculus
aagaaaggcttctgtctaccccagg

SEQ ID NO: 401421 - DNA, 25 bp, Mus musculus
aagaaagggcctatggactgctacc

SEQ ID NO: 401422 - DNA, 25 bp, Mus musculus
aagaaagggctgattctctccaccc

SEQ ID NO: 401423 - DNA, 25 bp, Mus musculus
aagaaagtcaatggctctcaggcgg

SEQ ID NO: 401424 - DNA, 25 bp, Mus musculus
aagaaagtgtcttggtccggccgag

SEQ ID NO: 401425 - DNA, 25 bp, Mus musculus
aagaaagttcataagggagccgtgc

SEQ ID NO: 401426 - DNA, 25 bp, Mus musculus
aagaaatcgtgtcctgatgcttagt

SEQ ID NO: 401427 - DNA, 25 bp, Mus musculus
aagaaatctgcatacccctgagctg

SEQ ID NO: 401428 - DNA, 25 bp, Mus musculus
aagaaatgtttgcttcctcagggtc

SEQ ID NO: 401429 - DNA, 25 bp, Mus musculus
aagaacaactcttcatagtaaaatc

SEQ ID NO: 401430 - DNA, 25 bp, Mus musculus
aagaacaagagctagcggcactgcg

SEQ ID NO: 401431 - DNA, 25 bp, Mus musculus
aagaacacagtggactctgaaatgg

SEQ ID NO: 401432 - DNA, 25 bp, Mus musculus
aagaacacgtggctcttagtgagca

SEQ ID NO: 401433 - DNA, 25 bp, Mus musculus
aagaacagactttggcttaagagac

SEQ ID NO: 401434 - DNA, 25 bp, Mus musculus
aagaacagtcaagagtcccagggca

SEQ ID NO: 401435 - DNA, 25 bp, Mus musculus
aagaacattcgagagcagggccgct

SEQ ID NO: 401436 - DNA, 25 bp, Mus musculus
aagaaccaagtacgtccaccaggag

SEQ ID NO: 401437 - DNA, 25 bp, Mus musculus
aagaaccccgttctgaacagacgtg

SEQ ID NO: 401438 - DNA, 25 bp, Mus musculus
aagaacctcgttatcctcatgggag

SEQ ID NO: 401439 - DNA, 25 bp, Mus musculus
aagaacctctattgggcggacacag

SEQ ID NO: 401440 - DNA, 25 bp, Mus musculus
aagaacctttaagtgagctgtgctc

SEQ ID NO: 401441 - DNA, 25 bp, Mus musculus
aagaaccttttgtggtcaggctaca

SEQ ID NO: 401442 - DNA, 25 bp, Mus musculus
aagaactagttcctcctgttgagca

SEQ ID NO: 401443 - DNA, 25 bp, Mus musculus
aagaacttggcccttcagtgacgga

SEQ ID NO: 401444 - DNA, 25 bp, Mus musculus
aagaagaaactcatggccgctaggg

SEQ ID NO: 401445 - DNA, 25 bp, Mus musculus
aagaagaagccgtctgtcctgccag

SEQ ID NO: 401446 - DNA, 25 bp, Mus musculus
aagaagaatccacgtggccttgtac

SEQ ID NO: 401447 - DNA, 25 bp, Mus musculus
aagaagacaggatctcggaggagct

SEQ ID NO: 401448 - DNA, 25 bp, Mus musculus
aagaagacagtcagcgttgcctcaa

SEQ ID NO: 401449 - DNA, 25 bp, Mus musculus
aagaagaccaccaacgtgttccgcg

SEQ ID NO: 401450 - DNA, 25 bp, Mus musculus
aagaagaccctgcagttagccgtgg

SEQ ID NO: 401451 - DNA, 25 bp, Mus musculus
aagaagaccgtgaagtacctgcagc

SEQ ID NO: 401452 - DNA, 25 bp, Mus musculus
aagaagacgctcctcgtgccatgga

SEQ ID NO: 401453 - DNA, 25 bp, Mus musculus
aagaagactacctcctccagactgg

SEQ ID NO: 401454 - DNA, 25 bp, Mus musculus
aagaagactctgtcccagctaagcg

SEQ ID NO: 401455 - DNA, 25 bp, Mus musculus
aagaagagggcaagcagaagggtta

SEQ ID NO: 401456 - DNA, 25 bp, Mus musculus
aagaagatgacttgccaggagttca

SEQ ID NO: 401457 - DNA, 25 bp, Mus musculus
aagaagcagaggtgtccaggcaaca

SEQ ID NO: 401458 - DNA, 25 bp, Mus musculus
aagaagcagcagttagcgtcttccg

SEQ ID NO: 401459 - DNA, 25 bp, Mus musculus
aagaagcagccggtcgacttgggtc

SEQ ID NO: 401460 - DNA, 25 bp, Mus musculus
aagaagcattcccagactctccagc

SEQ ID NO: 401461 - DNA, 25 bp, Mus musculus
aagaagcccgtgcccgtgggtcatc

SEQ ID NO: 401462 - DNA, 25 bp, Mus musculus
aagaagccgcgatttgtcttctcgg

SEQ ID NO: 401463 - DNA, 25 bp, Mus musculus
aagaagccggccgtggtgtacatgc

SEQ ID NO: 401464 - DNA, 25 bp, Mus musculus
aagaagccttttgagccatgtggac

SEQ ID NO: 401465 - DNA, 25 bp, Mus musculus
aagaagcgatgacgtcactgacccc

SEQ ID NO: 401466 - DNA, 25 bp, Mus musculus
aagaagcggctgaaagagtcaggtg

SEQ ID NO: 401467 - DNA, 25 bp, Mus musculus
aagaagcgtccatggttatcaccga

SEQ ID NO: 401468 - DNA, 25 bp, Mus musculus
aagaagctgagcatggcgtgctcag

SEQ ID NO: 401469 - DNA, 25 bp, Mus musculus
aagaagctgcattgaacgggagctg

SEQ ID NO: 401470 - DNA, 25 bp, Mus musculus
aagaagctgctatccacgggtacct

SEQ ID NO: 401471 - DNA, 25 bp, Mus musculus
aagaagctgcttactgatgacgacc

SEQ ID NO: 401472 - DNA, 25 bp, Mus musculus
aagaagctgtctccacggagccaaa

SEQ ID NO: 401473 - DNA, 25 bp, Mus musculus
aagaaggaccaagtgttgctggaca

SEQ ID NO: 401474 - DNA, 25 bp, Mus musculus
aagaaggacctgatactgctgaccc

SEQ ID NO: 401475 - DNA, 25 bp, Mus musculus
aagaaggacttggatcaaatgttca

SEQ ID NO: 401476 - DNA, 25 bp, Mus musculus
aagaaggcctagtttgcccgccctg

SEQ ID NO: 401477 - DNA, 25 bp, Mus musculus
aagaaggctatcagagaccaagggc

SEQ ID NO: 401478 - DNA, 25 bp, Mus musculus
aagaagggcccagatcacagtgggt

SEQ ID NO: 401479 - DNA, 25 bp, Mus musculus
aagaagggctgcattgcacggtctg

SEQ ID NO: 401480 - DNA, 25 bp, Mus musculus
aagaaggtacccctgaggactctca

SEQ ID NO: 401481 - DNA, 25 bp, Mus musculus
aagaaggtcgccgatgctctggcca

SEQ ID NO: 401482 - DNA, 25 bp, Mus musculus
aagaaggtggcagagcgtgcggctc

SEQ ID NO: 401483 - DNA, 25 bp, Mus musculus
aagaagtcacgggactcgtcagcgc

SEQ ID NO: 401484 - DNA, 25 bp, Mus musculus
aagaagtcatcttctgaaagccagg

SEQ ID NO: 401485 - DNA, 25 bp, Mus musculus
aagaagtccagagtgtgctcccctg

SEQ ID NO: 401486 - DNA, 25 bp, Mus musculus
aagaagtcggttttgctgccaggag

SEQ ID NO: 401487 - DNA, 25 bp, Mus musculus
aagaatatgacgacgagcagcgcgc

SEQ ID NO: 401488 - DNA, 25 bp, Mus musculus
aagaatatgtgagcaggccatggga

SEQ ID NO: 401489 - DNA, 25 bp, Mus musculus
aagaatcagagtgaagagtcatcct

SEQ ID NO: 401490 - DNA, 25 bp, Mus musculus
aagaatcagctcacctggatcggcc

SEQ ID NO: 401491 - DNA, 25 bp, Mus musculus
aagaatctctctggggtgtcactct

SEQ ID NO: 401492 - DNA, 25 bp, Mus musculus
aagaatctggacagcaccaccgtgg

SEQ ID NO: 401493 - DNA, 25 bp, Mus musculus
aagaatcttaaggaagtcttggtat

SEQ ID NO: 401494 - DNA, 25 bp, Mus musculus
aagaatgagggcaatattttgatca

SEQ ID NO: 401495 - DNA, 25 bp, Mus musculus
aagaatggaaacacctggatcctat

SEQ ID NO: 401496 - DNA, 25 bp, Mus musculus
aagaatggagtggatctatcatggc

SEQ ID NO: 401497 - DNA, 25 bp, Mus musculus
aagaatggcattcatcggaccgtcc

SEQ ID NO: 401498 - DNA, 25 bp, Mus musculus
aagaatgggcgtgctgtgtgtcatc

SEQ ID NO: 401499 - DNA, 25 bp, Mus musculus
aagaatgtacgcaacgctatccggg

SEQ ID NO: 401500 - DNA, 25 bp, Mus musculus
aagaatgtctcaaggactcaccccg

SEQ ID NO: 401501 - DNA, 25 bp, Mus musculus
aagaatgtgccagctgggtgtcagc

SEQ ID NO: 401502 - DNA, 25 bp, Mus musculus
aagaatgttttctttcaaagctcct

SEQ ID NO: 401503 - DNA, 25 bp, Mus musculus
aagaattacctgtgcagcagtcccc

SEQ ID NO: 401504 - DNA, 25 bp, Mus musculus
aagaattatctagcagttcatcagc

SEQ ID NO: 401505 - DNA, 25 bp, Mus musculus
aagaatttagtgctgtccctcacag

SEQ ID NO: 401506 - DNA, 25 bp, Mus musculus
aagaatttgcctccacctgtccaga

SEQ ID NO: 401507 - DNA, 25 bp, Mus musculus
aagaattttgagagactccggcctc

SEQ ID NO: 401508 - DNA, 25 bp, Mus musculus
aagacaacgacagtgagttcagact

SEQ ID NO: 401509 - DNA, 25 bp, Mus musculus
aagacaagctggtgcgtaaacgccg

SEQ ID NO: 401510 - DNA, 25 bp, Mus musculus
aagacaatggagacgatgccccaca

SEQ ID NO: 401511 - DNA, 25 bp, Mus musculus
aagacaccataggagacagcttcgg

SEQ ID NO: 401512 - DNA, 25 bp, Mus musculus
aagacacctataagatcctggcacg

SEQ ID NO: 401513 - DNA, 25 bp, Mus musculus
aagacacgtgagtctcccgacacac

SEQ ID NO: 401514 - DNA, 25 bp, Mus musculus
aagacactacagagcctccaggctg

SEQ ID NO: 401515 - DNA, 25 bp, Mus musculus
aagacagaagagctgcgggtcccac

SEQ ID NO: 401516 - DNA, 25 bp, Mus musculus
aagacagagtctttacatagctcag

SEQ ID NO: 401517 - DNA, 25 bp, Mus musculus
aagacagagttatgctttgctcggc

SEQ ID NO: 401518 - DNA, 25 bp, Mus musculus
aagacagatagagcaagggatggac

SEQ ID NO: 401519 - DNA, 25 bp, Mus musculus
aagacagatttgaccgctgtgccag

SEQ ID NO: 401520 - DNA, 25 bp, Mus musculus
aagacagcagctacaagctgccctc

SEQ ID NO: 401521 - DNA, 25 bp, Mus musculus
aagacagccgtgtcagttgcccagg

SEQ ID NO: 401522 - DNA, 25 bp, Mus musculus
aagacagcgggcaatccgtagagga

SEQ ID NO: 401523 - DNA, 25 bp, Mus musculus
aagacagcttgttcaaacatcgaag

SEQ ID NO: 401524 - DNA, 25 bp, Mus musculus
aagacagggctggtgttaggcaacc

SEQ ID NO: 401525 - DNA, 25 bp, Mus musculus
aagacagtccttgtgagagatgccc

SEQ ID NO: 401526 - DNA, 25 bp, Mus musculus
aagacagtcgaccatccacagggta

SEQ ID NO: 401527 - DNA, 25 bp, Mus musculus
aagacagtgaggtttctattctacc

SEQ ID NO: 401528 - DNA, 25 bp, Mus musculus
aagacattgaaaaggcccggcaggc

SEQ ID NO: 401529 - DNA, 25 bp, Mus musculus
aagaccagagaccaaccgcttctct

SEQ ID NO: 401530 - DNA, 25 bp, Mus musculus
aagaccagggtaggatcaaaccaga

SEQ ID NO: 401531 - DNA, 25 bp, Mus musculus
aagaccaggtgcactggagaggaac

SEQ ID NO: 401532 - DNA, 25 bp, Mus musculus
aagaccatggaaaagctgaggcccc

SEQ ID NO: 401533 - DNA, 25 bp, Mus musculus
aagaccgggtgtgacgcagctctgc

SEQ ID NO: 401534 - DNA, 25 bp, Mus musculus
aagaccgtctgaagggccagctgaa

SEQ ID NO: 401535 - DNA, 25 bp, Mus musculus
aagacctagcaagtggccagtgcct

SEQ ID NO: 401536 - DNA, 25 bp, Mus musculus
aagacctgaagctgtgtgatccgca

SEQ ID NO: 401537 - DNA, 25 bp, Mus musculus
aagacctggaggctcttgatctcag

SEQ ID NO: 401538 - DNA, 25 bp, Mus musculus
aagacctgtcagttgatgcctcaga

SEQ ID NO: 401539 - DNA, 25 bp, Mus musculus
aagacctgtgcgatcagctggacca

SEQ ID NO: 401540 - DNA, 25 bp, Mus musculus
aagaccttcatctcctttgtagtgg

SEQ ID NO: 401541 - DNA, 25 bp, Mus musculus
aagaccttcgatcagctaagcccgg

SEQ ID NO: 401542 - DNA, 25 bp, Mus musculus
aagacgcagaagctttcttccagga

SEQ ID NO: 401543 - DNA, 25 bp, Mus musculus
aagacgcagtttgggctctgcagga

SEQ ID NO: 401544 - DNA, 25 bp, Mus musculus
aagacgccgactccatcccatttga

SEQ ID NO: 401545 - DNA, 25 bp, Mus musculus
aagacgcggactacgaagctgacac

SEQ ID NO: 401546 - DNA, 25 bp, Mus musculus
aagacgctgcttgaagcctagacaa

SEQ ID NO: 401547 - DNA, 25 bp, Mus musculus
aagacggcccgacttcgtgacaagg

SEQ ID NO: 401548 - DNA, 25 bp, Mus musculus
aagacggtcacaaaacggccaacag

SEQ ID NO: 401549 - DNA, 25 bp, Mus musculus
aagacgtatcttcactcgcgcccgt

SEQ ID NO: 401550 - DNA, 25 bp, Mus musculus
aagacgtatgaggagatcgccagcc

SEQ ID NO: 401551 - DNA, 25 bp, Mus musculus
aagacgtcacgcgagcttcgagagc

SEQ ID NO: 401552 - DNA, 25 bp, Mus musculus
aagacgttgagaagctggcggcctt

SEQ ID NO: 401553 - DNA, 25 bp, Mus musculus
aagactataagcttcctctcctggg

SEQ ID NO: 401554 - DNA, 25 bp, Mus musculus
aagactcccaaaaacctgacctctg

SEQ ID NO: 401555 - DNA, 25 bp, Mus musculus
aagactctgagatgatgcgcctggg

SEQ ID NO: 401556 - DNA, 25 bp, Mus musculus
aagactctgcccaccgaagggtctg

SEQ ID NO: 401557 - DNA, 25 bp, Mus musculus
aagactgacgctgcctgggttgacc

SEQ ID NO: 401558 - DNA, 25 bp, Mus musculus
aagactgacgtgtccgggctgcggt

SEQ ID NO: 401559 - DNA, 25 bp, Mus musculus
aagactgatcacagtcactgtagcc

SEQ ID NO: 401560 - DNA, 25 bp, Mus musculus
aagactgcaatggaggtggcacgca

SEQ ID NO: 401561 - DNA, 25 bp, Mus musculus
aagactgccgaaaagtggaccccat

SEQ ID NO: 401562 - DNA, 25 bp, Mus musculus
aagactgcgaggtgacgcctgtgac

SEQ ID NO: 401563 - DNA, 25 bp, Mus musculus
aagactgctgagagtgtgggtaatc

SEQ ID NO: 401564 - DNA, 25 bp, Mus musculus
aagactgcttccaggacccacgctt

SEQ ID NO: 401565 - DNA, 25 bp, Mus musculus
aagactgtagactgcgtggagcgca

SEQ ID NO: 401566 - DNA, 25 bp, Mus musculus
aagactgtcgtggaccctgtgatga

SEQ ID NO: 401567 - DNA, 25 bp, Mus musculus
aagactgtgttaagagcgcgtgcca

SEQ ID NO: 401568 - DNA, 25 bp, Mus musculus
aagacttactgctgttattctgaag

SEQ ID NO: 401569 - DNA, 25 bp, Mus musculus
aagacttctgtccacctcatcatag

SEQ ID NO: 401570 - DNA, 25 bp, Mus musculus
aagacttggaatggacaactaaggc

SEQ ID NO: 401571 - DNA, 25 bp, Mus musculus
aagactttgtttgggctcagtggga

SEQ ID NO: 401572 - DNA, 25 bp, Mus musculus
aagagaaaaccatcgcattgtgaag

SEQ ID NO: 401573 - DNA, 25 bp, Mus musculus
aagagaaaccagtgtggccgctgag

SEQ ID NO: 401574 - DNA, 25 bp, Mus musculus
aagagaaagagtagagtgttccctc

SEQ ID NO: 401575 - DNA, 25 bp, Mus musculus
aagagaaaggccgtcaggaggcgga

SEQ ID NO: 401576 - DNA, 25 bp, Mus musculus
aagagaaaggccgtgacctggctcc

SEQ ID NO: 401577 - DNA, 25 bp, Mus musculus
aagagaagcgtctgcaactgtcccg

SEQ ID NO: 401578 - DNA, 25 bp, Mus musculus
aagagaagctgtacagtgctttctt

SEQ ID NO: 401579 - DNA, 25 bp, Mus musculus
aagagaaggcttgagtcctgagacc

SEQ ID NO: 401580 - DNA, 25 bp, Mus musculus
aagagaaggttatgtgcccagcaac

SEQ ID NO: 401581 - DNA, 25 bp, Mus musculus
aagagaagtcgaggcagctgcaaca

SEQ ID NO: 401582 - DNA, 25 bp, Mus musculus
aagagacctctgcttcactgaggag

SEQ ID NO: 401583 - DNA, 25 bp, Mus musculus
aagagacgccatgcaactgtgactg

SEQ ID NO: 401584 - DNA, 25 bp, Mus musculus
aagagacggtcgaactactgcgcag

SEQ ID NO: 401585 - DNA, 25 bp, Mus musculus
aagagagaccctacaggaccaggaa

SEQ ID NO: 401586 - DNA, 25 bp, Mus musculus
aagagagagatcaggtaaaaggatc

SEQ ID NO: 401587 - DNA, 25 bp, Mus musculus
aagagagcagcagaacaacagagga

SEQ ID NO: 401588 - DNA, 25 bp, Mus musculus
aagagagcggaggaccatgccgcac

SEQ ID NO: 401589 - DNA, 25 bp, Mus musculus
aagagagggctatatggcaccaagg

SEQ ID NO: 401590 - DNA, 25 bp, Mus musculus
aagagagtagccctggctctggcca

SEQ ID NO: 401591 - DNA, 25 bp, Mus musculus
aagagagtcttctttggagtgggca

SEQ ID NO: 401592 - DNA, 25 bp, Mus musculus
aagagatacagtcagggattccagg

SEQ ID NO: 401593 - DNA, 25 bp, Mus musculus
aagagatgctggacgacgcgcagaa

SEQ ID NO: 401594 - DNA, 25 bp, Mus musculus
aagagattcgatgcccagacaggag

SEQ ID NO: 401595 - DNA, 25 bp, Mus musculus
aagagcaaaacgtccaactacctgg

SEQ ID NO: 401596 - DNA, 25 bp, Mus musculus
aagagcaagcactgatcttgcagag

SEQ ID NO: 401597 - DNA, 25 bp, Mus musculus
aagagcaaggaagcccggatctcag

SEQ ID NO: 401598 - DNA, 25 bp, Mus musculus
aagagcacctgaggcgtgccatcgg

SEQ ID NO: 401599 - DNA, 25 bp, Mus musculus
aagagcagaagagctggggtctcat

SEQ ID NO: 401600 - DNA, 25 bp, Mus musculus
aagagcagcccactccgacattaaa

SEQ ID NO: 401601 - DNA, 25 bp, Mus musculus
aagagcaggcgcactaagataggct

SEQ ID NO: 401602 - DNA, 25 bp, Mus musculus
aagagcaggtgctgaacgccatcga

SEQ ID NO: 401603 - DNA, 25 bp, Mus musculus
aagagcatcttccttgtggcccaca

SEQ ID NO: 401604 - DNA, 25 bp, Mus musculus
aagagcattgcccaccgatagaggt

SEQ ID NO: 401605 - DNA, 25 bp, Mus musculus
aagagccaggcttgtcctaagaggg

SEQ ID NO: 401606 - DNA, 25 bp, Mus musculus
aagagcccggagaccttaagttcag

SEQ ID NO: 401607 - DNA, 25 bp, Mus musculus
aagagccctactccacgcggaggtg

SEQ ID NO: 401608 - DNA, 25 bp, Mus musculus
aagagccctccactgctagtactgg

SEQ ID NO: 401609 - DNA, 25 bp, Mus musculus
aagagccctccattcactggctcag

SEQ ID NO: 401610 - DNA, 25 bp, Mus musculus
aagagccctctggttcattgcctga

SEQ ID NO: 401611 - DNA, 25 bp, Mus musculus
aagagccgagtgagcccgtgagaca

SEQ ID NO: 401612 - DNA, 25 bp, Mus musculus
aagagccggctggaaggcaatagcc

SEQ ID NO: 401613 - DNA, 25 bp, Mus musculus
aagagccgggagtacgactgtcaga

SEQ ID NO: 401614 - DNA, 25 bp, Mus musculus
aagagccggttccaaacctactgag

SEQ ID NO: 401615 - DNA, 25 bp, Mus musculus
aagagcctgagaaaagcctgctgca

SEQ ID NO: 401616 - DNA, 25 bp, Mus musculus
aagagcgtcctctgcctgaaaatga

SEQ ID NO: 401617 - DNA, 25 bp, Mus musculus
aagagctagagtcggagaatgcccc

SEQ ID NO: 401618 - DNA, 25 bp, Mus musculus
aagagctagcttgtccacgtgagga

SEQ ID NO: 401619 - DNA, 25 bp, Mus musculus
aagagctgagggagatcgcttccga

SEQ ID NO: 401620 - DNA, 25 bp, Mus musculus
aagagctgcttcatggtccgagggc

SEQ ID NO: 401621 - DNA, 25 bp, Mus musculus
aagagctggcaactaagcggttcaa

SEQ ID NO: 401622 - DNA, 25 bp, Mus musculus
aagagctggtccgtatttatgtccc

SEQ ID NO: 401623 - DNA, 25 bp, Mus musculus
aagagcttcaagaggtcatccacgc

SEQ ID NO: 401624 - DNA, 25 bp, Mus musculus
aagagcttgattttttgggacccag

SEQ ID NO: 401625 - DNA, 25 bp, Mus musculus
aagaggaaagcggtgaatgttcgca

SEQ ID NO: 401626 - DNA, 25 bp, Mus musculus
aagaggaagcacgtgctctcaggca

SEQ ID NO: 401627 - DNA, 25 bp, Mus musculus
aagaggacattagaccctctggaac

SEQ ID NO: 401628 - DNA, 25 bp, Mus musculus
aagaggaccgtttggcagctggacc

SEQ ID NO: 401629 - DNA, 25 bp, Mus musculus
aagaggactcgcaagccgagaccaa

SEQ ID NO: 401630 - DNA, 25 bp, Mus musculus
aagaggactgctcatggaccgtggt

SEQ ID NO: 401631 - DNA, 25 bp, Mus musculus
aagaggagagaccaaacttcgcagg

SEQ ID NO: 401632 - DNA, 25 bp, Mus musculus
aagaggagatcaaccagctaacagc

SEQ ID NO: 401633 - DNA, 25 bp, Mus musculus
aagaggaggcccgtgatagtgccca

SEQ ID NO: 401634 - DNA, 25 bp, Mus musculus
aagaggagtagagtcccgtggaact

SEQ ID NO: 401635 - DNA, 25 bp, Mus musculus
aagaggatgggccagaacttcccca

SEQ ID NO: 401636 - DNA, 25 bp, Mus musculus
aagaggcagcggatcctacagtggc

SEQ ID NO: 401637 - DNA, 25 bp, Mus musculus
aagaggcagctcgttccctggacga

SEQ ID NO: 401638 - DNA, 25 bp, Mus musculus
aagaggcatattccccaaagtcgcg

SEQ ID NO: 401639 - DNA, 25 bp, Mus musculus
aagaggccactgcagttccttgggc

SEQ ID NO: 401640 - DNA, 25 bp, Mus musculus
aagaggccaggtttcattattgtgc

SEQ ID NO: 401641 - DNA, 25 bp, Mus musculus
aagaggcccagcttccattcaggcc

SEQ ID NO: 401642 - DNA, 25 bp, Mus musculus
aagaggccccggtttgatgtgtcac

SEQ ID NO: 401643 - DNA, 25 bp, Mus musculus
aagaggccgcctagggaaggtgaca

SEQ ID NO: 401644 - DNA, 25 bp, Mus musculus
aagaggcctgtaaaaactattggca

SEQ ID NO: 401645 - DNA, 25 bp, Mus musculus
aagaggccttttcattgtttgaccg

SEQ ID NO: 401646 - DNA, 25 bp, Mus musculus
aagaggcggacgtttcctgcacagg

SEQ ID NO: 401647 - DNA, 25 bp, Mus musculus
aagaggcggcaagagggccatctct

SEQ ID NO: 401648 - DNA, 25 bp, Mus musculus
aagaggcgtcttcaacacagtctgc

SEQ ID NO: 401649 - DNA, 25 bp, Mus musculus
aagaggctattcctttgtgaccaca

SEQ ID NO: 401650 - DNA, 25 bp, Mus musculus
aagaggctgaccaatagtagtccgg

SEQ ID NO: 401651 - DNA, 25 bp, Mus musculus
aagaggctgcacatgtagctgtacc

SEQ ID NO: 401652 - DNA, 25 bp, Mus musculus
aagaggcttcctgactaaccatgag

SEQ ID NO: 401653 - DNA, 25 bp, Mus musculus
aagagggatccctgagccgtgtagc

SEQ ID NO: 401654 - DNA, 25 bp, Mus musculus
aagagggcctcgtgattatcctgga

SEQ ID NO: 401655 - DNA, 25 bp, Mus musculus
aagagggcgttggaccacttagtgc

SEQ ID NO: 401656 - DNA, 25 bp, Mus musculus
aagaggtctgctcaggtagggacaa

SEQ ID NO: 401657 - DNA, 25 bp, Mus musculus
aagaggtgactttcatctatcagaa

SEQ ID NO: 401658 - DNA, 25 bp, Mus musculus
aagaggtgtcctattgccggcaatg

SEQ ID NO: 401659 - DNA, 25 bp, Mus musculus
aagaggttcctgttgctatacatgg

SEQ ID NO: 401660 - DNA, 25 bp, Mus musculus
aagaggtttttctcccaagctccag

SEQ ID NO: 401661 - DNA, 25 bp, Mus musculus
aagagtaaacgggagctgctgcacc

SEQ ID NO: 401662 - DNA, 25 bp, Mus musculus
aagagtaatgcttagtcagtggcag

SEQ ID NO: 401663 - DNA, 25 bp, Mus musculus
aagagtacgcggtgctggtgtccta

SEQ ID NO: 401664 - DNA, 25 bp, Mus musculus
aagagtagcccttgccaggaacagg

SEQ ID NO: 401665 - DNA, 25 bp, Mus musculus
aagagtatacgcttcggatccgggc

SEQ ID NO: 401666 - DNA, 25 bp, Mus musculus
aagagtatcactacccttcagggag

SEQ ID NO: 401667 - DNA, 25 bp, Mus musculus
aagagtcaaggctatggcagtccga

SEQ ID NO: 401668 - DNA, 25 bp, Mus musculus
aagagtcatctgtcccaggccacca

SEQ ID NO: 401669 - DNA, 25 bp, Mus musculus
aagagtccagattcaacaggcggcc

SEQ ID NO: 401670 - DNA, 25 bp, Mus musculus
aagagtccagcatctaagcccggga

SEQ ID NO: 401671 - DNA, 25 bp, Mus musculus
aagagtgcgcatgtacctcctagag

SEQ ID NO: 401672 - DNA, 25 bp, Mus musculus
aagagtggcgccatcatgtccgcct

SEQ ID NO: 401673 - DNA, 25 bp, Mus musculus
aagagttaactcgtctgcccctgaa

SEQ ID NO: 401674 - DNA, 25 bp, Mus musculus
aagagttcaggtgtgagcccagcct

SEQ ID NO: 401675 - DNA, 25 bp, Mus musculus
aagagttctatacctgccgcaggcg

SEQ ID NO: 401676 - DNA, 25 bp, Mus musculus
aagagtttaaccacgggctggtgct

SEQ ID NO: 401677 - DNA, 25 bp, Mus musculus
aagagttttgcctagggccagcgag

SEQ ID NO: 401678 - DNA, 25 bp, Mus musculus
aagataactcttctgtggccaatga

SEQ ID NO: 401679 - DNA, 25 bp, Mus musculus
aagataagtatctgccatgagactg

SEQ ID NO: 401680 - DNA, 25 bp, Mus musculus
aagatacaagttcaggttcaccacc

SEQ ID NO: 401681 - DNA, 25 bp, Mus musculus
aagatacggttgtcagggccgccct

SEQ ID NO: 401682 - DNA, 25 bp, Mus musculus
aagatacttgcaagtcagagaagtg

SEQ ID NO: 401683 - DNA, 25 bp, Mus musculus
aagatagctcctcggcactgttggc

SEQ ID NO: 401684 - DNA, 25 bp, Mus musculus
aagatatactgctcgggaggccggc

SEQ ID NO: 401685 - DNA, 25 bp, Mus musculus
aagatattcccgtgcttgctgagcc

SEQ ID NO: 401686 - DNA, 25 bp, Mus musculus
aagatcaaagcgtggaggagagtga

SEQ ID NO: 401687 - DNA, 25 bp, Mus musculus
aagatcatcggtggtccgggactcg

SEQ ID NO: 401688 - DNA, 25 bp, Mus musculus
aagatccaccctagttcggcaccag

SEQ ID NO: 401689 - DNA, 25 bp, Mus musculus
aagatccatcgagcaaagcacaggg

SEQ ID NO: 401690 - DNA, 25 bp, Mus musculus
aagatccatgctgtcatttaagccg

SEQ ID NO: 401691 - DNA, 25 bp, Mus musculus
aagatccatttcagcaccgcaccga

SEQ ID NO: 401692 - DNA, 25 bp, Mus musculus
aagatccccttgtctcaggctgaag

SEQ ID NO: 401693 - DNA, 25 bp, Mus musculus
aagatccgaagctacaatcgccggg

SEQ ID NO: 401694 - DNA, 25 bp, Mus musculus
aagatcctagcctcattccagaagc

SEQ ID NO: 401695 - DNA, 25 bp, Mus musculus
aagatcctcacctccaaattcctga

SEQ ID NO: 401696 - DNA, 25 bp, Mus musculus
aagatcctctattctgcgccgcgat

SEQ ID NO: 401697 - DNA, 25 bp, Mus musculus
aagatcctgcctgtgatggtgaccc

SEQ ID NO: 401698 - DNA, 25 bp, Mus musculus
aagatcgcaagtcccgtctcatggg

SEQ ID NO: 401699 - DNA, 25 bp, Mus musculus
aagatcgcagcgactggctcatagt

SEQ ID NO: 401700 - DNA, 25 bp, Mus musculus
aagatcgccatcctgggctaccggt

SEQ ID NO: 401701 - DNA, 25 bp, Mus musculus
aagatctacctgtccatctagggca

SEQ ID NO: 401702 - DNA, 25 bp, Mus musculus
aagatctacttgcttcctgaccgga

SEQ ID NO: 401703 - DNA, 25 bp, Mus musculus
aagatctggtgatgcttccgactcc

SEQ ID NO: 401704 - DNA, 25 bp, Mus musculus
aagatgaacaaataactgaaatagc

SEQ ID NO: 401705 - DNA, 25 bp, Mus musculus
aagatgaactcgagcctctgcaggg

SEQ ID NO: 401706 - DNA, 25 bp, Mus musculus
aagatgaacttggacctctgcggca

SEQ ID NO: 401707 - DNA, 25 bp, Mus musculus
aagatgaagcagaaagagcgagagc

SEQ ID NO: 401708 - DNA, 25 bp, Mus musculus
aagatgaagccagcattctccattc

SEQ ID NO: 401709 - DNA, 25 bp, Mus musculus
aagatgaagtggacattcctgtctc

SEQ ID NO: 401710 - DNA, 25 bp, Mus musculus
aagatgacctcgtgggagaccagga

SEQ ID NO: 401711 - DNA, 25 bp, Mus musculus
aagatgagcctgaagtccgaacgca

SEQ ID NO: 401712 - DNA, 25 bp, Mus musculus
aagatgagctgtgccgagtctccca

SEQ ID NO: 401713 - DNA, 25 bp, Mus musculus
aagatgataccaccaggctacgcag

SEQ ID NO: 401714 - DNA, 25 bp, Mus musculus
aagatgatcgagtccctgaccaagg

SEQ ID NO: 401715 - DNA, 25 bp, Mus musculus
aagatgatgaagtttcggttccggc

SEQ ID NO: 401716 - DNA, 25 bp, Mus musculus
aagatgcagagcagtctgaagtcgg

SEQ ID NO: 401717 - DNA, 25 bp, Mus musculus
aagatgccatggagcccaggcttca

SEQ ID NO: 401718 - DNA, 25 bp, Mus musculus
aagatgccgcagctgagtttcctcg

SEQ ID NO: 401719 - DNA, 25 bp, Mus musculus
aagatgcctgcccttcacatcgagg

SEQ ID NO: 401720 - DNA, 25 bp, Mus musculus
aagatgcggcagttccatgggctcc

SEQ ID NO: 401721 - DNA, 25 bp, Mus musculus
aagatgctatatgcagccacacgcg

SEQ ID NO: 401722 - DNA, 25 bp, Mus musculus
aagatgctgagtgggtgtacaatga

SEQ ID NO: 401723 - DNA, 25 bp, Mus musculus
aagatgctgtcctgccgtctccagt

SEQ ID NO: 401724 - DNA, 25 bp, Mus musculus
aagatggaagacacgagcctgctgc

SEQ ID NO: 401725 - DNA, 25 bp, Mus musculus
aagatggaatcttactatgtacctg

SEQ ID NO: 401726 - DNA, 25 bp, Mus musculus
aagatggatctttatcgccacggca

SEQ ID NO: 401727 - DNA, 25 bp, Mus musculus
aagatggcagactgtggtgtgccac

SEQ ID NO: 401728 - DNA, 25 bp, Mus musculus
aagatggcagagactagagggacct

SEQ ID NO: 401729 - DNA, 25 bp, Mus musculus
aagatggcatcttcaggcatgaccg

SEQ ID NO: 401730 - DNA, 25 bp, Mus musculus
aagatggccctttcgtttatggcag

SEQ ID NO: 401731 - DNA, 25 bp, Mus musculus
aagatggccgcgtctctactgctga

SEQ ID NO: 401732 - DNA, 25 bp, Mus musculus
aagatggcctatgttccagcaccgg

SEQ ID NO: 401733 - DNA, 25 bp, Mus musculus
aagatggcgactcccatgcatcggc

SEQ ID NO: 401734 - DNA, 25 bp, Mus musculus
aagatggcgccgtccgtagtgctgc

SEQ ID NO: 401735 - DNA, 25 bp, Mus musculus
aagatggctcaacaggctcacttgt

SEQ ID NO: 401736 - DNA, 25 bp, Mus musculus
aagatggcttccaaaggcgtgcggc

SEQ ID NO: 401737 - DNA, 25 bp, Mus musculus
aagatggtgaatgtgcccctggagc

SEQ ID NO: 401738 - DNA, 25 bp, Mus musculus
aagatgtaaacctcagggcctggcc

SEQ ID NO: 401739 - DNA, 25 bp, Mus musculus
aagatgtagctctgccttcaagaaa

SEQ ID NO: 401740 - DNA, 25 bp, Mus musculus
aagatgtcctcagttcggttcatgg

SEQ ID NO: 401741 - DNA, 25 bp, Mus musculus
aagatgtcgaggtcctctctgggcc

SEQ ID NO: 401742 - DNA, 25 bp, Mus musculus
aagatgtctcctgctctgaattagg

SEQ ID NO: 401743 - DNA, 25 bp, Mus musculus
aagatgtctctgaacggacagcgcg

SEQ ID NO: 401744 - DNA, 25 bp, Mus musculus
aagatgtgaccgatggcgtgctcct

SEQ ID NO: 401745 - DNA, 25 bp, Mus musculus
aagatgtggcagtagagccgcttcc

SEQ ID NO: 401746 - DNA, 25 bp, Mus musculus
aagatgttccgtcaaggcctcaggg

SEQ ID NO: 401747 - DNA, 25 bp, Mus musculus
aagattaggccgttgagtggatccc

SEQ ID NO: 401748 - DNA, 25 bp, Mus musculus
aagattcagaccctcaaactggcgg

SEQ ID NO: 401749 - DNA, 25 bp, Mus musculus
aagattcagtctggctggagccgga

SEQ ID NO: 401750 - DNA, 25 bp, Mus musculus
aagattccaagtcgatagcccaggc

SEQ ID NO: 401751 - DNA, 25 bp, Mus musculus
aagattcttgcgctttctctgaaga

SEQ ID NO: 401752 - DNA, 25 bp, Mus musculus
aagattgaaggatgctgtggcccac

SEQ ID NO: 401753 - DNA, 25 bp, Mus musculus
aagattgacatctgcacccggctgg

SEQ ID NO: 401754 - DNA, 25 bp, Mus musculus
aagattgaggccagcttgtgccgga

SEQ ID NO: 401755 - DNA, 25 bp, Mus musculus
aagattgctcaaaggcctggtccca

SEQ ID NO: 401756 - DNA, 25 bp, Mus musculus
aagattgctcccgacccgtttatgg

SEQ ID NO: 401757 - DNA, 25 bp, Mus musculus
aagattggagccgtcccaagggatg

SEQ ID NO: 401758 - DNA, 25 bp, Mus musculus
aagattggccattctgactctggag

SEQ ID NO: 401759 - DNA, 25 bp, Mus musculus
aagattgtcaacatcggcgcggtgc

SEQ ID NO: 401760 - DNA, 25 bp, Mus musculus
aagattgtcctagacccctcgggct

SEQ ID NO: 401761 - DNA, 25 bp, Mus musculus
aagatttctgatgaccctcaacaag

SEQ ID NO: 401762 - DNA, 25 bp, Mus musculus
aagattttccaactcgagtacctgg

SEQ ID NO: 401763 - DNA, 25 bp, Mus musculus
aagcaaacccaaagcatcggctgag

SEQ ID NO: 401764 - DNA, 25 bp, Mus musculus
aagcaaactggtcctcgagaacgcg

SEQ ID NO: 401765 - DNA, 25 bp, Mus musculus
aagcaaatgtgctcgcctcagtgca

SEQ ID NO: 401766 - DNA, 25 bp, Mus musculus
aagcaacgccacacagctggacggc

SEQ ID NO: 401767 - DNA, 25 bp, Mus musculus
aagcaactgtatcccgctcataaag

SEQ ID NO: 401768 - DNA, 25 bp, Mus musculus
aagcaagagagtggcgtaaacccaa

SEQ ID NO: 401769 - DNA, 25 bp, Mus musculus
aagcaagagtgtggacgcagcaaaa

SEQ ID NO: 401770 - DNA, 25 bp, Mus musculus
aagcaaggcggcacaagcatcctct

SEQ ID NO: 401771 - DNA, 25 bp, Mus musculus
aagcaaggtggccactggaactgcc

SEQ ID NO: 401772 - DNA, 25 bp, Mus musculus
aagcaagtgttctgagctgcccatc

SEQ ID NO: 401773 - DNA, 25 bp, Mus musculus
aagcaataaccacccttcactggtg

SEQ ID NO: 401774 - DNA, 25 bp, Mus musculus
aagcaatgaggttctgcgcagggcc

SEQ ID NO: 401775 - DNA, 25 bp, Mus musculus
aagcaatggcgggtatggcaagccc

SEQ ID NO: 401776 - DNA, 25 bp, Mus musculus
aagcaatgtccagtccgggaaccga

SEQ ID NO: 401777 - DNA, 25 bp, Mus musculus
aagcacaagtgccactacgcgggct

SEQ ID NO: 401778 - DNA, 25 bp, Mus musculus
aagcacagatgtacctcagggcgca

SEQ ID NO: 401779 - DNA, 25 bp, Mus musculus
aagcaccttgctcctttgccatcga

SEQ ID NO: 401780 - DNA, 25 bp, Mus musculus
aagcacgagcagcacgactgggact

SEQ ID NO: 401781 - DNA, 25 bp, Mus musculus
aagcacggcttcaatttggtcacat

SEQ ID NO: 401782 - DNA, 25 bp, Mus musculus
aagcacgtgaacagatggcccaagt

SEQ ID NO: 401783 - DNA, 25 bp, Mus musculus
aagcacgtgagccagcaaggtactc

SEQ ID NO: 401784 - DNA, 25 bp, Mus musculus
aagcactcagcttttgactttacgg

SEQ ID NO: 401785 - DNA, 25 bp, Mus musculus
aagcacttcagagtttattggaatc

SEQ ID NO: 401786 - DNA, 25 bp, Mus musculus
aagcacttgatgtgggcgtacccta

SEQ ID NO: 401787 - DNA, 25 bp, Mus musculus
aagcagaagtcagcctcagggcacg

SEQ ID NO: 401788 - DNA, 25 bp, Mus musculus
aagcagaattcttccagctcaaggg

SEQ ID NO: 401789 - DNA, 25 bp, Mus musculus
aagcagagcctgtgatacatggtgt

SEQ ID NO: 401790 - DNA, 25 bp, Mus musculus
aagcagagcggaagctgctgacttg

SEQ ID NO: 401791 - DNA, 25 bp, Mus musculus
aagcagaggcttgagttgagtccag

SEQ ID NO: 401792 - DNA, 25 bp, Mus musculus
aagcagagtgtcatcgtggtgcacg

SEQ ID NO: 401793 - DNA, 25 bp, Mus musculus
aagcagagtttgtgtgtatggcatc

SEQ ID NO: 401794 - DNA, 25 bp, Mus musculus
aagcagatctggacgctggagcaac

SEQ ID NO: 401795 - DNA, 25 bp, Mus musculus
aagcagattagtttgcggcaggccc

SEQ ID NO: 401796 - DNA, 25 bp, Mus musculus
aagcagcaagcagtaggccttggtc

SEQ ID NO: 401797 - DNA, 25 bp, Mus musculus
aagcagcagcaggtttcagatcaca

SEQ ID NO: 401798 - DNA, 25 bp, Mus musculus
aagcagcgaacagcgcgcaagagag

SEQ ID NO: 401799 - DNA, 25 bp, Mus musculus
aagcagctgtaggtgttcgcatcgc

SEQ ID NO: 401800 - DNA, 25 bp, Mus musculus
aagcagctgtttactctgcagacgg

SEQ ID NO: 401801 - DNA, 25 bp, Mus musculus
aagcagcttacctgcccgagtgggt

SEQ ID NO: 401802 - DNA, 25 bp, Mus musculus
aagcagcttgtctgaggtgtagcga

SEQ ID NO: 401803 - DNA, 25 bp, Mus musculus
aagcaggcgccatcaccaggatgtc

SEQ ID NO: 401804 - DNA, 25 bp, Mus musculus
aagcaggcggtttggcttcattgtc

SEQ ID NO: 401805 - DNA, 25 bp, Mus musculus
aagcagggtaggtccctagtggcca

SEQ ID NO: 401806 - DNA, 25 bp, Mus musculus
aagcaggtagtttgagcaaaagacc

SEQ ID NO: 401807 - DNA, 25 bp, Mus musculus
aagcaggtgaccagtgctctggccg

SEQ ID NO: 401808 - DNA, 25 bp, Mus musculus
aagcagtacccaacggccttcgtga

SEQ ID NO: 401809 - DNA, 25 bp, Mus musculus
aagcagtattgccacggatgggcca

SEQ ID NO: 401810 - DNA, 25 bp, Mus musculus
aagcagtgtctcatcgcccagaaga

SEQ ID NO: 401811 - DNA, 25 bp, Mus musculus
aagcagttggctccctttacagcac

SEQ ID NO: 401812 - DNA, 25 bp, Mus musculus
aagcatacagttgttgccaaacagg

SEQ ID NO: 401813 - DNA, 25 bp, Mus musculus
aagcatcagcgcctatcatcgggaa

SEQ ID NO: 401814 - DNA, 25 bp, Mus musculus
aagcatcaggcttctgccgtcggga

SEQ ID NO: 401815 - DNA, 25 bp, Mus musculus
aagcatctgaaatgggtctcatcca

SEQ ID NO: 401816 - DNA, 25 bp, Mus musculus
aagcatctgagagagcccagtgaag

SEQ ID NO: 401817 - DNA, 25 bp, Mus musculus
aagcatctgcccagtccttccgaga

SEQ ID NO: 401818 - DNA, 25 bp, Mus musculus
aagcatgcccgggagcgggtcactc

SEQ ID NO: 401819 - DNA, 25 bp, Mus musculus
aagcatggtgcctcctgagtggcac

SEQ ID NO: 401820 - DNA, 25 bp, Mus musculus
aagcatgtctccatcctttgaatga

SEQ ID NO: 401821 - DNA, 25 bp, Mus musculus
aagcatgtgccacgcttggcccaag

SEQ ID NO: 401822 - DNA, 25 bp, Mus musculus
aagccaaaaatgttcttcatccaag

SEQ ID NO: 401823 - DNA, 25 bp, Mus musculus
aagccaaagccccagatgggccagc

SEQ ID NO: 401824 - DNA, 25 bp, Mus musculus
aagccaaataaatgcaaatgttgtg

SEQ ID NO: 401825 - DNA, 25 bp, Mus musculus
aagccaactgtgtaggagggtcaag

SEQ ID NO: 401826 - DNA, 25 bp, Mus musculus
aagccaagggccaagagcagtggtt

SEQ ID NO: 401827 - DNA, 25 bp, Mus musculus
aagccactggccaagggagaagtct

SEQ ID NO: 401828 - DNA, 25 bp, Mus musculus
aagccagactcccagcaagaaggaa

SEQ ID NO: 401829 - DNA, 25 bp, Mus musculus
aagccagagaccttgcagtggactg

SEQ ID NO: 401830 - DNA, 25 bp, Mus musculus
aagccagggatatggagagcatgcc

SEQ ID NO: 401831 - DNA, 25 bp, Mus musculus
aagccagggccttcagccttcaaca

SEQ ID NO: 401832 - DNA, 25 bp, Mus musculus
aagccagtttatcagggccaccgca

SEQ ID NO: 401833 - DNA, 25 bp, Mus musculus
aagccagttttcatgatcagtccca

SEQ ID NO: 401834 - DNA, 25 bp, Mus musculus
aagccatcataaagatcacaaagcc

SEQ ID NO: 401835 - DNA, 25 bp, Mus musculus
aagccatcgggaggcacagtgcctt

SEQ ID NO: 401836 - DNA, 25 bp, Mus musculus
aagccatggaagaaagagggacaaa

SEQ ID NO: 401837 - DNA, 25 bp, Mus musculus
aagccattaccctcgcacttcagtg

SEQ ID NO: 401838 - DNA, 25 bp, Mus musculus
aagccattccgaggtccggagaccg

SEQ ID NO: 401839 - DNA, 25 bp, Mus musculus
aagcccacccctagtgacagagttc

SEQ ID NO: 401840 - DNA, 25 bp, Mus musculus
aagcccactctgcttctaccgggat

SEQ ID NO: 401841 - DNA, 25 bp, Mus musculus
aagcccagtgtaacctcgcattcct

SEQ ID NO: 401842 - DNA, 25 bp, Mus musculus
aagcccataggcctgatcccctggg

SEQ ID NO: 401843 - DNA, 25 bp, Mus musculus
aagcccccagttgaatgcattctgc

SEQ ID NO: 401844 - DNA, 25 bp, Mus musculus
aagcccgtcggatataagattgtca

SEQ ID NO: 401845 - DNA, 25 bp, Mus musculus
aagccctatgcgtgtgtcgtctgcg

SEQ ID NO: 401846 - DNA, 25 bp, Mus musculus
aagccctgcgagcacctctttgaga

SEQ ID NO: 401847 - DNA, 25 bp, Mus musculus
aagccctgtccgagcaagtttgaac

SEQ ID NO: 401848 - DNA, 25 bp, Mus musculus
aagccctgtgcactccgtgttggca

SEQ ID NO: 401849 - DNA, 25 bp, Mus musculus
aagcccttattcagatcgtcacgga

SEQ ID NO: 401850 - DNA, 25 bp, Mus musculus
aagccgaaatagaaacagcaactca

SEQ ID NO: 401851 - DNA, 25 bp, Mus musculus
aagccgagcaggtgtcccaactccg

SEQ ID NO: 401852 - DNA, 25 bp, Mus musculus
aagccgcccaagtgagtgagtgccg

SEQ ID NO: 401853 - DNA, 25 bp, Mus musculus
aagccgccgcctcaggtcagagtcg

SEQ ID NO: 401854 - DNA, 25 bp, Mus musculus
aagccgctgccgttgaaccttgtag

SEQ ID NO: 401855 - DNA, 25 bp, Mus musculus
aagccggatgtagggataaagactc

SEQ ID NO: 401856 - DNA, 25 bp, Mus musculus
aagccgggcagtccatttacagcac

SEQ ID NO: 401857 - DNA, 25 bp, Mus musculus
aagccgtcccgccttggagtaggca

SEQ ID NO: 401858 - DNA, 25 bp, Mus musculus
aagcctagagatcctaactctgttg

SEQ ID NO: 401859 - DNA, 25 bp, Mus musculus
aagcctaggaaatgtctatgtcctg

SEQ ID NO: 401860 - DNA, 25 bp, Mus musculus
aagcctatggcttcagctgcgacgg

SEQ ID NO: 401861 - DNA, 25 bp, Mus musculus
aagcctatgggtgggacactgctca

SEQ ID NO: 401862 - DNA, 25 bp, Mus musculus
aagcctcagtactggaacccgggag

SEQ ID NO: 401863 - DNA, 25 bp, Mus musculus
aagcctcataacctgagttcagtcc

SEQ ID NO: 401864 - DNA, 25 bp, Mus musculus
aagcctgcgggacaaccgtgaatgt

SEQ ID NO: 401865 - DNA, 25 bp, Mus musculus
aagcctgggtcggagagactggact

SEQ ID NO: 401866 - DNA, 25 bp, Mus musculus
aagcctggtgtgtttaactttgtca

SEQ ID NO: 401867 - DNA, 25 bp, Mus musculus
aagcctgtcagggactttgaactgc

SEQ ID NO: 401868 - DNA, 25 bp, Mus musculus
aagcctgtgggatctatgctggccc

SEQ ID NO: 401869 - DNA, 25 bp, Mus musculus
aagccttcggcctgaatctaccatg

SEQ ID NO: 401870 - DNA, 25 bp, Mus musculus
aagccttgccttttatctagtgaaa

SEQ ID NO: 401871 - DNA, 25 bp, Mus musculus
aagcctttcgtggtgtcagctcgca

SEQ ID NO: 401872 - DNA, 25 bp, Mus musculus
aagcgactgcgtgcggtgcacatga

SEQ ID NO: 401873 - DNA, 25 bp, Mus musculus
aagcgactggtgagcgagatctacg

SEQ ID NO: 401874 - DNA, 25 bp, Mus musculus
aagcgagagagaaaccacattggaa

SEQ ID NO: 401875 - DNA, 25 bp, Mus musculus
aagcgagagcctcggaaacgccgct

SEQ ID NO: 401876 - DNA, 25 bp, Mus musculus
aagcgaggcacagcaaggttccgct

SEQ ID NO: 401877 - DNA, 25 bp, Mus musculus
aagcgagtacttttggttggcaaag

SEQ ID NO: 401878 - DNA, 25 bp, Mus musculus
aagcgatggatggatacctctgcct

SEQ ID NO: 401879 - DNA, 25 bp, Mus musculus
aagcgcatctgtccaaatgcccctg

SEQ ID NO: 401880 - DNA, 25 bp, Mus musculus
aagcgcccgccctcaagtatgtgaa

SEQ ID NO: 401881 - DNA, 25 bp, Mus musculus
aagcgccgcttctacgtgacgactt

SEQ ID NO: 401882 - DNA, 25 bp, Mus musculus
aagcgcgagccgtgcgctttctgga

SEQ ID NO: 401883 - DNA, 25 bp, Mus musculus
aagcgctccccgaaaagttggctgg

SEQ ID NO: 401884 - DNA, 25 bp, Mus musculus
aagcgctctcggtcactctctgaga

SEQ ID NO: 401885 - DNA, 25 bp, Mus musculus
aagcggcgccagaccaataatcaga

SEQ ID NO: 401886 - DNA, 25 bp, Mus musculus
aagcgggaccggcaaagatgattca

SEQ ID NO: 401887 - DNA, 25 bp, Mus musculus
aagcgggctgggatgctcctgccct

SEQ ID NO: 401888 - DNA, 25 bp, Mus musculus
aagcgggtgagtggatccctgccca

SEQ ID NO: 401889 - DNA, 25 bp, Mus musculus
aagcggtccaccatggcccacggat

SEQ ID NO: 401890 - DNA, 25 bp, Mus musculus
aagcggtgagttcactagagcctca

SEQ ID NO: 401891 - DNA, 25 bp, Mus musculus
aagcggtggtgtgacctcaggctca

SEQ ID NO: 401892 - DNA, 25 bp, Mus musculus
aagcggttgtgagtcagctgtttaa

SEQ ID NO: 401893 - DNA, 25 bp, Mus musculus
aagcgtaagctgttagcgccagcga

SEQ ID NO: 401894 - DNA, 25 bp, Mus musculus
aagcgtaagtgaccgattctgagcc

SEQ ID NO: 401895 - DNA, 25 bp, Mus musculus
aagcgtatgattgacagcgaggaca

SEQ ID NO: 401896 - DNA, 25 bp, Mus musculus
aagcgtcatgtgaatgtcctgtacc

SEQ ID NO: 401897 - DNA, 25 bp, Mus musculus
aagcgtgtttcagagattatcagcg

SEQ ID NO: 401898 - DNA, 25 bp, Mus musculus
aagcgtttctctcagcgatcggtgc

SEQ ID NO: 401899 - DNA, 25 bp, Mus musculus
aagctaaagctgactcgcccagtgc

SEQ ID NO: 401900 - DNA, 25 bp, Mus musculus
aagctaaccgaggaaggagatgccc

SEQ ID NO: 401901 - DNA, 25 bp, Mus musculus
aagctactaagcaacctgggagacg

SEQ ID NO: 401902 - DNA, 25 bp, Mus musculus
aagctacttagtcccagccatgagg

SEQ ID NO: 401903 - DNA, 25 bp, Mus musculus
aagctaggattcaccctggcagagg

SEQ ID NO: 401904 - DNA, 25 bp, Mus musculus
aagctaggcatgtaaccccagcact

SEQ ID NO: 401905 - DNA, 25 bp, Mus musculus
aagctatgtggaggtgcgacgccct

SEQ ID NO: 401906 - DNA, 25 bp, Mus musculus
aagctattgacattgccgtgcgggc

SEQ ID NO: 401907 - DNA, 25 bp, Mus musculus
aagctcaagggagactagggcctcg

SEQ ID NO: 401908 - DNA, 25 bp, Mus musculus
aagctcagtctgatgctgccgggct

SEQ ID NO: 401909 - DNA, 25 bp, Mus musculus
aagctcagtggaaggccttgacccg

SEQ ID NO: 401910 - DNA, 25 bp, Mus musculus
aagctcccgccttagcaatacagca

SEQ ID NO: 401911 - DNA, 25 bp, Mus musculus
aagctcctgatggacagcccttgtg

SEQ ID NO: 401912 - DNA, 25 bp, Mus musculus
aagctcctggcgtggggatatgaac

SEQ ID NO: 401913 - DNA, 25 bp, Mus musculus
aagctccttggaacgggtgacactc

SEQ ID NO: 401914 - DNA, 25 bp, Mus musculus
aagctcgagcgaatggcaaacacct

SEQ ID NO: 401915 - DNA, 25 bp, Mus musculus
aagctcgctgcaaggtctttataca

SEQ ID NO: 401916 - DNA, 25 bp, Mus musculus
aagctcggccgtccttccttggaag

SEQ ID NO: 401917 - DNA, 25 bp, Mus musculus
aagctcgtggcctgtgtgagtcaag

SEQ ID NO: 401918 - DNA, 25 bp, Mus musculus
aagctctagcttggatgatcgcacg

SEQ ID NO: 401919 - DNA, 25 bp, Mus musculus
aagctctcaccaaatgaacgcccgg

SEQ ID NO: 401920 - DNA, 25 bp, Mus musculus
aagctctgtccagttcttccgatga

SEQ ID NO: 401921 - DNA, 25 bp, Mus musculus
aagctgaagaaaccgccctgggtgc

SEQ ID NO: 401922 - DNA, 25 bp, Mus musculus
aagctgaccactgcaatgaccgtcg

SEQ ID NO: 401923 - DNA, 25 bp, Mus musculus
aagctgacctgcacccctgatgtgg

SEQ ID NO: 401924 - DNA, 25 bp, Mus musculus
aagctgatcagggaagggccaagca

SEQ ID NO: 401925 - DNA, 25 bp, Mus musculus
aagctgatctgtctgtaggtccagg

SEQ ID NO: 401926 - DNA, 25 bp, Mus musculus
aagctgcatgagaacaacccacgtg

SEQ ID NO: 401927 - DNA, 25 bp, Mus musculus
aagctgccaaggaactgggatttca

SEQ ID NO: 401928 - DNA, 25 bp, Mus musculus
aagctgccactgttacctcacgagg

SEQ ID NO: 401929 - DNA, 25 bp, Mus musculus
aagctgcccctgatcttttcagcca

SEQ ID NO: 401930 - DNA, 25 bp, Mus musculus
aagctgcggtccttagatgcctgag

SEQ ID NO: 401931 - DNA, 25 bp, Mus musculus
aagctgcggtggatgctggacaacc

SEQ ID NO: 401932 - DNA, 25 bp, Mus musculus
aagctgcgttggacacaaaaggaca

SEQ ID NO: 401933 - DNA, 25 bp, Mus musculus
aagctgctgtccttccgggtggacg

SEQ ID NO: 401934 - DNA, 25 bp, Mus musculus
aagctggaagagagctacttcatcc

SEQ ID NO: 401935 - DNA, 25 bp, Mus musculus
aagctggcagtcagacagaccggtg

SEQ ID NO: 401936 - DNA, 25 bp, Mus musculus
aagctgggagcacatcttgttcacc

SEQ ID NO: 401937 - DNA, 25 bp, Mus musculus
aagctggggtttgaatctgaggcca

SEQ ID NO: 401938 - DNA, 25 bp, Mus musculus
aagctggtagcaagcccagcagtgg

SEQ ID NO: 401939 - DNA, 25 bp, Mus musculus
aagctggtgagtcaggttccttgtc

SEQ ID NO: 401940 - DNA, 25 bp, Mus musculus
aagctggtgctgatcactgcagccg

SEQ ID NO: 401941 - DNA, 25 bp, Mus musculus
aagctgtagtgtgatgatgggcacc

SEQ ID NO: 401942 - DNA, 25 bp, Mus musculus
aagctgtcccaaggagctccaaggg

SEQ ID NO: 401943 - DNA, 25 bp, Mus musculus
aagctgtgcagttcttccggcagga

SEQ ID NO: 401944 - DNA, 25 bp, Mus musculus
aagctgtgcgatctagaccagctca

SEQ ID NO: 401945 - DNA, 25 bp, Mus musculus
aagctgtggcctcctctagcacaca

SEQ ID NO: 401946 - DNA, 25 bp, Mus musculus
aagcttacgattgtctggttcaccc

SEQ ID NO: 401947 - DNA, 25 bp, Mus musculus
aagcttagagctcagcctgctagga

SEQ ID NO: 401948 - DNA, 25 bp, Mus musculus
aagcttagcccgtgcactggcagga

SEQ ID NO: 401949 - DNA, 25 bp, Mus musculus
aagcttctagaagggtacatactgg

SEQ ID NO: 401950 - DNA, 25 bp, Mus musculus
aagcttgctatgtctgtgtgcccag

SEQ ID NO: 401951 - DNA, 25 bp, Mus musculus
aagcttggacattgcgtcaccatgg

SEQ ID NO: 401952 - DNA, 25 bp, Mus musculus
aagcttggcagttgtagtgcatgtc

SEQ ID NO: 401953 - DNA, 25 bp, Mus musculus
aagcttggcgcgatgagtgtcagga

SEQ ID NO: 401954 - DNA, 25 bp, Mus musculus
aagcttgtccaagttaggcgagtcc

SEQ ID NO: 401955 - DNA, 25 bp, Mus musculus
aagcttgtgtattctactgatccaa

SEQ ID NO: 401956 - DNA, 25 bp, Mus musculus
aagctttcttgcagatggtatcaca

SEQ ID NO: 401957 - DNA, 25 bp, Mus musculus
aagctttgcatgtccagtctgggcc

SEQ ID NO: 401958 - DNA, 25 bp, Mus musculus
aagctttggacaggcgaattcatgg

SEQ ID NO: 401959 - DNA, 25 bp, Mus musculus
aaggaaaaaagcctggcgctgagac

SEQ ID NO: 401960 - DNA, 25 bp, Mus musculus
aaggaaacctccctacagcagttga

SEQ ID NO: 401961 - DNA, 25 bp, Mus musculus
aaggaaactatctaattgggctggc

SEQ ID NO: 401962 - DNA, 25 bp, Mus musculus
aaggaaatgcaagtaaccgcctggg

SEQ ID NO: 401963 - DNA, 25 bp, Mus musculus
aaggaacagtgagggagggtctcag

SEQ ID NO: 401964 - DNA, 25 bp, Mus musculus
aaggaacagttcaggctccccagta

SEQ ID NO: 401965 - DNA, 25 bp, Mus musculus
aaggaaccaggcttgattgcagccc

SEQ ID NO: 401966 - DNA, 25 bp, Mus musculus
aaggaaccctcttttctgcagcgtg

SEQ ID NO: 401967 - DNA, 25 bp, Mus musculus
aaggaaccgggccacctgagttgat

SEQ ID NO: 401968 - DNA, 25 bp, Mus musculus
aaggaaccgtggagaagcgctacgc

SEQ ID NO: 401969 - DNA, 25 bp, Mus musculus
aaggaactcatactgcaggctgcaa

SEQ ID NO: 401970 - DNA, 25 bp, Mus musculus
aaggaactcatcttctctgcccgag

SEQ ID NO: 401971 - DNA, 25 bp, Mus musculus
aaggaactgaccatcgtggctggcg

SEQ ID NO: 401972 - DNA, 25 bp, Mus musculus
aaggaagaaagcttggctcgccacg

SEQ ID NO: 401973 - DNA, 25 bp, Mus musculus
aaggaagatgtgtttctgccccagc

SEQ ID NO: 401974 - DNA, 25 bp, Mus musculus
aaggaagctgcaagtaaagcggaag

SEQ ID NO: 401975 - DNA, 25 bp, Mus musculus
aaggaaggagtgctcttattctcca

SEQ ID NO: 401976 - DNA, 25 bp, Mus musculus
aaggaagtaacgctttcagagaaag

SEQ ID NO: 401977 - DNA, 25 bp, Mus musculus
aaggaagtctttgatggcagtggcc

SEQ ID NO: 401978 - DNA, 25 bp, Mus musculus
aaggaagtgtttgttagtggccaca

SEQ ID NO: 401979 - DNA, 25 bp, Mus musculus
aaggaatatgtgagcctgggtgccc

SEQ ID NO: 401980 - DNA, 25 bp, Mus musculus
aaggaatcaaggcaatatggttgtt

SEQ ID NO: 401981 - DNA, 25 bp, Mus musculus
aaggaatgccttgttcatcaaagtg

SEQ ID NO: 401982 - DNA, 25 bp, Mus musculus
aaggacagctacaccctgacagagg

SEQ ID NO: 401983 - DNA, 25 bp, Mus musculus
aaggacattatgtagcccacaggga

SEQ ID NO: 401984 - DNA, 25 bp, Mus musculus
aaggaccacctaagtttaagcagcg

SEQ ID NO: 401985 - DNA, 25 bp, Mus musculus
aaggacccacagctccgtctgcggt

SEQ ID NO: 401986 - DNA, 25 bp, Mus musculus
aaggacctatgcgtttcttgtgaac

SEQ ID NO: 401987 - DNA, 25 bp, Mus musculus
aaggacctgagacatgctttccgca

SEQ ID NO: 401988 - DNA, 25 bp, Mus musculus
aaggaccttcctgagacactatgtc

SEQ ID NO: 401989 - DNA, 25 bp, Mus musculus
aaggacgatgctctttcaacccgaa

SEQ ID NO: 401990 - DNA, 25 bp, Mus musculus
aaggacgtagagttggtggcacacc

SEQ ID NO: 401991 - DNA, 25 bp, Mus musculus
aaggactatccagctgccaagaggg

SEQ ID NO: 401992 - DNA, 25 bp, Mus musculus
aaggactgaggcaggaagccgaacc

SEQ ID NO: 401993 - DNA, 25 bp, Mus musculus
aaggactggcatcgtccctgcctga

SEQ ID NO: 401994 - DNA, 25 bp, Mus musculus
aaggactggctctagcaactgctga

SEQ ID NO: 401995 - DNA, 25 bp, Mus musculus
aaggacttactctgccacaaatggg

SEQ ID NO: 401996 - DNA, 25 bp, Mus musculus
aaggacttcgtgaccgagaggctga

SEQ ID NO: 401997 - DNA, 25 bp, Mus musculus
aaggactttatatcctaccacagag

SEQ ID NO: 401998 - DNA, 25 bp, Mus musculus
aaggactttgaggttcggcacggca

SEQ ID NO: 401999 - DNA, 25 bp, Mus musculus
aaggagaaagccaagtcagcgcctg

SEQ ID NO: 402000 - DNA, 25 bp, Mus musculus
aaggagaatttcagcgcctggcagc

SEQ ID NO: 402001 - DNA, 25 bp, Mus musculus
aaggagaccatcttcttgcagccag

SEQ ID NO: 402002 - DNA, 25 bp, Mus musculus
aaggagagcttcaacaccatcggga

SEQ ID NO: 402003 - DNA, 25 bp, Mus musculus
aaggagagtgaatctgcgtattatc

SEQ ID NO: 402004 - DNA, 25 bp, Mus musculus
aaggagatcatcacattctggcagg

SEQ ID NO: 402005 - DNA, 25 bp, Mus musculus
aaggagattaccaactccccagagt

SEQ ID NO: 402006 - DNA, 25 bp, Mus musculus
aaggagattctctgcggctgcaaca

SEQ ID NO: 402007 - DNA, 25 bp, Mus musculus
aaggagcactctccaggcaagaaga

SEQ ID NO: 402008 - DNA, 25 bp, Mus musculus
aaggagcagcctagatcatcgcggg

SEQ ID NO: 402009 - DNA, 25 bp, Mus musculus
aaggagccaaccatgctggcggcag

SEQ ID NO: 402010 - DNA, 25 bp, Mus musculus
aaggagccaccctgattgcacagag

SEQ ID NO: 402011 - DNA, 25 bp, Mus musculus
aaggagcctgaggtccagcgacagc

SEQ ID NO: 402012 - DNA, 25 bp, Mus musculus
aaggagcgtgcttccgccaaaaggg

SEQ ID NO: 402013 - DNA, 25 bp, Mus musculus
aaggagctcaactacgaccgggagg

SEQ ID NO: 402014 - DNA, 25 bp, Mus musculus
aaggagctcggtcgtcactattcaa

SEQ ID NO: 402015 - DNA, 25 bp, Mus musculus
aaggaggacttctcggaagcggact

SEQ ID NO: 402016 - DNA, 25 bp, Mus musculus
aaggaggccatgagcgtaagtcttc

SEQ ID NO: 402017 - DNA, 25 bp, Mus musculus
aaggaggcccatgctcacaagcctg

SEQ ID NO: 402018 - DNA, 25 bp, Mus musculus
aaggaggctggcgagatctgaatct

SEQ ID NO: 402019 - DNA, 25 bp, Mus musculus
aaggagggcgatgcccaggacgaaa

SEQ ID NO: 402020 - DNA, 25 bp, Mus musculus
aaggagtaccgaatctgcatgccgc

SEQ ID NO: 402021 - DNA, 25 bp, Mus musculus
aaggagtccctctgtaagtctgaag

SEQ ID NO: 402022 - DNA, 25 bp, Mus musculus
aaggagtccggctgtgtggtactaa

SEQ ID NO: 402023 - DNA, 25 bp, Mus musculus
aaggagtcctcagggagtcaccaca

SEQ ID NO: 402024 - DNA, 25 bp, Mus musculus
aaggagtctccagtgtctcctgaca

SEQ ID NO: 402025 - DNA, 25 bp, Mus musculus
aaggagtcttcacccacaagcttag

SEQ ID NO: 402026 - DNA, 25 bp, Mus musculus
aaggagtgcatatgctgcagtgcct

SEQ ID NO: 402027 - DNA, 25 bp, Mus musculus
aaggagtggtgctttggtacaacac

SEQ ID NO: 402028 - DNA, 25 bp, Mus musculus
aaggagtggtggtggcccattacca

SEQ ID NO: 402029 - DNA, 25 bp, Mus musculus
aaggagtgttccagtgtagcgtgac

SEQ ID NO: 402030 - DNA, 25 bp, Mus musculus
aaggagttgtcgcactacatgagca

SEQ ID NO: 402031 - DNA, 25 bp, Mus musculus
aaggatacattccagcaactcctgc

SEQ ID NO: 402032 - DNA, 25 bp, Mus musculus
aaggatatgctctcttggctcggaa

SEQ ID NO: 402033 - DNA, 25 bp, Mus musculus
aaggatcacagctccgatcccgcgt

SEQ ID NO: 402034 - DNA, 25 bp, Mus musculus
aaggatcccaggctagctatgactc

SEQ ID NO: 402035 - DNA, 25 bp, Mus musculus
aaggatccgcgcttatcggtgggaa

SEQ ID NO: 402036 - DNA, 25 bp, Mus musculus
aaggatcgatcctaacatggagagc

SEQ ID NO: 402037 - DNA, 25 bp, Mus musculus
aaggatctcatctggcggtcgggta

SEQ ID NO: 402038 - DNA, 25 bp, Mus musculus
aaggatctgcttcaacgcctacccg

SEQ ID NO: 402039 - DNA, 25 bp, Mus musculus
aaggatctggatattaactgttggc

SEQ ID NO: 402040 - DNA, 25 bp, Mus musculus
aaggatgcatccctatactggtata

SEQ ID NO: 402041 - DNA, 25 bp, Mus musculus
aaggatggccatataaaaattacgg

SEQ ID NO: 402042 - DNA, 25 bp, Mus musculus
aaggatgtaacgaaagccagcggcc

SEQ ID NO: 402043 - DNA, 25 bp, Mus musculus
aaggatgtttcccacactagctggc

SEQ ID NO: 402044 - DNA, 25 bp, Mus musculus
aaggattacctgctttgcttccggg

SEQ ID NO: 402045 - DNA, 25 bp, Mus musculus
aaggattactgctttgcccgggagg

SEQ ID NO: 402046 - DNA, 25 bp, Mus musculus
aaggatttgcgagcccgagtggact

SEQ ID NO: 402047 - DNA, 25 bp, Mus musculus
aaggcaacacaagttgacggacccg

SEQ ID NO: 402048 - DNA, 25 bp, Mus musculus
aaggcaacaccatcaccgagactga

SEQ ID NO: 402049 - DNA, 25 bp, Mus musculus
aaggcaactcggttccccaaggatg

SEQ ID NO: 402050 - DNA, 25 bp, Mus musculus
aaggcaagcagatccacacagggag

SEQ ID NO: 402051 - DNA, 25 bp, Mus musculus
aaggcacacggctttctttctctgt

SEQ ID NO: 402052 - DNA, 25 bp, Mus musculus
aaggcacagatgttggctgcacacc

SEQ ID NO: 402053 - DNA, 25 bp, Mus musculus
aaggcacaggcagcgctcttggaaa

SEQ ID NO: 402054 - DNA, 25 bp, Mus musculus
aaggcacatggagctctctgtaaat

SEQ ID NO: 402055 - DNA, 25 bp, Mus musculus
aaggcaccaagtatgactacgcggg

SEQ ID NO: 402056 - DNA, 25 bp, Mus musculus
aaggcacccgccgaggtaggctggg

SEQ ID NO: 402057 - DNA, 25 bp, Mus musculus
aaggcactaaggatccaccgcttcc

SEQ ID NO: 402058 - DNA, 25 bp, Mus musculus
aaggcactggccaaatctgaagaag

SEQ ID NO: 402059 - DNA, 25 bp, Mus musculus
aaggcacttcagttgggtaatctgg

SEQ ID NO: 402060 - DNA, 25 bp, Mus musculus
aaggcagaccctgacgtaacgctgg

SEQ ID NO: 402061 - DNA, 25 bp, Mus musculus
aaggcagcactgagaaaagagtccg

SEQ ID NO: 402062 - DNA, 25 bp, Mus musculus
aaggcagctacctcgttcggctcag

SEQ ID NO: 402063 - DNA, 25 bp, Mus musculus
aaggcaggcatatcactgtgcattc

SEQ ID NO: 402064 - DNA, 25 bp, Mus musculus
aaggcaggccctgttctctcctaga

SEQ ID NO: 402065 - DNA, 25 bp, Mus musculus
aaggcagggtacctccttcacagga

SEQ ID NO: 402066 - DNA, 25 bp, Mus musculus
aaggcagtaggaggttggtccccag

SEQ ID NO: 402067 - DNA, 25 bp, Mus musculus
aaggcagtggcaccctgtgtcatca

SEQ ID NO: 402068 - DNA, 25 bp, Mus musculus
aaggcatagcatgaatggacgtcca

SEQ ID NO: 402069 - DNA, 25 bp, Mus musculus
aaggcatccagcgagccgagagtta

SEQ ID NO: 402070 - DNA, 25 bp, Mus musculus
aaggcatgatggcactcagcactcg

SEQ ID NO: 402071 - DNA, 25 bp, Mus musculus
aaggcatggcgcagactagaggtac

SEQ ID NO: 402072 - DNA, 25 bp, Mus musculus
aaggcatgtgctcgcaccgccagac

SEQ ID NO: 402073 - DNA, 25 bp, Mus musculus
aaggccaaccaggatcgggtcaagc

SEQ ID NO: 402074 - DNA, 25 bp, Mus musculus
aaggccaagaacaggtgatccccat

SEQ ID NO: 402075 - DNA, 25 bp, Mus musculus
aaggccactgtggacacttcaggga

SEQ ID NO: 402076 - DNA, 25 bp, Mus musculus
aaggccagacctcctaggtcctcaa

SEQ ID NO: 402077 - DNA, 25 bp, Mus musculus
aaggccagcagccatctgtgaagca

SEQ ID NO: 402078 - DNA, 25 bp, Mus musculus
aaggccagggttgcccatttcaaat

SEQ ID NO: 402079 - DNA, 25 bp, Mus musculus
aaggccagtcacatctacaagcaag

SEQ ID NO: 402080 - DNA, 25 bp, Mus musculus
aaggccatcattgtcaccgtgtggg

SEQ ID NO: 402081 - DNA, 25 bp, Mus musculus
aaggccatctgagctaccagcgaga

SEQ ID NO: 402082 - DNA, 25 bp, Mus musculus
aaggcccagcgcttcctccagaagg

SEQ ID NO: 402083 - DNA, 25 bp, Mus musculus
aaggcccagcggaagatcagtgcaa

SEQ ID NO: 402084 - DNA, 25 bp, Mus musculus
aaggcccattcagtttgcgctccgg

SEQ ID NO: 402085 - DNA, 25 bp, Mus musculus
aaggccccgtgcagaaggtgtacaa

SEQ ID NO: 402086 - DNA, 25 bp, Mus musculus
aaggcccgtggcttgatgttgctaa

SEQ ID NO: 402087 - DNA, 25 bp, Mus musculus
aaggcccgtggtgctttacgcagaa

SEQ ID NO: 402088 - DNA, 25 bp, Mus musculus
aaggccctctgatccagtgtgctcc

SEQ ID NO: 402089 - DNA, 25 bp, Mus musculus
aaggccctggcggatgacatcaagg

SEQ ID NO: 402090 - DNA, 25 bp, Mus musculus
aaggccctttgttatagcatccccg

SEQ ID NO: 402091 - DNA, 25 bp, Mus musculus
aaggccgcacggaactgaaagctct

SEQ ID NO: 402092 - DNA, 25 bp, Mus musculus
aaggccgtcaagtaccagagcaagg

SEQ ID NO: 402093 - DNA, 25 bp, Mus musculus
aaggcctctgtgtgtcggcactcta

SEQ ID NO: 402094 - DNA, 25 bp, Mus musculus
aaggcctgccggagataaagattac

SEQ ID NO: 402095 - DNA, 25 bp, Mus musculus
aaggcctgctggtgacagttataca

SEQ ID NO: 402096 - DNA, 25 bp, Mus musculus
aaggccttgcactacccactggttg

SEQ ID NO: 402097 - DNA, 25 bp, Mus musculus
aaggccttggagctagatcccggaa

SEQ ID NO: 402098 - DNA, 25 bp, Mus musculus
aaggccttgggagactgcttatgaa

SEQ ID NO: 402099 - DNA, 25 bp, Mus musculus
aaggcgagccccaggagtccatcag

SEQ ID NO: 402100 - DNA, 25 bp, Mus musculus
aaggcgagctgaacgatgactatcc

SEQ ID NO: 402101 - DNA, 25 bp, Mus musculus
aaggcgcctgagcaaagattccaag

SEQ ID NO: 402102 - DNA, 25 bp, Mus musculus
aaggcgctgccaccaagccggtgac

SEQ ID NO: 402103 - DNA, 25 bp, Mus musculus
aaggcgggcgctgcactatatgact

SEQ ID NO: 402104 - DNA, 25 bp, Mus musculus
aaggctaatagcagaggaggctccc

SEQ ID NO: 402105 - DNA, 25 bp, Mus musculus
aaggctagcccgttcagcgtggaga

SEQ ID NO: 402106 - DNA, 25 bp, Mus musculus
aaggctatctttatggactgtggca

SEQ ID NO: 402107 - DNA, 25 bp, Mus musculus
aaggctcatggttggatgtggccca

SEQ ID NO: 402108 - DNA, 25 bp, Mus musculus
aaggctctaggaggcactgacaaga

SEQ ID NO: 402109 - DNA, 25 bp, Mus musculus
aaggctctgagccaagactggagac

SEQ ID NO: 402110 - DNA, 25 bp, Mus musculus
aaggctgaaccttccaacgtgctga

SEQ ID NO: 402111 - DNA, 25 bp, Mus musculus
aaggctgaactgatcctgtaccgga

SEQ ID NO: 402112 - DNA, 25 bp, Mus musculus
aaggctgacctagcagctgcagagg

SEQ ID NO: 402113 - DNA, 25 bp, Mus musculus
aaggctgactcgctttcaccagggc

SEQ ID NO: 402114 - DNA, 25 bp, Mus musculus
aaggctgagctcttgtcttcctatg

SEQ ID NO: 402115 - DNA, 25 bp, Mus musculus
aaggctgatccctccattgtgcagg

SEQ ID NO: 402116 - DNA, 25 bp, Mus musculus
aaggctgccgtgtccacaaattgca

SEQ ID NO: 402117 - DNA, 25 bp, Mus musculus
aaggctgcgcccagatgatgtgcaa

SEQ ID NO: 402118 - DNA, 25 bp, Mus musculus
aaggctgcgtgtctccccagaatct

SEQ ID NO: 402119 - DNA, 25 bp, Mus musculus
aaggctggtccatgctcctgctggc

SEQ ID NO: 402120 - DNA, 25 bp, Mus musculus
aaggctgtcagctatgggatccaga

SEQ ID NO: 402121 - DNA, 25 bp, Mus musculus
aaggctgttgaagactatatagatg

SEQ ID NO: 402122 - DNA, 25 bp, Mus musculus
aaggcttcaaagcatccctgggagt

SEQ ID NO: 402123 - DNA, 25 bp, Mus musculus
aaggcttctgctctgacgccctcag

SEQ ID NO: 402124 - DNA, 25 bp, Mus musculus
aaggcttgctaatctcccggaggag

SEQ ID NO: 402125 - DNA, 25 bp, Mus musculus
aaggctttggtgttagtcacggaga

SEQ ID NO: 402126 - DNA, 25 bp, Mus musculus
aagggaaatcctgtgagcccggcga

SEQ ID NO: 402127 - DNA, 25 bp, Mus musculus
aagggaaggcatggcacacaacaga

SEQ ID NO: 402128 - DNA, 25 bp, Mus musculus
aagggacaaccttacatcgatgagg

SEQ ID NO: 402129 - DNA, 25 bp, Mus musculus
aagggacaacggtccagcctgacct

SEQ ID NO: 402130 - DNA, 25 bp, Mus musculus
aagggacagcgctggacagtacaga

SEQ ID NO: 402131 - DNA, 25 bp, Mus musculus
aagggacatcgtgcagaccgggttc

SEQ ID NO: 402132 - DNA, 25 bp, Mus musculus
aagggaccgaagaactggctcagca

SEQ ID NO: 402133 - DNA, 25 bp, Mus musculus
aagggacgtcctaaagctgcaagca

SEQ ID NO: 402134 - DNA, 25 bp, Mus musculus
aagggactgtcctcgttcatgcgcg

SEQ ID NO: 402135 - DNA, 25 bp, Mus musculus
aagggagtcttcacttcgcagaggg

SEQ ID NO: 402136 - DNA, 25 bp, Mus musculus
aagggatctccgcatacagctcagg

SEQ ID NO: 402137 - DNA, 25 bp, Mus musculus
aagggattcctttctcggcaccaga

SEQ ID NO: 402138 - DNA, 25 bp, Mus musculus
aagggcaaaccattgccatatggcg

SEQ ID NO: 402139 - DNA, 25 bp, Mus musculus
aagggcaaacgctggcaagagaaca

SEQ ID NO: 402140 - DNA, 25 bp, Mus musculus
aagggcacagtgcagatcaagacac

SEQ ID NO: 402141 - DNA, 25 bp, Mus musculus
aagggcacctcttcgtaatcattga

SEQ ID NO: 402142 - DNA, 25 bp, Mus musculus
aagggcacgtcttcctctatgggct

SEQ ID NO: 402143 - DNA, 25 bp, Mus musculus
aagggcagcccctgtacaaggacaa

SEQ ID NO: 402144 - DNA, 25 bp, Mus musculus
aagggcatatgcctcatcctgcaca

SEQ ID NO: 402145 - DNA, 25 bp, Mus musculus
aagggcatcattccctgtagctgga

SEQ ID NO: 402146 - DNA, 25 bp, Mus musculus
aagggcatcgtttcgctgtctgaca

SEQ ID NO: 402147 - DNA, 25 bp, Mus musculus
aagggcatgtctagcttactgacca

SEQ ID NO: 402148 - DNA, 25 bp, Mus musculus
aagggccagtacagctctctcgtgg

SEQ ID NO: 402149 - DNA, 25 bp, Mus musculus
aagggccagttgtgtccatattgca

SEQ ID NO: 402150 - DNA, 25 bp, Mus musculus
aagggcccttctccgtgagctggaa

SEQ ID NO: 402151 - DNA, 25 bp, Mus musculus
aagggccgtcacagaagctttcatt

SEQ ID NO: 402152 - DNA, 25 bp, Mus musculus
aagggccgtctctccgtttgcagaa

SEQ ID NO: 402153 - DNA, 25 bp, Mus musculus
aagggccgtgaagatccagcaagga

SEQ ID NO: 402154 - DNA, 25 bp, Mus musculus
aagggcctgggcactgtacatatct

SEQ ID NO: 402155 - DNA, 25 bp, Mus musculus
aagggcgcagcctcagtctgggaaa

SEQ ID NO: 402156 - DNA, 25 bp, Mus musculus
aagggcgtgtccgaggagtctcttt

SEQ ID NO: 402157 - DNA, 25 bp, Mus musculus
aagggctgccatctctgttctaggg

SEQ ID NO: 402158 - DNA, 25 bp, Mus musculus
aagggctgcgcgaatacttcggcca

SEQ ID NO: 402159 - DNA, 25 bp, Mus musculus
aagggctgctctgcaaacgaatcga

SEQ ID NO: 402160 - DNA, 25 bp, Mus musculus
aagggctggaccttgccgccagagt

SEQ ID NO: 402161 - DNA, 25 bp, Mus musculus
aagggcttatggcagggactttcct

SEQ ID NO: 402162 - DNA, 25 bp, Mus musculus
aagggcttccttagcagggacagaa

SEQ ID NO: 402163 - DNA, 25 bp, Mus musculus
aagggctttccgttatctggtgtgg

SEQ ID NO: 402164 - DNA, 25 bp, Mus musculus
aagggtacatactggcttgcaggct

SEQ ID NO: 402165 - DNA, 25 bp, Mus musculus
aagggtactgtagaggacagagaca

SEQ ID NO: 402166 - DNA, 25 bp, Mus musculus
aagggtagaccgtgaagccagtgca

SEQ ID NO: 402167 - DNA, 25 bp, Mus musculus
aagggtcgtctaatccagctgggca

SEQ ID NO: 402168 - DNA, 25 bp, Mus musculus
aagggtctcgtattgccgctgctgg

SEQ ID NO: 402169 - DNA, 25 bp, Mus musculus
aagggtgaccgcctgactaggactt

SEQ ID NO: 402170 - DNA, 25 bp, Mus musculus
aagggtgcctggagtccacctttgg

SEQ ID NO: 402171 - DNA, 25 bp, Mus musculus
aagggtgctgcctcgctgtgttcag

SEQ ID NO: 402172 - DNA, 25 bp, Mus musculus
aagggtttccgggatgcttcatccg

SEQ ID NO: 402173 - DNA, 25 bp, Mus musculus
aaggtaactgactaatggaagctgc

SEQ ID NO: 402174 - DNA, 25 bp, Mus musculus
aaggtaccactgaggagatctgcca

SEQ ID NO: 402175 - DNA, 25 bp, Mus musculus
aaggtactgctctgaggtctcccca

SEQ ID NO: 402176 - DNA, 25 bp, Mus musculus
aaggtactgggcacctttagctggg

SEQ ID NO: 402177 - DNA, 25 bp, Mus musculus
aaggtaggcttggaggctctgtaat

SEQ ID NO: 402178 - DNA, 25 bp, Mus musculus
aaggtatgctgcgtctgagggctct

SEQ ID NO: 402179 - DNA, 25 bp, Mus musculus
aaggtattcacaccgcctctgcctg

SEQ ID NO: 402180 - DNA, 25 bp, Mus musculus
aaggtcacagtgtcctcccttacca

SEQ ID NO: 402181 - DNA, 25 bp, Mus musculus
aaggtcagagagagcaccgtttggt

SEQ ID NO: 402182 - DNA, 25 bp, Mus musculus
aaggtcagagatttcctcactggag

SEQ ID NO: 402183 - DNA, 25 bp, Mus musculus
aaggtcatctcatcccgggaacagg

SEQ ID NO: 402184 - DNA, 25 bp, Mus musculus
aaggtcatgtccgaggccgagaagc

SEQ ID NO: 402185 - DNA, 25 bp, Mus musculus
aaggtcattcgggtcattgtccaca

SEQ ID NO: 402186 - DNA, 25 bp, Mus musculus
aaggtccggtccattctgtgctgca

SEQ ID NO: 402187 - DNA, 25 bp, Mus musculus
aaggtcctaagtcagcctcaccagc

SEQ ID NO: 402188 - DNA, 25 bp, Mus musculus
aaggtcctgagcacatagactgggc

SEQ ID NO: 402189 - DNA, 25 bp, Mus musculus
aaggtcctgaggtgccaaattgccc

SEQ ID NO: 402190 - DNA, 25 bp, Mus musculus
aaggtcgccttctagtcacttgcca

SEQ ID NO: 402191 - DNA, 25 bp, Mus musculus
aaggtcggaaactctggcgcgtcta

SEQ ID NO: 402192 - DNA, 25 bp, Mus musculus
aaggtcggatgatgagagccctagc

SEQ ID NO: 402193 - DNA, 25 bp, Mus musculus
aaggtctccaagctactctcctgag

SEQ ID NO: 402194 - DNA, 25 bp, Mus musculus
aaggtctccagcagccatcagggta

SEQ ID NO: 402195 - DNA, 25 bp, Mus musculus
aaggtctcccatgtgctaagtctgc

SEQ ID NO: 402196 - DNA, 25 bp, Mus musculus
aaggtctcctgctccgtctcgagag

SEQ ID NO: 402197 - DNA, 25 bp, Mus musculus
aaggtctgcccacgcccgtgtgttc

SEQ ID NO: 402198 - DNA, 25 bp, Mus musculus
aaggtctggatcttggagcctggca

SEQ ID NO: 402199 - DNA, 25 bp, Mus musculus
aaggtctggtgttggctgcttgaca

SEQ ID NO: 402200 - DNA, 25 bp, Mus musculus
aaggtcttctctcaccgaggtggca

SEQ ID NO: 402201 - DNA, 25 bp, Mus musculus
aaggtctttgggtcggctacagtgt

SEQ ID NO: 402202 - DNA, 25 bp, Mus musculus
aaggtgaactagacccgtcctcagg

SEQ ID NO: 402203 - DNA, 25 bp, Mus musculus
aaggtgacagcaatcaaggccgaag

SEQ ID NO: 402204 - DNA, 25 bp, Mus musculus
aaggtgacatctgggtaagtggctt

SEQ ID NO: 402205 - DNA, 25 bp, Mus musculus
aaggtgacccgtatgtgcttcgcag

SEQ ID NO: 402206 - DNA, 25 bp, Mus musculus
aaggtgactcaagagcctgaccacg

SEQ ID NO: 402207 - DNA, 25 bp, Mus musculus
aaggtgacttttcatatacatgctg

SEQ ID NO: 402208 - DNA, 25 bp, Mus musculus
aaggtgataaatctcttccggccca

SEQ ID NO: 402209 - DNA, 25 bp, Mus musculus
aaggtgattccagcccgggcttgag

SEQ ID NO: 402210 - DNA, 25 bp, Mus musculus
aaggtgcatgagagcaggaagttct

SEQ ID NO: 402211 - DNA, 25 bp, Mus musculus
aaggtgccctttgactagcctagaa

SEQ ID NO: 402212 - DNA, 25 bp, Mus musculus
aaggtgcctctttggatcgttcgca

SEQ ID NO: 402213 - DNA, 25 bp, Mus musculus
aaggtgctacccaagtcacgcaggg

SEQ ID NO: 402214 - DNA, 25 bp, Mus musculus
aaggtgctcccgctactcagaagtg

SEQ ID NO: 402215 - DNA, 25 bp, Mus musculus
aaggtgctctgttataaaggcatgc

SEQ ID NO: 402216 - DNA, 25 bp, Mus musculus
aaggtgctgattccctgctacgaag

SEQ ID NO: 402217 - DNA, 25 bp, Mus musculus
aaggtgctggacatccgagagacag

SEQ ID NO: 402218 - DNA, 25 bp, Mus musculus
aaggtgcttgctgataagcccagca

SEQ ID NO: 402219 - DNA, 25 bp, Mus musculus
aaggtggaccttttgacctcaagca

SEQ ID NO: 402220 - DNA, 25 bp, Mus musculus
aaggtggctacttggatgtcatccg

SEQ ID NO: 402221 - DNA, 25 bp, Mus musculus
aaggtggctgccttcttcgtggccg

SEQ ID NO: 402222 - DNA, 25 bp, Mus musculus
aaggtgggccttacgtctcatcagg

SEQ ID NO: 402223 - DNA, 25 bp, Mus musculus
aaggtggtgcagtctttccggtacg

SEQ ID NO: 402224 - DNA, 25 bp, Mus musculus
aaggtgtcggtggaaaatgctctgc

SEQ ID NO: 402225 - DNA, 25 bp, Mus musculus
aaggtgtggtacgacatgttccgag

SEQ ID NO: 402226 - DNA, 25 bp, Mus musculus
aaggtgttgcgtgaaacggcgaatc

SEQ ID NO: 402227 - DNA, 25 bp, Mus musculus
aaggtgttggagctagaccctgccc

SEQ ID NO: 402228 - DNA, 25 bp, Mus musculus
aaggtgtttcttggttattgagctc

SEQ ID NO: 402229 - DNA, 25 bp, Mus musculus
aaggttactcttacaatatccggca

SEQ ID NO: 402230 - DNA, 25 bp, Mus musculus
aaggttagttcctgcacttgagggc

SEQ ID NO: 402231 - DNA, 25 bp, Mus musculus
aaggttctcactgcgctcacaagga

SEQ ID NO: 402232 - DNA, 25 bp, Mus musculus
aaggttctccttggaccgccacaag

SEQ ID NO: 402233 - DNA, 25 bp, Mus musculus
aaggttgcagaaacttgtaaggcat

SEQ ID NO: 402234 - DNA, 25 bp, Mus musculus
aaggttgcagcttggtgcccacaga

SEQ ID NO: 402235 - DNA, 25 bp, Mus musculus
aaggttggacctcactcttgcggac

SEQ ID NO: 402236 - DNA, 25 bp, Mus musculus
aaggttgtgtgcaggcgaccaagat

SEQ ID NO: 402237 - DNA, 25 bp, Mus musculus
aaggtttactgtagcactcgggagc

SEQ ID NO: 402238 - DNA, 25 bp, Mus musculus
aaggtttatggaggtgatgaccgca

SEQ ID NO: 402239 - DNA, 25 bp, Mus musculus
aaggtttcttcgttgcatttcacag

SEQ ID NO: 402240 - DNA, 25 bp, Mus musculus
aagtaaaaagtaaatgcaagcccag

SEQ ID NO: 402241 - DNA, 25 bp, Mus musculus
aagtaaaaagtctcgaactcgccag

SEQ ID NO: 402242 - DNA, 25 bp, Mus musculus
aagtaaatgcctggacttccggcca

SEQ ID NO: 402243 - DNA, 25 bp, Mus musculus
aagtaaccagcccttgtgccctgtg

SEQ ID NO: 402244 - DNA, 25 bp, Mus musculus
aagtaacccagtccacgagattcag

SEQ ID NO: 402245 - DNA, 25 bp, Mus musculus
aagtaacgcttcttccaggacaggg

SEQ ID NO: 402246 - DNA, 25 bp, Mus musculus
aagtaacggcagcacacggactgca

SEQ ID NO: 402247 - DNA, 25 bp, Mus musculus
aagtaatgtttaaagtgtgccgcga

SEQ ID NO: 402248 - DNA, 25 bp, Mus musculus
aagtacaagcactggaaaaaggaga

SEQ ID NO: 402249 - DNA, 25 bp, Mus musculus
aagtacaatgacatcctcttccagg

SEQ ID NO: 402250 - DNA, 25 bp, Mus musculus
aagtacagaggcttcaccatcccag

SEQ ID NO: 402251 - DNA, 25 bp, Mus musculus
aagtacattatctccctggaccagg

SEQ ID NO: 402252 - DNA, 25 bp, Mus musculus
aagtaccacactgctcttgctcaga

SEQ ID NO: 402253 - DNA, 25 bp, Mus musculus
aagtacccagaagtgctcctcgtgc

SEQ ID NO: 402254 - DNA, 25 bp, Mus musculus
aagtaccccattgttggctacacag

SEQ ID NO: 402255 - DNA, 25 bp, Mus musculus
aagtacctgtctctagcgctcgacg

SEQ ID NO: 402256 - DNA, 25 bp, Mus musculus
aagtactgcagaccctaactccgga

SEQ ID NO: 402257 - DNA, 25 bp, Mus musculus
aagtactgtgcctccttgggacaca

SEQ ID NO: 402258 - DNA, 25 bp, Mus musculus
aagtacttttctctcccatccgtgg

SEQ ID NO: 402259 - DNA, 25 bp, Mus musculus
aagtagaggaagcacccagctgtcg

SEQ ID NO: 402260 - DNA, 25 bp, Mus musculus
aagtagatcgtcctccagagcagag

SEQ ID NO: 402261 - DNA, 25 bp, Mus musculus
aagtagccagctaattcccgagtgc

SEQ ID NO: 402262 - DNA, 25 bp, Mus musculus
aagtagcggcgctcaatggacagag

SEQ ID NO: 402263 - DNA, 25 bp, Mus musculus
aagtagctcagatgcaaggacagtc

SEQ ID NO: 402264 - DNA, 25 bp, Mus musculus
aagtagttcatctgcctcctctggg

SEQ ID NO: 402265 - DNA, 25 bp, Mus musculus
aagtatacctatgcccttgtgcgcg

SEQ ID NO: 402266 - DNA, 25 bp, Mus musculus
aagtatacgcggatggctgggctca

SEQ ID NO: 402267 - DNA, 25 bp, Mus musculus
aagtatcacacccttgactcctaac

SEQ ID NO: 402268 - DNA, 25 bp, Mus musculus
aagtatccacagtctctctgcccag

SEQ ID NO: 402269 - DNA, 25 bp, Mus musculus
aagtatgagctgatgcgcccatcca

SEQ ID NO: 402270 - DNA, 25 bp, Mus musculus
aagtatgcagcagtgactacccggg

SEQ ID NO: 402271 - DNA, 25 bp, Mus musculus
aagtatgcctcccaagttcaagcgc

SEQ ID NO: 402272 - DNA, 25 bp, Mus musculus
aagtatggactctcaggctgctgca

SEQ ID NO: 402273 - DNA, 25 bp, Mus musculus
aagtattacatcttacggcccgagg

SEQ ID NO: 402274 - DNA, 25 bp, Mus musculus
aagtattcctgctagcggctcccag

SEQ ID NO: 402275 - DNA, 25 bp, Mus musculus
aagtatttccttcgccagtccctgg

SEQ ID NO: 402276 - DNA, 25 bp, Mus musculus
aagtatttgcaaactagaatcttta

SEQ ID NO: 402277 - DNA, 25 bp, Mus musculus
aagtcaaaagcaaggtccatcccca

SEQ ID NO: 402278 - DNA, 25 bp, Mus musculus
aagtcaaaagtcagggcagcgcctc

SEQ ID NO: 402279 - DNA, 25 bp, Mus musculus
aagtcaacgacaccagcgatggcag

SEQ ID NO: 402280 - DNA, 25 bp, Mus musculus
aagtcaatgcgtgtatcccctgcca

SEQ ID NO: 402281 - DNA, 25 bp, Mus musculus
aagtcacagaacaaccttgggtgtc

SEQ ID NO: 402282 - DNA, 25 bp, Mus musculus
aagtcacagagccatccccgagact

SEQ ID NO: 402283 - DNA, 25 bp, Mus musculus
aagtcacagaggttgatagttctgg

SEQ ID NO: 402284 - DNA, 25 bp, Mus musculus
aagtcaccaggatggaatctgtggg

SEQ ID NO: 402285 - DNA, 25 bp, Mus musculus
aagtcaccccggctaacgtcagtgg

SEQ ID NO: 402286 - DNA, 25 bp, Mus musculus
aagtcaccctgatctcgctgctaag

SEQ ID NO: 402287 - DNA, 25 bp, Mus musculus
aagtcaccttcctctgaatttaggc

SEQ ID NO: 402288 - DNA, 25 bp, Mus musculus
aagtcacgaagcactggcatccagc

SEQ ID NO: 402289 - DNA, 25 bp, Mus musculus
aagtcacgcactctcacaactgcag

SEQ ID NO: 402290 - DNA, 25 bp, Mus musculus
aagtcactcagctgtactcaggaag

SEQ ID NO: 402291 - DNA, 25 bp, Mus musculus
aagtcagacccctacgccaaggtga

SEQ ID NO: 402292 - DNA, 25 bp, Mus musculus
aagtcaggagagctgcagtacactg

SEQ ID NO: 402293 - DNA, 25 bp, Mus musculus
aagtcaggtaatagagtgttagtcc

SEQ ID NO: 402294 - DNA, 25 bp, Mus musculus
aagtcagtttggacacagcaggccc

SEQ ID NO: 402295 - DNA, 25 bp, Mus musculus
aagtcatcacagagaccccaaaagg

SEQ ID NO: 402296 - DNA, 25 bp, Mus musculus
aagtcatccctgcacagagtaggtg

SEQ ID NO: 402297 - DNA, 25 bp, Mus musculus
aagtcatccttgtttccatatacga

SEQ ID NO: 402298 - DNA, 25 bp, Mus musculus
aagtcatctgctacgcttcgctgag

SEQ ID NO: 402299 - DNA, 25 bp, Mus musculus
aagtcatggagttgtagcggcaccc

SEQ ID NO: 402300 - DNA, 25 bp, Mus musculus
aagtcatgggaactgctgtagccca

SEQ ID NO: 402301 - DNA, 25 bp, Mus musculus
aagtcattccagcaatctcttcggg

SEQ ID NO: 402302 - DNA, 25 bp, Mus musculus
aagtccaagtcttgtagcgccggcg

SEQ ID NO: 402303 - DNA, 25 bp, Mus musculus
aagtccagagctaagctccgcctcg

SEQ ID NO: 402304 - DNA, 25 bp, Mus musculus
aagtccaggcagtgaacaaccaggg

SEQ ID NO: 402305 - DNA, 25 bp, Mus musculus
aagtccattgaggtgctacggcggc

SEQ ID NO: 402306 - DNA, 25 bp, Mus musculus
aagtcccagagatggcttcagaaaa

SEQ ID NO: 402307 - DNA, 25 bp, Mus musculus
aagtcccagcgcctgccttgcgggt

SEQ ID NO: 402308 - DNA, 25 bp, Mus musculus
aagtcccatgggacttcctggctgc

SEQ ID NO: 402309 - DNA, 25 bp, Mus musculus
aagtcccgggacagaggtgcagaat

SEQ ID NO: 402310 - DNA, 25 bp, Mus musculus
aagtcccgggtgatcttccagctaa

SEQ ID NO: 402311 - DNA, 25 bp, Mus musculus
aagtccctgactcggagcacaatgg

SEQ ID NO: 402312 - DNA, 25 bp, Mus musculus
aagtccctgagctgatgtcccctct

SEQ ID NO: 402313 - DNA, 25 bp, Mus musculus
aagtccctgagggtcatatattgac

SEQ ID NO: 402314 - DNA, 25 bp, Mus musculus
aagtcctaccaagtccctgagctga

SEQ ID NO: 402315 - DNA, 25 bp, Mus musculus
aagtcctagtccaacacttcaacag

SEQ ID NO: 402316 - DNA, 25 bp, Mus musculus
aagtcctatcggtcagctagcccag

SEQ ID NO: 402317 - DNA, 25 bp, Mus musculus
aagtcctgcctcagatgctgtagca

SEQ ID NO: 402318 - DNA, 25 bp, Mus musculus
aagtcctgctcttatcatctgccga

SEQ ID NO: 402319 - DNA, 25 bp, Mus musculus
aagtcctgcttaccccagctgggag

SEQ ID NO: 402320 - DNA, 25 bp, Mus musculus
aagtcctgtctctctgcaggttcca

SEQ ID NO: 402321 - DNA, 25 bp, Mus musculus
aagtccttctggcattaattcacaa

SEQ ID NO: 402322 - DNA, 25 bp, Mus musculus
aagtcgctctcggtatcctgttgga

SEQ ID NO: 402323 - DNA, 25 bp, Mus musculus
aagtcggataatggcagcgccttac

SEQ ID NO: 402324 - DNA, 25 bp, Mus musculus
aagtcggttacaacttcgtgtccag

SEQ ID NO: 402325 - DNA, 25 bp, Mus musculus
aagtcggttacacctcttggccaga

SEQ ID NO: 402326 - DNA, 25 bp, Mus musculus
aagtcgtaagtaagagcggcagccc

SEQ ID NO: 402327 - DNA, 25 bp, Mus musculus
aagtctcaaggacaccattgcccgg

SEQ ID NO: 402328 - DNA, 25 bp, Mus musculus
aagtctcagcgggtggaagccatca

SEQ ID NO: 402329 - DNA, 25 bp, Mus musculus
aagtctcctccacagacatccagtt

SEQ ID NO: 402330 - DNA, 25 bp, Mus musculus
aagtctctctctctggtaaatgtac

SEQ ID NO: 402331 - DNA, 25 bp, Mus musculus
aagtctctcttgcacagccctggag

SEQ ID NO: 402332 - DNA, 25 bp, Mus musculus
aagtctctggaagagcgaggccgca

SEQ ID NO: 402333 - DNA, 25 bp, Mus musculus
aagtctctgtcctgccaggccgtgg

SEQ ID NO: 402334 - DNA, 25 bp, Mus musculus
aagtctcttcgcaggaggttctgaa

SEQ ID NO: 402335 - DNA, 25 bp, Mus musculus
aagtctctttgtagcccagtttggc

SEQ ID NO: 402336 - DNA, 25 bp, Mus musculus
aagtctgacccttccctaatggatg

SEQ ID NO: 402337 - DNA, 25 bp, Mus musculus
aagtctgagtgccttgaccggacca

SEQ ID NO: 402338 - DNA, 25 bp, Mus musculus
aagtctgcgctgaagcccatcagaa

SEQ ID NO: 402339 - DNA, 25 bp, Mus musculus
aagtctggaaattgtggctgaccca

SEQ ID NO: 402340 - DNA, 25 bp, Mus musculus
aagtctggcagagaaaagccccggc

SEQ ID NO: 402341 - DNA, 25 bp, Mus musculus
aagtctgggcgctggagctaaacca

SEQ ID NO: 402342 - DNA, 25 bp, Mus musculus
aagtctgttggtgtcttcgccctaa

SEQ ID NO: 402343 - DNA, 25 bp, Mus musculus
aagtcttaactctttttgtctctgc

SEQ ID NO: 402344 - DNA, 25 bp, Mus musculus
aagtcttccacattgaggagctgca

SEQ ID NO: 402345 - DNA, 25 bp, Mus musculus
aagtcttcgtttcaccatggcaggg

SEQ ID NO: 402346 - DNA, 25 bp, Mus musculus
aagtcttgagactggaaacaaccaa

SEQ ID NO: 402347 - DNA, 25 bp, Mus musculus
aagtcttgttgggactgcgtgacag

SEQ ID NO: 402348 - DNA, 25 bp, Mus musculus
aagtctttccggaacgcagcgggag

SEQ ID NO: 402349 - DNA, 25 bp, Mus musculus
aagtctttgacaagtccccgcagag

SEQ ID NO: 402350 - DNA, 25 bp, Mus musculus
aagtgaaaggcatgagtttgccagg

SEQ ID NO: 402351 - DNA, 25 bp, Mus musculus
aagtgaacaccttgcaatcttctgc

SEQ ID NO: 402352 - DNA, 25 bp, Mus musculus
aagtgaacactgacggtgagattgg

SEQ ID NO: 402353 - DNA, 25 bp, Mus musculus
aagtgaacatgtttctaagaaccac

SEQ ID NO: 402354 - DNA, 25 bp, Mus musculus
aagtgaagctttggagttcgttcca

SEQ ID NO: 402355 - DNA, 25 bp, Mus musculus
aagtgaagggtaaagccgctctgcc

SEQ ID NO: 402356 - DNA, 25 bp, Mus musculus
aagtgaagtccctgccttctaggaa

SEQ ID NO: 402357 - DNA, 25 bp, Mus musculus
aagtgaatgttgatgctggccctcg

SEQ ID NO: 402358 - DNA, 25 bp, Mus musculus
aagtgaccccacattccagaagcgg

SEQ ID NO: 402359 - DNA, 25 bp, Mus musculus
aagtgactacttgcagggagttccc

SEQ ID NO: 402360 - DNA, 25 bp, Mus musculus
aagtgactccaaactgcagtgccgg

SEQ ID NO: 402361 - DNA, 25 bp, Mus musculus
aagtgagaatcttgcaggacctgcc

SEQ ID NO: 402362 - DNA, 25 bp, Mus musculus
aagtgagcagcattgtaaaggaggc

SEQ ID NO: 402363 - DNA, 25 bp, Mus musculus
aagtgagcatcctttcccgcctaag

SEQ ID NO: 402364 - DNA, 25 bp, Mus musculus
aagtgagctacaggcaaccaaaccg

SEQ ID NO: 402365 - DNA, 25 bp, Mus musculus
aagtgaggatacagtggagatgcca

SEQ ID NO: 402366 - DNA, 25 bp, Mus musculus
aagtgatacagttaaatggccccgg

SEQ ID NO: 402367 - DNA, 25 bp, Mus musculus
aagtgatctacagtgatgcccggcg

SEQ ID NO: 402368 - DNA, 25 bp, Mus musculus
aagtgatcttctgggacctgcctgg

SEQ ID NO: 402369 - DNA, 25 bp, Mus musculus
aagtgatgacttatggcgaacggcc

SEQ ID NO: 402370 - DNA, 25 bp, Mus musculus
aagtgatgagttgggttgtcagcct

SEQ ID NO: 402371 - DNA, 25 bp, Mus musculus
aagtgatgctcaatgggtccctccg

SEQ ID NO: 402372 - DNA, 25 bp, Mus musculus
aagtgatgtcgctgtcagtggcgcc

SEQ ID NO: 402373 - DNA, 25 bp, Mus musculus
aagtgattgtgtgtccaggttggtt

SEQ ID NO: 402374 - DNA, 25 bp, Mus musculus
aagtgcaaaccccttgcttcgagtc

SEQ ID NO: 402375 - DNA, 25 bp, Mus musculus
aagtgcaccttcaacagcacatggg

SEQ ID NO: 402376 - DNA, 25 bp, Mus musculus
aagtgcagccaagctcaagcgcaaa

SEQ ID NO: 402377 - DNA, 25 bp, Mus musculus
aagtgcagcctgacgggcctccgtc

SEQ ID NO: 402378 - DNA, 25 bp, Mus musculus
aagtgcatcattacacagagcccag

SEQ ID NO: 402379 - DNA, 25 bp, Mus musculus
aagtgccgccaccatcgagaagaaa

SEQ ID NO: 402380 - DNA, 25 bp, Mus musculus
aagtgccgcctacaggtaagaacag

SEQ ID NO: 402381 - DNA, 25 bp, Mus musculus
aagtgcctggagacctttgacgatc

SEQ ID NO: 402382 - DNA, 25 bp, Mus musculus
aagtgccttacaacgtgggacctgg

SEQ ID NO: 402383 - DNA, 25 bp, Mus musculus
aagtgcgaagagctccggaaatcca

SEQ ID NO: 402384 - DNA, 25 bp, Mus musculus
aagtgctgaccatccgcttctccag

SEQ ID NO: 402385 - DNA, 25 bp, Mus musculus
aagtgctgctgtaccagtgagctgc

SEQ ID NO: 402386 - DNA, 25 bp, Mus musculus
aagtgctggcgcaatcgcggcacga

SEQ ID NO: 402387 - DNA, 25 bp, Mus musculus
aagtgctgttcccagactagcacgt

SEQ ID NO: 402388 - DNA, 25 bp, Mus musculus
aagtgcttcttctcaggtctgccag

SEQ ID NO: 402389 - DNA, 25 bp, Mus musculus
aagtgcttgtaacctctgagtgatt

SEQ ID NO: 402390 - DNA, 25 bp, Mus musculus
aagtgcttttctcctgccccgtgag

SEQ ID NO: 402391 - DNA, 25 bp, Mus musculus
aagtggacatggacaaactcctggg

SEQ ID NO: 402392 - DNA, 25 bp, Mus musculus
aagtggaccgatgctaatttcttat

SEQ ID NO: 402393 - DNA, 25 bp, Mus musculus
aagtggacctttgcacacttgtggg

SEQ ID NO: 402394 - DNA, 25 bp, Mus musculus
aagtggactctggtatgggaactca

SEQ ID NO: 402395 - DNA, 25 bp, Mus musculus
aagtggcatacagcgtcactcaccg

SEQ ID NO: 402396 - DNA, 25 bp, Mus musculus
aagtggcatcccagtaaataaaagc

SEQ ID NO: 402397 - DNA, 25 bp, Mus musculus
aagtggcattgctcagccttggatg

SEQ ID NO: 402398 - DNA, 25 bp, Mus musculus
aagtggccaacttctactacgagcc

SEQ ID NO: 402399 - DNA, 25 bp, Mus musculus
aagtggccaagctggtacgcgtgct

SEQ ID NO: 402400 - DNA, 25 bp, Mus musculus
aagtggccactccacgcctgtggga

SEQ ID NO: 402401 - DNA, 25 bp, Mus musculus
aagtggccagatgggcggaaccacg

SEQ ID NO: 402402 - DNA, 25 bp, Mus musculus
aagtggccagtgtgtatgaatctcc

SEQ ID NO: 402403 - DNA, 25 bp, Mus musculus
aagtggccgtggtcctcctggaaag

SEQ ID NO: 402404 - DNA, 25 bp, Mus musculus
aagtggcttccccagcgttgagctg

SEQ ID NO: 402405 - DNA, 25 bp, Mus musculus
aagtgggcgagctggcagaactctt

SEQ ID NO: 402406 - DNA, 25 bp, Mus musculus
aagtgggtcatattttcaagacagg

SEQ ID NO: 402407 - DNA, 25 bp, Mus musculus
aagtgggtgctctgaacgccgctgt

SEQ ID NO: 402408 - DNA, 25 bp, Mus musculus
aagtggtaaaccaacagaatgctcc

SEQ ID NO: 402409 - DNA, 25 bp, Mus musculus
aagtggtatcacaccctgagggagc

SEQ ID NO: 402410 - DNA, 25 bp, Mus musculus
aagtggtcagctgttctgcagccca

SEQ ID NO: 402411 - DNA, 25 bp, Mus musculus
aagtgtacatcctgaccaggcctgg

SEQ ID NO: 402412 - DNA, 25 bp, Mus musculus
aagtgtcaggatgcccccctggatg

SEQ ID NO: 402413 - DNA, 25 bp, Mus musculus
aagtgtccaggcgagcagggcctaa

SEQ ID NO: 402414 - DNA, 25 bp, Mus musculus
aagtgtcccagttcatccgcaagca

SEQ ID NO: 402415 - DNA, 25 bp, Mus musculus
aagtgtcgccgatgccaggaatcga

SEQ ID NO: 402416 - DNA, 25 bp, Mus musculus
aagtgtcttgacagagaacctaagc

SEQ ID NO: 402417 - DNA, 25 bp, Mus musculus
aagtgtgactaccaccagccaggat

SEQ ID NO: 402418 - DNA, 25 bp, Mus musculus
aagtgtgacttaacaggaggcggcc

SEQ ID NO: 402419 - DNA, 25 bp, Mus musculus
aagtgtgcaacctggcctggtccaa

SEQ ID NO: 402420 - DNA, 25 bp, Mus musculus
aagtgtgcccatgtccctatctaag

SEQ ID NO: 402421 - DNA, 25 bp, Mus musculus
aagtgtgtgaacgaaggctacgccc

SEQ ID NO: 402422 - DNA, 25 bp, Mus musculus
aagtgtgtgacagagcctagaagcc

SEQ ID NO: 402423 - DNA, 25 bp, Mus musculus
aagtgttactattatcacgcccggg

SEQ ID NO: 402424 - DNA, 25 bp, Mus musculus
aagtgttagcctcctgatttgtctc

SEQ ID NO: 402425 - DNA, 25 bp, Mus musculus
aagtgttcagataggtggctccagg

SEQ ID NO: 402426 - DNA, 25 bp, Mus musculus
aagtgttcccgaatgcatttgcaca

SEQ ID NO: 402427 - DNA, 25 bp, Mus musculus
aagtgttccttccttgacgcctgag

SEQ ID NO: 402428 - DNA, 25 bp, Mus musculus
aagtgtttcctttccacggcatgcg

SEQ ID NO: 402429 - DNA, 25 bp, Mus musculus
aagtgtttgccagagcgtgtcagcc

SEQ ID NO: 402430 - DNA, 25 bp, Mus musculus
aagtgttttctatgtcgctgcgccg

SEQ ID NO: 402431 - DNA, 25 bp, Mus musculus
aagtgtttttcctcatcaccaaggg

SEQ ID NO: 402432 - DNA, 25 bp, Mus musculus
aagttacagaaagaatgcgttccag

SEQ ID NO: 402433 - DNA, 25 bp, Mus musculus
aagttacataaccaagtgtgtcagc

SEQ ID NO: 402434 - DNA, 25 bp, Mus musculus
aagttagctttagttccacagggag

SEQ ID NO: 402435 - DNA, 25 bp, Mus musculus
aagttcaaacgggagacagacggca

SEQ ID NO: 402436 - DNA, 25 bp, Mus musculus
aagttcaaatatgcttgcaggcaag

SEQ ID NO: 402437 - DNA, 25 bp, Mus musculus
aagttcaggcatagcttgggtctcc

SEQ ID NO: 402438 - DNA, 25 bp, Mus musculus
aagttcatggtcatccttagttagc

SEQ ID NO: 402439 - DNA, 25 bp, Mus musculus
aagttcccacaatgtcagtgtccag

SEQ ID NO: 402440 - DNA, 25 bp, Mus musculus
aagttcgccaacctaaacgagcagg

SEQ ID NO: 402441 - DNA, 25 bp, Mus musculus
aagttctggatcaccaatggccctg

SEQ ID NO: 402442 - DNA, 25 bp, Mus musculus
aagttctgtacaccagccaggttct

SEQ ID NO: 402443 - DNA, 25 bp, Mus musculus
aagttcttctaggtgatgccggccc

SEQ ID NO: 402444 - DNA, 25 bp, Mus musculus
aagttgacagagaaaggcaaggata

SEQ ID NO: 402445 - DNA, 25 bp, Mus musculus
aagttgacctgcgatctgtatggga

SEQ ID NO: 402446 - DNA, 25 bp, Mus musculus
aagttgactggcctctttagcagcc

SEQ ID NO: 402447 - DNA, 25 bp, Mus musculus
aagttgagagttgatcctgtgcccc

SEQ ID NO: 402448 - DNA, 25 bp, Mus musculus
aagttgagattcttggtgtcagacc

SEQ ID NO: 402449 - DNA, 25 bp, Mus musculus
aagttgcacagaccagagcttcagg

SEQ ID NO: 402450 - DNA, 25 bp, Mus musculus
aagttgcaggctgacgaccatcgag

SEQ ID NO: 402451 - DNA, 25 bp, Mus musculus
aagttgcagtggaagtagcgtcccc

SEQ ID NO: 402452 - DNA, 25 bp, Mus musculus
aagttgcctggctccttgcgtgccc

SEQ ID NO: 402453 - DNA, 25 bp, Mus musculus
aagttgcgcagatcacgttacggga

SEQ ID NO: 402454 - DNA, 25 bp, Mus musculus
aagttgctatgtaagaagtctgccc

SEQ ID NO: 402455 - DNA, 25 bp, Mus musculus
aagttggctcggcttctcgctctaa

SEQ ID NO: 402456 - DNA, 25 bp, Mus musculus
aagttgggcagcttcagcgacgacc

SEQ ID NO: 402457 - DNA, 25 bp, Mus musculus
aagttgggtccccatgatggctcca

SEQ ID NO: 402458 - DNA, 25 bp, Mus musculus
aagttgggttccttgccggcagtgc

SEQ ID NO: 402459 - DNA, 25 bp, Mus musculus
aagttgtatatgttacctgcgatgc

SEQ ID NO: 402460 - DNA, 25 bp, Mus musculus
aagttgtctgtctgtgattgaccca

SEQ ID NO: 402461 - DNA, 25 bp, Mus musculus
aagttgtggtggcagttgactctga

SEQ ID NO: 402462 - DNA, 25 bp, Mus musculus
aagtttaagttgtccgctgcatgcc

SEQ ID NO: 402463 - DNA, 25 bp, Mus musculus
aagtttaggcatcccaggaaggaag

SEQ ID NO: 402464 - DNA, 25 bp, Mus musculus
aagtttatgctattcttacccatgg

SEQ ID NO: 402465 - DNA, 25 bp, Mus musculus
aagtttcattggtcttcggacgccg

SEQ ID NO: 402466 - DNA, 25 bp, Mus musculus
aagtttccatcagacccgggcagta

SEQ ID NO: 402467 - DNA, 25 bp, Mus musculus
aagtttctatcagtcccagtgggca

SEQ ID NO: 402468 - DNA, 25 bp, Mus musculus
aagtttgactgttacaagtgccact

SEQ ID NO: 402469 - DNA, 25 bp, Mus musculus
aagtttgccgagcacgtcttccgca

SEQ ID NO: 402470 - DNA, 25 bp, Mus musculus
aagtttgtaagtcctgtgccctgca

SEQ ID NO: 402471 - DNA, 25 bp, Mus musculus
aagtttgtcccttgaccctggccag

SEQ ID NO: 402472 - DNA, 25 bp, Mus musculus
aagtttgtctgcttgagtgaatgcg

SEQ ID NO: 402473 - DNA, 25 bp, Mus musculus
aagtttgtgaagattggccgccctg

SEQ ID NO: 402474 - DNA, 25 bp, Mus musculus
aagtttgtgcctggcggtccacgag

SEQ ID NO: 402475 - DNA, 25 bp, Mus musculus
aagttttctgcatacctcgagaggg

SEQ ID NO: 402476 - DNA, 25 bp, Mus musculus
aataaaagctttgggtcacctgcct

SEQ ID NO: 402477 - DNA, 25 bp, Mus musculus
aataaaatatccctattgctgaagg

SEQ ID NO: 402478 - DNA, 25 bp, Mus musculus
aataaaatggcagtacaagctgggc

SEQ ID NO: 402479 - DNA, 25 bp, Mus musculus
aataaaattgcctcacccgcctggt

SEQ ID NO: 402480 - DNA, 25 bp, Mus musculus
aataaacactgaacccaggcctggc

SEQ ID NO: 402481 - DNA, 25 bp, Mus musculus
aataaacacttctatgggccgccgc

SEQ ID NO: 402482 - DNA, 25 bp, Mus musculus
aataaactgcgccaagactgtggga

SEQ ID NO: 402483 - DNA, 25 bp, Mus musculus
aataaactttgggtcgctgactgca

SEQ ID NO: 402484 - DNA, 25 bp, Mus musculus
aataaagccctcgtgggatggtgac

SEQ ID NO: 402485 - DNA, 25 bp, Mus musculus
aataaagctctgaacatgtgccagg

SEQ ID NO: 402486 - DNA, 25 bp, Mus musculus
aataaaggacctaacctccagcagc

SEQ ID NO: 402487 - DNA, 25 bp, Mus musculus
aataaaggagaacatgcctgtgggc

SEQ ID NO: 402488 - DNA, 25 bp, Mus musculus
aataaagggaacgtgatgggctgcc

SEQ ID NO: 402489 - DNA, 25 bp, Mus musculus
aataaagtagcaaggcgacaacagc

SEQ ID NO: 402490 - DNA, 25 bp, Mus musculus
aataaagttgtctgcagcatcaggc

SEQ ID NO: 402491 - DNA, 25 bp, Mus musculus
aataaagttgtctgtaccgttgctc

SEQ ID NO: 402492 - DNA, 25 bp, Mus musculus
aataaatactacaccgagcgctgcc

SEQ ID NO: 402493 - DNA, 25 bp, Mus musculus
aataaatccgaaacgcgtggtcctg

SEQ ID NO: 402494 - DNA, 25 bp, Mus musculus
aataaatcggatgcccttgggtggc

SEQ ID NO: 402495 - DNA, 25 bp, Mus musculus
aataaatctgctttcctggacatgc

SEQ ID NO: 402496 - DNA, 25 bp, Mus musculus
aataacaagatgaccaagaccgccg

SEQ ID NO: 402497 - DNA, 25 bp, Mus musculus
aataacagctagagacagtgggacc

SEQ ID NO: 402498 - DNA, 25 bp, Mus musculus
aataacatcgaacaaactgcctctg

SEQ ID NO: 402499 - DNA, 25 bp, Mus musculus
aataacattaacaccttcctcacag

SEQ ID NO: 402500 - DNA, 25 bp, Mus musculus
aataaccattccagtttctacacag

SEQ ID NO: 402501 - DNA, 25 bp, Mus musculus
aataacccaggagtgcttaaggccg

SEQ ID NO: 402502 - DNA, 25 bp, Mus musculus
aataaccggcaatcaccctctgtgg

SEQ ID NO: 402503 - DNA, 25 bp, Mus musculus
aataacctacttgtgcctgagccca

SEQ ID NO: 402504 - DNA, 25 bp, Mus musculus
aataacgatgatgaggacctgaccc

SEQ ID NO: 402505 - DNA, 25 bp, Mus musculus
aataacgctgatttggtgaccaggc

SEQ ID NO: 402506 - DNA, 25 bp, Mus musculus
aataacgggcagtcgctggagagca

SEQ ID NO: 402507 - DNA, 25 bp, Mus musculus
aataacgtgctacccgacctgaagc

SEQ ID NO: 402508 - DNA, 25 bp, Mus musculus
aataactcgatgaaagcgcttgcct

SEQ ID NO: 402509 - DNA, 25 bp, Mus musculus
aataactctgtggaaatgcaggcgc

SEQ ID NO: 402510 - DNA, 25 bp, Mus musculus
aataactttgtagaaactgctgctg

SEQ ID NO: 402511 - DNA, 25 bp, Mus musculus
aataagaacatgttgggcctgtgcc

SEQ ID NO: 402512 - DNA, 25 bp, Mus musculus
aataagaatgcccatacaggcggat

SEQ ID NO: 402513 - DNA, 25 bp, Mus musculus
aataagacatctggagagggccggc

SEQ ID NO: 402514 - DNA, 25 bp, Mus musculus
aataagaccgtgtgatgaggccagc

SEQ ID NO: 402515 - DNA, 25 bp, Mus musculus
aataagacgtggatccaggctgaca

SEQ ID NO: 402516 - DNA, 25 bp, Mus musculus
aataagagaattgggaggccacccg

SEQ ID NO: 402517 - DNA, 25 bp, Mus musculus
aataagaggaggaaactggccccat

SEQ ID NO: 402518 - DNA, 25 bp, Mus musculus
aataagaggttcaagagctgacccc

SEQ ID NO: 402519 - DNA, 25 bp, Mus musculus
aataagagttgcttggccagagcgg

SEQ ID NO: 402520 - DNA, 25 bp, Mus musculus
aataagctggctgtgcctgtagagc

SEQ ID NO: 402521 - DNA, 25 bp, Mus musculus
aataaggactctgcttgccccaagg

SEQ ID NO: 402522 - DNA, 25 bp, Mus musculus
aataaggagcctgttgccgaaaccg

SEQ ID NO: 402523 - DNA, 25 bp, Mus musculus
aataagggcttccacattgcctggg

SEQ ID NO: 402524 - DNA, 25 bp, Mus musculus
aataagtatggtttgttggcgcgcc

SEQ ID NO: 402525 - DNA, 25 bp, Mus musculus
aataagtccttccattctgttcaag

SEQ ID NO: 402526 - DNA, 25 bp, Mus musculus
aataagttcctgtgtggcttcggcc

SEQ ID NO: 402527 - DNA, 25 bp, Mus musculus
aataatcaccaggatcccacagggc

SEQ ID NO: 402528 - DNA, 25 bp, Mus musculus
aataatctgtggcaggaagggctcc

SEQ ID NO: 402529 - DNA, 25 bp, Mus musculus
aataatgaacatgtattctgctcca

SEQ ID NO: 402530 - DNA, 25 bp, Mus musculus
aataatgaagcccagtgcaccgaga

SEQ ID NO: 402531 - DNA, 25 bp, Mus musculus
aataatgccccggaaggcagccagt

SEQ ID NO: 402532 - DNA, 25 bp, Mus musculus
aataatggaggtggtccttccctgc

SEQ ID NO: 402533 - DNA, 25 bp, Mus musculus
aatacaacagcttgcaaatatggca

SEQ ID NO: 402534 - DNA, 25 bp, Mus musculus
aatacaagcggatcttcagcctgcg

SEQ ID NO: 402535 - DNA, 25 bp, Mus musculus
aatacaaggtggatccacgcctggc

SEQ ID NO: 402536 - DNA, 25 bp, Mus musculus
aatacacaggattgctgggcccacg

SEQ ID NO: 402537 - DNA, 25 bp, Mus musculus
aatacaccgtcttctgacttaaaga

SEQ ID NO: 402538 - DNA, 25 bp, Mus musculus
aatacactgtgatccggcagctcca

SEQ ID NO: 402539 - DNA, 25 bp, Mus musculus
aatacagtacttgaatgagggccct

SEQ ID NO: 402540 - DNA, 25 bp, Mus musculus
aatacagtctctgggaagcatcagg

SEQ ID NO: 402541 - DNA, 25 bp, Mus musculus
aatacatcacgaatgcaggccgcag

SEQ ID NO: 402542 - DNA, 25 bp, Mus musculus
aataccagggccactgggcaaagcc

SEQ ID NO: 402543 - DNA, 25 bp, Mus musculus
aataccagttgtacttcacgcagcc

SEQ ID NO: 402544 - DNA, 25 bp, Mus musculus
aatacccagttgctagagagctgcg

SEQ ID NO: 402545 - DNA, 25 bp, Mus musculus
aatacccatgcgcagtgtctcaggg

SEQ ID NO: 402546 - DNA, 25 bp, Mus musculus
aataccccgctcaatgttgctctca

SEQ ID NO: 402547 - DNA, 25 bp, Mus musculus
aatacccctttagacatttctgcag

SEQ ID NO: 402548 - DNA, 25 bp, Mus musculus
aatacccgagctttgtagaggcagc

SEQ ID NO: 402549 - DNA, 25 bp, Mus musculus
aataccctcaggtgcaccaagcaag

SEQ ID NO: 402550 - DNA, 25 bp, Mus musculus
aataccgtgcgccagattctcctga

SEQ ID NO: 402551 - DNA, 25 bp, Mus musculus
aatacctcgttcctggctgctctca

SEQ ID NO: 402552 - DNA, 25 bp, Mus musculus
aatacctctgcttgggatgggcccc

SEQ ID NO: 402553 - DNA, 25 bp, Mus musculus
aatacctgcagcatggagccgaggg

SEQ ID NO: 402554 - DNA, 25 bp, Mus musculus
aatacctgtagcctgcctaaaactg

SEQ ID NO: 402555 - DNA, 25 bp, Mus musculus
aataccttacatgccttttctcaag

SEQ ID NO: 402556 - DNA, 25 bp, Mus musculus
aataccttgcgcttggacagtgcct

SEQ ID NO: 402557 - DNA, 25 bp, Mus musculus
aatacgacgtgcctgtaaccatgga

SEQ ID NO: 402558 - DNA, 25 bp, Mus musculus
aatacggatccagtgtgcatgaccc

SEQ ID NO: 402559 - DNA, 25 bp, Mus musculus
aatacggctccgttgccagtcaaga

SEQ ID NO: 402560 - DNA, 25 bp, Mus musculus
aatacgggacctgcatgtgcctggt

SEQ ID NO: 402561 - DNA, 25 bp, Mus musculus
aatacgtgaacgacatgtggcccgg

SEQ ID NO: 402562 - DNA, 25 bp, Mus musculus
aatacgttgccatggtgatcgaccg

SEQ ID NO: 402563 - DNA, 25 bp, Mus musculus
aatactagtgatgtggtacccggcc

SEQ ID NO: 402564 - DNA, 25 bp, Mus musculus
aatactgacttctctctgtagaggg

SEQ ID NO: 402565 - DNA, 25 bp, Mus musculus
aatactggagcagctacagaataaa

SEQ ID NO: 402566 - DNA, 25 bp, Mus musculus
aatacttcctgatgggttcgagagc

SEQ ID NO: 402567 - DNA, 25 bp, Mus musculus
aatacttgagctgcacaggaccgcc

SEQ ID NO: 402568 - DNA, 25 bp, Mus musculus
aatactttgctcagattccaacggg

SEQ ID NO: 402569 - DNA, 25 bp, Mus musculus
aatactttggaagtctcttctcagg

SEQ ID NO: 402570 - DNA, 25 bp, Mus musculus
aatagaaagtagaagccgggcagtt

SEQ ID NO: 402571 - DNA, 25 bp, Mus musculus
aatagaaatggagcgggcattgagc

SEQ ID NO: 402572 - DNA, 25 bp, Mus musculus
aatagaacctgggagactctgagcc

SEQ ID NO: 402573 - DNA, 25 bp, Mus musculus
aatagaagttttgcaccgtccagaa

SEQ ID NO: 402574 - DNA, 25 bp, Mus musculus
aatagactggccagtaggatccccg

SEQ ID NO: 402575 - DNA, 25 bp, Mus musculus
aatagatatattcgacacagacggc

SEQ ID NO: 402576 - DNA, 25 bp, Mus musculus
aatagatctagctgagtccctgggc

SEQ ID NO: 402577 - DNA, 25 bp, Mus musculus
aatagatgctgagcctcaatttgca

SEQ ID NO: 402578 - DNA, 25 bp, Mus musculus
aatagatggttctgacattgcaccc

SEQ ID NO: 402579 - DNA, 25 bp, Mus musculus
aatagcacgtcagaaatatctttgg

SEQ ID NO: 402580 - DNA, 25 bp, Mus musculus
aatagcagcatctaatctcccaggg

SEQ ID NO: 402581 - DNA, 25 bp, Mus musculus
aatagcatcgaggatccaacaaggg

SEQ ID NO: 402582 - DNA, 25 bp, Mus musculus
aatagccaggacaaggctccacaag

SEQ ID NO: 402583 - DNA, 25 bp, Mus musculus
aatagccataggtgcctgtccagcc

SEQ ID NO: 402584 - DNA, 25 bp, Mus musculus
aatagccatctttaccatgccccgg

SEQ ID NO: 402585 - DNA, 25 bp, Mus musculus
aatagccgcgagttccagctgtgcg

SEQ ID NO: 402586 - DNA, 25 bp, Mus musculus
aatagccggctctggatgacctctg

SEQ ID NO: 402587 - DNA, 25 bp, Mus musculus
aatagcctacttcgcctggcagtgg

SEQ ID NO: 402588 - DNA, 25 bp, Mus musculus
aatagcctgcgttcagtgccaccag

SEQ ID NO: 402589 - DNA, 25 bp, Mus musculus
aatagcctggaggtagctctgggca

SEQ ID NO: 402590 - DNA, 25 bp, Mus musculus
aatagctcggtgtggaaaggcagac

SEQ ID NO: 402591 - DNA, 25 bp, Mus musculus
aatagcttgctaatgtttccccgga

SEQ ID NO: 402592 - DNA, 25 bp, Mus musculus
aataggaacgatgacaccttgccta

SEQ ID NO: 402593 - DNA, 25 bp, Mus musculus
aataggaagcttaataaagtgtgcc

SEQ ID NO: 402594 - DNA, 25 bp, Mus musculus
aataggattggatgatttgaggtcc

SEQ ID NO: 402595 - DNA, 25 bp, Mus musculus
aataggcacataacggtgctcactg

SEQ ID NO: 402596 - DNA, 25 bp, Mus musculus
aataggctacttcatttgtttcctg

SEQ ID NO: 402597 - DNA, 25 bp, Mus musculus
aataggctctttctctagacctaga

SEQ ID NO: 402598 - DNA, 25 bp, Mus musculus
aataggtcacctcaaacatttccca

SEQ ID NO: 402599 - DNA, 25 bp, Mus musculus
aataggtctgaggtggaagttaagc

SEQ ID NO: 402600 - DNA, 25 bp, Mus musculus
aataggtcttgaaaatggcatgatc

SEQ ID NO: 402601 - DNA, 25 bp, Mus musculus
aatagtccaagcaaaccatcttctg

SEQ ID NO: 402602 - DNA, 25 bp, Mus musculus
aatagtgaacataggcagctttgtc

SEQ ID NO: 402603 - DNA, 25 bp, Mus musculus
aatagtgtcttttgcagccctggcc

SEQ ID NO: 402604 - DNA, 25 bp, Mus musculus
aatagtgtgaacagatatgtctgtc

SEQ ID NO: 402605 - DNA, 25 bp, Mus musculus
aatagtttctgtccagccatcagcc

SEQ ID NO: 402606 - DNA, 25 bp, Mus musculus
aatataaccatagctagacaacagg

SEQ ID NO: 402607 - DNA, 25 bp, Mus musculus
aatataagggcaggacggcactggt

SEQ ID NO: 402608 - DNA, 25 bp, Mus musculus
aatatacatggtcttctagaggccc

SEQ ID NO: 402609 - DNA, 25 bp, Mus musculus
aatatactttattgtgaatgtcttg

SEQ ID NO: 402610 - DNA, 25 bp, Mus musculus
aatataggattaaggcgcagtggcc

SEQ ID NO: 402611 - DNA, 25 bp, Mus musculus
aatatagggctaagtgtggtcaaca

SEQ ID NO: 402612 - DNA, 25 bp, Mus musculus
aatatatcccggacagttccagccg

SEQ ID NO: 402613 - DNA, 25 bp, Mus musculus
aatatatctgcgcaactaacccacc

SEQ ID NO: 402614 - DNA, 25 bp, Mus musculus
aatatatgacccctgcatctgagga

SEQ ID NO: 402615 - DNA, 25 bp, Mus musculus
aatatcaaccggaagctctctgctg

SEQ ID NO: 402616 - DNA, 25 bp, Mus musculus
aatatcacggctactagtgaggaga

SEQ ID NO: 402617 - DNA, 25 bp, Mus musculus
aatatcaggacaagcagaggtctgg

SEQ ID NO: 402618 - DNA, 25 bp, Mus musculus
aatatcaggagggactttctacgcc

SEQ ID NO: 402619 - DNA, 25 bp, Mus musculus
aatatccacatccagctgagaagag

SEQ ID NO: 402620 - DNA, 25 bp, Mus musculus
aatatccagggtatctccaagcacc

SEQ ID NO: 402621 - DNA, 25 bp, Mus musculus
aatatccctgtgactgggcgtcggc

SEQ ID NO: 402622 - DNA, 25 bp, Mus musculus
aatatcctggtttccctgggtgccg

SEQ ID NO: 402623 - DNA, 25 bp, Mus musculus
aatatcggatttcctctggcccagg

SEQ ID NO: 402624 - DNA, 25 bp, Mus musculus
aatatcggcgttctgtgctatgaag

SEQ ID NO: 402625 - DNA, 25 bp, Mus musculus
aatatctgattcaccatgcgcttgg

SEQ ID NO: 402626 - DNA, 25 bp, Mus musculus
aatatctgcagggaaggtggaccac

SEQ ID NO: 402627 - DNA, 25 bp, Mus musculus
aatatctggtatggcttctcggtgc

SEQ ID NO: 402628 - DNA, 25 bp, Mus musculus
aatatcttcattaaggtagacaccc

SEQ ID NO: 402629 - DNA, 25 bp, Mus musculus
aatatcttgctgcttttggaaccca

SEQ ID NO: 402630 - DNA, 25 bp, Mus musculus
aatatgaaaattgccaagtctccct

SEQ ID NO: 402631 - DNA, 25 bp, Mus musculus
aatatgaaggtgctcttcgccgccg

SEQ ID NO: 402632 - DNA, 25 bp, Mus musculus
aatatgacaatataaggccacaaga

SEQ ID NO: 402633 - DNA, 25 bp, Mus musculus
aatatgaccttagagagctacgcca

SEQ ID NO: 402634 - DNA, 25 bp, Mus musculus
aatatgagccataccttcgggaccc

SEQ ID NO: 402635 - DNA, 25 bp, Mus musculus
aatatgatgaccagacctatgaggc

SEQ ID NO: 402636 - DNA, 25 bp, Mus musculus
aatatgcaaaatcccagaacagctg

SEQ ID NO: 402637 - DNA, 25 bp, Mus musculus
aatatgctcggccattgtgtctgcg

SEQ ID NO: 402638 - DNA, 25 bp, Mus musculus
aatatgctgcgggaacggaccgtgc

SEQ ID NO: 402639 - DNA, 25 bp, Mus musculus
aatatggaccaaacagccagttccc

SEQ ID NO: 402640 - DNA, 25 bp, Mus musculus
aatatggagcaagggatgcggacac

SEQ ID NO: 402641 - DNA, 25 bp, Mus musculus
aatatggcccgtatgttgcaggtgc

SEQ ID NO: 402642 - DNA, 25 bp, Mus musculus
aatatggccgcctccgtggatctgg

SEQ ID NO: 402643 - DNA, 25 bp, Mus musculus
aatatggcttcctatgtgggccccg

SEQ ID NO: 402644 - DNA, 25 bp, Mus musculus
aatatggtgccagccgagaagaccc

SEQ ID NO: 402645 - DNA, 25 bp, Mus musculus
aatatgtggtccgaaaccctcaggg

SEQ ID NO: 402646 - DNA, 25 bp, Mus musculus
aatatgtgtctgtggctatccccga

SEQ ID NO: 402647 - DNA, 25 bp, Mus musculus
aatatgtttggacacaagacacaag

SEQ ID NO: 402648 - DNA, 25 bp, Mus musculus
aatatgtttgtggaccccggagagc

SEQ ID NO: 402649 - DNA, 25 bp, Mus musculus
aatattatctttaactcctgcccgg

SEQ ID NO: 402650 - DNA, 25 bp, Mus musculus
aatattccgggactgtacggctggc

SEQ ID NO: 402651 - DNA, 25 bp, Mus musculus
aatattcggctcaaccaggtcaacg

SEQ ID NO: 402652 - DNA, 25 bp, Mus musculus
aatattctctttctggcacgaccgc

SEQ ID NO: 402653 - DNA, 25 bp, Mus musculus
aatattggtctgagtgtctgcacac

SEQ ID NO: 402654 - DNA, 25 bp, Mus musculus
aatattgtatgcctcctcggagccg

SEQ ID NO: 402655 - DNA, 25 bp, Mus musculus
aatatttcagcacactgcagccagg

SEQ ID NO: 402656 - DNA, 25 bp, Mus musculus
aatatttgagctttgcatcctaacg

SEQ ID NO: 402657 - DNA, 25 bp, Mus musculus
aatatttgatgggtaggctcgtacc

SEQ ID NO: 402658 - DNA, 25 bp, Mus musculus
aatatttgttttccctactacacag

SEQ ID NO: 402659 - DNA, 25 bp, Mus musculus
aatattttctatcagtgccaagggc

SEQ ID NO: 402660 - DNA, 25 bp, Mus musculus
aatcaaaaaggatggtttccagcac

SEQ ID NO: 402661 - DNA, 25 bp, Mus musculus
aatcaaagagcgctgtctgggtcac

SEQ ID NO: 402662 - DNA, 25 bp, Mus musculus
aatcaaaggatgctccaggcacagg

SEQ ID NO: 402663 - DNA, 25 bp, Mus musculus
aatcaaataaagcaaaggactggac

SEQ ID NO: 402664 - DNA, 25 bp, Mus musculus
aatcaacacaggcatggccggctgg

SEQ ID NO: 402665 - DNA, 25 bp, Mus musculus
aatcaacagaacagggaaagcggcc

SEQ ID NO: 402666 - DNA, 25 bp, Mus musculus
aatcaaccagaaattgcccgcagca

SEQ ID NO: 402667 - DNA, 25 bp, Mus musculus
aatcaaccgctttatggatcccaag

SEQ ID NO: 402668 - DNA, 25 bp, Mus musculus
aatcaactattcagcccagggaggg

SEQ ID NO: 402669 - DNA, 25 bp, Mus musculus
aatcaactctttactcagaatcacg

SEQ ID NO: 402670 - DNA, 25 bp, Mus musculus
aatcaagagctccacatcagggtcc

SEQ ID NO: 402671 - DNA, 25 bp, Mus musculus
aatcaagaggtccagttccaaagcc

SEQ ID NO: 402672 - DNA, 25 bp, Mus musculus
aatcaagcaccggatggagcaggcc

SEQ ID NO: 402673 - DNA, 25 bp, Mus musculus
aatcaagcccctgggtctgacctag

SEQ ID NO: 402674 - DNA, 25 bp, Mus musculus
aatcaaggacagaaagccaggagcc

SEQ ID NO: 402675 - DNA, 25 bp, Mus musculus
aatcaagtagattctggctagcccg

SEQ ID NO: 402676 - DNA, 25 bp, Mus musculus
aatcaagtctccacctttgaaagca

SEQ ID NO: 402677 - DNA, 25 bp, Mus musculus
aatcaatggcaagtccgagggtcgc

SEQ ID NO: 402678 - DNA, 25 bp, Mus musculus
aatcacaaccagctctagttctagg

SEQ ID NO: 402679 - DNA, 25 bp, Mus musculus
aatcacaattgggtgtcaggctcca

SEQ ID NO: 402680 - DNA, 25 bp, Mus musculus
aatcacagtggacatcgggacaccg

SEQ ID NO: 402681 - DNA, 25 bp, Mus musculus
aatcaccaggagttcgtcgagggcg

SEQ ID NO: 402682 - DNA, 25 bp, Mus musculus
aatcaccccagtcacataacggcag

SEQ ID NO: 402683 - DNA, 25 bp, Mus musculus
aatcacctggattggcagcctctga

SEQ ID NO: 402684 - DNA, 25 bp, Mus musculus
aatcactgcttcacctgtgctctca

SEQ ID NO: 402685 - DNA, 25 bp, Mus musculus
aatcactgtgaaggaaaagattcca

SEQ ID NO: 402686 - DNA, 25 bp, Mus musculus
aatcacttaaagatgttcctgcggg

SEQ ID NO: 402687 - DNA, 25 bp, Mus musculus
aatcagaactccctgtgaccctggc

SEQ ID NO: 402688 - DNA, 25 bp, Mus musculus
aatcagactcgtgcactgctggacg

SEQ ID NO: 402689 - DNA, 25 bp, Mus musculus
aatcagagatcatgcagggctagcc

SEQ ID NO: 402690 - DNA, 25 bp, Mus musculus
aatcagagcatatccctgcgtaggc

SEQ ID NO: 402691 - DNA, 25 bp, Mus musculus
aatcagagcttatgcatctgtgtgc

SEQ ID NO: 402692 - DNA, 25 bp, Mus musculus
aatcagatgcacatgagtttgaggc

SEQ ID NO: 402693 - DNA, 25 bp, Mus musculus
aatcagcgagcagcgcgcgtaaaca

SEQ ID NO: 402694 - DNA, 25 bp, Mus musculus
aatcagtatggttggcacggtcggc

SEQ ID NO: 402695 - DNA, 25 bp, Mus musculus
aatcagtctttgtatcgggcgcgcg

SEQ ID NO: 402696 - DNA, 25 bp, Mus musculus
aatcatacctacgagtgcatccaag

SEQ ID NO: 402697 - DNA, 25 bp, Mus musculus
aatcatagctgggaaatactgtggc

SEQ ID NO: 402698 - DNA, 25 bp, Mus musculus
aatcatagttggaagcgaagcatac

SEQ ID NO: 402699 - DNA, 25 bp, Mus musculus
aatcatcaggaagcgcgcagttggt

SEQ ID NO: 402700 - DNA, 25 bp, Mus musculus
aatcatccaagtgggttcacgctag

SEQ ID NO: 402701 - DNA, 25 bp, Mus musculus
aatcatcccaactggtaggcgcggc

SEQ ID NO: 402702 - DNA, 25 bp, Mus musculus
aatcatccccgttctaggtttcctg

SEQ ID NO: 402703 - DNA, 25 bp, Mus musculus
aatcatgcctgctgtttctgcacca

SEQ ID NO: 402704 - DNA, 25 bp, Mus musculus
aatcatgcggtcctctttgtccagg

SEQ ID NO: 402705 - DNA, 25 bp, Mus musculus
aatcatgtcccgtgtgttggtgccc

SEQ ID NO: 402706 - DNA, 25 bp, Mus musculus
aatccaaagccgaagagacgccatg

SEQ ID NO: 402707 - DNA, 25 bp, Mus musculus
aatccaacctctcctttagagtcag

SEQ ID NO: 402708 - DNA, 25 bp, Mus musculus
aatccaagaagtgttgtgcctcggc

SEQ ID NO: 402709 - DNA, 25 bp, Mus musculus
aatccaccctatccctaaatcaaat

SEQ ID NO: 402710 - DNA, 25 bp, Mus musculus
aatccagacccaggaagctgtgcgg

SEQ ID NO: 402711 - DNA, 25 bp, Mus musculus
aatccagatgattcgagacccagcc

SEQ ID NO: 402712 - DNA, 25 bp, Mus musculus
aatccagcggctggctggctggcga

SEQ ID NO: 402713 - DNA, 25 bp, Mus musculus
aatccaggtcctcaggaagcgcagc

SEQ ID NO: 402714 - DNA, 25 bp, Mus musculus
aatccagtcgctgtttttggcaagg

SEQ ID NO: 402715 - DNA, 25 bp, Mus musculus
aatccagttactgaccctctgaaaa

SEQ ID NO: 402716 - DNA, 25 bp, Mus musculus
aatccatggcaggtgtagttaaatc

SEQ ID NO: 402717 - DNA, 25 bp, Mus musculus
aatcccaaatgagtaatcctaccag

SEQ ID NO: 402718 - DNA, 25 bp, Mus musculus
aatcccaaggcagaggtcacacggt

SEQ ID NO: 402719 - DNA, 25 bp, Mus musculus
aatcccaggtgtcagcgagcttctg

SEQ ID NO: 402720 - DNA, 25 bp, Mus musculus
aatccccgggatggaactcattgcc

SEQ ID NO: 402721 - DNA, 25 bp, Mus musculus
aatccccttggagtgcagtagagcg

SEQ ID NO: 402722 - DNA, 25 bp, Mus musculus
aatcccgatgggagtatccagggca

SEQ ID NO: 402723 - DNA, 25 bp, Mus musculus
aatcccggctgcaggtgtgccgaaa

SEQ ID NO: 402724 - DNA, 25 bp, Mus musculus
aatcccggtgaagggcaagctgctg

SEQ ID NO: 402725 - DNA, 25 bp, Mus musculus
aatcccgtaggaactaagagcaggc

SEQ ID NO: 402726 - DNA, 25 bp, Mus musculus
aatccctggtgatccctggcctggg

SEQ ID NO: 402727 - DNA, 25 bp, Mus musculus
aatcccttggccctgagaacagtga

SEQ ID NO: 402728 - DNA, 25 bp, Mus musculus
aatcccttgtagacccattcctgtg

SEQ ID NO: 402729 - DNA, 25 bp, Mus musculus
aatccgagaatacgagcagaccctg

SEQ ID NO: 402730 - DNA, 25 bp, Mus musculus
aatccggtctgggtcgaattactga

SEQ ID NO: 402731 - DNA, 25 bp, Mus musculus
aatccgtgacgccagatgaggtgca

SEQ ID NO: 402732 - DNA, 25 bp, Mus musculus
aatccgtgccatgtgcaataagccc

SEQ ID NO: 402733 - DNA, 25 bp, Mus musculus
aatccgtgggtctggctagaaggcc

SEQ ID NO: 402734 - DNA, 25 bp, Mus musculus
aatccgtttcgtcaggtaatcccag

SEQ ID NO: 402735 - DNA, 25 bp, Mus musculus
aatcctacaacttaggaggcaagag

SEQ ID NO: 402736 - DNA, 25 bp, Mus musculus
aatcctatgccttttcaattgtagc

SEQ ID NO: 402737 - DNA, 25 bp, Mus musculus
aatcctcccatctgccactgagagt

SEQ ID NO: 402738 - DNA, 25 bp, Mus musculus
aatcctccttccagttgcacgcaga

SEQ ID NO: 402739 - DNA, 25 bp, Mus musculus
aatcctctgtttcctgggcggtaag

SEQ ID NO: 402740 - DNA, 25 bp, Mus musculus
aatcctgacacccactggcactgtg

SEQ ID NO: 402741 - DNA, 25 bp, Mus musculus
aatcctgacctatgtccccacagtg

SEQ ID NO: 402742 - DNA, 25 bp, Mus musculus
aatcctgcctcggtctcgtgagtgc

SEQ ID NO: 402743 - DNA, 25 bp, Mus musculus
aatcctggacttctttgatgcaggg

SEQ ID NO: 402744 - DNA, 25 bp, Mus musculus
aatcctgtctgcgaatcagtggcga

SEQ ID NO: 402745 - DNA, 25 bp, Mus musculus
aatcctgtgaagagccctgggctgt

SEQ ID NO: 402746 - DNA, 25 bp, Mus musculus
aatcctgtgggtgcctgtgagagcc

SEQ ID NO: 402747 - DNA, 25 bp, Mus musculus
aatccttgccttggtagccgtcagg

SEQ ID NO: 402748 - DNA, 25 bp, Mus musculus
aatccttgtggtaacagacgtcagc

SEQ ID NO: 402749 - DNA, 25 bp, Mus musculus
aatcctttgcccaccggttatgagc

SEQ ID NO: 402750 - DNA, 25 bp, Mus musculus
aatcgaccactttccggaagacgcg

SEQ ID NO: 402751 - DNA, 25 bp, Mus musculus
aatcgaccgggtcgccatctactca

SEQ ID NO: 402752 - DNA, 25 bp, Mus musculus
aatcgcaagggcttcatcaggctcg

SEQ ID NO: 402753 - DNA, 25 bp, Mus musculus
aatcgcaggaggtcccctggctggt

SEQ ID NO: 402754 - DNA, 25 bp, Mus musculus
aatcgccgcgccaagtggaagaagc

SEQ ID NO: 402755 - DNA, 25 bp, Mus musculus
aatcgcggctgggatctacagtcgg

SEQ ID NO: 402756 - DNA, 25 bp, Mus musculus
aatcgctcaagcagatgactccagg

SEQ ID NO: 402757 - DNA, 25 bp, Mus musculus
aatcggaagtccaatgcagtctgta

SEQ ID NO: 402758 - DNA, 25 bp, Mus musculus
aatcggattcgcgatcactcgtgac

SEQ ID NO: 402759 - DNA, 25 bp, Mus musculus
aatcggccggaagtgaccattacct

SEQ ID NO: 402760 - DNA, 25 bp, Mus musculus
aatcggcgagcatgagggtttcctg

SEQ ID NO: 402761 - DNA, 25 bp, Mus musculus
aatcggcggcgagtcggcatttgaa

SEQ ID NO: 402762 - DNA, 25 bp, Mus musculus
aatcggcggcgggtactttcgcagt

SEQ ID NO: 402763 - DNA, 25 bp, Mus musculus
aatcggctttgtacccatcgtcggc

SEQ ID NO: 402764 - DNA, 25 bp, Mus musculus
aatcgggtgatagctggaacctagc

SEQ ID NO: 402765 - DNA, 25 bp, Mus musculus
aatcggtagctgtcactggtgcggc

SEQ ID NO: 402766 - DNA, 25 bp, Mus musculus
aatcggtgcttcaagagatgagccc

SEQ ID NO: 402767 - DNA, 25 bp, Mus musculus
aatcggtggctaacgtcattggtgc

SEQ ID NO: 402768 - DNA, 25 bp, Mus musculus
aatcgtgctgactaatgcgttctaa

SEQ ID NO: 402769 - DNA, 25 bp, Mus musculus
aatcgtgtataggaaggcggcctcc

SEQ ID NO: 402770 - DNA, 25 bp, Mus musculus
aatcgtgtgctgaatgtgctccgcc

SEQ ID NO: 402771 - DNA, 25 bp, Mus musculus
aatcgttcccgaagcgccgcgcgtg

SEQ ID NO: 402772 - DNA, 25 bp, Mus musculus
aatctaaggttcctcacagtgggcc

SEQ ID NO: 402773 - DNA, 25 bp, Mus musculus
aatctacagaaaattgccagcctct

SEQ ID NO: 402774 - DNA, 25 bp, Mus musculus
aatctacagagctttcagttcaggg

SEQ ID NO: 402775 - DNA, 25 bp, Mus musculus
aatctacgatttctcagcgccagcg

SEQ ID NO: 402776 - DNA, 25 bp, Mus musculus
aatctagacggctcgtgcagcagca

SEQ ID NO: 402777 - DNA, 25 bp, Mus musculus
aatctatgagaaaggtgtgctcccc

SEQ ID NO: 402778 - DNA, 25 bp, Mus musculus
aatctcaaagtctgctgggagaaag

SEQ ID NO: 402779 - DNA, 25 bp, Mus musculus
aatctcacatccaatgggacaaggt

SEQ ID NO: 402780 - DNA, 25 bp, Mus musculus
aatctcagcaacctaagcagacgca

SEQ ID NO: 402781 - DNA, 25 bp, Mus musculus
aatctcatgtctaccctcaataggg

SEQ ID NO: 402782 - DNA, 25 bp, Mus musculus
aatctccaagttcctagtggtttcg

SEQ ID NO: 402783 - DNA, 25 bp, Mus musculus
aatctccagatgctacccgagagcg

SEQ ID NO: 402784 - DNA, 25 bp, Mus musculus
aatctccagggctccaaggcatgtt

SEQ ID NO: 402785 - DNA, 25 bp, Mus musculus
aatctccgtgaacttggacccctgg

SEQ ID NO: 402786 - DNA, 25 bp, Mus musculus
aatctcctgagggtggtgacaacag

SEQ ID NO: 402787 - DNA, 25 bp, Mus musculus
aatctcggagattcaggactgtaca

SEQ ID NO: 402788 - DNA, 25 bp, Mus musculus
aatctctgcattgtcaggagcgggc

SEQ ID NO: 402789 - DNA, 25 bp, Mus musculus
aatctctgcgtgacagagctcggcg

SEQ ID NO: 402790 - DNA, 25 bp, Mus musculus
aatctctggagtcaaaggcctgggc

SEQ ID NO: 402791 - DNA, 25 bp, Mus musculus
aatctcttgggaagcaagggaccca

SEQ ID NO: 402792 - DNA, 25 bp, Mus musculus
aatctgaaaccgtgaacacggaggg

SEQ ID NO: 402793 - DNA, 25 bp, Mus musculus
aatctgaccccagtgttcctggctc

SEQ ID NO: 402794 - DNA, 25 bp, Mus musculus
aatctgagaaagaggttgcaaccca

SEQ ID NO: 402795 - DNA, 25 bp, Mus musculus
aatctgagacagaaaaggccggcca

SEQ ID NO: 402796 - DNA, 25 bp, Mus musculus
aatctgaggcagaatggctggcatc

SEQ ID NO: 402797 - DNA, 25 bp, Mus musculus
aatctgcagtctcttctcgttaggg

SEQ ID NO: 402798 - DNA, 25 bp, Mus musculus
aatctgccaccatttcccttgagag

SEQ ID NO: 402799 - DNA, 25 bp, Mus musculus
aatctgccagattgtgtccacgcgc

SEQ ID NO: 402800 - DNA, 25 bp, Mus musculus
aatctgctctggcagcctaagtctg

SEQ ID NO: 402801 - DNA, 25 bp, Mus musculus
aatctgctgtgcgtgagctcctggg

SEQ ID NO: 402802 - DNA, 25 bp, Mus musculus
aatctggacttcaccacttttggag

SEQ ID NO: 402803 - DNA, 25 bp, Mus musculus
aatctggattgcaccttctactggc

SEQ ID NO: 402804 - DNA, 25 bp, Mus musculus
aatctggccagcgtgcatcgtggtg

SEQ ID NO: 402805 - DNA, 25 bp, Mus musculus
aatctggcgtacatgctggtgtgca

SEQ ID NO: 402806 - DNA, 25 bp, Mus musculus
aatctggctgcaaggaatgtgagga

SEQ ID NO: 402807 - DNA, 25 bp, Mus musculus
aatctgggccacacagagttcaagg

SEQ ID NO: 402808 - DNA, 25 bp, Mus musculus
aatctgggcttagtacgaaggcaag

SEQ ID NO: 402809 - DNA, 25 bp, Mus musculus
aatctggtggtgtctagcgtgcaac

SEQ ID NO: 402810 - DNA, 25 bp, Mus musculus
aatctgtcatgagacctccgggcct

SEQ ID NO: 402811 - DNA, 25 bp, Mus musculus
aatctgtccggcaccagtggcatgg

SEQ ID NO: 402812 - DNA, 25 bp, Mus musculus
aatctgtggatttgtgggagctgcc

SEQ ID NO: 402813 - DNA, 25 bp, Mus musculus
aatctgtggtatgattgtagcagcc

SEQ ID NO: 402814 - DNA, 25 bp, Mus musculus
aatctgtgtcgggatgctttgaaaa

SEQ ID NO: 402815 - DNA, 25 bp, Mus musculus
aatctgttctatgtctgcctgtgcc

SEQ ID NO: 402816 - DNA, 25 bp, Mus musculus
aatcttacagaatgacggcgtggtc

SEQ ID NO: 402817 - DNA, 25 bp, Mus musculus
aatcttctgctacacagaaggctgg

SEQ ID NO: 402818 - DNA, 25 bp, Mus musculus
aatcttcttgaagggctgacacggg

SEQ ID NO: 402819 - DNA, 25 bp, Mus musculus
aatcttgacactcctggcacaaatg

SEQ ID NO: 402820 - DNA, 25 bp, Mus musculus
aatcttgatcttgcatcaccagagg

SEQ ID NO: 402821 - DNA, 25 bp, Mus musculus
aatcttgtccgctatgttcgccagg

SEQ ID NO: 402822 - DNA, 25 bp, Mus musculus
aatctttaatggcaggtttgtccct

SEQ ID NO: 402823 - DNA, 25 bp, Mus musculus
aatctttgcagcagccctcaggtga

SEQ ID NO: 402824 - DNA, 25 bp, Mus musculus
aatgaaacagttccagggcatgccc

SEQ ID NO: 402825 - DNA, 25 bp, Mus musculus
aatgaaagccatcgagagtcccaac

SEQ ID NO: 402826 - DNA, 25 bp, Mus musculus
aatgaaagctttgtgtatgtcagag

SEQ ID NO: 402827 - DNA, 25 bp, Mus musculus
aatgaaaggcacatcttaagactgg

SEQ ID NO: 402828 - DNA, 25 bp, Mus musculus
aatgaaagtaaagcgctccggagcc

SEQ ID NO: 402829 - DNA, 25 bp, Mus musculus
aatgaaagtggtatcctggcaagca

SEQ ID NO: 402830 - DNA, 25 bp, Mus musculus
aatgaaatatttctggactccccag

SEQ ID NO: 402831 - DNA, 25 bp, Mus musculus
aatgaaattatggaactttggagaa

SEQ ID NO: 402832 - DNA, 25 bp, Mus musculus
aatgaacaagacatggcacccagag

SEQ ID NO: 402833 - DNA, 25 bp, Mus musculus
aatgaacactcagagccaggcggtg

SEQ ID NO: 402834 - DNA, 25 bp, Mus musculus
aatgaacatctgcactaggcccaag

SEQ ID NO: 402835 - DNA, 25 bp, Mus musculus
aatgaaccaccgagacccactgcag

SEQ ID NO: 402836 - DNA, 25 bp, Mus musculus
aatgaacgcgtgaagaagcagctcc

SEQ ID NO: 402837 - DNA, 25 bp, Mus musculus
aatgaactcatggagcagacctcgg

SEQ ID NO: 402838 - DNA, 25 bp, Mus musculus
aatgaactcttgaaagggtattcac

SEQ ID NO: 402839 - DNA, 25 bp, Mus musculus
aatgaagaccatgccatttggctgc

SEQ ID NO: 402840 - DNA, 25 bp, Mus musculus
aatgaagagtcaattcctgaaagct

SEQ ID NO: 402841 - DNA, 25 bp, Mus musculus
aatgaagatccccaagtctcggacg

SEQ ID NO: 402842 - DNA, 25 bp, Mus musculus
aatgaagctactgctcagacgggca

SEQ ID NO: 402843 - DNA, 25 bp, Mus musculus
aatgaaggacaaaaatggaagaggg

SEQ ID NO: 402844 - DNA, 25 bp, Mus musculus
aatgaagtccctgtctaacgctgca

SEQ ID NO: 402845 - DNA, 25 bp, Mus musculus
aatgaataactccttttgagaaagc

SEQ ID NO: 402846 - DNA, 25 bp, Mus musculus
aatgaataagggatgccagcccgcc

SEQ ID NO: 402847 - DNA, 25 bp, Mus musculus
aatgaatacacagctggatgcggca

SEQ ID NO: 402848 - DNA, 25 bp, Mus musculus
aatgaataggactagccactgaacc

SEQ ID NO: 402849 - DNA, 25 bp, Mus musculus
aatgaatcccgatctggacaccggc

SEQ ID NO: 402850 - DNA, 25 bp, Mus musculus
aatgaatctgattccagctcgagca

SEQ ID NO: 402851 - DNA, 25 bp, Mus musculus
aatgaatgaggatggcctgacgcct

SEQ ID NO: 402852 - DNA, 25 bp, Mus musculus
aatgaatgctatcgactccccagag

SEQ ID NO: 402853 - DNA, 25 bp, Mus musculus
aatgaatggcgctctctgttgccct

SEQ ID NO: 402854 - DNA, 25 bp, Mus musculus
aatgaattccgcgacgaggcgtgca

SEQ ID NO: 402855 - DNA, 25 bp, Mus musculus
aatgacaaatcttccacacctgggc

SEQ ID NO: 402856 - DNA, 25 bp, Mus musculus
aatgacacaggtatcgtgggccagc

SEQ ID NO: 402857 - DNA, 25 bp, Mus musculus
aatgacacgaagaggagctgggtcc

SEQ ID NO: 402858 - DNA, 25 bp, Mus musculus
aatgacacggaatctgctctggcag

SEQ ID NO: 402859 - DNA, 25 bp, Mus musculus
aatgacacggaatgcagtctgggcc

SEQ ID NO: 402860 - DNA, 25 bp, Mus musculus
aatgacagccctcagcatggcaagg

SEQ ID NO: 402861 - DNA, 25 bp, Mus musculus
aatgacagccgttgtactgcaaaca

SEQ ID NO: 402862 - DNA, 25 bp, Mus musculus
aatgaccacgcaggctggactctgg

SEQ ID NO: 402863 - DNA, 25 bp, Mus musculus
aatgaccagtataaatgtcagcggg

SEQ ID NO: 402864 - DNA, 25 bp, Mus musculus
aatgacccattagtacaagctacgg

SEQ ID NO: 402865 - DNA, 25 bp, Mus musculus
aatgacccttcgctgggccatgtgg

SEQ ID NO: 402866 - DNA, 25 bp, Mus musculus
aatgaccgaggtgtggtacaaggcc

SEQ ID NO: 402867 - DNA, 25 bp, Mus musculus
aatgacctctatgccactgtgaaag

SEQ ID NO: 402868 - DNA, 25 bp, Mus musculus
aatgacctgctacgagacctggaca

SEQ ID NO: 402869 - DNA, 25 bp, Mus musculus
aatgacctggtttgttatgctgaaa

SEQ ID NO: 402870 - DNA, 25 bp, Mus musculus
aatgacgaagagcagatggacaccc

SEQ ID NO: 402871 - DNA, 25 bp, Mus musculus
aatgacgagccagtacagatccggg

SEQ ID NO: 402872 - DNA, 25 bp, Mus musculus
aatgacgtcggtttgctcgtccccg

SEQ ID NO: 402873 - DNA, 25 bp, Mus musculus
aatgacgtgttgacaggacttcagc

SEQ ID NO: 402874 - DNA, 25 bp, Mus musculus
aatgacgttgaataagggtggaccg

SEQ ID NO: 402875 - DNA, 25 bp, Mus musculus
aatgactactaagaggccgtgacac

SEQ ID NO: 402876 - DNA, 25 bp, Mus musculus
aatgactcattctcaatcttgccaa

SEQ ID NO: 402877 - DNA, 25 bp, Mus musculus
aatgactccctgaggaagcgctacg

SEQ ID NO: 402878 - DNA, 25 bp, Mus musculus
aatgactcgcatgctggacctgggc

SEQ ID NO: 402879 - DNA, 25 bp, Mus musculus
aatgactctgtttccgctcggtggg

SEQ ID NO: 402880 - DNA, 25 bp, Mus musculus
aatgacttatcggtacatggacgac

SEQ ID NO: 402881 - DNA, 25 bp, Mus musculus
aatgacttcctcagtggccttgtag

SEQ ID NO: 402882 - DNA, 25 bp, Mus musculus
aatgagaaggactacccacctggct

SEQ ID NO: 402883 - DNA, 25 bp, Mus musculus
aatgagacgctcagtcatggctggc

SEQ ID NO: 402884 - DNA, 25 bp, Mus musculus
aatgagagagtacatgcctccagcc

SEQ ID NO: 402885 - DNA, 25 bp, Mus musculus
aatgagagccagaggcggttgctag

SEQ ID NO: 402886 - DNA, 25 bp, Mus musculus
aatgagagcgctccttgctggaaag

SEQ ID NO: 402887 - DNA, 25 bp, Mus musculus
aatgagagggaaacaagaggctgct

SEQ ID NO: 402888 - DNA, 25 bp, Mus musculus
aatgagagtcaagggaaacgcagcc

SEQ ID NO: 402889 - DNA, 25 bp, Mus musculus
aatgagatgaactgggatgcccgtc

SEQ ID NO: 402890 - DNA, 25 bp, Mus musculus
aatgagcatggactggaactagccc

SEQ ID NO: 402891 - DNA, 25 bp, Mus musculus
aatgagcctaccagaatgctggttg

SEQ ID NO: 402892 - DNA, 25 bp, Mus musculus
aatgagcgcatttggcagaacccgg

SEQ ID NO: 402893 - DNA, 25 bp, Mus musculus
aatgagctgaaggagagtaggtccc

SEQ ID NO: 402894 - DNA, 25 bp, Mus musculus
aatgagctgggcaatatttcctacc

SEQ ID NO: 402895 - DNA, 25 bp, Mus musculus
aatgagctgttcttgcggcagtccg

SEQ ID NO: 402896 - DNA, 25 bp, Mus musculus
aatgagctgttgctgaaatcagagc

SEQ ID NO: 402897 - DNA, 25 bp, Mus musculus
aatgagcttttcgtctctggcccca

SEQ ID NO: 402898 - DNA, 25 bp, Mus musculus
aatgaggcggctgatttgcaaacgg

SEQ ID NO: 402899 - DNA, 25 bp, Mus musculus
aatgaggcgtctcagtaccttagcc

SEQ ID NO: 402900 - DNA, 25 bp, Mus musculus
aatgagggccctgggctttgagccc

SEQ ID NO: 402901 - DNA, 25 bp, Mus musculus
aatgagtaagaacctgtgaaagccc

SEQ ID NO: 402902 - DNA, 25 bp, Mus musculus
aatgagtgaagaggatcagggctcc

SEQ ID NO: 402903 - DNA, 25 bp, Mus musculus
aatgagttgtcatcctagagcatcc

SEQ ID NO: 402904 - DNA, 25 bp, Mus musculus
aatgagtttacttctggagatggaa

SEQ ID NO: 402905 - DNA, 25 bp, Mus musculus
aatgatgaagtgctcagtgtgactg

SEQ ID NO: 402906 - DNA, 25 bp, Mus musculus
aatgatgaagtgctccaagtgactg

SEQ ID NO: 402907 - DNA, 25 bp, Mus musculus
aatgatgacaactaccacaaggcgg

SEQ ID NO: 402908 - DNA, 25 bp, Mus musculus
aatgatgaggaacttgaggcaagcc

SEQ ID NO: 402909 - DNA, 25 bp, Mus musculus
aatgatgaggtaggtttcgatgccc

SEQ ID NO: 402910 - DNA, 25 bp, Mus musculus
aatgatgcaaatagtcagctgcccg

SEQ ID NO: 402911 - DNA, 25 bp, Mus musculus
aatgatgcacaacctactgactggc

SEQ ID NO: 402912 - DNA, 25 bp, Mus musculus
aatgatgcagtacatacatagtatc

SEQ ID NO: 402913 - DNA, 25 bp, Mus musculus
aatgatggcgacagaggatcctacg

SEQ ID NO: 402914 - DNA, 25 bp, Mus musculus
aatgatgggagcttcctcggcggtc

SEQ ID NO: 402915 - DNA, 25 bp, Mus musculus
aatgatggtgctttgttgccagtcg

SEQ ID NO: 402916 - DNA, 25 bp, Mus musculus
aatgatgtacgttcctgccatgggc

SEQ ID NO: 402917 - DNA, 25 bp, Mus musculus
aatgatgtatcccaagccaaagccc

SEQ ID NO: 402918 - DNA, 25 bp, Mus musculus
aatgatgtatctctatgcctacgcc

SEQ ID NO: 402919 - DNA, 25 bp, Mus musculus
aatgattaacaggaagccaggcagc

SEQ ID NO: 402920 - DNA, 25 bp, Mus musculus
aatgattacgaccacgacagctccg

SEQ ID NO: 402921 - DNA, 25 bp, Mus musculus
aatgattcgggcctttgttcagcca

SEQ ID NO: 402922 - DNA, 25 bp, Mus musculus
aatgattgaaacagcgagaaacccc

SEQ ID NO: 402923 - DNA, 25 bp, Mus musculus
aatgcaaaccaaactcatgaccagg

SEQ ID NO: 402924 - DNA, 25 bp, Mus musculus
aatgcaaagcccacggagaagtcgg

SEQ ID NO: 402925 - DNA, 25 bp, Mus musculus
aatgcaaaggcagagtgattcccgg

SEQ ID NO: 402926 - DNA, 25 bp, Mus musculus
aatgcaactcagtccaagtaccggg

SEQ ID NO: 402927 - DNA, 25 bp, Mus musculus
aatgcaagctcaaagcagggattcc

SEQ ID NO: 402928 - DNA, 25 bp, Mus musculus
aatgcaatccgtcagaaaaaccaag

SEQ ID NO: 402929 - DNA, 25 bp, Mus musculus
aatgcaatgatgtaagaggcacctg

SEQ ID NO: 402930 - DNA, 25 bp, Mus musculus
aatgcacaagtgctggtcagggttc

SEQ ID NO: 402931 - DNA, 25 bp, Mus musculus
aatgcacagagctcacactgggcgg

SEQ ID NO: 402932 - DNA, 25 bp, Mus musculus
aatgcacagctgcagtccttggagc

SEQ ID NO: 402933 - DNA, 25 bp, Mus musculus
aatgcacccgtattcaaggcagacg

SEQ ID NO: 402934 - DNA, 25 bp, Mus musculus
aatgcaccgtctctgtggagacccg

SEQ ID NO: 402935 - DNA, 25 bp, Mus musculus
aatgcacctactttgctctagtcaa

SEQ ID NO: 402936 - DNA, 25 bp, Mus musculus
aatgcacgtgcaaacctgggctgga

SEQ ID NO: 402937 - DNA, 25 bp, Mus musculus
aatgcactgccttgtacttagcaag

SEQ ID NO: 402938 - DNA, 25 bp, Mus musculus
aatgcacttgtgtaatgagaactgc

SEQ ID NO: 402939 - DNA, 25 bp, Mus musculus
aatgcagaggcctcaagcaccttaa

SEQ ID NO: 402940 - DNA, 25 bp, Mus musculus
aatgcagattctgggttggtaaccc

SEQ ID NO: 402941 - DNA, 25 bp, Mus musculus
aatgcagccgacagctattcctggg

SEQ ID NO: 402942 - DNA, 25 bp, Mus musculus
aatgcagccttttcggccaatgaga

SEQ ID NO: 402943 - DNA, 25 bp, Mus musculus
aatgcaggaattgggacgtggccac

SEQ ID NO: 402944 - DNA, 25 bp, Mus musculus
aatgcagggaatctggagccctccg

SEQ ID NO: 402945 - DNA, 25 bp, Mus musculus
aatgcagggttgtggacctagttcc

SEQ ID NO: 402946 - DNA, 25 bp, Mus musculus
aatgcagtgacagcccttacctttt

SEQ ID NO: 402947 - DNA, 25 bp, Mus musculus
aatgcagtgcaaatagaatgcctgg

SEQ ID NO: 402948 - DNA, 25 bp, Mus musculus
aatgcagttctctctacccagtggg

SEQ ID NO: 402949 - DNA, 25 bp, Mus musculus
aatgcatccatttgcaacacacggg

SEQ ID NO: 402950 - DNA, 25 bp, Mus musculus
aatgcatgcggcaagcccattgggc

SEQ ID NO: 402951 - DNA, 25 bp, Mus musculus
aatgcatggtgcctaaagattccaa

SEQ ID NO: 402952 - DNA, 25 bp, Mus musculus
aatgcatgtggaacctgtgggtccc

SEQ ID NO: 402953 - DNA, 25 bp, Mus musculus
aatgccaacaatttccacagtcggg

SEQ ID NO: 402954 - DNA, 25 bp, Mus musculus
aatgccaatatcctgctgcggagcc

SEQ ID NO: 402955 - DNA, 25 bp, Mus musculus
aatgccacacgagcagagttccagg

SEQ ID NO: 402956 - DNA, 25 bp, Mus musculus
aatgccacggacaaggcagttagtc

SEQ ID NO: 402957 - DNA, 25 bp, Mus musculus
aatgccactgggatcagagacctcg

SEQ ID NO: 402958 - DNA, 25 bp, Mus musculus
aatgccagattggaatggagacccc

SEQ ID NO: 402959 - DNA, 25 bp, Mus musculus
aatgccagccagtggttaagctcag

SEQ ID NO: 402960 - DNA, 25 bp, Mus musculus
aatgccaggctgaaacatggacccg

SEQ ID NO: 402961 - DNA, 25 bp, Mus musculus
aatgccaggtgcttcattgtcagcc

SEQ ID NO: 402962 - DNA, 25 bp, Mus musculus
aatgccatgagggaccgaaaacgct

SEQ ID NO: 402963 - DNA, 25 bp, Mus musculus
aatgccatgagggtgtttggtgact

SEQ ID NO: 402964 - DNA, 25 bp, Mus musculus
aatgccattgatcggtggtcccgca

SEQ ID NO: 402965 - DNA, 25 bp, Mus musculus
aatgcccactttataggactgtaga

SEQ ID NO: 402966 - DNA, 25 bp, Mus musculus
aatgcccagccaaacatcacagtgg

SEQ ID NO: 402967 - DNA, 25 bp, Mus musculus
aatgcccagggatgcaaagtggcca

SEQ ID NO: 402968 - DNA, 25 bp, Mus musculus
aatgcccaggtcttcaggagttcca

SEQ ID NO: 402969 - DNA, 25 bp, Mus musculus
aatgccccactcagttcctaggaag

SEQ ID NO: 402970 - DNA, 25 bp, Mus musculus
aatgcccctgattggagaacacgtg

SEQ ID NO: 402971 - DNA, 25 bp, Mus musculus
aatgcccctgtgtttgagaagagcc

SEQ ID NO: 402972 - DNA, 25 bp, Mus musculus
aatgccctgggctactcggaactag

SEQ ID NO: 402973 - DNA, 25 bp, Mus musculus
aatgcccttggattttctgtgggcc

SEQ ID NO: 402974 - DNA, 25 bp, Mus musculus
aatgccgcggagaagccatagctaa

SEQ ID NO: 402975 - DNA, 25 bp, Mus musculus
aatgccgctgaattggaaggtgccc

SEQ ID NO: 402976 - DNA, 25 bp, Mus musculus
aatgccgtactgactgggagtgccc

SEQ ID NO: 402977 - DNA, 25 bp, Mus musculus
aatgcctccgtggacgagaactgcc

SEQ ID NO: 402978 - DNA, 25 bp, Mus musculus
aatgccttagcacaggtaaggtccc

SEQ ID NO: 402979 - DNA, 25 bp, Mus musculus
aatgccttggagatcgaatcctgcc

SEQ ID NO: 402980 - DNA, 25 bp, Mus musculus
aatgcgcgctcctacatcgaatctg

SEQ ID NO: 402981 - DNA, 25 bp, Mus musculus
aatgcggaaacacaaggctgctgcc

SEQ ID NO: 402982 - DNA, 25 bp, Mus musculus
aatgcggctgatgctgttgggttcc

SEQ ID NO: 402983 - DNA, 25 bp, Mus musculus
aatgcgtttgcattgagcccacagg

SEQ ID NO: 402984 - DNA, 25 bp, Mus musculus
aatgctagtgccctgagaaagactg

SEQ ID NO: 402985 - DNA, 25 bp, Mus musculus
aatgctcagtgcgattttaacaggg

SEQ ID NO: 402986 - DNA, 25 bp, Mus musculus
aatgctccacagaagcgccatagac

SEQ ID NO: 402987 - DNA, 25 bp, Mus musculus
aatgctcgactcaagtgtcccttgg

SEQ ID NO: 402988 - DNA, 25 bp, Mus musculus
aatgctctgattggccgtggtcaag

SEQ ID NO: 402989 - DNA, 25 bp, Mus musculus
aatgctgacctcctacgaagtgccg

SEQ ID NO: 402990 - DNA, 25 bp, Mus musculus
aatgctgagactataggcttatgcc

SEQ ID NO: 402991 - DNA, 25 bp, Mus musculus
aatgctgatgaagaggttgcaatgg

SEQ ID NO: 402992 - DNA, 25 bp, Mus musculus
aatgctgccctggacatcgtggacg

SEQ ID NO: 402993 - DNA, 25 bp, Mus musculus
aatgctgccgggtcacccatggaaa

SEQ ID NO: 402994 - DNA, 25 bp, Mus musculus
aatgctgctcagaaaacacccggaa

SEQ ID NO: 402995 - DNA, 25 bp, Mus musculus
aatgctgctctttctcacgctgtgg

SEQ ID NO: 402996 - DNA, 25 bp, Mus musculus
aatgctggaccagacaccaacggat

SEQ ID NO: 402997 - DNA, 25 bp, Mus musculus
aatgctggacttaggtgcttgcagg

SEQ ID NO: 402998 - DNA, 25 bp, Mus musculus
aatgctggagtgctgattatgcaac

SEQ ID NO: 402999 - DNA, 25 bp, Mus musculus
aatgctgggttcctatttaattaga

SEQ ID NO: 403000 - DNA, 25 bp, Mus musculus
aatgctgtacagaacatatacctgg

SEQ ID NO: 403001 - DNA, 25 bp, Mus musculus
aatgctgtgccaattgtaccccagg

SEQ ID NO: 403002 - DNA, 25 bp, Mus musculus
aatgctgtgtctctgtgttgctggc

SEQ ID NO: 403003 - DNA, 25 bp, Mus musculus
aatgcttacacctgagatctactag

SEQ ID NO: 403004 - DNA, 25 bp, Mus musculus
aatgctttcccataaataagcttga

SEQ ID NO: 403005 - DNA, 25 bp, Mus musculus
aatgctttgctattggctgccacag

SEQ ID NO: 403006 - DNA, 25 bp, Mus musculus
aatggaaagtatgggcgtcgcaaac

SEQ ID NO: 403007 - DNA, 25 bp, Mus musculus
aatggaacctttcccttctgtgtct

SEQ ID NO: 403008 - DNA, 25 bp, Mus musculus
aatggaagacacagtctctgcccgc

SEQ ID NO: 403009 - DNA, 25 bp, Mus musculus
aatggaattctgcagtcccctggga

SEQ ID NO: 403010 - DNA, 25 bp, Mus musculus
aatggacatccgacccactgacatc

SEQ ID NO: 403011 - DNA, 25 bp, Mus musculus
aatggacattgtcccgatggatcgg

SEQ ID NO: 403012 - DNA, 25 bp, Mus musculus
aatggacccctagaccagaggagtg

SEQ ID NO: 403013 - DNA, 25 bp, Mus musculus
aatggacggtgcttgctttaacagc

SEQ ID NO: 403014 - DNA, 25 bp, Mus musculus
aatggactgtttccccaaggcgtgg

SEQ ID NO: 403015 - DNA, 25 bp, Mus musculus
aatggagagctaaagagccttcggc

SEQ ID NO: 403016 - DNA, 25 bp, Mus musculus
aatggagatcggagcacttatggac

SEQ ID NO: 403017 - DNA, 25 bp, Mus musculus
aatggagcccttcccgttgagtggc

SEQ ID NO: 403018 - DNA, 25 bp, Mus musculus
aatggagcctgtcccaatgcccagg

SEQ ID NO: 403019 - DNA, 25 bp, Mus musculus
aatggaggtcccagatactacgtgg

SEQ ID NO: 403020 - DNA, 25 bp, Mus musculus
aatggaggtccttaaatgcaagccg

SEQ ID NO: 403021 - DNA, 25 bp, Mus musculus
aatggagtcccgctttgagaaaatg

SEQ ID NO: 403022 - DNA, 25 bp, Mus musculus
aatggagtggtagctgatgctgcta

SEQ ID NO: 403023 - DNA, 25 bp, Mus musculus
aatggagttactcgagcagtagtaa

SEQ ID NO: 403024 - DNA, 25 bp, Mus musculus
aatggatcttcagtgtgggaccacc

SEQ ID NO: 403025 - DNA, 25 bp, Mus musculus
aatggatgacatctacaaagctgcg

SEQ ID NO: 403026 - DNA, 25 bp, Mus musculus
aatggatttgcctgtcccaccaggc

SEQ ID NO: 403027 - DNA, 25 bp, Mus musculus
aatggcaagtccagctcaagcttag

SEQ ID NO: 403028 - DNA, 25 bp, Mus musculus
aatggcaattaaatcaggactgagg

SEQ ID NO: 403029 - DNA, 25 bp, Mus musculus
aatggcactacctctgcctacgacg

SEQ ID NO: 403030 - DNA, 25 bp, Mus musculus
aatggcactgtaagtttaacagacg

SEQ ID NO: 403031 - DNA, 25 bp, Mus musculus
aatggcagcatctacgtcttcaggg

SEQ ID NO: 403032 - DNA, 25 bp, Mus musculus
aatggcagccagttctttgtgaccc

SEQ ID NO: 403033 - DNA, 25 bp, Mus musculus
aatggcagccgattccagacttctg

SEQ ID NO: 403034 - DNA, 25 bp, Mus musculus
aatggcagcctttgactttctcgaa

SEQ ID NO: 403035 - DNA, 25 bp, Mus musculus
aatggcatatgaccgctacatggcg

SEQ ID NO: 403036 - DNA, 25 bp, Mus musculus
aatggcatcctctaaaaaggttact

SEQ ID NO: 403037 - DNA, 25 bp, Mus musculus
aatggcatgattcggtgagcagcaa

SEQ ID NO: 403038 - DNA, 25 bp, Mus musculus
aatggcattctgcttggtcttagga

SEQ ID NO: 403039 - DNA, 25 bp, Mus musculus
aatggccacctgtatcccactggct

SEQ ID NO: 403040 - DNA, 25 bp, Mus musculus
aatggccagagtttttgacagacag

SEQ ID NO: 403041 - DNA, 25 bp, Mus musculus
aatggcccatcccaagaagagctgg

SEQ ID NO: 403042 - DNA, 25 bp, Mus musculus
aatggcccggactatcagttgctaa

SEQ ID NO: 403043 - DNA, 25 bp, Mus musculus
aatggccctgaggtctgaaggcttc

SEQ ID NO: 403044 - DNA, 25 bp, Mus musculus
aatggcctgatgtcaaaccccgaga

SEQ ID NO: 403045 - DNA, 25 bp, Mus musculus
aatggcctgcctggtcgtgatggac

SEQ ID NO: 403046 - DNA, 25 bp, Mus musculus
aatggccttaccctcagcttgggag

SEQ ID NO: 403047 - DNA, 25 bp, Mus musculus
aatggcctttggagcaatgaaaagc

SEQ ID NO: 403048 - DNA, 25 bp, Mus musculus
aatggcggattcctcagaacgggac

SEQ ID NO: 403049 - DNA, 25 bp, Mus musculus
aatggcggcacctgtgttctgggca

SEQ ID NO: 403050 - DNA, 25 bp, Mus musculus
aatggcgtgtcttcactttccaagg

SEQ ID NO: 403051 - DNA, 25 bp, Mus musculus
aatggctctttgatggatggtaccc

SEQ ID NO: 403052 - DNA, 25 bp, Mus musculus
aatggctgcctaccaatctcgggag

SEQ ID NO: 403053 - DNA, 25 bp, Mus musculus
aatggctggatcaaaacctgtgacg

SEQ ID NO: 403054 - DNA, 25 bp, Mus musculus
aatggctggcaggtcgaacaaagtc

SEQ ID NO: 403055 - DNA, 25 bp, Mus musculus
aatggctgtcgtcatggcacctgca

SEQ ID NO: 403056 - DNA, 25 bp, Mus musculus
aatggctgtggtcatgcctgcaaac

SEQ ID NO: 403057 - DNA, 25 bp, Mus musculus
aatggctgttgggttactgagtgac

SEQ ID NO: 403058 - DNA, 25 bp, Mus musculus
aatggcttcagcctttcgtctttct

SEQ ID NO: 403059 - DNA, 25 bp, Mus musculus
aatggcttccactatgttgaccgcg

SEQ ID NO: 403060 - DNA, 25 bp, Mus musculus
aatgggaagcaagctttacctggag

SEQ ID NO: 403061 - DNA, 25 bp, Mus musculus
aatgggaccgttgagatgacttccg

SEQ ID NO: 403062 - DNA, 25 bp, Mus musculus
aatgggacgccagagcttcagaacc

SEQ ID NO: 403063 - DNA, 25 bp, Mus musculus
aatgggagcctttcgtccgggagct

SEQ ID NO: 403064 - DNA, 25 bp, Mus musculus
aatgggcaccgaagcaccaattctc

SEQ ID NO: 403065 - DNA, 25 bp, Mus musculus
aatgggcagtgccaaccacagtctg

SEQ ID NO: 403066 - DNA, 25 bp, Mus musculus
aatgggcatgtgagcttctcctccg

SEQ ID NO: 403067 - DNA, 25 bp, Mus musculus
aatgggcccatcttagtgtgctgac

SEQ ID NO: 403068 - DNA, 25 bp, Mus musculus
aatgggcggagctttctcaacatcc

SEQ ID NO: 403069 - DNA, 25 bp, Mus musculus
aatgggcggcaatggaaacctcagc

SEQ ID NO: 403070 - DNA, 25 bp, Mus musculus
aatgggcgtgcctgtgaaatgaatg

SEQ ID NO: 403071 - DNA, 25 bp, Mus musculus
aatgggctcacaggtattggtcgac

SEQ ID NO: 403072 - DNA, 25 bp, Mus musculus
aatgggctgaatcgttggaaaacct

SEQ ID NO: 403073 - DNA, 25 bp, Mus musculus
aatgggtcagacttcctcttctaca

SEQ ID NO: 403074 - DNA, 25 bp, Mus musculus
aatgggtcctctccatgtttgccaa

SEQ ID NO: 403075 - DNA, 25 bp, Mus musculus
aatgggtcttgttggatctttctca

SEQ ID NO: 403076 - DNA, 25 bp, Mus musculus
aatgggtgcagcttaaaagccccgg

SEQ ID NO: 403077 - DNA, 25 bp, Mus musculus
aatgggtggccatccagagcgtgtc

SEQ ID NO: 403078 - DNA, 25 bp, Mus musculus
aatgggtttcaccacggcaactgag

SEQ ID NO: 403079 - DNA, 25 bp, Mus musculus
aatggtaaaggccagtgccactgta

SEQ ID NO: 403080 - DNA, 25 bp, Mus musculus
aatggtaggtttctcatggtctccc

SEQ ID NO: 403081 - DNA, 25 bp, Mus musculus
aatggtcaagcagtcagctgcctgc

SEQ ID NO: 403082 - DNA, 25 bp, Mus musculus
aatggtcactactgagtgtcctcag

SEQ ID NO: 403083 - DNA, 25 bp, Mus musculus
aatggtcccagtggatgaaccgcag

SEQ ID NO: 403084 - DNA, 25 bp, Mus musculus
aatggtcgctttctcttgttccagg

SEQ ID NO: 403085 - DNA, 25 bp, Mus musculus
aatggtctctctgcaggtgtctccg

SEQ ID NO: 403086 - DNA, 25 bp, Mus musculus
aatggtgagccagacccaggcagcg

SEQ ID NO: 403087 - DNA, 25 bp, Mus musculus
aatggtgcagaagcatcctcaggcg

SEQ ID NO: 403088 - DNA, 25 bp, Mus musculus
aatggtgcgtttacccacgacaagg

SEQ ID NO: 403089 - DNA, 25 bp, Mus musculus
aatggtgctacccagctcatgtctg

SEQ ID NO: 403090 - DNA, 25 bp, Mus musculus
aatggtggccattgatcaggtccta

SEQ ID NO: 403091 - DNA, 25 bp, Mus musculus
aatggtgggcccacttaggcctaag

SEQ ID NO: 403092 - DNA, 25 bp, Mus musculus
aatggttcaattggagcaagtctcg

SEQ ID NO: 403093 - DNA, 25 bp, Mus musculus
aatggtttgagccaacccgtccagg

SEQ ID NO: 403094 - DNA, 25 bp, Mus musculus
aatggtttgagttgcaggacgtgaa

SEQ ID NO: 403095 - DNA, 25 bp, Mus musculus
aatggtttggtccagatccgcagca

SEQ ID NO: 403096 - DNA, 25 bp, Mus musculus
aatgtaattcggtctccaccaagcc

SEQ ID NO: 403097 - DNA, 25 bp, Mus musculus
aatgtacaagtgtcccagaggcctg

SEQ ID NO: 403098 - DNA, 25 bp, Mus musculus
aatgtacacttcaactactagagag

SEQ ID NO: 403099 - DNA, 25 bp, Mus musculus
aatgtacagcgtatcatggacacgg

SEQ ID NO: 403100 - DNA, 25 bp, Mus musculus
aatgtacatgttggcggagctggcc

SEQ ID NO: 403101 - DNA, 25 bp, Mus musculus
aatgtaccaggagccatatccacgg

SEQ ID NO: 403102 - DNA, 25 bp, Mus musculus
aatgtacctcgtgttgtgccctacc

SEQ ID NO: 403103 - DNA, 25 bp, Mus musculus
aatgtactcgaagaatgtggccctc

SEQ ID NO: 403104 - DNA, 25 bp, Mus musculus
aatgtacttgggtctgtcgtggtcc

SEQ ID NO: 403105 - DNA, 25 bp, Mus musculus
aatgtagctgacaactgtccccggg

SEQ ID NO: 403106 - DNA, 25 bp, Mus musculus
aatgtatttgccctcctggactcga

SEQ ID NO: 403107 - DNA, 25 bp, Mus musculus
aatgtcaaaacactctggctccctg

SEQ ID NO: 403108 - DNA, 25 bp, Mus musculus
aatgtcaagctgctccacgagatgc

SEQ ID NO: 403109 - DNA, 25 bp, Mus musculus
aatgtcaattgccaccgggttcggg

SEQ ID NO: 403110 - DNA, 25 bp, Mus musculus
aatgtcaccagggagcgctgcagga

SEQ ID NO: 403111 - DNA, 25 bp, Mus musculus
aatgtcacctgaactctctggtgta

SEQ ID NO: 403112 - DNA, 25 bp, Mus musculus
aatgtcacctggctccggaatggac

SEQ ID NO: 403113 - DNA, 25 bp, Mus musculus
aatgtcagcgactatgacggcccca

SEQ ID NO: 403114 - DNA, 25 bp, Mus musculus
aatgtcagcggtacgtgggagttca

SEQ ID NO: 403115 - DNA, 25 bp, Mus musculus
aatgtcagtcaacaccggcgaggta

SEQ ID NO: 403116 - DNA, 25 bp, Mus musculus
aatgtcagtcttaatgactatcctt

SEQ ID NO: 403117 - DNA, 25 bp, Mus musculus
aatgtcagtggcatagggcagatcc

SEQ ID NO: 403118 - DNA, 25 bp, Mus musculus
aatgtcatttaagtggcagtttgct

SEQ ID NO: 403119 - DNA, 25 bp, Mus musculus
aatgtccccatggtccaacctaata

SEQ ID NO: 403120 - DNA, 25 bp, Mus musculus
aatgtcccgtttcgctcagaggtcc

SEQ ID NO: 403121 - DNA, 25 bp, Mus musculus
aatgtccctttgcatatttgttaag

SEQ ID NO: 403122 - DNA, 25 bp, Mus musculus
aatgtcctttgcagaccagaacagg

SEQ ID NO: 403123 - DNA, 25 bp, Mus musculus
aatgtcgggcatgtggacctgtcac

SEQ ID NO: 403124 - DNA, 25 bp, Mus musculus
aatgtcgtcatctccctgtccagga

SEQ ID NO: 403125 - DNA, 25 bp, Mus musculus
aatgtcgtcccagcaatatcagcag

SEQ ID NO: 403126 - DNA, 25 bp, Mus musculus
aatgtcgtggtcttagcctgccctg

SEQ ID NO: 403127 - DNA, 25 bp, Mus musculus
aatgtctaaagatggaatactgctc

SEQ ID NO: 403128 - DNA, 25 bp, Mus musculus
aatgtctcttgtctatgggctgacc

SEQ ID NO: 403129 - DNA, 25 bp, Mus musculus
aatgtctgaacctcggcgtgtgggc

SEQ ID NO: 403130 - DNA, 25 bp, Mus musculus
aatgtctgttaggtgttcacatcag

SEQ ID NO: 403131 - DNA, 25 bp, Mus musculus
aatgtcttgaacaggcacttcggga

SEQ ID NO: 403132 - DNA, 25 bp, Mus musculus
aatgtgacaccaggacgcacacgct

SEQ ID NO: 403133 - DNA, 25 bp, Mus musculus
aatgtgaccatcctcttcagcggca

SEQ ID NO: 403134 - DNA, 25 bp, Mus musculus
aatgtgacctggaaaagtctaagcc

SEQ ID NO: 403135 - DNA, 25 bp, Mus musculus
aatgtgacctgtgtggtggagaccc

SEQ ID NO: 403136 - DNA, 25 bp, Mus musculus
aatgtgactacaactcgcctggtga

SEQ ID NO: 403137 - DNA, 25 bp, Mus musculus
aatgtgagcaatagttacctcgtgc

SEQ ID NO: 403138 - DNA, 25 bp, Mus musculus
aatgtgcagagtcttccttggtcag

SEQ ID NO: 403139 - DNA, 25 bp, Mus musculus
aatgtgccctctttgagaagccccg

SEQ ID NO: 403140 - DNA, 25 bp, Mus musculus
aatgtgcgcacatcactaagtgtct

SEQ ID NO: 403141 - DNA, 25 bp, Mus musculus
aatgtgcgggaaaaagagtggctcc

SEQ ID NO: 403142 - DNA, 25 bp, Mus musculus
aatgtgcgtccttgtggccagtaga

SEQ ID NO: 403143 - DNA, 25 bp, Mus musculus
aatgtgctcatctgcgagggcaagc

SEQ ID NO: 403144 - DNA, 25 bp, Mus musculus
aatgtggagactactgagggctacc

SEQ ID NO: 403145 - DNA, 25 bp, Mus musculus
aatgtggctactcagcagaactctt

SEQ ID NO: 403146 - DNA, 25 bp, Mus musculus
aatgtggctccctcagatgtaggcg

SEQ ID NO: 403147 - DNA, 25 bp, Mus musculus
aatgtggtacctatgcctcctgcag

SEQ ID NO: 403148 - DNA, 25 bp, Mus musculus
aatgtggtcaccaagcccagcttca

SEQ ID NO: 403149 - DNA, 25 bp, Mus musculus
aatgtggtcccagaatgaatctcct

SEQ ID NO: 403150 - DNA, 25 bp, Mus musculus
aatgtggtcccatgtcagtgtgcag

SEQ ID NO: 403151 - DNA, 25 bp, Mus musculus
aatgtggtcgtctgcctggctgtca

SEQ ID NO: 403152 - DNA, 25 bp, Mus musculus
aatgtgtaatccctagtatgcctca

SEQ ID NO: 403153 - DNA, 25 bp, Mus musculus
aatgtgtacctagcagatctcactg

SEQ ID NO: 403154 - DNA, 25 bp, Mus musculus
aatgtgtatggtgatatttgctccg

SEQ ID NO: 403155 - DNA, 25 bp, Mus musculus
aatgtgtgaaagattgaccgcaacc

SEQ ID NO: 403156 - DNA, 25 bp, Mus musculus
aatgtgtggagtgggtattacctga

SEQ ID NO: 403157 - DNA, 25 bp, Mus musculus
aatgtgttactaccgctttgggcag

SEQ ID NO: 403158 - DNA, 25 bp, Mus musculus
aatgtgttagactacggcctggacc

SEQ ID NO: 403159 - DNA, 25 bp, Mus musculus
aatgtgttgcatttgaatccttgaa

SEQ ID NO: 403160 - DNA, 25 bp, Mus musculus
aatgttaaaacgtactgggcctatg

SEQ ID NO: 403161 - DNA, 25 bp, Mus musculus
aatgttaattcatggagaaactgct

SEQ ID NO: 403162 - DNA, 25 bp, Mus musculus
aatgttaattgttgcccttcctgag

SEQ ID NO: 403163 - DNA, 25 bp, Mus musculus
aatgttactgagtcccttaaagcag

SEQ ID NO: 403164 - DNA, 25 bp, Mus musculus
aatgttatggaatattcctccaggc

SEQ ID NO: 403165 - DNA, 25 bp, Mus musculus
aatgttcagtatggcttcccttctg

SEQ ID NO: 403166 - DNA, 25 bp, Mus musculus
aatgttccagatggtcagggtccca

SEQ ID NO: 403167 - DNA, 25 bp, Mus musculus
aatgttcccgactcgcaagcagagg

SEQ ID NO: 403168 - DNA, 25 bp, Mus musculus
aatgttcgaacaagcccagattcag

SEQ ID NO: 403169 - DNA, 25 bp, Mus musculus
aatgttcgagtctcagcggatcggc

SEQ ID NO: 403170 - DNA, 25 bp, Mus musculus
aatgttctgcactggctctacagcc

SEQ ID NO: 403171 - DNA, 25 bp, Mus musculus
aatgttgcctctgtagatgcttggg

SEQ ID NO: 403172 - DNA, 25 bp, Mus musculus
aatgttggctgtccgtgagaaccgc

SEQ ID NO: 403173 - DNA, 25 bp, Mus musculus
aatgttgttagctctccccaggcac

SEQ ID NO: 403174 - DNA, 25 bp, Mus musculus
aatgtttccaggaatgcgtccttgg

SEQ ID NO: 403175 - DNA, 25 bp, Mus musculus
aatgtttcctcactcgttaagcagc

SEQ ID NO: 403176 - DNA, 25 bp, Mus musculus
aatgtttgagagcacctgcagccct

SEQ ID NO: 403177 - DNA, 25 bp, Mus musculus
aatgttttgagatccctgaaggcgc

SEQ ID NO: 403178 - DNA, 25 bp, Mus musculus
aattaaagggtgaccatttggagct

SEQ ID NO: 403179 - DNA, 25 bp, Mus musculus
aattaaatggatatcacctgggacc

SEQ ID NO: 403180 - DNA, 25 bp, Mus musculus
aattaactccttaagccgctggctg

SEQ ID NO: 403181 - DNA, 25 bp, Mus musculus
aattaagaatccttcagaagtttgg

SEQ ID NO: 403182 - DNA, 25 bp, Mus musculus
aattaaggtgcccatgatgtaccgg

SEQ ID NO: 403183 - DNA, 25 bp, Mus musculus
aattaagtcacatgtaaccccatgc

SEQ ID NO: 403184 - DNA, 25 bp, Mus musculus
aattaatcatcactgcgggcggcga

SEQ ID NO: 403185 - DNA, 25 bp, Mus musculus
aattaatgaaatcgctggcccctgg

SEQ ID NO: 403186 - DNA, 25 bp, Mus musculus
aattaatgcttgcttcgccctccag

SEQ ID NO: 403187 - DNA, 25 bp, Mus musculus
aattaatgttttgtggcatgtaacc

SEQ ID NO: 403188 - DNA, 25 bp, Mus musculus
aattacagcccggatcacaggtcgg

SEQ ID NO: 403189 - DNA, 25 bp, Mus musculus
aattacaggactttgaggaggacgg

SEQ ID NO: 403190 - DNA, 25 bp, Mus musculus
aattacctgcagagccctagtggcc

SEQ ID NO: 403191 - DNA, 25 bp, Mus musculus
aattacctggacaacttctggccag

SEQ ID NO: 403192 - DNA, 25 bp, Mus musculus
aattacgccccgaaatgtgcagcct

SEQ ID NO: 403193 - DNA, 25 bp, Mus musculus
aattagaaagcacagtgggaggctc

SEQ ID NO: 403194 - DNA, 25 bp, Mus musculus
aattagaatcccttggccactgcgg

SEQ ID NO: 403195 - DNA, 25 bp, Mus musculus
aattagacattgctatgggagccac

SEQ ID NO: 403196 - DNA, 25 bp, Mus musculus
aattagaccatatgcatctggcggc

SEQ ID NO: 403197 - DNA, 25 bp, Mus musculus
aattagagggtgtgttccgtgctgc

SEQ ID NO: 403198 - DNA, 25 bp, Mus musculus
aattagcaattcaccatggctggcg

SEQ ID NO: 403199 - DNA, 25 bp, Mus musculus
aattagcggtgacatctcaaagggc

SEQ ID NO: 403200 - DNA, 25 bp, Mus musculus
aattagctaccttgcccctgaagag

SEQ ID NO: 403201 - DNA, 25 bp, Mus musculus
aattagctgattctgaaaacttagg

SEQ ID NO: 403202 - DNA, 25 bp, Mus musculus
aattagcttgagtcttcagaagagc

SEQ ID NO: 403203 - DNA, 25 bp, Mus musculus
aattaggaatgtgggctgagaatcc

SEQ ID NO: 403204 - DNA, 25 bp, Mus musculus
aattaggctggcaggcggtaagccc

SEQ ID NO: 403205 - DNA, 25 bp, Mus musculus
aattagtatctgctggttcacggcc

SEQ ID NO: 403206 - DNA, 25 bp, Mus musculus
aattagtctgcactggaacaaggcc

SEQ ID NO: 403207 - DNA, 25 bp, Mus musculus
aattatacccggcaggagagcagcc

SEQ ID NO: 403208 - DNA, 25 bp, Mus musculus
aattataggagactggaagaaccac

SEQ ID NO: 403209 - DNA, 25 bp, Mus musculus
aattatagtaagtgagaccatgtcc

SEQ ID NO: 403210 - DNA, 25 bp, Mus musculus
aattatagtcccaaacttcccatgg

SEQ ID NO: 403211 - DNA, 25 bp, Mus musculus
aattatcaagaggtattcactgccg

SEQ ID NO: 403212 - DNA, 25 bp, Mus musculus
aattatgaaggtccagcaggtctgc

SEQ ID NO: 403213 - DNA, 25 bp, Mus musculus
aattatgactgcaaaacaccgggcc

SEQ ID NO: 403214 - DNA, 25 bp, Mus musculus
aattatgagctcttgccgggaaacc

SEQ ID NO: 403215 - DNA, 25 bp, Mus musculus
aattatgccgacatcagctcccgtg

SEQ ID NO: 403216 - DNA, 25 bp, Mus musculus
aattatggccaagtactacactcgg

SEQ ID NO: 403217 - DNA, 25 bp, Mus musculus
aattatgggaattgagcttaggacc

SEQ ID NO: 403218 - DNA, 25 bp, Mus musculus
aattatgggtaatctaggcgcagca

SEQ ID NO: 403219 - DNA, 25 bp, Mus musculus
aattatgtctactaagagagggacc

SEQ ID NO: 403220 - DNA, 25 bp, Mus musculus
aattatgttccttcttctgtcacca

SEQ ID NO: 403221 - DNA, 25 bp, Mus musculus
aattattgaagagagccgtgaggcc

SEQ ID NO: 403222 - DNA, 25 bp, Mus musculus
aattcaacggcgctgaagaccctgg

SEQ ID NO: 403223 - DNA, 25 bp, Mus musculus
aattcaagccatgagccaatgcagc

SEQ ID NO: 403224 - DNA, 25 bp, Mus musculus
aattcacaccgagtcttcagccagg

SEQ ID NO: 403225 - DNA, 25 bp, Mus musculus
aattcacacttgagctgtacaggca

SEQ ID NO: 403226 - DNA, 25 bp, Mus musculus
aattcaccaaagagccgttcattgt

SEQ ID NO: 403227 - DNA, 25 bp, Mus musculus
aattcacccatgacggattccgcga

SEQ ID NO: 403228 - DNA, 25 bp, Mus musculus
aattcactgaggtggagaaccagcc

SEQ ID NO: 403229 - DNA, 25 bp, Mus musculus
aattcacttgtttagccaggattac

SEQ ID NO: 403230 - DNA, 25 bp, Mus musculus
aattcagaatgacagagtgccctcc

SEQ ID NO: 403231 - DNA, 25 bp, Mus musculus
aattcagcgagatctgcccctctgc

SEQ ID NO: 403232 - DNA, 25 bp, Mus musculus
aattcaggcagttgcgctaccagga

SEQ ID NO: 403233 - DNA, 25 bp, Mus musculus
aattcaggcctgaactccagactgg

SEQ ID NO: 403234 - DNA, 25 bp, Mus musculus
aattcagggcctgcctggaccgcag

SEQ ID NO: 403235 - DNA, 25 bp, Mus musculus
aattcagtgcaaacacaggtcgccc

SEQ ID NO: 403236 - DNA, 25 bp, Mus musculus
aattcagtgtgtgtcggccgagtcc

SEQ ID NO: 403237 - DNA, 25 bp, Mus musculus
aattcagttttgtgagcctgcccgg

SEQ ID NO: 403238 - DNA, 25 bp, Mus musculus
aattcattctataagcagagcccca

SEQ ID NO: 403239 - DNA, 25 bp, Mus musculus
aattccaagctcagcgggtgccccg

SEQ ID NO: 403240 - DNA, 25 bp, Mus musculus
aattccagccattgcgctccgaagc

SEQ ID NO: 403241 - DNA, 25 bp, Mus musculus
aattccatggtgtttctgggacggc

SEQ ID NO: 403242 - DNA, 25 bp, Mus musculus
aattcccaggaagcctcactgcagg

SEQ ID NO: 403243 - DNA, 25 bp, Mus musculus
aattcccaggagcagaaagtcaccc

SEQ ID NO: 403244 - DNA, 25 bp, Mus musculus
aattcccagtgggttgtttcagccg

SEQ ID NO: 403245 - DNA, 25 bp, Mus musculus
aattcccctggcatgcgagactgga

SEQ ID NO: 403246 - DNA, 25 bp, Mus musculus
aattcccgagggaagtagtgctgca

SEQ ID NO: 403247 - DNA, 25 bp, Mus musculus
aattccctgaaatacactgctaaag

SEQ ID NO: 403248 - DNA, 25 bp, Mus musculus
aattccctttaggagggaggcacag

SEQ ID NO: 403249 - DNA, 25 bp, Mus musculus
aattccgcttcggtggagcagctcc

SEQ ID NO: 403250 - DNA, 25 bp, Mus musculus
aattcctagcccaccatgatgttca

SEQ ID NO: 403251 - DNA, 25 bp, Mus musculus
aattcctcatctgggacaccgctgg

SEQ ID NO: 403252 - DNA, 25 bp, Mus musculus
aattcctgtgaaaatggctcttctc

SEQ ID NO: 403253 - DNA, 25 bp, Mus musculus
aattccttttggcagtcaagacagc

SEQ ID NO: 403254 - DNA, 25 bp, Mus musculus
aattcgaacatgtcctggccgtagg

SEQ ID NO: 403255 - DNA, 25 bp, Mus musculus
aattcgactgaagacacatggtata

SEQ ID NO: 403256 - DNA, 25 bp, Mus musculus
aattcgaggcatggtccctgaccag

SEQ ID NO: 403257 - DNA, 25 bp, Mus musculus
aattcgcagtcatacatcggacggc

SEQ ID NO: 403258 - DNA, 25 bp, Mus musculus
aattcgctcacgctttgagacaggc

SEQ ID NO: 403259 - DNA, 25 bp, Mus musculus
aattcggcgagtctgaaagcctcag

SEQ ID NO: 403260 - DNA, 25 bp, Mus musculus
aattctcagattcagtcaaatccac

SEQ ID NO: 403261 - DNA, 25 bp, Mus musculus
aattctcagccatcaaggagccgca

SEQ ID NO: 403262 - DNA, 25 bp, Mus musculus
aattctcaggcaccagggtcagcag

SEQ ID NO: 403263 - DNA, 25 bp, Mus musculus
aattctccaagtgagagccgccggg

SEQ ID NO: 403264 - DNA, 25 bp, Mus musculus
aattctcgcaaaaccatgtactgtg

SEQ ID NO: 403265 - DNA, 25 bp, Mus musculus
aattctctggcctcaaagtccatgg

SEQ ID NO: 403266 - DNA, 25 bp, Mus musculus
aattctgaggattggcaagagaccg

SEQ ID NO: 403267 - DNA, 25 bp, Mus musculus
aattctgagtgtaccaatggctgcg

SEQ ID NO: 403268 - DNA, 25 bp, Mus musculus
aattctgcgcactgagaccgctagg

SEQ ID NO: 403269 - DNA, 25 bp, Mus musculus
aattctggccccatgtcttgctttc

SEQ ID NO: 403270 - DNA, 25 bp, Mus musculus
aattctgggacactccgttcagcgg

SEQ ID NO: 403271 - DNA, 25 bp, Mus musculus
aattctgggtgtgaatctcgatcgc

SEQ ID NO: 403272 - DNA, 25 bp, Mus musculus
aattctgtcttctgcctagcgctcg

SEQ ID NO: 403273 - DNA, 25 bp, Mus musculus
aattctgtgactacgggaaggccgc

SEQ ID NO: 403274 - DNA, 25 bp, Mus musculus
aattctgtgagtccctgaagggcgc

SEQ ID NO: 403275 - DNA, 25 bp, Mus musculus
aattctgtggctcgtgcagtcatgc

SEQ ID NO: 403276 - DNA, 25 bp, Mus musculus
aattctgttctctcttatggccaag

SEQ ID NO: 403277 - DNA, 25 bp, Mus musculus
aattcttaatttgctgtacatctga

SEQ ID NO: 403278 - DNA, 25 bp, Mus musculus
aattctttacctgctcctgcaagag

SEQ ID NO: 403279 - DNA, 25 bp, Mus musculus
aattctttcaggctggttccgaggt

SEQ ID NO: 403280 - DNA, 25 bp, Mus musculus
aattctttctttgtagtgtgtaagg

SEQ ID NO: 403281 - DNA, 25 bp, Mus musculus
aattctttgttataggctgggattc

SEQ ID NO: 403282 - DNA, 25 bp, Mus musculus
aattgaaaggtcacatcacatcaca

SEQ ID NO: 403283 - DNA, 25 bp, Mus musculus
aattgaacagttttcccacactcac

SEQ ID NO: 403284 - DNA, 25 bp, Mus musculus
aattgaaccgtgcacagacccgttg

SEQ ID NO: 403285 - DNA, 25 bp, Mus musculus
aattgaacttgcagagacgaagccc

SEQ ID NO: 403286 - DNA, 25 bp, Mus musculus
aattgaagagattcgcctggagggc

SEQ ID NO: 403287 - DNA, 25 bp, Mus musculus
aattgaagatatcgtttctgctccc

SEQ ID NO: 403288 - DNA, 25 bp, Mus musculus
aattgaaggtgcacaaagggcggca

SEQ ID NO: 403289 - DNA, 25 bp, Mus musculus
aattgaaggtggtttccaggctcac

SEQ ID NO: 403290 - DNA, 25 bp, Mus musculus
aattgaagtgtttgctccacccggg

SEQ ID NO: 403291 - DNA, 25 bp, Mus musculus
aattgaccgacaggagagtagccgc

SEQ ID NO: 403292 - DNA, 25 bp, Mus musculus
aattgagaaccccaaggatcacctg

SEQ ID NO: 403293 - DNA, 25 bp, Mus musculus
aattgagctgaagcaaggctacacc

SEQ ID NO: 403294 - DNA, 25 bp, Mus musculus
aattgaggactcagcacaggtggcc

SEQ ID NO: 403295 - DNA, 25 bp, Mus musculus
aattgaggctcgctctgtggaacgc

SEQ ID NO: 403296 - DNA, 25 bp, Mus musculus
aattgaggtggtctttactgttcac

SEQ ID NO: 403297 - DNA, 25 bp, Mus musculus
aattgagtgctacacccgcgggata

SEQ ID NO: 403298 - DNA, 25 bp, Mus musculus
aattgatatgcatttactgggcacc

SEQ ID NO: 403299 - DNA, 25 bp, Mus musculus
aattgatatttaatgactaagtgac

SEQ ID NO: 403300 - DNA, 25 bp, Mus musculus
aattgatgagaagagccaccctggt

SEQ ID NO: 403301 - DNA, 25 bp, Mus musculus
aattgatgcaggaaccacttcggtg

SEQ ID NO: 403302 - DNA, 25 bp, Mus musculus
aattgatgggatagccaccacacgc

SEQ ID NO: 403303 - DNA, 25 bp, Mus musculus
aattgcaaaggtagtggaggccagc

SEQ ID NO: 403304 - DNA, 25 bp, Mus musculus
aattgcaattctcaggccgggcgtg

SEQ ID NO: 403305 - DNA, 25 bp, Mus musculus
aattgcagagaatgtcctatgccgc

SEQ ID NO: 403306 - DNA, 25 bp, Mus musculus
aattgcagagggtcttgtgccagca

SEQ ID NO: 403307 - DNA, 25 bp, Mus musculus
aattgcaggcagcatgtcgagcacg

SEQ ID NO: 403308 - DNA, 25 bp, Mus musculus
aattgccaaaactcgatgcctccag

SEQ ID NO: 403309 - DNA, 25 bp, Mus musculus
aattgccaagagcaaaattacttga

SEQ ID NO: 403310 - DNA, 25 bp, Mus musculus
aattgcccagtctcagtctggtacg

SEQ ID NO: 403311 - DNA, 25 bp, Mus musculus
aattgcctgaaatgcctgaacccag

SEQ ID NO: 403312 - DNA, 25 bp, Mus musculus
aattgctctcccaaacatagcctca

SEQ ID NO: 403313 - DNA, 25 bp, Mus musculus
aattgctctgccaatacagcgtggg

SEQ ID NO: 403314 - DNA, 25 bp, Mus musculus
aattgctgctctcatcctgaatcgg

SEQ ID NO: 403315 - DNA, 25 bp, Mus musculus
aattgcttctctcgacctaagggtg

SEQ ID NO: 403316 - DNA, 25 bp, Mus musculus
aattggaaggcagtacccctgtgcg

SEQ ID NO: 403317 - DNA, 25 bp, Mus musculus
aattggaatatctaacatgatctga

SEQ ID NO: 403318 - DNA, 25 bp, Mus musculus
aattggacacggcagaaaggaactc

SEQ ID NO: 403319 - DNA, 25 bp, Mus musculus
aattggagaagatcatgtgaggcac

SEQ ID NO: 403320 - DNA, 25 bp, Mus musculus
aattggatcatggtatcatttctcc

SEQ ID NO: 403321 - DNA, 25 bp, Mus musculus
aattggatggcttcagacccgaggc

SEQ ID NO: 403322 - DNA, 25 bp, Mus musculus
aattggcaataaagctgacctggac

SEQ ID NO: 403323 - DNA, 25 bp, Mus musculus
aattggcacgggacatgcagaccga

SEQ ID NO: 403324 - DNA, 25 bp, Mus musculus
aattggcagcaagaagatactggtc

SEQ ID NO: 403325 - DNA, 25 bp, Mus musculus
aattggcatcggactgggaattggc

SEQ ID NO: 403326 - DNA, 25 bp, Mus musculus
aattggcatgcttcgagaatcacgg

SEQ ID NO: 403327 - DNA, 25 bp, Mus musculus
aattggctacaggaagggaacttgc

SEQ ID NO: 403328 - DNA, 25 bp, Mus musculus
aattggcttcctaacagaggttgag

SEQ ID NO: 403329 - DNA, 25 bp, Mus musculus
aattgggattctcctacctcgggat

SEQ ID NO: 403330 - DNA, 25 bp, Mus musculus
aattgggcacatagtcggccaggcc

SEQ ID NO: 403331 - DNA, 25 bp, Mus musculus
aattgggcatcctgttaaccctcag

SEQ ID NO: 403332 - DNA, 25 bp, Mus musculus
aattgggttcctctcgcggctgaag

SEQ ID NO: 403333 - DNA, 25 bp, Mus musculus
aattgggttgggtctctggttcatc

SEQ ID NO: 403334 - DNA, 25 bp, Mus musculus
aattggtagtgctccagcgaggcag

SEQ ID NO: 403335 - DNA, 25 bp, Mus musculus
aattggtgctgctagtctgtgagtg

SEQ ID NO: 403336 - DNA, 25 bp, Mus musculus
aattggtttcggatgaggagagccc

SEQ ID NO: 403337 - DNA, 25 bp, Mus musculus
aattgtacaaattcactgaccgtgg

SEQ ID NO: 403338 - DNA, 25 bp, Mus musculus
aattgtacgtggacagactgcggag

SEQ ID NO: 403339 - DNA, 25 bp, Mus musculus
aattgtagcttatccactttcagtg

SEQ ID NO: 403340 - DNA, 25 bp, Mus musculus
aattgtatgcataagttgggtcccc

SEQ ID NO: 403341 - DNA, 25 bp, Mus musculus
aattgtgaaaagctggcttggcccc

SEQ ID NO: 403342 - DNA, 25 bp, Mus musculus
aattgtgggctctgtgagcctcccc

SEQ ID NO: 403343 - DNA, 25 bp, Mus musculus
aattgtggtgggttctgcaaactca

SEQ ID NO: 403344 - DNA, 25 bp, Mus musculus
aattgtgtagctcaccatgggaccc

SEQ ID NO: 403345 - DNA, 25 bp, Mus musculus
aattgtgtccaatgctgaggtcccg

SEQ ID NO: 403346 - DNA, 25 bp, Mus musculus
aattgttagagggtacctctgagga

SEQ ID NO: 403347 - DNA, 25 bp, Mus musculus
aattgttcacagtgcagaccttgca

SEQ ID NO: 403348 - DNA, 25 bp, Mus musculus
aattgttccccgtggtgacgcaagg

SEQ ID NO: 403349 - DNA, 25 bp, Mus musculus
aatttaaaatcgctgcctgcctgag

SEQ ID NO: 403350 - DNA, 25 bp, Mus musculus
aatttaaccgggatgctgtctgcca

SEQ ID NO: 403351 - DNA, 25 bp, Mus musculus
aatttaacggcctcacgtcgtgcag

SEQ ID NO: 403352 - DNA, 25 bp, Mus musculus
aatttacaatgaggagtatggcgac

SEQ ID NO: 403353 - DNA, 25 bp, Mus musculus
aatttacagagcgtcctcggcctgg

SEQ ID NO: 403354 - DNA, 25 bp, Mus musculus
aatttacattcactgggcatagctg

SEQ ID NO: 403355 - DNA, 25 bp, Mus musculus
aatttacggcgtgttgccagagagc

SEQ ID NO: 403356 - DNA, 25 bp, Mus musculus
aatttagaagtcaaccagccatcgc

SEQ ID NO: 403357 - DNA, 25 bp, Mus musculus
aatttagactctgcatgtaactagc

SEQ ID NO: 403358 - DNA, 25 bp, Mus musculus
aatttagcggaatggccagatgccc

SEQ ID NO: 403359 - DNA, 25 bp, Mus musculus
aatttaggcccgtgaatgctgcaga

SEQ ID NO: 403360 - DNA, 25 bp, Mus musculus
aatttagtgcaggtgggcgacagcc

SEQ ID NO: 403361 - DNA, 25 bp, Mus musculus
aatttagttcctgcatatcctactc

SEQ ID NO: 403362 - DNA, 25 bp, Mus musculus
aatttatcaaatatgaagtgttcct

SEQ ID NO: 403363 - DNA, 25 bp, Mus musculus
aatttatgcacgctgaatatgaact

SEQ ID NO: 403364 - DNA, 25 bp, Mus musculus
aatttattatggaccagcccagtag

SEQ ID NO: 403365 - DNA, 25 bp, Mus musculus
aatttccaacgtcagagccatccag

SEQ ID NO: 403366 - DNA, 25 bp, Mus musculus
aatttccctagacctaacattccag

SEQ ID NO: 403367 - DNA, 25 bp, Mus musculus
aatttccctccggtatctgctgcag

SEQ ID NO: 403368 - DNA, 25 bp, Mus musculus
aatttccggtcagtgcaggtagtgc

SEQ ID NO: 403369 - DNA, 25 bp, Mus musculus
aatttctagggcagcatttttcagc

SEQ ID NO: 403370 - DNA, 25 bp, Mus musculus
aatttctccatctgtgaccgaccgg

SEQ ID NO: 403371 - DNA, 25 bp, Mus musculus
aatttctggccctcatctgatgagg

SEQ ID NO: 403372 - DNA, 25 bp, Mus musculus
aatttcttattcagtcacctctggg

SEQ ID NO: 403373 - DNA, 25 bp, Mus musculus
aatttcttgtgaagcccaacgccag

SEQ ID NO: 403374 - DNA, 25 bp, Mus musculus
aatttgaaatggcagctgggacagc

SEQ ID NO: 403375 - DNA, 25 bp, Mus musculus
aatttgaactgctgtggcttccgga

SEQ ID NO: 403376 - DNA, 25 bp, Mus musculus
aatttgaaggtggtcgtctcgcaac

SEQ ID NO: 403377 - DNA, 25 bp, Mus musculus
aatttgatcaatttgcaatgcaggc

SEQ ID NO: 403378 - DNA, 25 bp, Mus musculus
aatttgatgatctttgacacccgga

SEQ ID NO: 403379 - DNA, 25 bp, Mus musculus
aatttgatgcgcctctggatccgga

SEQ ID NO: 403380 - DNA, 25 bp, Mus musculus
aatttgcaaggtggccatctcacgg

SEQ ID NO: 403381 - DNA, 25 bp, Mus musculus
aatttgccggcacgagaatcttccc

SEQ ID NO: 403382 - DNA, 25 bp, Mus musculus
aatttgctatcggaagcagcagacc

SEQ ID NO: 403383 - DNA, 25 bp, Mus musculus
aatttgctcctgcagagacccggct

SEQ ID NO: 403384 - DNA, 25 bp, Mus musculus
aatttgctgtacatctgataacacc

SEQ ID NO: 403385 - DNA, 25 bp, Mus musculus
aatttggaccgtgatggaatggacc

SEQ ID NO: 403386 - DNA, 25 bp, Mus musculus
aatttggcaacctgacgaagctgac

SEQ ID NO: 403387 - DNA, 25 bp, Mus musculus
aatttggcagccgaaaagacctaca

SEQ ID NO: 403388 - DNA, 25 bp, Mus musculus
aatttggcccttgagttcgagcacc

SEQ ID NO: 403389 - DNA, 25 bp, Mus musculus
aatttggcgaggacaccttcttcgg

SEQ ID NO: 403390 - DNA, 25 bp, Mus musculus
aatttggcgcctgcctggatgggat

SEQ ID NO: 403391 - DNA, 25 bp, Mus musculus
aatttggcttccctgcgttcagtgg

SEQ ID NO: 403392 - DNA, 25 bp, Mus musculus
aatttgggacattgaaaaaagctgc

SEQ ID NO: 403393 - DNA, 25 bp, Mus musculus
aatttggtacaagtggatggcagcc

SEQ ID NO: 403394 - DNA, 25 bp, Mus musculus
aatttggtgttcagtccgagaggca

SEQ ID NO: 403395 - DNA, 25 bp, Mus musculus
aatttgtccagtacagggatccggg

SEQ ID NO: 403396 - DNA, 25 bp, Mus musculus
aatttgtccctgaacgaacgctgcc

SEQ ID NO: 403397 - DNA, 25 bp, Mus musculus
aatttgttaaccagccgccaagcag

SEQ ID NO: 403398 - DNA, 25 bp, Mus musculus
aattttaactggacatgttaattag

SEQ ID NO: 403399 - DNA, 25 bp, Mus musculus
aattttacgccaagggagcactgca

SEQ ID NO: 403400 - DNA, 25 bp, Mus musculus
aattttagcgaatggcctcctgcag

SEQ ID NO: 403401 - DNA, 25 bp, Mus musculus
aattttagtgcacttttatgctaag

SEQ ID NO: 403402 - DNA, 25 bp, Mus musculus
aattttcctgtactatgaaggctga

SEQ ID NO: 403403 - DNA, 25 bp, Mus musculus
aattttctgggagggaccgagcgca

SEQ ID NO: 403404 - DNA, 25 bp, Mus musculus
aattttcttgtgttgctgctccccg

SEQ ID NO: 403405 - DNA, 25 bp, Mus musculus
aattttgctcaacactctgtccccg

SEQ ID NO: 403406 - DNA, 25 bp, Mus musculus
acaaaactctgggtgcaaacgctca

SEQ ID NO: 403407 - DNA, 25 bp, Mus musculus
acaaaactgtggtgatcccctgccg

SEQ ID NO: 403408 - DNA, 25 bp, Mus musculus
acaaaaggtacatggtaagcagtcc

SEQ ID NO: 403409 - DNA, 25 bp, Mus musculus
acaaacacattaagggcgcagggca

SEQ ID NO: 403410 - DNA, 25 bp, Mus musculus
acaaacatccttcatagagatctgc

SEQ ID NO: 403411 - DNA, 25 bp, Mus musculus
acaaaccaggaagggagtcgcgagc

SEQ ID NO: 403412 - DNA, 25 bp, Mus musculus
acaaaccggacacccagatggatgc

SEQ ID NO: 403413 - DNA, 25 bp, Mus musculus
acaaagaagagagccttctccagcg

SEQ ID NO: 403414 - DNA, 25 bp, Mus musculus
acaaagacccgaagtactggccaga

SEQ ID NO: 403415 - DNA, 25 bp, Mus musculus
acaaagagctggcagcccctgaagg

SEQ ID NO: 403416 - DNA, 25 bp, Mus musculus
acaaagagttcaccaggcagcctgt

SEQ ID NO: 403417 - DNA, 25 bp, Mus musculus
acaaagataagtcacccccaactcg

SEQ ID NO: 403418 - DNA, 25 bp, Mus musculus
acaaagcaactgtttcgccgtcggc

SEQ ID NO: 403419 - DNA, 25 bp, Mus musculus
acaaagcacttgagagttcagggcc

SEQ ID NO: 403420 - DNA, 25 bp, Mus musculus
acaaagccagaaagcagaaggcagt

SEQ ID NO: 403421 - DNA, 25 bp, Mus musculus
acaaagcccctgatggtgagcacgg

SEQ ID NO: 403422 - DNA, 25 bp, Mus musculus
acaaagccctgctattgctggaggg

SEQ ID NO: 403423 - DNA, 25 bp, Mus musculus
acaaaggagctttgtgagtttgcta

SEQ ID NO: 403424 - DNA, 25 bp, Mus musculus
acaaaggcggcaacaagaagggctt

SEQ ID NO: 403425 - DNA, 25 bp, Mus musculus
acaaaggctgtgtggatgtctgccc

SEQ ID NO: 403426 - DNA, 25 bp, Mus musculus
acaaaggtgcgtcccttcagctctc

SEQ ID NO: 403427 - DNA, 25 bp, Mus musculus
acaaaggtggtgagtactgatcccc

SEQ ID NO: 403428 - DNA, 25 bp, Mus musculus
acaaatatgaaacatctgaagaagc

SEQ ID NO: 403429 - DNA, 25 bp, Mus musculus
acaaatgtttcctgatccagccgga

SEQ ID NO: 403430 - DNA, 25 bp, Mus musculus
acaacacggaccatacggctgagga

SEQ ID NO: 403431 - DNA, 25 bp, Mus musculus
acaacagtgagggagaacctggctg

SEQ ID NO: 403432 - DNA, 25 bp, Mus musculus
acaacatctgttgcgcgtgcctggc

SEQ ID NO: 403433 - DNA, 25 bp, Mus musculus
acaacatgagcctccatcggaaccg

SEQ ID NO: 403434 - DNA, 25 bp, Mus musculus
acaacatggctttctggcactcaaa

SEQ ID NO: 403435 - DNA, 25 bp, Mus musculus
acaaccctaaggtcttgtgccagca

SEQ ID NO: 403436 - DNA, 25 bp, Mus musculus
acaaccgagccaagatgttgcggaa

SEQ ID NO: 403437 - DNA, 25 bp, Mus musculus
acaaccgtgttctcaggcagtgggc

SEQ ID NO: 403438 - DNA, 25 bp, Mus musculus
acaacctcagcgagggcggctacga

SEQ ID NO: 403439 - DNA, 25 bp, Mus musculus
acaacctgcaagagtcttccaccat

SEQ ID NO: 403440 - DNA, 25 bp, Mus musculus
acaacgcgcggtcctggtcaggaat

SEQ ID NO: 403441 - DNA, 25 bp, Mus musculus
acaacggtgaatgggtaagctgtct

SEQ ID NO: 403442 - DNA, 25 bp, Mus musculus
acaacgtaggctgcaccggtactga

SEQ ID NO: 403443 - DNA, 25 bp, Mus musculus
acaacgtggatttattccaaagagg

SEQ ID NO: 403444 - DNA, 25 bp, Mus musculus
acaactccgactccgtgggatccag

SEQ ID NO: 403445 - DNA, 25 bp, Mus musculus
acaactgggatacatgggcggctca

SEQ ID NO: 403446 - DNA, 25 bp, Mus musculus
acaacttcagtagcgggcgacgcgg

SEQ ID NO: 403447 - DNA, 25 bp, Mus musculus
acaagacaacgcaggtctcaccggg

SEQ ID NO: 403448 - DNA, 25 bp, Mus musculus
acaagacgggatcctaatatcacag

SEQ ID NO: 403449 - DNA, 25 bp, Mus musculus
acaagacttcttgagcgaggcagcc

SEQ ID NO: 403450 - DNA, 25 bp, Mus musculus
acaagagactgcttccgcggagaag

SEQ ID NO: 403451 - DNA, 25 bp, Mus musculus
acaagatgacgtgggctccccgtag

SEQ ID NO: 403452 - DNA, 25 bp, Mus musculus
acaagcagcgactttgagggctgac

SEQ ID NO: 403453 - DNA, 25 bp, Mus musculus
acaagcaggtacaacaggtgacagt

SEQ ID NO: 403454 - DNA, 25 bp, Mus musculus
acaagcatatcccttggctgctgtg

SEQ ID NO: 403455 - DNA, 25 bp, Mus musculus
acaagcatcgagatatatttctcca

SEQ ID NO: 403456 - DNA, 25 bp, Mus musculus
acaagcatctgggataaagtggact

SEQ ID NO: 403457 - DNA, 25 bp, Mus musculus
acaagcgatggagcaggatggacca

SEQ ID NO: 403458 - DNA, 25 bp, Mus musculus
acaagcgcagtcaggagccggcagt

SEQ ID NO: 403459 - DNA, 25 bp, Mus musculus
acaagcgcccgttggtctctcagaa

SEQ ID NO: 403460 - DNA, 25 bp, Mus musculus
acaagcgtggttctaaagttcctgc

SEQ ID NO: 403461 - DNA, 25 bp, Mus musculus
acaagcttgagtctggaggaatccc

SEQ ID NO: 403462 - DNA, 25 bp, Mus musculus
acaagctttggctgtgtcagctgac

SEQ ID NO: 403463 - DNA, 25 bp, Mus musculus
acaaggaaggtaagatggagcccat

SEQ ID NO: 403464 - DNA, 25 bp, Mus musculus
acaaggcctcccaggtagatttagg

SEQ ID NO: 403465 - DNA, 25 bp, Mus musculus
acaaggccttgcagtgtggacgcca

SEQ ID NO: 403466 - DNA, 25 bp, Mus musculus
acaaggtgatgttaaactggctgac

SEQ ID NO: 403467 - DNA, 25 bp, Mus musculus
acaaggtgccgtttgccgggcagct

SEQ ID NO: 403468 - DNA, 25 bp, Mus musculus
acaaggtgtttgtggaggcagcaac

SEQ ID NO: 403469 - DNA, 25 bp, Mus musculus
acaagtacaactagtggcccagagc

SEQ ID NO: 403470 - DNA, 25 bp, Mus musculus
acaagtagtctagtcctggcaagtg

SEQ ID NO: 403471 - DNA, 25 bp, Mus musculus
acaagtcagtgagcccaagaaatgg

SEQ ID NO: 403472 - DNA, 25 bp, Mus musculus
acaagtgctggtcagggttctccaa

SEQ ID NO: 403473 - DNA, 25 bp, Mus musculus
acaagtgcttcctgctctcgcgaga

SEQ ID NO: 403474 - DNA, 25 bp, Mus musculus
acaagtggaacaactggagctggga

SEQ ID NO: 403475 - DNA, 25 bp, Mus musculus
acaataacgagctggtgaccggcaa

SEQ ID NO: 403476 - DNA, 25 bp, Mus musculus
acaataagacgtgggatgaggctcc

SEQ ID NO: 403477 - DNA, 25 bp, Mus musculus
acaatatgtggtgctggtcccgtca

SEQ ID NO: 403478 - DNA, 25 bp, Mus musculus
acaatcactgtggtcatgctgtcca

SEQ ID NO: 403479 - DNA, 25 bp, Mus musculus
acaatcgtaagctgtggagagccgg

SEQ ID NO: 403480 - DNA, 25 bp, Mus musculus
acaatgaaacgtgcgaggcagccca

SEQ ID NO: 403481 - DNA, 25 bp, Mus musculus
acaatgaagccaggtcggccctgct

SEQ ID NO: 403482 - DNA, 25 bp, Mus musculus
acaatgagcaaactgtcacgtgatg

SEQ ID NO: 403483 - DNA, 25 bp, Mus musculus
acaatgaggctttatctagaccgct

SEQ ID NO: 403484 - DNA, 25 bp, Mus musculus
acaatgcactcaagggaaggtcaga

SEQ ID NO: 403485 - DNA, 25 bp, Mus musculus
acaatggagcacttgagccaggcgc

SEQ ID NO: 403486 - DNA, 25 bp, Mus musculus
acaatgtgaggaccatcggtgccca

SEQ ID NO: 403487 - DNA, 25 bp, Mus musculus
acaattacatctgggcgctcaccga

SEQ ID NO: 403488 - DNA, 25 bp, Mus musculus
acaatttgagttctgtcctcgggac

SEQ ID NO: 403489 - DNA, 25 bp, Mus musculus
acacaaactgtcctgtcccaagtcg

SEQ ID NO: 403490 - DNA, 25 bp, Mus musculus
acacaacgtggaggaagcgctggct

SEQ ID NO: 403491 - DNA, 25 bp, Mus musculus
acacacaaggctcacccaggcagag

SEQ ID NO: 403492 - DNA, 25 bp, Mus musculus
acacacaccgaggaaggctgagctc

SEQ ID NO: 403493 - DNA, 25 bp, Mus musculus
acacacacctggactagtgttaggg

SEQ ID NO: 403494 - DNA, 25 bp, Mus musculus
acacacactctgtgtctccagtggg

SEQ ID NO: 403495 - DNA, 25 bp, Mus musculus
acacacagaggaggcggatttaaaa

SEQ ID NO: 403496 - DNA, 25 bp, Mus musculus
acacacaggccagatttctcacaga

SEQ ID NO: 403497 - DNA, 25 bp, Mus musculus
acacacagtagggagcaaagcagcc

SEQ ID NO: 403498 - DNA, 25 bp, Mus musculus
acacacatgcgtgcagggtagaggt

SEQ ID NO: 403499 - DNA, 25 bp, Mus musculus
acacacgagtggagcgcgattgacc

SEQ ID NO: 403500 - DNA, 25 bp, Mus musculus
acacactcttacttagtgccctgga

SEQ ID NO: 403501 - DNA, 25 bp, Mus musculus
acacagacttgtggacctagccggg

SEQ ID NO: 403502 - DNA, 25 bp, Mus musculus
acacagaggaggacgtagaaaggct

SEQ ID NO: 403503 - DNA, 25 bp, Mus musculus
acacagagggttagctggccgagct

SEQ ID NO: 403504 - DNA, 25 bp, Mus musculus
acacagagtgtggtactcatgatcg

SEQ ID NO: 403505 - DNA, 25 bp, Mus musculus
acacagattccttcgttgattaact

SEQ ID NO: 403506 - DNA, 25 bp, Mus musculus
acacagcacccttggatatggacag

SEQ ID NO: 403507 - DNA, 25 bp, Mus musculus
acacagcagtgttctgtcccagccg

SEQ ID NO: 403508 - DNA, 25 bp, Mus musculus
acacagcggtgtacaatgcggcgca

SEQ ID NO: 403509 - DNA, 25 bp, Mus musculus
acacagctcgggtgagggacatcga

SEQ ID NO: 403510 - DNA, 25 bp, Mus musculus
acacagggaccgcagaagctggctt

SEQ ID NO: 403511 - DNA, 25 bp, Mus musculus
acacagggtcatggactcccggctt

SEQ ID NO: 403512 - DNA, 25 bp, Mus musculus
acacagtgtgcccactcctgtgtca

SEQ ID NO: 403513 - DNA, 25 bp, Mus musculus
acacagtttgcagcgtgttggagga

SEQ ID NO: 403514 - DNA, 25 bp, Mus musculus
acacatagagaactggcgaggcctg

SEQ ID NO: 403515 - DNA, 25 bp, Mus musculus
acacatcacacataagcagaagccc

SEQ ID NO: 403516 - DNA, 25 bp, Mus musculus
acacattgtctgagggcctgccctg

SEQ ID NO: 403517 - DNA, 25 bp, Mus musculus
acaccaatgattacacccaagtggg

SEQ ID NO: 403518 - DNA, 25 bp, Mus musculus
acaccatcaagcagagagagcgcgg

SEQ ID NO: 403519 - DNA, 25 bp, Mus musculus
acaccatggatggtaccccagcgag

SEQ ID NO: 403520 - DNA, 25 bp, Mus musculus
acaccatttttagggcagggaagca

SEQ ID NO: 403521 - DNA, 25 bp, Mus musculus
acaccccagccttggcttggttaag

SEQ ID NO: 403522 - DNA, 25 bp, Mus musculus
acacccctgaacctgcaaattgacc

SEQ ID NO: 403523 - DNA, 25 bp, Mus musculus
acaccgagaggctgcgggcttgcca

SEQ ID NO: 403524 - DNA, 25 bp, Mus musculus
acaccgaggctgtgctgaacgggaa

SEQ ID NO: 403525 - DNA, 25 bp, Mus musculus
acaccgccaacgagtttgcgcgcaa

SEQ ID NO: 403526 - DNA, 25 bp, Mus musculus
acaccgcggtgctcggtacccattg

SEQ ID NO: 403527 - DNA, 25 bp, Mus musculus
acaccgcttcactgttcattaagag

SEQ ID NO: 403528 - DNA, 25 bp, Mus musculus
acaccggtgctttccggcggccaag

SEQ ID NO: 403529 - DNA, 25 bp, Mus musculus
acaccgtacagatgagagggcagcc

SEQ ID NO: 403530 - DNA, 25 bp, Mus musculus
acacctactgggagccagccacaat

SEQ ID NO: 403531 - DNA, 25 bp, Mus musculus
acacctctttcatggcttcggcgaa

SEQ ID NO: 403532 - DNA, 25 bp, Mus musculus
acacctgtggatgacgaatcttagc

SEQ ID NO: 403533 - DNA, 25 bp, Mus musculus
acaccttcttgttgcctccgagagc

SEQ ID NO: 403534 - DNA, 25 bp, Mus musculus
acaccttgaacgctgatgggaaaac

SEQ ID NO: 403535 - DNA, 25 bp, Mus musculus
acacgaactgtgtgccacggtacag

SEQ ID NO: 403536 - DNA, 25 bp, Mus musculus
acacgacggaggcacgtgagtaccc

SEQ ID NO: 403537 - DNA, 25 bp, Mus musculus
acacgagcaggaggaggattaccgc

SEQ ID NO: 403538 - DNA, 25 bp, Mus musculus
acacgaggaccgacccttcggccag

SEQ ID NO: 403539 - DNA, 25 bp, Mus musculus
acacgccccagtttgatttcagaaa

SEQ ID NO: 403540 - DNA, 25 bp, Mus musculus
acacgccgaacctcaccatatggag

SEQ ID NO: 403541 - DNA, 25 bp, Mus musculus
acacgcctgcagatacggagaacct

SEQ ID NO: 403542 - DNA, 25 bp, Mus musculus
acacgctgactgactgctctggcaa

SEQ ID NO: 403543 - DNA, 25 bp, Mus musculus
acacgctgccgaaggtctggaccag

SEQ ID NO: 403544 - DNA, 25 bp, Mus musculus
acacgctgctgagaccgagatgact

SEQ ID NO: 403545 - DNA, 25 bp, Mus musculus
acacggaaggtgaacttgatctgcc

SEQ ID NO: 403546 - DNA, 25 bp, Mus musculus
acacggagcggcagcgtacccgcga

SEQ ID NO: 403547 - DNA, 25 bp, Mus musculus
acacggatagccactgagcatgcct

SEQ ID NO: 403548 - DNA, 25 bp, Mus musculus
acacgtcagtcaacgcgggcagttc

SEQ ID NO: 403549 - DNA, 25 bp, Mus musculus
acactaccggtacaagttcagcctc

SEQ ID NO: 403550 - DNA, 25 bp, Mus musculus
acactactgagctggaagggctcgc

SEQ ID NO: 403551 - DNA, 25 bp, Mus musculus
acactagtgctctagggagggccgc

SEQ ID NO: 403552 - DNA, 25 bp, Mus musculus
acactatcttggcattggcccggca

SEQ ID NO: 403553 - DNA, 25 bp, Mus musculus
acactcctgagagagggaactgggt

SEQ ID NO: 403554 - DNA, 25 bp, Mus musculus
acactcttgacgctgggacctaggc

SEQ ID NO: 403555 - DNA, 25 bp, Mus musculus
acactcttttggactcacggcgcag

SEQ ID NO: 403556 - DNA, 25 bp, Mus musculus
acactgaaatcgctcctggaaaagg

SEQ ID NO: 403557 - DNA, 25 bp, Mus musculus
acactgaatatagggaggttgccgt

SEQ ID NO: 403558 - DNA, 25 bp, Mus musculus
acactgacgagtgcctgggaacacc

SEQ ID NO: 403559 - DNA, 25 bp, Mus musculus
acactgactgggaggaacgcgaagt

SEQ ID NO: 403560 - DNA, 25 bp, Mus musculus
acactgcaggacaggtacgagctca

SEQ ID NO: 403561 - DNA, 25 bp, Mus musculus
acactgcctgtggacttgtgtggtg

SEQ ID NO: 403562 - DNA, 25 bp, Mus musculus
acactgccttctgggtaaagtgcac

SEQ ID NO: 403563 - DNA, 25 bp, Mus musculus
acactgcctttgtcctgtgcctaaa

SEQ ID NO: 403564 - DNA, 25 bp, Mus musculus
acactggaacagtgagtgaggcccg

SEQ ID NO: 403565 - DNA, 25 bp, Mus musculus
acactgggaaggaggaccaaggcac

SEQ ID NO: 403566 - DNA, 25 bp, Mus musculus
acactgggcaaatgttgtttactac

SEQ ID NO: 403567 - DNA, 25 bp, Mus musculus
acactgggcaagagaaaccgcacgg

SEQ ID NO: 403568 - DNA, 25 bp, Mus musculus
acactgggcttgctgacctgtgagc

SEQ ID NO: 403569 - DNA, 25 bp, Mus musculus
acactgtaaacagctggagggcctg

SEQ ID NO: 403570 - DNA, 25 bp, Mus musculus
acactgtgagccacttgaccagcta

SEQ ID NO: 403571 - DNA, 25 bp, Mus musculus
acactgtgcttgatctgtgtgctgc

SEQ ID NO: 403572 - DNA, 25 bp, Mus musculus
acactgtggatctgtctcgggagca

SEQ ID NO: 403573 - DNA, 25 bp, Mus musculus
acactgtgttcgagcagagggacga

SEQ ID NO: 403574 - DNA, 25 bp, Mus musculus
acactgttctgctgctaccactggg

SEQ ID NO: 403575 - DNA, 25 bp, Mus musculus
acacttcagggtcagtcggtgccgc

SEQ ID NO: 403576 - DNA, 25 bp, Mus musculus
acacttccaacctccagagacgagg

SEQ ID NO: 403577 - DNA, 25 bp, Mus musculus
acacttggagttagaatatggcccc

SEQ ID NO: 403578 - DNA, 25 bp, Mus musculus
acacttgtgacaattggaagggccg

SEQ ID NO: 403579 - DNA, 25 bp, Mus musculus
acactttagacttccattcaggagg

SEQ ID NO: 403580 - DNA, 25 bp, Mus musculus
acagaaagacatagcagggaaggga

SEQ ID NO: 403581 - DNA, 25 bp, Mus musculus
acagaaagcatgctaccgtcagctc

SEQ ID NO: 403582 - DNA, 25 bp, Mus musculus
acagaacagccttgccgagcagaag

SEQ ID NO: 403583 - DNA, 25 bp, Mus musculus
acagaagaaggtgccgaagagcctc

SEQ ID NO: 403584 - DNA, 25 bp, Mus musculus
acagaagacctgtgctctagttggg

SEQ ID NO: 403585 - DNA, 25 bp, Mus musculus
acagaagagccacggaaatccccag

SEQ ID NO: 403586 - DNA, 25 bp, Mus musculus
acagaaggaaggacaacgcagaaga

SEQ ID NO: 403587 - DNA, 25 bp, Mus musculus
acagaaggtctgactttcaaggaaa

SEQ ID NO: 403588 - DNA, 25 bp, Mus musculus
acagaaggtgacagtggcgaaggca

SEQ ID NO: 403589 - DNA, 25 bp, Mus musculus
acagaagtaagatggacccgggcac

SEQ ID NO: 403590 - DNA, 25 bp, Mus musculus
acagaagtcacagttgcggcaggag

SEQ ID NO: 403591 - DNA, 25 bp, Mus musculus
acagaagtctatggccacacagggc

SEQ ID NO: 403592 - DNA, 25 bp, Mus musculus
acagaagtgttcgtgctgccccaaa

SEQ ID NO: 403593 - DNA, 25 bp, Mus musculus
acagaattggtgagtggtatgcagc

SEQ ID NO: 403594 - DNA, 25 bp, Mus musculus
acagacaagactgtgctgagctcac

SEQ ID NO: 403595 - DNA, 25 bp, Mus musculus
acagacagcagaggaacgtgaggcc

SEQ ID NO: 403596 - DNA, 25 bp, Mus musculus
acagacccagccatgccctgtggtg

SEQ ID NO: 403597 - DNA, 25 bp, Mus musculus
acagactctgccctttaacgagccg

SEQ ID NO: 403598 - DNA, 25 bp, Mus musculus
acagactgcctcctaattgtcaggg

SEQ ID NO: 403599 - DNA, 25 bp, Mus musculus
acagactgtgctgggttgtttctca

SEQ ID NO: 403600 - DNA, 25 bp, Mus musculus
acagacttgaaaagcgggccgcgtt

SEQ ID NO: 403601 - DNA, 25 bp, Mus musculus
acagagaagttcgagccctggaggt

SEQ ID NO: 403602 - DNA, 25 bp, Mus musculus
acagagacaggttgtaggttgtgat

SEQ ID NO: 403603 - DNA, 25 bp, Mus musculus
acagagaccgggatctaagccagga

SEQ ID NO: 403604 - DNA, 25 bp, Mus musculus
acagagaggcatcaccatacctggc

SEQ ID NO: 403605 - DNA, 25 bp, Mus musculus
acagagatccgccaactctgccgac

SEQ ID NO: 403606 - DNA, 25 bp, Mus musculus
acagagcctgcagtagcactgggca

SEQ ID NO: 403607 - DNA, 25 bp, Mus musculus
acagagccttcttccacggtggaga

SEQ ID NO: 403608 - DNA, 25 bp, Mus musculus
acagagctcagaacagtggcggtcc

SEQ ID NO: 403609 - DNA, 25 bp, Mus musculus
acagagctcaggcaggactggctgg

SEQ ID NO: 403610 - DNA, 25 bp, Mus musculus
acagagctcggcgctttgaggaagc

SEQ ID NO: 403611 - DNA, 25 bp, Mus musculus
acagaggaaccgaagccaagtacca

SEQ ID NO: 403612 - DNA, 25 bp, Mus musculus
acagaggccagactcgacccgcagg

SEQ ID NO: 403613 - DNA, 25 bp, Mus musculus
acagaggcggtttcccagtgcccag

SEQ ID NO: 403614 - DNA, 25 bp, Mus musculus
acagaggtcgtagaagagtccagcc

SEQ ID NO: 403615 - DNA, 25 bp, Mus musculus
acagaggtctccatggatttatgcc

SEQ ID NO: 403616 - DNA, 25 bp, Mus musculus
acagagtaggtgtcctgcactgagc

SEQ ID NO: 403617 - DNA, 25 bp, Mus musculus
acagagtccctggtgcactgtgact

SEQ ID NO: 403618 - DNA, 25 bp, Mus musculus
acagagtgggcctggatgagctccc

SEQ ID NO: 403619 - DNA, 25 bp, Mus musculus
acagagttgctatcttcgggttcag

SEQ ID NO: 403620 - DNA, 25 bp, Mus musculus
acagataatacctgagccacgccca

SEQ ID NO: 403621 - DNA, 25 bp, Mus musculus
acagatcggcgattttctggagcga

SEQ ID NO: 403622 - DNA, 25 bp, Mus musculus
acagatctcttggtctccagatggg

SEQ ID NO: 403623 - DNA, 25 bp, Mus musculus
acagatctgctggaatgaagtaggg

SEQ ID NO: 403624 - DNA, 25 bp, Mus musculus
acagatgccatctgcaaaccagagc

SEQ ID NO: 403625 - DNA, 25 bp, Mus musculus
acagatgtagccttccgcctcaggc

SEQ ID NO: 403626 - DNA, 25 bp, Mus musculus
acagatgtcagggttgggtctgcct

SEQ ID NO: 403627 - DNA, 25 bp, Mus musculus
acagatttacccgtggatgaccaaa

SEQ ID NO: 403628 - DNA, 25 bp, Mus musculus
acagcacagctgtcaaactcagtga

SEQ ID NO: 403629 - DNA, 25 bp, Mus musculus
acagcacctactgattgaacgcacg

SEQ ID NO: 403630 - DNA, 25 bp, Mus musculus
acagcactcggccagcttctgaagc

SEQ ID NO: 403631 - DNA, 25 bp, Mus musculus
acagcactgacttgcctcttgtgcc

SEQ ID NO: 403632 - DNA, 25 bp, Mus musculus
acagcactgggtgccctgcacagat

SEQ ID NO: 403633 - DNA, 25 bp, Mus musculus
acagcactgggttggcactgaagtc

SEQ ID NO: 403634 - DNA, 25 bp, Mus musculus
acagcagaatctgtaccatccaggg

SEQ ID NO: 403635 - DNA, 25 bp, Mus musculus
acagcagggacattcgggatcacag

SEQ ID NO: 403636 - DNA, 25 bp, Mus musculus
acagcagggctgacgcccagggctt

SEQ ID NO: 403637 - DNA, 25 bp, Mus musculus
acagcatacataccccttttccagt

SEQ ID NO: 403638 - DNA, 25 bp, Mus musculus
acagcatgaggagcggctacgtcgc

SEQ ID NO: 403639 - DNA, 25 bp, Mus musculus
acagcatgcctcttcttcattaaag

SEQ ID NO: 403640 - DNA, 25 bp, Mus musculus
acagcatggatctacgggatgggcc

SEQ ID NO: 403641 - DNA, 25 bp, Mus musculus
acagcatgtgtcatagtcatgagca

SEQ ID NO: 403642 - DNA, 25 bp, Mus musculus
acagccaagtggacctggttcggca

SEQ ID NO: 403643 - DNA, 25 bp, Mus musculus
acagccacagagaccaaggtggcag

SEQ ID NO: 403644 - DNA, 25 bp, Mus musculus
acagccacagcagaatctgtaccat

SEQ ID NO: 403645 - DNA, 25 bp, Mus musculus
acagccaccgattgtgctgggcccg

SEQ ID NO: 403646 - DNA, 25 bp, Mus musculus
acagccacgggctggctgacacgct

SEQ ID NO: 403647 - DNA, 25 bp, Mus musculus
acagccagatgtgttgccaaggtga

SEQ ID NO: 403648 - DNA, 25 bp, Mus musculus
acagccaggacatccccgtggtggt

SEQ ID NO: 403649 - DNA, 25 bp, Mus musculus
acagccagtggtggaagactctgag

SEQ ID NO: 403650 - DNA, 25 bp, Mus musculus
acagccatgtcctctgacagaaata

SEQ ID NO: 403651 - DNA, 25 bp, Mus musculus
acagccccgccgtacttgcaggaaa

SEQ ID NO: 403652 - DNA, 25 bp, Mus musculus
acagcccgaaggatcctcaacgagg

SEQ ID NO: 403653 - DNA, 25 bp, Mus musculus
acagcccgggagttctgtctaggcc

SEQ ID NO: 403654 - DNA, 25 bp, Mus musculus
acagccctgggacagatggatctcc

SEQ ID NO: 403655 - DNA, 25 bp, Mus musculus
acagccctgtggctcctgctgaaga

SEQ ID NO: 403656 - DNA, 25 bp, Mus musculus
acagccgcagggagctaggccactg

SEQ ID NO: 403657 - DNA, 25 bp, Mus musculus
acagccgggccctaatggagaacaa

SEQ ID NO: 403658 - DNA, 25 bp, Mus musculus
acagccggtggagattgagcgcaca

SEQ ID NO: 403659 - DNA, 25 bp, Mus musculus
acagccgtctacagtgggatgccaa

SEQ ID NO: 403660 - DNA, 25 bp, Mus musculus
acagcctcctggttcacgggacgct

SEQ ID NO: 403661 - DNA, 25 bp, Mus musculus
acagcctggatctcgccaaggagct

SEQ ID NO: 403662 - DNA, 25 bp, Mus musculus
acagcctggggcttcacaccctgtt

SEQ ID NO: 403663 - DNA, 25 bp, Mus musculus
acagccttgcctgagtgatgcagag

SEQ ID NO: 403664 - DNA, 25 bp, Mus musculus
acagccttgggtcatcagcgagagc

SEQ ID NO: 403665 - DNA, 25 bp, Mus musculus
acagcgagtgctctcaatccccgat

SEQ ID NO: 403666 - DNA, 25 bp, Mus musculus
acagcgatgtgggtcaggacgacaa

SEQ ID NO: 403667 - DNA, 25 bp, Mus musculus
acagcgggccgtgtgtgcaacttga

SEQ ID NO: 403668 - DNA, 25 bp, Mus musculus
acagcgtggagcatgcattgaggaa

SEQ ID NO: 403669 - DNA, 25 bp, Mus musculus
acagctagctctataagcaagacta

SEQ ID NO: 403670 - DNA, 25 bp, Mus musculus
acagctagtggcatttcttgagaac

SEQ ID NO: 403671 - DNA, 25 bp, Mus musculus
acagctagttccctggcccaggaga

SEQ ID NO: 403672 - DNA, 25 bp, Mus musculus
acagctccgtctgcggttaagagtg

SEQ ID NO: 403673 - DNA, 25 bp, Mus musculus
acagctcctctgagggccgtggagc

SEQ ID NO: 403674 - DNA, 25 bp, Mus musculus
acagctctctgtgcattggttcaca

SEQ ID NO: 403675 - DNA, 25 bp, Mus musculus
acagctctggcttttgcgggtcaaa

SEQ ID NO: 403676 - DNA, 25 bp, Mus musculus
acagctcttgaaaggcaaatcagct

SEQ ID NO: 403677 - DNA, 25 bp, Mus musculus
acagctgctgagtggaatcggccgc

SEQ ID NO: 403678 - DNA, 25 bp, Mus musculus
acagctgctgttcgccccttaggtg

SEQ ID NO: 403679 - DNA, 25 bp, Mus musculus
acagctgtcacttttggcaatattc

SEQ ID NO: 403680 - DNA, 25 bp, Mus musculus
acagctgtgcttcggctttcccagc

SEQ ID NO: 403681 - DNA, 25 bp, Mus musculus
acagctgtggcgaggttcctccgag

SEQ ID NO: 403682 - DNA, 25 bp, Mus musculus
acagcttcggtatcagttgggcacc

SEQ ID NO: 403683 - DNA, 25 bp, Mus musculus
acagcttttgaagccggtcctggga

SEQ ID NO: 403684 - DNA, 25 bp, Mus musculus
acaggaaaaactggccccagagact

SEQ ID NO: 403685 - DNA, 25 bp, Mus musculus
acaggaaacccgagcagcaggtgaa

SEQ ID NO: 403686 - DNA, 25 bp, Mus musculus
acaggaagagtcaggcgagaacagt

SEQ ID NO: 403687 - DNA, 25 bp, Mus musculus
acaggaatcagtgggtgtgggaaca

SEQ ID NO: 403688 - DNA, 25 bp, Mus musculus
acaggacccgcatctggaggagcct

SEQ ID NO: 403689 - DNA, 25 bp, Mus musculus
acaggactgtcgatgtggtgttgct

SEQ ID NO: 403690 - DNA, 25 bp, Mus musculus
acaggagaatcccagccagcgaaca

SEQ ID NO: 403691 - DNA, 25 bp, Mus musculus
acaggagatcaacgccactaaatag

SEQ ID NO: 403692 - DNA, 25 bp, Mus musculus
acaggaggctccttctgaggctgca

SEQ ID NO: 403693 - DNA, 25 bp, Mus musculus
acaggagtcctgatggatcccagcc

SEQ ID NO: 403694 - DNA, 25 bp, Mus musculus
acaggagttatggtcccagcaggga

SEQ ID NO: 403695 - DNA, 25 bp, Mus musculus
acaggatgcaggacttcgatggaca

SEQ ID NO: 403696 - DNA, 25 bp, Mus musculus
acaggattgagaggccctgtgctcc

SEQ ID NO: 403697 - DNA, 25 bp, Mus musculus
acaggcacaaggctctcaactgaga

SEQ ID NO: 403698 - DNA, 25 bp, Mus musculus
acaggcaggtcccataggagcagac

SEQ ID NO: 403699 - DNA, 25 bp, Mus musculus
acaggccagaggagcgacacctgca

SEQ ID NO: 403700 - DNA, 25 bp, Mus musculus
acaggccagatttctcacagacaag

SEQ ID NO: 403701 - DNA, 25 bp, Mus musculus
acaggccccgcctctctggtaggga

SEQ ID NO: 403702 - DNA, 25 bp, Mus musculus
acaggccggctcagctgccagtttg

SEQ ID NO: 403703 - DNA, 25 bp, Mus musculus
acaggcctatgtcgactaagtatcc

SEQ ID NO: 403704 - DNA, 25 bp, Mus musculus
acaggcctccagtcatgctgccaga

SEQ ID NO: 403705 - DNA, 25 bp, Mus musculus
acaggcctgttcctcgtgcgggaaa

SEQ ID NO: 403706 - DNA, 25 bp, Mus musculus
acaggctgattttctctccaccagg

SEQ ID NO: 403707 - DNA, 25 bp, Mus musculus
acaggctgcgagagggaaaagtata

SEQ ID NO: 403708 - DNA, 25 bp, Mus musculus
acaggctgtgcaagatgttctacgc

SEQ ID NO: 403709 - DNA, 25 bp, Mus musculus
acaggcttcaggacatgtgtgggct

SEQ ID NO: 403710 - DNA, 25 bp, Mus musculus
acagggaagtctacctcggaggcca

SEQ ID NO: 403711 - DNA, 25 bp, Mus musculus
acagggacattgtactatatgtgcc

SEQ ID NO: 403712 - DNA, 25 bp, Mus musculus
acagggacgggcttctcttcaggca

SEQ ID NO: 403713 - DNA, 25 bp, Mus musculus
acagggatcctgacatctccaggtg

SEQ ID NO: 403714 - DNA, 25 bp, Mus musculus
acagggcctcacactggtgattcca

SEQ ID NO: 403715 - DNA, 25 bp, Mus musculus
acagggccttgggtagaagcccctg

SEQ ID NO: 403716 - DNA, 25 bp, Mus musculus
acagggctccctgatctgtggttga

SEQ ID NO: 403717 - DNA, 25 bp, Mus musculus
acagggctccgggtctcgcttaggt

SEQ ID NO: 403718 - DNA, 25 bp, Mus musculus
acaggggctcaaggacaactgctcc

SEQ ID NO: 403719 - DNA, 25 bp, Mus musculus
acagggtagaatatgtacgaggtca

SEQ ID NO: 403720 - DNA, 25 bp, Mus musculus
acagggtctgggtgacgcaacgaca

SEQ ID NO: 403721 - DNA, 25 bp, Mus musculus
acagggtcttcacttactcagcgag

SEQ ID NO: 403722 - DNA, 25 bp, Mus musculus
acagggtttcatgcagcccgcgatg

SEQ ID NO: 403723 - DNA, 25 bp, Mus musculus
acaggtcgagtctccagccgccggg

SEQ ID NO: 403724 - DNA, 25 bp, Mus musculus
acaggtgacctgtcatcccgcagag

SEQ ID NO: 403725 - DNA, 25 bp, Mus musculus
acaggtgactcaggaatgttgaaaa

SEQ ID NO: 403726 - DNA, 25 bp, Mus musculus
acaggtgagcccaccaacggtcaca

SEQ ID NO: 403727 - DNA, 25 bp, Mus musculus
acaggtgcttctccgaaaccttacg

SEQ ID NO: 403728 - DNA, 25 bp, Mus musculus
acaggtggatgccttcatgtagttg

SEQ ID NO: 403729 - DNA, 25 bp, Mus musculus
acaggtggcgcaggtaagcttgaca

SEQ ID NO: 403730 - DNA, 25 bp, Mus musculus
acaggtgtaagtgaccccaaggcca

SEQ ID NO: 403731 - DNA, 25 bp, Mus musculus
acaggtgtttcccaactggattcgc

SEQ ID NO: 403732 - DNA, 25 bp, Mus musculus
acagtaaatactgacctgggaacag

SEQ ID NO: 403733 - DNA, 25 bp, Mus musculus
acagtaagtggcattccttggtggt

SEQ ID NO: 403734 - DNA, 25 bp, Mus musculus
acagtaataagtgcgtgaggaccca

SEQ ID NO: 403735 - DNA, 25 bp, Mus musculus
acagtagacagttcatcgacggccc

SEQ ID NO: 403736 - DNA, 25 bp, Mus musculus
acagtcagtgatttgggttcccgca

SEQ ID NO: 403737 - DNA, 25 bp, Mus musculus
acagtcatagcatcacctcaaggtg

SEQ ID NO: 403738 - DNA, 25 bp, Mus musculus
acagtccacaaagcaaaacccgagg

SEQ ID NO: 403739 - DNA, 25 bp, Mus musculus
acagtccacacattcatccagtcgg

SEQ ID NO: 403740 - DNA, 25 bp, Mus musculus
acagtccccaagacatacctgcaga

SEQ ID NO: 403741 - DNA, 25 bp, Mus musculus
acagtccggtgttgctaagtgacca

SEQ ID NO: 403742 - DNA, 25 bp, Mus musculus
acagtcctgaacgtttccctcggag

SEQ ID NO: 403743 - DNA, 25 bp, Mus musculus
acagtcgtgaggtccgagtgctgca

SEQ ID NO: 403744 - DNA, 25 bp, Mus musculus
acagtctatacacctggcgccaggg

SEQ ID NO: 403745 - DNA, 25 bp, Mus musculus
acagtctgaggcaccaggatatgag

SEQ ID NO: 403746 - DNA, 25 bp, Mus musculus
acagtctgcaggagctcggtgccat

SEQ ID NO: 403747 - DNA, 25 bp, Mus musculus
acagtctgcatcctcctagttggaa

SEQ ID NO: 403748 - DNA, 25 bp, Mus musculus
acagtctttattgggaatgccgggc

SEQ ID NO: 403749 - DNA, 25 bp, Mus musculus
acagtgaatttaggctgtgggcaag

SEQ ID NO: 403750 - DNA, 25 bp, Mus musculus
acagtgacaggcgtggctgctacca

SEQ ID NO: 403751 - DNA, 25 bp, Mus musculus
acagtgaccagctagccatgacgca

SEQ ID NO: 403752 - DNA, 25 bp, Mus musculus
acagtgagctgctgagtaacccggg

SEQ ID NO: 403753 - DNA, 25 bp, Mus musculus
acagtgatcccgtcaggctttcgag

SEQ ID NO: 403754 - DNA, 25 bp, Mus musculus
acagtgatgtggtacagctccggga

SEQ ID NO: 403755 - DNA, 25 bp, Mus musculus
acagtgctggctgggcagtgctaca

SEQ ID NO: 403756 - DNA, 25 bp, Mus musculus
acagtggccatggacctgcagaaca

SEQ ID NO: 403757 - DNA, 25 bp, Mus musculus
acagtgtacctgatcagatccgagg

SEQ ID NO: 403758 - DNA, 25 bp, Mus musculus
acagtgtgccagaggcagcctctct

SEQ ID NO: 403759 - DNA, 25 bp, Mus musculus
acagtgttcctgtcatggtctcctg

SEQ ID NO: 403760 - DNA, 25 bp, Mus musculus
acagttcctggtctatgcgggcaca

SEQ ID NO: 403761 - DNA, 25 bp, Mus musculus
acagttcggcatgggtttccttatc

SEQ ID NO: 403762 - DNA, 25 bp, Mus musculus
acagttgtgtatccctgctcttgcg

SEQ ID NO: 403763 - DNA, 25 bp, Mus musculus
acagtttgctgctgggtaaggagct

SEQ ID NO: 403764 - DNA, 25 bp, Mus musculus
acatacagcttctggcctacaggcc

SEQ ID NO: 403765 - DNA, 25 bp, Mus musculus
acatagagaaccacgcctgcctggg

SEQ ID NO: 403766 - DNA, 25 bp, Mus musculus
acatagagccggtggagcagccgct

SEQ ID NO: 403767 - DNA, 25 bp, Mus musculus
acatagaggcctctaccactgactg

SEQ ID NO: 403768 - DNA, 25 bp, Mus musculus
acatagaggtcttaccccttctgaa

SEQ ID NO: 403769 - DNA, 25 bp, Mus musculus
acatagcaattaaggtaggaggagg

SEQ ID NO: 403770 - DNA, 25 bp, Mus musculus
acatagctggggctgatctggaact

SEQ ID NO: 403771 - DNA, 25 bp, Mus musculus
acatagtcgtcagtcctcccttgga

SEQ ID NO: 403772 - DNA, 25 bp, Mus musculus
acatatggctgtaggaactggaccc

SEQ ID NO: 403773 - DNA, 25 bp, Mus musculus
acatcaaaaaccacgagggcgggct

SEQ ID NO: 403774 - DNA, 25 bp, Mus musculus
acatcaagggccagcatacggagac

SEQ ID NO: 403775 - DNA, 25 bp, Mus musculus
acatcaatgagtgtcgcccgggtgc

SEQ ID NO: 403776 - DNA, 25 bp, Mus musculus
acatcacgatgttgcgggacccagt

SEQ ID NO: 403777 - DNA, 25 bp, Mus musculus
acatcactgactgccacctgaaggg

SEQ ID NO: 403778 - DNA, 25 bp, Mus musculus
acatcactgtggagaccttggacac

SEQ ID NO: 403779 - DNA, 25 bp, Mus musculus
acatcagcgatctctcctgcacagg

SEQ ID NO: 403780 - DNA, 25 bp, Mus musculus
acatcaggtctgtgctttcccacgt

SEQ ID NO: 403781 - DNA, 25 bp, Mus musculus
acatcatagtgcttttaggccctgc

SEQ ID NO: 403782 - DNA, 25 bp, Mus musculus
acatcatcagctgagttgggctggg

SEQ ID NO: 403783 - DNA, 25 bp, Mus musculus
acatcatggcctgtgtcggagcaga

SEQ ID NO: 403784 - DNA, 25 bp, Mus musculus
acatccaggtgagggacagggagcc

SEQ ID NO: 403785 - DNA, 25 bp, Mus musculus
acatccccgctctggctgcgggaga

SEQ ID NO: 403786 - DNA, 25 bp, Mus musculus
acatccggcggcctcatggactgaa

SEQ ID NO: 403787 - DNA, 25 bp, Mus musculus
acatccgtcgtagtccagtgggaca

SEQ ID NO: 403788 - DNA, 25 bp, Mus musculus
acatcctcaggtgtctgtgcagatc

SEQ ID NO: 403789 - DNA, 25 bp, Mus musculus
acatcctggtgagctgagcagaggc

SEQ ID NO: 403790 - DNA, 25 bp, Mus musculus
acatccttcgagaaagccagcggca

SEQ ID NO: 403791 - DNA, 25 bp, Mus musculus
acatctcctatgtagtgggccgcga

SEQ ID NO: 403792 - DNA, 25 bp, Mus musculus
acatctctaacgtgttttcctgagc

SEQ ID NO: 403793 - DNA, 25 bp, Mus musculus
acatctcttgtgcagttcttcccca

SEQ ID NO: 403794 - DNA, 25 bp, Mus musculus
acatctgggccctggctgagacact

SEQ ID NO: 403795 - DNA, 25 bp, Mus musculus
acatctgttcaatgagtccaccggc

SEQ ID NO: 403796 - DNA, 25 bp, Mus musculus
acatcttcagcaggtgggacccgct

SEQ ID NO: 403797 - DNA, 25 bp, Mus musculus
acatcttgcctatttatctgctctg

SEQ ID NO: 403798 - DNA, 25 bp, Mus musculus
acatcttgggatgtggaaacactgc

SEQ ID NO: 403799 - DNA, 25 bp, Mus musculus
acatgacgggtctcctggatgatgg

SEQ ID NO: 403800 - DNA, 25 bp, Mus musculus
acatgagcctccatcggaaccgcat

SEQ ID NO: 403801 - DNA, 25 bp, Mus musculus
acatgagcgcgtcgccttcgggcta

SEQ ID NO: 403802 - DNA, 25 bp, Mus musculus
acatgaggaccacctttagatgttc

SEQ ID NO: 403803 - DNA, 25 bp, Mus musculus
acatgatttcttcctgctccagtaa

SEQ ID NO: 403804 - DNA, 25 bp, Mus musculus
acatgcaagggagggaaggtccaca

SEQ ID NO: 403805 - DNA, 25 bp, Mus musculus
acatgcacgtggctgcgagccagct

SEQ ID NO: 403806 - DNA, 25 bp, Mus musculus
acatgcatgtatgttttaaaggaaa

SEQ ID NO: 403807 - DNA, 25 bp, Mus musculus
acatgccagcggagccagagattcc

SEQ ID NO: 403808 - DNA, 25 bp, Mus musculus
acatgccttgagttggaacgctacc

SEQ ID NO: 403809 - DNA, 25 bp, Mus musculus
acatgctggagagtgggaaccctgc

SEQ ID NO: 403810 - DNA, 25 bp, Mus musculus
acatgctggagggattcttgctgcg

SEQ ID NO: 403811 - DNA, 25 bp, Mus musculus
acatgctggcaaggaaatgtcctgc

SEQ ID NO: 403812 - DNA, 25 bp, Mus musculus
acatgcttatttccctggacccgga

SEQ ID NO: 403813 - DNA, 25 bp, Mus musculus
acatggaatactgtctggcggccgc

SEQ ID NO: 403814 - DNA, 25 bp, Mus musculus
acatggagatcagcgcctacaggaa

SEQ ID NO: 403815 - DNA, 25 bp, Mus musculus
acatggagcctgatagggagagacc

SEQ ID NO: 403816 - DNA, 25 bp, Mus musculus
acatggagctgcatcgcaggtcccc

SEQ ID NO: 403817 - DNA, 25 bp, Mus musculus
acatggaggactagaggagctgtct

SEQ ID NO: 403818 - DNA, 25 bp, Mus musculus
acatggcgcgacttctggagcagtg

SEQ ID NO: 403819 - DNA, 25 bp, Mus musculus
acatggctaaagagagaccctggaa

SEQ ID NO: 403820 - DNA, 25 bp, Mus musculus
acatgggaaacatcacgccacacgg

SEQ ID NO: 403821 - DNA, 25 bp, Mus musculus
acatgggaagaaatattttctcaaa

SEQ ID NO: 403822 - DNA, 25 bp, Mus musculus
acatgggcgcgctgcagtacagccc

SEQ ID NO: 403823 - DNA, 25 bp, Mus musculus
acatgggtgagccttgaaaatctac

SEQ ID NO: 403824 - DNA, 25 bp, Mus musculus
acatggtgcatagaagggttgtccc

SEQ ID NO: 403825 - DNA, 25 bp, Mus musculus
acatggttgccagagagtccctaag

SEQ ID NO: 403826 - DNA, 25 bp, Mus musculus
acatgtactggaacgaggcagcgcc

SEQ ID NO: 403827 - DNA, 25 bp, Mus musculus
acatgtcagttctcctgtctacaaa

SEQ ID NO: 403828 - DNA, 25 bp, Mus musculus
acatgtgaagcatggtgagcagcga

SEQ ID NO: 403829 - DNA, 25 bp, Mus musculus
acatgtggtcatcagcagccggaag

SEQ ID NO: 403830 - DNA, 25 bp, Mus musculus
acatgtgtcagttcacggtctggac

SEQ ID NO: 403831 - DNA, 25 bp, Mus musculus
acatgttaaagcgagtggagcccct

SEQ ID NO: 403832 - DNA, 25 bp, Mus musculus
acatgttcaggcaggctagggtccc

SEQ ID NO: 403833 - DNA, 25 bp, Mus musculus
acatgttctcagaagcaggatttct

SEQ ID NO: 403834 - DNA, 25 bp, Mus musculus
acatgtttgaagaagccctgcgagc

SEQ ID NO: 403835 - DNA, 25 bp, Mus musculus
acatgtttgtaatcgctggcgtgcc

SEQ ID NO: 403836 - DNA, 25 bp, Mus musculus
acattaagaatgaagacagcccggg

SEQ ID NO: 403837 - DNA, 25 bp, Mus musculus
acattactatcttctctcccgaggg

SEQ ID NO: 403838 - DNA, 25 bp, Mus musculus
acattatctgtgtgtccaagctggg

SEQ ID NO: 403839 - DNA, 25 bp, Mus musculus
acattatgtatgagatatttctcca

SEQ ID NO: 403840 - DNA, 25 bp, Mus musculus
acattatttagggtgtctgatgcca

SEQ ID NO: 403841 - DNA, 25 bp, Mus musculus
acattccatacaccaagcttgggcg

SEQ ID NO: 403842 - DNA, 25 bp, Mus musculus
acattctgaactgagcggctgctgc

SEQ ID NO: 403843 - DNA, 25 bp, Mus musculus
acattgaatctgcttccttcctcag

SEQ ID NO: 403844 - DNA, 25 bp, Mus musculus
acattgagtggatgcaagtcaactc

SEQ ID NO: 403845 - DNA, 25 bp, Mus musculus
acattgagttttactggcgcggcga

SEQ ID NO: 403846 - DNA, 25 bp, Mus musculus
acattgcctgctgggaacattcgag

SEQ ID NO: 403847 - DNA, 25 bp, Mus musculus
acattggccctcagtatttaagtcc

SEQ ID NO: 403848 - DNA, 25 bp, Mus musculus
acattggctctttctcagtccgagc

SEQ ID NO: 403849 - DNA, 25 bp, Mus musculus
acattggtacactgagggattgtcc

SEQ ID NO: 403850 - DNA, 25 bp, Mus musculus
acattgtagggggtgcgccatgcac

SEQ ID NO: 403851 - DNA, 25 bp, Mus musculus
acatttaaaatgtagctgcacagtg

SEQ ID NO: 403852 - DNA, 25 bp, Mus musculus
acatttacgtgggagtggctgacac

SEQ ID NO: 403853 - DNA, 25 bp, Mus musculus
acatttcagttcaatagtggcaggg

SEQ ID NO: 403854 - DNA, 25 bp, Mus musculus
acatttctgaagtcggcccctgcag

SEQ ID NO: 403855 - DNA, 25 bp, Mus musculus
acatttgagtgatctgatgtgaccc

SEQ ID NO: 403856 - DNA, 25 bp, Mus musculus
acatttgggctgtcagcttcgggcc

SEQ ID NO: 403857 - DNA, 25 bp, Mus musculus
acatttgtggcataatagctttaaa

SEQ ID NO: 403858 - DNA, 25 bp, Mus musculus
acattttcggagtcaagtctagccc

SEQ ID NO: 403859 - DNA, 25 bp, Mus musculus
accaaaccccgaaatgctgacttat

SEQ ID NO: 403860 - DNA, 25 bp, Mus musculus
accaaaccggctggctgtggtcgga

SEQ ID NO: 403861 - DNA, 25 bp, Mus musculus
accaaagatttagcaccagagcagg

SEQ ID NO: 403862 - DNA, 25 bp, Mus musculus
accaaagcagccgtgggaatggtgt

SEQ ID NO: 403863 - DNA, 25 bp, Mus musculus
accaaatagaccagcttcagcggga

SEQ ID NO: 403864 - DNA, 25 bp, Mus musculus
accaaatgccgtgatgcgaggcccg

SEQ ID NO: 403865 - DNA, 25 bp, Mus musculus
accaacacaaagtaggaggctgcct

SEQ ID NO: 403866 - DNA, 25 bp, Mus musculus
accaactccggcacctgggaatcat

SEQ ID NO: 403867 - DNA, 25 bp, Mus musculus
accaagacgagtgtttgatgggcac

SEQ ID NO: 403868 - DNA, 25 bp, Mus musculus
accaagagcaggtgggcaggctttc

SEQ ID NO: 403869 - DNA, 25 bp, Mus musculus
accaagataatctggacttcaccac

SEQ ID NO: 403870 - DNA, 25 bp, Mus musculus
accaagatagaagagctggcccgcg

SEQ ID NO: 403871 - DNA, 25 bp, Mus musculus
accaagatgtctcccaccgatctaa

SEQ ID NO: 403872 - DNA, 25 bp, Mus musculus
accaagcccaagtctgtaaagcagg

SEQ ID NO: 403873 - DNA, 25 bp, Mus musculus
accaagcttgagagccaccttgatg

SEQ ID NO: 403874 - DNA, 25 bp, Mus musculus
accaaggcagctcggctttgtcagg

SEQ ID NO: 403875 - DNA, 25 bp, Mus musculus
accaagggatggcttttaaagtcat

SEQ ID NO: 403876 - DNA, 25 bp, Mus musculus
accaaggtaagcagctgggtcgtga

SEQ ID NO: 403877 - DNA, 25 bp, Mus musculus
accaaggtcagtgtggaaaggccct

SEQ ID NO: 403878 - DNA, 25 bp, Mus musculus
accaaggtgggcaaagatgagctct

SEQ ID NO: 403879 - DNA, 25 bp, Mus musculus
accaagtcctggtggagtcagacaa

SEQ ID NO: 403880 - DNA, 25 bp, Mus musculus
accaattgcacagcgcctagcaggg

SEQ ID NO: 403881 - DNA, 25 bp, Mus musculus
accacaaggctgtcggcgccagata

SEQ ID NO: 403882 - DNA, 25 bp, Mus musculus
accacaagtggcatagggacgggca

SEQ ID NO: 403883 - DNA, 25 bp, Mus musculus
accacactgggagagatgccgaagc

SEQ ID NO: 403884 - DNA, 25 bp, Mus musculus
accacaggaaggacagcaagtgtag

SEQ ID NO: 403885 - DNA, 25 bp, Mus musculus
accacatctgggagtactacagctg

SEQ ID NO: 403886 - DNA, 25 bp, Mus musculus
accacatttggagggcatgctgtgc

SEQ ID NO: 403887 - DNA, 25 bp, Mus musculus
accaccaaggatgagggcgactact

SEQ ID NO: 403888 - DNA, 25 bp, Mus musculus
accaccacgtgtcggctatgggcgc

SEQ ID NO: 403889 - DNA, 25 bp, Mus musculus
accaccagcctgtgccatgaacaag

SEQ ID NO: 403890 - DNA, 25 bp, Mus musculus
accaccgggccgtgagcttgcctta

SEQ ID NO: 403891 - DNA, 25 bp, Mus musculus
accacgctcggctctgagatgcgct

SEQ ID NO: 403892 - DNA, 25 bp, Mus musculus
accacgctggtgggaacgagaagct

SEQ ID NO: 403893 - DNA, 25 bp, Mus musculus
accacggacagcgtgagttgggaca

SEQ ID NO: 403894 - DNA, 25 bp, Mus musculus
accacggagcagctggactccctgg

SEQ ID NO: 403895 - DNA, 25 bp, Mus musculus
accacgttgctgttttgggatgaaa

SEQ ID NO: 403896 - DNA, 25 bp, Mus musculus
accactcagcgaagctggaggagcc

SEQ ID NO: 403897 - DNA, 25 bp, Mus musculus
accactctcagtttgtagcagacgt

SEQ ID NO: 403898 - DNA, 25 bp, Mus musculus
accactgggtgatgccgctgagaac

SEQ ID NO: 403899 - DNA, 25 bp, Mus musculus
accactgtgttagtagctgtgcacc

SEQ ID NO: 403900 - DNA, 25 bp, Mus musculus
accacttgggccctaggagccatgg

SEQ ID NO: 403901 - DNA, 25 bp, Mus musculus
accagaaaggattgtgcacccagcg

SEQ ID NO: 403902 - DNA, 25 bp, Mus musculus
accagaagattctgggccggaggct

SEQ ID NO: 403903 - DNA, 25 bp, Mus musculus
accagaaggaatagctgcgagctca

SEQ ID NO: 403904 - DNA, 25 bp, Mus musculus
accagaccttgccagtgcagggacc

SEQ ID NO: 403905 - DNA, 25 bp, Mus musculus
accagagaatcagatgctgctgctc

SEQ ID NO: 403906 - DNA, 25 bp, Mus musculus
accagagcagcaggacggaaatcaa

SEQ ID NO: 403907 - DNA, 25 bp, Mus musculus
accagagcgccttgaaggcagggat

SEQ ID NO: 403908 - DNA, 25 bp, Mus musculus
accagagcgctggtggatctcagca

SEQ ID NO: 403909 - DNA, 25 bp, Mus musculus
accagagcttcagggcagggcatga

SEQ ID NO: 403910 - DNA, 25 bp, Mus musculus
accagagggcgaggagaagtcacct

SEQ ID NO: 403911 - DNA, 25 bp, Mus musculus
accagagtaaggagtcactcagggc

SEQ ID NO: 403912 - DNA, 25 bp, Mus musculus
accagatcccctgcgggtggagcag

SEQ ID NO: 403913 - DNA, 25 bp, Mus musculus
accagcaggtcgacaaaggagccat

SEQ ID NO: 403914 - DNA, 25 bp, Mus musculus
accagcatctgcagaagactggcag

SEQ ID NO: 403915 - DNA, 25 bp, Mus musculus
accagccttgggtgttggaagcacc

SEQ ID NO: 403916 - DNA, 25 bp, Mus musculus
accagcctttggagtgcatagtaga

SEQ ID NO: 403917 - DNA, 25 bp, Mus musculus
accagcggaggtaagacagggacct

SEQ ID NO: 403918 - DNA, 25 bp, Mus musculus
accagcggctgagaggaaccgcctg

SEQ ID NO: 403919 - DNA, 25 bp, Mus musculus
accagctgctacttccgggatcgga

SEQ ID NO: 403920 - DNA, 25 bp, Mus musculus
accaggaagatgactcgggcagcct

SEQ ID NO: 403921 - DNA, 25 bp, Mus musculus
accaggactacagcgagggctactc

SEQ ID NO: 403922 - DNA, 25 bp, Mus musculus
accaggagaggcctgtaatatgccc

SEQ ID NO: 403923 - DNA, 25 bp, Mus musculus
accaggagcaccatttcaggataag

SEQ ID NO: 403924 - DNA, 25 bp, Mus musculus
accaggatcattcctaaggccccag

SEQ ID NO: 403925 - DNA, 25 bp, Mus musculus
accaggatggcctgtggcacccagc

SEQ ID NO: 403926 - DNA, 25 bp, Mus musculus
accaggcccagcatgatgatgagct

SEQ ID NO: 403927 - DNA, 25 bp, Mus musculus
accaggcgcactacggagagcagct

SEQ ID NO: 403928 - DNA, 25 bp, Mus musculus
accaggctgtggctgaccaggactg

SEQ ID NO: 403929 - DNA, 25 bp, Mus musculus
accagggaatcggtcacaggcgccg

SEQ ID NO: 403930 - DNA, 25 bp, Mus musculus
accagggacagatggcagtggttct

SEQ ID NO: 403931 - DNA, 25 bp, Mus musculus
accagggtttatggtggatggctct

SEQ ID NO: 403932 - DNA, 25 bp, Mus musculus
accaggtcgtcagggctagttcagc

SEQ ID NO: 403933 - DNA, 25 bp, Mus musculus
accaggtgctactacgctactatga

SEQ ID NO: 403934 - DNA, 25 bp, Mus musculus
accagtccgggagcagagtaaagcg

SEQ ID NO: 403935 - DNA, 25 bp, Mus musculus
accagtctgagtccttgagcccctg

SEQ ID NO: 403936 - DNA, 25 bp, Mus musculus
accagtggcaggtcacgagaaagga

SEQ ID NO: 403937 - DNA, 25 bp, Mus musculus
accagtgtcctcattaaaaacgtga

SEQ ID NO: 403938 - DNA, 25 bp, Mus musculus
accagttcaagacgcctcaggagtt

SEQ ID NO: 403939 - DNA, 25 bp, Mus musculus
accagttggatctagaacgtgccca

SEQ ID NO: 403940 - DNA, 25 bp, Mus musculus
accagttgtgacgtccatggagttg

SEQ ID NO: 403941 - DNA, 25 bp, Mus musculus
accataagtgcggagtgccccatga

SEQ ID NO: 403942 - DNA, 25 bp, Mus musculus
accatatgcccagagttggcaccaa

SEQ ID NO: 403943 - DNA, 25 bp, Mus musculus
accatcaagtggaagccctcttgtt

SEQ ID NO: 403944 - DNA, 25 bp, Mus musculus
accatcactcaatataggacggcag

SEQ ID NO: 403945 - DNA, 25 bp, Mus musculus
accatcagtagcgagagacatccca

SEQ ID NO: 403946 - DNA, 25 bp, Mus musculus
accatccaaggacaggcacggctca

SEQ ID NO: 403947 - DNA, 25 bp, Mus musculus
accatccgcctgttagaaagcttga

SEQ ID NO: 403948 - DNA, 25 bp, Mus musculus
accatcgtggcggtgaagaagctcg

SEQ ID NO: 403949 - DNA, 25 bp, Mus musculus
accatctcctgtaagccctcgtgag

SEQ ID NO: 403950 - DNA, 25 bp, Mus musculus
accatgaagctctgcgtgtctgccc

SEQ ID NO: 403951 - DNA, 25 bp, Mus musculus
accatgacagcgaggaaggcgtgac

SEQ ID NO: 403952 - DNA, 25 bp, Mus musculus
accatgagtgtgtgccgcgtgacct

SEQ ID NO: 403953 - DNA, 25 bp, Mus musculus
accatgctgtgtgcgaagacgggcc

SEQ ID NO: 403954 - DNA, 25 bp, Mus musculus
accatggcactgctcaggctcctgg

SEQ ID NO: 403955 - DNA, 25 bp, Mus musculus
accatgggtctcagcagttgcgggc

SEQ ID NO: 403956 - DNA, 25 bp, Mus musculus
accattctgttggaagagcgtcttc

SEQ ID NO: 403957 - DNA, 25 bp, Mus musculus
accattgttggagtagtctggaaac

SEQ ID NO: 403958 - DNA, 25 bp, Mus musculus
acccaaagccgcacggcagtgggag

SEQ ID NO: 403959 - DNA, 25 bp, Mus musculus
acccaaatgtggtggctgcaaccgc

SEQ ID NO: 403960 - DNA, 25 bp, Mus musculus
acccaattaatggacagaagttgct

SEQ ID NO: 403961 - DNA, 25 bp, Mus musculus
acccaccgtgttcatccttcaagaa

SEQ ID NO: 403962 - DNA, 25 bp, Mus musculus
acccacctgagctggccatggaagc

SEQ ID NO: 403963 - DNA, 25 bp, Mus musculus
acccaccttcagtgagccaggcatg

SEQ ID NO: 403964 - DNA, 25 bp, Mus musculus
acccacgaggactgtagctaccgag

SEQ ID NO: 403965 - DNA, 25 bp, Mus musculus
acccacgggcggttgatttgctcca

SEQ ID NO: 403966 - DNA, 25 bp, Mus musculus
acccacttccggatggaacgcggcg

SEQ ID NO: 403967 - DNA, 25 bp, Mus musculus
acccacttttggatctcagagagcg

SEQ ID NO: 403968 - DNA, 25 bp, Mus musculus
acccagcggctcctgcagtatggtg

SEQ ID NO: 403969 - DNA, 25 bp, Mus musculus
acccagctagcacctccaaaggaag

SEQ ID NO: 403970 - DNA, 25 bp, Mus musculus
acccaggacgcctgcgggagcagat

SEQ ID NO: 403971 - DNA, 25 bp, Mus musculus
acccagggcaagtggtggatccgca

SEQ ID NO: 403972 - DNA, 25 bp, Mus musculus
acccagtccagtgagtgttgcctga

SEQ ID NO: 403973 - DNA, 25 bp, Mus musculus
acccatccctcagaggtaagcagtg

SEQ ID NO: 403974 - DNA, 25 bp, Mus musculus
acccatctgatggtctggctagcag

SEQ ID NO: 403975 - DNA, 25 bp, Mus musculus
acccatgcatggttccgtgtccaaa

SEQ ID NO: 403976 - DNA, 25 bp, Mus musculus
acccatgcgcagtgtctcagggtgg

SEQ ID NO: 403977 - DNA, 25 bp, Mus musculus
accccagcccgatctgcaggaacct

SEQ ID NO: 403978 - DNA, 25 bp, Mus musculus
accccagcggcaggcaacttttgag

SEQ ID NO: 403979 - DNA, 25 bp, Mus musculus
accccgacatgcctcttagaagtgc

SEQ ID NO: 403980 - DNA, 25 bp, Mus musculus
accccgcacgaaccactggattagt

SEQ ID NO: 403981 - DNA, 25 bp, Mus musculus
accccgcctggctaagctgcaggtg

SEQ ID NO: 403982 - DNA, 25 bp, Mus musculus
accccgtgggtagagactgcttgga

SEQ ID NO: 403983 - DNA, 25 bp, Mus musculus
acccctaggtatgtgtgtgttccca

SEQ ID NO: 403984 - DNA, 25 bp, Mus musculus
acccctatggcgtctgggccagtag

SEQ ID NO: 403985 - DNA, 25 bp, Mus musculus
acccctattcctgagagttctgaga

SEQ ID NO: 403986 - DNA, 25 bp, Mus musculus
accccttggcagctgagggactgaa

SEQ ID NO: 403987 - DNA, 25 bp, Mus musculus
acccctttgctcctaggtgtccaga

SEQ ID NO: 403988 - DNA, 25 bp, Mus musculus
acccgactgtttagccgttcacacg

SEQ ID NO: 403989 - DNA, 25 bp, Mus musculus
acccgagagctcagggagcatcgag

SEQ ID NO: 403990 - DNA, 25 bp, Mus musculus
acccgcagcgcgagaagcttaagca

SEQ ID NO: 403991 - DNA, 25 bp, Mus musculus
acccgcccttgaacttgaagcgcgt

SEQ ID NO: 403992 - DNA, 25 bp, Mus musculus
acccgccgggcctgcatcaattgag

SEQ ID NO: 403993 - DNA, 25 bp, Mus musculus
acccggagtccgcagatatgttcga

SEQ ID NO: 403994 - DNA, 25 bp, Mus musculus
acccggcaggatcacagtctcttcg

SEQ ID NO: 403995 - DNA, 25 bp, Mus musculus
acccggctagtgtggactccagcag

SEQ ID NO: 403996 - DNA, 25 bp, Mus musculus
acccgtggaactgaggcccgagctg

SEQ ID NO: 403997 - DNA, 25 bp, Mus musculus
accctaagccggacccaagtgtgtg

SEQ ID NO: 403998 - DNA, 25 bp, Mus musculus
accctaattggaactgaggttcagg

SEQ ID NO: 403999 - DNA, 25 bp, Mus musculus
accctcaagggctggcatcgagtgt

SEQ ID NO: 404000 - DNA, 25 bp, Mus musculus
accctcaggatggtgcagaacccag

SEQ ID NO: 404001 - DNA, 25 bp, Mus musculus
accctcgtcgggtggaagagctgca

SEQ ID NO: 404002 - DNA, 25 bp, Mus musculus
accctgaggtgaaaagcgccatcga

SEQ ID NO: 404003 - DNA, 25 bp, Mus musculus
accctgccgggagctgaatctgaag

SEQ ID NO: 404004 - DNA, 25 bp, Mus musculus
accctgcctgggaaactaatgcaga

SEQ ID NO: 404005 - DNA, 25 bp, Mus musculus
accctgcgcgagtctctccatgaag

SEQ ID NO: 404006 - DNA, 25 bp, Mus musculus
accctgggcctggtcaagttcaaga

SEQ ID NO: 404007 - DNA, 25 bp, Mus musculus
accctggtcacctgggaaggcaaca

SEQ ID NO: 404008 - DNA, 25 bp, Mus musculus
accctgtcagagagccgaccggtga

SEQ ID NO: 404009 - DNA, 25 bp, Mus musculus
acccttccagcagcggagactggga

SEQ ID NO: 404010 - DNA, 25 bp, Mus musculus
acccttctgccctcctggaggtttg

SEQ ID NO: 404011 - DNA, 25 bp, Mus musculus
accctttaggtggtgcagggaagca

SEQ ID NO: 404012 - DNA, 25 bp, Mus musculus
accctttcacagagaatctggaaca

SEQ ID NO: 404013 - DNA, 25 bp, Mus musculus
accgaaccagcaaggtgcgggcgct

SEQ ID NO: 404014 - DNA, 25 bp, Mus musculus
accgacgctgtgtgtggcttacccg

SEQ ID NO: 404015 - DNA, 25 bp, Mus musculus
accgactttatagcgcctgccagga

SEQ ID NO: 404016 - DNA, 25 bp, Mus musculus
accgagaggaagacagctgctgcag

SEQ ID NO: 404017 - DNA, 25 bp, Mus musculus
accgagattcctgagagctgtgggc

SEQ ID NO: 404018 - DNA, 25 bp, Mus musculus
accgagccagtgaatgacagcagcg

SEQ ID NO: 404019 - DNA, 25 bp, Mus musculus
accgagcctctgcagggttcagaca

SEQ ID NO: 404020 - DNA, 25 bp, Mus musculus
accgaggtcctaggagacgagcctg

SEQ ID NO: 404021 - DNA, 25 bp, Mus musculus
accgagtgtgtaagatgttccgtca

SEQ ID NO: 404022 - DNA, 25 bp, Mus musculus
accgagtttggaggagtgatgtaat

SEQ ID NO: 404023 - DNA, 25 bp, Mus musculus
accgattgtgctgggcccggatgac

SEQ ID NO: 404024 - DNA, 25 bp, Mus musculus
accgcaagctagacctgtgggcagg

SEQ ID NO: 404025 - DNA, 25 bp, Mus musculus
accgcaccgggcttgtctcggtatc

SEQ ID NO: 404026 - DNA, 25 bp, Mus musculus
accgcagcacctgcgcagtggaggt

SEQ ID NO: 404027 - DNA, 25 bp, Mus musculus
accgcagcctgtggataattatgag

SEQ ID NO: 404028 - DNA, 25 bp, Mus musculus
accgcagtatcctgggcgagggcaa

SEQ ID NO: 404029 - DNA, 25 bp, Mus musculus
accgccaggttcatagagtacgagg

SEQ ID NO: 404030 - DNA, 25 bp, Mus musculus
accgcgctggccgtgaaatggactg

SEQ ID NO: 404031 - DNA, 25 bp, Mus musculus
accgctgtggtatccgtagtttagg

SEQ ID NO: 404032 - DNA, 25 bp, Mus musculus
accggagtcagccaagccaatgaga

SEQ ID NO: 404033 - DNA, 25 bp, Mus musculus
accggagtcccctgctaagagtgag

SEQ ID NO: 404034 - DNA, 25 bp, Mus musculus
accggcgcactggtagcgcaggctt

SEQ ID NO: 404035 - DNA, 25 bp, Mus musculus
accggcgtctgtagggtctggactc

SEQ ID NO: 404036 - DNA, 25 bp, Mus musculus
accggctatccctctgctgggtggc

SEQ ID NO: 404037 - DNA, 25 bp, Mus musculus
accggcttcggtctctgatagagcg

SEQ ID NO: 404038 - DNA, 25 bp, Mus musculus
accgggacccgaagcttgacatgct

SEQ ID NO: 404039 - DNA, 25 bp, Mus musculus
accgggctccggtgatgtatgtaca

SEQ ID NO: 404040 - DNA, 25 bp, Mus musculus
accgggtgaagaaatcgtgtcctga

SEQ ID NO: 404041 - DNA, 25 bp, Mus musculus
accggtgtcgccaactgcaaggagt

SEQ ID NO: 404042 - DNA, 25 bp, Mus musculus
accggtgtgtgataagctctctgag

SEQ ID NO: 404043 - DNA, 25 bp, Mus musculus
accggttcgccaggctttccctgtg

SEQ ID NO: 404044 - DNA, 25 bp, Mus musculus
accgtgatacccctgattgtggtgc

SEQ ID NO: 404045 - DNA, 25 bp, Mus musculus
accgtgcacttctgggaacagccaa

SEQ ID NO: 404046 - DNA, 25 bp, Mus musculus
accgtgctccttgggcctatggaaa

SEQ ID NO: 404047 - DNA, 25 bp, Mus musculus
accgtggcagtccaccacatctggg

SEQ ID NO: 404048 - DNA, 25 bp, Mus musculus
accgtgggattgtgggcatctctga

SEQ ID NO: 404049 - DNA, 25 bp, Mus musculus
accgtgggcgccagtacgtgttcga

SEQ ID NO: 404050 - DNA, 25 bp, Mus musculus
accgtgggcgtcctggctgtaaaca

SEQ ID NO: 404051 - DNA, 25 bp, Mus musculus
accgtgggtcggtcgtattgcctga

SEQ ID NO: 404052 - DNA, 25 bp, Mus musculus
accgttgtgtggtgcacccagaggc

SEQ ID NO: 404053 - DNA, 25 bp, Mus musculus
accgtttaacttgggctgatgcaga

SEQ ID NO: 404054 - DNA, 25 bp, Mus musculus
accgtttcgtggaactggcgctgcg

SEQ ID NO: 404055 - DNA, 25 bp, Mus musculus
acctaaaggaagcaggatgttctcc

SEQ ID NO: 404056 - DNA, 25 bp, Mus musculus
acctacaggtggaggagacccagct

SEQ ID NO: 404057 - DNA, 25 bp, Mus musculus
acctacctttcagggtggtcaggag

SEQ ID NO: 404058 - DNA, 25 bp, Mus musculus
acctacggctcggcgagctggaacg

SEQ ID NO: 404059 - DNA, 25 bp, Mus musculus
acctactgcaaagcctgaagacctg

SEQ ID NO: 404060 - DNA, 25 bp, Mus musculus
acctactgggaactttagaagctag

SEQ ID NO: 404061 - DNA, 25 bp, Mus musculus
acctagaggagagttcgtcgtccga

SEQ ID NO: 404062 - DNA, 25 bp, Mus musculus
acctagggctacacatcagtagtga

SEQ ID NO: 404063 - DNA, 25 bp, Mus musculus
acctagggctgagaccgtcgacgaa

SEQ ID NO: 404064 - DNA, 25 bp, Mus musculus
acctaggtgtactggttgtctccct

SEQ ID NO: 404065 - DNA, 25 bp, Mus musculus
acctagtggactgtgttgacggaag

SEQ ID NO: 404066 - DNA, 25 bp, Mus musculus
acctatctgtagtgtgcctggagcc

SEQ ID NO: 404067 - DNA, 25 bp, Mus musculus
acctatgactacaagacagatgaga

SEQ ID NO: 404068 - DNA, 25 bp, Mus musculus
acctatgtgcctaccgtgtttgaga

SEQ ID NO: 404069 - DNA, 25 bp, Mus musculus
acctcaagacagtgcaaatgggtga

SEQ ID NO: 404070 - DNA, 25 bp, Mus musculus
acctcaatgtacctcgtgttgtgcc

SEQ ID NO: 404071 - DNA, 25 bp, Mus musculus
acctcacagggaatgcagaagcacc

SEQ ID NO: 404072 - DNA, 25 bp, Mus musculus
acctcactggctttcgagtctcggc

SEQ ID NO: 404073 - DNA, 25 bp, Mus musculus
acctcagagtagaagagtgccgtcg

SEQ ID NO: 404074 - DNA, 25 bp, Mus musculus
acctcagagttgtggtccccggctc

SEQ ID NO: 404075 - DNA, 25 bp, Mus musculus
acctcatgcattgtgtgtcctggaa

SEQ ID NO: 404076 - DNA, 25 bp, Mus musculus
acctcattgccagcacggctttggg

SEQ ID NO: 404077 - DNA, 25 bp, Mus musculus
acctccaaggtctctgtgatcagtg

SEQ ID NO: 404078 - DNA, 25 bp, Mus musculus
acctccggtgtcagccttccagagt

SEQ ID NO: 404079 - DNA, 25 bp, Mus musculus
acctccgtcggctggccgtgagcgt

SEQ ID NO: 404080 - DNA, 25 bp, Mus musculus
acctcggaaggtgtcaggcatggaa

SEQ ID NO: 404081 - DNA, 25 bp, Mus musculus
acctcggccagccaaggatcttgga

SEQ ID NO: 404082 - DNA, 25 bp, Mus musculus
acctcgggcactgcttgggacacaa

SEQ ID NO: 404083 - DNA, 25 bp, Mus musculus
acctctagtgtgtgatagtgtggcc

SEQ ID NO: 404084 - DNA, 25 bp, Mus musculus
acctctcggagctgttactctttct

SEQ ID NO: 404085 - DNA, 25 bp, Mus musculus
acctctctctggctcgattctggga

SEQ ID NO: 404086 - DNA, 25 bp, Mus musculus
acctctgccttgcagagctcctggt

SEQ ID NO: 404087 - DNA, 25 bp, Mus musculus
acctctgtggattgaagactctcct

SEQ ID NO: 404088 - DNA, 25 bp, Mus musculus
acctcttgagaggagacgggacagc

SEQ ID NO: 404089 - DNA, 25 bp, Mus musculus
acctgagagtgtcacttccgcggcg

SEQ ID NO: 404090 - DNA, 25 bp, Mus musculus
acctgagagtgtgaagggtactgta

SEQ ID NO: 404091 - DNA, 25 bp, Mus musculus
acctgagggtgcagactcggtttct

SEQ ID NO: 404092 - DNA, 25 bp, Mus musculus
acctgagttcactctagatgtgaca

SEQ ID NO: 404093 - DNA, 25 bp, Mus musculus
acctgattggtcagtttttactgcc

SEQ ID NO: 404094 - DNA, 25 bp, Mus musculus
acctgcaggccttccgcagtggagc

SEQ ID NO: 404095 - DNA, 25 bp, Mus musculus
acctgccctggctgtatctgtcttt

SEQ ID NO: 404096 - DNA, 25 bp, Mus musculus
acctgcgagcgtttggcgcacgcga

SEQ ID NO: 404097 - DNA, 25 bp, Mus musculus
acctgcgctgagcacccgggaagtt

SEQ ID NO: 404098 - DNA, 25 bp, Mus musculus
acctgcgggttctggaggccaccgc

SEQ ID NO: 404099 - DNA, 25 bp, Mus musculus
acctgctccgtcttgggtgcctcaa

SEQ ID NO: 404100 - DNA, 25 bp, Mus musculus
acctgctgcccatcaacaatgacga

SEQ ID NO: 404101 - DNA, 25 bp, Mus musculus
acctgctgccgggattcttctgtga

SEQ ID NO: 404102 - DNA, 25 bp, Mus musculus
acctgctggatcagaaactctgtgg

SEQ ID NO: 404103 - DNA, 25 bp, Mus musculus
acctggaacgactggactgggacaa

SEQ ID NO: 404104 - DNA, 25 bp, Mus musculus
acctggaagacccttctgtcctgga

SEQ ID NO: 404105 - DNA, 25 bp, Mus musculus
acctggccataaacctcattcttag

SEQ ID NO: 404106 - DNA, 25 bp, Mus musculus
acctggctgagaagctacattaagc

SEQ ID NO: 404107 - DNA, 25 bp, Mus musculus
acctgggcacaaaccgccttcagtg

SEQ ID NO: 404108 - DNA, 25 bp, Mus musculus
acctgggctgccacagatactggaa

SEQ ID NO: 404109 - DNA, 25 bp, Mus musculus
acctgggctggaagcgattctggcc

SEQ ID NO: 404110 - DNA, 25 bp, Mus musculus
acctggtccacggagatgtcctctg

SEQ ID NO: 404111 - DNA, 25 bp, Mus musculus
acctggtgatgatggcagagactca

SEQ ID NO: 404112 - DNA, 25 bp, Mus musculus
acctggtgccagttgagaggtcacg

SEQ ID NO: 404113 - DNA, 25 bp, Mus musculus
acctggttgagaagataggcgacac

SEQ ID NO: 404114 - DNA, 25 bp, Mus musculus
acctggtttccataggcttcgagga

SEQ ID NO: 404115 - DNA, 25 bp, Mus musculus
acctgtaatgcgcacggaggaccga

SEQ ID NO: 404116 - DNA, 25 bp, Mus musculus
acctgtacatcctcggccaggctga

SEQ ID NO: 404117 - DNA, 25 bp, Mus musculus
acctgtagccatacatacacggacg

SEQ ID NO: 404118 - DNA, 25 bp, Mus musculus
acctgtcaagtaggtcagagcctcg

SEQ ID NO: 404119 - DNA, 25 bp, Mus musculus
acctgtcaggtgaccttccctggag

SEQ ID NO: 404120 - DNA, 25 bp, Mus musculus
acctgtgaatttcccagccgaaacg

SEQ ID NO: 404121 - DNA, 25 bp, Mus musculus
acctgtgcacgacgcagctcgggaa

SEQ ID NO: 404122 - DNA, 25 bp, Mus musculus
acctgtgctcttgtcaaagaaactc

SEQ ID NO: 404123 - DNA, 25 bp, Mus musculus
acctgtggaagatctgcgttaccga

SEQ ID NO: 404124 - DNA, 25 bp, Mus musculus
acctgtgtgaagaccgaagcttgcc

SEQ ID NO: 404125 - DNA, 25 bp, Mus musculus
acctgttgtgcaaaggcgggagcca

SEQ ID NO: 404126 - DNA, 25 bp, Mus musculus
acctgtttgctgatgaagattcacc

SEQ ID NO: 404127 - DNA, 25 bp, Mus musculus
accttacattctccaggacaccaaa

SEQ ID NO: 404128 - DNA, 25 bp, Mus musculus
accttagggcaaacataagggcagg

SEQ ID NO: 404129 - DNA, 25 bp, Mus musculus
accttccaagagatgcgagccctgg

SEQ ID NO: 404130 - DNA, 25 bp, Mus musculus
accttccagaggtgccaagtatgtg

SEQ ID NO: 404131 - DNA, 25 bp, Mus musculus
accttcctactgaacagcctactgg

SEQ ID NO: 404132 - DNA, 25 bp, Mus musculus
accttcctgagttgacggctgtcac

SEQ ID NO: 404133 - DNA, 25 bp, Mus musculus
accttctaatggagggatagagccc

SEQ ID NO: 404134 - DNA, 25 bp, Mus musculus
accttctctggagagtgcccggctg

SEQ ID NO: 404135 - DNA, 25 bp, Mus musculus
accttctgagacattctgctcccat

SEQ ID NO: 404136 - DNA, 25 bp, Mus musculus
accttgaaggtgacggcgggcatct

SEQ ID NO: 404137 - DNA, 25 bp, Mus musculus
accttgagaggtacagccgcagctt

SEQ ID NO: 404138 - DNA, 25 bp, Mus musculus
accttgcagctcacatgagcccagg

SEQ ID NO: 404139 - DNA, 25 bp, Mus musculus
accttgcagttcgagggttacgcca

SEQ ID NO: 404140 - DNA, 25 bp, Mus musculus
accttgctgaaggagtccctgtgac

SEQ ID NO: 404141 - DNA, 25 bp, Mus musculus
accttggagacgctggtcctgctga

SEQ ID NO: 404142 - DNA, 25 bp, Mus musculus
accttggatacatggcgacagaaag

SEQ ID NO: 404143 - DNA, 25 bp, Mus musculus
accttggatgctggagtctcgctgc

SEQ ID NO: 404144 - DNA, 25 bp, Mus musculus
accttggatggagtcagggcaagaa

SEQ ID NO: 404145 - DNA, 25 bp, Mus musculus
accttggcggcgactccacatcggg

SEQ ID NO: 404146 - DNA, 25 bp, Mus musculus
accttgtcgatgtagcccgcgaagc

SEQ ID NO: 404147 - DNA, 25 bp, Mus musculus
acctttagctccatgtcgcctcgtg

SEQ ID NO: 404148 - DNA, 25 bp, Mus musculus
acctttcgtagcaccgccgcaggtg

SEQ ID NO: 404149 - DNA, 25 bp, Mus musculus
acctttctctcttagtggccccagg

SEQ ID NO: 404150 - DNA, 25 bp, Mus musculus
acctttgaggaccatgtaagtaggg

SEQ ID NO: 404151 - DNA, 25 bp, Mus musculus
acctttgggccgatgtggacctcac

SEQ ID NO: 404152 - DNA, 25 bp, Mus musculus
acctttggtgtggtgctggtaggcc

SEQ ID NO: 404153 - DNA, 25 bp, Mus musculus
acgaaaagggcccacgtcagtcagg

SEQ ID NO: 404154 - DNA, 25 bp, Mus musculus
acgaacccgctctgggagtcctcaa

SEQ ID NO: 404155 - DNA, 25 bp, Mus musculus
acgaagatttgcagctggccggcct

SEQ ID NO: 404156 - DNA, 25 bp, Mus musculus
acgaagtcagctttggtccatggga

SEQ ID NO: 404157 - DNA, 25 bp, Mus musculus
acgacagcgactgcgaggagcccgt

SEQ ID NO: 404158 - DNA, 25 bp, Mus musculus
acgaccacactctcctcagtgctga

SEQ ID NO: 404159 - DNA, 25 bp, Mus musculus
acgacctctcgtgaggcctgtggca

SEQ ID NO: 404160 - DNA, 25 bp, Mus musculus
acgacgctgacctgagagagggcca

SEQ ID NO: 404161 - DNA, 25 bp, Mus musculus
acgacgctggtgttgcggactccgc

SEQ ID NO: 404162 - DNA, 25 bp, Mus musculus
acgacgtggacaggctgccgctgct

SEQ ID NO: 404163 - DNA, 25 bp, Mus musculus
acgacttcgggcctgccaagaacct

SEQ ID NO: 404164 - DNA, 25 bp, Mus musculus
acgagaagtgactgagactgctggc

SEQ ID NO: 404165 - DNA, 25 bp, Mus musculus
acgagacacgatggatgctgatgga

SEQ ID NO: 404166 - DNA, 25 bp, Mus musculus
acgagagcatctactgtggcggcgc

SEQ ID NO: 404167 - DNA, 25 bp, Mus musculus
acgaggaggactgtgccaggctaca

SEQ ID NO: 404168 - DNA, 25 bp, Mus musculus
acgaggattcgaggcgccggaactc

SEQ ID NO: 404169 - DNA, 25 bp, Mus musculus
acgagggctggacacccctgcatgc

SEQ ID NO: 404170 - DNA, 25 bp, Mus musculus
acgaggtgagctttggctgcccagc

SEQ ID NO: 404171 - DNA, 25 bp, Mus musculus
acgaggtgcaggatccagatgtgcc

SEQ ID NO: 404172 - DNA, 25 bp, Mus musculus
acgagtactgtgactgcccggaaga

SEQ ID NO: 404173 - DNA, 25 bp, Mus musculus
acgagtcaccacaccagcattaaca

SEQ ID NO: 404174 - DNA, 25 bp, Mus musculus
acgatgactgggacttcgcggacgc

SEQ ID NO: 404175 - DNA, 25 bp, Mus musculus
acgatgctgtggttccagggcgcca

SEQ ID NO: 404176 - DNA, 25 bp, Mus musculus
acgatggccctttgaggacttctca

SEQ ID NO: 404177 - DNA, 25 bp, Mus musculus
acgatgggccgagatcacgctttga

SEQ ID NO: 404178 - DNA, 25 bp, Mus musculus
acgattaatatggaagggcccagcc

SEQ ID NO: 404179 - DNA, 25 bp, Mus musculus
acgcaaaagtgtggaggctacagag

SEQ ID NO: 404180 - DNA, 25 bp, Mus musculus
acgcaaactaccaagcactcagctt

SEQ ID NO: 404181 - DNA, 25 bp, Mus musculus
acgcaagctggtgttccacgcacag

SEQ ID NO: 404182 - DNA, 25 bp, Mus musculus
acgcaatgcccgcacgtaacaggaa

SEQ ID NO: 404183 - DNA, 25 bp, Mus musculus
acgcacggcaggacttgaagcacga

SEQ ID NO: 404184 - DNA, 25 bp, Mus musculus
acgcacgtcactttactgataaccg

SEQ ID NO: 404185 - DNA, 25 bp, Mus musculus
acgcagcggagtatggaggtcatca

SEQ ID NO: 404186 - DNA, 25 bp, Mus musculus
acgcagctggcatcctgaccatggg

SEQ ID NO: 404187 - DNA, 25 bp, Mus musculus
acgcatagttggagggcagcctgca

SEQ ID NO: 404188 - DNA, 25 bp, Mus musculus
acgccatactcctttgctgggcagg

SEQ ID NO: 404189 - DNA, 25 bp, Mus musculus
acgccatgaaggacgagggccctgt

SEQ ID NO: 404190 - DNA, 25 bp, Mus musculus
acgccgacctgctggacacatcgga

SEQ ID NO: 404191 - DNA, 25 bp, Mus musculus
acgccgccggatgctttgaagttgc

SEQ ID NO: 404192 - DNA, 25 bp, Mus musculus
acgccgcctccggagatttaagcga

SEQ ID NO: 404193 - DNA, 25 bp, Mus musculus
acgccggacgccatgttgtggaaaa

SEQ ID NO: 404194 - DNA, 25 bp, Mus musculus
acgccggcggaggtgcgctacatct

SEQ ID NO: 404195 - DNA, 25 bp, Mus musculus
acgccggcttggtgtgagtttgctc

SEQ ID NO: 404196 - DNA, 25 bp, Mus musculus
acgcctaagacgctcagctgaggag

SEQ ID NO: 404197 - DNA, 25 bp, Mus musculus
acgcctcgaaaactgtgccctgctg

SEQ ID NO: 404198 - DNA, 25 bp, Mus musculus
acgcctctgaaacccaatcgtgaga

SEQ ID NO: 404199 - DNA, 25 bp, Mus musculus
acgcgacccggcgtagggcagagct

SEQ ID NO: 404200 - DNA, 25 bp, Mus musculus
acgcgcaggtcagtgtgactccgga

SEQ ID NO: 404201 - DNA, 25 bp, Mus musculus
acgcgcgagtcacggtcaagtacga

SEQ ID NO: 404202 - DNA, 25 bp, Mus musculus
acgcggagagctgcgagactgagga

SEQ ID NO: 404203 - DNA, 25 bp, Mus musculus
acgcgtagtttcaagggtgacctgg

SEQ ID NO: 404204 - DNA, 25 bp, Mus musculus
acgctacgtacgctcctggatggag

SEQ ID NO: 404205 - DNA, 25 bp, Mus musculus
acgctcaggagaatccaggaccggg

SEQ ID NO: 404206 - DNA, 25 bp, Mus musculus
acgctccgccggctttattgtcggc

SEQ ID NO: 404207 - DNA, 25 bp, Mus musculus
acgctgccaggaggtcacccaggat

SEQ ID NO: 404208 - DNA, 25 bp, Mus musculus
acgctgcgggtatcctgactctggg

SEQ ID NO: 404209 - DNA, 25 bp, Mus musculus
acgctggctgggtccctgtagaaca

SEQ ID NO: 404210 - DNA, 25 bp, Mus musculus
acgcttccgtgagacttgacaatag

SEQ ID NO: 404211 - DNA, 25 bp, Mus musculus
acggacaccgggtaaggctcagtca

SEQ ID NO: 404212 - DNA, 25 bp, Mus musculus
acggacctcttcgtgctgcgggaaa

SEQ ID NO: 404213 - DNA, 25 bp, Mus musculus
acggacttggtctcaggttaggcct

SEQ ID NO: 404214 - DNA, 25 bp, Mus musculus
acggagacccaccaagaactaatgc

SEQ ID NO: 404215 - DNA, 25 bp, Mus musculus
acggagctacgccggtctcagtcat

SEQ ID NO: 404216 - DNA, 25 bp, Mus musculus
acggatagggaaggccgaggccact

SEQ ID NO: 404217 - DNA, 25 bp, Mus musculus
acggatcagaaggtaatcacagccc

SEQ ID NO: 404218 - DNA, 25 bp, Mus musculus
acggattcgattcagctgtgggctc

SEQ ID NO: 404219 - DNA, 25 bp, Mus musculus
acggatttccgagccagcatgttct

SEQ ID NO: 404220 - DNA, 25 bp, Mus musculus
acggcatccacacaagcgaacattt

SEQ ID NO: 404221 - DNA, 25 bp, Mus musculus
acggcatgaaggacctggacgccat

SEQ ID NO: 404222 - DNA, 25 bp, Mus musculus
acggcatggtaggtgtccacgatgt

SEQ ID NO: 404223 - DNA, 25 bp, Mus musculus
acggccgcacggacaagagtaaagg

SEQ ID NO: 404224 - DNA, 25 bp, Mus musculus
acggccggctctgctgttctcatgg

SEQ ID NO: 404225 - DNA, 25 bp, Mus musculus
acggcgaccacatctctgtgcacag

SEQ ID NO: 404226 - DNA, 25 bp, Mus musculus
acggcgaccgcgactgcaaggacaa

SEQ ID NO: 404227 - DNA, 25 bp, Mus musculus
acggcgctggtcaccaaggagagca

SEQ ID NO: 404228 - DNA, 25 bp, Mus musculus
acggctccgcctgaggatagcagga

SEQ ID NO: 404229 - DNA, 25 bp, Mus musculus
acggctgtgccgtgatgctggccct

SEQ ID NO: 404230 - DNA, 25 bp, Mus musculus
acggcttcaccaacatggcccatgt

SEQ ID NO: 404231 - DNA, 25 bp, Mus musculus
acggctttgcatgggaggcccctag

SEQ ID NO: 404232 - DNA, 25 bp, Mus musculus
acgggatcctggttctctcgccagg

SEQ ID NO: 404233 - DNA, 25 bp, Mus musculus
acgggcagggcctctgtcagtcgct

SEQ ID NO: 404234 - DNA, 25 bp, Mus musculus
acgggccgcgtcgtcaatcctggtt

SEQ ID NO: 404235 - DNA, 25 bp, Mus musculus
acgggccgtttcgaggatgcttaca

SEQ ID NO: 404236 - DNA, 25 bp, Mus musculus
acgggcctgccctatgctatcggag

SEQ ID NO: 404237 - DNA, 25 bp, Mus musculus
acgggtgctgtccacacagggattc

SEQ ID NO: 404238 - DNA, 25 bp, Mus musculus
acggtaaccagatcccctgcgggtg

SEQ ID NO: 404239 - DNA, 25 bp, Mus musculus
acggtagaatccagagccctgtgct

SEQ ID NO: 404240 - DNA, 25 bp, Mus musculus
acggtcagttactcggccacggtca

SEQ ID NO: 404241 - DNA, 25 bp, Mus musculus
acggtcccggtctctgccggagagc

SEQ ID NO: 404242 - DNA, 25 bp, Mus musculus
acggtgaacagcagagtggcctcaa

SEQ ID NO: 404243 - DNA, 25 bp, Mus musculus
acgtacgagggctgccgcgagacca

SEQ ID NO: 404244 - DNA, 25 bp, Mus musculus
acgtacggtaagtgagggctctgcc

SEQ ID NO: 404245 - DNA, 25 bp, Mus musculus
acgtagtccaaagtctggttttgct

SEQ ID NO: 404246 - DNA, 25 bp, Mus musculus
acgtcacctgcggtcacggtagtga

SEQ ID NO: 404247 - DNA, 25 bp, Mus musculus
acgtcagtcaggaggctcgcgctaa

SEQ ID NO: 404248 - DNA, 25 bp, Mus musculus
acgtcatctacctgtctcggcggga

SEQ ID NO: 404249 - DNA, 25 bp, Mus musculus
acgtcccactttgccagcagaataa

SEQ ID NO: 404250 - DNA, 25 bp, Mus musculus
acgtccggtccggtcagaattctcg

SEQ ID NO: 404251 - DNA, 25 bp, Mus musculus
acgtcctctctgctgcaatactgca

SEQ ID NO: 404252 - DNA, 25 bp, Mus musculus
acgtcgactgtgtctgggagagcca

SEQ ID NO: 404253 - DNA, 25 bp, Mus musculus
acgtcgcggaaatctacttgttagg

SEQ ID NO: 404254 - DNA, 25 bp, Mus musculus
acgtctacacaccaggggcaaggca

SEQ ID NO: 404255 - DNA, 25 bp, Mus musculus
acgtctctgctctgtgaagcccgga

SEQ ID NO: 404256 - DNA, 25 bp, Mus musculus
acgtctgctgtgctcatccccttaa

SEQ ID NO: 404257 - DNA, 25 bp, Mus musculus
acgtctggtcttggctggatgtgca

SEQ ID NO: 404258 - DNA, 25 bp, Mus musculus
acgtgaagtcttgcagtcccaggga

SEQ ID NO: 404259 - DNA, 25 bp, Mus musculus
acgtgagcgccaggatcggcagcag

SEQ ID NO: 404260 - DNA, 25 bp, Mus musculus
acgtgcacaagagaagcctgggctt

SEQ ID NO: 404261 - DNA, 25 bp, Mus musculus
acgtgcctcctaggaagccaggtgc

SEQ ID NO: 404262 - DNA, 25 bp, Mus musculus
acgtgcctggctacatcgacatggt

SEQ ID NO: 404263 - DNA, 25 bp, Mus musculus
acgtggaaacacgaagcccaggaag

SEQ ID NO: 404264 - DNA, 25 bp, Mus musculus
acgtggagcggtacatcgcctcggt

SEQ ID NO: 404265 - DNA, 25 bp, Mus musculus
acgtggaggtccagacagcaggatc

SEQ ID NO: 404266 - DNA, 25 bp, Mus musculus
acgtggattttcaaccttctgcaga

SEQ ID NO: 404267 - DNA, 25 bp, Mus musculus
acgtggcactgcaggacgacagcat

SEQ ID NO: 404268 - DNA, 25 bp, Mus musculus
acgtggctatctcggccgggcttct

SEQ ID NO: 404269 - DNA, 25 bp, Mus musculus
acgtggctggcctgttcctggtcaa

SEQ ID NO: 404270 - DNA, 25 bp, Mus musculus
acgtgggatgcaagaaatgccctgg

SEQ ID NO: 404271 - DNA, 25 bp, Mus musculus
acgtgggcagtctcctctgtgtgaa

SEQ ID NO: 404272 - DNA, 25 bp, Mus musculus
acgtgtccgaactctgcatcccgga

SEQ ID NO: 404273 - DNA, 25 bp, Mus musculus
acgtgtggcccaaagtgtgattcga

SEQ ID NO: 404274 - DNA, 25 bp, Mus musculus
acgtgttattaacagggctgaagag

SEQ ID NO: 404275 - DNA, 25 bp, Mus musculus
acgtgttcaccttgccagagcctag

SEQ ID NO: 404276 - DNA, 25 bp, Mus musculus
acgtgttccgcagcttcgatgccaa

SEQ ID NO: 404277 - DNA, 25 bp, Mus musculus
acgttggcgcacatgcacgcgcgca

SEQ ID NO: 404278 - DNA, 25 bp, Mus musculus
acgttgtagcagcaaatgatcccaa

SEQ ID NO: 404279 - DNA, 25 bp, Mus musculus
acgtttctgagcaagcattctggcc

SEQ ID NO: 404280 - DNA, 25 bp, Mus musculus
acgtttcttttgaccaccttctcag

SEQ ID NO: 404281 - DNA, 25 bp, Mus musculus
acgtttggacaagaacacctggcca

SEQ ID NO: 404282 - DNA, 25 bp, Mus musculus
actaaacctggaagaaggactgcca

SEQ ID NO: 404283 - DNA, 25 bp, Mus musculus
actaaaggccacacgcaggaaggtg

SEQ ID NO: 404284 - DNA, 25 bp, Mus musculus
actaaatgggagacgagggatgttc

SEQ ID NO: 404285 - DNA, 25 bp, Mus musculus
actaaattgtcagccaaagccagtg

SEQ ID NO: 404286 - DNA, 25 bp, Mus musculus
actaagcaggtaattgagctccctc

SEQ ID NO: 404287 - DNA, 25 bp, Mus musculus
actaagcgagcacagtcccttgggc

SEQ ID NO: 404288 - DNA, 25 bp, Mus musculus
actaagggaacaggccgagtagcac

SEQ ID NO: 404289 - DNA, 25 bp, Mus musculus
actaagtaatgtggcatagtaccac

SEQ ID NO: 404290 - DNA, 25 bp, Mus musculus
actaagtgtggaggaattctgggtc

SEQ ID NO: 404291 - DNA, 25 bp, Mus musculus
actaatccggaagaacaaaatggtg

SEQ ID NO: 404292 - DNA, 25 bp, Mus musculus
actaatctgagatggcctatcccag

SEQ ID NO: 404293 - DNA, 25 bp, Mus musculus
actaatgcagagttcctaagagccc

SEQ ID NO: 404294 - DNA, 25 bp, Mus musculus
actaatgctggccttctgggcaccc

SEQ ID NO: 404295 - DNA, 25 bp, Mus musculus
actaattagtaagctgggtggcaca

SEQ ID NO: 404296 - DNA, 25 bp, Mus musculus
actaattgaatgtaggcgtctgaac

SEQ ID NO: 404297 - DNA, 25 bp, Mus musculus
actacaagcataagcccttggacca

SEQ ID NO: 404298 - DNA, 25 bp, Mus musculus
actacaagctgtgtgagcgctacgc

SEQ ID NO: 404299 - DNA, 25 bp, Mus musculus
actacaaggtgggtgagaacgccga

SEQ ID NO: 404300 - DNA, 25 bp, Mus musculus
actacacatcctgtgagcggctgct

SEQ ID NO: 404301 - DNA, 25 bp, Mus musculus
actacagaggaacggaggagccatc

SEQ ID NO: 404302 - DNA, 25 bp, Mus musculus
actacaggaagaaggatggctagaa

SEQ ID NO: 404303 - DNA, 25 bp, Mus musculus
actacatggtcggtctgcaggtccc

SEQ ID NO: 404304 - DNA, 25 bp, Mus musculus
actaccacgtggctctgtgaggcca

SEQ ID NO: 404305 - DNA, 25 bp, Mus musculus
actaccaggtatggacatcgctgtg

SEQ ID NO: 404306 - DNA, 25 bp, Mus musculus
actaccccacagtgtccgattttgc

SEQ ID NO: 404307 - DNA, 25 bp, Mus musculus
actaccggcggtggaaatcgtcagc

SEQ ID NO: 404308 - DNA, 25 bp, Mus musculus
actacctgaggaggctggttgccca

SEQ ID NO: 404309 - DNA, 25 bp, Mus musculus
actaccttagaagtgggcttgcgac

SEQ ID NO: 404310 - DNA, 25 bp, Mus musculus
actacgcagtgcgtttgggccgccg

SEQ ID NO: 404311 - DNA, 25 bp, Mus musculus
actacggttacgtgagcctcggccg

SEQ ID NO: 404312 - DNA, 25 bp, Mus musculus
actacgtggtgctcatggctgcggc

SEQ ID NO: 404313 - DNA, 25 bp, Mus musculus
actactacctggagcagtagacctt

SEQ ID NO: 404314 - DNA, 25 bp, Mus musculus
actactattctgtgacctgaactgc

SEQ ID NO: 404315 - DNA, 25 bp, Mus musculus
actactggacagatatgggcccaca

SEQ ID NO: 404316 - DNA, 25 bp, Mus musculus
actacttccggagcaaatcgggccg

SEQ ID NO: 404317 - DNA, 25 bp, Mus musculus
actacttctctacaggacctgagtc

SEQ ID NO: 404318 - DNA, 25 bp, Mus musculus
actacttggttctcactgcggtgga

SEQ ID NO: 404319 - DNA, 25 bp, Mus musculus
actagacatttctgtggccaaaggc

SEQ ID NO: 404320 - DNA, 25 bp, Mus musculus
actagacgaagcctgagtcacgggc

SEQ ID NO: 404321 - DNA, 25 bp, Mus musculus
actagactagcaagcgctgagcgca

SEQ ID NO: 404322 - DNA, 25 bp, Mus musculus
actagagaagcttggcgcgatgagt

SEQ ID NO: 404323 - DNA, 25 bp, Mus musculus
actagagagagtttgtgccgtgcac

SEQ ID NO: 404324 - DNA, 25 bp, Mus musculus
actagagagcttgttgaggctggca

SEQ ID NO: 404325 - DNA, 25 bp, Mus musculus
actagagctccaggcacaagggcgg

SEQ ID NO: 404326 - DNA, 25 bp, Mus musculus
actagaggttggacctcacagacgg

SEQ ID NO: 404327 - DNA, 25 bp, Mus musculus
actagcaacaaatatctggagagag

SEQ ID NO: 404328 - DNA, 25 bp, Mus musculus
actagcagctccctgttgctgttcc

SEQ ID NO: 404329 - DNA, 25 bp, Mus musculus
actaggatccccaagactgaagagc

SEQ ID NO: 404330 - DNA, 25 bp, Mus musculus
actaggcgccagacgggctggccct

SEQ ID NO: 404331 - DNA, 25 bp, Mus musculus
actaggctctgggtgcctcttctgg

SEQ ID NO: 404332 - DNA, 25 bp, Mus musculus
actaggctgacactgctgacggagc

SEQ ID NO: 404333 - DNA, 25 bp, Mus musculus
actaggctgccctacttactaggag

SEQ ID NO: 404334 - DNA, 25 bp, Mus musculus
actaggctgggactctcgggataca

SEQ ID NO: 404335 - DNA, 25 bp, Mus musculus
actaggtagggctcaagaccaccaa

SEQ ID NO: 404336 - DNA, 25 bp, Mus musculus
actaggtttgaactctccaggcccg

SEQ ID NO: 404337 - DNA, 25 bp, Mus musculus
actagtgacttacgccctggtggaa

SEQ ID NO: 404338 - DNA, 25 bp, Mus musculus
actagtggctccctaacaactctgg

SEQ ID NO: 404339 - DNA, 25 bp, Mus musculus
actagtgggacaatcctgttatgga

SEQ ID NO: 404340 - DNA, 25 bp, Mus musculus
actagttacgtttcctgttgctgtg

SEQ ID NO: 404341 - DNA, 25 bp, Mus musculus
actatatgagatacccgtggaggca

SEQ ID NO: 404342 - DNA, 25 bp, Mus musculus
actatatggccccagcatgcgacct

SEQ ID NO: 404343 - DNA, 25 bp, Mus musculus
actatcatcaggctagagtcatggg

SEQ ID NO: 404344 - DNA, 25 bp, Mus musculus
actatcttgaaggtgggctgtttgc

SEQ ID NO: 404345 - DNA, 25 bp, Mus musculus
actatgaacagatgggcctcctgcc

SEQ ID NO: 404346 - DNA, 25 bp, Mus musculus
actatgaccctctacttcgctgcgg

SEQ ID NO: 404347 - DNA, 25 bp, Mus musculus
actatggaaaccagcaatatggacc

SEQ ID NO: 404348 - DNA, 25 bp, Mus musculus
actatgtactgtccgtgtccgagaa

SEQ ID NO: 404349 - DNA, 25 bp, Mus musculus
actatgtagatctgcctagcctgga

SEQ ID NO: 404350 - DNA, 25 bp, Mus musculus
actatgtgccaggttagcctttcta

SEQ ID NO: 404351 - DNA, 25 bp, Mus musculus
actattccaggatgcgcgacagaca

SEQ ID NO: 404352 - DNA, 25 bp, Mus musculus
actattgaatgcagcgaggtgggcc

SEQ ID NO: 404353 - DNA, 25 bp, Mus musculus
actattgcggcctggagcagtgcca

SEQ ID NO: 404354 - DNA, 25 bp, Mus musculus
actattgggcccatcactgctggaa

SEQ ID NO: 404355 - DNA, 25 bp, Mus musculus
actatttattggtgaacgatctgac

SEQ ID NO: 404356 - DNA, 25 bp, Mus musculus
actatttcctatgggattccatcgg

SEQ ID NO: 404357 - DNA, 25 bp, Mus musculus
actcaaagctcttaaatggcccgtt

SEQ ID NO: 404358 - DNA, 25 bp, Mus musculus
actcaaagttttgtcactctgggca

SEQ ID NO: 404359 - DNA, 25 bp, Mus musculus
actcaacaacaggaacatgagagct

SEQ ID NO: 404360 - DNA, 25 bp, Mus musculus
actcaagacgggtaaaggcggcagc

SEQ ID NO: 404361 - DNA, 25 bp, Mus musculus
actcaatgacatgtgggcggacctg

SEQ ID NO: 404362 - DNA, 25 bp, Mus musculus
actcaatggcctttgttctgggaaa

SEQ ID NO: 404363 - DNA, 25 bp, Mus musculus
actcacaggccacctcagcgagact

SEQ ID NO: 404364 - DNA, 25 bp, Mus musculus
actcaccactggtgtggaacacggg

SEQ ID NO: 404365 - DNA, 25 bp, Mus musculus
actcaccttccgaggtatccaaaga

SEQ ID NO: 404366 - DNA, 25 bp, Mus musculus
actcacgatgcgtagcgggcagtgc

SEQ ID NO: 404367 - DNA, 25 bp, Mus musculus
actcacggcgcgaaggagagaaaca

SEQ ID NO: 404368 - DNA, 25 bp, Mus musculus
actcacttcataggctttaaggaag

SEQ ID NO: 404369 - DNA, 25 bp, Mus musculus
actcacttgctttgcccagcatgga

SEQ ID NO: 404370 - DNA, 25 bp, Mus musculus
actcagaacgagtggaagcaggtcc

SEQ ID NO: 404371 - DNA, 25 bp, Mus musculus
actcagaagagatgtagacggcccg

SEQ ID NO: 404372 - DNA, 25 bp, Mus musculus
actcagaagatagcagcgcctcagg

SEQ ID NO: 404373 - DNA, 25 bp, Mus musculus
actcagaagtaacctagccactttg

SEQ ID NO: 404374 - DNA, 25 bp, Mus musculus
actcagactataccccaaaagccaa

SEQ ID NO: 404375 - DNA, 25 bp, Mus musculus
actcagagtgagtggttgtcggatt

SEQ ID NO: 404376 - DNA, 25 bp, Mus musculus
actcagcgaagtttctgatttcgag

SEQ ID NO: 404377 - DNA, 25 bp, Mus musculus
actcagcttgtgtatcggtatctcg

SEQ ID NO: 404378 - DNA, 25 bp, Mus musculus
actcagggttgctaatggtgctaca

SEQ ID NO: 404379 - DNA, 25 bp, Mus musculus
actcagtcacccagcaaacactagg

SEQ ID NO: 404380 - DNA, 25 bp, Mus musculus
actcataattttgggcgtgatggca

SEQ ID NO: 404381 - DNA, 25 bp, Mus musculus
actcatatccgatgtctggtgtgca

SEQ ID NO: 404382 - DNA, 25 bp, Mus musculus
actcatctggcctggctccagacag

SEQ ID NO: 404383 - DNA, 25 bp, Mus musculus
actcatgcggtggtgtttgcccaac

SEQ ID NO: 404384 - DNA, 25 bp, Mus musculus
actcatgctgccaggctgcacagag

SEQ ID NO: 404385 - DNA, 25 bp, Mus musculus
actccacagattattgtttcttttg

SEQ ID NO: 404386 - DNA, 25 bp, Mus musculus
actccacctccatgtgacgcattga

SEQ ID NO: 404387 - DNA, 25 bp, Mus musculus
actccacgctgaattctaggtaaag

SEQ ID NO: 404388 - DNA, 25 bp, Mus musculus
actccaggaccagagacccagagat

SEQ ID NO: 404389 - DNA, 25 bp, Mus musculus
actccaggagcccaggtagcagtag

SEQ ID NO: 404390 - DNA, 25 bp, Mus musculus
actccagtgagctgaagaccgttct

SEQ ID NO: 404391 - DNA, 25 bp, Mus musculus
actccatagagttgccgaagcgtaa

SEQ ID NO: 404392 - DNA, 25 bp, Mus musculus
actccatgagtgacttcatagaacc

SEQ ID NO: 404393 - DNA, 25 bp, Mus musculus
actccatgtggagaccgtggcggaa

SEQ ID NO: 404394 - DNA, 25 bp, Mus musculus
actccatttacctagaggatactgc

SEQ ID NO: 404395 - DNA, 25 bp, Mus musculus
actcccaccgcgtgtttgtctcagg

SEQ ID NO: 404396 - DNA, 25 bp, Mus musculus
actcccgtgcatccatgtagaggcc

SEQ ID NO: 404397 - DNA, 25 bp, Mus musculus
actccgcggctttggatgagttacc

SEQ ID NO: 404398 - DNA, 25 bp, Mus musculus
actccggatggttggcagaagccct

SEQ ID NO: 404399 - DNA, 25 bp, Mus musculus
actcctacaactcatccaagagcag

SEQ ID NO: 404400 - DNA, 25 bp, Mus musculus
actcctagctaggttgtcggtggac

SEQ ID NO: 404401 - DNA, 25 bp, Mus musculus
actcctgacaacatggcctgctgtg

SEQ ID NO: 404402 - DNA, 25 bp, Mus musculus
actccttcggctttaactcagataa

SEQ ID NO: 404403 - DNA, 25 bp, Mus musculus
actcctttctctgctgagctgtgcg

SEQ ID NO: 404404 - DNA, 25 bp, Mus musculus
actcctttttcactcctgggtattg

SEQ ID NO: 404405 - DNA, 25 bp, Mus musculus
actcgaaagggcgagagacgacgcc

SEQ ID NO: 404406 - DNA, 25 bp, Mus musculus
actcgaggtgcactagcagtgtccc

SEQ ID NO: 404407 - DNA, 25 bp, Mus musculus
actcgcaagcagaggacgccggagt

SEQ ID NO: 404408 - DNA, 25 bp, Mus musculus
actcgcattcgttcttcatatggca

SEQ ID NO: 404409 - DNA, 25 bp, Mus musculus
actcgctggcatgcaccgtggagaa

SEQ ID NO: 404410 - DNA, 25 bp, Mus musculus
actcggtacggcagtccagagggaa

SEQ ID NO: 404411 - DNA, 25 bp, Mus musculus
actcggtagagaccgcggcttccct

SEQ ID NO: 404412 - DNA, 25 bp, Mus musculus
actcgtaggacttttcgtgaactct

SEQ ID NO: 404413 - DNA, 25 bp, Mus musculus
actcgtgagttttcggcagtttccg

SEQ ID NO: 404414 - DNA, 25 bp, Mus musculus
actctagatagccatgtagacatgg

SEQ ID NO: 404415 - DNA, 25 bp, Mus musculus
actctagcttccctaacgatcccag

SEQ ID NO: 404416 - DNA, 25 bp, Mus musculus
actctaggtgtgtgcaggcctggca

SEQ ID NO: 404417 - DNA, 25 bp, Mus musculus
actctcacggaccaggcagacattg

SEQ ID NO: 404418 - DNA, 25 bp, Mus musculus
actctcagcttaggccaacctggac

SEQ ID NO: 404419 - DNA, 25 bp, Mus musculus
actctcctgactcgcacgccgaagg

SEQ ID NO: 404420 - DNA, 25 bp, Mus musculus
actctcgtctgtcttggaaggttca

SEQ ID NO: 404421 - DNA, 25 bp, Mus musculus
actctctctgctgtcatactttttg

SEQ ID NO: 404422 - DNA, 25 bp, Mus musculus
actctcttacctcagctgaccaggg

SEQ ID NO: 404423 - DNA, 25 bp, Mus musculus
actctgaaaagctactaaagaaaat

SEQ ID NO: 404424 - DNA, 25 bp, Mus musculus
actctgaatcctgctagctcgggcg

SEQ ID NO: 404425 - DNA, 25 bp, Mus musculus
actctgagagctacggcggagagaa

SEQ ID NO: 404426 - DNA, 25 bp, Mus musculus
actctgagctgggaagtatatataa

SEQ ID NO: 404427 - DNA, 25 bp, Mus musculus
actctgcgttcacgatggactcggg

SEQ ID NO: 404428 - DNA, 25 bp, Mus musculus
actctgctccatgtcttcaatttat

SEQ ID NO: 404429 - DNA, 25 bp, Mus musculus
actctgctgatgagcagggacccag

SEQ ID NO: 404430 - DNA, 25 bp, Mus musculus
actctgctgggctccatagtgggca

SEQ ID NO: 404431 - DNA, 25 bp, Mus musculus
actctggaaaggtggtatgtggcac

SEQ ID NO: 404432 - DNA, 25 bp, Mus musculus
actctggactaattctgttctctct

SEQ ID NO: 404433 - DNA, 25 bp, Mus musculus
actctgggccccacggctatcatgt

SEQ ID NO: 404434 - DNA, 25 bp, Mus musculus
actctgtagcccctgctaggctgaa

SEQ ID NO: 404435 - DNA, 25 bp, Mus musculus
actctgtcctcactgggcgccgtgt

SEQ ID NO: 404436 - DNA, 25 bp, Mus musculus
actctgtggctgaagggcgtaaccc

SEQ ID NO: 404437 - DNA, 25 bp, Mus musculus
actcttagcgtcagggtatcttgcc

SEQ ID NO: 404438 - DNA, 25 bp, Mus musculus
actcttgacgcatgaaaattaactg

SEQ ID NO: 404439 - DNA, 25 bp, Mus musculus
actcttttctgtggacaggaaaggg

SEQ ID NO: 404440 - DNA, 25 bp, Mus musculus
actcttttgaatggaatcgggctga

SEQ ID NO: 404441 - DNA, 25 bp, Mus musculus
actgaaacaacggattatgctggcc

SEQ ID NO: 404442 - DNA, 25 bp, Mus musculus
actgaaagagattgggccaggctga

SEQ ID NO: 404443 - DNA, 25 bp, Mus musculus
actgaaagccagactcccagcaaga

SEQ ID NO: 404444 - DNA, 25 bp, Mus musculus
actgaaagcctataccaacgtgtga

SEQ ID NO: 404445 - DNA, 25 bp, Mus musculus
actgaaattacccactcgaccacag

SEQ ID NO: 404446 - DNA, 25 bp, Mus musculus
actgaacgccgttccgctcgttgtg

SEQ ID NO: 404447 - DNA, 25 bp, Mus musculus
actgaactcagttagggcaaaccca

SEQ ID NO: 404448 - DNA, 25 bp, Mus musculus
actgaactgcactgagatctcggcg

SEQ ID NO: 404449 - DNA, 25 bp, Mus musculus
actgaagaagacctcaacctccgga

SEQ ID NO: 404450 - DNA, 25 bp, Mus musculus
actgaagatctgtggtggcaacgac

SEQ ID NO: 404451 - DNA, 25 bp, Mus musculus
actgaagccgaggtcgggtgaccct

SEQ ID NO: 404452 - DNA, 25 bp, Mus musculus
actgaagtagaaccgaagtgtctgg

SEQ ID NO: 404453 - DNA, 25 bp, Mus musculus
actgaagtggactgcctgcgtgcct

SEQ ID NO: 404454 - DNA, 25 bp, Mus musculus
actgaattattctagcgaccttggc

SEQ ID NO: 404455 - DNA, 25 bp, Mus musculus
actgacagccttgtatgaacccagg

SEQ ID NO: 404456 - DNA, 25 bp, Mus musculus
actgacagtctgtgcaccctaacaa

SEQ ID NO: 404457 - DNA, 25 bp, Mus musculus
actgaccaaccaccggcagctttgt

SEQ ID NO: 404458 - DNA, 25 bp, Mus musculus
actgaccccacaggagctggatctg

SEQ ID NO: 404459 - DNA, 25 bp, Mus musculus
actgacccctatattgtgacatcgg

SEQ ID NO: 404460 - DNA, 25 bp, Mus musculus
actgacctgttttaaccagaatttg

SEQ ID NO: 404461 - DNA, 25 bp, Mus musculus
actgaccttggtatgcagcactgcc

SEQ ID NO: 404462 - DNA, 25 bp, Mus musculus
actgactaaactcctgctctgcggg

SEQ ID NO: 404463 - DNA, 25 bp, Mus musculus
actgagactctagggcgctgccgga

SEQ ID NO: 404464 - DNA, 25 bp, Mus musculus
actgagagaggatcgcaagcgcttc

SEQ ID NO: 404465 - DNA, 25 bp, Mus musculus
actgagatactgcactgggaaggcc

SEQ ID NO: 404466 - DNA, 25 bp, Mus musculus
actgagatcaaaacgggtagcccca

SEQ ID NO: 404467 - DNA, 25 bp, Mus musculus
actgagatcagacacacaagcccag

SEQ ID NO: 404468 - DNA, 25 bp, Mus musculus
actgagccaaaacaactcccagaaa

SEQ ID NO: 404469 - DNA, 25 bp, Mus musculus
actgagccaccgacctacaggtgga

SEQ ID NO: 404470 - DNA, 25 bp, Mus musculus
actgagccacctgaattacgctgca

SEQ ID NO: 404471 - DNA, 25 bp, Mus musculus
actgagccattatcctctggcactg

SEQ ID NO: 404472 - DNA, 25 bp, Mus musculus
actgagccatttactgagttaatga

SEQ ID NO: 404473 - DNA, 25 bp, Mus musculus
actgagcgaccaggtaacatcggcc

SEQ ID NO: 404474 - DNA, 25 bp, Mus musculus
actgagcgaggcgaggtaactaact

SEQ ID NO: 404475 - DNA, 25 bp, Mus musculus
actgaggactccgatcgagacgtct

SEQ ID NO: 404476 - DNA, 25 bp, Mus musculus
actgaggagatctcggacggagcct

SEQ ID NO: 404477 - DNA, 25 bp, Mus musculus
actgaggatggctgacctactatac

SEQ ID NO: 404478 - DNA, 25 bp, Mus musculus
actgaggccgacactttccacctgg

SEQ ID NO: 404479 - DNA, 25 bp, Mus musculus
actgaggcgacatccctggagagca

SEQ ID NO: 404480 - DNA, 25 bp, Mus musculus
actgagggcaatgatgtaagtgcct

SEQ ID NO: 404481 - DNA, 25 bp, Mus musculus
actgagggcgagagagaagccattc

SEQ ID NO: 404482 - DNA, 25 bp, Mus musculus
actgaggtctgggacttcctgcgac

SEQ ID NO: 404483 - DNA, 25 bp, Mus musculus
actgagtccagctgacccagctggt

SEQ ID NO: 404484 - DNA, 25 bp, Mus musculus
actgagtggacccaagaagaagcca

SEQ ID NO: 404485 - DNA, 25 bp, Mus musculus
actgagtgtagagaatgtcccctgc

SEQ ID NO: 404486 - DNA, 25 bp, Mus musculus
actgatgtgttcctgttcctgtggg

SEQ ID NO: 404487 - DNA, 25 bp, Mus musculus
actgattaggcgacggctggtgacc

SEQ ID NO: 404488 - DNA, 25 bp, Mus musculus
actgattctcagagcggccccgagt

SEQ ID NO: 404489 - DNA, 25 bp, Mus musculus
actgattgcgtttggctttgcttgg

SEQ ID NO: 404490 - DNA, 25 bp, Mus musculus
actgcaagatgaagccagcattctc

SEQ ID NO: 404491 - DNA, 25 bp, Mus musculus
actgcaagcctctcatatattctac

SEQ ID NO: 404492 - DNA, 25 bp, Mus musculus
actgcaatatccaagacgacgccgg

SEQ ID NO: 404493 - DNA, 25 bp, Mus musculus
actgcactggaagggacaatggagc

SEQ ID NO: 404494 - DNA, 25 bp, Mus musculus
actgcactgggtgtttgggttccca

SEQ ID NO: 404495 - DNA, 25 bp, Mus musculus
actgcagccaggcacaggctctcta

SEQ ID NO: 404496 - DNA, 25 bp, Mus musculus
actgcagctgcaatccaagagggcc

SEQ ID NO: 404497 - DNA, 25 bp, Mus musculus
actgcaggactactttgcagccaag

SEQ ID NO: 404498 - DNA, 25 bp, Mus musculus
actgcagtcggctgagggtagcacc

SEQ ID NO: 404499 - DNA, 25 bp, Mus musculus
actgcagtgtctaccacagctctct

SEQ ID NO: 404500 - DNA, 25 bp, Mus musculus
actgcatagtgcgagtaggcctggc

SEQ ID NO: 404501 - DNA, 25 bp, Mus musculus
actgcatttgttgttgatgaagtga

SEQ ID NO: 404502 - DNA, 25 bp, Mus musculus
actgccccagcctctaaagagagag

SEQ ID NO: 404503 - DNA, 25 bp, Mus musculus
actgccctgatgctttcctgacagg

SEQ ID NO: 404504 - DNA, 25 bp, Mus musculus
actgcctaaggaatggagccaaacc

SEQ ID NO: 404505 - DNA, 25 bp, Mus musculus
actgcctgctgcgtggccaacaggg

SEQ ID NO: 404506 - DNA, 25 bp, Mus musculus
actgcgaaagtatgatggtgaaaag

SEQ ID NO: 404507 - DNA, 25 bp, Mus musculus
actgcgaccatggacggacctgatg

SEQ ID NO: 404508 - DNA, 25 bp, Mus musculus
actgcgctgcagagcatccgctatg

SEQ ID NO: 404509 - DNA, 25 bp, Mus musculus
actgcgggctgcgagagaagtcacc

SEQ ID NO: 404510 - DNA, 25 bp, Mus musculus
actgcggtcaatggaacggtgccgc

SEQ ID NO: 404511 - DNA, 25 bp, Mus musculus
actgcgtctgccgtagccaaaggtc

SEQ ID NO: 404512 - DNA, 25 bp, Mus musculus
actgcgtggagctgttcatggatga

SEQ ID NO: 404513 - DNA, 25 bp, Mus musculus
actgctaggcgcgtcttggagctgc

SEQ ID NO: 404514 - DNA, 25 bp, Mus musculus
actgctagggacaccgactgaggaa

SEQ ID NO: 404515 - DNA, 25 bp, Mus musculus
actgctatgcggattttggcggaca

SEQ ID NO: 404516 - DNA, 25 bp, Mus musculus
actgctcatctgtaaacgccgcggg

SEQ ID NO: 404517 - DNA, 25 bp, Mus musculus
actgctcggtgggtgagatctaacc

SEQ ID NO: 404518 - DNA, 25 bp, Mus musculus
actgctctgctctttactatcctaa

SEQ ID NO: 404519 - DNA, 25 bp, Mus musculus
actgctgaaactgggcgctgtgctc

SEQ ID NO: 404520 - DNA, 25 bp, Mus musculus
actgctgcagctggcgttgggcatc

SEQ ID NO: 404521 - DNA, 25 bp, Mus musculus
actgctggccggaccaggctgcgta

SEQ ID NO: 404522 - DNA, 25 bp, Mus musculus
actgctgggacccttgggactgcaa

SEQ ID NO: 404523 - DNA, 25 bp, Mus musculus
actgctgtgcttctcaggtctgtac

SEQ ID NO: 404524 - DNA, 25 bp, Mus musculus
actgctgtgtaaaacctgggccgga

SEQ ID NO: 404525 - DNA, 25 bp, Mus musculus
actgctgttaggcaagaggaaagaa

SEQ ID NO: 404526 - DNA, 25 bp, Mus musculus
actgctgttccaccacggtaggctg

SEQ ID NO: 404527 - DNA, 25 bp, Mus musculus
actgcttccccgaaagctggagaag

SEQ ID NO: 404528 - DNA, 25 bp, Mus musculus
actggaaactctacataagatagac

SEQ ID NO: 404529 - DNA, 25 bp, Mus musculus
actggaaccctggatctgaagttac

SEQ ID NO: 404530 - DNA, 25 bp, Mus musculus
actggaactgcctctaatcatgtag

SEQ ID NO: 404531 - DNA, 25 bp, Mus musculus
actggaactggagtttaaagatagt

SEQ ID NO: 404532 - DNA, 25 bp, Mus musculus
actggaagcaggagtgctcctgtct

SEQ ID NO: 404533 - DNA, 25 bp, Mus musculus
actggaagccgagcacctttggagg

SEQ ID NO: 404534 - DNA, 25 bp, Mus musculus
actggaaggtccttgcctcagcgcg

SEQ ID NO: 404535 - DNA, 25 bp, Mus musculus
actggaatctcctgactttaccagg

SEQ ID NO: 404536 - DNA, 25 bp, Mus musculus
actggaatgcaaggtacagctctgc

SEQ ID NO: 404537 - DNA, 25 bp, Mus musculus
actggaatgtccctatgcccctgaa

SEQ ID NO: 404538 - DNA, 25 bp, Mus musculus
actggacaaagtgatgggccctctc

SEQ ID NO: 404539 - DNA, 25 bp, Mus musculus
actggacatctagcacagccctggg

SEQ ID NO: 404540 - DNA, 25 bp, Mus musculus
actggaccaaggttgggcctctggc

SEQ ID NO: 404541 - DNA, 25 bp, Mus musculus
actggacctcccaatgcgggcaaga

SEQ ID NO: 404542 - DNA, 25 bp, Mus musculus
actggactatgaacttggaccgcta

SEQ ID NO: 404543 - DNA, 25 bp, Mus musculus
actggactcgcttgggaaacgggca

SEQ ID NO: 404544 - DNA, 25 bp, Mus musculus
actggactcttttgcagcgccgggc

SEQ ID NO: 404545 - DNA, 25 bp, Mus musculus
actggagacggaacgcgaggcttcc

SEQ ID NO: 404546 - DNA, 25 bp, Mus musculus
actggagactggttttcggagcaca

SEQ ID NO: 404547 - DNA, 25 bp, Mus musculus
actggagaggaacaaagactgtcca

SEQ ID NO: 404548 - DNA, 25 bp, Mus musculus
actggagcagataaacgattcaacc

SEQ ID NO: 404549 - DNA, 25 bp, Mus musculus
actggagccatttatagtatgtgtg

SEQ ID NO: 404550 - DNA, 25 bp, Mus musculus
actggagctaaagaggactgtgcgc

SEQ ID NO: 404551 - DNA, 25 bp, Mus musculus
actggagctagctgctctctcttca

SEQ ID NO: 404552 - DNA, 25 bp, Mus musculus
actggagggccaccctcaagaccat

SEQ ID NO: 404553 - DNA, 25 bp, Mus musculus
actggaggttcgctcgctcagacga

SEQ ID NO: 404554 - DNA, 25 bp, Mus musculus
actggagtggactgagtgacaacca

SEQ ID NO: 404555 - DNA, 25 bp, Mus musculus
actggcaaggccttggcaggtcttg

SEQ ID NO: 404556 - DNA, 25 bp, Mus musculus
actggcagaagccacctctcaacag

SEQ ID NO: 404557 - DNA, 25 bp, Mus musculus
actggcagcactactctcggaagcg

SEQ ID NO: 404558 - DNA, 25 bp, Mus musculus
actggccaagtcaccgttgaggctg

SEQ ID NO: 404559 - DNA, 25 bp, Mus musculus
actggccaccgttgtacggcttcga

SEQ ID NO: 404560 - DNA, 25 bp, Mus musculus
actggccatggcctgcaaactggga

SEQ ID NO: 404561 - DNA, 25 bp, Mus musculus
actggcccagacgtcgaggatgccg

SEQ ID NO: 404562 - DNA, 25 bp, Mus musculus
actggccgggatcaacatgtgtctg

SEQ ID NO: 404563 - DNA, 25 bp, Mus musculus
actggcctcgtgcttgggattaaac

SEQ ID NO: 404564 - DNA, 25 bp, Mus musculus
actggcctctgtagacctctgcttg

SEQ ID NO: 404565 - DNA, 25 bp, Mus musculus
actggcgctgctggactaacaaagg

SEQ ID NO: 404566 - DNA, 25 bp, Mus musculus
actggcggccaggtacatcgacttc

SEQ ID NO: 404567 - DNA, 25 bp, Mus musculus
actggcggcggaagctcaagacagc

SEQ ID NO: 404568 - DNA, 25 bp, Mus musculus
actggctcctgctatgggtgggctc

SEQ ID NO: 404569 - DNA, 25 bp, Mus musculus
actggctggaacatatgggctgaat

SEQ ID NO: 404570 - DNA, 25 bp, Mus musculus
actggctggagtgtccgtcaggtca

SEQ ID NO: 404571 - DNA, 25 bp, Mus musculus
actggctgggtgtcagaaattggcc

SEQ ID NO: 404572 - DNA, 25 bp, Mus musculus
actggcttggcatcttctggtcgac

SEQ ID NO: 404573 - DNA, 25 bp, Mus musculus
actgggaaccctcttgcccagagga

SEQ ID NO: 404574 - DNA, 25 bp, Mus musculus
actgggagcgtcgtacatgaagaca

SEQ ID NO: 404575 - DNA, 25 bp, Mus musculus
actgggatccagactccactggaac

SEQ ID NO: 404576 - DNA, 25 bp, Mus musculus
actgggcagatctacctttacacta

SEQ ID NO: 404577 - DNA, 25 bp, Mus musculus
actgggcagccgagcagggacatct

SEQ ID NO: 404578 - DNA, 25 bp, Mus musculus
actgggcgtcctacaccctgggtgt

SEQ ID NO: 404579 - DNA, 25 bp, Mus musculus
actgggctcctaggcgactgaagac

SEQ ID NO: 404580 - DNA, 25 bp, Mus musculus
actgggctgaaggagggacttcaaa

SEQ ID NO: 404581 - DNA, 25 bp, Mus musculus
actgggtaagagagactgcaagcta

SEQ ID NO: 404582 - DNA, 25 bp, Mus musculus
actgggtctgcaagaatgtcaacgc

SEQ ID NO: 404583 - DNA, 25 bp, Mus musculus
actgggtgcagagagggttcatttc

SEQ ID NO: 404584 - DNA, 25 bp, Mus musculus
actggtacagaagagagacttcctg

SEQ ID NO: 404585 - DNA, 25 bp, Mus musculus
actggtagcgcaggcttgtcacgcc

SEQ ID NO: 404586 - DNA, 25 bp, Mus musculus
actggtcagggcttggaatgtagct

SEQ ID NO: 404587 - DNA, 25 bp, Mus musculus
actggtcattacgagtgcgctgagc

SEQ ID NO: 404588 - DNA, 25 bp, Mus musculus
actggtgaccagctctctgtgcagc

SEQ ID NO: 404589 - DNA, 25 bp, Mus musculus
actggtgctagtggtatgtgacaac

SEQ ID NO: 404590 - DNA, 25 bp, Mus musculus
actggtgtgcggtatgtttgaagac

SEQ ID NO: 404591 - DNA, 25 bp, Mus musculus
actggttggaccagggactgatgta

SEQ ID NO: 404592 - DNA, 25 bp, Mus musculus
actgtaaagcgcaaggagggtcctc

SEQ ID NO: 404593 - DNA, 25 bp, Mus musculus
actgtaaccatgctatgccaagagc

SEQ ID NO: 404594 - DNA, 25 bp, Mus musculus
actgtaagctccacaagggcaagaa

SEQ ID NO: 404595 - DNA, 25 bp, Mus musculus
actgtacctctggatgcccgggatg

SEQ ID NO: 404596 - DNA, 25 bp, Mus musculus
actgtaccttcatttctaccactgg

SEQ ID NO: 404597 - DNA, 25 bp, Mus musculus
actgtagctacacaccctcgagagg

SEQ ID NO: 404598 - DNA, 25 bp, Mus musculus
actgtaggaagtgccgctggagaaa

SEQ ID NO: 404599 - DNA, 25 bp, Mus musculus
actgtagggagctttcccattggga

SEQ ID NO: 404600 - DNA, 25 bp, Mus musculus
actgtatctagagctgcgggtctcc

SEQ ID NO: 404601 - DNA, 25 bp, Mus musculus
actgtatggatcctgcagtgatcgc

SEQ ID NO: 404602 - DNA, 25 bp, Mus musculus
actgtcacacagtatttattgttcc

SEQ ID NO: 404603 - DNA, 25 bp, Mus musculus
actgtcatggaacgaagatggcacc

SEQ ID NO: 404604 - DNA, 25 bp, Mus musculus
actgtcccatggctagagaaccgcg

SEQ ID NO: 404605 - DNA, 25 bp, Mus musculus
actgtccccatagatcttctcgcca

SEQ ID NO: 404606 - DNA, 25 bp, Mus musculus
actgtcgcccagctcgggacttgga

SEQ ID NO: 404607 - DNA, 25 bp, Mus musculus
actgtcggataaaggagctgggaac

SEQ ID NO: 404608 - DNA, 25 bp, Mus musculus
actgtcgggctcaactttctatggc

SEQ ID NO: 404609 - DNA, 25 bp, Mus musculus
actgtcgtggatctggcccagctga

SEQ ID NO: 404610 - DNA, 25 bp, Mus musculus
actgtctgctggctggtagcgtcac

SEQ ID NO: 404611 - DNA, 25 bp, Mus musculus
actgtctggaccactccccattgat

SEQ ID NO: 404612 - DNA, 25 bp, Mus musculus
actgtcttcatgaagtgggagttgc

SEQ ID NO: 404613 - DNA, 25 bp, Mus musculus
actgtcttcattcggcacttcctca

SEQ ID NO: 404614 - DNA, 25 bp, Mus musculus
actgtcttcggaagtgagctgcccg

SEQ ID NO: 404615 - DNA, 25 bp, Mus musculus
actgtcttttgggatgccacagcga

SEQ ID NO: 404616 - DNA, 25 bp, Mus musculus
actgtgaaactacagatttgggaca

SEQ ID NO: 404617 - DNA, 25 bp, Mus musculus
actgtgaagggagggccgcgtagac

SEQ ID NO: 404618 - DNA, 25 bp, Mus musculus
actgtgagaagcaagaagggtaagc

SEQ ID NO: 404619 - DNA, 25 bp, Mus musculus
actgtgatgcccacgcttgtgagga

SEQ ID NO: 404620 - DNA, 25 bp, Mus musculus
actgtgccaggtataatttcatttg

SEQ ID NO: 404621 - DNA, 25 bp, Mus musculus
actgtgccgcaagacccaaatcaaa

SEQ ID NO: 404622 - DNA, 25 bp, Mus musculus
actgtgcctggaactagctgctgcc

SEQ ID NO: 404623 - DNA, 25 bp, Mus musculus
actgtggaagctgaagtcattgcgg

SEQ ID NO: 404624 - DNA, 25 bp, Mus musculus
actgtggagcacaatgacgaacttc

SEQ ID NO: 404625 - DNA, 25 bp, Mus musculus
actgtgggaaacatagtctacattt

SEQ ID NO: 404626 - DNA, 25 bp, Mus musculus
actgtggtccaaggtacgagctctg

SEQ ID NO: 404627 - DNA, 25 bp, Mus musculus
actgtggtggatcataaagggcccc

SEQ ID NO: 404628 - DNA, 25 bp, Mus musculus
actgtgtgatgcacgacctgcggaa

SEQ ID NO: 404629 - DNA, 25 bp, Mus musculus
actgtgtggctcattaggactggaa

SEQ ID NO: 404630 - DNA, 25 bp, Mus musculus
actgtgtggtagctgatccccggaa

SEQ ID NO: 404631 - DNA, 25 bp, Mus musculus
actgtgttcatactgtccagtcagc

SEQ ID NO: 404632 - DNA, 25 bp, Mus musculus
actgttaatcacgaggctactgctg

SEQ ID NO: 404633 - DNA, 25 bp, Mus musculus
actgttaatggtcgtggctgctccc

SEQ ID NO: 404634 - DNA, 25 bp, Mus musculus
actgttagaaggttgagagactggc

SEQ ID NO: 404635 - DNA, 25 bp, Mus musculus
actgttatgaactgatgccaagccc

SEQ ID NO: 404636 - DNA, 25 bp, Mus musculus
actgttcagcttctaagtccatttg

SEQ ID NO: 404637 - DNA, 25 bp, Mus musculus
actgttccttacagagacctgtggg

SEQ ID NO: 404638 - DNA, 25 bp, Mus musculus
actgttgccgccttctctcgtggat

SEQ ID NO: 404639 - DNA, 25 bp, Mus musculus
actgttgctcttcagggctgtctgg

SEQ ID NO: 404640 - DNA, 25 bp, Mus musculus
actgtttccagagacgccaggagga

SEQ ID NO: 404641 - DNA, 25 bp, Mus musculus
actgtttggctctgccataggagga

SEQ ID NO: 404642 - DNA, 25 bp, Mus musculus
acttaaagagagtgcgggaagctgc

SEQ ID NO: 404643 - DNA, 25 bp, Mus musculus
acttaaagccatcgctacacctgag

SEQ ID NO: 404644 - DNA, 25 bp, Mus musculus
acttaactccaaagggactgtgcgg

SEQ ID NO: 404645 - DNA, 25 bp, Mus musculus
acttaactctggttaaaggtgtgca

SEQ ID NO: 404646 - DNA, 25 bp, Mus musculus
acttaagccaggtgtattgaattta

SEQ ID NO: 404647 - DNA, 25 bp, Mus musculus
acttaagggtctccgcgaggtacag

SEQ ID NO: 404648 - DNA, 25 bp, Mus musculus
acttaatgcaagctgaaaggacttc

SEQ ID NO: 404649 - DNA, 25 bp, Mus musculus
acttacaattgcgaaagggcgagga

SEQ ID NO: 404650 - DNA, 25 bp, Mus musculus
acttacacggccacactctgctgag

SEQ ID NO: 404651 - DNA, 25 bp, Mus musculus
acttacagctacaacgtggagggcg

SEQ ID NO: 404652 - DNA, 25 bp, Mus musculus
acttacctgactccggtgggtgtca

SEQ ID NO: 404653 - DNA, 25 bp, Mus musculus
acttagactgtcagagactcccctc

SEQ ID NO: 404654 - DNA, 25 bp, Mus musculus
acttagagagcttcgtccatttggg

SEQ ID NO: 404655 - DNA, 25 bp, Mus musculus
acttagataactgagccgtgtggca

SEQ ID NO: 404656 - DNA, 25 bp, Mus musculus
acttagcaaaaaggctgctggtggg

SEQ ID NO: 404657 - DNA, 25 bp, Mus musculus
acttagcttcggtgaggtggacttc

SEQ ID NO: 404658 - DNA, 25 bp, Mus musculus
acttagtaggcgtcagtggcaccac

SEQ ID NO: 404659 - DNA, 25 bp, Mus musculus
acttagtttgaacctgaagtaccag

SEQ ID NO: 404660 - DNA, 25 bp, Mus musculus
acttatactggagcctggaacagcc

SEQ ID NO: 404661 - DNA, 25 bp, Mus musculus
acttatcaagttcgagacagccaga

SEQ ID NO: 404662 - DNA, 25 bp, Mus musculus
acttatgggaaaacagcagaaagca

SEQ ID NO: 404663 - DNA, 25 bp, Mus musculus
acttattgatgggtgctgcctggcc

SEQ ID NO: 404664 - DNA, 25 bp, Mus musculus
acttcaaggcatacgagcaggcgct

SEQ ID NO: 404665 - DNA, 25 bp, Mus musculus
acttcaatattgttcgtgggccacc

SEQ ID NO: 404666 - DNA, 25 bp, Mus musculus
acttcacagctagagatggcactgg

SEQ ID NO: 404667 - DNA, 25 bp, Mus musculus
acttcactgggcaacctgtctgacc

SEQ ID NO: 404668 - DNA, 25 bp, Mus musculus
acttcagccaggcactaactgagct

SEQ ID NO: 404669 - DNA, 25 bp, Mus musculus
acttcagtgggctcggtggcaacac

SEQ ID NO: 404670 - DNA, 25 bp, Mus musculus
acttcataatgtggcgggctgtcca

SEQ ID NO: 404671 - DNA, 25 bp, Mus musculus
acttcatagtatgatcctgttttgg

SEQ ID NO: 404672 - DNA, 25 bp, Mus musculus
acttccaaacaagccatagggatgc

SEQ ID NO: 404673 - DNA, 25 bp, Mus musculus
acttccaggaacaggcggctactca

SEQ ID NO: 404674 - DNA, 25 bp, Mus musculus
acttccgagaagctgcggaggcaca

SEQ ID NO: 404675 - DNA, 25 bp, Mus musculus
acttcctacgtgcaaagtgtctcag

SEQ ID NO: 404676 - DNA, 25 bp, Mus musculus
acttcctgaaggtcgctgctgagca

SEQ ID NO: 404677 - DNA, 25 bp, Mus musculus
acttcgaacaccatcacatcactgg

SEQ ID NO: 404678 - DNA, 25 bp, Mus musculus
acttcgaggacgatcgctccgacag

SEQ ID NO: 404679 - DNA, 25 bp, Mus musculus
acttcgagtcccctggagcgccgtg

SEQ ID NO: 404680 - DNA, 25 bp, Mus musculus
acttcgagtggcaaagggctatccc

SEQ ID NO: 404681 - DNA, 25 bp, Mus musculus
acttcgatggcagaggagacggacc

SEQ ID NO: 404682 - DNA, 25 bp, Mus musculus
acttcgcagaggcagacaatcaggg

SEQ ID NO: 404683 - DNA, 25 bp, Mus musculus
acttcgtgcaggttatgggctgagc

SEQ ID NO: 404684 - DNA, 25 bp, Mus musculus
acttcgtgcgggacatgccatggct

SEQ ID NO: 404685 - DNA, 25 bp, Mus musculus
acttctaataaccacagatgctgta

SEQ ID NO: 404686 - DNA, 25 bp, Mus musculus
acttctccgagcagcagtgaccatg

SEQ ID NO: 404687 - DNA, 25 bp, Mus musculus
acttctctacccgtccaggctgggc

SEQ ID NO: 404688 - DNA, 25 bp, Mus musculus
acttctgaaggcgaactgggttgga

SEQ ID NO: 404689 - DNA, 25 bp, Mus musculus
acttctgaagttgtacctgatgtca

SEQ ID NO: 404690 - DNA, 25 bp, Mus musculus
acttctgaataagtgaacctttgaa

SEQ ID NO: 404691 - DNA, 25 bp, Mus musculus
acttctgcctcttaaggagacctca

SEQ ID NO: 404692 - DNA, 25 bp, Mus musculus
acttctgctaagtccatgggtcttg

SEQ ID NO: 404693 - DNA, 25 bp, Mus musculus
acttctgctgcaaagagtcggccca

SEQ ID NO: 404694 - DNA, 25 bp, Mus musculus
acttctggagggagagtggcacaca

SEQ ID NO: 404695 - DNA, 25 bp, Mus musculus
acttctggctgctaagaaataggcc

SEQ ID NO: 404696 - DNA, 25 bp, Mus musculus
acttctgggctgctaatgtgcctcc

SEQ ID NO: 404697 - DNA, 25 bp, Mus musculus
acttcttaacccagctccaggagct

SEQ ID NO: 404698 - DNA, 25 bp, Mus musculus
acttcttgagagctctctatgaagc

SEQ ID NO: 404699 - DNA, 25 bp, Mus musculus
acttgaagctcggacataccacgcg

SEQ ID NO: 404700 - DNA, 25 bp, Mus musculus
acttgaatacagtagaggttctagg

SEQ ID NO: 404701 - DNA, 25 bp, Mus musculus
acttgaatatttgccaagtatgtga

SEQ ID NO: 404702 - DNA, 25 bp, Mus musculus
acttgaatgattccgggtgtgccac

SEQ ID NO: 404703 - DNA, 25 bp, Mus musculus
acttgacacaagctttggtgaagaa

SEQ ID NO: 404704 - DNA, 25 bp, Mus musculus
acttgacagagggaagacacttgcc

SEQ ID NO: 404705 - DNA, 25 bp, Mus musculus
acttgaggctttctactgggacaca

SEQ ID NO: 404706 - DNA, 25 bp, Mus musculus
acttgagtgccagccctgtcatgga

SEQ ID NO: 404707 - DNA, 25 bp, Mus musculus
acttgagtgcctcccctgtcgtgga

SEQ ID NO: 404708 - DNA, 25 bp, Mus musculus
acttgatggccacggagggcctggc

SEQ ID NO: 404709 - DNA, 25 bp, Mus musculus
acttgcacgagagcagtgggatcca

SEQ ID NO: 404710 - DNA, 25 bp, Mus musculus
acttgcacttttcatagttactata

SEQ ID NO: 404711 - DNA, 25 bp, Mus musculus
acttgcagctccaggaagggttgcc

SEQ ID NO: 404712 - DNA, 25 bp, Mus musculus
acttgcaggcaagttccaacctctg

SEQ ID NO: 404713 - DNA, 25 bp, Mus musculus
acttgcatctcacgatccagtgtga

SEQ ID NO: 404714 - DNA, 25 bp, Mus musculus
acttgccctgtgccacctcagagtt

SEQ ID NO: 404715 - DNA, 25 bp, Mus musculus
acttgccgtgaagtgtggattccgg

SEQ ID NO: 404716 - DNA, 25 bp, Mus musculus
acttgcggcgccattgtaacatcca

SEQ ID NO: 404717 - DNA, 25 bp, Mus musculus
acttgctgccgagaacattggctgg

SEQ ID NO: 404718 - DNA, 25 bp, Mus musculus
acttgcttctgaacacaataaatct

SEQ ID NO: 404719 - DNA, 25 bp, Mus musculus
acttggaatcctggggtcacccaga

SEQ ID NO: 404720 - DNA, 25 bp, Mus musculus
acttggacaatcaccccaggaggca

SEQ ID NO: 404721 - DNA, 25 bp, Mus musculus
acttggacggtaagatgaccttggc

SEQ ID NO: 404722 - DNA, 25 bp, Mus musculus
acttggactgtttcccagcgaggca

SEQ ID NO: 404723 - DNA, 25 bp, Mus musculus
acttggagaggtgactgtggtcatc

SEQ ID NO: 404724 - DNA, 25 bp, Mus musculus
acttggaggaagacaggtggactca

SEQ ID NO: 404725 - DNA, 25 bp, Mus musculus
acttggaggcccatggtttctgacc

SEQ ID NO: 404726 - DNA, 25 bp, Mus musculus
acttggcatccaagatacgatgggc

SEQ ID NO: 404727 - DNA, 25 bp, Mus musculus
acttggcgtctagggaaaagagagc

SEQ ID NO: 404728 - DNA, 25 bp, Mus musculus
acttggctgaaatgaatgagtttga

SEQ ID NO: 404729 - DNA, 25 bp, Mus musculus
acttgggagcactccctgagggttc

SEQ ID NO: 404730 - DNA, 25 bp, Mus musculus
acttgggtaatttctgcctggctgg

SEQ ID NO: 404731 - DNA, 25 bp, Mus musculus
acttgggtatagctgcagccctggc

SEQ ID NO: 404732 - DNA, 25 bp, Mus musculus
acttgggtgtccaaatgacaggcgc

SEQ ID NO: 404733 - DNA, 25 bp, Mus musculus
acttggtcacggcactgtcagtggt

SEQ ID NO: 404734 - DNA, 25 bp, Mus musculus
acttggtcaggtgcgcgctgagatt

SEQ ID NO: 404735 - DNA, 25 bp, Mus musculus
acttggtggtgatctagtggtgcca

SEQ ID NO: 404736 - DNA, 25 bp, Mus musculus
acttggtgtctcgtgcaatttcaga

SEQ ID NO: 404737 - DNA, 25 bp, Mus musculus
acttggttggatgacagactgtaac

SEQ ID NO: 404738 - DNA, 25 bp, Mus musculus
acttgtagatgccttgaccgtccag

SEQ ID NO: 404739 - DNA, 25 bp, Mus musculus
acttgtcacacaagcatatcccttg

SEQ ID NO: 404740 - DNA, 25 bp, Mus musculus
acttgtccggcttccgcgagtgcct

SEQ ID NO: 404741 - DNA, 25 bp, Mus musculus
acttgtcctggacggtggctcgcct

SEQ ID NO: 404742 - DNA, 25 bp, Mus musculus
acttgtgtcctgcacccagtatggg

SEQ ID NO: 404743 - DNA, 25 bp, Mus musculus
acttgtgtgcctgtggatgcaaccc

SEQ ID NO: 404744 - DNA, 25 bp, Mus musculus
acttgtttatctggctgcggtggga

SEQ ID NO: 404745 - DNA, 25 bp, Mus musculus
actttaacagtccatagcaccgcgg

SEQ ID NO: 404746 - DNA, 25 bp, Mus musculus
actttaacatcggttcagagttcgg

SEQ ID NO: 404747 - DNA, 25 bp, Mus musculus
actttaagcaacagcagccagtcag

SEQ ID NO: 404748 - DNA, 25 bp, Mus musculus
actttagaagtagagatgtccctcc

SEQ ID NO: 404749 - DNA, 25 bp, Mus musculus
actttagacaaaccattcaggagaa

SEQ ID NO: 404750 - DNA, 25 bp, Mus musculus
actttattgcatgtatttgtgtggg

SEQ ID NO: 404751 - DNA, 25 bp, Mus musculus
actttcaaggtcgatgttgagggcg

SEQ ID NO: 404752 - DNA, 25 bp, Mus musculus
actttcaggtcatcaaacttggcgg

SEQ ID NO: 404753 - DNA, 25 bp, Mus musculus
actttccaggagagatgttagtacc

SEQ ID NO: 404754 - DNA, 25 bp, Mus musculus
actttcctcccgagagtgctggccg

SEQ ID NO: 404755 - DNA, 25 bp, Mus musculus
actttcctctccctgtctagctgag

SEQ ID NO: 404756 - DNA, 25 bp, Mus musculus
actttcgttcgtggatcagctctgg

SEQ ID NO: 404757 - DNA, 25 bp, Mus musculus
actttctagcttatgaacttggagg

SEQ ID NO: 404758 - DNA, 25 bp, Mus musculus
actttctatggctcccttgtgtctg

SEQ ID NO: 404759 - DNA, 25 bp, Mus musculus
actttctggctcgaggcacctggag

SEQ ID NO: 404760 - DNA, 25 bp, Mus musculus
actttgaaaagctgcggctgacatt

SEQ ID NO: 404761 - DNA, 25 bp, Mus musculus
actttgacaagtgaggccctagcca

SEQ ID NO: 404762 - DNA, 25 bp, Mus musculus
actttgacgccttctaccaggcgca

SEQ ID NO: 404763 - DNA, 25 bp, Mus musculus
actttgagcttgatgtcctggagga

SEQ ID NO: 404764 - DNA, 25 bp, Mus musculus
actttgcagcagaatagggatggtc

SEQ ID NO: 404765 - DNA, 25 bp, Mus musculus
actttgctgaggcagacgacccttc

SEQ ID NO: 404766 - DNA, 25 bp, Mus musculus
actttgctgtggtctaggctttgcc

SEQ ID NO: 404767 - DNA, 25 bp, Mus musculus
actttggagctcagcattttctggg

SEQ ID NO: 404768 - DNA, 25 bp, Mus musculus
actttggctcggcacatctccaggg

SEQ ID NO: 404769 - DNA, 25 bp, Mus musculus
actttggtcatttcagcctagctcc

SEQ ID NO: 404770 - DNA, 25 bp, Mus musculus
actttgtcacggcagacaccttcca

SEQ ID NO: 404771 - DNA, 25 bp, Mus musculus
actttgtttctcttgtaattagcac

SEQ ID NO: 404772 - DNA, 25 bp, Mus musculus
acttttagaaagatatgtcttgcac

SEQ ID NO: 404773 - DNA, 25 bp, Mus musculus
acttttcacagattgaattgcgcat

SEQ ID NO: 404774 - DNA, 25 bp, Mus musculus
acttttctcctaagaagtgatctgc

SEQ ID NO: 404775 - DNA, 25 bp, Mus musculus
acttttgcatagtgacaattgtggc

SEQ ID NO: 404776 - DNA, 25 bp, Mus musculus
acttttgccgtctatcaggtcttac

SEQ ID NO: 404777 - DNA, 25 bp, Mus musculus
actttttagcgaacatgtgatgacc

SEQ ID NO: 404778 - DNA, 25 bp, Mus musculus
agaaaaaagccttggcctgccggag

SEQ ID NO: 404779 - DNA, 25 bp, Mus musculus
agaaaaatgcctcggtgtgggatcc

SEQ ID NO: 404780 - DNA, 25 bp, Mus musculus
agaaaacctttgtgctggcgcccag

SEQ ID NO: 404781 - DNA, 25 bp, Mus musculus
agaaaacgaagtcctcagagttcca

SEQ ID NO: 404782 - DNA, 25 bp, Mus musculus
agaaaacgcaatgcggacaaccacc

SEQ ID NO: 404783 - DNA, 25 bp, Mus musculus
agaaaacggaactcacggcagacca

SEQ ID NO: 404784 - DNA, 25 bp, Mus musculus
agaaaactccactgtcagttctccc

SEQ ID NO: 404785 - DNA, 25 bp, Mus musculus
agaaaactgtccgttccacctctgg

SEQ ID NO: 404786 - DNA, 25 bp, Mus musculus
agaaaagcgcttggctctccccaaa

SEQ ID NO: 404787 - DNA, 25 bp, Mus musculus
agaaaagggcagaaaaggcgatgcc

SEQ ID NO: 404788 - DNA, 25 bp, Mus musculus
agaaaatattcctaccccggcgctg

SEQ ID NO: 404789 - DNA, 25 bp, Mus musculus
agaaaatcctttgccagtcacaccg

SEQ ID NO: 404790 - DNA, 25 bp, Mus musculus
agaaaatgctgagccggatctcgat

SEQ ID NO: 404791 - DNA, 25 bp, Mus musculus
agaaaatgtgaaaaggcctctgccc

SEQ ID NO: 404792 - DNA, 25 bp, Mus musculus
agaaacaaaagcacccgccatcagc

SEQ ID NO: 404793 - DNA, 25 bp, Mus musculus
agaaacaaaagccatcgaaagccgg

SEQ ID NO: 404794 - DNA, 25 bp, Mus musculus
agaaacacattctggtgctgagcga

SEQ ID NO: 404795 - DNA, 25 bp, Mus musculus
agaaacagctgcaaagaggccccgt

SEQ ID NO: 404796 - DNA, 25 bp, Mus musculus
agaaacagtcccagaagcagtgcgc

SEQ ID NO: 404797 - DNA, 25 bp, Mus musculus
agaaacattcctgccgactttcctg

SEQ ID NO: 404798 - DNA, 25 bp, Mus musculus
agaaacccttctacagccgactggt

SEQ ID NO: 404799 - DNA, 25 bp, Mus musculus
agaaacctaggtgtggagtgccaga

SEQ ID NO: 404800 - DNA, 25 bp, Mus musculus
agaaacctggtctcagaggtgaaga

SEQ ID NO: 404801 - DNA, 25 bp, Mus musculus
agaaaccttttctgagcctgcaaga

SEQ ID NO: 404802 - DNA, 25 bp, Mus musculus
agaaacggtctgcactcactgggtc

SEQ ID NO: 404803 - DNA, 25 bp, Mus musculus
agaaacgtggactagtgctgtggac

SEQ ID NO: 404804 - DNA, 25 bp, Mus musculus
agaaactgagactggaacccctgga

SEQ ID NO: 404805 - DNA, 25 bp, Mus musculus
agaaactgtctttcgctgccaccaa

SEQ ID NO: 404806 - DNA, 25 bp, Mus musculus
agaaagaactgtggcttcccgggca

SEQ ID NO: 404807 - DNA, 25 bp, Mus musculus
agaaagagtctcagcgcatcagcgc

SEQ ID NO: 404808 - DNA, 25 bp, Mus musculus
agaaagatgctgttttgcgctatct

SEQ ID NO: 404809 - DNA, 25 bp, Mus musculus
agaaagcaagctctcggcgatgaag

SEQ ID NO: 404810 - DNA, 25 bp, Mus musculus
agaaagcagaggtctccgcaaggga

SEQ ID NO: 404811 - DNA, 25 bp, Mus musculus
agaaagcagtcagtgtagcctccca

SEQ ID NO: 404812 - DNA, 25 bp, Mus musculus
agaaagccgaggtccagagtggacc

SEQ ID NO: 404813 - DNA, 25 bp, Mus musculus
agaaagctagcgacaggggccatgc

SEQ ID NO: 404814 - DNA, 25 bp, Mus musculus
agaaagctccaggatcatgccccag

SEQ ID NO: 404815 - DNA, 25 bp, Mus musculus
agaaaggaagagaccagacccacga

SEQ ID NO: 404816 - DNA, 25 bp, Mus musculus
agaaaggcaacgtgactcggtcccg

SEQ ID NO: 404817 - DNA, 25 bp, Mus musculus
agaaagtagttttgccccaggtgca

SEQ ID NO: 404818 - DNA, 25 bp, Mus musculus
agaaagtcatctacctgggcctgcg

SEQ ID NO: 404819 - DNA, 25 bp, Mus musculus
agaaagtgccggctaccccttcctg

SEQ ID NO: 404820 - DNA, 25 bp, Mus musculus
agaaataagctgaaacaaactgtgg

SEQ ID NO: 404821 - DNA, 25 bp, Mus musculus
agaaatacctccagccaacctcatg

SEQ ID NO: 404822 - DNA, 25 bp, Mus musculus
agaaatactgcggaggcttcttggt

SEQ ID NO: 404823 - DNA, 25 bp, Mus musculus
agaaatagactacagcgatgccccg

SEQ ID NO: 404824 - DNA, 25 bp, Mus musculus
agaaatatctgctacaggagctgga

SEQ ID NO: 404825 - DNA, 25 bp, Mus musculus
agaaatcagagctaactccaaaaaa

SEQ ID NO: 404826 - DNA, 25 bp, Mus musculus
agaaatcatgggattctcacggaga

SEQ ID NO: 404827 - DNA, 25 bp, Mus musculus
agaaatccaaactctctgatccccg

SEQ ID NO: 404828 - DNA, 25 bp, Mus musculus
agaaatcgtgttttaatttgatagc

SEQ ID NO: 404829 - DNA, 25 bp, Mus musculus
agaaatgatggttcccaggagcggc

SEQ ID NO: 404830 - DNA, 25 bp, Mus musculus
agaaatggaccgtgagtgacttggg

SEQ ID NO: 404831 - DNA, 25 bp, Mus musculus
agaaatggagctgggctagtagccc

SEQ ID NO: 404832 - DNA, 25 bp, Mus musculus
agaaatgtaaatggcatcagatgga

SEQ ID NO: 404833 - DNA, 25 bp, Mus musculus
agaaatgtcccaaccacctcggtgg

SEQ ID NO: 404834 - DNA, 25 bp, Mus musculus
agaaatgtccttatgacccggcccg

SEQ ID NO: 404835 - DNA, 25 bp, Mus musculus
agaaatgtcttcagtcggatggccg

SEQ ID NO: 404836 - DNA, 25 bp, Mus musculus
agaaattgtgcctgcagtcgctgca

SEQ ID NO: 404837 - DNA, 25 bp, Mus musculus
agaaatttaaaatctgtgtatgagt

SEQ ID NO: 404838 - DNA, 25 bp, Mus musculus
agaacaaaagaaacctggagccagg

SEQ ID NO: 404839 - DNA, 25 bp, Mus musculus
agaacaaaggcttgggataggagca

SEQ ID NO: 404840 - DNA, 25 bp, Mus musculus
agaacaacaccttctcctccggaag

SEQ ID NO: 404841 - DNA, 25 bp, Mus musculus
agaacaacgggctctctcctaactc

SEQ ID NO: 404842 - DNA, 25 bp, Mus musculus
agaacaaggccctcatcggtgaccg

SEQ ID NO: 404843 - DNA, 25 bp, Mus musculus
agaacacaagccagagaaacttcct

SEQ ID NO: 404844 - DNA, 25 bp, Mus musculus
agaacacgagcctgggaacccttca

SEQ ID NO: 404845 - DNA, 25 bp, Mus musculus
agaacactggtcacagccgtggcca

SEQ ID NO: 404846 - DNA, 25 bp, Mus musculus
agaacacttaactgcgacgaggaga

SEQ ID NO: 404847 - DNA, 25 bp, Mus musculus
agaacagaatgggtgtgaaacatgg

SEQ ID NO: 404848 - DNA, 25 bp, Mus musculus
agaacagaccctcccctttccagtg

SEQ ID NO: 404849 - DNA, 25 bp, Mus musculus
agaacagcagtctccccataaaggg

SEQ ID NO: 404850 - DNA, 25 bp, Mus musculus
agaacagcccttcagcacagcaaga

SEQ ID NO: 404851 - DNA, 25 bp, Mus musculus
agaacaggacccacacaacaccata

SEQ ID NO: 404852 - DNA, 25 bp, Mus musculus
agaacatcatctgggctaacctgcg

SEQ ID NO: 404853 - DNA, 25 bp, Mus musculus
agaacatgggattattttaccaagg

SEQ ID NO: 404854 - DNA, 25 bp, Mus musculus
agaacatgtgcgctttagagacccc

SEQ ID NO: 404855 - DNA, 25 bp, Mus musculus
agaacattgccaggcttcgtcatgc

SEQ ID NO: 404856 - DNA, 25 bp, Mus musculus
agaacattggagatggccggagccc

SEQ ID NO: 404857 - DNA, 25 bp, Mus musculus
agaaccagagacagagtcccgcaga

SEQ ID NO: 404858 - DNA, 25 bp, Mus musculus
agaaccagagcggagagccaggcac

SEQ ID NO: 404859 - DNA, 25 bp, Mus musculus
agaaccagccttgggaacagccctg

SEQ ID NO: 404860 - DNA, 25 bp, Mus musculus
agaaccaggcgctgccctcgggaca

SEQ ID NO: 404861 - DNA, 25 bp, Mus musculus
agaaccaggcttttccatcgatgag

SEQ ID NO: 404862 - DNA, 25 bp, Mus musculus
agaaccatgtggctcgtgtgcaccc

SEQ ID NO: 404863 - DNA, 25 bp, Mus musculus
agaacccagatgaaggccccaagtt

SEQ ID NO: 404864 - DNA, 25 bp, Mus musculus
agaacccagcctgcatggacaaggg

SEQ ID NO: 404865 - DNA, 25 bp, Mus musculus
agaacccggacctctgccctggagt

SEQ ID NO: 404866 - DNA, 25 bp, Mus musculus
agaaccctctgaggcatcccgtgtg

SEQ ID NO: 404867 - DNA, 25 bp, Mus musculus
agaaccggaaggatgctgaagccac

SEQ ID NO: 404868 - DNA, 25 bp, Mus musculus
agaaccggcaaactggtgctccaga

SEQ ID NO: 404869 - DNA, 25 bp, Mus musculus
agaacgagattcagacctaccgcag

SEQ ID NO: 404870 - DNA, 25 bp, Mus musculus
agaacgaggcgctgttcgagtacgc

SEQ ID NO: 404871 - DNA, 25 bp, Mus musculus
agaacgccaggagccggatcgcttg

SEQ ID NO: 404872 - DNA, 25 bp, Mus musculus
agaacgccattgtagccaagatgga

SEQ ID NO: 404873 - DNA, 25 bp, Mus musculus
agaacgcccgagctgtcataatggg

SEQ ID NO: 404874 - DNA, 25 bp, Mus musculus
agaacgccgccatgcgcctggagct

SEQ ID NO: 404875 - DNA, 25 bp, Mus musculus
agaacgctgaaatgaggccactcgg

SEQ ID NO: 404876 - DNA, 25 bp, Mus musculus
agaacggccctttcccaccagaatg

SEQ ID NO: 404877 - DNA, 25 bp, Mus musculus
agaacggctacccactgccagaggg

SEQ ID NO: 404878 - DNA, 25 bp, Mus musculus
agaacggcttccctcactgtgtgaa

SEQ ID NO: 404879 - DNA, 25 bp, Mus musculus
agaactaatgtcgtcatcccagtct

SEQ ID NO: 404880 - DNA, 25 bp, Mus musculus
agaactagaggacctaaccctgaag

SEQ ID NO: 404881 - DNA, 25 bp, Mus musculus
agaactcataatcccgtgcctggcg

SEQ ID NO: 404882 - DNA, 25 bp, Mus musculus
agaactccatcatcccacgacaaag

SEQ ID NO: 404883 - DNA, 25 bp, Mus musculus
agaactccgccagctcaaagaaaac

SEQ ID NO: 404884 - DNA, 25 bp, Mus musculus
agaactcctgtcagaaacggctgtg

SEQ ID NO: 404885 - DNA, 25 bp, Mus musculus
agaactccttcctgcttcagctcaa

SEQ ID NO: 404886 - DNA, 25 bp, Mus musculus
agaactcgaggcgtctgcttaaccc

SEQ ID NO: 404887 - DNA, 25 bp, Mus musculus
agaactgcagcatgtcgccctgggt

SEQ ID NO: 404888 - DNA, 25 bp, Mus musculus
agaacttacggcgttcgtctccaag

SEQ ID NO: 404889 - DNA, 25 bp, Mus musculus
agaacttcttctcgatagcctgcag

SEQ ID NO: 404890 - DNA, 25 bp, Mus musculus
agaacttgtagtcccctgtcacagg

SEQ ID NO: 404891 - DNA, 25 bp, Mus musculus
agaacttgtgactgaattccttggg

SEQ ID NO: 404892 - DNA, 25 bp, Mus musculus
agaactttctgagcccggtcaagcc

SEQ ID NO: 404893 - DNA, 25 bp, Mus musculus
agaagaaaattctctgttgcacctg

SEQ ID NO: 404894 - DNA, 25 bp, Mus musculus
agaagaaagccagatggtgggaaac

SEQ ID NO: 404895 - DNA, 25 bp, Mus musculus
agaagaaagcgtggccataccagcg

SEQ ID NO: 404896 - DNA, 25 bp, Mus musculus
agaagaaatgggagcgagccctgca

SEQ ID NO: 404897 - DNA, 25 bp, Mus musculus
agaagaactgttggatttgcctggg

SEQ ID NO: 404898 - DNA, 25 bp, Mus musculus
agaagaacttagagcgtggcaggct

SEQ ID NO: 404899 - DNA, 25 bp, Mus musculus
agaagaagatctgtacccggaagcc

SEQ ID NO: 404900 - DNA, 25 bp, Mus musculus
agaagaagcgccgtgcacgcatcaa

SEQ ID NO: 404901 - DNA, 25 bp, Mus musculus
agaagaagctgaccctgagcggcat

SEQ ID NO: 404902 - DNA, 25 bp, Mus musculus
agaagaatcgcatcgctgcccagaa

SEQ ID NO: 404903 - DNA, 25 bp, Mus musculus
agaagaatgggccacaactcgctcc

SEQ ID NO: 404904 - DNA, 25 bp, Mus musculus
agaagaatgtgctacctggctggag

SEQ ID NO: 404905 - DNA, 25 bp, Mus musculus
agaagaattacaagagctcagggac

SEQ ID NO: 404906 - DNA, 25 bp, Mus musculus
agaagaccaaggagcaggccaatgc

SEQ ID NO: 404907 - DNA, 25 bp, Mus musculus
agaagactcgagacccacagcattg

SEQ ID NO: 404908 - DNA, 25 bp, Mus musculus
agaagacttcacctatggcccgggc

SEQ ID NO: 404909 - DNA, 25 bp, Mus musculus
agaagagaagcccagctgcggttgg

SEQ ID NO: 404910 - DNA, 25 bp, Mus musculus
agaagagatccctgaacccacgttg

SEQ ID NO: 404911 - DNA, 25 bp, Mus musculus
agaagagccactccacatgggccaa

SEQ ID NO: 404912 - DNA, 25 bp, Mus musculus
agaagaggagtcttgcaggaagttc

SEQ ID NO: 404913 - DNA, 25 bp, Mus musculus
agaagaggcgccacctttcgtagca

SEQ ID NO: 404914 - DNA, 25 bp, Mus musculus
agaagagtctccctcattaaaagtg

SEQ ID NO: 404915 - DNA, 25 bp, Mus musculus
agaagatctgcagtcgccctgagct

SEQ ID NO: 404916 - DNA, 25 bp, Mus musculus
agaagatgatgtgaactccccagga

SEQ ID NO: 404917 - DNA, 25 bp, Mus musculus
agaagatggcatggcctccggtgcc

SEQ ID NO: 404918 - DNA, 25 bp, Mus musculus
agaagcaaggtgtctcttggaccag

SEQ ID NO: 404919 - DNA, 25 bp, Mus musculus
agaagcaatcaagtccctccagggc

SEQ ID NO: 404920 - DNA, 25 bp, Mus musculus
agaagcagggctttcctcagaggaa

SEQ ID NO: 404921 - DNA, 25 bp, Mus musculus
agaagcagtgtttgcaagggtcaga

SEQ ID NO: 404922 - DNA, 25 bp, Mus musculus
agaagcagttgtccccatgagcaga

SEQ ID NO: 404923 - DNA, 25 bp, Mus musculus
agaagccacctctcaacagcatctt

SEQ ID NO: 404924 - DNA, 25 bp, Mus musculus
agaagccagacaacaactcaccaag

SEQ ID NO: 404925 - DNA, 25 bp, Mus musculus
agaagccatcacagctctcaaggga

SEQ ID NO: 404926 - DNA, 25 bp, Mus musculus
agaagccgttagagatgccagccca

SEQ ID NO: 404927 - DNA, 25 bp, Mus musculus
agaagcctgagagttccgggagttt

SEQ ID NO: 404928 - DNA, 25 bp, Mus musculus
agaagcgagtccttggtctggtgtt

SEQ ID NO: 404929 - DNA, 25 bp, Mus musculus
agaagcgcgcaggatctgggtgccc

SEQ ID NO: 404930 - DNA, 25 bp, Mus musculus
agaagcggacccagccgctcgaggt

SEQ ID NO: 404931 - DNA, 25 bp, Mus musculus
agaagctgacctttctctgactggg

SEQ ID NO: 404932 - DNA, 25 bp, Mus musculus
agaagctgctcaagccctcagtcca

SEQ ID NO: 404933 - DNA, 25 bp, Mus musculus
agaagctgctgtacgccatcgagga

SEQ ID NO: 404934 - DNA, 25 bp, Mus musculus
agaagctgtctccatcttgtcggca

SEQ ID NO: 404935 - DNA, 25 bp, Mus musculus
agaagcttaatagccagtaccaagg

SEQ ID NO: 404936 - DNA, 25 bp, Mus musculus
agaagcttgcggagaagacagccaa

SEQ ID NO: 404937 - DNA, 25 bp, Mus musculus
agaaggaacactgcgactcagaggg

SEQ ID NO: 404938 - DNA, 25 bp, Mus musculus
agaaggaacgctccccggagatgca

SEQ ID NO: 404939 - DNA, 25 bp, Mus musculus
agaaggaagcgcagcgcctgatgaa

SEQ ID NO: 404940 - DNA, 25 bp, Mus musculus
agaaggaatctcgactgaaaaatga

SEQ ID NO: 404941 - DNA, 25 bp, Mus musculus
agaaggaattcatcagggtcttagt

SEQ ID NO: 404942 - DNA, 25 bp, Mus musculus
agaaggactccccaaaccaggatgc

SEQ ID NO: 404943 - DNA, 25 bp, Mus musculus
agaaggagctggtcttcccatcccg

SEQ ID NO: 404944 - DNA, 25 bp, Mus musculus
agaaggccgagaagctgtacccgct

SEQ ID NO: 404945 - DNA, 25 bp, Mus musculus
agaaggcctcgtggctgaacccgaa

SEQ ID NO: 404946 - DNA, 25 bp, Mus musculus
agaaggcctttggtcccgtctctct

SEQ ID NO: 404947 - DNA, 25 bp, Mus musculus
agaaggcgctcaagacactgggcat

SEQ ID NO: 404948 - DNA, 25 bp, Mus musculus
agaagggctttctatgctggaggca

SEQ ID NO: 404949 - DNA, 25 bp, Mus musculus
agaagggtaagtgagcccctgccgt

SEQ ID NO: 404950 - DNA, 25 bp, Mus musculus
agaaggtaccggagctaccgtcgtg

SEQ ID NO: 404951 - DNA, 25 bp, Mus musculus
agaaggtcatctacacgggcaagga

SEQ ID NO: 404952 - DNA, 25 bp, Mus musculus
agaaggtgacggaaaatactcccag

SEQ ID NO: 404953 - DNA, 25 bp, Mus musculus
agaaggtgcgttacctctcggagcg

SEQ ID NO: 404954 - DNA, 25 bp, Mus musculus
agaaggtggtgttcacaaggaagaa

SEQ ID NO: 404955 - DNA, 25 bp, Mus musculus
agaagtaagatagcctgtccaggag

SEQ ID NO: 404956 - DNA, 25 bp, Mus musculus
agaagtaccactgcaggaaccgtcg

SEQ ID NO: 404957 - DNA, 25 bp, Mus musculus
agaagtacctgtctgcccctgagag

SEQ ID NO: 404958 - DNA, 25 bp, Mus musculus
agaagtacttggcaccgtcagagcg

SEQ ID NO: 404959 - DNA, 25 bp, Mus musculus
agaagtagtcacgacaccttcctgc

SEQ ID NO: 404960 - DNA, 25 bp, Mus musculus
agaagtatgatagcgcggcggccat

SEQ ID NO: 404961 - DNA, 25 bp, Mus musculus
agaagtctcatttaaacaagcgcag

SEQ ID NO: 404962 - DNA, 25 bp, Mus musculus
agaagtctgtctgccatcgataggg

SEQ ID NO: 404963 - DNA, 25 bp, Mus musculus
agaagtgcctgcacccgctggaaag

SEQ ID NO: 404964 - DNA, 25 bp, Mus musculus
agaagtgtcccgagatgctgcagag

SEQ ID NO: 404965 - DNA, 25 bp, Mus musculus
agaagtgtctgcagcccagctacaa

SEQ ID NO: 404966 - DNA, 25 bp, Mus musculus
agaagtgtttcagggttccgtggct

SEQ ID NO: 404967 - DNA, 25 bp, Mus musculus
agaagttccacgatgcctgcttaga

SEQ ID NO: 404968 - DNA, 25 bp, Mus musculus
agaagtttctagctcgctatccgag

SEQ ID NO: 404969 - DNA, 25 bp, Mus musculus
agaagtttgctaacgctgtgggcca

SEQ ID NO: 404970 - DNA, 25 bp, Mus musculus
agaataaaggattgctgggacaacc

SEQ ID NO: 404971 - DNA, 25 bp, Mus musculus
agaataactccactggaaaccacgc

SEQ ID NO: 404972 - DNA, 25 bp, Mus musculus
agaataatcaatgagcccacggcgg

SEQ ID NO: 404973 - DNA, 25 bp, Mus musculus
agaatacatctaccagcgcaggccg

SEQ ID NO: 404974 - DNA, 25 bp, Mus musculus
agaatacatttgctaccctgtgaga

SEQ ID NO: 404975 - DNA, 25 bp, Mus musculus
agaatacttgtctcggctgccctgg

SEQ ID NO: 404976 - DNA, 25 bp, Mus musculus
agaatatgtgatgtcctgggctcca

SEQ ID NO: 404977 - DNA, 25 bp, Mus musculus
agaatccaggccctttaagctttgg

SEQ ID NO: 404978 - DNA, 25 bp, Mus musculus
agaatccgagcttgcagggaccgga

SEQ ID NO: 404979 - DNA, 25 bp, Mus musculus
agaatccgcgggacctatgagcgca

SEQ ID NO: 404980 - DNA, 25 bp, Mus musculus
agaatctcccctgctggttagctgg

SEQ ID NO: 404981 - DNA, 25 bp, Mus musculus
agaatctctgcatatgtgccctgga

SEQ ID NO: 404982 - DNA, 25 bp, Mus musculus
agaatctgactgtacctccgggcta

SEQ ID NO: 404983 - DNA, 25 bp, Mus musculus
agaatctgaggaacatggaaggaca

SEQ ID NO: 404984 - DNA, 25 bp, Mus musculus
agaatctgggttcaatgtctagcac

SEQ ID NO: 404985 - DNA, 25 bp, Mus musculus
agaatgacagctgcctacatctgaa

SEQ ID NO: 404986 - DNA, 25 bp, Mus musculus
agaatgatggcaaaccaccttgtaa

SEQ ID NO: 404987 - DNA, 25 bp, Mus musculus
agaatgcaaagtccccagactgtcc

SEQ ID NO: 404988 - DNA, 25 bp, Mus musculus
agaatgcctggaacaaccttgagag

SEQ ID NO: 404989 - DNA, 25 bp, Mus musculus
agaatgctgaccaaatgctgatgcc

SEQ ID NO: 404990 - DNA, 25 bp, Mus musculus
agaatggcgtctcaaccgactgcgg

SEQ ID NO: 404991 - DNA, 25 bp, Mus musculus
agaatggctggcatcaaggaggaca

SEQ ID NO: 404992 - DNA, 25 bp, Mus musculus
agaatggctgttgcagtcggcgtca

SEQ ID NO: 404993 - DNA, 25 bp, Mus musculus
agaattacgtacaagccactgaaga

SEQ ID NO: 404994 - DNA, 25 bp, Mus musculus
agaattactcactctaacagggcag

SEQ ID NO: 404995 - DNA, 25 bp, Mus musculus
agaattctgccctactgctccttca

SEQ ID NO: 404996 - DNA, 25 bp, Mus musculus
agaattctggcaacagagggcggca

SEQ ID NO: 404997 - DNA, 25 bp, Mus musculus
agaattctggccacggaagataggt

SEQ ID NO: 404998 - DNA, 25 bp, Mus musculus
agaattggcctctcctgtgttcgag

SEQ ID NO: 404999 - DNA, 25 bp, Mus musculus
agaatttcgtgtgggcagccccgac

SEQ ID NO: 405000 - DNA, 25 bp, Mus musculus
agacaaagtaagttaggaggaggct

SEQ ID NO: 405001 - DNA, 25 bp, Mus musculus
agacaaagtttctgcctccttggaa

SEQ ID NO: 405002 - DNA, 25 bp, Mus musculus
agacaacacgctcctgacctgaggg

SEQ ID NO: 405003 - DNA, 25 bp, Mus musculus
agacaacagagaggtccgtgtgccc

SEQ ID NO: 405004 - DNA, 25 bp, Mus musculus
agacaacagtctccgcctaggtgag

SEQ ID NO: 405005 - DNA, 25 bp, Mus musculus
agacaactctaaaatccactgaccc

SEQ ID NO: 405006 - DNA, 25 bp, Mus musculus
agacaactgtgagcgcgatggccgt

SEQ ID NO: 405007 - DNA, 25 bp, Mus musculus
agacaagatccctggctcggctgtg

SEQ ID NO: 405008 - DNA, 25 bp, Mus musculus
agacaagcagttaggaggagcccac

SEQ ID NO: 405009 - DNA, 25 bp, Mus musculus
agacaagccttacaggtgcccggag

SEQ ID NO: 405010 - DNA, 25 bp, Mus musculus
agacaagctccatctcccgtgggag

SEQ ID NO: 405011 - DNA, 25 bp, Mus musculus
agacaagggtgttggctttggcctg

SEQ ID NO: 405012 - DNA, 25 bp, Mus musculus
agacaaggttgtgagggccattccc

SEQ ID NO: 405013 - DNA, 25 bp, Mus musculus
agacaccatggtggcgtactggcga

SEQ ID NO: 405014 - DNA, 25 bp, Mus musculus
agacacccttggatcaatcctactg

SEQ ID NO: 405015 - DNA, 25 bp, Mus musculus
agacaccgaggtactgccggccctt

SEQ ID NO: 405016 - DNA, 25 bp, Mus musculus
agacacgaagccagtgggttttcaa

SEQ ID NO: 405017 - DNA, 25 bp, Mus musculus
agacacgccatactcctttgctggg

SEQ ID NO: 405018 - DNA, 25 bp, Mus musculus
agacactgctttcacgactggagga

SEQ ID NO: 405019 - DNA, 25 bp, Mus musculus
agacagaccatcctgatccagcaaa

SEQ ID NO: 405020 - DNA, 25 bp, Mus musculus
agacagacttctggcatcatacaag

SEQ ID NO: 405021 - DNA, 25 bp, Mus musculus
agacagagcaggctcgcgaaggagc

SEQ ID NO: 405022 - DNA, 25 bp, Mus musculus
agacagcccgaaggcccctgggaag

SEQ ID NO: 405023 - DNA, 25 bp, Mus musculus
agacagttctggagcctggccgctc

SEQ ID NO: 405024 - DNA, 25 bp, Mus musculus
agacagttgtacacgggcctggaga

SEQ ID NO: 405025 - DNA, 25 bp, Mus musculus
agacagttgttagccgctgtgtgag

SEQ ID NO: 405026 - DNA, 25 bp, Mus musculus
agacatatctgctgctgtccctagg

SEQ ID NO: 405027 - DNA, 25 bp, Mus musculus
agacatctggttatgtgactgcaaa

SEQ ID NO: 405028 - DNA, 25 bp, Mus musculus
agacatgattgtcacgcccttcgcc

SEQ ID NO: 405029 - DNA, 25 bp, Mus musculus
agacatgccggagcagctgtggcca

SEQ ID NO: 405030 - DNA, 25 bp, Mus musculus
agacatggatactgcgctggaggcc

SEQ ID NO: 405031 - DNA, 25 bp, Mus musculus
agacatggctctgggtgttaccagg

SEQ ID NO: 405032 - DNA, 25 bp, Mus musculus
agacatgggagttcgaggagcactc

SEQ ID NO: 405033 - DNA, 25 bp, Mus musculus
agacatgggtttggtcttgagtgcc

SEQ ID NO: 405034 - DNA, 25 bp, Mus musculus
agacattaaacaagttgaacacaag

SEQ ID NO: 405035 - DNA, 25 bp, Mus musculus
agacattccccgaagggtgcctgga

SEQ ID NO: 405036 - DNA, 25 bp, Mus musculus
agacatttgtaatctgggactccag

SEQ ID NO: 405037 - DNA, 25 bp, Mus musculus
agaccaaactgggattacggcgctt

SEQ ID NO: 405038 - DNA, 25 bp, Mus musculus
agaccaaggctcgtcctgcgaagag

SEQ ID NO: 405039 - DNA, 25 bp, Mus musculus
agaccaccagccaggtggccaagca

SEQ ID NO: 405040 - DNA, 25 bp, Mus musculus
agaccagctctaccttcacatcggg

SEQ ID NO: 405041 - DNA, 25 bp, Mus musculus
agaccaggacgtgtttgacgaggaa

SEQ ID NO: 405042 - DNA, 25 bp, Mus musculus
agaccagggtaggaaagacaagcag

SEQ ID NO: 405043 - DNA, 25 bp, Mus musculus
agaccataagggagaagggaaagca

SEQ ID NO: 405044 - DNA, 25 bp, Mus musculus
agaccatagccaggagttcacatct

SEQ ID NO: 405045 - DNA, 25 bp, Mus musculus
agaccatggaaccaacctcacctgt

SEQ ID NO: 405046 - DNA, 25 bp, Mus musculus
agaccatgggctggatttgagcacc

SEQ ID NO: 405047 - DNA, 25 bp, Mus musculus
agacccagacgctcgggatcagcgt

SEQ ID NO: 405048 - DNA, 25 bp, Mus musculus
agacccaggatcaggcctggcaggc

SEQ ID NO: 405049 - DNA, 25 bp, Mus musculus
agacccaggctgataagttccagag

SEQ ID NO: 405050 - DNA, 25 bp, Mus musculus
agacccattcctgtgaaagcagtgg

SEQ ID NO: 405051 - DNA, 25 bp, Mus musculus
agaccccatggtgcccgtctggtgg

SEQ ID NO: 405052 - DNA, 25 bp, Mus musculus
agacccccatcatgggcagccagag

SEQ ID NO: 405053 - DNA, 25 bp, Mus musculus
agacccctgtggcagtgtccctgtc

SEQ ID NO: 405054 - DNA, 25 bp, Mus musculus
agacccgagccagcaaaggagtgag

SEQ ID NO: 405055 - DNA, 25 bp, Mus musculus
agacccgaggaagcgtgtgtcttgc

SEQ ID NO: 405056 - DNA, 25 bp, Mus musculus
agacccgtcagtgcctttctttctg

SEQ ID NO: 405057 - DNA, 25 bp, Mus musculus
agaccgaccagtgagagcctgccga

SEQ ID NO: 405058 - DNA, 25 bp, Mus musculus
agaccgacgggcatagcttcagctc

SEQ ID NO: 405059 - DNA, 25 bp, Mus musculus
agaccgattagtggcagagttcacc

SEQ ID NO: 405060 - DNA, 25 bp, Mus musculus
agaccgcacaggtactcgaggctgg

SEQ ID NO: 405061 - DNA, 25 bp, Mus musculus
agacctaagtcctttgacctgcaag

SEQ ID NO: 405062 - DNA, 25 bp, Mus musculus
agacctcctcaacagcagcgggaga

SEQ ID NO: 405063 - DNA, 25 bp, Mus musculus
agacctcggcctgatgacctggaga

SEQ ID NO: 405064 - DNA, 25 bp, Mus musculus
agacctctgggagatctagcctgca

SEQ ID NO: 405065 - DNA, 25 bp, Mus musculus
agacctgaagagactaacgcctgcc

SEQ ID NO: 405066 - DNA, 25 bp, Mus musculus
agacctggccatctacacgggagaa

SEQ ID NO: 405067 - DNA, 25 bp, Mus musculus
agacctgttaggtgagctggcccac

SEQ ID NO: 405068 - DNA, 25 bp, Mus musculus
agacctgttgccagtccacactgtg

SEQ ID NO: 405069 - DNA, 25 bp, Mus musculus
agaccttagggcaaagattactggg

SEQ ID NO: 405070 - DNA, 25 bp, Mus musculus
agaccttccgattagctggctccga

SEQ ID NO: 405071 - DNA, 25 bp, Mus musculus
agaccttggctacctggcttcggag

SEQ ID NO: 405072 - DNA, 25 bp, Mus musculus
agacgagcctgtgcgagcgttagcc

SEQ ID NO: 405073 - DNA, 25 bp, Mus musculus
agacgattcgctggtgggatccacc

SEQ ID NO: 405074 - DNA, 25 bp, Mus musculus
agacgcagatggtattttttaacct

SEQ ID NO: 405075 - DNA, 25 bp, Mus musculus
agacgcccagagcagcgctgttaac

SEQ ID NO: 405076 - DNA, 25 bp, Mus musculus
agacgccctgagtgacgagcacagt

SEQ ID NO: 405077 - DNA, 25 bp, Mus musculus
agacgctggacctgcctgcgtggaa

SEQ ID NO: 405078 - DNA, 25 bp, Mus musculus
agacgcttagcttaggcctgaggga

SEQ ID NO: 405079 - DNA, 25 bp, Mus musculus
agacggccctcgctacactgtgagg

SEQ ID NO: 405080 - DNA, 25 bp, Mus musculus
agacgggacagccaaccctagccta

SEQ ID NO: 405081 - DNA, 25 bp, Mus musculus
agacggtacgcgatgccctgtgtcc

SEQ ID NO: 405082 - DNA, 25 bp, Mus musculus
agacggtcccgcatggatgaagcca

SEQ ID NO: 405083 - DNA, 25 bp, Mus musculus
agacggtccggaggcaactgatgac

SEQ ID NO: 405084 - DNA, 25 bp, Mus musculus
agacgtccacggctagcatggtgca

SEQ ID NO: 405085 - DNA, 25 bp, Mus musculus
agacgtgctcttcaaggctcccgag

SEQ ID NO: 405086 - DNA, 25 bp, Mus musculus
agacgtggaactcaacctggtgcgc

SEQ ID NO: 405087 - DNA, 25 bp, Mus musculus
agactactaagagacatggcccacg

SEQ ID NO: 405088 - DNA, 25 bp, Mus musculus
agactagatgctacccaatgacggg

SEQ ID NO: 405089 - DNA, 25 bp, Mus musculus
agactagggctcgaagtggcgatcc

SEQ ID NO: 405090 - DNA, 25 bp, Mus musculus
agactcaaattctgtgcccgctggt

SEQ ID NO: 405091 - DNA, 25 bp, Mus musculus
agactcagcgtgatcgtcacccaca

SEQ ID NO: 405092 - DNA, 25 bp, Mus musculus
agactcccagctggctatgaagaaa

SEQ ID NO: 405093 - DNA, 25 bp, Mus musculus
agactccgcgcgtcgccatttctgg

SEQ ID NO: 405094 - DNA, 25 bp, Mus musculus
agactccgtgtcactaggcgggcca

SEQ ID NO: 405095 - DNA, 25 bp, Mus musculus
agactcctggggtcacagattgggc

SEQ ID NO: 405096 - DNA, 25 bp, Mus musculus
agactcgaatctggtctgcttcgca

SEQ ID NO: 405097 - DNA, 25 bp, Mus musculus
agactcggctatggccagcctgcag

SEQ ID NO: 405098 - DNA, 25 bp, Mus musculus
agactcgttggcactcagacacacg

SEQ ID NO: 405099 - DNA, 25 bp, Mus musculus
agactcttgccgtgcgcacgctagg

SEQ ID NO: 405100 - DNA, 25 bp, Mus musculus
agactgaacgattttcgaaggacgg

SEQ ID NO: 405101 - DNA, 25 bp, Mus musculus
agactgactcatgcattggcgggtg

SEQ ID NO: 405102 - DNA, 25 bp, Mus musculus
agactgagaacgacaagcaccgggt

SEQ ID NO: 405103 - DNA, 25 bp, Mus musculus
agactgatttctgttggccggcccc

SEQ ID NO: 405104 - DNA, 25 bp, Mus musculus
agactgccactcttgcaatctgaca

SEQ ID NO: 405105 - DNA, 25 bp, Mus musculus
agactggagagaaggaggtcacccc

SEQ ID NO: 405106 - DNA, 25 bp, Mus musculus
agactggcccacacaatactgcgag

SEQ ID NO: 405107 - DNA, 25 bp, Mus musculus
agactgggatgggagttaccccagt

SEQ ID NO: 405108 - DNA, 25 bp, Mus musculus
agactgggtcctgcctgtactcgga

SEQ ID NO: 405109 - DNA, 25 bp, Mus musculus
agactggtcgacaactggaaggccc

SEQ ID NO: 405110 - DNA, 25 bp, Mus musculus
agactggtgcaggtagagaccccgt

SEQ ID NO: 405111 - DNA, 25 bp, Mus musculus
agactgtgaatcctgcaggaatgac

SEQ ID NO: 405112 - DNA, 25 bp, Mus musculus
agacttatggcttcagggacccgga

SEQ ID NO: 405113 - DNA, 25 bp, Mus musculus
agacttccaggaggtcccagactgc

SEQ ID NO: 405114 - DNA, 25 bp, Mus musculus
agacttcctggtggatgatgccgag

SEQ ID NO: 405115 - DNA, 25 bp, Mus musculus
agacttctccttcaggctctgcgta

SEQ ID NO: 405116 - DNA, 25 bp, Mus musculus
agacttctgttgtcatagcatttta

SEQ ID NO: 405117 - DNA, 25 bp, Mus musculus
agactttggatagcagccacgggca

SEQ ID NO: 405118 - DNA, 25 bp, Mus musculus
agagaaaaccctgaagtgcccacgg

SEQ ID NO: 405119 - DNA, 25 bp, Mus musculus
agagaaacctcccattgatgctgac

SEQ ID NO: 405120 - DNA, 25 bp, Mus musculus
agagaaacctgggcaggacgcgacc

SEQ ID NO: 405121 - DNA, 25 bp, Mus musculus
agagaaagaagctcgcttgcctggg

SEQ ID NO: 405122 - DNA, 25 bp, Mus musculus
agagaacctggtcatacttgagcag

SEQ ID NO: 405123 - DNA, 25 bp, Mus musculus
agagaaccttgcgtgggcgtcctat

SEQ ID NO: 405124 - DNA, 25 bp, Mus musculus
agagaactgttaggagacctggtcc

SEQ ID NO: 405125 - DNA, 25 bp, Mus musculus
agagaacttttgctttagaactagg

SEQ ID NO: 405126 - DNA, 25 bp, Mus musculus
agagaagaagcctaacctcaccctg

SEQ ID NO: 405127 - DNA, 25 bp, Mus musculus
agagaagctgctttgagccaaggga

SEQ ID NO: 405128 - DNA, 25 bp, Mus musculus
agagaatctaaggaaggccagagct

SEQ ID NO: 405129 - DNA, 25 bp, Mus musculus
agagaatgaattcgtgaccctgaag

SEQ ID NO: 405130 - DNA, 25 bp, Mus musculus
agagacagcttgtacgccgaggtgc

SEQ ID NO: 405131 - DNA, 25 bp, Mus musculus
agagacaggctgatccccggagttt

SEQ ID NO: 405132 - DNA, 25 bp, Mus musculus
agagacagtgatgcagagtgtgacc

SEQ ID NO: 405133 - DNA, 25 bp, Mus musculus
agagacattgttcccctcagatcga

SEQ ID NO: 405134 - DNA, 25 bp, Mus musculus
agagaccagtgcagttccctcaagg

SEQ ID NO: 405135 - DNA, 25 bp, Mus musculus
agagaccatgctacccacgtgggaa

SEQ ID NO: 405136 - DNA, 25 bp, Mus musculus
agagacccactgctcacagattctg

SEQ ID NO: 405137 - DNA, 25 bp, Mus musculus
agagaccttggtggacttccctgca

SEQ ID NO: 405138 - DNA, 25 bp, Mus musculus
agagacgaggcagttctgggcacct

SEQ ID NO: 405139 - DNA, 25 bp, Mus musculus
agagacgcacgcaagaggaagccac

SEQ ID NO: 405140 - DNA, 25 bp, Mus musculus
agagactgagctgccttgccaagga

SEQ ID NO: 405141 - DNA, 25 bp, Mus musculus
agagactgaggaaagaaacccagct

SEQ ID NO: 405142 - DNA, 25 bp, Mus musculus
agagactgcaggctacccttctggc

SEQ ID NO: 405143 - DNA, 25 bp, Mus musculus
agagactgcctgtgccccttggtcc

SEQ ID NO: 405144 - DNA, 25 bp, Mus musculus
agagactgtcctgatgaaccccaca

SEQ ID NO: 405145 - DNA, 25 bp, Mus musculus
agagacttctacaacccactggtgg

SEQ ID NO: 405146 - DNA, 25 bp, Mus musculus
agagacttgtcttggttggttcagc

SEQ ID NO: 405147 - DNA, 25 bp, Mus musculus
agagactttgttcagcccagcagga

SEQ ID NO: 405148 - DNA, 25 bp, Mus musculus
agagagaacacgctacctgcacctc

SEQ ID NO: 405149 - DNA, 25 bp, Mus musculus
agagagaactatccaagtgaagacc

SEQ ID NO: 405150 - DNA, 25 bp, Mus musculus
agagagacgccaagcagcctgagga

SEQ ID NO: 405151 - DNA, 25 bp, Mus musculus
agagagacttacattgccccttacc

SEQ ID NO: 405152 - DNA, 25 bp, Mus musculus
agagagactttctacagctacggag

SEQ ID NO: 405153 - DNA, 25 bp, Mus musculus
agagagagttctacgcctgtcaggg

SEQ ID NO: 405154 - DNA, 25 bp, Mus musculus
agagagcatccactgtcatgtacca

SEQ ID NO: 405155 - DNA, 25 bp, Mus musculus
agagagcatgtctttccgaggcgga

SEQ ID NO: 405156 - DNA, 25 bp, Mus musculus
agagagcgccacagttcagaacaag

SEQ ID NO: 405157 - DNA, 25 bp, Mus musculus
agagagctcggctggcagatgacct

SEQ ID NO: 405158 - DNA, 25 bp, Mus musculus
agagaggagacctgggatgcacaca

SEQ ID NO: 405159 - DNA, 25 bp, Mus musculus
agagaggagcagatccctcccagcg

SEQ ID NO: 405160 - DNA, 25 bp, Mus musculus
agagaggagcatgaagagtgactca

SEQ ID NO: 405161 - DNA, 25 bp, Mus musculus
agagaggcacagcactgggacaata

SEQ ID NO: 405162 - DNA, 25 bp, Mus musculus
agagaggcctgctccataaggtgca

SEQ ID NO: 405163 - DNA, 25 bp, Mus musculus
agagaggctgcacgtcaaggacaaa

SEQ ID NO: 405164 - DNA, 25 bp, Mus musculus
agagaggttgtgctcttagtcactg

SEQ ID NO: 405165 - DNA, 25 bp, Mus musculus
agagagtaaatcgtcctgggtggaa

SEQ ID NO: 405166 - DNA, 25 bp, Mus musculus
agagatatcctacatgcgccacgtg

SEQ ID NO: 405167 - DNA, 25 bp, Mus musculus
agagatcatccgtgtggtccatccc

SEQ ID NO: 405168 - DNA, 25 bp, Mus musculus
agagatccacctctcactcagagac

SEQ ID NO: 405169 - DNA, 25 bp, Mus musculus
agagatctgcggcatgccctgctct

SEQ ID NO: 405170 - DNA, 25 bp, Mus musculus
agagatcttccctctcatacaaaga

SEQ ID NO: 405171 - DNA, 25 bp, Mus musculus
agagatgcagcatttgcaatgcctt

SEQ ID NO: 405172 - DNA, 25 bp, Mus musculus
agagatgccctcaatattccccgaa

SEQ ID NO: 405173 - DNA, 25 bp, Mus musculus
agagatgcttcctccgaggtcccga

SEQ ID NO: 405174 - DNA, 25 bp, Mus musculus
agagatggcacatactggcccagca

SEQ ID NO: 405175 - DNA, 25 bp, Mus musculus
agagatggcagtcaccagaagccca

SEQ ID NO: 405176 - DNA, 25 bp, Mus musculus
agagattcatcagcaccctagtgag

SEQ ID NO: 405177 - DNA, 25 bp, Mus musculus
agagattcctctccccaatgagcgg

SEQ ID NO: 405178 - DNA, 25 bp, Mus musculus
agagattggttttctttctctcagc

SEQ ID NO: 405179 - DNA, 25 bp, Mus musculus
agagatttgttcagagatgtgacac

SEQ ID NO: 405180 - DNA, 25 bp, Mus musculus
agagcaactgttgtgcccgcctgtg

SEQ ID NO: 405181 - DNA, 25 bp, Mus musculus
agagcaagtgctcgcaaccactgcg

SEQ ID NO: 405182 - DNA, 25 bp, Mus musculus
agagcacctggtggttttccagaga

SEQ ID NO: 405183 - DNA, 25 bp, Mus musculus
agagcacggagctgagcagtcaccc

SEQ ID NO: 405184 - DNA, 25 bp, Mus musculus
agagcactgaatctcctggcactgg

SEQ ID NO: 405185 - DNA, 25 bp, Mus musculus
agagcagcctgtacaccgtgagcag

SEQ ID NO: 405186 - DNA, 25 bp, Mus musculus
agagcagtaccatccgttgggagtc

SEQ ID NO: 405187 - DNA, 25 bp, Mus musculus
agagcatccagtgcccttaacagct

SEQ ID NO: 405188 - DNA, 25 bp, Mus musculus
agagcatgaccttgaacctggccga

SEQ ID NO: 405189 - DNA, 25 bp, Mus musculus
agagcatgcgccttctggaccgtct

SEQ ID NO: 405190 - DNA, 25 bp, Mus musculus
agagcattcaccatcattgtcagga

SEQ ID NO: 405191 - DNA, 25 bp, Mus musculus
agagccaagcatgcaagggatccca

SEQ ID NO: 405192 - DNA, 25 bp, Mus musculus
agagccaagtgtgggagtgcacaac

SEQ ID NO: 405193 - DNA, 25 bp, Mus musculus
agagccacggtcacagccagagtga

SEQ ID NO: 405194 - DNA, 25 bp, Mus musculus
agagccacttctttactgcacgctg

SEQ ID NO: 405195 - DNA, 25 bp, Mus musculus
agagccagaaaactgaagcatgcaa

SEQ ID NO: 405196 - DNA, 25 bp, Mus musculus
agagccagcagagcgggacgcctct

SEQ ID NO: 405197 - DNA, 25 bp, Mus musculus
agagccagggctattgggaattagt

SEQ ID NO: 405198 - DNA, 25 bp, Mus musculus
agagcccatcaagaactgtcccagg

SEQ ID NO: 405199 - DNA, 25 bp, Mus musculus
agagcccgtttactttcactgtgcg

SEQ ID NO: 405200 - DNA, 25 bp, Mus musculus
agagccctggatcgcttgcaagaag

SEQ ID NO: 405201 - DNA, 25 bp, Mus musculus
agagcccttccactgtattcgagca

SEQ ID NO: 405202 - DNA, 25 bp, Mus musculus
agagccgacccaccatcgattcgga

SEQ ID NO: 405203 - DNA, 25 bp, Mus musculus
agagccgccaactgcctcgggtagc

SEQ ID NO: 405204 - DNA, 25 bp, Mus musculus
agagccgccacactcactggatgga

SEQ ID NO: 405205 - DNA, 25 bp, Mus musculus
agagcctcctcgtgtccacacatgg

SEQ ID NO: 405206 - DNA, 25 bp, Mus musculus
agagcctgagtatgggactcccggc

SEQ ID NO: 405207 - DNA, 25 bp, Mus musculus
agagcctgcaaacaagtttgcccag

SEQ ID NO: 405208 - DNA, 25 bp, Mus musculus
agagcctgccgaacacagccaggca

SEQ ID NO: 405209 - DNA, 25 bp, Mus musculus
agagccttccggtcaaaagccagga

SEQ ID NO: 405210 - DNA, 25 bp, Mus musculus
agagccttgttctccctcggtgtgc

SEQ ID NO: 405211 - DNA, 25 bp, Mus musculus
agagcgaaggcagcccagttggctc

SEQ ID NO: 405212 - DNA, 25 bp, Mus musculus
agagcgaggaggacttcctacggca

SEQ ID NO: 405213 - DNA, 25 bp, Mus musculus
agagcgctgtccagtctgtttgaac

SEQ ID NO: 405214 - DNA, 25 bp, Mus musculus
agagcggcgcggatggatccaacat

SEQ ID NO: 405215 - DNA, 25 bp, Mus musculus
agagcggctgcaagagttggttctc

SEQ ID NO: 405216 - DNA, 25 bp, Mus musculus
agagcgggacgcctctgaaagtcaa

SEQ ID NO: 405217 - DNA, 25 bp, Mus musculus
agagcgtcaacagggagatgtcacc

SEQ ID NO: 405218 - DNA, 25 bp, Mus musculus
agagctaaagctcgccctggctgag

SEQ ID NO: 405219 - DNA, 25 bp, Mus musculus
agagctaccaagaggcagccgctgc

SEQ ID NO: 405220 - DNA, 25 bp, Mus musculus
agagctacgaactgcctgacgggca

SEQ ID NO: 405221 - DNA, 25 bp, Mus musculus
agagctagtgtggtcttccttgacg

SEQ ID NO: 405222 - DNA, 25 bp, Mus musculus
agagctcccgacaagcaggccgctg

SEQ ID NO: 405223 - DNA, 25 bp, Mus musculus
agagctctgtgcctttcggtccaag

SEQ ID NO: 405224 - DNA, 25 bp, Mus musculus
agagctgaaatgacggtgttcgtgc

SEQ ID NO: 405225 - DNA, 25 bp, Mus musculus
agagctgcattgagaagcctgtcag

SEQ ID NO: 405226 - DNA, 25 bp, Mus musculus
agagctgtgactcggagccggctgg

SEQ ID NO: 405227 - DNA, 25 bp, Mus musculus
agagctgtgcgtcctgcccagaagt

SEQ ID NO: 405228 - DNA, 25 bp, Mus musculus
agagctgtggtcagcatcccggagc

SEQ ID NO: 405229 - DNA, 25 bp, Mus musculus
agagcttccgggtcgatctggacaa

SEQ ID NO: 405230 - DNA, 25 bp, Mus musculus
agaggaacctcagcgaaccaagaaa

SEQ ID NO: 405231 - DNA, 25 bp, Mus musculus
agaggaagacgtgcccatccggtac

SEQ ID NO: 405232 - DNA, 25 bp, Mus musculus
agaggacaacctctggtgctggtcc

SEQ ID NO: 405233 - DNA, 25 bp, Mus musculus
agaggacagatgctacggtgaaccc

SEQ ID NO: 405234 - DNA, 25 bp, Mus musculus
agaggaccaaccacactgcctagag

SEQ ID NO: 405235 - DNA, 25 bp, Mus musculus
agaggacccagctaacactcacagg

SEQ ID NO: 405236 - DNA, 25 bp, Mus musculus
agaggaccccagcatctcgggcatc

SEQ ID NO: 405237 - DNA, 25 bp, Mus musculus
agaggacgcagctgcccttgcccag

SEQ ID NO: 405238 - DNA, 25 bp, Mus musculus
agaggacgttctcctacagcgcaca

SEQ ID NO: 405239 - DNA, 25 bp, Mus musculus
agaggactgcttggtgatgcccgac

SEQ ID NO: 405240 - DNA, 25 bp, Mus musculus
agaggagcccagatcagagtcagaa

SEQ ID NO: 405241 - DNA, 25 bp, Mus musculus
agaggagccgtttccactctggccg

SEQ ID NO: 405242 - DNA, 25 bp, Mus musculus
agaggagctccgaggcctccctagt

SEQ ID NO: 405243 - DNA, 25 bp, Mus musculus
agaggagtccgttgacccccagtga

SEQ ID NO: 405244 - DNA, 25 bp, Mus musculus
agaggataccacatggagcaggcgt

SEQ ID NO: 405245 - DNA, 25 bp, Mus musculus
agaggatcgcctctccagcttgtca

SEQ ID NO: 405246 - DNA, 25 bp, Mus musculus
agaggatgctcaagcaccccttgct

SEQ ID NO: 405247 - DNA, 25 bp, Mus musculus
agaggcacgcctgcagatcgtccat

SEQ ID NO: 405248 - DNA, 25 bp, Mus musculus
agaggcagagtttgcgccaagttcc

SEQ ID NO: 405249 - DNA, 25 bp, Mus musculus
agaggcagcacaagaacgggcagat

SEQ ID NO: 405250 - DNA, 25 bp, Mus musculus
agaggccaagcaacaggtccatgat

SEQ ID NO: 405251 - DNA, 25 bp, Mus musculus
agaggccaaggcactacaggtgcga

SEQ ID NO: 405252 - DNA, 25 bp, Mus musculus
agaggccattgcttttcactgtgac

SEQ ID NO: 405253 - DNA, 25 bp, Mus musculus
agaggcccaagtgctccgagacatg

SEQ ID NO: 405254 - DNA, 25 bp, Mus musculus
agaggccgatcctcaagcccggcgg

SEQ ID NO: 405255 - DNA, 25 bp, Mus musculus
agaggccgttagaatccctccgtag

SEQ ID NO: 405256 - DNA, 25 bp, Mus musculus
agaggcctccagaccagacaagctc

SEQ ID NO: 405257 - DNA, 25 bp, Mus musculus
agaggcctccggttcatccatacaa

SEQ ID NO: 405258 - DNA, 25 bp, Mus musculus
agaggcgccacagtagccagtctct

SEQ ID NO: 405259 - DNA, 25 bp, Mus musculus
agaggcggagcctgcagaacaagat

SEQ ID NO: 405260 - DNA, 25 bp, Mus musculus
agaggctccctcaggtgggacagaa

SEQ ID NO: 405261 - DNA, 25 bp, Mus musculus
agaggctcctccgtctccttgggtc

SEQ ID NO: 405262 - DNA, 25 bp, Mus musculus
agaggctgccgcatccctagcatca

SEQ ID NO: 405263 - DNA, 25 bp, Mus musculus
agaggctgggcgctcgaccctggtc

SEQ ID NO: 405264 - DNA, 25 bp, Mus musculus
agaggctgtgcgacccacctcctgt

SEQ ID NO: 405265 - DNA, 25 bp, Mus musculus
agaggcttcctcacacacacgtgca

SEQ ID NO: 405266 - DNA, 25 bp, Mus musculus
agaggcttctagacgtgctggacac

SEQ ID NO: 405267 - DNA, 25 bp, Mus musculus
agaggcttgcaaacatcagggacca

SEQ ID NO: 405268 - DNA, 25 bp, Mus musculus
agagggaaaactcctgcgtgcgcct

SEQ ID NO: 405269 - DNA, 25 bp, Mus musculus
agagggagagacgacggcgtgaggc

SEQ ID NO: 405270 - DNA, 25 bp, Mus musculus
agagggcctgcctccaactctgcag

SEQ ID NO: 405271 - DNA, 25 bp, Mus musculus
agagggcctgtaggctctgagataa

SEQ ID NO: 405272 - DNA, 25 bp, Mus musculus
agagggcgcctttcctcgatcaagc

SEQ ID NO: 405273 - DNA, 25 bp, Mus musculus
agagggcgtagaggccttcgtccca

SEQ ID NO: 405274 - DNA, 25 bp, Mus musculus
agagggctgtgtaccgagatatcac

SEQ ID NO: 405275 - DNA, 25 bp, Mus musculus
agagggtacctctgaggacatggca

SEQ ID NO: 405276 - DNA, 25 bp, Mus musculus
agagggtatatttgtcgccagcccg

SEQ ID NO: 405277 - DNA, 25 bp, Mus musculus
agaggtcacaggaagactgagactg

SEQ ID NO: 405278 - DNA, 25 bp, Mus musculus
agaggtcacccagcagactgtggag

SEQ ID NO: 405279 - DNA, 25 bp, Mus musculus
agaggtcacggacccagcactgtct

SEQ ID NO: 405280 - DNA, 25 bp, Mus musculus
agaggtcagagaacgaagccgcagc

SEQ ID NO: 405281 - DNA, 25 bp, Mus musculus
agaggtctttgattccttcgaagga

SEQ ID NO: 405282 - DNA, 25 bp, Mus musculus
agaggtgcacgctgcctgccagaag

SEQ ID NO: 405283 - DNA, 25 bp, Mus musculus
agaggtgtgacatgccccaggagct

SEQ ID NO: 405284 - DNA, 25 bp, Mus musculus
agaggttcaagagctgaccccagta

SEQ ID NO: 405285 - DNA, 25 bp, Mus musculus
agagtaaaaggtgaccgcggctgcc

SEQ ID NO: 405286 - DNA, 25 bp, Mus musculus
agagtactccgttctgcgtgccaga

SEQ ID NO: 405287 - DNA, 25 bp, Mus musculus
agagtactgagccagccttcacaag

SEQ ID NO: 405288 - DNA, 25 bp, Mus musculus
agagtattccacaaggtccttagga

SEQ ID NO: 405289 - DNA, 25 bp, Mus musculus
agagtattcttttttccgccagcag

SEQ ID NO: 405290 - DNA, 25 bp, Mus musculus
agagtatttgttgtggccgaggcca

SEQ ID NO: 405291 - DNA, 25 bp, Mus musculus
agagtcaacgttcgagcctgtgccc

SEQ ID NO: 405292 - DNA, 25 bp, Mus musculus
agagtcacagccatcgacgggagct

SEQ ID NO: 405293 - DNA, 25 bp, Mus musculus
agagtcagggtctgcgcccacttct

SEQ ID NO: 405294 - DNA, 25 bp, Mus musculus
agagtcataaccctgctgttcccca

SEQ ID NO: 405295 - DNA, 25 bp, Mus musculus
agagtcatccttggccatgggacag

SEQ ID NO: 405296 - DNA, 25 bp, Mus musculus
agagtcctgctctcatgccaaaggg

SEQ ID NO: 405297 - DNA, 25 bp, Mus musculus
agagtctaagaaccctggcagctga

SEQ ID NO: 405298 - DNA, 25 bp, Mus musculus
agagtctctcttcagtccccgggaa

SEQ ID NO: 405299 - DNA, 25 bp, Mus musculus
agagtcttcatcttggtggcctgta

SEQ ID NO: 405300 - DNA, 25 bp, Mus musculus
agagtctttacatagctcagccctg

SEQ ID NO: 405301 - DNA, 25 bp, Mus musculus
agagtgagtactctgtgtctcccgg

SEQ ID NO: 405302 - DNA, 25 bp, Mus musculus
agagtgcaagtacgccatgctggcc

SEQ ID NO: 405303 - DNA, 25 bp, Mus musculus
agagtgcaatgcaggtaatcttcac

SEQ ID NO: 405304 - DNA, 25 bp, Mus musculus
agagtgcagtgagtgaacccagcct

SEQ ID NO: 405305 - DNA, 25 bp, Mus musculus
agagtgctgtcagcccaccgagtgg

SEQ ID NO: 405306 - DNA, 25 bp, Mus musculus
agagtgcttcccagctggtcagggc

SEQ ID NO: 405307 - DNA, 25 bp, Mus musculus
agagtggaccgagtgccctgaccag

SEQ ID NO: 405308 - DNA, 25 bp, Mus musculus
agagtggcgtaaacccaagaatgga

SEQ ID NO: 405309 - DNA, 25 bp, Mus musculus
agagtggttttcagctgcagtcgca

SEQ ID NO: 405310 - DNA, 25 bp, Mus musculus
agagtgtagaaagatcggaagagcc

SEQ ID NO: 405311 - DNA, 25 bp, Mus musculus
agagtgtctacggtccatggcaacg

SEQ ID NO: 405312 - DNA, 25 bp, Mus musculus
agagtgtctggtgatgcgggacccc

SEQ ID NO: 405313 - DNA, 25 bp, Mus musculus
agagtgtgcgcggaacccggctctc

SEQ ID NO: 405314 - DNA, 25 bp, Mus musculus
agagttcacaagacaagccagccag

SEQ ID NO: 405315 - DNA, 25 bp, Mus musculus
agagttcacggaggactgcccctct

SEQ ID NO: 405316 - DNA, 25 bp, Mus musculus
agagttcattctcgcagagcccaga

SEQ ID NO: 405317 - DNA, 25 bp, Mus musculus
agagttccgggagtttgcctgataa

SEQ ID NO: 405318 - DNA, 25 bp, Mus musculus
agagttctcaggaaaagtggtcagc

SEQ ID NO: 405319 - DNA, 25 bp, Mus musculus
agagttctccggttctacgtgccca

SEQ ID NO: 405320 - DNA, 25 bp, Mus musculus
agagttctgctgacacacgaggtga

SEQ ID NO: 405321 - DNA, 25 bp, Mus musculus
agagttctgtccactgtctagggca

SEQ ID NO: 405322 - DNA, 25 bp, Mus musculus
agagttctgtcgcacctatgtcctg

SEQ ID NO: 405323 - DNA, 25 bp, Mus musculus
agagttgcaccgtttccctggacca

SEQ ID NO: 405324 - DNA, 25 bp, Mus musculus
agagttgtttgtagggctctgtagc

SEQ ID NO: 405325 - DNA, 25 bp, Mus musculus
agagtttccgcaacggccagtacgc

SEQ ID NO: 405326 - DNA, 25 bp, Mus musculus
agagtttgcggacagcgatcctgcc

SEQ ID NO: 405327 - DNA, 25 bp, Mus musculus
agataaacatgagtgccccttcggc

SEQ ID NO: 405328 - DNA, 25 bp, Mus musculus
agataacaccatgcaacagccacag

SEQ ID NO: 405329 - DNA, 25 bp, Mus musculus
agataaccctttaatgagatatcaa

SEQ ID NO: 405330 - DNA, 25 bp, Mus musculus
agataagtgaatccgacagcccagg

SEQ ID NO: 405331 - DNA, 25 bp, Mus musculus
agatacaagtgttcagggagcccca

SEQ ID NO: 405332 - DNA, 25 bp, Mus musculus
agataccagtgtctcaggtgccaga

SEQ ID NO: 405333 - DNA, 25 bp, Mus musculus
agataccattaatgttgccaccagg

SEQ ID NO: 405334 - DNA, 25 bp, Mus musculus
agatactgattcgagccgcgcctta

SEQ ID NO: 405335 - DNA, 25 bp, Mus musculus
agatactggagttcgccgtgggcta

SEQ ID NO: 405336 - DNA, 25 bp, Mus musculus
agatactggtctcactctccacagg

SEQ ID NO: 405337 - DNA, 25 bp, Mus musculus
agatacttccgcctagagccgaaag

SEQ ID NO: 405338 - DNA, 25 bp, Mus musculus
agatactttgtgatgctctgaggaa

SEQ ID NO: 405339 - DNA, 25 bp, Mus musculus
agatagacacgtacctcaacgccgc

SEQ ID NO: 405340 - DNA, 25 bp, Mus musculus
agatagcaccagagttctgcccgca

SEQ ID NO: 405341 - DNA, 25 bp, Mus musculus
agatagccagactcttgccgtgcgc

SEQ ID NO: 405342 - DNA, 25 bp, Mus musculus
agatagctctgagggttccttgcca

SEQ ID NO: 405343 - DNA, 25 bp, Mus musculus
agatagctctgttattgttcagcca

SEQ ID NO: 405344 - DNA, 25 bp, Mus musculus
agatatactgatggccgaggctccg

SEQ ID NO: 405345 - DNA, 25 bp, Mus musculus
agatatccagtttcctccatcgagg

SEQ ID NO: 405346 - DNA, 25 bp, Mus musculus
agatatccttttgcgagctttcgag

SEQ ID NO: 405347 - DNA, 25 bp, Mus musculus
agatatctctcgttggagtccccag

SEQ ID NO: 405348 - DNA, 25 bp, Mus musculus
agatatgagaagagccttgaattgc

SEQ ID NO: 405349 - DNA, 25 bp, Mus musculus
agatatgggtctgcttctgactgtc

SEQ ID NO: 405350 - DNA, 25 bp, Mus musculus
agatatgtaaaactgccacccacgc

SEQ ID NO: 405351 - DNA, 25 bp, Mus musculus
agatattactcgagagggcctcccg

SEQ ID NO: 405352 - DNA, 25 bp, Mus musculus
agatattgccactgagcgtgcccag

SEQ ID NO: 405353 - DNA, 25 bp, Mus musculus
agatatttagtgctgctccgctgga

SEQ ID NO: 405354 - DNA, 25 bp, Mus musculus
agatcaagcctatgccaacagccag

SEQ ID NO: 405355 - DNA, 25 bp, Mus musculus
agatcacctgatctctggcaccctg

SEQ ID NO: 405356 - DNA, 25 bp, Mus musculus
agatcagagcaggaaaccccgttga

SEQ ID NO: 405357 - DNA, 25 bp, Mus musculus
agatcatattcttggcctggagccc

SEQ ID NO: 405358 - DNA, 25 bp, Mus musculus
agatccaacaagaccacccctgtgt

SEQ ID NO: 405359 - DNA, 25 bp, Mus musculus
agatccaccgtaaggccagaagagg

SEQ ID NO: 405360 - DNA, 25 bp, Mus musculus
agatccacctgtactctctcgctga

SEQ ID NO: 405361 - DNA, 25 bp, Mus musculus
agatccagctgtctatcgcctgtgc

SEQ ID NO: 405362 - DNA, 25 bp, Mus musculus
agatccatgctagaagcccagcagg

SEQ ID NO: 405363 - DNA, 25 bp, Mus musculus
agatccctgaggacgagcaactgca

SEQ ID NO: 405364 - DNA, 25 bp, Mus musculus
agatccggccctggaatctcagtga

SEQ ID NO: 405365 - DNA, 25 bp, Mus musculus
agatcctagggcaggtgtgcacacc

SEQ ID NO: 405366 - DNA, 25 bp, Mus musculus
agatcctccagctttaaatcccacg

SEQ ID NO: 405367 - DNA, 25 bp, Mus musculus
agatcctgatccagagccacatagc

SEQ ID NO: 405368 - DNA, 25 bp, Mus musculus
agatcctggcaggtcagctggcaga

SEQ ID NO: 405369 - DNA, 25 bp, Mus musculus
agatcctgggtggacccttcccgag

SEQ ID NO: 405370 - DNA, 25 bp, Mus musculus
agatccttgagccaggcactcacga

SEQ ID NO: 405371 - DNA, 25 bp, Mus musculus
agatcgcatcatttctcccatggag

SEQ ID NO: 405372 - DNA, 25 bp, Mus musculus
agatcgctcgcgaggccctgagcgc

SEQ ID NO: 405373 - DNA, 25 bp, Mus musculus
agatcgggccatccttctccacgat

SEQ ID NO: 405374 - DNA, 25 bp, Mus musculus
agatcgtgtcaaaggccgctcggat

SEQ ID NO: 405375 - DNA, 25 bp, Mus musculus
agatcgttggtggaagtgacgccca

SEQ ID NO: 405376 - DNA, 25 bp, Mus musculus
agatctacacttgggatggccgcca

SEQ ID NO: 405377 - DNA, 25 bp, Mus musculus
agatctacctcagcgcaggcgtgaa

SEQ ID NO: 405378 - DNA, 25 bp, Mus musculus
agatctcatggagctgggcggtttc

SEQ ID NO: 405379 - DNA, 25 bp, Mus musculus
agatctccgacttgttccctccagg

SEQ ID NO: 405380 - DNA, 25 bp, Mus musculus
agatctctcctttcagaaggacggg

SEQ ID NO: 405381 - DNA, 25 bp, Mus musculus
agatctgcttgaatttgtctcctag

SEQ ID NO: 405382 - DNA, 25 bp, Mus musculus
agatctggctctcccatccacatag

SEQ ID NO: 405383 - DNA, 25 bp, Mus musculus
agatctgtgatgacattttctgagc

SEQ ID NO: 405384 - DNA, 25 bp, Mus musculus
agatctgtgcaacagcgccgtggca

SEQ ID NO: 405385 - DNA, 25 bp, Mus musculus
agatctgtgccttcctgctgcgcaa

SEQ ID NO: 405386 - DNA, 25 bp, Mus musculus
agatctgttgacctgcggccgttgc

SEQ ID NO: 405387 - DNA, 25 bp, Mus musculus
agatcttgaattacctgtcgtcttg

SEQ ID NO: 405388 - DNA, 25 bp, Mus musculus
agatgaacctttggaaccggccagg

SEQ ID NO: 405389 - DNA, 25 bp, Mus musculus
agatgaacgaaatcgggagccctcg

SEQ ID NO: 405390 - DNA, 25 bp, Mus musculus
agatgaacggccgatactccagcaa

SEQ ID NO: 405391 - DNA, 25 bp, Mus musculus
agatgaactaatgctggagtggtgc

SEQ ID NO: 405392 - DNA, 25 bp, Mus musculus
agatgaccgtctacctgcacagtga

SEQ ID NO: 405393 - DNA, 25 bp, Mus musculus
agatgacgaccaagacactgaagcc

SEQ ID NO: 405394 - DNA, 25 bp, Mus musculus
agatgactctaaaacctggcgccct

SEQ ID NO: 405395 - DNA, 25 bp, Mus musculus
agatgactctccacatacctgtaga

SEQ ID NO: 405396 - DNA, 25 bp, Mus musculus
agatgagcatgtcccagtttgtgcg

SEQ ID NO: 405397 - DNA, 25 bp, Mus musculus
agatgagggcttgctctatgcctgg

SEQ ID NO: 405398 - DNA, 25 bp, Mus musculus
agatgagtgaaaattgcttctcgtg

SEQ ID NO: 405399 - DNA, 25 bp, Mus musculus
agatgatgacgttcagcctgcagga

SEQ ID NO: 405400 - DNA, 25 bp, Mus musculus
agatgattcgtgacctccagcagca

SEQ ID NO: 405401 - DNA, 25 bp, Mus musculus
agatgcattgaccagaacttgaggg

SEQ ID NO: 405402 - DNA, 25 bp, Mus musculus
agatgcccacggaggtccatgtggc

SEQ ID NO: 405403 - DNA, 25 bp, Mus musculus
agatgcccgggtagccatcaccatc

SEQ ID NO: 405404 - DNA, 25 bp, Mus musculus
agatgccctggcaagtccagggtcc

SEQ ID NO: 405405 - DNA, 25 bp, Mus musculus
agatgccgctcatgccattgtccca

SEQ ID NO: 405406 - DNA, 25 bp, Mus musculus
agatgcgctccctaaccacgtgtgt

SEQ ID NO: 405407 - DNA, 25 bp, Mus musculus
agatgcgctcgctgcttctggtccc

SEQ ID NO: 405408 - DNA, 25 bp, Mus musculus
agatgcgtctaagccttcctggagg

SEQ ID NO: 405409 - DNA, 25 bp, Mus musculus
agatgctacgaggtaagacaacccc

SEQ ID NO: 405410 - DNA, 25 bp, Mus musculus
agatgctgtaatcttgtgaaatgtt

SEQ ID NO: 405411 - DNA, 25 bp, Mus musculus
agatgcttcctaccctgtcgtgtga

SEQ ID NO: 405412 - DNA, 25 bp, Mus musculus
agatgcttggagtggaagcagaact

SEQ ID NO: 405413 - DNA, 25 bp, Mus musculus
agatggacatcctggcgaccgtcaa

SEQ ID NO: 405414 - DNA, 25 bp, Mus musculus
agatggagatggacaaacggattta

SEQ ID NO: 405415 - DNA, 25 bp, Mus musculus
agatggaggccatgcgtcagcagtc

SEQ ID NO: 405416 - DNA, 25 bp, Mus musculus
agatggatgccctcgctctgctctg

SEQ ID NO: 405417 - DNA, 25 bp, Mus musculus
agatggcacggtcttagaggtttca

SEQ ID NO: 405418 - DNA, 25 bp, Mus musculus
agatggccagcagagcggccacctt

SEQ ID NO: 405419 - DNA, 25 bp, Mus musculus
agatggccctctgcataaactcagg

SEQ ID NO: 405420 - DNA, 25 bp, Mus musculus
agatggcctcttcctcagcctaggg

SEQ ID NO: 405421 - DNA, 25 bp, Mus musculus
agatggcgactgcaatccggctgct

SEQ ID NO: 405422 - DNA, 25 bp, Mus musculus
agatggcggccgtcaaccacactat

SEQ ID NO: 405423 - DNA, 25 bp, Mus musculus
agatggcttgcctccgagggaaacg

SEQ ID NO: 405424 - DNA, 25 bp, Mus musculus
agatgggaacacacctggagacctg

SEQ ID NO: 405425 - DNA, 25 bp, Mus musculus
agatgggcaaaagagagtgttaaga

SEQ ID NO: 405426 - DNA, 25 bp, Mus musculus
agatgggttactggctcttgtgcaa

SEQ ID NO: 405427 - DNA, 25 bp, Mus musculus
agatggtactgaagcgccagctagc

SEQ ID NO: 405428 - DNA, 25 bp, Mus musculus
agatggtgcgctccaagttgcccaa

SEQ ID NO: 405429 - DNA, 25 bp, Mus musculus
agatggtgggaaaccccttggcctg

SEQ ID NO: 405430 - DNA, 25 bp, Mus musculus
agatggtgtattcctacggctccgg

SEQ ID NO: 405431 - DNA, 25 bp, Mus musculus
agatggttcccagcacttgtttgtg

SEQ ID NO: 405432 - DNA, 25 bp, Mus musculus
agatggttttccacgcaaaggcggt

SEQ ID NO: 405433 - DNA, 25 bp, Mus musculus
agatgtacgaggaagtgcacagtcc

SEQ ID NO: 405434 - DNA, 25 bp, Mus musculus
agatgtcagtgctcagccccacagt

SEQ ID NO: 405435 - DNA, 25 bp, Mus musculus
agatgtccaggctgtctgctcccag

SEQ ID NO: 405436 - DNA, 25 bp, Mus musculus
agatgtcctcagagccactagacct

SEQ ID NO: 405437 - DNA, 25 bp, Mus musculus
agatgtctgtccagcggagacggaa

SEQ ID NO: 405438 - DNA, 25 bp, Mus musculus
agatgtgacctggaagactgagccc

SEQ ID NO: 405439 - DNA, 25 bp, Mus musculus
agatgtgcaccgctacacgcagcct

SEQ ID NO: 405440 - DNA, 25 bp, Mus musculus
agatgtgtctgagcctctccacggg

SEQ ID NO: 405441 - DNA, 25 bp, Mus musculus
agatgtgtgcgtacaggctggttcc

SEQ ID NO: 405442 - DNA, 25 bp, Mus musculus
agatgtgttcctgtgcctgacgcga

SEQ ID NO: 405443 - DNA, 25 bp, Mus musculus
agatgttccagcaccgagagggctg

SEQ ID NO: 405444 - DNA, 25 bp, Mus musculus
agatgttctcgttagccctgcagga

SEQ ID NO: 405445 - DNA, 25 bp, Mus musculus
agatgttgccaagggtgggtacctc

SEQ ID NO: 405446 - DNA, 25 bp, Mus musculus
agatgttgttggattggacctggaa

SEQ ID NO: 405447 - DNA, 25 bp, Mus musculus
agatgtttgcagctttcccgccaga

SEQ ID NO: 405448 - DNA, 25 bp, Mus musculus
agattaaacagggtttgaggccagc

SEQ ID NO: 405449 - DNA, 25 bp, Mus musculus
agattacaagtaccctacagatagg

SEQ ID NO: 405450 - DNA, 25 bp, Mus musculus
agattacatctcttcctgcggcaag

SEQ ID NO: 405451 - DNA, 25 bp, Mus musculus
agattacattcctagacggcctcag

SEQ ID NO: 405452 - DNA, 25 bp, Mus musculus
agattcatcgcgagctgaggccgca

SEQ ID NO: 405453 - DNA, 25 bp, Mus musculus
agattcgctactccgtgccagaaga

SEQ ID NO: 405454 - DNA, 25 bp, Mus musculus
agattcggcgcagggcatccaagaa

SEQ ID NO: 405455 - DNA, 25 bp, Mus musculus
agattctgagaagtgcagcagcagc

SEQ ID NO: 405456 - DNA, 25 bp, Mus musculus
agattctgcaaaaggctgagcccca

SEQ ID NO: 405457 - DNA, 25 bp, Mus musculus
agattctgggtgtgttcgagagcct

SEQ ID NO: 405458 - DNA, 25 bp, Mus musculus
agattgaagcagagtctggaacagg

SEQ ID NO: 405459 - DNA, 25 bp, Mus musculus
agattgagcttgtgttccggcccca

SEQ ID NO: 405460 - DNA, 25 bp, Mus musculus
agattgaggagctagttgccaggcc

SEQ ID NO: 405461 - DNA, 25 bp, Mus musculus
agattgccaagttgctgaagccaca

SEQ ID NO: 405462 - DNA, 25 bp, Mus musculus
agattggagtcaatgcattttgcat

SEQ ID NO: 405463 - DNA, 25 bp, Mus musculus
agattggcccgcagattggaggatc

SEQ ID NO: 405464 - DNA, 25 bp, Mus musculus
agattggtgtgctgtgaattgcaca

SEQ ID NO: 405465 - DNA, 25 bp, Mus musculus
agattgtgtctcactctgtctagcc

SEQ ID NO: 405466 - DNA, 25 bp, Mus musculus
agatttaacttgaccctgactacag

SEQ ID NO: 405467 - DNA, 25 bp, Mus musculus
agatttcaggatgggaatgagccca

SEQ ID NO: 405468 - DNA, 25 bp, Mus musculus
agatttgaaggatgcactggccggc

SEQ ID NO: 405469 - DNA, 25 bp, Mus musculus
agatttgggtgccttcccagatggc

SEQ ID NO: 405470 - DNA, 25 bp, Mus musculus
agatttggtccaagccatccccgta

SEQ ID NO: 405471 - DNA, 25 bp, Mus musculus
agattttacaaatcccagggcagag

SEQ ID NO: 405472 - DNA, 25 bp, Mus musculus
agcaaaaacagcagggacttcccca

SEQ ID NO: 405473 - DNA, 25 bp, Mus musculus
agcaaagactgcgtgttcaccgaga

SEQ ID NO: 405474 - DNA, 25 bp, Mus musculus
agcaaagctaccatgagtcccggga

SEQ ID NO: 405475 - DNA, 25 bp, Mus musculus
agcaacagaagctgccgcgccgctg

SEQ ID NO: 405476 - DNA, 25 bp, Mus musculus
agcaaccaggctccagcctcggtgg

SEQ ID NO: 405477 - DNA, 25 bp, Mus musculus
agcaaccattgaccagacaacccag

SEQ ID NO: 405478 - DNA, 25 bp, Mus musculus
agcaaccttgctcgtttagcccagg

SEQ ID NO: 405479 - DNA, 25 bp, Mus musculus
agcaacggatgctggtgacacccga

SEQ ID NO: 405480 - DNA, 25 bp, Mus musculus
agcaacgggcttcggcttcttgaac

SEQ ID NO: 405481 - DNA, 25 bp, Mus musculus
agcaactgactgcccacagcagagc

SEQ ID NO: 405482 - DNA, 25 bp, Mus musculus
agcaactggtgagtactggagatcc

SEQ ID NO: 405483 - DNA, 25 bp, Mus musculus
agcaagaaggtctcacacgcacaga

SEQ ID NO: 405484 - DNA, 25 bp, Mus musculus
agcaagaggcccaggaaggacgcac

SEQ ID NO: 405485 - DNA, 25 bp, Mus musculus
agcaagcattgctggcgtgacaccg

SEQ ID NO: 405486 - DNA, 25 bp, Mus musculus
agcaagcttatgtgatgccagcaga

SEQ ID NO: 405487 - DNA, 25 bp, Mus musculus
agcaagggccattcgcggagtacta

SEQ ID NO: 405488 - DNA, 25 bp, Mus musculus
agcaaggtccttgtacgagcgcggc

SEQ ID NO: 405489 - DNA, 25 bp, Mus musculus
agcaaggttccgctggtcgtcctac

SEQ ID NO: 405490 - DNA, 25 bp, Mus musculus
agcaaggttgcaagggactcgatcc

SEQ ID NO: 405491 - DNA, 25 bp, Mus musculus
agcaagtcccttttatggtcccagg

SEQ ID NO: 405492 - DNA, 25 bp, Mus musculus
agcaagttgttctacccctggtcac

SEQ ID NO: 405493 - DNA, 25 bp, Mus musculus
agcaataccgcagggagcgggaaca

SEQ ID NO: 405494 - DNA, 25 bp, Mus musculus
agcaatctgtcctccactgtcttgg

SEQ ID NO: 405495 - DNA, 25 bp, Mus musculus
agcaatgacactgcccttctgtggg

SEQ ID NO: 405496 - DNA, 25 bp, Mus musculus
agcaatgcccttcagcctgtctaca

SEQ ID NO: 405497 - DNA, 25 bp, Mus musculus
agcacaaagagggacgggcagaccc

SEQ ID NO: 405498 - DNA, 25 bp, Mus musculus
agcacaacagagtccgggacccaga

SEQ ID NO: 405499 - DNA, 25 bp, Mus musculus
agcacaacccgctgagtgcgcgagc

SEQ ID NO: 405500 - DNA, 25 bp, Mus musculus
agcacaagcctctagggcatttggg

SEQ ID NO: 405501 - DNA, 25 bp, Mus musculus
agcacacactgatggccaccagaag

SEQ ID NO: 405502 - DNA, 25 bp, Mus musculus
agcacacagactgggtaccacatgg

SEQ ID NO: 405503 - DNA, 25 bp, Mus musculus
agcacacagcagtcaagagttccca

SEQ ID NO: 405504 - DNA, 25 bp, Mus musculus
agcacaccacggagaagcccacaga

SEQ ID NO: 405505 - DNA, 25 bp, Mus musculus
agcacactgtgaccggactctccat

SEQ ID NO: 405506 - DNA, 25 bp, Mus musculus
agcacaggatggttgtggatctttg

SEQ ID NO: 405507 - DNA, 25 bp, Mus musculus
agcacagggatagggctggctctca

SEQ ID NO: 405508 - DNA, 25 bp, Mus musculus
agcacatctggaatgcctcccttgg

SEQ ID NO: 405509 - DNA, 25 bp, Mus musculus
agcacattccactgcttccttggca

SEQ ID NO: 405510 - DNA, 25 bp, Mus musculus
agcaccaagaggagccatcacagaa

SEQ ID NO: 405511 - DNA, 25 bp, Mus musculus
agcaccctatgggaggagtcctcag

SEQ ID NO: 405512 - DNA, 25 bp, Mus musculus
agcaccgccgcaggtggctaaggct

SEQ ID NO: 405513 - DNA, 25 bp, Mus musculus
agcaccgtgagcaacctcagccatt

SEQ ID NO: 405514 - DNA, 25 bp, Mus musculus
agcacctacttctggtgactcacga

SEQ ID NO: 405515 - DNA, 25 bp, Mus musculus
agcacctcctccatgttgaccaagc

SEQ ID NO: 405516 - DNA, 25 bp, Mus musculus
agcacctcctttgcagcagacattg

SEQ ID NO: 405517 - DNA, 25 bp, Mus musculus
agcacctcggcttcttcctttcagg

SEQ ID NO: 405518 - DNA, 25 bp, Mus musculus
agcacctctacccaagtctatggac

SEQ ID NO: 405519 - DNA, 25 bp, Mus musculus
agcaccttcagagcttgcaccagaa

SEQ ID NO: 405520 - DNA, 25 bp, Mus musculus
agcacgacggcgacgtccgtgcagc

SEQ ID NO: 405521 - DNA, 25 bp, Mus musculus
agcactaaccacacttcctgtttgg

SEQ ID NO: 405522 - DNA, 25 bp, Mus musculus
agcactacggccagttcacgtgcga

SEQ ID NO: 405523 - DNA, 25 bp, Mus musculus
agcactcatgcaccgatgccctctt

SEQ ID NO: 405524 - DNA, 25 bp, Mus musculus
agcactcctgagaacctggtccagg

SEQ ID NO: 405525 - DNA, 25 bp, Mus musculus
agcactcggacgaggatgctcccag

SEQ ID NO: 405526 - DNA, 25 bp, Mus musculus
agcactcgggagacctgggtctgcc

SEQ ID NO: 405527 - DNA, 25 bp, Mus musculus
agcactgctactctgcctggttcct

SEQ ID NO: 405528 - DNA, 25 bp, Mus musculus
agcactggattctcatccggaggga

SEQ ID NO: 405529 - DNA, 25 bp, Mus musculus
agcacttgcccgtttgtagccatag

SEQ ID NO: 405530 - DNA, 25 bp, Mus musculus
agcacttggtgctctgacctggtgg

SEQ ID NO: 405531 - DNA, 25 bp, Mus musculus
agcacttgtttgtgtctgtagggac

SEQ ID NO: 405532 - DNA, 25 bp, Mus musculus
agcactttaacgtcctcgtcctcat

SEQ ID NO: 405533 - DNA, 25 bp, Mus musculus
agcagaaacacaccggcctggctgg

SEQ ID NO: 405534 - DNA, 25 bp, Mus musculus
agcagaacacaagccagagaaactt

SEQ ID NO: 405535 - DNA, 25 bp, Mus musculus
agcagaagtgagtccatcgcctccc

SEQ ID NO: 405536 - DNA, 25 bp, Mus musculus
agcagagctgaaggtctgcccacgc

SEQ ID NO: 405537 - DNA, 25 bp, Mus musculus
agcagagctgagtacctggcaagga

SEQ ID NO: 405538 - DNA, 25 bp, Mus musculus
agcagatgccgccttgcactttaac

SEQ ID NO: 405539 - DNA, 25 bp, Mus musculus
agcagcaagaaactacggcacacca

SEQ ID NO: 405540 - DNA, 25 bp, Mus musculus
agcagcacaaacaagagaaagcccc

SEQ ID NO: 405541 - DNA, 25 bp, Mus musculus
agcagcagcctctgcgaacagagcc

SEQ ID NO: 405542 - DNA, 25 bp, Mus musculus
agcagcagcgctttcatccaggcaa

SEQ ID NO: 405543 - DNA, 25 bp, Mus musculus
agcagcaggagcaaactatcgccga

SEQ ID NO: 405544 - DNA, 25 bp, Mus musculus
agcagcagtcccagagccgagtgct

SEQ ID NO: 405545 - DNA, 25 bp, Mus musculus
agcagcagtcgagggcttggtattc

SEQ ID NO: 405546 - DNA, 25 bp, Mus musculus
agcagcagtctgtttcctcttcgag

SEQ ID NO: 405547 - DNA, 25 bp, Mus musculus
agcagccattcagagccctgcatgg

SEQ ID NO: 405548 - DNA, 25 bp, Mus musculus
agcagcccatcaacgaggagcaggc

SEQ ID NO: 405549 - DNA, 25 bp, Mus musculus
agcagcccttgtcctcgaaatcgag

SEQ ID NO: 405550 - DNA, 25 bp, Mus musculus
agcagccggcatgaggaattcccag

SEQ ID NO: 405551 - DNA, 25 bp, Mus musculus
agcagccgggccaagagtttaacca

SEQ ID NO: 405552 - DNA, 25 bp, Mus musculus
agcagcgactccctctgagtggtcc

SEQ ID NO: 405553 - DNA, 25 bp, Mus musculus
agcagcggccgttcacaaggatgct

SEQ ID NO: 405554 - DNA, 25 bp, Mus musculus
agcagcgtaaacacaaccagcgggt

SEQ ID NO: 405555 - DNA, 25 bp, Mus musculus
agcagctgcatgttggattccctcc

SEQ ID NO: 405556 - DNA, 25 bp, Mus musculus
agcagcttagatttagaagtcttct

SEQ ID NO: 405557 - DNA, 25 bp, Mus musculus
agcagcttcgcttcaccgtggtgga

SEQ ID NO: 405558 - DNA, 25 bp, Mus musculus
agcaggagtttcagcgggcccaagc

SEQ ID NO: 405559 - DNA, 25 bp, Mus musculus
agcaggcataactcaccactcctgg

SEQ ID NO: 405560 - DNA, 25 bp, Mus musculus
agcaggccttctccgtgggtctgaa

SEQ ID NO: 405561 - DNA, 25 bp, Mus musculus
agcaggcttctgtggacagtgtcac

SEQ ID NO: 405562 - DNA, 25 bp, Mus musculus
agcagggctagtggccacagagcca

SEQ ID NO: 405563 - DNA, 25 bp, Mus musculus
agcaggtaccttgctgcgacccgtg

SEQ ID NO: 405564 - DNA, 25 bp, Mus musculus
agcaggtgccgagtgcctggcctca

SEQ ID NO: 405565 - DNA, 25 bp, Mus musculus
agcaggtggttgtacctcccttgac

SEQ ID NO: 405566 - DNA, 25 bp, Mus musculus
agcaggttggccactgcctggtaca

SEQ ID NO: 405567 - DNA, 25 bp, Mus musculus
agcagtcagagccatgttacccacg

SEQ ID NO: 405568 - DNA, 25 bp, Mus musculus
agcagtcgggtcaaggcgtgcttct

SEQ ID NO: 405569 - DNA, 25 bp, Mus musculus
agcagtctggcaactcctaaggcgg

SEQ ID NO: 405570 - DNA, 25 bp, Mus musculus
agcagtgctgcgtcccgtgtcagtt

SEQ ID NO: 405571 - DNA, 25 bp, Mus musculus
agcagtgtagttattgcctttcaga

SEQ ID NO: 405572 - DNA, 25 bp, Mus musculus
agcagttaggaagtgaataacccac

SEQ ID NO: 405573 - DNA, 25 bp, Mus musculus
agcagttagtgagcaacagggcgcc

SEQ ID NO: 405574 - DNA, 25 bp, Mus musculus
agcagttcggacgacatggcgccat

SEQ ID NO: 405575 - DNA, 25 bp, Mus musculus
agcagttctgcatccgaaggcctcg

SEQ ID NO: 405576 - DNA, 25 bp, Mus musculus
agcatcacgtcctctgacagattgg

SEQ ID NO: 405577 - DNA, 25 bp, Mus musculus
agcatccacgtgttggctcagccag

SEQ ID NO: 405578 - DNA, 25 bp, Mus musculus
agcatcctctgacagctccgttctg

SEQ ID NO: 405579 - DNA, 25 bp, Mus musculus
agcatcctgctgaacggtctggccg

SEQ ID NO: 405580 - DNA, 25 bp, Mus musculus
agcatcggcgcacccggagtttcca

SEQ ID NO: 405581 - DNA, 25 bp, Mus musculus
agcatcgtctgtctgcgcccagagc

SEQ ID NO: 405582 - DNA, 25 bp, Mus musculus
agcatctaaatcaccagcgccaggg

SEQ ID NO: 405583 - DNA, 25 bp, Mus musculus
agcatctcaacaagcaccagggcgt

SEQ ID NO: 405584 - DNA, 25 bp, Mus musculus
agcatctgtcagtggccagaccacc

SEQ ID NO: 405585 - DNA, 25 bp, Mus musculus
agcatctgtccatcaaaagatccca

SEQ ID NO: 405586 - DNA, 25 bp, Mus musculus
agcatcttgatgagcttccaccacc

SEQ ID NO: 405587 - DNA, 25 bp, Mus musculus
agcatgactttgtgaggagccgcca

SEQ ID NO: 405588 - DNA, 25 bp, Mus musculus
agcatgagggtgatcttagtcgagc

SEQ ID NO: 405589 - DNA, 25 bp, Mus musculus
agcatgattactggcaagttcccag

SEQ ID NO: 405590 - DNA, 25 bp, Mus musculus
agcatgccatcactggtatagtggg

SEQ ID NO: 405591 - DNA, 25 bp, Mus musculus
agcatgctaagcaggatctcctctt

SEQ ID NO: 405592 - DNA, 25 bp, Mus musculus
agcatgcttggaaacacagcggcca

SEQ ID NO: 405593 - DNA, 25 bp, Mus musculus
agcatggacaaatgtccctgaagtg

SEQ ID NO: 405594 - DNA, 25 bp, Mus musculus
agcatggccatgattagacaacacg

SEQ ID NO: 405595 - DNA, 25 bp, Mus musculus
agcatggtaggatccgtgtcccgga

SEQ ID NO: 405596 - DNA, 25 bp, Mus musculus
agcatgtatcctagctccgtgcgcc

SEQ ID NO: 405597 - DNA, 25 bp, Mus musculus
agcatgtctgtggtagtgtgtctgc

SEQ ID NO: 405598 - DNA, 25 bp, Mus musculus
agcattggacagtgagccctcccaa

SEQ ID NO: 405599 - DNA, 25 bp, Mus musculus
agcatttcactcaccatagcaagga

SEQ ID NO: 405600 - DNA, 25 bp, Mus musculus
agcatttcatcttctactttctgga

SEQ ID NO: 405601 - DNA, 25 bp, Mus musculus
agccaaaatgtggtctgatgaaaca

SEQ ID NO: 405602 - DNA, 25 bp, Mus musculus
agccaaattggtccttcccgcaggg

SEQ ID NO: 405603 - DNA, 25 bp, Mus musculus
agccaaccgaggcacttatggagtg

SEQ ID NO: 405604 - DNA, 25 bp, Mus musculus
agccaaggccatggaattccctgaa

SEQ ID NO: 405605 - DNA, 25 bp, Mus musculus
agccaaggcttcacccagtcctaag

SEQ ID NO: 405606 - DNA, 25 bp, Mus musculus
agccaatgaccatttggcaggaggg

SEQ ID NO: 405607 - DNA, 25 bp, Mus musculus
agccaatgtccctaccagctggttc

SEQ ID NO: 405608 - DNA, 25 bp, Mus musculus
agccaattcggtgtggaagatctcc

SEQ ID NO: 405609 - DNA, 25 bp, Mus musculus
agccacaccatggagccctggctgt

SEQ ID NO: 405610 - DNA, 25 bp, Mus musculus
agccacagaccttgtaaacccacga

SEQ ID NO: 405611 - DNA, 25 bp, Mus musculus
agccaccagagcagagcccctgtgt

SEQ ID NO: 405612 - DNA, 25 bp, Mus musculus
agccaccattctgtagtctcttgca

SEQ ID NO: 405613 - DNA, 25 bp, Mus musculus
agccacctggatatcctgtgtgtgc

SEQ ID NO: 405614 - DNA, 25 bp, Mus musculus
agccaccttgagcatggagaccaca

SEQ ID NO: 405615 - DNA, 25 bp, Mus musculus
agccacgctgctctttggtctccta

SEQ ID NO: 405616 - DNA, 25 bp, Mus musculus
agccactcttggagcgggttgctga

SEQ ID NO: 405617 - DNA, 25 bp, Mus musculus
agccactggagagggcacacgctag

SEQ ID NO: 405618 - DNA, 25 bp, Mus musculus
agccactggccctgtcttgtttgct

SEQ ID NO: 405619 - DNA, 25 bp, Mus musculus
agccactgtgccattgtctaagaaa

SEQ ID NO: 405620 - DNA, 25 bp, Mus musculus
agccactgtggacaggtgatccatc

SEQ ID NO: 405621 - DNA, 25 bp, Mus musculus
agccagacctcctcgcaagtgacag

SEQ ID NO: 405622 - DNA, 25 bp, Mus musculus
agccagataacctcggacacacatc

SEQ ID NO: 405623 - DNA, 25 bp, Mus musculus
agccagcagtttctaatgtcaccga

SEQ ID NO: 405624 - DNA, 25 bp, Mus musculus
agccagctctgtttacctggaccca

SEQ ID NO: 405625 - DNA, 25 bp, Mus musculus
agccagctgggcaggtagccagcac

SEQ ID NO: 405626 - DNA, 25 bp, Mus musculus
agccaggaacttgtacagcaccagg

SEQ ID NO: 405627 - DNA, 25 bp, Mus musculus
agccaggagcatgggagcttagtta

SEQ ID NO: 405628 - DNA, 25 bp, Mus musculus
agccaggcaccatggacactcctgt

SEQ ID NO: 405629 - DNA, 25 bp, Mus musculus
agccaggctgcttagaattatcatg

SEQ ID NO: 405630 - DNA, 25 bp, Mus musculus
agccagggtcctgatcttggtaggc

SEQ ID NO: 405631 - DNA, 25 bp, Mus musculus
agccagtcggcgatgccagagcatg

SEQ ID NO: 405632 - DNA, 25 bp, Mus musculus
agccagtgcaccgtacacataaaat

SEQ ID NO: 405633 - DNA, 25 bp, Mus musculus
agccagtgggccaccggacagtgtt

SEQ ID NO: 405634 - DNA, 25 bp, Mus musculus
agccagtgggtgaaaatgatgcaga

SEQ ID NO: 405635 - DNA, 25 bp, Mus musculus
agccatagcagtgcccttttatggc

SEQ ID NO: 405636 - DNA, 25 bp, Mus musculus
agccatatgggctgctcccaggcac

SEQ ID NO: 405637 - DNA, 25 bp, Mus musculus
agccatcaagctggtgctcaccgta

SEQ ID NO: 405638 - DNA, 25 bp, Mus musculus
agccatcaggttcaacagagaaatg

SEQ ID NO: 405639 - DNA, 25 bp, Mus musculus
agccatgatggaggcaccaggcgct

SEQ ID NO: 405640 - DNA, 25 bp, Mus musculus
agccatgggcgcacgtgtttgcaga

SEQ ID NO: 405641 - DNA, 25 bp, Mus musculus
agccatttaatcagggaaagcaccc

SEQ ID NO: 405642 - DNA, 25 bp, Mus musculus
agccatttggtttcactcagtgttc

SEQ ID NO: 405643 - DNA, 25 bp, Mus musculus
agcccaaccgtccagcagtgaggac

SEQ ID NO: 405644 - DNA, 25 bp, Mus musculus
agcccaagatggagctccactgcct

SEQ ID NO: 405645 - DNA, 25 bp, Mus musculus
agcccaagtgtggtgtgggcctcca

SEQ ID NO: 405646 - DNA, 25 bp, Mus musculus
agcccactccgacattaaactagga

SEQ ID NO: 405647 - DNA, 25 bp, Mus musculus
agcccactcctcatgaggtctgcta

SEQ ID NO: 405648 - DNA, 25 bp, Mus musculus
agcccagacatttgccacagcaaaa

SEQ ID NO: 405649 - DNA, 25 bp, Mus musculus
agcccagcatacagactgctgacag

SEQ ID NO: 405650 - DNA, 25 bp, Mus musculus
agcccagggtttgttctctagccaa

SEQ ID NO: 405651 - DNA, 25 bp, Mus musculus
agcccatcatcttcgtttctgacag

SEQ ID NO: 405652 - DNA, 25 bp, Mus musculus
agcccatctggtggaaagagagacc

SEQ ID NO: 405653 - DNA, 25 bp, Mus musculus
agcccatgtctcctcgctgtgggag

SEQ ID NO: 405654 - DNA, 25 bp, Mus musculus
agccccagcaagaaccgcgggcttt

SEQ ID NO: 405655 - DNA, 25 bp, Mus musculus
agccccattgcttcttctttttaag

SEQ ID NO: 405656 - DNA, 25 bp, Mus musculus
agccccccgccgatgatggagcgga

SEQ ID NO: 405657 - DNA, 25 bp, Mus musculus
agcccccctatgagccggagtcagg

SEQ ID NO: 405658 - DNA, 25 bp, Mus musculus
agccccgccctgattgccaatatag

SEQ ID NO: 405659 - DNA, 25 bp, Mus musculus
agccccgtttctaggatcgtaagcg

SEQ ID NO: 405660 - DNA, 25 bp, Mus musculus
agcccctactttctggctgtgccag

SEQ ID NO: 405661 - DNA, 25 bp, Mus musculus
agcccctccctgctagtcagagata

SEQ ID NO: 405662 - DNA, 25 bp, Mus musculus
agccccttggaaactcggagctggg

SEQ ID NO: 405663 - DNA, 25 bp, Mus musculus
agcccgagctattttgacagtcaaa

SEQ ID NO: 405664 - DNA, 25 bp, Mus musculus
agcccgccggagagcacagctgcgt

SEQ ID NO: 405665 - DNA, 25 bp, Mus musculus
agcccgctgctggactccgatttga

SEQ ID NO: 405666 - DNA, 25 bp, Mus musculus
agcccggcaatgtggagaacaacgg

SEQ ID NO: 405667 - DNA, 25 bp, Mus musculus
agcccggcgtacaggtcgcacggct

SEQ ID NO: 405668 - DNA, 25 bp, Mus musculus
agcccggctggtcgcagacatctgc

SEQ ID NO: 405669 - DNA, 25 bp, Mus musculus
agcccgtctcacagaggacagcaac

SEQ ID NO: 405670 - DNA, 25 bp, Mus musculus
agcccgttgtcaggtgcagtgccga

SEQ ID NO: 405671 - DNA, 25 bp, Mus musculus
agccctactggatcggcgacggcgt

SEQ ID NO: 405672 - DNA, 25 bp, Mus musculus
agccctagatgaagtggatgcgcca

SEQ ID NO: 405673 - DNA, 25 bp, Mus musculus
agccctatccgtgtttctgttctgg

SEQ ID NO: 405674 - DNA, 25 bp, Mus musculus
agccctggaggtggcgctgggttcc

SEQ ID NO: 405675 - DNA, 25 bp, Mus musculus
agccctgggcggaagacaacaaggt

SEQ ID NO: 405676 - DNA, 25 bp, Mus musculus
agccctggttccttcggtgatttgt

SEQ ID NO: 405677 - DNA, 25 bp, Mus musculus
agccctgtaaggtagttcttgccca

SEQ ID NO: 405678 - DNA, 25 bp, Mus musculus
agccctgtccgagtctgttctataa

SEQ ID NO: 405679 - DNA, 25 bp, Mus musculus
agccctgtgcgggtcatcgcttgcg

SEQ ID NO: 405680 - DNA, 25 bp, Mus musculus
agcccttttgtctgtgcccagcgag

SEQ ID NO: 405681 - DNA, 25 bp, Mus musculus
agccgagagcggctagccatcagca

SEQ ID NO: 405682 - DNA, 25 bp, Mus musculus
agccgagcagggacatctacctggg

SEQ ID NO: 405683 - DNA, 25 bp, Mus musculus
agccgaggcaggatccgcagccatg

SEQ ID NO: 405684 - DNA, 25 bp, Mus musculus
agccgaggcccctacggaaggctct

SEQ ID NO: 405685 - DNA, 25 bp, Mus musculus
agccgccatcaaaaggtccacactg

SEQ ID NO: 405686 - DNA, 25 bp, Mus musculus
agccgcctagcttcctacagtgtca

SEQ ID NO: 405687 - DNA, 25 bp, Mus musculus
agccgcctgagtatccctggatgaa

SEQ ID NO: 405688 - DNA, 25 bp, Mus musculus
agccgctgcgtctcaggtctctttt

SEQ ID NO: 405689 - DNA, 25 bp, Mus musculus
agccggagacctgagccgaccttga

SEQ ID NO: 405690 - DNA, 25 bp, Mus musculus
agccggagccgtactgggttaagca

SEQ ID NO: 405691 - DNA, 25 bp, Mus musculus
agccggagcggtgggactcctcctt

SEQ ID NO: 405692 - DNA, 25 bp, Mus musculus
agccggatggcttcttgagaggaac

SEQ ID NO: 405693 - DNA, 25 bp, Mus musculus
agccggccagcaagagcttctccta

SEQ ID NO: 405694 - DNA, 25 bp, Mus musculus
agccggcgcgcttctctagttgcag

SEQ ID NO: 405695 - DNA, 25 bp, Mus musculus
agccggctgggaagccgctgtttcc

SEQ ID NO: 405696 - DNA, 25 bp, Mus musculus
agccggtcctgggacaagaggctat

SEQ ID NO: 405697 - DNA, 25 bp, Mus musculus
agccgtcagcccaggtcggtatgag

SEQ ID NO: 405698 - DNA, 25 bp, Mus musculus
agccgtctggccgaaattgagtaac

SEQ ID NO: 405699 - DNA, 25 bp, Mus musculus
agccgtgggcaagacgtgtcttctc

SEQ ID NO: 405700 - DNA, 25 bp, Mus musculus
agccgttgaaaggtaggtctaatag

SEQ ID NO: 405701 - DNA, 25 bp, Mus musculus
agcctaaagactgcgacttcctgga

SEQ ID NO: 405702 - DNA, 25 bp, Mus musculus
agcctaaccacctacagccaggagg

SEQ ID NO: 405703 - DNA, 25 bp, Mus musculus
agcctaacctggagacctgcagcag

SEQ ID NO: 405704 - DNA, 25 bp, Mus musculus
agcctacaaccatggtggtaccacc

SEQ ID NO: 405705 - DNA, 25 bp, Mus musculus
agcctagacaacagcaccgcaagct

SEQ ID NO: 405706 - DNA, 25 bp, Mus musculus
agcctagctgagactcaagccccag

SEQ ID NO: 405707 - DNA, 25 bp, Mus musculus
agcctcacgtccatgtccgtggcgg

SEQ ID NO: 405708 - DNA, 25 bp, Mus musculus
agcctcaggtatctctcaggcactg

SEQ ID NO: 405709 - DNA, 25 bp, Mus musculus
agcctcatcctcatactgttcataa

SEQ ID NO: 405710 - DNA, 25 bp, Mus musculus
agcctcccatcatgaggtggcagct

SEQ ID NO: 405711 - DNA, 25 bp, Mus musculus
agcctcctctcaacatggtctacag

SEQ ID NO: 405712 - DNA, 25 bp, Mus musculus
agcctcggaacctgctgctagcctt

SEQ ID NO: 405713 - DNA, 25 bp, Mus musculus
agcctcggaggctcaaggtcagcca

SEQ ID NO: 405714 - DNA, 25 bp, Mus musculus
agcctcttcagagggcttgtggcaa

SEQ ID NO: 405715 - DNA, 25 bp, Mus musculus
agcctgaaacccgaggtggcccaga

SEQ ID NO: 405716 - DNA, 25 bp, Mus musculus
agcctgaactggtttggagtcagtg

SEQ ID NO: 405717 - DNA, 25 bp, Mus musculus
agcctgaccgtcaccactggcatga

SEQ ID NO: 405718 - DNA, 25 bp, Mus musculus
agcctgacgcctggccaggagtgtt

SEQ ID NO: 405719 - DNA, 25 bp, Mus musculus
agcctgagctctgttgcaacgttgc

SEQ ID NO: 405720 - DNA, 25 bp, Mus musculus
agcctgcctgcgcagtgacccgatt

SEQ ID NO: 405721 - DNA, 25 bp, Mus musculus
agcctgcctgtgtcatggtcctgga

SEQ ID NO: 405722 - DNA, 25 bp, Mus musculus
agcctggccgcaaggactcggccga

SEQ ID NO: 405723 - DNA, 25 bp, Mus musculus
agcctggcggctggcctcataaaca

SEQ ID NO: 405724 - DNA, 25 bp, Mus musculus
agcctgggaaagtatctcaatagag

SEQ ID NO: 405725 - DNA, 25 bp, Mus musculus
agcctgggtctcatggactactacc

SEQ ID NO: 405726 - DNA, 25 bp, Mus musculus
agcctggtgtctagtcgcccatcgt

SEQ ID NO: 405727 - DNA, 25 bp, Mus musculus
agcctgtagaatggagtctgagaag

SEQ ID NO: 405728 - DNA, 25 bp, Mus musculus
agcctgtaggtactggaactgctca

SEQ ID NO: 405729 - DNA, 25 bp, Mus musculus
agcctgtcagcgctgggagccacct

SEQ ID NO: 405730 - DNA, 25 bp, Mus musculus
agcctgtcctccgtagctttgggaa

SEQ ID NO: 405731 - DNA, 25 bp, Mus musculus
agcctgtcttgcaggaacccttcct

SEQ ID NO: 405732 - DNA, 25 bp, Mus musculus
agcctgtgccaggacgtggtattca

SEQ ID NO: 405733 - DNA, 25 bp, Mus musculus
agccttacagctgcgatatatacag

SEQ ID NO: 405734 - DNA, 25 bp, Mus musculus
agccttagccgccatgtcttccggg

SEQ ID NO: 405735 - DNA, 25 bp, Mus musculus
agccttatggcggacgggacctgtc

SEQ ID NO: 405736 - DNA, 25 bp, Mus musculus
agccttcaaaggagtggctctggga

SEQ ID NO: 405737 - DNA, 25 bp, Mus musculus
agccttgagtcccagggtgtgcact

SEQ ID NO: 405738 - DNA, 25 bp, Mus musculus
agccttgcaccttcatcgagaccat

SEQ ID NO: 405739 - DNA, 25 bp, Mus musculus
agccttgcccgcagtgctcatggag

SEQ ID NO: 405740 - DNA, 25 bp, Mus musculus
agccttgccctgtccacgtgtgtct

SEQ ID NO: 405741 - DNA, 25 bp, Mus musculus
agccttggccacgagttggcctagg

SEQ ID NO: 405742 - DNA, 25 bp, Mus musculus
agccttggcccgaggccagcacatt

SEQ ID NO: 405743 - DNA, 25 bp, Mus musculus
agccttggccttggtcatgggcaga

SEQ ID NO: 405744 - DNA, 25 bp, Mus musculus
agccttggctgaaccagatggacag

SEQ ID NO: 405745 - DNA, 25 bp, Mus musculus
agccttggctgcagcgcgcaggagg

SEQ ID NO: 405746 - DNA, 25 bp, Mus musculus
agcctttccttttactgcgcctgcg

SEQ ID NO: 405747 - DNA, 25 bp, Mus musculus
agcctttctgctggttagtctacac

SEQ ID NO: 405748 - DNA, 25 bp, Mus musculus
agccttttccactcctctagacatg

SEQ ID NO: 405749 - DNA, 25 bp, Mus musculus
agcgaaaaatttggcctcagccagc

SEQ ID NO: 405750 - DNA, 25 bp, Mus musculus
agcgaaagcctgatgcactgcggga

SEQ ID NO: 405751 - DNA, 25 bp, Mus musculus
agcgaccggacaacggagccgctga

SEQ ID NO: 405752 - DNA, 25 bp, Mus musculus
agcgaccgggtgtcggcctccaagc

SEQ ID NO: 405753 - DNA, 25 bp, Mus musculus
agcgactcaggcacgcctcagtcaa

SEQ ID NO: 405754 - DNA, 25 bp, Mus musculus
agcgagaatcctccccctgttgagg

SEQ ID NO: 405755 - DNA, 25 bp, Mus musculus
agcgagcatcgtggaatccgtggcc

SEQ ID NO: 405756 - DNA, 25 bp, Mus musculus
agcgaggacgggacaacgcacagtt

SEQ ID NO: 405757 - DNA, 25 bp, Mus musculus
agcgaggtcattggccactaccctg

SEQ ID NO: 405758 - DNA, 25 bp, Mus musculus
agcgatcagtgcacccgagagagat

SEQ ID NO: 405759 - DNA, 25 bp, Mus musculus
agcgatgtaaacagacgcacttctg

SEQ ID NO: 405760 - DNA, 25 bp, Mus musculus
agcgcaaagctgatgggtacaacca

SEQ ID NO: 405761 - DNA, 25 bp, Mus musculus
agcgcaagcgggacgggcccaacat

SEQ ID NO: 405762 - DNA, 25 bp, Mus musculus
agcgcacactcggattgcgaggctg

SEQ ID NO: 405763 - DNA, 25 bp, Mus musculus
agcgcaggatggacttctacgccga

SEQ ID NO: 405764 - DNA, 25 bp, Mus musculus
agcgcaggcccctcctggtacagag

SEQ ID NO: 405765 - DNA, 25 bp, Mus musculus
agcgcattacatgcccgacgtggac

SEQ ID NO: 405766 - DNA, 25 bp, Mus musculus
agcgcattctacacaagaccaaggg

SEQ ID NO: 405767 - DNA, 25 bp, Mus musculus
agcgccacagaaaccgtaggtgtgg

SEQ ID NO: 405768 - DNA, 25 bp, Mus musculus
agcgcccagagttcatcccgtatca

SEQ ID NO: 405769 - DNA, 25 bp, Mus musculus
agcgcccaggaggtgtcagctctga

SEQ ID NO: 405770 - DNA, 25 bp, Mus musculus
agcgccccatggtgtggtgctgttt

SEQ ID NO: 405771 - DNA, 25 bp, Mus musculus
agcgccctgccgacttcttgtaatt

SEQ ID NO: 405772 - DNA, 25 bp, Mus musculus
agcgcctgcttcatcaccgttagga

SEQ ID NO: 405773 - DNA, 25 bp, Mus musculus
agcgcctggtgaagaagcctgtgcc

SEQ ID NO: 405774 - DNA, 25 bp, Mus musculus
agcgccttaccacccatgcagattt

SEQ ID NO: 405775 - DNA, 25 bp, Mus musculus
agcgcgaatccaaggagcctgggac

SEQ ID NO: 405776 - DNA, 25 bp, Mus musculus
agcgcgcacaggaacaggacacttt

SEQ ID NO: 405777 - DNA, 25 bp, Mus musculus
agcgcgcatggacctttcctcagca

SEQ ID NO: 405778 - DNA, 25 bp, Mus musculus
agcgcgctgcggagaatgaactacg

SEQ ID NO: 405779 - DNA, 25 bp, Mus musculus
agcgcgtgatcgtagagcacgcccg

SEQ ID NO: 405780 - DNA, 25 bp, Mus musculus
agcgctagtgggtgattttctctga

SEQ ID NO: 405781 - DNA, 25 bp, Mus musculus
agcgctctcacacagaatcttctgg

SEQ ID NO: 405782 - DNA, 25 bp, Mus musculus
agcgctgcacgcctgggatataatg

SEQ ID NO: 405783 - DNA, 25 bp, Mus musculus
agcgctgccttcatggaccgtctgg

SEQ ID NO: 405784 - DNA, 25 bp, Mus musculus
agcgctgttccctcccgttcttatg

SEQ ID NO: 405785 - DNA, 25 bp, Mus musculus
agcgcttaccccagctttgaggaca

SEQ ID NO: 405786 - DNA, 25 bp, Mus musculus
agcgcttagcttcagggtatccgag

SEQ ID NO: 405787 - DNA, 25 bp, Mus musculus
agcgcttcatgcgtatggattcaag

SEQ ID NO: 405788 - DNA, 25 bp, Mus musculus
agcgcttcctccagaaggccgagaa

SEQ ID NO: 405789 - DNA, 25 bp, Mus musculus
agcggagagccaggcaccatggaca

SEQ ID NO: 405790 - DNA, 25 bp, Mus musculus
agcggagtctttgttcccttcacag

SEQ ID NO: 405791 - DNA, 25 bp, Mus musculus
agcggatcctttgccacccatgaag

SEQ ID NO: 405792 - DNA, 25 bp, Mus musculus
agcggatggaattgctctaaggcaa

SEQ ID NO: 405793 - DNA, 25 bp, Mus musculus
agcggcaagcactacggccagttca

SEQ ID NO: 405794 - DNA, 25 bp, Mus musculus
agcggcccctgaagcagtccctggg

SEQ ID NO: 405795 - DNA, 25 bp, Mus musculus
agcggccgcgatggaagaacttacg

SEQ ID NO: 405796 - DNA, 25 bp, Mus musculus
agcggcctcaagaactgtcacaatg

SEQ ID NO: 405797 - DNA, 25 bp, Mus musculus
agcggcgaggactctcgggtcccat

SEQ ID NO: 405798 - DNA, 25 bp, Mus musculus
agcggcgagtgcatacacctgggct

SEQ ID NO: 405799 - DNA, 25 bp, Mus musculus
agcggcgcctctccaagtgtctgtg

SEQ ID NO: 405800 - DNA, 25 bp, Mus musculus
agcggcgggagaggaacacttctct

SEQ ID NO: 405801 - DNA, 25 bp, Mus musculus
agcggctcccgagggttcgtgtcca

SEQ ID NO: 405802 - DNA, 25 bp, Mus musculus
agcggctgggccagtttgtgaccct

SEQ ID NO: 405803 - DNA, 25 bp, Mus musculus
agcggcttcagttggcagctgtagc

SEQ ID NO: 405804 - DNA, 25 bp, Mus musculus
agcgggaacctgaagcggctagtca

SEQ ID NO: 405805 - DNA, 25 bp, Mus musculus
agcgggactgctcgcttctagcgta

SEQ ID NO: 405806 - DNA, 25 bp, Mus musculus
agcgggatcctgaccccgcgttcgt

SEQ ID NO: 405807 - DNA, 25 bp, Mus musculus
agcgggttccttttgccttgactgc

SEQ ID NO: 405808 - DNA, 25 bp, Mus musculus
agcggtactgccgaggagtcaatgc

SEQ ID NO: 405809 - DNA, 25 bp, Mus musculus
agcgtaagtggccatcccagccttg

SEQ ID NO: 405810 - DNA, 25 bp, Mus musculus
agcgtatgactgctctgctctttac

SEQ ID NO: 405811 - DNA, 25 bp, Mus musculus
agcgtcctgggctgacctctgcagg

SEQ ID NO: 405812 - DNA, 25 bp, Mus musculus
agcgtctacaagactgggccctgcg

SEQ ID NO: 405813 - DNA, 25 bp, Mus musculus
agcgtgaaccgctcccgggagctct

SEQ ID NO: 405814 - DNA, 25 bp, Mus musculus
agcgtgcctggatccctgactggat

SEQ ID NO: 405815 - DNA, 25 bp, Mus musculus
agcgtgccttgcaacagcccgctgt

SEQ ID NO: 405816 - DNA, 25 bp, Mus musculus
agcgtgcgtgaacagcccaacagta

SEQ ID NO: 405817 - DNA, 25 bp, Mus musculus
agcgtggacggcctgaacatgttca

SEQ ID NO: 405818 - DNA, 25 bp, Mus musculus
agcgtggcaagcaccgtgcggttcc

SEQ ID NO: 405819 - DNA, 25 bp, Mus musculus
agcgtgtataccaggaggccaccaa

SEQ ID NO: 405820 - DNA, 25 bp, Mus musculus
agcgtttccagttggcgccacctgc

SEQ ID NO: 405821 - DNA, 25 bp, Mus musculus
agcgtttgcaaaacgggcttctgga

SEQ ID NO: 405822 - DNA, 25 bp, Mus musculus
agctaaacaggctggctcagtatcg

SEQ ID NO: 405823 - DNA, 25 bp, Mus musculus
agctaaccatgtgtccctctgtcag

SEQ ID NO: 405824 - DNA, 25 bp, Mus musculus
agctaagagcgctgcctgagcaaca

SEQ ID NO: 405825 - DNA, 25 bp, Mus musculus
agctaagagcggtcctctcacctcg

SEQ ID NO: 405826 - DNA, 25 bp, Mus musculus
agctaagtgggatgtggctgatact

SEQ ID NO: 405827 - DNA, 25 bp, Mus musculus
agctaattccgctgggaccgtcctg

SEQ ID NO: 405828 - DNA, 25 bp, Mus musculus
agctaattctcagggtcttagaccc

SEQ ID NO: 405829 - DNA, 25 bp, Mus musculus
agctacagcagctacagccaaggga

SEQ ID NO: 405830 - DNA, 25 bp, Mus musculus
agctacccactggtcggcctgtgtg

SEQ ID NO: 405831 - DNA, 25 bp, Mus musculus
agctaccctggcgagcagcaaaaga

SEQ ID NO: 405832 - DNA, 25 bp, Mus musculus
agctacctgacaaggtctgccggga

SEQ ID NO: 405833 - DNA, 25 bp, Mus musculus
agctacgcgcacatgaacggctgga

SEQ ID NO: 405834 - DNA, 25 bp, Mus musculus
agctacgtacatatacccgacaatg

SEQ ID NO: 405835 - DNA, 25 bp, Mus musculus
agctactgctgtttggctccccgga

SEQ ID NO: 405836 - DNA, 25 bp, Mus musculus
agctagagacccgtgtgcaggccgc

SEQ ID NO: 405837 - DNA, 25 bp, Mus musculus
agctagagcaccagctagacccaaa

SEQ ID NO: 405838 - DNA, 25 bp, Mus musculus
agctagcaacatcttgggcactggg

SEQ ID NO: 405839 - DNA, 25 bp, Mus musculus
agctagcgctgcgtatcgggctgac

SEQ ID NO: 405840 - DNA, 25 bp, Mus musculus
agctaggaagacacggcgctggaac

SEQ ID NO: 405841 - DNA, 25 bp, Mus musculus
agctaggcggtgagttccctgtgca

SEQ ID NO: 405842 - DNA, 25 bp, Mus musculus
agctagtgagcttcgaagaggacgc

SEQ ID NO: 405843 - DNA, 25 bp, Mus musculus
agctagtgtgcatgtgcctaccgcc

SEQ ID NO: 405844 - DNA, 25 bp, Mus musculus
agctataccaccatcagcacgctgg

SEQ ID NO: 405845 - DNA, 25 bp, Mus musculus
agctatgcaacacgcgttcattccg

SEQ ID NO: 405846 - DNA, 25 bp, Mus musculus
agctattctgatgcgtggagcaggc

SEQ ID NO: 405847 - DNA, 25 bp, Mus musculus
agctattgcgccacgacaggaggaa

SEQ ID NO: 405848 - DNA, 25 bp, Mus musculus
agctcaaccctgtggcgccctgata

SEQ ID NO: 405849 - DNA, 25 bp, Mus musculus
agctcaaggacttcgggccggagac

SEQ ID NO: 405850 - DNA, 25 bp, Mus musculus
agctcaatttcctgccaaccacggg

SEQ ID NO: 405851 - DNA, 25 bp, Mus musculus
agctcactcttctctgccttaggaa

SEQ ID NO: 405852 - DNA, 25 bp, Mus musculus
agctcagcgctccaacaaaactcgg

SEQ ID NO: 405853 - DNA, 25 bp, Mus musculus
agctcagtgagcaccggaagctgga

SEQ ID NO: 405854 - DNA, 25 bp, Mus musculus
agctcatcctgttgggagtcctgga

SEQ ID NO: 405855 - DNA, 25 bp, Mus musculus
agctcatctgtccatgccttcagga

SEQ ID NO: 405856 - DNA, 25 bp, Mus musculus
agctcattctgtgaccagcctcaga

SEQ ID NO: 405857 - DNA, 25 bp, Mus musculus
agctccatctcaggcgcagacgccg

SEQ ID NO: 405858 - DNA, 25 bp, Mus musculus
agctcccgaaagctcggaaaactgg

SEQ ID NO: 405859 - DNA, 25 bp, Mus musculus
agctcccgggaagcaggtgtactgt

SEQ ID NO: 405860 - DNA, 25 bp, Mus musculus
agctccctcagctgcagtgttgcag

SEQ ID NO: 405861 - DNA, 25 bp, Mus musculus
agctccgcgcctgagcggagtgaac

SEQ ID NO: 405862 - DNA, 25 bp, Mus musculus
agctccgctgttctgagcactccga

SEQ ID NO: 405863 - DNA, 25 bp, Mus musculus
agctccggccgttgacagctacgca

SEQ ID NO: 405864 - DNA, 25 bp, Mus musculus
agctccgttctgtacctggtcaggg

SEQ ID NO: 405865 - DNA, 25 bp, Mus musculus
agctcctacttgtcgcctgtttctc

SEQ ID NO: 405866 - DNA, 25 bp, Mus musculus
agctcctgaagactcgcacagagga

SEQ ID NO: 405867 - DNA, 25 bp, Mus musculus
agctcgactgtctgggtcacaacta

SEQ ID NO: 405868 - DNA, 25 bp, Mus musculus
agctcgagtctctaaaggtcttaca

SEQ ID NO: 405869 - DNA, 25 bp, Mus musculus
agctcgctcggcttctcgtgcttac

SEQ ID NO: 405870 - DNA, 25 bp, Mus musculus
agctctacgactgtaaggagtgtag

SEQ ID NO: 405871 - DNA, 25 bp, Mus musculus
agctctattttattgacgttgttac

SEQ ID NO: 405872 - DNA, 25 bp, Mus musculus
agctctcagccaggagtgcgtctgt

SEQ ID NO: 405873 - DNA, 25 bp, Mus musculus
agctctctcatctcaggttccatct

SEQ ID NO: 405874 - DNA, 25 bp, Mus musculus
agctctctgaacagccaaggctaga

SEQ ID NO: 405875 - DNA, 25 bp, Mus musculus
agctctcttccttgctgccacaaga

SEQ ID NO: 405876 - DNA, 25 bp, Mus musculus
agctctcttctctcagtgaaaccct

SEQ ID NO: 405877 - DNA, 25 bp, Mus musculus
agctctggcccgattcggagtcgcg

SEQ ID NO: 405878 - DNA, 25 bp, Mus musculus
agctctgggcccctgtcctcctgag

SEQ ID NO: 405879 - DNA, 25 bp, Mus musculus
agctctggtatctgggcctggagta

SEQ ID NO: 405880 - DNA, 25 bp, Mus musculus
agctctgtgcaaacctaaccccgag

SEQ ID NO: 405881 - DNA, 25 bp, Mus musculus
agctctgtttcagctggagcttggg

SEQ ID NO: 405882 - DNA, 25 bp, Mus musculus
agctcttcactctgttttgcgttgc

SEQ ID NO: 405883 - DNA, 25 bp, Mus musculus
agctcttcatagtcaactcttgccc

SEQ ID NO: 405884 - DNA, 25 bp, Mus musculus
agctcttcatctcccggacacagag

SEQ ID NO: 405885 - DNA, 25 bp, Mus musculus
agctcttcatgctcggtttggaatg

SEQ ID NO: 405886 - DNA, 25 bp, Mus musculus
agctcttctgggatccgagcccagc

SEQ ID NO: 405887 - DNA, 25 bp, Mus musculus
agctcttgccttaccccagatccac

SEQ ID NO: 405888 - DNA, 25 bp, Mus musculus
agctctttcattcctgagcccgtgt

SEQ ID NO: 405889 - DNA, 25 bp, Mus musculus
agctgaaaacgggttctgcggaaag

SEQ ID NO: 405890 - DNA, 25 bp, Mus musculus
agctgaacaactttcctcccgagag

SEQ ID NO: 405891 - DNA, 25 bp, Mus musculus
agctgaaccgggaatctgtgcgcgc

SEQ ID NO: 405892 - DNA, 25 bp, Mus musculus
agctgaacgatgaagggaaactgtc

SEQ ID NO: 405893 - DNA, 25 bp, Mus musculus
agctgaacgtcttactggtggccaa

SEQ ID NO: 405894 - DNA, 25 bp, Mus musculus
agctgaactgcaggcccagtggact

SEQ ID NO: 405895 - DNA, 25 bp, Mus musculus
agctgactacctacttctttctcca

SEQ ID NO: 405896 - DNA, 25 bp, Mus musculus
agctgactgaggagcaaatcgccga

SEQ ID NO: 405897 - DNA, 25 bp, Mus musculus
agctgactggcatgccatagctggg

SEQ ID NO: 405898 - DNA, 25 bp, Mus musculus
agctgagatctcgactgtgaaccca

SEQ ID NO: 405899 - DNA, 25 bp, Mus musculus
agctgaggcgtttcgatggcgtcca

SEQ ID NO: 405900 - DNA, 25 bp, Mus musculus
agctgagtcgttactttgaagtccg

SEQ ID NO: 405901 - DNA, 25 bp, Mus musculus
agctgatcaaggtaggcatgcatgg

SEQ ID NO: 405902 - DNA, 25 bp, Mus musculus
agctgatcctgacgtcgcctttcgg

SEQ ID NO: 405903 - DNA, 25 bp, Mus musculus
agctgatcgagtgtgcccgctctgt

SEQ ID NO: 405904 - DNA, 25 bp, Mus musculus
agctgatcggccatgctcgcagggt

SEQ ID NO: 405905 - DNA, 25 bp, Mus musculus
agctgcaacacactgagcaccaggc

SEQ ID NO: 405906 - DNA, 25 bp, Mus musculus
agctgcacagtggacccacactagg

SEQ ID NO: 405907 - DNA, 25 bp, Mus musculus
agctgcagaaatcctgaggctcaga

SEQ ID NO: 405908 - DNA, 25 bp, Mus musculus
agctgcaggcatcgtctcctacggg

SEQ ID NO: 405909 - DNA, 25 bp, Mus musculus
agctgccactttggcgtctggcaaa

SEQ ID NO: 405910 - DNA, 25 bp, Mus musculus
agctgcccttgcgtgcatgcgtgga

SEQ ID NO: 405911 - DNA, 25 bp, Mus musculus
agctgccggccgtagcttcccaggg

SEQ ID NO: 405912 - DNA, 25 bp, Mus musculus
agctgccggtgttttccgcgctcca

SEQ ID NO: 405913 - DNA, 25 bp, Mus musculus
agctgcctgcttgtttgtagagttc

SEQ ID NO: 405914 - DNA, 25 bp, Mus musculus
agctgccttgatgtttactttgaca

SEQ ID NO: 405915 - DNA, 25 bp, Mus musculus
agctgcgctctggtgctggacacaa

SEQ ID NO: 405916 - DNA, 25 bp, Mus musculus
agctgcggcagtagttggcaccccg

SEQ ID NO: 405917 - DNA, 25 bp, Mus musculus
agctgcgtagcctgcaagaacccac

SEQ ID NO: 405918 - DNA, 25 bp, Mus musculus
agctgcgtccccagtggtggtcaga

SEQ ID NO: 405919 - DNA, 25 bp, Mus musculus
agctgcgtctgcagtagcctggccg

SEQ ID NO: 405920 - DNA, 25 bp, Mus musculus
agctgctaccactgtctactgtgca

SEQ ID NO: 405921 - DNA, 25 bp, Mus musculus
agctgctatgttgcgagggcacccg

SEQ ID NO: 405922 - DNA, 25 bp, Mus musculus
agctgctgccaacaaccgtcggagc

SEQ ID NO: 405923 - DNA, 25 bp, Mus musculus
agctgctgtcatggcgggtgctctg

SEQ ID NO: 405924 - DNA, 25 bp, Mus musculus
agctgcttcctgactttcactggcg

SEQ ID NO: 405925 - DNA, 25 bp, Mus musculus
agctgcttctgacgccctgctagcg

SEQ ID NO: 405926 - DNA, 25 bp, Mus musculus
agctggaaccgcctagccacctttg

SEQ ID NO: 405927 - DNA, 25 bp, Mus musculus
agctggaaggctcctagggtcccaa

SEQ ID NO: 405928 - DNA, 25 bp, Mus musculus
agctggaaggtgcagcgtttcttcc

SEQ ID NO: 405929 - DNA, 25 bp, Mus musculus
agctggacagttccatcctttgcat

SEQ ID NO: 405930 - DNA, 25 bp, Mus musculus
agctggactccctgggctgccgcat

SEQ ID NO: 405931 - DNA, 25 bp, Mus musculus
agctggagttcgacctgggcaacct

SEQ ID NO: 405932 - DNA, 25 bp, Mus musculus
agctggatgatggagccgctgtccc

SEQ ID NO: 405933 - DNA, 25 bp, Mus musculus
agctggcagcccgtcgtgcgttgct

SEQ ID NO: 405934 - DNA, 25 bp, Mus musculus
agctggccagctgcacacaagatgc

SEQ ID NO: 405935 - DNA, 25 bp, Mus musculus
agctggccattgtcgggactacaga

SEQ ID NO: 405936 - DNA, 25 bp, Mus musculus
agctggcccctgtcggtaagagtga

SEQ ID NO: 405937 - DNA, 25 bp, Mus musculus
agctggcggcatctttgtcacgtga

SEQ ID NO: 405938 - DNA, 25 bp, Mus musculus
agctggcggtcccttagaaacctgg

SEQ ID NO: 405939 - DNA, 25 bp, Mus musculus
agctggctggttggagttcaccgca

SEQ ID NO: 405940 - DNA, 25 bp, Mus musculus
agctgggcagtaaagtccctttctg

SEQ ID NO: 405941 - DNA, 25 bp, Mus musculus
agctgggtccaggaagtcacgcaca

SEQ ID NO: 405942 - DNA, 25 bp, Mus musculus
agctggtcctgggttggtctgatcc

SEQ ID NO: 405943 - DNA, 25 bp, Mus musculus
agctggtgccttcacgacgctgaac

SEQ ID NO: 405944 - DNA, 25 bp, Mus musculus
agctggtgctgggtcctgcctttaa

SEQ ID NO: 405945 - DNA, 25 bp, Mus musculus
agctggttgtcctgagtatctaaga

SEQ ID NO: 405946 - DNA, 25 bp, Mus musculus
agctgtagaccctgtcactcggcca

SEQ ID NO: 405947 - DNA, 25 bp, Mus musculus
agctgtattcatactgtccttgtca

SEQ ID NO: 405948 - DNA, 25 bp, Mus musculus
agctgtcacaaggacgcatctgcct

SEQ ID NO: 405949 - DNA, 25 bp, Mus musculus
agctgtcatgccagcggtgggaatt

SEQ ID NO: 405950 - DNA, 25 bp, Mus musculus
agctgtcttgctttttcctaccccg

SEQ ID NO: 405951 - DNA, 25 bp, Mus musculus
agctgtgcacctctttgcactgatg

SEQ ID NO: 405952 - DNA, 25 bp, Mus musculus
agctgttcattagggctccaaagcg

SEQ ID NO: 405953 - DNA, 25 bp, Mus musculus
agctgttctatgatggccctcggga

SEQ ID NO: 405954 - DNA, 25 bp, Mus musculus
agcttcagccatttcaccttgtggg

SEQ ID NO: 405955 - DNA, 25 bp, Mus musculus
agcttcaggaagtgacagagcaatc

SEQ ID NO: 405956 - DNA, 25 bp, Mus musculus
agcttccaatggaatcactgtcccc

SEQ ID NO: 405957 - DNA, 25 bp, Mus musculus
agcttctaagtcacctgtctgtgtc

SEQ ID NO: 405958 - DNA, 25 bp, Mus musculus
agcttctcactcagctccggtgaca

SEQ ID NO: 405959 - DNA, 25 bp, Mus musculus
agcttctccaccgtgggaaagtctg

SEQ ID NO: 405960 - DNA, 25 bp, Mus musculus
agcttctgtagtccatctgtgcaga

SEQ ID NO: 405961 - DNA, 25 bp, Mus musculus
agcttctgttactgtccgggcggcc

SEQ ID NO: 405962 - DNA, 25 bp, Mus musculus
agcttcttcgatgatggctgatcaa

SEQ ID NO: 405963 - DNA, 25 bp, Mus musculus
agcttgagagagtgtcggccctgaa

SEQ ID NO: 405964 - DNA, 25 bp, Mus musculus
agcttgagggctagcgacgcctgtg

SEQ ID NO: 405965 - DNA, 25 bp, Mus musculus
agcttgctgaaccttagtacctgtc

SEQ ID NO: 405966 - DNA, 25 bp, Mus musculus
agcttgctggctctgtgctctacga

SEQ ID NO: 405967 - DNA, 25 bp, Mus musculus
agcttggccaccacaacgagatgag

SEQ ID NO: 405968 - DNA, 25 bp, Mus musculus
agcttggtcccttgcctctttgtga

SEQ ID NO: 405969 - DNA, 25 bp, Mus musculus
agcttgtgtgcctcagcggacctca

SEQ ID NO: 405970 - DNA, 25 bp, Mus musculus
agctttaaaagaatacttgagaggg

SEQ ID NO: 405971 - DNA, 25 bp, Mus musculus
agctttcattcaagtcctgctctta

SEQ ID NO: 405972 - DNA, 25 bp, Mus musculus
agctttcccaggctgcatcccagca

SEQ ID NO: 405973 - DNA, 25 bp, Mus musculus
agctttgtggagtctgaaatcacca

SEQ ID NO: 405974 - DNA, 25 bp, Mus musculus
agcttttcgaggaactgccagtccg

SEQ ID NO: 405975 - DNA, 25 bp, Mus musculus
agcttttctctgaatccactggaga

SEQ ID NO: 405976 - DNA, 25 bp, Mus musculus
agcttttgcaagaagggacctccca

SEQ ID NO: 405977 - DNA, 25 bp, Mus musculus
aggaaaactaccctgcacctgctgc

SEQ ID NO: 405978 - DNA, 25 bp, Mus musculus
aggaaaacttgatttcatcacactg

SEQ ID NO: 405979 - DNA, 25 bp, Mus musculus
aggaaacagagaggcacagcactgg

SEQ ID NO: 405980 - DNA, 25 bp, Mus musculus
aggaaaccagcaagtctccctccgt

SEQ ID NO: 405981 - DNA, 25 bp, Mus musculus
aggaaaccttctgtgagcccaccaa

SEQ ID NO: 405982 - DNA, 25 bp, Mus musculus
aggaaagacccagagatggcccgat

SEQ ID NO: 405983 - DNA, 25 bp, Mus musculus
aggaaaggcctcatcaacacaggcg

SEQ ID NO: 405984 - DNA, 25 bp, Mus musculus
aggaaatccagccaaagcccgatga

SEQ ID NO: 405985 - DNA, 25 bp, Mus musculus
aggaaatgcttaccaccaggcggca

SEQ ID NO: 405986 - DNA, 25 bp, Mus musculus
aggaaattctgtccacagcctttgg

SEQ ID NO: 405987 - DNA, 25 bp, Mus musculus
aggaaccagcaaagacgccctaagt

SEQ ID NO: 405988 - DNA, 25 bp, Mus musculus
aggaacccctgcgtacagctacgtg

SEQ ID NO: 405989 - DNA, 25 bp, Mus musculus
aggaaccgtgcaggccttagcgtga

SEQ ID NO: 405990 - DNA, 25 bp, Mus musculus
aggaacctccgcctggtgtctgtgc

SEQ ID NO: 405991 - DNA, 25 bp, Mus musculus
aggaacctgcctgaatgccgctgtg

SEQ ID NO: 405992 - DNA, 25 bp, Mus musculus
aggaactcatccgtcgccagcgaag

SEQ ID NO: 405993 - DNA, 25 bp, Mus musculus
aggaactctccccatcttgtaagcc

SEQ ID NO: 405994 - DNA, 25 bp, Mus musculus
aggaactgaggaagcggctgacacc

SEQ ID NO: 405995 - DNA, 25 bp, Mus musculus
aggaacttcaggatgccagggacca

SEQ ID NO: 405996 - DNA, 25 bp, Mus musculus
aggaagaagaatcaaggccagcctg

SEQ ID NO: 405997 - DNA, 25 bp, Mus musculus
aggaagactcccagctggctatgaa

SEQ ID NO: 405998 - DNA, 25 bp, Mus musculus
aggaagagagatgagcccatgccgt

SEQ ID NO: 405999 - DNA, 25 bp, Mus musculus
aggaagagccccatctggtggagca

SEQ ID NO: 406000 - DNA, 25 bp, Mus musculus
aggaagagcgcaaggcgaaacacgc

SEQ ID NO: 406001 - DNA, 25 bp, Mus musculus
aggaagaggagcaaatcccggtgaa

SEQ ID NO: 406002 - DNA, 25 bp, Mus musculus
aggaagcagaggtaccccgacgctg

SEQ ID NO: 406003 - DNA, 25 bp, Mus musculus
aggaagcagctgcaaccaggagtcc

SEQ ID NO: 406004 - DNA, 25 bp, Mus musculus
aggaagcatggagccagacagcaaa

SEQ ID NO: 406005 - DNA, 25 bp, Mus musculus
aggaagccccctttctacagagcct

SEQ ID NO: 406006 - DNA, 25 bp, Mus musculus
aggaagccgccactgagcagaagaa

SEQ ID NO: 406007 - DNA, 25 bp, Mus musculus
aggaagcctggaattcttgcccgca

SEQ ID NO: 406008 - DNA, 25 bp, Mus musculus
aggaagcggctggatttatgatgac

SEQ ID NO: 406009 - DNA, 25 bp, Mus musculus
aggaagctttcgtgcaggagcagcc

SEQ ID NO: 406010 - DNA, 25 bp, Mus musculus
aggaaggaccttctgcagccctaga

SEQ ID NO: 406011 - DNA, 25 bp, Mus musculus
aggaaggagccgacagcctggatct

SEQ ID NO: 406012 - DNA, 25 bp, Mus musculus
aggaaggattccacaagcagccacg

SEQ ID NO: 406013 - DNA, 25 bp, Mus musculus
aggaagggaccccatgagccagctt

SEQ ID NO: 406014 - DNA, 25 bp, Mus musculus
aggaaggtccaagaactgaactggg

SEQ ID NO: 406015 - DNA, 25 bp, Mus musculus
aggaagtatacccaggagcaggccc

SEQ ID NO: 406016 - DNA, 25 bp, Mus musculus
aggaagtgacattagccccaggagc

SEQ ID NO: 406017 - DNA, 25 bp, Mus musculus
aggaagtgccctgcccgagggtcat

SEQ ID NO: 406018 - DNA, 25 bp, Mus musculus
aggaatccggtctgccttcaagagg

SEQ ID NO: 406019 - DNA, 25 bp, Mus musculus
aggaatgagggaaacagcccgtcct

SEQ ID NO: 406020 - DNA, 25 bp, Mus musculus
aggaattccgccagggagcagggca

SEQ ID NO: 406021 - DNA, 25 bp, Mus musculus
aggaatttgcagaaatcttacattt

SEQ ID NO: 406022 - DNA, 25 bp, Mus musculus
aggacaacccaagggagcgggctca

SEQ ID NO: 406023 - DNA, 25 bp, Mus musculus
aggacaataccccaactggaagcag

SEQ ID NO: 406024 - DNA, 25 bp, Mus musculus
aggacacatgcctgccgcactgctg

SEQ ID NO: 406025 - DNA, 25 bp, Mus musculus
aggacactaggaccccatcccagaa

SEQ ID NO: 406026 - DNA, 25 bp, Mus musculus
aggacactctccaacaatagggacg

SEQ ID NO: 406027 - DNA, 25 bp, Mus musculus
aggacagaaagctcacgtggaccac

SEQ ID NO: 406028 - DNA, 25 bp, Mus musculus
aggacagaatgcacccgttcatagg

SEQ ID NO: 406029 - DNA, 25 bp, Mus musculus
aggacagcaacccacactactacaa

SEQ ID NO: 406030 - DNA, 25 bp, Mus musculus
aggacagcaccagactctcagcggt

SEQ ID NO: 406031 - DNA, 25 bp, Mus musculus
aggacagcagacattgggacaccca

SEQ ID NO: 406032 - DNA, 25 bp, Mus musculus
aggacaggcaaccagaagccaggca

SEQ ID NO: 406033 - DNA, 25 bp, Mus musculus
aggacagggccttttgactatcacc

SEQ ID NO: 406034 - DNA, 25 bp, Mus musculus
aggacatcttcactggtgggcccca

SEQ ID NO: 406035 - DNA, 25 bp, Mus musculus
aggacatggcgctggttcacaggcc

SEQ ID NO: 406036 - DNA, 25 bp, Mus musculus
aggaccaaagttcccagctgcaggg

SEQ ID NO: 406037 - DNA, 25 bp, Mus musculus
aggaccaaccgagcgccaagtcagg

SEQ ID NO: 406038 - DNA, 25 bp, Mus musculus
aggacccagaaaccgcagagcttgt

SEQ ID NO: 406039 - DNA, 25 bp, Mus musculus
aggacccatgctttgcccaaggaga

SEQ ID NO: 406040 - DNA, 25 bp, Mus musculus
aggacccgtgagacccgctgaagtg

SEQ ID NO: 406041 - DNA, 25 bp, Mus musculus
aggacctgactcatgagctatggaa

SEQ ID NO: 406042 - DNA, 25 bp, Mus musculus
aggacgaagaagaagccgcgatttg

SEQ ID NO: 406043 - DNA, 25 bp, Mus musculus
aggacgccgcggcttccgcttgatt

SEQ ID NO: 406044 - DNA, 25 bp, Mus musculus
aggacgcctccggatatctgaccag

SEQ ID NO: 406045 - DNA, 25 bp, Mus musculus
aggacgcggccatcgtaggctacaa

SEQ ID NO: 406046 - DNA, 25 bp, Mus musculus
aggacggccggctccttcagtgcta

SEQ ID NO: 406047 - DNA, 25 bp, Mus musculus
aggacggtcacctgctgcacagggc

SEQ ID NO: 406048 - DNA, 25 bp, Mus musculus
aggacgtagctgacgcctccacggg

SEQ ID NO: 406049 - DNA, 25 bp, Mus musculus
aggactatgtattccaactcatggg

SEQ ID NO: 406050 - DNA, 25 bp, Mus musculus
aggactccccactctgagatgcctg

SEQ ID NO: 406051 - DNA, 25 bp, Mus musculus
aggactcccgggatgccgacgatgc

SEQ ID NO: 406052 - DNA, 25 bp, Mus musculus
aggactctcctcaccacgttgggaa

SEQ ID NO: 406053 - DNA, 25 bp, Mus musculus
aggactgcagcatccctttcgaggg

SEQ ID NO: 406054 - DNA, 25 bp, Mus musculus
aggactgcccagcttcctctttctg

SEQ ID NO: 406055 - DNA, 25 bp, Mus musculus
aggactgggagtgcttccgagccat

SEQ ID NO: 406056 - DNA, 25 bp, Mus musculus
aggactggttctgtctccgaggaga

SEQ ID NO: 406057 - DNA, 25 bp, Mus musculus
aggacttcctgttgcagcgaagacc

SEQ ID NO: 406058 - DNA, 25 bp, Mus musculus
aggacttctactacctcagccacga

SEQ ID NO: 406059 - DNA, 25 bp, Mus musculus
aggacttctcggaagcggacttggt

SEQ ID NO: 406060 - DNA, 25 bp, Mus musculus
aggactttctaatattgatcattgg

SEQ ID NO: 406061 - DNA, 25 bp, Mus musculus
aggagaaagaccagcctgccgagat

SEQ ID NO: 406062 - DNA, 25 bp, Mus musculus
aggagaacagcattattccctggtg

SEQ ID NO: 406063 - DNA, 25 bp, Mus musculus
aggagaactgtctgtgccgcttcca

SEQ ID NO: 406064 - DNA, 25 bp, Mus musculus
aggagaactttgactggccagccgc

SEQ ID NO: 406065 - DNA, 25 bp, Mus musculus
aggagaaggacccagacgcacagaa

SEQ ID NO: 406066 - DNA, 25 bp, Mus musculus
aggagaatctcagaccttttcaaag

SEQ ID NO: 406067 - DNA, 25 bp, Mus musculus
aggagacatgccagcagctggcccg

SEQ ID NO: 406068 - DNA, 25 bp, Mus musculus
aggagactccactaccaatgatgcg

SEQ ID NO: 406069 - DNA, 25 bp, Mus musculus
aggagactcgctttggcccagaaga

SEQ ID NO: 406070 - DNA, 25 bp, Mus musculus
aggagactcggctatggccagcctg

SEQ ID NO: 406071 - DNA, 25 bp, Mus musculus
aggagactctcctttcgatttatgc

SEQ ID NO: 406072 - DNA, 25 bp, Mus musculus
aggagagactgcctagcgagcaacc

SEQ ID NO: 406073 - DNA, 25 bp, Mus musculus
aggagataggtttaactttgctggc

SEQ ID NO: 406074 - DNA, 25 bp, Mus musculus
aggagatatgtcaggagacactgct

SEQ ID NO: 406075 - DNA, 25 bp, Mus musculus
aggagcagcttcagtaggcataggg

SEQ ID NO: 406076 - DNA, 25 bp, Mus musculus
aggagcatgaactgcatccccactg

SEQ ID NO: 406077 - DNA, 25 bp, Mus musculus
aggagcattggctacggcggctaca

SEQ ID NO: 406078 - DNA, 25 bp, Mus musculus
aggagcccggctggtcgcagacatc

SEQ ID NO: 406079 - DNA, 25 bp, Mus musculus
aggagcctgtcacagaaaaccacag

SEQ ID NO: 406080 - DNA, 25 bp, Mus musculus
aggagcctgttcatcgatcgcacga

SEQ ID NO: 406081 - DNA, 25 bp, Mus musculus
aggagcgcgccaccatgatgtacta

SEQ ID NO: 406082 - DNA, 25 bp, Mus musculus
aggagcgggaatatagagctgcccc

SEQ ID NO: 406083 - DNA, 25 bp, Mus musculus
aggagcgggcgcttcaccgtccgca

SEQ ID NO: 406084 - DNA, 25 bp, Mus musculus
aggagctccagggacaagacgcctt

SEQ ID NO: 406085 - DNA, 25 bp, Mus musculus
aggagctcgttcgaggccagctgcc

SEQ ID NO: 406086 - DNA, 25 bp, Mus musculus
aggagctgcactacaccaaggagaa

SEQ ID NO: 406087 - DNA, 25 bp, Mus musculus
aggagctgccgcacggacactttcc

SEQ ID NO: 406088 - DNA, 25 bp, Mus musculus
aggagctgtccatcttgttttctga

SEQ ID NO: 406089 - DNA, 25 bp, Mus musculus
aggagcttccggtgtgacagcccag

SEQ ID NO: 406090 - DNA, 25 bp, Mus musculus
aggagctttcccatcgcagaggaag

SEQ ID NO: 406091 - DNA, 25 bp, Mus musculus
aggaggaaaacatcacacgggcgct

SEQ ID NO: 406092 - DNA, 25 bp, Mus musculus
aggaggaccctcaaagtctgcctgt

SEQ ID NO: 406093 - DNA, 25 bp, Mus musculus
aggaggacctgctctgtacacggca

SEQ ID NO: 406094 - DNA, 25 bp, Mus musculus
aggaggacgtgaagaaaaagctgaa

SEQ ID NO: 406095 - DNA, 25 bp, Mus musculus
aggaggcatgcttctgtcagtttca

SEQ ID NO: 406096 - DNA, 25 bp, Mus musculus
aggaggcccattttgctgtcaacca

SEQ ID NO: 406097 - DNA, 25 bp, Mus musculus
aggaggcccctatgaaccgatggag

SEQ ID NO: 406098 - DNA, 25 bp, Mus musculus
aggaggcccctgaccctaatagcct

SEQ ID NO: 406099 - DNA, 25 bp, Mus musculus
aggaggccgctcatctgtcagtgga

SEQ ID NO: 406100 - DNA, 25 bp, Mus musculus
aggaggcctctacactgtcacacgg

SEQ ID NO: 406101 - DNA, 25 bp, Mus musculus
aggaggcgaggcaagacctgcggct

SEQ ID NO: 406102 - DNA, 25 bp, Mus musculus
aggaggctaccccattaaagagacg

SEQ ID NO: 406103 - DNA, 25 bp, Mus musculus
aggaggctcagatctttgactacaa

SEQ ID NO: 406104 - DNA, 25 bp, Mus musculus
aggaggctgccgacgaaatctgcaa

SEQ ID NO: 406105 - DNA, 25 bp, Mus musculus
aggagggattagacccaggctctgt

SEQ ID NO: 406106 - DNA, 25 bp, Mus musculus
aggagggcacgttgcccgccgcctt

SEQ ID NO: 406107 - DNA, 25 bp, Mus musculus
aggagggtcctcgtatccgggatca

SEQ ID NO: 406108 - DNA, 25 bp, Mus musculus
aggaggtataagaccttcagtgtgc

SEQ ID NO: 406109 - DNA, 25 bp, Mus musculus
aggaggtgctgtcttatagatgccc

SEQ ID NO: 406110 - DNA, 25 bp, Mus musculus
aggagtacatatcggccaccaaaga

SEQ ID NO: 406111 - DNA, 25 bp, Mus musculus
aggagtacccgtgttccagcagcac

SEQ ID NO: 406112 - DNA, 25 bp, Mus musculus
aggagtcacccagtccacgggagag

SEQ ID NO: 406113 - DNA, 25 bp, Mus musculus
aggagtcatacgagccctagggcca

SEQ ID NO: 406114 - DNA, 25 bp, Mus musculus
aggagtcgcgggagggtccagctcg

SEQ ID NO: 406115 - DNA, 25 bp, Mus musculus
aggagtggctcacccgaagtgccaa

SEQ ID NO: 406116 - DNA, 25 bp, Mus musculus
aggagtgtctttctagcctgctggt

SEQ ID NO: 406117 - DNA, 25 bp, Mus musculus
aggagttcacagtactgggccgcca

SEQ ID NO: 406118 - DNA, 25 bp, Mus musculus
aggagttgtgactacggagatgtca

SEQ ID NO: 406119 - DNA, 25 bp, Mus musculus
aggagtttccctacacacctgtgtc

SEQ ID NO: 406120 - DNA, 25 bp, Mus musculus
aggagtttgagacctaccggccaga

SEQ ID NO: 406121 - DNA, 25 bp, Mus musculus
aggataccgacgagtcctcagagga

SEQ ID NO: 406122 - DNA, 25 bp, Mus musculus
aggatagaacactccgcctctctgg

SEQ ID NO: 406123 - DNA, 25 bp, Mus musculus
aggatagcctccagatctgtgtggg

SEQ ID NO: 406124 - DNA, 25 bp, Mus musculus
aggatcaccttaccccagctctggt

SEQ ID NO: 406125 - DNA, 25 bp, Mus musculus
aggatcaggcatgcccaagtgcagg

SEQ ID NO: 406126 - DNA, 25 bp, Mus musculus
aggatcccgtggctgctttcaagag

SEQ ID NO: 406127 - DNA, 25 bp, Mus musculus
aggatcctaagacgcatccctgcag

SEQ ID NO: 406128 - DNA, 25 bp, Mus musculus
aggatcctgcttcccttgatggtca

SEQ ID NO: 406129 - DNA, 25 bp, Mus musculus
aggatcctggcttcgtgcctgcctt

SEQ ID NO: 406130 - DNA, 25 bp, Mus musculus
aggatcgcggaatccaggctccgag

SEQ ID NO: 406131 - DNA, 25 bp, Mus musculus
aggatctatctcaggctcccttttc

SEQ ID NO: 406132 - DNA, 25 bp, Mus musculus
aggatctctgggttcgtactctgct

SEQ ID NO: 406133 - DNA, 25 bp, Mus musculus
aggatctgaacgagacgctgctgcg

SEQ ID NO: 406134 - DNA, 25 bp, Mus musculus
aggatcttgagaagagggccgcacc

SEQ ID NO: 406135 - DNA, 25 bp, Mus musculus
aggatcttgcctggcagacgctctg

SEQ ID NO: 406136 - DNA, 25 bp, Mus musculus
aggatgacgtaattgccacccagcc

SEQ ID NO: 406137 - DNA, 25 bp, Mus musculus
aggatgatcctcacacctgccctgt

SEQ ID NO: 406138 - DNA, 25 bp, Mus musculus
aggatgccggcgacgagactcctga

SEQ ID NO: 406139 - DNA, 25 bp, Mus musculus
aggatgcctgccttctgcccaggtg

SEQ ID NO: 406140 - DNA, 25 bp, Mus musculus
aggatgccttttgggcagccgtagt

SEQ ID NO: 406141 - DNA, 25 bp, Mus musculus
aggatgcgctctccgtccgctcgga

SEQ ID NO: 406142 - DNA, 25 bp, Mus musculus
aggatgctgttgacggtgactttgc

SEQ ID NO: 406143 - DNA, 25 bp, Mus musculus
aggattaaagctgccttctgctagc

SEQ ID NO: 406144 - DNA, 25 bp, Mus musculus
aggattcctccagtaacagccagca

SEQ ID NO: 406145 - DNA, 25 bp, Mus musculus
aggattcgcctccaagggtgaccga

SEQ ID NO: 406146 - DNA, 25 bp, Mus musculus
aggatttccatctccacgaagcggg

SEQ ID NO: 406147 - DNA, 25 bp, Mus musculus
aggatttcccttagagttgagccag

SEQ ID NO: 406148 - DNA, 25 bp, Mus musculus
aggcaactgacttccagattcttgg

SEQ ID NO: 406149 - DNA, 25 bp, Mus musculus
aggcaaggcagctccagttggcaga

SEQ ID NO: 406150 - DNA, 25 bp, Mus musculus
aggcaatgccggagccctttgagca

SEQ ID NO: 406151 - DNA, 25 bp, Mus musculus
aggcacacctacaacaccggaacat

SEQ ID NO: 406152 - DNA, 25 bp, Mus musculus
aggcacatcgtcgagctgcaccggg

SEQ ID NO: 406153 - DNA, 25 bp, Mus musculus
aggcacctgcatacattcgcaaaaa

SEQ ID NO: 406154 - DNA, 25 bp, Mus musculus
aggcacggaggatgacacggtccct

SEQ ID NO: 406155 - DNA, 25 bp, Mus musculus
aggcactccgcacttgaactttggg

SEQ ID NO: 406156 - DNA, 25 bp, Mus musculus
aggcagcactcaaatccaggtcaga

SEQ ID NO: 406157 - DNA, 25 bp, Mus musculus
aggcagcagccatcttgtcaccggt

SEQ ID NO: 406158 - DNA, 25 bp, Mus musculus
aggcagcaggacatggagaaaaagt

SEQ ID NO: 406159 - DNA, 25 bp, Mus musculus
aggcagccgcgcacatgggctaagc

SEQ ID NO: 406160 - DNA, 25 bp, Mus musculus
aggcaggacccgctctggagtgtgg

SEQ ID NO: 406161 - DNA, 25 bp, Mus musculus
aggcaggagggctagccacccatcc

SEQ ID NO: 406162 - DNA, 25 bp, Mus musculus
aggcaggcggccttctgcagcccag

SEQ ID NO: 406163 - DNA, 25 bp, Mus musculus
aggcaggtagccttttcgagcctga

SEQ ID NO: 406164 - DNA, 25 bp, Mus musculus
aggcaggttacactgtgtagcccag

SEQ ID NO: 406165 - DNA, 25 bp, Mus musculus
aggcagtcataacccacacatgggc

SEQ ID NO: 406166 - DNA, 25 bp, Mus musculus
aggcagttaggagctgagcgcacca

SEQ ID NO: 406167 - DNA, 25 bp, Mus musculus
aggcatcaggcagcgaggagtccaa

SEQ ID NO: 406168 - DNA, 25 bp, Mus musculus
aggcatcttctaccggccagagcag

SEQ ID NO: 406169 - DNA, 25 bp, Mus musculus
aggcatgaattctgctggacaggga

SEQ ID NO: 406170 - DNA, 25 bp, Mus musculus
aggcatgccttacctggctcctctg

SEQ ID NO: 406171 - DNA, 25 bp, Mus musculus
aggccacagtgctgattaacacaag

SEQ ID NO: 406172 - DNA, 25 bp, Mus musculus
aggccaccgggctgtaccgagccgt

SEQ ID NO: 406173 - DNA, 25 bp, Mus musculus
aggccacgggacctgccatcagtct

SEQ ID NO: 406174 - DNA, 25 bp, Mus musculus
aggccactgtgggatcaactgcggt

SEQ ID NO: 406175 - DNA, 25 bp, Mus musculus
aggccagagaaggacattacgtgtc

SEQ ID NO: 406176 - DNA, 25 bp, Mus musculus
aggccaggtcctcagagaagaaaaa

SEQ ID NO: 406177 - DNA, 25 bp, Mus musculus
aggccagtctgctttacttatcaag

SEQ ID NO: 406178 - DNA, 25 bp, Mus musculus
aggccatcgagtcccatctgctgaa

SEQ ID NO: 406179 - DNA, 25 bp, Mus musculus
aggccatggcgttgctgacagctca

SEQ ID NO: 406180 - DNA, 25 bp, Mus musculus
aggcccaggaaaagctggaggttgg

SEQ ID NO: 406181 - DNA, 25 bp, Mus musculus
aggccccaactgaacgatcctgtgg

SEQ ID NO: 406182 - DNA, 25 bp, Mus musculus
aggccccactcaggctaggtcagtg

SEQ ID NO: 406183 - DNA, 25 bp, Mus musculus
aggcccctgattccataagtcctgg

SEQ ID NO: 406184 - DNA, 25 bp, Mus musculus
aggcccgtggacagagattcccaga

SEQ ID NO: 406185 - DNA, 25 bp, Mus musculus
aggccctccgctgtgcaaattctgg

SEQ ID NO: 406186 - DNA, 25 bp, Mus musculus
aggccctggccagcacgagaattct

SEQ ID NO: 406187 - DNA, 25 bp, Mus musculus
aggccctggtgtcagctgtccccga

SEQ ID NO: 406188 - DNA, 25 bp, Mus musculus
aggccgacaccgagctgactaggat

SEQ ID NO: 406189 - DNA, 25 bp, Mus musculus
aggccgatgagctgcctgttctgca

SEQ ID NO: 406190 - DNA, 25 bp, Mus musculus
aggccgcaggccagctgctcacatt

SEQ ID NO: 406191 - DNA, 25 bp, Mus musculus
aggccgcttgccttcctactgcaga

SEQ ID NO: 406192 - DNA, 25 bp, Mus musculus
aggccggccccatggtttacacaga

SEQ ID NO: 406193 - DNA, 25 bp, Mus musculus
aggccgtgacacttggtttcgagcg

SEQ ID NO: 406194 - DNA, 25 bp, Mus musculus
aggcctaggtctgcctgacacctgg

SEQ ID NO: 406195 - DNA, 25 bp, Mus musculus
aggcctcaggagttttttctcttca

SEQ ID NO: 406196 - DNA, 25 bp, Mus musculus
aggcctcccgtgctctcaaagatgg

SEQ ID NO: 406197 - DNA, 25 bp, Mus musculus
aggcctctaggccacacaagcctgg

SEQ ID NO: 406198 - DNA, 25 bp, Mus musculus
aggcctgcgccggtgcatctgtaac

SEQ ID NO: 406199 - DNA, 25 bp, Mus musculus
aggcctggtgactggtgagccccac

SEQ ID NO: 406200 - DNA, 25 bp, Mus musculus
aggcctgtcccaactctgaatcctg

SEQ ID NO: 406201 - DNA, 25 bp, Mus musculus
aggccttcagtagcgatatgtggga

SEQ ID NO: 406202 - DNA, 25 bp, Mus musculus
aggcctttttccagcgcgtccagta

SEQ ID NO: 406203 - DNA, 25 bp, Mus musculus
aggcgaccagtccacaaatgaaaca

SEQ ID NO: 406204 - DNA, 25 bp, Mus musculus
aggcgacctctgttctcaacccttg

SEQ ID NO: 406205 - DNA, 25 bp, Mus musculus
aggcgacttggtgctccgccgagaa

SEQ ID NO: 406206 - DNA, 25 bp, Mus musculus
aggcgaggaggaattgtgatctcac

SEQ ID NO: 406207 - DNA, 25 bp, Mus musculus
aggcgagtcaaagcccacttgttgg

SEQ ID NO: 406208 - DNA, 25 bp, Mus musculus
aggcgagtccctttcccaggaggag

SEQ ID NO: 406209 - DNA, 25 bp, Mus musculus
aggcgccgtcgccatgcgctgggtc

SEQ ID NO: 406210 - DNA, 25 bp, Mus musculus
aggcgcggtcctccccttagagttg

SEQ ID NO: 406211 - DNA, 25 bp, Mus musculus
aggcgcgttctctcgctgcctgggc

SEQ ID NO: 406212 - DNA, 25 bp, Mus musculus
aggcggaccccaggacgcgtctgga

SEQ ID NO: 406213 - DNA, 25 bp, Mus musculus
aggcggacgccctacgaatggatgc

SEQ ID NO: 406214 - DNA, 25 bp, Mus musculus
aggcggcccagtggctagctcttgc

SEQ ID NO: 406215 - DNA, 25 bp, Mus musculus
aggcggccgacattcacactttcag

SEQ ID NO: 406216 - DNA, 25 bp, Mus musculus
aggcgggcacgctccattttaatga

SEQ ID NO: 406217 - DNA, 25 bp, Mus musculus
aggcggtccagcctcacaaaggctc

SEQ ID NO: 406218 - DNA, 25 bp, Mus musculus
aggcggtttcccagtgcccagctgc

SEQ ID NO: 406219 - DNA, 25 bp, Mus musculus
aggcgtccctgtcgccgtctgctaa

SEQ ID NO: 406220 - DNA, 25 bp, Mus musculus
aggcgtcctggcactgtcaattggc

SEQ ID NO: 406221 - DNA, 25 bp, Mus musculus
aggcgtggacaaaggctcctctcgg

SEQ ID NO: 406222 - DNA, 25 bp, Mus musculus
aggcgttcgggatgatccggctttc

SEQ ID NO: 406223 - DNA, 25 bp, Mus musculus
aggctaacagctccacaacatcggc

SEQ ID NO: 406224 - DNA, 25 bp, Mus musculus
aggctagctatgactctgacgtggg

SEQ ID NO: 406225 - DNA, 25 bp, Mus musculus
aggctagtaactcccagatcccagg

SEQ ID NO: 406226 - DNA, 25 bp, Mus musculus
aggctatgtgagctggttgccccca

SEQ ID NO: 406227 - DNA, 25 bp, Mus musculus
aggctcaggcccagtgtgcatgcag

SEQ ID NO: 406228 - DNA, 25 bp, Mus musculus
aggctcccagcacccaagatgagga

SEQ ID NO: 406229 - DNA, 25 bp, Mus musculus
aggctcccagggttgttctggtcag

SEQ ID NO: 406230 - DNA, 25 bp, Mus musculus
aggctcctcacgagacactggtgca

SEQ ID NO: 406231 - DNA, 25 bp, Mus musculus
aggctcctctgcgtatgaactggtg

SEQ ID NO: 406232 - DNA, 25 bp, Mus musculus
aggctccttattcagtagccacggg

SEQ ID NO: 406233 - DNA, 25 bp, Mus musculus
aggctctcaagcctggccgcaagga

SEQ ID NO: 406234 - DNA, 25 bp, Mus musculus
aggctctcggctgtaaccagctgtg

SEQ ID NO: 406235 - DNA, 25 bp, Mus musculus
aggctctgacggcaccattcggttg

SEQ ID NO: 406236 - DNA, 25 bp, Mus musculus
aggctctgagccttgaaccttcctc

SEQ ID NO: 406237 - DNA, 25 bp, Mus musculus
aggctcttccttctggttcatttta

SEQ ID NO: 406238 - DNA, 25 bp, Mus musculus
aggctcttgtactccctgcgcagct

SEQ ID NO: 406239 - DNA, 25 bp, Mus musculus
aggctgaaccttcccaaaatgcatg

SEQ ID NO: 406240 - DNA, 25 bp, Mus musculus
aggctgaactgggtgctcaccacca

SEQ ID NO: 406241 - DNA, 25 bp, Mus musculus
aggctgaagttgacctgcgggaccc

SEQ ID NO: 406242 - DNA, 25 bp, Mus musculus
aggctgcaccttcgcggacaagatc

SEQ ID NO: 406243 - DNA, 25 bp, Mus musculus
aggctgccattaggaccctgcaggc

SEQ ID NO: 406244 - DNA, 25 bp, Mus musculus
aggctgcgtccttcccgtgctttgt

SEQ ID NO: 406245 - DNA, 25 bp, Mus musculus
aggctgcgtgtctccccagaatctc

SEQ ID NO: 406246 - DNA, 25 bp, Mus musculus
aggctgctaagaagctcctccgtcc

SEQ ID NO: 406247 - DNA, 25 bp, Mus musculus
aggctgctcatctgcgcccttctat

SEQ ID NO: 406248 - DNA, 25 bp, Mus musculus
aggctgctccttacccagtcgggac

SEQ ID NO: 406249 - DNA, 25 bp, Mus musculus
aggctgctctccctccgaagcttgt

SEQ ID NO: 406250 - DNA, 25 bp, Mus musculus
aggctgctgagacccagcatccgct

SEQ ID NO: 406251 - DNA, 25 bp, Mus musculus
aggctggaggcctagaggctcccca

SEQ ID NO: 406252 - DNA, 25 bp, Mus musculus
aggctggccgctccgggcttccaat

SEQ ID NO: 406253 - DNA, 25 bp, Mus musculus
aggctgtctccctgcattgtgtagc

SEQ ID NO: 406254 - DNA, 25 bp, Mus musculus
aggctgttccgggacagaagaagaa

SEQ ID NO: 406255 - DNA, 25 bp, Mus musculus
aggcttccaccccagagtctgagga

SEQ ID NO: 406256 - DNA, 25 bp, Mus musculus
aggcttctcaaaccgcctgctggtt

SEQ ID NO: 406257 - DNA, 25 bp, Mus musculus
aggcttgcagccctttccagcacag

SEQ ID NO: 406258 - DNA, 25 bp, Mus musculus
aggcttgcaggacgctggctacaaa

SEQ ID NO: 406259 - DNA, 25 bp, Mus musculus
agggaaacccaaaagcagcgcttag

SEQ ID NO: 406260 - DNA, 25 bp, Mus musculus
agggaaccgactcagactgctctca

SEQ ID NO: 406261 - DNA, 25 bp, Mus musculus
agggaactgcacaatacaaatacag

SEQ ID NO: 406262 - DNA, 25 bp, Mus musculus
agggaagagacaccaacttttctat

SEQ ID NO: 406263 - DNA, 25 bp, Mus musculus
agggaaggcaaagccggatgctgtc

SEQ ID NO: 406264 - DNA, 25 bp, Mus musculus
agggaagtatcttcacctgctcagc

SEQ ID NO: 406265 - DNA, 25 bp, Mus musculus
agggaatccagacatggctgctgac

SEQ ID NO: 406266 - DNA, 25 bp, Mus musculus
agggacacaaggacaaggcccaaga

SEQ ID NO: 406267 - DNA, 25 bp, Mus musculus
agggaccactgatcctgtgccagga

SEQ ID NO: 406268 - DNA, 25 bp, Mus musculus
agggaccagatgcagttcaagttca

SEQ ID NO: 406269 - DNA, 25 bp, Mus musculus
agggacccggtgaccatcgactgtg

SEQ ID NO: 406270 - DNA, 25 bp, Mus musculus
agggaccgtgtctcagcccaagaag

SEQ ID NO: 406271 - DNA, 25 bp, Mus musculus
agggacctccgttggctgggactca

SEQ ID NO: 406272 - DNA, 25 bp, Mus musculus
agggacgagacacctctggcctttg

SEQ ID NO: 406273 - DNA, 25 bp, Mus musculus
agggactaggtagggctcaagacca

SEQ ID NO: 406274 - DNA, 25 bp, Mus musculus
agggactcgccttctgctatgttga

SEQ ID NO: 406275 - DNA, 25 bp, Mus musculus
agggactcttgttggatccacccgg

SEQ ID NO: 406276 - DNA, 25 bp, Mus musculus
agggactggaagttgcaggaaacct

SEQ ID NO: 406277 - DNA, 25 bp, Mus musculus
agggacttacccatctcctgtggta

SEQ ID NO: 406278 - DNA, 25 bp, Mus musculus
agggacttgggcaacctaccagcag

SEQ ID NO: 406279 - DNA, 25 bp, Mus musculus
agggagagatcctcagaagtctgga

SEQ ID NO: 406280 - DNA, 25 bp, Mus musculus
agggagaggacactattactttagc

SEQ ID NO: 406281 - DNA, 25 bp, Mus musculus
agggagcctgtctctatccctctca

SEQ ID NO: 406282 - DNA, 25 bp, Mus musculus
agggagcgagactctgccaccgcat

SEQ ID NO: 406283 - DNA, 25 bp, Mus musculus
agggagcgggctcactctttcacct

SEQ ID NO: 406284 - DNA, 25 bp, Mus musculus
agggaggccccattgacctgccagg

SEQ ID NO: 406285 - DNA, 25 bp, Mus musculus
agggaggcgaagtcaggtccaacct

SEQ ID NO: 406286 - DNA, 25 bp, Mus musculus
agggagggtctcaggccagccctcc

SEQ ID NO: 406287 - DNA, 25 bp, Mus musculus
agggagtcaatcatgctgctttaac

SEQ ID NO: 406288 - DNA, 25 bp, Mus musculus
agggatatcttcactccccatgctg

SEQ ID NO: 406289 - DNA, 25 bp, Mus musculus
agggatcccgctctaccatttatgg

SEQ ID NO: 406290 - DNA, 25 bp, Mus musculus
agggcaaatctaaccgaacggcagg

SEQ ID NO: 406291 - DNA, 25 bp, Mus musculus
agggcaaggcacgacagccagctgc

SEQ ID NO: 406292 - DNA, 25 bp, Mus musculus
agggcacagcctgtgacacactgtg

SEQ ID NO: 406293 - DNA, 25 bp, Mus musculus
agggcacccacagcaagacgacttt

SEQ ID NO: 406294 - DNA, 25 bp, Mus musculus
agggcacttctacccaacattaaca

SEQ ID NO: 406295 - DNA, 25 bp, Mus musculus
agggcatcgtgcttcctctgcagaa

SEQ ID NO: 406296 - DNA, 25 bp, Mus musculus
agggcatctccctgcagaccttgga

SEQ ID NO: 406297 - DNA, 25 bp, Mus musculus
agggcatgagtactctctcccacct

SEQ ID NO: 406298 - DNA, 25 bp, Mus musculus
agggccaagggcctcactagtttga

SEQ ID NO: 406299 - DNA, 25 bp, Mus musculus
agggccagacctccttccagtgtgg

SEQ ID NO: 406300 - DNA, 25 bp, Mus musculus
agggccatggagaacacggtgacaa

SEQ ID NO: 406301 - DNA, 25 bp, Mus musculus
agggcccacgtcagtcaggaggctc

SEQ ID NO: 406302 - DNA, 25 bp, Mus musculus
agggcccagcagtctaaagctccca

SEQ ID NO: 406303 - DNA, 25 bp, Mus musculus
agggccccgtggatcttggagcaaa

SEQ ID NO: 406304 - DNA, 25 bp, Mus musculus
agggccctagcacacacaatataca

SEQ ID NO: 406305 - DNA, 25 bp, Mus musculus
agggccctgctaggtcatgcacgaa

SEQ ID NO: 406306 - DNA, 25 bp, Mus musculus
agggcctaccccagatcttctcaga

SEQ ID NO: 406307 - DNA, 25 bp, Mus musculus
agggcctcaggtagctttggctgca

SEQ ID NO: 406308 - DNA, 25 bp, Mus musculus
agggcctcatgtcggaaccacagcc

SEQ ID NO: 406309 - DNA, 25 bp, Mus musculus
agggcctcccatgcagcaggctgga

SEQ ID NO: 406310 - DNA, 25 bp, Mus musculus
agggcgagatgagcgcctgcagcga

SEQ ID NO: 406311 - DNA, 25 bp, Mus musculus
agggcgagcacaatgctcagcccca

SEQ ID NO: 406312 - DNA, 25 bp, Mus musculus
agggcgcacggcagtctctaagttg

SEQ ID NO: 406313 - DNA, 25 bp, Mus musculus
agggcgccatgccaacagtccagtt

SEQ ID NO: 406314 - DNA, 25 bp, Mus musculus
agggcgcttgctgcacctatgccaa

SEQ ID NO: 406315 - DNA, 25 bp, Mus musculus
agggcgtaggcacctcctcctttct

SEQ ID NO: 406316 - DNA, 25 bp, Mus musculus
agggctaccgggacgtgagcatcac

SEQ ID NO: 406317 - DNA, 25 bp, Mus musculus
agggctactcctggtgcctgcagga

SEQ ID NO: 406318 - DNA, 25 bp, Mus musculus
agggctagaacaccacctatcctgc

SEQ ID NO: 406319 - DNA, 25 bp, Mus musculus
agggctcacagcctgcacttgcagg

SEQ ID NO: 406320 - DNA, 25 bp, Mus musculus
agggctcaccatgcgttgggatcag

SEQ ID NO: 406321 - DNA, 25 bp, Mus musculus
agggctcccacaacagaggctccca

SEQ ID NO: 406322 - DNA, 25 bp, Mus musculus
agggctccgggcttcacttctgtgg

SEQ ID NO: 406323 - DNA, 25 bp, Mus musculus
agggctctggttttattcatcccag

SEQ ID NO: 406324 - DNA, 25 bp, Mus musculus
agggctgtgactgaccattagacca

SEQ ID NO: 406325 - DNA, 25 bp, Mus musculus
agggcttcacatgtctggctcaggg

SEQ ID NO: 406326 - DNA, 25 bp, Mus musculus
agggcttcaggctcactcatgcagg

SEQ ID NO: 406327 - DNA, 25 bp, Mus musculus
agggcttctgctcccgccttggttc

SEQ ID NO: 406328 - DNA, 25 bp, Mus musculus
agggcttctggacaatcctcggaga

SEQ ID NO: 406329 - DNA, 25 bp, Mus musculus
agggcttggagagtaccccgagcct

SEQ ID NO: 406330 - DNA, 25 bp, Mus musculus
agggcttggctatgtgtcctgtagc

SEQ ID NO: 406331 - DNA, 25 bp, Mus musculus
agggcttgtcccttgcattccggca

SEQ ID NO: 406332 - DNA, 25 bp, Mus musculus
agggctttcatcctgagggcaccca

SEQ ID NO: 406333 - DNA, 25 bp, Mus musculus
aggggtcagggcagcacccttctgc

SEQ ID NO: 406334 - DNA, 25 bp, Mus musculus
agggtaactgtgactgcagggctca

SEQ ID NO: 406335 - DNA, 25 bp, Mus musculus
agggtagtccagtttgcagtcggct

SEQ ID NO: 406336 - DNA, 25 bp, Mus musculus
agggtcacttgcctcaccttagcgc

SEQ ID NO: 406337 - DNA, 25 bp, Mus musculus
agggtcgcttttcctcgtctcccag

SEQ ID NO: 406338 - DNA, 25 bp, Mus musculus
agggtctgcgcccacttctgaaggc

SEQ ID NO: 406339 - DNA, 25 bp, Mus musculus
agggtcttcccagacagactgggca

SEQ ID NO: 406340 - DNA, 25 bp, Mus musculus
agggtgccctgtggcctgtcaatca

SEQ ID NO: 406341 - DNA, 25 bp, Mus musculus
agggtgctgtgccacagtttagctc

SEQ ID NO: 406342 - DNA, 25 bp, Mus musculus
agggtggaaactgaaagatttgttg

SEQ ID NO: 406343 - DNA, 25 bp, Mus musculus
agggtggtccctcgcaaactctgga

SEQ ID NO: 406344 - DNA, 25 bp, Mus musculus
agggttccaggatccaggctgtgct

SEQ ID NO: 406345 - DNA, 25 bp, Mus musculus
agggttcctcttctctacagcttca

SEQ ID NO: 406346 - DNA, 25 bp, Mus musculus
agggttctgccaaggcgccaccatc

SEQ ID NO: 406347 - DNA, 25 bp, Mus musculus
agggttgcagagactagtgagccat

SEQ ID NO: 406348 - DNA, 25 bp, Mus musculus
agggtttccagatcttggttcagga

SEQ ID NO: 406349 - DNA, 25 bp, Mus musculus
aggtaaccgttctcacatgccggca

SEQ ID NO: 406350 - DNA, 25 bp, Mus musculus
aggtaactaactgcgcaggcgtcgg

SEQ ID NO: 406351 - DNA, 25 bp, Mus musculus
aggtaagatggagcccattgtgtgt

SEQ ID NO: 406352 - DNA, 25 bp, Mus musculus
aggtaaggctgcctactggatgcca

SEQ ID NO: 406353 - DNA, 25 bp, Mus musculus
aggtaatcaaggaggatgctgctga

SEQ ID NO: 406354 - DNA, 25 bp, Mus musculus
aggtaatctccgaaggcagcagcgc

SEQ ID NO: 406355 - DNA, 25 bp, Mus musculus
aggtaccagtgggtccgctgcaaac

SEQ ID NO: 406356 - DNA, 25 bp, Mus musculus
aggtaccggcattggccctggccta

SEQ ID NO: 406357 - DNA, 25 bp, Mus musculus
aggtacgagctcactgccttgtttc

SEQ ID NO: 406358 - DNA, 25 bp, Mus musculus
aggtactgcccaccatggactgagg

SEQ ID NO: 406359 - DNA, 25 bp, Mus musculus
aggtagatcctcaccaagggctgcg

SEQ ID NO: 406360 - DNA, 25 bp, Mus musculus
aggtagcctccgatcctcctgtgca

SEQ ID NO: 406361 - DNA, 25 bp, Mus musculus
aggtaggcacagatctccagcagca

SEQ ID NO: 406362 - DNA, 25 bp, Mus musculus
aggtaggctgacacgggaccacgga

SEQ ID NO: 406363 - DNA, 25 bp, Mus musculus
aggtagtcttcaccaagctggtagc

SEQ ID NO: 406364 - DNA, 25 bp, Mus musculus
aggtatcagccgagacaggcggtcg

SEQ ID NO: 406365 - DNA, 25 bp, Mus musculus
aggtatgactttagggattgattgc

SEQ ID NO: 406366 - DNA, 25 bp, Mus musculus
aggtattttgctcagtcccgggccg

SEQ ID NO: 406367 - DNA, 25 bp, Mus musculus
aggtcacaggtttcaggccctggag

SEQ ID NO: 406368 - DNA, 25 bp, Mus musculus
aggtcaccaaagatgctgcagaggc

SEQ ID NO: 406369 - DNA, 25 bp, Mus musculus
aggtcaccacgggatgctgtggctt

SEQ ID NO: 406370 - DNA, 25 bp, Mus musculus
aggtcaccacttgcaagcacacagg

SEQ ID NO: 406371 - DNA, 25 bp, Mus musculus
aggtcaccataacggaaacatcgga

SEQ ID NO: 406372 - DNA, 25 bp, Mus musculus
aggtcactattactggctcggctgc

SEQ ID NO: 406373 - DNA, 25 bp, Mus musculus
aggtcactcaccatgcactacgtta

SEQ ID NO: 406374 - DNA, 25 bp, Mus musculus
aggtcagaggcgacctgatcggtcc

SEQ ID NO: 406375 - DNA, 25 bp, Mus musculus
aggtcagcgatgactttgtcttaag

SEQ ID NO: 406376 - DNA, 25 bp, Mus musculus
aggtcaggcgactttcagtggttcc

SEQ ID NO: 406377 - DNA, 25 bp, Mus musculus
aggtcagtgcttcgcgcttccccag

SEQ ID NO: 406378 - DNA, 25 bp, Mus musculus
aggtccatagcccactggccctgat

SEQ ID NO: 406379 - DNA, 25 bp, Mus musculus
aggtccccggctagtgctcttgcca

SEQ ID NO: 406380 - DNA, 25 bp, Mus musculus
aggtccggcagcagatccgagacaa

SEQ ID NO: 406381 - DNA, 25 bp, Mus musculus
aggtccggtcctttgctggctgctg

SEQ ID NO: 406382 - DNA, 25 bp, Mus musculus
aggtcctcgggctgattgtcatccc

SEQ ID NO: 406383 - DNA, 25 bp, Mus musculus
aggtcctgatcctgaaactttctgt

SEQ ID NO: 406384 - DNA, 25 bp, Mus musculus
aggtcctgctggagcgtccctgctg

SEQ ID NO: 406385 - DNA, 25 bp, Mus musculus
aggtccttgtccttccctctacgtg

SEQ ID NO: 406386 - DNA, 25 bp, Mus musculus
aggtcgctgtcttccagtctccggc

SEQ ID NO: 406387 - DNA, 25 bp, Mus musculus
aggtcgtccttgagagctcgtgtcc

SEQ ID NO: 406388 - DNA, 25 bp, Mus musculus
aggtctactgtagaccccacctggg

SEQ ID NO: 406389 - DNA, 25 bp, Mus musculus
aggtctatgatccacccacattctc

SEQ ID NO: 406390 - DNA, 25 bp, Mus musculus
aggtctattgcagagaggtgacaga

SEQ ID NO: 406391 - DNA, 25 bp, Mus musculus
aggtctcacatcatggggctataac

SEQ ID NO: 406392 - DNA, 25 bp, Mus musculus
aggtctcgttctgcgtgccctagag

SEQ ID NO: 406393 - DNA, 25 bp, Mus musculus
aggtctctgacctcccaagtgtctg

SEQ ID NO: 406394 - DNA, 25 bp, Mus musculus
aggtctgtgccatagacactgcctg

SEQ ID NO: 406395 - DNA, 25 bp, Mus musculus
aggtctgtgtcatccggcaccctcg

SEQ ID NO: 406396 - DNA, 25 bp, Mus musculus
aggtcttacacttcattggattccg

SEQ ID NO: 406397 - DNA, 25 bp, Mus musculus
aggtctttcagagcacagtgtcccg

SEQ ID NO: 406398 - DNA, 25 bp, Mus musculus
aggtgacactgctgatgaaggagcc

SEQ ID NO: 406399 - DNA, 25 bp, Mus musculus
aggtgacagccggagcgacacgcct

SEQ ID NO: 406400 - DNA, 25 bp, Mus musculus
aggtgacatcaggtgccctagctac

SEQ ID NO: 406401 - DNA, 25 bp, Mus musculus
aggtgacatccaccccaatgttcag

SEQ ID NO: 406402 - DNA, 25 bp, Mus musculus
aggtgagagcttggagcatcccgca

SEQ ID NO: 406403 - DNA, 25 bp, Mus musculus
aggtgagccgtctcccagcggcctg

SEQ ID NO: 406404 - DNA, 25 bp, Mus musculus
aggtgccaccggcagtccttgtctc

SEQ ID NO: 406405 - DNA, 25 bp, Mus musculus
aggtgccctagctaccgaccctggt

SEQ ID NO: 406406 - DNA, 25 bp, Mus musculus
aggtgccttcgaccacttgcctcag

SEQ ID NO: 406407 - DNA, 25 bp, Mus musculus
aggtgcgcacgggaacctaccggca

SEQ ID NO: 406408 - DNA, 25 bp, Mus musculus
aggtgcgctacatctcccctaagca

SEQ ID NO: 406409 - DNA, 25 bp, Mus musculus
aggtgctccacctgtacgtgacata

SEQ ID NO: 406410 - DNA, 25 bp, Mus musculus
aggtgcttaacctccacttcgtgag

SEQ ID NO: 406411 - DNA, 25 bp, Mus musculus
aggtgcttggcaacaactcagagaa

SEQ ID NO: 406412 - DNA, 25 bp, Mus musculus
aggtggccagttccactctgcctga

SEQ ID NO: 406413 - DNA, 25 bp, Mus musculus
aggtggctacgaggtatctcctggc

SEQ ID NO: 406414 - DNA, 25 bp, Mus musculus
aggtggctctcgtttggacctgtca

SEQ ID NO: 406415 - DNA, 25 bp, Mus musculus
aggtgggccggctggcggttgtcac

SEQ ID NO: 406416 - DNA, 25 bp, Mus musculus
aggtgggtgatggtccttcctgtct

SEQ ID NO: 406417 - DNA, 25 bp, Mus musculus
aggtggtgagtgtctccagaacgcc

SEQ ID NO: 406418 - DNA, 25 bp, Mus musculus
aggtgtatacccaggcggagtgctc

SEQ ID NO: 406419 - DNA, 25 bp, Mus musculus
aggtgtccctctcacaagcgctgga

SEQ ID NO: 406420 - DNA, 25 bp, Mus musculus
aggtgtctacacttgccaatctggg

SEQ ID NO: 406421 - DNA, 25 bp, Mus musculus
aggtgtctgtactccgtgaactccg

SEQ ID NO: 406422 - DNA, 25 bp, Mus musculus
aggtgtctttcccagaagtgttcag

SEQ ID NO: 406423 - DNA, 25 bp, Mus musculus
aggtgtgagtcattgtgttgagctc

SEQ ID NO: 406424 - DNA, 25 bp, Mus musculus
aggttacaggctgcccagaattcag

SEQ ID NO: 406425 - DNA, 25 bp, Mus musculus
aggttacccctttgtcatgatgctg

SEQ ID NO: 406426 - DNA, 25 bp, Mus musculus
aggttagtcagcttgggcccactca

SEQ ID NO: 406427 - DNA, 25 bp, Mus musculus
aggttatatcccaccaatggctcag

SEQ ID NO: 406428 - DNA, 25 bp, Mus musculus
aggttatcaattggacgggcagaga

SEQ ID NO: 406429 - DNA, 25 bp, Mus musculus
aggttcaccctgcacagctggaagc

SEQ ID NO: 406430 - DNA, 25 bp, Mus musculus
aggttcaggctgcatcgcccctgcg

SEQ ID NO: 406431 - DNA, 25 bp, Mus musculus
aggttccactggcattccgagtcag

SEQ ID NO: 406432 - DNA, 25 bp, Mus musculus
aggttgtgaacgagcgggccaccct

SEQ ID NO: 406433 - DNA, 25 bp, Mus musculus
aggtttaggactgtccctggtccag

SEQ ID NO: 406434 - DNA, 25 bp, Mus musculus
aggtttatgcccgagcccctgtgaa

SEQ ID NO: 406435 - DNA, 25 bp, Mus musculus
aggtttccacgcatatgccaccatc

SEQ ID NO: 406436 - DNA, 25 bp, Mus musculus
aggtttccaggattgacagcccagg

SEQ ID NO: 406437 - DNA, 25 bp, Mus musculus
aggtttctgccatgtctttttccaa

SEQ ID NO: 406438 - DNA, 25 bp, Mus musculus
aggtttgtacttcgctctgagccag

SEQ ID NO: 406439 - DNA, 25 bp, Mus musculus
aggtttgtcagacaccagcccggac

SEQ ID NO: 406440 - DNA, 25 bp, Mus musculus
aggtttgtgggctcattcaggatag

SEQ ID NO: 406441 - DNA, 25 bp, Mus musculus
aggttttactcaggctagcttaggc

SEQ ID NO: 406442 - DNA, 25 bp, Mus musculus
aggttttttgactgtgccctaggca

SEQ ID NO: 406443 - DNA, 25 bp, Mus musculus
agtaaaacacccaacgccatcagct

SEQ ID NO: 406444 - DNA, 25 bp, Mus musculus
agtaaaagcagccaagagaccgtcc

SEQ ID NO: 406445 - DNA, 25 bp, Mus musculus
agtaaagcgcagaagtcggagccga

SEQ ID NO: 406446 - DNA, 25 bp, Mus musculus
agtaacctagccactttggacctgg

SEQ ID NO: 406447 - DNA, 25 bp, Mus musculus
agtaacctgcgtgattctgacccca

SEQ ID NO: 406448 - DNA, 25 bp, Mus musculus
agtaactgaattgcccagttcttgg

SEQ ID NO: 406449 - DNA, 25 bp, Mus musculus
agtaactggaggtggcttgtgtatc

SEQ ID NO: 406450 - DNA, 25 bp, Mus musculus
agtaagtcctcaggcggctacacgt

SEQ ID NO: 406451 - DNA, 25 bp, Mus musculus
agtaagtgaggtcacagccgccctc

SEQ ID NO: 406452 - DNA, 25 bp, Mus musculus
agtaagtgctcctgactgcgcagcc

SEQ ID NO: 406453 - DNA, 25 bp, Mus musculus
agtaagtttaagtcaccgtgcctgg

SEQ ID NO: 406454 - DNA, 25 bp, Mus musculus
agtaatagccggagcggttggcacc

SEQ ID NO: 406455 - DNA, 25 bp, Mus musculus
agtaatctttgccattccggacgca

SEQ ID NO: 406456 - DNA, 25 bp, Mus musculus
agtaatgaatttgcccgagactata

SEQ ID NO: 406457 - DNA, 25 bp, Mus musculus
agtaatgctgtctgggttccgagaa

SEQ ID NO: 406458 - DNA, 25 bp, Mus musculus
agtaatgtcatctttcctgttttcc

SEQ ID NO: 406459 - DNA, 25 bp, Mus musculus
agtacaacctggtgtgaccgcggca

SEQ ID NO: 406460 - DNA, 25 bp, Mus musculus
agtacaagaaggtggcctggatcca

SEQ ID NO: 406461 - DNA, 25 bp, Mus musculus
agtacaagagggtctccaacgccag

SEQ ID NO: 406462 - DNA, 25 bp, Mus musculus
agtacacacagttgagagccgccgt

SEQ ID NO: 406463 - DNA, 25 bp, Mus musculus
agtacacattaccatcagaccctgg

SEQ ID NO: 406464 - DNA, 25 bp, Mus musculus
agtacaccccaagcaatgagtcagg

SEQ ID NO: 406465 - DNA, 25 bp, Mus musculus
agtacacgtgggatccggacacgct

SEQ ID NO: 406466 - DNA, 25 bp, Mus musculus
agtacagaaagaagcgcagcgcatc

SEQ ID NO: 406467 - DNA, 25 bp, Mus musculus
agtacagcaacaagcgggtgtcccg

SEQ ID NO: 406468 - DNA, 25 bp, Mus musculus
agtacagcagtcacatggcctcaag

SEQ ID NO: 406469 - DNA, 25 bp, Mus musculus
agtacatccctgagaagcgggccag

SEQ ID NO: 406470 - DNA, 25 bp, Mus musculus
agtaccaagcgtagcccctatgagg

SEQ ID NO: 406471 - DNA, 25 bp, Mus musculus
agtaccaggctgcttaattaagtgc

SEQ ID NO: 406472 - DNA, 25 bp, Mus musculus
agtaccagtgatggataacttgctt

SEQ ID NO: 406473 - DNA, 25 bp, Mus musculus
agtaccgctctctccggacgacaag

SEQ ID NO: 406474 - DNA, 25 bp, Mus musculus
agtacctggagatgagacccacatg

SEQ ID NO: 406475 - DNA, 25 bp, Mus musculus
agtacctgtctattgccgagcgcgc

SEQ ID NO: 406476 - DNA, 25 bp, Mus musculus
agtaccttcggcagctgtttcaaag

SEQ ID NO: 406477 - DNA, 25 bp, Mus musculus
agtaccttctacactcgtcgtctgg

SEQ ID NO: 406478 - DNA, 25 bp, Mus musculus
agtacgagaacttgccgtggcccga

SEQ ID NO: 406479 - DNA, 25 bp, Mus musculus
agtacgagcgctacagcttccgcag

SEQ ID NO: 406480 - DNA, 25 bp, Mus musculus
agtacggtcaggttttatgtgtcag

SEQ ID NO: 406481 - DNA, 25 bp, Mus musculus
agtacgtcaccgttcaggagcctga

SEQ ID NO: 406482 - DNA, 25 bp, Mus musculus
agtacgtgggtatccggctcctagt

SEQ ID NO: 406483 - DNA, 25 bp, Mus musculus
agtactacaacgtgtgccgctcggg

SEQ ID NO: 406484 - DNA, 25 bp, Mus musculus
agtactacgagcatcgctaccaggg

SEQ ID NO: 406485 - DNA, 25 bp, Mus musculus
agtactagactcttctggcagggtg

SEQ ID NO: 406486 - DNA, 25 bp, Mus musculus
agtactgcagcaaagaacgccatgc

SEQ ID NO: 406487 - DNA, 25 bp, Mus musculus
agtactggacaacgtgctctatgca

SEQ ID NO: 406488 - DNA, 25 bp, Mus musculus
agtactggagatccatcaaatggcc

SEQ ID NO: 406489 - DNA, 25 bp, Mus musculus
agtactggccagttatctctgaggc

SEQ ID NO: 406490 - DNA, 25 bp, Mus musculus
agtactgggccaatttcgcaagaaa

SEQ ID NO: 406491 - DNA, 25 bp, Mus musculus
agtacttgcctagccctaattgcag

SEQ ID NO: 406492 - DNA, 25 bp, Mus musculus
agtacttgctaatcctggtcctccc

SEQ ID NO: 406493 - DNA, 25 bp, Mus musculus
agtactttcatctggccgcgtgggc

SEQ ID NO: 406494 - DNA, 25 bp, Mus musculus
agtagaacgttctcaggctgcagcg

SEQ ID NO: 406495 - DNA, 25 bp, Mus musculus
agtagaagaaataggaactggctcc

SEQ ID NO: 406496 - DNA, 25 bp, Mus musculus
agtagaagaggcaggattcagagtc

SEQ ID NO: 406497 - DNA, 25 bp, Mus musculus
agtagacgccaaacctattatttgg

SEQ ID NO: 406498 - DNA, 25 bp, Mus musculus
agtagactgttaactcgggcccaga

SEQ ID NO: 406499 - DNA, 25 bp, Mus musculus
agtagagaacacgaacaccgctgcg

SEQ ID NO: 406500 - DNA, 25 bp, Mus musculus
agtagatcccaaaaaccgtgcagcg

SEQ ID NO: 406501 - DNA, 25 bp, Mus musculus
agtagcagcatcgaggaggaagtcc

SEQ ID NO: 406502 - DNA, 25 bp, Mus musculus
agtagcgtagactaggaggcccaga

SEQ ID NO: 406503 - DNA, 25 bp, Mus musculus
agtagcgtatcgttctgcaccagcg

SEQ ID NO: 406504 - DNA, 25 bp, Mus musculus
agtagctcttggtccagtcggcgcc

SEQ ID NO: 406505 - DNA, 25 bp, Mus musculus
agtagctgctccaggaaagaagaaa

SEQ ID NO: 406506 - DNA, 25 bp, Mus musculus
agtagctgcttatgaggatagggaa

SEQ ID NO: 406507 - DNA, 25 bp, Mus musculus
agtaggctactgctcacccattgga

SEQ ID NO: 406508 - DNA, 25 bp, Mus musculus
agtaggtctgcaggcccacatcatt

SEQ ID NO: 406509 - DNA, 25 bp, Mus musculus
agtagtatagcatgcctgacccctg

SEQ ID NO: 406510 - DNA, 25 bp, Mus musculus
agtagtgctttgtcccaagtgctca

SEQ ID NO: 406511 - DNA, 25 bp, Mus musculus
agtatagcctcacttctcgggaagg

SEQ ID NO: 406512 - DNA, 25 bp, Mus musculus
agtatagctgcaccagtctccaggg

SEQ ID NO: 406513 - DNA, 25 bp, Mus musculus
agtataggcctccacgaatcaggga

SEQ ID NO: 406514 - DNA, 25 bp, Mus musculus
agtatcaaatggaaacccccgccag

SEQ ID NO: 406515 - DNA, 25 bp, Mus musculus
agtatcccacaaggcatcgccaggt

SEQ ID NO: 406516 - DNA, 25 bp, Mus musculus
agtatctcacataccctgagagagg

SEQ ID NO: 406517 - DNA, 25 bp, Mus musculus
agtatctgacgccttctcctggcct

SEQ ID NO: 406518 - DNA, 25 bp, Mus musculus
agtatctgggaaatgccatccttaa

SEQ ID NO: 406519 - DNA, 25 bp, Mus musculus
agtatctgtgggtcattggctctca

SEQ ID NO: 406520 - DNA, 25 bp, Mus musculus
agtatgaactgggagcatcgcgtac

SEQ ID NO: 406521 - DNA, 25 bp, Mus musculus
agtatgcatacaaggagcgccgggc

SEQ ID NO: 406522 - DNA, 25 bp, Mus musculus
agtatgccaccagtatgccaccaag

SEQ ID NO: 406523 - DNA, 25 bp, Mus musculus
agtatgcctcccactttgtgataga

SEQ ID NO: 406524 - DNA, 25 bp, Mus musculus
agtatgcgtagctttctgtgttccc

SEQ ID NO: 406525 - DNA, 25 bp, Mus musculus
agtatgctgttgttctgcccgggct

SEQ ID NO: 406526 - DNA, 25 bp, Mus musculus
agtatggattacgaccctctagtgg

SEQ ID NO: 406527 - DNA, 25 bp, Mus musculus
agtattacctaacaactgtttgtgg

SEQ ID NO: 406528 - DNA, 25 bp, Mus musculus
agtattatcacctgggccctagcca

SEQ ID NO: 406529 - DNA, 25 bp, Mus musculus
agtattcagtctcggctctcccctg

SEQ ID NO: 406530 - DNA, 25 bp, Mus musculus
agtattgtcacgctccaacctgggc

SEQ ID NO: 406531 - DNA, 25 bp, Mus musculus
agtatttaacattctggagccccag

SEQ ID NO: 406532 - DNA, 25 bp, Mus musculus
agtatttccatttagccgcctgggc

SEQ ID NO: 406533 - DNA, 25 bp, Mus musculus
agtcaaacgctatgcaccaggcctg

SEQ ID NO: 406534 - DNA, 25 bp, Mus musculus
agtcaaagctgacccacagacataa

SEQ ID NO: 406535 - DNA, 25 bp, Mus musculus
agtcaaccctcactgaacatcagcg

SEQ ID NO: 406536 - DNA, 25 bp, Mus musculus
agtcaacccttacagtacatcagaa

SEQ ID NO: 406537 - DNA, 25 bp, Mus musculus
agtcaaggccttcagtccttcagtc

SEQ ID NO: 406538 - DNA, 25 bp, Mus musculus
agtcaagtgtggacacagctggcca

SEQ ID NO: 406539 - DNA, 25 bp, Mus musculus
agtcaatcgctactatgtgtccaag

SEQ ID NO: 406540 - DNA, 25 bp, Mus musculus
agtcaattcgggaaagtggcgctgc

SEQ ID NO: 406541 - DNA, 25 bp, Mus musculus
agtcacaagggcagtctcactcgct

SEQ ID NO: 406542 - DNA, 25 bp, Mus musculus
agtcacaatggcttcagcctttcgt

SEQ ID NO: 406543 - DNA, 25 bp, Mus musculus
agtcacagagattcaggcgcacgga

SEQ ID NO: 406544 - DNA, 25 bp, Mus musculus
agtcacagatgaagatggcccagag

SEQ ID NO: 406545 - DNA, 25 bp, Mus musculus
agtcacaggtacaggaggtgcgcca

SEQ ID NO: 406546 - DNA, 25 bp, Mus musculus
agtcaccccaggcacatgcgtgatg

SEQ ID NO: 406547 - DNA, 25 bp, Mus musculus
agtcactattttcttccatcatccc

SEQ ID NO: 406548 - DNA, 25 bp, Mus musculus
agtcagagtgcgagtccttccctag

SEQ ID NO: 406549 - DNA, 25 bp, Mus musculus
agtcagcagatattttcccacgggc

SEQ ID NO: 406550 - DNA, 25 bp, Mus musculus
agtcagcagggtttctccgaggccc

SEQ ID NO: 406551 - DNA, 25 bp, Mus musculus
agtcagcccagcctcctatgagaat

SEQ ID NO: 406552 - DNA, 25 bp, Mus musculus
agtcagcccccagcaagaaaatgtg

SEQ ID NO: 406553 - DNA, 25 bp, Mus musculus
agtcagctgcaagtctcctcattca

SEQ ID NO: 406554 - DNA, 25 bp, Mus musculus
agtcaggaggctcgcgctaactcgt

SEQ ID NO: 406555 - DNA, 25 bp, Mus musculus
agtcagggtgtctcagcagaaggtc

SEQ ID NO: 406556 - DNA, 25 bp, Mus musculus
agtcagtacgtggagggagacccca

SEQ ID NO: 406557 - DNA, 25 bp, Mus musculus
agtcagtcagagcatctcatagctg

SEQ ID NO: 406558 - DNA, 25 bp, Mus musculus
agtcagtcattcctcctctttggag

SEQ ID NO: 406559 - DNA, 25 bp, Mus musculus
agtcagtcgagaccccttgcccagg

SEQ ID NO: 406560 - DNA, 25 bp, Mus musculus
agtcagttcccctttctgtatgtga

SEQ ID NO: 406561 - DNA, 25 bp, Mus musculus
agtcatacagtcttgtttgaaggca

SEQ ID NO: 406562 - DNA, 25 bp, Mus musculus
agtcatccgaattaaacccttcaag

SEQ ID NO: 406563 - DNA, 25 bp, Mus musculus
agtcatcctgtactcatcttcttag

SEQ ID NO: 406564 - DNA, 25 bp, Mus musculus
agtcattattccgaagcggccgccg

SEQ ID NO: 406565 - DNA, 25 bp, Mus musculus
agtcattgatactgtagctctgagg

SEQ ID NO: 406566 - DNA, 25 bp, Mus musculus
agtcattgatgtgcccgagccctac

SEQ ID NO: 406567 - DNA, 25 bp, Mus musculus
agtccaacagcgaccgggtgtcggc

SEQ ID NO: 406568 - DNA, 25 bp, Mus musculus
agtccaagtctaggtcgcggtccaa

SEQ ID NO: 406569 - DNA, 25 bp, Mus musculus
agtccacagcctcgcgggctaagaa

SEQ ID NO: 406570 - DNA, 25 bp, Mus musculus
agtccaccaaactcgtgctcaaggg

SEQ ID NO: 406571 - DNA, 25 bp, Mus musculus
agtccactcactgccttaaacagag

SEQ ID NO: 406572 - DNA, 25 bp, Mus musculus
agtccagacgttacatcccacagag

SEQ ID NO: 406573 - DNA, 25 bp, Mus musculus
agtccagcacttagcctgggtcgcc

SEQ ID NO: 406574 - DNA, 25 bp, Mus musculus
agtccagcgtggaccccagaacatg

SEQ ID NO: 406575 - DNA, 25 bp, Mus musculus
agtccagggacgaggcgctttgtca

SEQ ID NO: 406576 - DNA, 25 bp, Mus musculus
agtccatcagcatgcctcagacact

SEQ ID NO: 406577 - DNA, 25 bp, Mus musculus
agtccatgggactgttgcctacaca

SEQ ID NO: 406578 - DNA, 25 bp, Mus musculus
agtccatttgtttctctgagaataa

SEQ ID NO: 406579 - DNA, 25 bp, Mus musculus
agtcccaaggcagccctcagaaagg

SEQ ID NO: 406580 - DNA, 25 bp, Mus musculus
agtcccactgtcagcatcttctact

SEQ ID NO: 406581 - DNA, 25 bp, Mus musculus
agtccccaccaggagttccagggag

SEQ ID NO: 406582 - DNA, 25 bp, Mus musculus
agtccccgcagaggaagcacaagtg

SEQ ID NO: 406583 - DNA, 25 bp, Mus musculus
agtccccgtaggcagcagctgctaa

SEQ ID NO: 406584 - DNA, 25 bp, Mus musculus
agtccctgcactccacttggacggg

SEQ ID NO: 406585 - DNA, 25 bp, Mus musculus
agtccgccgtaagcagaagggagaa

SEQ ID NO: 406586 - DNA, 25 bp, Mus musculus
agtccgtgacggtggcaacttccca

SEQ ID NO: 406587 - DNA, 25 bp, Mus musculus
agtcctcaggtttgctatcctcagt

SEQ ID NO: 406588 - DNA, 25 bp, Mus musculus
agtcctcctgggacaaaccatggga

SEQ ID NO: 406589 - DNA, 25 bp, Mus musculus
agtcctcggtttaagaggcaacaca

SEQ ID NO: 406590 - DNA, 25 bp, Mus musculus
agtcctctacagtgtctgtcccttg

SEQ ID NO: 406591 - DNA, 25 bp, Mus musculus
agtcctctcagcaggtgaaccacac

SEQ ID NO: 406592 - DNA, 25 bp, Mus musculus
agtcctgagcgagttcgggagcctc

SEQ ID NO: 406593 - DNA, 25 bp, Mus musculus
agtcctgcagtcagtgagcttgggc

SEQ ID NO: 406594 - DNA, 25 bp, Mus musculus
agtcctgcctctttcatctggcttc

SEQ ID NO: 406595 - DNA, 25 bp, Mus musculus
agtcctgcgagataagtatgttggg

SEQ ID NO: 406596 - DNA, 25 bp, Mus musculus
agtcctgtggccatgtttttcaggg

SEQ ID NO: 406597 - DNA, 25 bp, Mus musculus
agtcctgtgtgcttcttgaggctca

SEQ ID NO: 406598 - DNA, 25 bp, Mus musculus
agtcgcagcagagagctgatctcaa

SEQ ID NO: 406599 - DNA, 25 bp, Mus musculus
agtcgcaggcttccctagagcacag

SEQ ID NO: 406600 - DNA, 25 bp, Mus musculus
agtcgcagtggtctccgtcgcttca

SEQ ID NO: 406601 - DNA, 25 bp, Mus musculus
agtcgccaagcagtacgtccagtta

SEQ ID NO: 406602 - DNA, 25 bp, Mus musculus
agtcgctccctcttggaagcgctct

SEQ ID NO: 406603 - DNA, 25 bp, Mus musculus
agtcgctgctggcaccacttgtcga

SEQ ID NO: 406604 - DNA, 25 bp, Mus musculus
agtcggatgcgaaccagctacagct

SEQ ID NO: 406605 - DNA, 25 bp, Mus musculus
agtcggcacagcagcgcatttgact

SEQ ID NO: 406606 - DNA, 25 bp, Mus musculus
agtcgggccggcatcttttctgaga

SEQ ID NO: 406607 - DNA, 25 bp, Mus musculus
agtcgtcacggccaaacagggcaag

SEQ ID NO: 406608 - DNA, 25 bp, Mus musculus
agtcgtcagcatggctcgctcggtg

SEQ ID NO: 406609 - DNA, 25 bp, Mus musculus
agtcgtccgctatgtgcagctgcca

SEQ ID NO: 406610 - DNA, 25 bp, Mus musculus
agtcgttggactaggaaatcatgcc

SEQ ID NO: 406611 - DNA, 25 bp, Mus musculus
agtctaaatccacacagcagagcag

SEQ ID NO: 406612 - DNA, 25 bp, Mus musculus
agtctaacaagcttctgtgtatgtg

SEQ ID NO: 406613 - DNA, 25 bp, Mus musculus
agtctaacttcaatccctgcgtggg

SEQ ID NO: 406614 - DNA, 25 bp, Mus musculus
agtctagtggccgtggcccgatgcc

SEQ ID NO: 406615 - DNA, 25 bp, Mus musculus
agtctatgatgacggtaccaaagta

SEQ ID NO: 406616 - DNA, 25 bp, Mus musculus
agtctatgcctagaaaacgcttcct

SEQ ID NO: 406617 - DNA, 25 bp, Mus musculus
agtctattttcatggttcatcacaa

SEQ ID NO: 406618 - DNA, 25 bp, Mus musculus
agtctcaagactcccagagcttggg

SEQ ID NO: 406619 - DNA, 25 bp, Mus musculus
agtctcaccgaagatgcgcaggcgc

SEQ ID NO: 406620 - DNA, 25 bp, Mus musculus
agtctcacgtgatggcctctcgacg

SEQ ID NO: 406621 - DNA, 25 bp, Mus musculus
agtctccaagcgtggcagctgcgag

SEQ ID NO: 406622 - DNA, 25 bp, Mus musculus
agtctcccatggctcacagaaaggg

SEQ ID NO: 406623 - DNA, 25 bp, Mus musculus
agtctccgcggcacggcggcaactt

SEQ ID NO: 406624 - DNA, 25 bp, Mus musculus
agtctctggaccatcgcctcggcgg

SEQ ID NO: 406625 - DNA, 25 bp, Mus musculus
agtctctgggcatcaagcatgagga

SEQ ID NO: 406626 - DNA, 25 bp, Mus musculus
agtctcttcgagtacattgccatgg

SEQ ID NO: 406627 - DNA, 25 bp, Mus musculus
agtctgagagccaccgccgggctct

SEQ ID NO: 406628 - DNA, 25 bp, Mus musculus
agtctgctccctaaccagtgtgtta

SEQ ID NO: 406629 - DNA, 25 bp, Mus musculus
agtctgctggtttagtgggcctcca

SEQ ID NO: 406630 - DNA, 25 bp, Mus musculus
agtctggccctttggatgtctcttc

SEQ ID NO: 406631 - DNA, 25 bp, Mus musculus
agtctggcgccaaaggtatctcctg

SEQ ID NO: 406632 - DNA, 25 bp, Mus musculus
agtctggtaacatgacggcggcgcc

SEQ ID NO: 406633 - DNA, 25 bp, Mus musculus
agtctgtctgcctacccttcagatc

SEQ ID NO: 406634 - DNA, 25 bp, Mus musculus
agtctgtgagcttgccatccctctc

SEQ ID NO: 406635 - DNA, 25 bp, Mus musculus
agtcttacatagcatcccgtcaggg

SEQ ID NO: 406636 - DNA, 25 bp, Mus musculus
agtcttcatagcaaggccgggcgag

SEQ ID NO: 406637 - DNA, 25 bp, Mus musculus
agtcttctgactgactcacacaaag

SEQ ID NO: 406638 - DNA, 25 bp, Mus musculus
agtcttgaggatacacaggatccgc

SEQ ID NO: 406639 - DNA, 25 bp, Mus musculus
agtcttggcttggtgtgtatcttac

SEQ ID NO: 406640 - DNA, 25 bp, Mus musculus
agtctttagacctctgctgggtgtg

SEQ ID NO: 406641 - DNA, 25 bp, Mus musculus
agtctttccacaaacctctcagcaa

SEQ ID NO: 406642 - DNA, 25 bp, Mus musculus
agtctttcgaaggagctgccgccat

SEQ ID NO: 406643 - DNA, 25 bp, Mus musculus
agtctttgctccaagccagctgtgg

SEQ ID NO: 406644 - DNA, 25 bp, Mus musculus
agtctttgctctgtgcacccctgta

SEQ ID NO: 406645 - DNA, 25 bp, Mus musculus
agtctttgctggagttagtttctgc

SEQ ID NO: 406646 - DNA, 25 bp, Mus musculus
agtctttgtcttctcttgggttggg

SEQ ID NO: 406647 - DNA, 25 bp, Mus musculus
agtgaaaaccgcgacgacctgcaca

SEQ ID NO: 406648 - DNA, 25 bp, Mus musculus
agtgaaagacgccatcgatgacgtg

SEQ ID NO: 406649 - DNA, 25 bp, Mus musculus
agtgaaataactctccccacggcca

SEQ ID NO: 406650 - DNA, 25 bp, Mus musculus
agtgaacaaaatcagcgctcccgag

SEQ ID NO: 406651 - DNA, 25 bp, Mus musculus
agtgaactgtcagcctccttctgag

SEQ ID NO: 406652 - DNA, 25 bp, Mus musculus
agtgaagaataaagaaagcagatgc

SEQ ID NO: 406653 - DNA, 25 bp, Mus musculus
agtgaagcggattgcaacgtgccca

SEQ ID NO: 406654 - DNA, 25 bp, Mus musculus
agtgaaggacactctcatccccgag

SEQ ID NO: 406655 - DNA, 25 bp, Mus musculus
agtgaaggcccatgatgcaatgccc

SEQ ID NO: 406656 - DNA, 25 bp, Mus musculus
agtgaataagccctgcagtcctgat

SEQ ID NO: 406657 - DNA, 25 bp, Mus musculus
agtgaattccagtgcacctcagagg

SEQ ID NO: 406658 - DNA, 25 bp, Mus musculus
agtgacaacacctcagtgactaccc

SEQ ID NO: 406659 - DNA, 25 bp, Mus musculus
agtgacaatggcagcttcaggcggc

SEQ ID NO: 406660 - DNA, 25 bp, Mus musculus
agtgacacacctatgccccagggct

SEQ ID NO: 406661 - DNA, 25 bp, Mus musculus
agtgacaccattcttgcctaaccct

SEQ ID NO: 406662 - DNA, 25 bp, Mus musculus
agtgacagctcatctcaactgaaca

SEQ ID NO: 406663 - DNA, 25 bp, Mus musculus
agtgaccacaacagaggctggaggc

SEQ ID NO: 406664 - DNA, 25 bp, Mus musculus
agtgaccatgccttcaccagccaga

SEQ ID NO: 406665 - DNA, 25 bp, Mus musculus
agtgacccagactgtgcctctccag

SEQ ID NO: 406666 - DNA, 25 bp, Mus musculus
agtgaccccgagtttgcacagtggc

SEQ ID NO: 406667 - DNA, 25 bp, Mus musculus
agtgaccggacttctaatccccagg

SEQ ID NO: 406668 - DNA, 25 bp, Mus musculus
agtgactaagtttccctgctggtga

SEQ ID NO: 406669 - DNA, 25 bp, Mus musculus
agtgactcaggcagcagacgacgat

SEQ ID NO: 406670 - DNA, 25 bp, Mus musculus
agtgagaccccagtcctcggctggg

SEQ ID NO: 406671 - DNA, 25 bp, Mus musculus
agtgagacgttggaaggcagtggaa

SEQ ID NO: 406672 - DNA, 25 bp, Mus musculus
agtgagagggccttgcaccgcatct

SEQ ID NO: 406673 - DNA, 25 bp, Mus musculus
agtgagcaagtgtcctgggcaagct

SEQ ID NO: 406674 - DNA, 25 bp, Mus musculus
agtgagcactcccactgaactacat

SEQ ID NO: 406675 - DNA, 25 bp, Mus musculus
agtgagcagccccttaaggaaagct

SEQ ID NO: 406676 - DNA, 25 bp, Mus musculus
agtgagcatagtgatgccagtccca

SEQ ID NO: 406677 - DNA, 25 bp, Mus musculus
agtgaggacaaacccgtggccaact

SEQ ID NO: 406678 - DNA, 25 bp, Mus musculus
agtgaggataatggacagccctgtc

SEQ ID NO: 406679 - DNA, 25 bp, Mus musculus
agtgagggagtagcaggcatctcca

SEQ ID NO: 406680 - DNA, 25 bp, Mus musculus
agtgagttcaaactccccgcaaccg

SEQ ID NO: 406681 - DNA, 25 bp, Mus musculus
agtgatcaaactggcttgcactgac

SEQ ID NO: 406682 - DNA, 25 bp, Mus musculus
agtgatctctgcctttacttaaaga

SEQ ID NO: 406683 - DNA, 25 bp, Mus musculus
agtgatctgggcagccaggcgcatc

SEQ ID NO: 406684 - DNA, 25 bp, Mus musculus
agtgatggccccaggctgtagcggg

SEQ ID NO: 406685 - DNA, 25 bp, Mus musculus
agtgattcatgtagaggtggcccca

SEQ ID NO: 406686 - DNA, 25 bp, Mus musculus
agtgattcccctctgcgccaagtct

SEQ ID NO: 406687 - DNA, 25 bp, Mus musculus
agtgattcccttttctactctctgc

SEQ ID NO: 406688 - DNA, 25 bp, Mus musculus
agtgcaaagagtgtgcgtcccctcg

SEQ ID NO: 406689 - DNA, 25 bp, Mus musculus
agtgcaaagtttccctgacccagag

SEQ ID NO: 406690 - DNA, 25 bp, Mus musculus
agtgcaagcgagacagcttccccaa

SEQ ID NO: 406691 - DNA, 25 bp, Mus musculus
agtgcaagtcagtgccacagcccga

SEQ ID NO: 406692 - DNA, 25 bp, Mus musculus
agtgcaagtgcccaaaaacgtcaga

SEQ ID NO: 406693 - DNA, 25 bp, Mus musculus
agtgcaccctgaatactggaccaag

SEQ ID NO: 406694 - DNA, 25 bp, Mus musculus
agtgcactccttagctacatcccta

SEQ ID NO: 406695 - DNA, 25 bp, Mus musculus
agtgcagacgacagcagtcaccctg

SEQ ID NO: 406696 - DNA, 25 bp, Mus musculus
agtgcagagctgattggatgtccca

SEQ ID NO: 406697 - DNA, 25 bp, Mus musculus
agtgcagcaggatgccggagccttc

SEQ ID NO: 406698 - DNA, 25 bp, Mus musculus
agtgcagccaccttggcaaccaaga

SEQ ID NO: 406699 - DNA, 25 bp, Mus musculus
agtgcagcgcccttttccgaggcgt

SEQ ID NO: 406700 - DNA, 25 bp, Mus musculus
agtgcaggcggaactcagccagtcc

SEQ ID NO: 406701 - DNA, 25 bp, Mus musculus
agtgcaggtgggtggccatccccgg

SEQ ID NO: 406702 - DNA, 25 bp, Mus musculus
agtgcatacacctgggctggcgctg

SEQ ID NO: 406703 - DNA, 25 bp, Mus musculus
agtgcattcaggcttaggctcccag

SEQ ID NO: 406704 - DNA, 25 bp, Mus musculus
agtgccacaggccttaaggtccttg

SEQ ID NO: 406705 - DNA, 25 bp, Mus musculus
agtgccacgaagaaagacatagagc

SEQ ID NO: 406706 - DNA, 25 bp, Mus musculus
agtgccattcctagcctccctttga

SEQ ID NO: 406707 - DNA, 25 bp, Mus musculus
agtgcccactgggtctggttctcgc

SEQ ID NO: 406708 - DNA, 25 bp, Mus musculus
agtgcccaggacaaatgccctctgt

SEQ ID NO: 406709 - DNA, 25 bp, Mus musculus
agtgcccagtggtcatccttgagaa

SEQ ID NO: 406710 - DNA, 25 bp, Mus musculus
agtgccccagggtgaaatacttctt

SEQ ID NO: 406711 - DNA, 25 bp, Mus musculus
agtgcccttcgcttccttgtagtaa

SEQ ID NO: 406712 - DNA, 25 bp, Mus musculus
agtgccggcactactctgctcctgt

SEQ ID NO: 406713 - DNA, 25 bp, Mus musculus
agtgcctgcctcctaccactgggag

SEQ ID NO: 406714 - DNA, 25 bp, Mus musculus
agtgcgcacgctggtttgctcgccg

SEQ ID NO: 406715 - DNA, 25 bp, Mus musculus
agtgcgctcatttcacaaatttcca

SEQ ID NO: 406716 - DNA, 25 bp, Mus musculus
agtgcggcgttttccagtggattcc

SEQ ID NO: 406717 - DNA, 25 bp, Mus musculus
agtgcgtctgtaggagagccaagcc

SEQ ID NO: 406718 - DNA, 25 bp, Mus musculus
agtgcgtgacccttctccggaaaag

SEQ ID NO: 406719 - DNA, 25 bp, Mus musculus
agtgcgtttgctcccagaggtttct

SEQ ID NO: 406720 - DNA, 25 bp, Mus musculus
agtgctatgtctttgcccaggagta

SEQ ID NO: 406721 - DNA, 25 bp, Mus musculus
agtgctattcctgggtctctggccg

SEQ ID NO: 406722 - DNA, 25 bp, Mus musculus
agtgctcagacagcggaagtgctgt

SEQ ID NO: 406723 - DNA, 25 bp, Mus musculus
agtgctcatctcttctgtccccagg

SEQ ID NO: 406724 - DNA, 25 bp, Mus musculus
agtgctcattgcttctccccagagg

SEQ ID NO: 406725 - DNA, 25 bp, Mus musculus
agtgctcctggccacactagctgct

SEQ ID NO: 406726 - DNA, 25 bp, Mus musculus
agtgctcgggctctcacagcagccg

SEQ ID NO: 406727 - DNA, 25 bp, Mus musculus
agtgctcggtgctttcctctgctag

SEQ ID NO: 406728 - DNA, 25 bp, Mus musculus
agtgctctagctctgtgacctgcct

SEQ ID NO: 406729 - DNA, 25 bp, Mus musculus
agtgctcttctgaccggcgttgtaa

SEQ ID NO: 406730 - DNA, 25 bp, Mus musculus
agtgctgaaggtgtacgagcagccc

SEQ ID NO: 406731 - DNA, 25 bp, Mus musculus
agtgctgaccttggctttgctgtgc

SEQ ID NO: 406732 - DNA, 25 bp, Mus musculus
agtgctgagcagatgccggctccga

SEQ ID NO: 406733 - DNA, 25 bp, Mus musculus
agtgctgcggtctttctgggctcca

SEQ ID NO: 406734 - DNA, 25 bp, Mus musculus
agtgctgcgtttcctctcccggcaa

SEQ ID NO: 406735 - DNA, 25 bp, Mus musculus
agtgctgctgggacatggcttcaga

SEQ ID NO: 406736 - DNA, 25 bp, Mus musculus
agtgctggatggtgatacaatgacc

SEQ ID NO: 406737 - DNA, 25 bp, Mus musculus
agtgctgtactactgccctgtatcc

SEQ ID NO: 406738 - DNA, 25 bp, Mus musculus
agtgctgtcggcctggctgctctta

SEQ ID NO: 406739 - DNA, 25 bp, Mus musculus
agtgctgtggcaagtcttgggccca

SEQ ID NO: 406740 - DNA, 25 bp, Mus musculus
agtgctgtgtctagccggcttccgg

SEQ ID NO: 406741 - DNA, 25 bp, Mus musculus
agtgcttgctaacaggcgtctgata

SEQ ID NO: 406742 - DNA, 25 bp, Mus musculus
agtgctttcctggtttcgccagcaa

SEQ ID NO: 406743 - DNA, 25 bp, Mus musculus
agtggaaaaacctctctcgtttcag

SEQ ID NO: 406744 - DNA, 25 bp, Mus musculus
agtggaaagatcactaggccctttg

SEQ ID NO: 406745 - DNA, 25 bp, Mus musculus
agtggaacaccgataacactctggg

SEQ ID NO: 406746 - DNA, 25 bp, Mus musculus
agtggaacatatcaccagccttggc

SEQ ID NO: 406747 - DNA, 25 bp, Mus musculus
agtggaagaaaacttggttcatgaa

SEQ ID NO: 406748 - DNA, 25 bp, Mus musculus
agtggaagagagaccacgccctctc

SEQ ID NO: 406749 - DNA, 25 bp, Mus musculus
agtggaccagtggacgctaccgcct

SEQ ID NO: 406750 - DNA, 25 bp, Mus musculus
agtggagacatcttactctggtggc

SEQ ID NO: 406751 - DNA, 25 bp, Mus musculus
agtggagcaaccgtccagcaagcct

SEQ ID NO: 406752 - DNA, 25 bp, Mus musculus
agtggaggagttcgcacctgccaaa

SEQ ID NO: 406753 - DNA, 25 bp, Mus musculus
agtggaggttcagacactgtcccca

SEQ ID NO: 406754 - DNA, 25 bp, Mus musculus
agtggagtcccctgacacagtacag

SEQ ID NO: 406755 - DNA, 25 bp, Mus musculus
agtggagttacggattcatgtgagc

SEQ ID NO: 406756 - DNA, 25 bp, Mus musculus
agtggagttcaaatgccccgatggc

SEQ ID NO: 406757 - DNA, 25 bp, Mus musculus
agtggataacttgcaggagggcccc

SEQ ID NO: 406758 - DNA, 25 bp, Mus musculus
agtggatcgggaggcagcgctgtcc

SEQ ID NO: 406759 - DNA, 25 bp, Mus musculus
agtggattctggagtggcccctgtc

SEQ ID NO: 406760 - DNA, 25 bp, Mus musculus
agtggcaaatgcatagatcggtctg

SEQ ID NO: 406761 - DNA, 25 bp, Mus musculus
agtggcacggccctgtccttcctgt

SEQ ID NO: 406762 - DNA, 25 bp, Mus musculus
agtggcagagtgttgaaggaactca

SEQ ID NO: 406763 - DNA, 25 bp, Mus musculus
agtggcaggcatttaagggagctcc

SEQ ID NO: 406764 - DNA, 25 bp, Mus musculus
agtggcagggcctaatggttatgcc

SEQ ID NO: 406765 - DNA, 25 bp, Mus musculus
agtggcatgacccacccctgattgt

SEQ ID NO: 406766 - DNA, 25 bp, Mus musculus
agtggcattgcctcgtcagatggga

SEQ ID NO: 406767 - DNA, 25 bp, Mus musculus
agtggccactgctttctgacccagg

SEQ ID NO: 406768 - DNA, 25 bp, Mus musculus
agtggccaggttcaacgaccttcga

SEQ ID NO: 406769 - DNA, 25 bp, Mus musculus
agtggccctacgcagctcgtgctta

SEQ ID NO: 406770 - DNA, 25 bp, Mus musculus
agtggcgagttctcctgacggtgcc

SEQ ID NO: 406771 - DNA, 25 bp, Mus musculus
agtggctagctccaactcttgcgct

SEQ ID NO: 406772 - DNA, 25 bp, Mus musculus
agtggctccccaaagtataagtgcg

SEQ ID NO: 406773 - DNA, 25 bp, Mus musculus
agtggctccctaccaggcagtaagg

SEQ ID NO: 406774 - DNA, 25 bp, Mus musculus
agtggctgtactggcctgaagagca

SEQ ID NO: 406775 - DNA, 25 bp, Mus musculus
agtggcttctctcggccgtggccat

SEQ ID NO: 406776 - DNA, 25 bp, Mus musculus
agtggcttgggtgtgtacccgaatc

SEQ ID NO: 406777 - DNA, 25 bp, Mus musculus
agtgggaccctcagcctaccctgaa

SEQ ID NO: 406778 - DNA, 25 bp, Mus musculus
agtgggatcggaacagctctggaca

SEQ ID NO: 406779 - DNA, 25 bp, Mus musculus
agtgggcagccaagagtaaacagga

SEQ ID NO: 406780 - DNA, 25 bp, Mus musculus
agtgggccagaggtccagacttcaa

SEQ ID NO: 406781 - DNA, 25 bp, Mus musculus
agtgggccctgacctagagctagat

SEQ ID NO: 406782 - DNA, 25 bp, Mus musculus
agtgggcgcagctagcgggtcggct

SEQ ID NO: 406783 - DNA, 25 bp, Mus musculus
agtgggctccacctttacaagtagg

SEQ ID NO: 406784 - DNA, 25 bp, Mus musculus
agtgggctccgctgactctcttgga

SEQ ID NO: 406785 - DNA, 25 bp, Mus musculus
agtgggctcgctctgaagacctgca

SEQ ID NO: 406786 - DNA, 25 bp, Mus musculus
agtgggcttcacttagaacagtacc

SEQ ID NO: 406787 - DNA, 25 bp, Mus musculus
agtgggcttcccaagccagctccag

SEQ ID NO: 406788 - DNA, 25 bp, Mus musculus
agtgggtcagtctcaagcttgtgta

SEQ ID NO: 406789 - DNA, 25 bp, Mus musculus
agtgggtctccacacattcagaggg

SEQ ID NO: 406790 - DNA, 25 bp, Mus musculus
agtgggtgattttctctgagatctc

SEQ ID NO: 406791 - DNA, 25 bp, Mus musculus
agtggtagcaggaagcagccagttt

SEQ ID NO: 406792 - DNA, 25 bp, Mus musculus
agtggtcctgagctgtcatgccagc

SEQ ID NO: 406793 - DNA, 25 bp, Mus musculus
agtggtgcctacaacaagagctgcc

SEQ ID NO: 406794 - DNA, 25 bp, Mus musculus
agtggttcaacgctggagtcgcctc

SEQ ID NO: 406795 - DNA, 25 bp, Mus musculus
agtgtacttacccaacaagctgagg

SEQ ID NO: 406796 - DNA, 25 bp, Mus musculus
agtgtaggatcattttccattatgg

SEQ ID NO: 406797 - DNA, 25 bp, Mus musculus
agtgtagttatataccaaccagtat

SEQ ID NO: 406798 - DNA, 25 bp, Mus musculus
agtgtatacaccatccatcagcaag

SEQ ID NO: 406799 - DNA, 25 bp, Mus musculus
agtgtatccgcaccatgccttgtga

SEQ ID NO: 406800 - DNA, 25 bp, Mus musculus
agtgtcagcttctgggccacctgga

SEQ ID NO: 406801 - DNA, 25 bp, Mus musculus
agtgtccactgtcgctctgccaaga

SEQ ID NO: 406802 - DNA, 25 bp, Mus musculus
agtgtccagataactgaggccccag

SEQ ID NO: 406803 - DNA, 25 bp, Mus musculus
agtgtccaggtttctgcccattgca

SEQ ID NO: 406804 - DNA, 25 bp, Mus musculus
agtgtcccagagtatccctcaaagg

SEQ ID NO: 406805 - DNA, 25 bp, Mus musculus
agtgtcccaggtggctaaggcccag

SEQ ID NO: 406806 - DNA, 25 bp, Mus musculus
agtgtccccaaaagcgccaagatgc

SEQ ID NO: 406807 - DNA, 25 bp, Mus musculus
agtgtccccaaactaattctctgag

SEQ ID NO: 406808 - DNA, 25 bp, Mus musculus
agtgtccgccaggacggcctgatgt

SEQ ID NO: 406809 - DNA, 25 bp, Mus musculus
agtgtccggtggagtctgagcattt

SEQ ID NO: 406810 - DNA, 25 bp, Mus musculus
agtgtcctgggcaagctctgggtca

SEQ ID NO: 406811 - DNA, 25 bp, Mus musculus
agtgtccttcctcactcttctctgt

SEQ ID NO: 406812 - DNA, 25 bp, Mus musculus
agtgtctccccagtatactttctga

SEQ ID NO: 406813 - DNA, 25 bp, Mus musculus
agtgtcttagtgtcgtccagtatag

SEQ ID NO: 406814 - DNA, 25 bp, Mus musculus
agtgtcttgccatcccagttgtacc

SEQ ID NO: 406815 - DNA, 25 bp, Mus musculus
agtgtgaactgggaaccccgaccag

SEQ ID NO: 406816 - DNA, 25 bp, Mus musculus
agtgtgacccatcgcagctctgggc

SEQ ID NO: 406817 - DNA, 25 bp, Mus musculus
agtgtgatcatcttcgagccggcca

SEQ ID NO: 406818 - DNA, 25 bp, Mus musculus
agtgtgcactaggtgtgctctacca

SEQ ID NO: 406819 - DNA, 25 bp, Mus musculus
agtgtgcagccattcattaatcccg

SEQ ID NO: 406820 - DNA, 25 bp, Mus musculus
agtgtgctcatctttcatcgacggg

SEQ ID NO: 406821 - DNA, 25 bp, Mus musculus
agtgtgctcccggaagtcggccatg

SEQ ID NO: 406822 - DNA, 25 bp, Mus musculus
agtgtgctcccttccctttccagaa

SEQ ID NO: 406823 - DNA, 25 bp, Mus musculus
agtgtggaccccttctatgagatgt

SEQ ID NO: 406824 - DNA, 25 bp, Mus musculus
agtgtgggatccctctctgaggacc

SEQ ID NO: 406825 - DNA, 25 bp, Mus musculus
agtgtggttcaggtcgggcggagtg

SEQ ID NO: 406826 - DNA, 25 bp, Mus musculus
agtgtgtatgagtgcctctggcttc

SEQ ID NO: 406827 - DNA, 25 bp, Mus musculus
agtgtgtcgggctgcaggccaatcc

SEQ ID NO: 406828 - DNA, 25 bp, Mus musculus
agtgtgtgagacttgcaagcagacc

SEQ ID NO: 406829 - DNA, 25 bp, Mus musculus
agtgtgttcagaacgccgctaccgg

SEQ ID NO: 406830 - DNA, 25 bp, Mus musculus
agtgtgttgtctttccaatggtgcc

SEQ ID NO: 406831 - DNA, 25 bp, Mus musculus
agtgttacctgatccctgagggcag

SEQ ID NO: 406832 - DNA, 25 bp, Mus musculus
agtgttagccgagttggtccccaga

SEQ ID NO: 406833 - DNA, 25 bp, Mus musculus
agtgttcaggaagcagtagcctcca

SEQ ID NO: 406834 - DNA, 25 bp, Mus musculus
agtgttccaagtgtcccagccaaga

SEQ ID NO: 406835 - DNA, 25 bp, Mus musculus
agtgttccagcacgctgccatcact

SEQ ID NO: 406836 - DNA, 25 bp, Mus musculus
agtgttcccaacaaccagcagacag

SEQ ID NO: 406837 - DNA, 25 bp, Mus musculus
agtgttcctctccagtcctcacaag

SEQ ID NO: 406838 - DNA, 25 bp, Mus musculus
agtgttctgcccatcctgtgagtca

SEQ ID NO: 406839 - DNA, 25 bp, Mus musculus
agtgttcttgagacctcccctgaca

SEQ ID NO: 406840 - DNA, 25 bp, Mus musculus
agtgttcttgctactccgaggagga

SEQ ID NO: 406841 - DNA, 25 bp, Mus musculus
agtgttgattccatgctgaacgctg

SEQ ID NO: 406842 - DNA, 25 bp, Mus musculus
agtgtttgttcattgccaggccggc

SEQ ID NO: 406843 - DNA, 25 bp, Mus musculus
agtgttttcataccacagtggcaag

SEQ ID NO: 406844 - DNA, 25 bp, Mus musculus
agttaactgtgcacccgagcccaag

SEQ ID NO: 406845 - DNA, 25 bp, Mus musculus
agttaagagccaccactcagccgta

SEQ ID NO: 406846 - DNA, 25 bp, Mus musculus
agttaagtgttgcatctcctgtgaa

SEQ ID NO: 406847 - DNA, 25 bp, Mus musculus
agttacaacgcctggtggccgccga

SEQ ID NO: 406848 - DNA, 25 bp, Mus musculus
agttacagatagtcaagagggtgcc

SEQ ID NO: 406849 - DNA, 25 bp, Mus musculus
agttacatgtagacactgacctctg

SEQ ID NO: 406850 - DNA, 25 bp, Mus musculus
agttacccgagtcaaagccgtcagg

SEQ ID NO: 406851 - DNA, 25 bp, Mus musculus
agttacctgcacaccgggtcacaga

SEQ ID NO: 406852 - DNA, 25 bp, Mus musculus
agttacgcctgggagtccgcatggg

SEQ ID NO: 406853 - DNA, 25 bp, Mus musculus
agttactctgtaactgatgagacag

SEQ ID NO: 406854 - DNA, 25 bp, Mus musculus
agttactcttgcacggccactgcag

SEQ ID NO: 406855 - DNA, 25 bp, Mus musculus
agttagcctaagtgttcctctccag

SEQ ID NO: 406856 - DNA, 25 bp, Mus musculus
agttaggacctgtcatttctgccag

SEQ ID NO: 406857 - DNA, 25 bp, Mus musculus
agttagtagtgctgttaggagtccc

SEQ ID NO: 406858 - DNA, 25 bp, Mus musculus
agttagtttattctggagcgctgag

SEQ ID NO: 406859 - DNA, 25 bp, Mus musculus
agttatacatttccttctcctggga

SEQ ID NO: 406860 - DNA, 25 bp, Mus musculus
agttatctaagccatccgaggtcgt

SEQ ID NO: 406861 - DNA, 25 bp, Mus musculus
agttattaccacgtagccgaccgag

SEQ ID NO: 406862 - DNA, 25 bp, Mus musculus
agttcaacatcacacgggcatccaa

SEQ ID NO: 406863 - DNA, 25 bp, Mus musculus
agttcaaccatcagacacaattttg

SEQ ID NO: 406864 - DNA, 25 bp, Mus musculus
agttcaagcttctgcaggcggagga

SEQ ID NO: 406865 - DNA, 25 bp, Mus musculus
agttcaatggagaagacgtggacac

SEQ ID NO: 406866 - DNA, 25 bp, Mus musculus
agttcacagcaccagggaggtatga

SEQ ID NO: 406867 - DNA, 25 bp, Mus musculus
agttcacccttacggattcctggag

SEQ ID NO: 406868 - DNA, 25 bp, Mus musculus
agttcacctgtctgatccgacatgg

SEQ ID NO: 406869 - DNA, 25 bp, Mus musculus
agttcactcccaacattcaagctag

SEQ ID NO: 406870 - DNA, 25 bp, Mus musculus
agttcacttatgaccagcgcaccga

SEQ ID NO: 406871 - DNA, 25 bp, Mus musculus
agttcagagaaacagagccccatgg

SEQ ID NO: 406872 - DNA, 25 bp, Mus musculus
agttcagagagcgtgtcattgtccc

SEQ ID NO: 406873 - DNA, 25 bp, Mus musculus
agttcagaggacaacccaagggagc

SEQ ID NO: 406874 - DNA, 25 bp, Mus musculus
agttcagaggctgcctggattccag

SEQ ID NO: 406875 - DNA, 25 bp, Mus musculus
agttcagctgcctgcaaagaccaga

SEQ ID NO: 406876 - DNA, 25 bp, Mus musculus
agttcagctgtagaaagagccgcca

SEQ ID NO: 406877 - DNA, 25 bp, Mus musculus
agttcaggacactgcctgtggatca

SEQ ID NO: 406878 - DNA, 25 bp, Mus musculus
agttcaggtaagttcattgttgcag

SEQ ID NO: 406879 - DNA, 25 bp, Mus musculus
agttcagtctcttcatctagttagg

SEQ ID NO: 406880 - DNA, 25 bp, Mus musculus
agttcagtgcgcaggtaaaagttaa

SEQ ID NO: 406881 - DNA, 25 bp, Mus musculus
agttcataccaaacacagatcatgg

SEQ ID NO: 406882 - DNA, 25 bp, Mus musculus
agttcatactcatgctcaccctggg

SEQ ID NO: 406883 - DNA, 25 bp, Mus musculus
agttcatcaagtgccgaggagccct

SEQ ID NO: 406884 - DNA, 25 bp, Mus musculus
agttcatcagtactggacaaccagg

SEQ ID NO: 406885 - DNA, 25 bp, Mus musculus
agttcatccgcggagccaaaagcga

SEQ ID NO: 406886 - DNA, 25 bp, Mus musculus
agttcatgagcagcacggtgttccg

SEQ ID NO: 406887 - DNA, 25 bp, Mus musculus
agttcatgccaaccctcacgagaga

SEQ ID NO: 406888 - DNA, 25 bp, Mus musculus
agttcatgtctaccatagcctacag

SEQ ID NO: 406889 - DNA, 25 bp, Mus musculus
agttcatgttggtggctcacggccc

SEQ ID NO: 406890 - DNA, 25 bp, Mus musculus
agttcattatgcaaagatgtcacca

SEQ ID NO: 406891 - DNA, 25 bp, Mus musculus
agttcattctccctgcggctttgga

SEQ ID NO: 406892 - DNA, 25 bp, Mus musculus
agttcattctggcaaaccacgaggg

SEQ ID NO: 406893 - DNA, 25 bp, Mus musculus
agttccaagtcttcaacctcactgg

SEQ ID NO: 406894 - DNA, 25 bp, Mus musculus
agttccagcctacagcgaatggcca

SEQ ID NO: 406895 - DNA, 25 bp, Mus musculus
agttccaggtggacacaggtgccaa

SEQ ID NO: 406896 - DNA, 25 bp, Mus musculus
agttcccagcgcagtatggcatcca

SEQ ID NO: 406897 - DNA, 25 bp, Mus musculus
agttcccagcttccctaggtgacct

SEQ ID NO: 406898 - DNA, 25 bp, Mus musculus
agttccctagctcctcacggaggca

SEQ ID NO: 406899 - DNA, 25 bp, Mus musculus
agttccctcagtctgctagctactg

SEQ ID NO: 406900 - DNA, 25 bp, Mus musculus
agttccctcggcgagcgcctttgtt

SEQ ID NO: 406901 - DNA, 25 bp, Mus musculus
agttccctgcctcagtagagagcga

SEQ ID NO: 406902 - DNA, 25 bp, Mus musculus
agttcctctccttccaaagtgtgtg

SEQ ID NO: 406903 - DNA, 25 bp, Mus musculus
agttcctgagaaggcggtttgtcct

SEQ ID NO: 406904 - DNA, 25 bp, Mus musculus
agttcctgaggatcaaggactagta

SEQ ID NO: 406905 - DNA, 25 bp, Mus musculus
agttcctggattcccctgccaaggc

SEQ ID NO: 406906 - DNA, 25 bp, Mus musculus
agttcctgggatcgcagctcgagaa

SEQ ID NO: 406907 - DNA, 25 bp, Mus musculus
agttcctgggtcctgtccgaaggca

SEQ ID NO: 406908 - DNA, 25 bp, Mus musculus
agttcctgtgtcttgctgctcctaa

SEQ ID NO: 406909 - DNA, 25 bp, Mus musculus
agttccttctagactgggccgagca

SEQ ID NO: 406910 - DNA, 25 bp, Mus musculus
agttccttgcaattctgaggcacaa

SEQ ID NO: 406911 - DNA, 25 bp, Mus musculus
agttcgaagatccagctcagtggcc

SEQ ID NO: 406912 - DNA, 25 bp, Mus musculus
agttcgcgcgtcatcagagcatcca

SEQ ID NO: 406913 - DNA, 25 bp, Mus musculus
agttcgctgcaaatgtggccgccag

SEQ ID NO: 406914 - DNA, 25 bp, Mus musculus
agttcggatcactggccggcatcag

SEQ ID NO: 406915 - DNA, 25 bp, Mus musculus
agttctaatccgtcctctctcagtg

SEQ ID NO: 406916 - DNA, 25 bp, Mus musculus
agttctaccgtagggcgatgcagct

SEQ ID NO: 406917 - DNA, 25 bp, Mus musculus
agttctagaaagtatcctgccccgg

SEQ ID NO: 406918 - DNA, 25 bp, Mus musculus
agttctagaggcgagacctgggata

SEQ ID NO: 406919 - DNA, 25 bp, Mus musculus
agttctatcactgggagatggagca

SEQ ID NO: 406920 - DNA, 25 bp, Mus musculus
agttctatggtcacctgagtttgaa

SEQ ID NO: 406921 - DNA, 25 bp, Mus musculus
agttctattggccattgttttgaaa

SEQ ID NO: 406922 - DNA, 25 bp, Mus musculus
agttctcagatgaacgggccgcgta

SEQ ID NO: 406923 - DNA, 25 bp, Mus musculus
agttctccagcaccttacccaggaa

SEQ ID NO: 406924 - DNA, 25 bp, Mus musculus
agttctgatcgaccccgttctggag

SEQ ID NO: 406925 - DNA, 25 bp, Mus musculus
agttctggagtgcaagctctggtcc

SEQ ID NO: 406926 - DNA, 25 bp, Mus musculus
agttctggcaggtactgactcggca

SEQ ID NO: 406927 - DNA, 25 bp, Mus musculus
agttctggccggttgagtctgttca

SEQ ID NO: 406928 - DNA, 25 bp, Mus musculus
agttctgtgacctgtacacccctct

SEQ ID NO: 406929 - DNA, 25 bp, Mus musculus
agttcttagcctgttcggagccgca

SEQ ID NO: 406930 - DNA, 25 bp, Mus musculus
agttcttcacgcgaggacagcctgt

SEQ ID NO: 406931 - DNA, 25 bp, Mus musculus
agttcttcggagagcacctgttgga

SEQ ID NO: 406932 - DNA, 25 bp, Mus musculus
agttcttgggcaccagccttcgagg

SEQ ID NO: 406933 - DNA, 25 bp, Mus musculus
agttctttcgcaattaagatccggg

SEQ ID NO: 406934 - DNA, 25 bp, Mus musculus
agttgaagcaccacattgagagggc

SEQ ID NO: 406935 - DNA, 25 bp, Mus musculus
agttgagacaaaggttagtgctatc

SEQ ID NO: 406936 - DNA, 25 bp, Mus musculus
agttgagactgggtcccactctgta

SEQ ID NO: 406937 - DNA, 25 bp, Mus musculus
agttgaggcctggagcaatgtttca

SEQ ID NO: 406938 - DNA, 25 bp, Mus musculus
agttgaggcttttccgttcccgcag

SEQ ID NO: 406939 - DNA, 25 bp, Mus musculus
agttgagtggcctaagttggttcca

SEQ ID NO: 406940 - DNA, 25 bp, Mus musculus
agttgatggacgacgggaagaactt

SEQ ID NO: 406941 - DNA, 25 bp, Mus musculus
agttgcttagcaacagacacccacc

SEQ ID NO: 406942 - DNA, 25 bp, Mus musculus
agttggaagtgcagggaggcattct

SEQ ID NO: 406943 - DNA, 25 bp, Mus musculus
agttggactattaggaagcttgccc

SEQ ID NO: 406944 - DNA, 25 bp, Mus musculus
agttggagcactccaaggccctgga

SEQ ID NO: 406945 - DNA, 25 bp, Mus musculus
agttggagtctgttttgctaattgt

SEQ ID NO: 406946 - DNA, 25 bp, Mus musculus
agttggatatacctcgcctagtgtc

SEQ ID NO: 406947 - DNA, 25 bp, Mus musculus
agttggcttgattccctgctctgcg

SEQ ID NO: 406948 - DNA, 25 bp, Mus musculus
agttgggtctcctcctgagcttgct

SEQ ID NO: 406949 - DNA, 25 bp, Mus musculus
agttgggtgaccacaaaggcgtcaa

SEQ ID NO: 406950 - DNA, 25 bp, Mus musculus
agttggtcaaggtgagttgtagtct

SEQ ID NO: 406951 - DNA, 25 bp, Mus musculus
agttggttccagagtcacattctcc

SEQ ID NO: 406952 - DNA, 25 bp, Mus musculus
agttggttctctcctgtcgtgtggg

SEQ ID NO: 406953 - DNA, 25 bp, Mus musculus
agttgtagctcgcagcaggactgca

SEQ ID NO: 406954 - DNA, 25 bp, Mus musculus
agttgtagtgcttgcagcctccgtg

SEQ ID NO: 406955 - DNA, 25 bp, Mus musculus
agttgtcccacccagtgctaggtgt

SEQ ID NO: 406956 - DNA, 25 bp, Mus musculus
agttgtccccagctgaatgtttgcc

SEQ ID NO: 406957 - DNA, 25 bp, Mus musculus
agttgtgtcctgctaagtcctctgc

SEQ ID NO: 406958 - DNA, 25 bp, Mus musculus
agttgttgcccttgtccagctttca

SEQ ID NO: 406959 - DNA, 25 bp, Mus musculus
agtttaaaactaacctctggatcag

SEQ ID NO: 406960 - DNA, 25 bp, Mus musculus
agtttaaagttgcacaagaggtcac

SEQ ID NO: 406961 - DNA, 25 bp, Mus musculus
agtttaactgtctgtcctgcccggg

SEQ ID NO: 406962 - DNA, 25 bp, Mus musculus
agtttacgacagaggaactcccatt

SEQ ID NO: 406963 - DNA, 25 bp, Mus musculus
agtttagggatcacactggttggcc

SEQ ID NO: 406964 - DNA, 25 bp, Mus musculus
agtttcactgcctgactctgctcag

SEQ ID NO: 406965 - DNA, 25 bp, Mus musculus
agtttcaggttatttacagagtggc

SEQ ID NO: 406966 - DNA, 25 bp, Mus musculus
agtttcggaccagtttcagaccacg

SEQ ID NO: 406967 - DNA, 25 bp, Mus musculus
agtttctacgcccattctctgcgcg

SEQ ID NO: 406968 - DNA, 25 bp, Mus musculus
agtttctccacgcttctggcagagg

SEQ ID NO: 406969 - DNA, 25 bp, Mus musculus
agtttctcttcaccagtctgccagt

SEQ ID NO: 406970 - DNA, 25 bp, Mus musculus
agtttcttcaagaggagcgtccgca

SEQ ID NO: 406971 - DNA, 25 bp, Mus musculus
agtttcttcagtgaccgcggcggaa

SEQ ID NO: 406972 - DNA, 25 bp, Mus musculus
agtttctttgactcctggtgtgagg

SEQ ID NO: 406973 - DNA, 25 bp, Mus musculus
agtttgaaaagagagacagggtgcc

SEQ ID NO: 406974 - DNA, 25 bp, Mus musculus
agtttgacaaagacggcgatggaga

SEQ ID NO: 406975 - DNA, 25 bp, Mus musculus
agtttgagtcccaagtgctagcccc

SEQ ID NO: 406976 - DNA, 25 bp, Mus musculus
agtttgcagtgaaagccaggcatcc

SEQ ID NO: 406977 - DNA, 25 bp, Mus musculus
agtttgccatttttgccgacgccta

SEQ ID NO: 406978 - DNA, 25 bp, Mus musculus
agtttgctactcttgccctggccct

SEQ ID NO: 406979 - DNA, 25 bp, Mus musculus
agtttggagacttcgcccactcgga

SEQ ID NO: 406980 - DNA, 25 bp, Mus musculus
agtttggcgcccagtggccctgacc

SEQ ID NO: 406981 - DNA, 25 bp, Mus musculus
agtttggcggtctgttgacaggtat

SEQ ID NO: 406982 - DNA, 25 bp, Mus musculus
agtttggtgcctacatgcaggtgca

SEQ ID NO: 406983 - DNA, 25 bp, Mus musculus
agtttgtaaacatcagcgatctctc

SEQ ID NO: 406984 - DNA, 25 bp, Mus musculus
agtttgtcaatagcctgccctggaa

SEQ ID NO: 406985 - DNA, 25 bp, Mus musculus
agtttgtcgctacgaagccgggaca

SEQ ID NO: 406986 - DNA, 25 bp, Mus musculus
agtttgtgatcctgagagatgagaa

SEQ ID NO: 406987 - DNA, 25 bp, Mus musculus
agtttgtgcccagtatgcccgagcg

SEQ ID NO: 406988 - DNA, 25 bp, Mus musculus
agttttaatgaaccccacatggtcg

SEQ ID NO: 406989 - DNA, 25 bp, Mus musculus
agttttatccagagcagatccccag

SEQ ID NO: 406990 - DNA, 25 bp, Mus musculus
agttttcagggctgcatgcttggag

SEQ ID NO: 406991 - DNA, 25 bp, Mus musculus
agttttccaaagcacctcgaacagg

SEQ ID NO: 406992 - DNA, 25 bp, Mus musculus
agttttctgactgagcggtgtgtgc

SEQ ID NO: 406993 - DNA, 25 bp, Mus musculus
agttttctgcagacactctggtgga

SEQ ID NO: 406994 - DNA, 25 bp, Mus musculus
agttttggccgcaacgctctggagc

SEQ ID NO: 406995 - DNA, 25 bp, Mus musculus
agtttttagcccagacagctctcag

SEQ ID NO: 406996 - DNA, 25 bp, Mus musculus
agtttttctactcttattggacagg

SEQ ID NO: 406997 - DNA, 25 bp, Mus musculus
ataaaaactaaaccgcgcaaccatg

SEQ ID NO: 406998 - DNA, 25 bp, Mus musculus
ataaaacttgcagtcagccttcctg

SEQ ID NO: 406999 - DNA, 25 bp, Mus musculus
ataaaagcgagcaccgtcagggacg

SEQ ID NO: 407000 - DNA, 25 bp, Mus musculus
ataaaatcgggcagagacagcagcg

SEQ ID NO: 407001 - DNA, 25 bp, Mus musculus
ataaaatggcggctaccaggacggc

SEQ ID NO: 407002 - DNA, 25 bp, Mus musculus
ataaacactgcttgaccaccggtgt

SEQ ID NO: 407003 - DNA, 25 bp, Mus musculus
ataaacatggagacacgggtcgcag

SEQ ID NO: 407004 - DNA, 25 bp, Mus musculus
ataaaccatgtgctaggccccaaga

SEQ ID NO: 407005 - DNA, 25 bp, Mus musculus
ataaacgggtgaagcgtcggctgct

SEQ ID NO: 407006 - DNA, 25 bp, Mus musculus
ataaagagccgagtgctgcctccaa

SEQ ID NO: 407007 - DNA, 25 bp, Mus musculus
ataaagcaagctcttccggtggcct

SEQ ID NO: 407008 - DNA, 25 bp, Mus musculus
ataaaggcgacttctgcagcgggtc

SEQ ID NO: 407009 - DNA, 25 bp, Mus musculus
ataaaggtcattgctcatccctggg

SEQ ID NO: 407010 - DNA, 25 bp, Mus musculus
ataaagttgtggaacgcctgctgcg

SEQ ID NO: 407011 - DNA, 25 bp, Mus musculus
ataaatagtgctgcctttgaagctg

SEQ ID NO: 407012 - DNA, 25 bp, Mus musculus
ataaatctgttcgttctcttctgct

SEQ ID NO: 407013 - DNA, 25 bp, Mus musculus
ataacagcttttagggctagagaga

SEQ ID NO: 407014 - DNA, 25 bp, Mus musculus
ataaccggagcgctccccatggact

SEQ ID NO: 407015 - DNA, 25 bp, Mus musculus
ataaccgtccgcgacgccgagtggg

SEQ ID NO: 407016 - DNA, 25 bp, Mus musculus
ataacgaaggccacctccagaggag

SEQ ID NO: 407017 - DNA, 25 bp, Mus musculus
ataacgttgaccgagccgagagcag

SEQ ID NO: 407018 - DNA, 25 bp, Mus musculus
ataactgcctggacttccctgcggg

SEQ ID NO: 407019 - DNA, 25 bp, Mus musculus
ataagagttctagggctgtggttgc

SEQ ID NO: 407020 - DNA, 25 bp, Mus musculus
ataagcaaagcaaacatggccccgg

SEQ ID NO: 407021 - DNA, 25 bp, Mus musculus
ataagcccagccttgttctacgcca

SEQ ID NO: 407022 - DNA, 25 bp, Mus musculus
ataagcgtgcagtaccctcagaggc

SEQ ID NO: 407023 - DNA, 25 bp, Mus musculus
ataaggagtatgatgagtgcacctc

SEQ ID NO: 407024 - DNA, 25 bp, Mus musculus
ataagtgccatagcgacccagctgg

SEQ ID NO: 407025 - DNA, 25 bp, Mus musculus
ataagtgggagtttacagccagagg

SEQ ID NO: 407026 - DNA, 25 bp, Mus musculus
ataatagcctcataagccagccctg

SEQ ID NO: 407027 - DNA, 25 bp, Mus musculus
ataatgagcttattggtggacggca

SEQ ID NO: 407028 - DNA, 25 bp, Mus musculus
ataatgctgtgttttctgccgccgg

SEQ ID NO: 407029 - DNA, 25 bp, Mus musculus
ataatgtcacctcgaaccagcctcg

SEQ ID NO: 407030 - DNA, 25 bp, Mus musculus
ataatttagaaagtctaagcctggc

SEQ ID NO: 407031 - DNA, 25 bp, Mus musculus
atacaaaaggacaggtgctgtccac

SEQ ID NO: 407032 - DNA, 25 bp, Mus musculus
atacaaacacaaatgcatgcccagg

SEQ ID NO: 407033 - DNA, 25 bp, Mus musculus
atacacaacgggtggttctcaacct

SEQ ID NO: 407034 - DNA, 25 bp, Mus musculus
atacacctgggctggcgctgcgacg

SEQ ID NO: 407035 - DNA, 25 bp, Mus musculus
atacagatgcagactccccgtgctc

SEQ ID NO: 407036 - DNA, 25 bp, Mus musculus
atacagatgcttgggagtgaagtcc

SEQ ID NO: 407037 - DNA, 25 bp, Mus musculus
atacaggtccaagggaacattgcgc

SEQ ID NO: 407038 - DNA, 25 bp, Mus musculus
atacaggtcggcgatgacagggctc

SEQ ID NO: 407039 - DNA, 25 bp, Mus musculus
ataccaaagtcaggacagtccaaat

SEQ ID NO: 407040 - DNA, 25 bp, Mus musculus
ataccaaattttctgggaatgcctt

SEQ ID NO: 407041 - DNA, 25 bp, Mus musculus
ataccagtggaagctcagggcgcaa

SEQ ID NO: 407042 - DNA, 25 bp, Mus musculus
ataccatgtcggtcgcactcagcaa

SEQ ID NO: 407043 - DNA, 25 bp, Mus musculus
atacccacgccccagttattcagga

SEQ ID NO: 407044 - DNA, 25 bp, Mus musculus
atacctcaggaatcgggacaatgcc

SEQ ID NO: 407045 - DNA, 25 bp, Mus musculus
atacctggcggtgcagcaactcagc

SEQ ID NO: 407046 - DNA, 25 bp, Mus musculus
atacctgggtcgtggaacgcagcca

SEQ ID NO: 407047 - DNA, 25 bp, Mus musculus
atactcactgcctaggtgaccccag

SEQ ID NO: 407048 - DNA, 25 bp, Mus musculus
atactgggcccacctgggagctcag

SEQ ID NO: 407049 - DNA, 25 bp, Mus musculus
atacttactatgtccagcagccgcc

SEQ ID NO: 407050 - DNA, 25 bp, Mus musculus
atagaaagaaatgagaccgcccggt

SEQ ID NO: 407051 - DNA, 25 bp, Mus musculus
atagaaagccctgttccgtccctgg

SEQ ID NO: 407052 - DNA, 25 bp, Mus musculus
atagaagagacaacaccagtgtgaa

SEQ ID NO: 407053 - DNA, 25 bp, Mus musculus
atagaagcagcagacaagggaaccc

SEQ ID NO: 407054 - DNA, 25 bp, Mus musculus
atagaccaccagatctgcccaggag

SEQ ID NO: 407055 - DNA, 25 bp, Mus musculus
atagacccactgactgagacctgcg

SEQ ID NO: 407056 - DNA, 25 bp, Mus musculus
atagaccctgtcgttccctgtggag

SEQ ID NO: 407057 - DNA, 25 bp, Mus musculus
atagaccgggtctcctccaggcggc

SEQ ID NO: 407058 - DNA, 25 bp, Mus musculus
atagacgggagtattcagcgaggct

SEQ ID NO: 407059 - DNA, 25 bp, Mus musculus
atagagatgagcgtgggtacccgaa

SEQ ID NO: 407060 - DNA, 25 bp, Mus musculus
atagagcgaaatggagagagactgt

SEQ ID NO: 407061 - DNA, 25 bp, Mus musculus
atagagggcggcacgcagtgcactc

SEQ ID NO: 407062 - DNA, 25 bp, Mus musculus
atagccatgcaaggtcgccttctag

SEQ ID NO: 407063 - DNA, 25 bp, Mus musculus
atagcccctgcttggtaaatgcccc

SEQ ID NO: 407064 - DNA, 25 bp, Mus musculus
atagccttgaggaccagccccatag

SEQ ID NO: 407065 - DNA, 25 bp, Mus musculus
atagcgaagcagagagaagcccagc

SEQ ID NO: 407066 - DNA, 25 bp, Mus musculus
atagcgcctcccagttgatgctcca

SEQ ID NO: 407067 - DNA, 25 bp, Mus musculus
atagcgctcgctggttgtcctggaa

SEQ ID NO: 407068 - DNA, 25 bp, Mus musculus
atagctgtgtagtcctcatccccga

SEQ ID NO: 407069 - DNA, 25 bp, Mus musculus
ataggcacaacggtgctgcagggta

SEQ ID NO: 407070 - DNA, 25 bp, Mus musculus
ataggccgtgccgtaatgacctgcc

SEQ ID NO: 407071 - DNA, 25 bp, Mus musculus
atagggtcccaacacagaacaggct

SEQ ID NO: 407072 - DNA, 25 bp, Mus musculus
ataggtcgctctccgcctgctgtgt

SEQ ID NO: 407073 - DNA, 25 bp, Mus musculus
atagtagtaccccagtggtgctcct

SEQ ID NO: 407074 - DNA, 25 bp, Mus musculus
atagtcccttaaggccaaagcccag

SEQ ID NO: 407075 - DNA, 25 bp, Mus musculus
atagtgtctggtttgatatggcacc

SEQ ID NO: 407076 - DNA, 25 bp, Mus musculus
atagttactgcaaatgtgaaattac

SEQ ID NO: 407077 - DNA, 25 bp, Mus musculus
atagttgcaacagaaaccacatggt

SEQ ID NO: 407078 - DNA, 25 bp, Mus musculus
atagttgccacccaagcagatgaag

SEQ ID NO: 407079 - DNA, 25 bp, Mus musculus
atataaaatgcaccggaccccttca

SEQ ID NO: 407080 - DNA, 25 bp, Mus musculus
atataaagggaaagccacgccccag

SEQ ID NO: 407081 - DNA, 25 bp, Mus musculus
atataccacatgagagccccactag

SEQ ID NO: 407082 - DNA, 25 bp, Mus musculus
atatagagacgacccttttcatcag

SEQ ID NO: 407083 - DNA, 25 bp, Mus musculus
atataggccggctaccactcagcgt

SEQ ID NO: 407084 - DNA, 25 bp, Mus musculus
atatagtttctaaaaagcgataggg

SEQ ID NO: 407085 - DNA, 25 bp, Mus musculus
atatatgtcactatcaccagggctg

SEQ ID NO: 407086 - DNA, 25 bp, Mus musculus
atatcaacaaaagcctggtcctcgc

SEQ ID NO: 407087 - DNA, 25 bp, Mus musculus
atatcaactcggtggccggcgtgct

SEQ ID NO: 407088 - DNA, 25 bp, Mus musculus
atatcaatgagtgcctgaccctggg

SEQ ID NO: 407089 - DNA, 25 bp, Mus musculus
atatcacgaggttgcccagctggaa

SEQ ID NO: 407090 - DNA, 25 bp, Mus musculus
atatcagctgaaggcggtaaacaag

SEQ ID NO: 407091 - DNA, 25 bp, Mus musculus
atatccacagtgacaaaacccctgg

SEQ ID NO: 407092 - DNA, 25 bp, Mus musculus
atatcccagttctacgcccacatgg

SEQ ID NO: 407093 - DNA, 25 bp, Mus musculus
atatcgtggtggtagctcagggctc

SEQ ID NO: 407094 - DNA, 25 bp, Mus musculus
atatctcgtcgctgaacctggccga

SEQ ID NO: 407095 - DNA, 25 bp, Mus musculus
atatctggctgggtagctgccctcg

SEQ ID NO: 407096 - DNA, 25 bp, Mus musculus
atatgaaataggaaggctggctgcc

SEQ ID NO: 407097 - DNA, 25 bp, Mus musculus
atatgatcagccagcgttcagccgg

SEQ ID NO: 407098 - DNA, 25 bp, Mus musculus
atatggacagagatgcattcagtgc

SEQ ID NO: 407099 - DNA, 25 bp, Mus musculus
atatggccctgcctagtctactaga

SEQ ID NO: 407100 - DNA, 25 bp, Mus musculus
atatggccttcaccaccgagaggag

SEQ ID NO: 407101 - DNA, 25 bp, Mus musculus
atatggtcaccaagagctcctcagg

SEQ ID NO: 407102 - DNA, 25 bp, Mus musculus
atatgtccggccagacggtgctgac

SEQ ID NO: 407103 - DNA, 25 bp, Mus musculus
atattattatctgcctccccacggg

SEQ ID NO: 407104 - DNA, 25 bp, Mus musculus
atattgggaagttccaagaggaggc

SEQ ID NO: 407105 - DNA, 25 bp, Mus musculus
atatttagggccttcctgggtctct

SEQ ID NO: 407106 - DNA, 25 bp, Mus musculus
atatttgacgatgagcgctgccgcc

SEQ ID NO: 407107 - DNA, 25 bp, Mus musculus
atatttgctggactatggatgtagc

SEQ ID NO: 407108 - DNA, 25 bp, Mus musculus
atcaacatatgtgaatttccagaag

SEQ ID NO: 407109 - DNA, 25 bp, Mus musculus
atcaacttcaaggtgggatcgtccg

SEQ ID NO: 407110 - DNA, 25 bp, Mus musculus
atcaagagccccatggtcagcgtgg

SEQ ID NO: 407111 - DNA, 25 bp, Mus musculus
atcaagccctcggtggtggtacagc

SEQ ID NO: 407112 - DNA, 25 bp, Mus musculus
atcaaggtgcatccagcccgggtat

SEQ ID NO: 407113 - DNA, 25 bp, Mus musculus
atcaagtcagttctttctccaaaag

SEQ ID NO: 407114 - DNA, 25 bp, Mus musculus
atcacaccggtgaggaagtgttagg

SEQ ID NO: 407115 - DNA, 25 bp, Mus musculus
atcacaggtccccagggaacgctca

SEQ ID NO: 407116 - DNA, 25 bp, Mus musculus
atcaccatcgtcaagtcggcgccgg

SEQ ID NO: 407117 - DNA, 25 bp, Mus musculus
atcaccgggccccacacaggaagag

SEQ ID NO: 407118 - DNA, 25 bp, Mus musculus
atcacggaggcccatgagagcttca

SEQ ID NO: 407119 - DNA, 25 bp, Mus musculus
atcacgggcggctcaacctccaagg

SEQ ID NO: 407120 - DNA, 25 bp, Mus musculus
atcacgtaccgggaggtgctagaga

SEQ ID NO: 407121 - DNA, 25 bp, Mus musculus
atcagaccctggctgactgtgctgg

SEQ ID NO: 407122 - DNA, 25 bp, Mus musculus
atcagatctttctaccatgagggac

SEQ ID NO: 407123 - DNA, 25 bp, Mus musculus
atcagctgtaccgtgggctctggca

SEQ ID NO: 407124 - DNA, 25 bp, Mus musculus
atcaggacgaggacagaggagctca

SEQ ID NO: 407125 - DNA, 25 bp, Mus musculus
atcaggcagcgaggagtccaacatg

SEQ ID NO: 407126 - DNA, 25 bp, Mus musculus
atcaggtaggtcactggccctcact

SEQ ID NO: 407127 - DNA, 25 bp, Mus musculus
atcagtggtacttgggcattgggaa

SEQ ID NO: 407128 - DNA, 25 bp, Mus musculus
atcatcacggcgcagatcacctggg

SEQ ID NO: 407129 - DNA, 25 bp, Mus musculus
atcatcccgcaaggctgatgctgca

SEQ ID NO: 407130 - DNA, 25 bp, Mus musculus
atcatcgtccaacgcttcaagcaag

SEQ ID NO: 407131 - DNA, 25 bp, Mus musculus
atcatctccaggcattgttatccag

SEQ ID NO: 407132 - DNA, 25 bp, Mus musculus
atcatctgagcccagcagtctgaga

SEQ ID NO: 407133 - DNA, 25 bp, Mus musculus
atcatgaaggaagtccggcgagccc

SEQ ID NO: 407134 - DNA, 25 bp, Mus musculus
atcatgaatacccaccaggcctgct

SEQ ID NO: 407135 - DNA, 25 bp, Mus musculus
atcatggaactgcaggacgggtaca

SEQ ID NO: 407136 - DNA, 25 bp, Mus musculus
atcatgtcaagagccgtcgccgctg

SEQ ID NO: 407137 - DNA, 25 bp, Mus musculus
atcattagcctcatgagtgccggca

SEQ ID NO: 407138 - DNA, 25 bp, Mus musculus
atcattctgagccatcggcagggcc

SEQ ID NO: 407139 - DNA, 25 bp, Mus musculus
atccaagtgagcatcgagagcggcc

SEQ ID NO: 407140 - DNA, 25 bp, Mus musculus
atccagacgtgcagcagcctcagga

SEQ ID NO: 407141 - DNA, 25 bp, Mus musculus
atccaggctccgagggaaagcagcg

SEQ ID NO: 407142 - DNA, 25 bp, Mus musculus
atccagtctctgctggccgggagcc

SEQ ID NO: 407143 - DNA, 25 bp, Mus musculus
atccagtgatgtcccagaaggcgca

SEQ ID NO: 407144 - DNA, 25 bp, Mus musculus
atccagtgggtctcctaggagggac

SEQ ID NO: 407145 - DNA, 25 bp, Mus musculus
atccatgttttcagcactctccaag

SEQ ID NO: 407146 - DNA, 25 bp, Mus musculus
atcccacagtggcattggtgaggat

SEQ ID NO: 407147 - DNA, 25 bp, Mus musculus
atcccacgtggctatctcggccggg

SEQ ID NO: 407148 - DNA, 25 bp, Mus musculus
atcccaggatgctaccctctgagca

SEQ ID NO: 407149 - DNA, 25 bp, Mus musculus
atcccagggacaacgctctcttcag

SEQ ID NO: 407150 - DNA, 25 bp, Mus musculus
atccccgcgtcttggccgagagagg

SEQ ID NO: 407151 - DNA, 25 bp, Mus musculus
atccccgttgttgcgcggtgctcaa

SEQ ID NO: 407152 - DNA, 25 bp, Mus musculus
atcccgcagagagaacgccaggagc

SEQ ID NO: 407153 - DNA, 25 bp, Mus musculus
atcccgcggccgctgacatgttcga

SEQ ID NO: 407154 - DNA, 25 bp, Mus musculus
atcccggagggtggcgagccaaaat

SEQ ID NO: 407155 - DNA, 25 bp, Mus musculus
atccctctgaagacagttgccccgt

SEQ ID NO: 407156 - DNA, 25 bp, Mus musculus
atccctggaagcagtgatctgaaaa

SEQ ID NO: 407157 - DNA, 25 bp, Mus musculus
atccgacggccgagcttcagtgaac

SEQ ID NO: 407158 - DNA, 25 bp, Mus musculus
atccgagcccagctcatagcctggg

SEQ ID NO: 407159 - DNA, 25 bp, Mus musculus
atccgagttcgatccctaggactgg

SEQ ID NO: 407160 - DNA, 25 bp, Mus musculus
atccggtaccgtgccaggctgtgac

SEQ ID NO: 407161 - DNA, 25 bp, Mus musculus
atccgtgggctcgagaacctgctgg

SEQ ID NO: 407162 - DNA, 25 bp, Mus musculus
atcctagccgaagccgagcgggact

SEQ ID NO: 407163 - DNA, 25 bp, Mus musculus
atcctcaacgggagatgctgacagc

SEQ ID NO: 407164 - DNA, 25 bp, Mus musculus
atcctcacttgggacaaaagcctgg

SEQ ID NO: 407165 - DNA, 25 bp, Mus musculus
atcctcatgcactggtggcgggccg

SEQ ID NO: 407166 - DNA, 25 bp, Mus musculus
atcctcattgatggtacatggagcc

SEQ ID NO: 407167 - DNA, 25 bp, Mus musculus
atcctcgccctctaccattgaattg

SEQ ID NO: 407168 - DNA, 25 bp, Mus musculus
atcctgaagacctagctgccctctg

SEQ ID NO: 407169 - DNA, 25 bp, Mus musculus
atcctgcactgggtcggaggagtcc

SEQ ID NO: 407170 - DNA, 25 bp, Mus musculus
atcctgcccggacaacggctggttc

SEQ ID NO: 407171 - DNA, 25 bp, Mus musculus
atcctggaagccacagggagacgca

SEQ ID NO: 407172 - DNA, 25 bp, Mus musculus
atcctggacagcaagccggctgcaa

SEQ ID NO: 407173 - DNA, 25 bp, Mus musculus
atcctgggactagcttggaagggcc

SEQ ID NO: 407174 - DNA, 25 bp, Mus musculus
atcctgggcctgcttgtgctgcgct

SEQ ID NO: 407175 - DNA, 25 bp, Mus musculus
atcctgggcttcagctactccctga

SEQ ID NO: 407176 - DNA, 25 bp, Mus musculus
atcctgtgactcactaggccctggg

SEQ ID NO: 407177 - DNA, 25 bp, Mus musculus
atcctgtttgtggtgggctgtcgca

SEQ ID NO: 407178 - DNA, 25 bp, Mus musculus
atccttgggaccacttctctttctg

SEQ ID NO: 407179 - DNA, 25 bp, Mus musculus
atcgaagccagaaatgcagccattg

SEQ ID NO: 407180 - DNA, 25 bp, Mus musculus
atcgagcaaagcacagggcctgcag

SEQ ID NO: 407181 - DNA, 25 bp, Mus musculus
atcgagcacttcagcaagttctccc

SEQ ID NO: 407182 - DNA, 25 bp, Mus musculus
atcgattcggacacaatcacctgct

SEQ ID NO: 407183 - DNA, 25 bp, Mus musculus
atcgcagaacgcgagtgcggagctc

SEQ ID NO: 407184 - DNA, 25 bp, Mus musculus
atcgcagcgggtatggaccagcagc

SEQ ID NO: 407185 - DNA, 25 bp, Mus musculus
atcgcatttttggacactgtaccca

SEQ ID NO: 407186 - DNA, 25 bp, Mus musculus
atcgccgtcgcctgcatcgtggagc

SEQ ID NO: 407187 - DNA, 25 bp, Mus musculus
atcgccgtttatatggagcccctgg

SEQ ID NO: 407188 - DNA, 25 bp, Mus musculus
atcgcgcgagtcagcagaagtgcag

SEQ ID NO: 407189 - DNA, 25 bp, Mus musculus
atcgcggcggttttcagggttctgg

SEQ ID NO: 407190 - DNA, 25 bp, Mus musculus
atcgcggtgaccgtgctgggcttcc

SEQ ID NO: 407191 - DNA, 25 bp, Mus musculus
atcgctagcgccacagaaaccaggt

SEQ ID NO: 407192 - DNA, 25 bp, Mus musculus
atcggacgtctctgttgcggcctgc

SEQ ID NO: 407193 - DNA, 25 bp, Mus musculus
atcggagtcggatcacagtggccag

SEQ ID NO: 407194 - DNA, 25 bp, Mus musculus
atcggattccgcgaacaagccctgt

SEQ ID NO: 407195 - DNA, 25 bp, Mus musculus
atcggccgatgatccaggcaggagc

SEQ ID NO: 407196 - DNA, 25 bp, Mus musculus
atcggctcatagctcgaaggaaagc

SEQ ID NO: 407197 - DNA, 25 bp, Mus musculus
atcggctccggatcccggaagcacg

SEQ ID NO: 407198 - DNA, 25 bp, Mus musculus
atcgggagcgcgtcctggctcagct

SEQ ID NO: 407199 - DNA, 25 bp, Mus musculus
atcgggaggccgaagggaggaggtg

SEQ ID NO: 407200 - DNA, 25 bp, Mus musculus
atcgtgctgggatcttctttgtgcc

SEQ ID NO: 407201 - DNA, 25 bp, Mus musculus
atcgtgggtgaccaagcgcagtcct

SEQ ID NO: 407202 - DNA, 25 bp, Mus musculus
atcgtgggttcgaccagctgaaggc

SEQ ID NO: 407203 - DNA, 25 bp, Mus musculus
atcgtgtgagttcctgctcctcctc

SEQ ID NO: 407204 - DNA, 25 bp, Mus musculus
atcgtgttacggttgggccagccac

SEQ ID NO: 407205 - DNA, 25 bp, Mus musculus
atcgttacttccagcttcaccaggg

SEQ ID NO: 407206 - DNA, 25 bp, Mus musculus
atcgttttaagatcgagggacgtgc

SEQ ID NO: 407207 - DNA, 25 bp, Mus musculus
atctacaatgacactcgggccaggg

SEQ ID NO: 407208 - DNA, 25 bp, Mus musculus
atctaccccatgcagcaacctggag

SEQ ID NO: 407209 - DNA, 25 bp, Mus musculus
atctacctcttcctcacggtgggct

SEQ ID NO: 407210 - DNA, 25 bp, Mus musculus
atctactactcattggattgccggg

SEQ ID NO: 407211 - DNA, 25 bp, Mus musculus
atctagaatactgggtcattgggaa

SEQ ID NO: 407212 - DNA, 25 bp, Mus musculus
atctaggaaaatgcagcgctgccct

SEQ ID NO: 407213 - DNA, 25 bp, Mus musculus
atctagtcagtatgccccggaccag

SEQ ID NO: 407214 - DNA, 25 bp, Mus musculus
atctcaagggagaccgatcgcgact

SEQ ID NO: 407215 - DNA, 25 bp, Mus musculus
atctcacagaggctgtcgcaggcgc

SEQ ID NO: 407216 - DNA, 25 bp, Mus musculus
atctcactcgtctaggagcctcgca

SEQ ID NO: 407217 - DNA, 25 bp, Mus musculus
atctcatttgtggacggtcttcacc

SEQ ID NO: 407218 - DNA, 25 bp, Mus musculus
atctcccagatagggaaccagtggc

SEQ ID NO: 407219 - DNA, 25 bp, Mus musculus
atctcccaggccaggaaagccgtgg

SEQ ID NO: 407220 - DNA, 25 bp, Mus musculus
atctcccggacacagaggtcctctg

SEQ ID NO: 407221 - DNA, 25 bp, Mus musculus
atctccctacgtccttatccgtggg

SEQ ID NO: 407222 - DNA, 25 bp, Mus musculus
atctccgaccgccttatcagtcagg

SEQ ID NO: 407223 - DNA, 25 bp, Mus musculus
atctcgcagacacccgtaggcggag

SEQ ID NO: 407224 - DNA, 25 bp, Mus musculus
atctcgctgcctacctcagaatctg

SEQ ID NO: 407225 - DNA, 25 bp, Mus musculus
atctcggcctcactccttgctgagg

SEQ ID NO: 407226 - DNA, 25 bp, Mus musculus
atctctacttccaagggctgctcct

SEQ ID NO: 407227 - DNA, 25 bp, Mus musculus
atctctatggatcctgaacctactg

SEQ ID NO: 407228 - DNA, 25 bp, Mus musculus
atctctgcccctagggagcagccat

SEQ ID NO: 407229 - DNA, 25 bp, Mus musculus
atctctggtctctgtaagtgcgccc

SEQ ID NO: 407230 - DNA, 25 bp, Mus musculus
atctcttgccttttgtcccctctag

SEQ ID NO: 407231 - DNA, 25 bp, Mus musculus
atctctttggattacctttcgccca

SEQ ID NO: 407232 - DNA, 25 bp, Mus musculus
atctgaagccttgtgtagtattaac

SEQ ID NO: 407233 - DNA, 25 bp, Mus musculus
atctgagtgggaacaagagtgagct

SEQ ID NO: 407234 - DNA, 25 bp, Mus musculus
atctgccaagtcctgctgaggccca

SEQ ID NO: 407235 - DNA, 25 bp, Mus musculus
atctgcttctcgctagtcagcccag

SEQ ID NO: 407236 - DNA, 25 bp, Mus musculus
atctggaccagggaccaatgaggac

SEQ ID NO: 407237 - DNA, 25 bp, Mus musculus
atctggagacattttgtagtctgca

SEQ ID NO: 407238 - DNA, 25 bp, Mus musculus
atctgggaagcaggctggatctcgc

SEQ ID NO: 407239 - DNA, 25 bp, Mus musculus
atctgggacataggcggacagcccc

SEQ ID NO: 407240 - DNA, 25 bp, Mus musculus
atctgggggatctaggaagctttag

SEQ ID NO: 407241 - DNA, 25 bp, Mus musculus
atctgtaagcccagtactcccgaag

SEQ ID NO: 407242 - DNA, 25 bp, Mus musculus
atctgtagcacccaacagtcttctg

SEQ ID NO: 407243 - DNA, 25 bp, Mus musculus
atcttagcctcctcggtctcctacc

SEQ ID NO: 407244 - DNA, 25 bp, Mus musculus
atcttagtgcgggaagctcagcgac

SEQ ID NO: 407245 - DNA, 25 bp, Mus musculus
atcttcaccagctcccgggaagcag

SEQ ID NO: 407246 - DNA, 25 bp, Mus musculus
atcttcagctggcaaagtcgcgccc

SEQ ID NO: 407247 - DNA, 25 bp, Mus musculus
atcttcctgcccaaggcctgagtgg

SEQ ID NO: 407248 - DNA, 25 bp, Mus musculus
atcttctcaaacacccggacatgcg

SEQ ID NO: 407249 - DNA, 25 bp, Mus musculus
atcttctgggtgttagtatttcata

SEQ ID NO: 407250 - DNA, 25 bp, Mus musculus
atcttgaaaagcacagtgagcagca

SEQ ID NO: 407251 - DNA, 25 bp, Mus musculus
atcttgactgctcctgacaccgcta

SEQ ID NO: 407252 - DNA, 25 bp, Mus musculus
atcttgctcgacacaggctgcctcg

SEQ ID NO: 407253 - DNA, 25 bp, Mus musculus
atcttggaacaaataattactgagc

SEQ ID NO: 407254 - DNA, 25 bp, Mus musculus
atcttggaactggaggagcggcaca

SEQ ID NO: 407255 - DNA, 25 bp, Mus musculus
atcttgtcaccggtgctgctgctga

SEQ ID NO: 407256 - DNA, 25 bp, Mus musculus
atctttccaagatccccgagggcga

SEQ ID NO: 407257 - DNA, 25 bp, Mus musculus
atgaaaacagaaacccctctccctg

SEQ ID NO: 407258 - DNA, 25 bp, Mus musculus
atgaaagatgggaaatgggatacag

SEQ ID NO: 407259 - DNA, 25 bp, Mus musculus
atgaaagtcggcaggagggcatcat

SEQ ID NO: 407260 - DNA, 25 bp, Mus musculus
atgaaatttccgaggcgcctgcgcg

SEQ ID NO: 407261 - DNA, 25 bp, Mus musculus
atgaacaaccggacagtgcagcacg

SEQ ID NO: 407262 - DNA, 25 bp, Mus musculus
atgaacaaggagtccccacctactg

SEQ ID NO: 407263 - DNA, 25 bp, Mus musculus
atgaactggcggtcctaaaggcggc

SEQ ID NO: 407264 - DNA, 25 bp, Mus musculus
atgaagaggagaccccacatgctac

SEQ ID NO: 407265 - DNA, 25 bp, Mus musculus
atgaagatcagcgagaatcctcccc

SEQ ID NO: 407266 - DNA, 25 bp, Mus musculus
atgaagatggctgggctgaatgcta

SEQ ID NO: 407267 - DNA, 25 bp, Mus musculus
atgaagcaccccaagccatccgtgc

SEQ ID NO: 407268 - DNA, 25 bp, Mus musculus
atgaagccctatggacgccgtaacg

SEQ ID NO: 407269 - DNA, 25 bp, Mus musculus
atgaagctgattcaggcaccccagg

SEQ ID NO: 407270 - DNA, 25 bp, Mus musculus
atgaaggtggtgattctgatggccc

SEQ ID NO: 407271 - DNA, 25 bp, Mus musculus
atgaagtccagaactgctgcccgca

SEQ ID NO: 407272 - DNA, 25 bp, Mus musculus
atgaagtcggcctgcaaaccccacg

SEQ ID NO: 407273 - DNA, 25 bp, Mus musculus
atgaagttcagcgttgcggtcccca

SEQ ID NO: 407274 - DNA, 25 bp, Mus musculus
atgaagtttgagtcccgcggcaagg

SEQ ID NO: 407275 - DNA, 25 bp, Mus musculus
atgaatgcaggacgcctccagggtc

SEQ ID NO: 407276 - DNA, 25 bp, Mus musculus
atgaattgcgaggatgtcaccaccg

SEQ ID NO: 407277 - DNA, 25 bp, Mus musculus
atgacaaccggccacatagacagac

SEQ ID NO: 407278 - DNA, 25 bp, Mus musculus
atgacaacgtcagcgccacagaaac

SEQ ID NO: 407279 - DNA, 25 bp, Mus musculus
atgacagcctgtggccggtagtgac

SEQ ID NO: 407280 - DNA, 25 bp, Mus musculus
atgacatcacgggactgctgtggtg

SEQ ID NO: 407281 - DNA, 25 bp, Mus musculus
atgaccaatggagccatatgctggg

SEQ ID NO: 407282 - DNA, 25 bp, Mus musculus
atgaccagcgctctgggcatcacag

SEQ ID NO: 407283 - DNA, 25 bp, Mus musculus
atgacctcagttccatcctcgggac

SEQ ID NO: 407284 - DNA, 25 bp, Mus musculus
atgacgacgatgactggaacccttg

SEQ ID NO: 407285 - DNA, 25 bp, Mus musculus
atgacgtcattctgcggccctcgct

SEQ ID NO: 407286 - DNA, 25 bp, Mus musculus
atgacttgcccaaagccaccagcta

SEQ ID NO: 407287 - DNA, 25 bp, Mus musculus
atgagaagcggctgtctagccaggc

SEQ ID NO: 407288 - DNA, 25 bp, Mus musculus
atgagaccggcgtcgcatgctagga

SEQ ID NO: 407289 - DNA, 25 bp, Mus musculus
atgagatgttccagcaccgagaggg

SEQ ID NO: 407290 - DNA, 25 bp, Mus musculus
atgagcagctcgaagccctggagaa

SEQ ID NO: 407291 - DNA, 25 bp, Mus musculus
atgagctcccgttggcccaagggtg

SEQ ID NO: 407292 - DNA, 25 bp, Mus musculus
atgaggacctgagctgagaagccag

SEQ ID NO: 407293 - DNA, 25 bp, Mus musculus
atgaggaggcagagcgactgcaact

SEQ ID NO: 407294 - DNA, 25 bp, Mus musculus
atgaggccacatgcagaggacaccc

SEQ ID NO: 407295 - DNA, 25 bp, Mus musculus
atgaggccgccgtctccatctactg

SEQ ID NO: 407296 - DNA, 25 bp, Mus musculus
atgaggcggccgagctctgcgggcg

SEQ ID NO: 407297 - DNA, 25 bp, Mus musculus
atgaggctccgcaaatacctgcagc

SEQ ID NO: 407298 - DNA, 25 bp, Mus musculus
atgaggctgtctgtgttggcccagc

SEQ ID NO: 407299 - DNA, 25 bp, Mus musculus
atgagggactctggaaccctgagca

SEQ ID NO: 407300 - DNA, 25 bp, Mus musculus
atgaggtcggccacacacggattcg

SEQ ID NO: 407301 - DNA, 25 bp, Mus musculus
atgaggtctgctaccaaccatctct

SEQ ID NO: 407302 - DNA, 25 bp, Mus musculus
atgagtcttcggtgatgcagctggc

SEQ ID NO: 407303 - DNA, 25 bp, Mus musculus
atgagttggtgtccggagaccgcga

SEQ ID NO: 407304 - DNA, 25 bp, Mus musculus
atgatacccaactaccagctgtggg

SEQ ID NO: 407305 - DNA, 25 bp, Mus musculus
atgatctgaacttccggcgccggga

SEQ ID NO: 407306 - DNA, 25 bp, Mus musculus
atgatctttttctgcccgcccggag

SEQ ID NO: 407307 - DNA, 25 bp, Mus musculus
atgatgatcgtgaaccccgaccgtc

SEQ ID NO: 407308 - DNA, 25 bp, Mus musculus
atgatgatgggaatgagctaggctc

SEQ ID NO: 407309 - DNA, 25 bp, Mus musculus
atgatgatggtgaagttttaggaga

SEQ ID NO: 407310 - DNA, 25 bp, Mus musculus
atgatggaactcacacgcatgccag

SEQ ID NO: 407311 - DNA, 25 bp, Mus musculus
atgatgggacccgagaagcagagca

SEQ ID NO: 407312 - DNA, 25 bp, Mus musculus
atgatgtgcacataaacttcactca

SEQ ID NO: 407313 - DNA, 25 bp, Mus musculus
atgatgtgtgcgagctcgtccggca

SEQ ID NO: 407314 - DNA, 25 bp, Mus musculus
atgatttccatgctggaggagaaac

SEQ ID NO: 407315 - DNA, 25 bp, Mus musculus
atgcaaagcccaggagccaggattt

SEQ ID NO: 407316 - DNA, 25 bp, Mus musculus
atgcaagatcggacagcgcggtgac

SEQ ID NO: 407317 - DNA, 25 bp, Mus musculus
atgcaagtgagtccacaggaccgga

SEQ ID NO: 407318 - DNA, 25 bp, Mus musculus
atgcacacaagccacagtacccatg

SEQ ID NO: 407319 - DNA, 25 bp, Mus musculus
atgcaccaagccctcatgcctgtgg

SEQ ID NO: 407320 - DNA, 25 bp, Mus musculus
atgcacgcttgcgtagtcgggcttg

SEQ ID NO: 407321 - DNA, 25 bp, Mus musculus
atgcagaggcgcaccaggttgctag

SEQ ID NO: 407322 - DNA, 25 bp, Mus musculus
atgcagatggaacctacgccgtgga

SEQ ID NO: 407323 - DNA, 25 bp, Mus musculus
atgcagattcttaagccccacccag

SEQ ID NO: 407324 - DNA, 25 bp, Mus musculus
atgcagcaagagcaggtcccctctc

SEQ ID NO: 407325 - DNA, 25 bp, Mus musculus
atgcagcagaaacagggccatttgt

SEQ ID NO: 407326 - DNA, 25 bp, Mus musculus
atgcagccctttgcggtgggcagca

SEQ ID NO: 407327 - DNA, 25 bp, Mus musculus
atgcaggacgcctccagggtctacg

SEQ ID NO: 407328 - DNA, 25 bp, Mus musculus
atgcagggccccatggcgcctggct

SEQ ID NO: 407329 - DNA, 25 bp, Mus musculus
atgcaggggcccatccagcagcctt

SEQ ID NO: 407330 - DNA, 25 bp, Mus musculus
atgccaaagtgttctcctcactgcc

SEQ ID NO: 407331 - DNA, 25 bp, Mus musculus
atgccaacagcccagcgtgcgtgaa

SEQ ID NO: 407332 - DNA, 25 bp, Mus musculus
atgccaaggcacaactaccggaggg

SEQ ID NO: 407333 - DNA, 25 bp, Mus musculus
atgccaccagatggacgacttcggg

SEQ ID NO: 407334 - DNA, 25 bp, Mus musculus
atgccagagatgtcggccttggtgc

SEQ ID NO: 407335 - DNA, 25 bp, Mus musculus
atgcccaaggcactaggcgccagac

SEQ ID NO: 407336 - DNA, 25 bp, Mus musculus
atgccccatataggccataagtggc

SEQ ID NO: 407337 - DNA, 25 bp, Mus musculus
atgccgagatgggattttacaggtg

SEQ ID NO: 407338 - DNA, 25 bp, Mus musculus
atgccgcagccatcggtcacagagg

SEQ ID NO: 407339 - DNA, 25 bp, Mus musculus
atgcctaagcctggtgtgtttaact

SEQ ID NO: 407340 - DNA, 25 bp, Mus musculus
atgcctagaggatggtttacaaaac

SEQ ID NO: 407341 - DNA, 25 bp, Mus musculus
atgcctgccggctgccagaccttgg

SEQ ID NO: 407342 - DNA, 25 bp, Mus musculus
atgcctgggatgaggcccaagttga

SEQ ID NO: 407343 - DNA, 25 bp, Mus musculus
atgcgaacatctggctgggcctcaa

SEQ ID NO: 407344 - DNA, 25 bp, Mus musculus
atgcgaactgcgcaccgcgcgctgt

SEQ ID NO: 407345 - DNA, 25 bp, Mus musculus
atgcgaagctgcagcgactcaggca

SEQ ID NO: 407346 - DNA, 25 bp, Mus musculus
atgcgacagagaagggcgaggctca

SEQ ID NO: 407347 - DNA, 25 bp, Mus musculus
atgcgcaccgcatcgttacttccag

SEQ ID NO: 407348 - DNA, 25 bp, Mus musculus
atgcgcaggcgccaatgagctccgc

SEQ ID NO: 407349 - DNA, 25 bp, Mus musculus
atgcgctgagctgtgcacgctgcgt

SEQ ID NO: 407350 - DNA, 25 bp, Mus musculus
atgcgggttcaggaagatctgccga

SEQ ID NO: 407351 - DNA, 25 bp, Mus musculus
atgcgtattcccgtagacccgagca

SEQ ID NO: 407352 - DNA, 25 bp, Mus musculus
atgctcaaatccctgggaatgtcag

SEQ ID NO: 407353 - DNA, 25 bp, Mus musculus
atgctctgaggaaacgggtcacccc

SEQ ID NO: 407354 - DNA, 25 bp, Mus musculus
atgctgactgtgtggttccgggccc

SEQ ID NO: 407355 - DNA, 25 bp, Mus musculus
atgctgccttcttatttcataggac

SEQ ID NO: 407356 - DNA, 25 bp, Mus musculus
atgctgctctcctgcaagtaccggg

SEQ ID NO: 407357 - DNA, 25 bp, Mus musculus
atgctgcttgcttggacccgctgga

SEQ ID NO: 407358 - DNA, 25 bp, Mus musculus
atgctggagacttggtgaaaacgag

SEQ ID NO: 407359 - DNA, 25 bp, Mus musculus
atgctgggatgcacgcttgcgtagt

SEQ ID NO: 407360 - DNA, 25 bp, Mus musculus
atgcttcatccgtcctcatcacagg

SEQ ID NO: 407361 - DNA, 25 bp, Mus musculus
atggaaatggagataaagatgactg

SEQ ID NO: 407362 - DNA, 25 bp, Mus musculus
atggaatagccaggacccgtgagac

SEQ ID NO: 407363 - DNA, 25 bp, Mus musculus
atggaccatccccacattcttgtga

SEQ ID NO: 407364 - DNA, 25 bp, Mus musculus
atggacgccgcgttgaccgaaagct

SEQ ID NO: 407365 - DNA, 25 bp, Mus musculus
atggactccccactgcctagatctg

SEQ ID NO: 407366 - DNA, 25 bp, Mus musculus
atggactgaaaacttctgtgaaggg

SEQ ID NO: 407367 - DNA, 25 bp, Mus musculus
atggactggaactagccccacactc

SEQ ID NO: 407368 - DNA, 25 bp, Mus musculus
atggacttgcctgggcacagtggca

SEQ ID NO: 407369 - DNA, 25 bp, Mus musculus
atggagacacggaaacgcctggcta

SEQ ID NO: 407370 - DNA, 25 bp, Mus musculus
atggagacctgacataggccccacc

SEQ ID NO: 407371 - DNA, 25 bp, Mus musculus
atggagagctgtggtatcccccagc

SEQ ID NO: 407372 - DNA, 25 bp, Mus musculus
atggagctgaccactcacggcctga

SEQ ID NO: 407373 - DNA, 25 bp, Mus musculus
atggaggagcacatacccactgcct

SEQ ID NO: 407374 - DNA, 25 bp, Mus musculus
atggaggctctaggaccgcgcagac

SEQ ID NO: 407375 - DNA, 25 bp, Mus musculus
atggagttcaaacgcggccgcttcc

SEQ ID NO: 407376 - DNA, 25 bp, Mus musculus
atggatatcggcaggagtgcgccca

SEQ ID NO: 407377 - DNA, 25 bp, Mus musculus
atggatatggccgactacagcgctg

SEQ ID NO: 407378 - DNA, 25 bp, Mus musculus
atggatcccagccacttgcatctca

SEQ ID NO: 407379 - DNA, 25 bp, Mus musculus
atggatctgctactcctgtttggac

SEQ ID NO: 407380 - DNA, 25 bp, Mus musculus
atggatgacagatgcagagagcccc

SEQ ID NO: 407381 - DNA, 25 bp, Mus musculus
atggatggatctggtaacagggaca

SEQ ID NO: 407382 - DNA, 25 bp, Mus musculus
atggatgtggagagccagccttccc

SEQ ID NO: 407383 - DNA, 25 bp, Mus musculus
atggcaaggcgaagctcccgggtct

SEQ ID NO: 407384 - DNA, 25 bp, Mus musculus
atggcactcagcactcggacccagg

SEQ ID NO: 407385 - DNA, 25 bp, Mus musculus
atggcagacattggcgtgtagtgtc

SEQ ID NO: 407386 - DNA, 25 bp, Mus musculus
atggcaggcacatgtggttggcccc

SEQ ID NO: 407387 - DNA, 25 bp, Mus musculus
atggccaggcctggttcgcagaccg

SEQ ID NO: 407388 - DNA, 25 bp, Mus musculus
atggccagtcagacccagggtatcc

SEQ ID NO: 407389 - DNA, 25 bp, Mus musculus
atggccctgttggtgcacttcctac

SEQ ID NO: 407390 - DNA, 25 bp, Mus musculus
atggccgactacagcgctgccctgg

SEQ ID NO: 407391 - DNA, 25 bp, Mus musculus
atggccgggtggaacgcctacatcg

SEQ ID NO: 407392 - DNA, 25 bp, Mus musculus
atggccttgactcggctctccttgg

SEQ ID NO: 407393 - DNA, 25 bp, Mus musculus
atggcgactgctgaagccctgacca

SEQ ID NO: 407394 - DNA, 25 bp, Mus musculus
atggcgccccaccaggtgagtatgc

SEQ ID NO: 407395 - DNA, 25 bp, Mus musculus
atggcggatagactcactcagctgc

SEQ ID NO: 407396 - DNA, 25 bp, Mus musculus
atggcggccaccaggcctggtgacc

SEQ ID NO: 407397 - DNA, 25 bp, Mus musculus
atggcggcgagctccatggaccact

SEQ ID NO: 407398 - DNA, 25 bp, Mus musculus
atggcggctctgaccgatgtgcagc

SEQ ID NO: 407399 - DNA, 25 bp, Mus musculus
atggcgggctctgctacgatcgttg

SEQ ID NO: 407400 - DNA, 25 bp, Mus musculus
atggcgttcgagtcgctgcctccac

SEQ ID NO: 407401 - DNA, 25 bp, Mus musculus
atggcgttctctcagtctcacgtga

SEQ ID NO: 407402 - DNA, 25 bp, Mus musculus
atggcgttggcggaagtgaaaccac

SEQ ID NO: 407403 - DNA, 25 bp, Mus musculus
atggctcccacagggaccaaggcag

SEQ ID NO: 407404 - DNA, 25 bp, Mus musculus
atggctctaacaacgctgctcttgc

SEQ ID NO: 407405 - DNA, 25 bp, Mus musculus
atggctgccctttcctgtgcactgg

SEQ ID NO: 407406 - DNA, 25 bp, Mus musculus
atggctgctcaggtcacggattgag

SEQ ID NO: 407407 - DNA, 25 bp, Mus musculus
atggcttcgctgcacccggctttct

SEQ ID NO: 407408 - DNA, 25 bp, Mus musculus
atgggaaacccggatggcttctcac

SEQ ID NO: 407409 - DNA, 25 bp, Mus musculus
atgggaggcccctagacgcctgtcc

SEQ ID NO: 407410 - DNA, 25 bp, Mus musculus
atgggagtctacctccacatccctt

SEQ ID NO: 407411 - DNA, 25 bp, Mus musculus
atgggatcccagttgtgcaccgaca

SEQ ID NO: 407412 - DNA, 25 bp, Mus musculus
atgggcatccattcaaagagctctg

SEQ ID NO: 407413 - DNA, 25 bp, Mus musculus
atgggcctggcaacccggtagtacg

SEQ ID NO: 407414 - DNA, 25 bp, Mus musculus
atgggcggctgctcttcctcaagga

SEQ ID NO: 407415 - DNA, 25 bp, Mus musculus
atgggctcaccgcacagccagataa

SEQ ID NO: 407416 - DNA, 25 bp, Mus musculus
atgggtctacgctcgccgaccaacg

SEQ ID NO: 407417 - DNA, 25 bp, Mus musculus
atgggtgcccgcagcgacgattcag

SEQ ID NO: 407418 - DNA, 25 bp, Mus musculus
atgggttccagctccgtagatccgg

SEQ ID NO: 407419 - DNA, 25 bp, Mus musculus
atggtacaagcggtccaccatggcc

SEQ ID NO: 407420 - DNA, 25 bp, Mus musculus
atggtagtcagcacgtggcgcgacc

SEQ ID NO: 407421 - DNA, 25 bp, Mus musculus
atggtccaagagtccagcagcggtg

SEQ ID NO: 407422 - DNA, 25 bp, Mus musculus
atggtccttgtcaccttctccgtta

SEQ ID NO: 407423 - DNA, 25 bp, Mus musculus
atggtctggaccaacgtcacctccg

SEQ ID NO: 407424 - DNA, 25 bp, Mus musculus
atggtgagaaccctgagctcagccc

SEQ ID NO: 407425 - DNA, 25 bp, Mus musculus
atggtgagtgattatgagactggct

SEQ ID NO: 407426 - DNA, 25 bp, Mus musculus
atggtgggagtgaagccggtcggga

SEQ ID NO: 407427 - DNA, 25 bp, Mus musculus
atggtggtggcctcggaatctgaca

SEQ ID NO: 407428 - DNA, 25 bp, Mus musculus
atggtgtcactgacgagcccctcag

SEQ ID NO: 407429 - DNA, 25 bp, Mus musculus
atggtgtgaagagaagtgaactgct

SEQ ID NO: 407430 - DNA, 25 bp, Mus musculus
atggtgtggagcaggatcctgaaac

SEQ ID NO: 407431 - DNA, 25 bp, Mus musculus
atggttgacagttctaaagtctggg

SEQ ID NO: 407432 - DNA, 25 bp, Mus musculus
atgtaacccctaagccagcagcaga

SEQ ID NO: 407433 - DNA, 25 bp, Mus musculus
atgtaagacgccttggaagaggagt

SEQ ID NO: 407434 - DNA, 25 bp, Mus musculus
atgtaagcccttccccaggctgggc

SEQ ID NO: 407435 - DNA, 25 bp, Mus musculus
atgtagtttaatggctttacaaaga

SEQ ID NO: 407436 - DNA, 25 bp, Mus musculus
atgtcaacggctgggctaacggcgc

SEQ ID NO: 407437 - DNA, 25 bp, Mus musculus
atgtcaggagtttcagaggaggacc

SEQ ID NO: 407438 - DNA, 25 bp, Mus musculus
atgtccagcatgtccccagttccag

SEQ ID NO: 407439 - DNA, 25 bp, Mus musculus
atgtcctgatctggtggccgcgcct

SEQ ID NO: 407440 - DNA, 25 bp, Mus musculus
atgtcggaaccacagcctgacctgg

SEQ ID NO: 407441 - DNA, 25 bp, Mus musculus
atgtctaataacagcaccaccagca

SEQ ID NO: 407442 - DNA, 25 bp, Mus musculus
atgtctctgtgttcgcccggcctgg

SEQ ID NO: 407443 - DNA, 25 bp, Mus musculus
atgtctgtgtcagctggtgctggac

SEQ ID NO: 407444 - DNA, 25 bp, Mus musculus
atgtcttccagcagacccgtggcgc

SEQ ID NO: 407445 - DNA, 25 bp, Mus musculus
atgtgaaatctgaccccgggagtgg

SEQ ID NO: 407446 - DNA, 25 bp, Mus musculus
atgtgaacctactgttactgtaacc

SEQ ID NO: 407447 - DNA, 25 bp, Mus musculus
atgtgacatgtcagaactggcaggg

SEQ ID NO: 407448 - DNA, 25 bp, Mus musculus
atgtgagcgcctacagtggactcgg

SEQ ID NO: 407449 - DNA, 25 bp, Mus musculus
atgtgcagcgccctggctttgccac

SEQ ID NO: 407450 - DNA, 25 bp, Mus musculus
atgtgccagagaccatcacacccgg

SEQ ID NO: 407451 - DNA, 25 bp, Mus musculus
atgtgcggacaacctcagctacggg

SEQ ID NO: 407452 - DNA, 25 bp, Mus musculus
atgtgcgtggctgcagcctagtgaa

SEQ ID NO: 407453 - DNA, 25 bp, Mus musculus
atgtgctatcatgcccggcgctgga

SEQ ID NO: 407454 - DNA, 25 bp, Mus musculus
atgtggccttgattgggcaggcaaa

SEQ ID NO: 407455 - DNA, 25 bp, Mus musculus
atgtgggagcctggtgtagtttccc

SEQ ID NO: 407456 - DNA, 25 bp, Mus musculus
atgtgggccggtgttctctgtgctc

SEQ ID NO: 407457 - DNA, 25 bp, Mus musculus
atgtgtccgagtacagctgccgcga

SEQ ID NO: 407458 - DNA, 25 bp, Mus musculus
atgtgtcctggtcccaccccttaga

SEQ ID NO: 407459 - DNA, 25 bp, Mus musculus
atgtgtcttcgggagctcagcatgg

SEQ ID NO: 407460 - DNA, 25 bp, Mus musculus
atgtgtgacgacgaggagaccaccg

SEQ ID NO: 407461 - DNA, 25 bp, Mus musculus
atgtgtgactctcctccctgtgctg

SEQ ID NO: 407462 - DNA, 25 bp, Mus musculus
atgtgtgcagcacttcattcaaggc

SEQ ID NO: 407463 - DNA, 25 bp, Mus musculus
atgttctgtcaagccgcatggaggg

SEQ ID NO: 407464 - DNA, 25 bp, Mus musculus
atgttctttgggttgccagccatgc

SEQ ID NO: 407465 - DNA, 25 bp, Mus musculus
atgttgcaaagtgcccgggcctcca

SEQ ID NO: 407466 - DNA, 25 bp, Mus musculus
atgtttcaatgtcccctgcttaaaa

SEQ ID NO: 407467 - DNA, 25 bp, Mus musculus
atgtttgcctcccactgcgaatcca

SEQ ID NO: 407468 - DNA, 25 bp, Mus musculus
atgtttgtcttgtggccttggcagc

SEQ ID NO: 407469 - DNA, 25 bp, Mus musculus
atgttttgcctgatttcagtgtcag

SEQ ID NO: 407470 - DNA, 25 bp, Mus musculus
attaaacaaaatggccctccggatg

SEQ ID NO: 407471 - DNA, 25 bp, Mus musculus
attaaacttaggtctgtgcactggc

SEQ ID NO: 407472 - DNA, 25 bp, Mus musculus
attaaagatgaaccaagaccctgga

SEQ ID NO: 407473 - DNA, 25 bp, Mus musculus
attaacacgcaaacaccgccgagtg

SEQ ID NO: 407474 - DNA, 25 bp, Mus musculus
attaacgtgcgtcccagccacgtgg

SEQ ID NO: 407475 - DNA, 25 bp, Mus musculus
attaagatccgggtggaaacaatgg

SEQ ID NO: 407476 - DNA, 25 bp, Mus musculus
attaagtcccgtacaggcccagagt

SEQ ID NO: 407477 - DNA, 25 bp, Mus musculus
attaattgatcgtcttcctggccag

SEQ ID NO: 407478 - DNA, 25 bp, Mus musculus
attaatttcttttctcaccaccctg

SEQ ID NO: 407479 - DNA, 25 bp, Mus musculus
attaatttgcgaattcagacccggg

SEQ ID NO: 407480 - DNA, 25 bp, Mus musculus
attacaaagcagcaaaattagtgcc

SEQ ID NO: 407481 - DNA, 25 bp, Mus musculus
attaccagcgcctgtccgatgtcct

SEQ ID NO: 407482 - DNA, 25 bp, Mus musculus
attaccggagcaggcgatggcatcg

SEQ ID NO: 407483 - DNA, 25 bp, Mus musculus
attacctacgtttgcgtggactgca

SEQ ID NO: 407484 - DNA, 25 bp, Mus musculus
attacggattttgggctttgcaaag

SEQ ID NO: 407485 - DNA, 25 bp, Mus musculus
attacgttagtaggcagttagggcg

SEQ ID NO: 407486 - DNA, 25 bp, Mus musculus
attagaaacatgagcagtttaaccg

SEQ ID NO: 407487 - DNA, 25 bp, Mus musculus
attagagaaccaagcaccacaccct

SEQ ID NO: 407488 - DNA, 25 bp, Mus musculus
attagagcccgcttgctgccggagg

SEQ ID NO: 407489 - DNA, 25 bp, Mus musculus
attagagcctgaccccagcagtgca

SEQ ID NO: 407490 - DNA, 25 bp, Mus musculus
attatgtagatgtacgaagctgtca

SEQ ID NO: 407491 - DNA, 25 bp, Mus musculus
attattgctcgatcttgctctcagg

SEQ ID NO: 407492 - DNA, 25 bp, Mus musculus
attcaaaggcgtgtgtgcactggag

SEQ ID NO: 407493 - DNA, 25 bp, Mus musculus
attcacaagcctacacaacttctcg

SEQ ID NO: 407494 - DNA, 25 bp, Mus musculus
attcacagtccgagaacgaggcctc

SEQ ID NO: 407495 - DNA, 25 bp, Mus musculus
attcacctgatgttcgacgactacg

SEQ ID NO: 407496 - DNA, 25 bp, Mus musculus
attcactcaagctacacatacacag

SEQ ID NO: 407497 - DNA, 25 bp, Mus musculus
attcagcccactttgacttccaggg

SEQ ID NO: 407498 - DNA, 25 bp, Mus musculus
attcagggtatggagctgtgcgcca

SEQ ID NO: 407499 - DNA, 25 bp, Mus musculus
attcatggaaacgtccctgctccgg

SEQ ID NO: 407500 - DNA, 25 bp, Mus musculus
attcattaagctccccttttctggg

SEQ ID NO: 407501 - DNA, 25 bp, Mus musculus
attcccgggctctcagaggaagagg

SEQ ID NO: 407502 - DNA, 25 bp, Mus musculus
attccgtggcccacagacgtggtca

SEQ ID NO: 407503 - DNA, 25 bp, Mus musculus
attcctctcaggttaacatgcaaag

SEQ ID NO: 407504 - DNA, 25 bp, Mus musculus
attccttccatgcacagtctctttg

SEQ ID NO: 407505 - DNA, 25 bp, Mus musculus
attcctttatgggagcgtctgcgcc

SEQ ID NO: 407506 - DNA, 25 bp, Mus musculus
attcctttgtgatcggctcgggctg

SEQ ID NO: 407507 - DNA, 25 bp, Mus musculus
attcgcaggtcagccagcagcactg

SEQ ID NO: 407508 - DNA, 25 bp, Mus musculus
attcgggcactagagcatgggtacc

SEQ ID NO: 407509 - DNA, 25 bp, Mus musculus
attctcatccggagggaagtctgtg

SEQ ID NO: 407510 - DNA, 25 bp, Mus musculus
attctccttggagcaccattggcca

SEQ ID NO: 407511 - DNA, 25 bp, Mus musculus
attctgagtgcaccgtggagcccat

SEQ ID NO: 407512 - DNA, 25 bp, Mus musculus
attctgcctatcttccacaagcctg

SEQ ID NO: 407513 - DNA, 25 bp, Mus musculus
attctgcggcgctggaaggaacacg

SEQ ID NO: 407514 - DNA, 25 bp, Mus musculus
attctgggagacagggaggccctac

SEQ ID NO: 407515 - DNA, 25 bp, Mus musculus
attcttcacttgctgtcttctgtga

SEQ ID NO: 407516 - DNA, 25 bp, Mus musculus
attcttctgagaggcgggcttccca

SEQ ID NO: 407517 - DNA, 25 bp, Mus musculus
attcttctggtaccagtccagcatc

SEQ ID NO: 407518 - DNA, 25 bp, Mus musculus
attctttgccccatacctttacacg

SEQ ID NO: 407519 - DNA, 25 bp, Mus musculus
attgaaatcaatgctcggcaacagc

SEQ ID NO: 407520 - DNA, 25 bp, Mus musculus
attgaacccgggtgcccttgaagag

SEQ ID NO: 407521 - DNA, 25 bp, Mus musculus
attgaacgccataagaagaagatcc

SEQ ID NO: 407522 - DNA, 25 bp, Mus musculus
attgaagttatctccccaacccatg

SEQ ID NO: 407523 - DNA, 25 bp, Mus musculus
attgaccagaagcttgtccccacct

SEQ ID NO: 407524 - DNA, 25 bp, Mus musculus
attgagacccggacggtgcgctaac

SEQ ID NO: 407525 - DNA, 25 bp, Mus musculus
attgagccttcctgtgctggtcccc

SEQ ID NO: 407526 - DNA, 25 bp, Mus musculus
attgaggagcaaatggatgactggc

SEQ ID NO: 407527 - DNA, 25 bp, Mus musculus
attgaggagctgaacacccaggtcg

SEQ ID NO: 407528 - DNA, 25 bp, Mus musculus
attgaggtggcggtctctggctttc

SEQ ID NO: 407529 - DNA, 25 bp, Mus musculus
attgcacacaggctaatacttttcc

SEQ ID NO: 407530 - DNA, 25 bp, Mus musculus
attgcactattaataccagcccctg

SEQ ID NO: 407531 - DNA, 25 bp, Mus musculus
attgcagccctgagtgactgggcag

SEQ ID NO: 407532 - DNA, 25 bp, Mus musculus
attgccaaaacactggccagcttgt

SEQ ID NO: 407533 - DNA, 25 bp, Mus musculus
attgccaaccagttccctgacatct

SEQ ID NO: 407534 - DNA, 25 bp, Mus musculus
attgccaccgagagaggcccggtgc

SEQ ID NO: 407535 - DNA, 25 bp, Mus musculus
attgccagccatgtgtgtgtaagcc

SEQ ID NO: 407536 - DNA, 25 bp, Mus musculus
attgcccagccacgatgcaggaaga

SEQ ID NO: 407537 - DNA, 25 bp, Mus musculus
attgcctgtctcatcggactcatca

SEQ ID NO: 407538 - DNA, 25 bp, Mus musculus
attgcgaggccggtgagtgactcca

SEQ ID NO: 407539 - DNA, 25 bp, Mus musculus
attgctaacatggagggctggagac

SEQ ID NO: 407540 - DNA, 25 bp, Mus musculus
attgctcacccaggcaacagtgtgg

SEQ ID NO: 407541 - DNA, 25 bp, Mus musculus
attgctccagctagctcacccaggg

SEQ ID NO: 407542 - DNA, 25 bp, Mus musculus
attgctgatggaaattctggaagcc

SEQ ID NO: 407543 - DNA, 25 bp, Mus musculus
attgctgtcagcatgggatttggac

SEQ ID NO: 407544 - DNA, 25 bp, Mus musculus
attggagccggagtccatcgcctgt

SEQ ID NO: 407545 - DNA, 25 bp, Mus musculus
attggcaacagcagcgtcgggaaga

SEQ ID NO: 407546 - DNA, 25 bp, Mus musculus
attggccaggaaggtagaggcacta

SEQ ID NO: 407547 - DNA, 25 bp, Mus musculus
attggccgatgccacctcgaacagc

SEQ ID NO: 407548 - DNA, 25 bp, Mus musculus
attggccgccgcttcagtgaagagc

SEQ ID NO: 407549 - DNA, 25 bp, Mus musculus
attggcctggtctgttgtgttgtct

SEQ ID NO: 407550 - DNA, 25 bp, Mus musculus
attggctggatacctctagatctac

SEQ ID NO: 407551 - DNA, 25 bp, Mus musculus
attgggccaggagtgtcttcttgga

SEQ ID NO: 407552 - DNA, 25 bp, Mus musculus
attgggccttcacaccgtcatggag

SEQ ID NO: 407553 - DNA, 25 bp, Mus musculus
attgggtttggagggcttacacagc

SEQ ID NO: 407554 - DNA, 25 bp, Mus musculus
attggtagtgaaatttggtctggcc

SEQ ID NO: 407555 - DNA, 25 bp, Mus musculus
attggtccccaaggaggcatggcct

SEQ ID NO: 407556 - DNA, 25 bp, Mus musculus
attggttaggaatgggacacacgcc

SEQ ID NO: 407557 - DNA, 25 bp, Mus musculus
attgtacaatgaccggccctgggag

SEQ ID NO: 407558 - DNA, 25 bp, Mus musculus
attgtaggacaaggcccagcgccga

SEQ ID NO: 407559 - DNA, 25 bp, Mus musculus
attgtcccaggaggcgttgaccctt

SEQ ID NO: 407560 - DNA, 25 bp, Mus musculus
attgtcctagtcctgtgagagcccc

SEQ ID NO: 407561 - DNA, 25 bp, Mus musculus
attgtgcgaacaaacctagggaggc

SEQ ID NO: 407562 - DNA, 25 bp, Mus musculus
attgtggaagccaatgtccccatgg

SEQ ID NO: 407563 - DNA, 25 bp, Mus musculus
attgtggccattttaaagtcagatg

SEQ ID NO: 407564 - DNA, 25 bp, Mus musculus
attgtgtgacccttgccctatgacc

SEQ ID NO: 407565 - DNA, 25 bp, Mus musculus
attgttacttaccactgcagccggg

SEQ ID NO: 407566 - DNA, 25 bp, Mus musculus
attgttcgcaggcacaggaagccgc

SEQ ID NO: 407567 - DNA, 25 bp, Mus musculus
attgttgggacagaaagatattgca

SEQ ID NO: 407568 - DNA, 25 bp, Mus musculus
atttaatactacaggccagcgagga

SEQ ID NO: 407569 - DNA, 25 bp, Mus musculus
atttacaaagaaggagtcaaagatc

SEQ ID NO: 407570 - DNA, 25 bp, Mus musculus
atttagctacctctgcaccgtccat

SEQ ID NO: 407571 - DNA, 25 bp, Mus musculus
atttagctgcagaaatgccggtgag

SEQ ID NO: 407572 - DNA, 25 bp, Mus musculus
atttatagcctatgttagttatgca

SEQ ID NO: 407573 - DNA, 25 bp, Mus musculus
atttcacagtgttgtcctgtcctgg

SEQ ID NO: 407574 - DNA, 25 bp, Mus musculus
atttcagcctagctccctgtccaga

SEQ ID NO: 407575 - DNA, 25 bp, Mus musculus
atttcatggcaagggtgagcgttca

SEQ ID NO: 407576 - DNA, 25 bp, Mus musculus
atttccagcccaaggttcagagccg

SEQ ID NO: 407577 - DNA, 25 bp, Mus musculus
atttccatgtgaatggcagcctgtg

SEQ ID NO: 407578 - DNA, 25 bp, Mus musculus
atttcccaccagtctgagtccttga

SEQ ID NO: 407579 - DNA, 25 bp, Mus musculus
atttcccagcgctcaacatcttgtg

SEQ ID NO: 407580 - DNA, 25 bp, Mus musculus
atttccccaggcattgggctccagg

SEQ ID NO: 407581 - DNA, 25 bp, Mus musculus
atttcctaatgggagcctgaacagg

SEQ ID NO: 407582 - DNA, 25 bp, Mus musculus
atttcctaggtctgggctgcgtgcg

SEQ ID NO: 407583 - DNA, 25 bp, Mus musculus
atttcgctgtgccttcttccgttac

SEQ ID NO: 407584 - DNA, 25 bp, Mus musculus
atttcggaggcactggaatcctagc

SEQ ID NO: 407585 - DNA, 25 bp, Mus musculus
atttctctggagacaatgagggaca

SEQ ID NO: 407586 - DNA, 25 bp, Mus musculus
atttctgaaggtccgcgccggaaga

SEQ ID NO: 407587 - DNA, 25 bp, Mus musculus
atttcttagggcgacagtccccgcg

SEQ ID NO: 407588 - DNA, 25 bp, Mus musculus
atttgaaaggttgcccacatgggtg

SEQ ID NO: 407589 - DNA, 25 bp, Mus musculus
atttgccattcgacctccgccaggg

SEQ ID NO: 407590 - DNA, 25 bp, Mus musculus
atttgccccaggcagctgagcagga

SEQ ID NO: 407591 - DNA, 25 bp, Mus musculus
atttgcgcagcaccgtttccttgag

SEQ ID NO: 407592 - DNA, 25 bp, Mus musculus
atttgctgttctcctaggcctgggc

SEQ ID NO: 407593 - DNA, 25 bp, Mus musculus
atttgcttcttactccacactgtgg

SEQ ID NO: 407594 - DNA, 25 bp, Mus musculus
atttggcagacagctgatgtgtggc

SEQ ID NO: 407595 - DNA, 25 bp, Mus musculus
atttgggccactctggaacactggg

SEQ ID NO: 407596 - DNA, 25 bp, Mus musculus
atttgggtgctaaaatagttctcac

SEQ ID NO: 407597 - DNA, 25 bp, Mus musculus
atttgtagtcccaaaggcggcggca

SEQ ID NO: 407598 - DNA, 25 bp, Mus musculus
atttgtcagctgaaaggaggcgccc

SEQ ID NO: 407599 - DNA, 25 bp, Mus musculus
atttgttcccatagccacctctgag

SEQ ID NO: 407600 - DNA, 25 bp, Mus musculus
atttgtttgcatcgccctgcagtgc

SEQ ID NO: 407601 - DNA, 25 bp, Mus musculus
attttaagggccagtatgttgacca

SEQ ID NO: 407602 - DNA, 25 bp, Mus musculus
attttaatgatatccctcttcccag

SEQ ID NO: 407603 - DNA, 25 bp, Mus musculus
attttactatccgagcacccttgtg

SEQ ID NO: 407604 - DNA, 25 bp, Mus musculus
attttagaaggacacgccacacgcc

SEQ ID NO: 407605 - DNA, 25 bp, Mus musculus
attttagcagaaatgaccctgttcc

SEQ ID NO: 407606 - DNA, 25 bp, Mus musculus
attttagccgggtgccatggcccac

SEQ ID NO: 407607 - DNA, 25 bp, Mus musculus
attttcccagggttcgacagccagg

SEQ ID NO: 407608 - DNA, 25 bp, Mus musculus
attttgaacatgacacctctgggaa

SEQ ID NO: 407609 - DNA, 25 bp, Mus musculus
attttggacggcaactcggctcccg

SEQ ID NO: 407610 - DNA, 25 bp, Mus musculus
attttggagctgagaattaaggaaa

SEQ ID NO: 407611 - DNA, 25 bp, Mus musculus
attttgggccacgaaagctctgggt

SEQ ID NO: 407612 - DNA, 25 bp, Mus musculus
atttttcccgaaagcctcacgcaga

SEQ ID NO: 407613 - DNA, 25 bp, Mus musculus
caaaaaacacccaagacagacgagg

SEQ ID NO: 407614 - DNA, 25 bp, Mus musculus
caaaaaacagccttggtggcgcaag

SEQ ID NO: 407615 - DNA, 25 bp, Mus musculus
caaaaaacggctggactctgagatg

SEQ ID NO: 407616 - DNA, 25 bp, Mus musculus
caaaaaactagttctggcccagcag

SEQ ID NO: 407617 - DNA, 25 bp, Mus musculus
caaaaaacttaatgtgctgactgag

SEQ ID NO: 407618 - DNA, 25 bp, Mus musculus
caaaaaagacgaggcttgactctgg

SEQ ID NO: 407619 - DNA, 25 bp, Mus musculus
caaaaaagccaagagaggtcgcctt

SEQ ID NO: 407620 - DNA, 25 bp, Mus musculus
caaaaaagcctcgtgctgtcggacc

SEQ ID NO: 407621 - DNA, 25 bp, Mus musculus
caaaaaagcctgctcagaagggaaa

SEQ ID NO: 407622 - DNA, 25 bp, Mus musculus
caaaaaatcagtgagccctgccgtg

SEQ ID NO: 407623 - DNA, 25 bp, Mus musculus
caaaaaatgcatcgctgtggcccct

SEQ ID NO: 407624 - DNA, 25 bp, Mus musculus
caaaaaatgctgtggtgatggtccc

SEQ ID NO: 407625 - DNA, 25 bp, Mus musculus
caaaaaatgggtctccatgtagccc

SEQ ID NO: 407626 - DNA, 25 bp, Mus musculus
caaaaaatgtgagaaagtatgccgt

SEQ ID NO: 407627 - DNA, 25 bp, Mus musculus
caaaaacatccttgtagctacgggc

SEQ ID NO: 407628 - DNA, 25 bp, Mus musculus
caaaaacgagtcatggacgacaggc

SEQ ID NO: 407629 - DNA, 25 bp, Mus musculus
caaaaacgatatattccgagaagtc

SEQ ID NO: 407630 - DNA, 25 bp, Mus musculus
caaaaacggtgctgtgctaactgca

SEQ ID NO: 407631 - DNA, 25 bp, Mus musculus
caaaaacgtgttcatccaagtgcca

SEQ ID NO: 407632 - DNA, 25 bp, Mus musculus
caaaaactgctgtgccggaagctcc

SEQ ID NO: 407633 - DNA, 25 bp, Mus musculus
caaaaagaagccctggcacctgagg

SEQ ID NO: 407634 - DNA, 25 bp, Mus musculus
caaaaagaattcgatactgcagcgg

SEQ ID NO: 407635 - DNA, 25 bp, Mus musculus
caaaaagaggcagacgaagaggact

SEQ ID NO: 407636 - DNA, 25 bp, Mus musculus
caaaaagagtgatcatggcaacgcc

SEQ ID NO: 407637 - DNA, 25 bp, Mus musculus
caaaaagatctacgaggcgaagcgc

SEQ ID NO: 407638 - DNA, 25 bp, Mus musculus
caaaaagcacttacagggagcggcc

SEQ ID NO: 407639 - DNA, 25 bp, Mus musculus
caaaaagcagtgtggttccatgccg

SEQ ID NO: 407640 - DNA, 25 bp, Mus musculus
caaaaagcatggttggacacctggt

SEQ ID NO: 407641 - DNA, 25 bp, Mus musculus
caaaaagcatgtgtccaggaatcac

SEQ ID NO: 407642 - DNA, 25 bp, Mus musculus
caaaaagcattgtccatgaggaggt

SEQ ID NO: 407643 - DNA, 25 bp, Mus musculus
caaaaagcctcaagaagctgaatat

SEQ ID NO: 407644 - DNA, 25 bp, Mus musculus
caaaaagcgttagacctggactcca

SEQ ID NO: 407645 - DNA, 25 bp, Mus musculus
caaaaaggaagtggccagtttcaca

SEQ ID NO: 407646 - DNA, 25 bp, Mus musculus
caaaaaggctgacctagcagctgca

SEQ ID NO: 407647 - DNA, 25 bp, Mus musculus
caaaaaggtccgagatgtaggctgt

SEQ ID NO: 407648 - DNA, 25 bp, Mus musculus
caaaaagtcgggagctagagactgg

SEQ ID NO: 407649 - DNA, 25 bp, Mus musculus
caaaaagtctactcactcaggtggg

SEQ ID NO: 407650 - DNA, 25 bp, Mus musculus
caaaaagttccgtcgccaagcctat

SEQ ID NO: 407651 - DNA, 25 bp, Mus musculus
caaaaagttcttccagatggtgggc

SEQ ID NO: 407652 - DNA, 25 bp, Mus musculus
caaaaagttgcaccccagcatggat

SEQ ID NO: 407653 - DNA, 25 bp, Mus musculus
caaaaataatatcctggtccgtggg

SEQ ID NO: 407654 - DNA, 25 bp, Mus musculus
caaaaatagcagcaatttgagtttg

SEQ ID NO: 407655 - DNA, 25 bp, Mus musculus
caaaaatcgctcacaaaagcaagtg

SEQ ID NO: 407656 - DNA, 25 bp, Mus musculus
caaaaatctggcatccaaaagcggt

SEQ ID NO: 407657 - DNA, 25 bp, Mus musculus
caaaaatgagtgaaagctgtagtcc

SEQ ID NO: 407658 - DNA, 25 bp, Mus musculus
caaaaatgcggccaaaaccaggagg

SEQ ID NO: 407659 - DNA, 25 bp, Mus musculus
caaaaatggatgtgccaaccgccaa

SEQ ID NO: 407660 - DNA, 25 bp, Mus musculus
caaaaatggatttgcctgtcccacc

SEQ ID NO: 407661 - DNA, 25 bp, Mus musculus
caaaaatggcgtctcctggtctcac

SEQ ID NO: 407662 - DNA, 25 bp, Mus musculus
caaaaatgtaaaattcaagaatgtc

SEQ ID NO: 407663 - DNA, 25 bp, Mus musculus
caaaaatgtggctggcagatagctg

SEQ ID NO: 407664 - DNA, 25 bp, Mus musculus
caaaaattctcgtgcggtgcctcag

SEQ ID NO: 407665 - DNA, 25 bp, Mus musculus
caaaaattctgtggtgatctaaggt

SEQ ID NO: 407666 - DNA, 25 bp, Mus musculus
caaaacaaagactgtcaggtgctcg

SEQ ID NO: 407667 - DNA, 25 bp, Mus musculus
caaaacaaatagtagagcagggccc

SEQ ID NO: 407668 - DNA, 25 bp, Mus musculus
caaaacaagacactaaagctagcgg

SEQ ID NO: 407669 - DNA, 25 bp, Mus musculus
caaaacaagagtcctgggcctgtca

SEQ ID NO: 407670 - DNA, 25 bp, Mus musculus
caaaacacaacctgtctgcaacaaa

SEQ ID NO: 407671 - DNA, 25 bp, Mus musculus
caaaacacgaaatagaggcccacta

SEQ ID NO: 407672 - DNA, 25 bp, Mus musculus
caaaacagaggacacaggatgccca

SEQ ID NO: 407673 - DNA, 25 bp, Mus musculus
caaaacatattcacgtgaccctttc

SEQ ID NO: 407674 - DNA, 25 bp, Mus musculus
caaaacattctagcggccatcgagg

SEQ ID NO: 407675 - DNA, 25 bp, Mus musculus
caaaacattgggactggttggaaca

SEQ ID NO: 407676 - DNA, 25 bp, Mus musculus
caaaacatttatcctaatcttggaa

SEQ ID NO: 407677 - DNA, 25 bp, Mus musculus
caaaaccaaagagctcatctgtggc

SEQ ID NO: 407678 - DNA, 25 bp, Mus musculus
caaaaccaagagtgtggctttcgga

SEQ ID NO: 407679 - DNA, 25 bp, Mus musculus
caaaaccacatgtaagaggagaggg

SEQ ID NO: 407680 - DNA, 25 bp, Mus musculus
caaaaccagggctccgtgtaggctt

SEQ ID NO: 407681 - DNA, 25 bp, Mus musculus
caaaacccagtgtgaccagtgtctc

SEQ ID NO: 407682 - DNA, 25 bp, Mus musculus
caaaaccgtgccttgtggaaatgaa

SEQ ID NO: 407683 - DNA, 25 bp, Mus musculus
caaaacctaagcatgatggccgacg

SEQ ID NO: 407684 - DNA, 25 bp, Mus musculus
caaaacctattggaatctgggctac

SEQ ID NO: 407685 - DNA, 25 bp, Mus musculus
caaaacctctggaagccgcgattga

SEQ ID NO: 407686 - DNA, 25 bp, Mus musculus
caaaacgatgtgatggtgcctgata

SEQ ID NO: 407687 - DNA, 25 bp, Mus musculus
caaaacggagagattgtggaccaca

SEQ ID NO: 407688 - DNA, 25 bp, Mus musculus
caaaacggagctcatgtggtaccca

SEQ ID NO: 407689 - DNA, 25 bp, Mus musculus
caaaacgggccgtgaagcctgacat

SEQ ID NO: 407690 - DNA, 25 bp, Mus musculus
caaaacgtcggattgcagagcggga

SEQ ID NO: 407691 - DNA, 25 bp, Mus musculus
caaaacgtggggctggttccatccg

SEQ ID NO: 407692 - DNA, 25 bp, Mus musculus
caaaactaacgggaccggtgtgcag

SEQ ID NO: 407693 - DNA, 25 bp, Mus musculus
caaaactaagcatcaacttctctac

SEQ ID NO: 407694 - DNA, 25 bp, Mus musculus
caaaactaagtcttccgatggcggc

SEQ ID NO: 407695 - DNA, 25 bp, Mus musculus
caaaactatgctatgaggtcactcc

SEQ ID NO: 407696 - DNA, 25 bp, Mus musculus
caaaactattgaaggcacagcccga

SEQ ID NO: 407697 - DNA, 25 bp, Mus musculus
caaaactccattagaaggtgcccag

SEQ ID NO: 407698 - DNA, 25 bp, Mus musculus
caaaactctgaaagaagcactgaag

SEQ ID NO: 407699 - DNA, 25 bp, Mus musculus
caaaactgaatctgtaagcagctcc

SEQ ID NO: 407700 - DNA, 25 bp, Mus musculus
caaaactgacccatggacatgaggc

SEQ ID NO: 407701 - DNA, 25 bp, Mus musculus
caaaactgagatcgatgcgctgaag

SEQ ID NO: 407702 - DNA, 25 bp, Mus musculus
caaaactgctcaaccaaaagactgg

SEQ ID NO: 407703 - DNA, 25 bp, Mus musculus
caaaactggtcttgcgtgccagagc

SEQ ID NO: 407704 - DNA, 25 bp, Mus musculus
caaaactgtcccctttctctgaatt

SEQ ID NO: 407705 - DNA, 25 bp, Mus musculus
caaaacttactcgtgggacaatgcc

SEQ ID NO: 407706 - DNA, 25 bp, Mus musculus
caaaacttcgcctgcagctctacta

SEQ ID NO: 407707 - DNA, 25 bp, Mus musculus
caaaacttgattatgctgtggcctg

SEQ ID NO: 407708 - DNA, 25 bp, Mus musculus
caaaagaaacgctggctaaagcggt

SEQ ID NO: 407709 - DNA, 25 bp, Mus musculus
caaaagaaactcatgaagcccgtgg

SEQ ID NO: 407710 - DNA, 25 bp, Mus musculus
caaaagaagctggtggcaacggtgt

SEQ ID NO: 407711 - DNA, 25 bp, Mus musculus
caaaagacagatgggctcaggcgat

SEQ ID NO: 407712 - DNA, 25 bp, Mus musculus
caaaagacccactgtgtggaaagga

SEQ ID NO: 407713 - DNA, 25 bp, Mus musculus
caaaagactaaaatatgacggccca

SEQ ID NO: 407714 - DNA, 25 bp, Mus musculus
caaaagactgtctgctgctcagcat

SEQ ID NO: 407715 - DNA, 25 bp, Mus musculus
caaaagagaaataagctagagtgtc

SEQ ID NO: 407716 - DNA, 25 bp, Mus musculus
caaaagagactgtttgaggctccat

SEQ ID NO: 407717 - DNA, 25 bp, Mus musculus
caaaagagagtgttaagagaaaagc

SEQ ID NO: 407718 - DNA, 25 bp, Mus musculus
caaaagagcagtggttctggcagca

SEQ ID NO: 407719 - DNA, 25 bp, Mus musculus
caaaagagcccctagttgctggtgc

SEQ ID NO: 407720 - DNA, 25 bp, Mus musculus
caaaagagcccgatttctgaagatc

SEQ ID NO: 407721 - DNA, 25 bp, Mus musculus
caaaagagcctgtgtgggcacctag

SEQ ID NO: 407722 - DNA, 25 bp, Mus musculus
caaaagaggaagattactcagagag

SEQ ID NO: 407723 - DNA, 25 bp, Mus musculus
caaaagagggccaaactcaggtgac

SEQ ID NO: 407724 - DNA, 25 bp, Mus musculus
caaaagagggctttccagagcacag

SEQ ID NO: 407725 - DNA, 25 bp, Mus musculus
caaaagaggtcccagggccaatggc

SEQ ID NO: 407726 - DNA, 25 bp, Mus musculus
caaaagatagaggaattggcccgta

SEQ ID NO: 407727 - DNA, 25 bp, Mus musculus
caaaagatcgttgatacctgcgagc

SEQ ID NO: 407728 - DNA, 25 bp, Mus musculus
caaaagatctgctgcctggtgaatc

SEQ ID NO: 407729 - DNA, 25 bp, Mus musculus
caaaagatgcgtggatgattcgaga

SEQ ID NO: 407730 - DNA, 25 bp, Mus musculus
caaaagatttcagggatcacgccag

SEQ ID NO: 407731 - DNA, 25 bp, Mus musculus
caaaagcaagctttgggccacatgg

SEQ ID NO: 407732 - DNA, 25 bp, Mus musculus
caaaagcagaagatagccaatgaga

SEQ ID NO: 407733 - DNA, 25 bp, Mus musculus
caaaagcagaagcatcggactccaa

SEQ ID NO: 407734 - DNA, 25 bp, Mus musculus
caaaagcagctacgacctgggctac

SEQ ID NO: 407735 - DNA, 25 bp, Mus musculus
caaaagcaggacgtggattccgaca

SEQ ID NO: 407736 - DNA, 25 bp, Mus musculus
caaaagcagggacctaaacctctgg

SEQ ID NO: 407737 - DNA, 25 bp, Mus musculus
caaaagcagtctgtgtcggagccac

SEQ ID NO: 407738 - DNA, 25 bp, Mus musculus
caaaagcatatgtgaacgcctgaag

SEQ ID NO: 407739 - DNA, 25 bp, Mus musculus
caaaagccaaaagacgactgcggaa

SEQ ID NO: 407740 - DNA, 25 bp, Mus musculus
caaaagccaattacttaagccaggt

SEQ ID NO: 407741 - DNA, 25 bp, Mus musculus
caaaagccgaggtagttctcactga

SEQ ID NO: 407742 - DNA, 25 bp, Mus musculus
caaaagccgtcaagccatggagaga

SEQ ID NO: 407743 - DNA, 25 bp, Mus musculus
caaaagcctggagggtctgattttt

SEQ ID NO: 407744 - DNA, 25 bp, Mus musculus
caaaagccttgttagttcagcatca

SEQ ID NO: 407745 - DNA, 25 bp, Mus musculus
caaaagcgacgtgaagcctgtgcct

SEQ ID NO: 407746 - DNA, 25 bp, Mus musculus
caaaagcgggagtgcaaatgcctac

SEQ ID NO: 407747 - DNA, 25 bp, Mus musculus
caaaagcggtgtcaatgttgggtca

SEQ ID NO: 407748 - DNA, 25 bp, Mus musculus
caaaagcgtccagattagatgtcac

SEQ ID NO: 407749 - DNA, 25 bp, Mus musculus
caaaagcgtcttaaccggaggtctg

SEQ ID NO: 407750 - DNA, 25 bp, Mus musculus
caaaagcgtgcgtagctggaacttc

SEQ ID NO: 407751 - DNA, 25 bp, Mus musculus
caaaagcgtgtgatacaggagggcc

SEQ ID NO: 407752 - DNA, 25 bp, Mus musculus
caaaagctcggctgaggaggctaca

SEQ ID NO: 407753 - DNA, 25 bp, Mus musculus
caaaagctcttcttggtgaccagtc

SEQ ID NO: 407754 - DNA, 25 bp, Mus musculus
caaaagctcttgaggagcggctagg

SEQ ID NO: 407755 - DNA, 25 bp, Mus musculus
caaaagctgactgctcccaaggtcg

SEQ ID NO: 407756 - DNA, 25 bp, Mus musculus
caaaagctgcgtgtgaagtccccag

SEQ ID NO: 407757 - DNA, 25 bp, Mus musculus
caaaagctggatttagggacatagg

SEQ ID NO: 407758 - DNA, 25 bp, Mus musculus
caaaagcttggacattgcgtcacca

SEQ ID NO: 407759 - DNA, 25 bp, Mus musculus
caaaaggaaatcactgcactggctc

SEQ ID NO: 407760 - DNA, 25 bp, Mus musculus
caaaaggaagttcgatcagctcgct

SEQ ID NO: 407761 - DNA, 25 bp, Mus musculus
caaaaggagctcatgtgcttcgacc

SEQ ID NO: 407762 - DNA, 25 bp, Mus musculus
caaaaggagtgtttgccctgctctc

SEQ ID NO: 407763 - DNA, 25 bp, Mus musculus
caaaaggataaggtcttcccagagt

SEQ ID NO: 407764 - DNA, 25 bp, Mus musculus
caaaaggatgtttactaagtcagac

SEQ ID NO: 407765 - DNA, 25 bp, Mus musculus
caaaaggattgaatatgccccagga

SEQ ID NO: 407766 - DNA, 25 bp, Mus musculus
caaaaggcccatggaaactccgagg

SEQ ID NO: 407767 - DNA, 25 bp, Mus musculus
caaaaggcgctatagcctgtgtgac

SEQ ID NO: 407768 - DNA, 25 bp, Mus musculus
caaaaggcgggcactgatgcttcac

SEQ ID NO: 407769 - DNA, 25 bp, Mus musculus
caaaaggcgtctgtgtccacgaggc

SEQ ID NO: 407770 - DNA, 25 bp, Mus musculus
caaaaggctgtcagctatgggatcc

SEQ ID NO: 407771 - DNA, 25 bp, Mus musculus
caaaaggcttcacagcaggtagctc

SEQ ID NO: 407772 - DNA, 25 bp, Mus musculus
caaaagggaaccatagaccaggaag

SEQ ID NO: 407773 - DNA, 25 bp, Mus musculus
caaaagggagctgagccggtgttca

SEQ ID NO: 407774 - DNA, 25 bp, Mus musculus
caaaagggcagagttgactcttgag

SEQ ID NO: 407775 - DNA, 25 bp, Mus musculus
caaaagggccactggatgtctgcct

SEQ ID NO: 407776 - DNA, 25 bp, Mus musculus
caaaagggccagtctccgagatgtg

SEQ ID NO: 407777 - DNA, 25 bp, Mus musculus
caaaagggccatccaagtgctgagg

SEQ ID NO: 407778 - DNA, 25 bp, Mus musculus
caaaagggctgtgcacctgtcagat

SEQ ID NO: 407779 - DNA, 25 bp, Mus musculus
caaaaggtaagccatgctgagcgag

SEQ ID NO: 407780 - DNA, 25 bp, Mus musculus
caaaaggtaggcatggatctctggc

SEQ ID NO: 407781 - DNA, 25 bp, Mus musculus
caaaaggtatccagtgtgacaggac

SEQ ID NO: 407782 - DNA, 25 bp, Mus musculus
caaaaggtcatggagagcgtaggcc

SEQ ID NO: 407783 - DNA, 25 bp, Mus musculus
caaaaggtccatgcactccgactgg

SEQ ID NO: 407784 - DNA, 25 bp, Mus musculus
caaaaggtgaatgcttgtctgcaca

SEQ ID NO: 407785 - DNA, 25 bp, Mus musculus
caaaaggtgcattggctggaggccc

SEQ ID NO: 407786 - DNA, 25 bp, Mus musculus
caaaaggttagtgccaggagatgct

SEQ ID NO: 407787 - DNA, 25 bp, Mus musculus
caaaagtagtttgagatccccagag

SEQ ID NO: 407788 - DNA, 25 bp, Mus musculus
caaaagtcataccattgggcctgga

SEQ ID NO: 407789 - DNA, 25 bp, Mus musculus
caaaagtcgaacatggaggatcctc

SEQ ID NO: 407790 - DNA, 25 bp, Mus musculus
caaaagtcgtgtacagtggacccca

SEQ ID NO: 407791 - DNA, 25 bp, Mus musculus
caaaagtctcctcttcagggctgga

SEQ ID NO: 407792 - DNA, 25 bp, Mus musculus
caaaagtctggagagcccaattgcc

SEQ ID NO: 407793 - DNA, 25 bp, Mus musculus
caaaagtctggagtaggcagtgctc

SEQ ID NO: 407794 - DNA, 25 bp, Mus musculus
caaaagtgaacccactgagccggga

SEQ ID NO: 407795 - DNA, 25 bp, Mus musculus
caaaagtgaagatgcagaggtgtcc

SEQ ID NO: 407796 - DNA, 25 bp, Mus musculus
caaaagtggcatggacatacaagtc

SEQ ID NO: 407797 - DNA, 25 bp, Mus musculus
caaaagtggcccagtagagctactc

SEQ ID NO: 407798 - DNA, 25 bp, Mus musculus
caaaagtgtgacatgcttctgccct

SEQ ID NO: 407799 - DNA, 25 bp, Mus musculus
caaaagttccagttcgtctcgcctg

SEQ ID NO: 407800 - DNA, 25 bp, Mus musculus
caaaagttctatcaacctggagcag

SEQ ID NO: 407801 - DNA, 25 bp, Mus musculus
caaaagttgtacattccagtaggac

SEQ ID NO: 407802 - DNA, 25 bp, Mus musculus
caaaatacacagcacagagggagga

SEQ ID NO: 407803 - DNA, 25 bp, Mus musculus
caaaatagctagtgctggagagccc

SEQ ID NO: 407804 - DNA, 25 bp, Mus musculus
caaaatagctggcttcccgtcagac

SEQ ID NO: 407805 - DNA, 25 bp, Mus musculus
caaaataggaactcactttcaaggg

SEQ ID NO: 407806 - DNA, 25 bp, Mus musculus
caaaatatccaaatgctggcgctgg

SEQ ID NO: 407807 - DNA, 25 bp, Mus musculus
caaaatatgtgaagcctctggtgca

SEQ ID NO: 407808 - DNA, 25 bp, Mus musculus
caaaatatgtgacccgaaggcatcg

SEQ ID NO: 407809 - DNA, 25 bp, Mus musculus
caaaatattgaaggtgtggccagga

SEQ ID NO: 407810 - DNA, 25 bp, Mus musculus
caaaatcaaagacatgccggaggag

SEQ ID NO: 407811 - DNA, 25 bp, Mus musculus
caaaatcacggatgcctagggcaca

SEQ ID NO: 407812 - DNA, 25 bp, Mus musculus
caaaatcactggcaagggcaagaag

SEQ ID NO: 407813 - DNA, 25 bp, Mus musculus
caaaatccacgacatggcagatggg

SEQ ID NO: 407814 - DNA, 25 bp, Mus musculus
caaaatcctgtacgcaccagtgggc

SEQ ID NO: 407815 - DNA, 25 bp, Mus musculus
caaaatctacttcatggctgggtca

SEQ ID NO: 407816 - DNA, 25 bp, Mus musculus
caaaatctgtcttgaggcctgagct

SEQ ID NO: 407817 - DNA, 25 bp, Mus musculus
caaaatctgtggctcggccttggag

SEQ ID NO: 407818 - DNA, 25 bp, Mus musculus
caaaatgaatgataccctgagagag

SEQ ID NO: 407819 - DNA, 25 bp, Mus musculus
caaaatgacttctgccgagctggac

SEQ ID NO: 407820 - DNA, 25 bp, Mus musculus
caaaatgagccagttgctgagggca

SEQ ID NO: 407821 - DNA, 25 bp, Mus musculus
caaaatgagctcagacttcagggag

SEQ ID NO: 407822 - DNA, 25 bp, Mus musculus
caaaatgattggaacagagaggtct

SEQ ID NO: 407823 - DNA, 25 bp, Mus musculus
caaaatgcatggtgacattgtagcc

SEQ ID NO: 407824 - DNA, 25 bp, Mus musculus
caaaatgctgatccggatgtggaca

SEQ ID NO: 407825 - DNA, 25 bp, Mus musculus
caaaatgctgcttgactgtggagtt

SEQ ID NO: 407826 - DNA, 25 bp, Mus musculus
caaaatgcttagacaacatcatggc

SEQ ID NO: 407827 - DNA, 25 bp, Mus musculus
caaaatggagacactggagatcgac

SEQ ID NO: 407828 - DNA, 25 bp, Mus musculus
caaaatggagcatggcgaggcagac

SEQ ID NO: 407829 - DNA, 25 bp, Mus musculus
caaaatggcggtgtgctaggctcct

SEQ ID NO: 407830 - DNA, 25 bp, Mus musculus
caaaatgggctccagctggttgtgc

SEQ ID NO: 407831 - DNA, 25 bp, Mus musculus
caaaatgggcttgacatgggatgcc

SEQ ID NO: 407832 - DNA, 25 bp, Mus musculus
caaaatggtgcaggtcttacaggcg

SEQ ID NO: 407833 - DNA, 25 bp, Mus musculus
caaaatggtgcttttccaacatttg

SEQ ID NO: 407834 - DNA, 25 bp, Mus musculus
caaaatgtggcttggtgactagaac

SEQ ID NO: 407835 - DNA, 25 bp, Mus musculus
caaaatgttccgaccgacagaagga

SEQ ID NO: 407836 - DNA, 25 bp, Mus musculus
caaaattacgtgactggcaccatga

SEQ ID NO: 407837 - DNA, 25 bp, Mus musculus
caaaattagacagatcagcagtgcc

SEQ ID NO: 407838 - DNA, 25 bp, Mus musculus
caaaattgactgtgtccgagtggcc

SEQ ID NO: 407839 - DNA, 25 bp, Mus musculus
caaaattgagagaaccgagagaact

SEQ ID NO: 407840 - DNA, 25 bp, Mus musculus
caaaattgcgcaagcatcctgggaa

SEQ ID NO: 407841 - DNA, 25 bp, Mus musculus
caaaattgcgttggtgccacctagg

SEQ ID NO: 407842 - DNA, 25 bp, Mus musculus
caaaatttatgcctaggaaatgtgc

SEQ ID NO: 407843 - DNA, 25 bp, Mus musculus
caaaatttctcagacactgagctac

SEQ ID NO: 407844 - DNA, 25 bp, Mus musculus
caaaatttgagtccctggctgacga

SEQ ID NO: 407845 - DNA, 25 bp, Mus musculus
caaacaaaatattgaaggtgtggcc

SEQ ID NO: 407846 - DNA, 25 bp, Mus musculus
caaacaaacacagatgacaaccggc

SEQ ID NO: 407847 - DNA, 25 bp, Mus musculus
caaacaaacttgtttacgggcacag

SEQ ID NO: 407848 - DNA, 25 bp, Mus musculus
caaacaaagggatagccactgctga

SEQ ID NO: 407849 - DNA, 25 bp, Mus musculus
caaacaacagtgtctggctcagaag

SEQ ID NO: 407850 - DNA, 25 bp, Mus musculus
caaacaacatggcttcaggacaaca

SEQ ID NO: 407851 - DNA, 25 bp, Mus musculus
caaacaacgttctgcggaggtggag

SEQ ID NO: 407852 - DNA, 25 bp, Mus musculus
caaacaacttaacttgacatcgcaa

SEQ ID NO: 407853 - DNA, 25 bp, Mus musculus
caaacaagaacaactgacaaggagc

SEQ ID NO: 407854 - DNA, 25 bp, Mus musculus
caaacaagagacacaggagggcaaa

SEQ ID NO: 407855 - DNA, 25 bp, Mus musculus
caaacaagcaatgtaaccgtggatg

SEQ ID NO: 407856 - DNA, 25 bp, Mus musculus
caaacaagcccgtgagtgtcaaggt

SEQ ID NO: 407857 - DNA, 25 bp, Mus musculus
caaacaaggaatgaggcagcactga

SEQ ID NO: 407858 - DNA, 25 bp, Mus musculus
caaacaaggtagtgtcagtgtgggc

SEQ ID NO: 407859 - DNA, 25 bp, Mus musculus
caaacaagtttatctgctccggccg

SEQ ID NO: 407860 - DNA, 25 bp, Mus musculus
caaacaatctgtgactatcaagacc

SEQ ID NO: 407861 - DNA, 25 bp, Mus musculus
caaacaatgatgaagacgggcaagc

SEQ ID NO: 407862 - DNA, 25 bp, Mus musculus
caaacaatggattctgactcggact

SEQ ID NO: 407863 - DNA, 25 bp, Mus musculus
caaacacacaagaaccctctgaggc

SEQ ID NO: 407864 - DNA, 25 bp, Mus musculus
caaacacacgggactgtaggaacct

SEQ ID NO: 407865 - DNA, 25 bp, Mus musculus
caaacacagactggttaataaagtc

SEQ ID NO: 407866 - DNA, 25 bp, Mus musculus
caaacacagcccagtgctgagctgg

SEQ ID NO: 407867 - DNA, 25 bp, Mus musculus
caaacacagtcgttgcggctgccat

SEQ ID NO: 407868 - DNA, 25 bp, Mus musculus
caaacaccagtaggctctggccatg

SEQ ID NO: 407869 - DNA, 25 bp, Mus musculus
caaacactaaatatgggcctggcta

SEQ ID NO: 407870 - DNA, 25 bp, Mus musculus
caaacactctatctgttcagtcaag

SEQ ID NO: 407871 - DNA, 25 bp, Mus musculus
caaacacttgttggtggaaacgagc

SEQ ID NO: 407872 - DNA, 25 bp, Mus musculus
caaacagaacgtggtaccctgaggt

SEQ ID NO: 407873 - DNA, 25 bp, Mus musculus
caaacagaagtctgttttatttctg

SEQ ID NO: 407874 - DNA, 25 bp, Mus musculus
caaacagatgtcttttctcaggagc

SEQ ID NO: 407875 - DNA, 25 bp, Mus musculus
caaacagcaaagtaccctggaggag

SEQ ID NO: 407876 - DNA, 25 bp, Mus musculus
caaacagcgtggtcaagtatgagct

SEQ ID NO: 407877 - DNA, 25 bp, Mus musculus
caaacagctcacaaaggttaggtca

SEQ ID NO: 407878 - DNA, 25 bp, Mus musculus
caaacagctgcagggttcaaggcct

SEQ ID NO: 407879 - DNA, 25 bp, Mus musculus
caaacagctggtgcagtacatctac

SEQ ID NO: 407880 - DNA, 25 bp, Mus musculus
caaacagcttcaagaggccattggg

SEQ ID NO: 407881 - DNA, 25 bp, Mus musculus
caaacagcttgtcagggcgttggtc

SEQ ID NO: 407882 - DNA, 25 bp, Mus musculus
caaacaggaaggagttcaagttcct

SEQ ID NO: 407883 - DNA, 25 bp, Mus musculus
caaacaggagctatggatgacacca

SEQ ID NO: 407884 - DNA, 25 bp, Mus musculus
caaacaggattgcaaggagctccag

SEQ ID NO: 407885 - DNA, 25 bp, Mus musculus
caaacaggtcgtggatgtgttctcc

SEQ ID NO: 407886 - DNA, 25 bp, Mus musculus
caaacaggtgtggagaagtcccttc

SEQ ID NO: 407887 - DNA, 25 bp, Mus musculus
caaacaggttcaaagggatccaagc

SEQ ID NO: 407888 - DNA, 25 bp, Mus musculus
caaacagtgttcaaatgcccagcca

SEQ ID NO: 407889 - DNA, 25 bp, Mus musculus
caaacagttgcgtaaagagtcccag

SEQ ID NO: 407890 - DNA, 25 bp, Mus musculus
caaacatagactggaggtgcataca

SEQ ID NO: 407891 - DNA, 25 bp, Mus musculus
caaacataggcaaaccacaggctgt

SEQ ID NO: 407892 - DNA, 25 bp, Mus musculus
caaacatcaggcctcacacggatag

SEQ ID NO: 407893 - DNA, 25 bp, Mus musculus
caaacatcgaagagtattaattaca

SEQ ID NO: 407894 - DNA, 25 bp, Mus musculus
caaacatctttcgagggtcagtgac

SEQ ID NO: 407895 - DNA, 25 bp, Mus musculus
caaacatgagtccagggagagcttc

SEQ ID NO: 407896 - DNA, 25 bp, Mus musculus
caaacatggactctcctaaggccgt

SEQ ID NO: 407897 - DNA, 25 bp, Mus musculus
caaacatggcactgagtaggacccg

SEQ ID NO: 407898 - DNA, 25 bp, Mus musculus
caaacatgggcaggagcatcttggc

SEQ ID NO: 407899 - DNA, 25 bp, Mus musculus
caaacatgggcctgcagtaacgtca

SEQ ID NO: 407900 - DNA, 25 bp, Mus musculus
caaacatgggcgtactggaaggctg

SEQ ID NO: 407901 - DNA, 25 bp, Mus musculus
caaacatggtgtcctccttgggaag

SEQ ID NO: 407902 - DNA, 25 bp, Mus musculus
caaacatgtgaagaaggccatcaga

SEQ ID NO: 407903 - DNA, 25 bp, Mus musculus
caaacattgtgagagtctttctgtc

SEQ ID NO: 407904 - DNA, 25 bp, Mus musculus
caaacattgtggacctgaagaccga

SEQ ID NO: 407905 - DNA, 25 bp, Mus musculus
caaacatttggactgagacttggga

SEQ ID NO: 407906 - DNA, 25 bp, Mus musculus
caaacatttgtgaaacggctgcctc

SEQ ID NO: 407907 - DNA, 25 bp, Mus musculus
caaaccaaaagtgagccgtagtcgg

SEQ ID NO: 407908 - DNA, 25 bp, Mus musculus
caaaccaatgtgagaggctgcctag

SEQ ID NO: 407909 - DNA, 25 bp, Mus musculus
caaaccaatttggtgtcagaagcca

SEQ ID NO: 407910 - DNA, 25 bp, Mus musculus
caaaccactgctatgtactgactga

SEQ ID NO: 407911 - DNA, 25 bp, Mus musculus
caaaccactgctcaggaatcccaga

SEQ ID NO: 407912 - DNA, 25 bp, Mus musculus
caaaccagcagttggtaccagtggg

SEQ ID NO: 407913 - DNA, 25 bp, Mus musculus
caaaccaggcagacaggatgaaact

SEQ ID NO: 407914 - DNA, 25 bp, Mus musculus
caaaccagggatgtgaggatgacac

SEQ ID NO: 407915 - DNA, 25 bp, Mus musculus
caaaccaggtacatctccgacatgc

SEQ ID NO: 407916 - DNA, 25 bp, Mus musculus
caaaccatgactgttttatcttggc

SEQ ID NO: 407917 - DNA, 25 bp, Mus musculus
caaaccatgcctcttgccagtaact

SEQ ID NO: 407918 - DNA, 25 bp, Mus musculus
caaaccatgtgtggttgccaagcca

SEQ ID NO: 407919 - DNA, 25 bp, Mus musculus
caaaccattgtgttcatatcttaaa

SEQ ID NO: 407920 - DNA, 25 bp, Mus musculus
caaacccaggccatgtcaaagagta

SEQ ID NO: 407921 - DNA, 25 bp, Mus musculus
caaacccagtttatgcggagggcgc

SEQ ID NO: 407922 - DNA, 25 bp, Mus musculus
caaacccataactgcttgaaggtgc

SEQ ID NO: 407923 - DNA, 25 bp, Mus musculus
caaacccctaggcagtgatgacagc

SEQ ID NO: 407924 - DNA, 25 bp, Mus musculus
caaacccctgagttcacatgttaaa

SEQ ID NO: 407925 - DNA, 25 bp, Mus musculus
caaacccgatgagcaagaagtgact

SEQ ID NO: 407926 - DNA, 25 bp, Mus musculus
caaaccctggctgggattgcggagc

SEQ ID NO: 407927 - DNA, 25 bp, Mus musculus
caaaccctgtgaaggatctgcctga

SEQ ID NO: 407928 - DNA, 25 bp, Mus musculus
caaacccttaggagactgaatcaga

SEQ ID NO: 407929 - DNA, 25 bp, Mus musculus
caaacccttggctatgtcgacgact

SEQ ID NO: 407930 - DNA, 25 bp, Mus musculus
caaaccggagaagacgggctttgct

SEQ ID NO: 407931 - DNA, 25 bp, Mus musculus
caaaccggcccttggatgaagaaag

SEQ ID NO: 407932 - DNA, 25 bp, Mus musculus
caaaccggtttaatgagcagctgca

SEQ ID NO: 407933 - DNA, 25 bp, Mus musculus
caaacctaaggaaagtgcccgacag

SEQ ID NO: 407934 - DNA, 25 bp, Mus musculus
caaacctcaagatgtccgggtgggt

SEQ ID NO: 407935 - DNA, 25 bp, Mus musculus
caaacctcagtggtggttctgtggt

SEQ ID NO: 407936 - DNA, 25 bp, Mus musculus
caaacctccactaataccggcgtga

SEQ ID NO: 407937 - DNA, 25 bp, Mus musculus
caaacctgccagaaagcttggtcca

SEQ ID NO: 407938 - DNA, 25 bp, Mus musculus
caaacctgctgtgcagttgaggcca

SEQ ID NO: 407939 - DNA, 25 bp, Mus musculus
caaacctggaagtgcctcttcaggg

SEQ ID NO: 407940 - DNA, 25 bp, Mus musculus
caaacctggatggtggtgtccctag

SEQ ID NO: 407941 - DNA, 25 bp, Mus musculus
caaacctgtcactgtgggaagcagc

SEQ ID NO: 407942 - DNA, 25 bp, Mus musculus
caaacctgtgatttcacctgcaaaa

SEQ ID NO: 407943 - DNA, 25 bp, Mus musculus
caaaccttaggagacgatcacgatc

SEQ ID NO: 407944 - DNA, 25 bp, Mus musculus
caaaccttgcagagcagttagagca

SEQ ID NO: 407945 - DNA, 25 bp, Mus musculus
caaaccttgtgcgactatggaccat

SEQ ID NO: 407946 - DNA, 25 bp, Mus musculus
caaacctttttctggattggaatgc

SEQ ID NO: 407947 - DNA, 25 bp, Mus musculus
caaacctttttggagtgctagccct

SEQ ID NO: 407948 - DNA, 25 bp, Mus musculus
caaacgaaaacagtactcaggagca

SEQ ID NO: 407949 - DNA, 25 bp, Mus musculus
caaacgaagggtcatgcctgtggcc

SEQ ID NO: 407950 - DNA, 25 bp, Mus musculus
caaacgaatcgtagggctggagaga

SEQ ID NO: 407951 - DNA, 25 bp, Mus musculus
caaacgagccaaacgagactcctcg

SEQ ID NO: 407952 - DNA, 25 bp, Mus musculus
caaacgaggccgagatgacttccaa

SEQ ID NO: 407953 - DNA, 25 bp, Mus musculus
caaacgatgaaaaggccagggctga

SEQ ID NO: 407954 - DNA, 25 bp, Mus musculus
caaacgcaagcagtggttcagtcca

SEQ ID NO: 407955 - DNA, 25 bp, Mus musculus
caaacgcagcattcttgataggtgc

SEQ ID NO: 407956 - DNA, 25 bp, Mus musculus
caaacgcatcaaagtggaggccagc

SEQ ID NO: 407957 - DNA, 25 bp, Mus musculus
caaacgcgagctcagaatacatgga

SEQ ID NO: 407958 - DNA, 25 bp, Mus musculus
caaacgcgccgtggagaaactcatt

SEQ ID NO: 407959 - DNA, 25 bp, Mus musculus
caaacgcgctcgacctctgtgtgta

SEQ ID NO: 407960 - DNA, 25 bp, Mus musculus
caaacgcgctgtgtctgaacatcag

SEQ ID NO: 407961 - DNA, 25 bp, Mus musculus
caaacgcgttttgcaggtcgctagc

SEQ ID NO: 407962 - DNA, 25 bp, Mus musculus
caaacgctgcgtggacattggcatg

SEQ ID NO: 407963 - DNA, 25 bp, Mus musculus
caaacgctggcaagagaacacgagc

SEQ ID NO: 407964 - DNA, 25 bp, Mus musculus
caaacgcttcgattacgatgacaag

SEQ ID NO: 407965 - DNA, 25 bp, Mus musculus
caaacgcttgactgttcactggagg

SEQ ID NO: 407966 - DNA, 25 bp, Mus musculus
caaacggaagaccattctgacaacg

SEQ ID NO: 407967 - DNA, 25 bp, Mus musculus
caaacggagcctgcggtgattactc

SEQ ID NO: 407968 - DNA, 25 bp, Mus musculus
caaacggatttatttagagctgcgg

SEQ ID NO: 407969 - DNA, 25 bp, Mus musculus
caaacggctgtttcagaggtcccct

SEQ ID NO: 407970 - DNA, 25 bp, Mus musculus
caaacgggtatctcatgtctcaggg

SEQ ID NO: 407971 - DNA, 25 bp, Mus musculus
caaacggtggtggaaatagatgcgc

SEQ ID NO: 407972 - DNA, 25 bp, Mus musculus
caaacggtgtctcctcagtcagcta

SEQ ID NO: 407973 - DNA, 25 bp, Mus musculus
caaacggtgttcaattttccagcaa

SEQ ID NO: 407974 - DNA, 25 bp, Mus musculus
caaacgtacggatcctgcaggaagc

SEQ ID NO: 407975 - DNA, 25 bp, Mus musculus
caaacgtagcccatgcagatggcca

SEQ ID NO: 407976 - DNA, 25 bp, Mus musculus
caaacgtcacggtgagatgagacag

SEQ ID NO: 407977 - DNA, 25 bp, Mus musculus
caaacgtgctgggtggccaaatcag

SEQ ID NO: 407978 - DNA, 25 bp, Mus musculus
caaacgtggtgtctggctcaggatc

SEQ ID NO: 407979 - DNA, 25 bp, Mus musculus
caaacgtgtgtacttcggcctgaga

SEQ ID NO: 407980 - DNA, 25 bp, Mus musculus
caaacgttcagtatagccatgggac

SEQ ID NO: 407981 - DNA, 25 bp, Mus musculus
caaactaactagagcagcggaagcc

SEQ ID NO: 407982 - DNA, 25 bp, Mus musculus
caaactaccctcaggaatgcgctgg

SEQ ID NO: 407983 - DNA, 25 bp, Mus musculus
caaactacctagactgcctcgtgga

SEQ ID NO: 407984 - DNA, 25 bp, Mus musculus
caaactacgactggaaagggtcaag

SEQ ID NO: 407985 - DNA, 25 bp, Mus musculus
caaactactgggtcttaagagcgca

SEQ ID NO: 407986 - DNA, 25 bp, Mus musculus
caaactactgttcccgcaaggtgcg

SEQ ID NO: 407987 - DNA, 25 bp, Mus musculus
caaactagagtggatacaggaggac

SEQ ID NO: 407988 - DNA, 25 bp, Mus musculus
caaactatagagtgctgccgactgc

SEQ ID NO: 407989 - DNA, 25 bp, Mus musculus
caaactatgcatggacggacacgtg

SEQ ID NO: 407990 - DNA, 25 bp, Mus musculus
caaactcaaagtgggcgaccgtatc

SEQ ID NO: 407991 - DNA, 25 bp, Mus musculus
caaactcaaatgaccttgcaggctc

SEQ ID NO: 407992 - DNA, 25 bp, Mus musculus
caaactcacggcagttccaggcttc

SEQ ID NO: 407993 - DNA, 25 bp, Mus musculus
caaactcagtatttcccggactgta

SEQ ID NO: 407994 - DNA, 25 bp, Mus musculus
caaactcagtccctggccaggaagt

SEQ ID NO: 407995 - DNA, 25 bp, Mus musculus
caaactcatgggtgggtctccgaga

SEQ ID NO: 407996 - DNA, 25 bp, Mus musculus
caaactcattgggttagccttggac

SEQ ID NO: 407997 - DNA, 25 bp, Mus musculus
caaactcccggctgaactgcaagag

SEQ ID NO: 407998 - DNA, 25 bp, Mus musculus
caaactccggctcgtcttgtcgcag

SEQ ID NO: 407999 - DNA, 25 bp, Mus musculus
caaactcgagaaggctgaagcgcaa

SEQ ID NO: 408000 - DNA, 25 bp, Mus musculus
caaactcggagactaactcagaacc

SEQ ID NO: 408001 - DNA, 25 bp, Mus musculus
caaactcggattgctaaacttccag

SEQ ID NO: 408002 - DNA, 25 bp, Mus musculus
caaactcggcgtgaacgtttaactg

SEQ ID NO: 408003 - DNA, 25 bp, Mus musculus
caaactcgtttgtgcttggctccag

SEQ ID NO: 408004 - DNA, 25 bp, Mus musculus
caaactctcagactctgtggaagag

SEQ ID NO: 408005 - DNA, 25 bp, Mus musculus
caaactctgtaatcatgaaaatctg

SEQ ID NO: 408006 - DNA, 25 bp, Mus musculus
caaactgaaaacattctagtggcca

SEQ ID NO: 408007 - DNA, 25 bp, Mus musculus
caaactgaaaatagacaggaatcct

SEQ ID NO: 408008 - DNA, 25 bp, Mus musculus
caaactgacctttgctcaggcggga

SEQ ID NO: 408009 - DNA, 25 bp, Mus musculus
caaactgactgactatcgtgggaaa

SEQ ID NO: 408010 - DNA, 25 bp, Mus musculus
caaactgagatttaaccgtaagaag

SEQ ID NO: 408011 - DNA, 25 bp, Mus musculus
caaactgaggaccaccgggtggcta

SEQ ID NO: 408012 - DNA, 25 bp, Mus musculus
caaactgaggtacactctagaagcg

SEQ ID NO: 408013 - DNA, 25 bp, Mus musculus
caaactgaggttcaataggtggttc

SEQ ID NO: 408014 - DNA, 25 bp, Mus musculus
caaactgagtaagtcgggtcaacca

SEQ ID NO: 408015 - DNA, 25 bp, Mus musculus
caaactgatttaccggcactatgcc

SEQ ID NO: 408016 - DNA, 25 bp, Mus musculus
caaactgcagacactcggagggtgg

SEQ ID NO: 408017 - DNA, 25 bp, Mus musculus
caaactgcagatgattgaggtgcct

SEQ ID NO: 408018 - DNA, 25 bp, Mus musculus
caaactgcatagagctgaccgagaa

SEQ ID NO: 408019 - DNA, 25 bp, Mus musculus
caaactgcatatcgtggacctgtct

SEQ ID NO: 408020 - DNA, 25 bp, Mus musculus
caaactgccccggttcaagatagaa

SEQ ID NO: 408021 - DNA, 25 bp, Mus musculus
caaactgccctgctccttggagagg

SEQ ID NO: 408022 - DNA, 25 bp, Mus musculus
caaactgcggaagaaatggaagggc

SEQ ID NO: 408023 - DNA, 25 bp, Mus musculus
caaactgcttctgctcgatgtgctc

SEQ ID NO: 408024 - DNA, 25 bp, Mus musculus
caaactgcttgagtgccatgggaca

SEQ ID NO: 408025 - DNA, 25 bp, Mus musculus
caaactggaaaaagctcgactggca

SEQ ID NO: 408026 - DNA, 25 bp, Mus musculus
caaactggaaactgtgaaatgggct

SEQ ID NO: 408027 - DNA, 25 bp, Mus musculus
caaactggatggctttttcgggaag

SEQ ID NO: 408028 - DNA, 25 bp, Mus musculus
caaactggcttgaaatggtgacact

SEQ ID NO: 408029 - DNA, 25 bp, Mus musculus
caaactggtggctgaggtgtccctg

SEQ ID NO: 408030 - DNA, 25 bp, Mus musculus
caaactgtcgtaggaactatgctcg

SEQ ID NO: 408031 - DNA, 25 bp, Mus musculus
caaactgtgaagacgatggaagcca

SEQ ID NO: 408032 - DNA, 25 bp, Mus musculus
caaactgtgagagtgatcgggaacg

SEQ ID NO: 408033 - DNA, 25 bp, Mus musculus
caaactgtgggaacgtgagcaacgc

SEQ ID NO: 408034 - DNA, 25 bp, Mus musculus
caaactgtggtctctggccgagatc

SEQ ID NO: 408035 - DNA, 25 bp, Mus musculus
caaacttacaaatatgcgccgctca

SEQ ID NO: 408036 - DNA, 25 bp, Mus musculus
caaacttcattgtgctcagactggt

SEQ ID NO: 408037 - DNA, 25 bp, Mus musculus
caaacttccacctgattgagcggga

SEQ ID NO: 408038 - DNA, 25 bp, Mus musculus
caaacttcccaggagcggccggagg

SEQ ID NO: 408039 - DNA, 25 bp, Mus musculus
caaacttcctgaaatccgtggacga

SEQ ID NO: 408040 - DNA, 25 bp, Mus musculus
caaacttcctgccagtttgtctgtc

SEQ ID NO: 408041 - DNA, 25 bp, Mus musculus
caaacttcgaccttcagcggaggag

SEQ ID NO: 408042 - DNA, 25 bp, Mus musculus
caaacttgaacagctcgtgaaccag

SEQ ID NO: 408043 - DNA, 25 bp, Mus musculus
caaacttgagcaccgattccgctgg

SEQ ID NO: 408044 - DNA, 25 bp, Mus musculus
caaacttgttgtctgatgaggagcg

SEQ ID NO: 408045 - DNA, 25 bp, Mus musculus
caaactttaagtagctgcttatgag

SEQ ID NO: 408046 - DNA, 25 bp, Mus musculus
caaactttatagatttatacagggc

SEQ ID NO: 408047 - DNA, 25 bp, Mus musculus
caaactttgagagcatgtccctggg

SEQ ID NO: 408048 - DNA, 25 bp, Mus musculus
caaacttttctgttcctacattagg

SEQ ID NO: 408049 - DNA, 25 bp, Mus musculus
caaagaaaagaccttccacggctgg

SEQ ID NO: 408050 - DNA, 25 bp, Mus musculus
caaagaaaagagtaggcatcagagc

SEQ ID NO: 408051 - DNA, 25 bp, Mus musculus
caaagaaacatcaccgaggaggcgc

SEQ ID NO: 408052 - DNA, 25 bp, Mus musculus
caaagaaaggcacgatgagctctcc

SEQ ID NO: 408053 - DNA, 25 bp, Mus musculus
caaagaaatgaagacctttggtcct

SEQ ID NO: 408054 - DNA, 25 bp, Mus musculus
caaagaacaaagtcgggtgcacctg

SEQ ID NO: 408055 - DNA, 25 bp, Mus musculus
caaagaacacggtcccagggactca

SEQ ID NO: 408056 - DNA, 25 bp, Mus musculus
caaagaacatgatgcgaaaggccac

SEQ ID NO: 408057 - DNA, 25 bp, Mus musculus
caaagaaccgctgatttggtccggc

SEQ ID NO: 408058 - DNA, 25 bp, Mus musculus
caaagaactgacatacgcttaagtg

SEQ ID NO: 408059 - DNA, 25 bp, Mus musculus
caaagaagaaaaggtgggtcagcca

SEQ ID NO: 408060 - DNA, 25 bp, Mus musculus
caaagaagaataaacccgagtggcg

SEQ ID NO: 408061 - DNA, 25 bp, Mus musculus
caaagaagctgtggacctgcgggat

SEQ ID NO: 408062 - DNA, 25 bp, Mus musculus
caaagaaggatatatagctgcgcac

SEQ ID NO: 408063 - DNA, 25 bp, Mus musculus
caaagaagggcagtggtcttcccca

SEQ ID NO: 408064 - DNA, 25 bp, Mus musculus
caaagaagggcatggaagtctgcgc

SEQ ID NO: 408065 - DNA, 25 bp, Mus musculus
caaagaaggtggtccttagctcggc

SEQ ID NO: 408066 - DNA, 25 bp, Mus musculus
caaagaagtccaggtcacttggcgc

SEQ ID NO: 408067 - DNA, 25 bp, Mus musculus
caaagaagtgttttcagtgagtcaa

SEQ ID NO: 408068 - DNA, 25 bp, Mus musculus
caaagaatattacctcggaggccac

SEQ ID NO: 408069 - DNA, 25 bp, Mus musculus
caaagaatccctgtggagccactga

SEQ ID NO: 408070 - DNA, 25 bp, Mus musculus
caaagaatctcagcaacctaagcag

SEQ ID NO: 408071 - DNA, 25 bp, Mus musculus
caaagaatggaaaagtgccctggca

SEQ ID NO: 408072 - DNA, 25 bp, Mus musculus
caaagaatgtgaaatgcagaccatg

SEQ ID NO: 408073 - DNA, 25 bp, Mus musculus
caaagaattaggtgaccacgtgcac

SEQ ID NO: 408074 - DNA, 25 bp, Mus musculus
caaagaattgggagtcacacagcac

SEQ ID NO: 408075 - DNA, 25 bp, Mus musculus
caaagacaaagcagggcccgagaaa

SEQ ID NO: 408076 - DNA, 25 bp, Mus musculus
caaagacaagagttgtgagcacgtc

SEQ ID NO: 408077 - DNA, 25 bp, Mus musculus
caaagacaagcggagaatcgtgagc

SEQ ID NO: 408078 - DNA, 25 bp, Mus musculus
caaagacaattcatagcctgtggtc

SEQ ID NO: 408079 - DNA, 25 bp, Mus musculus
caaagacagcaagagcacctgggtg

SEQ ID NO: 408080 - DNA, 25 bp, Mus musculus
caaagacagctgtaagcccatcgat

SEQ ID NO: 408081 - DNA, 25 bp, Mus musculus
caaagacagctttgagtagaaaagc

SEQ ID NO: 408082 - DNA, 25 bp, Mus musculus
caaagacagggaatgaacaacgggc

SEQ ID NO: 408083 - DNA, 25 bp, Mus musculus
caaagacagtagtaggtatctaggg

SEQ ID NO: 408084 - DNA, 25 bp, Mus musculus
caaagacagtatttgcccggagagg

SEQ ID NO: 408085 - DNA, 25 bp, Mus musculus
caaagacagtgggtagccttgtgca

SEQ ID NO: 408086 - DNA, 25 bp, Mus musculus
caaagacatctaaccagtgtaagaa

SEQ ID NO: 408087 - DNA, 25 bp, Mus musculus
caaagacattggaaaggagcccgct

SEQ ID NO: 408088 - DNA, 25 bp, Mus musculus
caaagaccgcctttcttcttccttg

SEQ ID NO: 408089 - DNA, 25 bp, Mus musculus
caaagacctcatgggcttcgggacc

SEQ ID NO: 408090 - DNA, 25 bp, Mus musculus
caaagaccttggatggagtcagggc

SEQ ID NO: 408091 - DNA, 25 bp, Mus musculus
caaagacgtggcagtagtgcagcgc

SEQ ID NO: 408092 - DNA, 25 bp, Mus musculus
caaagacgttttgaagctctgcaca

SEQ ID NO: 408093 - DNA, 25 bp, Mus musculus
caaagactcatgctcttgggaggcc

SEQ ID NO: 408094 - DNA, 25 bp, Mus musculus
caaagactcttggaccgtgtggttc

SEQ ID NO: 408095 - DNA, 25 bp, Mus musculus
caaagactgaatggcaagaccctca

SEQ ID NO: 408096 - DNA, 25 bp, Mus musculus
caaagactgcagaataggcgtttcg

SEQ ID NO: 408097 - DNA, 25 bp, Mus musculus
caaagactggttttctgccagggac

SEQ ID NO: 408098 - DNA, 25 bp, Mus musculus
caaagactgtccaaatggattgcgt

SEQ ID NO: 408099 - DNA, 25 bp, Mus musculus
caaagacttcaaacaagacggagag

SEQ ID NO: 408100 - DNA, 25 bp, Mus musculus
caaagacttccccagaggcatgtta

SEQ ID NO: 408101 - DNA, 25 bp, Mus musculus
caaagactttggtatttaatagttg

SEQ ID NO: 408102 - DNA, 25 bp, Mus musculus
caaagagaaactgctccggcaaatg

SEQ ID NO: 408103 - DNA, 25 bp, Mus musculus
caaagagaacattcagactcaggct

SEQ ID NO: 408104 - DNA, 25 bp, Mus musculus
caaagagaaccaatggtgtgaagag

SEQ ID NO: 408105 - DNA, 25 bp, Mus musculus
caaagagaagaagctcccgctgggt

SEQ ID NO: 408106 - DNA, 25 bp, Mus musculus
caaagagaatgtggacgtgccgctg

SEQ ID NO: 408107 - DNA, 25 bp, Mus musculus
caaagagaatgttctggaccgagct

SEQ ID NO: 408108 - DNA, 25 bp, Mus musculus
caaagagacaagaaagggataccca

SEQ ID NO: 408109 - DNA, 25 bp, Mus musculus
caaagagacctgagttgtgctggca

SEQ ID NO: 408110 - DNA, 25 bp, Mus musculus
caaagagactccctctgtgaatgta

SEQ ID NO: 408111 - DNA, 25 bp, Mus musculus
caaagagacttgtacagacggaatc

SEQ ID NO: 408112 - DNA, 25 bp, Mus musculus
caaagagagacagagccatgtaggc

SEQ ID NO: 408113 - DNA, 25 bp, Mus musculus
caaagagagcctaccgtgaactcgt

SEQ ID NO: 408114 - DNA, 25 bp, Mus musculus
caaagagaggcacacttcctggtgg

SEQ ID NO: 408115 - DNA, 25 bp, Mus musculus
caaagagatgtaagtggcgacctgc

SEQ ID NO: 408116 - DNA, 25 bp, Mus musculus
caaagagatgtagctataatacaca

SEQ ID NO: 408117 - DNA, 25 bp, Mus musculus
caaagagcaaacacaggaggagatt

SEQ ID NO: 408118 - DNA, 25 bp, Mus musculus
caaagagcaaggattgggtgaaacc

SEQ ID NO: 408119 - DNA, 25 bp, Mus musculus
caaagagcaatttcaaagatgtact

SEQ ID NO: 408120 - DNA, 25 bp, Mus musculus
caaagagcagcgttcctgagactgg

SEQ ID NO: 408121 - DNA, 25 bp, Mus musculus
caaagagcagtcgtgtggtgaccgc

SEQ ID NO: 408122 - DNA, 25 bp, Mus musculus
caaagagcatttgggtaatttctga

SEQ ID NO: 408123 - DNA, 25 bp, Mus musculus
caaagagcccagtagagaaaacatg

SEQ ID NO: 408124 - DNA, 25 bp, Mus musculus
caaagagcccggttgcgtcgagccg

SEQ ID NO: 408125 - DNA, 25 bp, Mus musculus
caaagagcccttgatcgggaacagg

SEQ ID NO: 408126 - DNA, 25 bp, Mus musculus
caaagagccgaagatgccagcaagt

SEQ ID NO: 408127 - DNA, 25 bp, Mus musculus
caaagagcctaggtcaatgaagctt

SEQ ID NO: 408128 - DNA, 25 bp, Mus musculus
caaagagcgtcctgagtgttcccaa

SEQ ID NO: 408129 - DNA, 25 bp, Mus musculus
caaagagctgccctgcaaagatggg

SEQ ID NO: 408130 - DNA, 25 bp, Mus musculus
caaagagctgggacttcggaactcc

SEQ ID NO: 408131 - DNA, 25 bp, Mus musculus
caaagagctgtgtagcacaattcac

SEQ ID NO: 408132 - DNA, 25 bp, Mus musculus
caaagagcttcagtggtcaaggcca

SEQ ID NO: 408133 - DNA, 25 bp, Mus musculus
caaagaggaacagcgggactatgtc

SEQ ID NO: 408134 - DNA, 25 bp, Mus musculus
caaagaggacttgcaaaggagtctc

SEQ ID NO: 408135 - DNA, 25 bp, Mus musculus
caaagaggagcaacagactcaggtc

SEQ ID NO: 408136 - DNA, 25 bp, Mus musculus
caaagaggatccaggtgacgtggca

SEQ ID NO: 408137 - DNA, 25 bp, Mus musculus
caaagaggatgctccattggcgact

SEQ ID NO: 408138 - DNA, 25 bp, Mus musculus
caaagagggacatgcaggaaaattt

SEQ ID NO: 408139 - DNA, 25 bp, Mus musculus
caaagaggtatgtgttccccagcac

SEQ ID NO: 408140 - DNA, 25 bp, Mus musculus
caaagaggtgtcctattgccggcaa

SEQ ID NO: 408141 - DNA, 25 bp, Mus musculus
caaagagtcagggaagtatcttcac

SEQ ID NO: 408142 - DNA, 25 bp, Mus musculus
caaagagtctgctccctaaccagtg

SEQ ID NO: 408143 - DNA, 25 bp, Mus musculus
caaagagtgagtataggctggacct

SEQ ID NO: 408144 - DNA, 25 bp, Mus musculus
caaagagtgctaagctccaggctca

SEQ ID NO: 408145 - DNA, 25 bp, Mus musculus
caaagagtggtgacccaatcgccaa

SEQ ID NO: 408146 - DNA, 25 bp, Mus musculus
caaagagttccgtagcaagcaggac

SEQ ID NO: 408147 - DNA, 25 bp, Mus musculus
caaagagtttcagcatcgacagcat

SEQ ID NO: 408148 - DNA, 25 bp, Mus musculus
caaagagtttctagatgctggccag

SEQ ID NO: 408149 - DNA, 25 bp, Mus musculus
caaagagttttgatcagctgacacc

SEQ ID NO: 408150 - DNA, 25 bp, Mus musculus
caaagatactgaggcatccacaggg

SEQ ID NO: 408151 - DNA, 25 bp, Mus musculus
caaagatactggagtactgactccc

SEQ ID NO: 408152 - DNA, 25 bp, Mus musculus
caaagatactttcagtcccgatgag

SEQ ID NO: 408153 - DNA, 25 bp, Mus musculus
caaagataggcatatttgcagttca

SEQ ID NO: 408154 - DNA, 25 bp, Mus musculus
caaagatcaaatgtactcggacggc

SEQ ID NO: 408155 - DNA, 25 bp, Mus musculus
caaagatcagagaagactcgagacc

SEQ ID NO: 408156 - DNA, 25 bp, Mus musculus
caaagatccctcttgtggtcaggag

SEQ ID NO: 408157 - DNA, 25 bp, Mus musculus
caaagatctctgtgtcttagctaca

SEQ ID NO: 408158 - DNA, 25 bp, Mus musculus
caaagatctgcactgtggacggcat

SEQ ID NO: 408159 - DNA, 25 bp, Mus musculus
caaagatctggagttagggtagcct

SEQ ID NO: 408160 - DNA, 25 bp, Mus musculus
caaagatcttcacgtgtagctcgga

SEQ ID NO: 408161 - DNA, 25 bp, Mus musculus
caaagatgaatatgagaagctcgcg

SEQ ID NO: 408162 - DNA, 25 bp, Mus musculus
caaagatgagattccctacctgcgg

SEQ ID NO: 408163 - DNA, 25 bp, Mus musculus
caaagatgcaggacagagaaccacc

SEQ ID NO: 408164 - DNA, 25 bp, Mus musculus
caaagatgccttttctaccgtagaa

SEQ ID NO: 408165 - DNA, 25 bp, Mus musculus
caaagatgctctacggtttctgggc

SEQ ID NO: 408166 - DNA, 25 bp, Mus musculus
caaagatgcttcctctagtccagaa

SEQ ID NO: 408167 - DNA, 25 bp, Mus musculus
caaagatggccaggttcgccgagta

SEQ ID NO: 408168 - DNA, 25 bp, Mus musculus
caaagatgggtggaaagtatcaaat

SEQ ID NO: 408169 - DNA, 25 bp, Mus musculus
caaagatgtcatccgactgctggag

SEQ ID NO: 408170 - DNA, 25 bp, Mus musculus
caaagattagaggagaaagacccaa

SEQ ID NO: 408171 - DNA, 25 bp, Mus musculus
caaagattccggtggactgaaggca

SEQ ID NO: 408172 - DNA, 25 bp, Mus musculus
caaagattgctgtggaccgtgtcaa

SEQ ID NO: 408173 - DNA, 25 bp, Mus musculus
caaagattggacatgcctgctaagg

SEQ ID NO: 408174 - DNA, 25 bp, Mus musculus
caaagcaaactacgttccaggagcc

SEQ ID NO: 408175 - DNA, 25 bp, Mus musculus
caaagcaacttaaggtacaagggat

SEQ ID NO: 408176 - DNA, 25 bp, Mus musculus
caaagcaacttgagtagaaaaggac

SEQ ID NO: 408177 - DNA, 25 bp, Mus musculus
caaagcaagatgtcaaagcggccag

SEQ ID NO: 408178 - DNA, 25 bp, Mus musculus
caaagcaagtgctaagacaggcagg

SEQ ID NO: 408179 - DNA, 25 bp, Mus musculus
caaagcaatgtgtgatcgatgaccg

SEQ ID NO: 408180 - DNA, 25 bp, Mus musculus
caaagcaccaactgtaaatccatgt

SEQ ID NO: 408181 - DNA, 25 bp, Mus musculus
caaagcacccgaaagaaccgagaga

SEQ ID NO: 408182 - DNA, 25 bp, Mus musculus
caaagcacggaacgagagattccag

SEQ ID NO: 408183 - DNA, 25 bp, Mus musculus
caaagcacggcttcgagtgacagga

SEQ ID NO: 408184 - DNA, 25 bp, Mus musculus
caaagcagcagggaatcagttctca

SEQ ID NO: 408185 - DNA, 25 bp, Mus musculus
caaagcagcccagggttctcggaga

SEQ ID NO: 408186 - DNA, 25 bp, Mus musculus
caaagcaggaagacaaagagcgccg

SEQ ID NO: 408187 - DNA, 25 bp, Mus musculus
caaagcaggtcggtaagttcacaga

SEQ ID NO: 408188 - DNA, 25 bp, Mus musculus
caaagcagtctttggtgggagacat

SEQ ID NO: 408189 - DNA, 25 bp, Mus musculus
caaagcagtgtagcctcttcaggaa

SEQ ID NO: 408190 - DNA, 25 bp, Mus musculus
caaagcagtgtctccgtggaagtct

SEQ ID NO: 408191 - DNA, 25 bp, Mus musculus
caaagcagtttccttgttttagaga

SEQ ID NO: 408192 - DNA, 25 bp, Mus musculus
caaagcagtttgtatctgaagcctg

SEQ ID NO: 408193 - DNA, 25 bp, Mus musculus
caaagcatagctaggaattgtcaac

SEQ ID NO: 408194 - DNA, 25 bp, Mus musculus
caaagcatcaggttgcagaatgggt

SEQ ID NO: 408195 - DNA, 25 bp, Mus musculus
caaagcatgcgtgtcagaggtcaac

SEQ ID NO: 408196 - DNA, 25 bp, Mus musculus
caaagcatgtcatacgcgagccaat

SEQ ID NO: 408197 - DNA, 25 bp, Mus musculus
caaagccaacagtcaatgagcagga

SEQ ID NO: 408198 - DNA, 25 bp, Mus musculus
caaagccaacatggttcgtcagcgg

SEQ ID NO: 408199 - DNA, 25 bp, Mus musculus
caaagccaatgagatgccagctcca

SEQ ID NO: 408200 - DNA, 25 bp, Mus musculus
caaagccagagtccttcagagagat

SEQ ID NO: 408201 - DNA, 25 bp, Mus musculus
caaagccagctatgagtctcggtcg

SEQ ID NO: 408202 - DNA, 25 bp, Mus musculus
caaagccagcttgaccacagtggga

SEQ ID NO: 408203 - DNA, 25 bp, Mus musculus
caaagccaggacaaggtaaataact

SEQ ID NO: 408204 - DNA, 25 bp, Mus musculus
caaagccaggctaagggaatctacc

SEQ ID NO: 408205 - DNA, 25 bp, Mus musculus
caaagccagggaggcgtagtatccc

SEQ ID NO: 408206 - DNA, 25 bp, Mus musculus
caaagccatgctgtagtaccggagg

SEQ ID NO: 408207 - DNA, 25 bp, Mus musculus
caaagccattcccagacagtcaagg

SEQ ID NO: 408208 - DNA, 25 bp, Mus musculus
caaagcccagcttacatgaaggagg

SEQ ID NO: 408209 - DNA, 25 bp, Mus musculus
caaagcccctattagcctcatgtgg

SEQ ID NO: 408210 - DNA, 25 bp, Mus musculus
caaagccctcgtggacatggcaaaa

SEQ ID NO: 408211 - DNA, 25 bp, Mus musculus
caaagccgatgatatgtgtgccaag

SEQ ID NO: 408212 - DNA, 25 bp, Mus musculus
caaagccggaggagtccagttctct

SEQ ID NO: 408213 - DNA, 25 bp, Mus musculus
caaagccgtattccagacagcagag

SEQ ID NO: 408214 - DNA, 25 bp, Mus musculus
caaagccgtgtcactgggatatcca

SEQ ID NO: 408215 - DNA, 25 bp, Mus musculus
caaagcctcatggttcctggacccc

SEQ ID NO: 408216 - DNA, 25 bp, Mus musculus
caaagcctccctcgtatgaaagtaa

SEQ ID NO: 408217 - DNA, 25 bp, Mus musculus
caaagcctgaattaatatcaccagt

SEQ ID NO: 408218 - DNA, 25 bp, Mus musculus
caaagcctgagggaaccgattctct

SEQ ID NO: 408219 - DNA, 25 bp, Mus musculus
caaagcctgcaagaggtggcgagac

SEQ ID NO: 408220 - DNA, 25 bp, Mus musculus
caaagcctgcgggaaactgaacttc

SEQ ID NO: 408221 - DNA, 25 bp, Mus musculus
caaagcctggcagaagacagcacaa

SEQ ID NO: 408222 - DNA, 25 bp, Mus musculus
caaagcctggtgactttccttggca

SEQ ID NO: 408223 - DNA, 25 bp, Mus musculus
caaagcctgtctgacactcgagtca

SEQ ID NO: 408224 - DNA, 25 bp, Mus musculus
caaagccttcttagtgactcccagg

SEQ ID NO: 408225 - DNA, 25 bp, Mus musculus
caaagcgaacgctgagaagacttcg

SEQ ID NO: 408226 - DNA, 25 bp, Mus musculus
caaagcgaagccaatccgtttctgg

SEQ ID NO: 408227 - DNA, 25 bp, Mus musculus
caaagcgaggcttgtgaatcacagt

SEQ ID NO: 408228 - DNA, 25 bp, Mus musculus
caaagcgcgagttattgattccggc

SEQ ID NO: 408229 - DNA, 25 bp, Mus musculus
caaagcggaagagcaggtcagctac

SEQ ID NO: 408230 - DNA, 25 bp, Mus musculus
caaagcggctattgtggcccgacac

SEQ ID NO: 408231 - DNA, 25 bp, Mus musculus
caaagcgggaagattagtgacggtc

SEQ ID NO: 408232 - DNA, 25 bp, Mus musculus
caaagcgggcaacgagaaagacgtc

SEQ ID NO: 408233 - DNA, 25 bp, Mus musculus
caaagcgggtgtgctcttggtctgc

SEQ ID NO: 408234 - DNA, 25 bp, Mus musculus
caaagcgtccgaagatcagaagtgc

SEQ ID NO: 408235 - DNA, 25 bp, Mus musculus
caaagctaaaagaagtggacgacgt

SEQ ID NO: 408236 - DNA, 25 bp, Mus musculus
caaagctagattgtcttaagaccta

SEQ ID NO: 408237 - DNA, 25 bp, Mus musculus
caaagctagcatgagggaattgggc

SEQ ID NO: 408238 - DNA, 25 bp, Mus musculus
caaagctagcccatgagtagtacgt

SEQ ID NO: 408239 - DNA, 25 bp, Mus musculus
caaagctccagggagcaggtctgct

SEQ ID NO: 408240 - DNA, 25 bp, Mus musculus
caaagctcctttaactctgtttctg

SEQ ID NO: 408241 - DNA, 25 bp, Mus musculus
caaagctcggataggagacctggac

SEQ ID NO: 408242 - DNA, 25 bp, Mus musculus
caaagctctggagaatgatgcagac

SEQ ID NO: 408243 - DNA, 25 bp, Mus musculus
caaagctctggctgtactcgccaag

SEQ ID NO: 408244 - DNA, 25 bp, Mus musculus
caaagctcttaaggcaatgactcga

SEQ ID NO: 408245 - DNA, 25 bp, Mus musculus
caaagctcttaatacctgtggttcc

SEQ ID NO: 408246 - DNA, 25 bp, Mus musculus
caaagctgacaaactccagagggag

SEQ ID NO: 408247 - DNA, 25 bp, Mus musculus
caaagctgactctagatcctgcacg

SEQ ID NO: 408248 - DNA, 25 bp, Mus musculus
caaagctgagtcttaatcaacttca

SEQ ID NO: 408249 - DNA, 25 bp, Mus musculus
caaagctgatgatctaattggtcct

SEQ ID NO: 408250 - DNA, 25 bp, Mus musculus
caaagctgccaaggacgtgctgggc

SEQ ID NO: 408251 - DNA, 25 bp, Mus musculus
caaagctgccattgttctagaggaa

SEQ ID NO: 408252 - DNA, 25 bp, Mus musculus
caaagctgctttcgaggctcacgtc

SEQ ID NO: 408253 - DNA, 25 bp, Mus musculus
caaagctgggaaagtgaacctcacc

SEQ ID NO: 408254 - DNA, 25 bp, Mus musculus
caaagctgggaacactaccgagagt

SEQ ID NO: 408255 - DNA, 25 bp, Mus musculus
caaagctgggtttcttctggccact

SEQ ID NO: 408256 - DNA, 25 bp, Mus musculus
caaagctggtcgtgattgtgccaca

SEQ ID NO: 408257 - DNA, 25 bp, Mus musculus
caaagctggtctgtgggagtgtctc

SEQ ID NO: 408258 - DNA, 25 bp, Mus musculus
caaagctgtagctgaaggaatccct

SEQ ID NO: 408259 - DNA, 25 bp, Mus musculus
caaagctgtccaaaaggcagagggc

SEQ ID NO: 408260 - DNA, 25 bp, Mus musculus
caaagctgtctgtggaggtacaatc

SEQ ID NO: 408261 - DNA, 25 bp, Mus musculus
caaagctgtgatcactcagtgggag

SEQ ID NO: 408262 - DNA, 25 bp, Mus musculus
caaagctgtgatggactgtggaatt

SEQ ID NO: 408263 - DNA, 25 bp, Mus musculus
caaagctgtgtgtcctgagattaca

SEQ ID NO: 408264 - DNA, 25 bp, Mus musculus
caaagcttgcaagaggaagtccact

SEQ ID NO: 408265 - DNA, 25 bp, Mus musculus
caaagctttgatctagggtgctgca

SEQ ID NO: 408266 - DNA, 25 bp, Mus musculus
caaagcttttggattctggatgaca

SEQ ID NO: 408267 - DNA, 25 bp, Mus musculus
caaaggaacgcatatgctgcagtgt

SEQ ID NO: 408268 - DNA, 25 bp, Mus musculus
caaaggaagaattacgtgcgcccag

SEQ ID NO: 408269 - DNA, 25 bp, Mus musculus
caaaggaagacatctaggcttcggg

SEQ ID NO: 408270 - DNA, 25 bp, Mus musculus
caaaggaagcaagtctctggacggc

SEQ ID NO: 408271 - DNA, 25 bp, Mus musculus
caaaggaatagccaccctgggtcaa

SEQ ID NO: 408272 - DNA, 25 bp, Mus musculus
caaaggaatagtacccactgggaga

SEQ ID NO: 408273 - DNA, 25 bp, Mus musculus
caaaggaatgcgttttaccaggagg

SEQ ID NO: 408274 - DNA, 25 bp, Mus musculus
caaaggacagccttaccaaaccaat

SEQ ID NO: 408275 - DNA, 25 bp, Mus musculus
caaaggacatgaaacatcggctggg

SEQ ID NO: 408276 - DNA, 25 bp, Mus musculus
caaaggacccgcgttggacaacaat

SEQ ID NO: 408277 - DNA, 25 bp, Mus musculus
caaaggacgggtcgtggttcatcca

SEQ ID NO: 408278 - DNA, 25 bp, Mus musculus
caaaggactgcttcgaaacctccgg

SEQ ID NO: 408279 - DNA, 25 bp, Mus musculus
caaaggactgcttttagtacggtca

SEQ ID NO: 408280 - DNA, 25 bp, Mus musculus
caaaggactgtagtgcccaaggaag

SEQ ID NO: 408281 - DNA, 25 bp, Mus musculus
caaaggacttgcaggtctgccggct

SEQ ID NO: 408282 - DNA, 25 bp, Mus musculus
caaaggagaacctggacgagtcggt

SEQ ID NO: 408283 - DNA, 25 bp, Mus musculus
caaaggagaagagaggttggaccct

SEQ ID NO: 408284 - DNA, 25 bp, Mus musculus
caaaggagaagattgtgaaatacct

SEQ ID NO: 408285 - DNA, 25 bp, Mus musculus
caaaggagcactctccaggcaagaa

SEQ ID NO: 408286 - DNA, 25 bp, Mus musculus
caaaggaggaagtgacgaagcagct

SEQ ID NO: 408287 - DNA, 25 bp, Mus musculus
caaaggagggacatgtatcaacacc

SEQ ID NO: 408288 - DNA, 25 bp, Mus musculus
caaaggaggtagcaagtgcatcaaa

SEQ ID NO: 408289 - DNA, 25 bp, Mus musculus
caaaggagtctggtgaccaatagtc

SEQ ID NO: 408290 - DNA, 25 bp, Mus musculus
caaaggagttctcactggagagcca

SEQ ID NO: 408291 - DNA, 25 bp, Mus musculus
caaaggatccttctctaagggccgc

SEQ ID NO: 408292 - DNA, 25 bp, Mus musculus
caaaggatctcaacggagggctgcg

SEQ ID NO: 408293 - DNA, 25 bp, Mus musculus
caaaggatgaagttcagcacgtggg

SEQ ID NO: 408294 - DNA, 25 bp, Mus musculus
caaaggatgatgaagcaagagctgt

SEQ ID NO: 408295 - DNA, 25 bp, Mus musculus
caaaggatgatgattctgggcgtac

SEQ ID NO: 408296 - DNA, 25 bp, Mus musculus
caaaggatgctctcacgtgtacacc

SEQ ID NO: 408297 - DNA, 25 bp, Mus musculus
caaaggatggcaggtcagtgctaca

SEQ ID NO: 408298 - DNA, 25 bp, Mus musculus
caaaggatttatgggcccacctggc

SEQ ID NO: 408299 - DNA, 25 bp, Mus musculus
caaaggatttgcaaagtgattgcgt

SEQ ID NO: 408300 - DNA, 25 bp, Mus musculus
caaaggcaaaagatgaagcgtgaga

SEQ ID NO: 408301 - DNA, 25 bp, Mus musculus
caaaggcaaagtgtctatgtgggct

SEQ ID NO: 408302 - DNA, 25 bp, Mus musculus
caaaggcaaatctcagtggacagga

SEQ ID NO: 408303 - DNA, 25 bp, Mus musculus
caaaggcaagttcggtcatgagttc

SEQ ID NO: 408304 - DNA, 25 bp, Mus musculus
caaaggcactgtcgtgggcaacatc

SEQ ID NO: 408305 - DNA, 25 bp, Mus musculus
caaaggcagagaccttgggaactct

SEQ ID NO: 408306 - DNA, 25 bp, Mus musculus
caaaggcagagtgattcccggaatg

SEQ ID NO: 408307 - DNA, 25 bp, Mus musculus
caaaggcagcatgtcagcagagaag

SEQ ID NO: 408308 - DNA, 25 bp, Mus musculus
caaaggcagcattgcaaggcttctt

SEQ ID NO: 408309 - DNA, 25 bp, Mus musculus
caaaggcagctgaagagaatcgcaa

SEQ ID NO: 408310 - DNA, 25 bp, Mus musculus
caaaggcagggcaaggaaactggcc

SEQ ID NO: 408311 - DNA, 25 bp, Mus musculus
caaaggcatagagagattggttttc

SEQ ID NO: 408312 - DNA, 25 bp, Mus musculus
caaaggcatgtaaattcacgacccc

SEQ ID NO: 408313 - DNA, 25 bp, Mus musculus
caaaggcattgctcagggatactgg

SEQ ID NO: 408314 - DNA, 25 bp, Mus musculus
caaaggcatttgagcacccagggct

SEQ ID NO: 408315 - DNA, 25 bp, Mus musculus
caaaggccacgggaacaaagtcctg

SEQ ID NO: 408316 - DNA, 25 bp, Mus musculus
caaaggccactttactgaggctcta

SEQ ID NO: 408317 - DNA, 25 bp, Mus musculus
caaaggccagggtggcaagtccaag

SEQ ID NO: 408318 - DNA, 25 bp, Mus musculus
caaaggcccttctgagtcaagcaaa

SEQ ID NO: 408319 - DNA, 25 bp, Mus musculus
caaaggcctacgacctgagttcgat

SEQ ID NO: 408320 - DNA, 25 bp, Mus musculus
caaaggcctcaacacgcacaaacat

SEQ ID NO: 408321 - DNA, 25 bp, Mus musculus
caaaggcctggataacagaaaatgc

SEQ ID NO: 408322 - DNA, 25 bp, Mus musculus
caaaggccttcgctgtagggcccaa

SEQ ID NO: 408323 - DNA, 25 bp, Mus musculus
caaaggcgacagacacggaacatga

SEQ ID NO: 408324 - DNA, 25 bp, Mus musculus
caaaggcgggaatgtctgcgtgcaa

SEQ ID NO: 408325 - DNA, 25 bp, Mus musculus
caaaggcggtcctctgactgatacc

SEQ ID NO: 408326 - DNA, 25 bp, Mus musculus
caaaggctacattcaggcggtggat

SEQ ID NO: 408327 - DNA, 25 bp, Mus musculus
caaaggctccacatgctcacctgaa

SEQ ID NO: 408328 - DNA, 25 bp, Mus musculus
caaaggctccactctaatggctggc

SEQ ID NO: 408329 - DNA, 25 bp, Mus musculus
caaaggctgccaatcgggtactgca

SEQ ID NO: 408330 - DNA, 25 bp, Mus musculus
caaaggctgccacgttctagagaag

SEQ ID NO: 408331 - DNA, 25 bp, Mus musculus
caaaggctgctgtttcgaagacgat

SEQ ID NO: 408332 - DNA, 25 bp, Mus musculus
caaaggcttcatgtggctggatgcc

SEQ ID NO: 408333 - DNA, 25 bp, Mus musculus
caaaggcttggattgactgacttca

SEQ ID NO: 408334 - DNA, 25 bp, Mus musculus
caaaggctttcgtgacgctgcggag

SEQ ID NO: 408335 - DNA, 25 bp, Mus musculus
caaaggctttggaagacgtctgcat

SEQ ID NO: 408336 - DNA, 25 bp, Mus musculus
caaaggcttttcatagaaataatca

SEQ ID NO: 408337 - DNA, 25 bp, Mus musculus
caaagggaaaggtactgctgcagcc

SEQ ID NO: 408338 - DNA, 25 bp, Mus musculus
caaagggaaatcagtgtcgccacca

SEQ ID NO: 408339 - DNA, 25 bp, Mus musculus
caaagggaacatttggacagcttac

SEQ ID NO: 408340 - DNA, 25 bp, Mus musculus
caaagggaagcgtgtctgactaatt

SEQ ID NO: 408341 - DNA, 25 bp, Mus musculus
caaagggaattactggactctggac

SEQ ID NO: 408342 - DNA, 25 bp, Mus musculus
caaagggagctacttgcctcgagtc

SEQ ID NO: 408343 - DNA, 25 bp, Mus musculus
caaagggagctatgaacaggcgagc

SEQ ID NO: 408344 - DNA, 25 bp, Mus musculus
caaagggatctgtggattgtggcaa

SEQ ID NO: 408345 - DNA, 25 bp, Mus musculus
caaagggatgtctgagcaagaggcc

SEQ ID NO: 408346 - DNA, 25 bp, Mus musculus
caaagggcagaacgtcttgttgact

SEQ ID NO: 408347 - DNA, 25 bp, Mus musculus
caaagggccaaagaagctagacaac

SEQ ID NO: 408348 - DNA, 25 bp, Mus musculus
caaagggccctcttgctgtaggtgg

SEQ ID NO: 408349 - DNA, 25 bp, Mus musculus
caaagggctccctgtggatgccaca

SEQ ID NO: 408350 - DNA, 25 bp, Mus musculus
caaagggtagcatttcttcagcgac

SEQ ID NO: 408351 - DNA, 25 bp, Mus musculus
caaagggtcaccatgaaggatacgg

SEQ ID NO: 408352 - DNA, 25 bp, Mus musculus
caaagggtccaggtgaaggtgccac

SEQ ID NO: 408353 - DNA, 25 bp, Mus musculus
caaagggtcgcatttaccagggcac

SEQ ID NO: 408354 - DNA, 25 bp, Mus musculus
caaagggtgcaactgtaagcgctca

SEQ ID NO: 408355 - DNA, 25 bp, Mus musculus
caaagggtgcagatcctagaacgca

SEQ ID NO: 408356 - DNA, 25 bp, Mus musculus
caaagggttcagtttgccgatggct

SEQ ID NO: 408357 - DNA, 25 bp, Mus musculus
caaagggtttgagatccgagaccac

SEQ ID NO: 408358 - DNA, 25 bp, Mus musculus
caaaggtaaactatcttcagctggc

SEQ ID NO: 408359 - DNA, 25 bp, Mus musculus
caaaggtacagctgtctagtgcgct

SEQ ID NO: 408360 - DNA, 25 bp, Mus musculus
caaaggtacatctgggaagctgtca

SEQ ID NO: 408361 - DNA, 25 bp, Mus musculus
caaaggtagacagaggtagcccagt

SEQ ID NO: 408362 - DNA, 25 bp, Mus musculus
caaaggtatgtgtgactctcctccc

SEQ ID NO: 408363 - DNA, 25 bp, Mus musculus
caaaggtcatgtgtgtgtcctgtca

SEQ ID NO: 408364 - DNA, 25 bp, Mus musculus
caaaggtccctacaggagctgagtc

SEQ ID NO: 408365 - DNA, 25 bp, Mus musculus
caaaggtcctgaggcttcagtgccc

SEQ ID NO: 408366 - DNA, 25 bp, Mus musculus
caaaggtcgcctacagtcagagcta

SEQ ID NO: 408367 - DNA, 25 bp, Mus musculus
caaaggtctctcctcgtgatgggac

SEQ ID NO: 408368 - DNA, 25 bp, Mus musculus
caaaggtctgcctgtgtggctgcag

SEQ ID NO: 408369 - DNA, 25 bp, Mus musculus
caaaggtgacttgacacaaagttcg

SEQ ID NO: 408370 - DNA, 25 bp, Mus musculus
caaaggtgagagctttcgttttcct

SEQ ID NO: 408371 - DNA, 25 bp, Mus musculus
caaaggtggagagttaccgctgccg

SEQ ID NO: 408372 - DNA, 25 bp, Mus musculus
caaaggtggcatctgtcaaaactgg

SEQ ID NO: 408373 - DNA, 25 bp, Mus musculus
caaaggtggtacactagcccatgct

SEQ ID NO: 408374 - DNA, 25 bp, Mus musculus
caaaggtgtcatgatggagctgagc

SEQ ID NO: 408375 - DNA, 25 bp, Mus musculus
caaaggtgtgagtcctatcagtgcc

SEQ ID NO: 408376 - DNA, 25 bp, Mus musculus
caaaggtgtgcagaacaagagcccc

SEQ ID NO: 408377 - DNA, 25 bp, Mus musculus
caaaggtgtgcttagtactcaggac

SEQ ID NO: 408378 - DNA, 25 bp, Mus musculus
caaaggttcagtggagaggtcacca

SEQ ID NO: 408379 - DNA, 25 bp, Mus musculus
caaaggttgctgctaaactggacaa

SEQ ID NO: 408380 - DNA, 25 bp, Mus musculus
caaaggtttctcagcaggttacagg

SEQ ID NO: 408381 - DNA, 25 bp, Mus musculus
caaaggttttgctctctatttgttc

SEQ ID NO: 408382 - DNA, 25 bp, Mus musculus
caaagtaactcgcttgaactcagta

SEQ ID NO: 408383 - DNA, 25 bp, Mus musculus
caaagtacagcagcttaagggaagc

SEQ ID NO: 408384 - DNA, 25 bp, Mus musculus
caaagtacagtgcttgctccggtca

SEQ ID NO: 408385 - DNA, 25 bp, Mus musculus
caaagtacagtggttgctactggaa

SEQ ID NO: 408386 - DNA, 25 bp, Mus musculus
caaagtacatttggtggcaggtcaa

SEQ ID NO: 408387 - DNA, 25 bp, Mus musculus
caaagtaccggatttctgtgcctca

SEQ ID NO: 408388 - DNA, 25 bp, Mus musculus
caaagtaccgtatgcgcaacgtgca

SEQ ID NO: 408389 - DNA, 25 bp, Mus musculus
caaagtactaacagcactgggccag

SEQ ID NO: 408390 - DNA, 25 bp, Mus musculus
caaagtagagggacagctgctgctc

SEQ ID NO: 408391 - DNA, 25 bp, Mus musculus
caaagtaggagctggaaccggtcca

SEQ ID NO: 408392 - DNA, 25 bp, Mus musculus
caaagtagtgtccagtcatagtccc

SEQ ID NO: 408393 - DNA, 25 bp, Mus musculus
caaagtatatgccagaacgcctgcg

SEQ ID NO: 408394 - DNA, 25 bp, Mus musculus
caaagtatccagtcgggtaaccgca

SEQ ID NO: 408395 - DNA, 25 bp, Mus musculus
caaagtatgctagccatggaggacg

SEQ ID NO: 408396 - DNA, 25 bp, Mus musculus
caaagtatgtccacaaccaaggaag

SEQ ID NO: 408397 - DNA, 25 bp, Mus musculus
caaagtcaaagggaaggccacctgc

SEQ ID NO: 408398 - DNA, 25 bp, Mus musculus
caaagtcaacaagaccgagcagagg

SEQ ID NO: 408399 - DNA, 25 bp, Mus musculus
caaagtcaaggaattctgagaagcc

SEQ ID NO: 408400 - DNA, 25 bp, Mus musculus
caaagtcagactggcatccaaggcc

SEQ ID NO: 408401 - DNA, 25 bp, Mus musculus
caaagtcagcgttcacctctggtgc

SEQ ID NO: 408402 - DNA, 25 bp, Mus musculus
caaagtcatgtctacactgagaggg

SEQ ID NO: 408403 - DNA, 25 bp, Mus musculus
caaagtccaccattactggaatttt

SEQ ID NO: 408404 - DNA, 25 bp, Mus musculus
caaagtccagggtgcaaacgtgagg

SEQ ID NO: 408405 - DNA, 25 bp, Mus musculus
caaagtccctgagaaactggtggcc

SEQ ID NO: 408406 - DNA, 25 bp, Mus musculus
caaagtccgctgtggctgagacgcg

SEQ ID NO: 408407 - DNA, 25 bp, Mus musculus
caaagtccggcagagccttgagcag

SEQ ID NO: 408408 - DNA, 25 bp, Mus musculus
caaagtcgtcgtcgttcaaggaaga

SEQ ID NO: 408409 - DNA, 25 bp, Mus musculus
caaagtcgtggaaagcctaagggca

SEQ ID NO: 408410 - DNA, 25 bp, Mus musculus
caaagtctacctttggtttggctga

SEQ ID NO: 408411 - DNA, 25 bp, Mus musculus
caaagtctctatgatgctggccagc

SEQ ID NO: 408412 - DNA, 25 bp, Mus musculus
caaagtctctatgttaatatactat

SEQ ID NO: 408413 - DNA, 25 bp, Mus musculus
caaagtctgcttgggtccattgctc

SEQ ID NO: 408414 - DNA, 25 bp, Mus musculus
caaagtctggcgtctggatctagtc

SEQ ID NO: 408415 - DNA, 25 bp, Mus musculus
caaagtctggttcttggatatttca

SEQ ID NO: 408416 - DNA, 25 bp, Mus musculus
caaagtcttgctaccctggagtctg

SEQ ID NO: 408417 - DNA, 25 bp, Mus musculus
caaagtgaaagagccaccctgctgg

SEQ ID NO: 408418 - DNA, 25 bp, Mus musculus
caaagtgaagggtacctggctgcag

SEQ ID NO: 408419 - DNA, 25 bp, Mus musculus
caaagtgaccctgacaaaatgaagg

SEQ ID NO: 408420 - DNA, 25 bp, Mus musculus
caaagtgactggagccggttcgaga

SEQ ID NO: 408421 - DNA, 25 bp, Mus musculus
caaagtgagaagaatgtgctacctg

SEQ ID NO: 408422 - DNA, 25 bp, Mus musculus
caaagtgagccagtgcaaccagaag

SEQ ID NO: 408423 - DNA, 25 bp, Mus musculus
caaagtgagtctagattctgcggtc

SEQ ID NO: 408424 - DNA, 25 bp, Mus musculus
caaagtgatccggagtgatggaacc

SEQ ID NO: 408425 - DNA, 25 bp, Mus musculus
caaagtgcactatggtcaggacgag

SEQ ID NO: 408426 - DNA, 25 bp, Mus musculus
caaagtgcaggattatcggcaggca

SEQ ID NO: 408427 - DNA, 25 bp, Mus musculus
caaagtgcccaactatttacatcgc

SEQ ID NO: 408428 - DNA, 25 bp, Mus musculus
caaagtgcgtggttggcttctggct

SEQ ID NO: 408429 - DNA, 25 bp, Mus musculus
caaagtgcgtttggtgaatggcccc

SEQ ID NO: 408430 - DNA, 25 bp, Mus musculus
caaagtgctgctgaagagacaccca

SEQ ID NO: 408431 - DNA, 25 bp, Mus musculus
caaagtggaagagcctcgagctgaa

SEQ ID NO: 408432 - DNA, 25 bp, Mus musculus
caaagtggacctgatggctgactaa

SEQ ID NO: 408433 - DNA, 25 bp, Mus musculus
caaagtggagcccaagttgtccgtg

SEQ ID NO: 408434 - DNA, 25 bp, Mus musculus
caaagtggaggtcttgcatactgca

SEQ ID NO: 408435 - DNA, 25 bp, Mus musculus
caaagtggatcgatacaacatcagg

SEQ ID NO: 408436 - DNA, 25 bp, Mus musculus
caaagtggatgtcgccctaagtctc

SEQ ID NO: 408437 - DNA, 25 bp, Mus musculus
caaagtggcctttatcacaggtggt

SEQ ID NO: 408438 - DNA, 25 bp, Mus musculus
caaagtggctgcgtctgactggaca

SEQ ID NO: 408439 - DNA, 25 bp, Mus musculus
caaagtgggcgtgtccagtctcatc

SEQ ID NO: 408440 - DNA, 25 bp, Mus musculus
caaagtggtccgcaatgagttcacc

SEQ ID NO: 408441 - DNA, 25 bp, Mus musculus
caaagtgtcaccaagaatgatgagg

SEQ ID NO: 408442 - DNA, 25 bp, Mus musculus
caaagtgtctgataccgtggtcgag

SEQ ID NO: 408443 - DNA, 25 bp, Mus musculus
caaagtgtggacttggtcttccccg

SEQ ID NO: 408444 - DNA, 25 bp, Mus musculus
caaagtgtggatcgcctccgaagac

SEQ ID NO: 408445 - DNA, 25 bp, Mus musculus
caaagtgtggatctgcagccatgct

SEQ ID NO: 408446 - DNA, 25 bp, Mus musculus
caaagtgtggcaatcaggtcatgac

SEQ ID NO: 408447 - DNA, 25 bp, Mus musculus
caaagtgtggctgaccgtgctgttc

SEQ ID NO: 408448 - DNA, 25 bp, Mus musculus
caaagtgtggtttcaggacctgcag

SEQ ID NO: 408449 - DNA, 25 bp, Mus musculus
caaagtgttcaggtggccggatctc

SEQ ID NO: 408450 - DNA, 25 bp, Mus musculus
caaagttaaagaaacatgtcaacaa

SEQ ID NO: 408451 - DNA, 25 bp, Mus musculus
caaagttagactcaccgttgaggct

SEQ ID NO: 408452 - DNA, 25 bp, Mus musculus
caaagttagcaacgtggagggcatc

SEQ ID NO: 408453 - DNA, 25 bp, Mus musculus
caaagttaggcctcagcctcagtct

SEQ ID NO: 408454 - DNA, 25 bp, Mus musculus
caaagttagtgctgtggaccacggc

SEQ ID NO: 408455 - DNA, 25 bp, Mus musculus
caaagttcacttggatggcatgtac

SEQ ID NO: 408456 - DNA, 25 bp, Mus musculus
caaagttcatggtctggtaaagcag

SEQ ID NO: 408457 - DNA, 25 bp, Mus musculus
caaagttccagttgtgaaggagcca

SEQ ID NO: 408458 - DNA, 25 bp, Mus musculus
caaagttccgtccagcaagggcttg

SEQ ID NO: 408459 - DNA, 25 bp, Mus musculus
caaagttcgaaaggtgatctggctg

SEQ ID NO: 408460 - DNA, 25 bp, Mus musculus
caaagttcgtggtcgccaagagcaa

SEQ ID NO: 408461 - DNA, 25 bp, Mus musculus
caaagttgagctccggtcatccaga

SEQ ID NO: 408462 - DNA, 25 bp, Mus musculus
caaagttgagggttaaggatggatc

SEQ ID NO: 408463 - DNA, 25 bp, Mus musculus
caaagttgcagctgaggaacgggca

SEQ ID NO: 408464 - DNA, 25 bp, Mus musculus
caaagttgccaacctcgacgggcta

SEQ ID NO: 408465 - DNA, 25 bp, Mus musculus
caaagttgccactccgtgtgacagg

SEQ ID NO: 408466 - DNA, 25 bp, Mus musculus
caaagttgcctaagcaggccaggga

SEQ ID NO: 408467 - DNA, 25 bp, Mus musculus
caaagttggactacagctggctgca

SEQ ID NO: 408468 - DNA, 25 bp, Mus musculus
caaagttggcaattattcctggcgg

SEQ ID NO: 408469 - DNA, 25 bp, Mus musculus
caaagttggtgcagatcgagcggct

SEQ ID NO: 408470 - DNA, 25 bp, Mus musculus
caaagtttaggaggcgctgcagtca

SEQ ID NO: 408471 - DNA, 25 bp, Mus musculus
caaagtttgaaagggtctacagcca

SEQ ID NO: 408472 - DNA, 25 bp, Mus musculus
caaagtttgttttggtgatggcata

SEQ ID NO: 408473 - DNA, 25 bp, Mus musculus
caaagttttggaaatgagccaccca

SEQ ID NO: 408474 - DNA, 25 bp, Mus musculus
caaagtttttgtcatgccggcagag

SEQ ID NO: 408475 - DNA, 25 bp, Mus musculus
caaataaaaaagttgaggcctggag

SEQ ID NO: 408476 - DNA, 25 bp, Mus musculus
caaataaaaatggtccggctggctt

SEQ ID NO: 408477 - DNA, 25 bp, Mus musculus
caaataacagcttttagggctagag

SEQ ID NO: 408478 - DNA, 25 bp, Mus musculus
caaataacaggattggtctggctcc

SEQ ID NO: 408479 - DNA, 25 bp, Mus musculus
caaataacgtggataaatgcatggt

SEQ ID NO: 408480 - DNA, 25 bp, Mus musculus
caaataactggtgttcccgagccca

SEQ ID NO: 408481 - DNA, 25 bp, Mus musculus
caaataagggcatcacaagtcagtc

SEQ ID NO: 408482 - DNA, 25 bp, Mus musculus
caaatacagtcgagcagagtgggca

SEQ ID NO: 408483 - DNA, 25 bp, Mus musculus
caaataccatgtctgtgacccaaag

SEQ ID NO: 408484 - DNA, 25 bp, Mus musculus
caaataccccaagaggagttccgag

SEQ ID NO: 408485 - DNA, 25 bp, Mus musculus
caaataccctctggagaaatggcag

SEQ ID NO: 408486 - DNA, 25 bp, Mus musculus
caaataccggaagaatgaagccaag

SEQ ID NO: 408487 - DNA, 25 bp, Mus musculus
caaatacggcttcaggtggcagtgc

SEQ ID NO: 408488 - DNA, 25 bp, Mus musculus
caaatacggtagatcagtgggacac

SEQ ID NO: 408489 - DNA, 25 bp, Mus musculus
caaatactacagtgaggaggctgaa

SEQ ID NO: 408490 - DNA, 25 bp, Mus musculus
caaatactatgtcaaggagcggtcc

SEQ ID NO: 408491 - DNA, 25 bp, Mus musculus
caaatactgggttggcacgtttcca

SEQ ID NO: 408492 - DNA, 25 bp, Mus musculus
caaatacttgcagtgggaagggccg

SEQ ID NO: 408493 - DNA, 25 bp, Mus musculus
caaatagaagacctaaggcttaagc

SEQ ID NO: 408494 - DNA, 25 bp, Mus musculus
caaatagaccatgtagcttggccct

SEQ ID NO: 408495 - DNA, 25 bp, Mus musculus
caaatagggacgtgggcagaaagcc

SEQ ID NO: 408496 - DNA, 25 bp, Mus musculus
caaatagtagcacttgtcactgcac

SEQ ID NO: 408497 - DNA, 25 bp, Mus musculus
caaatagtcctgcaagtagtagatt

SEQ ID NO: 408498 - DNA, 25 bp, Mus musculus
caaatagttcctaggtgacgagacc

SEQ ID NO: 408499 - DNA, 25 bp, Mus musculus
caaatataaggcgtcctggcactgt

SEQ ID NO: 408500 - DNA, 25 bp, Mus musculus
caaatatcaggatctgggtaccagc

SEQ ID NO: 408501 - DNA, 25 bp, Mus musculus
caaatatgaagcctgcagcagccct

SEQ ID NO: 408502 - DNA, 25 bp, Mus musculus
caaatatgcactctctcaggatgtc

SEQ ID NO: 408503 - DNA, 25 bp, Mus musculus
caaatatgctgatgaagagatcccc

SEQ ID NO: 408504 - DNA, 25 bp, Mus musculus
caaatatggaataaacagatggctc

SEQ ID NO: 408505 - DNA, 25 bp, Mus musculus
caaatatggattctagggcccaggg

SEQ ID NO: 408506 - DNA, 25 bp, Mus musculus
caaatatgttgtctcggcaggctcc

SEQ ID NO: 408507 - DNA, 25 bp, Mus musculus
caaatattcatatggtgtgcgagcc

SEQ ID NO: 408508 - DNA, 25 bp, Mus musculus
caaatattgtaactctgcgtgaagt

SEQ ID NO: 408509 - DNA, 25 bp, Mus musculus
caaatattttcatcaccagcctggc

SEQ ID NO: 408510 - DNA, 25 bp, Mus musculus
caaatcaaagcattagtatgggcac

SEQ ID NO: 408511 - DNA, 25 bp, Mus musculus
caaatcaaaggaagcgtcagttgct

SEQ ID NO: 408512 - DNA, 25 bp, Mus musculus
caaatcaagtaaatgttgtacatat

SEQ ID NO: 408513 - DNA, 25 bp, Mus musculus
caaatcaatgtggtttctttggaac

SEQ ID NO: 408514 - DNA, 25 bp, Mus musculus
caaatcagaactctgtgagccctgg

SEQ ID NO: 408515 - DNA, 25 bp, Mus musculus
caaatcagaggagtgtggacaagct

SEQ ID NO: 408516 - DNA, 25 bp, Mus musculus
caaatcagcgtggtagactgccagc

SEQ ID NO: 408517 - DNA, 25 bp, Mus musculus
caaatcaggtgcacagcagaaggct

SEQ ID NO: 408518 - DNA, 25 bp, Mus musculus
caaatcatgagtacctccagttcca

SEQ ID NO: 408519 - DNA, 25 bp, Mus musculus
caaatcattgacttccgaggactgc

SEQ ID NO: 408520 - DNA, 25 bp, Mus musculus
caaatccaagacgatggcaggacat

SEQ ID NO: 408521 - DNA, 25 bp, Mus musculus
caaatccagtgcaaaggaggcctga

SEQ ID NO: 408522 - DNA, 25 bp, Mus musculus
caaatccagtggtgggtagttatac

SEQ ID NO: 408523 - DNA, 25 bp, Mus musculus
caaatccagttgtgaaccgtcactg

SEQ ID NO: 408524 - DNA, 25 bp, Mus musculus
caaatccctagtagatgccaggcca

SEQ ID NO: 408525 - DNA, 25 bp, Mus musculus
caaatccgggcgtgtgtggaaagac

SEQ ID NO: 408526 - DNA, 25 bp, Mus musculus
caaatcctgaggtaagctgtctatt

SEQ ID NO: 408527 - DNA, 25 bp, Mus musculus
caaatcctgcgccttgctggaagca

SEQ ID NO: 408528 - DNA, 25 bp, Mus musculus
caaatcctgctgtgccctggagtca

SEQ ID NO: 408529 - DNA, 25 bp, Mus musculus
caaatcctggagcttcatgggaacc

SEQ ID NO: 408530 - DNA, 25 bp, Mus musculus
caaatcctggatgaatgcagaggcc

SEQ ID NO: 408531 - DNA, 25 bp, Mus musculus
caaatcctggcatggtctcttccac

SEQ ID NO: 408532 - DNA, 25 bp, Mus musculus
caaatcctgggtgtcaaagcctcta

SEQ ID NO: 408533 - DNA, 25 bp, Mus musculus
caaatcctgttaatagagagatgta

SEQ ID NO: 408534 - DNA, 25 bp, Mus musculus
caaatcctttccgttcagtacttag

SEQ ID NO: 408535 - DNA, 25 bp, Mus musculus
caaatcgacagcatttctaagttga

SEQ ID NO: 408536 - DNA, 25 bp, Mus musculus
caaatcgatgggtaaatgtcgcgcc

SEQ ID NO: 408537 - DNA, 25 bp, Mus musculus
caaatcggatctcaaggccgacagt

SEQ ID NO: 408538 - DNA, 25 bp, Mus musculus
caaatcggtgcagtacaatggcagc

SEQ ID NO: 408539 - DNA, 25 bp, Mus musculus
caaatcgtaacaatcctatagcctg

SEQ ID NO: 408540 - DNA, 25 bp, Mus musculus
caaatctaaccccagtgagcaggag

SEQ ID NO: 408541 - DNA, 25 bp, Mus musculus
caaatctatgaatcgtgaatgcaga

SEQ ID NO: 408542 - DNA, 25 bp, Mus musculus
caaatctctctgtcacttgagcagg

SEQ ID NO: 408543 - DNA, 25 bp, Mus musculus
caaatctctgcccataacctggagg

SEQ ID NO: 408544 - DNA, 25 bp, Mus musculus
caaatctgcgcatgccttggtaggc

SEQ ID NO: 408545 - DNA, 25 bp, Mus musculus
caaatctgtatatcattgtcagtcc

SEQ ID NO: 408546 - DNA, 25 bp, Mus musculus
caaatcttttgggacaaggctcagg

SEQ ID NO: 408547 - DNA, 25 bp, Mus musculus
caaatgaaaacaatcgaggctagag

SEQ ID NO: 408548 - DNA, 25 bp, Mus musculus
caaatgaaaacctttgccaggctca

SEQ ID NO: 408549 - DNA, 25 bp, Mus musculus
caaatgaaacaccacctggccacag

SEQ ID NO: 408550 - DNA, 25 bp, Mus musculus
caaatgaaacagacggcaagagcac

SEQ ID NO: 408551 - DNA, 25 bp, Mus musculus
caaatgaactattaacaggtactct

SEQ ID NO: 408552 - DNA, 25 bp, Mus musculus
caaatgaactgctctaggctctgag

SEQ ID NO: 408553 - DNA, 25 bp, Mus musculus
caaatgaagattttacagacggcta

SEQ ID NO: 408554 - DNA, 25 bp, Mus musculus
caaatgacatactactgagaacgga

SEQ ID NO: 408555 - DNA, 25 bp, Mus musculus
caaatgaccacgtgtgggaggccct

SEQ ID NO: 408556 - DNA, 25 bp, Mus musculus
caaatgaccactgactatgggcacc

SEQ ID NO: 408557 - DNA, 25 bp, Mus musculus
caaatgacccgacggttgggagcct

SEQ ID NO: 408558 - DNA, 25 bp, Mus musculus
caaatgacctcaatctgttcttaag

SEQ ID NO: 408559 - DNA, 25 bp, Mus musculus
caaatgactagcaggttccagggac

SEQ ID NO: 408560 - DNA, 25 bp, Mus musculus
caaatgacttctgagctgcgttggg

SEQ ID NO: 408561 - DNA, 25 bp, Mus musculus
caaatgagagaatgagaatcccatg

SEQ ID NO: 408562 - DNA, 25 bp, Mus musculus
caaatgaggatagcaacctgaggcc

SEQ ID NO: 408563 - DNA, 25 bp, Mus musculus
caaatgaggctgtggttaaacgtca

SEQ ID NO: 408564 - DNA, 25 bp, Mus musculus
caaatgagggtgtcagccatgtgca

SEQ ID NO: 408565 - DNA, 25 bp, Mus musculus
caaatgatcagtagtaccgggccgt

SEQ ID NO: 408566 - DNA, 25 bp, Mus musculus
caaatgatgcagagtggtccagagt

SEQ ID NO: 408567 - DNA, 25 bp, Mus musculus
caaatgatggatcgtcggagaaacc

SEQ ID NO: 408568 - DNA, 25 bp, Mus musculus
caaatgatggcttcgctaaagtgca

SEQ ID NO: 408569 - DNA, 25 bp, Mus musculus
caaatgatgtcaatgaaacagagtc

SEQ ID NO: 408570 - DNA, 25 bp, Mus musculus
caaatgattgaaaactggcgaaagc

SEQ ID NO: 408571 - DNA, 25 bp, Mus musculus
caaatgcacgcctgttgagggcagc

SEQ ID NO: 408572 - DNA, 25 bp, Mus musculus
caaatgcaggtgaaggcgagtgaca

SEQ ID NO: 408573 - DNA, 25 bp, Mus musculus
caaatgcagtgcgtttgctcccaga

SEQ ID NO: 408574 - DNA, 25 bp, Mus musculus
caaatgcagttagggttggctggct

SEQ ID NO: 408575 - DNA, 25 bp, Mus musculus
caaatgcatcatcctcaccgtgtgg

SEQ ID NO: 408576 - DNA, 25 bp, Mus musculus
caaatgcatcggcaagatgctgcaa

SEQ ID NO: 408577 - DNA, 25 bp, Mus musculus
caaatgcatggaccgaggatgcccc

SEQ ID NO: 408578 - DNA, 25 bp, Mus musculus
caaatgcatgggaggagatcgcaac

SEQ ID NO: 408579 - DNA, 25 bp, Mus musculus
caaatgcattatggctcatgccgcc

SEQ ID NO: 408580 - DNA, 25 bp, Mus musculus
caaatgccagtcttctcggaggagg

SEQ ID NO: 408581 - DNA, 25 bp, Mus musculus
caaatgcccagacaagatgccgaag

SEQ ID NO: 408582 - DNA, 25 bp, Mus musculus
caaatgccctgaatggaatgctgcg

SEQ ID NO: 408583 - DNA, 25 bp, Mus musculus
caaatgcccttcagctcagctctgg

SEQ ID NO: 408584 - DNA, 25 bp, Mus musculus
caaatgccttctaatctactggaca

SEQ ID NO: 408585 - DNA, 25 bp, Mus musculus
caaatgccttttgtcaaaaggaggg

SEQ ID NO: 408586 - DNA, 25 bp, Mus musculus
caaatgcgagttctgtgacgtccgt

SEQ ID NO: 408587 - DNA, 25 bp, Mus musculus
caaatgcgcctctggtacacatggt

SEQ ID NO: 408588 - DNA, 25 bp, Mus musculus
caaatgcgctctcatgctaacagga

SEQ ID NO: 408589 - DNA, 25 bp, Mus musculus
caaatgcggtatgcgaaattgtcca

SEQ ID NO: 408590 - DNA, 25 bp, Mus musculus
caaatgcgttatcaatgcctccggc

SEQ ID NO: 408591 - DNA, 25 bp, Mus musculus
caaatgctagtaccatcagtgggag

SEQ ID NO: 408592 - DNA, 25 bp, Mus musculus
caaatgctcagtgccttgtttctgg

SEQ ID NO: 408593 - DNA, 25 bp, Mus musculus
caaatgctgggtccgaagctcagac

SEQ ID NO: 408594 - DNA, 25 bp, Mus musculus
caaatgctgtgcgttaggagccgct

SEQ ID NO: 408595 - DNA, 25 bp, Mus musculus
caaatgcttaagctgcaggtctgac

SEQ ID NO: 408596 - DNA, 25 bp, Mus musculus
caaatgcttcaaacaaagggcccta

SEQ ID NO: 408597 - DNA, 25 bp, Mus musculus
caaatgctttatgggtgtggctcaa

SEQ ID NO: 408598 - DNA, 25 bp, Mus musculus
caaatgctttttaagtgtacgccag

SEQ ID NO: 408599 - DNA, 25 bp, Mus musculus
caaatggaacaatgcataatggcct

SEQ ID NO: 408600 - DNA, 25 bp, Mus musculus
caaatggaacgtggaggacaccttc

SEQ ID NO: 408601 - DNA, 25 bp, Mus musculus
caaatggaatgttctccggcatgct

SEQ ID NO: 408602 - DNA, 25 bp, Mus musculus
caaatggagccaaagccaacggagt

SEQ ID NO: 408603 - DNA, 25 bp, Mus musculus
caaatggaggactacgtaatcggga

SEQ ID NO: 408604 - DNA, 25 bp, Mus musculus
caaatggaggcagtttgcagcccct

SEQ ID NO: 408605 - DNA, 25 bp, Mus musculus
caaatggatatctgaaaaacggctc

SEQ ID NO: 408606 - DNA, 25 bp, Mus musculus
caaatggatcctcccaaagctggac

SEQ ID NO: 408607 - DNA, 25 bp, Mus musculus
caaatggcaagaatcggtgtaaatc

SEQ ID NO: 408608 - DNA, 25 bp, Mus musculus
caaatggcacttgtcatagttggga

SEQ ID NO: 408609 - DNA, 25 bp, Mus musculus
caaatggcatctacgcaaaggcacc

SEQ ID NO: 408610 - DNA, 25 bp, Mus musculus
caaatggccagctcttcatgagtgg

SEQ ID NO: 408611 - DNA, 25 bp, Mus musculus
caaatggccatttcatgcgctgtgg

SEQ ID NO: 408612 - DNA, 25 bp, Mus musculus
caaatggcggacttcgatacctacg

SEQ ID NO: 408613 - DNA, 25 bp, Mus musculus
caaatggctacatcgaattgttgag

SEQ ID NO: 408614 - DNA, 25 bp, Mus musculus
caaatggctctactgaagggaccct

SEQ ID NO: 408615 - DNA, 25 bp, Mus musculus
caaatggcttgtgccttggcctgca

SEQ ID NO: 408616 - DNA, 25 bp, Mus musculus
caaatgggacgcacaatctgagctc

SEQ ID NO: 408617 - DNA, 25 bp, Mus musculus
caaatgggcgtgtttatcactttca

SEQ ID NO: 408618 - DNA, 25 bp, Mus musculus
caaatggtgcacatgcagaaggctc

SEQ ID NO: 408619 - DNA, 25 bp, Mus musculus
caaatggtgggtgattacagcagcc

SEQ ID NO: 408620 - DNA, 25 bp, Mus musculus
caaatggtttatgtcggcgtggcaa

SEQ ID NO: 408621 - DNA, 25 bp, Mus musculus
caaatgtaacaagctggtgggcgga

SEQ ID NO: 408622 - DNA, 25 bp, Mus musculus
caaatgtatacaggtgcgggtccgt

SEQ ID NO: 408623 - DNA, 25 bp, Mus musculus
caaatgtcacccgagcagactgagt

SEQ ID NO: 408624 - DNA, 25 bp, Mus musculus
caaatgtcactagctgtccaatgga

SEQ ID NO: 408625 - DNA, 25 bp, Mus musculus
caaatgtcaggatacccaatgccaa

SEQ ID NO: 408626 - DNA, 25 bp, Mus musculus
caaatgtccccatctaggcaaggtc

SEQ ID NO: 408627 - DNA, 25 bp, Mus musculus
caaatgtgatgtgtgcgggcaactc

SEQ ID NO: 408628 - DNA, 25 bp, Mus musculus
caaatgtgcaaagatcaacagacgg

SEQ ID NO: 408629 - DNA, 25 bp, Mus musculus
caaatgtggaagacccctgcttgga

SEQ ID NO: 408630 - DNA, 25 bp, Mus musculus
caaatgtggatgttgttcacgcgcc

SEQ ID NO: 408631 - DNA, 25 bp, Mus musculus
caaatgtgtctaacgctgggctgcc

SEQ ID NO: 408632 - DNA, 25 bp, Mus musculus
caaattaagcgaggaggcagagccc

SEQ ID NO: 408633 - DNA, 25 bp, Mus musculus
caaattaatgggagacgaacctgac

SEQ ID NO: 408634 - DNA, 25 bp, Mus musculus
caaattaatgtaggtacagcctgac

SEQ ID NO: 408635 - DNA, 25 bp, Mus musculus
caaattaatgtcctagggcggccag

SEQ ID NO: 408636 - DNA, 25 bp, Mus musculus
caaattacaagctgcctctgggcct

SEQ ID NO: 408637 - DNA, 25 bp, Mus musculus
caaattagacttcctgggttccagt

SEQ ID NO: 408638 - DNA, 25 bp, Mus musculus
caaattagatcctgtcttcctggag

SEQ ID NO: 408639 - DNA, 25 bp, Mus musculus
caaattcacaaactggtgggccacg

SEQ ID NO: 408640 - DNA, 25 bp, Mus musculus
caaattcaccaagagttctgtctaa

SEQ ID NO: 408641 - DNA, 25 bp, Mus musculus
caaattcacgtttgttattctaagg

SEQ ID NO: 408642 - DNA, 25 bp, Mus musculus
caaattcaggtcaaatggtcgggca

SEQ ID NO: 408643 - DNA, 25 bp, Mus musculus
caaattcattctttcgggccaggcc

SEQ ID NO: 408644 - DNA, 25 bp, Mus musculus
caaattccactgaagctgggcagaa

SEQ ID NO: 408645 - DNA, 25 bp, Mus musculus
caaattccaggctgaagagcaccta

SEQ ID NO: 408646 - DNA, 25 bp, Mus musculus
caaattccctgatgctgagaccgat

SEQ ID NO: 408647 - DNA, 25 bp, Mus musculus
caaattcctttggagactcggagcg

SEQ ID NO: 408648 - DNA, 25 bp, Mus musculus
caaattcgtgtcgttgctgcaggag

SEQ ID NO: 408649 - DNA, 25 bp, Mus musculus
caaattctacatgcccaagcgtgtg

SEQ ID NO: 408650 - DNA, 25 bp, Mus musculus
caaattctacgttggtgcaggcacc

SEQ ID NO: 408651 - DNA, 25 bp, Mus musculus
caaattctagacctcccttgccgga

SEQ ID NO: 408652 - DNA, 25 bp, Mus musculus
caaattcttattcttgttgggcaag

SEQ ID NO: 408653 - DNA, 25 bp, Mus musculus
caaattgaagaagtccggcaggtag

SEQ ID NO: 408654 - DNA, 25 bp, Mus musculus
caaattgaagatatggagccagcac

SEQ ID NO: 408655 - DNA, 25 bp, Mus musculus
caaattgacgctgcatacctctagc

SEQ ID NO: 408656 - DNA, 25 bp, Mus musculus
caaattgagcgctgtgtctttaagg

SEQ ID NO: 408657 - DNA, 25 bp, Mus musculus
caaattgaggaagccgggcgtgtgc

SEQ ID NO: 408658 - DNA, 25 bp, Mus musculus
caaattgataggcagctgccctcgg

SEQ ID NO: 408659 - DNA, 25 bp, Mus musculus
caaattgatgaaaatcacaggcccc

SEQ ID NO: 408660 - DNA, 25 bp, Mus musculus
caaattgcaagaaggtacggactca

SEQ ID NO: 408661 - DNA, 25 bp, Mus musculus
caaattgccatgtgacggtgagggt

SEQ ID NO: 408662 - DNA, 25 bp, Mus musculus
caaattggacagttgcaagagctga

SEQ ID NO: 408663 - DNA, 25 bp, Mus musculus
caaattggagcttggatcctgcctc

SEQ ID NO: 408664 - DNA, 25 bp, Mus musculus
caaattggccatgctcaggacgtga

SEQ ID NO: 408665 - DNA, 25 bp, Mus musculus
caaattggctggtgctacccactac

SEQ ID NO: 408666 - DNA, 25 bp, Mus musculus
caaattgggatcgtggaacaggagc

SEQ ID NO: 408667 - DNA, 25 bp, Mus musculus
caaattgtacataatggaagtagtc

SEQ ID NO: 408668 - DNA, 25 bp, Mus musculus
caaattgtcagccacttctgctaag

SEQ ID NO: 408669 - DNA, 25 bp, Mus musculus
caaatttactgtatttggccatgtg

SEQ ID NO: 408670 - DNA, 25 bp, Mus musculus
caaatttagatccttgtcagaaaca

SEQ ID NO: 408671 - DNA, 25 bp, Mus musculus
caaatttcaaggtgccgatcgatcc

SEQ ID NO: 408672 - DNA, 25 bp, Mus musculus
caaatttccacactgaccccttggt

SEQ ID NO: 408673 - DNA, 25 bp, Mus musculus
caaatttcgattcggccgcagacgg

SEQ ID NO: 408674 - DNA, 25 bp, Mus musculus
caaatttcggcttccatcagagctg

SEQ ID NO: 408675 - DNA, 25 bp, Mus musculus
caaatttgactgcagggctagctca

SEQ ID NO: 408676 - DNA, 25 bp, Mus musculus
caaatttgatgtgagtggctacccc

SEQ ID NO: 408677 - DNA, 25 bp, Mus musculus
caaatttggaaagaacgcgcacggg

SEQ ID NO: 408678 - DNA, 25 bp, Mus musculus
caaatttgtattgcttcccaggcca

SEQ ID NO: 408679 - DNA, 25 bp, Mus musculus
caaattttaaacctgctcggcagac

SEQ ID NO: 408680 - DNA, 25 bp, Mus musculus
caacaaaaaagcctgctcagaaggg

SEQ ID NO: 408681 - DNA, 25 bp, Mus musculus
caacaaaacccctaggtggacagag

SEQ ID NO: 408682 - DNA, 25 bp, Mus musculus
caacaaaagggacaagagcggtgcc

SEQ ID NO: 408683 - DNA, 25 bp, Mus musculus
caacaaaatccgagagctgcgtgct

SEQ ID NO: 408684 - DNA, 25 bp, Mus musculus
caacaaacgtcaaaatgggaagctc

SEQ ID NO: 408685 - DNA, 25 bp, Mus musculus
caacaaagactttcacgtgggtgga

SEQ ID NO: 408686 - DNA, 25 bp, Mus musculus
caacaaagagcttacggcggaggtc

SEQ ID NO: 408687 - DNA, 25 bp, Mus musculus
caacaaagatgatgacacccagtgg

SEQ ID NO: 408688 - DNA, 25 bp, Mus musculus
caacaaagatgtgcctagaggagcc

SEQ ID NO: 408689 - DNA, 25 bp, Mus musculus
caacaaagccaacgtggtaaccagc

SEQ ID NO: 408690 - DNA, 25 bp, Mus musculus
caacaaagccacgtgggatgcaaga

SEQ ID NO: 408691 - DNA, 25 bp, Mus musculus
caacaaagctagttcaaagccagtc

SEQ ID NO: 408692 - DNA, 25 bp, Mus musculus
caacaaaggtatctatgggcagagc

SEQ ID NO: 408693 - DNA, 25 bp, Mus musculus
caacaaagtgatcgaaggtctggac

SEQ ID NO: 408694 - DNA, 25 bp, Mus musculus
caacaaatcaaaggtgacaggcccc

SEQ ID NO: 408695 - DNA, 25 bp, Mus musculus
caacaacaagttaggagccctgcct

SEQ ID NO: 408696 - DNA, 25 bp, Mus musculus
caacaacaatgagtgggccaggtac

SEQ ID NO: 408697 - DNA, 25 bp, Mus musculus
caacaacaatggtggagcagagaac

SEQ ID NO: 408698 - DNA, 25 bp, Mus musculus
caacaacaggatatggcccagttca

SEQ ID NO: 408699 - DNA, 25 bp, Mus musculus
caacaacagtgtgggtgctcaggat

SEQ ID NO: 408700 - DNA, 25 bp, Mus musculus
caacaacagttctgtagagagttta

SEQ ID NO: 408701 - DNA, 25 bp, Mus musculus
caacaacgcggagaacactgaggct

SEQ ID NO: 408702 - DNA, 25 bp, Mus musculus
caacaactcatgctgagagcgctca

SEQ ID NO: 408703 - DNA, 25 bp, Mus musculus
caacaactctaatctgggtccagta

SEQ ID NO: 408704 - DNA, 25 bp, Mus musculus
caacaactgcatgaaggcgggaatc

SEQ ID NO: 408705 - DNA, 25 bp, Mus musculus
caacaactgtgtggaggccaaggac

SEQ ID NO: 408706 - DNA, 25 bp, Mus musculus
caacaactttcgtgacagcctggag

SEQ ID NO: 408707 - DNA, 25 bp, Mus musculus
caacaagaactgcaaggccctgaga

SEQ ID NO: 408708 - DNA, 25 bp, Mus musculus
caacaagaatcgtattgacattgcc

SEQ ID NO: 408709 - DNA, 25 bp, Mus musculus
caacaagcagaattggcccaacagg

SEQ ID NO: 408710 - DNA, 25 bp, Mus musculus
caacaagccaagctagtaagtcggg

SEQ ID NO: 408711 - DNA, 25 bp, Mus musculus
caacaagctgcttttactagaagga

SEQ ID NO: 408712 - DNA, 25 bp, Mus musculus
caacaaggagtagacagaggatggc

SEQ ID NO: 408713 - DNA, 25 bp, Mus musculus
caacaagggcagcaacgatgcgtac

SEQ ID NO: 408714 - DNA, 25 bp, Mus musculus
caacaagggtttgacctggacctgg

SEQ ID NO: 408715 - DNA, 25 bp, Mus musculus
caacaagggttttactcagctcgcc

SEQ ID NO: 408716 - DNA, 25 bp, Mus musculus
caacaaggtggaactgcaggccaag

SEQ ID NO: 408717 - DNA, 25 bp, Mus musculus
caacaaggtggtgatgatgtccagc

SEQ ID NO: 408718 - DNA, 25 bp, Mus musculus
caacaaggtgttgctgggcggcatc

SEQ ID NO: 408719 - DNA, 25 bp, Mus musculus
caacaagtatgagagctgcaccagc

SEQ ID NO: 408720 - DNA, 25 bp, Mus musculus
caacaagtgccagtgtcgagagggc

SEQ ID NO: 408721 - DNA, 25 bp, Mus musculus
caacaagtgcggtctcgggctagac

SEQ ID NO: 408722 - DNA, 25 bp, Mus musculus
caacaagttctccaggaagtccggc

SEQ ID NO: 408723 - DNA, 25 bp, Mus musculus
caacaagtttcatttctgcgacatc

SEQ ID NO: 408724 - DNA, 25 bp, Mus musculus
caacaatggcagtgacagggcagtc

SEQ ID NO: 408725 - DNA, 25 bp, Mus musculus
caacaatgtcatgctcggagagccc

SEQ ID NO: 408726 - DNA, 25 bp, Mus musculus
caacaatgtcctatctggaggcacc

SEQ ID NO: 408727 - DNA, 25 bp, Mus musculus
caacaattactccacgtgccagaca

SEQ ID NO: 408728 - DNA, 25 bp, Mus musculus
caacacaaacgagtgccggatggtc

SEQ ID NO: 408729 - DNA, 25 bp, Mus musculus
caacacaaagtcaatccccaggagt

SEQ ID NO: 408730 - DNA, 25 bp, Mus musculus
caacacaacaaaagggaagttctcg

SEQ ID NO: 408731 - DNA, 25 bp, Mus musculus
caacacaaggtcagggctttggagg

SEQ ID NO: 408732 - DNA, 25 bp, Mus musculus
caacacacgtgtaactgtcagccgg

SEQ ID NO: 408733 - DNA, 25 bp, Mus musculus
caacacagcaaaaagttcagccaca

SEQ ID NO: 408734 - DNA, 25 bp, Mus musculus
caacacagctgtatcttagacctag

SEQ ID NO: 408735 - DNA, 25 bp, Mus musculus
caacacaggcatgttcgaagtccaa

SEQ ID NO: 408736 - DNA, 25 bp, Mus musculus
caacacagggttattacagccagtc

SEQ ID NO: 408737 - DNA, 25 bp, Mus musculus
caacacaggtagaattgtattacac

SEQ ID NO: 408738 - DNA, 25 bp, Mus musculus
caacacatgagcacaagaggcgggt

SEQ ID NO: 408739 - DNA, 25 bp, Mus musculus
caacacccagggtaagtggttcctg

SEQ ID NO: 408740 - DNA, 25 bp, Mus musculus
caacacctgggctctttggtacctc

SEQ ID NO: 408741 - DNA, 25 bp, Mus musculus
caacacctgtcatggttaccgaggc

SEQ ID NO: 408742 - DNA, 25 bp, Mus musculus
caacaccttgtggacttgaggctca

SEQ ID NO: 408743 - DNA, 25 bp, Mus musculus
caacacgcctcaaaacctgatagag

SEQ ID NO: 408744 - DNA, 25 bp, Mus musculus
caacacgcgtttgtggaggccattc

SEQ ID NO: 408745 - DNA, 25 bp, Mus musculus
caacacggagaccagcgagatgctg

SEQ ID NO: 408746 - DNA, 25 bp, Mus musculus
caacacggcgatgactttgactggt

SEQ ID NO: 408747 - DNA, 25 bp, Mus musculus
caacacgggaagagctccttggaga

SEQ ID NO: 408748 - DNA, 25 bp, Mus musculus
caacacgtcaagaaaggagggccac

SEQ ID NO: 408749 - DNA, 25 bp, Mus musculus
caacacgtggaaggcaatggaagga

SEQ ID NO: 408750 - DNA, 25 bp, Mus musculus
caacactatgattttgaagtacgcg

SEQ ID NO: 408751 - DNA, 25 bp, Mus musculus
caacactgacactggtcgggaggac

SEQ ID NO: 408752 - DNA, 25 bp, Mus musculus
caacactgagatacgcaacttgggt

SEQ ID NO: 408753 - DNA, 25 bp, Mus musculus
caacactgagcccaagggactgggt

SEQ ID NO: 408754 - DNA, 25 bp, Mus musculus
caacactgcagggtgggagacagct

SEQ ID NO: 408755 - DNA, 25 bp, Mus musculus
caacactggcttggtgcgggttcct

SEQ ID NO: 408756 - DNA, 25 bp, Mus musculus
caacactgggcatctgctagcgaaa

SEQ ID NO: 408757 - DNA, 25 bp, Mus musculus
caacacttgggagactcggaaagga

SEQ ID NO: 408758 - DNA, 25 bp, Mus musculus
caacacttggtgtcacatgtgagcc

SEQ ID NO: 408759 - DNA, 25 bp, Mus musculus
caacacttttgtgcgttagagacgc

SEQ ID NO: 408760 - DNA, 25 bp, Mus musculus
caacagaacgagcagtgacagcaca

SEQ ID NO: 408761 - DNA, 25 bp, Mus musculus
caacagaagcttggacagaggtccc

SEQ ID NO: 408762 - DNA, 25 bp, Mus musculus
caacagaagtgtagagtccagcgac

SEQ ID NO: 408763 - DNA, 25 bp, Mus musculus
caacagacagctgccttggacacag

SEQ ID NO: 408764 - DNA, 25 bp, Mus musculus
caacagagaaatggcccaatcacag

SEQ ID NO: 408765 - DNA, 25 bp, Mus musculus
caacagagacttccgcatggcgtac

SEQ ID NO: 408766 - DNA, 25 bp, Mus musculus
caacagagatgggttagaggcttca

SEQ ID NO: 408767 - DNA, 25 bp, Mus musculus
caacagagcaagctggtctgcagcc

SEQ ID NO: 408768 - DNA, 25 bp, Mus musculus
caacagagccaggattcagcaggag

SEQ ID NO: 408769 - DNA, 25 bp, Mus musculus
caacagaggaaaggcacgtgggtac

SEQ ID NO: 408770 - DNA, 25 bp, Mus musculus
caacagaggaacatggaagcaccca

SEQ ID NO: 408771 - DNA, 25 bp, Mus musculus
caacagaggccatgggcacaggatc

SEQ ID NO: 408772 - DNA, 25 bp, Mus musculus
caacagagtagctgccacggtcctg

SEQ ID NO: 408773 - DNA, 25 bp, Mus musculus
caacagagtctttgtcccagaggtc

SEQ ID NO: 408774 - DNA, 25 bp, Mus musculus
caacagagttcgagccgcagtggtt

SEQ ID NO: 408775 - DNA, 25 bp, Mus musculus
caacagattcttagttggtcccaag

SEQ ID NO: 408776 - DNA, 25 bp, Mus musculus
caacagcacactcttccttagggaa

SEQ ID NO: 408777 - DNA, 25 bp, Mus musculus
caacagcaggccttgaggttccgag

SEQ ID NO: 408778 - DNA, 25 bp, Mus musculus
caacagcagggtcttgggcaacaag

SEQ ID NO: 408779 - DNA, 25 bp, Mus musculus
caacagccagaccagaacaagaaga

SEQ ID NO: 408780 - DNA, 25 bp, Mus musculus
caacagccgtagtcatggcggcgcc

SEQ ID NO: 408781 - DNA, 25 bp, Mus musculus
caacagccgtgtgtcatagaactgt

SEQ ID NO: 408782 - DNA, 25 bp, Mus musculus
caacagcctatgaaagttctgagag

SEQ ID NO: 408783 - DNA, 25 bp, Mus musculus
caacagcctggtgtatggagcgaag

SEQ ID NO: 408784 - DNA, 25 bp, Mus musculus
caacagcgaatacgagtcgggctct

SEQ ID NO: 408785 - DNA, 25 bp, Mus musculus
caacagcgtattttagagcaacaga

SEQ ID NO: 408786 - DNA, 25 bp, Mus musculus
caacagcgtgtagggaaattgagtc

SEQ ID NO: 408787 - DNA, 25 bp, Mus musculus
caacagctacgcctggatggtggtc

SEQ ID NO: 408788 - DNA, 25 bp, Mus musculus
caacagctagactgcaaatctgaga

SEQ ID NO: 408789 - DNA, 25 bp, Mus musculus
caacagctatgaactgcagcgagag

SEQ ID NO: 408790 - DNA, 25 bp, Mus musculus
caacagctcggagaatcgctcggtt

SEQ ID NO: 408791 - DNA, 25 bp, Mus musculus
caacagctgagcagatgcggcttgc

SEQ ID NO: 408792 - DNA, 25 bp, Mus musculus
caacagctgccggtggtagcttaca

SEQ ID NO: 408793 - DNA, 25 bp, Mus musculus
caacagctgctgcatatggaggcta

SEQ ID NO: 408794 - DNA, 25 bp, Mus musculus
caacagctgtaggaggtggattctt

SEQ ID NO: 408795 - DNA, 25 bp, Mus musculus
caacagctgtaggttggacttttta

SEQ ID NO: 408796 - DNA, 25 bp, Mus musculus
caacagctgtctttgaagggccatc

SEQ ID NO: 408797 - DNA, 25 bp, Mus musculus
caacagctgtgtgtgtagagtacaa

SEQ ID NO: 408798 - DNA, 25 bp, Mus musculus
caacaggccctataccatgcggtaa

SEQ ID NO: 408799 - DNA, 25 bp, Mus musculus
caacaggcgttttgcaatgcagacg

SEQ ID NO: 408800 - DNA, 25 bp, Mus musculus
caacagggcttcgttccaggaacaa

SEQ ID NO: 408801 - DNA, 25 bp, Mus musculus
caacagggtaaaagcagcactgctt

SEQ ID NO: 408802 - DNA, 25 bp, Mus musculus
caacagggtacagtatgagccagcc

SEQ ID NO: 408803 - DNA, 25 bp, Mus musculus
caacagggttttctcgaagccaaca

SEQ ID NO: 408804 - DNA, 25 bp, Mus musculus
caacaggtgaatacaactgtgcctc

SEQ ID NO: 408805 - DNA, 25 bp, Mus musculus
caacaggtgtgctgagaggccaccg

SEQ ID NO: 408806 - DNA, 25 bp, Mus musculus
caacaggtgtggaagtcagtttaac

SEQ ID NO: 408807 - DNA, 25 bp, Mus musculus
caacaggtgtggagctggacatcga

SEQ ID NO: 408808 - DNA, 25 bp, Mus musculus
caacaggtgtgtgcagactattcca

SEQ ID NO: 408809 - DNA, 25 bp, Mus musculus
caacagtagcttaaaatctgagtca

SEQ ID NO: 408810 - DNA, 25 bp, Mus musculus
caacagtagggagcatgacacagca

SEQ ID NO: 408811 - DNA, 25 bp, Mus musculus
caacagtatatcagtttccgaaggt

SEQ ID NO: 408812 - DNA, 25 bp, Mus musculus
caacagtcctagaaatcatgccaga

SEQ ID NO: 408813 - DNA, 25 bp, Mus musculus
caacagtcggatcgtgcagttctca

SEQ ID NO: 408814 - DNA, 25 bp, Mus musculus
caacagtgaggtgtaattggagaat

SEQ ID NO: 408815 - DNA, 25 bp, Mus musculus
caacagtgatagtgactcaggcaca

SEQ ID NO: 408816 - DNA, 25 bp, Mus musculus
caacagtggaagcatagatagggcc

SEQ ID NO: 408817 - DNA, 25 bp, Mus musculus
caacagtggcagctggacgaagcaa

SEQ ID NO: 408818 - DNA, 25 bp, Mus musculus
caacagtggctgctaccctgatgag

SEQ ID NO: 408819 - DNA, 25 bp, Mus musculus
caacagtggctgtaagaaatccagg

SEQ ID NO: 408820 - DNA, 25 bp, Mus musculus
caacagtgtagagaaatagaaaaca

SEQ ID NO: 408821 - DNA, 25 bp, Mus musculus
caacagtgtgggaggtttctgccaa

SEQ ID NO: 408822 - DNA, 25 bp, Mus musculus
caacagtgtgttttcagagaccaag

SEQ ID NO: 408823 - DNA, 25 bp, Mus musculus
caacagttaaaaaagcactgctgct

SEQ ID NO: 408824 - DNA, 25 bp, Mus musculus
caacagttcttggacccaggtcggg

SEQ ID NO: 408825 - DNA, 25 bp, Mus musculus
caacagttgggatcctgggtgaccg

SEQ ID NO: 408826 - DNA, 25 bp, Mus musculus
caacagtttccgatggcagcaagct

SEQ ID NO: 408827 - DNA, 25 bp, Mus musculus
caacagttttcgtgggacactcaag

SEQ ID NO: 408828 - DNA, 25 bp, Mus musculus
caacataactgtgatcggctggcag

SEQ ID NO: 408829 - DNA, 25 bp, Mus musculus
caacataatggtttggaatgcggtc

SEQ ID NO: 408830 - DNA, 25 bp, Mus musculus
caacatacgcttcgtcggtggactg

SEQ ID NO: 408831 - DNA, 25 bp, Mus musculus
caacatagagggagtcatgcggcca

SEQ ID NO: 408832 - DNA, 25 bp, Mus musculus
caacatagcgcgttccaggttcagt

SEQ ID NO: 408833 - DNA, 25 bp, Mus musculus
caacatagtgctgatgaagggccaa

SEQ ID NO: 408834 - DNA, 25 bp, Mus musculus
caacatatgaatgtgggagacacac

SEQ ID NO: 408835 - DNA, 25 bp, Mus musculus
caacatcaacttttctttggagcag

SEQ ID NO: 408836 - DNA, 25 bp, Mus musculus
caacatcagaactttctttataaac

SEQ ID NO: 408837 - DNA, 25 bp, Mus musculus
caacatcaggaatttacaactcaga

SEQ ID NO: 408838 - DNA, 25 bp, Mus musculus
caacatcaggctacatggaagggta

SEQ ID NO: 408839 - DNA, 25 bp, Mus musculus
caacatcatctactgggcggcgtac

SEQ ID NO: 408840 - DNA, 25 bp, Mus musculus
caacatcatggcaaaaatgacatct

SEQ ID NO: 408841 - DNA, 25 bp, Mus musculus
caacatccccggagatgagggagga

SEQ ID NO: 408842 - DNA, 25 bp, Mus musculus
caacatcgggtcactgagagacggc

SEQ ID NO: 408843 - DNA, 25 bp, Mus musculus
caacatctaattgaacaagtggagc

SEQ ID NO: 408844 - DNA, 25 bp, Mus musculus
caacatctatgtggaccgcgtgatc

SEQ ID NO: 408845 - DNA, 25 bp, Mus musculus
caacatctcatctcacgttcatcag

SEQ ID NO: 408846 - DNA, 25 bp, Mus musculus
caacatctgtcccatgctgatggag

SEQ ID NO: 408847 - DNA, 25 bp, Mus musculus
caacatgaacctcgtgggcagctac

SEQ ID NO: 408848 - DNA, 25 bp, Mus musculus
caacatgacgggtttatgcttttaa

SEQ ID NO: 408849 - DNA, 25 bp, Mus musculus
caacatgagaaaccatttgtgctat

SEQ ID NO: 408850 - DNA, 25 bp, Mus musculus
caacatgagtttcaggatgcagagc

SEQ ID NO: 408851 - DNA, 25 bp, Mus musculus
caacatgatttctaacctgtggaca

SEQ ID NO: 408852 - DNA, 25 bp, Mus musculus
caacatgccccgttctgaggctagt

SEQ ID NO: 408853 - DNA, 25 bp, Mus musculus
caacatgcctaaccgatgaggtacg

SEQ ID NO: 408854 - DNA, 25 bp, Mus musculus
caacatgctgaaagtttactctgcg

SEQ ID NO: 408855 - DNA, 25 bp, Mus musculus
caacatgctgtatattgaatggagc

SEQ ID NO: 408856 - DNA, 25 bp, Mus musculus
caacatgctgttggacaagaaccga

SEQ ID NO: 408857 - DNA, 25 bp, Mus musculus
caacatggaggacgtgatcaactgc

SEQ ID NO: 408858 - DNA, 25 bp, Mus musculus
caacatggccgactcatcatcgagg

SEQ ID NO: 408859 - DNA, 25 bp, Mus musculus
caacatggcctttcttggaagtcaa

SEQ ID NO: 408860 - DNA, 25 bp, Mus musculus
caacatggcgcttcagagggttcgg

SEQ ID NO: 408861 - DNA, 25 bp, Mus musculus
caacatgggcttgagtgactccagc

SEQ ID NO: 408862 - DNA, 25 bp, Mus musculus
caacatggtggttctcggcaagtac

SEQ ID NO: 408863 - DNA, 25 bp, Mus musculus
caacatgtggaagcccaggacaggt

SEQ ID NO: 408864 - DNA, 25 bp, Mus musculus
caacatgtggctgatagtgtctggc

SEQ ID NO: 408865 - DNA, 25 bp, Mus musculus
caacatgtgggaaccaagtcctgga

SEQ ID NO: 408866 - DNA, 25 bp, Mus musculus
caacatgtgtcctcgatgcaacaag

SEQ ID NO: 408867 - DNA, 25 bp, Mus musculus
caacatgtgttgtaactactacggc

SEQ ID NO: 408868 - DNA, 25 bp, Mus musculus
caacattaacatcaactttggtgga

SEQ ID NO: 408869 - DNA, 25 bp, Mus musculus
caacattcgagagcttgagcggcag

SEQ ID NO: 408870 - DNA, 25 bp, Mus musculus
caacattctggctcagggttgcagt

SEQ ID NO: 408871 - DNA, 25 bp, Mus musculus
caacattctggtcattgtgggatcc

SEQ ID NO: 408872 - DNA, 25 bp, Mus musculus
caacattcttggcatcacgcaggca

SEQ ID NO: 408873 - DNA, 25 bp, Mus musculus
caacattgacttagaaattgaagag

SEQ ID NO: 408874 - DNA, 25 bp, Mus musculus
caacattgcctgtggtcagacctca

SEQ ID NO: 408875 - DNA, 25 bp, Mus musculus
caacattgcgtttctcccctatgag

SEQ ID NO: 408876 - DNA, 25 bp, Mus musculus
caacattggaagatgagggctgcta

SEQ ID NO: 408877 - DNA, 25 bp, Mus musculus
caacattggaaggacaggcgtgctc

SEQ ID NO: 408878 - DNA, 25 bp, Mus musculus
caacattgtatgtaaccgtacgagg

SEQ ID NO: 408879 - DNA, 25 bp, Mus musculus
caacattgtggctctggaggacgtc

SEQ ID NO: 408880 - DNA, 25 bp, Mus musculus
caacatttaaagtggactgacccta

SEQ ID NO: 408881 - DNA, 25 bp, Mus musculus
caacatttctctggacggacggcct

SEQ ID NO: 408882 - DNA, 25 bp, Mus musculus
caaccaaacaagacacttggctaat

SEQ ID NO: 408883 - DNA, 25 bp, Mus musculus
caaccaaaccgagaggcattctgga

SEQ ID NO: 408884 - DNA, 25 bp, Mus musculus
caaccaagctgagttctgcctgtca

SEQ ID NO: 408885 - DNA, 25 bp, Mus musculus
caaccaaggccgtgtatgaccgaat

SEQ ID NO: 408886 - DNA, 25 bp, Mus musculus
caaccaatagggatagagcagctaa

SEQ ID NO: 408887 - DNA, 25 bp, Mus musculus
caaccaatccaaggagctgctgggc

SEQ ID NO: 408888 - DNA, 25 bp, Mus musculus
caaccaatgaaaggaagcgggagat

SEQ ID NO: 408889 - DNA, 25 bp, Mus musculus
caaccaatggatagtaaagagggat

SEQ ID NO: 408890 - DNA, 25 bp, Mus musculus
caaccacattgaggacctgaaccag

SEQ ID NO: 408891 - DNA, 25 bp, Mus musculus
caaccacgaagagtgagtggagctc

SEQ ID NO: 408892 - DNA, 25 bp, Mus musculus
caaccacggattgcgaactctgcga

SEQ ID NO: 408893 - DNA, 25 bp, Mus musculus
caaccactatagtaggtggcctttc

SEQ ID NO: 408894 - DNA, 25 bp, Mus musculus
caaccagaatgaggatgcctgccgc

SEQ ID NO: 408895 - DNA, 25 bp, Mus musculus
caaccagataactgatatcggagcc

SEQ ID NO: 408896 - DNA, 25 bp, Mus musculus
caaccagcgggaaactacgatagtc

SEQ ID NO: 408897 - DNA, 25 bp, Mus musculus
caaccaggacatagaagagggcaac

SEQ ID NO: 408898 - DNA, 25 bp, Mus musculus
caaccagggctgcagttagaactct

SEQ ID NO: 408899 - DNA, 25 bp, Mus musculus
caaccagggttatctgctgagcaca

SEQ ID NO: 408900 - DNA, 25 bp, Mus musculus
caaccaggtaatggtgaactgcaga

SEQ ID NO: 408901 - DNA, 25 bp, Mus musculus
caaccaggtgcgagcactgctgcct

SEQ ID NO: 408902 - DNA, 25 bp, Mus musculus
caaccaggtgtagaaggcgtgaatc

SEQ ID NO: 408903 - DNA, 25 bp, Mus musculus
caaccagtaaggcttgacttccagt

SEQ ID NO: 408904 - DNA, 25 bp, Mus musculus
caaccataggtgtgcctggcagaga

SEQ ID NO: 408905 - DNA, 25 bp, Mus musculus
caaccatcaatcaggaaatgttctg

SEQ ID NO: 408906 - DNA, 25 bp, Mus musculus
caaccatgagccgtccgagatgagt

SEQ ID NO: 408907 - DNA, 25 bp, Mus musculus
caaccatggaaaaccgcggctggtc

SEQ ID NO: 408908 - DNA, 25 bp, Mus musculus
caaccatggctcaagaggtgtcttc

SEQ ID NO: 408909 - DNA, 25 bp, Mus musculus
caaccatggtcctgcagggatctag

SEQ ID NO: 408910 - DNA, 25 bp, Mus musculus
caaccattgcctttccagtcgggaa

SEQ ID NO: 408911 - DNA, 25 bp, Mus musculus
caaccattggtctgggtagcccaca

SEQ ID NO: 408912 - DNA, 25 bp, Mus musculus
caaccattgtatcagagtcgcatag

SEQ ID NO: 408913 - DNA, 25 bp, Mus musculus
caacccaaacatcgacctggacaag

SEQ ID NO: 408914 - DNA, 25 bp, Mus musculus
caacccagatgggttactggctctt

SEQ ID NO: 408915 - DNA, 25 bp, Mus musculus
caacccagcggacttcagaagcagc

SEQ ID NO: 408916 - DNA, 25 bp, Mus musculus
caacccaggtgcgaaagacagtgat

SEQ ID NO: 408917 - DNA, 25 bp, Mus musculus
caacccaggtgtctgccaggagaaa

SEQ ID NO: 408918 - DNA, 25 bp, Mus musculus
caacccagtgattgccatctaatga

SEQ ID NO: 408919 - DNA, 25 bp, Mus musculus
caacccatacttgaggacctgcaga

SEQ ID NO: 408920 - DNA, 25 bp, Mus musculus
caacccatcttttgtggaaggcgag

SEQ ID NO: 408921 - DNA, 25 bp, Mus musculus
caaccccactggatggactaggtga

SEQ ID NO: 408922 - DNA, 25 bp, Mus musculus
caaccccagtctctgaggaaatgga

SEQ ID NO: 408923 - DNA, 25 bp, Mus musculus
caacccctaggttggcctggtcaga

SEQ ID NO: 408924 - DNA, 25 bp, Mus musculus
caaccccttttgtgaggagctgctg

SEQ ID NO: 408925 - DNA, 25 bp, Mus musculus
caacccgctgtataaagaggccacc

SEQ ID NO: 408926 - DNA, 25 bp, Mus musculus
caacccgcttgatcggctggatgag

SEQ ID NO: 408927 - DNA, 25 bp, Mus musculus
caacccggcttggagtggatgggat

SEQ ID NO: 408928 - DNA, 25 bp, Mus musculus
caacccggtggaaggctcttctgga

SEQ ID NO: 408929 - DNA, 25 bp, Mus musculus
caacccgtgggcaaattcttcagga

SEQ ID NO: 408930 - DNA, 25 bp, Mus musculus
caacccgtgtagtggcatataggaa

SEQ ID NO: 408931 - DNA, 25 bp, Mus musculus
caaccctagggtggctgcatccttg

SEQ ID NO: 408932 - DNA, 25 bp, Mus musculus
caaccctagtgggtgatatgcacag

SEQ ID NO: 408933 - DNA, 25 bp, Mus musculus
caaccctcgagatatgggcgtaggc

SEQ ID NO: 408934 - DNA, 25 bp, Mus musculus
caaccctgaattcgatggcctggac

SEQ ID NO: 408935 - DNA, 25 bp, Mus musculus
caaccctgacttggctttggaggag

SEQ ID NO: 408936 - DNA, 25 bp, Mus musculus
caaccctgagatggagacaaatgct

SEQ ID NO: 408937 - DNA, 25 bp, Mus musculus
caaccctgatgtgtgaggaaagtca

SEQ ID NO: 408938 - DNA, 25 bp, Mus musculus
caaccctggaagagcatagatgtgc

SEQ ID NO: 408939 - DNA, 25 bp, Mus musculus
caaccctggctcagagcctaaggac

SEQ ID NO: 408940 - DNA, 25 bp, Mus musculus
caaccctggtatggcacaaatcctg

SEQ ID NO: 408941 - DNA, 25 bp, Mus musculus
caacccttccagcagcggagactgg

SEQ ID NO: 408942 - DNA, 25 bp, Mus musculus
caacccttgggcgtacagatgagct

SEQ ID NO: 408943 - DNA, 25 bp, Mus musculus
caaccgacgggagactgagcttgag

SEQ ID NO: 408944 - DNA, 25 bp, Mus musculus
caaccgaggcacttatggagtgtcc

SEQ ID NO: 408945 - DNA, 25 bp, Mus musculus
caaccgattgtcactgctgctgaag

SEQ ID NO: 408946 - DNA, 25 bp, Mus musculus
caaccgatttggcagtgatgaggac

SEQ ID NO: 408947 - DNA, 25 bp, Mus musculus
caaccgccgtgcaagatggaggaaa

SEQ ID NO: 408948 - DNA, 25 bp, Mus musculus
caaccgcctgaggtagatcgctgag

SEQ ID NO: 408949 - DNA, 25 bp, Mus musculus
caaccgcgacgaggcggagaaatgc

SEQ ID NO: 408950 - DNA, 25 bp, Mus musculus
caaccgctggatgctggagcgcaaa

SEQ ID NO: 408951 - DNA, 25 bp, Mus musculus
caaccgctggtggtcaggacagaat

SEQ ID NO: 408952 - DNA, 25 bp, Mus musculus
caaccggagtctgaagtctggacca

SEQ ID NO: 408953 - DNA, 25 bp, Mus musculus
caaccggagtgaggacaaatcccat

SEQ ID NO: 408954 - DNA, 25 bp, Mus musculus
caaccggatcatgggctttcacagg

SEQ ID NO: 408955 - DNA, 25 bp, Mus musculus
caaccggcaggctaagtggaagatc

SEQ ID NO: 408956 - DNA, 25 bp, Mus musculus
caaccggcttaagaagaagatgcag

SEQ ID NO: 408957 - DNA, 25 bp, Mus musculus
caaccgggctgtaccaatgtctgct

SEQ ID NO: 408958 - DNA, 25 bp, Mus musculus
caaccgggtcggagagactttccag

SEQ ID NO: 408959 - DNA, 25 bp, Mus musculus
caaccggtggtttcttcatgcaata

SEQ ID NO: 408960 - DNA, 25 bp, Mus musculus
caaccgtagaactcttgcttagcag

SEQ ID NO: 408961 - DNA, 25 bp, Mus musculus
caaccgtggctttgccaagctgaag

SEQ ID NO: 408962 - DNA, 25 bp, Mus musculus
caaccgtgggacatgtataagcctc

SEQ ID NO: 408963 - DNA, 25 bp, Mus musculus
caaccgtgtgctagacttgtcagaa

SEQ ID NO: 408964 - DNA, 25 bp, Mus musculus
caaccgttgtttgactggctgaaag

SEQ ID NO: 408965 - DNA, 25 bp, Mus musculus
caaccgtttacgtggcgcctatggc

SEQ ID NO: 408966 - DNA, 25 bp, Mus musculus
caaccgtttgcagaccaggaatcca

SEQ ID NO: 408967 - DNA, 25 bp, Mus musculus
caacctaaacttgtgctcggcggca

SEQ ID NO: 408968 - DNA, 25 bp, Mus musculus
caacctaaggttgatgggtccacac

SEQ ID NO: 408969 - DNA, 25 bp, Mus musculus
caacctaatgcttcattattggaag

SEQ ID NO: 408970 - DNA, 25 bp, Mus musculus
caacctacaggaaggagctgatcgg

SEQ ID NO: 408971 - DNA, 25 bp, Mus musculus
caacctaccagctgtgcgagtggct

SEQ ID NO: 408972 - DNA, 25 bp, Mus musculus
caacctagactacagtgacaacggc

SEQ ID NO: 408973 - DNA, 25 bp, Mus musculus
caacctagagaagaccccatcatgt

SEQ ID NO: 408974 - DNA, 25 bp, Mus musculus
caacctagagtgagatagccctggg

SEQ ID NO: 408975 - DNA, 25 bp, Mus musculus
caacctagttcaagagtggctggca

SEQ ID NO: 408976 - DNA, 25 bp, Mus musculus
caacctatggcccatctgtaagaag

SEQ ID NO: 408977 - DNA, 25 bp, Mus musculus
caacctcatgtctggcatcttgggc

SEQ ID NO: 408978 - DNA, 25 bp, Mus musculus
caacctccaggagagtaaccagact

SEQ ID NO: 408979 - DNA, 25 bp, Mus musculus
caacctccccagatgcttgcattaa

SEQ ID NO: 408980 - DNA, 25 bp, Mus musculus
caacctccggtgaaagcagttgagg

SEQ ID NO: 408981 - DNA, 25 bp, Mus musculus
caacctcgagctgcatggatagagc

SEQ ID NO: 408982 - DNA, 25 bp, Mus musculus
caacctcggctgtgacgtggacttt

SEQ ID NO: 408983 - DNA, 25 bp, Mus musculus
caacctctccggtgacactgtagga

SEQ ID NO: 408984 - DNA, 25 bp, Mus musculus
caacctctggccttttcagaagcag

SEQ ID NO: 408985 - DNA, 25 bp, Mus musculus
caacctgaaggtgcctggagaacat

SEQ ID NO: 408986 - DNA, 25 bp, Mus musculus
caacctgaatgacctagggcctcgg

SEQ ID NO: 408987 - DNA, 25 bp, Mus musculus
caacctgaccagagggagctgagct

SEQ ID NO: 408988 - DNA, 25 bp, Mus musculus
caacctgagagttactggtggaacc

SEQ ID NO: 408989 - DNA, 25 bp, Mus musculus
caacctgagcagtttcgcgggtggc

SEQ ID NO: 408990 - DNA, 25 bp, Mus musculus
caacctgaggttacaagacggtgct

SEQ ID NO: 408991 - DNA, 25 bp, Mus musculus
caacctgatcaagcagcgagaggct

SEQ ID NO: 408992 - DNA, 25 bp, Mus musculus
caacctgcaatgagggcagactgag

SEQ ID NO: 408993 - DNA, 25 bp, Mus musculus
caacctgcatgcttcgagccgggat

SEQ ID NO: 408994 - DNA, 25 bp, Mus musculus
caacctgcccctgagatttggaagg

SEQ ID NO: 408995 - DNA, 25 bp, Mus musculus
caacctggcggtgttcttggagagc

SEQ ID NO: 408996 - DNA, 25 bp, Mus musculus
caacctgggcaagggacgttacaag

SEQ ID NO: 408997 - DNA, 25 bp, Mus musculus
caacctgggctccaaactgaggaca

SEQ ID NO: 408998 - DNA, 25 bp, Mus musculus
caacctgggtgctgcgggtgttcaa

SEQ ID NO: 408999 - DNA, 25 bp, Mus musculus
caacctggtgctgttcctgaatggc

SEQ ID NO: 409000 - DNA, 25 bp, Mus musculus
caacctggttctggagtgcatcgac

SEQ ID NO: 409001 - DNA, 25 bp, Mus musculus
caacctgtagttccattggacagac

SEQ ID NO: 409002 - DNA, 25 bp, Mus musculus
caacctgtcaggttagcgtcaggca

SEQ ID NO: 409003 - DNA, 25 bp, Mus musculus
caacctgttgctgtattgagtttta

SEQ ID NO: 409004 - DNA, 25 bp, Mus musculus
caacctgtttcggacgtgcatgggc

SEQ ID NO: 409005 - DNA, 25 bp, Mus musculus
caacctgttttttagatgaaaccag

SEQ ID NO: 409006 - DNA, 25 bp, Mus musculus
caaccttaaggcaggctagggagga

SEQ ID NO: 409007 - DNA, 25 bp, Mus musculus
caaccttgaagaattgtctcagcgt

SEQ ID NO: 409008 - DNA, 25 bp, Mus musculus
caaccttgaagtatgccctgcggag

SEQ ID NO: 409009 - DNA, 25 bp, Mus musculus
caaccttgccatcgagagtgcctgc

SEQ ID NO: 409010 - DNA, 25 bp, Mus musculus
caaccttgccgaagagctggagagc

SEQ ID NO: 409011 - DNA, 25 bp, Mus musculus
caaccttgcgatgtgaactctgaga

SEQ ID NO: 409012 - DNA, 25 bp, Mus musculus
caaccttgctgtggcgtactgcaga

SEQ ID NO: 409013 - DNA, 25 bp, Mus musculus
caaccttggaagtgatggagactcc

SEQ ID NO: 409014 - DNA, 25 bp, Mus musculus
caaccttggccttcagggaatcaca

SEQ ID NO: 409015 - DNA, 25 bp, Mus musculus
caaccttgtagtcttctttggagcc

SEQ ID NO: 409016 - DNA, 25 bp, Mus musculus
caacctttaagcatcagaggcggac

SEQ ID NO: 409017 - DNA, 25 bp, Mus musculus
caacctttcgtaagcctccagctgg

SEQ ID NO: 409018 - DNA, 25 bp, Mus musculus
caacctttgggaacacgtggaatca

SEQ ID NO: 409019 - DNA, 25 bp, Mus musculus
caacctttgggatcgtgggacagaa

SEQ ID NO: 409020 - DNA, 25 bp, Mus musculus
caacgaagggtaatcaggtgtctcc

SEQ ID NO: 409021 - DNA, 25 bp, Mus musculus
caacgacaagatgtggatgcagacc

SEQ ID NO: 409022 - DNA, 25 bp, Mus musculus
caacgacaagtttgcagaggacggg

SEQ ID NO: 409023 - DNA, 25 bp, Mus musculus
caacgacagaagaaggaggcacgaa

SEQ ID NO: 409024 - DNA, 25 bp, Mus musculus
caacgacctggttttgcgaagggca

SEQ ID NO: 409025 - DNA, 25 bp, Mus musculus
caacgacgacgctgtgtatggcgat

SEQ ID NO: 409026 - DNA, 25 bp, Mus musculus
caacgacgatgctgtacgagtgctg

SEQ ID NO: 409027 - DNA, 25 bp, Mus musculus
caacgactggcgagagtgagaaccg

SEQ ID NO: 409028 - DNA, 25 bp, Mus musculus
caacgactgtaagctgaaagagaga

SEQ ID NO: 409029 - DNA, 25 bp, Mus musculus
caacgacttgaactctatggcgggt

SEQ ID NO: 409030 - DNA, 25 bp, Mus musculus
caacgagagatttgctgtgccagaa

SEQ ID NO: 409031 - DNA, 25 bp, Mus musculus
caacgagcagacaaacgaagggcac

SEQ ID NO: 409032 - DNA, 25 bp, Mus musculus
caacgagctgcagaacgaagtgtca

SEQ ID NO: 409033 - DNA, 25 bp, Mus musculus
caacgaggagttctgcgccaatgtc

SEQ ID NO: 409034 - DNA, 25 bp, Mus musculus
caacgagggtctgcatagggtttca

SEQ ID NO: 409035 - DNA, 25 bp, Mus musculus
caacgagtacaggaaggcctttgcc

SEQ ID NO: 409036 - DNA, 25 bp, Mus musculus
caacgagtacgcgtgcttgaaggcc

SEQ ID NO: 409037 - DNA, 25 bp, Mus musculus
caacgagtaggttctgtggcccacc

SEQ ID NO: 409038 - DNA, 25 bp, Mus musculus
caacgagtcatgagccgctggaaca

SEQ ID NO: 409039 - DNA, 25 bp, Mus musculus
caacgagtgattgctgtgctgtccc

SEQ ID NO: 409040 - DNA, 25 bp, Mus musculus
caacgagtgcggaacggcttttggc

SEQ ID NO: 409041 - DNA, 25 bp, Mus musculus
caacgagtgtctgggtgactacccc

SEQ ID NO: 409042 - DNA, 25 bp, Mus musculus
caacgagttcatcacctggagtcag

SEQ ID NO: 409043 - DNA, 25 bp, Mus musculus
caacgagttcatctcagtgcaagca

SEQ ID NO: 409044 - DNA, 25 bp, Mus musculus
caacgagtttgtagtgtggagcccc

SEQ ID NO: 409045 - DNA, 25 bp, Mus musculus
caacgataatttcagcagaggagga

SEQ ID NO: 409046 - DNA, 25 bp, Mus musculus
caacgatagctaacctgcagactga

SEQ ID NO: 409047 - DNA, 25 bp, Mus musculus
caacgatatccctggctcagacatc

SEQ ID NO: 409048 - DNA, 25 bp, Mus musculus
caacgatcatgcttgacactgagaa

SEQ ID NO: 409049 - DNA, 25 bp, Mus musculus
caacgatgagaacgtagatggcctc

SEQ ID NO: 409050 - DNA, 25 bp, Mus musculus
caacgatgtaagtgtagccctccag

SEQ ID NO: 409051 - DNA, 25 bp, Mus musculus
caacgattacgagcacaaggaagcc

SEQ ID NO: 409052 - DNA, 25 bp, Mus musculus
caacgattcgggtgtcttgatggcc

SEQ ID NO: 409053 - DNA, 25 bp, Mus musculus
caacgcaatggtggtctggtaccca

SEQ ID NO: 409054 - DNA, 25 bp, Mus musculus
caacgccagtgctccatctgtgagg

SEQ ID NO: 409055 - DNA, 25 bp, Mus musculus
caacgcggagtttcgaagtgtcttc

SEQ ID NO: 409056 - DNA, 25 bp, Mus musculus
caacgcgtggctgtcatatgaactg

SEQ ID NO: 409057 - DNA, 25 bp, Mus musculus
caacgcgtgtaaggagcttgccata

SEQ ID NO: 409058 - DNA, 25 bp, Mus musculus
caacgctatcttggcctgtacaacg

SEQ ID NO: 409059 - DNA, 25 bp, Mus musculus
caacgctgcgctagtctattatgta

SEQ ID NO: 409060 - DNA, 25 bp, Mus musculus
caacgctgctagttatcagggcaga

SEQ ID NO: 409061 - DNA, 25 bp, Mus musculus
caacgctggacctgatgagaagaca

SEQ ID NO: 409062 - DNA, 25 bp, Mus musculus
caacgctttgcatcacggtggcctg

SEQ ID NO: 409063 - DNA, 25 bp, Mus musculus
caacggaacgttcttggatgggaca

SEQ ID NO: 409064 - DNA, 25 bp, Mus musculus
caacggaggcgctcagagaagaaga

SEQ ID NO: 409065 - DNA, 25 bp, Mus musculus
caacggatctggactctgtaaggca

SEQ ID NO: 409066 - DNA, 25 bp, Mus musculus
caacggcaagcagaattacaggaga

SEQ ID NO: 409067 - DNA, 25 bp, Mus musculus
caacggcaagcatggcaagaagatc

SEQ ID NO: 409068 - DNA, 25 bp, Mus musculus
caacggcaaggagtggaaatcatcc

SEQ ID NO: 409069 - DNA, 25 bp, Mus musculus
caacggcaaggtgttcgacgtgacc

SEQ ID NO: 409070 - DNA, 25 bp, Mus musculus
caacggcaagtggttcgacaagcga

SEQ ID NO: 409071 - DNA, 25 bp, Mus musculus
caacggcaatcccaagaacgctgat

SEQ ID NO: 409072 - DNA, 25 bp, Mus musculus
caacggcagctacagcatgatgcag

SEQ ID NO: 409073 - DNA, 25 bp, Mus musculus
caacggcccaggctatgtcggtaca

SEQ ID NO: 409074 - DNA, 25 bp, Mus musculus
caacggcccagtggaaagtagtgct

SEQ ID NO: 409075 - DNA, 25 bp, Mus musculus
caacggcctgtaattacagctctgg

SEQ ID NO: 409076 - DNA, 25 bp, Mus musculus
caacggcgaagaagaggatgagctc

SEQ ID NO: 409077 - DNA, 25 bp, Mus musculus
caacggcggtttgctctattcgcag

SEQ ID NO: 409078 - DNA, 25 bp, Mus musculus
caacggctccccaggtatagctgtt

SEQ ID NO: 409079 - DNA, 25 bp, Mus musculus
caacggctctcagctgatactgcga

SEQ ID NO: 409080 - DNA, 25 bp, Mus musculus
caacggctctgttctgtgatcggca

SEQ ID NO: 409081 - DNA, 25 bp, Mus musculus
caacggctgcaaatatgctcggagc

SEQ ID NO: 409082 - DNA, 25 bp, Mus musculus
caacggctgctcaatgctcagaagg

SEQ ID NO: 409083 - DNA, 25 bp, Mus musculus
caacggctgggcatcagaaaggccc

SEQ ID NO: 409084 - DNA, 25 bp, Mus musculus
caacgggaaacgatggagctagaca

SEQ ID NO: 409085 - DNA, 25 bp, Mus musculus
caacgggagataaacgttggagcct

SEQ ID NO: 409086 - DNA, 25 bp, Mus musculus
caacgggcatgcctgtgatgaacat

SEQ ID NO: 409087 - DNA, 25 bp, Mus musculus
caacgggcgttacactagcaatgag

SEQ ID NO: 409088 - DNA, 25 bp, Mus musculus
caacgggctccacttgtccaaggat

SEQ ID NO: 409089 - DNA, 25 bp, Mus musculus
caacgggctggtgatactgacgtac

SEQ ID NO: 409090 - DNA, 25 bp, Mus musculus
caacgggtgataactcagagcttct

SEQ ID NO: 409091 - DNA, 25 bp, Mus musculus
caacggtactatccagggaaccagg

SEQ ID NO: 409092 - DNA, 25 bp, Mus musculus
caacggtatggctgtcggtgatttt

SEQ ID NO: 409093 - DNA, 25 bp, Mus musculus
caacggtattatcctgctggcggta

SEQ ID NO: 409094 - DNA, 25 bp, Mus musculus
caacggtcgggaatacagcagctgt

SEQ ID NO: 409095 - DNA, 25 bp, Mus musculus
caacggtctcaacgtggaaggcatc

SEQ ID NO: 409096 - DNA, 25 bp, Mus musculus
caacggtggagtggtcttcaaggtc

SEQ ID NO: 409097 - DNA, 25 bp, Mus musculus
caacggttctggaaagatgcagcct

SEQ ID NO: 409098 - DNA, 25 bp, Mus musculus
caacgtaggtggagctctatgagtc

SEQ ID NO: 409099 - DNA, 25 bp, Mus musculus
caacgtcaaagcaaagaggtccaca

SEQ ID NO: 409100 - DNA, 25 bp, Mus musculus
caacgtcaggtgtcctccagggaaa

SEQ ID NO: 409101 - DNA, 25 bp, Mus musculus
caacgtgaaagcataacagctagca

SEQ ID NO: 409102 - DNA, 25 bp, Mus musculus
caacgtgaaagttcggaagtgctcc

SEQ ID NO: 409103 - DNA, 25 bp, Mus musculus
caacgtgcaacgatgtggatacagc

SEQ ID NO: 409104 - DNA, 25 bp, Mus musculus
caacgtgccattcctgtttgatgat

SEQ ID NO: 409105 - DNA, 25 bp, Mus musculus
caacgtgcccgaagagctgagtgtc

SEQ ID NO: 409106 - DNA, 25 bp, Mus musculus
caacgtgccggccaatttcaatgag

SEQ ID NO: 409107 - DNA, 25 bp, Mus musculus
caacgtgctcctgtccagtgatgga

SEQ ID NO: 409108 - DNA, 25 bp, Mus musculus
caacgtggacttcctctgtgaagac

SEQ ID NO: 409109 - DNA, 25 bp, Mus musculus
caacgtggagcagaatgacatgctg

SEQ ID NO: 409110 - DNA, 25 bp, Mus musculus
caacgtgggatcgaatacatatggc

SEQ ID NO: 409111 - DNA, 25 bp, Mus musculus
caacgtgggcaacatggatctctcc

SEQ ID NO: 409112 - DNA, 25 bp, Mus musculus
caacgtggtcccgaataagagcaca

SEQ ID NO: 409113 - DNA, 25 bp, Mus musculus
caacgtggtggtttttattctgaag

SEQ ID NO: 409114 - DNA, 25 bp, Mus musculus
caacgtgtggcctgactgctcacct

SEQ ID NO: 409115 - DNA, 25 bp, Mus musculus
caacgttaatgaagaccggccagca

SEQ ID NO: 409116 - DNA, 25 bp, Mus musculus
caacgttcaagaggttcgatgtcca

SEQ ID NO: 409117 - DNA, 25 bp, Mus musculus
caacgttccgcggtcaatacagcaa

SEQ ID NO: 409118 - DNA, 25 bp, Mus musculus
caacgttgactttgacgacacggag

SEQ ID NO: 409119 - DNA, 25 bp, Mus musculus
caacgttgcccgaggctgatcgaga

SEQ ID NO: 409120 - DNA, 25 bp, Mus musculus
caacgttgtcttaagcccaggtggc

SEQ ID NO: 409121 - DNA, 25 bp, Mus musculus
caacgtttgcgttcgtgagctactg

SEQ ID NO: 409122 - DNA, 25 bp, Mus musculus
caactaaagacgcatgtgaggactc

SEQ ID NO: 409123 - DNA, 25 bp, Mus musculus
caactaaagatccacttacggagac

SEQ ID NO: 409124 - DNA, 25 bp, Mus musculus
caactaaatcgcatagaagaaggca

SEQ ID NO: 409125 - DNA, 25 bp, Mus musculus
caactaactgcgctgggaatggacg

SEQ ID NO: 409126 - DNA, 25 bp, Mus musculus
caactaagacaaggtactgttagcc

SEQ ID NO: 409127 - DNA, 25 bp, Mus musculus
caactaaggatgctgtgctatcaga

SEQ ID NO: 409128 - DNA, 25 bp, Mus musculus
caactaatcacatcgggctctgcct

SEQ ID NO: 409129 - DNA, 25 bp, Mus musculus
caactacaaggcaggttgaggcagg

SEQ ID NO: 409130 - DNA, 25 bp, Mus musculus
caactacagggtgatgggaaactaa

SEQ ID NO: 409131 - DNA, 25 bp, Mus musculus
caactacccgacctgcatgatctgg

SEQ ID NO: 409132 - DNA, 25 bp, Mus musculus
caactacgggaaactggagacactg

SEQ ID NO: 409133 - DNA, 25 bp, Mus musculus
caactactggaattctgtgcgaccc

SEQ ID NO: 409134 - DNA, 25 bp, Mus musculus
caactagcaatctgtgggtggtgac

SEQ ID NO: 409135 - DNA, 25 bp, Mus musculus
caactaggctgggatcactggatca

SEQ ID NO: 409136 - DNA, 25 bp, Mus musculus
caactaggtgcaaataaggcgggtc

SEQ ID NO: 409137 - DNA, 25 bp, Mus musculus
caactataacgtggactaccccagg

SEQ ID NO: 409138 - DNA, 25 bp, Mus musculus
caactataatgtcagcccagtggag

SEQ ID NO: 409139 - DNA, 25 bp, Mus musculus
caactatagcagcttgtcaagagga

SEQ ID NO: 409140 - DNA, 25 bp, Mus musculus
caactatagcgagctgcaggacgcg

SEQ ID NO: 409141 - DNA, 25 bp, Mus musculus
caactatcacagagcgaagcttgcg

SEQ ID NO: 409142 - DNA, 25 bp, Mus musculus
caactatcataggtgtggtcgaaca

SEQ ID NO: 409143 - DNA, 25 bp, Mus musculus
caactatgagcagtggcagtcccag

SEQ ID NO: 409144 - DNA, 25 bp, Mus musculus
caactatgcatctaaccagcgggag

SEQ ID NO: 409145 - DNA, 25 bp, Mus musculus
caactatggaggaggtaataaattc

SEQ ID NO: 409146 - DNA, 25 bp, Mus musculus
caactatgtcgaggcctgcacttga

SEQ ID NO: 409147 - DNA, 25 bp, Mus musculus
caactatgtgggttatggacactga

SEQ ID NO: 409148 - DNA, 25 bp, Mus musculus
caactatgtggtcgacctgggcaac

SEQ ID NO: 409149 - DNA, 25 bp, Mus musculus
caactatgtgtaaggtgggccactc

SEQ ID NO: 409150 - DNA, 25 bp, Mus musculus
caactattctggaggagtcgtcaac

SEQ ID NO: 409151 - DNA, 25 bp, Mus musculus
caactatttgttgcaaagactgaaa

SEQ ID NO: 409152 - DNA, 25 bp, Mus musculus
caactcaaggacgagtggaaccgga

SEQ ID NO: 409153 - DNA, 25 bp, Mus musculus
caactcaagtaagccaaattcattg

SEQ ID NO: 409154 - DNA, 25 bp, Mus musculus
caactcagaacagcaagcctggtgc

SEQ ID NO: 409155 - DNA, 25 bp, Mus musculus
caactcagggtttccaggcttcgtg

SEQ ID NO: 409156 - DNA, 25 bp, Mus musculus
caactcaggtcgttaggcatggtgg

SEQ ID NO: 409157 - DNA, 25 bp, Mus musculus
caactcatggtggtggaaagtccca

SEQ ID NO: 409158 - DNA, 25 bp, Mus musculus
caactcattactgggtatagctcag

SEQ ID NO: 409159 - DNA, 25 bp, Mus musculus
caactccagcaagaaagggctttat

SEQ ID NO: 409160 - DNA, 25 bp, Mus musculus
caactcccatgcaaaagcttttacc

SEQ ID NO: 409161 - DNA, 25 bp, Mus musculus
caactccgatagaggtggtgtctgg

SEQ ID NO: 409162 - DNA, 25 bp, Mus musculus
caactccgggaagatctgctggctc

SEQ ID NO: 409163 - DNA, 25 bp, Mus musculus
caactcctgctgaaatcgttctcca

SEQ ID NO: 409164 - DNA, 25 bp, Mus musculus
caactcgacttgatctccgaggtgc

SEQ ID NO: 409165 - DNA, 25 bp, Mus musculus
caactcgagtgtgtgtagaagtgct

SEQ ID NO: 409166 - DNA, 25 bp, Mus musculus
caactcgccatgatgggctgtggct

SEQ ID NO: 409167 - DNA, 25 bp, Mus musculus
caactctactctggcggtggcaaag

SEQ ID NO: 409168 - DNA, 25 bp, Mus musculus
caactctagcacatagtggcctcag

SEQ ID NO: 409169 - DNA, 25 bp, Mus musculus
caactctagtcctctgcaaggccag

SEQ ID NO: 409170 - DNA, 25 bp, Mus musculus
caactctctggaacggatgatctgt

SEQ ID NO: 409171 - DNA, 25 bp, Mus musculus
caactctgagaaggcggtcgtgaaa

SEQ ID NO: 409172 - DNA, 25 bp, Mus musculus
caactctgcctgaacctatttggtg

SEQ ID NO: 409173 - DNA, 25 bp, Mus musculus
caactctgcctgaagagggcggcac

SEQ ID NO: 409174 - DNA, 25 bp, Mus musculus
caactctggcatcacatacaggaag

SEQ ID NO: 409175 - DNA, 25 bp, Mus musculus
caactctgtgtgagtattcatctcc

SEQ ID NO: 409176 - DNA, 25 bp, Mus musculus
caactcttctccacgcaggagcgag

SEQ ID NO: 409177 - DNA, 25 bp, Mus musculus
caactcttggcgctgcttggctctc

SEQ ID NO: 409178 - DNA, 25 bp, Mus musculus
caactctttctttgctaattcacag

SEQ ID NO: 409179 - DNA, 25 bp, Mus musculus
caactgaaaccgatcggctctggag

SEQ ID NO: 409180 - DNA, 25 bp, Mus musculus
caactgaaagccgaggtggtcgcaa

SEQ ID NO: 409181 - DNA, 25 bp, Mus musculus
caactgaaatcttggtgcaatcagc

SEQ ID NO: 409182 - DNA, 25 bp, Mus musculus
caactgaaatgaatggcaagaagcc

SEQ ID NO: 409183 - DNA, 25 bp, Mus musculus
caactgaataaggaggagatgacgg

SEQ ID NO: 409184 - DNA, 25 bp, Mus musculus
caactgacggagtttgtacagcgcc

SEQ ID NO: 409185 - DNA, 25 bp, Mus musculus
caactgacgtgggaaaggtctccgc

SEQ ID NO: 409186 - DNA, 25 bp, Mus musculus
caactgagaagctaataagcagcac

SEQ ID NO: 409187 - DNA, 25 bp, Mus musculus
caactgagcaggagagtgtgtccct

SEQ ID NO: 409188 - DNA, 25 bp, Mus musculus
caactgagtttcttgattaggtctc

SEQ ID NO: 409189 - DNA, 25 bp, Mus musculus
caactgcaaatgtgcgtacctgcca

SEQ ID NO: 409190 - DNA, 25 bp, Mus musculus
caactgcaagtgatagcgcgtgaca

SEQ ID NO: 409191 - DNA, 25 bp, Mus musculus
caactgcaattttccttccttctac

SEQ ID NO: 409192 - DNA, 25 bp, Mus musculus
caactgcagctggattacttcggag

SEQ ID NO: 409193 - DNA, 25 bp, Mus musculus
caactgcagtggagtgttccggcac

SEQ ID NO: 409194 - DNA, 25 bp, Mus musculus
caactgcatttattattctcgggaa

SEQ ID NO: 409195 - DNA, 25 bp, Mus musculus
caactgccagacagcctatgtggtc

SEQ ID NO: 409196 - DNA, 25 bp, Mus musculus
caactgcctggaaaaacttgcctgc

SEQ ID NO: 409197 - DNA, 25 bp, Mus musculus
caactgcgactacgtgctgtgtgaa

SEQ ID NO: 409198 - DNA, 25 bp, Mus musculus
caactgcgagaaggctatgggcgca

SEQ ID NO: 409199 - DNA, 25 bp, Mus musculus
caactgcggcgatctctactcggag

SEQ ID NO: 409200 - DNA, 25 bp, Mus musculus
caactgcggtacagacgcaccaggt

SEQ ID NO: 409201 - DNA, 25 bp, Mus musculus
caactgcgtggcacacacttcaaga

SEQ ID NO: 409202 - DNA, 25 bp, Mus musculus
caactgcgtgtcctaaatctgttcc

SEQ ID NO: 409203 - DNA, 25 bp, Mus musculus
caactgctaggtagtgtaagcccca

SEQ ID NO: 409204 - DNA, 25 bp, Mus musculus
caactgctagtccatattggccacg

SEQ ID NO: 409205 - DNA, 25 bp, Mus musculus
caactgctgcttatgtgtggactga

SEQ ID NO: 409206 - DNA, 25 bp, Mus musculus
caactgctggtggtgtgcctgtgac

SEQ ID NO: 409207 - DNA, 25 bp, Mus musculus
caactgcttggagacctgaaactca

SEQ ID NO: 409208 - DNA, 25 bp, Mus musculus
caactgcttgggtgaagtgaccatc

SEQ ID NO: 409209 - DNA, 25 bp, Mus musculus
caactgctttctggactgtacgaca

SEQ ID NO: 409210 - DNA, 25 bp, Mus musculus
caactggaagccacaatgattcggg

SEQ ID NO: 409211 - DNA, 25 bp, Mus musculus
caactggaatccagagcccagggag

SEQ ID NO: 409212 - DNA, 25 bp, Mus musculus
caactggcggtaagtcggctgcaga

SEQ ID NO: 409213 - DNA, 25 bp, Mus musculus
caactgggaatgctaaaacgggact

SEQ ID NO: 409214 - DNA, 25 bp, Mus musculus
caactgggaccctgtctcggagaat

SEQ ID NO: 409215 - DNA, 25 bp, Mus musculus
caactgggcagggtgtattttagca

SEQ ID NO: 409216 - DNA, 25 bp, Mus musculus
caactgggtatttggcgaggtcacg

SEQ ID NO: 409217 - DNA, 25 bp, Mus musculus
caactgggtgtgtgctcacgtgctc

SEQ ID NO: 409218 - DNA, 25 bp, Mus musculus
caactggtattctagctggagcaaa

SEQ ID NO: 409219 - DNA, 25 bp, Mus musculus
caactggtggtgctaactgtgcgca

SEQ ID NO: 409220 - DNA, 25 bp, Mus musculus
caactgtaacaaaccccactgggag

SEQ ID NO: 409221 - DNA, 25 bp, Mus musculus
caactgtcagcatgaatcaaggtca

SEQ ID NO: 409222 - DNA, 25 bp, Mus musculus
caactgtcatctggaatttgcaacc

SEQ ID NO: 409223 - DNA, 25 bp, Mus musculus
caactgtccaggaggaaaacgagcc

SEQ ID NO: 409224 - DNA, 25 bp, Mus musculus
caactgtcgttctaaatggctatga

SEQ ID NO: 409225 - DNA, 25 bp, Mus musculus
caactgtctgcgaaggcgattcctg

SEQ ID NO: 409226 - DNA, 25 bp, Mus musculus
caactgtgacaagcatggccggtac

SEQ ID NO: 409227 - DNA, 25 bp, Mus musculus
caactgtgacagatactccgtagga

SEQ ID NO: 409228 - DNA, 25 bp, Mus musculus
caactgtgacagtgggactcctggc

SEQ ID NO: 409229 - DNA, 25 bp, Mus musculus
caactgtgacctttgtggcaagagc

SEQ ID NO: 409230 - DNA, 25 bp, Mus musculus
caactgtgagggatgtagttgccct

SEQ ID NO: 409231 - DNA, 25 bp, Mus musculus
caactgtgattgatcctggcgccca

SEQ ID NO: 409232 - DNA, 25 bp, Mus musculus
caactgtggacaactggaggcagat

SEQ ID NO: 409233 - DNA, 25 bp, Mus musculus
caactgtgtcagagagcttcggtcc

SEQ ID NO: 409234 - DNA, 25 bp, Mus musculus
caactgttcagtgatggctgtggac

SEQ ID NO: 409235 - DNA, 25 bp, Mus musculus
caactgttcatgcagatggcagagc

SEQ ID NO: 409236 - DNA, 25 bp, Mus musculus
caactgttgtgttgaaggctgcagc

SEQ ID NO: 409237 - DNA, 25 bp, Mus musculus
caactgtttttgtagctaagatgag

SEQ ID NO: 409238 - DNA, 25 bp, Mus musculus
caacttaacctgtagccaaggataa

SEQ ID NO: 409239 - DNA, 25 bp, Mus musculus
caacttaagtctctgcagcaagcac

SEQ ID NO: 409240 - DNA, 25 bp, Mus musculus
caacttaattctaagcccagctggg

SEQ ID NO: 409241 - DNA, 25 bp, Mus musculus
caacttactgtttcaaggtggacgt

SEQ ID NO: 409242 - DNA, 25 bp, Mus musculus
caacttagatcgtcaggctacatga

SEQ ID NO: 409243 - DNA, 25 bp, Mus musculus
caacttagtggcctgggagacaagc

SEQ ID NO: 409244 - DNA, 25 bp, Mus musculus
caacttagtgggacacgagctgcag

SEQ ID NO: 409245 - DNA, 25 bp, Mus musculus
caacttattggcatgatggagtgac

SEQ ID NO: 409246 - DNA, 25 bp, Mus musculus
caacttcaaggacatgggctgggac

SEQ ID NO: 409247 - DNA, 25 bp, Mus musculus
caacttcaaggtcggagagggcttc

SEQ ID NO: 409248 - DNA, 25 bp, Mus musculus
caacttcacacactctgcggtcggt

SEQ ID NO: 409249 - DNA, 25 bp, Mus musculus
caacttcactatcctggccctgggt

SEQ ID NO: 409250 - DNA, 25 bp, Mus musculus
caacttcagcagtcaggagaaggga

SEQ ID NO: 409251 - DNA, 25 bp, Mus musculus
caacttccgggagctggtgcacatt

SEQ ID NO: 409252 - DNA, 25 bp, Mus musculus
caacttcgtaaggagactgaggagc

SEQ ID NO: 409253 - DNA, 25 bp, Mus musculus
caacttcgtcaagggtccggctgta

SEQ ID NO: 409254 - DNA, 25 bp, Mus musculus
caacttctctacctgctcttctgga

SEQ ID NO: 409255 - DNA, 25 bp, Mus musculus
caacttctgtttaggagtctgaagc

SEQ ID NO: 409256 - DNA, 25 bp, Mus musculus
caacttcttaggcaaagcgtcaggg

SEQ ID NO: 409257 - DNA, 25 bp, Mus musculus
caacttcttccggaatgcactgtgg

SEQ ID NO: 409258 - DNA, 25 bp, Mus musculus
caacttcttggtcaaggtcttggga

SEQ ID NO: 409259 - DNA, 25 bp, Mus musculus
caacttgaagtacactggccctgct

SEQ ID NO: 409260 - DNA, 25 bp, Mus musculus
caacttgaccaaaaagcgggtgacg

SEQ ID NO: 409261 - DNA, 25 bp, Mus musculus
caacttgagagtgctatgcgcagct

SEQ ID NO: 409262 - DNA, 25 bp, Mus musculus
caacttgatgatgtcgtccgggcag

SEQ ID NO: 409263 - DNA, 25 bp, Mus musculus
caacttgcgactgatttggtttcct

SEQ ID NO: 409264 - DNA, 25 bp, Mus musculus
caacttgcggttagcatgtaaaagc

SEQ ID NO: 409265 - DNA, 25 bp, Mus musculus
caacttgcgtaaaaagggagccgat

SEQ ID NO: 409266 - DNA, 25 bp, Mus musculus
caacttgcgtgtttgtccgcggctc

SEQ ID NO: 409267 - DNA, 25 bp, Mus musculus
caacttggccgatgcttccaggaaa

SEQ ID NO: 409268 - DNA, 25 bp, Mus musculus
caacttggcgctctacttgctgtag

SEQ ID NO: 409269 - DNA, 25 bp, Mus musculus
caacttggctatggcacagacgctg

SEQ ID NO: 409270 - DNA, 25 bp, Mus musculus
caacttgggcaaaggcgttctggac

SEQ ID NO: 409271 - DNA, 25 bp, Mus musculus
caacttggtcaaaatggcatcagca

SEQ ID NO: 409272 - DNA, 25 bp, Mus musculus
caacttggtggcgtgttcgtcaacg

SEQ ID NO: 409273 - DNA, 25 bp, Mus musculus
caacttggtggcttctcctgggata

SEQ ID NO: 409274 - DNA, 25 bp, Mus musculus
caacttgtactgaatctatgggtcc

SEQ ID NO: 409275 - DNA, 25 bp, Mus musculus
caactttaggagacctgggcaatcc

SEQ ID NO: 409276 - DNA, 25 bp, Mus musculus
caactttagtgggaagacttctgcc

SEQ ID NO: 409277 - DNA, 25 bp, Mus musculus
caactttccaatcctgcgcggtcag

SEQ ID NO: 409278 - DNA, 25 bp, Mus musculus
caactttcgagttctttgtggactg

SEQ ID NO: 409279 - DNA, 25 bp, Mus musculus
caactttgcgaatgcagttagcgat

SEQ ID NO: 409280 - DNA, 25 bp, Mus musculus
caactttgcgtgctttgttctctgg

SEQ ID NO: 409281 - DNA, 25 bp, Mus musculus
caactttgtgactggcctatggttc

SEQ ID NO: 409282 - DNA, 25 bp, Mus musculus
caactttgtggagaggtgggaccac

SEQ ID NO: 409283 - DNA, 25 bp, Mus musculus
caactttgtggtacaggtcagcgtc

SEQ ID NO: 409284 - DNA, 25 bp, Mus musculus
caacttttcccagctagacagacag

SEQ ID NO: 409285 - DNA, 25 bp, Mus musculus
caacttttctatctgtacatactag

SEQ ID NO: 409286 - DNA, 25 bp, Mus musculus
caacttttggtgtgggatcactcca

SEQ ID NO: 409287 - DNA, 25 bp, Mus musculus
caacttttgtgagcccaacccagag

SEQ ID NO: 409288 - DNA, 25 bp, Mus musculus
caagaaaaaggcctgtcacggtgca

SEQ ID NO: 409289 - DNA, 25 bp, Mus musculus
caagaaaaatgagtagcctgccgat

SEQ ID NO: 409290 - DNA, 25 bp, Mus musculus
caagaaaaatggagatcagagagaa

SEQ ID NO: 409291 - DNA, 25 bp, Mus musculus
caagaaaacgggactgtgcatgcca

SEQ ID NO: 409292 - DNA, 25 bp, Mus musculus
caagaaaagcttgtaagagactgag

SEQ ID NO: 409293 - DNA, 25 bp, Mus musculus
caagaaaagggatgtggccaaggac

SEQ ID NO: 409294 - DNA, 25 bp, Mus musculus
caagaaaagtcaccgagcactggag

SEQ ID NO: 409295 - DNA, 25 bp, Mus musculus
caagaaaagtggctcctggtacatc

SEQ ID NO: 409296 - DNA, 25 bp, Mus musculus
caagaaaatcttgacactcctggca

SEQ ID NO: 409297 - DNA, 25 bp, Mus musculus
caagaaaatgaacgtttgtctccac

SEQ ID NO: 409298 - DNA, 25 bp, Mus musculus
caagaaaattccatatagataggct

SEQ ID NO: 409299 - DNA, 25 bp, Mus musculus
caagaaacatggctacacggtcaaa

SEQ ID NO: 409300 - DNA, 25 bp, Mus musculus
caagaaacccgagcctaagaaggag

SEQ ID NO: 409301 - DNA, 25 bp, Mus musculus
caagaaaccgctttgaaggaaccag

SEQ ID NO: 409302 - DNA, 25 bp, Mus musculus
caagaaacgattgtgcggacggcat

SEQ ID NO: 409303 - DNA, 25 bp, Mus musculus
caagaaacgctttggccagtggacc

SEQ ID NO: 409304 - DNA, 25 bp, Mus musculus
caagaaacggcataccagaggtggc

SEQ ID NO: 409305 - DNA, 25 bp, Mus musculus
caagaaagaggcgagctctggccgt

SEQ ID NO: 409306 - DNA, 25 bp, Mus musculus
caagaaagcaggtgaactgggatcc

SEQ ID NO: 409307 - DNA, 25 bp, Mus musculus
caagaaagctgcaccttgagatggc

SEQ ID NO: 409308 - DNA, 25 bp, Mus musculus
caagaaaggagactaccagaaggcc

SEQ ID NO: 409309 - DNA, 25 bp, Mus musculus
caagaaaggagtccagataatgaag

SEQ ID NO: 409310 - DNA, 25 bp, Mus musculus
caagaaagtgaagtccgctagggat

SEQ ID NO: 409311 - DNA, 25 bp, Mus musculus
caagaaagttctacaggacaagcga

SEQ ID NO: 409312 - DNA, 25 bp, Mus musculus
caagaaatcgggatgtcagcctcaa

SEQ ID NO: 409313 - DNA, 25 bp, Mus musculus
caagaaatctgacaatgggacctac

SEQ ID NO: 409314 - DNA, 25 bp, Mus musculus
caagaaatgaaagcgggcaagagac

SEQ ID NO: 409315 - DNA, 25 bp, Mus musculus
caagaaatgaagcttctatagaagt

SEQ ID NO: 409316 - DNA, 25 bp, Mus musculus
caagaaattgaaacacggaggcagc

SEQ ID NO: 409317 - DNA, 25 bp, Mus musculus
caagaacaaatgaggtcctcagcag

SEQ ID NO: 409318 - DNA, 25 bp, Mus musculus
caagaacaagctcaactgcatagca

SEQ ID NO: 409319 - DNA, 25 bp, Mus musculus
caagaacaccagacgctcaaggaga

SEQ ID NO: 409320 - DNA, 25 bp, Mus musculus
caagaacacggagaccttcagggag

SEQ ID NO: 409321 - DNA, 25 bp, Mus musculus
caagaacactttggcggtgcacctc

SEQ ID NO: 409322 - DNA, 25 bp, Mus musculus
caagaacagcaacgagtaccgggta

SEQ ID NO: 409323 - DNA, 25 bp, Mus musculus
caagaacaggcgacacttgagaggt

SEQ ID NO: 409324 - DNA, 25 bp, Mus musculus
caagaacagggaaacatgataccaa

SEQ ID NO: 409325 - DNA, 25 bp, Mus musculus
caagaacatgagcagcgacggctgt

SEQ ID NO: 409326 - DNA, 25 bp, Mus musculus
caagaacatgattgggcaagcaccc

SEQ ID NO: 409327 - DNA, 25 bp, Mus musculus
caagaacatgtttgccatctggcga

SEQ ID NO: 409328 - DNA, 25 bp, Mus musculus
caagaacattcaggacgtgggtgcc

SEQ ID NO: 409329 - DNA, 25 bp, Mus musculus
caagaaccagagtttgccatgccag

SEQ ID NO: 409330 - DNA, 25 bp, Mus musculus
caagaaccagtagcatacacagtgt

SEQ ID NO: 409331 - DNA, 25 bp, Mus musculus
caagaaccatctagtgaaagccgcc

SEQ ID NO: 409332 - DNA, 25 bp, Mus musculus
caagaaccatgagtcagccgaggag

SEQ ID NO: 409333 - DNA, 25 bp, Mus musculus
caagaaccccgatcattctgaggct

SEQ ID NO: 409334 - DNA, 25 bp, Mus musculus
caagaaccgatgcagttcggaagag

SEQ ID NO: 409335 - DNA, 25 bp, Mus musculus
caagaaccgcacagtctctggtggg

SEQ ID NO: 409336 - DNA, 25 bp, Mus musculus
caagaacctacgcatccagtgtgag

SEQ ID NO: 409337 - DNA, 25 bp, Mus musculus
caagaacctactgtgggagccatcg

SEQ ID NO: 409338 - DNA, 25 bp, Mus musculus
caagaacctggtacagctggagggc

SEQ ID NO: 409339 - DNA, 25 bp, Mus musculus
caagaacctgtacatgagggaccag

SEQ ID NO: 409340 - DNA, 25 bp, Mus musculus
caagaacggcattcagtggtgtcca

SEQ ID NO: 409341 - DNA, 25 bp, Mus musculus
caagaacggctacaacctccgaagg

SEQ ID NO: 409342 - DNA, 25 bp, Mus musculus
caagaactcactgatgcacgcagag

SEQ ID NO: 409343 - DNA, 25 bp, Mus musculus
caagaactccagcagtctaaatcca

SEQ ID NO: 409344 - DNA, 25 bp, Mus musculus
caagaactccgtgaagtcagtacca

SEQ ID NO: 409345 - DNA, 25 bp, Mus musculus
caagaactccgtgggatcactggga

SEQ ID NO: 409346 - DNA, 25 bp, Mus musculus
caagaactcgtaagagtaagggagc

SEQ ID NO: 409347 - DNA, 25 bp, Mus musculus
caagaactggcctgtcagaatgacc

SEQ ID NO: 409348 - DNA, 25 bp, Mus musculus
caagaactgtggatagcgcagagcc

SEQ ID NO: 409349 - DNA, 25 bp, Mus musculus
caagaactgtgtcatgtcccggaag

SEQ ID NO: 409350 - DNA, 25 bp, Mus musculus
caagaactgttcattcaagatagca

SEQ ID NO: 409351 - DNA, 25 bp, Mus musculus
caagaacttcacatggatggacaga

SEQ ID NO: 409352 - DNA, 25 bp, Mus musculus
caagaacttctacggtggcaatggc

SEQ ID NO: 409353 - DNA, 25 bp, Mus musculus
caagaagaagacagagcactccatc

SEQ ID NO: 409354 - DNA, 25 bp, Mus musculus
caagaagaagctctgagatgaggcc

SEQ ID NO: 409355 - DNA, 25 bp, Mus musculus
caagaagaagggactgttccggcgc

SEQ ID NO: 409356 - DNA, 25 bp, Mus musculus
caagaagacggcatgcgtgttaccc

SEQ ID NO: 409357 - DNA, 25 bp, Mus musculus
caagaagagaatcacgccaggagag

SEQ ID NO: 409358 - DNA, 25 bp, Mus musculus
caagaagagacccacacactgtgga

SEQ ID NO: 409359 - DNA, 25 bp, Mus musculus
caagaagagcatcggaatcccagag

SEQ ID NO: 409360 - DNA, 25 bp, Mus musculus
caagaagagcgagctcagctgtgcc

SEQ ID NO: 409361 - DNA, 25 bp, Mus musculus
caagaagaggaaaacgaccctgctg

SEQ ID NO: 409362 - DNA, 25 bp, Mus musculus
caagaagaggaagtttcagcccctc

SEQ ID NO: 409363 - DNA, 25 bp, Mus musculus
caagaagagggtccatcgctgtcag

SEQ ID NO: 409364 - DNA, 25 bp, Mus musculus
caagaagcaacaagccagagtgatg

SEQ ID NO: 409365 - DNA, 25 bp, Mus musculus
caagaagcaacacactaagaaaaac

SEQ ID NO: 409366 - DNA, 25 bp, Mus musculus
caagaagcacaaggcggaatggcgc

SEQ ID NO: 409367 - DNA, 25 bp, Mus musculus
caagaagcaccgcaacaagatgtac

SEQ ID NO: 409368 - DNA, 25 bp, Mus musculus
caagaagcactacctgtgttatgac

SEQ ID NO: 409369 - DNA, 25 bp, Mus musculus
caagaagcactcgtagacattgggc

SEQ ID NO: 409370 - DNA, 25 bp, Mus musculus
caagaagcaggtgggctcaggtttc

SEQ ID NO: 409371 - DNA, 25 bp, Mus musculus
caagaagccaactgtgggctgccgt

SEQ ID NO: 409372 - DNA, 25 bp, Mus musculus
caagaagccatgctctcaatggaga

SEQ ID NO: 409373 - DNA, 25 bp, Mus musculus
caagaagccatgttgactgacagcc

SEQ ID NO: 409374 - DNA, 25 bp, Mus musculus
caagaagcgctacttccggctgagt

SEQ ID NO: 409375 - DNA, 25 bp, Mus musculus
caagaagcggccatgaatcaggacg

SEQ ID NO: 409376 - DNA, 25 bp, Mus musculus
caagaagcgggaaggtgagctcaca

SEQ ID NO: 409377 - DNA, 25 bp, Mus musculus
caagaagctactttagggcacacca

SEQ ID NO: 409378 - DNA, 25 bp, Mus musculus
caagaagctcctggtctaattggcc

SEQ ID NO: 409379 - DNA, 25 bp, Mus musculus
caagaagctggcacggcgaagaaat

SEQ ID NO: 409380 - DNA, 25 bp, Mus musculus
caagaagctgtactggacggactcc

SEQ ID NO: 409381 - DNA, 25 bp, Mus musculus
caagaagcttcccacggatgtgcca

SEQ ID NO: 409382 - DNA, 25 bp, Mus musculus
caagaagcttcgaggcttcagctgt

SEQ ID NO: 409383 - DNA, 25 bp, Mus musculus
caagaaggaagtagcaatggaggac

SEQ ID NO: 409384 - DNA, 25 bp, Mus musculus
caagaaggactcaccattggcagca

SEQ ID NO: 409385 - DNA, 25 bp, Mus musculus
caagaaggaggatggctttaccgca

SEQ ID NO: 409386 - DNA, 25 bp, Mus musculus
caagaaggatgcaaaaggtccagcc

SEQ ID NO: 409387 - DNA, 25 bp, Mus musculus
caagaaggccaatgatcgggagcgc

SEQ ID NO: 409388 - DNA, 25 bp, Mus musculus
caagaaggccctttgagtcgttcct

SEQ ID NO: 409389 - DNA, 25 bp, Mus musculus
caagaaggctcaggtgaagagctgt

SEQ ID NO: 409390 - DNA, 25 bp, Mus musculus
caagaaggctgagtatggctcccaa

SEQ ID NO: 409391 - DNA, 25 bp, Mus musculus
caagaaggctttgtgcacgtgagga

SEQ ID NO: 409392 - DNA, 25 bp, Mus musculus
caagaagggcttgtccaaaggctgc

SEQ ID NO: 409393 - DNA, 25 bp, Mus musculus
caagaagggtaagcaggacaaagct

SEQ ID NO: 409394 - DNA, 25 bp, Mus musculus
caagaagggttcaaagatcgcgccg

SEQ ID NO: 409395 - DNA, 25 bp, Mus musculus
caagaaggtagacattgccggcatc

SEQ ID NO: 409396 - DNA, 25 bp, Mus musculus
caagaaggttcgtctggtgccacga

SEQ ID NO: 409397 - DNA, 25 bp, Mus musculus
caagaagtacacacaggctgggaac

SEQ ID NO: 409398 - DNA, 25 bp, Mus musculus
caagaagtattaggtcggaaagaca

SEQ ID NO: 409399 - DNA, 25 bp, Mus musculus
caagaagtccaaggctgagcagagc

SEQ ID NO: 409400 - DNA, 25 bp, Mus musculus
caagaagtgccgtttcccagacgac

SEQ ID NO: 409401 - DNA, 25 bp, Mus musculus
caagaagtggaacatatcaccagcc

SEQ ID NO: 409402 - DNA, 25 bp, Mus musculus
caagaagtggacagcatgcggagca

SEQ ID NO: 409403 - DNA, 25 bp, Mus musculus
caagaagtggtcattgcgctggccc

SEQ ID NO: 409404 - DNA, 25 bp, Mus musculus
caagaagtgtctggagctcatgagt

SEQ ID NO: 409405 - DNA, 25 bp, Mus musculus
caagaagttactggctcacaagcgc

SEQ ID NO: 409406 - DNA, 25 bp, Mus musculus
caagaagttctagctgtgcacaaga

SEQ ID NO: 409407 - DNA, 25 bp, Mus musculus
caagaagttgcaacaggctaaagga

SEQ ID NO: 409408 - DNA, 25 bp, Mus musculus
caagaatccttagcccaagcaagtg

SEQ ID NO: 409409 - DNA, 25 bp, Mus musculus
caagaatcgcaagaaagccagagcc

SEQ ID NO: 409410 - DNA, 25 bp, Mus musculus
caagaatcttaagcgcgtggccaag

SEQ ID NO: 409411 - DNA, 25 bp, Mus musculus
caagaatcttcctgccctgttgaga

SEQ ID NO: 409412 - DNA, 25 bp, Mus musculus
caagaatgccgaaatttaaggagcc

SEQ ID NO: 409413 - DNA, 25 bp, Mus musculus
caagaatgcctggtaaatgaagccc

SEQ ID NO: 409414 - DNA, 25 bp, Mus musculus
caagaatggctgttatggcgaaaag

SEQ ID NO: 409415 - DNA, 25 bp, Mus musculus
caagaatgggctcgtccacggtgtc

SEQ ID NO: 409416 - DNA, 25 bp, Mus musculus
caagaatggttgtcccagtggcagc

SEQ ID NO: 409417 - DNA, 25 bp, Mus musculus
caagaatgtctttaagcctgccaac

SEQ ID NO: 409418 - DNA, 25 bp, Mus musculus
caagaatgtgcctagctggcataaa

SEQ ID NO: 409419 - DNA, 25 bp, Mus musculus
caagaatgttctcccactgatgtgt

SEQ ID NO: 409420 - DNA, 25 bp, Mus musculus
caagaattagattctcaccgggagg

SEQ ID NO: 409421 - DNA, 25 bp, Mus musculus
caagaattatggtgtgttcccagca

SEQ ID NO: 409422 - DNA, 25 bp, Mus musculus
caagaattcaagaaggcaaggaacc

SEQ ID NO: 409423 - DNA, 25 bp, Mus musculus
caagaattcaatgctcggcgcaagc

SEQ ID NO: 409424 - DNA, 25 bp, Mus musculus
caagaattttggaccgactgctgga

SEQ ID NO: 409425 - DNA, 25 bp, Mus musculus
caagacaaaaaagtaggtcagtttg

SEQ ID NO: 409426 - DNA, 25 bp, Mus musculus
caagacaagatagacagaagcagag

SEQ ID NO: 409427 - DNA, 25 bp, Mus musculus
caagacaattttaacctacagtagg

SEQ ID NO: 409428 - DNA, 25 bp, Mus musculus
caagacaatttttctctgtagcctt

SEQ ID NO: 409429 - DNA, 25 bp, Mus musculus
caagacacaccttcatggagacaca

SEQ ID NO: 409430 - DNA, 25 bp, Mus musculus
caagacactggacttcgagatgttc

SEQ ID NO: 409431 - DNA, 25 bp, Mus musculus
caagacacttggctaattaatgttt

SEQ ID NO: 409432 - DNA, 25 bp, Mus musculus
caagacagaattttcccagtgccaa

SEQ ID NO: 409433 - DNA, 25 bp, Mus musculus
caagacagagaacctagatcgagcc

SEQ ID NO: 409434 - DNA, 25 bp, Mus musculus
caagacagcgttgctgcaggtgttc

SEQ ID NO: 409435 - DNA, 25 bp, Mus musculus
caagacagctcactccagaagaaag

SEQ ID NO: 409436 - DNA, 25 bp, Mus musculus
caagacagctccactttcgaaaggg

SEQ ID NO: 409437 - DNA, 25 bp, Mus musculus
caagacaggcatggtttttccgcaa

SEQ ID NO: 409438 - DNA, 25 bp, Mus musculus
caagacagggtttttatatggagct

SEQ ID NO: 409439 - DNA, 25 bp, Mus musculus
caagacagtctttatacagtgtcca

SEQ ID NO: 409440 - DNA, 25 bp, Mus musculus
caagacagtgcctaccagagcatcg

SEQ ID NO: 409441 - DNA, 25 bp, Mus musculus
caagacagtgctccctaatagtcct

SEQ ID NO: 409442 - DNA, 25 bp, Mus musculus
caagacatacatctgagccgggcgt

SEQ ID NO: 409443 - DNA, 25 bp, Mus musculus
caagacatccaaggcagagtaaagg

SEQ ID NO: 409444 - DNA, 25 bp, Mus musculus
caagacatccctgagttttataaat

SEQ ID NO: 409445 - DNA, 25 bp, Mus musculus
caagacatgtctagcccaacgctag

SEQ ID NO: 409446 - DNA, 25 bp, Mus musculus
caagaccaaaggcaaacatgtgttc

SEQ ID NO: 409447 - DNA, 25 bp, Mus musculus
caagaccaagaggtactagtggtgt

SEQ ID NO: 409448 - DNA, 25 bp, Mus musculus
caagaccagtagacccagaaagagt

SEQ ID NO: 409449 - DNA, 25 bp, Mus musculus
caagaccagtgtttataccaatacc

SEQ ID NO: 409450 - DNA, 25 bp, Mus musculus
caagaccataggaacagcgaatggg

SEQ ID NO: 409451 - DNA, 25 bp, Mus musculus
caagaccatgatctttccagtccag

SEQ ID NO: 409452 - DNA, 25 bp, Mus musculus
caagaccatggctgactgcaacaga

SEQ ID NO: 409453 - DNA, 25 bp, Mus musculus
caagacccaagaggagtgcgtggcc

SEQ ID NO: 409454 - DNA, 25 bp, Mus musculus
caagacccaaggctgtcatgagcag

SEQ ID NO: 409455 - DNA, 25 bp, Mus musculus
caagacccaggtaatgagctagcag

SEQ ID NO: 409456 - DNA, 25 bp, Mus musculus
caagacccggacagtgacaagaatg

SEQ ID NO: 409457 - DNA, 25 bp, Mus musculus
caagaccctcctggaagagaaggca

SEQ ID NO: 409458 - DNA, 25 bp, Mus musculus
caagaccctgcagaacatcctggag

SEQ ID NO: 409459 - DNA, 25 bp, Mus musculus
caagaccctggaattaatacaacca

SEQ ID NO: 409460 - DNA, 25 bp, Mus musculus
caagaccctgtttccaggtgtgtga

SEQ ID NO: 409461 - DNA, 25 bp, Mus musculus
caagaccctttatctaccaggagtg

SEQ ID NO: 409462 - DNA, 25 bp, Mus musculus
caagaccgctaaaatgcagggcaac

SEQ ID NO: 409463 - DNA, 25 bp, Mus musculus
caagaccgggcctatgattatgtgg

SEQ ID NO: 409464 - DNA, 25 bp, Mus musculus
caagacctagaatgaccaagaatgt

SEQ ID NO: 409465 - DNA, 25 bp, Mus musculus
caagacctattgagtggcgtgaacc

SEQ ID NO: 409466 - DNA, 25 bp, Mus musculus
caagacctgggctagccctgtggtc

SEQ ID NO: 409467 - DNA, 25 bp, Mus musculus
caagacctggttccaaaatcggagg

SEQ ID NO: 409468 - DNA, 25 bp, Mus musculus
caagacctggttcctcatgtgtaaa

SEQ ID NO: 409469 - DNA, 25 bp, Mus musculus
caagacctgtatgctttgaagtcaa

SEQ ID NO: 409470 - DNA, 25 bp, Mus musculus
caagacctgttcctagtagcctatg

SEQ ID NO: 409471 - DNA, 25 bp, Mus musculus
caagacgagggtgtcaactccgaga

SEQ ID NO: 409472 - DNA, 25 bp, Mus musculus
caagacgctgcagcaatattgagca

SEQ ID NO: 409473 - DNA, 25 bp, Mus musculus
caagacgctgctcagttactcggag

SEQ ID NO: 409474 - DNA, 25 bp, Mus musculus
caagacggtaagcagagctcacaca

SEQ ID NO: 409475 - DNA, 25 bp, Mus musculus
caagactatgtccactcaggagccc

SEQ ID NO: 409476 - DNA, 25 bp, Mus musculus
caagactccttctgcagttcagcaa

SEQ ID NO: 409477 - DNA, 25 bp, Mus musculus
caagactcgctgctgatccggagga

SEQ ID NO: 409478 - DNA, 25 bp, Mus musculus
caagactcggtggacttctcgctgg

SEQ ID NO: 409479 - DNA, 25 bp, Mus musculus
caagactcgtgtggagctcggaaag

SEQ ID NO: 409480 - DNA, 25 bp, Mus musculus
caagactctgaagggtggctacacc

SEQ ID NO: 409481 - DNA, 25 bp, Mus musculus
caagactctgctggatacatggact

SEQ ID NO: 409482 - DNA, 25 bp, Mus musculus
caagactgcagagtacgacgtggcc

SEQ ID NO: 409483 - DNA, 25 bp, Mus musculus
caagactgcctttaacctaaccgtg

SEQ ID NO: 409484 - DNA, 25 bp, Mus musculus
caagactgctgggaacgtacttctg

SEQ ID NO: 409485 - DNA, 25 bp, Mus musculus
caagactggcacgactggatgaaca

SEQ ID NO: 409486 - DNA, 25 bp, Mus musculus
caagactggtcacctcacgttggtc

SEQ ID NO: 409487 - DNA, 25 bp, Mus musculus
caagactgtcatgcacaaggaggca

SEQ ID NO: 409488 - DNA, 25 bp, Mus musculus
caagacttacctagatgtgccccaa

SEQ ID NO: 409489 - DNA, 25 bp, Mus musculus
caagacttcgagaggacgggatcca

SEQ ID NO: 409490 - DNA, 25 bp, Mus musculus
caagacttcgttggacatgatctcc

SEQ ID NO: 409491 - DNA, 25 bp, Mus musculus
caagacttgcttgtgaggctcctct

SEQ ID NO: 409492 - DNA, 25 bp, Mus musculus
caagacttggaacccctgtggaatc

SEQ ID NO: 409493 - DNA, 25 bp, Mus musculus
caagacttgttccttaccagcgaag

SEQ ID NO: 409494 - DNA, 25 bp, Mus musculus
caagactttcaactttctacccagg

SEQ ID NO: 409495 - DNA, 25 bp, Mus musculus
caagactttctctggctggctgggc

SEQ ID NO: 409496 - DNA, 25 bp, Mus musculus
caagagaaaagggagcaagtcctgc

SEQ ID NO: 409497 - DNA, 25 bp, Mus musculus
caagagaaatgaattgtactgactc

SEQ ID NO: 409498 - DNA, 25 bp, Mus musculus
caagagaaattcaggcctggctgca

SEQ ID NO: 409499 - DNA, 25 bp, Mus musculus
caagagaacaactagtggaccaggg

SEQ ID NO: 409500 - DNA, 25 bp, Mus musculus
caagagaagcgggtcatttcagggt

SEQ ID NO: 409501 - DNA, 25 bp, Mus musculus
caagagaagtatgttggaaatccca

SEQ ID NO: 409502 - DNA, 25 bp, Mus musculus
caagagaattggctttatagcaaat

SEQ ID NO: 409503 - DNA, 25 bp, Mus musculus
caagagacaaccaccaaacatgacc

SEQ ID NO: 409504 - DNA, 25 bp, Mus musculus
caagagacacttggtagaacccagc

SEQ ID NO: 409505 - DNA, 25 bp, Mus musculus
caagagacagatagtggctggcacc

SEQ ID NO: 409506 - DNA, 25 bp, Mus musculus
caagagaccatagtaccgaaggagc

SEQ ID NO: 409507 - DNA, 25 bp, Mus musculus
caagagacctccagaaatcacagcg

SEQ ID NO: 409508 - DNA, 25 bp, Mus musculus
caagagacctgggttttgtccagaa

SEQ ID NO: 409509 - DNA, 25 bp, Mus musculus
caagagacgagctttccctggagga

SEQ ID NO: 409510 - DNA, 25 bp, Mus musculus
caagagactgccttctgaactagac

SEQ ID NO: 409511 - DNA, 25 bp, Mus musculus
caagagacttcagcttacagcaggc

SEQ ID NO: 409512 - DNA, 25 bp, Mus musculus
caagagagccgggacattaacgcct

SEQ ID NO: 409513 - DNA, 25 bp, Mus musculus
caagagagcctccacaagcatgtag

SEQ ID NO: 409514 - DNA, 25 bp, Mus musculus
caagagagcttggtcagcaacaatc

SEQ ID NO: 409515 - DNA, 25 bp, Mus musculus
caagagaggctcttaatccagctgt

SEQ ID NO: 409516 - DNA, 25 bp, Mus musculus
caagagaggtacatccccgaggata

SEQ ID NO: 409517 - DNA, 25 bp, Mus musculus
caagagagtattcaccaagagcaag

SEQ ID NO: 409518 - DNA, 25 bp, Mus musculus
caagagagtcaactccaaagtccac

SEQ ID NO: 409519 - DNA, 25 bp, Mus musculus
caagagagttgtaccgaaaggcaaa

SEQ ID NO: 409520 - DNA, 25 bp, Mus musculus
caagagatgaccgtgtgactacagt

SEQ ID NO: 409521 - DNA, 25 bp, Mus musculus
caagagattcttggtaccagcagta

SEQ ID NO: 409522 - DNA, 25 bp, Mus musculus
caagagatttctggcactgctgaca

SEQ ID NO: 409523 - DNA, 25 bp, Mus musculus
caagagcaagtatggacctgccgga

SEQ ID NO: 409524 - DNA, 25 bp, Mus musculus
caagagcaagtttgagtacgtgcgg

SEQ ID NO: 409525 - DNA, 25 bp, Mus musculus
caagagcaagtttgggacagccgct

SEQ ID NO: 409526 - DNA, 25 bp, Mus musculus
caagagcactgctggatagttgcct

SEQ ID NO: 409527 - DNA, 25 bp, Mus musculus
caagagcactgtctatgggcaaatg

SEQ ID NO: 409528 - DNA, 25 bp, Mus musculus
caagagcagaggtaagtcacgcacg

SEQ ID NO: 409529 - DNA, 25 bp, Mus musculus
caagagcagcaaggatacagggagc

SEQ ID NO: 409530 - DNA, 25 bp, Mus musculus
caagagcagctctttagccaggagg

SEQ ID NO: 409531 - DNA, 25 bp, Mus musculus
caagagcagtctttgccttggagct

SEQ ID NO: 409532 - DNA, 25 bp, Mus musculus
caagagcagtggttccgagtgagcc

SEQ ID NO: 409533 - DNA, 25 bp, Mus musculus
caagagcatacattttgaaggcttc

SEQ ID NO: 409534 - DNA, 25 bp, Mus musculus
caagagcatcagaaacacgtacaca

SEQ ID NO: 409535 - DNA, 25 bp, Mus musculus
caagagcatcctttatcaacaggga

SEQ ID NO: 409536 - DNA, 25 bp, Mus musculus
caagagcattaatcccgacgaggcg

SEQ ID NO: 409537 - DNA, 25 bp, Mus musculus
caagagccctctgatgaagccgagc

SEQ ID NO: 409538 - DNA, 25 bp, Mus musculus
caagagccgaatgtttcgtgtccag

SEQ ID NO: 409539 - DNA, 25 bp, Mus musculus
caagagcctggatgactcccagtgc

SEQ ID NO: 409540 - DNA, 25 bp, Mus musculus
caagagcctgtacctggatctggag

SEQ ID NO: 409541 - DNA, 25 bp, Mus musculus
caagagcctgtgtggttctgcctcc

SEQ ID NO: 409542 - DNA, 25 bp, Mus musculus
caagagccttgcacatctacgagat

SEQ ID NO: 409543 - DNA, 25 bp, Mus musculus
caagagcgcgaggaattgaaactcc

SEQ ID NO: 409544 - DNA, 25 bp, Mus musculus
caagagcggcctgtgattttaactg

SEQ ID NO: 409545 - DNA, 25 bp, Mus musculus
caagagcgggtatctcgaggaacca

SEQ ID NO: 409546 - DNA, 25 bp, Mus musculus
caagagctacgatttcccctttggg

SEQ ID NO: 409547 - DNA, 25 bp, Mus musculus
caagagctaggatgctttatagcac

SEQ ID NO: 409548 - DNA, 25 bp, Mus musculus
caagagctcagcgtcaaggagaggc

SEQ ID NO: 409549 - DNA, 25 bp, Mus musculus
caagagctcagcgttaaaccctgga

SEQ ID NO: 409550 - DNA, 25 bp, Mus musculus
caagagctcggacagaggcggagag

SEQ ID NO: 409551 - DNA, 25 bp, Mus musculus
caagagctgaaagaagcaggtcccc

SEQ ID NO: 409552 - DNA, 25 bp, Mus musculus
caagagctgctggactttaccaact

SEQ ID NO: 409553 - DNA, 25 bp, Mus musculus
caagagctgcttggtctgaaaccgc

SEQ ID NO: 409554 - DNA, 25 bp, Mus musculus
caagagcttcctgagtacgagccag

SEQ ID NO: 409555 - DNA, 25 bp, Mus musculus
caagagcttctcagatcggcagcag

SEQ ID NO: 409556 - DNA, 25 bp, Mus musculus
caagagcttcttcaagcgcagcgtg

SEQ ID NO: 409557 - DNA, 25 bp, Mus musculus
caagagcttgggaaactgacagggc

SEQ ID NO: 409558 - DNA, 25 bp, Mus musculus
caagagcttgtttgtgagggacaca

SEQ ID NO: 409559 - DNA, 25 bp, Mus musculus
caagagctttaaaccttgaggtgta

SEQ ID NO: 409560 - DNA, 25 bp, Mus musculus
caagaggaaagatcatgaagaggcc

SEQ ID NO: 409561 - DNA, 25 bp, Mus musculus
caagaggaacaggattcgcagatgc

SEQ ID NO: 409562 - DNA, 25 bp, Mus musculus
caagaggaagttaggctgcgtgccc

SEQ ID NO: 409563 - DNA, 25 bp, Mus musculus
caagaggacccatgctagatcagag

SEQ ID NO: 409564 - DNA, 25 bp, Mus musculus
caagaggacctctaaagcaacagcc

SEQ ID NO: 409565 - DNA, 25 bp, Mus musculus
caagaggactagatgccagaggact

SEQ ID NO: 409566 - DNA, 25 bp, Mus musculus
caagaggactctttactctgcagga

SEQ ID NO: 409567 - DNA, 25 bp, Mus musculus
caagaggactgcgtttggcccaagt

SEQ ID NO: 409568 - DNA, 25 bp, Mus musculus
caagaggagactcgttttgcccgtc

SEQ ID NO: 409569 - DNA, 25 bp, Mus musculus
caagaggagcattggcacgtggcct

SEQ ID NO: 409570 - DNA, 25 bp, Mus musculus
caagaggagctgtgacacctggcgt

SEQ ID NO: 409571 - DNA, 25 bp, Mus musculus
caagaggatcatttgtccccgggag

SEQ ID NO: 409572 - DNA, 25 bp, Mus musculus
caagaggatcttggtttcaaggcca

SEQ ID NO: 409573 - DNA, 25 bp, Mus musculus
caagaggatgctcgccgctccgaat

SEQ ID NO: 409574 - DNA, 25 bp, Mus musculus
caagaggatgctttgtgttaaaggc

SEQ ID NO: 409575 - DNA, 25 bp, Mus musculus
caagaggatgtgcagatggcctacc

SEQ ID NO: 409576 - DNA, 25 bp, Mus musculus
caagaggattgagcgttggcacacg

SEQ ID NO: 409577 - DNA, 25 bp, Mus musculus
caagaggccctgctaaggctctggc

SEQ ID NO: 409578 - DNA, 25 bp, Mus musculus
caagaggcgaagtgcactgtacatg

SEQ ID NO: 409579 - DNA, 25 bp, Mus musculus
caagaggctagcacctacagcgtag

SEQ ID NO: 409580 - DNA, 25 bp, Mus musculus
caagaggctcacacagatcagcgag

SEQ ID NO: 409581 - DNA, 25 bp, Mus musculus
caagagggaccctgtcaaccaggga

SEQ ID NO: 409582 - DNA, 25 bp, Mus musculus
caagagggccttgacagtcctggaa

SEQ ID NO: 409583 - DNA, 25 bp, Mus musculus
caagaggggcctgtagccagctcct

SEQ ID NO: 409584 - DNA, 25 bp, Mus musculus
caagagggtccagtgagttaggaca

SEQ ID NO: 409585 - DNA, 25 bp, Mus musculus
caagagggtcttccatgcaactgaa

SEQ ID NO: 409586 - DNA, 25 bp, Mus musculus
caagagggtgcctcgtacatgcagg

SEQ ID NO: 409587 - DNA, 25 bp, Mus musculus
caagaggtccatagctgatgtggca

SEQ ID NO: 409588 - DNA, 25 bp, Mus musculus
caagaggtctctccggataaggtgc

SEQ ID NO: 409589 - DNA, 25 bp, Mus musculus
caagaggtcttgtacgtggctcgct

SEQ ID NO: 409590 - DNA, 25 bp, Mus musculus
caagaggtggttcttcctactgagg

SEQ ID NO: 409591 - DNA, 25 bp, Mus musculus
caagaggttccctgaagatcagaca

SEQ ID NO: 409592 - DNA, 25 bp, Mus musculus
caagaggttctccagtttgtccgat

SEQ ID NO: 409593 - DNA, 25 bp, Mus musculus
caagaggttgcctgttctgagcagc

SEQ ID NO: 409594 - DNA, 25 bp, Mus musculus
caagaggtttgcgagatggacttca

SEQ ID NO: 409595 - DNA, 25 bp, Mus musculus
caagagtaactcgaggtgcactagc

SEQ ID NO: 409596 - DNA, 25 bp, Mus musculus
caagagtaacttcatggcagcgggt

SEQ ID NO: 409597 - DNA, 25 bp, Mus musculus
caagagtagaagtcggagcagcagc

SEQ ID NO: 409598 - DNA, 25 bp, Mus musculus
caagagtagagtccagttctcctgg

SEQ ID NO: 409599 - DNA, 25 bp, Mus musculus
caagagtagcagttccagcggagaa

SEQ ID NO: 409600 - DNA, 25 bp, Mus musculus
caagagtagtggtagcttgtcccct

SEQ ID NO: 409601 - DNA, 25 bp, Mus musculus
caagagtatctccatgagcgtggct

SEQ ID NO: 409602 - DNA, 25 bp, Mus musculus
caagagtcagtcagatggcaaagaa

SEQ ID NO: 409603 - DNA, 25 bp, Mus musculus
caagagtcatattgcccagtggtca

SEQ ID NO: 409604 - DNA, 25 bp, Mus musculus
caagagtccctgctatggaaagtgc

SEQ ID NO: 409605 - DNA, 25 bp, Mus musculus
caagagtcctctcgtgggttcgcac

SEQ ID NO: 409606 - DNA, 25 bp, Mus musculus
caagagtcgcatgtcagcagaggca

SEQ ID NO: 409607 - DNA, 25 bp, Mus musculus
caagagtctgttgcatggcctacaa

SEQ ID NO: 409608 - DNA, 25 bp, Mus musculus
caagagtcttgctgaatcccaggaa

SEQ ID NO: 409609 - DNA, 25 bp, Mus musculus
caagagtgcctttgggaccacagct

SEQ ID NO: 409610 - DNA, 25 bp, Mus musculus
caagagtggatgcaaagtcctcccg

SEQ ID NO: 409611 - DNA, 25 bp, Mus musculus
caagagtggcgctggaaatatttca

SEQ ID NO: 409612 - DNA, 25 bp, Mus musculus
caagagtgtgactccagggactcca

SEQ ID NO: 409613 - DNA, 25 bp, Mus musculus
caagagttgctgcagtccgctgtct

SEQ ID NO: 409614 - DNA, 25 bp, Mus musculus
caagagttgggaacagcagttctcc

SEQ ID NO: 409615 - DNA, 25 bp, Mus musculus
caagagtttgtgctccagtagcgac

SEQ ID NO: 409616 - DNA, 25 bp, Mus musculus
caagataaacttgggccctggcctg

SEQ ID NO: 409617 - DNA, 25 bp, Mus musculus
caagatacgattgctccaaacagaa

SEQ ID NO: 409618 - DNA, 25 bp, Mus musculus
caagatagaagagagctataccctc

SEQ ID NO: 409619 - DNA, 25 bp, Mus musculus
caagatagaggtggccaagctgaaa

SEQ ID NO: 409620 - DNA, 25 bp, Mus musculus
caagataggagttgagttccagggc

SEQ ID NO: 409621 - DNA, 25 bp, Mus musculus
caagatagggctgtctccaaggcca

SEQ ID NO: 409622 - DNA, 25 bp, Mus musculus
caagatcaaagggttggctcgccag

SEQ ID NO: 409623 - DNA, 25 bp, Mus musculus
caagatcaaagtgcgctggttccgg

SEQ ID NO: 409624 - DNA, 25 bp, Mus musculus
caagatcaatgaaggagaggtactc

SEQ ID NO: 409625 - DNA, 25 bp, Mus musculus
caagatcaatggcatccgctggcac

SEQ ID NO: 409626 - DNA, 25 bp, Mus musculus
caagatcagcatcctccttagcaag

SEQ ID NO: 409627 - DNA, 25 bp, Mus musculus
caagatcagcgtaggacagattcgc

SEQ ID NO: 409628 - DNA, 25 bp, Mus musculus
caagatcagctgcaaggtgacctcc

SEQ ID NO: 409629 - DNA, 25 bp, Mus musculus
caagatcatcattcgtgtgcagacc

SEQ ID NO: 409630 - DNA, 25 bp, Mus musculus
caagatcatgtctcggctcaaggac

SEQ ID NO: 409631 - DNA, 25 bp, Mus musculus
caagatcatgtggttgtgtggcaaa

SEQ ID NO: 409632 - DNA, 25 bp, Mus musculus
caagatccaaaagtagctatgccct

SEQ ID NO: 409633 - DNA, 25 bp, Mus musculus
caagatccagttcacatcgctatac

SEQ ID NO: 409634 - DNA, 25 bp, Mus musculus
caagatcccatctcgctagctgtgg

SEQ ID NO: 409635 - DNA, 25 bp, Mus musculus
caagatccgggacagtaagtacagg

SEQ ID NO: 409636 - DNA, 25 bp, Mus musculus
caagatccggtgtgccaatgagacc

SEQ ID NO: 409637 - DNA, 25 bp, Mus musculus
caagatccgtgtggtgctgaacaag

SEQ ID NO: 409638 - DNA, 25 bp, Mus musculus
caagatcctcctgtgtattgccaac

SEQ ID NO: 409639 - DNA, 25 bp, Mus musculus
caagatcctgatcattgggaacagc

SEQ ID NO: 409640 - DNA, 25 bp, Mus musculus
caagatcctgttgaggtgggaaccc

SEQ ID NO: 409641 - DNA, 25 bp, Mus musculus
caagatccttccagatcgccaaagg

SEQ ID NO: 409642 - DNA, 25 bp, Mus musculus
caagatccttgggtcctggagaacg

SEQ ID NO: 409643 - DNA, 25 bp, Mus musculus
caagatcgaagtttgcctcaccagg

SEQ ID NO: 409644 - DNA, 25 bp, Mus musculus
caagatcgtgggtagcaatgcaggc

SEQ ID NO: 409645 - DNA, 25 bp, Mus musculus
caagatctactagcactgagaaaac

SEQ ID NO: 409646 - DNA, 25 bp, Mus musculus
caagatctctggagctgttgtgagc

SEQ ID NO: 409647 - DNA, 25 bp, Mus musculus
caagatctctggctaaagtttcgca

SEQ ID NO: 409648 - DNA, 25 bp, Mus musculus
caagatctgcatcggctggaggcct

SEQ ID NO: 409649 - DNA, 25 bp, Mus musculus
caagatctggccaaagctgagggtg

SEQ ID NO: 409650 - DNA, 25 bp, Mus musculus
caagatctggtcactggccgagacg

SEQ ID NO: 409651 - DNA, 25 bp, Mus musculus
caagatctgtgaccagctcaagggc

SEQ ID NO: 409652 - DNA, 25 bp, Mus musculus
caagatcttcgaaatgcaaaataca

SEQ ID NO: 409653 - DNA, 25 bp, Mus musculus
caagatcttttgaaaattgtggaga

SEQ ID NO: 409654 - DNA, 25 bp, Mus musculus
caagatgaaactacacttgtgagca

SEQ ID NO: 409655 - DNA, 25 bp, Mus musculus
caagatgaagattcggcgcagggca

SEQ ID NO: 409656 - DNA, 25 bp, Mus musculus
caagatgagaaatcacgcagaggcc

SEQ ID NO: 409657 - DNA, 25 bp, Mus musculus
caagatgagccaactcctggtgcca

SEQ ID NO: 409658 - DNA, 25 bp, Mus musculus
caagatgataaacgtgttagagcca

SEQ ID NO: 409659 - DNA, 25 bp, Mus musculus
caagatgatgatggttatgcagccc

SEQ ID NO: 409660 - DNA, 25 bp, Mus musculus
caagatgcagtttgagatgcacgac

SEQ ID NO: 409661 - DNA, 25 bp, Mus musculus
caagatgcattatcagcccagggat

SEQ ID NO: 409662 - DNA, 25 bp, Mus musculus
caagatgccaaatgtgacccgagtg

SEQ ID NO: 409663 - DNA, 25 bp, Mus musculus
caagatgctgagactaagtgcacga

SEQ ID NO: 409664 - DNA, 25 bp, Mus musculus
caagatgctgcaatggagaactcta

SEQ ID NO: 409665 - DNA, 25 bp, Mus musculus
caagatggaaaaggtgtactccacc

SEQ ID NO: 409666 - DNA, 25 bp, Mus musculus
caagatggaattcagggatggaccc

SEQ ID NO: 409667 - DNA, 25 bp, Mus musculus
caagatggaccagttctgcaaggag

SEQ ID NO: 409668 - DNA, 25 bp, Mus musculus
caagatggagaccagcatggaccac

SEQ ID NO: 409669 - DNA, 25 bp, Mus musculus
caagatggcactgtctaccggaagt

SEQ ID NO: 409670 - DNA, 25 bp, Mus musculus
caagatggctcctgtctccagaagg

SEQ ID NO: 409671 - DNA, 25 bp, Mus musculus
caagatgggcgaggtcttcacggac

SEQ ID NO: 409672 - DNA, 25 bp, Mus musculus
caagatgtagatccaaacgtagccc

SEQ ID NO: 409673 - DNA, 25 bp, Mus musculus
caagatgtcatcaagctagcctgcg

SEQ ID NO: 409674 - DNA, 25 bp, Mus musculus
caagatgtcttgctggaacctggca

SEQ ID NO: 409675 - DNA, 25 bp, Mus musculus
caagatgtgccattcgaaaagcgct

SEQ ID NO: 409676 - DNA, 25 bp, Mus musculus
caagatgtgcggtacttcctgcggc

SEQ ID NO: 409677 - DNA, 25 bp, Mus musculus
caagatgtgttcctggcactgtgtc

SEQ ID NO: 409678 - DNA, 25 bp, Mus musculus
caagatgttcatcggaggactcagt

SEQ ID NO: 409679 - DNA, 25 bp, Mus musculus
caagatgttgttgtgaatgagctca

SEQ ID NO: 409680 - DNA, 25 bp, Mus musculus
caagattaagattgtacgggcttcc

SEQ ID NO: 409681 - DNA, 25 bp, Mus musculus
caagattacagctgtcccgtggagt

SEQ ID NO: 409682 - DNA, 25 bp, Mus musculus
caagattatggataccggactgctc

SEQ ID NO: 409683 - DNA, 25 bp, Mus musculus
caagattcatttgcagcccgggaag

SEQ ID NO: 409684 - DNA, 25 bp, Mus musculus
caagattccccagatgagaggtgca

SEQ ID NO: 409685 - DNA, 25 bp, Mus musculus
caagattccgttcatccaggaggcg

SEQ ID NO: 409686 - DNA, 25 bp, Mus musculus
caagattctggccagctttcgtgag

SEQ ID NO: 409687 - DNA, 25 bp, Mus musculus
caagattgaccttcatttccgggag

SEQ ID NO: 409688 - DNA, 25 bp, Mus musculus
caagattgcattttaagtttcctgg

SEQ ID NO: 409689 - DNA, 25 bp, Mus musculus
caagattgccgaaaacgtggaggag

SEQ ID NO: 409690 - DNA, 25 bp, Mus musculus
caagattggagaaccaagaaagcac

SEQ ID NO: 409691 - DNA, 25 bp, Mus musculus
caagattggattctgagcttagacc

SEQ ID NO: 409692 - DNA, 25 bp, Mus musculus
caagattggtgagtctgtctaccca

SEQ ID NO: 409693 - DNA, 25 bp, Mus musculus
caagattgtggaaaaccctgaggat

SEQ ID NO: 409694 - DNA, 25 bp, Mus musculus
caagatttatggtctcagagggtca

SEQ ID NO: 409695 - DNA, 25 bp, Mus musculus
caagatttcaccttgtaaataataa

SEQ ID NO: 409696 - DNA, 25 bp, Mus musculus
caagatttcttcaacggcaaggagc

SEQ ID NO: 409697 - DNA, 25 bp, Mus musculus
caagatttggaatacggacaggcac

SEQ ID NO: 409698 - DNA, 25 bp, Mus musculus
caagattttggcagcaaccatggcc

SEQ ID NO: 409699 - DNA, 25 bp, Mus musculus
caagcaaaccagtgcaaatgatgtc

SEQ ID NO: 409700 - DNA, 25 bp, Mus musculus
caagcaaatcgtgtctgggaaaaga

SEQ ID NO: 409701 - DNA, 25 bp, Mus musculus
caagcaaatctgctgtgcgtgagct

SEQ ID NO: 409702 - DNA, 25 bp, Mus musculus
caagcaaatggtagatgtgtgagcc

SEQ ID NO: 409703 - DNA, 25 bp, Mus musculus
caagcaacagaagtcatgtgtatgc

SEQ ID NO: 409704 - DNA, 25 bp, Mus musculus
caagcaacatcatgtgaggccacac

SEQ ID NO: 409705 - DNA, 25 bp, Mus musculus
caagcaacggctatggatgcaacat

SEQ ID NO: 409706 - DNA, 25 bp, Mus musculus
caagcaacggctcatggagatgtac

SEQ ID NO: 409707 - DNA, 25 bp, Mus musculus
caagcaagagaagccggtatatgga

SEQ ID NO: 409708 - DNA, 25 bp, Mus musculus
caagcaagagctatacggactaccg

SEQ ID NO: 409709 - DNA, 25 bp, Mus musculus
caagcaagatcccaaatgtgaagac

SEQ ID NO: 409710 - DNA, 25 bp, Mus musculus
caagcaagcatcattgtgaggctta

SEQ ID NO: 409711 - DNA, 25 bp, Mus musculus
caagcaagccggcatccagtgagtt

SEQ ID NO: 409712 - DNA, 25 bp, Mus musculus
caagcaagcctgtcaaatgctctgc

SEQ ID NO: 409713 - DNA, 25 bp, Mus musculus
caagcaagcggcaagatgaggccct

SEQ ID NO: 409714 - DNA, 25 bp, Mus musculus
caagcaagcgttaggtagggagtca

SEQ ID NO: 409715 - DNA, 25 bp, Mus musculus
caagcaagcgtttgaggccgacgta

SEQ ID NO: 409716 - DNA, 25 bp, Mus musculus
caagcaagttacaacacttaccaca

SEQ ID NO: 409717 - DNA, 25 bp, Mus musculus
caagcaatcgtgagcgcagtggcaa

SEQ ID NO: 409718 - DNA, 25 bp, Mus musculus
caagcaattcaagcagaggcggatc

SEQ ID NO: 409719 - DNA, 25 bp, Mus musculus
caagcaattttgctaacttcagtgc

SEQ ID NO: 409720 - DNA, 25 bp, Mus musculus
caagcaattttttggccgccaccga

SEQ ID NO: 409721 - DNA, 25 bp, Mus musculus
caagcacacaatgggactctctgag

SEQ ID NO: 409722 - DNA, 25 bp, Mus musculus
caagcacacagtctacagcatggag

SEQ ID NO: 409723 - DNA, 25 bp, Mus musculus
caagcacacattttgctggtactgt

SEQ ID NO: 409724 - DNA, 25 bp, Mus musculus
caagcacagacctgttgtggctcct

SEQ ID NO: 409725 - DNA, 25 bp, Mus musculus
caagcacagccacaaagaatgatcg

SEQ ID NO: 409726 - DNA, 25 bp, Mus musculus
caagcacaggacacatcagttgggc

SEQ ID NO: 409727 - DNA, 25 bp, Mus musculus
caagcacagggcagaattgtctcag

SEQ ID NO: 409728 - DNA, 25 bp, Mus musculus
caagcacatagaaggctggagcgcc

SEQ ID NO: 409729 - DNA, 25 bp, Mus musculus
caagcacattgacatccaccctgaa

SEQ ID NO: 409730 - DNA, 25 bp, Mus musculus
caagcaccatgggttaggcccgaga

SEQ ID NO: 409731 - DNA, 25 bp, Mus musculus
caagcacctgctgaagaaagactac

SEQ ID NO: 409732 - DNA, 25 bp, Mus musculus
caagcacgtgctcatggtctaccaa

SEQ ID NO: 409733 - DNA, 25 bp, Mus musculus
caagcacgtttctttccaccgcaga

SEQ ID NO: 409734 - DNA, 25 bp, Mus musculus
caagcactccactggcctatggata

SEQ ID NO: 409735 - DNA, 25 bp, Mus musculus
caagcactgatgcagttgtttcctg

SEQ ID NO: 409736 - DNA, 25 bp, Mus musculus
caagcactgattttccaattggcca

SEQ ID NO: 409737 - DNA, 25 bp, Mus musculus
caagcactggccgtggttcggaacg

SEQ ID NO: 409738 - DNA, 25 bp, Mus musculus
caagcactggtgtgatctcgaagta

SEQ ID NO: 409739 - DNA, 25 bp, Mus musculus
caagcactgtagagataagaaccca

SEQ ID NO: 409740 - DNA, 25 bp, Mus musculus
caagcactgtgcactgtcaaaagga

SEQ ID NO: 409741 - DNA, 25 bp, Mus musculus
caagcacttagcatggatcagaaga

SEQ ID NO: 409742 - DNA, 25 bp, Mus musculus
caagcacttcctactgttgtttcta

SEQ ID NO: 409743 - DNA, 25 bp, Mus musculus
caagcactttcattggcccgcaagg

SEQ ID NO: 409744 - DNA, 25 bp, Mus musculus
caagcactttgctgactgaaccatg

SEQ ID NO: 409745 - DNA, 25 bp, Mus musculus
caagcagaagaaaaccagccgaggt

SEQ ID NO: 409746 - DNA, 25 bp, Mus musculus
caagcagacaggacagggactggac

SEQ ID NO: 409747 - DNA, 25 bp, Mus musculus
caagcagaccgagatgtgtagctca

SEQ ID NO: 409748 - DNA, 25 bp, Mus musculus
caagcagacgcgtaagagtggctcc

SEQ ID NO: 409749 - DNA, 25 bp, Mus musculus
caagcagacggtggcatattctccc

SEQ ID NO: 409750 - DNA, 25 bp, Mus musculus
caagcagacttgagcctgggtgcca

SEQ ID NO: 409751 - DNA, 25 bp, Mus musculus
caagcagagtgtacaatggcatcct

SEQ ID NO: 409752 - DNA, 25 bp, Mus musculus
caagcagagttcagatgaggagctc

SEQ ID NO: 409753 - DNA, 25 bp, Mus musculus
caagcagatgattgaatgggccctc

SEQ ID NO: 409754 - DNA, 25 bp, Mus musculus
caagcagcatgcatactatccaagt

SEQ ID NO: 409755 - DNA, 25 bp, Mus musculus
caagcagccttgaagtcagctaggg

SEQ ID NO: 409756 - DNA, 25 bp, Mus musculus
caagcagcgtgctgttgaatgtggc

SEQ ID NO: 409757 - DNA, 25 bp, Mus musculus
caagcagctagcaaaacccaaagag

SEQ ID NO: 409758 - DNA, 25 bp, Mus musculus
caagcagctgatggtatccaggaac

SEQ ID NO: 409759 - DNA, 25 bp, Mus musculus
caagcagctggctatggcccagaag

SEQ ID NO: 409760 - DNA, 25 bp, Mus musculus
caagcagctggctgtgtttccagtg

SEQ ID NO: 409761 - DNA, 25 bp, Mus musculus
caagcagcttgtatgcagcactcaa

SEQ ID NO: 409762 - DNA, 25 bp, Mus musculus
caagcaggacatggaccctgcctta

SEQ ID NO: 409763 - DNA, 25 bp, Mus musculus
caagcaggcagctgtccatactcac

SEQ ID NO: 409764 - DNA, 25 bp, Mus musculus
caagcaggcgaaagaagctgtgaag

SEQ ID NO: 409765 - DNA, 25 bp, Mus musculus
caagcaggctgacaggcagtgatcc

SEQ ID NO: 409766 - DNA, 25 bp, Mus musculus
caagcaggtgttggttgagaacttc

SEQ ID NO: 409767 - DNA, 25 bp, Mus musculus
caagcagtaagagtatgacccagac

SEQ ID NO: 409768 - DNA, 25 bp, Mus musculus
caagcagtactgtagatggtctcaa

SEQ ID NO: 409769 - DNA, 25 bp, Mus musculus
caagcagtaggccttggtcattact

SEQ ID NO: 409770 - DNA, 25 bp, Mus musculus
caagcagtagtatggtggcacctca

SEQ ID NO: 409771 - DNA, 25 bp, Mus musculus
caagcagtatccctattactttggg

SEQ ID NO: 409772 - DNA, 25 bp, Mus musculus
caagcagtgatttcaaccaccgcta

SEQ ID NO: 409773 - DNA, 25 bp, Mus musculus
caagcagtgcctatccagaaagtcc

SEQ ID NO: 409774 - DNA, 25 bp, Mus musculus
caagcagtggtcgtattggcctatc

SEQ ID NO: 409775 - DNA, 25 bp, Mus musculus
caagcagttcctccgtgatgtagac

SEQ ID NO: 409776 - DNA, 25 bp, Mus musculus
caagcataaagcacccggagagagg

SEQ ID NO: 409777 - DNA, 25 bp, Mus musculus
caagcataagggaaagagatgatga

SEQ ID NO: 409778 - DNA, 25 bp, Mus musculus
caagcatatttgtggaggagtcctg

SEQ ID NO: 409779 - DNA, 25 bp, Mus musculus
caagcatcatgcagtggcgagtcat

SEQ ID NO: 409780 - DNA, 25 bp, Mus musculus
caagcatcggattgttctgtgcaag

SEQ ID NO: 409781 - DNA, 25 bp, Mus musculus
caagcatgatgacttggattcaggt

SEQ ID NO: 409782 - DNA, 25 bp, Mus musculus
caagcatggattgtggtcccaggag

SEQ ID NO: 409783 - DNA, 25 bp, Mus musculus
caagcatgggcttcgagactgccaa

SEQ ID NO: 409784 - DNA, 25 bp, Mus musculus
caagcatgtaagtggtccctgacta

SEQ ID NO: 409785 - DNA, 25 bp, Mus musculus
caagcatgtgaggaaaaggacaccc

SEQ ID NO: 409786 - DNA, 25 bp, Mus musculus
caagcatgtgcgtgcagataaacac

SEQ ID NO: 409787 - DNA, 25 bp, Mus musculus
caagcattcgagaagcccagtggtc

SEQ ID NO: 409788 - DNA, 25 bp, Mus musculus
caagcattgcaaaagtgagccgtaa

SEQ ID NO: 409789 - DNA, 25 bp, Mus musculus
caagcattggagctaaatctggcat

SEQ ID NO: 409790 - DNA, 25 bp, Mus musculus
caagcatttctgtctgttcaacctg

SEQ ID NO: 409791 - DNA, 25 bp, Mus musculus
caagcatttggcatcaaggtccggt

SEQ ID NO: 409792 - DNA, 25 bp, Mus musculus
caagccaaatggaagggtgctgcac

SEQ ID NO: 409793 - DNA, 25 bp, Mus musculus
caagccaaatgtacatgattctggg

SEQ ID NO: 409794 - DNA, 25 bp, Mus musculus
caagccaaatgtgagacgccaagca

SEQ ID NO: 409795 - DNA, 25 bp, Mus musculus
caagccaacaccttctagtgggaaa

SEQ ID NO: 409796 - DNA, 25 bp, Mus musculus
caagccaatggagaagaggtgttcc

SEQ ID NO: 409797 - DNA, 25 bp, Mus musculus
caagccaatgtactgagcctcggtg

SEQ ID NO: 409798 - DNA, 25 bp, Mus musculus
caagccaatgtatggtgccggcaaa

SEQ ID NO: 409799 - DNA, 25 bp, Mus musculus
caagccacagtacccatgaggagat

SEQ ID NO: 409800 - DNA, 25 bp, Mus musculus
caagccacgcctgggaatgctgggt

SEQ ID NO: 409801 - DNA, 25 bp, Mus musculus
caagccactgttctctgcggaggag

SEQ ID NO: 409802 - DNA, 25 bp, Mus musculus
caagccagaccaccgtgcttgtggt

SEQ ID NO: 409803 - DNA, 25 bp, Mus musculus
caagccagaggagataaagatgcgc

SEQ ID NO: 409804 - DNA, 25 bp, Mus musculus
caagccagagtaccatgtcagtgtt

SEQ ID NO: 409805 - DNA, 25 bp, Mus musculus
caagccagataatgacagactcgtg

SEQ ID NO: 409806 - DNA, 25 bp, Mus musculus
caagccagcctaactgcagtcagga

SEQ ID NO: 409807 - DNA, 25 bp, Mus musculus
caagccaggcgtttgcatcttagag

SEQ ID NO: 409808 - DNA, 25 bp, Mus musculus
caagccagggacgtcgaagaagtct

SEQ ID NO: 409809 - DNA, 25 bp, Mus musculus
caagccagtgtctcttcgtggagga

SEQ ID NO: 409810 - DNA, 25 bp, Mus musculus
caagccatacctgagggcagcggaa

SEQ ID NO: 409811 - DNA, 25 bp, Mus musculus
caagccatccttgtgctaagagatc

SEQ ID NO: 409812 - DNA, 25 bp, Mus musculus
caagccatgtgcgttcagaaaggtc

SEQ ID NO: 409813 - DNA, 25 bp, Mus musculus
caagcccaagccgttagaagcagga

SEQ ID NO: 409814 - DNA, 25 bp, Mus musculus
caagcccaggagatgcagagtacca

SEQ ID NO: 409815 - DNA, 25 bp, Mus musculus
caagcccaggattggttgcgcaggc

SEQ ID NO: 409816 - DNA, 25 bp, Mus musculus
caagcccagtgagctattggtgccc

SEQ ID NO: 409817 - DNA, 25 bp, Mus musculus
caagcccatggttgatgatgacgac

SEQ ID NO: 409818 - DNA, 25 bp, Mus musculus
caagcccgatttggtcagtccgtga

SEQ ID NO: 409819 - DNA, 25 bp, Mus musculus
caagcccggagttctatgagcaagc

SEQ ID NO: 409820 - DNA, 25 bp, Mus musculus
caagcccggcagactggtactgcat

SEQ ID NO: 409821 - DNA, 25 bp, Mus musculus
caagccctctgattgttcctcgaag

SEQ ID NO: 409822 - DNA, 25 bp, Mus musculus
caagccctgaagttggctttccagg

SEQ ID NO: 409823 - DNA, 25 bp, Mus musculus
caagccctgactttacggaggcgag

SEQ ID NO: 409824 - DNA, 25 bp, Mus musculus
caagccctggatgtgcaagaagcac

SEQ ID NO: 409825 - DNA, 25 bp, Mus musculus
caagccctgtggtacttcggctcgg

SEQ ID NO: 409826 - DNA, 25 bp, Mus musculus
caagccctgtgtgaggtactgctgg

SEQ ID NO: 409827 - DNA, 25 bp, Mus musculus
caagccctgttgaagaaattcccag

SEQ ID NO: 409828 - DNA, 25 bp, Mus musculus
caagcccttagttttccacagcaga

SEQ ID NO: 409829 - DNA, 25 bp, Mus musculus
caagccgaatggacaaagaaacctc

SEQ ID NO: 409830 - DNA, 25 bp, Mus musculus
caagccgagaccaaatccctgagtt

SEQ ID NO: 409831 - DNA, 25 bp, Mus musculus
caagccgatacagaccgcacattgg

SEQ ID NO: 409832 - DNA, 25 bp, Mus musculus
caagccgcgttagcacctgcataaa

SEQ ID NO: 409833 - DNA, 25 bp, Mus musculus
caagccgctggctgtgtaacaagct

SEQ ID NO: 409834 - DNA, 25 bp, Mus musculus
caagccggagcttgtagaggcaggg

SEQ ID NO: 409835 - DNA, 25 bp, Mus musculus
caagccggtcaatgcggtaaccaga

SEQ ID NO: 409836 - DNA, 25 bp, Mus musculus
caagccggtgctgagagacatgagc

SEQ ID NO: 409837 - DNA, 25 bp, Mus musculus
caagccggttttgatgttttccaca

SEQ ID NO: 409838 - DNA, 25 bp, Mus musculus
caagccgtgactgtagcctggaaca

SEQ ID NO: 409839 - DNA, 25 bp, Mus musculus
caagcctagctttaagccttgtagc

SEQ ID NO: 409840 - DNA, 25 bp, Mus musculus
caagcctagtagtttatgttcatca

SEQ ID NO: 409841 - DNA, 25 bp, Mus musculus
caagcctagtgggactgacaatgcg

SEQ ID NO: 409842 - DNA, 25 bp, Mus musculus
caagcctcagctaaacaagcccatg

SEQ ID NO: 409843 - DNA, 25 bp, Mus musculus
caagcctccaaaggtaaggagtctc

SEQ ID NO: 409844 - DNA, 25 bp, Mus musculus
caagcctcgggcatagaagtgatcc

SEQ ID NO: 409845 - DNA, 25 bp, Mus musculus
caagcctctgcactggtagaatcgg

SEQ ID NO: 409846 - DNA, 25 bp, Mus musculus
caagcctgaatggagcaatctggcc

SEQ ID NO: 409847 - DNA, 25 bp, Mus musculus
caagcctgaggcgaagtctgtccat

SEQ ID NO: 409848 - DNA, 25 bp, Mus musculus
caagcctgattttgactgctcgaga

SEQ ID NO: 409849 - DNA, 25 bp, Mus musculus
caagcctgcttttctggtctccaag

SEQ ID NO: 409850 - DNA, 25 bp, Mus musculus
caagcctggaatgggaatgaaaacc

SEQ ID NO: 409851 - DNA, 25 bp, Mus musculus
caagcctggaggcactcttgagcca

SEQ ID NO: 409852 - DNA, 25 bp, Mus musculus
caagcctgggctcgaagacaacatt

SEQ ID NO: 409853 - DNA, 25 bp, Mus musculus
caagcctggtgtgcaagacgtgact

SEQ ID NO: 409854 - DNA, 25 bp, Mus musculus
caagcctgtgtgatgggtctgaccc

SEQ ID NO: 409855 - DNA, 25 bp, Mus musculus
caagcctgtgttaggaagtcgccct

SEQ ID NO: 409856 - DNA, 25 bp, Mus musculus
caagccttaggaactggcagacgga

SEQ ID NO: 409857 - DNA, 25 bp, Mus musculus
caagccttcaggaatgatgccacag

SEQ ID NO: 409858 - DNA, 25 bp, Mus musculus
caagccttcgctggttgcacagtca

SEQ ID NO: 409859 - DNA, 25 bp, Mus musculus
caagccttggagaaggcgaagtctg

SEQ ID NO: 409860 - DNA, 25 bp, Mus musculus
caagccttgggctgttgggcaagtc

SEQ ID NO: 409861 - DNA, 25 bp, Mus musculus
caagccttggttgagtttgacacag

SEQ ID NO: 409862 - DNA, 25 bp, Mus musculus
caagcgaaggagagcatgatccgtc

SEQ ID NO: 409863 - DNA, 25 bp, Mus musculus
caagcgaaggtatgctgcgtctgag

SEQ ID NO: 409864 - DNA, 25 bp, Mus musculus
caagcgaagtggtgacctgagagct

SEQ ID NO: 409865 - DNA, 25 bp, Mus musculus
caagcgaattcgctacaagaagaat

SEQ ID NO: 409866 - DNA, 25 bp, Mus musculus
caagcgacctaaggtaaggtgggct

SEQ ID NO: 409867 - DNA, 25 bp, Mus musculus
caagcgacggtgatacagagagact

SEQ ID NO: 409868 - DNA, 25 bp, Mus musculus
caagcgagatgcgttcatggaccac

SEQ ID NO: 409869 - DNA, 25 bp, Mus musculus
caagcgagtgtgtccctccagtaaa

SEQ ID NO: 409870 - DNA, 25 bp, Mus musculus
caagcgattctggaagtgacagtcc

SEQ ID NO: 409871 - DNA, 25 bp, Mus musculus
caagcgcaaagtccgctgtccgagg

SEQ ID NO: 409872 - DNA, 25 bp, Mus musculus
caagcgcacatggtccacctagtgg

SEQ ID NO: 409873 - DNA, 25 bp, Mus musculus
caagcgcccaaaaccaagagagtaa

SEQ ID NO: 409874 - DNA, 25 bp, Mus musculus
caagcgccgcggcaatttggttccg

SEQ ID NO: 409875 - DNA, 25 bp, Mus musculus
caagcgcctactactagtcggtggg

SEQ ID NO: 409876 - DNA, 25 bp, Mus musculus
caagcgcctgcgaagttcacagtgg

SEQ ID NO: 409877 - DNA, 25 bp, Mus musculus
caagcgcggcaagaaatctgcgggc

SEQ ID NO: 409878 - DNA, 25 bp, Mus musculus
caagcgctacgaatcacagcttcgg

SEQ ID NO: 409879 - DNA, 25 bp, Mus musculus
caagcgctcacagagcagacaatca

SEQ ID NO: 409880 - DNA, 25 bp, Mus musculus
caagcgctgttggtgagagactctg

SEQ ID NO: 409881 - DNA, 25 bp, Mus musculus
caagcgcttgcgagactacagagag

SEQ ID NO: 409882 - DNA, 25 bp, Mus musculus
caagcgctttaggaagggatcaaca

SEQ ID NO: 409883 - DNA, 25 bp, Mus musculus
caagcggagacattggagacgaacc

SEQ ID NO: 409884 - DNA, 25 bp, Mus musculus
caagcggatccgtgcctatgagatg

SEQ ID NO: 409885 - DNA, 25 bp, Mus musculus
caagcggccactgctaagtactcag

SEQ ID NO: 409886 - DNA, 25 bp, Mus musculus
caagcggccctgcaggaaattcctg

SEQ ID NO: 409887 - DNA, 25 bp, Mus musculus
caagcgggagttccttaaggcctct

SEQ ID NO: 409888 - DNA, 25 bp, Mus musculus
caagcgggccaagggcaaaagccga

SEQ ID NO: 409889 - DNA, 25 bp, Mus musculus
caagcggtttgggaccttgaacaag

SEQ ID NO: 409890 - DNA, 25 bp, Mus musculus
caagcgtagcaactatttatgaaaa

SEQ ID NO: 409891 - DNA, 25 bp, Mus musculus
caagcgtaggcgatttcagaaaacc

SEQ ID NO: 409892 - DNA, 25 bp, Mus musculus
caagcgtcactgaagcaggtgcaga

SEQ ID NO: 409893 - DNA, 25 bp, Mus musculus
caagcgtgacggacaaatctgggca

SEQ ID NO: 409894 - DNA, 25 bp, Mus musculus
caagcgtgcacagctctggccttta

SEQ ID NO: 409895 - DNA, 25 bp, Mus musculus
caagcgtgccttggacgagtacacc

SEQ ID NO: 409896 - DNA, 25 bp, Mus musculus
caagcgtgggcagtttcctagaaat

SEQ ID NO: 409897 - DNA, 25 bp, Mus musculus
caagcgtggttcaatcaagagctcc

SEQ ID NO: 409898 - DNA, 25 bp, Mus musculus
caagcgtttaaagcagcctggccac

SEQ ID NO: 409899 - DNA, 25 bp, Mus musculus
caagcgtttgttcgagtcatgccta

SEQ ID NO: 409900 - DNA, 25 bp, Mus musculus
caagcgtttgtttgagttacaggtc

SEQ ID NO: 409901 - DNA, 25 bp, Mus musculus
caagcgttttggtgcctggtacaga

SEQ ID NO: 409902 - DNA, 25 bp, Mus musculus
caagctaacctcagtgcctagtcac

SEQ ID NO: 409903 - DNA, 25 bp, Mus musculus
caagctaagtcatactggagtgaaa

SEQ ID NO: 409904 - DNA, 25 bp, Mus musculus
caagctaagtgatttctctactaaa

SEQ ID NO: 409905 - DNA, 25 bp, Mus musculus
caagctactcgcctgatgaccggag

SEQ ID NO: 409906 - DNA, 25 bp, Mus musculus
caagctactgctcccaatagtcaca

SEQ ID NO: 409907 - DNA, 25 bp, Mus musculus
caagctagaagcatggagtcctgta

SEQ ID NO: 409908 - DNA, 25 bp, Mus musculus
caagctaggcttccggtcagcgaag

SEQ ID NO: 409909 - DNA, 25 bp, Mus musculus
caagctagttcggaatcgccaggaa

SEQ ID NO: 409910 - DNA, 25 bp, Mus musculus
caagctatagctttgcccaccagag

SEQ ID NO: 409911 - DNA, 25 bp, Mus musculus
caagctatgagtttctgtgggaccc

SEQ ID NO: 409912 - DNA, 25 bp, Mus musculus
caagctatgccgacctagagtctca

SEQ ID NO: 409913 - DNA, 25 bp, Mus musculus
caagctcaaatatggccggaagaag

SEQ ID NO: 409914 - DNA, 25 bp, Mus musculus
caagctcacagaggagtccggatca

SEQ ID NO: 409915 - DNA, 25 bp, Mus musculus
caagctcaggtcacagaatccgtcg

SEQ ID NO: 409916 - DNA, 25 bp, Mus musculus
caagctcatcggtaacatggccctg

SEQ ID NO: 409917 - DNA, 25 bp, Mus musculus
caagctcatgaaggacaacaaggac

SEQ ID NO: 409918 - DNA, 25 bp, Mus musculus
caagctccaaaagtctgtagacaca

SEQ ID NO: 409919 - DNA, 25 bp, Mus musculus
caagctccgagtgttggacccagag

SEQ ID NO: 409920 - DNA, 25 bp, Mus musculus
caagctcctttgtccgctgatcggc

SEQ ID NO: 409921 - DNA, 25 bp, Mus musculus
caagctctatgtcggtggccttcca

SEQ ID NO: 409922 - DNA, 25 bp, Mus musculus
caagctctctcatttgaaatgcacg

SEQ ID NO: 409923 - DNA, 25 bp, Mus musculus
caagctctgagcaggtccaacagga

SEQ ID NO: 409924 - DNA, 25 bp, Mus musculus
caagctctgcgacgtggtcatcaaa

SEQ ID NO: 409925 - DNA, 25 bp, Mus musculus
caagctctgctcagtcctcttgagg

SEQ ID NO: 409926 - DNA, 25 bp, Mus musculus
caagctctgggtagatgcctgctct

SEQ ID NO: 409927 - DNA, 25 bp, Mus musculus
caagctctgttggaagctctgaatc

SEQ ID NO: 409928 - DNA, 25 bp, Mus musculus
caagctcttaagcatcgtggcgctg

SEQ ID NO: 409929 - DNA, 25 bp, Mus musculus
caagctgaaccctggcagcagtgac

SEQ ID NO: 409930 - DNA, 25 bp, Mus musculus
caagctgaacgttggtggcaaaggc

SEQ ID NO: 409931 - DNA, 25 bp, Mus musculus
caagctgaagaagtcagaactgaag

SEQ ID NO: 409932 - DNA, 25 bp, Mus musculus
caagctgaagcctttgttgaacaag

SEQ ID NO: 409933 - DNA, 25 bp, Mus musculus
caagctgacagagaacctcgtggcc

SEQ ID NO: 409934 - DNA, 25 bp, Mus musculus
caagctgaccctgagtaggaaagaa

SEQ ID NO: 409935 - DNA, 25 bp, Mus musculus
caagctgagcatggcaaaatgtcga

SEQ ID NO: 409936 - DNA, 25 bp, Mus musculus
caagctgaggacgtctactttgcca

SEQ ID NO: 409937 - DNA, 25 bp, Mus musculus
caagctgagggtatgaaacagaccc

SEQ ID NO: 409938 - DNA, 25 bp, Mus musculus
caagctgcaaaaagggcaagatccc

SEQ ID NO: 409939 - DNA, 25 bp, Mus musculus
caagctgcacctgtttgagaaccca

SEQ ID NO: 409940 - DNA, 25 bp, Mus musculus
caagctgcaggagagcggattctac

SEQ ID NO: 409941 - DNA, 25 bp, Mus musculus
caagctgcagttagggatggcacca

SEQ ID NO: 409942 - DNA, 25 bp, Mus musculus
caagctgcctgggaaatgctgcgag

SEQ ID NO: 409943 - DNA, 25 bp, Mus musculus
caagctgcgcttggacttggaggct

SEQ ID NO: 409944 - DNA, 25 bp, Mus musculus
caagctggacgagaaggtatcaaca

SEQ ID NO: 409945 - DNA, 25 bp, Mus musculus
caagctggcacattatggaaaggat

SEQ ID NO: 409946 - DNA, 25 bp, Mus musculus
caagctggcgaatcgtaatgaggcg

SEQ ID NO: 409947 - DNA, 25 bp, Mus musculus
caagctggcgcacattaagaggctc

SEQ ID NO: 409948 - DNA, 25 bp, Mus musculus
caagctgggtgtatcaagagtgtca

SEQ ID NO: 409949 - DNA, 25 bp, Mus musculus
caagctggtcaagtgtggcggcata

SEQ ID NO: 409950 - DNA, 25 bp, Mus musculus
caagctgtacccgtggaagagtggc

SEQ ID NO: 409951 - DNA, 25 bp, Mus musculus
caagctgtacgaactctcctggaga

SEQ ID NO: 409952 - DNA, 25 bp, Mus musculus
caagctgtagtcagtgcaggtgcca

SEQ ID NO: 409953 - DNA, 25 bp, Mus musculus
caagctgtcaaggagaggccatgat

SEQ ID NO: 409954 - DNA, 25 bp, Mus musculus
caagctgtggagaagtgctactgcc

SEQ ID NO: 409955 - DNA, 25 bp, Mus musculus
caagctgtgggatgttcgggattcc

SEQ ID NO: 409956 - DNA, 25 bp, Mus musculus
caagctgttcttcaatggacgacca

SEQ ID NO: 409957 - DNA, 25 bp, Mus musculus
caagcttaaggaatatggctgccaa

SEQ ID NO: 409958 - DNA, 25 bp, Mus musculus
caagcttaattgtgcatctacgaca

SEQ ID NO: 409959 - DNA, 25 bp, Mus musculus
caagcttactgagtgcacgggctgc

SEQ ID NO: 409960 - DNA, 25 bp, Mus musculus
caagcttagcagaagttttccttga

SEQ ID NO: 409961 - DNA, 25 bp, Mus musculus
caagcttagcgggtggagacacgtt

SEQ ID NO: 409962 - DNA, 25 bp, Mus musculus
caagcttcaatcagtggccgggata

SEQ ID NO: 409963 - DNA, 25 bp, Mus musculus
caagcttcagcgagtccaggagaaa

SEQ ID NO: 409964 - DNA, 25 bp, Mus musculus
caagcttcagtgaatgggcgggccc

SEQ ID NO: 409965 - DNA, 25 bp, Mus musculus
caagcttcccaggagtctggctagc

SEQ ID NO: 409966 - DNA, 25 bp, Mus musculus
caagcttccgtgtgttgcagcaaag

SEQ ID NO: 409967 - DNA, 25 bp, Mus musculus
caagcttcgcaatgagtatggtcct

SEQ ID NO: 409968 - DNA, 25 bp, Mus musculus
caagcttctgagatgaagaacccgg

SEQ ID NO: 409969 - DNA, 25 bp, Mus musculus
caagcttctgctggccattatggag

SEQ ID NO: 409970 - DNA, 25 bp, Mus musculus
caagcttgctatggtcagcaggagg

SEQ ID NO: 409971 - DNA, 25 bp, Mus musculus
caagcttggagggtttcaggaacac

SEQ ID NO: 409972 - DNA, 25 bp, Mus musculus
caagcttggcttaactctgttctta

SEQ ID NO: 409973 - DNA, 25 bp, Mus musculus
caagcttgttgccagtatcttcaca

SEQ ID NO: 409974 - DNA, 25 bp, Mus musculus
caagctttaagcacaacaattgaac

SEQ ID NO: 409975 - DNA, 25 bp, Mus musculus
caagctttatggagcctagtgtggc

SEQ ID NO: 409976 - DNA, 25 bp, Mus musculus
caagctttcgacgtgctggtgctgc

SEQ ID NO: 409977 - DNA, 25 bp, Mus musculus
caagctttgaggattgtaggcagcc

SEQ ID NO: 409978 - DNA, 25 bp, Mus musculus
caaggaaaagactaacgagcggctc

SEQ ID NO: 409979 - DNA, 25 bp, Mus musculus
caaggaaaagagacgcacgcaagag

SEQ ID NO: 409980 - DNA, 25 bp, Mus musculus
caaggaaaatgtccgggctgcagcc

SEQ ID NO: 409981 - DNA, 25 bp, Mus musculus
caaggaaacatttctttgatgagtg

SEQ ID NO: 409982 - DNA, 25 bp, Mus musculus
caaggaaacgtttgtgcaggactca

SEQ ID NO: 409983 - DNA, 25 bp, Mus musculus
caaggaaagactgggagctggctaa

SEQ ID NO: 409984 - DNA, 25 bp, Mus musculus
caaggaaaggcatcgaggagtggat

SEQ ID NO: 409985 - DNA, 25 bp, Mus musculus
caaggaaagtcttcgtgctcggtga

SEQ ID NO: 409986 - DNA, 25 bp, Mus musculus
caaggaaatatgtgtccgcactgtc

SEQ ID NO: 409987 - DNA, 25 bp, Mus musculus
caaggaaatgctggtggatgtgccc

SEQ ID NO: 409988 - DNA, 25 bp, Mus musculus
caaggaaatggttttgtccaggaca

SEQ ID NO: 409989 - DNA, 25 bp, Mus musculus
caaggaacagctaaatccgcaggcc

SEQ ID NO: 409990 - DNA, 25 bp, Mus musculus
caaggaacatcttgggtcaccaaca

SEQ ID NO: 409991 - DNA, 25 bp, Mus musculus
caaggaaccaaaggaggctctcgga

SEQ ID NO: 409992 - DNA, 25 bp, Mus musculus
caaggaaccattcctcagaaggatt

SEQ ID NO: 409993 - DNA, 25 bp, Mus musculus
caaggaactccggtcgagaagccga

SEQ ID NO: 409994 - DNA, 25 bp, Mus musculus
caaggaactcgttagagctggttgc

SEQ ID NO: 409995 - DNA, 25 bp, Mus musculus
caaggaactgtttactggagtgcca

SEQ ID NO: 409996 - DNA, 25 bp, Mus musculus
caaggaagacaatcgctgcgtgggc

SEQ ID NO: 409997 - DNA, 25 bp, Mus musculus
caaggaagcctcttgcctgattacc

SEQ ID NO: 409998 - DNA, 25 bp, Mus musculus
caaggaagttctggctgcacataca

SEQ ID NO: 409999 - DNA, 25 bp, Mus musculus
caaggaatagtcacctgcccaagca

SEQ ID NO: 410000 - DNA, 25 bp, Mus musculus
caaggaatccatgacccaggactct

SEQ ID NO: 410001 - DNA, 25 bp, Mus musculus
caaggaatgcctgatactgcagtcg

SEQ ID NO: 410002 - DNA, 25 bp, Mus musculus
caaggaatgtaatgcaggaagccat

SEQ ID NO: 410003 - DNA, 25 bp, Mus musculus
caaggaattatacccactgcagata

SEQ ID NO: 410004 - DNA, 25 bp, Mus musculus
caaggaattgcttacccaggaggga

SEQ ID NO: 410005 - DNA, 25 bp, Mus musculus
caaggacaaagatggctcggcagac

SEQ ID NO: 410006 - DNA, 25 bp, Mus musculus
caaggacaagtaccgtgtggtctac

SEQ ID NO: 410007 - DNA, 25 bp, Mus musculus
caaggacaccctgagaaacatggca

SEQ ID NO: 410008 - DNA, 25 bp, Mus musculus
caaggacactttcaccgaggaactc

SEQ ID NO: 410009 - DNA, 25 bp, Mus musculus
caaggacagagagtgctcctccaag

SEQ ID NO: 410010 - DNA, 25 bp, Mus musculus
caaggacagtcgaaggatatgccac

SEQ ID NO: 410011 - DNA, 25 bp, Mus musculus
caaggacagttatgcgctgagcccg

SEQ ID NO: 410012 - DNA, 25 bp, Mus musculus
caaggacatgaagtcaacgtgtacc

SEQ ID NO: 410013 - DNA, 25 bp, Mus musculus
caaggacatgattgaagacgcaggc

SEQ ID NO: 410014 - DNA, 25 bp, Mus musculus
caaggaccaggccagagagagactt

SEQ ID NO: 410015 - DNA, 25 bp, Mus musculus
caaggacccttggtactgcagtcga

SEQ ID NO: 410016 - DNA, 25 bp, Mus musculus
caaggaccgctgtgagaactgcagc

SEQ ID NO: 410017 - DNA, 25 bp, Mus musculus
caaggacctgattggacctctggca

SEQ ID NO: 410018 - DNA, 25 bp, Mus musculus
caaggacctggctgaacatcatgag

SEQ ID NO: 410019 - DNA, 25 bp, Mus musculus
caaggacgacggtggtattgtcatc

SEQ ID NO: 410020 - DNA, 25 bp, Mus musculus
caaggacgagttgtctgagcccgag

SEQ ID NO: 410021 - DNA, 25 bp, Mus musculus
caaggacgcatctgccttcagaaag

SEQ ID NO: 410022 - DNA, 25 bp, Mus musculus
caaggacggtgtggaccaagactgc

SEQ ID NO: 410023 - DNA, 25 bp, Mus musculus
caaggacgtcagagacttcggcacc

SEQ ID NO: 410024 - DNA, 25 bp, Mus musculus
caaggactaaagatgaattattttc

SEQ ID NO: 410025 - DNA, 25 bp, Mus musculus
caaggactactatcagacgctgggc

SEQ ID NO: 410026 - DNA, 25 bp, Mus musculus
caaggactcctcctagttttgcagg

SEQ ID NO: 410027 - DNA, 25 bp, Mus musculus
caaggactccttgatgtgggcatgg

SEQ ID NO: 410028 - DNA, 25 bp, Mus musculus
caaggactctaaggacagccataca

SEQ ID NO: 410029 - DNA, 25 bp, Mus musculus
caaggactctgagccacatggagca

SEQ ID NO: 410030 - DNA, 25 bp, Mus musculus
caaggactctgcctttgacccaaag

SEQ ID NO: 410031 - DNA, 25 bp, Mus musculus
caaggactgccacggcgaggacttc

SEQ ID NO: 410032 - DNA, 25 bp, Mus musculus
caaggactggaggtctggaccagca

SEQ ID NO: 410033 - DNA, 25 bp, Mus musculus
caaggactgtgtgtgcaaaggtgaa

SEQ ID NO: 410034 - DNA, 25 bp, Mus musculus
caaggactgttgtggccatctgaga

SEQ ID NO: 410035 - DNA, 25 bp, Mus musculus
caaggacttctacaagcagatgcgg

SEQ ID NO: 410036 - DNA, 25 bp, Mus musculus
caaggacttctacccagcgatagca

SEQ ID NO: 410037 - DNA, 25 bp, Mus musculus
caaggacttgttgagaactgcatca

SEQ ID NO: 410038 - DNA, 25 bp, Mus musculus
caaggagaaagaagataaatgccca

SEQ ID NO: 410039 - DNA, 25 bp, Mus musculus
caaggagacacactctaggtgggcc

SEQ ID NO: 410040 - DNA, 25 bp, Mus musculus
caaggagaccagcttacacagtccg

SEQ ID NO: 410041 - DNA, 25 bp, Mus musculus
caaggagacgacttatcaagaagcc

SEQ ID NO: 410042 - DNA, 25 bp, Mus musculus
caaggagagcaaatttcgggaccgc

SEQ ID NO: 410043 - DNA, 25 bp, Mus musculus
caaggagatcgagtaccgcatggca

SEQ ID NO: 410044 - DNA, 25 bp, Mus musculus
caaggagatgaagcaatggccccaa

SEQ ID NO: 410045 - DNA, 25 bp, Mus musculus
caaggagatgatggcgcagaagccc

SEQ ID NO: 410046 - DNA, 25 bp, Mus musculus
caaggagcagtctctgcgcggcagt

SEQ ID NO: 410047 - DNA, 25 bp, Mus musculus
caaggagccagtgtgattgcaaacc

SEQ ID NO: 410048 - DNA, 25 bp, Mus musculus
caaggagcctcttatcagtggctgg

SEQ ID NO: 410049 - DNA, 25 bp, Mus musculus
caaggagcctgttaagagagagaat

SEQ ID NO: 410050 - DNA, 25 bp, Mus musculus
caaggagcgctttcactggcagagt

SEQ ID NO: 410051 - DNA, 25 bp, Mus musculus
caaggagctacagccaaagagagct

SEQ ID NO: 410052 - DNA, 25 bp, Mus musculus
caaggagctgtatgcgtgggacaac

SEQ ID NO: 410053 - DNA, 25 bp, Mus musculus
caaggagcttctaggaggtacagac

SEQ ID NO: 410054 - DNA, 25 bp, Mus musculus
caaggagcttgctgccaatgcgtgt

SEQ ID NO: 410055 - DNA, 25 bp, Mus musculus
caaggaggaattgggctctttcgtc

SEQ ID NO: 410056 - DNA, 25 bp, Mus musculus
caaggaggatgtctttgttcaccag

SEQ ID NO: 410057 - DNA, 25 bp, Mus musculus
caaggaggcctctagtgacacagga

SEQ ID NO: 410058 - DNA, 25 bp, Mus musculus
caaggaggccttatcaagcagggca

SEQ ID NO: 410059 - DNA, 25 bp, Mus musculus
caaggaggctccacatactgctgct

SEQ ID NO: 410060 - DNA, 25 bp, Mus musculus
caaggaggctctacgctgacttcag

SEQ ID NO: 410061 - DNA, 25 bp, Mus musculus
caaggaggtacacatccaagccgag

SEQ ID NO: 410062 - DNA, 25 bp, Mus musculus
caaggaggtccacaaagtgaaggtt

SEQ ID NO: 410063 - DNA, 25 bp, Mus musculus
caaggaggttgccaaagacctgtac

SEQ ID NO: 410064 - DNA, 25 bp, Mus musculus
caaggaggttgccaagcagtgcaca

SEQ ID NO: 410065 - DNA, 25 bp, Mus musculus
caaggagtatgcgtacctgaagggc

SEQ ID NO: 410066 - DNA, 25 bp, Mus musculus
caaggagtcggcaagcaaacaatga

SEQ ID NO: 410067 - DNA, 25 bp, Mus musculus
caaggagtctagatgtggagcatca

SEQ ID NO: 410068 - DNA, 25 bp, Mus musculus
caaggagtgcctgcataggttctgc

SEQ ID NO: 410069 - DNA, 25 bp, Mus musculus
caaggagtgttcttccaccagggtc

SEQ ID NO: 410070 - DNA, 25 bp, Mus musculus
caaggagttctacgacaacctctgc

SEQ ID NO: 410071 - DNA, 25 bp, Mus musculus
caaggataacaatgcccacacggtg

SEQ ID NO: 410072 - DNA, 25 bp, Mus musculus
caaggataacatcaacgtgaagcaa

SEQ ID NO: 410073 - DNA, 25 bp, Mus musculus
caaggataatgtacagctggccagc

SEQ ID NO: 410074 - DNA, 25 bp, Mus musculus
caaggatataaacttcagcaggctg

SEQ ID NO: 410075 - DNA, 25 bp, Mus musculus
caaggatcaagaaggatcttcaggg

SEQ ID NO: 410076 - DNA, 25 bp, Mus musculus
caaggatcagcagcctgaggcgata

SEQ ID NO: 410077 - DNA, 25 bp, Mus musculus
caaggatccacagtcattcagagag

SEQ ID NO: 410078 - DNA, 25 bp, Mus musculus
caaggatccccgtgtgaggtggcac

SEQ ID NO: 410079 - DNA, 25 bp, Mus musculus
caaggatccgtgaagaacaaaaagg

SEQ ID NO: 410080 - DNA, 25 bp, Mus musculus
caaggatccgtgctgaagttttcaa

SEQ ID NO: 410081 - DNA, 25 bp, Mus musculus
caaggatcctcaacaaagaagagag

SEQ ID NO: 410082 - DNA, 25 bp, Mus musculus
caaggatcgagttagcgcagagccg

SEQ ID NO: 410083 - DNA, 25 bp, Mus musculus
caaggatcttgtactgcctgtcatc

SEQ ID NO: 410084 - DNA, 25 bp, Mus musculus
caaggatgagcgttttctgctgtac

SEQ ID NO: 410085 - DNA, 25 bp, Mus musculus
caaggatgcaaggaacactgaggca

SEQ ID NO: 410086 - DNA, 25 bp, Mus musculus
caaggatgccagttttccagcacga

SEQ ID NO: 410087 - DNA, 25 bp, Mus musculus
caaggatggaaaggtgttgtactca

SEQ ID NO: 410088 - DNA, 25 bp, Mus musculus
caaggatggtgaactgagaggctac

SEQ ID NO: 410089 - DNA, 25 bp, Mus musculus
caaggatgtagtcgtggaactcaag

SEQ ID NO: 410090 - DNA, 25 bp, Mus musculus
caaggatgtggtgccagtaaaccca

SEQ ID NO: 410091 - DNA, 25 bp, Mus musculus
caaggattcctgtgctaaagcagac

SEQ ID NO: 410092 - DNA, 25 bp, Mus musculus
caaggattgaagtcaggcttatgtg

SEQ ID NO: 410093 - DNA, 25 bp, Mus musculus
caaggattgccacggatgctctctc

SEQ ID NO: 410094 - DNA, 25 bp, Mus musculus
caaggattggagacttggcacccca

SEQ ID NO: 410095 - DNA, 25 bp, Mus musculus
caaggattgttaccctgccgtgcag

SEQ ID NO: 410096 - DNA, 25 bp, Mus musculus
caaggatttaaaacatctgagtaga

SEQ ID NO: 410097 - DNA, 25 bp, Mus musculus
caaggatttcagtaccgtcagccgt

SEQ ID NO: 410098 - DNA, 25 bp, Mus musculus
caaggatttggcagacctggtctcc

SEQ ID NO: 410099 - DNA, 25 bp, Mus musculus
caaggattttgaggaacacggtgac

SEQ ID NO: 410100 - DNA, 25 bp, Mus musculus
caaggattttgggaagtctacgcaa

SEQ ID NO: 410101 - DNA, 25 bp, Mus musculus
caaggcaacgctggccctagaatct

SEQ ID NO: 410102 - DNA, 25 bp, Mus musculus
caaggcaagaccacgacgatgagaa

SEQ ID NO: 410103 - DNA, 25 bp, Mus musculus
caaggcaagcgaaagggtatgacaa

SEQ ID NO: 410104 - DNA, 25 bp, Mus musculus
caaggcaaggtactgtagggcaaaa

SEQ ID NO: 410105 - DNA, 25 bp, Mus musculus
caaggcaatgctaggtgaggaacaa

SEQ ID NO: 410106 - DNA, 25 bp, Mus musculus
caaggcaatgtgacgagaactacta

SEQ ID NO: 410107 - DNA, 25 bp, Mus musculus
caaggcaccccaagataagaagaca

SEQ ID NO: 410108 - DNA, 25 bp, Mus musculus
caaggcactaggacctagaaggcaa

SEQ ID NO: 410109 - DNA, 25 bp, Mus musculus
caaggcactcctgaagattctgggc

SEQ ID NO: 410110 - DNA, 25 bp, Mus musculus
caaggcagacataagcggtaacatc

SEQ ID NO: 410111 - DNA, 25 bp, Mus musculus
caaggcagccttgagacagacaaac

SEQ ID NO: 410112 - DNA, 25 bp, Mus musculus
caaggcagtcagtaacctgcatgga

SEQ ID NO: 410113 - DNA, 25 bp, Mus musculus
caaggcagtgattgttcccgggaac

SEQ ID NO: 410114 - DNA, 25 bp, Mus musculus
caaggcagttagtcatataatggct

SEQ ID NO: 410115 - DNA, 25 bp, Mus musculus
caaggcatctggttcacagaaggcg

SEQ ID NO: 410116 - DNA, 25 bp, Mus musculus
caaggcattatttattgctgcatgc

SEQ ID NO: 410117 - DNA, 25 bp, Mus musculus
caaggcatttcgcagaggttttcat

SEQ ID NO: 410118 - DNA, 25 bp, Mus musculus
caaggccacactgggttcggcatgt

SEQ ID NO: 410119 - DNA, 25 bp, Mus musculus
caaggccagcaagatcgaggtctac

SEQ ID NO: 410120 - DNA, 25 bp, Mus musculus
caaggccagcaagattgagacccgg

SEQ ID NO: 410121 - DNA, 25 bp, Mus musculus
caaggccaggctatgaacaaatgtg

SEQ ID NO: 410122 - DNA, 25 bp, Mus musculus
caaggccagggagtatgttgaccac

SEQ ID NO: 410123 - DNA, 25 bp, Mus musculus
caaggccagtcgcagttctgagaag

SEQ ID NO: 410124 - DNA, 25 bp, Mus musculus
caaggccagttgaacagtgcttctc

SEQ ID NO: 410125 - DNA, 25 bp, Mus musculus
caaggccatgatcctggctgaccat

SEQ ID NO: 410126 - DNA, 25 bp, Mus musculus
caaggccatgtgtaccggttctgca

SEQ ID NO: 410127 - DNA, 25 bp, Mus musculus
caaggcccaagagattgatcaaacc

SEQ ID NO: 410128 - DNA, 25 bp, Mus musculus
caaggcccagattgtcaaagctctt

SEQ ID NO: 410129 - DNA, 25 bp, Mus musculus
caaggccccatagcgtttgagaacg

SEQ ID NO: 410130 - DNA, 25 bp, Mus musculus
caaggcccctcatggatatctgaag

SEQ ID NO: 410131 - DNA, 25 bp, Mus musculus
caaggcccgtctatggtctccataa

SEQ ID NO: 410132 - DNA, 25 bp, Mus musculus
caaggccctacgaagcagaaaatgc

SEQ ID NO: 410133 - DNA, 25 bp, Mus musculus
caaggccctagcaggtaatcaggga

SEQ ID NO: 410134 - DNA, 25 bp, Mus musculus
caaggccgtgaaatgctctgtcagt

SEQ ID NO: 410135 - DNA, 25 bp, Mus musculus
caaggcctagagtacagaattgaca

SEQ ID NO: 410136 - DNA, 25 bp, Mus musculus
caaggcctatgggttcaagaacaag

SEQ ID NO: 410137 - DNA, 25 bp, Mus musculus
caaggcctattccaaaggacgggca

SEQ ID NO: 410138 - DNA, 25 bp, Mus musculus
caaggcctccatttctcattataga

SEQ ID NO: 410139 - DNA, 25 bp, Mus musculus
caaggcctgcgtcaactttctggaa

SEQ ID NO: 410140 - DNA, 25 bp, Mus musculus
caaggcctgtcgagagtccgttact

SEQ ID NO: 410141 - DNA, 25 bp, Mus musculus
caaggccttccagagggacgtgttc

SEQ ID NO: 410142 - DNA, 25 bp, Mus musculus
caaggccttttcatagtctccaagc

SEQ ID NO: 410143 - DNA, 25 bp, Mus musculus
caaggcgaagctcccgggtctcctg

SEQ ID NO: 410144 - DNA, 25 bp, Mus musculus
caaggcgaggctggtttcccatacc

SEQ ID NO: 410145 - DNA, 25 bp, Mus musculus
caaggcgctaactgcagtaggcaga

SEQ ID NO: 410146 - DNA, 25 bp, Mus musculus
caaggcgctcactccattgcaggaa

SEQ ID NO: 410147 - DNA, 25 bp, Mus musculus
caaggcggtggctggtgaattctcc

SEQ ID NO: 410148 - DNA, 25 bp, Mus musculus
caaggcgtgacctagttcactgcaa

SEQ ID NO: 410149 - DNA, 25 bp, Mus musculus
caaggcgtttgatgtggagcccagc

SEQ ID NO: 410150 - DNA, 25 bp, Mus musculus
caaggctaattacgacgtcctggag

SEQ ID NO: 410151 - DNA, 25 bp, Mus musculus
caaggctagacacagcagttgagct

SEQ ID NO: 410152 - DNA, 25 bp, Mus musculus
caaggctatatatggtacccaagac

SEQ ID NO: 410153 - DNA, 25 bp, Mus musculus
caaggctatcatgctaatccaggtg

SEQ ID NO: 410154 - DNA, 25 bp, Mus musculus
caaggctcaagcacataggatccac

SEQ ID NO: 410155 - DNA, 25 bp, Mus musculus
caaggctcagcgcatatcaggtgac

SEQ ID NO: 410156 - DNA, 25 bp, Mus musculus
caaggctcgtttctcaggctcagga

SEQ ID NO: 410157 - DNA, 25 bp, Mus musculus
caaggctctgaggaaaaatattaat

SEQ ID NO: 410158 - DNA, 25 bp, Mus musculus
caaggctcttgttgattgggcttcc

SEQ ID NO: 410159 - DNA, 25 bp, Mus musculus
caaggctgaagctctgatgtaccca

SEQ ID NO: 410160 - DNA, 25 bp, Mus musculus
caaggctgcaccactggcaaaatgc

SEQ ID NO: 410161 - DNA, 25 bp, Mus musculus
caaggctgcagcgtcgaagctagaa

SEQ ID NO: 410162 - DNA, 25 bp, Mus musculus
caaggctgccaagagtgctcgagat

SEQ ID NO: 410163 - DNA, 25 bp, Mus musculus
caaggctgccagtgaggaatgaaga

SEQ ID NO: 410164 - DNA, 25 bp, Mus musculus
caaggctgccatcccaagtatcaag

SEQ ID NO: 410165 - DNA, 25 bp, Mus musculus
caaggctgcctggaattgcgaccac

SEQ ID NO: 410166 - DNA, 25 bp, Mus musculus
caaggctgctgcaacagaagatgct

SEQ ID NO: 410167 - DNA, 25 bp, Mus musculus
caaggctggcatgaaccgggtattc

SEQ ID NO: 410168 - DNA, 25 bp, Mus musculus
caaggctgtcagttctcgaattact

SEQ ID NO: 410169 - DNA, 25 bp, Mus musculus
caaggctgtgtccatgagtgatatc

SEQ ID NO: 410170 - DNA, 25 bp, Mus musculus
caaggctgtttctgtgcttccgtgt

SEQ ID NO: 410171 - DNA, 25 bp, Mus musculus
caaggcttaaggaggtccgactgca

SEQ ID NO: 410172 - DNA, 25 bp, Mus musculus
caaggcttccaagtccagtgagagc

SEQ ID NO: 410173 - DNA, 25 bp, Mus musculus
caaggcttgaggctggagacctttc

SEQ ID NO: 410174 - DNA, 25 bp, Mus musculus
caaggcttggtctatctcattggga

SEQ ID NO: 410175 - DNA, 25 bp, Mus musculus
caaggcttgtgttagagatgtcacc

SEQ ID NO: 410176 - DNA, 25 bp, Mus musculus
caaggctttccgctcttggaggaca

SEQ ID NO: 410177 - DNA, 25 bp, Mus musculus
caaggcttttcagtttcaggcagga

SEQ ID NO: 410178 - DNA, 25 bp, Mus musculus
caagggaaaatgactccccacagtt

SEQ ID NO: 410179 - DNA, 25 bp, Mus musculus
caagggaactctactttcagaacaa

SEQ ID NO: 410180 - DNA, 25 bp, Mus musculus
caagggaactggactgaaactgatg

SEQ ID NO: 410181 - DNA, 25 bp, Mus musculus
caagggaagagcgtaccacaacagt

SEQ ID NO: 410182 - DNA, 25 bp, Mus musculus
caagggaagatggaaatataaatgc

SEQ ID NO: 410183 - DNA, 25 bp, Mus musculus
caagggaatcatgaaacaggtgcat

SEQ ID NO: 410184 - DNA, 25 bp, Mus musculus
caagggaatctactacctgagcgga

SEQ ID NO: 410185 - DNA, 25 bp, Mus musculus
caagggacagcacagggccttttgc

SEQ ID NO: 410186 - DNA, 25 bp, Mus musculus
caagggacatcttacaggaccagag

SEQ ID NO: 410187 - DNA, 25 bp, Mus musculus
caagggaccaggtgctctttgagag

SEQ ID NO: 410188 - DNA, 25 bp, Mus musculus
caagggaccatgtgtgatagcgcca

SEQ ID NO: 410189 - DNA, 25 bp, Mus musculus
caagggactagcgaggcatcaggca

SEQ ID NO: 410190 - DNA, 25 bp, Mus musculus
caagggagaccaggattctctctgg

SEQ ID NO: 410191 - DNA, 25 bp, Mus musculus
caagggagactgcttctagctgcca

SEQ ID NO: 410192 - DNA, 25 bp, Mus musculus
caagggagcaatcctcagtgggaca

SEQ ID NO: 410193 - DNA, 25 bp, Mus musculus
caagggagccaagcaagtggagtcc

SEQ ID NO: 410194 - DNA, 25 bp, Mus musculus
caagggagcctcatgctttaccggg

SEQ ID NO: 410195 - DNA, 25 bp, Mus musculus
caagggaggcgacctgttcttcacg

SEQ ID NO: 410196 - DNA, 25 bp, Mus musculus
caagggatcattaaaactggctcac

SEQ ID NO: 410197 - DNA, 25 bp, Mus musculus
caagggatctgacccttgagacaga

SEQ ID NO: 410198 - DNA, 25 bp, Mus musculus
caagggatgctgacaacaccaggct

SEQ ID NO: 410199 - DNA, 25 bp, Mus musculus
caagggatggctaaaaagggctcca

SEQ ID NO: 410200 - DNA, 25 bp, Mus musculus
caagggattcgctgtttgttcgaca

SEQ ID NO: 410201 - DNA, 25 bp, Mus musculus
caagggcaactcactggactcagat

SEQ ID NO: 410202 - DNA, 25 bp, Mus musculus
caagggcaagaggatgtgatcacac

SEQ ID NO: 410203 - DNA, 25 bp, Mus musculus
caagggcaagccatggccttctttt

SEQ ID NO: 410204 - DNA, 25 bp, Mus musculus
caagggcaatctaccaagcagtgaa

SEQ ID NO: 410205 - DNA, 25 bp, Mus musculus
caagggcacactcaggaagatggca

SEQ ID NO: 410206 - DNA, 25 bp, Mus musculus
caagggcacggcgtcatgaagtaca

SEQ ID NO: 410207 - DNA, 25 bp, Mus musculus
caagggcagccagtctacaaaatga

SEQ ID NO: 410208 - DNA, 25 bp, Mus musculus
caagggcagtgctcatcacagatca

SEQ ID NO: 410209 - DNA, 25 bp, Mus musculus
caagggcatgatccgcaaacagtag

SEQ ID NO: 410210 - DNA, 25 bp, Mus musculus
caagggccaagagcagtggttccga

SEQ ID NO: 410211 - DNA, 25 bp, Mus musculus
caagggcccaagctgaaacaagcaa

SEQ ID NO: 410212 - DNA, 25 bp, Mus musculus
caagggcccttgtaaagacatgtcc

SEQ ID NO: 410213 - DNA, 25 bp, Mus musculus
caagggccggaagctgcataagatg

SEQ ID NO: 410214 - DNA, 25 bp, Mus musculus
caagggcctcttctttctcagggtg

SEQ ID NO: 410215 - DNA, 25 bp, Mus musculus
caagggcgacacgacaatgaagagt

SEQ ID NO: 410216 - DNA, 25 bp, Mus musculus
caagggcgctgaagaccaagacaat

SEQ ID NO: 410217 - DNA, 25 bp, Mus musculus
caagggcgctggaatatagaggaac

SEQ ID NO: 410218 - DNA, 25 bp, Mus musculus
caagggcgtactggaaacacatttc

SEQ ID NO: 410219 - DNA, 25 bp, Mus musculus
caagggctaccagcttctagaagaa

SEQ ID NO: 410220 - DNA, 25 bp, Mus musculus
caagggctatcttaggcaggtgaaa

SEQ ID NO: 410221 - DNA, 25 bp, Mus musculus
caagggctcaatctggaaatcgaaa

SEQ ID NO: 410222 - DNA, 25 bp, Mus musculus
caagggctcccgtagtgttcagagg

SEQ ID NO: 410223 - DNA, 25 bp, Mus musculus
caagggctcctacgcaaaagtcaaa

SEQ ID NO: 410224 - DNA, 25 bp, Mus musculus
caagggctggatgatctgtctggac

SEQ ID NO: 410225 - DNA, 25 bp, Mus musculus
caagggctggatggtagacatctcc

SEQ ID NO: 410226 - DNA, 25 bp, Mus musculus
caagggctgtgctaatccgaggact

SEQ ID NO: 410227 - DNA, 25 bp, Mus musculus
caagggcttcatcactcgtcaggat

SEQ ID NO: 410228 - DNA, 25 bp, Mus musculus
caagggcttggaaggttaacgcgca

SEQ ID NO: 410229 - DNA, 25 bp, Mus musculus
caagggtactgactcgcagccagat

SEQ ID NO: 410230 - DNA, 25 bp, Mus musculus
caagggtagagcactattggcggcc

SEQ ID NO: 410231 - DNA, 25 bp, Mus musculus
caagggtcattcatgtgggagcaac

SEQ ID NO: 410232 - DNA, 25 bp, Mus musculus
caagggtctccatattgttacacaa

SEQ ID NO: 410233 - DNA, 25 bp, Mus musculus
caagggtctttcactacgacaggaa

SEQ ID NO: 410234 - DNA, 25 bp, Mus musculus
caagggtgatctggccgatgtgcaa

SEQ ID NO: 410235 - DNA, 25 bp, Mus musculus
caagggtgcggcactaccacattca

SEQ ID NO: 410236 - DNA, 25 bp, Mus musculus
caagggtgcttctgttaaatctggg

SEQ ID NO: 410237 - DNA, 25 bp, Mus musculus
caagggtgctttccgtgacccgtca

SEQ ID NO: 410238 - DNA, 25 bp, Mus musculus
caagggtgtcactgcttcatcctcg

SEQ ID NO: 410239 - DNA, 25 bp, Mus musculus
caagggttccttctgcaaccagggc

SEQ ID NO: 410240 - DNA, 25 bp, Mus musculus
caagggttgtactctgtcctcgcct

SEQ ID NO: 410241 - DNA, 25 bp, Mus musculus
caagggttgtcccaatgagccaaac

SEQ ID NO: 410242 - DNA, 25 bp, Mus musculus
caagggttgtctggtgtatgtaaac

SEQ ID NO: 410243 - DNA, 25 bp, Mus musculus
caagggtttgtcataaagggcacga

SEQ ID NO: 410244 - DNA, 25 bp, Mus musculus
caaggtaaacatggccgtgatggct

SEQ ID NO: 410245 - DNA, 25 bp, Mus musculus
caaggtaagatactcaatcaaggcc

SEQ ID NO: 410246 - DNA, 25 bp, Mus musculus
caaggtaagtctattttgatagtag

SEQ ID NO: 410247 - DNA, 25 bp, Mus musculus
caaggtaatctgtggttcagtgcca

SEQ ID NO: 410248 - DNA, 25 bp, Mus musculus
caaggtaattcattattgagagctc

SEQ ID NO: 410249 - DNA, 25 bp, Mus musculus
caaggtaattgtatcttcttaaaca

SEQ ID NO: 410250 - DNA, 25 bp, Mus musculus
caaggtaattgtggccgtcatagga

SEQ ID NO: 410251 - DNA, 25 bp, Mus musculus
caaggtagacatgggtaggaagctc

SEQ ID NO: 410252 - DNA, 25 bp, Mus musculus
caaggtagagaagatctcggagact

SEQ ID NO: 410253 - DNA, 25 bp, Mus musculus
caaggtagaggaagcttcaggccaa

SEQ ID NO: 410254 - DNA, 25 bp, Mus musculus
caaggtagatagcatactcagggaa

SEQ ID NO: 410255 - DNA, 25 bp, Mus musculus
caaggtagcattgttcgcagccgtc

SEQ ID NO: 410256 - DNA, 25 bp, Mus musculus
caaggtagggactgactttgcatgt

SEQ ID NO: 410257 - DNA, 25 bp, Mus musculus
caaggtagtgcaagtgttccgcctc

SEQ ID NO: 410258 - DNA, 25 bp, Mus musculus
caaggtatattctatgggctctccc

SEQ ID NO: 410259 - DNA, 25 bp, Mus musculus
caaggtatcacatcaacaggcccta

SEQ ID NO: 410260 - DNA, 25 bp, Mus musculus
caaggtatcctctggaagcccactg

SEQ ID NO: 410261 - DNA, 25 bp, Mus musculus
caaggtattccttgccattcggagg

SEQ ID NO: 410262 - DNA, 25 bp, Mus musculus
caaggtatttgctgagctgtggccc

SEQ ID NO: 410263 - DNA, 25 bp, Mus musculus
caaggtcaactgctaggagacgaca

SEQ ID NO: 410264 - DNA, 25 bp, Mus musculus
caaggtcaggactttgtgcctgcaa

SEQ ID NO: 410265 - DNA, 25 bp, Mus musculus
caaggtcagtcaaggttaacaggtc

SEQ ID NO: 410266 - DNA, 25 bp, Mus musculus
caaggtccagaatgagcagtaaaca

SEQ ID NO: 410267 - DNA, 25 bp, Mus musculus
caaggtcctcaccaaccaggagagt

SEQ ID NO: 410268 - DNA, 25 bp, Mus musculus
caaggtcctgaccttcctagacagt

SEQ ID NO: 410269 - DNA, 25 bp, Mus musculus
caaggtcggctctctgagacgggtc

SEQ ID NO: 410270 - DNA, 25 bp, Mus musculus
caaggtcgttctggcatgctgcaaa

SEQ ID NO: 410271 - DNA, 25 bp, Mus musculus
caaggtctacaataaagcaggccca

SEQ ID NO: 410272 - DNA, 25 bp, Mus musculus
caaggtctacagcaccaagagcgat

SEQ ID NO: 410273 - DNA, 25 bp, Mus musculus
caaggtctatgcgatgctatacgtc

SEQ ID NO: 410274 - DNA, 25 bp, Mus musculus
caaggtctgttcaggaaaatgtccc

SEQ ID NO: 410275 - DNA, 25 bp, Mus musculus
caaggtcttgaaaggtgaaatccca

SEQ ID NO: 410276 - DNA, 25 bp, Mus musculus
caaggtctttatacagatgcggatc

SEQ ID NO: 410277 - DNA, 25 bp, Mus musculus
caaggtcttttctgtggccatcaca

SEQ ID NO: 410278 - DNA, 25 bp, Mus musculus
caaggtgaactgctggaagatccca

SEQ ID NO: 410279 - DNA, 25 bp, Mus musculus
caaggtgaagacactcaaggctgag

SEQ ID NO: 410280 - DNA, 25 bp, Mus musculus
caaggtgagggaatctgtgttaaca

SEQ ID NO: 410281 - DNA, 25 bp, Mus musculus
caaggtgcacctaaagcagaaggcg

SEQ ID NO: 410282 - DNA, 25 bp, Mus musculus
caaggtgcagagtctggattcctac

SEQ ID NO: 410283 - DNA, 25 bp, Mus musculus
caaggtgcagcattacgtggcctac

SEQ ID NO: 410284 - DNA, 25 bp, Mus musculus
caaggtgcatatattgggtctcttc

SEQ ID NO: 410285 - DNA, 25 bp, Mus musculus
caaggtgccgactgtgaactaaata

SEQ ID NO: 410286 - DNA, 25 bp, Mus musculus
caaggtgctggatgtactacgccaa

SEQ ID NO: 410287 - DNA, 25 bp, Mus musculus
caaggtgctgttatcaagccgacgg

SEQ ID NO: 410288 - DNA, 25 bp, Mus musculus
caaggtgctttgttgtctaacctga

SEQ ID NO: 410289 - DNA, 25 bp, Mus musculus
caaggtggaaacatcgttcagtctc

SEQ ID NO: 410290 - DNA, 25 bp, Mus musculus
caaggtggaccattcctctaggaag

SEQ ID NO: 410291 - DNA, 25 bp, Mus musculus
caaggtggactgtgagaccaatctc

SEQ ID NO: 410292 - DNA, 25 bp, Mus musculus
caaggtggacttttcgatgcccagg

SEQ ID NO: 410293 - DNA, 25 bp, Mus musculus
caaggtggcactaggcggaacctac

SEQ ID NO: 410294 - DNA, 25 bp, Mus musculus
caaggtggcttccattctgtaactg

SEQ ID NO: 410295 - DNA, 25 bp, Mus musculus
caaggtgggcaatctgtgcatctca

SEQ ID NO: 410296 - DNA, 25 bp, Mus musculus
caaggtggtcttcaacacgatgcaa

SEQ ID NO: 410297 - DNA, 25 bp, Mus musculus
caaggtgtacggcaaaacgtcgcac

SEQ ID NO: 410298 - DNA, 25 bp, Mus musculus
caaggtgtagacattcctagggaca

SEQ ID NO: 410299 - DNA, 25 bp, Mus musculus
caaggtgtcaccaagaatgatgagg

SEQ ID NO: 410300 - DNA, 25 bp, Mus musculus
caaggtgtccatggatctgcgggcc

SEQ ID NO: 410301 - DNA, 25 bp, Mus musculus
caaggtgtgccctatgaatcgatac

SEQ ID NO: 410302 - DNA, 25 bp, Mus musculus
caaggtgtgccgaaggagaagctca

SEQ ID NO: 410303 - DNA, 25 bp, Mus musculus
caaggttacagattctcctgatcca

SEQ ID NO: 410304 - DNA, 25 bp, Mus musculus
caaggttacccgagagaagaagatc

SEQ ID NO: 410305 - DNA, 25 bp, Mus musculus
caaggttatcgtgcgcatccgagac

SEQ ID NO: 410306 - DNA, 25 bp, Mus musculus
caaggttcagcatctacttacgtca

SEQ ID NO: 410307 - DNA, 25 bp, Mus musculus
caaggttctagttcacaggtctccc

SEQ ID NO: 410308 - DNA, 25 bp, Mus musculus
caaggttctctaaggcctaacatag

SEQ ID NO: 410309 - DNA, 25 bp, Mus musculus
caaggttcttcccacatacgatgca

SEQ ID NO: 410310 - DNA, 25 bp, Mus musculus
caaggttgaccagggactgtctaca

SEQ ID NO: 410311 - DNA, 25 bp, Mus musculus
caaggttgaggtttctatcagcaca

SEQ ID NO: 410312 - DNA, 25 bp, Mus musculus
caaggttgcagctgtcggaaggctc

SEQ ID NO: 410313 - DNA, 25 bp, Mus musculus
caaggttgctgggtatatctgccat

SEQ ID NO: 410314 - DNA, 25 bp, Mus musculus
caaggttgggcctctggcacagctg

SEQ ID NO: 410315 - DNA, 25 bp, Mus musculus
caaggttgtataaactctgtccaaa

SEQ ID NO: 410316 - DNA, 25 bp, Mus musculus
caaggtttaagaggagaggctccca

SEQ ID NO: 410317 - DNA, 25 bp, Mus musculus
caaggtttcgttctcatgccgcggg

SEQ ID NO: 410318 - DNA, 25 bp, Mus musculus
caaggtttgacttggtaacccagca

SEQ ID NO: 410319 - DNA, 25 bp, Mus musculus
caaggttttcagtagggcgctccag

SEQ ID NO: 410320 - DNA, 25 bp, Mus musculus
caagtaaaagaatcactcggccagg

SEQ ID NO: 410321 - DNA, 25 bp, Mus musculus
caagtaaacgccactttagtcgtgg

SEQ ID NO: 410322 - DNA, 25 bp, Mus musculus
caagtaaatggcacagccgggctgg

SEQ ID NO: 410323 - DNA, 25 bp, Mus musculus
caagtaacggagaaagaagacagac

SEQ ID NO: 410324 - DNA, 25 bp, Mus musculus
caagtaacgggtgttctgacagcta

SEQ ID NO: 410325 - DNA, 25 bp, Mus musculus
caagtaactttggacgacatggaga

SEQ ID NO: 410326 - DNA, 25 bp, Mus musculus
caagtaaggtactaactgtcctccg

SEQ ID NO: 410327 - DNA, 25 bp, Mus musculus
caagtaatgtgcctatgccagctaa

SEQ ID NO: 410328 - DNA, 25 bp, Mus musculus
caagtacaaggctagcacaggctaa

SEQ ID NO: 410329 - DNA, 25 bp, Mus musculus
caagtacaagtaacagccaatcaga

SEQ ID NO: 410330 - DNA, 25 bp, Mus musculus
caagtacacgctcagatggctggcc

SEQ ID NO: 410331 - DNA, 25 bp, Mus musculus
caagtacagggcaattaaggtgccc

SEQ ID NO: 410332 - DNA, 25 bp, Mus musculus
caagtacagtctcaatggccggcag

SEQ ID NO: 410333 - DNA, 25 bp, Mus musculus
caagtacatcgagcacttcagcaag

SEQ ID NO: 410334 - DNA, 25 bp, Mus musculus
caagtacatgaggagccataaggca

SEQ ID NO: 410335 - DNA, 25 bp, Mus musculus
caagtacattgcagtgtcctcagag

SEQ ID NO: 410336 - DNA, 25 bp, Mus musculus
caagtaccaattgcagagccaggag

SEQ ID NO: 410337 - DNA, 25 bp, Mus musculus
caagtaccatctcttactgtgatgt

SEQ ID NO: 410338 - DNA, 25 bp, Mus musculus
caagtacccggaaagtcagttctga

SEQ ID NO: 410339 - DNA, 25 bp, Mus musculus
caagtacccggtggtggtcatcaaa

SEQ ID NO: 410340 - DNA, 25 bp, Mus musculus
caagtacctgcgcatccctgatgag

SEQ ID NO: 410341 - DNA, 25 bp, Mus musculus
caagtacgagacactgcagatggcg

SEQ ID NO: 410342 - DNA, 25 bp, Mus musculus
caagtacggaatgaagctgccgggc

SEQ ID NO: 410343 - DNA, 25 bp, Mus musculus
caagtacggagaagtgaatcagccc

SEQ ID NO: 410344 - DNA, 25 bp, Mus musculus
caagtactacaggatgatgcagact

SEQ ID NO: 410345 - DNA, 25 bp, Mus musculus
caagtactactttgcagtgcgcgcc

SEQ ID NO: 410346 - DNA, 25 bp, Mus musculus
caagtactgagtttcaggcacacac

SEQ ID NO: 410347 - DNA, 25 bp, Mus musculus
caagtactggactgctacaacaggt

SEQ ID NO: 410348 - DNA, 25 bp, Mus musculus
caagtactgggagtacactttcaaa

SEQ ID NO: 410349 - DNA, 25 bp, Mus musculus
caagtactgggtttagttctgcgca

SEQ ID NO: 410350 - DNA, 25 bp, Mus musculus
caagtacttcttggcagagctgctg

SEQ ID NO: 410351 - DNA, 25 bp, Mus musculus
caagtacttgatggaaacgtggccg

SEQ ID NO: 410352 - DNA, 25 bp, Mus musculus
caagtagaaagtcattaggaaccaa

SEQ ID NO: 410353 - DNA, 25 bp, Mus musculus
caagtagaattaccacagagcccag

SEQ ID NO: 410354 - DNA, 25 bp, Mus musculus
caagtagagtcatttgaagcccggc

SEQ ID NO: 410355 - DNA, 25 bp, Mus musculus
caagtagcaaaaaatacagttatcg

SEQ ID NO: 410356 - DNA, 25 bp, Mus musculus
caagtagccccagtctaaaggagtg

SEQ ID NO: 410357 - DNA, 25 bp, Mus musculus
caagtagctgagaagtctgaccagc

SEQ ID NO: 410358 - DNA, 25 bp, Mus musculus
caagtaggactgtcaagtagtctca

SEQ ID NO: 410359 - DNA, 25 bp, Mus musculus
caagtagtaatccaaagttgccgcc

SEQ ID NO: 410360 - DNA, 25 bp, Mus musculus
caagtagtcatgagagttcctagag

SEQ ID NO: 410361 - DNA, 25 bp, Mus musculus
caagtagtctgaaaacacccctggg

SEQ ID NO: 410362 - DNA, 25 bp, Mus musculus
caagtagttacactccggcaagaca

SEQ ID NO: 410363 - DNA, 25 bp, Mus musculus
caagtagttgaaggtgttgcgtgaa

SEQ ID NO: 410364 - DNA, 25 bp, Mus musculus
caagtagtttgcttgcacttcgcaa

SEQ ID NO: 410365 - DNA, 25 bp, Mus musculus
caagtagtttggagcatctcaagga

SEQ ID NO: 410366 - DNA, 25 bp, Mus musculus
caagtagtttgtacagctccgggag

SEQ ID NO: 410367 - DNA, 25 bp, Mus musculus
caagtatctcgattagccagtccgc

SEQ ID NO: 410368 - DNA, 25 bp, Mus musculus
caagtatctggccacctgtgcggat

SEQ ID NO: 410369 - DNA, 25 bp, Mus musculus
caagtatgacgatgaagagtgcacc

SEQ ID NO: 410370 - DNA, 25 bp, Mus musculus
caagtatgggattgaagaacacggc

SEQ ID NO: 410371 - DNA, 25 bp, Mus musculus
caagtatgtcattagatccggatca

SEQ ID NO: 410372 - DNA, 25 bp, Mus musculus
caagtatgttggaacaccaggtcaa

SEQ ID NO: 410373 - DNA, 25 bp, Mus musculus
caagtattcaccactgagttaggcc

SEQ ID NO: 410374 - DNA, 25 bp, Mus musculus
caagtattctggagcttcagcggca

SEQ ID NO: 410375 - DNA, 25 bp, Mus musculus
caagtattgggatacctcgggctaa

SEQ ID NO: 410376 - DNA, 25 bp, Mus musculus
caagtatttctggaggctgacccgg

SEQ ID NO: 410377 - DNA, 25 bp, Mus musculus
caagtcaaaatcatctgcaagcaag

SEQ ID NO: 410378 - DNA, 25 bp, Mus musculus
caagtcaaatgatctaagttatgca

SEQ ID NO: 410379 - DNA, 25 bp, Mus musculus
caagtcaactgcaagagagaaaggg

SEQ ID NO: 410380 - DNA, 25 bp, Mus musculus
caagtcaagattgctgaaggccaca

SEQ ID NO: 410381 - DNA, 25 bp, Mus musculus
caagtcaagtttgtccctggtgcga

SEQ ID NO: 410382 - DNA, 25 bp, Mus musculus
caagtcacgcctgaacagtagggca

SEQ ID NO: 410383 - DNA, 25 bp, Mus musculus
caagtcagaagtccgagaacagatc

SEQ ID NO: 410384 - DNA, 25 bp, Mus musculus
caagtcagagaagttgcagccagct

SEQ ID NO: 410385 - DNA, 25 bp, Mus musculus
caagtcagcctcctgaaacatcttt

SEQ ID NO: 410386 - DNA, 25 bp, Mus musculus
caagtcagctggttacctccctagc

SEQ ID NO: 410387 - DNA, 25 bp, Mus musculus
caagtcaggcagaataggacccgcc

SEQ ID NO: 410388 - DNA, 25 bp, Mus musculus
caagtcaggctgagctacaatccta

SEQ ID NO: 410389 - DNA, 25 bp, Mus musculus
caagtcagggacaaagatatgagag

SEQ ID NO: 410390 - DNA, 25 bp, Mus musculus
caagtcagggttgtcgcgatggcat

SEQ ID NO: 410391 - DNA, 25 bp, Mus musculus
caagtcagtacgtggtgcaggtgaa

SEQ ID NO: 410392 - DNA, 25 bp, Mus musculus
caagtcatacagtgaggcaagctca

SEQ ID NO: 410393 - DNA, 25 bp, Mus musculus
caagtcatagggtgggcataatccc

SEQ ID NO: 410394 - DNA, 25 bp, Mus musculus
caagtcatcctgattccgttgggca

SEQ ID NO: 410395 - DNA, 25 bp, Mus musculus
caagtccaagagacaccgtagtcgc

SEQ ID NO: 410396 - DNA, 25 bp, Mus musculus
caagtcccaagtccttagagcaagt

SEQ ID NO: 410397 - DNA, 25 bp, Mus musculus
caagtcccagaagacgtagccgtca

SEQ ID NO: 410398 - DNA, 25 bp, Mus musculus
caagtccctagcaccattggaggca

SEQ ID NO: 410399 - DNA, 25 bp, Mus musculus
caagtcctacctgagtgtccgtggc

SEQ ID NO: 410400 - DNA, 25 bp, Mus musculus
caagtcctccttcgatactaccaaa

SEQ ID NO: 410401 - DNA, 25 bp, Mus musculus
caagtcctgcagaaaccacccagga

SEQ ID NO: 410402 - DNA, 25 bp, Mus musculus
caagtcctgggcacagtcaaatggt

SEQ ID NO: 410403 - DNA, 25 bp, Mus musculus
caagtcctggtagacgtggagacga

SEQ ID NO: 410404 - DNA, 25 bp, Mus musculus
caagtccttacatgaaccaggctgg

SEQ ID NO: 410405 - DNA, 25 bp, Mus musculus
caagtcctttcgttctgtgggcaac

SEQ ID NO: 410406 - DNA, 25 bp, Mus musculus
caagtcgattctacaggacatgggc

SEQ ID NO: 410407 - DNA, 25 bp, Mus musculus
caagtcgccgggagctgtagtccct

SEQ ID NO: 410408 - DNA, 25 bp, Mus musculus
caagtcgctgaaagagtcggaggca

SEQ ID NO: 410409 - DNA, 25 bp, Mus musculus
caagtcggagctgtgtctggataac

SEQ ID NO: 410410 - DNA, 25 bp, Mus musculus
caagtcgtggtggatcctgcggaaa

SEQ ID NO: 410411 - DNA, 25 bp, Mus musculus
caagtctaagcggaaagtgaaccac

SEQ ID NO: 410412 - DNA, 25 bp, Mus musculus
caagtctaggattctttatagctcc

SEQ ID NO: 410413 - DNA, 25 bp, Mus musculus
caagtctagggcagtctccaagcag

SEQ ID NO: 410414 - DNA, 25 bp, Mus musculus
caagtctaggtatcagcgtatgcag

SEQ ID NO: 410415 - DNA, 25 bp, Mus musculus
caagtctataaagagcacacgcagg

SEQ ID NO: 410416 - DNA, 25 bp, Mus musculus
caagtctatcagttcagcgcatcca

SEQ ID NO: 410417 - DNA, 25 bp, Mus musculus
caagtctatctcaacaggctgccag

SEQ ID NO: 410418 - DNA, 25 bp, Mus musculus
caagtctccatgaactggcggtgag

SEQ ID NO: 410419 - DNA, 25 bp, Mus musculus
caagtctcggacagcgttcactgca

SEQ ID NO: 410420 - DNA, 25 bp, Mus musculus
caagtctcgtgtgtaaaagtatcca

SEQ ID NO: 410421 - DNA, 25 bp, Mus musculus
caagtctctgaactatgacagtgaa

SEQ ID NO: 410422 - DNA, 25 bp, Mus musculus
caagtctgagttctacgcgggcaag

SEQ ID NO: 410423 - DNA, 25 bp, Mus musculus
caagtctgatgagcgaagcgttctg

SEQ ID NO: 410424 - DNA, 25 bp, Mus musculus
caagtctgcatgctatggagtccac

SEQ ID NO: 410425 - DNA, 25 bp, Mus musculus
caagtctgtctcagccagtagatcc

SEQ ID NO: 410426 - DNA, 25 bp, Mus musculus
caagtctgtgatgacacgggcccat

SEQ ID NO: 410427 - DNA, 25 bp, Mus musculus
caagtctgtgtatgacggccctgag

SEQ ID NO: 410428 - DNA, 25 bp, Mus musculus
caagtctgtgttagctgcggaagcc

SEQ ID NO: 410429 - DNA, 25 bp, Mus musculus
caagtgaaagtgtccctgaaggcca

SEQ ID NO: 410430 - DNA, 25 bp, Mus musculus
caagtgaactgtcctaaagttggtg

SEQ ID NO: 410431 - DNA, 25 bp, Mus musculus
caagtgaattaccaagactcccagg

SEQ ID NO: 410432 - DNA, 25 bp, Mus musculus
caagtgaattcaccctgacctggag

SEQ ID NO: 410433 - DNA, 25 bp, Mus musculus
caagtgacacttgacggactgcgca

SEQ ID NO: 410434 - DNA, 25 bp, Mus musculus
caagtgacctgcctgctcatctggg

SEQ ID NO: 410435 - DNA, 25 bp, Mus musculus
caagtgacggtctcaacagggcaag

SEQ ID NO: 410436 - DNA, 25 bp, Mus musculus
caagtgagagattccgggcagtacc

SEQ ID NO: 410437 - DNA, 25 bp, Mus musculus
caagtgagatgcacatgccctaggg

SEQ ID NO: 410438 - DNA, 25 bp, Mus musculus
caagtgagcataaaaaacaaggact

SEQ ID NO: 410439 - DNA, 25 bp, Mus musculus
caagtgagcggtgagcaagtaagca

SEQ ID NO: 410440 - DNA, 25 bp, Mus musculus
caagtgagcttacaggcactggcat

SEQ ID NO: 410441 - DNA, 25 bp, Mus musculus
caagtgaggttctccaacgaccaga

SEQ ID NO: 410442 - DNA, 25 bp, Mus musculus
caagtgatgactgcagcatccactc

SEQ ID NO: 410443 - DNA, 25 bp, Mus musculus
caagtgatgatgataatactagaac

SEQ ID NO: 410444 - DNA, 25 bp, Mus musculus
caagtgatgtatgaagctctgcaga

SEQ ID NO: 410445 - DNA, 25 bp, Mus musculus
caagtgatgttaccaggtgagccgt

SEQ ID NO: 410446 - DNA, 25 bp, Mus musculus
caagtgcaacctgatgaggccgaag

SEQ ID NO: 410447 - DNA, 25 bp, Mus musculus
caagtgcaagcccacacttttggaa

SEQ ID NO: 410448 - DNA, 25 bp, Mus musculus
caagtgcacgttaatctctgaggac

SEQ ID NO: 410449 - DNA, 25 bp, Mus musculus
caagtgcagacatggaccagacgtc

SEQ ID NO: 410450 - DNA, 25 bp, Mus musculus
caagtgcagcaggatggttctggtc

SEQ ID NO: 410451 - DNA, 25 bp, Mus musculus
caagtgcagcgagtgtgagaaagcc

SEQ ID NO: 410452 - DNA, 25 bp, Mus musculus
caagtgcaggatggactaccagcgt

SEQ ID NO: 410453 - DNA, 25 bp, Mus musculus
caagtgcatgcttcaggctcgacga

SEQ ID NO: 410454 - DNA, 25 bp, Mus musculus
caagtgccaaggactggaatcccgg

SEQ ID NO: 410455 - DNA, 25 bp, Mus musculus
caagtgcccgtaatctgactcccag

SEQ ID NO: 410456 - DNA, 25 bp, Mus musculus
caagtgccgttgtgcccatggacaa

SEQ ID NO: 410457 - DNA, 25 bp, Mus musculus
caagtgcctgataccagcgtgcaag

SEQ ID NO: 410458 - DNA, 25 bp, Mus musculus
caagtgccttccatgttagtgctgg

SEQ ID NO: 410459 - DNA, 25 bp, Mus musculus
caagtgccttggaacatggaatgcc

SEQ ID NO: 410460 - DNA, 25 bp, Mus musculus
caagtgcggattgatttccccaggg

SEQ ID NO: 410461 - DNA, 25 bp, Mus musculus
caagtgcgggcatatctgtggaaac

SEQ ID NO: 410462 - DNA, 25 bp, Mus musculus
caagtgctcaatcgaaggctggttc

SEQ ID NO: 410463 - DNA, 25 bp, Mus musculus
caagtgctcaggtgaggttctttca

SEQ ID NO: 410464 - DNA, 25 bp, Mus musculus
caagtgctccaaacctaacggtcag

SEQ ID NO: 410465 - DNA, 25 bp, Mus musculus
caagtgctctcagtgtgaccagaac

SEQ ID NO: 410466 - DNA, 25 bp, Mus musculus
caagtgctgccccatgaacagtctc

SEQ ID NO: 410467 - DNA, 25 bp, Mus musculus
caagtgctgctcagtccctgtgagg

SEQ ID NO: 410468 - DNA, 25 bp, Mus musculus
caagtgctgctggacattcggtctc

SEQ ID NO: 410469 - DNA, 25 bp, Mus musculus
caagtgctggataacctgatggaca

SEQ ID NO: 410470 - DNA, 25 bp, Mus musculus
caagtgctggatgaacaaacgtacc

SEQ ID NO: 410471 - DNA, 25 bp, Mus musculus
caagtgctgggctctagcgaagaca

SEQ ID NO: 410472 - DNA, 25 bp, Mus musculus
caagtgctgtgggaacaacggcttc

SEQ ID NO: 410473 - DNA, 25 bp, Mus musculus
caagtgcttcccgagctgagaatta

SEQ ID NO: 410474 - DNA, 25 bp, Mus musculus
caagtggaaacgtgtcaaggcaggc

SEQ ID NO: 410475 - DNA, 25 bp, Mus musculus
caagtggaactctatgtgtgtgagc

SEQ ID NO: 410476 - DNA, 25 bp, Mus musculus
caagtggaacttttggactcagagg

SEQ ID NO: 410477 - DNA, 25 bp, Mus musculus
caagtggacgcccagaagatgaaaa

SEQ ID NO: 410478 - DNA, 25 bp, Mus musculus
caagtggacttgctcccggttctcg

SEQ ID NO: 410479 - DNA, 25 bp, Mus musculus
caagtggacttttgacagcccagag

SEQ ID NO: 410480 - DNA, 25 bp, Mus musculus
caagtggagacggtgcggcagctcc

SEQ ID NO: 410481 - DNA, 25 bp, Mus musculus
caagtggagcctagcacctcctcat

SEQ ID NO: 410482 - DNA, 25 bp, Mus musculus
caagtggataaactgctccggagga

SEQ ID NO: 410483 - DNA, 25 bp, Mus musculus
caagtggatatcactggaaatctgg

SEQ ID NO: 410484 - DNA, 25 bp, Mus musculus
caagtggatatgtggctgtgcagac

SEQ ID NO: 410485 - DNA, 25 bp, Mus musculus
caagtggatcgccagttcccggatc

SEQ ID NO: 410486 - DNA, 25 bp, Mus musculus
caagtggattgacctgacatggaag

SEQ ID NO: 410487 - DNA, 25 bp, Mus musculus
caagtggattttgttcatgagagcc

SEQ ID NO: 410488 - DNA, 25 bp, Mus musculus
caagtggcactctatggctgtgagc

SEQ ID NO: 410489 - DNA, 25 bp, Mus musculus
caagtggcccgctcaatagtgatga

SEQ ID NO: 410490 - DNA, 25 bp, Mus musculus
caagtggccctatcaacctgaggat

SEQ ID NO: 410491 - DNA, 25 bp, Mus musculus
caagtggctgagatgtcccgagtca

SEQ ID NO: 410492 - DNA, 25 bp, Mus musculus
caagtggcttcttgtgtgcaacgtg

SEQ ID NO: 410493 - DNA, 25 bp, Mus musculus
caagtgggaccatgactgatcgtca

SEQ ID NO: 410494 - DNA, 25 bp, Mus musculus
caagtgggcacagtttgtcctgtct

SEQ ID NO: 410495 - DNA, 25 bp, Mus musculus
caagtgggtcaaggccaagtgtcac

SEQ ID NO: 410496 - DNA, 25 bp, Mus musculus
caagtggtcacgcaggcattatctc

SEQ ID NO: 410497 - DNA, 25 bp, Mus musculus
caagtggtccaactgggagatccca

SEQ ID NO: 410498 - DNA, 25 bp, Mus musculus
caagtggtccctccttcggtgaaag

SEQ ID NO: 410499 - DNA, 25 bp, Mus musculus
caagtggtgacttccgtgcctggta

SEQ ID NO: 410500 - DNA, 25 bp, Mus musculus
caagtggtgccatgaagatccccaa

SEQ ID NO: 410501 - DNA, 25 bp, Mus musculus
caagtggttccaagtaagggatgcc

SEQ ID NO: 410502 - DNA, 25 bp, Mus musculus
caagtggtttgcagttccagaaggc

SEQ ID NO: 410503 - DNA, 25 bp, Mus musculus
caagtggtttggtaatgtacgactc

SEQ ID NO: 410504 - DNA, 25 bp, Mus musculus
caagtgtacggtctgcaaggaatcc

SEQ ID NO: 410505 - DNA, 25 bp, Mus musculus
caagtgtactcttgacttaaatatg

SEQ ID NO: 410506 - DNA, 25 bp, Mus musculus
caagtgtatatgtgacccgggctac

SEQ ID NO: 410507 - DNA, 25 bp, Mus musculus
caagtgtatggacacccgacgcaag

SEQ ID NO: 410508 - DNA, 25 bp, Mus musculus
caagtgtatggtcaatattttcccc

SEQ ID NO: 410509 - DNA, 25 bp, Mus musculus
caagtgtcaaaatcaaaggaggtcc

SEQ ID NO: 410510 - DNA, 25 bp, Mus musculus
caagtgtcactgagggagcagacca

SEQ ID NO: 410511 - DNA, 25 bp, Mus musculus
caagtgtcagtctgtggtcgtcaaa

SEQ ID NO: 410512 - DNA, 25 bp, Mus musculus
caagtgtcgaaggtgcatggttcac

SEQ ID NO: 410513 - DNA, 25 bp, Mus musculus
caagtgtctgatcagcccgatggtc

SEQ ID NO: 410514 - DNA, 25 bp, Mus musculus
caagtgtctgttgagagccacggat

SEQ ID NO: 410515 - DNA, 25 bp, Mus musculus
caagtgtgaaaacggagacgcctgc

SEQ ID NO: 410516 - DNA, 25 bp, Mus musculus
caagtgtgaagcgctgcagggcttc

SEQ ID NO: 410517 - DNA, 25 bp, Mus musculus
caagtgtgacatggacgacaagaga

SEQ ID NO: 410518 - DNA, 25 bp, Mus musculus
caagtgtgacttgcaccatgtgtgt

SEQ ID NO: 410519 - DNA, 25 bp, Mus musculus
caagtgtgaggcgataaacccggtc

SEQ ID NO: 410520 - DNA, 25 bp, Mus musculus
caagtgtgataagatgcctggctac

SEQ ID NO: 410521 - DNA, 25 bp, Mus musculus
caagtgtgcatgtcactgagaggcc

SEQ ID NO: 410522 - DNA, 25 bp, Mus musculus
caagtgtgggacatgcctgggcttc

SEQ ID NO: 410523 - DNA, 25 bp, Mus musculus
caagtgtgtccatgatataacagcc

SEQ ID NO: 410524 - DNA, 25 bp, Mus musculus
caagtgtgtgccatcattgagcgag

SEQ ID NO: 410525 - DNA, 25 bp, Mus musculus
caagtgttatgatgggcagcaaggc

SEQ ID NO: 410526 - DNA, 25 bp, Mus musculus
caagtgttcaatgactgccccagac

SEQ ID NO: 410527 - DNA, 25 bp, Mus musculus
caagtgttcccagatgctctcagga

SEQ ID NO: 410528 - DNA, 25 bp, Mus musculus
caagtgttctgagctgcccatcttc

SEQ ID NO: 410529 - DNA, 25 bp, Mus musculus
caagtgttctggagccacaatggga

SEQ ID NO: 410530 - DNA, 25 bp, Mus musculus
caagtgttcttagttatcagtttag

SEQ ID NO: 410531 - DNA, 25 bp, Mus musculus
caagtgttgaagaagaatcatttcc

SEQ ID NO: 410532 - DNA, 25 bp, Mus musculus
caagtgttgacgcttcttcccggga

SEQ ID NO: 410533 - DNA, 25 bp, Mus musculus
caagtgtttcaaagagattgggtca

SEQ ID NO: 410534 - DNA, 25 bp, Mus musculus
caagtgtttcggtgccatgtgcagc

SEQ ID NO: 410535 - DNA, 25 bp, Mus musculus
caagtgtttgctcaccatggccggc

SEQ ID NO: 410536 - DNA, 25 bp, Mus musculus
caagttaaatgctgaatatcacgtc

SEQ ID NO: 410537 - DNA, 25 bp, Mus musculus
caagttaactctgacctggaggtgg

SEQ ID NO: 410538 - DNA, 25 bp, Mus musculus
caagttaaggtccaaagaggcagta

SEQ ID NO: 410539 - DNA, 25 bp, Mus musculus
caagttacaaatctggaggcaaagc

SEQ ID NO: 410540 - DNA, 25 bp, Mus musculus
caagttaccagctgacatgcgccag

SEQ ID NO: 410541 - DNA, 25 bp, Mus musculus
caagttactccaagatgtgcgccaa

SEQ ID NO: 410542 - DNA, 25 bp, Mus musculus
caagttattattatgcaaccacaag

SEQ ID NO: 410543 - DNA, 25 bp, Mus musculus
caagttattgcaccgctgacagagg

SEQ ID NO: 410544 - DNA, 25 bp, Mus musculus
caagttcaacgtccctgaggaccag

SEQ ID NO: 410545 - DNA, 25 bp, Mus musculus
caagttcaagcagaggcagactcga

SEQ ID NO: 410546 - DNA, 25 bp, Mus musculus
caagttcaccaagatactccgggag

SEQ ID NO: 410547 - DNA, 25 bp, Mus musculus
caagttcagggactaagtgcctcca

SEQ ID NO: 410548 - DNA, 25 bp, Mus musculus
caagttcagggtgagcggttccatc

SEQ ID NO: 410549 - DNA, 25 bp, Mus musculus
caagttcagtgtgcatctgcctggg

SEQ ID NO: 410550 - DNA, 25 bp, Mus musculus
caagttcatcgccatgaggaggtcc

SEQ ID NO: 410551 - DNA, 25 bp, Mus musculus
caagttcatttgtacacccttcaaa

SEQ ID NO: 410552 - DNA, 25 bp, Mus musculus
caagttccaccctacaaggctgtgt

SEQ ID NO: 410553 - DNA, 25 bp, Mus musculus
caagttccagcatggcgtcatcgtg

SEQ ID NO: 410554 - DNA, 25 bp, Mus musculus
caagttcccgtcagcttcgagaaaa

SEQ ID NO: 410555 - DNA, 25 bp, Mus musculus
caagttccctagctagaagacctgg

SEQ ID NO: 410556 - DNA, 25 bp, Mus musculus
caagttccgagagatgctgaccaat

SEQ ID NO: 410557 - DNA, 25 bp, Mus musculus
caagttccggcaggagcatgggatc

SEQ ID NO: 410558 - DNA, 25 bp, Mus musculus
caagttcgaatcctccgtgggctgg

SEQ ID NO: 410559 - DNA, 25 bp, Mus musculus
caagttcgccttgcagaggtctgga

SEQ ID NO: 410560 - DNA, 25 bp, Mus musculus
caagttctacttgctggtggtggtc

SEQ ID NO: 410561 - DNA, 25 bp, Mus musculus
caagttctcacctctttgtctgccg

SEQ ID NO: 410562 - DNA, 25 bp, Mus musculus
caagttctcatgattctgtccaggg

SEQ ID NO: 410563 - DNA, 25 bp, Mus musculus
caagttctcgctggaagaggcgtac

SEQ ID NO: 410564 - DNA, 25 bp, Mus musculus
caagttctctttccgagtgggtcag

SEQ ID NO: 410565 - DNA, 25 bp, Mus musculus
caagttctgaaaattaccattgccc

SEQ ID NO: 410566 - DNA, 25 bp, Mus musculus
caagttctggaaggtacggaagcct

SEQ ID NO: 410567 - DNA, 25 bp, Mus musculus
caagttctgtgacgagtgtgtcccc

SEQ ID NO: 410568 - DNA, 25 bp, Mus musculus
caagttctgtgttgagccactgggc

SEQ ID NO: 410569 - DNA, 25 bp, Mus musculus
caagttgacatgattcagggaaagg

SEQ ID NO: 410570 - DNA, 25 bp, Mus musculus
caagttgcagacttagggagcagcc

SEQ ID NO: 410571 - DNA, 25 bp, Mus musculus
caagttgctaaagtgcaggcacagc

SEQ ID NO: 410572 - DNA, 25 bp, Mus musculus
caagttggacctgggcttcaaggac

SEQ ID NO: 410573 - DNA, 25 bp, Mus musculus
caagttggagcttcttgacaggaaa

SEQ ID NO: 410574 - DNA, 25 bp, Mus musculus
caagttggatgaagtaactcgacgc

SEQ ID NO: 410575 - DNA, 25 bp, Mus musculus
caagttggatgtgctcgtgctggcc

SEQ ID NO: 410576 - DNA, 25 bp, Mus musculus
caagttggccctcatgtcagtcata

SEQ ID NO: 410577 - DNA, 25 bp, Mus musculus
caagttgggtgtcctgccagtcaga

SEQ ID NO: 410578 - DNA, 25 bp, Mus musculus
caagttggttttcaatccagaaggg

SEQ ID NO: 410579 - DNA, 25 bp, Mus musculus
caagttgtcaggaaacgaagccatc

SEQ ID NO: 410580 - DNA, 25 bp, Mus musculus
caagttgtctgatatccctgaaggg

SEQ ID NO: 410581 - DNA, 25 bp, Mus musculus
caagttgtggctgaccgcatggaca

SEQ ID NO: 410582 - DNA, 25 bp, Mus musculus
caagttgtgggtagacacgtgctca

SEQ ID NO: 410583 - DNA, 25 bp, Mus musculus
caagttgtgggtcgtcatttctccg

SEQ ID NO: 410584 - DNA, 25 bp, Mus musculus
caagtttaaaaagagcgcgctggcg

SEQ ID NO: 410585 - DNA, 25 bp, Mus musculus
caagtttaaaatggagctggaagcc

SEQ ID NO: 410586 - DNA, 25 bp, Mus musculus
caagtttaaccagtgtgggacctgc

SEQ ID NO: 410587 - DNA, 25 bp, Mus musculus
caagtttactgcaagacagctgcgc

SEQ ID NO: 410588 - DNA, 25 bp, Mus musculus
caagtttatcggttctccaccaggc

SEQ ID NO: 410589 - DNA, 25 bp, Mus musculus
caagtttccaatgaggctgtgaccg

SEQ ID NO: 410590 - DNA, 25 bp, Mus musculus
caagtttcgcaagttgagatccccg

SEQ ID NO: 410591 - DNA, 25 bp, Mus musculus
caagtttctcaatacggcgacctgg

SEQ ID NO: 410592 - DNA, 25 bp, Mus musculus
caagtttctcggcattcgggagcag

SEQ ID NO: 410593 - DNA, 25 bp, Mus musculus
caagtttgaggccaaaatcgggcaa

SEQ ID NO: 410594 - DNA, 25 bp, Mus musculus
caagtttgcaagctgacctggctga

SEQ ID NO: 410595 - DNA, 25 bp, Mus musculus
caagtttgcagatgttcagagggaa

SEQ ID NO: 410596 - DNA, 25 bp, Mus musculus
caagtttgctgtccagagacgccgt

SEQ ID NO: 410597 - DNA, 25 bp, Mus musculus
caagtttgctgtggagagtctcgtc

SEQ ID NO: 410598 - DNA, 25 bp, Mus musculus
caagtttggcctctttactccagga

SEQ ID NO: 410599 - DNA, 25 bp, Mus musculus
caagtttggctttcacacagtgaca

SEQ ID NO: 410600 - DNA, 25 bp, Mus musculus
caagtttgggaaggacaggcaccag

SEQ ID NO: 410601 - DNA, 25 bp, Mus musculus
caagtttgggatccccaatgtagcc

SEQ ID NO: 410602 - DNA, 25 bp, Mus musculus
caagtttgtattcccagcacatcgg

SEQ ID NO: 410603 - DNA, 25 bp, Mus musculus
caagttttactcctcgcgggacgca

SEQ ID NO: 410604 - DNA, 25 bp, Mus musculus
caagttttgagggaggttatccaca

SEQ ID NO: 410605 - DNA, 25 bp, Mus musculus
caagttttgattctcagcccagggc

SEQ ID NO: 410606 - DNA, 25 bp, Mus musculus
caagtttttcttcccttagatgatg

SEQ ID NO: 410607 - DNA, 25 bp, Mus musculus
caagttttttcgtcaatgggctgac

SEQ ID NO: 410608 - DNA, 25 bp, Mus musculus
caataaaacccaagcaaatggtgta

SEQ ID NO: 410609 - DNA, 25 bp, Mus musculus
caataaaacctgactttggcccgcg

SEQ ID NO: 410610 - DNA, 25 bp, Mus musculus
caataaaagggctcagtacaggcac

SEQ ID NO: 410611 - DNA, 25 bp, Mus musculus
caataaacacttgcgactgttgtgc

SEQ ID NO: 410612 - DNA, 25 bp, Mus musculus
caataaacggtgatgcccattcgga

SEQ ID NO: 410613 - DNA, 25 bp, Mus musculus
caataaagcatttagcagtacaatc

SEQ ID NO: 410614 - DNA, 25 bp, Mus musculus
caataaaggctgtaccaatcggaca

SEQ ID NO: 410615 - DNA, 25 bp, Mus musculus
caataaatccgcagtggtgacctac

SEQ ID NO: 410616 - DNA, 25 bp, Mus musculus
caataaatcgtacagcagtgacagc

SEQ ID NO: 410617 - DNA, 25 bp, Mus musculus
caataaatgaaaaggtgccgcagcg

SEQ ID NO: 410618 - DNA, 25 bp, Mus musculus
caataacaagtagcccaagtgggca

SEQ ID NO: 410619 - DNA, 25 bp, Mus musculus
caataacagggtgggccttgcccct

SEQ ID NO: 410620 - DNA, 25 bp, Mus musculus
caataacatctgcaagagctggccc

SEQ ID NO: 410621 - DNA, 25 bp, Mus musculus
caataacccatttccctggtgctgg

SEQ ID NO: 410622 - DNA, 25 bp, Mus musculus
caataaccgggtgcaggaaggctac

SEQ ID NO: 410623 - DNA, 25 bp, Mus musculus
caataacctgttttgatgaagccca

SEQ ID NO: 410624 - DNA, 25 bp, Mus musculus
caataactacctgggcctgagcagc

SEQ ID NO: 410625 - DNA, 25 bp, Mus musculus
caataactgtctggtctgtgggcgg

SEQ ID NO: 410626 - DNA, 25 bp, Mus musculus
caataactgtgaaaatgggctgtgc

SEQ ID NO: 410627 - DNA, 25 bp, Mus musculus
caataacttagtgggagctcctacc

SEQ ID NO: 410628 - DNA, 25 bp, Mus musculus
caataagagtgagcccagctgggaa

SEQ ID NO: 410629 - DNA, 25 bp, Mus musculus
caataagattgtataatggtcccca

SEQ ID NO: 410630 - DNA, 25 bp, Mus musculus
caataagccctgctgaaggctggcc

SEQ ID NO: 410631 - DNA, 25 bp, Mus musculus
caataagcgggcttggaacgccagc

SEQ ID NO: 410632 - DNA, 25 bp, Mus musculus
caataagcttgatgcccacgtggcc

SEQ ID NO: 410633 - DNA, 25 bp, Mus musculus
caataaggcggcaatggagctgtgt

SEQ ID NO: 410634 - DNA, 25 bp, Mus musculus
caataataaagtctccccttgcaaa

SEQ ID NO: 410635 - DNA, 25 bp, Mus musculus
caataataaggcactggtggcacct

SEQ ID NO: 410636 - DNA, 25 bp, Mus musculus
caataatattgcacccaggctctcc

SEQ ID NO: 410637 - DNA, 25 bp, Mus musculus
caataatcttgtgggttctcgctca

SEQ ID NO: 410638 - DNA, 25 bp, Mus musculus
caataatgtcatcctgcgcagggag

SEQ ID NO: 410639 - DNA, 25 bp, Mus musculus
caataatttaaagacagcatcaaga

SEQ ID NO: 410640 - DNA, 25 bp, Mus musculus
caataatttcgtgcactcctgaagg

SEQ ID NO: 410641 - DNA, 25 bp, Mus musculus
caatacaaggaacatggcacccagc

SEQ ID NO: 410642 - DNA, 25 bp, Mus musculus
caatacagagacaatatggtgggtc

SEQ ID NO: 410643 - DNA, 25 bp, Mus musculus
caatacagatatgtcaaagagaagc

SEQ ID NO: 410644 - DNA, 25 bp, Mus musculus
caatacaggagagagtgcgctgccc

SEQ ID NO: 410645 - DNA, 25 bp, Mus musculus
caatacagtcatattaaccagtaca

SEQ ID NO: 410646 - DNA, 25 bp, Mus musculus
caatacagtcttgccatctgcttaa

SEQ ID NO: 410647 - DNA, 25 bp, Mus musculus
caatacatctctgagtgacgggacc

SEQ ID NO: 410648 - DNA, 25 bp, Mus musculus
caatacatctgtggcggacagggcg

SEQ ID NO: 410649 - DNA, 25 bp, Mus musculus
caataccatccttaccgacgctgtg

SEQ ID NO: 410650 - DNA, 25 bp, Mus musculus
caataccatggcgaagtagcttcct

SEQ ID NO: 410651 - DNA, 25 bp, Mus musculus
caataccgcatctgtggatcccgac

SEQ ID NO: 410652 - DNA, 25 bp, Mus musculus
caataccgtagaggagcccctggat

SEQ ID NO: 410653 - DNA, 25 bp, Mus musculus
caataccgtcttcatttcgctgcca

SEQ ID NO: 410654 - DNA, 25 bp, Mus musculus
caatacggaggcaatcatggcttta

SEQ ID NO: 410655 - DNA, 25 bp, Mus musculus
caatacggagttgtggaacccagac

SEQ ID NO: 410656 - DNA, 25 bp, Mus musculus
caatactacatacaggtcagggtcc

SEQ ID NO: 410657 - DNA, 25 bp, Mus musculus
caatactggctaacaaggttccggg

SEQ ID NO: 410658 - DNA, 25 bp, Mus musculus
caatacttagctttcagcgaggaga

SEQ ID NO: 410659 - DNA, 25 bp, Mus musculus
caatagaactgtgtgccatcgacga

SEQ ID NO: 410660 - DNA, 25 bp, Mus musculus
caatagagtgaagcagaggagatcc

SEQ ID NO: 410661 - DNA, 25 bp, Mus musculus
caatagatacactcctcagggcagc

SEQ ID NO: 410662 - DNA, 25 bp, Mus musculus
caatagatccttgtatggaccagga

SEQ ID NO: 410663 - DNA, 25 bp, Mus musculus
caatagatctccattaaagctggcg

SEQ ID NO: 410664 - DNA, 25 bp, Mus musculus
caatagcactctgagcgtggcggga

SEQ ID NO: 410665 - DNA, 25 bp, Mus musculus
caatagccatactcagcctgagcgg

SEQ ID NO: 410666 - DNA, 25 bp, Mus musculus
caatagcgatactgggagaccctgc

SEQ ID NO: 410667 - DNA, 25 bp, Mus musculus
caatagcggcatcaaatctggtggc

SEQ ID NO: 410668 - DNA, 25 bp, Mus musculus
caatagcgttcaacttcgaggcggg

SEQ ID NO: 410669 - DNA, 25 bp, Mus musculus
caataggacattgtgagccgtagat

SEQ ID NO: 410670 - DNA, 25 bp, Mus musculus
caataggacccggagctgtagggct

SEQ ID NO: 410671 - DNA, 25 bp, Mus musculus
caataggcgttttcctgtgtggccc

SEQ ID NO: 410672 - DNA, 25 bp, Mus musculus
caatagggcttctggccacaagaac

SEQ ID NO: 410673 - DNA, 25 bp, Mus musculus
caatagggcttttgcagacagatca

SEQ ID NO: 410674 - DNA, 25 bp, Mus musculus
caatagtacatacctgacagggcaa

SEQ ID NO: 410675 - DNA, 25 bp, Mus musculus
caatagtaccattatagtacctcca

SEQ ID NO: 410676 - DNA, 25 bp, Mus musculus
caatagtcggaaagagtatgacaca

SEQ ID NO: 410677 - DNA, 25 bp, Mus musculus
caatagtctgttcctgagggagagc

SEQ ID NO: 410678 - DNA, 25 bp, Mus musculus
caatagtgacaacgtggtcctgcga

SEQ ID NO: 410679 - DNA, 25 bp, Mus musculus
caatagtgaccctgtggcagtggcc

SEQ ID NO: 410680 - DNA, 25 bp, Mus musculus
caatagtgtagagaccaggacaccc

SEQ ID NO: 410681 - DNA, 25 bp, Mus musculus
caatagtgtctcagtcgcatgtcaa

SEQ ID NO: 410682 - DNA, 25 bp, Mus musculus
caatagttgtacgaatagcaggctc

SEQ ID NO: 410683 - DNA, 25 bp, Mus musculus
caatagttttcaggtgttgcccaca

SEQ ID NO: 410684 - DNA, 25 bp, Mus musculus
caatataaagccaatcttgaagcca

SEQ ID NO: 410685 - DNA, 25 bp, Mus musculus
caatatacacagcatacatacccct

SEQ ID NO: 410686 - DNA, 25 bp, Mus musculus
caatataccagcttttgccgcagcg

SEQ ID NO: 410687 - DNA, 25 bp, Mus musculus
caatatatgctaattaggctggcct

SEQ ID NO: 410688 - DNA, 25 bp, Mus musculus
caatatcagctttgcagaaggaaac

SEQ ID NO: 410689 - DNA, 25 bp, Mus musculus
caatatcagtgagttcaagtggccc

SEQ ID NO: 410690 - DNA, 25 bp, Mus musculus
caatatcatctaccggaggtggacc

SEQ ID NO: 410691 - DNA, 25 bp, Mus musculus
caatatctgcaacgtggtcctgatg

SEQ ID NO: 410692 - DNA, 25 bp, Mus musculus
caatatctgcaagacccataatggc

SEQ ID NO: 410693 - DNA, 25 bp, Mus musculus
caatatctggatgtctgggagacca

SEQ ID NO: 410694 - DNA, 25 bp, Mus musculus
caatatctgggatcgggttctcagc

SEQ ID NO: 410695 - DNA, 25 bp, Mus musculus
caatatctgtggagtcggcgtagca

SEQ ID NO: 410696 - DNA, 25 bp, Mus musculus
caatatgaagttgttccaggaagag

SEQ ID NO: 410697 - DNA, 25 bp, Mus musculus
caatatgagtcctggcgctgtgtca

SEQ ID NO: 410698 - DNA, 25 bp, Mus musculus
caatatgcatggtaatagagttatc

SEQ ID NO: 410699 - DNA, 25 bp, Mus musculus
caatatgctagacctctgggaagac

SEQ ID NO: 410700 - DNA, 25 bp, Mus musculus
caatatgctgcgtgcctgctgaaaa

SEQ ID NO: 410701 - DNA, 25 bp, Mus musculus
caatatggacagagatgcattcagt

SEQ ID NO: 410702 - DNA, 25 bp, Mus musculus
caatatgggtacaacgtagctgccg

SEQ ID NO: 410703 - DNA, 25 bp, Mus musculus
caatatggttgttttgctcctcggc

SEQ ID NO: 410704 - DNA, 25 bp, Mus musculus
caatatgtgtactctgggctgtgtc

SEQ ID NO: 410705 - DNA, 25 bp, Mus musculus
caatatgtgttcagtccggacgcgg

SEQ ID NO: 410706 - DNA, 25 bp, Mus musculus
caatatgttcacttatttaaagcat

SEQ ID NO: 410707 - DNA, 25 bp, Mus musculus
caatattaagctgccgtaaggacca

SEQ ID NO: 410708 - DNA, 25 bp, Mus musculus
caatattacctcaacgagcagggcg

SEQ ID NO: 410709 - DNA, 25 bp, Mus musculus
caatattattaccaagggagccaga

SEQ ID NO: 410710 - DNA, 25 bp, Mus musculus
caatattgtcctcagcgcgggaatc

SEQ ID NO: 410711 - DNA, 25 bp, Mus musculus
caatatttgcacaatttcaacacag

SEQ ID NO: 410712 - DNA, 25 bp, Mus musculus
caatcaagagacgaggttgcaaagc

SEQ ID NO: 410713 - DNA, 25 bp, Mus musculus
caatcaagaggatgctccacgggca

SEQ ID NO: 410714 - DNA, 25 bp, Mus musculus
caatcaagatcaagctagagcagga

SEQ ID NO: 410715 - DNA, 25 bp, Mus musculus
caatcaagatgtcaaacccaggtca

SEQ ID NO: 410716 - DNA, 25 bp, Mus musculus
caatcaagccagtaccgagtgtggt

SEQ ID NO: 410717 - DNA, 25 bp, Mus musculus
caatcaaggccgaagtcccagcctt

SEQ ID NO: 410718 - DNA, 25 bp, Mus musculus
caatcaaggctgtgtcccaagaagg

SEQ ID NO: 410719 - DNA, 25 bp, Mus musculus
caatcaccagtttgagagtggcctc

SEQ ID NO: 410720 - DNA, 25 bp, Mus musculus
caatcaccgggtggcttcagagcct

SEQ ID NO: 410721 - DNA, 25 bp, Mus musculus
caatcacgaagaggaggtggccgac

SEQ ID NO: 410722 - DNA, 25 bp, Mus musculus
caatcacgagaagggatacgtccaa

SEQ ID NO: 410723 - DNA, 25 bp, Mus musculus
caatcactgtgtgtcgtcaccttaa

SEQ ID NO: 410724 - DNA, 25 bp, Mus musculus
caatcagaagctcagggagaagtcc

SEQ ID NO: 410725 - DNA, 25 bp, Mus musculus
caatcagattgtcatggtgagatca

SEQ ID NO: 410726 - DNA, 25 bp, Mus musculus
caatcagcctgttgtaagtgcccgg

SEQ ID NO: 410727 - DNA, 25 bp, Mus musculus
caatcagcgtgggtgaggtcatcac

SEQ ID NO: 410728 - DNA, 25 bp, Mus musculus
caatcagggagaagtacaaggcttc

SEQ ID NO: 410729 - DNA, 25 bp, Mus musculus
caatcagggttccaggatccaggct

SEQ ID NO: 410730 - DNA, 25 bp, Mus musculus
caatcaggtgtcctgtaacagtccc

SEQ ID NO: 410731 - DNA, 25 bp, Mus musculus
caatcaggttgtatactggagtcac

SEQ ID NO: 410732 - DNA, 25 bp, Mus musculus
caatcagtactgcaaagacacccgg

SEQ ID NO: 410733 - DNA, 25 bp, Mus musculus
caatcagtgacatgcaagggtacag

SEQ ID NO: 410734 - DNA, 25 bp, Mus musculus
caatcagtgagagtctaaaagcccc

SEQ ID NO: 410735 - DNA, 25 bp, Mus musculus
caatcagtgcatccggtgacagcct

SEQ ID NO: 410736 - DNA, 25 bp, Mus musculus
caatcagttctgtggtggtggatcc

SEQ ID NO: 410737 - DNA, 25 bp, Mus musculus
caatcagttggagtcagcggtggca

SEQ ID NO: 410738 - DNA, 25 bp, Mus musculus
caatcataggaagcaaggcggaggc

SEQ ID NO: 410739 - DNA, 25 bp, Mus musculus
caatcatcaagtactcagagggcct

SEQ ID NO: 410740 - DNA, 25 bp, Mus musculus
caatcatcatcaagtaggtagaagt

SEQ ID NO: 410741 - DNA, 25 bp, Mus musculus
caatcatccacgaagagaagccgct

SEQ ID NO: 410742 - DNA, 25 bp, Mus musculus
caatcatccgtgtagagacgcctga

SEQ ID NO: 410743 - DNA, 25 bp, Mus musculus
caatcatgaagaactaacccgggac

SEQ ID NO: 410744 - DNA, 25 bp, Mus musculus
caatcatggtctccctcaaggaaga

SEQ ID NO: 410745 - DNA, 25 bp, Mus musculus
caatcattacttctgtggctacgta

SEQ ID NO: 410746 - DNA, 25 bp, Mus musculus
caatcattggtaaggagaagggcta

SEQ ID NO: 410747 - DNA, 25 bp, Mus musculus
caatcatttgttccctcacggtggg

SEQ ID NO: 410748 - DNA, 25 bp, Mus musculus
caatccaaggttccctgagccagag

SEQ ID NO: 410749 - DNA, 25 bp, Mus musculus
caatccaccatgttatcagaggcta

SEQ ID NO: 410750 - DNA, 25 bp, Mus musculus
caatccaggagtctctgggacagtc

SEQ ID NO: 410751 - DNA, 25 bp, Mus musculus
caatccaggtggaaggctctgccgt

SEQ ID NO: 410752 - DNA, 25 bp, Mus musculus
caatccagtaagttgtttgaggaaa

SEQ ID NO: 410753 - DNA, 25 bp, Mus musculus
caatccccttgctaggaggcagtaa

SEQ ID NO: 410754 - DNA, 25 bp, Mus musculus
caatcccgagtttgttcccttgagg

SEQ ID NO: 410755 - DNA, 25 bp, Mus musculus
caatcccgcgtctggcaaacaaagt

SEQ ID NO: 410756 - DNA, 25 bp, Mus musculus
caatccggatcaaacgtggctgagc

SEQ ID NO: 410757 - DNA, 25 bp, Mus musculus
caatccggatggtgtgtgcacagca

SEQ ID NO: 410758 - DNA, 25 bp, Mus musculus
caatccgggagaaatagaatatact

SEQ ID NO: 410759 - DNA, 25 bp, Mus musculus
caatccggtggctctgtgcaactac

SEQ ID NO: 410760 - DNA, 25 bp, Mus musculus
caatccgtttctggcagctctctga

SEQ ID NO: 410761 - DNA, 25 bp, Mus musculus
caatcctaacttggatgccgtggga

SEQ ID NO: 410762 - DNA, 25 bp, Mus musculus
caatcctaggaacttccctggaagt

SEQ ID NO: 410763 - DNA, 25 bp, Mus musculus
caatcctcggagaaaatgcatcatc

SEQ ID NO: 410764 - DNA, 25 bp, Mus musculus
caatcctctggcacaaggactggga

SEQ ID NO: 410765 - DNA, 25 bp, Mus musculus
caatcctggttggtgctatgttcat

SEQ ID NO: 410766 - DNA, 25 bp, Mus musculus
caatcctgtatccagcgggagatca

SEQ ID NO: 410767 - DNA, 25 bp, Mus musculus
caatcgacgtggtttacacctgggt

SEQ ID NO: 410768 - DNA, 25 bp, Mus musculus
caatcgagaaggaagcggcagactc

SEQ ID NO: 410769 - DNA, 25 bp, Mus musculus
caatcgagagcgcttcctgaagggc

SEQ ID NO: 410770 - DNA, 25 bp, Mus musculus
caatcgatggtgtgaaagccgtcct

SEQ ID NO: 410771 - DNA, 25 bp, Mus musculus
caatcgcatggtagaggccgtggac

SEQ ID NO: 410772 - DNA, 25 bp, Mus musculus
caatcgcccttgagcatgactcgaa

SEQ ID NO: 410773 - DNA, 25 bp, Mus musculus
caatcgctatgggaagaaatacaac

SEQ ID NO: 410774 - DNA, 25 bp, Mus musculus
caatcggacaccacctgtagggagg

SEQ ID NO: 410775 - DNA, 25 bp, Mus musculus
caatcggatatctcatggcctacaa

SEQ ID NO: 410776 - DNA, 25 bp, Mus musculus
caatcggtgaaagccaaagtagcat

SEQ ID NO: 410777 - DNA, 25 bp, Mus musculus
caatcgtcatgtccatgctggagaa

SEQ ID NO: 410778 - DNA, 25 bp, Mus musculus
caatcgtggctagggatgcagactc

SEQ ID NO: 410779 - DNA, 25 bp, Mus musculus
caatctacaggtgaccctggcagta

SEQ ID NO: 410780 - DNA, 25 bp, Mus musculus
caatctacgagaccatgcgggacta

SEQ ID NO: 410781 - DNA, 25 bp, Mus musculus
caatctactcctttgacggtcggga

SEQ ID NO: 410782 - DNA, 25 bp, Mus musculus
caatctatgaacgtgccggtcgagt

SEQ ID NO: 410783 - DNA, 25 bp, Mus musculus
caatctatgccaaaccactgaggtc

SEQ ID NO: 410784 - DNA, 25 bp, Mus musculus
caatctcactgagcggcaggtcaaa

SEQ ID NO: 410785 - DNA, 25 bp, Mus musculus
caatctcatattgggcttgccagca

SEQ ID NO: 410786 - DNA, 25 bp, Mus musculus
caatctcatgagaacgatgggttac

SEQ ID NO: 410787 - DNA, 25 bp, Mus musculus
caatctcccaggtgtgtcacatgtg

SEQ ID NO: 410788 - DNA, 25 bp, Mus musculus
caatctccggtacagctatttcact

SEQ ID NO: 410789 - DNA, 25 bp, Mus musculus
caatctctctcggtgcagtgggata

SEQ ID NO: 410790 - DNA, 25 bp, Mus musculus
caatctctgtggtaggaaggccctg

SEQ ID NO: 410791 - DNA, 25 bp, Mus musculus
caatctcttcccctatgttgtagaa

SEQ ID NO: 410792 - DNA, 25 bp, Mus musculus
caatctgaacaacatgctggacaag

SEQ ID NO: 410793 - DNA, 25 bp, Mus musculus
caatctgactgctgtgggctgctca

SEQ ID NO: 410794 - DNA, 25 bp, Mus musculus
caatctgactttgattttaaggcca

SEQ ID NO: 410795 - DNA, 25 bp, Mus musculus
caatctgaggaggttgcacaatggc

SEQ ID NO: 410796 - DNA, 25 bp, Mus musculus
caatctgaggattggcacatgctgc

SEQ ID NO: 410797 - DNA, 25 bp, Mus musculus
caatctgagtgctgatgaggtaacc

SEQ ID NO: 410798 - DNA, 25 bp, Mus musculus
caatctgcgatgacggatggaccga

SEQ ID NO: 410799 - DNA, 25 bp, Mus musculus
caatctggaaagaagctgcgcgcct

SEQ ID NO: 410800 - DNA, 25 bp, Mus musculus
caatctggccaaggatactgagttc

SEQ ID NO: 410801 - DNA, 25 bp, Mus musculus
caatctggctcaggctcaaaggcta

SEQ ID NO: 410802 - DNA, 25 bp, Mus musculus
caatctgggcttttcactccgcgag

SEQ ID NO: 410803 - DNA, 25 bp, Mus musculus
caatctgggtaaaaagcatggacaa

SEQ ID NO: 410804 - DNA, 25 bp, Mus musculus
caatctggtatctttgcctggagaa

SEQ ID NO: 410805 - DNA, 25 bp, Mus musculus
caatctgtattcacgccctgttgga

SEQ ID NO: 410806 - DNA, 25 bp, Mus musculus
caatctgtcgcgatgccgaaggaaa

SEQ ID NO: 410807 - DNA, 25 bp, Mus musculus
caatctgttccgctggtgactgcca

SEQ ID NO: 410808 - DNA, 25 bp, Mus musculus
caatctgttcgtggggctgctcatg

SEQ ID NO: 410809 - DNA, 25 bp, Mus musculus
caatcttcaagcactacaccgaggg

SEQ ID NO: 410810 - DNA, 25 bp, Mus musculus
caatcttcccaatgaagttcctggt

SEQ ID NO: 410811 - DNA, 25 bp, Mus musculus
caatctttgctgtgagcccctgaca

SEQ ID NO: 410812 - DNA, 25 bp, Mus musculus
caatctttgttgtaggtcctgggaa

SEQ ID NO: 410813 - DNA, 25 bp, Mus musculus
caatgaaaacatagtggccactgct

SEQ ID NO: 410814 - DNA, 25 bp, Mus musculus
caatgaaaaccgtgctactgtggct

SEQ ID NO: 410815 - DNA, 25 bp, Mus musculus
caatgaaactttggcacctggcatc

SEQ ID NO: 410816 - DNA, 25 bp, Mus musculus
caatgaaagggaacttagagttggc

SEQ ID NO: 410817 - DNA, 25 bp, Mus musculus
caatgaaagtgaagttgcagccacc

SEQ ID NO: 410818 - DNA, 25 bp, Mus musculus
caatgaaatcttgcctcaggaacag

SEQ ID NO: 410819 - DNA, 25 bp, Mus musculus
caatgaacaagtcaggaagaaggag

SEQ ID NO: 410820 - DNA, 25 bp, Mus musculus
caatgaacaagtggctgtgctgcgc

SEQ ID NO: 410821 - DNA, 25 bp, Mus musculus
caatgaacgcctatgtgactgtgac

SEQ ID NO: 410822 - DNA, 25 bp, Mus musculus
caatgaagaccctgatagatatccc

SEQ ID NO: 410823 - DNA, 25 bp, Mus musculus
caatgaagacgaggaagttccagca

SEQ ID NO: 410824 - DNA, 25 bp, Mus musculus
caatgaagacgggaagtgcacagcc

SEQ ID NO: 410825 - DNA, 25 bp, Mus musculus
caatgaagatgggttaggttacacc

SEQ ID NO: 410826 - DNA, 25 bp, Mus musculus
caatgaagatttaggagactcggca

SEQ ID NO: 410827 - DNA, 25 bp, Mus musculus
caatgaagctgtgggaccataggct

SEQ ID NO: 410828 - DNA, 25 bp, Mus musculus
caatgaagctgttgtatggccagag

SEQ ID NO: 410829 - DNA, 25 bp, Mus musculus
caatgaataactctgtgccccaaga

SEQ ID NO: 410830 - DNA, 25 bp, Mus musculus
caatgaatagctcctagagaagggc

SEQ ID NO: 410831 - DNA, 25 bp, Mus musculus
caatgaatatgtgcgcgatctgcct

SEQ ID NO: 410832 - DNA, 25 bp, Mus musculus
caatgaatctctcatcagccgggcc

SEQ ID NO: 410833 - DNA, 25 bp, Mus musculus
caatgaatctgtaccgtttgagacc

SEQ ID NO: 410834 - DNA, 25 bp, Mus musculus
caatgaatgctggaaggagcctccc

SEQ ID NO: 410835 - DNA, 25 bp, Mus musculus
caatgaatgttgcaagtgggccagc

SEQ ID NO: 410836 - DNA, 25 bp, Mus musculus
caatgaattccagtcctcaggtggc

SEQ ID NO: 410837 - DNA, 25 bp, Mus musculus
caatgacaacttgacagtgacgtgc

SEQ ID NO: 410838 - DNA, 25 bp, Mus musculus
caatgacaagtggtttggttcagca

SEQ ID NO: 410839 - DNA, 25 bp, Mus musculus
caatgacagaggagatgtctgccgg

SEQ ID NO: 410840 - DNA, 25 bp, Mus musculus
caatgacagtcctgctgcacgaagt

SEQ ID NO: 410841 - DNA, 25 bp, Mus musculus
caatgacatgagtccggagcaaacg

SEQ ID NO: 410842 - DNA, 25 bp, Mus musculus
caatgacatggaggacgagttctac

SEQ ID NO: 410843 - DNA, 25 bp, Mus musculus
caatgaccaatacaaagccggagga

SEQ ID NO: 410844 - DNA, 25 bp, Mus musculus
caatgaccagcagggattggccaca

SEQ ID NO: 410845 - DNA, 25 bp, Mus musculus
caatgaccataaggaggctgtaggc

SEQ ID NO: 410846 - DNA, 25 bp, Mus musculus
caatgaccggcagtatgactctcgt

SEQ ID NO: 410847 - DNA, 25 bp, Mus musculus
caatgaccgtggacagcagcatgag

SEQ ID NO: 410848 - DNA, 25 bp, Mus musculus
caatgacctttgtccaccctggata

SEQ ID NO: 410849 - DNA, 25 bp, Mus musculus
caatgacgaggtagcccgagagttc

SEQ ID NO: 410850 - DNA, 25 bp, Mus musculus
caatgactcaagaacccctggaaga

SEQ ID NO: 410851 - DNA, 25 bp, Mus musculus
caatgactcatttgcaagctggcct

SEQ ID NO: 410852 - DNA, 25 bp, Mus musculus
caatgactccctgttgggccgtgag

SEQ ID NO: 410853 - DNA, 25 bp, Mus musculus
caatgactggaagaggctgaacaca

SEQ ID NO: 410854 - DNA, 25 bp, Mus musculus
caatgactggcagagccttgtgatg

SEQ ID NO: 410855 - DNA, 25 bp, Mus musculus
caatgactgggtggtgacctgcagc

SEQ ID NO: 410856 - DNA, 25 bp, Mus musculus
caatgactgtggaggactgaaacgc

SEQ ID NO: 410857 - DNA, 25 bp, Mus musculus
caatgagaacgagaagggaaaggcc

SEQ ID NO: 410858 - DNA, 25 bp, Mus musculus
caatgagaagtagaaccttgagact

SEQ ID NO: 410859 - DNA, 25 bp, Mus musculus
caatgagaatcgagagaacgcgtcg

SEQ ID NO: 410860 - DNA, 25 bp, Mus musculus
caatgagaatgcacaaccctctgaa

SEQ ID NO: 410861 - DNA, 25 bp, Mus musculus
caatgagacctacgtggacacagca

SEQ ID NO: 410862 - DNA, 25 bp, Mus musculus
caatgagagtcctgccggtggtagt

SEQ ID NO: 410863 - DNA, 25 bp, Mus musculus
caatgagatacagagggacccaggt

SEQ ID NO: 410864 - DNA, 25 bp, Mus musculus
caatgagatcgtgcttctggaggcc

SEQ ID NO: 410865 - DNA, 25 bp, Mus musculus
caatgagatgtgtgagctggaccca

SEQ ID NO: 410866 - DNA, 25 bp, Mus musculus
caatgagcagccatgggagagtcct

SEQ ID NO: 410867 - DNA, 25 bp, Mus musculus
caatgagcatgaagtcggtgaggcc

SEQ ID NO: 410868 - DNA, 25 bp, Mus musculus
caatgagccattaaagtgcaggtcc

SEQ ID NO: 410869 - DNA, 25 bp, Mus musculus
caatgagcggcactatggtggcctc

SEQ ID NO: 410870 - DNA, 25 bp, Mus musculus
caatgagctcatggcctactggtac

SEQ ID NO: 410871 - DNA, 25 bp, Mus musculus
caatgagctgcgctgtcagtgcctg

SEQ ID NO: 410872 - DNA, 25 bp, Mus musculus
caatgagctgtgtgcggctgaatcc

SEQ ID NO: 410873 - DNA, 25 bp, Mus musculus
caatgagcttgaataccccaggact

SEQ ID NO: 410874 - DNA, 25 bp, Mus musculus
caatgaggacctggaacagcgccag

SEQ ID NO: 410875 - DNA, 25 bp, Mus musculus
caatgaggattctatcaacaggcaa

SEQ ID NO: 410876 - DNA, 25 bp, Mus musculus
caatgaggcagcgtggaactatacc

SEQ ID NO: 410877 - DNA, 25 bp, Mus musculus
caatgaggccggagtctgaagtgct

SEQ ID NO: 410878 - DNA, 25 bp, Mus musculus
caatgaggtcattggcgtgtgccaa

SEQ ID NO: 410879 - DNA, 25 bp, Mus musculus
caatgagtactttgcgctccgcgtg

SEQ ID NO: 410880 - DNA, 25 bp, Mus musculus
caatgagtggatggccatgtctgac

SEQ ID NO: 410881 - DNA, 25 bp, Mus musculus
caatgagtgggcacaggagacactc

SEQ ID NO: 410882 - DNA, 25 bp, Mus musculus
caatgatagtcccaaagaaaaagat

SEQ ID NO: 410883 - DNA, 25 bp, Mus musculus
caatgatccctttgaactttcccag

SEQ ID NO: 410884 - DNA, 25 bp, Mus musculus
caatgatctcatgcagtacccggtg

SEQ ID NO: 410885 - DNA, 25 bp, Mus musculus
caatgatgaagtaaaacgcggtgtc

SEQ ID NO: 410886 - DNA, 25 bp, Mus musculus
caatgatgaccttgcagatgctggg

SEQ ID NO: 410887 - DNA, 25 bp, Mus musculus
caatgatgcatttctttgtggaaaa

SEQ ID NO: 410888 - DNA, 25 bp, Mus musculus
caatgatggaggctactatgaccca

SEQ ID NO: 410889 - DNA, 25 bp, Mus musculus
caatgatggcattcgactgtctgga

SEQ ID NO: 410890 - DNA, 25 bp, Mus musculus
caatgatgtccaggtgttttccgga

SEQ ID NO: 410891 - DNA, 25 bp, Mus musculus
caatgatgtggctcgttagacccga

SEQ ID NO: 410892 - DNA, 25 bp, Mus musculus
caatgattcagaatgaagggtgcaa

SEQ ID NO: 410893 - DNA, 25 bp, Mus musculus
caatgattgcaacggacacagagct

SEQ ID NO: 410894 - DNA, 25 bp, Mus musculus
caatgattgtagaacctgtggctat

SEQ ID NO: 410895 - DNA, 25 bp, Mus musculus
caatgattgtgtcccatgaactggc

SEQ ID NO: 410896 - DNA, 25 bp, Mus musculus
caatgatttaaatgaccagccttac

SEQ ID NO: 410897 - DNA, 25 bp, Mus musculus
caatgcactggagttcggtcccaac

SEQ ID NO: 410898 - DNA, 25 bp, Mus musculus
caatgcagccatcctagacgagagc

SEQ ID NO: 410899 - DNA, 25 bp, Mus musculus
caatgcagcctggaaccttgcggag

SEQ ID NO: 410900 - DNA, 25 bp, Mus musculus
caatgcagcgtatgaaacaccagcc

SEQ ID NO: 410901 - DNA, 25 bp, Mus musculus
caatgcagtctatgagcccacagaa

SEQ ID NO: 410902 - DNA, 25 bp, Mus musculus
caatgcagttttggtgacgacaggc

SEQ ID NO: 410903 - DNA, 25 bp, Mus musculus
caatgcatgccaccactaggctgga

SEQ ID NO: 410904 - DNA, 25 bp, Mus musculus
caatgcattctatactggctgaggg

SEQ ID NO: 410905 - DNA, 25 bp, Mus musculus
caatgcattttggagagagcccagt

SEQ ID NO: 410906 - DNA, 25 bp, Mus musculus
caatgccacattgcgaggctggaag

SEQ ID NO: 410907 - DNA, 25 bp, Mus musculus
caatgccagaagaatttgagggaac

SEQ ID NO: 410908 - DNA, 25 bp, Mus musculus
caatgccatggcgttctgtgctaaa

SEQ ID NO: 410909 - DNA, 25 bp, Mus musculus
caatgccatgtttgacttcagcgag

SEQ ID NO: 410910 - DNA, 25 bp, Mus musculus
caatgcccgggatgtctctgtgaag

SEQ ID NO: 410911 - DNA, 25 bp, Mus musculus
caatgccctggatgatgatcgtgaa

SEQ ID NO: 410912 - DNA, 25 bp, Mus musculus
caatgccgtgagtgaagctgtggtc

SEQ ID NO: 410913 - DNA, 25 bp, Mus musculus
caatgccgtggtcttagtacccagt

SEQ ID NO: 410914 - DNA, 25 bp, Mus musculus
caatgcctagtggtgtccagaagtc

SEQ ID NO: 410915 - DNA, 25 bp, Mus musculus
caatgcctcagatggttgagtgcac

SEQ ID NO: 410916 - DNA, 25 bp, Mus musculus
caatgccttcgatgctgatgggaac

SEQ ID NO: 410917 - DNA, 25 bp, Mus musculus
caatgccttgaatgccgtgtaccaa

SEQ ID NO: 410918 - DNA, 25 bp, Mus musculus
caatgccttggctctgagtggcccc

SEQ ID NO: 410919 - DNA, 25 bp, Mus musculus
caatgccttttgctactgccgcaag

SEQ ID NO: 410920 - DNA, 25 bp, Mus musculus
caatgcgcataatgggagaagcttc

SEQ ID NO: 410921 - DNA, 25 bp, Mus musculus
caatgcgggtcgttaacaagtatac

SEQ ID NO: 410922 - DNA, 25 bp, Mus musculus
caatgcgtgatgctacaaaggacgt

SEQ ID NO: 410923 - DNA, 25 bp, Mus musculus
caatgcgtgcaacgatatgggcaag

SEQ ID NO: 410924 - DNA, 25 bp, Mus musculus
caatgctaacggttgagcgggccct

SEQ ID NO: 410925 - DNA, 25 bp, Mus musculus
caatgctcagcttcactctttcgta

SEQ ID NO: 410926 - DNA, 25 bp, Mus musculus
caatgctcagtgtggacatcgctgg

SEQ ID NO: 410927 - DNA, 25 bp, Mus musculus
caatgctccctggtagtaaggcacg

SEQ ID NO: 410928 - DNA, 25 bp, Mus musculus
caatgctcctcagagtggcctggct

SEQ ID NO: 410929 - DNA, 25 bp, Mus musculus
caatgctcctgggtcctaatggaca

SEQ ID NO: 410930 - DNA, 25 bp, Mus musculus
caatgctcgcaagatccatggtgag

SEQ ID NO: 410931 - DNA, 25 bp, Mus musculus
caatgctcttggctctccgtataga

SEQ ID NO: 410932 - DNA, 25 bp, Mus musculus
caatgctctttttatactcggagcc

SEQ ID NO: 410933 - DNA, 25 bp, Mus musculus
caatgctgcccaaggactgtgactc

SEQ ID NO: 410934 - DNA, 25 bp, Mus musculus
caatgctgctgtagtgagtgccaaa

SEQ ID NO: 410935 - DNA, 25 bp, Mus musculus
caatgctgtattgcctcctaagtgc

SEQ ID NO: 410936 - DNA, 25 bp, Mus musculus
caatgctgtccatccaaaagtggca

SEQ ID NO: 410937 - DNA, 25 bp, Mus musculus
caatgctgtctcactgggtgtatca

SEQ ID NO: 410938 - DNA, 25 bp, Mus musculus
caatgctgtgctgatcaacgagagg

SEQ ID NO: 410939 - DNA, 25 bp, Mus musculus
caatgctgtggacatggagctctac

SEQ ID NO: 410940 - DNA, 25 bp, Mus musculus
caatgcttattaagggcagtgcggg

SEQ ID NO: 410941 - DNA, 25 bp, Mus musculus
caatgcttcagttacagcgtcccca

SEQ ID NO: 410942 - DNA, 25 bp, Mus musculus
caatgcttcccctgtgaacctgaca

SEQ ID NO: 410943 - DNA, 25 bp, Mus musculus
caatgcttcgaggaccaggtttact

SEQ ID NO: 410944 - DNA, 25 bp, Mus musculus
caatgcttctaaggcctggaacgaa

SEQ ID NO: 410945 - DNA, 25 bp, Mus musculus
caatgcttctagttaacaggctgga

SEQ ID NO: 410946 - DNA, 25 bp, Mus musculus
caatgcttggacgaactcggtacca

SEQ ID NO: 410947 - DNA, 25 bp, Mus musculus
caatgctttggaaacagccacgggc

SEQ ID NO: 410948 - DNA, 25 bp, Mus musculus
caatggaaagttgcgccttcaaggc

SEQ ID NO: 410949 - DNA, 25 bp, Mus musculus
caatggaacagttggtggaaaaagc

SEQ ID NO: 410950 - DNA, 25 bp, Mus musculus
caatggaactcaggtgacactgctg

SEQ ID NO: 410951 - DNA, 25 bp, Mus musculus
caatggaatcgatgaatgctgggaa

SEQ ID NO: 410952 - DNA, 25 bp, Mus musculus
caatggaattcacgaggaaagtaac

SEQ ID NO: 410953 - DNA, 25 bp, Mus musculus
caatggacggcatcatctatgggac

SEQ ID NO: 410954 - DNA, 25 bp, Mus musculus
caatggacgtggatctcaaccaggc

SEQ ID NO: 410955 - DNA, 25 bp, Mus musculus
caatggacttgcagcctctcttgtc

SEQ ID NO: 410956 - DNA, 25 bp, Mus musculus
caatggacttgccagaattcgagga

SEQ ID NO: 410957 - DNA, 25 bp, Mus musculus
caatggagcaaagaaggcacacaca

SEQ ID NO: 410958 - DNA, 25 bp, Mus musculus
caatggagctgatatatatgccgga

SEQ ID NO: 410959 - DNA, 25 bp, Mus musculus
caatggaggtcactatgagcagcgt

SEQ ID NO: 410960 - DNA, 25 bp, Mus musculus
caatggagtcagatccagatgcctt

SEQ ID NO: 410961 - DNA, 25 bp, Mus musculus
caatggagtccgctttacctgcaag

SEQ ID NO: 410962 - DNA, 25 bp, Mus musculus
caatggatactgtagctctgaggga

SEQ ID NO: 410963 - DNA, 25 bp, Mus musculus
caatggatgctgctttaggctgtag

SEQ ID NO: 410964 - DNA, 25 bp, Mus musculus
caatggattccagtacgttttgcac

SEQ ID NO: 410965 - DNA, 25 bp, Mus musculus
caatggattctgactcggactcacc

SEQ ID NO: 410966 - DNA, 25 bp, Mus musculus
caatggattgcatggaaacctgatc

SEQ ID NO: 410967 - DNA, 25 bp, Mus musculus
caatggcaacctggtggatatcttc

SEQ ID NO: 410968 - DNA, 25 bp, Mus musculus
caatggcaagactgcatcgcggagg

SEQ ID NO: 410969 - DNA, 25 bp, Mus musculus
caatggcagagcgtggttaagaagc

SEQ ID NO: 410970 - DNA, 25 bp, Mus musculus
caatggcagccttatccgggagaga

SEQ ID NO: 410971 - DNA, 25 bp, Mus musculus
caatggcagggacgtgggcggcgaa

SEQ ID NO: 410972 - DNA, 25 bp, Mus musculus
caatggcagtcttgtacctggcagc

SEQ ID NO: 410973 - DNA, 25 bp, Mus musculus
caatggcagttatagggagacccct

SEQ ID NO: 410974 - DNA, 25 bp, Mus musculus
caatggcatcataagggacaggacc

SEQ ID NO: 410975 - DNA, 25 bp, Mus musculus
caatggcccgctccaagatgggtga

SEQ ID NO: 410976 - DNA, 25 bp, Mus musculus
caatggccgaggaatatgactacgt

SEQ ID NO: 410977 - DNA, 25 bp, Mus musculus
caatggccgtaagaactgcaaggag

SEQ ID NO: 410978 - DNA, 25 bp, Mus musculus
caatggccgttaagatagactacac

SEQ ID NO: 410979 - DNA, 25 bp, Mus musculus
caatggcctagagttgcttactgcc

SEQ ID NO: 410980 - DNA, 25 bp, Mus musculus
caatggcctcacgttggtgtccaga

SEQ ID NO: 410981 - DNA, 25 bp, Mus musculus
caatggcctgtggtcaccttggtgc

SEQ ID NO: 410982 - DNA, 25 bp, Mus musculus
caatggcgatttgtgaaccgtatcc

SEQ ID NO: 410983 - DNA, 25 bp, Mus musculus
caatggcgctcctccctgtggagct

SEQ ID NO: 410984 - DNA, 25 bp, Mus musculus
caatggctatctgagggtccgcatc

SEQ ID NO: 410985 - DNA, 25 bp, Mus musculus
caatggctatggacacctggtcacc

SEQ ID NO: 410986 - DNA, 25 bp, Mus musculus
caatggctatgtggtgactaagccc

SEQ ID NO: 410987 - DNA, 25 bp, Mus musculus
caatggctggcttttactaaagtgg

SEQ ID NO: 410988 - DNA, 25 bp, Mus musculus
caatgggaacaatggagctactggc

SEQ ID NO: 410989 - DNA, 25 bp, Mus musculus
caatgggactcacagcaaaggagca

SEQ ID NO: 410990 - DNA, 25 bp, Mus musculus
caatgggatgtatctgtaacaacgc

SEQ ID NO: 410991 - DNA, 25 bp, Mus musculus
caatgggctatccaccaagcagaag

SEQ ID NO: 410992 - DNA, 25 bp, Mus musculus
caatgggctatgaacgagaacaagt

SEQ ID NO: 410993 - DNA, 25 bp, Mus musculus
caatgggctcatcgtgcgtctggta

SEQ ID NO: 410994 - DNA, 25 bp, Mus musculus
caatgggctctgcaaagtgtgttca

SEQ ID NO: 410995 - DNA, 25 bp, Mus musculus
caatgggtagttatatccccacaca

SEQ ID NO: 410996 - DNA, 25 bp, Mus musculus
caatgggtcatagggagtcttccac

SEQ ID NO: 410997 - DNA, 25 bp, Mus musculus
caatgggtcgtttcttcagctgcgg

SEQ ID NO: 410998 - DNA, 25 bp, Mus musculus
caatgggtgtggaaaacaggagccc

SEQ ID NO: 410999 - DNA, 25 bp, Mus musculus
caatggtaaaaaatcagtggctcac

SEQ ID NO: 411000 - DNA, 25 bp, Mus musculus
caatggtagaattctccgtggagct

SEQ ID NO: 411001 - DNA, 25 bp, Mus musculus
caatggtagctgtatgagacctggc

SEQ ID NO: 411002 - DNA, 25 bp, Mus musculus
caatggtatttatatcccgaaaggg

SEQ ID NO: 411003 - DNA, 25 bp, Mus musculus
caatggtcaccagatccgttggcca

SEQ ID NO: 411004 - DNA, 25 bp, Mus musculus
caatggtcagctagtgactacacgg

SEQ ID NO: 411005 - DNA, 25 bp, Mus musculus
caatggtcttggaggtcttttccag

SEQ ID NO: 411006 - DNA, 25 bp, Mus musculus
caatggtgagaagcaaccgtggcac

SEQ ID NO: 411007 - DNA, 25 bp, Mus musculus
caatggtgggactcaaaatcggaat

SEQ ID NO: 411008 - DNA, 25 bp, Mus musculus
caatggtgtatcaggcagcatcgaa

SEQ ID NO: 411009 - DNA, 25 bp, Mus musculus
caatggtgttgtacatatgtctgta

SEQ ID NO: 411010 - DNA, 25 bp, Mus musculus
caatggttcagtcagcaggaagcct

SEQ ID NO: 411011 - DNA, 25 bp, Mus musculus
caatggttcctcctggcatcaagta

SEQ ID NO: 411012 - DNA, 25 bp, Mus musculus
caatggttcgaggactggcactacg

SEQ ID NO: 411013 - DNA, 25 bp, Mus musculus
caatggttctttcctcttctcagga

SEQ ID NO: 411014 - DNA, 25 bp, Mus musculus
caatggttgactgtgagtcgggcac

SEQ ID NO: 411015 - DNA, 25 bp, Mus musculus
caatggttggagaaatagcttcggc

SEQ ID NO: 411016 - DNA, 25 bp, Mus musculus
caatggttgggctcagaggcactca

SEQ ID NO: 411017 - DNA, 25 bp, Mus musculus
caatggtttatcaacggaacagccg

SEQ ID NO: 411018 - DNA, 25 bp, Mus musculus
caatggttttgcataaacatggaga

SEQ ID NO: 411019 - DNA, 25 bp, Mus musculus
caatgtaagctcatacttggtggtg

SEQ ID NO: 411020 - DNA, 25 bp, Mus musculus
caatgtaataatcacagtactcttc

SEQ ID NO: 411021 - DNA, 25 bp, Mus musculus
caatgtaatctacaaaccacccggg

SEQ ID NO: 411022 - DNA, 25 bp, Mus musculus
caatgtacacatcttcgtctccgag

SEQ ID NO: 411023 - DNA, 25 bp, Mus musculus
caatgtacacgaccgagattctggc

SEQ ID NO: 411024 - DNA, 25 bp, Mus musculus
caatgtacgattgacaagagtcagc

SEQ ID NO: 411025 - DNA, 25 bp, Mus musculus
caatgtactggctagatggtgggca

SEQ ID NO: 411026 - DNA, 25 bp, Mus musculus
caatgtagatgagtagcccaaggct

SEQ ID NO: 411027 - DNA, 25 bp, Mus musculus
caatgtagtgaagcacatccgggac

SEQ ID NO: 411028 - DNA, 25 bp, Mus musculus
caatgtatggtaggtgctttagcga

SEQ ID NO: 411029 - DNA, 25 bp, Mus musculus
caatgtcaaggtagctgtgtgcgac

SEQ ID NO: 411030 - DNA, 25 bp, Mus musculus
caatgtcacattcagcttgcgcaga

SEQ ID NO: 411031 - DNA, 25 bp, Mus musculus
caatgtcaccgagaaggtcacccag

SEQ ID NO: 411032 - DNA, 25 bp, Mus musculus
caatgtcacgagtgcttcgagagca

SEQ ID NO: 411033 - DNA, 25 bp, Mus musculus
caatgtcagagttaagtcttgggac

SEQ ID NO: 411034 - DNA, 25 bp, Mus musculus
caatgtcaggcgtccatgctagcga

SEQ ID NO: 411035 - DNA, 25 bp, Mus musculus
caatgtcagtccagttgtgagtccc

SEQ ID NO: 411036 - DNA, 25 bp, Mus musculus
caatgtcagtgtcgctgagacaggc

SEQ ID NO: 411037 - DNA, 25 bp, Mus musculus
caatgtccaaatagcagcctcggag

SEQ ID NO: 411038 - DNA, 25 bp, Mus musculus
caatgtccctcatgtagggtgcgct

SEQ ID NO: 411039 - DNA, 25 bp, Mus musculus
caatgtcgacgtgttggtgggctac

SEQ ID NO: 411040 - DNA, 25 bp, Mus musculus
caatgtcggcagactttaaaaggct

SEQ ID NO: 411041 - DNA, 25 bp, Mus musculus
caatgtcgtggagtagaatggtgta

SEQ ID NO: 411042 - DNA, 25 bp, Mus musculus
caatgtcgtggatgctggagttgga

SEQ ID NO: 411043 - DNA, 25 bp, Mus musculus
caatgtctgggatgttctcaagggc

SEQ ID NO: 411044 - DNA, 25 bp, Mus musculus
caatgtcttctctgtttacacacgg

SEQ ID NO: 411045 - DNA, 25 bp, Mus musculus
caatgtgaatctggctagtgcccca

SEQ ID NO: 411046 - DNA, 25 bp, Mus musculus
caatgtgacattaactttccaggag

SEQ ID NO: 411047 - DNA, 25 bp, Mus musculus
caatgtgactccactgccggggatc

SEQ ID NO: 411048 - DNA, 25 bp, Mus musculus
caatgtgactgtgagcgtatccaac

SEQ ID NO: 411049 - DNA, 25 bp, Mus musculus
caatgtgatgaaaaagagcacccca

SEQ ID NO: 411050 - DNA, 25 bp, Mus musculus
caatgtgcaccaacatgatgagcta

SEQ ID NO: 411051 - DNA, 25 bp, Mus musculus
caatgtgcagcatggtaacctgggc

SEQ ID NO: 411052 - DNA, 25 bp, Mus musculus
caatgtgccctgaccaagaccggtt

SEQ ID NO: 411053 - DNA, 25 bp, Mus musculus
caatgtgccctggtacagtgaggcc

SEQ ID NO: 411054 - DNA, 25 bp, Mus musculus
caatgtgctggtgggctatacggtc

SEQ ID NO: 411055 - DNA, 25 bp, Mus musculus
caatgtgcttaagaccctggatccc

SEQ ID NO: 411056 - DNA, 25 bp, Mus musculus
caatgtgctttcatcagtgtacggg

SEQ ID NO: 411057 - DNA, 25 bp, Mus musculus
caatgtggaagaagaacgggcagcc

SEQ ID NO: 411058 - DNA, 25 bp, Mus musculus
caatgtggacaggaagcaaatcaaa

SEQ ID NO: 411059 - DNA, 25 bp, Mus musculus
caatgtggacatttgatgctcaggg

SEQ ID NO: 411060 - DNA, 25 bp, Mus musculus
caatgtggatgaggataaccccggc

SEQ ID NO: 411061 - DNA, 25 bp, Mus musculus
caatgtggatgatcctggaagccac

SEQ ID NO: 411062 - DNA, 25 bp, Mus musculus
caatgtgggacagccaacactgagg

SEQ ID NO: 411063 - DNA, 25 bp, Mus musculus
caatgtgggctatcataacgagcac

SEQ ID NO: 411064 - DNA, 25 bp, Mus musculus
caatgtgggtcatagagctggctgt

SEQ ID NO: 411065 - DNA, 25 bp, Mus musculus
caatgtggtccacagatgggcacca

SEQ ID NO: 411066 - DNA, 25 bp, Mus musculus
caatgtgtcaaagtccgggtgccag

SEQ ID NO: 411067 - DNA, 25 bp, Mus musculus
caatgtgtcattggtcgacccagct

SEQ ID NO: 411068 - DNA, 25 bp, Mus musculus
caatgtgtcatttccggctgctgta

SEQ ID NO: 411069 - DNA, 25 bp, Mus musculus
caatgtgtcctccttcgtgctgcgg

SEQ ID NO: 411070 - DNA, 25 bp, Mus musculus
caatgtgtcgactgagggtcttgct

SEQ ID NO: 411071 - DNA, 25 bp, Mus musculus
caatgttaaagttgagcccctggaa

SEQ ID NO: 411072 - DNA, 25 bp, Mus musculus
caatgttcagtcaaagaaggaccta

SEQ ID NO: 411073 - DNA, 25 bp, Mus musculus
caatgttcatgcagtgttccagtca

SEQ ID NO: 411074 - DNA, 25 bp, Mus musculus
caatgttcattgctagtgccgggaa

SEQ ID NO: 411075 - DNA, 25 bp, Mus musculus
caatgttccgttctgaggagtccaa

SEQ ID NO: 411076 - DNA, 25 bp, Mus musculus
caatgttcggaggaagcgctatgcc

SEQ ID NO: 411077 - DNA, 25 bp, Mus musculus
caatgttctactggtcaatcggcac

SEQ ID NO: 411078 - DNA, 25 bp, Mus musculus
caatgttgaatatagaggactctgc

SEQ ID NO: 411079 - DNA, 25 bp, Mus musculus
caatgttgagttggccaagactggc

SEQ ID NO: 411080 - DNA, 25 bp, Mus musculus
caatgttgctgcacacagatggagc

SEQ ID NO: 411081 - DNA, 25 bp, Mus musculus
caatgttgtatcaggtggtttcccc

SEQ ID NO: 411082 - DNA, 25 bp, Mus musculus
caatgtttcagtggcttacccatgc

SEQ ID NO: 411083 - DNA, 25 bp, Mus musculus
caatgtttgtctggtcatactggaa

SEQ ID NO: 411084 - DNA, 25 bp, Mus musculus
caatgttttcgggaacgcctgcatc

SEQ ID NO: 411085 - DNA, 25 bp, Mus musculus
caattaaacacgagctccttccaag

SEQ ID NO: 411086 - DNA, 25 bp, Mus musculus
caattaagatttctaagccttggaa

SEQ ID NO: 411087 - DNA, 25 bp, Mus musculus
caattacacagaggacggcctggtc

SEQ ID NO: 411088 - DNA, 25 bp, Mus musculus
caattacagggtatccagctgcctc

SEQ ID NO: 411089 - DNA, 25 bp, Mus musculus
caattacatgttcccgagccaaggg

SEQ ID NO: 411090 - DNA, 25 bp, Mus musculus
caattaccggaagcaccatgtgaca

SEQ ID NO: 411091 - DNA, 25 bp, Mus musculus
caattacgatttcttcgcgcacggt

SEQ ID NO: 411092 - DNA, 25 bp, Mus musculus
caattactcctctacggtggcaggg

SEQ ID NO: 411093 - DNA, 25 bp, Mus musculus
caattacttcgaagcgaagcgggcg

SEQ ID NO: 411094 - DNA, 25 bp, Mus musculus
caattagagcatttccgtcatagaa

SEQ ID NO: 411095 - DNA, 25 bp, Mus musculus
caattagggtaacatcagaaagctt

SEQ ID NO: 411096 - DNA, 25 bp, Mus musculus
caattagtggcagagctctcgaacc

SEQ ID NO: 411097 - DNA, 25 bp, Mus musculus
caattatactgaggtggctgctaca

SEQ ID NO: 411098 - DNA, 25 bp, Mus musculus
caattatggagtgtcggtgctcagc

SEQ ID NO: 411099 - DNA, 25 bp, Mus musculus
caattattttcagcatgtatagcca

SEQ ID NO: 411100 - DNA, 25 bp, Mus musculus
caattcaagctgctgttgggagcaa

SEQ ID NO: 411101 - DNA, 25 bp, Mus musculus
caattcactttgtggaacgaaacca

SEQ ID NO: 411102 - DNA, 25 bp, Mus musculus
caattcagaatggtatggaagggtc

SEQ ID NO: 411103 - DNA, 25 bp, Mus musculus
caattcagatcatgtggtccgtggc

SEQ ID NO: 411104 - DNA, 25 bp, Mus musculus
caattcagatcgcagctggcatgga

SEQ ID NO: 411105 - DNA, 25 bp, Mus musculus
caattcataagccaatcgagccgga

SEQ ID NO: 411106 - DNA, 25 bp, Mus musculus
caattccaggcacatcttcgggtca

SEQ ID NO: 411107 - DNA, 25 bp, Mus musculus
caattccagtgaaaggctggactcc

SEQ ID NO: 411108 - DNA, 25 bp, Mus musculus
caattcccaaggtgagactggagac

SEQ ID NO: 411109 - DNA, 25 bp, Mus musculus
caattcccagaatgccgatacgtgt

SEQ ID NO: 411110 - DNA, 25 bp, Mus musculus
caattccctcagaccaagggtaggg

SEQ ID NO: 411111 - DNA, 25 bp, Mus musculus
caattcctttctggagccgggcaac

SEQ ID NO: 411112 - DNA, 25 bp, Mus musculus
caattctagagacatgggcctggtt

SEQ ID NO: 411113 - DNA, 25 bp, Mus musculus
caattctctgtgagcgtggagcacg

SEQ ID NO: 411114 - DNA, 25 bp, Mus musculus
caattctggttctttgagcgtggaa

SEQ ID NO: 411115 - DNA, 25 bp, Mus musculus
caattcttctctggtgggcaggtga

SEQ ID NO: 411116 - DNA, 25 bp, Mus musculus
caattcttgatccagcaggtgacac

SEQ ID NO: 411117 - DNA, 25 bp, Mus musculus
caattctttacctctggctgggaga

SEQ ID NO: 411118 - DNA, 25 bp, Mus musculus
caattcttttacaggaaattatgga

SEQ ID NO: 411119 - DNA, 25 bp, Mus musculus
caattgagatgacacctgatatgga

SEQ ID NO: 411120 - DNA, 25 bp, Mus musculus
caattgaggctatccagcggacgga

SEQ ID NO: 411121 - DNA, 25 bp, Mus musculus
caattgagggactggtgcttgtacc

SEQ ID NO: 411122 - DNA, 25 bp, Mus musculus
caattgcaacggaaatcgcctggag

SEQ ID NO: 411123 - DNA, 25 bp, Mus musculus
caattgccagacagaggagtccaga

SEQ ID NO: 411124 - DNA, 25 bp, Mus musculus
caattgccaggctgggagcagctca

SEQ ID NO: 411125 - DNA, 25 bp, Mus musculus
caattgcctggatctgcggagcttc

SEQ ID NO: 411126 - DNA, 25 bp, Mus musculus
caattgctctgggaaagcatccaaa

SEQ ID NO: 411127 - DNA, 25 bp, Mus musculus
caattgctgttaatgacctgggaac

SEQ ID NO: 411128 - DNA, 25 bp, Mus musculus
caattggagcttaccttggacgagt

SEQ ID NO: 411129 - DNA, 25 bp, Mus musculus
caattggatctgtcaaactcgggat

SEQ ID NO: 411130 - DNA, 25 bp, Mus musculus
caattggcctgatgtccgggagctc

SEQ ID NO: 411131 - DNA, 25 bp, Mus musculus
caattgggaagtgcctagagtccag

SEQ ID NO: 411132 - DNA, 25 bp, Mus musculus
caattgggacatcacagggttggcc

SEQ ID NO: 411133 - DNA, 25 bp, Mus musculus
caattgggctgagcacacgtgatcc

SEQ ID NO: 411134 - DNA, 25 bp, Mus musculus
caattggtaaagctgtgtactgctc

SEQ ID NO: 411135 - DNA, 25 bp, Mus musculus
caattggtccgtgtcccgagaagct

SEQ ID NO: 411136 - DNA, 25 bp, Mus musculus
caattggtgtggttagtcctgtgta

SEQ ID NO: 411137 - DNA, 25 bp, Mus musculus
caattgtacagtggaatacagagtc

SEQ ID NO: 411138 - DNA, 25 bp, Mus musculus
caattgtagatgagcgttccgggtg

SEQ ID NO: 411139 - DNA, 25 bp, Mus musculus
caattgtcaagccacgaagggtcct

SEQ ID NO: 411140 - DNA, 25 bp, Mus musculus
caattgtcgcaatcgtaggaatcac

SEQ ID NO: 411141 - DNA, 25 bp, Mus musculus
caattgtctcaggtctttatccaca

SEQ ID NO: 411142 - DNA, 25 bp, Mus musculus
caattgtgactcttctcagagtagc

SEQ ID NO: 411143 - DNA, 25 bp, Mus musculus
caattgtgaggcatgcagtctaaac

SEQ ID NO: 411144 - DNA, 25 bp, Mus musculus
caattgtggctcagtggcgtctgcc

SEQ ID NO: 411145 - DNA, 25 bp, Mus musculus
caatttaactaggtgcggtggctac

SEQ ID NO: 411146 - DNA, 25 bp, Mus musculus
caatttacactggatacccgctgag

SEQ ID NO: 411147 - DNA, 25 bp, Mus musculus
caatttactccaggcgagggcgcct

SEQ ID NO: 411148 - DNA, 25 bp, Mus musculus
caatttaggcacagctgacatggcc

SEQ ID NO: 411149 - DNA, 25 bp, Mus musculus
caatttaggcacttggaggaaggta

SEQ ID NO: 411150 - DNA, 25 bp, Mus musculus
caatttaggtacgagagtcagctgc

SEQ ID NO: 411151 - DNA, 25 bp, Mus musculus
caatttagtgacgatgacctctcag

SEQ ID NO: 411152 - DNA, 25 bp, Mus musculus
caatttatgccctgccttgagagga

SEQ ID NO: 411153 - DNA, 25 bp, Mus musculus
caatttcacggtgcccacggtttgg

SEQ ID NO: 411154 - DNA, 25 bp, Mus musculus
caatttccagaaggacgtgggcgaa

SEQ ID NO: 411155 - DNA, 25 bp, Mus musculus
caatttccagtccttccatatccga

SEQ ID NO: 411156 - DNA, 25 bp, Mus musculus
caatttcccggacagtggccggacg

SEQ ID NO: 411157 - DNA, 25 bp, Mus musculus
caatttccggccagcgtggtggagg

SEQ ID NO: 411158 - DNA, 25 bp, Mus musculus
caatttgaccactatggacgtagag

SEQ ID NO: 411159 - DNA, 25 bp, Mus musculus
caatttgacgggatcatgggcctgg

SEQ ID NO: 411160 - DNA, 25 bp, Mus musculus
caatttgagaggaaatagactcacc

SEQ ID NO: 411161 - DNA, 25 bp, Mus musculus
caatttgatggtcctgactgggaac

SEQ ID NO: 411162 - DNA, 25 bp, Mus musculus
caatttgcaagagaaccaggtggca

SEQ ID NO: 411163 - DNA, 25 bp, Mus musculus
caatttgcgaaaagtggtcccctgt

SEQ ID NO: 411164 - DNA, 25 bp, Mus musculus
caatttgctgaccagatgggatacc

SEQ ID NO: 411165 - DNA, 25 bp, Mus musculus
caatttgctgggagccattcactgc

SEQ ID NO: 411166 - DNA, 25 bp, Mus musculus
caatttggaacagacctctctagca

SEQ ID NO: 411167 - DNA, 25 bp, Mus musculus
caatttggagaagtcagtgttcacc

SEQ ID NO: 411168 - DNA, 25 bp, Mus musculus
caatttggaggaatgacctgccacc

SEQ ID NO: 411169 - DNA, 25 bp, Mus musculus
caatttggcctgaagagtcgataga

SEQ ID NO: 411170 - DNA, 25 bp, Mus musculus
caatttgggactctttgctgcggga

SEQ ID NO: 411171 - DNA, 25 bp, Mus musculus
caatttgggagtactgatgaatgtc

SEQ ID NO: 411172 - DNA, 25 bp, Mus musculus
caatttgtagatgatcaggtgctag

SEQ ID NO: 411173 - DNA, 25 bp, Mus musculus
caatttgtcagaagcgatgggtcag

SEQ ID NO: 411174 - DNA, 25 bp, Mus musculus
caatttgtccaaagagctccaagct

SEQ ID NO: 411175 - DNA, 25 bp, Mus musculus
caatttgtgcatccagtctgagagc

SEQ ID NO: 411176 - DNA, 25 bp, Mus musculus
caattttaactgtcaccatgtagcc

SEQ ID NO: 411177 - DNA, 25 bp, Mus musculus
caattttaagcttggcacgggaagg

SEQ ID NO: 411178 - DNA, 25 bp, Mus musculus
caattttaccctcatttctgcaggg

SEQ ID NO: 411179 - DNA, 25 bp, Mus musculus
caattttgagggagcctgaacccac

SEQ ID NO: 411180 - DNA, 25 bp, Mus musculus
caattttgggtgacaaggcagccgc

SEQ ID NO: 411181 - DNA, 25 bp, Mus musculus
caatttttgctgataaggcgtttgc

SEQ ID NO: 411182 - DNA, 25 bp, Mus musculus
cacaaaaacgggtgactacggcaag

SEQ ID NO: 411183 - DNA, 25 bp, Mus musculus
cacaaaaaggcatggtggactctgc

SEQ ID NO: 411184 - DNA, 25 bp, Mus musculus
cacaaaacacctggtccttaggaga

SEQ ID NO: 411185 - DNA, 25 bp, Mus musculus
cacaaaacactttcaggctggagga

SEQ ID NO: 411186 - DNA, 25 bp, Mus musculus
cacaaaactaacgagatcatgctgg

SEQ ID NO: 411187 - DNA, 25 bp, Mus musculus
cacaaaactggaaacggcggatctg

SEQ ID NO: 411188 - DNA, 25 bp, Mus musculus
cacaaaagcaaggtgtccgagcagc

SEQ ID NO: 411189 - DNA, 25 bp, Mus musculus
cacaaaaggctttctaggaggccaa

SEQ ID NO: 411190 - DNA, 25 bp, Mus musculus
cacaaaagtggctgcatatggtagt

SEQ ID NO: 411191 - DNA, 25 bp, Mus musculus
cacaaaatggactgaagataaggcc

SEQ ID NO: 411192 - DNA, 25 bp, Mus musculus
cacaaaatgggtctctttaccagtc

SEQ ID NO: 411193 - DNA, 25 bp, Mus musculus
cacaaacaaaggaactgggaggcat

SEQ ID NO: 411194 - DNA, 25 bp, Mus musculus
cacaaacacggttgcagagagcgag

SEQ ID NO: 411195 - DNA, 25 bp, Mus musculus
cacaaacggagctttgtaatctcgg

SEQ ID NO: 411196 - DNA, 25 bp, Mus musculus
cacaaactaggtttgtgagagctgg

SEQ ID NO: 411197 - DNA, 25 bp, Mus musculus
cacaaactggataaggaagtaacgc

SEQ ID NO: 411198 - DNA, 25 bp, Mus musculus
cacaaagaagttagacaagggagga

SEQ ID NO: 411199 - DNA, 25 bp, Mus musculus
cacaaagatgggaccgtagagttca

SEQ ID NO: 411200 - DNA, 25 bp, Mus musculus
cacaaagcggaaacagaggcggcat

SEQ ID NO: 411201 - DNA, 25 bp, Mus musculus
cacaaagctgctacaactgaaatga

SEQ ID NO: 411202 - DNA, 25 bp, Mus musculus
cacaaagcttcttcatgagggaatc

SEQ ID NO: 411203 - DNA, 25 bp, Mus musculus
cacaaaggccgtgtcctgagggact

SEQ ID NO: 411204 - DNA, 25 bp, Mus musculus
cacaaaggcgtcaagggacccagaa

SEQ ID NO: 411205 - DNA, 25 bp, Mus musculus
cacaaaggtctcatcacaggtgaca

SEQ ID NO: 411206 - DNA, 25 bp, Mus musculus
cacaaaggtggtggctatgtaaccc

SEQ ID NO: 411207 - DNA, 25 bp, Mus musculus
cacaaagtcaagcaggtgcccagag

SEQ ID NO: 411208 - DNA, 25 bp, Mus musculus
cacaaagtgaaaagcatcgaattgc

SEQ ID NO: 411209 - DNA, 25 bp, Mus musculus
cacaaagtggaagagcctcgagctg

SEQ ID NO: 411210 - DNA, 25 bp, Mus musculus
cacaaagtgtcgaacggtatatcca

SEQ ID NO: 411211 - DNA, 25 bp, Mus musculus
cacaaagtgttgaactgaagggaca

SEQ ID NO: 411212 - DNA, 25 bp, Mus musculus
cacaaatgcttgtggtgagcctcga

SEQ ID NO: 411213 - DNA, 25 bp, Mus musculus
cacaaatgggatgactaggctggag

SEQ ID NO: 411214 - DNA, 25 bp, Mus musculus
cacaaatggtctatcagtcggcccg

SEQ ID NO: 411215 - DNA, 25 bp, Mus musculus
cacaacaagacgtgcttagagttcg

SEQ ID NO: 411216 - DNA, 25 bp, Mus musculus
cacaacacagagagtctaggagact

SEQ ID NO: 411217 - DNA, 25 bp, Mus musculus
cacaacagacttgcgccgggaggcg

SEQ ID NO: 411218 - DNA, 25 bp, Mus musculus
cacaacagcgttaatatgaatacat

SEQ ID NO: 411219 - DNA, 25 bp, Mus musculus
cacaacaggaataaggtgccttcca

SEQ ID NO: 411220 - DNA, 25 bp, Mus musculus
cacaacatctggtacttcggcagca

SEQ ID NO: 411221 - DNA, 25 bp, Mus musculus
cacaacatgatctgacgacaatgca

SEQ ID NO: 411222 - DNA, 25 bp, Mus musculus
cacaacatggtgatttacaactaca

SEQ ID NO: 411223 - DNA, 25 bp, Mus musculus
cacaacccaagtggtggatgggtca

SEQ ID NO: 411224 - DNA, 25 bp, Mus musculus
cacaacccagaagacactaggtggg

SEQ ID NO: 411225 - DNA, 25 bp, Mus musculus
cacaaccggctgagcaagaacaaga

SEQ ID NO: 411226 - DNA, 25 bp, Mus musculus
cacaacgaagatagcggaggatccc

SEQ ID NO: 411227 - DNA, 25 bp, Mus musculus
cacaacgggcgcaattgctttggca

SEQ ID NO: 411228 - DNA, 25 bp, Mus musculus
cacaacgtggagaagcttcgggaca

SEQ ID NO: 411229 - DNA, 25 bp, Mus musculus
cacaacgtgtggtactacggcctct

SEQ ID NO: 411230 - DNA, 25 bp, Mus musculus
cacaacgtttgaaaagcaacccaga

SEQ ID NO: 411231 - DNA, 25 bp, Mus musculus
cacaactacggaacatctttatcac

SEQ ID NO: 411232 - DNA, 25 bp, Mus musculus
cacaactcagtgctatcaaggaaga

SEQ ID NO: 411233 - DNA, 25 bp, Mus musculus
cacaactgccccacttgggtggaag

SEQ ID NO: 411234 - DNA, 25 bp, Mus musculus
cacaactgtgcttaagaggacccta

SEQ ID NO: 411235 - DNA, 25 bp, Mus musculus
cacaactgttcgtgagcgctcaagg

SEQ ID NO: 411236 - DNA, 25 bp, Mus musculus
cacaacttccggctgaatgagagag

SEQ ID NO: 411237 - DNA, 25 bp, Mus musculus
cacaacttgagagccaggttacagg

SEQ ID NO: 411238 - DNA, 25 bp, Mus musculus
cacaactttggctgggtaactagaa

SEQ ID NO: 411239 - DNA, 25 bp, Mus musculus
cacaagaaaatagctaaagtgaaat

SEQ ID NO: 411240 - DNA, 25 bp, Mus musculus
cacaagaagaaaaagcggctggcca

SEQ ID NO: 411241 - DNA, 25 bp, Mus musculus
cacaagaagcagtaagttggcacct

SEQ ID NO: 411242 - DNA, 25 bp, Mus musculus
cacaagaagccccttatctgaggtg

SEQ ID NO: 411243 - DNA, 25 bp, Mus musculus
cacaagaaggacattgggcccaaca

SEQ ID NO: 411244 - DNA, 25 bp, Mus musculus
cacaagacaggtccaaatctctggg

SEQ ID NO: 411245 - DNA, 25 bp, Mus musculus
cacaagacattctgccactgggagc

SEQ ID NO: 411246 - DNA, 25 bp, Mus musculus
cacaagacgttaaggcaggctgggt

SEQ ID NO: 411247 - DNA, 25 bp, Mus musculus
cacaagactttgaaaccacagggct

SEQ ID NO: 411248 - DNA, 25 bp, Mus musculus
cacaagagaggagagtctgtcacca

SEQ ID NO: 411249 - DNA, 25 bp, Mus musculus
cacaagagctgtggtcaaggctaca

SEQ ID NO: 411250 - DNA, 25 bp, Mus musculus
cacaagatcgtttccctgctggcgg

SEQ ID NO: 411251 - DNA, 25 bp, Mus musculus
cacaagatgcccactcaagggcgca

SEQ ID NO: 411252 - DNA, 25 bp, Mus musculus
cacaagatggactgggttgcgacct

SEQ ID NO: 411253 - DNA, 25 bp, Mus musculus
cacaagatgtaccttgaaaggctgc

SEQ ID NO: 411254 - DNA, 25 bp, Mus musculus
cacaagcaaagtggagataactacc

SEQ ID NO: 411255 - DNA, 25 bp, Mus musculus
cacaagcaagcaggtagatacacgt

SEQ ID NO: 411256 - DNA, 25 bp, Mus musculus
cacaagcagccaagtgcggtagcag

SEQ ID NO: 411257 - DNA, 25 bp, Mus musculus
cacaagcagtaggaattctaatgtc

SEQ ID NO: 411258 - DNA, 25 bp, Mus musculus
cacaagcagtgaccatcagagggca

SEQ ID NO: 411259 - DNA, 25 bp, Mus musculus
cacaagcagttcaagaagaagggct

SEQ ID NO: 411260 - DNA, 25 bp, Mus musculus
cacaagccggttgatgcaaatggga

SEQ ID NO: 411261 - DNA, 25 bp, Mus musculus
cacaagccttctcttcagggtggta

SEQ ID NO: 411262 - DNA, 25 bp, Mus musculus
cacaagcgaacatttctggaaacca

SEQ ID NO: 411263 - DNA, 25 bp, Mus musculus
cacaagcggctgaaccctgatggaa

SEQ ID NO: 411264 - DNA, 25 bp, Mus musculus
cacaagcgggcagaagagttcctga

SEQ ID NO: 411265 - DNA, 25 bp, Mus musculus
cacaagcggtgtgtcctcaaagtcc

SEQ ID NO: 411266 - DNA, 25 bp, Mus musculus
cacaagctcgggacaagcgagacag

SEQ ID NO: 411267 - DNA, 25 bp, Mus musculus
cacaagctgaggaattgcgtcgaga

SEQ ID NO: 411268 - DNA, 25 bp, Mus musculus
cacaagctgcgtgtggatcccgtca

SEQ ID NO: 411269 - DNA, 25 bp, Mus musculus
cacaagcttctgatgcatttctggg

SEQ ID NO: 411270 - DNA, 25 bp, Mus musculus
cacaagcttgtgagtcagaggccgt

SEQ ID NO: 411271 - DNA, 25 bp, Mus musculus
cacaaggaaagtggcaggcatggcc

SEQ ID NO: 411272 - DNA, 25 bp, Mus musculus
cacaaggaacctacgtttgggcaat

SEQ ID NO: 411273 - DNA, 25 bp, Mus musculus
cacaaggaaggttttggcacaagac

SEQ ID NO: 411274 - DNA, 25 bp, Mus musculus
cacaaggacctttggctgcagatgc

SEQ ID NO: 411275 - DNA, 25 bp, Mus musculus
cacaaggacgactctgggcagtact

SEQ ID NO: 411276 - DNA, 25 bp, Mus musculus
cacaaggactctgccctctgaaggg

SEQ ID NO: 411277 - DNA, 25 bp, Mus musculus
cacaaggagcgttcattttcggtaa

SEQ ID NO: 411278 - DNA, 25 bp, Mus musculus
cacaaggatgtacacagaaggccat

SEQ ID NO: 411279 - DNA, 25 bp, Mus musculus
cacaaggcatgagagtaggagagca

SEQ ID NO: 411280 - DNA, 25 bp, Mus musculus
cacaaggcctagtctggaagcgtat

SEQ ID NO: 411281 - DNA, 25 bp, Mus musculus
cacaaggctactggaaaagatggat

SEQ ID NO: 411282 - DNA, 25 bp, Mus musculus
cacaagggcctatccggacattggt

SEQ ID NO: 411283 - DNA, 25 bp, Mus musculus
cacaagggtccttgggccaaagagg

SEQ ID NO: 411284 - DNA, 25 bp, Mus musculus
cacaaggtgctgctgggcatcaaaa

SEQ ID NO: 411285 - DNA, 25 bp, Mus musculus
cacaaggtgtctgtcagagggctca

SEQ ID NO: 411286 - DNA, 25 bp, Mus musculus
cacaaggttcatttacgatttttct

SEQ ID NO: 411287 - DNA, 25 bp, Mus musculus
cacaagtacacgtggaaacgagggc

SEQ ID NO: 411288 - DNA, 25 bp, Mus musculus
cacaagtcagcgttataaaatcctg

SEQ ID NO: 411289 - DNA, 25 bp, Mus musculus
cacaagtcgtagcttctgagcgcgc

SEQ ID NO: 411290 - DNA, 25 bp, Mus musculus
cacaagtctcggatgtacagccagt

SEQ ID NO: 411291 - DNA, 25 bp, Mus musculus
cacaagtctggctacctggctggag

SEQ ID NO: 411292 - DNA, 25 bp, Mus musculus
cacaagtgctttcccaggaggtgac

SEQ ID NO: 411293 - DNA, 25 bp, Mus musculus
cacaagtgtaaagatcgaaggaggg

SEQ ID NO: 411294 - DNA, 25 bp, Mus musculus
cacaagtgtgtacgagagtccctac

SEQ ID NO: 411295 - DNA, 25 bp, Mus musculus
cacaagtgttaccatcgtgcgcccg

SEQ ID NO: 411296 - DNA, 25 bp, Mus musculus
cacaagtgttgtgtcgtgcagtgac

SEQ ID NO: 411297 - DNA, 25 bp, Mus musculus
cacaagttcattgtcaggtggcaga

SEQ ID NO: 411298 - DNA, 25 bp, Mus musculus
cacaagttggttcgtttcgcggcgc

SEQ ID NO: 411299 - DNA, 25 bp, Mus musculus
cacaagttgtaaccccaatgaggcc

SEQ ID NO: 411300 - DNA, 25 bp, Mus musculus
cacaataataagatgacagacgagc

SEQ ID NO: 411301 - DNA, 25 bp, Mus musculus
cacaatagtgccacacagaagcatg

SEQ ID NO: 411302 - DNA, 25 bp, Mus musculus
cacaatccgtgtgagtcgagctgcg

SEQ ID NO: 411303 - DNA, 25 bp, Mus musculus
cacaatgagggaggaactgctttcc

SEQ ID NO: 411304 - DNA, 25 bp, Mus musculus
cacaatgaggtgaatcggaagctgg

SEQ ID NO: 411305 - DNA, 25 bp, Mus musculus
cacaatgcgctgagtgaccctgaga

SEQ ID NO: 411306 - DNA, 25 bp, Mus musculus
cacaatggaaagacagccgactcct

SEQ ID NO: 411307 - DNA, 25 bp, Mus musculus
cacaatggcaacgtggtggtagctg

SEQ ID NO: 411308 - DNA, 25 bp, Mus musculus
cacaatgggacgagttaggagtaac

SEQ ID NO: 411309 - DNA, 25 bp, Mus musculus
cacaatgtctcctcattgacgtgga

SEQ ID NO: 411310 - DNA, 25 bp, Mus musculus
cacaattcgaggagacgtaagcagt

SEQ ID NO: 411311 - DNA, 25 bp, Mus musculus
cacaattcttaaaagtgtattccag

SEQ ID NO: 411312 - DNA, 25 bp, Mus musculus
cacaattctttctccgtgagttgca

SEQ ID NO: 411313 - DNA, 25 bp, Mus musculus
cacaattggctggttgagatggaca

SEQ ID NO: 411314 - DNA, 25 bp, Mus musculus
cacacaaactgggtggaaacaccga

SEQ ID NO: 411315 - DNA, 25 bp, Mus musculus
cacacaaagccctgtcagctggtga

SEQ ID NO: 411316 - DNA, 25 bp, Mus musculus
cacacaatatacaaggtcttctgcc

SEQ ID NO: 411317 - DNA, 25 bp, Mus musculus
cacacaatatccatggcttagggtt

SEQ ID NO: 411318 - DNA, 25 bp, Mus musculus
cacacacaaaggaaggtctccccgg

SEQ ID NO: 411319 - DNA, 25 bp, Mus musculus
cacacacactataggaggacgcata

SEQ ID NO: 411320 - DNA, 25 bp, Mus musculus
cacacacagacagaggaggcatttc

SEQ ID NO: 411321 - DNA, 25 bp, Mus musculus
cacacacagactgagcaccaggagt

SEQ ID NO: 411322 - DNA, 25 bp, Mus musculus
cacacacatgtgagaaaggactggc

SEQ ID NO: 411323 - DNA, 25 bp, Mus musculus
cacacacattgttggagccccgtca

SEQ ID NO: 411324 - DNA, 25 bp, Mus musculus
cacacacggtccatcagatacaaag

SEQ ID NO: 411325 - DNA, 25 bp, Mus musculus
cacacacgtgaaaactgctaagaca

SEQ ID NO: 411326 - DNA, 25 bp, Mus musculus
cacacactatgatgtgtgcactggg

SEQ ID NO: 411327 - DNA, 25 bp, Mus musculus
cacacactcttcctgtgccattgta

SEQ ID NO: 411328 - DNA, 25 bp, Mus musculus
cacacactgaaagaagttcgccggg

SEQ ID NO: 411329 - DNA, 25 bp, Mus musculus
cacacactgcggttcattagatggg

SEQ ID NO: 411330 - DNA, 25 bp, Mus musculus
cacacactggaggaggttaacaaca

SEQ ID NO: 411331 - DNA, 25 bp, Mus musculus
cacacagaacaagctccaaggaaac

SEQ ID NO: 411332 - DNA, 25 bp, Mus musculus
cacacagaggatacgagagagttac

SEQ ID NO: 411333 - DNA, 25 bp, Mus musculus
cacacagagggctggcatgaagctc

SEQ ID NO: 411334 - DNA, 25 bp, Mus musculus
cacacagaggtgatagagtatgtcc

SEQ ID NO: 411335 - DNA, 25 bp, Mus musculus
cacacagagtgttaagtgggaccct

SEQ ID NO: 411336 - DNA, 25 bp, Mus musculus
cacacagagtgttcaggttctcaga

SEQ ID NO: 411337 - DNA, 25 bp, Mus musculus
cacacagatggccaacaggcctgta

SEQ ID NO: 411338 - DNA, 25 bp, Mus musculus
cacacagcaagggagtatcaggttc

SEQ ID NO: 411339 - DNA, 25 bp, Mus musculus
cacacagcactaaggcaaagaagct

SEQ ID NO: 411340 - DNA, 25 bp, Mus musculus
cacacagccctgcttgacaaggctg

SEQ ID NO: 411341 - DNA, 25 bp, Mus musculus
cacacagcgactgggtccgagatgt

SEQ ID NO: 411342 - DNA, 25 bp, Mus musculus
cacacagcggaatggcactccaagt

SEQ ID NO: 411343 - DNA, 25 bp, Mus musculus
cacacagcttaggagtgaggtcttc

SEQ ID NO: 411344 - DNA, 25 bp, Mus musculus
cacacaggaaccacagcttcaagtg

SEQ ID NO: 411345 - DNA, 25 bp, Mus musculus
cacacaggattggtacgggatagca

SEQ ID NO: 411346 - DNA, 25 bp, Mus musculus
cacacaggatttcagagggctagtc

SEQ ID NO: 411347 - DNA, 25 bp, Mus musculus
cacacaggcaggaagtgtacctggt

SEQ ID NO: 411348 - DNA, 25 bp, Mus musculus
cacacaggcttgatcatctgagaag

SEQ ID NO: 411349 - DNA, 25 bp, Mus musculus
cacacagggaaggaacgtttctcgt

SEQ ID NO: 411350 - DNA, 25 bp, Mus musculus
cacacagggagcctgcgcctgcaga

SEQ ID NO: 411351 - DNA, 25 bp, Mus musculus
cacacagggatatcttgcaggcctc

SEQ ID NO: 411352 - DNA, 25 bp, Mus musculus
cacacagggtggaaaaagtggtcca

SEQ ID NO: 411353 - DNA, 25 bp, Mus musculus
cacacagggttaatgatgccacaag

SEQ ID NO: 411354 - DNA, 25 bp, Mus musculus
cacacaggtgcacagacaagatcat

SEQ ID NO: 411355 - DNA, 25 bp, Mus musculus
cacacaggtgctgaagagtaaccca

SEQ ID NO: 411356 - DNA, 25 bp, Mus musculus
cacacaggtggttggcattttgaaa

SEQ ID NO: 411357 - DNA, 25 bp, Mus musculus
cacacaggtttatgggttctacgac

SEQ ID NO: 411358 - DNA, 25 bp, Mus musculus
cacacagtagtatataatgttcctc

SEQ ID NO: 411359 - DNA, 25 bp, Mus musculus
cacacagtcctgctggaagggcaga

SEQ ID NO: 411360 - DNA, 25 bp, Mus musculus
cacacagtgatcgagtttagcaggg

SEQ ID NO: 411361 - DNA, 25 bp, Mus musculus
cacacagtgtttgagacgcacttag

SEQ ID NO: 411362 - DNA, 25 bp, Mus musculus
cacacagttgtagtatgggatgcta

SEQ ID NO: 411363 - DNA, 25 bp, Mus musculus
cacacagttgtgcagcttaggacat

SEQ ID NO: 411364 - DNA, 25 bp, Mus musculus
cacacagtttacctgctaagaggaa

SEQ ID NO: 411365 - DNA, 25 bp, Mus musculus
cacacatactaatcaggtggtgagg

SEQ ID NO: 411366 - DNA, 25 bp, Mus musculus
cacacatctctgatttctccagtgg

SEQ ID NO: 411367 - DNA, 25 bp, Mus musculus
cacacatctttctgtacctgatcta

SEQ ID NO: 411368 - DNA, 25 bp, Mus musculus
cacacatggattcgaaggcctgagg

SEQ ID NO: 411369 - DNA, 25 bp, Mus musculus
cacacatggatttctactgtcccag

SEQ ID NO: 411370 - DNA, 25 bp, Mus musculus
cacacatgggcaggataggctggct

SEQ ID NO: 411371 - DNA, 25 bp, Mus musculus
cacacatgggcatggctggttgcat

SEQ ID NO: 411372 - DNA, 25 bp, Mus musculus
cacacatggtgatgctaaggaccag

SEQ ID NO: 411373 - DNA, 25 bp, Mus musculus
cacacatggtggaacaaacgggatt

SEQ ID NO: 411374 - DNA, 25 bp, Mus musculus
cacacattggaagatgaagacgtca

SEQ ID NO: 411375 - DNA, 25 bp, Mus musculus
cacacattgtatgggcttctaagca

SEQ ID NO: 411376 - DNA, 25 bp, Mus musculus
cacaccagcatgagcggaagcagta

SEQ ID NO: 411377 - DNA, 25 bp, Mus musculus
cacaccatctcaggacttgagtggg

SEQ ID NO: 411378 - DNA, 25 bp, Mus musculus
cacacccagactatggctctcatga

SEQ ID NO: 411379 - DNA, 25 bp, Mus musculus
cacacccaggaaggatggcctagct

SEQ ID NO: 411380 - DNA, 25 bp, Mus musculus
cacacccatatttctgataacagag

SEQ ID NO: 411381 - DNA, 25 bp, Mus musculus
cacaccccggtgatctttggagaag

SEQ ID NO: 411382 - DNA, 25 bp, Mus musculus
cacacccctaggcttatgcatcaaa

SEQ ID NO: 411383 - DNA, 25 bp, Mus musculus
cacacccggcctttattcatgacag

SEQ ID NO: 411384 - DNA, 25 bp, Mus musculus
cacacccgtgtggtagtgggcgttc

SEQ ID NO: 411385 - DNA, 25 bp, Mus musculus
cacaccggcgtgtgctatggcatca

SEQ ID NO: 411386 - DNA, 25 bp, Mus musculus
cacacctacgacaggggcacaggga

SEQ ID NO: 411387 - DNA, 25 bp, Mus musculus
cacacctagctttttctcttgggac

SEQ ID NO: 411388 - DNA, 25 bp, Mus musculus
cacacctatgttggaggcctgccag

SEQ ID NO: 411389 - DNA, 25 bp, Mus musculus
cacacctcgggttaagcatttctta

SEQ ID NO: 411390 - DNA, 25 bp, Mus musculus
cacacctgaagggaatgatgggcga

SEQ ID NO: 411391 - DNA, 25 bp, Mus musculus
cacacctgctgtgcgtggctcaggg

SEQ ID NO: 411392 - DNA, 25 bp, Mus musculus
cacacctgggtgagttattcggcag

SEQ ID NO: 411393 - DNA, 25 bp, Mus musculus
cacacctggtgcatcatggaggcta

SEQ ID NO: 411394 - DNA, 25 bp, Mus musculus
cacacctgtctactctggcatgtgt

SEQ ID NO: 411395 - DNA, 25 bp, Mus musculus
cacacgaagctgatcagggaagggc

SEQ ID NO: 411396 - DNA, 25 bp, Mus musculus
cacacgaatgggtagatgagggctc

SEQ ID NO: 411397 - DNA, 25 bp, Mus musculus
cacacgattggctgtttctggccca

SEQ ID NO: 411398 - DNA, 25 bp, Mus musculus
cacacgcggtttgtctgcatctcag

SEQ ID NO: 411399 - DNA, 25 bp, Mus musculus
cacacgcgtgcgagttttcagggcc

SEQ ID NO: 411400 - DNA, 25 bp, Mus musculus
cacacgctaggaagggcacacgcgt

SEQ ID NO: 411401 - DNA, 25 bp, Mus musculus
cacacggaaatactgagggacacac

SEQ ID NO: 411402 - DNA, 25 bp, Mus musculus
cacacggagaagtcaggcatagtac

SEQ ID NO: 411403 - DNA, 25 bp, Mus musculus
cacacggctttggatgtgagtgaac

SEQ ID NO: 411404 - DNA, 25 bp, Mus musculus
cacacgggagagtctgaagctgtca

SEQ ID NO: 411405 - DNA, 25 bp, Mus musculus
cacacgggccttgtcaggaaaagga

SEQ ID NO: 411406 - DNA, 25 bp, Mus musculus
cacacgggcgagaagaagttcagct

SEQ ID NO: 411407 - DNA, 25 bp, Mus musculus
cacacgggtagctacagatgtggca

SEQ ID NO: 411408 - DNA, 25 bp, Mus musculus
cacacggtgtatgtccactgcaacg

SEQ ID NO: 411409 - DNA, 25 bp, Mus musculus
cacacggtgtggatgtgactgccca

SEQ ID NO: 411410 - DNA, 25 bp, Mus musculus
cacacggttaatctagagggagcat

SEQ ID NO: 411411 - DNA, 25 bp, Mus musculus
cacacggtttgaagaggtcctccac

SEQ ID NO: 411412 - DNA, 25 bp, Mus musculus
cacacgtgcactgtggtacgcacat

SEQ ID NO: 411413 - DNA, 25 bp, Mus musculus
cacacgtgccattgccatattggta

SEQ ID NO: 411414 - DNA, 25 bp, Mus musculus
cacacgtggagacctggagaagcta

SEQ ID NO: 411415 - DNA, 25 bp, Mus musculus
cacacgtggctggatacgctggcaa

SEQ ID NO: 411416 - DNA, 25 bp, Mus musculus
cacacgtgtgcaaacagggtcttcc

SEQ ID NO: 411417 - DNA, 25 bp, Mus musculus
cacacgtgtgcaaagattgcggcaa

SEQ ID NO: 411418 - DNA, 25 bp, Mus musculus
cacacgtgtgcaggaccttggccat

SEQ ID NO: 411419 - DNA, 25 bp, Mus musculus
cacacgtgtgtgaccgcagataaca

SEQ ID NO: 411420 - DNA, 25 bp, Mus musculus
cacacgttccatttctcgggaggca

SEQ ID NO: 411421 - DNA, 25 bp, Mus musculus
cacactacatgtcaggttcgggagg

SEQ ID NO: 411422 - DNA, 25 bp, Mus musculus
cacactagcaggtcttcggaggagc

SEQ ID NO: 411423 - DNA, 25 bp, Mus musculus
cacactagcgacctgagctcattca

SEQ ID NO: 411424 - DNA, 25 bp, Mus musculus
cacactagtggtggatgagcacacg

SEQ ID NO: 411425 - DNA, 25 bp, Mus musculus
cacactattgtgagggctttcagac

SEQ ID NO: 411426 - DNA, 25 bp, Mus musculus
cacactcaaagtggctgatttcggc

SEQ ID NO: 411427 - DNA, 25 bp, Mus musculus
cacactcaagaatggtcgcgaggct

SEQ ID NO: 411428 - DNA, 25 bp, Mus musculus
cacactcaggagctgtgagcacgag

SEQ ID NO: 411429 - DNA, 25 bp, Mus musculus
cacactccagcagatgtctggctgt

SEQ ID NO: 411430 - DNA, 25 bp, Mus musculus
cacactcgggcattgtcagatccaa

SEQ ID NO: 411431 - DNA, 25 bp, Mus musculus
cacactctggagctgtatctggcgc

SEQ ID NO: 411432 - DNA, 25 bp, Mus musculus
cacactctgggcctttctggacatc

SEQ ID NO: 411433 - DNA, 25 bp, Mus musculus
cacactctgtgacttggctgaccga

SEQ ID NO: 411434 - DNA, 25 bp, Mus musculus
cacactcttttgttggccttggtgc

SEQ ID NO: 411435 - DNA, 25 bp, Mus musculus
cacactgaacagtgaagaatttgtt

SEQ ID NO: 411436 - DNA, 25 bp, Mus musculus
cacactgaatgaggatctgcaaaca

SEQ ID NO: 411437 - DNA, 25 bp, Mus musculus
cacactgagtcaaggaatggagagc

SEQ ID NO: 411438 - DNA, 25 bp, Mus musculus
cacactgcaggtattgcaccaggca

SEQ ID NO: 411439 - DNA, 25 bp, Mus musculus
cacactgcccgtcatgcaggaggag

SEQ ID NO: 411440 - DNA, 25 bp, Mus musculus
cacactgcgcggaatggtgaacttg

SEQ ID NO: 411441 - DNA, 25 bp, Mus musculus
cacactgctcataggaacgtcagct

SEQ ID NO: 411442 - DNA, 25 bp, Mus musculus
cacactggagctgtcgtcctgcgta

SEQ ID NO: 411443 - DNA, 25 bp, Mus musculus
cacactggagtccttccttatacag

SEQ ID NO: 411444 - DNA, 25 bp, Mus musculus
cacactggcctctaaagttggaatg

SEQ ID NO: 411445 - DNA, 25 bp, Mus musculus
cacactggcctgcagagatggtctc

SEQ ID NO: 411446 - DNA, 25 bp, Mus musculus
cacactggggctaggagtctcaagg

SEQ ID NO: 411447 - DNA, 25 bp, Mus musculus
cacactggttgtgactctgcgcaag

SEQ ID NO: 411448 - DNA, 25 bp, Mus musculus
cacactgtaagagtacaatctgagc

SEQ ID NO: 411449 - DNA, 25 bp, Mus musculus
cacactgtcccgtgaaggctcagag

SEQ ID NO: 411450 - DNA, 25 bp, Mus musculus
cacactgtcggttttcagggccagc

SEQ ID NO: 411451 - DNA, 25 bp, Mus musculus
cacactgtgactgctgaaactctgg

SEQ ID NO: 411452 - DNA, 25 bp, Mus musculus
cacactgtgtgctgatgggagatgc

SEQ ID NO: 411453 - DNA, 25 bp, Mus musculus
cacacttagcagtgagcgtgcaccg

SEQ ID NO: 411454 - DNA, 25 bp, Mus musculus
cacacttctcaatgaccaagggtct

SEQ ID NO: 411455 - DNA, 25 bp, Mus musculus
cacacttctttgctctgaaaataaa

SEQ ID NO: 411456 - DNA, 25 bp, Mus musculus
cacacttgcaccattcagaaatagg

SEQ ID NO: 411457 - DNA, 25 bp, Mus musculus
cacacttgggaaaggaagcatggcg

SEQ ID NO: 411458 - DNA, 25 bp, Mus musculus
cacacttgtcagtggcttaggcttt

SEQ ID NO: 411459 - DNA, 25 bp, Mus musculus
cacacttgtgctgtgaagtcctctc

SEQ ID NO: 411460 - DNA, 25 bp, Mus musculus
cacacttgtgtaggaatgctcccag

SEQ ID NO: 411461 - DNA, 25 bp, Mus musculus
cacactttctgcattcctggaaggg

SEQ ID NO: 411462 - DNA, 25 bp, Mus musculus
cacactttgcaatcgggctggacct

SEQ ID NO: 411463 - DNA, 25 bp, Mus musculus
cacactttggaaacgggtcccatca

SEQ ID NO: 411464 - DNA, 25 bp, Mus musculus
cacagaaaacacaagttcagctcga

SEQ ID NO: 411465 - DNA, 25 bp, Mus musculus
cacagaaaacacagttgggaccctg

SEQ ID NO: 411466 - DNA, 25 bp, Mus musculus
cacagaaaacttgcaggacagactc

SEQ ID NO: 411467 - DNA, 25 bp, Mus musculus
cacagaaaataggagcagagcagat

SEQ ID NO: 411468 - DNA, 25 bp, Mus musculus
cacagaaaataggatgggccattac

SEQ ID NO: 411469 - DNA, 25 bp, Mus musculus
cacagaaagatgaggcataagcgcc

SEQ ID NO: 411470 - DNA, 25 bp, Mus musculus
cacagaaagtctacatgggcagccc

SEQ ID NO: 411471 - DNA, 25 bp, Mus musculus
cacagaaagtgtggagtaactgcag

SEQ ID NO: 411472 - DNA, 25 bp, Mus musculus
cacagaaatcaacctgctgttgcta

SEQ ID NO: 411473 - DNA, 25 bp, Mus musculus
cacagaaatttggaaaagtggacta

SEQ ID NO: 411474 - DNA, 25 bp, Mus musculus
cacagaacaggcacttccttgggac

SEQ ID NO: 411475 - DNA, 25 bp, Mus musculus
cacagaacagggaaggttggctatg

SEQ ID NO: 411476 - DNA, 25 bp, Mus musculus
cacagaactgagaggtagggagcca

SEQ ID NO: 411477 - DNA, 25 bp, Mus musculus
cacagaactgagtcactgagtaact

SEQ ID NO: 411478 - DNA, 25 bp, Mus musculus
cacagaacttaattggcatttgcta

SEQ ID NO: 411479 - DNA, 25 bp, Mus musculus
cacagaagaattgcgccaggcagca

SEQ ID NO: 411480 - DNA, 25 bp, Mus musculus
cacagaagattctaggaggccataa

SEQ ID NO: 411481 - DNA, 25 bp, Mus musculus
cacagaagcatctttgggacgctac

SEQ ID NO: 411482 - DNA, 25 bp, Mus musculus
cacagaagcgtggaaaactggccct

SEQ ID NO: 411483 - DNA, 25 bp, Mus musculus
cacagaagctcagagggcttgcggg

SEQ ID NO: 411484 - DNA, 25 bp, Mus musculus
cacagaagctcttgttcctgaggag

SEQ ID NO: 411485 - DNA, 25 bp, Mus musculus
cacagaaggaatgtgagccccaacc

SEQ ID NO: 411486 - DNA, 25 bp, Mus musculus
cacagaaggagtggctaaggaccaa

SEQ ID NO: 411487 - DNA, 25 bp, Mus musculus
cacagaaggcagctggatttcacgc

SEQ ID NO: 411488 - DNA, 25 bp, Mus musculus
cacagaaggcgttgatctataaagt

SEQ ID NO: 411489 - DNA, 25 bp, Mus musculus
cacagaaggctggaataggatcatc

SEQ ID NO: 411490 - DNA, 25 bp, Mus musculus
cacagaagtctttctagagtccaga

SEQ ID NO: 411491 - DNA, 25 bp, Mus musculus
cacagaattcttgagagcgggagct

SEQ ID NO: 411492 - DNA, 25 bp, Mus musculus
cacagacaggtacttaaacggcggc

SEQ ID NO: 411493 - DNA, 25 bp, Mus musculus
cacagacatacaagcggaagcgctc

SEQ ID NO: 411494 - DNA, 25 bp, Mus musculus
cacagacatggatctcttaagtaca

SEQ ID NO: 411495 - DNA, 25 bp, Mus musculus
cacagacatggatgggaaagccaga

SEQ ID NO: 411496 - DNA, 25 bp, Mus musculus
cacagaccaggagcggagcaatcct

SEQ ID NO: 411497 - DNA, 25 bp, Mus musculus
cacagaccctaggagtgagagcaga

SEQ ID NO: 411498 - DNA, 25 bp, Mus musculus
cacagaccggaggtaggctgacacg

SEQ ID NO: 411499 - DNA, 25 bp, Mus musculus
cacagaccgtgcaagcttcgagaag

SEQ ID NO: 411500 - DNA, 25 bp, Mus musculus
cacagacctcatccagctggtggag

SEQ ID NO: 411501 - DNA, 25 bp, Mus musculus
cacagacctggaggcaagactggga

SEQ ID NO: 411502 - DNA, 25 bp, Mus musculus
cacagacgaaatttgggcagccagc

SEQ ID NO: 411503 - DNA, 25 bp, Mus musculus
cacagacggtatatgcagccagtgc

SEQ ID NO: 411504 - DNA, 25 bp, Mus musculus
cacagacgtctccacagaggagatg

SEQ ID NO: 411505 - DNA, 25 bp, Mus musculus
cacagactctgtggagcctgagata

SEQ ID NO: 411506 - DNA, 25 bp, Mus musculus
cacagactggagtactggtgggcca

SEQ ID NO: 411507 - DNA, 25 bp, Mus musculus
cacagactgggactagagatgacac

SEQ ID NO: 411508 - DNA, 25 bp, Mus musculus
cacagactgggtaccacatggaaga

SEQ ID NO: 411509 - DNA, 25 bp, Mus musculus
cacagacttgggtcagagtgaagcc

SEQ ID NO: 411510 - DNA, 25 bp, Mus musculus
cacagacttgtgtaagtaatatcac

SEQ ID NO: 411511 - DNA, 25 bp, Mus musculus
cacagactttgatgggcggttgctc

SEQ ID NO: 411512 - DNA, 25 bp, Mus musculus
cacagacttttgagttagcggcact

SEQ ID NO: 411513 - DNA, 25 bp, Mus musculus
cacagagaatttgtcaggtttgaaa

SEQ ID NO: 411514 - DNA, 25 bp, Mus musculus
cacagagaccaccagtaaggagaca

SEQ ID NO: 411515 - DNA, 25 bp, Mus musculus
cacagagagcaagggtataggcact

SEQ ID NO: 411516 - DNA, 25 bp, Mus musculus
cacagagagctttcccagagagccg

SEQ ID NO: 411517 - DNA, 25 bp, Mus musculus
cacagagcacgctagtttggacggt

SEQ ID NO: 411518 - DNA, 25 bp, Mus musculus
cacagagcagacaatcagagaccat

SEQ ID NO: 411519 - DNA, 25 bp, Mus musculus
cacagagcaggcagagagcttctac

SEQ ID NO: 411520 - DNA, 25 bp, Mus musculus
cacagagcatgtactgctggcttgg

SEQ ID NO: 411521 - DNA, 25 bp, Mus musculus
cacagagcccagaattgatatcact

SEQ ID NO: 411522 - DNA, 25 bp, Mus musculus
cacagagccctcttgagtcgggaac

SEQ ID NO: 411523 - DNA, 25 bp, Mus musculus
cacagagcctgtggatgaatactgc

SEQ ID NO: 411524 - DNA, 25 bp, Mus musculus
cacagagctagcaaggcttgatcca

SEQ ID NO: 411525 - DNA, 25 bp, Mus musculus
cacagagctattgatgggtctcaac

SEQ ID NO: 411526 - DNA, 25 bp, Mus musculus
cacagaggactacctaattttaggc

SEQ ID NO: 411527 - DNA, 25 bp, Mus musculus
cacagaggagtcaagtggcttttcc

SEQ ID NO: 411528 - DNA, 25 bp, Mus musculus
cacagaggatcgtggaaggtcagtt

SEQ ID NO: 411529 - DNA, 25 bp, Mus musculus
cacagaggatgttagcagcgagtca

SEQ ID NO: 411530 - DNA, 25 bp, Mus musculus
cacagagggaccttcggtagcgaga

SEQ ID NO: 411531 - DNA, 25 bp, Mus musculus
cacagagggcatcgtgtaggtatcc

SEQ ID NO: 411532 - DNA, 25 bp, Mus musculus
cacagaggtcacgagagcactggaa

SEQ ID NO: 411533 - DNA, 25 bp, Mus musculus
cacagaggtgttggctgctgcagac

SEQ ID NO: 411534 - DNA, 25 bp, Mus musculus
cacagagtaactctctgcctgcgat

SEQ ID NO: 411535 - DNA, 25 bp, Mus musculus
cacagagtatgtgcccatgaataga

SEQ ID NO: 411536 - DNA, 25 bp, Mus musculus
cacagagtcgtgtggtgacaaggcc

SEQ ID NO: 411537 - DNA, 25 bp, Mus musculus
cacagagtggtcgtgctttatagac

SEQ ID NO: 411538 - DNA, 25 bp, Mus musculus
cacagagtgtggacgactatcctca

SEQ ID NO: 411539 - DNA, 25 bp, Mus musculus
cacagagttaaagaagtacagccac

SEQ ID NO: 411540 - DNA, 25 bp, Mus musculus
cacagagttactgaagacagacaag

SEQ ID NO: 411541 - DNA, 25 bp, Mus musculus
cacagataagcgcagaaatggtcca

SEQ ID NO: 411542 - DNA, 25 bp, Mus musculus
cacagataagtccagaaagccaggg

SEQ ID NO: 411543 - DNA, 25 bp, Mus musculus
cacagatcctgcaagcctttctaac

SEQ ID NO: 411544 - DNA, 25 bp, Mus musculus
cacagatcgtgctaagtgggagtca

SEQ ID NO: 411545 - DNA, 25 bp, Mus musculus
cacagatcttgctcagacgaagggc

SEQ ID NO: 411546 - DNA, 25 bp, Mus musculus
cacagatggagtgcagcaagttccc

SEQ ID NO: 411547 - DNA, 25 bp, Mus musculus
cacagatggcagtgaccagtggcct

SEQ ID NO: 411548 - DNA, 25 bp, Mus musculus
cacagatgtagtttgtccccaacag

SEQ ID NO: 411549 - DNA, 25 bp, Mus musculus
cacagatgtgagagcaaaggccaaa

SEQ ID NO: 411550 - DNA, 25 bp, Mus musculus
cacagatgtgggacgcagcttgctt

SEQ ID NO: 411551 - DNA, 25 bp, Mus musculus
cacagatgtgtgcagaagtcctaag

SEQ ID NO: 411552 - DNA, 25 bp, Mus musculus
cacagattgaattgcgcattcttgc

SEQ ID NO: 411553 - DNA, 25 bp, Mus musculus
cacagattgggatactggcagcagc

SEQ ID NO: 411554 - DNA, 25 bp, Mus musculus
cacagcaaatgcagggcagtcggac

SEQ ID NO: 411555 - DNA, 25 bp, Mus musculus
cacagcaacgggaaacgatggagct

SEQ ID NO: 411556 - DNA, 25 bp, Mus musculus
cacagcaactgaccatcggaggaga

SEQ ID NO: 411557 - DNA, 25 bp, Mus musculus
cacagcaagcagacgcagtacgtgc

SEQ ID NO: 411558 - DNA, 25 bp, Mus musculus
cacagcaagcaggtggccatctgca

SEQ ID NO: 411559 - DNA, 25 bp, Mus musculus
cacagcaagtgctaattagtctaga

SEQ ID NO: 411560 - DNA, 25 bp, Mus musculus
cacagcaatgtggactctaacggag

SEQ ID NO: 411561 - DNA, 25 bp, Mus musculus
cacagcacaagctacatcatcatag

SEQ ID NO: 411562 - DNA, 25 bp, Mus musculus
cacagcaccagaattaaagtgggcc

SEQ ID NO: 411563 - DNA, 25 bp, Mus musculus
cacagcaccgtgaaaagtcccagat

SEQ ID NO: 411564 - DNA, 25 bp, Mus musculus
cacagcagagcagaggccccagaaa

SEQ ID NO: 411565 - DNA, 25 bp, Mus musculus
cacagcagagtgtcgctttaaggag

SEQ ID NO: 411566 - DNA, 25 bp, Mus musculus
cacagcagggtagtgttgcagccca

SEQ ID NO: 411567 - DNA, 25 bp, Mus musculus
cacagcaggttgtagaggtctcacc

SEQ ID NO: 411568 - DNA, 25 bp, Mus musculus
cacagcagtaggaatgcattggagg

SEQ ID NO: 411569 - DNA, 25 bp, Mus musculus
cacagcagtagtggttcagccgctc

SEQ ID NO: 411570 - DNA, 25 bp, Mus musculus
cacagcatcgcactttagagtggaa

SEQ ID NO: 411571 - DNA, 25 bp, Mus musculus
cacagcatgctgagctaggcggcag

SEQ ID NO: 411572 - DNA, 25 bp, Mus musculus
cacagcatgtctccacagatgagcg

SEQ ID NO: 411573 - DNA, 25 bp, Mus musculus
cacagccaccacaagcaggaatggg

SEQ ID NO: 411574 - DNA, 25 bp, Mus musculus
cacagccaggatcggtatgagttct

SEQ ID NO: 411575 - DNA, 25 bp, Mus musculus
cacagccagggaaagagtctcactc

SEQ ID NO: 411576 - DNA, 25 bp, Mus musculus
cacagccccgaaaatggagatggag

SEQ ID NO: 411577 - DNA, 25 bp, Mus musculus
cacagcccgggaattctcagaggat

SEQ ID NO: 411578 - DNA, 25 bp, Mus musculus
cacagccctaggatcatagacaaga

SEQ ID NO: 411579 - DNA, 25 bp, Mus musculus
cacagccctggacttgagttacgga

SEQ ID NO: 411580 - DNA, 25 bp, Mus musculus
cacagccctgtatattgccaagaaa

SEQ ID NO: 411581 - DNA, 25 bp, Mus musculus
cacagccgaggacattgttatcaga

SEQ ID NO: 411582 - DNA, 25 bp, Mus musculus
cacagccgcggagatactatgatat

SEQ ID NO: 411583 - DNA, 25 bp, Mus musculus
cacagccggcagatgaggactatgg

SEQ ID NO: 411584 - DNA, 25 bp, Mus musculus
cacagcctctgtgaaaccagtgcag

SEQ ID NO: 411585 - DNA, 25 bp, Mus musculus
cacagcctgaaagcgctgggcagga

SEQ ID NO: 411586 - DNA, 25 bp, Mus musculus
cacagcctgactctaactcggacag

SEQ ID NO: 411587 - DNA, 25 bp, Mus musculus
cacagccttaagacgtgtagcccag

SEQ ID NO: 411588 - DNA, 25 bp, Mus musculus
cacagccttggacatgcgtggacga

SEQ ID NO: 411589 - DNA, 25 bp, Mus musculus
cacagcgagtggtactttggcgcca

SEQ ID NO: 411590 - DNA, 25 bp, Mus musculus
cacagcgcagcctgactgagataga

SEQ ID NO: 411591 - DNA, 25 bp, Mus musculus
cacagcggacttacttggaatggcc

SEQ ID NO: 411592 - DNA, 25 bp, Mus musculus
cacagcggcagctttgacctgtcat

SEQ ID NO: 411593 - DNA, 25 bp, Mus musculus
cacagcgggcaagtgttcgagttcc

SEQ ID NO: 411594 - DNA, 25 bp, Mus musculus
cacagcggtgtttgccagcatctac

SEQ ID NO: 411595 - DNA, 25 bp, Mus musculus
cacagcgttcacaaggtaattgtat

SEQ ID NO: 411596 - DNA, 25 bp, Mus musculus
cacagcgtttaaaatggagacggcc

SEQ ID NO: 411597 - DNA, 25 bp, Mus musculus
cacagctagcaaagagggagacaca

SEQ ID NO: 411598 - DNA, 25 bp, Mus musculus
cacagctaggtttggagtgcccgct

SEQ ID NO: 411599 - DNA, 25 bp, Mus musculus
cacagctcaacgaattggagaggag

SEQ ID NO: 411600 - DNA, 25 bp, Mus musculus
cacagctcctccacagttgcatgag

SEQ ID NO: 411601 - DNA, 25 bp, Mus musculus
cacagctgagaagtgctaccgggtc

SEQ ID NO: 411602 - DNA, 25 bp, Mus musculus
cacagctgagcaacttcctggagga

SEQ ID NO: 411603 - DNA, 25 bp, Mus musculus
cacagctgatcgaagaatgggcaaa

SEQ ID NO: 411604 - DNA, 25 bp, Mus musculus
cacagctgggctctaacaatttctt

SEQ ID NO: 411605 - DNA, 25 bp, Mus musculus
cacagctggtggctaattcaggact

SEQ ID NO: 411606 - DNA, 25 bp, Mus musculus
cacagctggtgtgagtcaggaaaac

SEQ ID NO: 411607 - DNA, 25 bp, Mus musculus
cacagctgtgacagaggaaagaggc

SEQ ID NO: 411608 - DNA, 25 bp, Mus musculus
cacagctgtgatgagtgcagacacc

SEQ ID NO: 411609 - DNA, 25 bp, Mus musculus
cacagcttattatttggacaagtcc

SEQ ID NO: 411610 - DNA, 25 bp, Mus musculus
cacagcttcagagtgcttccgggag

SEQ ID NO: 411611 - DNA, 25 bp, Mus musculus
cacaggaacaggacactttgctaca

SEQ ID NO: 411612 - DNA, 25 bp, Mus musculus
cacaggaacattgctgggctgagga

SEQ ID NO: 411613 - DNA, 25 bp, Mus musculus
cacaggaagattacaatgccccaga

SEQ ID NO: 411614 - DNA, 25 bp, Mus musculus
cacaggaagtcttgtatgttcaaat

SEQ ID NO: 411615 - DNA, 25 bp, Mus musculus
cacaggacagtacaggatgcttgcc

SEQ ID NO: 411616 - DNA, 25 bp, Mus musculus
cacaggacagttatgggagactacc

SEQ ID NO: 411617 - DNA, 25 bp, Mus musculus
cacaggaccggaggctttgagatga

SEQ ID NO: 411618 - DNA, 25 bp, Mus musculus
cacaggacctctttcattgggaagg

SEQ ID NO: 411619 - DNA, 25 bp, Mus musculus
cacaggagagctattcgcagcgaca

SEQ ID NO: 411620 - DNA, 25 bp, Mus musculus
cacaggagataaaggacgagcagat

SEQ ID NO: 411621 - DNA, 25 bp, Mus musculus
cacaggagattagggacatgagaga

SEQ ID NO: 411622 - DNA, 25 bp, Mus musculus
cacaggagcacgttcgacagtggct

SEQ ID NO: 411623 - DNA, 25 bp, Mus musculus
cacaggagcctctctagtattcagg

SEQ ID NO: 411624 - DNA, 25 bp, Mus musculus
cacaggagctgtacgagtcgtcaca

SEQ ID NO: 411625 - DNA, 25 bp, Mus musculus
cacaggaggccctgccgcagagagc

SEQ ID NO: 411626 - DNA, 25 bp, Mus musculus
cacaggaggcttggttatgggctac

SEQ ID NO: 411627 - DNA, 25 bp, Mus musculus
cacaggaggtgacgcggaaatacca

SEQ ID NO: 411628 - DNA, 25 bp, Mus musculus
cacaggagtctcgaaaccgcagtag

SEQ ID NO: 411629 - DNA, 25 bp, Mus musculus
cacaggatcgagaatggcaccatga

SEQ ID NO: 411630 - DNA, 25 bp, Mus musculus
cacaggatcttgctggcggctatac

SEQ ID NO: 411631 - DNA, 25 bp, Mus musculus
cacaggatgctagcaaaagggatcc

SEQ ID NO: 411632 - DNA, 25 bp, Mus musculus
cacaggcacccaaggaaggtctttg

SEQ ID NO: 411633 - DNA, 25 bp, Mus musculus
cacaggcacgtggacttatcaggat

SEQ ID NO: 411634 - DNA, 25 bp, Mus musculus
cacaggcacgttctttgagacaaag

SEQ ID NO: 411635 - DNA, 25 bp, Mus musculus
cacaggcagggcgaactatagtcat

SEQ ID NO: 411636 - DNA, 25 bp, Mus musculus
cacaggcagggtcacttagagagct

SEQ ID NO: 411637 - DNA, 25 bp, Mus musculus
cacaggcagtgccactgcgcaggtt

SEQ ID NO: 411638 - DNA, 25 bp, Mus musculus
cacaggcatggtttctaaggcagac

SEQ ID NO: 411639 - DNA, 25 bp, Mus musculus
cacaggccaaggtagagatcggtcc

SEQ ID NO: 411640 - DNA, 25 bp, Mus musculus
cacaggccaccatgaagggtatcac

SEQ ID NO: 411641 - DNA, 25 bp, Mus musculus
cacaggccagcatgaaggagtatgt

SEQ ID NO: 411642 - DNA, 25 bp, Mus musculus
cacaggcctgaagttggagcgagct

SEQ ID NO: 411643 - DNA, 25 bp, Mus musculus
cacaggcctgatgtgaaacctcgaa

SEQ ID NO: 411644 - DNA, 25 bp, Mus musculus
cacaggcctggtgcagatcacagag

SEQ ID NO: 411645 - DNA, 25 bp, Mus musculus
cacaggccttttgtggcagcccagg

SEQ ID NO: 411646 - DNA, 25 bp, Mus musculus
cacaggcgatttcaccgagctggga

SEQ ID NO: 411647 - DNA, 25 bp, Mus musculus
cacaggcggtgtgacctttcggagt

SEQ ID NO: 411648 - DNA, 25 bp, Mus musculus
cacaggcggtttctgggagaggcta

SEQ ID NO: 411649 - DNA, 25 bp, Mus musculus
cacaggcgttggcagtgagctttcc

SEQ ID NO: 411650 - DNA, 25 bp, Mus musculus
cacaggctaagctcgctgcaaggtc

SEQ ID NO: 411651 - DNA, 25 bp, Mus musculus
cacaggctcacaggacatttgggat

SEQ ID NO: 411652 - DNA, 25 bp, Mus musculus
cacaggctcaccatgatgatcaagg

SEQ ID NO: 411653 - DNA, 25 bp, Mus musculus
cacaggctcagctatagtccaacat

SEQ ID NO: 411654 - DNA, 25 bp, Mus musculus
cacaggctggcactagtggacaaca

SEQ ID NO: 411655 - DNA, 25 bp, Mus musculus
cacaggctgggaactatctggctca

SEQ ID NO: 411656 - DNA, 25 bp, Mus musculus
cacaggctgtgtgcagaccaggata

SEQ ID NO: 411657 - DNA, 25 bp, Mus musculus
cacaggcttctagggacagacacag

SEQ ID NO: 411658 - DNA, 25 bp, Mus musculus
cacagggaccattgttggaggccgc

SEQ ID NO: 411659 - DNA, 25 bp, Mus musculus
cacagggaggcaggtttctcggtca

SEQ ID NO: 411660 - DNA, 25 bp, Mus musculus
cacagggatcattgtggaattggac

SEQ ID NO: 411661 - DNA, 25 bp, Mus musculus
cacagggatgattagagggtctcac

SEQ ID NO: 411662 - DNA, 25 bp, Mus musculus
cacagggcatgtgtacgcaatgaaa

SEQ ID NO: 411663 - DNA, 25 bp, Mus musculus
cacagggcctgagacactgatgaat

SEQ ID NO: 411664 - DNA, 25 bp, Mus musculus
cacagggcgttagaaatggatggct

SEQ ID NO: 411665 - DNA, 25 bp, Mus musculus
cacagggctaaagaaagtgaccacc

SEQ ID NO: 411666 - DNA, 25 bp, Mus musculus
cacagggctggatttcccaagtcag

SEQ ID NO: 411667 - DNA, 25 bp, Mus musculus
cacagggctgtctttgtttaggctg

SEQ ID NO: 411668 - DNA, 25 bp, Mus musculus
cacagggtacatgtcacagtaagac

SEQ ID NO: 411669 - DNA, 25 bp, Mus musculus
cacagggtcagaaagcaatgcacag

SEQ ID NO: 411670 - DNA, 25 bp, Mus musculus
cacagggtgccgataatgatgaaac

SEQ ID NO: 411671 - DNA, 25 bp, Mus musculus
cacagggttcttgcagtaggtgaca

SEQ ID NO: 411672 - DNA, 25 bp, Mus musculus
cacaggtaaccttggcctctggaaa

SEQ ID NO: 411673 - DNA, 25 bp, Mus musculus
cacaggtaggatgttcagcttaata

SEQ ID NO: 411674 - DNA, 25 bp, Mus musculus
cacaggtgaccttgcaataaaaagc

SEQ ID NO: 411675 - DNA, 25 bp, Mus musculus
cacaggtgtgctctcagtgtacaca

SEQ ID NO: 411676 - DNA, 25 bp, Mus musculus
cacaggttagtgtctgagcacatgg

SEQ ID NO: 411677 - DNA, 25 bp, Mus musculus
cacaggttcctctcacctaagtggg

SEQ ID NO: 411678 - DNA, 25 bp, Mus musculus
cacaggttccttgccagagtactga

SEQ ID NO: 411679 - DNA, 25 bp, Mus musculus
cacaggttgacaacatgggcctgga

SEQ ID NO: 411680 - DNA, 25 bp, Mus musculus
cacaggttgccgatagggagtacac

SEQ ID NO: 411681 - DNA, 25 bp, Mus musculus
cacaggttggtcatgggttcccacc

SEQ ID NO: 411682 - DNA, 25 bp, Mus musculus
cacaggtttacttggcctgttgatg

SEQ ID NO: 411683 - DNA, 25 bp, Mus musculus
cacaggtttgaggagaccttccttt

SEQ ID NO: 411684 - DNA, 25 bp, Mus musculus
cacagtaaagcagtggaagccctca

SEQ ID NO: 411685 - DNA, 25 bp, Mus musculus
cacagtaactccctgagtatgaggg

SEQ ID NO: 411686 - DNA, 25 bp, Mus musculus
cacagtaactctacagatgggctta

SEQ ID NO: 411687 - DNA, 25 bp, Mus musculus
cacagtacaaaaggtggcccgggtg

SEQ ID NO: 411688 - DNA, 25 bp, Mus musculus
cacagtactatctcggtatgtaatc

SEQ ID NO: 411689 - DNA, 25 bp, Mus musculus
cacagtagatctggcctaatggcag

SEQ ID NO: 411690 - DNA, 25 bp, Mus musculus
cacagtagatggtacagaactgtat

SEQ ID NO: 411691 - DNA, 25 bp, Mus musculus
cacagtagcgaaaatgaccaggaga

SEQ ID NO: 411692 - DNA, 25 bp, Mus musculus
cacagtaggctggactggcccacat

SEQ ID NO: 411693 - DNA, 25 bp, Mus musculus
cacagtagggcattctattcgtcag

SEQ ID NO: 411694 - DNA, 25 bp, Mus musculus
cacagtagggccagataagaatcca

SEQ ID NO: 411695 - DNA, 25 bp, Mus musculus
cacagtatactcaagcgcagcaagc

SEQ ID NO: 411696 - DNA, 25 bp, Mus musculus
cacagtatcctggaggcatgaacta

SEQ ID NO: 411697 - DNA, 25 bp, Mus musculus
cacagtatgcgtatgctgcccagaa

SEQ ID NO: 411698 - DNA, 25 bp, Mus musculus
cacagtatggaaaaaagtgtcacct

SEQ ID NO: 411699 - DNA, 25 bp, Mus musculus
cacagtcactatgggctgctcatag

SEQ ID NO: 411700 - DNA, 25 bp, Mus musculus
cacagtcagcaacgtcaagatggac

SEQ ID NO: 411701 - DNA, 25 bp, Mus musculus
cacagtcagggtggtactaaactcc

SEQ ID NO: 411702 - DNA, 25 bp, Mus musculus
cacagtcatgtgatgcgcaaggaca

SEQ ID NO: 411703 - DNA, 25 bp, Mus musculus
cacagtccatgctgagaagggcggc

SEQ ID NO: 411704 - DNA, 25 bp, Mus musculus
cacagtccgaggttgtgactcacct

SEQ ID NO: 411705 - DNA, 25 bp, Mus musculus
cacagtcctcaaataccttctcaag

SEQ ID NO: 411706 - DNA, 25 bp, Mus musculus
cacagtccttcagcagatcagagag

SEQ ID NO: 411707 - DNA, 25 bp, Mus musculus
cacagtctactgcaagcctgggtca

SEQ ID NO: 411708 - DNA, 25 bp, Mus musculus
cacagtctcgttttgagtggaacca

SEQ ID NO: 411709 - DNA, 25 bp, Mus musculus
cacagtctctggaagttaaaggaag

SEQ ID NO: 411710 - DNA, 25 bp, Mus musculus
cacagtctgagtctgcctggagcaa

SEQ ID NO: 411711 - DNA, 25 bp, Mus musculus
cacagtcttccatgttgtgaccttt

SEQ ID NO: 411712 - DNA, 25 bp, Mus musculus
cacagtctttggacacggctgacag

SEQ ID NO: 411713 - DNA, 25 bp, Mus musculus
cacagtgaacccagggcagacactg

SEQ ID NO: 411714 - DNA, 25 bp, Mus musculus
cacagtgaagctgggcattttagac

SEQ ID NO: 411715 - DNA, 25 bp, Mus musculus
cacagtgaagtgacagcgagtctcc

SEQ ID NO: 411716 - DNA, 25 bp, Mus musculus
cacagtgaccgaaagctgggccagt

SEQ ID NO: 411717 - DNA, 25 bp, Mus musculus
cacagtgatagaatccagtgtgcac

SEQ ID NO: 411718 - DNA, 25 bp, Mus musculus
cacagtgatctttgttcagggaacg

SEQ ID NO: 411719 - DNA, 25 bp, Mus musculus
cacagtgcaaggagatgttcgggtc

SEQ ID NO: 411720 - DNA, 25 bp, Mus musculus
cacagtgcacactgggtaatcagca

SEQ ID NO: 411721 - DNA, 25 bp, Mus musculus
cacagtgcagccagagtgggatgac

SEQ ID NO: 411722 - DNA, 25 bp, Mus musculus
cacagtgccatcttatcgtagggaa

SEQ ID NO: 411723 - DNA, 25 bp, Mus musculus
cacagtgcccatgctacagtcggat

SEQ ID NO: 411724 - DNA, 25 bp, Mus musculus
cacagtgccctacggtggaagtcat

SEQ ID NO: 411725 - DNA, 25 bp, Mus musculus
cacagtgccggtggacttgagcttt

SEQ ID NO: 411726 - DNA, 25 bp, Mus musculus
cacagtgcgctcgaaggagaggatc

SEQ ID NO: 411727 - DNA, 25 bp, Mus musculus
cacagtgctcacgatcaagggtgtt

SEQ ID NO: 411728 - DNA, 25 bp, Mus musculus
cacagtggaatttgccgtgaacaca

SEQ ID NO: 411729 - DNA, 25 bp, Mus musculus
cacagtggagctctacaaaggcaga

SEQ ID NO: 411730 - DNA, 25 bp, Mus musculus
cacagtggagtctgcgtgcttaagg

SEQ ID NO: 411731 - DNA, 25 bp, Mus musculus
cacagtggatcacccagaagtggct

SEQ ID NO: 411732 - DNA, 25 bp, Mus musculus
cacagtggcttgctatgacattgag

SEQ ID NO: 411733 - DNA, 25 bp, Mus musculus
cacagtgggagccaggagaattcta

SEQ ID NO: 411734 - DNA, 25 bp, Mus musculus
cacagtgggcaagaacggcctctta

SEQ ID NO: 411735 - DNA, 25 bp, Mus musculus
cacagtgggcagtcaagtccgaatc

SEQ ID NO: 411736 - DNA, 25 bp, Mus musculus
cacagtgggcattaggtactcaggc

SEQ ID NO: 411737 - DNA, 25 bp, Mus musculus
cacagtgggcggtatctgccaggac

SEQ ID NO: 411738 - DNA, 25 bp, Mus musculus
cacagtggggctgcttaggtctcca

SEQ ID NO: 411739 - DNA, 25 bp, Mus musculus
cacagtggggctttgtctaaacaaa

SEQ ID NO: 411740 - DNA, 25 bp, Mus musculus
cacagtgggtaatgttaggtggcac

SEQ ID NO: 411741 - DNA, 25 bp, Mus musculus
cacagtggtcggaatggcttgcacc

SEQ ID NO: 411742 - DNA, 25 bp, Mus musculus
cacagtgtagaaatcaatggctcat

SEQ ID NO: 411743 - DNA, 25 bp, Mus musculus
cacagtgtatgaccatggtgtcaac

SEQ ID NO: 411744 - DNA, 25 bp, Mus musculus
cacagtgtatggtttggtcccttga

SEQ ID NO: 411745 - DNA, 25 bp, Mus musculus
cacagtgtcagagggagcaaatgcc

SEQ ID NO: 411746 - DNA, 25 bp, Mus musculus
cacagtgtgaaaacggaacccagag

SEQ ID NO: 411747 - DNA, 25 bp, Mus musculus
cacagtgtgggcgagcttcagcata

SEQ ID NO: 411748 - DNA, 25 bp, Mus musculus
cacagtgttgtgacatcctagaggc

SEQ ID NO: 411749 - DNA, 25 bp, Mus musculus
cacagttagacaacctgacgggcag

SEQ ID NO: 411750 - DNA, 25 bp, Mus musculus
cacagttcccagtgcatcttcttag

SEQ ID NO: 411751 - DNA, 25 bp, Mus musculus
cacagttcggactcgggaccgcgag

SEQ ID NO: 411752 - DNA, 25 bp, Mus musculus
cacagttcttctttccatgattggg

SEQ ID NO: 411753 - DNA, 25 bp, Mus musculus
cacagttgaatatctcccaggcatg

SEQ ID NO: 411754 - DNA, 25 bp, Mus musculus
cacagttgacccagtagctgcaggc

SEQ ID NO: 411755 - DNA, 25 bp, Mus musculus
cacagttgattattccaggagccac

SEQ ID NO: 411756 - DNA, 25 bp, Mus musculus
cacagttggaagctttggttaataa

SEQ ID NO: 411757 - DNA, 25 bp, Mus musculus
cacagttgttccgttgcgtggagca

SEQ ID NO: 411758 - DNA, 25 bp, Mus musculus
cacagtttagtactagctggcgtgg

SEQ ID NO: 411759 - DNA, 25 bp, Mus musculus
cacagtttccttgggtcatggcgca

SEQ ID NO: 411760 - DNA, 25 bp, Mus musculus
cacagtttctgtggaagggcgactc

SEQ ID NO: 411761 - DNA, 25 bp, Mus musculus
cacagtttgcgttagtcctgcgtaa

SEQ ID NO: 411762 - DNA, 25 bp, Mus musculus
cacagtttttacagagctcaggaga

SEQ ID NO: 411763 - DNA, 25 bp, Mus musculus
cacagtttttggtaagtcgccagca

SEQ ID NO: 411764 - DNA, 25 bp, Mus musculus
cacataaaatgtgaggaccccgctt

SEQ ID NO: 411765 - DNA, 25 bp, Mus musculus
cacataaacccgtctcctgggaaga

SEQ ID NO: 411766 - DNA, 25 bp, Mus musculus
cacataacacttggttgattggaat

SEQ ID NO: 411767 - DNA, 25 bp, Mus musculus
cacataagaggctggtatgaacaca

SEQ ID NO: 411768 - DNA, 25 bp, Mus musculus
cacataagttcgtcatgcggctgca

SEQ ID NO: 411769 - DNA, 25 bp, Mus musculus
cacataatgtggctggaagaatccc

SEQ ID NO: 411770 - DNA, 25 bp, Mus musculus
cacataatttggacctgcctaagca

SEQ ID NO: 411771 - DNA, 25 bp, Mus musculus
cacatacacagtaccgagaggttag

SEQ ID NO: 411772 - DNA, 25 bp, Mus musculus
cacatacagcaccacgaagagaaga

SEQ ID NO: 411773 - DNA, 25 bp, Mus musculus
cacataccaggtcagtgtttgctat

SEQ ID NO: 411774 - DNA, 25 bp, Mus musculus
cacataccattattttttgggccat

SEQ ID NO: 411775 - DNA, 25 bp, Mus musculus
cacatacgcatggagggctttgaca

SEQ ID NO: 411776 - DNA, 25 bp, Mus musculus
cacatacgttgggtcgaactgcaga

SEQ ID NO: 411777 - DNA, 25 bp, Mus musculus
cacatactatgaaccagtccactca

SEQ ID NO: 411778 - DNA, 25 bp, Mus musculus
cacatacttaaacctggccttcagg

SEQ ID NO: 411779 - DNA, 25 bp, Mus musculus
cacatagaccctgttagcggagaga

SEQ ID NO: 411780 - DNA, 25 bp, Mus musculus
cacatagacctcaataatggttcag

SEQ ID NO: 411781 - DNA, 25 bp, Mus musculus
cacatagactctgcagtagctcttg

SEQ ID NO: 411782 - DNA, 25 bp, Mus musculus
cacatagagtgaatgatgtattccc

SEQ ID NO: 411783 - DNA, 25 bp, Mus musculus
cacatagatgtaacgcgtgtcggaa

SEQ ID NO: 411784 - DNA, 25 bp, Mus musculus
cacatagctttaaataaaggcaacc

SEQ ID NO: 411785 - DNA, 25 bp, Mus musculus
cacatagggctcttcccaggagtcc

SEQ ID NO: 411786 - DNA, 25 bp, Mus musculus
cacataggtttaggactgtccctgg

SEQ ID NO: 411787 - DNA, 25 bp, Mus musculus
cacatagtagtaccccagtggtgct

SEQ ID NO: 411788 - DNA, 25 bp, Mus musculus
cacatagtagtgctttggaaaccct

SEQ ID NO: 411789 - DNA, 25 bp, Mus musculus
cacatagtcctgtacagtttgaggc

SEQ ID NO: 411790 - DNA, 25 bp, Mus musculus
cacatagtggcctcaggatgaagcc

SEQ ID NO: 411791 - DNA, 25 bp, Mus musculus
cacatagtgtcatctcggctgggta

SEQ ID NO: 411792 - DNA, 25 bp, Mus musculus
cacatatacatagtgttactagagc

SEQ ID NO: 411793 - DNA, 25 bp, Mus musculus
cacatcaagacagaataaacccacg

SEQ ID NO: 411794 - DNA, 25 bp, Mus musculus
cacatcaagcccaggttccctgctt

SEQ ID NO: 411795 - DNA, 25 bp, Mus musculus
cacatcagaatgcaggcgaggtcca

SEQ ID NO: 411796 - DNA, 25 bp, Mus musculus
cacatcagatcgttggagcagacca

SEQ ID NO: 411797 - DNA, 25 bp, Mus musculus
cacatcagatgctaaggagggcctg

SEQ ID NO: 411798 - DNA, 25 bp, Mus musculus
cacatcaggccagtgtatgagggag

SEQ ID NO: 411799 - DNA, 25 bp, Mus musculus
cacatcagtgaaggctattatctca

SEQ ID NO: 411800 - DNA, 25 bp, Mus musculus
cacatcagtgtgtttgagctctgct

SEQ ID NO: 411801 - DNA, 25 bp, Mus musculus
cacatcagttaggtccagggcatcc

SEQ ID NO: 411802 - DNA, 25 bp, Mus musculus
cacatccagtcctctacagtgtctg

SEQ ID NO: 411803 - DNA, 25 bp, Mus musculus
cacatccagttggtgaagtcacagg

SEQ ID NO: 411804 - DNA, 25 bp, Mus musculus
cacatccccggtgtgggaaaatgca

SEQ ID NO: 411805 - DNA, 25 bp, Mus musculus
cacatccgaaaggaggaagggtcct

SEQ ID NO: 411806 - DNA, 25 bp, Mus musculus
cacatccgagagtcaagagggtcat

SEQ ID NO: 411807 - DNA, 25 bp, Mus musculus
cacatccgcatcaagcacagtggga

SEQ ID NO: 411808 - DNA, 25 bp, Mus musculus
cacatccgcctgactgagcgggagg

SEQ ID NO: 411809 - DNA, 25 bp, Mus musculus
cacatccgggatcattgccagcaga

SEQ ID NO: 411810 - DNA, 25 bp, Mus musculus
cacatccttggaggccatcagacag

SEQ ID NO: 411811 - DNA, 25 bp, Mus musculus
cacatcctttgtgggcatcaccaag

SEQ ID NO: 411812 - DNA, 25 bp, Mus musculus
cacatcgaagcgttatggcctggga

SEQ ID NO: 411813 - DNA, 25 bp, Mus musculus
cacatcgccatagagaagaggagcc

SEQ ID NO: 411814 - DNA, 25 bp, Mus musculus
cacatcggaagctgggacatgagga

SEQ ID NO: 411815 - DNA, 25 bp, Mus musculus
cacatcggccagcaggaatggtact

SEQ ID NO: 411816 - DNA, 25 bp, Mus musculus
cacatcgtggaggaatggcttatca

SEQ ID NO: 411817 - DNA, 25 bp, Mus musculus
cacatcgttcgagactgagataaca

SEQ ID NO: 411818 - DNA, 25 bp, Mus musculus
cacatctagcattccagcattctgg

SEQ ID NO: 411819 - DNA, 25 bp, Mus musculus
cacatctcagaggagctgaccacga

SEQ ID NO: 411820 - DNA, 25 bp, Mus musculus
cacatctcgggtcttttgcacagcc

SEQ ID NO: 411821 - DNA, 25 bp, Mus musculus
cacatctctctctgcatggtggata

SEQ ID NO: 411822 - DNA, 25 bp, Mus musculus
cacatctgcattcattactaggtat

SEQ ID NO: 411823 - DNA, 25 bp, Mus musculus
cacatctggacctgctatgcgaagc

SEQ ID NO: 411824 - DNA, 25 bp, Mus musculus
cacatctggcagtaattgacacctc

SEQ ID NO: 411825 - DNA, 25 bp, Mus musculus
cacatctggccttttacgtgggttc

SEQ ID NO: 411826 - DNA, 25 bp, Mus musculus
cacatctgttaagaggcaaaaagaa

SEQ ID NO: 411827 - DNA, 25 bp, Mus musculus
cacatctgttgcagccgcttacaag

SEQ ID NO: 411828 - DNA, 25 bp, Mus musculus
cacatcttgcagtcttaaaaatgca

SEQ ID NO: 411829 - DNA, 25 bp, Mus musculus
cacatcttgttactcgggaatgaac

SEQ ID NO: 411830 - DNA, 25 bp, Mus musculus
cacatctttgggactctagctcaga

SEQ ID NO: 411831 - DNA, 25 bp, Mus musculus
cacatcttttcgacgcaacttcagc

SEQ ID NO: 411832 - DNA, 25 bp, Mus musculus
cacatgaagcctgctgagggaacct

SEQ ID NO: 411833 - DNA, 25 bp, Mus musculus
cacatgaagcctttgatttcaacat

SEQ ID NO: 411834 - DNA, 25 bp, Mus musculus
cacatgagcactctgccttttggaa

SEQ ID NO: 411835 - DNA, 25 bp, Mus musculus
cacatgagcgttcacaggccacacg

SEQ ID NO: 411836 - DNA, 25 bp, Mus musculus
cacatgaggagttgctggtgctcac

SEQ ID NO: 411837 - DNA, 25 bp, Mus musculus
cacatgatggcgatacgggagctca

SEQ ID NO: 411838 - DNA, 25 bp, Mus musculus
cacatgatttggttgctattggcaa

SEQ ID NO: 411839 - DNA, 25 bp, Mus musculus
cacatgcactttctttcccagggat

SEQ ID NO: 411840 - DNA, 25 bp, Mus musculus
cacatgcagccctcggtggatgaag

SEQ ID NO: 411841 - DNA, 25 bp, Mus musculus
cacatgcagtggaggtagtctgtca

SEQ ID NO: 411842 - DNA, 25 bp, Mus musculus
cacatgccagtggtggagaccttgc

SEQ ID NO: 411843 - DNA, 25 bp, Mus musculus
cacatgcccatgcttgtacacagag

SEQ ID NO: 411844 - DNA, 25 bp, Mus musculus
cacatgccttgcagtttcagacgac

SEQ ID NO: 411845 - DNA, 25 bp, Mus musculus
cacatgcggaagatgctggcatact

SEQ ID NO: 411846 - DNA, 25 bp, Mus musculus
cacatgcgtccatattgcacaggag

SEQ ID NO: 411847 - DNA, 25 bp, Mus musculus
cacatgctgactgggcaggccttaa

SEQ ID NO: 411848 - DNA, 25 bp, Mus musculus
cacatgcttagaattaagcggtgcc

SEQ ID NO: 411849 - DNA, 25 bp, Mus musculus
cacatgctttctgaggatggtgaca

SEQ ID NO: 411850 - DNA, 25 bp, Mus musculus
cacatggagatggtggaccagccac

SEQ ID NO: 411851 - DNA, 25 bp, Mus musculus
cacatggcaactcccatgttgggtt

SEQ ID NO: 411852 - DNA, 25 bp, Mus musculus
cacatggcagtcctgaaagagacac

SEQ ID NO: 411853 - DNA, 25 bp, Mus musculus
cacatggcagtgaggacaggaagct

SEQ ID NO: 411854 - DNA, 25 bp, Mus musculus
cacatggccctgatgaagctttcct

SEQ ID NO: 411855 - DNA, 25 bp, Mus musculus
cacatggcccttaggctaaagtcac

SEQ ID NO: 411856 - DNA, 25 bp, Mus musculus
cacatggcctccagctcgagggagt

SEQ ID NO: 411857 - DNA, 25 bp, Mus musculus
cacatggccttggtcatggacatca

SEQ ID NO: 411858 - DNA, 25 bp, Mus musculus
cacatggcgacctcacggagtttgg

SEQ ID NO: 411859 - DNA, 25 bp, Mus musculus
cacatggcggtcacagtcaggcttg

SEQ ID NO: 411860 - DNA, 25 bp, Mus musculus
cacatggctgctacctttctgaaga

SEQ ID NO: 411861 - DNA, 25 bp, Mus musculus
cacatgggaacaagtggccctggca

SEQ ID NO: 411862 - DNA, 25 bp, Mus musculus
cacatgggaagcataggcagatgga

SEQ ID NO: 411863 - DNA, 25 bp, Mus musculus
cacatgggacagatctgctgcagag

SEQ ID NO: 411864 - DNA, 25 bp, Mus musculus
cacatgggtgctatgaggctgatga

SEQ ID NO: 411865 - DNA, 25 bp, Mus musculus
cacatggtacaatacgagggcccag

SEQ ID NO: 411866 - DNA, 25 bp, Mus musculus
cacatggtccctttggcttgaagcc

SEQ ID NO: 411867 - DNA, 25 bp, Mus musculus
cacatggtgatggatgactgcagcc

SEQ ID NO: 411868 - DNA, 25 bp, Mus musculus
cacatgtaagaagtgcgggaaattc

SEQ ID NO: 411869 - DNA, 25 bp, Mus musculus
cacatgtacccttaaaatagaagag

SEQ ID NO: 411870 - DNA, 25 bp, Mus musculus
cacatgtacctgttctgtaccaatg

SEQ ID NO: 411871 - DNA, 25 bp, Mus musculus
cacatgtacggaacacagggataaa

SEQ ID NO: 411872 - DNA, 25 bp, Mus musculus
cacatgtactcactgggtccaaggg

SEQ ID NO: 411873 - DNA, 25 bp, Mus musculus
cacatgtagaaaatgctgcgagcga

SEQ ID NO: 411874 - DNA, 25 bp, Mus musculus
cacatgtaggtagttgtagaattca

SEQ ID NO: 411875 - DNA, 25 bp, Mus musculus
cacatgtattgatggcgccgtgggc

SEQ ID NO: 411876 - DNA, 25 bp, Mus musculus
cacatgtcaacagcaggctcctgag

SEQ ID NO: 411877 - DNA, 25 bp, Mus musculus
cacatgtcacctaggcaaaaggcct

SEQ ID NO: 411878 - DNA, 25 bp, Mus musculus
cacatgtcagagagaaaggcaggta

SEQ ID NO: 411879 - DNA, 25 bp, Mus musculus
cacatgtccaaacacacagtggtgg

SEQ ID NO: 411880 - DNA, 25 bp, Mus musculus
cacatgtcggtggtggacctgttca

SEQ ID NO: 411881 - DNA, 25 bp, Mus musculus
cacatgtgcatggtaatgcgaggcg

SEQ ID NO: 411882 - DNA, 25 bp, Mus musculus
cacatgtgccacagcttgtgcaagt

SEQ ID NO: 411883 - DNA, 25 bp, Mus musculus
cacatgtggagagttgcgttcgtcc

SEQ ID NO: 411884 - DNA, 25 bp, Mus musculus
cacatgtgggtatctgctacttctc

SEQ ID NO: 411885 - DNA, 25 bp, Mus musculus
cacatgtgtctatgaggtcactgct

SEQ ID NO: 411886 - DNA, 25 bp, Mus musculus
cacatgtgtggattgctcccgtgag

SEQ ID NO: 411887 - DNA, 25 bp, Mus musculus
cacatgtgtttgagcttaacgcagg

SEQ ID NO: 411888 - DNA, 25 bp, Mus musculus
cacatgttcaacagcaagcaggtca

SEQ ID NO: 411889 - DNA, 25 bp, Mus musculus
cacatgttcccaactgggccaagag

SEQ ID NO: 411890 - DNA, 25 bp, Mus musculus
cacatgttctgaataggctggctca

SEQ ID NO: 411891 - DNA, 25 bp, Mus musculus
cacatgttgaaggtctccagcggct

SEQ ID NO: 411892 - DNA, 25 bp, Mus musculus
cacattaaaagcaaacggtcttccg

SEQ ID NO: 411893 - DNA, 25 bp, Mus musculus
cacattactgggacgctaactggga

SEQ ID NO: 411894 - DNA, 25 bp, Mus musculus
cacattacttcaggaggaggttaca

SEQ ID NO: 411895 - DNA, 25 bp, Mus musculus
cacattagcaagatggagccggcag

SEQ ID NO: 411896 - DNA, 25 bp, Mus musculus
cacattaggcaacctggagggagca

SEQ ID NO: 411897 - DNA, 25 bp, Mus musculus
cacattagggcttgaaagtggcctc

SEQ ID NO: 411898 - DNA, 25 bp, Mus musculus
cacattaggtcttccttcgtgtccc

SEQ ID NO: 411899 - DNA, 25 bp, Mus musculus
cacattaggtgtctcgaaggaactc

SEQ ID NO: 411900 - DNA, 25 bp, Mus musculus
cacattagttttaacagctgcatca

SEQ ID NO: 411901 - DNA, 25 bp, Mus musculus
cacattataaggatggcctcggcca

SEQ ID NO: 411902 - DNA, 25 bp, Mus musculus
cacattcaacttacagggcagagcc

SEQ ID NO: 411903 - DNA, 25 bp, Mus musculus
cacattcagaggcatgatccaggct

SEQ ID NO: 411904 - DNA, 25 bp, Mus musculus
cacattcatcacaaccctggaggag

SEQ ID NO: 411905 - DNA, 25 bp, Mus musculus
cacattcatggagacagcgagcttt

SEQ ID NO: 411906 - DNA, 25 bp, Mus musculus
cacattcccagaagtttgtaagtga

SEQ ID NO: 411907 - DNA, 25 bp, Mus musculus
cacattcctttgaggttgaccatga

SEQ ID NO: 411908 - DNA, 25 bp, Mus musculus
cacattcgacaacaggaaaggagcc

SEQ ID NO: 411909 - DNA, 25 bp, Mus musculus
cacattcgtgaaaaagactgagtcc

SEQ ID NO: 411910 - DNA, 25 bp, Mus musculus
cacattctctggaacccggagtctg

SEQ ID NO: 411911 - DNA, 25 bp, Mus musculus
cacattctgagcttggtgtctcacc

SEQ ID NO: 411912 - DNA, 25 bp, Mus musculus
cacattctgatggtggagcttcgag

SEQ ID NO: 411913 - DNA, 25 bp, Mus musculus
cacattctggctgatcccgtggaga

SEQ ID NO: 411914 - DNA, 25 bp, Mus musculus
cacattctgggatgtggatggaagc

SEQ ID NO: 411915 - DNA, 25 bp, Mus musculus
cacattctgtccaggaagggcggcg

SEQ ID NO: 411916 - DNA, 25 bp, Mus musculus
cacattcttaggactggagcctgga

SEQ ID NO: 411917 - DNA, 25 bp, Mus musculus
cacattcttgtgacctggctttgat

SEQ ID NO: 411918 - DNA, 25 bp, Mus musculus
cacattgacagagcatacagagaag

SEQ ID NO: 411919 - DNA, 25 bp, Mus musculus
cacattgacagggaacaggagttta

SEQ ID NO: 411920 - DNA, 25 bp, Mus musculus
cacattgagcctatcagccagggta

SEQ ID NO: 411921 - DNA, 25 bp, Mus musculus
cacattgaggctaactgggctggct

SEQ ID NO: 411922 - DNA, 25 bp, Mus musculus
cacattgatgaaaggctaggactct

SEQ ID NO: 411923 - DNA, 25 bp, Mus musculus
cacattgcaaagcttgttggaccca

SEQ ID NO: 411924 - DNA, 25 bp, Mus musculus
cacattgctgccagtgaacaggtct

SEQ ID NO: 411925 - DNA, 25 bp, Mus musculus
cacattggaatctaggctctgcata

SEQ ID NO: 411926 - DNA, 25 bp, Mus musculus
cacattggcatggatgaccggcgtc

SEQ ID NO: 411927 - DNA, 25 bp, Mus musculus
cacattggcctttgaggaacattct

SEQ ID NO: 411928 - DNA, 25 bp, Mus musculus
cacattggctgtggtgcttggcgcc

SEQ ID NO: 411929 - DNA, 25 bp, Mus musculus
cacattgtgactccggactggctgg

SEQ ID NO: 411930 - DNA, 25 bp, Mus musculus
cacattgttagcagagcctgagggc

SEQ ID NO: 411931 - DNA, 25 bp, Mus musculus
cacatttagctgagaatcttgactt

SEQ ID NO: 411932 - DNA, 25 bp, Mus musculus
cacatttcggagaacaaggagtttc

SEQ ID NO: 411933 - DNA, 25 bp, Mus musculus
cacatttgacctggagcggtaccga

SEQ ID NO: 411934 - DNA, 25 bp, Mus musculus
cacatttgaggctttcgctggtaca

SEQ ID NO: 411935 - DNA, 25 bp, Mus musculus
cacatttgagtgaagagagacatac

SEQ ID NO: 411936 - DNA, 25 bp, Mus musculus
cacatttgccggatttgccagctgc

SEQ ID NO: 411937 - DNA, 25 bp, Mus musculus
cacatttggacccacagaggttcaa

SEQ ID NO: 411938 - DNA, 25 bp, Mus musculus
cacatttggtgttgcctgcttctct

SEQ ID NO: 411939 - DNA, 25 bp, Mus musculus
cacatttgtagctggaatgccctcc

SEQ ID NO: 411940 - DNA, 25 bp, Mus musculus
cacattttaacagggcagctggcca

SEQ ID NO: 411941 - DNA, 25 bp, Mus musculus
caccaaaagtcctgcggcgtttcga

SEQ ID NO: 411942 - DNA, 25 bp, Mus musculus
caccaaaagtgagtattcccaggct

SEQ ID NO: 411943 - DNA, 25 bp, Mus musculus
caccaaaatagaagccaggtatggc

SEQ ID NO: 411944 - DNA, 25 bp, Mus musculus
caccaaaatggcgagctgggctgcg

SEQ ID NO: 411945 - DNA, 25 bp, Mus musculus
caccaaagaaaggtctcaagatccc

SEQ ID NO: 411946 - DNA, 25 bp, Mus musculus
caccaaagcagtccgtaaaagacaa

SEQ ID NO: 411947 - DNA, 25 bp, Mus musculus
caccaaagtgaaaggcagatccgca

SEQ ID NO: 411948 - DNA, 25 bp, Mus musculus
caccaaagtggagcagttcagacca

SEQ ID NO: 411949 - DNA, 25 bp, Mus musculus
caccaaagtttctgaaccgccaggt

SEQ ID NO: 411950 - DNA, 25 bp, Mus musculus
caccaacaggacagagaccgatact

SEQ ID NO: 411951 - DNA, 25 bp, Mus musculus
caccaagaagacatcgatgcttcaa

SEQ ID NO: 411952 - DNA, 25 bp, Mus musculus
caccaagaaggacattaaggccgcg

SEQ ID NO: 411953 - DNA, 25 bp, Mus musculus
caccaagagagggacctttgtacca

SEQ ID NO: 411954 - DNA, 25 bp, Mus musculus
caccaagcctaggtgataatttcca

SEQ ID NO: 411955 - DNA, 25 bp, Mus musculus
caccaaggaaattgcaggaagggct

SEQ ID NO: 411956 - DNA, 25 bp, Mus musculus
caccaaggagttgtctgctgccact

SEQ ID NO: 411957 - DNA, 25 bp, Mus musculus
caccaagggtgtttttgcagggcca

SEQ ID NO: 411958 - DNA, 25 bp, Mus musculus
caccaaggtatcgtgggctaaagat

SEQ ID NO: 411959 - DNA, 25 bp, Mus musculus
caccaaggtgatgggcgccgtgcct

SEQ ID NO: 411960 - DNA, 25 bp, Mus musculus
caccaaggtgtgcaagtatgtgaac

SEQ ID NO: 411961 - DNA, 25 bp, Mus musculus
caccaagtcccatcagaaaagcatt

SEQ ID NO: 411962 - DNA, 25 bp, Mus musculus
caccaagtggcaaaggaactgctca

SEQ ID NO: 411963 - DNA, 25 bp, Mus musculus
caccaagtgtgaaggcagcagagtc

SEQ ID NO: 411964 - DNA, 25 bp, Mus musculus
caccaagttggagcctagggaagag

SEQ ID NO: 411965 - DNA, 25 bp, Mus musculus
caccaagtttcttcaggccgcgttc

SEQ ID NO: 411966 - DNA, 25 bp, Mus musculus
caccaatcatgcctcaagcgctgga

SEQ ID NO: 411967 - DNA, 25 bp, Mus musculus
caccaatcggcatttgtaaacagga

SEQ ID NO: 411968 - DNA, 25 bp, Mus musculus
caccaatcggttctctcggaatcag

SEQ ID NO: 411969 - DNA, 25 bp, Mus musculus
caccaatgaacgtagaaggctgctg

SEQ ID NO: 411970 - DNA, 25 bp, Mus musculus
caccacaactatgcgggagatcctt

SEQ ID NO: 411971 - DNA, 25 bp, Mus musculus
caccacagcggctgggatggcagac

SEQ ID NO: 411972 - DNA, 25 bp, Mus musculus
caccacagtgagtcaggtggtgtga

SEQ ID NO: 411973 - DNA, 25 bp, Mus musculus
caccaccaggattggagtgctctag

SEQ ID NO: 411974 - DNA, 25 bp, Mus musculus
caccaccctcaatttgtaaacgagg

SEQ ID NO: 411975 - DNA, 25 bp, Mus musculus
caccaccctggagtttgaaaatgtg

SEQ ID NO: 411976 - DNA, 25 bp, Mus musculus
caccaccgctatgtttgtaggaggc

SEQ ID NO: 411977 - DNA, 25 bp, Mus musculus
caccaccgtggtgatcactcttgtt

SEQ ID NO: 411978 - DNA, 25 bp, Mus musculus
caccacctgatccattgtaatgaca

SEQ ID NO: 411979 - DNA, 25 bp, Mus musculus
caccacgggagaccctggcgcatgt

SEQ ID NO: 411980 - DNA, 25 bp, Mus musculus
caccacggtgcttgaatctccacat

SEQ ID NO: 411981 - DNA, 25 bp, Mus musculus
caccactccttaccgttgttgagaa

SEQ ID NO: 411982 - DNA, 25 bp, Mus musculus
caccactggaagatcgatgacaaga

SEQ ID NO: 411983 - DNA, 25 bp, Mus musculus
caccactgtccctggatggagaact

SEQ ID NO: 411984 - DNA, 25 bp, Mus musculus
caccactgtggagatcttcttgacg

SEQ ID NO: 411985 - DNA, 25 bp, Mus musculus
caccacttcttattgttctggaagc

SEQ ID NO: 411986 - DNA, 25 bp, Mus musculus
caccagaaagctcttatgatctcca

SEQ ID NO: 411987 - DNA, 25 bp, Mus musculus
caccagaagttgtaccaggaccagg

SEQ ID NO: 411988 - DNA, 25 bp, Mus musculus
caccagacgcgttagcctttgaaga

SEQ ID NO: 411989 - DNA, 25 bp, Mus musculus
caccagagaggatgggctcaagtac

SEQ ID NO: 411990 - DNA, 25 bp, Mus musculus
caccagagagtcactttattgctgt

SEQ ID NO: 411991 - DNA, 25 bp, Mus musculus
caccagagccactgatgggacaagt

SEQ ID NO: 411992 - DNA, 25 bp, Mus musculus
caccagagcttatccagtgtgtcag

SEQ ID NO: 411993 - DNA, 25 bp, Mus musculus
caccagatttcaggcgtttaaaagc

SEQ ID NO: 411994 - DNA, 25 bp, Mus musculus
caccagcacctgagtatattctaac

SEQ ID NO: 411995 - DNA, 25 bp, Mus musculus
caccagcagaagagatgactaagaa

SEQ ID NO: 411996 - DNA, 25 bp, Mus musculus
caccagcagtgtctgagggttccaa

SEQ ID NO: 411997 - DNA, 25 bp, Mus musculus
caccagccagtatctttgccaggag

SEQ ID NO: 411998 - DNA, 25 bp, Mus musculus
caccagccatagtgaccaccaagat

SEQ ID NO: 411999 - DNA, 25 bp, Mus musculus
caccagccatcaggttcaacagaga

SEQ ID NO: 412000 - DNA, 25 bp, Mus musculus
caccagcgagagtcatcaaagagcc

SEQ ID NO: 412001 - DNA, 25 bp, Mus musculus
caccagcgcccggatagagtacttg

SEQ ID NO: 412002 - DNA, 25 bp, Mus musculus
caccagcgtagatgtggaccagcca

SEQ ID NO: 412003 - DNA, 25 bp, Mus musculus
caccagctttcgtttatgggcagag

SEQ ID NO: 412004 - DNA, 25 bp, Mus musculus
caccaggagatgcacgcagaggatc

SEQ ID NO: 412005 - DNA, 25 bp, Mus musculus
caccaggaggttctagcaaggtcac

SEQ ID NO: 412006 - DNA, 25 bp, Mus musculus
caccaggatgcgttggaactgatca

SEQ ID NO: 412007 - DNA, 25 bp, Mus musculus
caccaggcacaaatctaggacacca

SEQ ID NO: 412008 - DNA, 25 bp, Mus musculus
caccaggcactattaactttctgac

SEQ ID NO: 412009 - DNA, 25 bp, Mus musculus
caccaggcatgtgaggtagctctag

SEQ ID NO: 412010 - DNA, 25 bp, Mus musculus
caccaggccaaagctctcaagaaag

SEQ ID NO: 412011 - DNA, 25 bp, Mus musculus
caccaggccccatttgttgtgctga

SEQ ID NO: 412012 - DNA, 25 bp, Mus musculus
caccaggcggtagaagagatcctca

SEQ ID NO: 412013 - DNA, 25 bp, Mus musculus
caccaggctgggagaagcgtatgag

SEQ ID NO: 412014 - DNA, 25 bp, Mus musculus
caccagggacacatggagtggctct

SEQ ID NO: 412015 - DNA, 25 bp, Mus musculus
caccagggcctgtatttcaatgaca

SEQ ID NO: 412016 - DNA, 25 bp, Mus musculus
caccagggtactggatttcaggaca

SEQ ID NO: 412017 - DNA, 25 bp, Mus musculus
caccagggtccctattgaagaggct

SEQ ID NO: 412018 - DNA, 25 bp, Mus musculus
caccagggtgactggtgccagtaga

SEQ ID NO: 412019 - DNA, 25 bp, Mus musculus
caccaggtacagcaggacgatgtca

SEQ ID NO: 412020 - DNA, 25 bp, Mus musculus
caccaggtgagtatgcgtagctttc

SEQ ID NO: 412021 - DNA, 25 bp, Mus musculus
caccaggttaccttggatgtggagt

SEQ ID NO: 412022 - DNA, 25 bp, Mus musculus
caccaggtttagaattgccgtcatg

SEQ ID NO: 412023 - DNA, 25 bp, Mus musculus
caccagtaacgtttccttatttctg

SEQ ID NO: 412024 - DNA, 25 bp, Mus musculus
caccagtaatttctgaagaggctgc

SEQ ID NO: 412025 - DNA, 25 bp, Mus musculus
caccagtagaggatgaagaaccaaa

SEQ ID NO: 412026 - DNA, 25 bp, Mus musculus
caccagtagatgtatggaaccaaca

SEQ ID NO: 412027 - DNA, 25 bp, Mus musculus
caccagtagtcggtgtccctgggaa

SEQ ID NO: 412028 - DNA, 25 bp, Mus musculus
caccagtagtgccttcctggaagct

SEQ ID NO: 412029 - DNA, 25 bp, Mus musculus
caccagtccagattacattcctaga

SEQ ID NO: 412030 - DNA, 25 bp, Mus musculus
caccagtggtgggtgcatcaagccg

SEQ ID NO: 412031 - DNA, 25 bp, Mus musculus
caccagtgtctacttcagcagagca

SEQ ID NO: 412032 - DNA, 25 bp, Mus musculus
caccagtgtgaaaaacaagcatcag

SEQ ID NO: 412033 - DNA, 25 bp, Mus musculus
caccagtttcctgtgaggtcccgga

SEQ ID NO: 412034 - DNA, 25 bp, Mus musculus
caccagttttcaaaggcgcagagca

SEQ ID NO: 412035 - DNA, 25 bp, Mus musculus
caccataaggacaagggaggcgttc

SEQ ID NO: 412036 - DNA, 25 bp, Mus musculus
caccataggtaggacacgaagctta

SEQ ID NO: 412037 - DNA, 25 bp, Mus musculus
caccatatgggcagtttccacgatg

SEQ ID NO: 412038 - DNA, 25 bp, Mus musculus
caccatccagattaccaattccaag

SEQ ID NO: 412039 - DNA, 25 bp, Mus musculus
caccatcctagggatctgcaagaca

SEQ ID NO: 412040 - DNA, 25 bp, Mus musculus
caccatcctgtgtggcgtgacttct

SEQ ID NO: 412041 - DNA, 25 bp, Mus musculus
caccatcggcagaacaaattgactt

SEQ ID NO: 412042 - DNA, 25 bp, Mus musculus
caccatcggcttttgcccgtacggg

SEQ ID NO: 412043 - DNA, 25 bp, Mus musculus
caccatcgtgcatgtgggcgacaaa

SEQ ID NO: 412044 - DNA, 25 bp, Mus musculus
caccatcgtggccaaatgctgagaa

SEQ ID NO: 412045 - DNA, 25 bp, Mus musculus
caccatctctaatgaaggcagtgag

SEQ ID NO: 412046 - DNA, 25 bp, Mus musculus
caccatgactgatgaacgtttgcgc

SEQ ID NO: 412047 - DNA, 25 bp, Mus musculus
caccatgactgtatccgagaagggc

SEQ ID NO: 412048 - DNA, 25 bp, Mus musculus
caccatgagaaagcggtagagctac

SEQ ID NO: 412049 - DNA, 25 bp, Mus musculus
caccatgatggaggagatcgaccgg

SEQ ID NO: 412050 - DNA, 25 bp, Mus musculus
caccatgatttttatgggctaccaa

SEQ ID NO: 412051 - DNA, 25 bp, Mus musculus
caccatgcactacgttactaaactg

SEQ ID NO: 412052 - DNA, 25 bp, Mus musculus
caccatgcatggactgacgggcaag

SEQ ID NO: 412053 - DNA, 25 bp, Mus musculus
caccatgccttagctgcaggagcag

SEQ ID NO: 412054 - DNA, 25 bp, Mus musculus
caccatgcggttgttcaagtagaca

SEQ ID NO: 412055 - DNA, 25 bp, Mus musculus
caccatgcttaatattgagatgttc

SEQ ID NO: 412056 - DNA, 25 bp, Mus musculus
caccatggaagtagaagcgaaggac

SEQ ID NO: 412057 - DNA, 25 bp, Mus musculus
caccatggatagagctgacaccaac

SEQ ID NO: 412058 - DNA, 25 bp, Mus musculus
caccatggcaggaggactgtttgct

SEQ ID NO: 412059 - DNA, 25 bp, Mus musculus
caccatggctggcaagaaagtctgc

SEQ ID NO: 412060 - DNA, 25 bp, Mus musculus
caccatggtctgttaagggacagcc

SEQ ID NO: 412061 - DNA, 25 bp, Mus musculus
caccatggtcttgcggatgctcgga

SEQ ID NO: 412062 - DNA, 25 bp, Mus musculus
caccatggttcagcagtatagcaag

SEQ ID NO: 412063 - DNA, 25 bp, Mus musculus
caccatgtagtgcttctggcggccc

SEQ ID NO: 412064 - DNA, 25 bp, Mus musculus
caccatgtatatatgaagctgagca

SEQ ID NO: 412065 - DNA, 25 bp, Mus musculus
caccattacaaaggtccctttcagg

SEQ ID NO: 412066 - DNA, 25 bp, Mus musculus
caccattacggtcggcgtgtacgag

SEQ ID NO: 412067 - DNA, 25 bp, Mus musculus
caccattataggaggcggagatact

SEQ ID NO: 412068 - DNA, 25 bp, Mus musculus
caccattcagtgaacagccctgtca

SEQ ID NO: 412069 - DNA, 25 bp, Mus musculus
caccattcggctgctgatgcacgga

SEQ ID NO: 412070 - DNA, 25 bp, Mus musculus
caccattctggacatgtcagcccgg

SEQ ID NO: 412071 - DNA, 25 bp, Mus musculus
caccattggaggatttagagttagg

SEQ ID NO: 412072 - DNA, 25 bp, Mus musculus
caccattggagggtgatcaacagca

SEQ ID NO: 412073 - DNA, 25 bp, Mus musculus
caccattggcatagaggagaacgga

SEQ ID NO: 412074 - DNA, 25 bp, Mus musculus
caccattggtaagtcagctccttgt

SEQ ID NO: 412075 - DNA, 25 bp, Mus musculus
cacccaaatcttgtgtgtttaccca

SEQ ID NO: 412076 - DNA, 25 bp, Mus musculus
cacccaagaggaaggaacagagttt

SEQ ID NO: 412077 - DNA, 25 bp, Mus musculus
cacccacagccggtatgaggagcat

SEQ ID NO: 412078 - DNA, 25 bp, Mus musculus
cacccaccggagaatgggaagccga

SEQ ID NO: 412079 - DNA, 25 bp, Mus musculus
cacccacggagctgacagaaatgcg

SEQ ID NO: 412080 - DNA, 25 bp, Mus musculus
cacccacgggattagttttgcaagc

SEQ ID NO: 412081 - DNA, 25 bp, Mus musculus
cacccacgggcaggaaatgttctac

SEQ ID NO: 412082 - DNA, 25 bp, Mus musculus
cacccactctcttgttggagacaaa

SEQ ID NO: 412083 - DNA, 25 bp, Mus musculus
cacccactgcaggatgtgttgatac

SEQ ID NO: 412084 - DNA, 25 bp, Mus musculus
cacccactgctttggctttggacca

SEQ ID NO: 412085 - DNA, 25 bp, Mus musculus
cacccactggtgtcctatgaagaac

SEQ ID NO: 412086 - DNA, 25 bp, Mus musculus
cacccagacaatacgcggaacactt

SEQ ID NO: 412087 - DNA, 25 bp, Mus musculus
cacccagacgttggcggatgatgtg

SEQ ID NO: 412088 - DNA, 25 bp, Mus musculus
cacccagaggctaaggaatcagtca

SEQ ID NO: 412089 - DNA, 25 bp, Mus musculus
cacccagctttgcaaggattttgga

SEQ ID NO: 412090 - DNA, 25 bp, Mus musculus
cacccaggactgcttaggaacagga

SEQ ID NO: 412091 - DNA, 25 bp, Mus musculus
cacccaggagttgcaacggaagaaa

SEQ ID NO: 412092 - DNA, 25 bp, Mus musculus
cacccaggccttcagagtcagatgt

SEQ ID NO: 412093 - DNA, 25 bp, Mus musculus
cacccaggctgaacttgagaagata

SEQ ID NO: 412094 - DNA, 25 bp, Mus musculus
cacccagggtgtggcaagacttact

SEQ ID NO: 412095 - DNA, 25 bp, Mus musculus
cacccaggtagaggatgtggagaac

SEQ ID NO: 412096 - DNA, 25 bp, Mus musculus
cacccaggtagctgaaattgtggcc

SEQ ID NO: 412097 - DNA, 25 bp, Mus musculus
cacccagtcaaggatgtcagaggga

SEQ ID NO: 412098 - DNA, 25 bp, Mus musculus
cacccagtgtgctacaagagctcaa

SEQ ID NO: 412099 - DNA, 25 bp, Mus musculus
cacccatagcataggaggacgtagg

SEQ ID NO: 412100 - DNA, 25 bp, Mus musculus
cacccatagtgtgggggcgacagta

SEQ ID NO: 412101 - DNA, 25 bp, Mus musculus
cacccatgcagatttctaggcagag

SEQ ID NO: 412102 - DNA, 25 bp, Mus musculus
cacccattgataagggcttggtacg

SEQ ID NO: 412103 - DNA, 25 bp, Mus musculus
caccccaaaggagattgctggaaga

SEQ ID NO: 412104 - DNA, 25 bp, Mus musculus
caccccaactgtctgtgctagtctg

SEQ ID NO: 412105 - DNA, 25 bp, Mus musculus
caccccagtggaaactcctggaaag

SEQ ID NO: 412106 - DNA, 25 bp, Mus musculus
caccccatagccagatgctgcagtg

SEQ ID NO: 412107 - DNA, 25 bp, Mus musculus
caccccatgaacaatgaaagcaaaa

SEQ ID NO: 412108 - DNA, 25 bp, Mus musculus
caccccgagggcagttttccaagag

SEQ ID NO: 412109 - DNA, 25 bp, Mus musculus
caccccggcttcttgaagacaaaga

SEQ ID NO: 412110 - DNA, 25 bp, Mus musculus
caccccgtgctctgggagatgggaa

SEQ ID NO: 412111 - DNA, 25 bp, Mus musculus
cacccctgggtagatgatatttgac

SEQ ID NO: 412112 - DNA, 25 bp, Mus musculus
cacccctttgggaagctcagagtta

SEQ ID NO: 412113 - DNA, 25 bp, Mus musculus
cacccgaagccagtttgaggaggca

SEQ ID NO: 412114 - DNA, 25 bp, Mus musculus
cacccgagcttcagtcgatggcctg

SEQ ID NO: 412115 - DNA, 25 bp, Mus musculus
cacccgcatgggaaaggactacgaa

SEQ ID NO: 412116 - DNA, 25 bp, Mus musculus
cacccggacaagagaagaatgagct

SEQ ID NO: 412117 - DNA, 25 bp, Mus musculus
cacccggagagagaagaaatgatgc

SEQ ID NO: 412118 - DNA, 25 bp, Mus musculus
cacccggctgcagttcaagatagta

SEQ ID NO: 412119 - DNA, 25 bp, Mus musculus
cacccgggagctttttggcatacag

SEQ ID NO: 412120 - DNA, 25 bp, Mus musculus
cacccgggctagttgttcttctgaa

SEQ ID NO: 412121 - DNA, 25 bp, Mus musculus
cacccgggtgataggaggaccagtc

SEQ ID NO: 412122 - DNA, 25 bp, Mus musculus
cacccggtgcctgttagtttcgaga

SEQ ID NO: 412123 - DNA, 25 bp, Mus musculus
cacccgtaagaggtttgacagccga

SEQ ID NO: 412124 - DNA, 25 bp, Mus musculus
cacccgtagggacattcctcgtgga

SEQ ID NO: 412125 - DNA, 25 bp, Mus musculus
cacccgtatctggagtaagctgagg

SEQ ID NO: 412126 - DNA, 25 bp, Mus musculus
caccctactgaagaattttgctttg

SEQ ID NO: 412127 - DNA, 25 bp, Mus musculus
caccctagatgttactctgccttag

SEQ ID NO: 412128 - DNA, 25 bp, Mus musculus
caccctcaggatcagcagatagaag

SEQ ID NO: 412129 - DNA, 25 bp, Mus musculus
caccctcctgtttgaaagacggcaa

SEQ ID NO: 412130 - DNA, 25 bp, Mus musculus
caccctcgtgtgtgggaggattccc

SEQ ID NO: 412131 - DNA, 25 bp, Mus musculus
caccctctagatcgtggagccgaga

SEQ ID NO: 412132 - DNA, 25 bp, Mus musculus
caccctgaaggactggaagagagcc

SEQ ID NO: 412133 - DNA, 25 bp, Mus musculus
caccctgcctttagactcctggtta

SEQ ID NO: 412134 - DNA, 25 bp, Mus musculus
caccctgcggaaactgcgcagattt

SEQ ID NO: 412135 - DNA, 25 bp, Mus musculus
caccctgggaagtaccagacagcca

SEQ ID NO: 412136 - DNA, 25 bp, Mus musculus
caccctgggcagttacgtcatgctc

SEQ ID NO: 412137 - DNA, 25 bp, Mus musculus
caccctgggtgaacatctggctgct

SEQ ID NO: 412138 - DNA, 25 bp, Mus musculus
caccctggtggaagaagcttggaga

SEQ ID NO: 412139 - DNA, 25 bp, Mus musculus
caccctgtattgtttctgtagcctc

SEQ ID NO: 412140 - DNA, 25 bp, Mus musculus
caccctgtgggtttacttcaacaga

SEQ ID NO: 412141 - DNA, 25 bp, Mus musculus
caccctgttgtggacttgataaagc

SEQ ID NO: 412142 - DNA, 25 bp, Mus musculus
cacccttgtgatttggactctgagg

SEQ ID NO: 412143 - DNA, 25 bp, Mus musculus
cacccttgttaagcatttatgacta

SEQ ID NO: 412144 - DNA, 25 bp, Mus musculus
caccctttgaggtcaagatccgaag

SEQ ID NO: 412145 - DNA, 25 bp, Mus musculus
caccctttgtggttgaggtccctga

SEQ ID NO: 412146 - DNA, 25 bp, Mus musculus
caccgaatgctttgggcgtaggctc

SEQ ID NO: 412147 - DNA, 25 bp, Mus musculus
caccgaccctgatggcattggcgtt

SEQ ID NO: 412148 - DNA, 25 bp, Mus musculus
caccgagagtggatgctgaacttca

SEQ ID NO: 412149 - DNA, 25 bp, Mus musculus
caccgagatcttacagggagaagca

SEQ ID NO: 412150 - DNA, 25 bp, Mus musculus
caccgagctgtccactagagtcact

SEQ ID NO: 412151 - DNA, 25 bp, Mus musculus
caccgaggaccagactgacaaaggg

SEQ ID NO: 412152 - DNA, 25 bp, Mus musculus
caccgaggagagtagaacagctgtt

SEQ ID NO: 412153 - DNA, 25 bp, Mus musculus
caccgaggcttacggatctgcgtca

SEQ ID NO: 412154 - DNA, 25 bp, Mus musculus
caccgagtaccagtttgtggagcag

SEQ ID NO: 412155 - DNA, 25 bp, Mus musculus
caccgagtggagagccaagtttcgc

SEQ ID NO: 412156 - DNA, 25 bp, Mus musculus
caccgagtggagttcagcctcgaga

SEQ ID NO: 412157 - DNA, 25 bp, Mus musculus
caccgagtggcgttctatggcgtcc

SEQ ID NO: 412158 - DNA, 25 bp, Mus musculus
caccgatgagagaggaagtagcttc

SEQ ID NO: 412159 - DNA, 25 bp, Mus musculus
caccgcaacaagatgtacaaggaca

SEQ ID NO: 412160 - DNA, 25 bp, Mus musculus
caccgcaatgcactcgtagaagtca

SEQ ID NO: 412161 - DNA, 25 bp, Mus musculus
caccgcacgcggtgctatgactgcg

SEQ ID NO: 412162 - DNA, 25 bp, Mus musculus
caccgcagaggatggcaacaagttc

SEQ ID NO: 412163 - DNA, 25 bp, Mus musculus
caccgcagcctgacattatgctcaa

SEQ ID NO: 412164 - DNA, 25 bp, Mus musculus
caccgcagtggagagtgtgacagac

SEQ ID NO: 412165 - DNA, 25 bp, Mus musculus
caccgccggtgttagggatccagat

SEQ ID NO: 412166 - DNA, 25 bp, Mus musculus
caccgcgtgcgcaatgacagaactt

SEQ ID NO: 412167 - DNA, 25 bp, Mus musculus
caccgcgtggactttatttatctga

SEQ ID NO: 412168 - DNA, 25 bp, Mus musculus
caccgctcggccttggagatctgct

SEQ ID NO: 412169 - DNA, 25 bp, Mus musculus
caccgctttggtgtgtgacaatggc

SEQ ID NO: 412170 - DNA, 25 bp, Mus musculus
caccggaagaaaagagggctgcctt

SEQ ID NO: 412171 - DNA, 25 bp, Mus musculus
caccggacaaagatctgagagacgc

SEQ ID NO: 412172 - DNA, 25 bp, Mus musculus
caccggacagtgtttgcgttctgca

SEQ ID NO: 412173 - DNA, 25 bp, Mus musculus
caccggacatagtgggcaagacctc

SEQ ID NO: 412174 - DNA, 25 bp, Mus musculus
caccggaccgctgacttatctggaa

SEQ ID NO: 412175 - DNA, 25 bp, Mus musculus
caccggagctgaggtggccttcaac

SEQ ID NO: 412176 - DNA, 25 bp, Mus musculus
caccggatgaagtagcttaagtcaa

SEQ ID NO: 412177 - DNA, 25 bp, Mus musculus
caccggatgctctgcgttactgagg

SEQ ID NO: 412178 - DNA, 25 bp, Mus musculus
caccggatgcttcggtttttccagg

SEQ ID NO: 412179 - DNA, 25 bp, Mus musculus
caccggcaagctgtgatttgctgtc

SEQ ID NO: 412180 - DNA, 25 bp, Mus musculus
caccggccccatgaagtagaggagg

SEQ ID NO: 412181 - DNA, 25 bp, Mus musculus
caccggcccgagttgattgactatg

SEQ ID NO: 412182 - DNA, 25 bp, Mus musculus
caccggccgtgcaagttgctatggg

SEQ ID NO: 412183 - DNA, 25 bp, Mus musculus
caccggctgcagagagtctagggac

SEQ ID NO: 412184 - DNA, 25 bp, Mus musculus
caccggctgggagtggctgttccta

SEQ ID NO: 412185 - DNA, 25 bp, Mus musculus
caccggcttggtgctcgtaaaaagg

SEQ ID NO: 412186 - DNA, 25 bp, Mus musculus
caccgggagctgtctgtggaatcat

SEQ ID NO: 412187 - DNA, 25 bp, Mus musculus
caccgggaggatggaagcgtaaatt

SEQ ID NO: 412188 - DNA, 25 bp, Mus musculus
caccgggcagtggtaggcatgaaac

SEQ ID NO: 412189 - DNA, 25 bp, Mus musculus
caccgggccttgtttacttctgcag

SEQ ID NO: 412190 - DNA, 25 bp, Mus musculus
caccgggtgctgttctataaggacg

SEQ ID NO: 412191 - DNA, 25 bp, Mus musculus
caccggtgacccagcgaagttaagt

SEQ ID NO: 412192 - DNA, 25 bp, Mus musculus
caccggtgctgaatagagaggaaga

SEQ ID NO: 412193 - DNA, 25 bp, Mus musculus
caccggtgggtatatcattttggag

SEQ ID NO: 412194 - DNA, 25 bp, Mus musculus
caccggttgaagcacgcaagcaata

SEQ ID NO: 412195 - DNA, 25 bp, Mus musculus
caccgtaatgctagtgccctgagaa

SEQ ID NO: 412196 - DNA, 25 bp, Mus musculus
caccgtactctaaaggaagcttgcg

SEQ ID NO: 412197 - DNA, 25 bp, Mus musculus
caccgtcaagaggaatgatggctta

SEQ ID NO: 412198 - DNA, 25 bp, Mus musculus
caccgtcagcgaggaaggcattttc

SEQ ID NO: 412199 - DNA, 25 bp, Mus musculus
caccgtcatacattggaagtcctcg

SEQ ID NO: 412200 - DNA, 25 bp, Mus musculus
caccgtcgaggcttttgcgcttgtc

SEQ ID NO: 412201 - DNA, 25 bp, Mus musculus
caccgtctttaatgagaggcctaca

SEQ ID NO: 412202 - DNA, 25 bp, Mus musculus
caccgtgagctgtagatcctggcag

SEQ ID NO: 412203 - DNA, 25 bp, Mus musculus
caccgtgaggatgcagggcgtcatt

SEQ ID NO: 412204 - DNA, 25 bp, Mus musculus
caccgtgattgtagctgatgacagc

SEQ ID NO: 412205 - DNA, 25 bp, Mus musculus
caccgtgcagcagttcaaggaagcg

SEQ ID NO: 412206 - DNA, 25 bp, Mus musculus
caccgtgcgaaccaggatagcttgc

SEQ ID NO: 412207 - DNA, 25 bp, Mus musculus
caccgtggaaaaagatggcgccttc

SEQ ID NO: 412208 - DNA, 25 bp, Mus musculus
caccgtggaccagaccaagtggatc

SEQ ID NO: 412209 - DNA, 25 bp, Mus musculus
caccgtggatatgggagttctttta

SEQ ID NO: 412210 - DNA, 25 bp, Mus musculus
caccgtggctaaagtgatgatcatc

SEQ ID NO: 412211 - DNA, 25 bp, Mus musculus
caccgtgtagatgcagggaactcaa

SEQ ID NO: 412212 - DNA, 25 bp, Mus musculus
caccgtgtcctagaagggctgcagg

SEQ ID NO: 412213 - DNA, 25 bp, Mus musculus
caccgtgtggattgcactgaagaca

SEQ ID NO: 412214 - DNA, 25 bp, Mus musculus
caccgttgcaggaagctgatttcat

SEQ ID NO: 412215 - DNA, 25 bp, Mus musculus
caccgtttacctagagctggagaag

SEQ ID NO: 412216 - DNA, 25 bp, Mus musculus
caccgtttttgcctttctgaatcag

SEQ ID NO: 412217 - DNA, 25 bp, Mus musculus
cacctaaaacaccagcgtcacgaat

SEQ ID NO: 412218 - DNA, 25 bp, Mus musculus
cacctaaaagctgggctggagcgat

SEQ ID NO: 412219 - DNA, 25 bp, Mus musculus
cacctaagattaaggctggccagag

SEQ ID NO: 412220 - DNA, 25 bp, Mus musculus
cacctaagggacagaagaactctct

SEQ ID NO: 412221 - DNA, 25 bp, Mus musculus
cacctaagtgactgtgaatgcgcca

SEQ ID NO: 412222 - DNA, 25 bp, Mus musculus
cacctaatgttgtcccagctctgca

SEQ ID NO: 412223 - DNA, 25 bp, Mus musculus
cacctaattcattgaggcagggtct

SEQ ID NO: 412224 - DNA, 25 bp, Mus musculus
cacctacagaagagtcgtggccggg

SEQ ID NO: 412225 - DNA, 25 bp, Mus musculus
cacctacagcgtagcggagagaatt

SEQ ID NO: 412226 - DNA, 25 bp, Mus musculus
cacctacagtgaagacatccagaga

SEQ ID NO: 412227 - DNA, 25 bp, Mus musculus
cacctaccctctttgcaactaataa

SEQ ID NO: 412228 - DNA, 25 bp, Mus musculus
cacctacggctacctcattgttggg

SEQ ID NO: 412229 - DNA, 25 bp, Mus musculus
cacctacgtttgttggatggagcgc

SEQ ID NO: 412230 - DNA, 25 bp, Mus musculus
cacctactgggcacgaatgttcaag

SEQ ID NO: 412231 - DNA, 25 bp, Mus musculus
cacctagagaggacggatggatgcc

SEQ ID NO: 412232 - DNA, 25 bp, Mus musculus
cacctagatctgtgggtagtgatac

SEQ ID NO: 412233 - DNA, 25 bp, Mus musculus
cacctagctgggtttcgtcaagcca

SEQ ID NO: 412234 - DNA, 25 bp, Mus musculus
cacctaggagacattccaagatttg

SEQ ID NO: 412235 - DNA, 25 bp, Mus musculus
cacctagggagggtttcagcatcaa

SEQ ID NO: 412236 - DNA, 25 bp, Mus musculus
cacctatagagtaaaatggatcccc

SEQ ID NO: 412237 - DNA, 25 bp, Mus musculus
cacctatgagtgcaccagatgtcct

SEQ ID NO: 412238 - DNA, 25 bp, Mus musculus
cacctatgggcgacgggccctgaaa

SEQ ID NO: 412239 - DNA, 25 bp, Mus musculus
cacctatgtaaaggcactgtgtaac

SEQ ID NO: 412240 - DNA, 25 bp, Mus musculus
cacctcaagggccagggagtttgac

SEQ ID NO: 412241 - DNA, 25 bp, Mus musculus
cacctcaggagaaagaagctataga

SEQ ID NO: 412242 - DNA, 25 bp, Mus musculus
cacctcagggaatgcagtggacttc

SEQ ID NO: 412243 - DNA, 25 bp, Mus musculus
cacctcagggagactttgccgaaga

SEQ ID NO: 412244 - DNA, 25 bp, Mus musculus
cacctcagtgactcttgtctgcaca

SEQ ID NO: 412245 - DNA, 25 bp, Mus musculus
cacctcagtgatctttgactctgca

SEQ ID NO: 412246 - DNA, 25 bp, Mus musculus
cacctcccaggctacttctctgaca

SEQ ID NO: 412247 - DNA, 25 bp, Mus musculus
cacctcctagagtgcaccatgtagt

SEQ ID NO: 412248 - DNA, 25 bp, Mus musculus
cacctcggaccgtgtctatgagaaa

SEQ ID NO: 412249 - DNA, 25 bp, Mus musculus
cacctcggataatggcgacagccgt

SEQ ID NO: 412250 - DNA, 25 bp, Mus musculus
cacctcggcccttgggaagggagca

SEQ ID NO: 412251 - DNA, 25 bp, Mus musculus
cacctcggctttatggttgctccaa

SEQ ID NO: 412252 - DNA, 25 bp, Mus musculus
cacctcgggactggacatatttgca

SEQ ID NO: 412253 - DNA, 25 bp, Mus musculus
cacctcgggcacaaattgaggctgg

SEQ ID NO: 412254 - DNA, 25 bp, Mus musculus
cacctcgtctgtctagtgggcacta

SEQ ID NO: 412255 - DNA, 25 bp, Mus musculus
cacctcgtgtttagttgctctgtag

SEQ ID NO: 412256 - DNA, 25 bp, Mus musculus
cacctcgttgagagcacagctggct

SEQ ID NO: 412257 - DNA, 25 bp, Mus musculus
cacctctaagggtcagaagcactga

SEQ ID NO: 412258 - DNA, 25 bp, Mus musculus
cacctctagtatccggggcgttggc

SEQ ID NO: 412259 - DNA, 25 bp, Mus musculus
cacctctcgattgagctgattggca

SEQ ID NO: 412260 - DNA, 25 bp, Mus musculus
cacctctctctcaagtgaagagaaa

SEQ ID NO: 412261 - DNA, 25 bp, Mus musculus
cacctctgaagctgtggcaccacag

SEQ ID NO: 412262 - DNA, 25 bp, Mus musculus
cacctctggagaagcgtagggccat

SEQ ID NO: 412263 - DNA, 25 bp, Mus musculus
cacctctggagttgcggagcttgca

SEQ ID NO: 412264 - DNA, 25 bp, Mus musculus
cacctctgggaaactagaatgttcc

SEQ ID NO: 412265 - DNA, 25 bp, Mus musculus
cacctctggtgctccgaggagatct

SEQ ID NO: 412266 - DNA, 25 bp, Mus musculus
cacctctgtgtgctgttggcaggaa

SEQ ID NO: 412267 - DNA, 25 bp, Mus musculus
cacctgaaccggtcaagcctgaagt

SEQ ID NO: 412268 - DNA, 25 bp, Mus musculus
cacctgaagaaattggagggccgcc

SEQ ID NO: 412269 - DNA, 25 bp, Mus musculus
cacctgaagaattttgcgagccgac

SEQ ID NO: 412270 - DNA, 25 bp, Mus musculus
cacctgaccgatgaagactttgacc

SEQ ID NO: 412271 - DNA, 25 bp, Mus musculus
cacctgagattcctggagtgcctcc

SEQ ID NO: 412272 - DNA, 25 bp, Mus musculus
cacctgagcagaagtgcgaggagtc

SEQ ID NO: 412273 - DNA, 25 bp, Mus musculus
cacctgaggaggtggatgaatccaa

SEQ ID NO: 412274 - DNA, 25 bp, Mus musculus
cacctgaggctaccttcttctaaag

SEQ ID NO: 412275 - DNA, 25 bp, Mus musculus
cacctgagggtgttcatacaagccg

SEQ ID NO: 412276 - DNA, 25 bp, Mus musculus
cacctgaggttctgatgtatgatcc

SEQ ID NO: 412277 - DNA, 25 bp, Mus musculus
cacctgagtgacatgttttttgacc

SEQ ID NO: 412278 - DNA, 25 bp, Mus musculus
cacctgagttgatgtggccttgatt

SEQ ID NO: 412279 - DNA, 25 bp, Mus musculus
cacctgattggatggactgccttcc

SEQ ID NO: 412280 - DNA, 25 bp, Mus musculus
cacctgcaatgtgaaggcgaggacc

SEQ ID NO: 412281 - DNA, 25 bp, Mus musculus
cacctgcaggcggtactgatgaacc

SEQ ID NO: 412282 - DNA, 25 bp, Mus musculus
cacctgcaggttattgacagcgaaa

SEQ ID NO: 412283 - DNA, 25 bp, Mus musculus
cacctgcattgtctgtgatgtcaag

SEQ ID NO: 412284 - DNA, 25 bp, Mus musculus
cacctgccaagcatgtaagtggtcc

SEQ ID NO: 412285 - DNA, 25 bp, Mus musculus
cacctgcgctgtgtcggaagggaaa

SEQ ID NO: 412286 - DNA, 25 bp, Mus musculus
cacctgctggaacttacagaagacc

SEQ ID NO: 412287 - DNA, 25 bp, Mus musculus
cacctgctgtgacaaggataactgt

SEQ ID NO: 412288 - DNA, 25 bp, Mus musculus
cacctgcttagcaaacgcttgtggg

SEQ ID NO: 412289 - DNA, 25 bp, Mus musculus
cacctggaaacctgtattcacgtag

SEQ ID NO: 412290 - DNA, 25 bp, Mus musculus
cacctggaaggcagcaacggttgga

SEQ ID NO: 412291 - DNA, 25 bp, Mus musculus
cacctggaggatttggctgctgcat

SEQ ID NO: 412292 - DNA, 25 bp, Mus musculus
cacctggagtccttgagcgtaaaca

SEQ ID NO: 412293 - DNA, 25 bp, Mus musculus
cacctggatcctatacagagagatt

SEQ ID NO: 412294 - DNA, 25 bp, Mus musculus
cacctggatgtgtttgggcaaagcc

SEQ ID NO: 412295 - DNA, 25 bp, Mus musculus
cacctggcacagttcacatgtgaag

SEQ ID NO: 412296 - DNA, 25 bp, Mus musculus
cacctggcaggtccacggtgtgacc

SEQ ID NO: 412297 - DNA, 25 bp, Mus musculus
cacctggccacagtttgtaaagctt

SEQ ID NO: 412298 - DNA, 25 bp, Mus musculus
cacctggccgtgaatgactttgacc

SEQ ID NO: 412299 - DNA, 25 bp, Mus musculus
cacctggcgctgtgaaacctgcgtc

SEQ ID NO: 412300 - DNA, 25 bp, Mus musculus
cacctggctaggagttcctttttca

SEQ ID NO: 412301 - DNA, 25 bp, Mus musculus
cacctgggaagctttggtccgaaca

SEQ ID NO: 412302 - DNA, 25 bp, Mus musculus
cacctgggactacctggactggatt

SEQ ID NO: 412303 - DNA, 25 bp, Mus musculus
cacctgggaggttttgggagccaag

SEQ ID NO: 412304 - DNA, 25 bp, Mus musculus
cacctgggctacgtttatgggcaga

SEQ ID NO: 412305 - DNA, 25 bp, Mus musculus
cacctgggcttccaaatgaaggaca

SEQ ID NO: 412306 - DNA, 25 bp, Mus musculus
cacctgggtcctaagtatgtgggcc

SEQ ID NO: 412307 - DNA, 25 bp, Mus musculus
cacctggtatcttatttgcctgagt

SEQ ID NO: 412308 - DNA, 25 bp, Mus musculus
cacctggtcgctgaatgggaagaca

SEQ ID NO: 412309 - DNA, 25 bp, Mus musculus
cacctggtgtgtgaggaaacggcca

SEQ ID NO: 412310 - DNA, 25 bp, Mus musculus
cacctggtgttccagctgatttggg

SEQ ID NO: 412311 - DNA, 25 bp, Mus musculus
cacctggttggatggcaaacacgtt

SEQ ID NO: 412312 - DNA, 25 bp, Mus musculus
cacctgtaaggaccgcaagattcgg

SEQ ID NO: 412313 - DNA, 25 bp, Mus musculus
cacctgtagcagaagggaggagaca

SEQ ID NO: 412314 - DNA, 25 bp, Mus musculus
cacctgtcggatgaagcgctgatgg

SEQ ID NO: 412315 - DNA, 25 bp, Mus musculus
cacctgtctggtgaacgctggcttc

SEQ ID NO: 412316 - DNA, 25 bp, Mus musculus
cacctgtctggtggaaatgccttag

SEQ ID NO: 412317 - DNA, 25 bp, Mus musculus
cacctgtgatcctaagacagctgaa

SEQ ID NO: 412318 - DNA, 25 bp, Mus musculus
cacctgtgctgttgggacaaaaacc

SEQ ID NO: 412319 - DNA, 25 bp, Mus musculus
cacctgtgggactcaatgttgccta

SEQ ID NO: 412320 - DNA, 25 bp, Mus musculus
cacctgtgtggtatagcctcaatat

SEQ ID NO: 412321 - DNA, 25 bp, Mus musculus
cacctgttcaggttgtggcagcctc

SEQ ID NO: 412322 - DNA, 25 bp, Mus musculus
cacctgttcattgccgggtagcgga

SEQ ID NO: 412323 - DNA, 25 bp, Mus musculus
cacctgttctggatgtgaagcgacc

SEQ ID NO: 412324 - DNA, 25 bp, Mus musculus
caccttaatgattgctatgcccagc

SEQ ID NO: 412325 - DNA, 25 bp, Mus musculus
caccttaatgtctcctgtcatccag

SEQ ID NO: 412326 - DNA, 25 bp, Mus musculus
caccttagcggttcacgaggagacc

SEQ ID NO: 412327 - DNA, 25 bp, Mus musculus
caccttatgctagctgggcctatgg

SEQ ID NO: 412328 - DNA, 25 bp, Mus musculus
caccttcaagaccatcccaggaggg

SEQ ID NO: 412329 - DNA, 25 bp, Mus musculus
caccttcaagctgggcaagtacctg

SEQ ID NO: 412330 - DNA, 25 bp, Mus musculus
caccttcacagttagagcttgggag

SEQ ID NO: 412331 - DNA, 25 bp, Mus musculus
caccttcagggcaaatcagctggca

SEQ ID NO: 412332 - DNA, 25 bp, Mus musculus
caccttccatgcaactggaccaagg

SEQ ID NO: 412333 - DNA, 25 bp, Mus musculus
caccttcctgtggagctacgtgacg

SEQ ID NO: 412334 - DNA, 25 bp, Mus musculus
caccttcgagggtagcttttgcacg

SEQ ID NO: 412335 - DNA, 25 bp, Mus musculus
caccttctaaacacttgacttgatt

SEQ ID NO: 412336 - DNA, 25 bp, Mus musculus
caccttctatgtgctggagttgcaa

SEQ ID NO: 412337 - DNA, 25 bp, Mus musculus
caccttctgacatcatgggagcagg

SEQ ID NO: 412338 - DNA, 25 bp, Mus musculus
caccttctgatggagctgttgcctg

SEQ ID NO: 412339 - DNA, 25 bp, Mus musculus
caccttctgcctccgtgaatctgat

SEQ ID NO: 412340 - DNA, 25 bp, Mus musculus
caccttctgcggctagtgcttggaa

SEQ ID NO: 412341 - DNA, 25 bp, Mus musculus
caccttctgttacgcggctgggaac

SEQ ID NO: 412342 - DNA, 25 bp, Mus musculus
caccttgagactggttcgggtacta

SEQ ID NO: 412343 - DNA, 25 bp, Mus musculus
caccttgagggatgagaggccacac

SEQ ID NO: 412344 - DNA, 25 bp, Mus musculus
caccttgcctgcaggtagagtgggt

SEQ ID NO: 412345 - DNA, 25 bp, Mus musculus
caccttgctgtgtgagtcgatgcgg

SEQ ID NO: 412346 - DNA, 25 bp, Mus musculus
caccttggagggaagcatatcgttc

SEQ ID NO: 412347 - DNA, 25 bp, Mus musculus
caccttggaggttagggattcaaca

SEQ ID NO: 412348 - DNA, 25 bp, Mus musculus
caccttggatctagggctgccagga

SEQ ID NO: 412349 - DNA, 25 bp, Mus musculus
caccttggcagctgggagcttgctt

SEQ ID NO: 412350 - DNA, 25 bp, Mus musculus
caccttgggagtgccaaggcaccaa

SEQ ID NO: 412351 - DNA, 25 bp, Mus musculus
caccttgtattttaggctggcccag

SEQ ID NO: 412352 - DNA, 25 bp, Mus musculus
caccttgtcactagaggatgccacc

SEQ ID NO: 412353 - DNA, 25 bp, Mus musculus
caccttgtgagtacagcctgcatcc

SEQ ID NO: 412354 - DNA, 25 bp, Mus musculus
caccttgtggtgtggaatctggaac

SEQ ID NO: 412355 - DNA, 25 bp, Mus musculus
caccttgttagaggtgctgctctgg

SEQ ID NO: 412356 - DNA, 25 bp, Mus musculus
cacctttatggagaaagccctttca

SEQ ID NO: 412357 - DNA, 25 bp, Mus musculus
cacctttcggcaacactatggacgg

SEQ ID NO: 412358 - DNA, 25 bp, Mus musculus
cacctttctgccatggatcacttag

SEQ ID NO: 412359 - DNA, 25 bp, Mus musculus
cacctttgaatgtgaagttgacccg

SEQ ID NO: 412360 - DNA, 25 bp, Mus musculus
cacctttgacaagaagttccgctgt

SEQ ID NO: 412361 - DNA, 25 bp, Mus musculus
cacctttgcagcacatgtattctac

SEQ ID NO: 412362 - DNA, 25 bp, Mus musculus
cacctttggcgagatgtcagacggg

SEQ ID NO: 412363 - DNA, 25 bp, Mus musculus
cacctttgtggtgccggagcctgat

SEQ ID NO: 412364 - DNA, 25 bp, Mus musculus
caccttttacctattgaactccagg

SEQ ID NO: 412365 - DNA, 25 bp, Mus musculus
cacgaaacagggaacagaatggctt

SEQ ID NO: 412366 - DNA, 25 bp, Mus musculus
cacgaaaccctttgagatggtggca

SEQ ID NO: 412367 - DNA, 25 bp, Mus musculus
cacgaaacggtcatctaggaggaag

SEQ ID NO: 412368 - DNA, 25 bp, Mus musculus
cacgaaactctaaaccacaaccata

SEQ ID NO: 412369 - DNA, 25 bp, Mus musculus
cacgaaatagatgaagacagccctt

SEQ ID NO: 412370 - DNA, 25 bp, Mus musculus
cacgaagcaatctgtgcagtgaaca

SEQ ID NO: 412371 - DNA, 25 bp, Mus musculus
cacgaagccatctgtacagtagagg

SEQ ID NO: 412372 - DNA, 25 bp, Mus musculus
cacgaagctctgtttgatgctggca

SEQ ID NO: 412373 - DNA, 25 bp, Mus musculus
cacgaagctgctacatgtctggagg

SEQ ID NO: 412374 - DNA, 25 bp, Mus musculus
cacgaaggacctatctggaatggcc

SEQ ID NO: 412375 - DNA, 25 bp, Mus musculus
cacgaaggtcactgtaaactggccg

SEQ ID NO: 412376 - DNA, 25 bp, Mus musculus
cacgaagtacaagcgctggcagaac

SEQ ID NO: 412377 - DNA, 25 bp, Mus musculus
cacgaagtacactgggagacctgca

SEQ ID NO: 412378 - DNA, 25 bp, Mus musculus
cacgaagtgtggaaggactcagcca

SEQ ID NO: 412379 - DNA, 25 bp, Mus musculus
cacgaatatcaacgaggcactgctt

SEQ ID NO: 412380 - DNA, 25 bp, Mus musculus
cacgaatcacagttactctggaggg

SEQ ID NO: 412381 - DNA, 25 bp, Mus musculus
cacgacacgtgctctggaggagaca

SEQ ID NO: 412382 - DNA, 25 bp, Mus musculus
cacgacagtcttgcagtatgatgac

SEQ ID NO: 412383 - DNA, 25 bp, Mus musculus
cacgaccaggtcctactgaaaggca

SEQ ID NO: 412384 - DNA, 25 bp, Mus musculus
cacgacctcgatgtggaccttgcaa

SEQ ID NO: 412385 - DNA, 25 bp, Mus musculus
cacgacctgctacctgatgggagaa

SEQ ID NO: 412386 - DNA, 25 bp, Mus musculus
cacgacctggtatttgtagtttgcc

SEQ ID NO: 412387 - DNA, 25 bp, Mus musculus
cacgactgcgatgctgggacatgct

SEQ ID NO: 412388 - DNA, 25 bp, Mus musculus
cacgactggtttggactcaagcaca

SEQ ID NO: 412389 - DNA, 25 bp, Mus musculus
cacgacttgttttagccctgcaggc

SEQ ID NO: 412390 - DNA, 25 bp, Mus musculus
cacgagaagctcctggtggtagacc

SEQ ID NO: 412391 - DNA, 25 bp, Mus musculus
cacgagaaggtaggcaaatggaaag

SEQ ID NO: 412392 - DNA, 25 bp, Mus musculus
cacgagaatgagaacgctgaatgca

SEQ ID NO: 412393 - DNA, 25 bp, Mus musculus
cacgagagggttcacagcaacgaaa

SEQ ID NO: 412394 - DNA, 25 bp, Mus musculus
cacgagagtcttctagttctaggca

SEQ ID NO: 412395 - DNA, 25 bp, Mus musculus
cacgagatttgcataaatggaggac

SEQ ID NO: 412396 - DNA, 25 bp, Mus musculus
cacgagcaggctcttggtgctaagt

SEQ ID NO: 412397 - DNA, 25 bp, Mus musculus
cacgagcaggtagacttcaaggact

SEQ ID NO: 412398 - DNA, 25 bp, Mus musculus
cacgagctaggaggtatttccgtca

SEQ ID NO: 412399 - DNA, 25 bp, Mus musculus
cacgagctggtggtttaggcataaa

SEQ ID NO: 412400 - DNA, 25 bp, Mus musculus
cacgagcttggcttaacagaatgtc

SEQ ID NO: 412401 - DNA, 25 bp, Mus musculus
cacgagctttggaaaacaggccacc

SEQ ID NO: 412402 - DNA, 25 bp, Mus musculus
cacgaggagagaggttttcacggtt

SEQ ID NO: 412403 - DNA, 25 bp, Mus musculus
cacgaggagctgtgaactacctgca

SEQ ID NO: 412404 - DNA, 25 bp, Mus musculus
cacgaggagtacctgaaactgaagg

SEQ ID NO: 412405 - DNA, 25 bp, Mus musculus
cacgaggccaaagaaccaggagggc

SEQ ID NO: 412406 - DNA, 25 bp, Mus musculus
cacgaggtactccagaatagaagcc

SEQ ID NO: 412407 - DNA, 25 bp, Mus musculus
cacgagtacgtagatcagcccaaaa

SEQ ID NO: 412408 - DNA, 25 bp, Mus musculus
cacgagtagaaggaccgttggccaa

SEQ ID NO: 412409 - DNA, 25 bp, Mus musculus
cacgagtgctctttccaggagggca

SEQ ID NO: 412410 - DNA, 25 bp, Mus musculus
cacgagtggcgctttcagtggcaac

SEQ ID NO: 412411 - DNA, 25 bp, Mus musculus
cacgagtgggccatggctaggacat

SEQ ID NO: 412412 - DNA, 25 bp, Mus musculus
cacgagttcggtccccagcttttct

SEQ ID NO: 412413 - DNA, 25 bp, Mus musculus
cacgagttggcctaggccacagtgg

SEQ ID NO: 412414 - DNA, 25 bp, Mus musculus
cacgatagactgctctgtttcaaga

SEQ ID NO: 412415 - DNA, 25 bp, Mus musculus
cacgatccagtgtgatttatttaaa

SEQ ID NO: 412416 - DNA, 25 bp, Mus musculus
cacgatcggcctaggagacttgctg

SEQ ID NO: 412417 - DNA, 25 bp, Mus musculus
cacgatcgtgagaagccattgtgca

SEQ ID NO: 412418 - DNA, 25 bp, Mus musculus
cacgatgcttcagaggcagatgcct

SEQ ID NO: 412419 - DNA, 25 bp, Mus musculus
cacgatggagcacaggaaagatcag

SEQ ID NO: 412420 - DNA, 25 bp, Mus musculus
cacgatggctctgctacctgaagga

SEQ ID NO: 412421 - DNA, 25 bp, Mus musculus
cacgatggtttcctacagctgcgag

SEQ ID NO: 412422 - DNA, 25 bp, Mus musculus
cacgatgtagccactttactgaggg

SEQ ID NO: 412423 - DNA, 25 bp, Mus musculus
cacgatgtccattaagaagcgagcc

SEQ ID NO: 412424 - DNA, 25 bp, Mus musculus
cacgattacttacctggcccaggag

SEQ ID NO: 412425 - DNA, 25 bp, Mus musculus
cacgattgacgtgttcctgccaggg

SEQ ID NO: 412426 - DNA, 25 bp, Mus musculus
cacgattgagaagaacggcaaggtc

SEQ ID NO: 412427 - DNA, 25 bp, Mus musculus
cacgcaagatggtggaacagcttaa

SEQ ID NO: 412428 - DNA, 25 bp, Mus musculus
cacgcaaggactttcatcgggaagc

SEQ ID NO: 412429 - DNA, 25 bp, Mus musculus
cacgcaatgtgctggtgtacgacaa

SEQ ID NO: 412430 - DNA, 25 bp, Mus musculus
cacgcaccatcatggaccattatga

SEQ ID NO: 412431 - DNA, 25 bp, Mus musculus
cacgcagaagctcgagtgggccttc

SEQ ID NO: 412432 - DNA, 25 bp, Mus musculus
cacgcagacttatggctcggaatac

SEQ ID NO: 412433 - DNA, 25 bp, Mus musculus
cacgcagatgatgaaggataagaag

SEQ ID NO: 412434 - DNA, 25 bp, Mus musculus
cacgcagcttgtggagagcagtccc

SEQ ID NO: 412435 - DNA, 25 bp, Mus musculus
cacgcaggcctttgttggagagctc

SEQ ID NO: 412436 - DNA, 25 bp, Mus musculus
cacgcaggtgtgtttcccaatggcc

SEQ ID NO: 412437 - DNA, 25 bp, Mus musculus
cacgcagtgactgaacagtgtagtc

SEQ ID NO: 412438 - DNA, 25 bp, Mus musculus
cacgcatagtagagttcctgaaagc

SEQ ID NO: 412439 - DNA, 25 bp, Mus musculus
cacgcatcagcatgtagcgtctgaa

SEQ ID NO: 412440 - DNA, 25 bp, Mus musculus
cacgcatggatcttgggtctggctt

SEQ ID NO: 412441 - DNA, 25 bp, Mus musculus
cacgccaaggtattaccctggcggt

SEQ ID NO: 412442 - DNA, 25 bp, Mus musculus
cacgccacgggcttttataatgtcg

SEQ ID NO: 412443 - DNA, 25 bp, Mus musculus
cacgcccggcttgaaaaaacatgtt

SEQ ID NO: 412444 - DNA, 25 bp, Mus musculus
cacgcccgggtctatgagttcctgg

SEQ ID NO: 412445 - DNA, 25 bp, Mus musculus
cacgccctctctttctgtgttcaga

SEQ ID NO: 412446 - DNA, 25 bp, Mus musculus
cacgccggaactgccagagagttgc

SEQ ID NO: 412447 - DNA, 25 bp, Mus musculus
cacgcctaggaagagaagatcatca

SEQ ID NO: 412448 - DNA, 25 bp, Mus musculus
cacgcctccctgtcagattcaaaag

SEQ ID NO: 412449 - DNA, 25 bp, Mus musculus
cacgcgacagttgaggacgaggaac

SEQ ID NO: 412450 - DNA, 25 bp, Mus musculus
cacgcgagacgctcagggtttgaac

SEQ ID NO: 412451 - DNA, 25 bp, Mus musculus
cacgcgatggaaatttctgtttttc

SEQ ID NO: 412452 - DNA, 25 bp, Mus musculus
cacgcgcaggtgtttttagacgggc

SEQ ID NO: 412453 - DNA, 25 bp, Mus musculus
cacgcgctgtctgagaatgagagag

SEQ ID NO: 412454 - DNA, 25 bp, Mus musculus
cacgcggcgcgtgagattgaagaac

SEQ ID NO: 412455 - DNA, 25 bp, Mus musculus
cacgcgggtctctgggattagaatc

SEQ ID NO: 412456 - DNA, 25 bp, Mus musculus
cacgcggtattctccttgaaggcaa

SEQ ID NO: 412457 - DNA, 25 bp, Mus musculus
cacgcggttatactcgggagccaaa

SEQ ID NO: 412458 - DNA, 25 bp, Mus musculus
cacgctcagaagttgtaggtgcctg

SEQ ID NO: 412459 - DNA, 25 bp, Mus musculus
cacgctcgggcactagtcagagagt

SEQ ID NO: 412460 - DNA, 25 bp, Mus musculus
cacgctctttaaacaggctcattgc

SEQ ID NO: 412461 - DNA, 25 bp, Mus musculus
cacgctgaaaggcagaagcagttcg

SEQ ID NO: 412462 - DNA, 25 bp, Mus musculus
cacgctgcggagatggtacaccgag

SEQ ID NO: 412463 - DNA, 25 bp, Mus musculus
cacgctgctgaggtgcgcaggaaca

SEQ ID NO: 412464 - DNA, 25 bp, Mus musculus
cacgctggacccgactttcgaggaa

SEQ ID NO: 412465 - DNA, 25 bp, Mus musculus
cacgctggagctgcacggagaaaat

SEQ ID NO: 412466 - DNA, 25 bp, Mus musculus
cacgctgggatggaattgcctctgc

SEQ ID NO: 412467 - DNA, 25 bp, Mus musculus
cacgctggtgtattctgctgaagaa

SEQ ID NO: 412468 - DNA, 25 bp, Mus musculus
cacgctgtgcagaggcatggaaatc

SEQ ID NO: 412469 - DNA, 25 bp, Mus musculus
cacgctgtgcatggcctacaatgac

SEQ ID NO: 412470 - DNA, 25 bp, Mus musculus
cacgctgttctgagtagcctgacgg

SEQ ID NO: 412471 - DNA, 25 bp, Mus musculus
cacgcttcatttgtggaatctgaga

SEQ ID NO: 412472 - DNA, 25 bp, Mus musculus
cacgcttcctgaaacggaaagccaa

SEQ ID NO: 412473 - DNA, 25 bp, Mus musculus
cacgcttggcaaaaatggaataata

SEQ ID NO: 412474 - DNA, 25 bp, Mus musculus
cacgcttgggatccagatatcggga

SEQ ID NO: 412475 - DNA, 25 bp, Mus musculus
cacggaaacataatggacatgggcc

SEQ ID NO: 412476 - DNA, 25 bp, Mus musculus
cacggaaaggaagtaggcagcatca

SEQ ID NO: 412477 - DNA, 25 bp, Mus musculus
cacggaaatccccagccagggtggc

SEQ ID NO: 412478 - DNA, 25 bp, Mus musculus
cacggaacagttgcagatgagctgc

SEQ ID NO: 412479 - DNA, 25 bp, Mus musculus
cacggaagacactcgggatcaaaac

SEQ ID NO: 412480 - DNA, 25 bp, Mus musculus
cacggaagatgtcaggtatcaaagc

SEQ ID NO: 412481 - DNA, 25 bp, Mus musculus
cacggaattggctacaggaagggaa

SEQ ID NO: 412482 - DNA, 25 bp, Mus musculus
cacggacactggtgagaggactctt

SEQ ID NO: 412483 - DNA, 25 bp, Mus musculus
cacggaccacccagtcaggtatgga

SEQ ID NO: 412484 - DNA, 25 bp, Mus musculus
cacggacgacgaggacttttacact

SEQ ID NO: 412485 - DNA, 25 bp, Mus musculus
cacggacgaggagggcaatgcttat

SEQ ID NO: 412486 - DNA, 25 bp, Mus musculus
cacggactcatataccaggacggga

SEQ ID NO: 412487 - DNA, 25 bp, Mus musculus
cacggactggctaatctgcaggcag

SEQ ID NO: 412488 - DNA, 25 bp, Mus musculus
cacggactgtgtgaaagaaggtgca

SEQ ID NO: 412489 - DNA, 25 bp, Mus musculus
cacggacttacggttggattgacag

SEQ ID NO: 412490 - DNA, 25 bp, Mus musculus
cacggagaacgatctctatgaaggt

SEQ ID NO: 412491 - DNA, 25 bp, Mus musculus
cacggagaatatacagacggagcac

SEQ ID NO: 412492 - DNA, 25 bp, Mus musculus
cacggagacggagtttgcttgccac

SEQ ID NO: 412493 - DNA, 25 bp, Mus musculus
cacggagagcttttgacgtcagggc

SEQ ID NO: 412494 - DNA, 25 bp, Mus musculus
cacggagaggaaaccaaacagattt

SEQ ID NO: 412495 - DNA, 25 bp, Mus musculus
cacggagatcccagaaggaattaca

SEQ ID NO: 412496 - DNA, 25 bp, Mus musculus
cacggagatcgttgccattgacgca

SEQ ID NO: 412497 - DNA, 25 bp, Mus musculus
cacggagatggatgtgccaaacgtc

SEQ ID NO: 412498 - DNA, 25 bp, Mus musculus
cacggagcgccagccttgagtttgt

SEQ ID NO: 412499 - DNA, 25 bp, Mus musculus
cacggagctaagtgggcagatgttt

SEQ ID NO: 412500 - DNA, 25 bp, Mus musculus
cacggaggcattttgtacagaggtt

SEQ ID NO: 412501 - DNA, 25 bp, Mus musculus
cacggagtatagaggctgccgcatc

SEQ ID NO: 412502 - DNA, 25 bp, Mus musculus
cacggagtattttgtgcgcaccaaa

SEQ ID NO: 412503 - DNA, 25 bp, Mus musculus
cacggagttctctgagctggagcta

SEQ ID NO: 412504 - DNA, 25 bp, Mus musculus
cacggatgacatggatcttcctggg

SEQ ID NO: 412505 - DNA, 25 bp, Mus musculus
cacggatgactttcgtctggagagc

SEQ ID NO: 412506 - DNA, 25 bp, Mus musculus
cacggatttcggtttcggccgccag

SEQ ID NO: 412507 - DNA, 25 bp, Mus musculus
cacggcaaattcataccaagatgcg

SEQ ID NO: 412508 - DNA, 25 bp, Mus musculus
cacggcaacttgcttctgaacacaa

SEQ ID NO: 412509 - DNA, 25 bp, Mus musculus
cacggcaccagacgattcataatgg

SEQ ID NO: 412510 - DNA, 25 bp, Mus musculus
cacggcactaacaacccctataaca

SEQ ID NO: 412511 - DNA, 25 bp, Mus musculus
cacggcagagccagatatgatgagc

SEQ ID NO: 412512 - DNA, 25 bp, Mus musculus
cacggccaacaaccatgaacctgga

SEQ ID NO: 412513 - DNA, 25 bp, Mus musculus
cacggccaccatgcttgagatagga

SEQ ID NO: 412514 - DNA, 25 bp, Mus musculus
cacggccactatgaattctctgctg

SEQ ID NO: 412515 - DNA, 25 bp, Mus musculus
cacggccaggctttaaacatttgag

SEQ ID NO: 412516 - DNA, 25 bp, Mus musculus
cacggccccgctttgtgaagcaaga

SEQ ID NO: 412517 - DNA, 25 bp, Mus musculus
cacggcccctactgaagtgtctgct

SEQ ID NO: 412518 - DNA, 25 bp, Mus musculus
cacggccctggaacaagctattaag

SEQ ID NO: 412519 - DNA, 25 bp, Mus musculus
cacggccctgtgctcatgcttggaa

SEQ ID NO: 412520 - DNA, 25 bp, Mus musculus
cacggccgttcagtgctagataaca

SEQ ID NO: 412521 - DNA, 25 bp, Mus musculus
cacggcctcataccggtggttctgg

SEQ ID NO: 412522 - DNA, 25 bp, Mus musculus
cacggcgacactggccctgagattg

SEQ ID NO: 412523 - DNA, 25 bp, Mus musculus
cacggcgagagcgagttcaaccttt

SEQ ID NO: 412524 - DNA, 25 bp, Mus musculus
cacggctacataatttcccaggagg

SEQ ID NO: 412525 - DNA, 25 bp, Mus musculus
cacggctcagtctggcctgggtgcc

SEQ ID NO: 412526 - DNA, 25 bp, Mus musculus
cacggctcggtggatgctatgacag

SEQ ID NO: 412527 - DNA, 25 bp, Mus musculus
cacggctgaacatggaacaactgct

SEQ ID NO: 412528 - DNA, 25 bp, Mus musculus
cacggctgagggtctcgtggtgaca

SEQ ID NO: 412529 - DNA, 25 bp, Mus musculus
cacggctgccatcggaaactttcta

SEQ ID NO: 412530 - DNA, 25 bp, Mus musculus
cacggcttggctctgaactgttcaa

SEQ ID NO: 412531 - DNA, 25 bp, Mus musculus
cacggctttcgtgtcgtctgcgagc

SEQ ID NO: 412532 - DNA, 25 bp, Mus musculus
cacgggaagagttttgcatcaagac

SEQ ID NO: 412533 - DNA, 25 bp, Mus musculus
cacgggaatgcacaattgaggctac

SEQ ID NO: 412534 - DNA, 25 bp, Mus musculus
cacgggagattctgagggagcaacc

SEQ ID NO: 412535 - DNA, 25 bp, Mus musculus
cacgggagcttctcagccttcaggg

SEQ ID NO: 412536 - DNA, 25 bp, Mus musculus
cacgggaggctcaagtcacggaatt

SEQ ID NO: 412537 - DNA, 25 bp, Mus musculus
cacgggatacgtaaggagacctgtc

SEQ ID NO: 412538 - DNA, 25 bp, Mus musculus
cacgggatctagtcggagttgccag

SEQ ID NO: 412539 - DNA, 25 bp, Mus musculus
cacgggatgggagccaatgaataca

SEQ ID NO: 412540 - DNA, 25 bp, Mus musculus
cacgggattaaagactggagccacc

SEQ ID NO: 412541 - DNA, 25 bp, Mus musculus
cacgggcaatttctgtgacagacag

SEQ ID NO: 412542 - DNA, 25 bp, Mus musculus
cacgggcattgtgacccatgaacag

SEQ ID NO: 412543 - DNA, 25 bp, Mus musculus
cacgggcctggaaactaagcctgcg

SEQ ID NO: 412544 - DNA, 25 bp, Mus musculus
cacgggcctggcaggatctgctttc

SEQ ID NO: 412545 - DNA, 25 bp, Mus musculus
cacgggctacttactgggtgctgaa

SEQ ID NO: 412546 - DNA, 25 bp, Mus musculus
cacgggctctggtgcaagatctaat

SEQ ID NO: 412547 - DNA, 25 bp, Mus musculus
cacgggctgccgtatgtagccgaca

SEQ ID NO: 412548 - DNA, 25 bp, Mus musculus
cacgggcttaactgtggtgtctcaa

SEQ ID NO: 412549 - DNA, 25 bp, Mus musculus
cacgggcttggctagcaaggatcac

SEQ ID NO: 412550 - DNA, 25 bp, Mus musculus
cacgggtactacacatggagaggct

SEQ ID NO: 412551 - DNA, 25 bp, Mus musculus
cacgggtccctgcatcctttggagg

SEQ ID NO: 412552 - DNA, 25 bp, Mus musculus
cacgggtcgcaggtattttgtagca

SEQ ID NO: 412553 - DNA, 25 bp, Mus musculus
cacgggtctgtcaggtgcagttttt

SEQ ID NO: 412554 - DNA, 25 bp, Mus musculus
cacgggtcttgccttgcatgcgagt

SEQ ID NO: 412555 - DNA, 25 bp, Mus musculus
cacgggtggattcaggcaaccctac

SEQ ID NO: 412556 - DNA, 25 bp, Mus musculus
cacgggtggcaacatagccttcttg

SEQ ID NO: 412557 - DNA, 25 bp, Mus musculus
cacgggtgttcagaaataagagcta

SEQ ID NO: 412558 - DNA, 25 bp, Mus musculus
cacgggtttcctttgacatcgccag

SEQ ID NO: 412559 - DNA, 25 bp, Mus musculus
cacgggttttcctctagctgctgac

SEQ ID NO: 412560 - DNA, 25 bp, Mus musculus
cacggtacctcattaataaaggcca

SEQ ID NO: 412561 - DNA, 25 bp, Mus musculus
cacggtagagaactaataacatttt

SEQ ID NO: 412562 - DNA, 25 bp, Mus musculus
cacggtcacttgatgggctgcagct

SEQ ID NO: 412563 - DNA, 25 bp, Mus musculus
cacggtcattaaaaagtgtgctgag

SEQ ID NO: 412564 - DNA, 25 bp, Mus musculus
cacggtcattatcaccatggccagc

SEQ ID NO: 412565 - DNA, 25 bp, Mus musculus
cacggtctatgcttcagatcctgcc

SEQ ID NO: 412566 - DNA, 25 bp, Mus musculus
cacggtgacaaatgctgagaggtat

SEQ ID NO: 412567 - DNA, 25 bp, Mus musculus
cacggtgagagccaacaggtgctac

SEQ ID NO: 412568 - DNA, 25 bp, Mus musculus
cacggtgagcataaccaccggcatc

SEQ ID NO: 412569 - DNA, 25 bp, Mus musculus
cacggtgcacggagggaaacgttct

SEQ ID NO: 412570 - DNA, 25 bp, Mus musculus
cacggtgcctcttctgcctgatgct

SEQ ID NO: 412571 - DNA, 25 bp, Mus musculus
cacggtggaggatatgtctgttgcc

SEQ ID NO: 412572 - DNA, 25 bp, Mus musculus
cacggtgggcaacctgagctctaag

SEQ ID NO: 412573 - DNA, 25 bp, Mus musculus
cacggtgtcaccattagtctgggcg

SEQ ID NO: 412574 - DNA, 25 bp, Mus musculus
cacggtgtcactcaaagacttccag

SEQ ID NO: 412575 - DNA, 25 bp, Mus musculus
cacggtgtgagtacaggatccatgc

SEQ ID NO: 412576 - DNA, 25 bp, Mus musculus
cacggtgtgtgctactgatgactcc

SEQ ID NO: 412577 - DNA, 25 bp, Mus musculus
cacggttagtccacatctgagggac

SEQ ID NO: 412578 - DNA, 25 bp, Mus musculus
cacggttccgtcagaaataaagcct

SEQ ID NO: 412579 - DNA, 25 bp, Mus musculus
cacggttctgtgtgcagttcccaac

SEQ ID NO: 412580 - DNA, 25 bp, Mus musculus
cacggttgacgggaagaaccagctc

SEQ ID NO: 412581 - DNA, 25 bp, Mus musculus
cacggttgggaaacgatgctgcctt

SEQ ID NO: 412582 - DNA, 25 bp, Mus musculus
cacggttgtcttctcaaatggcaga

SEQ ID NO: 412583 - DNA, 25 bp, Mus musculus
cacgtaagcctaatggaccagcggg

SEQ ID NO: 412584 - DNA, 25 bp, Mus musculus
cacgtaatgggttcacagaagactc

SEQ ID NO: 412585 - DNA, 25 bp, Mus musculus
cacgtactaagatcgactggaacaa

SEQ ID NO: 412586 - DNA, 25 bp, Mus musculus
cacgtactgcctactcggtgctaac

SEQ ID NO: 412587 - DNA, 25 bp, Mus musculus
cacgtagctttcgagaccatgggat

SEQ ID NO: 412588 - DNA, 25 bp, Mus musculus
cacgtagtgaattgccctggacaca

SEQ ID NO: 412589 - DNA, 25 bp, Mus musculus
cacgtatacatatgcagagcccatg

SEQ ID NO: 412590 - DNA, 25 bp, Mus musculus
cacgtatcagtgtcaaggagcaaag

SEQ ID NO: 412591 - DNA, 25 bp, Mus musculus
cacgtatcatttgctcattcttcta

SEQ ID NO: 412592 - DNA, 25 bp, Mus musculus
cacgtatgaatcaggcagccgctgg

SEQ ID NO: 412593 - DNA, 25 bp, Mus musculus
cacgtatgagcagatggagtttcca

SEQ ID NO: 412594 - DNA, 25 bp, Mus musculus
cacgtatgcttctgtggtttcccag

SEQ ID NO: 412595 - DNA, 25 bp, Mus musculus
cacgtatgtacaccatgtcatgagc

SEQ ID NO: 412596 - DNA, 25 bp, Mus musculus
cacgtatgttacaggcggtgggcca

SEQ ID NO: 412597 - DNA, 25 bp, Mus musculus
cacgtcaccgcatggaatcagttca

SEQ ID NO: 412598 - DNA, 25 bp, Mus musculus
cacgtcagcctgtgcatgcccgttg

SEQ ID NO: 412599 - DNA, 25 bp, Mus musculus
cacgtccatcgaggtgggtgtcaaa

SEQ ID NO: 412600 - DNA, 25 bp, Mus musculus
cacgtcccatggaggttcaccgatc

SEQ ID NO: 412601 - DNA, 25 bp, Mus musculus
cacgtcccatgtcaggaacaggcct

SEQ ID NO: 412602 - DNA, 25 bp, Mus musculus
cacgtcccggatgacttagttccag

SEQ ID NO: 412603 - DNA, 25 bp, Mus musculus
cacgtccgttatcttgatagagcct

SEQ ID NO: 412604 - DNA, 25 bp, Mus musculus
cacgtcctgcaagccgagcaggtgt

SEQ ID NO: 412605 - DNA, 25 bp, Mus musculus
cacgtcgctcagaaacagggtctca

SEQ ID NO: 412606 - DNA, 25 bp, Mus musculus
cacgtcggagatggcggtgaccttc

SEQ ID NO: 412607 - DNA, 25 bp, Mus musculus
cacgtcgtgctcaaggaggtgcgct

SEQ ID NO: 412608 - DNA, 25 bp, Mus musculus
cacgtctatgtttgtgatctcagca

SEQ ID NO: 412609 - DNA, 25 bp, Mus musculus
cacgtctccgctagtacctggttac

SEQ ID NO: 412610 - DNA, 25 bp, Mus musculus
cacgtcttacagagcatatgagaag

SEQ ID NO: 412611 - DNA, 25 bp, Mus musculus
cacgtgaagatcgaacaggactggc

SEQ ID NO: 412612 - DNA, 25 bp, Mus musculus
cacgtgaatgtgttttccgggaaca

SEQ ID NO: 412613 - DNA, 25 bp, Mus musculus
cacgtgactaggaagaaccatgcca

SEQ ID NO: 412614 - DNA, 25 bp, Mus musculus
cacgtgacttacatctctacaggga

SEQ ID NO: 412615 - DNA, 25 bp, Mus musculus
cacgtgagtctgaaatcggaggacc

SEQ ID NO: 412616 - DNA, 25 bp, Mus musculus
cacgtgatctgtttggactgtttcc

SEQ ID NO: 412617 - DNA, 25 bp, Mus musculus
cacgtgcagcttggaatgggccgct

SEQ ID NO: 412618 - DNA, 25 bp, Mus musculus
cacgtgcaggacaggaaggccttaa

SEQ ID NO: 412619 - DNA, 25 bp, Mus musculus
cacgtgcagtttgttgggtcataca

SEQ ID NO: 412620 - DNA, 25 bp, Mus musculus
cacgtgccgggacttaagactcagc

SEQ ID NO: 412621 - DNA, 25 bp, Mus musculus
cacgtgcgatttctacagcggctca

SEQ ID NO: 412622 - DNA, 25 bp, Mus musculus
cacgtgctggcaggaaaaggatcaa

SEQ ID NO: 412623 - DNA, 25 bp, Mus musculus
cacgtgctgtcggtgttcccgctgg

SEQ ID NO: 412624 - DNA, 25 bp, Mus musculus
cacgtgcttcagactcatttgcgag

SEQ ID NO: 412625 - DNA, 25 bp, Mus musculus
cacgtgctttgagtgcgagatcacc

SEQ ID NO: 412626 - DNA, 25 bp, Mus musculus
cacgtggacactgggaactcttacc

SEQ ID NO: 412627 - DNA, 25 bp, Mus musculus
cacgtggactcaaagttacgggccg

SEQ ID NO: 412628 - DNA, 25 bp, Mus musculus
cacgtggacttatcaggattgctga

SEQ ID NO: 412629 - DNA, 25 bp, Mus musculus
cacgtggccatgaggtgtgtcatca

SEQ ID NO: 412630 - DNA, 25 bp, Mus musculus
cacgtggccattgcagtagagggac

SEQ ID NO: 412631 - DNA, 25 bp, Mus musculus
cacgtggccccagaaataagggagc

SEQ ID NO: 412632 - DNA, 25 bp, Mus musculus
cacgtggcccgggactctattggga

SEQ ID NO: 412633 - DNA, 25 bp, Mus musculus
cacgtggcttgcaatgtggacccca

SEQ ID NO: 412634 - DNA, 25 bp, Mus musculus
cacgtggcttgctgctgtgggaaca

SEQ ID NO: 412635 - DNA, 25 bp, Mus musculus
cacgtggtacggaagacaactctct

SEQ ID NO: 412636 - DNA, 25 bp, Mus musculus
cacgtggtcaaggtgtacaaccgcc

SEQ ID NO: 412637 - DNA, 25 bp, Mus musculus
cacgtgtatgacaactggcccatgg

SEQ ID NO: 412638 - DNA, 25 bp, Mus musculus
cacgtgtcaagagatgggctcctca

SEQ ID NO: 412639 - DNA, 25 bp, Mus musculus
cacgtgtcagaggacttcacctggg

SEQ ID NO: 412640 - DNA, 25 bp, Mus musculus
cacgtgtcatggttagcagttagcg

SEQ ID NO: 412641 - DNA, 25 bp, Mus musculus
cacgtgtgacactctcggaatggca

SEQ ID NO: 412642 - DNA, 25 bp, Mus musculus
cacgtgtgagggacttcctggacca

SEQ ID NO: 412643 - DNA, 25 bp, Mus musculus
cacgtgtggcaaaaactgtaccccg

SEQ ID NO: 412644 - DNA, 25 bp, Mus musculus
cacgtgtggcctgctctcatggaga

SEQ ID NO: 412645 - DNA, 25 bp, Mus musculus
cacgtgtgtcagagcacatgcctaa

SEQ ID NO: 412646 - DNA, 25 bp, Mus musculus
cacgtgtgtccattgcagggatagc

SEQ ID NO: 412647 - DNA, 25 bp, Mus musculus
cacgtgtgtcgctcatgtgtggaaa

SEQ ID NO: 412648 - DNA, 25 bp, Mus musculus
cacgtgttagtgtttcgctgccaag

SEQ ID NO: 412649 - DNA, 25 bp, Mus musculus
cacgtgttgacgcttcccttggaca

SEQ ID NO: 412650 - DNA, 25 bp, Mus musculus
cacgtgtttggactctagcttagca

SEQ ID NO: 412651 - DNA, 25 bp, Mus musculus
cacgttacctgagcgaatggaagca

SEQ ID NO: 412652 - DNA, 25 bp, Mus musculus
cacgttagatgatgcggatgaccca

SEQ ID NO: 412653 - DNA, 25 bp, Mus musculus
cacgttagcgctgaatgacaagggc

SEQ ID NO: 412654 - DNA, 25 bp, Mus musculus
cacgttcaagaacagttgccccgag

SEQ ID NO: 412655 - DNA, 25 bp, Mus musculus
cacgttcatccttagagtgtttctg

SEQ ID NO: 412656 - DNA, 25 bp, Mus musculus
cacgttcatggctctcgggtaggac

SEQ ID NO: 412657 - DNA, 25 bp, Mus musculus
cacgttccgcaactacgacctggat

SEQ ID NO: 412658 - DNA, 25 bp, Mus musculus
cacgttctcattgtgatggctagta

SEQ ID NO: 412659 - DNA, 25 bp, Mus musculus
cacgttctgacaggactgtgtgaca

SEQ ID NO: 412660 - DNA, 25 bp, Mus musculus
cacgttcttggcagtgaagcccgac

SEQ ID NO: 412661 - DNA, 25 bp, Mus musculus
cacgttggaccaactgaagcggcgg

SEQ ID NO: 412662 - DNA, 25 bp, Mus musculus
cacgttgggaatggatgctgcagtc

SEQ ID NO: 412663 - DNA, 25 bp, Mus musculus
cacgtttaccccagcaatccatgag

SEQ ID NO: 412664 - DNA, 25 bp, Mus musculus
cacgtttatatgtcactggcaggaa

SEQ ID NO: 412665 - DNA, 25 bp, Mus musculus
cacgtttctttacctggcgcttgta

SEQ ID NO: 412666 - DNA, 25 bp, Mus musculus
cacgttttaagcaacctggactggc

SEQ ID NO: 412667 - DNA, 25 bp, Mus musculus
cacgttttacattgagccagcagag

SEQ ID NO: 412668 - DNA, 25 bp, Mus musculus
cacgttttacggaggcagcagtacc

SEQ ID NO: 412669 - DNA, 25 bp, Mus musculus
cactaaactctaaggatgcggcgct

SEQ ID NO: 412670 - DNA, 25 bp, Mus musculus
cactaaagcaactttgttgtggcga

SEQ ID NO: 412671 - DNA, 25 bp, Mus musculus
cactaacctggagtttggaggcttt

SEQ ID NO: 412672 - DNA, 25 bp, Mus musculus
cactaacggtacaaggatgaactgc

SEQ ID NO: 412673 - DNA, 25 bp, Mus musculus
cactaacttagaaaacagacgcggg

SEQ ID NO: 412674 - DNA, 25 bp, Mus musculus
cactaagagattttccatggcggga

SEQ ID NO: 412675 - DNA, 25 bp, Mus musculus
cactaagagggtgtaaaggcaagcc

SEQ ID NO: 412676 - DNA, 25 bp, Mus musculus
cactaagatcaatgggagtccccgg

SEQ ID NO: 412677 - DNA, 25 bp, Mus musculus
cactaaggatgtcttagtcctcaca

SEQ ID NO: 412678 - DNA, 25 bp, Mus musculus
cactaagggcagaagtatggcaact

SEQ ID NO: 412679 - DNA, 25 bp, Mus musculus
cactaaggtgaccagcaacgtgcag

SEQ ID NO: 412680 - DNA, 25 bp, Mus musculus
cactaaggtgcaagccaggttcagc

SEQ ID NO: 412681 - DNA, 25 bp, Mus musculus
cactaaggtggctgtagttggtaca

SEQ ID NO: 412682 - DNA, 25 bp, Mus musculus
cactaagtgaacttttgtggcttcc

SEQ ID NO: 412683 - DNA, 25 bp, Mus musculus
cactaagtggtctgtagtttgtcgt

SEQ ID NO: 412684 - DNA, 25 bp, Mus musculus
cactaagtgtcttggattaagtctc

SEQ ID NO: 412685 - DNA, 25 bp, Mus musculus
cactaagtgttaactgagaacctgc

SEQ ID NO: 412686 - DNA, 25 bp, Mus musculus
cactaagtttttctggtcgcctgga

SEQ ID NO: 412687 - DNA, 25 bp, Mus musculus
cactaatagcagtgcgggcatccgg

SEQ ID NO: 412688 - DNA, 25 bp, Mus musculus
cactaattagtgtcatgccgttacc

SEQ ID NO: 412689 - DNA, 25 bp, Mus musculus
cactaattcagatagtgccagcaca

SEQ ID NO: 412690 - DNA, 25 bp, Mus musculus
cactaatttccatagggtctgggag

SEQ ID NO: 412691 - DNA, 25 bp, Mus musculus
cactacaaattgaccgtgccgcggt

SEQ ID NO: 412692 - DNA, 25 bp, Mus musculus
cactacaagttggattgccgaaaag

SEQ ID NO: 412693 - DNA, 25 bp, Mus musculus
cactacaatgtgatcgagcgcgtca

SEQ ID NO: 412694 - DNA, 25 bp, Mus musculus
cactacagctgaccgacttggacga

SEQ ID NO: 412695 - DNA, 25 bp, Mus musculus
cactacaggcttgggacatgggtcc

SEQ ID NO: 412696 - DNA, 25 bp, Mus musculus
cactacatggcactagctgggtgag

SEQ ID NO: 412697 - DNA, 25 bp, Mus musculus
cactaccagagagttgagaccccag

SEQ ID NO: 412698 - DNA, 25 bp, Mus musculus
cactaccgagaggaaccaggtggac

SEQ ID NO: 412699 - DNA, 25 bp, Mus musculus
cactaccgtgggtggaagagccaca

SEQ ID NO: 412700 - DNA, 25 bp, Mus musculus
cactacgcgatgaccgtggcaaggt

SEQ ID NO: 412701 - DNA, 25 bp, Mus musculus
cactacggagtatgtgtagcctcag

SEQ ID NO: 412702 - DNA, 25 bp, Mus musculus
cactactacaagcataagcccttgg

SEQ ID NO: 412703 - DNA, 25 bp, Mus musculus
cactactggctggatgtcgagaaaa

SEQ ID NO: 412704 - DNA, 25 bp, Mus musculus
cactactgggtcactcgaggattcc

SEQ ID NO: 412705 - DNA, 25 bp, Mus musculus
cactagaatgtacataggttgctgc

SEQ ID NO: 412706 - DNA, 25 bp, Mus musculus
cactagaggaagaagcgaggtcatc

SEQ ID NO: 412707 - DNA, 25 bp, Mus musculus
cactagagtcacttaacttggtctt

SEQ ID NO: 412708 - DNA, 25 bp, Mus musculus
cactagagtgctaaatcaaacacag

SEQ ID NO: 412709 - DNA, 25 bp, Mus musculus
cactagagttaaatgaaatggatcc

SEQ ID NO: 412710 - DNA, 25 bp, Mus musculus
cactagatcagggacttgaatgcac

SEQ ID NO: 412711 - DNA, 25 bp, Mus musculus
cactagatcagtgcaagaacacaga

SEQ ID NO: 412712 - DNA, 25 bp, Mus musculus
cactagatgaagtgcgtagggttaa

SEQ ID NO: 412713 - DNA, 25 bp, Mus musculus
cactagatggcgcatccgatgcaga

SEQ ID NO: 412714 - DNA, 25 bp, Mus musculus
cactagcaacatgttctgtctgggc

SEQ ID NO: 412715 - DNA, 25 bp, Mus musculus
cactagcagtatgcccggagtgcca

SEQ ID NO: 412716 - DNA, 25 bp, Mus musculus
cactagcatgagtaaaagggctggg

SEQ ID NO: 412717 - DNA, 25 bp, Mus musculus
cactagcccgagtcagcagtttcca

SEQ ID NO: 412718 - DNA, 25 bp, Mus musculus
cactagccggtgaaggaattctcta

SEQ ID NO: 412719 - DNA, 25 bp, Mus musculus
cactagcggcggcattttgcaggca

SEQ ID NO: 412720 - DNA, 25 bp, Mus musculus
cactagcgggtggtcactgattcct

SEQ ID NO: 412721 - DNA, 25 bp, Mus musculus
cactaggaaatgtagcccgggctct

SEQ ID NO: 412722 - DNA, 25 bp, Mus musculus
cactaggacccatgcagaaggagct

SEQ ID NO: 412723 - DNA, 25 bp, Mus musculus
cactaggccctttggagtcagggaa

SEQ ID NO: 412724 - DNA, 25 bp, Mus musculus
cactaggcgagttagatagggaacc

SEQ ID NO: 412725 - DNA, 25 bp, Mus musculus
cactagggatagattcaagtgcagc

SEQ ID NO: 412726 - DNA, 25 bp, Mus musculus
cactaggtgattggttcacaagaac

SEQ ID NO: 412727 - DNA, 25 bp, Mus musculus
cactagtaacactgagggcggctgg

SEQ ID NO: 412728 - DNA, 25 bp, Mus musculus
cactagtcagggagttgcatgcagg

SEQ ID NO: 412729 - DNA, 25 bp, Mus musculus
cactagtcctgatctgagggctgag

SEQ ID NO: 412730 - DNA, 25 bp, Mus musculus
cactagtgaagagaggcagaggttc

SEQ ID NO: 412731 - DNA, 25 bp, Mus musculus
cactagtgcacttgagggatacaaa

SEQ ID NO: 412732 - DNA, 25 bp, Mus musculus
cactagtgtcacgtcttctggcaga

SEQ ID NO: 412733 - DNA, 25 bp, Mus musculus
cactagttccccttattgttatagc

SEQ ID NO: 412734 - DNA, 25 bp, Mus musculus
cactagttctagactgtgaggaaga

SEQ ID NO: 412735 - DNA, 25 bp, Mus musculus
cactagtttgagacagcacttttcc

SEQ ID NO: 412736 - DNA, 25 bp, Mus musculus
cactataacattagccattgggccc

SEQ ID NO: 412737 - DNA, 25 bp, Mus musculus
cactatatgctgtgccttaggctta

SEQ ID NO: 412738 - DNA, 25 bp, Mus musculus
cactatcatgaaggactcgggagag

SEQ ID NO: 412739 - DNA, 25 bp, Mus musculus
cactatcctggacctggattctgat

SEQ ID NO: 412740 - DNA, 25 bp, Mus musculus
cactatcggcgtggagtttggatcc

SEQ ID NO: 412741 - DNA, 25 bp, Mus musculus
cactatcggtgtggacttcagggag

SEQ ID NO: 412742 - DNA, 25 bp, Mus musculus
cactatcgtgataactttggaggag

SEQ ID NO: 412743 - DNA, 25 bp, Mus musculus
cactatctcgtatgcgagggcgcca

SEQ ID NO: 412744 - DNA, 25 bp, Mus musculus
cactatctgaggaaaggcaaaaccc

SEQ ID NO: 412745 - DNA, 25 bp, Mus musculus
cactatctggtgattacaaagcagc

SEQ ID NO: 412746 - DNA, 25 bp, Mus musculus
cactatgaaaaacacggtcttttga

SEQ ID NO: 412747 - DNA, 25 bp, Mus musculus
cactatgacggaagttcagctttag

SEQ ID NO: 412748 - DNA, 25 bp, Mus musculus
cactatgagcgctgaagaggactac

SEQ ID NO: 412749 - DNA, 25 bp, Mus musculus
cactatgagtattggtcaagcacgc

SEQ ID NO: 412750 - DNA, 25 bp, Mus musculus
cactatgcaagatcagacagaggtc

SEQ ID NO: 412751 - DNA, 25 bp, Mus musculus
cactatgcagatacctgtacacatc

SEQ ID NO: 412752 - DNA, 25 bp, Mus musculus
cactatggagtcctgctcatgctca

SEQ ID NO: 412753 - DNA, 25 bp, Mus musculus
cactatgggcatgtggagggtcctc

SEQ ID NO: 412754 - DNA, 25 bp, Mus musculus
cactatgggcctccttaaagggcga

SEQ ID NO: 412755 - DNA, 25 bp, Mus musculus
cactatggtcgttttgcaagcacac

SEQ ID NO: 412756 - DNA, 25 bp, Mus musculus
cactatgtcttggaggatgcttttg

SEQ ID NO: 412757 - DNA, 25 bp, Mus musculus
cactatgtggagaacggcacggtta

SEQ ID NO: 412758 - DNA, 25 bp, Mus musculus
cactattaaatggatggtagatgcc

SEQ ID NO: 412759 - DNA, 25 bp, Mus musculus
cactattacttctcgggtggccaca

SEQ ID NO: 412760 - DNA, 25 bp, Mus musculus
cactattactttagctagcagaggg

SEQ ID NO: 412761 - DNA, 25 bp, Mus musculus
cactattcctgaggatacaagaaca

SEQ ID NO: 412762 - DNA, 25 bp, Mus musculus
cactattgctgattagactatgcag

SEQ ID NO: 412763 - DNA, 25 bp, Mus musculus
cactatttcctaaggcagtggcctt

SEQ ID NO: 412764 - DNA, 25 bp, Mus musculus
cactatttctgggtgggtccagaca

SEQ ID NO: 412765 - DNA, 25 bp, Mus musculus
cactatttgttgtgatcagcctgca

SEQ ID NO: 412766 - DNA, 25 bp, Mus musculus
cactcaaaaggagctatgggttttc

SEQ ID NO: 412767 - DNA, 25 bp, Mus musculus
cactcaaaagggagggctaaggcca

SEQ ID NO: 412768 - DNA, 25 bp, Mus musculus
cactcaacagcgtgtagggaaattg

SEQ ID NO: 412769 - DNA, 25 bp, Mus musculus
cactcaactttctcaaaagaagtta

SEQ ID NO: 412770 - DNA, 25 bp, Mus musculus
cactcaagaagccaagatgtcaact

SEQ ID NO: 412771 - DNA, 25 bp, Mus musculus
cactcaagagggaagccgtgtacac

SEQ ID NO: 412772 - DNA, 25 bp, Mus musculus
cactcaagttgcatgctggatatca

SEQ ID NO: 412773 - DNA, 25 bp, Mus musculus
cactcacaaggacagtagtggaaag

SEQ ID NO: 412774 - DNA, 25 bp, Mus musculus
cactcacacgtattacatatgcaca

SEQ ID NO: 412775 - DNA, 25 bp, Mus musculus
cactcacagagtggctgaagaacca

SEQ ID NO: 412776 - DNA, 25 bp, Mus musculus
cactcacagtagagggccctaaggg

SEQ ID NO: 412777 - DNA, 25 bp, Mus musculus
cactcacctaagctggcggagcaaa

SEQ ID NO: 412778 - DNA, 25 bp, Mus musculus
cactcacctggtgtactcagaagag

SEQ ID NO: 412779 - DNA, 25 bp, Mus musculus
cactcacgagaggagctagggtcat

SEQ ID NO: 412780 - DNA, 25 bp, Mus musculus
cactcacgattgtagctggaaacag

SEQ ID NO: 412781 - DNA, 25 bp, Mus musculus
cactcacgggtgtcaaagaggcctc

SEQ ID NO: 412782 - DNA, 25 bp, Mus musculus
cactcactgaatgggatccgacact

SEQ ID NO: 412783 - DNA, 25 bp, Mus musculus
cactcacttgtgtgggcacgtggaa

SEQ ID NO: 412784 - DNA, 25 bp, Mus musculus
cactcagaatcttttgcgcacacaa

SEQ ID NO: 412785 - DNA, 25 bp, Mus musculus
cactcagaggaagccttgggtcaca

SEQ ID NO: 412786 - DNA, 25 bp, Mus musculus
cactcagaggtggagagtctcgcac

SEQ ID NO: 412787 - DNA, 25 bp, Mus musculus
cactcagcgttagccactggataga

SEQ ID NO: 412788 - DNA, 25 bp, Mus musculus
cactcaggaaaccaaacagggcagc

SEQ ID NO: 412789 - DNA, 25 bp, Mus musculus
cactcagggtctccatacgctgtga

SEQ ID NO: 412790 - DNA, 25 bp, Mus musculus
cactcagggttgagagacgtctgca

SEQ ID NO: 412791 - DNA, 25 bp, Mus musculus
cactcaggtggttccgatggctcca

SEQ ID NO: 412792 - DNA, 25 bp, Mus musculus
cactcagtatagtaattggagacac

SEQ ID NO: 412793 - DNA, 25 bp, Mus musculus
cactcagtcacatcttgtcatccaa

SEQ ID NO: 412794 - DNA, 25 bp, Mus musculus
cactcagtggactaggctgtgagcc

SEQ ID NO: 412795 - DNA, 25 bp, Mus musculus
cactcagtgttctctttacctaacc

SEQ ID NO: 412796 - DNA, 25 bp, Mus musculus
cactcagttcctaggaagaactaaa

SEQ ID NO: 412797 - DNA, 25 bp, Mus musculus
cactcatcaaggtgaatcctcatcc

SEQ ID NO: 412798 - DNA, 25 bp, Mus musculus
cactcatctaggaatccagagagag

SEQ ID NO: 412799 - DNA, 25 bp, Mus musculus
cactcatctgtctgtcaagtaccag

SEQ ID NO: 412800 - DNA, 25 bp, Mus musculus
cactcatgcatcaacagtgaggaca

SEQ ID NO: 412801 - DNA, 25 bp, Mus musculus
cactcatttgaggtcccaggtgaac

SEQ ID NO: 412802 - DNA, 25 bp, Mus musculus
cactccaaggaggtgctgtcttata

SEQ ID NO: 412803 - DNA, 25 bp, Mus musculus
cactccacaagcaagaagagctgtg

SEQ ID NO: 412804 - DNA, 25 bp, Mus musculus
cactccagacctaagacatgcacta

SEQ ID NO: 412805 - DNA, 25 bp, Mus musculus
cactccagactggaatagttctaaa

SEQ ID NO: 412806 - DNA, 25 bp, Mus musculus
cactccagccttgtggtgggacaca

SEQ ID NO: 412807 - DNA, 25 bp, Mus musculus
cactccaggttgaggcgaagctgcg

SEQ ID NO: 412808 - DNA, 25 bp, Mus musculus
cactccagtggtcatttctagacca

SEQ ID NO: 412809 - DNA, 25 bp, Mus musculus
cactccatgaggtatttcgaaacct

SEQ ID NO: 412810 - DNA, 25 bp, Mus musculus
cactcccctatgactaaggagtggg

SEQ ID NO: 412811 - DNA, 25 bp, Mus musculus
cactccctgtgtgccatggatggtg

SEQ ID NO: 412812 - DNA, 25 bp, Mus musculus
cactccgaggaatggcagtattaag

SEQ ID NO: 412813 - DNA, 25 bp, Mus musculus
cactccgatgaagcagacgtggctg

SEQ ID NO: 412814 - DNA, 25 bp, Mus musculus
cactccgcctgagggctacgatgtg

SEQ ID NO: 412815 - DNA, 25 bp, Mus musculus
cactccggcgtggaaagctgtgtac

SEQ ID NO: 412816 - DNA, 25 bp, Mus musculus
cactccgggcctatttgttcagctg

SEQ ID NO: 412817 - DNA, 25 bp, Mus musculus
cactccgggttgtggaggacctgct

SEQ ID NO: 412818 - DNA, 25 bp, Mus musculus
cactccggtggagagcatagtggct

SEQ ID NO: 412819 - DNA, 25 bp, Mus musculus
cactccgtggttcttaatcacattg

SEQ ID NO: 412820 - DNA, 25 bp, Mus musculus
cactcctcggcttcattcaaggcgg

SEQ ID NO: 412821 - DNA, 25 bp, Mus musculus
cactcctctataaaatgttctgcgc

SEQ ID NO: 412822 - DNA, 25 bp, Mus musculus
cactcctgcgttgtgtaaggaccgg

SEQ ID NO: 412823 - DNA, 25 bp, Mus musculus
cactcctggagtaaaatattgcctg

SEQ ID NO: 412824 - DNA, 25 bp, Mus musculus
cactcctggcatttttgtggtccgt

SEQ ID NO: 412825 - DNA, 25 bp, Mus musculus
cactcctggctgtcccttgtctgaa

SEQ ID NO: 412826 - DNA, 25 bp, Mus musculus
cactcctggctttgtgaggcaccca

SEQ ID NO: 412827 - DNA, 25 bp, Mus musculus
cactcctgggtattggaaattcata

SEQ ID NO: 412828 - DNA, 25 bp, Mus musculus
cactcctggtaattgatgttgcgct

SEQ ID NO: 412829 - DNA, 25 bp, Mus musculus
cactccttccttctgcgggttgaaa

SEQ ID NO: 412830 - DNA, 25 bp, Mus musculus
cactcgaagctgtaaaactgggtct

SEQ ID NO: 412831 - DNA, 25 bp, Mus musculus
cactcgaagtgttgtccaaacgtgg

SEQ ID NO: 412832 - DNA, 25 bp, Mus musculus
cactcgagccagataagggagagga

SEQ ID NO: 412833 - DNA, 25 bp, Mus musculus
cactcgcagtggaaagaacggccag

SEQ ID NO: 412834 - DNA, 25 bp, Mus musculus
cactcgcgagatctgacgcgccgat

SEQ ID NO: 412835 - DNA, 25 bp, Mus musculus
cactcgcgttaacaggaaggtggca

SEQ ID NO: 412836 - DNA, 25 bp, Mus musculus
cactcgctggctgtggaaccttgaa

SEQ ID NO: 412837 - DNA, 25 bp, Mus musculus
cactcggaggataaaggtctgcgga

SEQ ID NO: 412838 - DNA, 25 bp, Mus musculus
cactcggagtgggacaagctgttca

SEQ ID NO: 412839 - DNA, 25 bp, Mus musculus
cactcgggaggtagatacagggttt

SEQ ID NO: 412840 - DNA, 25 bp, Mus musculus
cactcgggtgtattgattggctgga

SEQ ID NO: 412841 - DNA, 25 bp, Mus musculus
cactcgggtgtggaaagaacatttc

SEQ ID NO: 412842 - DNA, 25 bp, Mus musculus
cactcggtgagggttaaagatcttt

SEQ ID NO: 412843 - DNA, 25 bp, Mus musculus
cactcgtcagattggcagttgtgga

SEQ ID NO: 412844 - DNA, 25 bp, Mus musculus
cactcgtccgatgttgaagatgtca

SEQ ID NO: 412845 - DNA, 25 bp, Mus musculus
cactcgtggtttatggtctgctggg

SEQ ID NO: 412846 - DNA, 25 bp, Mus musculus
cactcgtttgtcaatgtccctctga

SEQ ID NO: 412847 - DNA, 25 bp, Mus musculus
cactctaaggtgtgaagttgcccag

SEQ ID NO: 412848 - DNA, 25 bp, Mus musculus
cactctaagtcttgttgggactgcg

SEQ ID NO: 412849 - DNA, 25 bp, Mus musculus
cactctagcatttataggccctctg

SEQ ID NO: 412850 - DNA, 25 bp, Mus musculus
cactctaggcttggttgagccgtgc

SEQ ID NO: 412851 - DNA, 25 bp, Mus musculus
cactctcatgacatatttatgtggg

SEQ ID NO: 412852 - DNA, 25 bp, Mus musculus
cactctccctgtggctatagatagc

SEQ ID NO: 412853 - DNA, 25 bp, Mus musculus
cactctcctcaggtggaaaggcctt

SEQ ID NO: 412854 - DNA, 25 bp, Mus musculus
cactctcgggcagggacacgaggac

SEQ ID NO: 412855 - DNA, 25 bp, Mus musculus
cactctcgggtgtaacagctagcta

SEQ ID NO: 412856 - DNA, 25 bp, Mus musculus
cactctcgggttaggatccaggaaa

SEQ ID NO: 412857 - DNA, 25 bp, Mus musculus
cactctcgtgcagggtcgaggcaaa

SEQ ID NO: 412858 - DNA, 25 bp, Mus musculus
cactctctcctgctctagttgtctt

SEQ ID NO: 412859 - DNA, 25 bp, Mus musculus
cactctgagaacgagaagcacggga

SEQ ID NO: 412860 - DNA, 25 bp, Mus musculus
cactctgagctactagatctgccca

SEQ ID NO: 412861 - DNA, 25 bp, Mus musculus
cactctgagctttgctttctcgtca

SEQ ID NO: 412862 - DNA, 25 bp, Mus musculus
cactctgaggctaccaatgggcagg

SEQ ID NO: 412863 - DNA, 25 bp, Mus musculus
cactctgattgttatggccgcggcc

SEQ ID NO: 412864 - DNA, 25 bp, Mus musculus
cactctgatttggttcgtggcaggg

SEQ ID NO: 412865 - DNA, 25 bp, Mus musculus
cactctgcaagaagcagctgtaggt

SEQ ID NO: 412866 - DNA, 25 bp, Mus musculus
cactctgcagatgaagggtaaacct

SEQ ID NO: 412867 - DNA, 25 bp, Mus musculus
cactctgctgggagacgcatgctct

SEQ ID NO: 412868 - DNA, 25 bp, Mus musculus
cactctgggagaacttggaccttgt

SEQ ID NO: 412869 - DNA, 25 bp, Mus musculus
cactctggtggagtttctgcttgat

SEQ ID NO: 412870 - DNA, 25 bp, Mus musculus
cactctggttggtaagagggtctct

SEQ ID NO: 412871 - DNA, 25 bp, Mus musculus
cactctgtaagagtgagttggacca

SEQ ID NO: 412872 - DNA, 25 bp, Mus musculus
cactctgtacacctgcagggcgtaa

SEQ ID NO: 412873 - DNA, 25 bp, Mus musculus
cactctgtagctatagtcggagccc

SEQ ID NO: 412874 - DNA, 25 bp, Mus musculus
cactcttacagtgaaggccccaaag

SEQ ID NO: 412875 - DNA, 25 bp, Mus musculus
cactcttatacggacagctggcaca

SEQ ID NO: 412876 - DNA, 25 bp, Mus musculus
cactcttatggccatcagggaaacc

SEQ ID NO: 412877 - DNA, 25 bp, Mus musculus
cactcttccctagaattggagctga

SEQ ID NO: 412878 - DNA, 25 bp, Mus musculus
cactcttcgggtagcctggtacatc

SEQ ID NO: 412879 - DNA, 25 bp, Mus musculus
cactcttctctgactggcaggcaga

SEQ ID NO: 412880 - DNA, 25 bp, Mus musculus
cactcttgagttaaccattgaaagc

SEQ ID NO: 412881 - DNA, 25 bp, Mus musculus
cactcttggcgcgtgctggagcgca

SEQ ID NO: 412882 - DNA, 25 bp, Mus musculus
cactcttgtagtattcctgatggct

SEQ ID NO: 412883 - DNA, 25 bp, Mus musculus
cactcttgtatctctcactggacag

SEQ ID NO: 412884 - DNA, 25 bp, Mus musculus
cactctttgagcagcacggactggt

SEQ ID NO: 412885 - DNA, 25 bp, Mus musculus
cactctttgcggtcccacagtgcag

SEQ ID NO: 412886 - DNA, 25 bp, Mus musculus
cactctttgggtctgaagctgggca

SEQ ID NO: 412887 - DNA, 25 bp, Mus musculus
cactgaaaaaatactagacctttgc

SEQ ID NO: 412888 - DNA, 25 bp, Mus musculus
cactgaaaaatacgcagaggctttg

SEQ ID NO: 412889 - DNA, 25 bp, Mus musculus
cactgaaaattcataagcatggcca

SEQ ID NO: 412890 - DNA, 25 bp, Mus musculus
cactgaaacgttgcagcttgccaac

SEQ ID NO: 412891 - DNA, 25 bp, Mus musculus
cactgaaacttttccagacatggat

SEQ ID NO: 412892 - DNA, 25 bp, Mus musculus
cactgaaagggtagcagcgttagca

SEQ ID NO: 412893 - DNA, 25 bp, Mus musculus
cactgaaatcttcgatggcgtccgc

SEQ ID NO: 412894 - DNA, 25 bp, Mus musculus
cactgaacagatattacggaggaga

SEQ ID NO: 412895 - DNA, 25 bp, Mus musculus
cactgaacctgcagagctgactaaa

SEQ ID NO: 412896 - DNA, 25 bp, Mus musculus
cactgaactggaagggataagagcc

SEQ ID NO: 412897 - DNA, 25 bp, Mus musculus
cactgaagaaattagggacggcgtc

SEQ ID NO: 412898 - DNA, 25 bp, Mus musculus
cactgaagaggcagcagtatgctac

SEQ ID NO: 412899 - DNA, 25 bp, Mus musculus
cactgaagatccacattccggagcc

SEQ ID NO: 412900 - DNA, 25 bp, Mus musculus
cactgaagcacaaataggagacaca

SEQ ID NO: 412901 - DNA, 25 bp, Mus musculus
cactgaaggcccacatgaggaagac

SEQ ID NO: 412902 - DNA, 25 bp, Mus musculus
cactgaagtaagcaatcctggagca

SEQ ID NO: 412903 - DNA, 25 bp, Mus musculus
cactgaatctcagggtgccgtggac

SEQ ID NO: 412904 - DNA, 25 bp, Mus musculus
cactgaatgcagagaacggcgagac

SEQ ID NO: 412905 - DNA, 25 bp, Mus musculus
cactgacacagtaagaccggtgact

SEQ ID NO: 412906 - DNA, 25 bp, Mus musculus
cactgacagagagaagctagagcca

SEQ ID NO: 412907 - DNA, 25 bp, Mus musculus
cactgacagagatgattcgggctag

SEQ ID NO: 412908 - DNA, 25 bp, Mus musculus
cactgacaggacacgagctctatgc

SEQ ID NO: 412909 - DNA, 25 bp, Mus musculus
cactgacatggaaacagtgagttcc

SEQ ID NO: 412910 - DNA, 25 bp, Mus musculus
cactgacatgtacgtgcagcctgtg

SEQ ID NO: 412911 - DNA, 25 bp, Mus musculus
cactgaccgagaaggtgaggactag

SEQ ID NO: 412912 - DNA, 25 bp, Mus musculus
cactgaccggcctgtatgctatcca

SEQ ID NO: 412913 - DNA, 25 bp, Mus musculus
cactgaccgttgtagacttttgtac

SEQ ID NO: 412914 - DNA, 25 bp, Mus musculus
cactgacctggaactgaatgcctga

SEQ ID NO: 412915 - DNA, 25 bp, Mus musculus
cactgaccttggagcttgtaaacga

SEQ ID NO: 412916 - DNA, 25 bp, Mus musculus
cactgacggtgcatgccaagatgag

SEQ ID NO: 412917 - DNA, 25 bp, Mus musculus
cactgacgtgggaagccatggagca

SEQ ID NO: 412918 - DNA, 25 bp, Mus musculus
cactgactgcagacttgggccaagg

SEQ ID NO: 412919 - DNA, 25 bp, Mus musculus
cactgagaaaacgtcttttgtggaa

SEQ ID NO: 412920 - DNA, 25 bp, Mus musculus
cactgagaaggattagtgcctgtaa

SEQ ID NO: 412921 - DNA, 25 bp, Mus musculus
cactgagactgatacatacgcctgc

SEQ ID NO: 412922 - DNA, 25 bp, Mus musculus
cactgagatcagagtggtggctcct

SEQ ID NO: 412923 - DNA, 25 bp, Mus musculus
cactgagatccttcagggagggaac

SEQ ID NO: 412924 - DNA, 25 bp, Mus musculus
cactgagatgtctctctagacgaag

SEQ ID NO: 412925 - DNA, 25 bp, Mus musculus
cactgagcagttcatagttcaatat

SEQ ID NO: 412926 - DNA, 25 bp, Mus musculus
cactgagcatcccatgaagaaggcc

SEQ ID NO: 412927 - DNA, 25 bp, Mus musculus
cactgagcctgcaaagggaagggac

SEQ ID NO: 412928 - DNA, 25 bp, Mus musculus
cactgagcgcttctcgtcttgtgac

SEQ ID NO: 412929 - DNA, 25 bp, Mus musculus
cactgagctgaccaagctcctgttg

SEQ ID NO: 412930 - DNA, 25 bp, Mus musculus
cactgagctgcactctggccaggga

SEQ ID NO: 412931 - DNA, 25 bp, Mus musculus
cactgagctggctgaacgacaaggt

SEQ ID NO: 412932 - DNA, 25 bp, Mus musculus
cactgagctgttggtcccttctgac

SEQ ID NO: 412933 - DNA, 25 bp, Mus musculus
cactgaggtcctgaatgagtatttc

SEQ ID NO: 412934 - DNA, 25 bp, Mus musculus
cactgaggtgtactgtgcctaacca

SEQ ID NO: 412935 - DNA, 25 bp, Mus musculus
cactgaggttcagcatgggctacta

SEQ ID NO: 412936 - DNA, 25 bp, Mus musculus
cactgagtcactgcagaaagggaag

SEQ ID NO: 412937 - DNA, 25 bp, Mus musculus
cactgagtctgcatgaggattggca

SEQ ID NO: 412938 - DNA, 25 bp, Mus musculus
cactgagtgctagggaaactgccat

SEQ ID NO: 412939 - DNA, 25 bp, Mus musculus
cactgagttgcatgttgagcactgc

SEQ ID NO: 412940 - DNA, 25 bp, Mus musculus
cactgagtttacaagctggattccg

SEQ ID NO: 412941 - DNA, 25 bp, Mus musculus
cactgagtttagagcgaacgttccc

SEQ ID NO: 412942 - DNA, 25 bp, Mus musculus
cactgagtttggtgggagctgaccc

SEQ ID NO: 412943 - DNA, 25 bp, Mus musculus
cactgatcaagtggaagggacccaa

SEQ ID NO: 412944 - DNA, 25 bp, Mus musculus
cactgatcaatgcatggtgcctaaa

SEQ ID NO: 412945 - DNA, 25 bp, Mus musculus
cactgatcacaacggagctgagggc

SEQ ID NO: 412946 - DNA, 25 bp, Mus musculus
cactgatcgccaagagtgtactgca

SEQ ID NO: 412947 - DNA, 25 bp, Mus musculus
cactgatgcagaagaagactcagct

SEQ ID NO: 412948 - DNA, 25 bp, Mus musculus
cactgatgcccctcaggaaatggga

SEQ ID NO: 412949 - DNA, 25 bp, Mus musculus
cactgatgctgtacttctctggaga

SEQ ID NO: 412950 - DNA, 25 bp, Mus musculus
cactgatggaacaggatgaaggtcc

SEQ ID NO: 412951 - DNA, 25 bp, Mus musculus
cactgatgggcacagagaagtcaca

SEQ ID NO: 412952 - DNA, 25 bp, Mus musculus
cactgatgggcgaagactgtctgaa

SEQ ID NO: 412953 - DNA, 25 bp, Mus musculus
cactgatgtgtaaggactagaggcc

SEQ ID NO: 412954 - DNA, 25 bp, Mus musculus
cactgattgtgtcctctgggtaaag

SEQ ID NO: 412955 - DNA, 25 bp, Mus musculus
cactgattttttggtcaggtttcac

SEQ ID NO: 412956 - DNA, 25 bp, Mus musculus
cactgcaaagagcacaagccatgtg

SEQ ID NO: 412957 - DNA, 25 bp, Mus musculus
cactgcaaagtgtgttgaattgttc

SEQ ID NO: 412958 - DNA, 25 bp, Mus musculus
cactgcaagggcacaaacaggcgat

SEQ ID NO: 412959 - DNA, 25 bp, Mus musculus
cactgcaatgtctttgtggaacacg

SEQ ID NO: 412960 - DNA, 25 bp, Mus musculus
cactgcacacgtctagaggctgtaa

SEQ ID NO: 412961 - DNA, 25 bp, Mus musculus
cactgcaccaaggaagaccgggtgt

SEQ ID NO: 412962 - DNA, 25 bp, Mus musculus
cactgcacgtggtactgaagaacca

SEQ ID NO: 412963 - DNA, 25 bp, Mus musculus
cactgcactgcaaatggaacctgga

SEQ ID NO: 412964 - DNA, 25 bp, Mus musculus
cactgcagacatttccttaacattg

SEQ ID NO: 412965 - DNA, 25 bp, Mus musculus
cactgcagagatgctatgggactca

SEQ ID NO: 412966 - DNA, 25 bp, Mus musculus
cactgcagcctaactacctgtctgt

SEQ ID NO: 412967 - DNA, 25 bp, Mus musculus
cactgcaggaaagggacttaggcgc

SEQ ID NO: 412968 - DNA, 25 bp, Mus musculus
cactgcaggagtcatgaagcgcttt

SEQ ID NO: 412969 - DNA, 25 bp, Mus musculus
cactgcaggtaggatcgaccgtgaa

SEQ ID NO: 412970 - DNA, 25 bp, Mus musculus
cactgcaggtggaaaactggtcaca

SEQ ID NO: 412971 - DNA, 25 bp, Mus musculus
cactgcagtccaagagatggcgcga

SEQ ID NO: 412972 - DNA, 25 bp, Mus musculus
cactgcatattacttggattaacca

SEQ ID NO: 412973 - DNA, 25 bp, Mus musculus
cactgcatcggtggaggaggattct

SEQ ID NO: 412974 - DNA, 25 bp, Mus musculus
cactgcatgctgtagaaacggcaac

SEQ ID NO: 412975 - DNA, 25 bp, Mus musculus
cactgcatggtaaactcggcttggt

SEQ ID NO: 412976 - DNA, 25 bp, Mus musculus
cactgccaactgatgggactggaca

SEQ ID NO: 412977 - DNA, 25 bp, Mus musculus
cactgccacaccaatggagggtact

SEQ ID NO: 412978 - DNA, 25 bp, Mus musculus
cactgccacagtgcagatatcttta

SEQ ID NO: 412979 - DNA, 25 bp, Mus musculus
cactgccagagtcaccattgaatct

SEQ ID NO: 412980 - DNA, 25 bp, Mus musculus
cactgccagtgtgcaaggatagact

SEQ ID NO: 412981 - DNA, 25 bp, Mus musculus
cactgccatgatgaggtggtctgaa

SEQ ID NO: 412982 - DNA, 25 bp, Mus musculus
cactgcccaccgactactggaaggt

SEQ ID NO: 412983 - DNA, 25 bp, Mus musculus
cactgcccaggttgtcttcttagat

SEQ ID NO: 412984 - DNA, 25 bp, Mus musculus
cactgcccagtgtggccgttagcca

SEQ ID NO: 412985 - DNA, 25 bp, Mus musculus
cactgccccggtttactttcattga

SEQ ID NO: 412986 - DNA, 25 bp, Mus musculus
cactgcccctaggtaaagagataag

SEQ ID NO: 412987 - DNA, 25 bp, Mus musculus
cactgcccgctgtatgaagactgta

SEQ ID NO: 412988 - DNA, 25 bp, Mus musculus
cactgccctgtaagcgtgttagagg

SEQ ID NO: 412989 - DNA, 25 bp, Mus musculus
cactgccctgttggctgctagtcag

SEQ ID NO: 412990 - DNA, 25 bp, Mus musculus
cactgcccttgatgtgggcgcaaag

SEQ ID NO: 412991 - DNA, 25 bp, Mus musculus
cactgccgaggggaacattcatgct

SEQ ID NO: 412992 - DNA, 25 bp, Mus musculus
cactgccggagtggtgttgccaaag

SEQ ID NO: 412993 - DNA, 25 bp, Mus musculus
cactgccgggatatggaagaagcga

SEQ ID NO: 412994 - DNA, 25 bp, Mus musculus
cactgcctaagtgggagcatgcacg

SEQ ID NO: 412995 - DNA, 25 bp, Mus musculus
cactgcctccagtccttaaagtaag

SEQ ID NO: 412996 - DNA, 25 bp, Mus musculus
cactgcctgaggaccgaggtttgta

SEQ ID NO: 412997 - DNA, 25 bp, Mus musculus
cactgcctgggtgctcctttataca

SEQ ID NO: 412998 - DNA, 25 bp, Mus musculus
cactgcctgggttggatttgtaaac

SEQ ID NO: 412999 - DNA, 25 bp, Mus musculus
cactgcctgttgatgtgggcttaca

SEQ ID NO: 413000 - DNA, 25 bp, Mus musculus
cactgcgattccttgtcctgtgcaa

SEQ ID NO: 413001 - DNA, 25 bp, Mus musculus
cactgcgcaggttgctcagcggaac

SEQ ID NO: 413002 - DNA, 25 bp, Mus musculus
cactgcgctgtctcgcaaggaggca

SEQ ID NO: 413003 - DNA, 25 bp, Mus musculus
cactgcggagccattgaggagcatt

SEQ ID NO: 413004 - DNA, 25 bp, Mus musculus
cactgcggcgtcacagaaactaggc

SEQ ID NO: 413005 - DNA, 25 bp, Mus musculus
cactgcgggtgcatgccacttctgt

SEQ ID NO: 413006 - DNA, 25 bp, Mus musculus
cactgctcaccagggctactgagga

SEQ ID NO: 413007 - DNA, 25 bp, Mus musculus
cactgctgagatgctagttcatgac

SEQ ID NO: 413008 - DNA, 25 bp, Mus musculus
cactgctgagcaagtgcctgtgaag

SEQ ID NO: 413009 - DNA, 25 bp, Mus musculus
cactgctggacgtaaggatccttga

SEQ ID NO: 413010 - DNA, 25 bp, Mus musculus
cactgctggcccaagttgttcctgg

SEQ ID NO: 413011 - DNA, 25 bp, Mus musculus
cactgctggcttcggaagagatcac

SEQ ID NO: 413012 - DNA, 25 bp, Mus musculus
cactgctgggcaatgccatcgcctt

SEQ ID NO: 413013 - DNA, 25 bp, Mus musculus
cactgctgtggttgttccttggacc

SEQ ID NO: 413014 - DNA, 25 bp, Mus musculus
cactgcttaaaacctagggtgtggg

SEQ ID NO: 413015 - DNA, 25 bp, Mus musculus
cactgcttccttggcagagtcggat

SEQ ID NO: 413016 - DNA, 25 bp, Mus musculus
cactgcttggagtcatgcatgacac

SEQ ID NO: 413017 - DNA, 25 bp, Mus musculus
cactgctttaagaattcgggactca

SEQ ID NO: 413018 - DNA, 25 bp, Mus musculus
cactgctttaagttctagatgattg

SEQ ID NO: 413019 - DNA, 25 bp, Mus musculus
cactgctttcctgccatgaggcttt

SEQ ID NO: 413020 - DNA, 25 bp, Mus musculus
cactgctttgaaggatgactgggag

SEQ ID NO: 413021 - DNA, 25 bp, Mus musculus
cactggaaattcttgttcagtcggg

SEQ ID NO: 413022 - DNA, 25 bp, Mus musculus
cactggaagacatggtgcgcctgcg

SEQ ID NO: 413023 - DNA, 25 bp, Mus musculus
cactggaagatgacggcagccagaa

SEQ ID NO: 413024 - DNA, 25 bp, Mus musculus
cactggaagcctttgaggagatccc

SEQ ID NO: 413025 - DNA, 25 bp, Mus musculus
cactggaatgaatgaaggcctctgg

SEQ ID NO: 413026 - DNA, 25 bp, Mus musculus
cactggacacatccgtgagcaggga

SEQ ID NO: 413027 - DNA, 25 bp, Mus musculus
cactggacagagatgccctattgca

SEQ ID NO: 413028 - DNA, 25 bp, Mus musculus
cactggacagcatatttaagaaaca

SEQ ID NO: 413029 - DNA, 25 bp, Mus musculus
cactggacatggacaatcctcggga

SEQ ID NO: 413030 - DNA, 25 bp, Mus musculus
cactggaccaatacgggctgcatca

SEQ ID NO: 413031 - DNA, 25 bp, Mus musculus
cactggaccatcttatcttggcttg

SEQ ID NO: 413032 - DNA, 25 bp, Mus musculus
cactggaccttggataagtgtggca

SEQ ID NO: 413033 - DNA, 25 bp, Mus musculus
cactggacgaggtgggtctggtctc

SEQ ID NO: 413034 - DNA, 25 bp, Mus musculus
cactggacgccggaggaaagaactc

SEQ ID NO: 413035 - DNA, 25 bp, Mus musculus
cactggagaaacacgggagtgtgtc

SEQ ID NO: 413036 - DNA, 25 bp, Mus musculus
cactggagaccttgccaggccttgg

SEQ ID NO: 413037 - DNA, 25 bp, Mus musculus
cactggagactgagcaaaaggaaat

SEQ ID NO: 413038 - DNA, 25 bp, Mus musculus
cactggagatctcttctaatgggag

SEQ ID NO: 413039 - DNA, 25 bp, Mus musculus
cactggaggacagcatatacgggac

SEQ ID NO: 413040 - DNA, 25 bp, Mus musculus
cactggaggcaatctttctacctgc

SEQ ID NO: 413041 - DNA, 25 bp, Mus musculus
cactggaggctgtcgctgttgtctg

SEQ ID NO: 413042 - DNA, 25 bp, Mus musculus
cactggagggcttcgtcatcgtgat

SEQ ID NO: 413043 - DNA, 25 bp, Mus musculus
cactggatcaaaggtgtgagtcatt

SEQ ID NO: 413044 - DNA, 25 bp, Mus musculus
cactggatccagaacaatacgaggg

SEQ ID NO: 413045 - DNA, 25 bp, Mus musculus
cactggatctggagtcggaggctca

SEQ ID NO: 413046 - DNA, 25 bp, Mus musculus
cactggatgataggagttcaaggcc

SEQ ID NO: 413047 - DNA, 25 bp, Mus musculus
cactggatggaggtgaatgactaac

SEQ ID NO: 413048 - DNA, 25 bp, Mus musculus
cactggatggcacaactgggcctct

SEQ ID NO: 413049 - DNA, 25 bp, Mus musculus
cactggatggcttcaggcgatcttc

SEQ ID NO: 413050 - DNA, 25 bp, Mus musculus
cactggatggctttggactgtacac

SEQ ID NO: 413051 - DNA, 25 bp, Mus musculus
cactggattttctgcgacagcggct

SEQ ID NO: 413052 - DNA, 25 bp, Mus musculus
cactggcaaagaagctggagaaact

SEQ ID NO: 413053 - DNA, 25 bp, Mus musculus
cactggcaagttcatccgtcctgga

SEQ ID NO: 413054 - DNA, 25 bp, Mus musculus
cactggcactatggtgggatttccc

SEQ ID NO: 413055 - DNA, 25 bp, Mus musculus
cactggcacttggtggacgactctt

SEQ ID NO: 413056 - DNA, 25 bp, Mus musculus
cactggcagggcaatctttgagatc

SEQ ID NO: 413057 - DNA, 25 bp, Mus musculus
cactggcagtgatgtcatgagaccc

SEQ ID NO: 413058 - DNA, 25 bp, Mus musculus
cactggcagtggttatggaggcaac

SEQ ID NO: 413059 - DNA, 25 bp, Mus musculus
cactggcatccggaagaacttggag

SEQ ID NO: 413060 - DNA, 25 bp, Mus musculus
cactggcatcctcaacgtggatgag

SEQ ID NO: 413061 - DNA, 25 bp, Mus musculus
cactggcatcgctcggtggctcggg

SEQ ID NO: 413062 - DNA, 25 bp, Mus musculus
cactggcattctgatcattctggag

SEQ ID NO: 413063 - DNA, 25 bp, Mus musculus
cactggccagcaaggagcatggact

SEQ ID NO: 413064 - DNA, 25 bp, Mus musculus
cactggccagccagttcaagtacgc

SEQ ID NO: 413065 - DNA, 25 bp, Mus musculus
cactggccagcgaggatcgaacatg

SEQ ID NO: 413066 - DNA, 25 bp, Mus musculus
cactggccagtacgtcaagaaagat

SEQ ID NO: 413067 - DNA, 25 bp, Mus musculus
cactggccatagcttgagcatacga

SEQ ID NO: 413068 - DNA, 25 bp, Mus musculus
cactggccatgtttagaaaaagtac

SEQ ID NO: 413069 - DNA, 25 bp, Mus musculus
cactggcccggatgaatggacggct

SEQ ID NO: 413070 - DNA, 25 bp, Mus musculus
cactggcccggtgtcgaaaacgttg

SEQ ID NO: 413071 - DNA, 25 bp, Mus musculus
cactggccctgatgaccgggaggat

SEQ ID NO: 413072 - DNA, 25 bp, Mus musculus
cactggccggtggaggcttaactca

SEQ ID NO: 413073 - DNA, 25 bp, Mus musculus
cactggcctctatggagacatactc

SEQ ID NO: 413074 - DNA, 25 bp, Mus musculus
cactggcctgcacaactctgtattt

SEQ ID NO: 413075 - DNA, 25 bp, Mus musculus
cactggcctggaagatattaaatgt

SEQ ID NO: 413076 - DNA, 25 bp, Mus musculus
cactggcgccccaaagatgtggtgg

SEQ ID NO: 413077 - DNA, 25 bp, Mus musculus
cactggcgggagtgcttaggccact

SEQ ID NO: 413078 - DNA, 25 bp, Mus musculus
cactggcgtcagtaaggacattcag

SEQ ID NO: 413079 - DNA, 25 bp, Mus musculus
cactggcgtggaaaggatcgagctc

SEQ ID NO: 413080 - DNA, 25 bp, Mus musculus
cactggctctaaagcagatcgggcc

SEQ ID NO: 413081 - DNA, 25 bp, Mus musculus
cactggctgccaagacctgatttca

SEQ ID NO: 413082 - DNA, 25 bp, Mus musculus
cactggctgcgacatagattggaac

SEQ ID NO: 413083 - DNA, 25 bp, Mus musculus
cactggctgcggtatgcgtggccaa

SEQ ID NO: 413084 - DNA, 25 bp, Mus musculus
cactggctgctgtggtgacaacgac

SEQ ID NO: 413085 - DNA, 25 bp, Mus musculus
cactggctggactgggctaaagaga

SEQ ID NO: 413086 - DNA, 25 bp, Mus musculus
cactggctggctaacgtcaaatacc

SEQ ID NO: 413087 - DNA, 25 bp, Mus musculus
cactggctgggtacctggctttgta

SEQ ID NO: 413088 - DNA, 25 bp, Mus musculus
cactggctgtgattttctgtaatgc

SEQ ID NO: 413089 - DNA, 25 bp, Mus musculus
cactggctgtgctttgctgtttagg

SEQ ID NO: 413090 - DNA, 25 bp, Mus musculus
cactggcttaactcagtggtagaag

SEQ ID NO: 413091 - DNA, 25 bp, Mus musculus
cactggctttcttgggcccacagga

SEQ ID NO: 413092 - DNA, 25 bp, Mus musculus
cactggcttttacgtggcgaagagc

SEQ ID NO: 413093 - DNA, 25 bp, Mus musculus
cactgggaaaaagtgtggatggact

SEQ ID NO: 413094 - DNA, 25 bp, Mus musculus
cactgggaaatgatccaacagggca

SEQ ID NO: 413095 - DNA, 25 bp, Mus musculus
cactgggacactctgtgctttaaca

SEQ ID NO: 413096 - DNA, 25 bp, Mus musculus
cactgggacatctctgtagcaacaa

SEQ ID NO: 413097 - DNA, 25 bp, Mus musculus
cactgggagaattagataatagggc

SEQ ID NO: 413098 - DNA, 25 bp, Mus musculus
cactgggagctgaaacggaaaccta

SEQ ID NO: 413099 - DNA, 25 bp, Mus musculus
cactgggagtctgcaaaaagctaca

SEQ ID NO: 413100 - DNA, 25 bp, Mus musculus
cactgggagttctgagatttggtca

SEQ ID NO: 413101 - DNA, 25 bp, Mus musculus
cactgggattggctttgacgagttt

SEQ ID NO: 413102 - DNA, 25 bp, Mus musculus
cactgggcacagagcatcgatggta

SEQ ID NO: 413103 - DNA, 25 bp, Mus musculus
cactgggcatactgaatgggtcacc

SEQ ID NO: 413104 - DNA, 25 bp, Mus musculus
cactgggcatatcaagctgccttga

SEQ ID NO: 413105 - DNA, 25 bp, Mus musculus
cactgggcccaacactaagcaaaac

SEQ ID NO: 413106 - DNA, 25 bp, Mus musculus
cactgggcccaacgcataggctgat

SEQ ID NO: 413107 - DNA, 25 bp, Mus musculus
cactgggccgactgggccccttagg

SEQ ID NO: 413108 - DNA, 25 bp, Mus musculus
cactgggccgcctggtgaagtttgc

SEQ ID NO: 413109 - DNA, 25 bp, Mus musculus
cactgggcctccagagcgcttggat

SEQ ID NO: 413110 - DNA, 25 bp, Mus musculus
cactgggctcgtgctacaaatgtca

SEQ ID NO: 413111 - DNA, 25 bp, Mus musculus
cactgggctgaagcaggtacctaaa

SEQ ID NO: 413112 - DNA, 25 bp, Mus musculus
cactgggctgacatgttggccaacc

SEQ ID NO: 413113 - DNA, 25 bp, Mus musculus
cactgggtaatcagcacctgttgtg

SEQ ID NO: 413114 - DNA, 25 bp, Mus musculus
cactgggtgtgcactccgagcgatc

SEQ ID NO: 413115 - DNA, 25 bp, Mus musculus
cactggtaaactgcatggactgggc

SEQ ID NO: 413116 - DNA, 25 bp, Mus musculus
cactggtacacgtgggtcgctacga

SEQ ID NO: 413117 - DNA, 25 bp, Mus musculus
cactggtaccatccccacttaagag

SEQ ID NO: 413118 - DNA, 25 bp, Mus musculus
cactggtagatttgcatggatactt

SEQ ID NO: 413119 - DNA, 25 bp, Mus musculus
cactggtctagctctctatggtgga

SEQ ID NO: 413120 - DNA, 25 bp, Mus musculus
cactggtctcatacattggctctca

SEQ ID NO: 413121 - DNA, 25 bp, Mus musculus
cactggtctggatggcagctggtac

SEQ ID NO: 413122 - DNA, 25 bp, Mus musculus
cactggtgaccggatatgccgccta

SEQ ID NO: 413123 - DNA, 25 bp, Mus musculus
cactggtgatggacgtacagaccca

SEQ ID NO: 413124 - DNA, 25 bp, Mus musculus
cactggtgcattgcaggtgcgtctc

SEQ ID NO: 413125 - DNA, 25 bp, Mus musculus
cactggtgccctttgtgcagaatct

SEQ ID NO: 413126 - DNA, 25 bp, Mus musculus
cactggtgctggtaacgtttgtctc

SEQ ID NO: 413127 - DNA, 25 bp, Mus musculus
cactggtggaaagctgaaactgtca

SEQ ID NO: 413128 - DNA, 25 bp, Mus musculus
cactggtggatgtggccctaaagcg

SEQ ID NO: 413129 - DNA, 25 bp, Mus musculus
cactggtgtgtacaatcagacaagc

SEQ ID NO: 413130 - DNA, 25 bp, Mus musculus
cactggtgtttaagttgaagagcag

SEQ ID NO: 413131 - DNA, 25 bp, Mus musculus
cactggttcctacctgaaggctggc

SEQ ID NO: 413132 - DNA, 25 bp, Mus musculus
cactggttgctaacgctatgggagt

SEQ ID NO: 413133 - DNA, 25 bp, Mus musculus
cactggttggctgactgacgggcta

SEQ ID NO: 413134 - DNA, 25 bp, Mus musculus
cactggttggtggtcctgtatcatt

SEQ ID NO: 413135 - DNA, 25 bp, Mus musculus
cactggttgtcagcggttcagggca

SEQ ID NO: 413136 - DNA, 25 bp, Mus musculus
cactggtttcagtataggcatgcgc

SEQ ID NO: 413137 - DNA, 25 bp, Mus musculus
cactggtttccaaagagtttaggca

SEQ ID NO: 413138 - DNA, 25 bp, Mus musculus
cactggtttccttaccctggtcagg

SEQ ID NO: 413139 - DNA, 25 bp, Mus musculus
cactgtagagatggccaaaagtcac

SEQ ID NO: 413140 - DNA, 25 bp, Mus musculus
cactgtaggcatcccattctgatga

SEQ ID NO: 413141 - DNA, 25 bp, Mus musculus
cactgtatattccacatatgagaaa

SEQ ID NO: 413142 - DNA, 25 bp, Mus musculus
cactgtcacggagaagagatggagc

SEQ ID NO: 413143 - DNA, 25 bp, Mus musculus
cactgtcacgttggcggtcatcaca

SEQ ID NO: 413144 - DNA, 25 bp, Mus musculus
cactgtcatctaggctgctctgcaa

SEQ ID NO: 413145 - DNA, 25 bp, Mus musculus
cactgtcatgtagcaggagcctcga

SEQ ID NO: 413146 - DNA, 25 bp, Mus musculus
cactgtccatgttggtttggaatgt

SEQ ID NO: 413147 - DNA, 25 bp, Mus musculus
cactgtcccaggaaaagaatagggc

SEQ ID NO: 413148 - DNA, 25 bp, Mus musculus
cactgtcccctagaaggaatcctga

SEQ ID NO: 413149 - DNA, 25 bp, Mus musculus
cactgtcccgtgtacagagtggaga

SEQ ID NO: 413150 - DNA, 25 bp, Mus musculus
cactgtccgatgaagaaactcaggg

SEQ ID NO: 413151 - DNA, 25 bp, Mus musculus
cactgtccgtctcctgggctggaaa

SEQ ID NO: 413152 - DNA, 25 bp, Mus musculus
cactgtcgctcactccctactttgt

SEQ ID NO: 413153 - DNA, 25 bp, Mus musculus
cactgtcgctggttagcctcaggga

SEQ ID NO: 413154 - DNA, 25 bp, Mus musculus
cactgtctacctgggaaagcgggac

SEQ ID NO: 413155 - DNA, 25 bp, Mus musculus
cactgtctgatcatggcaaggcttg

SEQ ID NO: 413156 - DNA, 25 bp, Mus musculus
cactgtctgctggtcacaatggccg

SEQ ID NO: 413157 - DNA, 25 bp, Mus musculus
cactgtctgtctgggatggcttcca

SEQ ID NO: 413158 - DNA, 25 bp, Mus musculus
cactgtctgtgcatcagctggtgga

SEQ ID NO: 413159 - DNA, 25 bp, Mus musculus
cactgtcttctggtatcaggaagcc

SEQ ID NO: 413160 - DNA, 25 bp, Mus musculus
cactgtcttgacctatggaagtgaa

SEQ ID NO: 413161 - DNA, 25 bp, Mus musculus
cactgtgaacacaatttatagctgt

SEQ ID NO: 413162 - DNA, 25 bp, Mus musculus
cactgtgaagtttagaatggagctc

SEQ ID NO: 413163 - DNA, 25 bp, Mus musculus
cactgtgaccatttgggtataggag

SEQ ID NO: 413164 - DNA, 25 bp, Mus musculus
cactgtgacgatcaccgaagccaag

SEQ ID NO: 413165 - DNA, 25 bp, Mus musculus
cactgtgactatgaaaatcggcaga

SEQ ID NO: 413166 - DNA, 25 bp, Mus musculus
cactgtgagcctagccaagaaggta

SEQ ID NO: 413167 - DNA, 25 bp, Mus musculus
cactgtgatgggacggctgaacaaa

SEQ ID NO: 413168 - DNA, 25 bp, Mus musculus
cactgtgcgtggaaagcgtagacaa

SEQ ID NO: 413169 - DNA, 25 bp, Mus musculus
cactgtgctcacagacatgtggttt

SEQ ID NO: 413170 - DNA, 25 bp, Mus musculus
cactgtgctcgtgtgtggaggactc

SEQ ID NO: 413171 - DNA, 25 bp, Mus musculus
cactgtgctgggacaaaggtaacct

SEQ ID NO: 413172 - DNA, 25 bp, Mus musculus
cactgtggacaccaggcttgcatgt

SEQ ID NO: 413173 - DNA, 25 bp, Mus musculus
cactgtggcaagtgtgacagcgaca

SEQ ID NO: 413174 - DNA, 25 bp, Mus musculus
cactgtggcagctccaatagccagg

SEQ ID NO: 413175 - DNA, 25 bp, Mus musculus
cactgtggccttaggaggatactgg

SEQ ID NO: 413176 - DNA, 25 bp, Mus musculus
cactgtggtaccctgtcaagagcct

SEQ ID NO: 413177 - DNA, 25 bp, Mus musculus
cactgtggtcctacgtgtcggtgaa

SEQ ID NO: 413178 - DNA, 25 bp, Mus musculus
cactgtggtgtgctctacgaagact

SEQ ID NO: 413179 - DNA, 25 bp, Mus musculus
cactgtggttctgtctacgttcata

SEQ ID NO: 413180 - DNA, 25 bp, Mus musculus
cactgtgtcctcagaaggtagggca

SEQ ID NO: 413181 - DNA, 25 bp, Mus musculus
cactgtgtcggagaccgagatcacc

SEQ ID NO: 413182 - DNA, 25 bp, Mus musculus
cactgtgtctctcctgtctgaagac

SEQ ID NO: 413183 - DNA, 25 bp, Mus musculus
cactgtgtctgtctcaggctaggca

SEQ ID NO: 413184 - DNA, 25 bp, Mus musculus
cactgtgtgactttgcccaggtccc

SEQ ID NO: 413185 - DNA, 25 bp, Mus musculus
cactgtgtgagaagcgtcctggcta

SEQ ID NO: 413186 - DNA, 25 bp, Mus musculus
cactgtgtgccgataaagacagcca

SEQ ID NO: 413187 - DNA, 25 bp, Mus musculus
cactgtgtgcggttcctattgctca

SEQ ID NO: 413188 - DNA, 25 bp, Mus musculus
cactgtgtggcaagagggcattaca

SEQ ID NO: 413189 - DNA, 25 bp, Mus musculus
cactgtgtggtaagagctgctcctc

SEQ ID NO: 413190 - DNA, 25 bp, Mus musculus
cactgtgtgtcgactgctactcaac

SEQ ID NO: 413191 - DNA, 25 bp, Mus musculus
cactgttaacgttgcctttcagagg

SEQ ID NO: 413192 - DNA, 25 bp, Mus musculus
cactgttaagatcgccaaggtgacc

SEQ ID NO: 413193 - DNA, 25 bp, Mus musculus
cactgttaagggatcaagctcagcc

SEQ ID NO: 413194 - DNA, 25 bp, Mus musculus
cactgttcccgtctatgaaggctac

SEQ ID NO: 413195 - DNA, 25 bp, Mus musculus
cactgttgacaaacgcatggacttt

SEQ ID NO: 413196 - DNA, 25 bp, Mus musculus
cactgttgagctgggagagtagccc

SEQ ID NO: 413197 - DNA, 25 bp, Mus musculus
cactgttgcagtaaagcctgcttcc

SEQ ID NO: 413198 - DNA, 25 bp, Mus musculus
cactgttggaggcagcagcaagaat

SEQ ID NO: 413199 - DNA, 25 bp, Mus musculus
cactgttgtaaacgaggccgccatg

SEQ ID NO: 413200 - DNA, 25 bp, Mus musculus
cactgttgtctgctgtaaggatcaa

SEQ ID NO: 413201 - DNA, 25 bp, Mus musculus
cactgttgtgcctgggtttcctgct

SEQ ID NO: 413202 - DNA, 25 bp, Mus musculus
cactgtttaagcagcaggagcatga

SEQ ID NO: 413203 - DNA, 25 bp, Mus musculus
cactgtttgattgccgagaggagac

SEQ ID NO: 413204 - DNA, 25 bp, Mus musculus
cactgtttgcctagaaagccagaag

SEQ ID NO: 413205 - DNA, 25 bp, Mus musculus
cacttaaaagatgcagcctgggcta

SEQ ID NO: 413206 - DNA, 25 bp, Mus musculus
cacttaaagacacatgggcagagcc

SEQ ID NO: 413207 - DNA, 25 bp, Mus musculus
cacttaaatgaagtgctcagctgaa

SEQ ID NO: 413208 - DNA, 25 bp, Mus musculus
cacttaaccacagagagaacaccag

SEQ ID NO: 413209 - DNA, 25 bp, Mus musculus
cacttaagatcaaccaagggcctgg

SEQ ID NO: 413210 - DNA, 25 bp, Mus musculus
cacttaaggagggtgtgtgtacttc

SEQ ID NO: 413211 - DNA, 25 bp, Mus musculus
cacttaaggcaagtagacaagccaa

SEQ ID NO: 413212 - DNA, 25 bp, Mus musculus
cacttaagttggaatggtagtttct

SEQ ID NO: 413213 - DNA, 25 bp, Mus musculus
cacttaatactgaccgccatggatg

SEQ ID NO: 413214 - DNA, 25 bp, Mus musculus
cacttacatgtattccccaaatgtt

SEQ ID NO: 413215 - DNA, 25 bp, Mus musculus
cacttacccttccttcttgttgcaa

SEQ ID NO: 413216 - DNA, 25 bp, Mus musculus
cacttacgagcgctacagagggaca

SEQ ID NO: 413217 - DNA, 25 bp, Mus musculus
cacttacggtgctgatctccctgag

SEQ ID NO: 413218 - DNA, 25 bp, Mus musculus
cacttactgcaccaagcacgtggcg

SEQ ID NO: 413219 - DNA, 25 bp, Mus musculus
cacttagaaattgaaaagctctctg

SEQ ID NO: 413220 - DNA, 25 bp, Mus musculus
cacttagccccagaagtattttggg

SEQ ID NO: 413221 - DNA, 25 bp, Mus musculus
cacttagctacaatcaaaatgagga

SEQ ID NO: 413222 - DNA, 25 bp, Mus musculus
cacttagctagcctgaggctgcact

SEQ ID NO: 413223 - DNA, 25 bp, Mus musculus
cacttaggcttgtctcctgggttaa

SEQ ID NO: 413224 - DNA, 25 bp, Mus musculus
cacttaggtgaaaaagtccttcagg

SEQ ID NO: 413225 - DNA, 25 bp, Mus musculus
cacttaggttgccatgtcaggcgaa

SEQ ID NO: 413226 - DNA, 25 bp, Mus musculus
cacttagtaagtgctcacttggctc

SEQ ID NO: 413227 - DNA, 25 bp, Mus musculus
cacttagtaattttcgtcggagcac

SEQ ID NO: 413228 - DNA, 25 bp, Mus musculus
cacttatcgtgtgagcttggccaaa

SEQ ID NO: 413229 - DNA, 25 bp, Mus musculus
cacttatctgcactaaactttctct

SEQ ID NO: 413230 - DNA, 25 bp, Mus musculus
cacttatgagtgcagatccaccgta

SEQ ID NO: 413231 - DNA, 25 bp, Mus musculus
cacttatgctgtacgctgccgagag

SEQ ID NO: 413232 - DNA, 25 bp, Mus musculus
cacttatggaattgagcccttggag

SEQ ID NO: 413233 - DNA, 25 bp, Mus musculus
cacttatggtacaggagcagcggct

SEQ ID NO: 413234 - DNA, 25 bp, Mus musculus
cacttattacatggccggaggtacc

SEQ ID NO: 413235 - DNA, 25 bp, Mus musculus
cacttattattgagtggcctcagga

SEQ ID NO: 413236 - DNA, 25 bp, Mus musculus
cacttatttgactgtgtggccaagc

SEQ ID NO: 413237 - DNA, 25 bp, Mus musculus
cacttattttgccaacctgtggaag

SEQ ID NO: 413238 - DNA, 25 bp, Mus musculus
cacttcaagatacaaaagtgagaag

SEQ ID NO: 413239 - DNA, 25 bp, Mus musculus
cacttcaagttaactgctacggttc

SEQ ID NO: 413240 - DNA, 25 bp, Mus musculus
cacttcacaaaaaaggcccgggcag

SEQ ID NO: 413241 - DNA, 25 bp, Mus musculus
cacttcacaagactctgaagcaagc

SEQ ID NO: 413242 - DNA, 25 bp, Mus musculus
cacttcacagagcagaggtggccct

SEQ ID NO: 413243 - DNA, 25 bp, Mus musculus
cacttcagacgcacacaggttggca

SEQ ID NO: 413244 - DNA, 25 bp, Mus musculus
cacttcagagatgagatagcagcct

SEQ ID NO: 413245 - DNA, 25 bp, Mus musculus
cacttcagagccttgttggacagca

SEQ ID NO: 413246 - DNA, 25 bp, Mus musculus
cacttcaggacaaaagcagtgactg

SEQ ID NO: 413247 - DNA, 25 bp, Mus musculus
cacttcataaaggagtgacatcata

SEQ ID NO: 413248 - DNA, 25 bp, Mus musculus
cacttcatggagaacgagcgtctga

SEQ ID NO: 413249 - DNA, 25 bp, Mus musculus
cacttcatgggcctgtggcaaggca

SEQ ID NO: 413250 - DNA, 25 bp, Mus musculus
cacttccaaaggctggcgttggcca

SEQ ID NO: 413251 - DNA, 25 bp, Mus musculus
cacttccagtgaggagagctctact

SEQ ID NO: 413252 - DNA, 25 bp, Mus musculus
cacttcccgagtgagtatggcctac

SEQ ID NO: 413253 - DNA, 25 bp, Mus musculus
cacttccgagagcaggatggcatcc

SEQ ID NO: 413254 - DNA, 25 bp, Mus musculus
cacttccgcacttacttggtattcg

SEQ ID NO: 413255 - DNA, 25 bp, Mus musculus
cacttccggaaaaagcgatgggcgg

SEQ ID NO: 413256 - DNA, 25 bp, Mus musculus
cacttccggacaagtggcagcacga

SEQ ID NO: 413257 - DNA, 25 bp, Mus musculus
cacttccgggtgttgtctggccgcc

SEQ ID NO: 413258 - DNA, 25 bp, Mus musculus
cacttccgtttgtttgtggaagcac

SEQ ID NO: 413259 - DNA, 25 bp, Mus musculus
cacttcctgtaaaaatagtggagtg

SEQ ID NO: 413260 - DNA, 25 bp, Mus musculus
cacttcctgtagaaatatggactaa

SEQ ID NO: 413261 - DNA, 25 bp, Mus musculus
cacttcgctagtggtgattcagcca

SEQ ID NO: 413262 - DNA, 25 bp, Mus musculus
cacttcgggtgttgtgggagcggac

SEQ ID NO: 413263 - DNA, 25 bp, Mus musculus
cacttcgtgagcgaagaggccagcc

SEQ ID NO: 413264 - DNA, 25 bp, Mus musculus
cacttctaaataccgagcgtctgca

SEQ ID NO: 413265 - DNA, 25 bp, Mus musculus
cacttctacgcagggcagtgccaga

SEQ ID NO: 413266 - DNA, 25 bp, Mus musculus
cacttctcaactcaggtgagatgca

SEQ ID NO: 413267 - DNA, 25 bp, Mus musculus
cacttctcctccagagccagggaga

SEQ ID NO: 413268 - DNA, 25 bp, Mus musculus
cacttctctgaagggctgggaccag

SEQ ID NO: 413269 - DNA, 25 bp, Mus musculus
cacttctggcaggtggatcacatca

SEQ ID NO: 413270 - DNA, 25 bp, Mus musculus
cacttctggccatagagttgtatag

SEQ ID NO: 413271 - DNA, 25 bp, Mus musculus
cacttctggcccgaggtatccaaga

SEQ ID NO: 413272 - DNA, 25 bp, Mus musculus
cacttctggccgactctgctgacag

SEQ ID NO: 413273 - DNA, 25 bp, Mus musculus
cacttctgtgctgttgacgaggact

SEQ ID NO: 413274 - DNA, 25 bp, Mus musculus
cacttctgtgggtcaaatctcttgg

SEQ ID NO: 413275 - DNA, 25 bp, Mus musculus
cacttcttcatttcccaagggcaga

SEQ ID NO: 413276 - DNA, 25 bp, Mus musculus
cacttcttggtgaacttggcagcgc

SEQ ID NO: 413277 - DNA, 25 bp, Mus musculus
cacttctttaccctgctgcaagaag

SEQ ID NO: 413278 - DNA, 25 bp, Mus musculus
cacttgaacgccaaaggactgtccc

SEQ ID NO: 413279 - DNA, 25 bp, Mus musculus
cacttgaagaggctgaaccttactg

SEQ ID NO: 413280 - DNA, 25 bp, Mus musculus
cacttgaagcacactcagcagaggc

SEQ ID NO: 413281 - DNA, 25 bp, Mus musculus
cacttgaagggtgtggcttccattt

SEQ ID NO: 413282 - DNA, 25 bp, Mus musculus
cacttgaaggtgatcgagcagcggc

SEQ ID NO: 413283 - DNA, 25 bp, Mus musculus
cacttgactctgttgccgtggtgaa

SEQ ID NO: 413284 - DNA, 25 bp, Mus musculus
cacttgactgaaatggcccctacag

SEQ ID NO: 413285 - DNA, 25 bp, Mus musculus
cacttgactgtcttgtggaccacga

SEQ ID NO: 413286 - DNA, 25 bp, Mus musculus
cacttgagacagaaaccggaggacg

SEQ ID NO: 413287 - DNA, 25 bp, Mus musculus
cacttgagagaccagaaccgggtca

SEQ ID NO: 413288 - DNA, 25 bp, Mus musculus
cacttgagagctacacctgtcagaa

SEQ ID NO: 413289 - DNA, 25 bp, Mus musculus
cacttgagcaaaatagaggtcggtc

SEQ ID NO: 413290 - DNA, 25 bp, Mus musculus
cacttgaggcacctgaactggagca

SEQ ID NO: 413291 - DNA, 25 bp, Mus musculus
cacttgagtgaaggtcggaacgcca

SEQ ID NO: 413292 - DNA, 25 bp, Mus musculus
cacttgagttctgcaactgaagaaa

SEQ ID NO: 413293 - DNA, 25 bp, Mus musculus
cacttgataggaaaagcattcggaa

SEQ ID NO: 413294 - DNA, 25 bp, Mus musculus
cacttgatagggaattgaagctaca

SEQ ID NO: 413295 - DNA, 25 bp, Mus musculus
cacttgatgaacattgggatgggcc

SEQ ID NO: 413296 - DNA, 25 bp, Mus musculus
cacttgatgcttgtggtttctagaa

SEQ ID NO: 413297 - DNA, 25 bp, Mus musculus
cacttgatgtagaaagggctgcagc

SEQ ID NO: 413298 - DNA, 25 bp, Mus musculus
cacttgatgtcaagggtggcaccac

SEQ ID NO: 413299 - DNA, 25 bp, Mus musculus
cacttgatgtggaggataccgcgga

SEQ ID NO: 413300 - DNA, 25 bp, Mus musculus
cacttgattcctttgctcaagtcaa

SEQ ID NO: 413301 - DNA, 25 bp, Mus musculus
cacttgatttggatctcaggacgga

SEQ ID NO: 413302 - DNA, 25 bp, Mus musculus
cacttgcaagtgtccttggcctggt

SEQ ID NO: 413303 - DNA, 25 bp, Mus musculus
cacttgcacgaacaggacctcaagc

SEQ ID NO: 413304 - DNA, 25 bp, Mus musculus
cacttgcagagtgctagtgaggcca

SEQ ID NO: 413305 - DNA, 25 bp, Mus musculus
cacttgcagcatctacgtgggaaag

SEQ ID NO: 413306 - DNA, 25 bp, Mus musculus
cacttgcagctgaaactatggtgag

SEQ ID NO: 413307 - DNA, 25 bp, Mus musculus
cacttgcatttcgtattcgcaggag

SEQ ID NO: 413308 - DNA, 25 bp, Mus musculus
cacttgccatgtgactgagctagca

SEQ ID NO: 413309 - DNA, 25 bp, Mus musculus
cacttgctgggcgaatcctgcttca

SEQ ID NO: 413310 - DNA, 25 bp, Mus musculus
cacttggaactagacgggactctgg

SEQ ID NO: 413311 - DNA, 25 bp, Mus musculus
cacttggaatgaatggcgctctctg

SEQ ID NO: 413312 - DNA, 25 bp, Mus musculus
cacttggaatgctcttttctggaga

SEQ ID NO: 413313 - DNA, 25 bp, Mus musculus
cacttggactccagaataagttcaa

SEQ ID NO: 413314 - DNA, 25 bp, Mus musculus
cacttggagtttactgtcctgttca

SEQ ID NO: 413315 - DNA, 25 bp, Mus musculus
cacttggatgacagcggttggcctt

SEQ ID NO: 413316 - DNA, 25 bp, Mus musculus
cacttgggcaagtgttgggcagagc

SEQ ID NO: 413317 - DNA, 25 bp, Mus musculus
cacttgggtgtcatgtcctggatca

SEQ ID NO: 413318 - DNA, 25 bp, Mus musculus
cacttggtacattggaacgcagtca

SEQ ID NO: 413319 - DNA, 25 bp, Mus musculus
cacttggtggattgctgtgcgtcca

SEQ ID NO: 413320 - DNA, 25 bp, Mus musculus
cacttggtgtgtttccaaatggcag

SEQ ID NO: 413321 - DNA, 25 bp, Mus musculus
cacttggttaaatgacctgcaacag

SEQ ID NO: 413322 - DNA, 25 bp, Mus musculus
cacttgtaccaaagcatgagggagg

SEQ ID NO: 413323 - DNA, 25 bp, Mus musculus
cacttgtacgtgtggtgtattctca

SEQ ID NO: 413324 - DNA, 25 bp, Mus musculus
cacttgtagcaaggaagccactgtt

SEQ ID NO: 413325 - DNA, 25 bp, Mus musculus
cacttgtcaaatggactatgatagc

SEQ ID NO: 413326 - DNA, 25 bp, Mus musculus
cacttgtcaggttttccagccagaa

SEQ ID NO: 413327 - DNA, 25 bp, Mus musculus
cacttgtcgaagaagcggctgaact

SEQ ID NO: 413328 - DNA, 25 bp, Mus musculus
cacttgtgacatttacgcggagagc

SEQ ID NO: 413329 - DNA, 25 bp, Mus musculus
cacttgtgatgaagactcggtggcc

SEQ ID NO: 413330 - DNA, 25 bp, Mus musculus
cacttgtggaacacgaggctgtcgc

SEQ ID NO: 413331 - DNA, 25 bp, Mus musculus
cacttgtggtttctcatggtgacct

SEQ ID NO: 413332 - DNA, 25 bp, Mus musculus
cacttgttgtcttctactgggccca

SEQ ID NO: 413333 - DNA, 25 bp, Mus musculus
cactttacgtcggtgcacgggacag

SEQ ID NO: 413334 - DNA, 25 bp, Mus musculus
cactttactgataaccgtcactcag

SEQ ID NO: 413335 - DNA, 25 bp, Mus musculus
cactttactgcaataacttggcctc

SEQ ID NO: 413336 - DNA, 25 bp, Mus musculus
cactttaggaagcatccaaggtggc

SEQ ID NO: 413337 - DNA, 25 bp, Mus musculus
cactttatagactatcctgaggagc

SEQ ID NO: 413338 - DNA, 25 bp, Mus musculus
cactttatggtgtagcctgcagcgg

SEQ ID NO: 413339 - DNA, 25 bp, Mus musculus
cactttattgggagtttattctcaa

SEQ ID NO: 413340 - DNA, 25 bp, Mus musculus
cactttcaagggtatgtctgtctgg

SEQ ID NO: 413341 - DNA, 25 bp, Mus musculus
cactttcagtgggaagccttgggat

SEQ ID NO: 413342 - DNA, 25 bp, Mus musculus
cactttcatttgcactgggagctct

SEQ ID NO: 413343 - DNA, 25 bp, Mus musculus
cactttccacattactgaggcaggg

SEQ ID NO: 413344 - DNA, 25 bp, Mus musculus
cactttccactttaattcaaaggcg

SEQ ID NO: 413345 - DNA, 25 bp, Mus musculus
cactttccggtagccctggatatgg

SEQ ID NO: 413346 - DNA, 25 bp, Mus musculus
cactttccttgtggtactctggact

SEQ ID NO: 413347 - DNA, 25 bp, Mus musculus
cactttctacaggtgaagaccaagg

SEQ ID NO: 413348 - DNA, 25 bp, Mus musculus
cactttctctgaggaactgtggccg

SEQ ID NO: 413349 - DNA, 25 bp, Mus musculus
cactttctgacatagagggctggac

SEQ ID NO: 413350 - DNA, 25 bp, Mus musculus
cactttctggaaggagttcggcacg

SEQ ID NO: 413351 - DNA, 25 bp, Mus musculus
cactttcttagtcaacagacctgac

SEQ ID NO: 413352 - DNA, 25 bp, Mus musculus
cactttgaactaatgggcgctcctc

SEQ ID NO: 413353 - DNA, 25 bp, Mus musculus
cactttgacacgacacaggtggcgt

SEQ ID NO: 413354 - DNA, 25 bp, Mus musculus
cactttgacctacgtgatgcgggcc

SEQ ID NO: 413355 - DNA, 25 bp, Mus musculus
cactttgagaatggtgagaaatact

SEQ ID NO: 413356 - DNA, 25 bp, Mus musculus
cactttgagggtggaggtagatacc

SEQ ID NO: 413357 - DNA, 25 bp, Mus musculus
cactttgagttacaacgggaccacg

SEQ ID NO: 413358 - DNA, 25 bp, Mus musculus
cactttgagttggtatcagtatttt

SEQ ID NO: 413359 - DNA, 25 bp, Mus musculus
cactttgccagcagaataaaaggtg

SEQ ID NO: 413360 - DNA, 25 bp, Mus musculus
cactttgccatgatgcacggcggga

SEQ ID NO: 413361 - DNA, 25 bp, Mus musculus
cactttggaaagtacaagcactgga

SEQ ID NO: 413362 - DNA, 25 bp, Mus musculus
cactttggccctctgtctgtcacta

SEQ ID NO: 413363 - DNA, 25 bp, Mus musculus
cactttgggttgctcagtctcctgg

SEQ ID NO: 413364 - DNA, 25 bp, Mus musculus
cactttggtaacggagggtgcactg

SEQ ID NO: 413365 - DNA, 25 bp, Mus musculus
cactttggtcaaaagctgcttaaga

SEQ ID NO: 413366 - DNA, 25 bp, Mus musculus
cactttgtagagtacggcaggaccg

SEQ ID NO: 413367 - DNA, 25 bp, Mus musculus
cactttgtagatagaatatatatgc

SEQ ID NO: 413368 - DNA, 25 bp, Mus musculus
cactttgtcacaagagggaccaccg

SEQ ID NO: 413369 - DNA, 25 bp, Mus musculus
cactttgtgatgacagaggtgccat

SEQ ID NO: 413370 - DNA, 25 bp, Mus musculus
cactttgttgctcaggctaagcagg

SEQ ID NO: 413371 - DNA, 25 bp, Mus musculus
cacttttaagaggattagcagtaac

SEQ ID NO: 413372 - DNA, 25 bp, Mus musculus
cacttttaatgcaggacttggagcc

SEQ ID NO: 413373 - DNA, 25 bp, Mus musculus
cacttttagagggtaggagcgcact

SEQ ID NO: 413374 - DNA, 25 bp, Mus musculus
cacttttatgctagctggcgcctgc

SEQ ID NO: 413375 - DNA, 25 bp, Mus musculus
cacttttctgggactgaggatggca

SEQ ID NO: 413376 - DNA, 25 bp, Mus musculus
cacttttggcaaggaatgccagacc

SEQ ID NO: 413377 - DNA, 25 bp, Mus musculus
cacttttggtttgccaccggaggag

SEQ ID NO: 413378 - DNA, 25 bp, Mus musculus
cacttttgtcctaaaactgccacga

SEQ ID NO: 413379 - DNA, 25 bp, Mus musculus
cactttttcacgagactgctgcaga

SEQ ID NO: 413380 - DNA, 25 bp, Mus musculus
cactttttgtcgtagcccggtggcg

SEQ ID NO: 413381 - DNA, 25 bp, Mus musculus
cactttttgtctgtgggttcgctcc

SEQ ID NO: 413382 - DNA, 25 bp, Mus musculus
cagaaaaacttctcataccaagtag

SEQ ID NO: 413383 - DNA, 25 bp, Mus musculus
cagaaaaaggagcttggccatgtca

SEQ ID NO: 413384 - DNA, 25 bp, Mus musculus
cagaaaacaatgtgccgggtgccta

SEQ ID NO: 413385 - DNA, 25 bp, Mus musculus
cagaaaaccatgaccccgtggagct

SEQ ID NO: 413386 - DNA, 25 bp, Mus musculus
cagaaaacgatttggtgttgtaggg

SEQ ID NO: 413387 - DNA, 25 bp, Mus musculus
cagaaaactgtgagagtcggtgcac

SEQ ID NO: 413388 - DNA, 25 bp, Mus musculus
cagaaaagcacatttgtacagagtc

SEQ ID NO: 413389 - DNA, 25 bp, Mus musculus
cagaaaaggtctacgtgcagcgagc

SEQ ID NO: 413390 - DNA, 25 bp, Mus musculus
cagaaaatgaaagccacccaagggc

SEQ ID NO: 413391 - DNA, 25 bp, Mus musculus
cagaaaatgccacatcaccgcagga

SEQ ID NO: 413392 - DNA, 25 bp, Mus musculus
cagaaacaactgcaatgacggagac

SEQ ID NO: 413393 - DNA, 25 bp, Mus musculus
cagaaacaagccgtagtgagcctat

SEQ ID NO: 413394 - DNA, 25 bp, Mus musculus
cagaaacagaattgtattacttcca

SEQ ID NO: 413395 - DNA, 25 bp, Mus musculus
cagaaacaggaaatccgggaagctt

SEQ ID NO: 413396 - DNA, 25 bp, Mus musculus
cagaaacaggatccactctgtaaga

SEQ ID NO: 413397 - DNA, 25 bp, Mus musculus
cagaaacgcaaggaggtggtgcaca

SEQ ID NO: 413398 - DNA, 25 bp, Mus musculus
cagaaacggatcattggtgggaaca

SEQ ID NO: 413399 - DNA, 25 bp, Mus musculus
cagaaactaccagaggaatactgtg

SEQ ID NO: 413400 - DNA, 25 bp, Mus musculus
cagaaactctgttgggagaccctga

SEQ ID NO: 413401 - DNA, 25 bp, Mus musculus
cagaaactgtctgctgaccttcctt

SEQ ID NO: 413402 - DNA, 25 bp, Mus musculus
cagaaagaacacagtcaggatgggt

SEQ ID NO: 413403 - DNA, 25 bp, Mus musculus
cagaaagagactccctggatggcag

SEQ ID NO: 413404 - DNA, 25 bp, Mus musculus
cagaaagagactgtggtcccaggca

SEQ ID NO: 413405 - DNA, 25 bp, Mus musculus
cagaaagagctcgtcaggtggactc

SEQ ID NO: 413406 - DNA, 25 bp, Mus musculus
cagaaagagcttggaagcaaggagt

SEQ ID NO: 413407 - DNA, 25 bp, Mus musculus
cagaaagaggaaatgacttgcccaa

SEQ ID NO: 413408 - DNA, 25 bp, Mus musculus
cagaaagagtcgatggctaccctac

SEQ ID NO: 413409 - DNA, 25 bp, Mus musculus
cagaaagagtgggtttggaatcctc

SEQ ID NO: 413410 - DNA, 25 bp, Mus musculus
cagaaagatctagaaccgtgtgctc

SEQ ID NO: 413411 - DNA, 25 bp, Mus musculus
cagaaagccctgacccatataaggt

SEQ ID NO: 413412 - DNA, 25 bp, Mus musculus
cagaaagctttggtcattgcccaca

SEQ ID NO: 413413 - DNA, 25 bp, Mus musculus
cagaaaggacgtagccctgcttgct

SEQ ID NO: 413414 - DNA, 25 bp, Mus musculus
cagaaaggagactgtggagagccac

SEQ ID NO: 413415 - DNA, 25 bp, Mus musculus
cagaaaggccaatgagggtaaattc

SEQ ID NO: 413416 - DNA, 25 bp, Mus musculus
cagaaaggcgaggattgtagctcca

SEQ ID NO: 413417 - DNA, 25 bp, Mus musculus
cagaaagggatgtggtggctcaaaa

SEQ ID NO: 413418 - DNA, 25 bp, Mus musculus
cagaaagggcactcgaaaatacatc

SEQ ID NO: 413419 - DNA, 25 bp, Mus musculus
cagaaagtaatgctgggaaccccat

SEQ ID NO: 413420 - DNA, 25 bp, Mus musculus
cagaaagtacaccttcagaatggcc

SEQ ID NO: 413421 - DNA, 25 bp, Mus musculus
cagaaagtctgctgggattggattt

SEQ ID NO: 413422 - DNA, 25 bp, Mus musculus
cagaaagtcttgtgtccagccagcc

SEQ ID NO: 413423 - DNA, 25 bp, Mus musculus
cagaaagttgcagtgagctccaggc

SEQ ID NO: 413424 - DNA, 25 bp, Mus musculus
cagaaataaacgactctgaagagga

SEQ ID NO: 413425 - DNA, 25 bp, Mus musculus
cagaaataagtcaccttttaaggca

SEQ ID NO: 413426 - DNA, 25 bp, Mus musculus
cagaaataattttgcaggacacagg

SEQ ID NO: 413427 - DNA, 25 bp, Mus musculus
cagaaatacgaccatcagcgggagc

SEQ ID NO: 413428 - DNA, 25 bp, Mus musculus
cagaaatcaagtcagctcagctcag

SEQ ID NO: 413429 - DNA, 25 bp, Mus musculus
cagaaatcgaaacggccatgactac

SEQ ID NO: 413430 - DNA, 25 bp, Mus musculus
cagaaatcggttgactccgagggca

SEQ ID NO: 413431 - DNA, 25 bp, Mus musculus
cagaaatcgtgcatgaagggaagaa

SEQ ID NO: 413432 - DNA, 25 bp, Mus musculus
cagaaatgaagactgggtgtcgccc

SEQ ID NO: 413433 - DNA, 25 bp, Mus musculus
cagaaatgaggtgatccgggcaaca

SEQ ID NO: 413434 - DNA, 25 bp, Mus musculus
cagaaatgatcaactccagggccta

SEQ ID NO: 413435 - DNA, 25 bp, Mus musculus
cagaaatgatcttttgccaccggag

SEQ ID NO: 413436 - DNA, 25 bp, Mus musculus
cagaaatgcaaagacagaaaacgat

SEQ ID NO: 413437 - DNA, 25 bp, Mus musculus
cagaaatgcagtctcaaaaaagcaa

SEQ ID NO: 413438 - DNA, 25 bp, Mus musculus
cagaaatgccaaggactgcctggta

SEQ ID NO: 413439 - DNA, 25 bp, Mus musculus
cagaaatgcccgtggtagcaggaat

SEQ ID NO: 413440 - DNA, 25 bp, Mus musculus
cagaaatgcggttgaggacacttgc

SEQ ID NO: 413441 - DNA, 25 bp, Mus musculus
cagaaatgctctgactgctgtagag

SEQ ID NO: 413442 - DNA, 25 bp, Mus musculus
cagaaatgctgggtggcttcatgga

SEQ ID NO: 413443 - DNA, 25 bp, Mus musculus
cagaaatggagagaataccggcggc

SEQ ID NO: 413444 - DNA, 25 bp, Mus musculus
cagaaatggccctgtgcacgctgta

SEQ ID NO: 413445 - DNA, 25 bp, Mus musculus
cagaaatggcctgaagaccagggta

SEQ ID NO: 413446 - DNA, 25 bp, Mus musculus
cagaaatgggcgttcagcacagcag

SEQ ID NO: 413447 - DNA, 25 bp, Mus musculus
cagaaatgtcacctcagcaatggga

SEQ ID NO: 413448 - DNA, 25 bp, Mus musculus
cagaaatgtgttctggtactcccat

SEQ ID NO: 413449 - DNA, 25 bp, Mus musculus
cagaaatgttccttcggagctgcca

SEQ ID NO: 413450 - DNA, 25 bp, Mus musculus
cagaaattcagaggtgcaggtccaa

SEQ ID NO: 413451 - DNA, 25 bp, Mus musculus
cagaaatttcgtgcagccttcagga

SEQ ID NO: 413452 - DNA, 25 bp, Mus musculus
cagaacaaatgtggccctccgtgtg

SEQ ID NO: 413453 - DNA, 25 bp, Mus musculus
cagaacacaagcaactcctcaagga

SEQ ID NO: 413454 - DNA, 25 bp, Mus musculus
cagaacaccgttgtcgctgtggagg

SEQ ID NO: 413455 - DNA, 25 bp, Mus musculus
cagaacagctgaggcagcgttcagt

SEQ ID NO: 413456 - DNA, 25 bp, Mus musculus
cagaacaggttcaggaagagacagc

SEQ ID NO: 413457 - DNA, 25 bp, Mus musculus
cagaacataatggacacctgcctgt

SEQ ID NO: 413458 - DNA, 25 bp, Mus musculus
cagaacatatgacaaggacaccacc

SEQ ID NO: 413459 - DNA, 25 bp, Mus musculus
cagaacatcagggagtgaggagact

SEQ ID NO: 413460 - DNA, 25 bp, Mus musculus
cagaacatcctgactcaaattgata

SEQ ID NO: 413461 - DNA, 25 bp, Mus musculus
cagaacatcggctacaagctgggcc

SEQ ID NO: 413462 - DNA, 25 bp, Mus musculus
cagaacatgaattcaggctacctgg

SEQ ID NO: 413463 - DNA, 25 bp, Mus musculus
cagaacatgtccgaatgctgtgaga

SEQ ID NO: 413464 - DNA, 25 bp, Mus musculus
cagaaccaggactttgggtcgcccg

SEQ ID NO: 413465 - DNA, 25 bp, Mus musculus
cagaaccaggagtccgagaagcctt

SEQ ID NO: 413466 - DNA, 25 bp, Mus musculus
cagaaccagggaaaatgggacagcc

SEQ ID NO: 413467 - DNA, 25 bp, Mus musculus
cagaaccaggtgttagagaagcagc

SEQ ID NO: 413468 - DNA, 25 bp, Mus musculus
cagaaccccgagagaatagtcaagt

SEQ ID NO: 413469 - DNA, 25 bp, Mus musculus
cagaacccgtctgagcagtgtctct

SEQ ID NO: 413470 - DNA, 25 bp, Mus musculus
cagaaccctgagtgatggatgcatc

SEQ ID NO: 413471 - DNA, 25 bp, Mus musculus
cagaaccgagagaagcagtaggatc

SEQ ID NO: 413472 - DNA, 25 bp, Mus musculus
cagaaccggcgtatgaagaagaagc

SEQ ID NO: 413473 - DNA, 25 bp, Mus musculus
cagaacctctgtggccctgtgggaa

SEQ ID NO: 413474 - DNA, 25 bp, Mus musculus
cagaacctgacgtgaaattgcgcgg

SEQ ID NO: 413475 - DNA, 25 bp, Mus musculus
cagaacctgcgcttttactggaagg

SEQ ID NO: 413476 - DNA, 25 bp, Mus musculus
cagaacctggacgaggacttgggtc

SEQ ID NO: 413477 - DNA, 25 bp, Mus musculus
cagaacctggtgatcgggcttggcc

SEQ ID NO: 413478 - DNA, 25 bp, Mus musculus
cagaacctggtgtaatagatgatca

SEQ ID NO: 413479 - DNA, 25 bp, Mus musculus
cagaaccttgtgtaagcagtggtca

SEQ ID NO: 413480 - DNA, 25 bp, Mus musculus
cagaacctttgtggacatggacacc

SEQ ID NO: 413481 - DNA, 25 bp, Mus musculus
cagaacgccctgttacaccttgtgc

SEQ ID NO: 413482 - DNA, 25 bp, Mus musculus
cagaacgctctaaggccaagtggca

SEQ ID NO: 413483 - DNA, 25 bp, Mus musculus
cagaacggatcagcgagcacaaagt

SEQ ID NO: 413484 - DNA, 25 bp, Mus musculus
cagaacgtgattgcaccaggctgcc

SEQ ID NO: 413485 - DNA, 25 bp, Mus musculus
cagaactagcttgttggtatcaact

SEQ ID NO: 413486 - DNA, 25 bp, Mus musculus
cagaactagtgaggcaccctgggta

SEQ ID NO: 413487 - DNA, 25 bp, Mus musculus
cagaactattcgctgctcgcaggag

SEQ ID NO: 413488 - DNA, 25 bp, Mus musculus
cagaactctagcttgaggtccgcga

SEQ ID NO: 413489 - DNA, 25 bp, Mus musculus
cagaactctggtgcaagtgagaaca

SEQ ID NO: 413490 - DNA, 25 bp, Mus musculus
cagaactgatctggtcacgagggtt

SEQ ID NO: 413491 - DNA, 25 bp, Mus musculus
cagaactgcccaagaggcggcaaga

SEQ ID NO: 413492 - DNA, 25 bp, Mus musculus
cagaactgctgatggagacaaaggc

SEQ ID NO: 413493 - DNA, 25 bp, Mus musculus
cagaactggagtggatgcataattc

SEQ ID NO: 413494 - DNA, 25 bp, Mus musculus
cagaactggcctctgactagtagag

SEQ ID NO: 413495 - DNA, 25 bp, Mus musculus
cagaactggtttcctcctcaagcag

SEQ ID NO: 413496 - DNA, 25 bp, Mus musculus
cagaactgtggagctggcctaaaca

SEQ ID NO: 413497 - DNA, 25 bp, Mus musculus
cagaactgtttcgagctgggaaccc

SEQ ID NO: 413498 - DNA, 25 bp, Mus musculus
cagaacttcagggtagcacttaaga

SEQ ID NO: 413499 - DNA, 25 bp, Mus musculus
cagaacttgaatacttagggccaga

SEQ ID NO: 413500 - DNA, 25 bp, Mus musculus
cagaacttgtaagagacagggacca

SEQ ID NO: 413501 - DNA, 25 bp, Mus musculus
cagaactttatgcaagacctgatga

SEQ ID NO: 413502 - DNA, 25 bp, Mus musculus
cagaacttttatatgtacgtgacct

SEQ ID NO: 413503 - DNA, 25 bp, Mus musculus
cagaacttttcattttgccgggaga

SEQ ID NO: 413504 - DNA, 25 bp, Mus musculus
cagaagaaaccacgcagaagtcgca

SEQ ID NO: 413505 - DNA, 25 bp, Mus musculus
cagaagaaactgatgagcttggtca

SEQ ID NO: 413506 - DNA, 25 bp, Mus musculus
cagaagaaagcctttgccacctgtg

SEQ ID NO: 413507 - DNA, 25 bp, Mus musculus
cagaagaaagcttgtgtcgcagctc

SEQ ID NO: 413508 - DNA, 25 bp, Mus musculus
cagaagaacaggtcaaagagacagc

SEQ ID NO: 413509 - DNA, 25 bp, Mus musculus
cagaagaacaggtcatctccattaa

SEQ ID NO: 413510 - DNA, 25 bp, Mus musculus
cagaagaaccgcgaggaactggaca

SEQ ID NO: 413511 - DNA, 25 bp, Mus musculus
cagaagaagagcaggtttgtacttc

SEQ ID NO: 413512 - DNA, 25 bp, Mus musculus
cagaagaaggctattcagactgcca

SEQ ID NO: 413513 - DNA, 25 bp, Mus musculus
cagaagaagtaaagaggcagggccc

SEQ ID NO: 413514 - DNA, 25 bp, Mus musculus
cagaagaattccaggagggcatgac

SEQ ID NO: 413515 - DNA, 25 bp, Mus musculus
cagaagaattttgccaggacccact

SEQ ID NO: 413516 - DNA, 25 bp, Mus musculus
cagaagacaaaagcatgggatcgcc

SEQ ID NO: 413517 - DNA, 25 bp, Mus musculus
cagaagaccctgtgaccatgatgga

SEQ ID NO: 413518 - DNA, 25 bp, Mus musculus
cagaagacctggtggccaagctgaa

SEQ ID NO: 413519 - DNA, 25 bp, Mus musculus
cagaagacgcctgttgaggtgtccc

SEQ ID NO: 413520 - DNA, 25 bp, Mus musculus
cagaagactctcatacgcgggaagc

SEQ ID NO: 413521 - DNA, 25 bp, Mus musculus
cagaagactctgtatggacggccca

SEQ ID NO: 413522 - DNA, 25 bp, Mus musculus
cagaagactcttaaagacaatgtga

SEQ ID NO: 413523 - DNA, 25 bp, Mus musculus
cagaagagagacatggaacagaggc

SEQ ID NO: 413524 - DNA, 25 bp, Mus musculus
cagaagagctctggaaaggcgcatt

SEQ ID NO: 413525 - DNA, 25 bp, Mus musculus
cagaagaggcgggagagcattccca

SEQ ID NO: 413526 - DNA, 25 bp, Mus musculus
cagaagagggaccatgtgcccatag

SEQ ID NO: 413527 - DNA, 25 bp, Mus musculus
cagaagagggttcttgaagccagac

SEQ ID NO: 413528 - DNA, 25 bp, Mus musculus
cagaagaggtggacgacaaggttct

SEQ ID NO: 413529 - DNA, 25 bp, Mus musculus
cagaagagtcccctctgagctgaga

SEQ ID NO: 413530 - DNA, 25 bp, Mus musculus
cagaagagtgaagcctcgacggcag

SEQ ID NO: 413531 - DNA, 25 bp, Mus musculus
cagaagagtttgatgacacagcgct

SEQ ID NO: 413532 - DNA, 25 bp, Mus musculus
cagaagataaatggaatgacagccg

SEQ ID NO: 413533 - DNA, 25 bp, Mus musculus
cagaagatcatgaccacgcagaagt

SEQ ID NO: 413534 - DNA, 25 bp, Mus musculus
cagaagatcattactcagggagcag

SEQ ID NO: 413535 - DNA, 25 bp, Mus musculus
cagaagatgcgtggatggaacagtc

SEQ ID NO: 413536 - DNA, 25 bp, Mus musculus
cagaagattggtcagatagaagcac

SEQ ID NO: 413537 - DNA, 25 bp, Mus musculus
cagaagcaatggtgtcctcatacaa

SEQ ID NO: 413538 - DNA, 25 bp, Mus musculus
cagaagcagccgttagtacgtggct

SEQ ID NO: 413539 - DNA, 25 bp, Mus musculus
cagaagcagcgcatctaaggtcgat

SEQ ID NO: 413540 - DNA, 25 bp, Mus musculus
cagaagcagggtctagaagcctcgc

SEQ ID NO: 413541 - DNA, 25 bp, Mus musculus
cagaagcagtttgttggcagcatcc

SEQ ID NO: 413542 - DNA, 25 bp, Mus musculus
cagaagcatagagcgctgggacacc

SEQ ID NO: 413543 - DNA, 25 bp, Mus musculus
cagaagcatcgagtaaaagtcagca

SEQ ID NO: 413544 - DNA, 25 bp, Mus musculus
cagaagcatgataagcacctggtgc

SEQ ID NO: 413545 - DNA, 25 bp, Mus musculus
cagaagcatgcaatggccttttgcc

SEQ ID NO: 413546 - DNA, 25 bp, Mus musculus
cagaagcatttctcaggacacctgg

SEQ ID NO: 413547 - DNA, 25 bp, Mus musculus
cagaagccatgctgggtagtgcaca

SEQ ID NO: 413548 - DNA, 25 bp, Mus musculus
cagaagcccctggtactgaacgagg

SEQ ID NO: 413549 - DNA, 25 bp, Mus musculus
cagaagccgctgagttgagaggaca

SEQ ID NO: 413550 - DNA, 25 bp, Mus musculus
cagaagcgcactggtaaaaccgaac

SEQ ID NO: 413551 - DNA, 25 bp, Mus musculus
cagaagcgtgatcttggagcctccg

SEQ ID NO: 413552 - DNA, 25 bp, Mus musculus
cagaagctacaagacatccagagag

SEQ ID NO: 413553 - DNA, 25 bp, Mus musculus
cagaagctagaacagtcaacccaca

SEQ ID NO: 413554 - DNA, 25 bp, Mus musculus
cagaagctctccaaagcagtggcga

SEQ ID NO: 413555 - DNA, 25 bp, Mus musculus
cagaagctctgcaaggagccgacgg

SEQ ID NO: 413556 - DNA, 25 bp, Mus musculus
cagaagctctggaatcgcaagggac

SEQ ID NO: 413557 - DNA, 25 bp, Mus musculus
cagaagctgatcgagtactataaga

SEQ ID NO: 413558 - DNA, 25 bp, Mus musculus
cagaagctgcagttcgatcactgga

SEQ ID NO: 413559 - DNA, 25 bp, Mus musculus
cagaagcttcgctataggtgagcaa

SEQ ID NO: 413560 - DNA, 25 bp, Mus musculus
cagaaggaaagtgcatccgcaccac

SEQ ID NO: 413561 - DNA, 25 bp, Mus musculus
cagaaggaaccccagcctacaggtt

SEQ ID NO: 413562 - DNA, 25 bp, Mus musculus
cagaaggaactagaccaggaaccgg

SEQ ID NO: 413563 - DNA, 25 bp, Mus musculus
cagaaggaactggagccactggtct

SEQ ID NO: 413564 - DNA, 25 bp, Mus musculus
cagaaggaagaacttctcaaagctt

SEQ ID NO: 413565 - DNA, 25 bp, Mus musculus
cagaaggagcgaatgtcagagtacc

SEQ ID NO: 413566 - DNA, 25 bp, Mus musculus
cagaaggagctcatgacattgcaac

SEQ ID NO: 413567 - DNA, 25 bp, Mus musculus
cagaaggagctgcaaatatgggaac

SEQ ID NO: 413568 - DNA, 25 bp, Mus musculus
cagaaggaggtttgcatccggcacc

SEQ ID NO: 413569 - DNA, 25 bp, Mus musculus
cagaaggatttgagataagccccga

SEQ ID NO: 413570 - DNA, 25 bp, Mus musculus
cagaaggcaagcaattcgggagtct

SEQ ID NO: 413571 - DNA, 25 bp, Mus musculus
cagaaggcagccttggtgaacggcc

SEQ ID NO: 413572 - DNA, 25 bp, Mus musculus
cagaaggccatagcggagaaagacc

SEQ ID NO: 413573 - DNA, 25 bp, Mus musculus
cagaaggccatctacgaagcagtgc

SEQ ID NO: 413574 - DNA, 25 bp, Mus musculus
cagaaggcccgagagatgtacagct

SEQ ID NO: 413575 - DNA, 25 bp, Mus musculus
cagaaggccctacattctcaagagg

SEQ ID NO: 413576 - DNA, 25 bp, Mus musculus
cagaaggccttcagtcaaatgggac

SEQ ID NO: 413577 - DNA, 25 bp, Mus musculus
cagaaggcggttcagagtcatcaaa

SEQ ID NO: 413578 - DNA, 25 bp, Mus musculus
cagaaggctctcgacagtctggcca

SEQ ID NO: 413579 - DNA, 25 bp, Mus musculus
cagaaggctgactatgctgccacag

SEQ ID NO: 413580 - DNA, 25 bp, Mus musculus
cagaagggatgtcaatgtcaacagc

SEQ ID NO: 413581 - DNA, 25 bp, Mus musculus
cagaagggcatctatccaggaacca

SEQ ID NO: 413582 - DNA, 25 bp, Mus musculus
cagaagggtcattattagatgcgta

SEQ ID NO: 413583 - DNA, 25 bp, Mus musculus
cagaagggtgtcatcaaggctacac

SEQ ID NO: 413584 - DNA, 25 bp, Mus musculus
cagaaggtctcaggaacagcttgcc

SEQ ID NO: 413585 - DNA, 25 bp, Mus musculus
cagaaggtgctagtctggtccgcgt

SEQ ID NO: 413586 - DNA, 25 bp, Mus musculus
cagaaggtggtggttcaccccctgg

SEQ ID NO: 413587 - DNA, 25 bp, Mus musculus
cagaaggttactaagtttccagcga

SEQ ID NO: 413588 - DNA, 25 bp, Mus musculus
cagaagtacctaggtgacgggccca

SEQ ID NO: 413589 - DNA, 25 bp, Mus musculus
cagaagtactttagcattagtctag

SEQ ID NO: 413590 - DNA, 25 bp, Mus musculus
cagaagtagagttcctcagccacca

SEQ ID NO: 413591 - DNA, 25 bp, Mus musculus
cagaagtaggcgagccgctttcatc

SEQ ID NO: 413592 - DNA, 25 bp, Mus musculus
cagaagtataggagagccggacagc

SEQ ID NO: 413593 - DNA, 25 bp, Mus musculus
cagaagtatgagactgcgcggcgtc

SEQ ID NO: 413594 - DNA, 25 bp, Mus musculus
cagaagtatggtgttgcccgttaaa

SEQ ID NO: 413595 - DNA, 25 bp, Mus musculus
cagaagtatgtcaaggagaaccctc

SEQ ID NO: 413596 - DNA, 25 bp, Mus musculus
cagaagtcagatcaccaagcggaaa

SEQ ID NO: 413597 - DNA, 25 bp, Mus musculus
cagaagtcagtggttcaaagacagc

SEQ ID NO: 413598 - DNA, 25 bp, Mus musculus
cagaagtcctacgatgcagaatgat

SEQ ID NO: 413599 - DNA, 25 bp, Mus musculus
cagaagtcgccgtggtctcagtagc

SEQ ID NO: 413600 - DNA, 25 bp, Mus musculus
cagaagtcgcctttggagaaagcca

SEQ ID NO: 413601 - DNA, 25 bp, Mus musculus
cagaagtgcagtgtggtccagctac

SEQ ID NO: 413602 - DNA, 25 bp, Mus musculus
cagaagtgccatctacaggctgaag

SEQ ID NO: 413603 - DNA, 25 bp, Mus musculus
cagaagtgcctatccccagcagaat

SEQ ID NO: 413604 - DNA, 25 bp, Mus musculus
cagaagtgcgagacacagatgctca

SEQ ID NO: 413605 - DNA, 25 bp, Mus musculus
cagaagtggaggaaaccctcaagag

SEQ ID NO: 413606 - DNA, 25 bp, Mus musculus
cagaagtgggatggaaagtcgacca

SEQ ID NO: 413607 - DNA, 25 bp, Mus musculus
cagaagtgtcgcagcatgtcccaaa

SEQ ID NO: 413608 - DNA, 25 bp, Mus musculus
cagaagttacggaacctacggctcg

SEQ ID NO: 413609 - DNA, 25 bp, Mus musculus
cagaagttatcagttgcccacatgt

SEQ ID NO: 413610 - DNA, 25 bp, Mus musculus
cagaagttcgtgtgcacacagcggt

SEQ ID NO: 413611 - DNA, 25 bp, Mus musculus
cagaagttctgttgtgcgcatcaca

SEQ ID NO: 413612 - DNA, 25 bp, Mus musculus
cagaagttctttggcctgcccatga

SEQ ID NO: 413613 - DNA, 25 bp, Mus musculus
cagaagttgtcagttatcagctcca

SEQ ID NO: 413614 - DNA, 25 bp, Mus musculus
cagaagtttacaagacagccagagc

SEQ ID NO: 413615 - DNA, 25 bp, Mus musculus
cagaagtttcttcccacagtgggag

SEQ ID NO: 413616 - DNA, 25 bp, Mus musculus
cagaagtttgggtacatataagaaa

SEQ ID NO: 413617 - DNA, 25 bp, Mus musculus
cagaagttttccttgattactccca

SEQ ID NO: 413618 - DNA, 25 bp, Mus musculus
cagaataaatagtgctgcctttgaa

SEQ ID NO: 413619 - DNA, 25 bp, Mus musculus
cagaataagatgacagagcacagca

SEQ ID NO: 413620 - DNA, 25 bp, Mus musculus
cagaataagttcaatatgtaacggg

SEQ ID NO: 413621 - DNA, 25 bp, Mus musculus
cagaatacaagcgttccccgtggtt

SEQ ID NO: 413622 - DNA, 25 bp, Mus musculus
cagaataccagaaaccgggtggcta

SEQ ID NO: 413623 - DNA, 25 bp, Mus musculus
cagaatagaactgaccgggttggca

SEQ ID NO: 413624 - DNA, 25 bp, Mus musculus
cagaatagccaaccgactgaggtgg

SEQ ID NO: 413625 - DNA, 25 bp, Mus musculus
cagaatagctgggtcaaggttaagc

SEQ ID NO: 413626 - DNA, 25 bp, Mus musculus
cagaatatatctgagggtgatgtaa

SEQ ID NO: 413627 - DNA, 25 bp, Mus musculus
cagaatatctagtcccggtacttgg

SEQ ID NO: 413628 - DNA, 25 bp, Mus musculus
cagaatatgcctatggcgcagcagg

SEQ ID NO: 413629 - DNA, 25 bp, Mus musculus
cagaatcaagagtacaaatggcttc

SEQ ID NO: 413630 - DNA, 25 bp, Mus musculus
cagaatcacgctccaatgcaggtca

SEQ ID NO: 413631 - DNA, 25 bp, Mus musculus
cagaatcagagcagaacggactgga

SEQ ID NO: 413632 - DNA, 25 bp, Mus musculus
cagaatcagttctagcgatgccaac

SEQ ID NO: 413633 - DNA, 25 bp, Mus musculus
cagaatcatggttggtttcaaggcc

SEQ ID NO: 413634 - DNA, 25 bp, Mus musculus
cagaatccagatatggcggcccaga

SEQ ID NO: 413635 - DNA, 25 bp, Mus musculus
cagaatcctctgcatccaggcagca

SEQ ID NO: 413636 - DNA, 25 bp, Mus musculus
cagaatccttttcagggaggccaca

SEQ ID NO: 413637 - DNA, 25 bp, Mus musculus
cagaatcggaaaggaggctgccaga

SEQ ID NO: 413638 - DNA, 25 bp, Mus musculus
cagaatcggactactttggcaacgt

SEQ ID NO: 413639 - DNA, 25 bp, Mus musculus
cagaatcggcggactaagcagaaga

SEQ ID NO: 413640 - DNA, 25 bp, Mus musculus
cagaatctctctcactggcctgcac

SEQ ID NO: 413641 - DNA, 25 bp, Mus musculus
cagaatctgagctcatgcgtgtgca

SEQ ID NO: 413642 - DNA, 25 bp, Mus musculus
cagaatctgtgcatgcgcttggacc

SEQ ID NO: 413643 - DNA, 25 bp, Mus musculus
cagaatgaacaaggatgccatgccc

SEQ ID NO: 413644 - DNA, 25 bp, Mus musculus
cagaatgaccagaaggcggtggcct

SEQ ID NO: 413645 - DNA, 25 bp, Mus musculus
cagaatgactgcaagattacgggac

SEQ ID NO: 413646 - DNA, 25 bp, Mus musculus
cagaatgagctttttggacaaacgc

SEQ ID NO: 413647 - DNA, 25 bp, Mus musculus
cagaatgagggctacagctaggacc

SEQ ID NO: 413648 - DNA, 25 bp, Mus musculus
cagaatgagtcggagaacaggaaac

SEQ ID NO: 413649 - DNA, 25 bp, Mus musculus
cagaatgatcctcacatgatggaac

SEQ ID NO: 413650 - DNA, 25 bp, Mus musculus
cagaatgctactatggcccagaaga

SEQ ID NO: 413651 - DNA, 25 bp, Mus musculus
cagaatgctcaagacgtagtcagcc

SEQ ID NO: 413652 - DNA, 25 bp, Mus musculus
cagaatgctcaaggtggagagccgt

SEQ ID NO: 413653 - DNA, 25 bp, Mus musculus
cagaatgctggttgggcaagcctgt

SEQ ID NO: 413654 - DNA, 25 bp, Mus musculus
cagaatggaagtgacccagagagga

SEQ ID NO: 413655 - DNA, 25 bp, Mus musculus
cagaatggcacccttagaggctggc

SEQ ID NO: 413656 - DNA, 25 bp, Mus musculus
cagaatggctccagagtcaccagga

SEQ ID NO: 413657 - DNA, 25 bp, Mus musculus
cagaatgggaccttaagcgagggac

SEQ ID NO: 413658 - DNA, 25 bp, Mus musculus
cagaatgggcaaggagaagacacac

SEQ ID NO: 413659 - DNA, 25 bp, Mus musculus
cagaatggtatggaagggtcaagat

SEQ ID NO: 413660 - DNA, 25 bp, Mus musculus
cagaatggtcctggactggctccca

SEQ ID NO: 413661 - DNA, 25 bp, Mus musculus
cagaatgtaaggaaaatgctcagcc

SEQ ID NO: 413662 - DNA, 25 bp, Mus musculus
cagaatgtacagatgatgggcagcc

SEQ ID NO: 413663 - DNA, 25 bp, Mus musculus
cagaatgtcattgtcgggaccgtca

SEQ ID NO: 413664 - DNA, 25 bp, Mus musculus
cagaatgtcccctgtcacctatggg

SEQ ID NO: 413665 - DNA, 25 bp, Mus musculus
cagaatgtgactgcgactgccagag

SEQ ID NO: 413666 - DNA, 25 bp, Mus musculus
cagaatgtgagctgaagacgccctt

SEQ ID NO: 413667 - DNA, 25 bp, Mus musculus
cagaatgtgcgcacgttggctctca

SEQ ID NO: 413668 - DNA, 25 bp, Mus musculus
cagaattaggcacccagtactcagg

SEQ ID NO: 413669 - DNA, 25 bp, Mus musculus
cagaattcaggaaggatgccccagg

SEQ ID NO: 413670 - DNA, 25 bp, Mus musculus
cagaattcctagtgcaacgggcagc

SEQ ID NO: 413671 - DNA, 25 bp, Mus musculus
cagaattctcagttatcaggccaga

SEQ ID NO: 413672 - DNA, 25 bp, Mus musculus
cagaattctgtaggttgaaggctcc

SEQ ID NO: 413673 - DNA, 25 bp, Mus musculus
cagaattggccatcaaaggataggg

SEQ ID NO: 413674 - DNA, 25 bp, Mus musculus
cagaattgggctggatgtaaccgga

SEQ ID NO: 413675 - DNA, 25 bp, Mus musculus
cagaattggttctcctatgccggag

SEQ ID NO: 413676 - DNA, 25 bp, Mus musculus
cagaatttaacacaccaacatgcat

SEQ ID NO: 413677 - DNA, 25 bp, Mus musculus
cagaatttcaagtgtccctcagagg

SEQ ID NO: 413678 - DNA, 25 bp, Mus musculus
cagaatttcgatgtcctggtgccca

SEQ ID NO: 413679 - DNA, 25 bp, Mus musculus
cagaatttgtatcctgtccatccta

SEQ ID NO: 413680 - DNA, 25 bp, Mus musculus
cagacaaaatggacgtccggtgcca

SEQ ID NO: 413681 - DNA, 25 bp, Mus musculus
cagacaaagacaatatccgccagga

SEQ ID NO: 413682 - DNA, 25 bp, Mus musculus
cagacaaataaatgggccttcgaga

SEQ ID NO: 413683 - DNA, 25 bp, Mus musculus
cagacaacagtgcatcaagagagga

SEQ ID NO: 413684 - DNA, 25 bp, Mus musculus
cagacaagaaggtccactgggcttc

SEQ ID NO: 413685 - DNA, 25 bp, Mus musculus
cagacaagatggctagctcagcccg

SEQ ID NO: 413686 - DNA, 25 bp, Mus musculus
cagacaaggcggtgaaggactattc

SEQ ID NO: 413687 - DNA, 25 bp, Mus musculus
cagacaagtgtctaggaacaacagc

SEQ ID NO: 413688 - DNA, 25 bp, Mus musculus
cagacaataggcctgtatgaaattt

SEQ ID NO: 413689 - DNA, 25 bp, Mus musculus
cagacaatgaaatggactccaggcc

SEQ ID NO: 413690 - DNA, 25 bp, Mus musculus
cagacaatggtaggaagataagaga

SEQ ID NO: 413691 - DNA, 25 bp, Mus musculus
cagacaatggtatcccgaagttcag

SEQ ID NO: 413692 - DNA, 25 bp, Mus musculus
cagacacaaattggccgctcaggga

SEQ ID NO: 413693 - DNA, 25 bp, Mus musculus
cagacacacgtcagtcttgcagctt

SEQ ID NO: 413694 - DNA, 25 bp, Mus musculus
cagacacagtctagcttgggaaaca

SEQ ID NO: 413695 - DNA, 25 bp, Mus musculus
cagacacagttgtccccgaggaagc

SEQ ID NO: 413696 - DNA, 25 bp, Mus musculus
cagacacatgtacccttaaaataga

SEQ ID NO: 413697 - DNA, 25 bp, Mus musculus
cagacacccatttggaagtggagac

SEQ ID NO: 413698 - DNA, 25 bp, Mus musculus
cagacaccggtggagagacagtacc

SEQ ID NO: 413699 - DNA, 25 bp, Mus musculus
cagacacgggtgtgctgtatgccct

SEQ ID NO: 413700 - DNA, 25 bp, Mus musculus
cagacactggatttaaggcacacac

SEQ ID NO: 413701 - DNA, 25 bp, Mus musculus
cagacactgggttttgcaaggagaa

SEQ ID NO: 413702 - DNA, 25 bp, Mus musculus
cagacactgtcctgatcgagagaaa

SEQ ID NO: 413703 - DNA, 25 bp, Mus musculus
cagacactgtcgatacgtggatgaa

SEQ ID NO: 413704 - DNA, 25 bp, Mus musculus
cagacactgtgagcagatacatggt

SEQ ID NO: 413705 - DNA, 25 bp, Mus musculus
cagacactgtggcttatacctgtga

SEQ ID NO: 413706 - DNA, 25 bp, Mus musculus
cagacacttgcttgagatacaccat

SEQ ID NO: 413707 - DNA, 25 bp, Mus musculus
cagacagaataataccctgaccggg

SEQ ID NO: 413708 - DNA, 25 bp, Mus musculus
cagacagacaaaaacggccgtactc

SEQ ID NO: 413709 - DNA, 25 bp, Mus musculus
cagacagacgttgctggaaacacca

SEQ ID NO: 413710 - DNA, 25 bp, Mus musculus
cagacagaggtaggtgcttactgca

SEQ ID NO: 413711 - DNA, 25 bp, Mus musculus
cagacagagtaatgaagcaggccca

SEQ ID NO: 413712 - DNA, 25 bp, Mus musculus
cagacagagttggtgagagacctca

SEQ ID NO: 413713 - DNA, 25 bp, Mus musculus
cagacagcctcggaagactattggg

SEQ ID NO: 413714 - DNA, 25 bp, Mus musculus
cagacagcgatggaggaagccttca

SEQ ID NO: 413715 - DNA, 25 bp, Mus musculus
cagacaggagggaggaagtcgtgct

SEQ ID NO: 413716 - DNA, 25 bp, Mus musculus
cagacaggatgcagatttcaatcaa

SEQ ID NO: 413717 - DNA, 25 bp, Mus musculus
cagacaggctgcatcacggaagagt

SEQ ID NO: 413718 - DNA, 25 bp, Mus musculus
cagacaggctgggttctgggcctac

SEQ ID NO: 413719 - DNA, 25 bp, Mus musculus
cagacagggctgtgcatagtggaac

SEQ ID NO: 413720 - DNA, 25 bp, Mus musculus
cagacaggtctgtccacttgtcaca

SEQ ID NO: 413721 - DNA, 25 bp, Mus musculus
cagacagtcaagtgtccgcggagcc

SEQ ID NO: 413722 - DNA, 25 bp, Mus musculus
cagacagtccttccgcatggcaatg

SEQ ID NO: 413723 - DNA, 25 bp, Mus musculus
cagacagtgacgaggacagtagttc

SEQ ID NO: 413724 - DNA, 25 bp, Mus musculus
cagacagtgatgttcctgagccgca

SEQ ID NO: 413725 - DNA, 25 bp, Mus musculus
cagacagtgctgttgtacaccttta

SEQ ID NO: 413726 - DNA, 25 bp, Mus musculus
cagacagtttgtgggttgtgaaaat

SEQ ID NO: 413727 - DNA, 25 bp, Mus musculus
cagacataacttttggcggcggatt

SEQ ID NO: 413728 - DNA, 25 bp, Mus musculus
cagacatccgagtattggcctgggc

SEQ ID NO: 413729 - DNA, 25 bp, Mus musculus
cagacatccgctacgtcaagacggt

SEQ ID NO: 413730 - DNA, 25 bp, Mus musculus
cagacatccttagcactagttctca

SEQ ID NO: 413731 - DNA, 25 bp, Mus musculus
cagacatcggctggatcactggtca

SEQ ID NO: 413732 - DNA, 25 bp, Mus musculus
cagacatgcaaacttccaggacagc

SEQ ID NO: 413733 - DNA, 25 bp, Mus musculus
cagacatgcaaaggcacggagagga

SEQ ID NO: 413734 - DNA, 25 bp, Mus musculus
cagacatgccaagatcaagagggcc

SEQ ID NO: 413735 - DNA, 25 bp, Mus musculus
cagacatgccctcgtcagtgcgatg

SEQ ID NO: 413736 - DNA, 25 bp, Mus musculus
cagacatgccggacgaggtcaacat

SEQ ID NO: 413737 - DNA, 25 bp, Mus musculus
cagacatgccgtgactttgccgaga

SEQ ID NO: 413738 - DNA, 25 bp, Mus musculus
cagacatgctgtgacttggtatggt

SEQ ID NO: 413739 - DNA, 25 bp, Mus musculus
cagacatgctgtgctactggttggc

SEQ ID NO: 413740 - DNA, 25 bp, Mus musculus
cagacatggctaaagagtgaaaggc

SEQ ID NO: 413741 - DNA, 25 bp, Mus musculus
cagacatggtccacagaccagtgag

SEQ ID NO: 413742 - DNA, 25 bp, Mus musculus
cagacatgtcattttccgtggaggc

SEQ ID NO: 413743 - DNA, 25 bp, Mus musculus
cagacattagactggcggctgggac

SEQ ID NO: 413744 - DNA, 25 bp, Mus musculus
cagacattcagcctcgcatggataa

SEQ ID NO: 413745 - DNA, 25 bp, Mus musculus
cagacatttatgactggtcccagag

SEQ ID NO: 413746 - DNA, 25 bp, Mus musculus
cagaccaaagagtgcaacaaacgaa

SEQ ID NO: 413747 - DNA, 25 bp, Mus musculus
cagaccaacaacatgctgatgatag

SEQ ID NO: 413748 - DNA, 25 bp, Mus musculus
cagaccaagtgtgtgtacgaccgag

SEQ ID NO: 413749 - DNA, 25 bp, Mus musculus
cagaccagaactacgactatgccag

SEQ ID NO: 413750 - DNA, 25 bp, Mus musculus
cagaccagtctgatttggacagtcc

SEQ ID NO: 413751 - DNA, 25 bp, Mus musculus
cagaccagtgagtgagaacgatatc

SEQ ID NO: 413752 - DNA, 25 bp, Mus musculus
cagaccagttagaaactacctaagg

SEQ ID NO: 413753 - DNA, 25 bp, Mus musculus
cagaccatctctggagtcaccgtga

SEQ ID NO: 413754 - DNA, 25 bp, Mus musculus
cagaccattagtttggcggaagaat

SEQ ID NO: 413755 - DNA, 25 bp, Mus musculus
cagaccatttcctttacatcgggta

SEQ ID NO: 413756 - DNA, 25 bp, Mus musculus
cagacccaggaaaaatcaagcggat

SEQ ID NO: 413757 - DNA, 25 bp, Mus musculus
cagaccccgtggtaggagtgcagct

SEQ ID NO: 413758 - DNA, 25 bp, Mus musculus
cagacccgaagtccagagctaagct

SEQ ID NO: 413759 - DNA, 25 bp, Mus musculus
cagacccgaatgatccaaatggaga

SEQ ID NO: 413760 - DNA, 25 bp, Mus musculus
cagacccgcagccttgaacttcagt

SEQ ID NO: 413761 - DNA, 25 bp, Mus musculus
cagacccggagattgagagcagttt

SEQ ID NO: 413762 - DNA, 25 bp, Mus musculus
cagacccgtgagctcttaatttcca

SEQ ID NO: 413763 - DNA, 25 bp, Mus musculus
cagacccgtggccaaccgtctgggt

SEQ ID NO: 413764 - DNA, 25 bp, Mus musculus
cagaccctccagatgaggaccacgt

SEQ ID NO: 413765 - DNA, 25 bp, Mus musculus
cagaccctgcgtgctgttgacaagg

SEQ ID NO: 413766 - DNA, 25 bp, Mus musculus
cagaccctgctgtaagtgtaggcta

SEQ ID NO: 413767 - DNA, 25 bp, Mus musculus
cagaccctgggatgcgaatctttag

SEQ ID NO: 413768 - DNA, 25 bp, Mus musculus
cagacccttcttgcagagagagcga

SEQ ID NO: 413769 - DNA, 25 bp, Mus musculus
cagaccgaaggaaacagactgtgga

SEQ ID NO: 413770 - DNA, 25 bp, Mus musculus
cagaccgttgctgcgacagatagaa

SEQ ID NO: 413771 - DNA, 25 bp, Mus musculus
cagacctaagcagggagtgacacca

SEQ ID NO: 413772 - DNA, 25 bp, Mus musculus
cagacctcagtgtggaacagtgaac

SEQ ID NO: 413773 - DNA, 25 bp, Mus musculus
cagacctccgtacttggctttgcag

SEQ ID NO: 413774 - DNA, 25 bp, Mus musculus
cagacctcgggctgcctttgtttga

SEQ ID NO: 413775 - DNA, 25 bp, Mus musculus
cagacctcggtgtgctggtgcgtaa

SEQ ID NO: 413776 - DNA, 25 bp, Mus musculus
cagacctgaatgctgtgctccagct

SEQ ID NO: 413777 - DNA, 25 bp, Mus musculus
cagacctgagcctaacctccagtga

SEQ ID NO: 413778 - DNA, 25 bp, Mus musculus
cagacctgaggttgctacttttggc

SEQ ID NO: 413779 - DNA, 25 bp, Mus musculus
cagacctgctgactagtgggaattc

SEQ ID NO: 413780 - DNA, 25 bp, Mus musculus
cagacctgctgagctgaaagcaaaa

SEQ ID NO: 413781 - DNA, 25 bp, Mus musculus
cagacctggagaagcgttcagtgtg

SEQ ID NO: 413782 - DNA, 25 bp, Mus musculus
cagacctggatggaggttttaccca

SEQ ID NO: 413783 - DNA, 25 bp, Mus musculus
cagacctgtatcctgtgggatgaga

SEQ ID NO: 413784 - DNA, 25 bp, Mus musculus
cagaccttaagggacaacacgcatt

SEQ ID NO: 413785 - DNA, 25 bp, Mus musculus
cagaccttgacgcacttgggcgaca

SEQ ID NO: 413786 - DNA, 25 bp, Mus musculus
cagaccttggagattgacttggact

SEQ ID NO: 413787 - DNA, 25 bp, Mus musculus
cagaccttggatacatggcgacaga

SEQ ID NO: 413788 - DNA, 25 bp, Mus musculus
cagaccttgggtgcaaactctgcag

SEQ ID NO: 413789 - DNA, 25 bp, Mus musculus
cagaccttggttaagagggacagaa

SEQ ID NO: 413790 - DNA, 25 bp, Mus musculus
cagacctttacccaagtgagcgcta

SEQ ID NO: 413791 - DNA, 25 bp, Mus musculus
cagacgacggccattgcaatagaat

SEQ ID NO: 413792 - DNA, 25 bp, Mus musculus
cagacgagctcctgagctggaagag

SEQ ID NO: 413793 - DNA, 25 bp, Mus musculus
cagacgagctctaagtggaaggacc

SEQ ID NO: 413794 - DNA, 25 bp, Mus musculus
cagacgcagtacgtgctggatgtgc

SEQ ID NO: 413795 - DNA, 25 bp, Mus musculus
cagacgcggccaatgtaaacatggc

SEQ ID NO: 413796 - DNA, 25 bp, Mus musculus
cagacgctctgaggttagttggcaa

SEQ ID NO: 413797 - DNA, 25 bp, Mus musculus
cagacgctgctggatgtccctgtga

SEQ ID NO: 413798 - DNA, 25 bp, Mus musculus
cagacgctggactaatgcttccata

SEQ ID NO: 413799 - DNA, 25 bp, Mus musculus
cagacgctggtcaactatggcacat

SEQ ID NO: 413800 - DNA, 25 bp, Mus musculus
cagacgctggtggagacccttatcc

SEQ ID NO: 413801 - DNA, 25 bp, Mus musculus
cagacgcttatctagaccaagtggg

SEQ ID NO: 413802 - DNA, 25 bp, Mus musculus
cagacggaaaccttagagagatgcc

SEQ ID NO: 413803 - DNA, 25 bp, Mus musculus
cagacggctatagaggaccatgaaa

SEQ ID NO: 413804 - DNA, 25 bp, Mus musculus
cagacggcttcagaaggaaggccac

SEQ ID NO: 413805 - DNA, 25 bp, Mus musculus
cagacgggtctatggatatctttcc

SEQ ID NO: 413806 - DNA, 25 bp, Mus musculus
cagacggtttcgtgagatgggcaac

SEQ ID NO: 413807 - DNA, 25 bp, Mus musculus
cagacgtacatcatccaggaggaga

SEQ ID NO: 413808 - DNA, 25 bp, Mus musculus
cagacgtacggcgaagtgaaccaac

SEQ ID NO: 413809 - DNA, 25 bp, Mus musculus
cagacgtccttcagtgctggctgga

SEQ ID NO: 413810 - DNA, 25 bp, Mus musculus
cagacgtggacgacaagaagacttc

SEQ ID NO: 413811 - DNA, 25 bp, Mus musculus
cagacgtggcggtcactggtgatcc

SEQ ID NO: 413812 - DNA, 25 bp, Mus musculus
cagacgttcgtcatgcattcgcaca

SEQ ID NO: 413813 - DNA, 25 bp, Mus musculus
cagacgttggcaaaagtcaggccca

SEQ ID NO: 413814 - DNA, 25 bp, Mus musculus
cagacgttgtcattggcccattgtg

SEQ ID NO: 413815 - DNA, 25 bp, Mus musculus
cagacgtttcagtgggtgaagctcc

SEQ ID NO: 413816 - DNA, 25 bp, Mus musculus
cagactacagcgactggatcacggc

SEQ ID NO: 413817 - DNA, 25 bp, Mus musculus
cagactactatgacctgggctacca

SEQ ID NO: 413818 - DNA, 25 bp, Mus musculus
cagactactgtatcagggaccgaga

SEQ ID NO: 413819 - DNA, 25 bp, Mus musculus
cagactatagtaggattggatacca

SEQ ID NO: 413820 - DNA, 25 bp, Mus musculus
cagactatcgcgaagctgcagcagt

SEQ ID NO: 413821 - DNA, 25 bp, Mus musculus
cagactcagctagaaccatgaaggc

SEQ ID NO: 413822 - DNA, 25 bp, Mus musculus
cagactccctgtgcaatgtaccaaa

SEQ ID NO: 413823 - DNA, 25 bp, Mus musculus
cagactcctgaaaggcacagctgag

SEQ ID NO: 413824 - DNA, 25 bp, Mus musculus
cagactccttcagtggtggccaaga

SEQ ID NO: 413825 - DNA, 25 bp, Mus musculus
cagactcctttgattgtagtcatcc

SEQ ID NO: 413826 - DNA, 25 bp, Mus musculus
cagactcgtcgctcagtgggcgaga

SEQ ID NO: 413827 - DNA, 25 bp, Mus musculus
cagactcgtttggtgatgcctgcga

SEQ ID NO: 413828 - DNA, 25 bp, Mus musculus
cagactctaacgaggactgggcagt

SEQ ID NO: 413829 - DNA, 25 bp, Mus musculus
cagactctgccataggttcagttca

SEQ ID NO: 413830 - DNA, 25 bp, Mus musculus
cagactctgggcatatgacatattc

SEQ ID NO: 413831 - DNA, 25 bp, Mus musculus
cagactctgggcatgggcaagagaa

SEQ ID NO: 413832 - DNA, 25 bp, Mus musculus
cagactcttggctgtgtgcgccgca

SEQ ID NO: 413833 - DNA, 25 bp, Mus musculus
cagactctttagtgtggcagtggag

SEQ ID NO: 413834 - DNA, 25 bp, Mus musculus
cagactgaagatccgcatagacgcc

SEQ ID NO: 413835 - DNA, 25 bp, Mus musculus
cagactgaaggaggcagcatggcac

SEQ ID NO: 413836 - DNA, 25 bp, Mus musculus
cagactgacatggtgacaagagcca

SEQ ID NO: 413837 - DNA, 25 bp, Mus musculus
cagactgagcagaggctgtacccaa

SEQ ID NO: 413838 - DNA, 25 bp, Mus musculus
cagactgagctgtggccaaccgttt

SEQ ID NO: 413839 - DNA, 25 bp, Mus musculus
cagactgatcgctgtcctggaaaag

SEQ ID NO: 413840 - DNA, 25 bp, Mus musculus
cagactgatcgtggatgagaccccg

SEQ ID NO: 413841 - DNA, 25 bp, Mus musculus
cagactgccgctcgattatagagtt

SEQ ID NO: 413842 - DNA, 25 bp, Mus musculus
cagactgcgagactggttcaaggcc

SEQ ID NO: 413843 - DNA, 25 bp, Mus musculus
cagactgcggattaccaggtgccct

SEQ ID NO: 413844 - DNA, 25 bp, Mus musculus
cagactgcgttgtgtagtccagcca

SEQ ID NO: 413845 - DNA, 25 bp, Mus musculus
cagactggccttcagatcctcttat

SEQ ID NO: 413846 - DNA, 25 bp, Mus musculus
cagactggccttcattacgactaca

SEQ ID NO: 413847 - DNA, 25 bp, Mus musculus
cagactggctctgcatgtctggcca

SEQ ID NO: 413848 - DNA, 25 bp, Mus musculus
cagactgggcagtcaagagttgcac

SEQ ID NO: 413849 - DNA, 25 bp, Mus musculus
cagactgggctgaaagattgaagca

SEQ ID NO: 413850 - DNA, 25 bp, Mus musculus
cagactgtcaggagcaaccattcga

SEQ ID NO: 413851 - DNA, 25 bp, Mus musculus
cagactgtccaaaggccgagtgctt

SEQ ID NO: 413852 - DNA, 25 bp, Mus musculus
cagactgtccatggccagcaagatg

SEQ ID NO: 413853 - DNA, 25 bp, Mus musculus
cagactgtcttatcagctactgctg

SEQ ID NO: 413854 - DNA, 25 bp, Mus musculus
cagacttacagagggttatcagggc

SEQ ID NO: 413855 - DNA, 25 bp, Mus musculus
cagacttagctgagtgggacccatc

SEQ ID NO: 413856 - DNA, 25 bp, Mus musculus
cagacttcctcgtggccatcgtgtg

SEQ ID NO: 413857 - DNA, 25 bp, Mus musculus
cagacttcgggatacagcagcaggt

SEQ ID NO: 413858 - DNA, 25 bp, Mus musculus
cagacttcgtggctgtcacctgagc

SEQ ID NO: 413859 - DNA, 25 bp, Mus musculus
cagacttctgcaggcctacagctgg

SEQ ID NO: 413860 - DNA, 25 bp, Mus musculus
cagacttcttggtagcactagccca

SEQ ID NO: 413861 - DNA, 25 bp, Mus musculus
cagacttcttggttcagcagatgcc

SEQ ID NO: 413862 - DNA, 25 bp, Mus musculus
cagacttgaccatgaatcttggtga

SEQ ID NO: 413863 - DNA, 25 bp, Mus musculus
cagacttgagtcagctcctgtaggg

SEQ ID NO: 413864 - DNA, 25 bp, Mus musculus
cagacttggaacttgtttcttagga

SEQ ID NO: 413865 - DNA, 25 bp, Mus musculus
cagacttggcaaaagtggtgatgac

SEQ ID NO: 413866 - DNA, 25 bp, Mus musculus
cagacttggccaaatggacgggact

SEQ ID NO: 413867 - DNA, 25 bp, Mus musculus
cagacttggcgacacgttcctttaa

SEQ ID NO: 413868 - DNA, 25 bp, Mus musculus
cagacttgggaaggacttggacttt

SEQ ID NO: 413869 - DNA, 25 bp, Mus musculus
cagacttgggagatgaaaatgagcg

SEQ ID NO: 413870 - DNA, 25 bp, Mus musculus
cagacttgttattctcacttgctgc

SEQ ID NO: 413871 - DNA, 25 bp, Mus musculus
cagacttgttgatgagcaggagcga

SEQ ID NO: 413872 - DNA, 25 bp, Mus musculus
cagactttatgggtgtggccttcaa

SEQ ID NO: 413873 - DNA, 25 bp, Mus musculus
cagacttttgactggtcggacggca

SEQ ID NO: 413874 - DNA, 25 bp, Mus musculus
cagactttttcattggaggagaaga

SEQ ID NO: 413875 - DNA, 25 bp, Mus musculus
cagagaaaaccatcgcgaagcggct

SEQ ID NO: 413876 - DNA, 25 bp, Mus musculus
cagagaaaccttggctcagctcaga

SEQ ID NO: 413877 - DNA, 25 bp, Mus musculus
cagagaaagctgtctcggcaactga

SEQ ID NO: 413878 - DNA, 25 bp, Mus musculus
cagagaaagtgacataccggcgagt

SEQ ID NO: 413879 - DNA, 25 bp, Mus musculus
cagagaaattatgtctagaactgtg

SEQ ID NO: 413880 - DNA, 25 bp, Mus musculus
cagagaaccaaagcatgaaagacgg

SEQ ID NO: 413881 - DNA, 25 bp, Mus musculus
cagagaacccgcttggctggagtct

SEQ ID NO: 413882 - DNA, 25 bp, Mus musculus
cagagaactccgtggcctgagacgt

SEQ ID NO: 413883 - DNA, 25 bp, Mus musculus
cagagaactctctgcagcaaccatg

SEQ ID NO: 413884 - DNA, 25 bp, Mus musculus
cagagaactgcacctacagtgtggt

SEQ ID NO: 413885 - DNA, 25 bp, Mus musculus
cagagaagaaggtcgtgcccctgaa

SEQ ID NO: 413886 - DNA, 25 bp, Mus musculus
cagagaagactgttacagattccag

SEQ ID NO: 413887 - DNA, 25 bp, Mus musculus
cagagaagcatgattaaacaaggga

SEQ ID NO: 413888 - DNA, 25 bp, Mus musculus
cagagaaggactattcggacacacc

SEQ ID NO: 413889 - DNA, 25 bp, Mus musculus
cagagaaggcgccaacagttagcat

SEQ ID NO: 413890 - DNA, 25 bp, Mus musculus
cagagaagtgattgtgtgtccaggt

SEQ ID NO: 413891 - DNA, 25 bp, Mus musculus
cagagaagttaagtacagataagag

SEQ ID NO: 413892 - DNA, 25 bp, Mus musculus
cagagaagttttcctgcattccaga

SEQ ID NO: 413893 - DNA, 25 bp, Mus musculus
cagagaagtttttcacgggctatcc

SEQ ID NO: 413894 - DNA, 25 bp, Mus musculus
cagagaatctggaacactgtcgtag

SEQ ID NO: 413895 - DNA, 25 bp, Mus musculus
cagagaatctgtcactgtactcgac

SEQ ID NO: 413896 - DNA, 25 bp, Mus musculus
cagagaatcttctatgcctgcatgt

SEQ ID NO: 413897 - DNA, 25 bp, Mus musculus
cagagaatgacttagagccacaggc

SEQ ID NO: 413898 - DNA, 25 bp, Mus musculus
cagagaatgatgctgttcgacacca

SEQ ID NO: 413899 - DNA, 25 bp, Mus musculus
cagagaatgccgtgcgcatggacga

SEQ ID NO: 413900 - DNA, 25 bp, Mus musculus
cagagaatgctacagccaatgggca

SEQ ID NO: 413901 - DNA, 25 bp, Mus musculus
cagagaatgctatcctggaggtggc

SEQ ID NO: 413902 - DNA, 25 bp, Mus musculus
cagagaattccacaagcccctggtg

SEQ ID NO: 413903 - DNA, 25 bp, Mus musculus
cagagaatttcctcgccgtgctgag

SEQ ID NO: 413904 - DNA, 25 bp, Mus musculus
cagagacaaagagcacgaagagacc

SEQ ID NO: 413905 - DNA, 25 bp, Mus musculus
cagagacaaagtcctgcagtcagtg

SEQ ID NO: 413906 - DNA, 25 bp, Mus musculus
cagagacaaggcctgactcgaagcc

SEQ ID NO: 413907 - DNA, 25 bp, Mus musculus
cagagacaagtaaagaagtggccac

SEQ ID NO: 413908 - DNA, 25 bp, Mus musculus
cagagacaagtatggaggctgttgc

SEQ ID NO: 413909 - DNA, 25 bp, Mus musculus
cagagacagggtacgtgaagaaact

SEQ ID NO: 413910 - DNA, 25 bp, Mus musculus
cagagacagtagtaccgagctgggc

SEQ ID NO: 413911 - DNA, 25 bp, Mus musculus
cagagacatatcaggagaccccgtg

SEQ ID NO: 413912 - DNA, 25 bp, Mus musculus
cagagacatggagaacgacaaggcc

SEQ ID NO: 413913 - DNA, 25 bp, Mus musculus
cagagacatgtgatagggcttccca

SEQ ID NO: 413914 - DNA, 25 bp, Mus musculus
cagagaccattgacagagtgactgc

SEQ ID NO: 413915 - DNA, 25 bp, Mus musculus
cagagacccgcgtaaacttgtcagg

SEQ ID NO: 413916 - DNA, 25 bp, Mus musculus
cagagacccggccattaagctcgga

SEQ ID NO: 413917 - DNA, 25 bp, Mus musculus
cagagaccgactttggagttcccaa

SEQ ID NO: 413918 - DNA, 25 bp, Mus musculus
cagagacctgcatagcgcttggagc

SEQ ID NO: 413919 - DNA, 25 bp, Mus musculus
cagagaccttgcagtggactgtatc

SEQ ID NO: 413920 - DNA, 25 bp, Mus musculus
cagagacgcgcctctctggtctgag

SEQ ID NO: 413921 - DNA, 25 bp, Mus musculus
cagagacggtcatcgccatgaggct

SEQ ID NO: 413922 - DNA, 25 bp, Mus musculus
cagagactaccagacgggaaggaac

SEQ ID NO: 413923 - DNA, 25 bp, Mus musculus
cagagactcaatgctggaacctggt

SEQ ID NO: 413924 - DNA, 25 bp, Mus musculus
cagagactctccagttcacggtgga

SEQ ID NO: 413925 - DNA, 25 bp, Mus musculus
cagagactgccacctacttggacga

SEQ ID NO: 413926 - DNA, 25 bp, Mus musculus
cagagactgctgaactgacacggag

SEQ ID NO: 413927 - DNA, 25 bp, Mus musculus
cagagacttagcaaggcagctgccc

SEQ ID NO: 413928 - DNA, 25 bp, Mus musculus
cagagacttcatagctgcagagaca

SEQ ID NO: 413929 - DNA, 25 bp, Mus musculus
cagagacttgcaaatgcctatttcc

SEQ ID NO: 413930 - DNA, 25 bp, Mus musculus
cagagacttgttcttggccaacggc

SEQ ID NO: 413931 - DNA, 25 bp, Mus musculus
cagagagaactgaatccacgagatc

SEQ ID NO: 413932 - DNA, 25 bp, Mus musculus
cagagagaaggctttgcagaccacc

SEQ ID NO: 413933 - DNA, 25 bp, Mus musculus
cagagagaagggtctttgatagtaa

SEQ ID NO: 413934 - DNA, 25 bp, Mus musculus
cagagagacagcttgcaaactaggc

SEQ ID NO: 413935 - DNA, 25 bp, Mus musculus
cagagagaccattccctatagcagt

SEQ ID NO: 413936 - DNA, 25 bp, Mus musculus
cagagagactaaggaccctggattc

SEQ ID NO: 413937 - DNA, 25 bp, Mus musculus
cagagagatattttgcgcacacaca

SEQ ID NO: 413938 - DNA, 25 bp, Mus musculus
cagagagatcgcaaagctaagcaca

SEQ ID NO: 413939 - DNA, 25 bp, Mus musculus
cagagagcactcattacttaaggag

SEQ ID NO: 413940 - DNA, 25 bp, Mus musculus
cagagagcccgggagttagaacaca

SEQ ID NO: 413941 - DNA, 25 bp, Mus musculus
cagagagcccttcgagatggcagat

SEQ ID NO: 413942 - DNA, 25 bp, Mus musculus
cagagagccgtgaccaaagaggaac

SEQ ID NO: 413943 - DNA, 25 bp, Mus musculus
cagagagcctaagcccagttttgga

SEQ ID NO: 413944 - DNA, 25 bp, Mus musculus
cagagagctgcaaaggaccatgaga

SEQ ID NO: 413945 - DNA, 25 bp, Mus musculus
cagagagctgtaccccatgatagag

SEQ ID NO: 413946 - DNA, 25 bp, Mus musculus
cagagaggagccacgcaatactcag

SEQ ID NO: 413947 - DNA, 25 bp, Mus musculus
cagagaggagggtaaagccaacacc

SEQ ID NO: 413948 - DNA, 25 bp, Mus musculus
cagagaggcctgattagcacaggga

SEQ ID NO: 413949 - DNA, 25 bp, Mus musculus
cagagagggcatacaccgagaactt

SEQ ID NO: 413950 - DNA, 25 bp, Mus musculus
cagagagggtattgactacaccagc

SEQ ID NO: 413951 - DNA, 25 bp, Mus musculus
cagagaggtctccaaaagaagctaa

SEQ ID NO: 413952 - DNA, 25 bp, Mus musculus
cagagagtagccattgatggaatac

SEQ ID NO: 413953 - DNA, 25 bp, Mus musculus
cagagagtcccctaaggttcaggga

SEQ ID NO: 413954 - DNA, 25 bp, Mus musculus
cagagagtctgcaagaagatctcca

SEQ ID NO: 413955 - DNA, 25 bp, Mus musculus
cagagagtcttcatggctatcccaa

SEQ ID NO: 413956 - DNA, 25 bp, Mus musculus
cagagagtgctagtccgtgagagaa

SEQ ID NO: 413957 - DNA, 25 bp, Mus musculus
cagagagtggccgtgagtcagacac

SEQ ID NO: 413958 - DNA, 25 bp, Mus musculus
cagagagttccgcaggatgccagaa

SEQ ID NO: 413959 - DNA, 25 bp, Mus musculus
cagagagttgaagtcgcacgtgcag

SEQ ID NO: 413960 - DNA, 25 bp, Mus musculus
cagagagttttggacccagagggac

SEQ ID NO: 413961 - DNA, 25 bp, Mus musculus
cagagatacccactgctgcttctag

SEQ ID NO: 413962 - DNA, 25 bp, Mus musculus
cagagatagctgtacatccaagctt

SEQ ID NO: 413963 - DNA, 25 bp, Mus musculus
cagagatatgcgtcaccagaagaca

SEQ ID NO: 413964 - DNA, 25 bp, Mus musculus
cagagatcacagaatagaatcagca

SEQ ID NO: 413965 - DNA, 25 bp, Mus musculus
cagagatcacagataaacttcgagg

SEQ ID NO: 413966 - DNA, 25 bp, Mus musculus
cagagatcacatttttgtatggtaa

SEQ ID NO: 413967 - DNA, 25 bp, Mus musculus
cagagatccagaaaatccgcacggc

SEQ ID NO: 413968 - DNA, 25 bp, Mus musculus
cagagatccgcaaagaatgcctcca

SEQ ID NO: 413969 - DNA, 25 bp, Mus musculus
cagagatccggcgtgtttttataca

SEQ ID NO: 413970 - DNA, 25 bp, Mus musculus
cagagatcctgataggtacgccgcg

SEQ ID NO: 413971 - DNA, 25 bp, Mus musculus
cagagatccttttgcaagagaaatg

SEQ ID NO: 413972 - DNA, 25 bp, Mus musculus
cagagatctcttccgctataggtaa

SEQ ID NO: 413973 - DNA, 25 bp, Mus musculus
cagagatgaacccaaggcctgttct

SEQ ID NO: 413974 - DNA, 25 bp, Mus musculus
cagagatgaacgtaagctgggagcc

SEQ ID NO: 413975 - DNA, 25 bp, Mus musculus
cagagatgaccacagacctgcttcc

SEQ ID NO: 413976 - DNA, 25 bp, Mus musculus
cagagatgatatgcacacctttgtc

SEQ ID NO: 413977 - DNA, 25 bp, Mus musculus
cagagatgcaacgatgagaaggtac

SEQ ID NO: 413978 - DNA, 25 bp, Mus musculus
cagagatgccatgacaatgggaagc

SEQ ID NO: 413979 - DNA, 25 bp, Mus musculus
cagagatgccttcaaacggaggaac

SEQ ID NO: 413980 - DNA, 25 bp, Mus musculus
cagagatgcgctgctctgactgcta

SEQ ID NO: 413981 - DNA, 25 bp, Mus musculus
cagagatgctgctgtggagccattt

SEQ ID NO: 413982 - DNA, 25 bp, Mus musculus
cagagatgctggagtcggattgccc

SEQ ID NO: 413983 - DNA, 25 bp, Mus musculus
cagagattaccacgtgccatcggga

SEQ ID NO: 413984 - DNA, 25 bp, Mus musculus
cagagattgggcttagtactagagg

SEQ ID NO: 413985 - DNA, 25 bp, Mus musculus
cagagattggttcgactctcacccg

SEQ ID NO: 413986 - DNA, 25 bp, Mus musculus
cagagcaagcttagtgtgaccccaa

SEQ ID NO: 413987 - DNA, 25 bp, Mus musculus
cagagcacatacttcttactagaga

SEQ ID NO: 413988 - DNA, 25 bp, Mus musculus
cagagcacccgactcaaagcattgg

SEQ ID NO: 413989 - DNA, 25 bp, Mus musculus
cagagcacctgaattgagttcccaa

SEQ ID NO: 413990 - DNA, 25 bp, Mus musculus
cagagcacctttgtggcatcaattt

SEQ ID NO: 413991 - DNA, 25 bp, Mus musculus
cagagcagaagcgttgagtatttca

SEQ ID NO: 413992 - DNA, 25 bp, Mus musculus
cagagcagacccagtaagtgagcag

SEQ ID NO: 413993 - DNA, 25 bp, Mus musculus
cagagcagccctgatatttgaggcc

SEQ ID NO: 413994 - DNA, 25 bp, Mus musculus
cagagcagcgtgtacaaggtcagcc

SEQ ID NO: 413995 - DNA, 25 bp, Mus musculus
cagagcaggaagtctgcgacctgga

SEQ ID NO: 413996 - DNA, 25 bp, Mus musculus
cagagcagggtagagcaggtcttcc

SEQ ID NO: 413997 - DNA, 25 bp, Mus musculus
cagagcagtatacactggtgggcca

SEQ ID NO: 413998 - DNA, 25 bp, Mus musculus
cagagcagttttggcaatccaggga

SEQ ID NO: 413999 - DNA, 25 bp, Mus musculus
cagagcatcttccagtttacttgtg

SEQ ID NO: 414000 - DNA, 25 bp, Mus musculus
cagagcatgccatcaacataggcga

SEQ ID NO: 414001 - DNA, 25 bp, Mus musculus
cagagcattactggcccttggtttt

SEQ ID NO: 414002 - DNA, 25 bp, Mus musculus
cagagcatttaagtgcagaaatgag

SEQ ID NO: 414003 - DNA, 25 bp, Mus musculus
cagagccaatctctgcgtgacagag

SEQ ID NO: 414004 - DNA, 25 bp, Mus musculus
cagagccagattcgaatgtgcaagc

SEQ ID NO: 414005 - DNA, 25 bp, Mus musculus
cagagcccaagtgatcatggcaaga

SEQ ID NO: 414006 - DNA, 25 bp, Mus musculus
cagagcccaggaaggtattcacacc

SEQ ID NO: 414007 - DNA, 25 bp, Mus musculus
cagagcccatgctgtagtcaagcta

SEQ ID NO: 414008 - DNA, 25 bp, Mus musculus
cagagcccgaggagagagtgtggtt

SEQ ID NO: 414009 - DNA, 25 bp, Mus musculus
cagagcccgctagtgttgcacacga

SEQ ID NO: 414010 - DNA, 25 bp, Mus musculus
cagagcccggcaattgagagagagc

SEQ ID NO: 414011 - DNA, 25 bp, Mus musculus
cagagcccggtaaacagaagattca

SEQ ID NO: 414012 - DNA, 25 bp, Mus musculus
cagagccctgaggaattatgccaga

SEQ ID NO: 414013 - DNA, 25 bp, Mus musculus
cagagccctttgcatcgcttggctg

SEQ ID NO: 414014 - DNA, 25 bp, Mus musculus
cagagccgggcatataatatacaag

SEQ ID NO: 414015 - DNA, 25 bp, Mus musculus
cagagccggtgtgacatgacagaac

SEQ ID NO: 414016 - DNA, 25 bp, Mus musculus
cagagcctaactatgaaacttcgga

SEQ ID NO: 414017 - DNA, 25 bp, Mus musculus
cagagcctagaagatggaattatgc

SEQ ID NO: 414018 - DNA, 25 bp, Mus musculus
cagagcctcctgatatgttattcag

SEQ ID NO: 414019 - DNA, 25 bp, Mus musculus
cagagcctctcggtagtggtctgcc

SEQ ID NO: 414020 - DNA, 25 bp, Mus musculus
cagagcctgaaagggtgggactaca

SEQ ID NO: 414021 - DNA, 25 bp, Mus musculus
cagagcctgagttgcaacgaaaaca

SEQ ID NO: 414022 - DNA, 25 bp, Mus musculus
cagagcctggatgggtggaattcca

SEQ ID NO: 414023 - DNA, 25 bp, Mus musculus
cagagcctggctcaaaaccttggaa

SEQ ID NO: 414024 - DNA, 25 bp, Mus musculus
cagagccttctcctggtgatgaacc

SEQ ID NO: 414025 - DNA, 25 bp, Mus musculus
cagagccttgctgacatcatttgct

SEQ ID NO: 414026 - DNA, 25 bp, Mus musculus
cagagcgccttgtccgcggctcgga

SEQ ID NO: 414027 - DNA, 25 bp, Mus musculus
cagagcggagccatcatctgcatcc

SEQ ID NO: 414028 - DNA, 25 bp, Mus musculus
cagagcgtacagacctcgggagcga

SEQ ID NO: 414029 - DNA, 25 bp, Mus musculus
cagagcgtgcagctgtggccattca

SEQ ID NO: 414030 - DNA, 25 bp, Mus musculus
cagagctagcaggattgagcgagca

SEQ ID NO: 414031 - DNA, 25 bp, Mus musculus
cagagctagttgaatcccagggacc

SEQ ID NO: 414032 - DNA, 25 bp, Mus musculus
cagagctagttgctttggacttgtg

SEQ ID NO: 414033 - DNA, 25 bp, Mus musculus
cagagctcaggtattctgggcatgc

SEQ ID NO: 414034 - DNA, 25 bp, Mus musculus
cagagctcgctacactaagaacaag

SEQ ID NO: 414035 - DNA, 25 bp, Mus musculus
cagagctctcgggagtgtggctctc

SEQ ID NO: 414036 - DNA, 25 bp, Mus musculus
cagagctctgaaatgtctctccgag

SEQ ID NO: 414037 - DNA, 25 bp, Mus musculus
cagagctctgcatagaagtcctaca

SEQ ID NO: 414038 - DNA, 25 bp, Mus musculus
cagagctcttgctggtgtctgtctg

SEQ ID NO: 414039 - DNA, 25 bp, Mus musculus
cagagctgaaaatgcctgtgtgcca

SEQ ID NO: 414040 - DNA, 25 bp, Mus musculus
cagagctgaacttggagaaagctgc

SEQ ID NO: 414041 - DNA, 25 bp, Mus musculus
cagagctgaaggacttgcaggccag

SEQ ID NO: 414042 - DNA, 25 bp, Mus musculus
cagagctgacaaagggtctccggag

SEQ ID NO: 414043 - DNA, 25 bp, Mus musculus
cagagctgaccagtggaacgttaac

SEQ ID NO: 414044 - DNA, 25 bp, Mus musculus
cagagctgactattcctagggtaga

SEQ ID NO: 414045 - DNA, 25 bp, Mus musculus
cagagctgcaaagccaagcatttgt

SEQ ID NO: 414046 - DNA, 25 bp, Mus musculus
cagagctgcatctgtgtggtgatac

SEQ ID NO: 414047 - DNA, 25 bp, Mus musculus
cagagctgcctagtgccttggagag

SEQ ID NO: 414048 - DNA, 25 bp, Mus musculus
cagagctgcctcgttattccaaaga

SEQ ID NO: 414049 - DNA, 25 bp, Mus musculus
cagagctgcgagtgtttagagtaga

SEQ ID NO: 414050 - DNA, 25 bp, Mus musculus
cagagctggaataacaagcttgtgt

SEQ ID NO: 414051 - DNA, 25 bp, Mus musculus
cagagctggacgacatgggcatgct

SEQ ID NO: 414052 - DNA, 25 bp, Mus musculus
cagagctgggatagagaggcacctt

SEQ ID NO: 414053 - DNA, 25 bp, Mus musculus
cagagctgggcattcttcaagtcag

SEQ ID NO: 414054 - DNA, 25 bp, Mus musculus
cagagctgggttgcgccaaggcttt

SEQ ID NO: 414055 - DNA, 25 bp, Mus musculus
cagagctggtgagagaaatcgaata

SEQ ID NO: 414056 - DNA, 25 bp, Mus musculus
cagagctgtcgctgagtcctaggct

SEQ ID NO: 414057 - DNA, 25 bp, Mus musculus
cagagctgtctttccggatctcgga

SEQ ID NO: 414058 - DNA, 25 bp, Mus musculus
cagagcttcgactggctgctgaggc

SEQ ID NO: 414059 - DNA, 25 bp, Mus musculus
cagagcttcgtttgtggttgaccct

SEQ ID NO: 414060 - DNA, 25 bp, Mus musculus
cagagcttctgtatcctggctgtcc

SEQ ID NO: 414061 - DNA, 25 bp, Mus musculus
cagagcttgggccttgaagagtctc

SEQ ID NO: 414062 - DNA, 25 bp, Mus musculus
cagagcttgtggacagaatcgttca

SEQ ID NO: 414063 - DNA, 25 bp, Mus musculus
cagagctttccaaggatgagatgaa

SEQ ID NO: 414064 - DNA, 25 bp, Mus musculus
cagagctttccacaatttagtgccc

SEQ ID NO: 414065 - DNA, 25 bp, Mus musculus
cagagctttcgccaaggacctgagc

SEQ ID NO: 414066 - DNA, 25 bp, Mus musculus
cagagctttgtatgcagttagcctg

SEQ ID NO: 414067 - DNA, 25 bp, Mus musculus
cagagctttttgagtacacccagag

SEQ ID NO: 414068 - DNA, 25 bp, Mus musculus
cagaggaacaacgtggtgcgcaaca

SEQ ID NO: 414069 - DNA, 25 bp, Mus musculus
cagaggaagactgctgttaggcaag

SEQ ID NO: 414070 - DNA, 25 bp, Mus musculus
cagaggaaggaaaactcagggtctt

SEQ ID NO: 414071 - DNA, 25 bp, Mus musculus
cagaggaatttgatgccccgagacc

SEQ ID NO: 414072 - DNA, 25 bp, Mus musculus
cagaggaatttgcactccgagatca

SEQ ID NO: 414073 - DNA, 25 bp, Mus musculus
cagaggacaatgttagtgtagagcc

SEQ ID NO: 414074 - DNA, 25 bp, Mus musculus
cagaggaccagtgtagactgacagt

SEQ ID NO: 414075 - DNA, 25 bp, Mus musculus
cagaggacctgtgtgcttaaagtct

SEQ ID NO: 414076 - DNA, 25 bp, Mus musculus
cagaggacgaatgcggttggtaact

SEQ ID NO: 414077 - DNA, 25 bp, Mus musculus
cagaggacgccggagtcgtagctcc

SEQ ID NO: 414078 - DNA, 25 bp, Mus musculus
cagaggacgtctatgccacaaaaca

SEQ ID NO: 414079 - DNA, 25 bp, Mus musculus
cagaggactagtggttgtgtctcaa

SEQ ID NO: 414080 - DNA, 25 bp, Mus musculus
cagaggactcacttgtaatttcaca

SEQ ID NO: 414081 - DNA, 25 bp, Mus musculus
cagaggagagccttatagacggccc

SEQ ID NO: 414082 - DNA, 25 bp, Mus musculus
cagaggagatcgctcgcaaggaact

SEQ ID NO: 414083 - DNA, 25 bp, Mus musculus
cagaggagcgcatcattgtgaagca

SEQ ID NO: 414084 - DNA, 25 bp, Mus musculus
cagaggagcgctcgcatcacaaggt

SEQ ID NO: 414085 - DNA, 25 bp, Mus musculus
cagaggagcttttgtgagcctagcc

SEQ ID NO: 414086 - DNA, 25 bp, Mus musculus
cagaggaggaacttatggggacaca

SEQ ID NO: 414087 - DNA, 25 bp, Mus musculus
cagaggaggagccatcacaatagac

SEQ ID NO: 414088 - DNA, 25 bp, Mus musculus
cagaggaggaggtaagagaaaataa

SEQ ID NO: 414089 - DNA, 25 bp, Mus musculus
cagaggaggcacaactacaggagtc

SEQ ID NO: 414090 - DNA, 25 bp, Mus musculus
cagaggagtcaaacagtgcagagat

SEQ ID NO: 414091 - DNA, 25 bp, Mus musculus
cagaggataccaacacgagatgcca

SEQ ID NO: 414092 - DNA, 25 bp, Mus musculus
cagaggatacctttgtccacgaagc

SEQ ID NO: 414093 - DNA, 25 bp, Mus musculus
cagaggatactcactcggacgtgga

SEQ ID NO: 414094 - DNA, 25 bp, Mus musculus
cagaggatcgtgtaacggactgtta

SEQ ID NO: 414095 - DNA, 25 bp, Mus musculus
cagaggatgcccttaaagttctgat

SEQ ID NO: 414096 - DNA, 25 bp, Mus musculus
cagaggattgagtttgagccggcca

SEQ ID NO: 414097 - DNA, 25 bp, Mus musculus
cagaggatttgtgtccatcgtgccc

SEQ ID NO: 414098 - DNA, 25 bp, Mus musculus
cagaggcacagttggcttcagggtt

SEQ ID NO: 414099 - DNA, 25 bp, Mus musculus
cagaggcacctcctagatgtggaca

SEQ ID NO: 414100 - DNA, 25 bp, Mus musculus
cagaggcagactcgacagttcaaga

SEQ ID NO: 414101 - DNA, 25 bp, Mus musculus
cagaggcagcacgaaatcattttga

SEQ ID NO: 414102 - DNA, 25 bp, Mus musculus
cagaggcagcgctcagcgcccagga

SEQ ID NO: 414103 - DNA, 25 bp, Mus musculus
cagaggcagcgttatcctgctaggc

SEQ ID NO: 414104 - DNA, 25 bp, Mus musculus
cagaggcagcttatatcggcttcgc

SEQ ID NO: 414105 - DNA, 25 bp, Mus musculus
cagaggcagtacattgtggcggaat

SEQ ID NO: 414106 - DNA, 25 bp, Mus musculus
cagaggcagtggctttcgatcagaa

SEQ ID NO: 414107 - DNA, 25 bp, Mus musculus
cagaggcatcgaggtgttcagcaaa

SEQ ID NO: 414108 - DNA, 25 bp, Mus musculus
cagaggcatgtgttactgaagcaga

SEQ ID NO: 414109 - DNA, 25 bp, Mus musculus
cagaggccatctgaaaagacttggg

SEQ ID NO: 414110 - DNA, 25 bp, Mus musculus
cagaggcccctctagaggacaacag

SEQ ID NO: 414111 - DNA, 25 bp, Mus musculus
cagaggcccggcttcgtgattgaca

SEQ ID NO: 414112 - DNA, 25 bp, Mus musculus
cagaggccgagaaatgcagctgctg

SEQ ID NO: 414113 - DNA, 25 bp, Mus musculus
cagaggccggacgtttgaccagatc

SEQ ID NO: 414114 - DNA, 25 bp, Mus musculus
cagaggcgccttttgatccgtccaa

SEQ ID NO: 414115 - DNA, 25 bp, Mus musculus
cagaggcgctccgtttgcagtatcg

SEQ ID NO: 414116 - DNA, 25 bp, Mus musculus
cagaggcgggcatatttctttgagc

SEQ ID NO: 414117 - DNA, 25 bp, Mus musculus
cagaggcggttggatttttgtcagc

SEQ ID NO: 414118 - DNA, 25 bp, Mus musculus
cagaggcgtcttgtagcctggagca

SEQ ID NO: 414119 - DNA, 25 bp, Mus musculus
cagaggctatagacctgggtgtgaa

SEQ ID NO: 414120 - DNA, 25 bp, Mus musculus
cagaggctcatcaaatcccgaggga

SEQ ID NO: 414121 - DNA, 25 bp, Mus musculus
cagaggctcctgtgtgatgaccact

SEQ ID NO: 414122 - DNA, 25 bp, Mus musculus
cagaggctctccaaagcaggactta

SEQ ID NO: 414123 - DNA, 25 bp, Mus musculus
cagaggctcttgaatcgcaggcaaa

SEQ ID NO: 414124 - DNA, 25 bp, Mus musculus
cagaggctgagcttcaaggcatggt

SEQ ID NO: 414125 - DNA, 25 bp, Mus musculus
cagaggctggaggaagtcgttccta

SEQ ID NO: 414126 - DNA, 25 bp, Mus musculus
cagaggcttagcttggacagttcac

SEQ ID NO: 414127 - DNA, 25 bp, Mus musculus
cagaggcttaggagaacaccatgca

SEQ ID NO: 414128 - DNA, 25 bp, Mus musculus
cagaggctttcttccaagctggaga

SEQ ID NO: 414129 - DNA, 25 bp, Mus musculus
cagagggaaggcaaatcctcccggc

SEQ ID NO: 414130 - DNA, 25 bp, Mus musculus
cagagggacattcatcaaagggcca

SEQ ID NO: 414131 - DNA, 25 bp, Mus musculus
cagagggagctcaccgactagaatt

SEQ ID NO: 414132 - DNA, 25 bp, Mus musculus
cagagggcacgctatgaggcagcta

SEQ ID NO: 414133 - DNA, 25 bp, Mus musculus
cagagggcagttggctatgtcgtac

SEQ ID NO: 414134 - DNA, 25 bp, Mus musculus
cagagggcgcaacaaaatcctgaga

SEQ ID NO: 414135 - DNA, 25 bp, Mus musculus
cagagggctccctgggcttggcatt

SEQ ID NO: 414136 - DNA, 25 bp, Mus musculus
cagagggctttagtcgatgattgca

SEQ ID NO: 414137 - DNA, 25 bp, Mus musculus
cagaggggcgcaaccttgtggccat

SEQ ID NO: 414138 - DNA, 25 bp, Mus musculus
cagagggtatgagaaatagagaact

SEQ ID NO: 414139 - DNA, 25 bp, Mus musculus
cagagggtcacactgaacggcatct

SEQ ID NO: 414140 - DNA, 25 bp, Mus musculus
cagagggtcactggcttggacttca

SEQ ID NO: 414141 - DNA, 25 bp, Mus musculus
cagagggtccatataagtctcgaga

SEQ ID NO: 414142 - DNA, 25 bp, Mus musculus
cagagggttcaagcagccatgggat

SEQ ID NO: 414143 - DNA, 25 bp, Mus musculus
cagagggttcctgggatgcagacat

SEQ ID NO: 414144 - DNA, 25 bp, Mus musculus
cagaggtactacgtggaaaggccca

SEQ ID NO: 414145 - DNA, 25 bp, Mus musculus
cagaggtagcgggtctctaaggctc

SEQ ID NO: 414146 - DNA, 25 bp, Mus musculus
cagaggtcagaaaaacaaccacggg

SEQ ID NO: 414147 - DNA, 25 bp, Mus musculus
cagaggtccctcagtcagtgatgtt

SEQ ID NO: 414148 - DNA, 25 bp, Mus musculus
cagaggtctatgatccacccacatt

SEQ ID NO: 414149 - DNA, 25 bp, Mus musculus
cagaggtctcaggtgccctagaaaa

SEQ ID NO: 414150 - DNA, 25 bp, Mus musculus
cagaggtgccactgtgactcgagga

SEQ ID NO: 414151 - DNA, 25 bp, Mus musculus
cagaggtgcggtgccattcacagaa

SEQ ID NO: 414152 - DNA, 25 bp, Mus musculus
cagaggtggcgagctaaagcccaaa

SEQ ID NO: 414153 - DNA, 25 bp, Mus musculus
cagaggtgttctcagctgtccaacc

SEQ ID NO: 414154 - DNA, 25 bp, Mus musculus
cagaggtgtttctgtgccatagggc

SEQ ID NO: 414155 - DNA, 25 bp, Mus musculus
cagaggttcaggtgacaagcatccc

SEQ ID NO: 414156 - DNA, 25 bp, Mus musculus
cagaggttcccaaggtctccagaag

SEQ ID NO: 414157 - DNA, 25 bp, Mus musculus
cagaggttgagcattatatacatga

SEQ ID NO: 414158 - DNA, 25 bp, Mus musculus
cagaggttgcctgaaaccatctgaa

SEQ ID NO: 414159 - DNA, 25 bp, Mus musculus
cagaggtttctgagggctagtccca

SEQ ID NO: 414160 - DNA, 25 bp, Mus musculus
cagagtaaagagaggcaaaaaccca

SEQ ID NO: 414161 - DNA, 25 bp, Mus musculus
cagagtaagaaggacagtaagtggc

SEQ ID NO: 414162 - DNA, 25 bp, Mus musculus
cagagtaagcttgtccgcctggaac

SEQ ID NO: 414163 - DNA, 25 bp, Mus musculus
cagagtaaggatgcagtttgaggac

SEQ ID NO: 414164 - DNA, 25 bp, Mus musculus
cagagtacccagcacagtcctagtg

SEQ ID NO: 414165 - DNA, 25 bp, Mus musculus
cagagtacgggtggataaaaagcct

SEQ ID NO: 414166 - DNA, 25 bp, Mus musculus
cagagtactatctccacaaggtgga

SEQ ID NO: 414167 - DNA, 25 bp, Mus musculus
cagagtagcatctgccaggctgaga

SEQ ID NO: 414168 - DNA, 25 bp, Mus musculus
cagagtagcgttgtccaatcaggga

SEQ ID NO: 414169 - DNA, 25 bp, Mus musculus
cagagtagggtttcaaagcaggcag

SEQ ID NO: 414170 - DNA, 25 bp, Mus musculus
cagagtatcccatgcctaacgagac

SEQ ID NO: 414171 - DNA, 25 bp, Mus musculus
cagagtatctcaggaagcgcttcgg

SEQ ID NO: 414172 - DNA, 25 bp, Mus musculus
cagagtatgaggtgaacccttcagc

SEQ ID NO: 414173 - DNA, 25 bp, Mus musculus
cagagtatgctgttgagatgccaca

SEQ ID NO: 414174 - DNA, 25 bp, Mus musculus
cagagtcacattctccactgttctc

SEQ ID NO: 414175 - DNA, 25 bp, Mus musculus
cagagtcagcacatactgcacaggt

SEQ ID NO: 414176 - DNA, 25 bp, Mus musculus
cagagtcagcctgggtaaaaccctg

SEQ ID NO: 414177 - DNA, 25 bp, Mus musculus
cagagtcaggtgtcatctagcctag

SEQ ID NO: 414178 - DNA, 25 bp, Mus musculus
cagagtcagtggacgcataggtgcc

SEQ ID NO: 414179 - DNA, 25 bp, Mus musculus
cagagtccaagtccatgccagtgtt

SEQ ID NO: 414180 - DNA, 25 bp, Mus musculus
cagagtccagaagctaagggtcact

SEQ ID NO: 414181 - DNA, 25 bp, Mus musculus
cagagtcccagtgctagaaaggtag

SEQ ID NO: 414182 - DNA, 25 bp, Mus musculus
cagagtcccccctaaacagatatgg

SEQ ID NO: 414183 - DNA, 25 bp, Mus musculus
cagagtcccgggataggccattccc

SEQ ID NO: 414184 - DNA, 25 bp, Mus musculus
cagagtccctgcatttctcccagtg

SEQ ID NO: 414185 - DNA, 25 bp, Mus musculus
cagagtccggctgccactaaggaag

SEQ ID NO: 414186 - DNA, 25 bp, Mus musculus
cagagtccgggagtattggctgcca

SEQ ID NO: 414187 - DNA, 25 bp, Mus musculus
cagagtcctctgtgggtgtctggaa

SEQ ID NO: 414188 - DNA, 25 bp, Mus musculus
cagagtcctttgctaggtagggtcc

SEQ ID NO: 414189 - DNA, 25 bp, Mus musculus
cagagtcgcaaagtagcggcgctca

SEQ ID NO: 414190 - DNA, 25 bp, Mus musculus
cagagtcgctgagatccagagggac

SEQ ID NO: 414191 - DNA, 25 bp, Mus musculus
cagagtcggaagaaggcgtgaacca

SEQ ID NO: 414192 - DNA, 25 bp, Mus musculus
cagagtctcacattccgggtgtgcg

SEQ ID NO: 414193 - DNA, 25 bp, Mus musculus
cagagtctcatcgaggatgcccgca

SEQ ID NO: 414194 - DNA, 25 bp, Mus musculus
cagagtctccttggagcctacaggc

SEQ ID NO: 414195 - DNA, 25 bp, Mus musculus
cagagtctgggtctacagatcaaac

SEQ ID NO: 414196 - DNA, 25 bp, Mus musculus
cagagtgaacagtatcagccccggt

SEQ ID NO: 414197 - DNA, 25 bp, Mus musculus
cagagtgacagtcgcctcaagaggc

SEQ ID NO: 414198 - DNA, 25 bp, Mus musculus
cagagtgactctgctaaggcagcgg

SEQ ID NO: 414199 - DNA, 25 bp, Mus musculus
cagagtgagcattcggtggatttac

SEQ ID NO: 414200 - DNA, 25 bp, Mus musculus
cagagtgatacatgctaaggtgggc

SEQ ID NO: 414201 - DNA, 25 bp, Mus musculus
cagagtgatccccttgaaaatggac

SEQ ID NO: 414202 - DNA, 25 bp, Mus musculus
cagagtgctagtgaggccagacagt

SEQ ID NO: 414203 - DNA, 25 bp, Mus musculus
cagagtgctcggtccaacagggata

SEQ ID NO: 414204 - DNA, 25 bp, Mus musculus
cagagtggacagaagcaatggtgtc

SEQ ID NO: 414205 - DNA, 25 bp, Mus musculus
cagagtggactgtggctacccctct

SEQ ID NO: 414206 - DNA, 25 bp, Mus musculus
cagagtggagaatcatacggagtgc

SEQ ID NO: 414207 - DNA, 25 bp, Mus musculus
cagagtggcagctcgtgcttagtgt

SEQ ID NO: 414208 - DNA, 25 bp, Mus musculus
cagagtggccgctgcaagatcgtag

SEQ ID NO: 414209 - DNA, 25 bp, Mus musculus
cagagtgggcactacgcctttaacg

SEQ ID NO: 414210 - DNA, 25 bp, Mus musculus
cagagtggtccagagtgtttgtatt

SEQ ID NO: 414211 - DNA, 25 bp, Mus musculus
cagagtgtgacctaaaggacactgt

SEQ ID NO: 414212 - DNA, 25 bp, Mus musculus
cagagtgtgcgcagaatccagcagt

SEQ ID NO: 414213 - DNA, 25 bp, Mus musculus
cagagtgtggactgcatcccgagag

SEQ ID NO: 414214 - DNA, 25 bp, Mus musculus
cagagtgtgggcttccaaggagcca

SEQ ID NO: 414215 - DNA, 25 bp, Mus musculus
cagagtgttaagtgggaccctcagc

SEQ ID NO: 414216 - DNA, 25 bp, Mus musculus
cagagttatagccaccacagaaagc

SEQ ID NO: 414217 - DNA, 25 bp, Mus musculus
cagagttcaccgaaagtctagagct

SEQ ID NO: 414218 - DNA, 25 bp, Mus musculus
cagagttcatgtagccatgggcact

SEQ ID NO: 414219 - DNA, 25 bp, Mus musculus
cagagttccagctggtcagctccat

SEQ ID NO: 414220 - DNA, 25 bp, Mus musculus
cagagttccatcttttgtcagtaga

SEQ ID NO: 414221 - DNA, 25 bp, Mus musculus
cagagttcccaggatgaagatgctg

SEQ ID NO: 414222 - DNA, 25 bp, Mus musculus
cagagttgacacatgcacattggat

SEQ ID NO: 414223 - DNA, 25 bp, Mus musculus
cagagtttcacaagctgcagcgatg

SEQ ID NO: 414224 - DNA, 25 bp, Mus musculus
cagagtttccaaaagtatggcccca

SEQ ID NO: 414225 - DNA, 25 bp, Mus musculus
cagagtttgaaaggcctccctgaga

SEQ ID NO: 414226 - DNA, 25 bp, Mus musculus
cagagtttgagaacattggcgccat

SEQ ID NO: 414227 - DNA, 25 bp, Mus musculus
cagagtttgtttccggcagttcaca

SEQ ID NO: 414228 - DNA, 25 bp, Mus musculus
cagagttttcagagctacaatccaa

SEQ ID NO: 414229 - DNA, 25 bp, Mus musculus
cagagttttttacacagcaatgaga

SEQ ID NO: 414230 - DNA, 25 bp, Mus musculus
cagataaagctgtccctgaccgaga

SEQ ID NO: 414231 - DNA, 25 bp, Mus musculus
cagataaagtccaggtggtagcaga

SEQ ID NO: 414232 - DNA, 25 bp, Mus musculus
cagataaagtccatcgcaagcgggc

SEQ ID NO: 414233 - DNA, 25 bp, Mus musculus
cagataacataaggcatgctcttgc

SEQ ID NO: 414234 - DNA, 25 bp, Mus musculus
cagataactgatatcggagccaggt

SEQ ID NO: 414235 - DNA, 25 bp, Mus musculus
cagataactggtacggacatgggct

SEQ ID NO: 414236 - DNA, 25 bp, Mus musculus
cagataatgacactgggactcagag

SEQ ID NO: 414237 - DNA, 25 bp, Mus musculus
cagatacaagagcaacaaccaggac

SEQ ID NO: 414238 - DNA, 25 bp, Mus musculus
cagatacatctttttgagttagagg

SEQ ID NO: 414239 - DNA, 25 bp, Mus musculus
cagatacctacaggccgcaatcgag

SEQ ID NO: 414240 - DNA, 25 bp, Mus musculus
cagatacctagggaattgagctcag

SEQ ID NO: 414241 - DNA, 25 bp, Mus musculus
cagatacctggaaaacgggccaagg

SEQ ID NO: 414242 - DNA, 25 bp, Mus musculus
cagataccttggctgtgaggcaaaa

SEQ ID NO: 414243 - DNA, 25 bp, Mus musculus
cagatacgattgacgagagagccat

SEQ ID NO: 414244 - DNA, 25 bp, Mus musculus
cagatacggttcagaatgggcctga

SEQ ID NO: 414245 - DNA, 25 bp, Mus musculus
cagatactgtatacctcttggaggg

SEQ ID NO: 414246 - DNA, 25 bp, Mus musculus
cagatactttgtcacggcagacacc

SEQ ID NO: 414247 - DNA, 25 bp, Mus musculus
cagatactttgtggaggcctatgcc

SEQ ID NO: 414248 - DNA, 25 bp, Mus musculus
cagatagagctccagggctaggtca

SEQ ID NO: 414249 - DNA, 25 bp, Mus musculus
cagatagatgagtcccgcttagaca

SEQ ID NO: 414250 - DNA, 25 bp, Mus musculus
cagatagccccttactgtttgtgta

SEQ ID NO: 414251 - DNA, 25 bp, Mus musculus
cagatagtaaacatatcatccatgc

SEQ ID NO: 414252 - DNA, 25 bp, Mus musculus
cagatatacccaagatagggcaaat

SEQ ID NO: 414253 - DNA, 25 bp, Mus musculus
cagatatactatgccggccctgtca

SEQ ID NO: 414254 - DNA, 25 bp, Mus musculus
cagatatactgagggaggtgaaact

SEQ ID NO: 414255 - DNA, 25 bp, Mus musculus
cagatatcatgccagtccagacgag

SEQ ID NO: 414256 - DNA, 25 bp, Mus musculus
cagatatccccaagatgctgtggca

SEQ ID NO: 414257 - DNA, 25 bp, Mus musculus
cagatatcgcccagcgtgaagagcg

SEQ ID NO: 414258 - DNA, 25 bp, Mus musculus
cagatatgacagattccaccgcaga

SEQ ID NO: 414259 - DNA, 25 bp, Mus musculus
cagatatgcctgaccatgacttaga

SEQ ID NO: 414260 - DNA, 25 bp, Mus musculus
cagatatggatagctctctgggtaa

SEQ ID NO: 414261 - DNA, 25 bp, Mus musculus
cagatatggatatggctaccgccgc

SEQ ID NO: 414262 - DNA, 25 bp, Mus musculus
cagatatggcttcggtctgatgcag

SEQ ID NO: 414263 - DNA, 25 bp, Mus musculus
cagatatgtgccacaacgctgggca

SEQ ID NO: 414264 - DNA, 25 bp, Mus musculus
cagatatgttctctgccaggccgag

SEQ ID NO: 414265 - DNA, 25 bp, Mus musculus
cagatattacggaggagaaagccga

SEQ ID NO: 414266 - DNA, 25 bp, Mus musculus
cagatattgtccctactggagcacc

SEQ ID NO: 414267 - DNA, 25 bp, Mus musculus
cagatcaaggtgcaagtccaaggcc

SEQ ID NO: 414268 - DNA, 25 bp, Mus musculus
cagatcagacatgtagcactgtgac

SEQ ID NO: 414269 - DNA, 25 bp, Mus musculus
cagatcaggccagtgacagggtaga

SEQ ID NO: 414270 - DNA, 25 bp, Mus musculus
cagatcagggtattcagctgctgca

SEQ ID NO: 414271 - DNA, 25 bp, Mus musculus
cagatcatgccctagtccccaagat

SEQ ID NO: 414272 - DNA, 25 bp, Mus musculus
cagatcattctgagcaaccaagcag

SEQ ID NO: 414273 - DNA, 25 bp, Mus musculus
cagatcattgctttcatcgagggca

SEQ ID NO: 414274 - DNA, 25 bp, Mus musculus
cagatccagctcgagagatgccagg

SEQ ID NO: 414275 - DNA, 25 bp, Mus musculus
cagatccaggattccgcagggagag

SEQ ID NO: 414276 - DNA, 25 bp, Mus musculus
cagatccatggatagtagggcctta

SEQ ID NO: 414277 - DNA, 25 bp, Mus musculus
cagatccccagcttctaggaaaagg

SEQ ID NO: 414278 - DNA, 25 bp, Mus musculus
cagatcccggaaggaaaaagcccag

SEQ ID NO: 414279 - DNA, 25 bp, Mus musculus
cagatccctgagtgtctagggaatg

SEQ ID NO: 414280 - DNA, 25 bp, Mus musculus
cagatccctgctatgtgagccctgg

SEQ ID NO: 414281 - DNA, 25 bp, Mus musculus
cagatccgaggagctgtttggcagc

SEQ ID NO: 414282 - DNA, 25 bp, Mus musculus
cagatccgagtgattcccttttcta

SEQ ID NO: 414283 - DNA, 25 bp, Mus musculus
cagatccgtcaggactggaggcaac

SEQ ID NO: 414284 - DNA, 25 bp, Mus musculus
cagatcctatgcacctctgacagga

SEQ ID NO: 414285 - DNA, 25 bp, Mus musculus
cagatcctcagagtcaaggaccggg

SEQ ID NO: 414286 - DNA, 25 bp, Mus musculus
cagatcctgccgaagttcctcaaga

SEQ ID NO: 414287 - DNA, 25 bp, Mus musculus
cagatcctggagtcattgtatagca

SEQ ID NO: 414288 - DNA, 25 bp, Mus musculus
cagatccttggagctcatgggttta

SEQ ID NO: 414289 - DNA, 25 bp, Mus musculus
cagatcgagaaaagatagaagcctc

SEQ ID NO: 414290 - DNA, 25 bp, Mus musculus
cagatcgagatctttggtggagcca

SEQ ID NO: 414291 - DNA, 25 bp, Mus musculus
cagatcgaggttccagaacaaggca

SEQ ID NO: 414292 - DNA, 25 bp, Mus musculus
cagatcgagtgtatagtgctcctga

SEQ ID NO: 414293 - DNA, 25 bp, Mus musculus
cagatcgcagtggtacaggaacagt

SEQ ID NO: 414294 - DNA, 25 bp, Mus musculus
cagatcggcacattcataccttggg

SEQ ID NO: 414295 - DNA, 25 bp, Mus musculus
cagatcggccctcctttgaagaaat

SEQ ID NO: 414296 - DNA, 25 bp, Mus musculus
cagatctacgaatggatggtccgca

SEQ ID NO: 414297 - DNA, 25 bp, Mus musculus
cagatctactgtgaaaagcatgccc

SEQ ID NO: 414298 - DNA, 25 bp, Mus musculus
cagatctagcactcttggccatcaa

SEQ ID NO: 414299 - DNA, 25 bp, Mus musculus
cagatctagttggttacagacatgc

SEQ ID NO: 414300 - DNA, 25 bp, Mus musculus
cagatctgagaacaaccaacaaggg

SEQ ID NO: 414301 - DNA, 25 bp, Mus musculus
cagatctgagtggtttttgagccca

SEQ ID NO: 414302 - DNA, 25 bp, Mus musculus
cagatctgcgtcaatgccatgggca

SEQ ID NO: 414303 - DNA, 25 bp, Mus musculus
cagatctggcatgtgaaccccatgg

SEQ ID NO: 414304 - DNA, 25 bp, Mus musculus
cagatctgtccgtctctagtgccaa

SEQ ID NO: 414305 - DNA, 25 bp, Mus musculus
cagatctgtgcaaaagcagtgaggg

SEQ ID NO: 414306 - DNA, 25 bp, Mus musculus
cagatctgttgagcgaggcggttca

SEQ ID NO: 414307 - DNA, 25 bp, Mus musculus
cagatcttactagcttccagcgggc

SEQ ID NO: 414308 - DNA, 25 bp, Mus musculus
cagatctttaggagagagtgcaaca

SEQ ID NO: 414309 - DNA, 25 bp, Mus musculus
cagatcttttcttcgacagtggaac

SEQ ID NO: 414310 - DNA, 25 bp, Mus musculus
cagatgaactggtgtgacagtgcca

SEQ ID NO: 414311 - DNA, 25 bp, Mus musculus
cagatgaagatctccgacttgttcc

SEQ ID NO: 414312 - DNA, 25 bp, Mus musculus
cagatgaagcggatcaacagcatgc

SEQ ID NO: 414313 - DNA, 25 bp, Mus musculus
cagatgaaggccacggtgctgaaag

SEQ ID NO: 414314 - DNA, 25 bp, Mus musculus
cagatgaatacgaccagccttggga

SEQ ID NO: 414315 - DNA, 25 bp, Mus musculus
cagatgaatttgtggctggacctca

SEQ ID NO: 414316 - DNA, 25 bp, Mus musculus
cagatgacagcaagggacaacagcc

SEQ ID NO: 414317 - DNA, 25 bp, Mus musculus
cagatgacccctttcatggaaacgg

SEQ ID NO: 414318 - DNA, 25 bp, Mus musculus
cagatgacctgaacgagaagattgc

SEQ ID NO: 414319 - DNA, 25 bp, Mus musculus
cagatgacgaagaagcatgagggcc

SEQ ID NO: 414320 - DNA, 25 bp, Mus musculus
cagatgagaaacctgcacgaagcaa

SEQ ID NO: 414321 - DNA, 25 bp, Mus musculus
cagatgagaccgttcctggtgagcc

SEQ ID NO: 414322 - DNA, 25 bp, Mus musculus
cagatgagagatgggcactacaccc

SEQ ID NO: 414323 - DNA, 25 bp, Mus musculus
cagatgagcacttgaacaccaaggg

SEQ ID NO: 414324 - DNA, 25 bp, Mus musculus
cagatgagtccaaaatgttaatgat

SEQ ID NO: 414325 - DNA, 25 bp, Mus musculus
cagatgataggcacacggaggaaca

SEQ ID NO: 414326 - DNA, 25 bp, Mus musculus
cagatgatagtgaacttcccacaag

SEQ ID NO: 414327 - DNA, 25 bp, Mus musculus
cagatgatatcaacttcttgagagc

SEQ ID NO: 414328 - DNA, 25 bp, Mus musculus
cagatgatccatgctgtaagcccag

SEQ ID NO: 414329 - DNA, 25 bp, Mus musculus
cagatgatggaatggccgtggctac

SEQ ID NO: 414330 - DNA, 25 bp, Mus musculus
cagatgatggcaatgacgtgtcccc

SEQ ID NO: 414331 - DNA, 25 bp, Mus musculus
cagatgatgggacactttcggagat

SEQ ID NO: 414332 - DNA, 25 bp, Mus musculus
cagatgattctgagtcacccaggcc

SEQ ID NO: 414333 - DNA, 25 bp, Mus musculus
cagatgcagaactaaaccctaggtg

SEQ ID NO: 414334 - DNA, 25 bp, Mus musculus
cagatgcagaatgagcagcagggcc

SEQ ID NO: 414335 - DNA, 25 bp, Mus musculus
cagatgcagagttagcccaagggag

SEQ ID NO: 414336 - DNA, 25 bp, Mus musculus
cagatgcagagttgaagcccagaac

SEQ ID NO: 414337 - DNA, 25 bp, Mus musculus
cagatgcagccacttgtagccagca

SEQ ID NO: 414338 - DNA, 25 bp, Mus musculus
cagatgcagtacctgcagcggaaag

SEQ ID NO: 414339 - DNA, 25 bp, Mus musculus
cagatgccccagtggccagaagaag

SEQ ID NO: 414340 - DNA, 25 bp, Mus musculus
cagatgcctagccaagaagtacaag

SEQ ID NO: 414341 - DNA, 25 bp, Mus musculus
cagatgcctttgtacacgtggacga

SEQ ID NO: 414342 - DNA, 25 bp, Mus musculus
cagatgcgcctgtccaagaagatgg

SEQ ID NO: 414343 - DNA, 25 bp, Mus musculus
cagatgcggctgaagtaagggtcca

SEQ ID NO: 414344 - DNA, 25 bp, Mus musculus
cagatgctaaaaggcttccccaggg

SEQ ID NO: 414345 - DNA, 25 bp, Mus musculus
cagatgctactcgactgcctaggca

SEQ ID NO: 414346 - DNA, 25 bp, Mus musculus
cagatgctgcctagacaacggctcc

SEQ ID NO: 414347 - DNA, 25 bp, Mus musculus
cagatgctggaatcggtgcattggc

SEQ ID NO: 414348 - DNA, 25 bp, Mus musculus
cagatgctgggctagaaaagctcca

SEQ ID NO: 414349 - DNA, 25 bp, Mus musculus
cagatgctgtaagataagatagata

SEQ ID NO: 414350 - DNA, 25 bp, Mus musculus
cagatgctgtcggaagtgtgctcac

SEQ ID NO: 414351 - DNA, 25 bp, Mus musculus
cagatgctgtgtaacctcggcaagg

SEQ ID NO: 414352 - DNA, 25 bp, Mus musculus
cagatgcttgcattaaagatgtata

SEQ ID NO: 414353 - DNA, 25 bp, Mus musculus
cagatgctttgacccggaacacgga

SEQ ID NO: 414354 - DNA, 25 bp, Mus musculus
cagatggaacaggactagaagaagg

SEQ ID NO: 414355 - DNA, 25 bp, Mus musculus
cagatggaatctccacgacagccgg

SEQ ID NO: 414356 - DNA, 25 bp, Mus musculus
cagatggaccccttctcaggacaga

SEQ ID NO: 414357 - DNA, 25 bp, Mus musculus
cagatggacctgagggtgcagactc

SEQ ID NO: 414358 - DNA, 25 bp, Mus musculus
cagatggatcagtactaaaacccga

SEQ ID NO: 414359 - DNA, 25 bp, Mus musculus
cagatggattctttaaatgtgggca

SEQ ID NO: 414360 - DNA, 25 bp, Mus musculus
cagatggcacagttccgaaacagga

SEQ ID NO: 414361 - DNA, 25 bp, Mus musculus
cagatggcacattagaaagagacac

SEQ ID NO: 414362 - DNA, 25 bp, Mus musculus
cagatggccagcaatgaagtttcga

SEQ ID NO: 414363 - DNA, 25 bp, Mus musculus
cagatggccgatgaagcttgtgaca

SEQ ID NO: 414364 - DNA, 25 bp, Mus musculus
cagatggccgatgtgtaagaggtca

SEQ ID NO: 414365 - DNA, 25 bp, Mus musculus
cagatggcgtcacttcgtcagaggc

SEQ ID NO: 414366 - DNA, 25 bp, Mus musculus
cagatggctatgatgaggaggtacc

SEQ ID NO: 414367 - DNA, 25 bp, Mus musculus
cagatggctctcatccacaaggatg

SEQ ID NO: 414368 - DNA, 25 bp, Mus musculus
cagatgggaaacagactaacggacc

SEQ ID NO: 414369 - DNA, 25 bp, Mus musculus
cagatgggacgtggaaacattaagt

SEQ ID NO: 414370 - DNA, 25 bp, Mus musculus
cagatgggcaagttttaccctgaac

SEQ ID NO: 414371 - DNA, 25 bp, Mus musculus
cagatgggccggtttatgtgtcttc

SEQ ID NO: 414372 - DNA, 25 bp, Mus musculus
cagatgggtctggaaactaaaacaa

SEQ ID NO: 414373 - DNA, 25 bp, Mus musculus
cagatggtatcctctgcgggccaag

SEQ ID NO: 414374 - DNA, 25 bp, Mus musculus
cagatggtcacagatatgctggagc

SEQ ID NO: 414375 - DNA, 25 bp, Mus musculus
cagatggtcatagtgatcaaggccc

SEQ ID NO: 414376 - DNA, 25 bp, Mus musculus
cagatggtccatggtcaagggctac

SEQ ID NO: 414377 - DNA, 25 bp, Mus musculus
cagatggtctagtttccaagggcaa

SEQ ID NO: 414378 - DNA, 25 bp, Mus musculus
cagatggtctgtgaccctggagaag

SEQ ID NO: 414379 - DNA, 25 bp, Mus musculus
cagatggtgcgttcaaacccgggat

SEQ ID NO: 414380 - DNA, 25 bp, Mus musculus
cagatggtgttagcaggactggcct

SEQ ID NO: 414381 - DNA, 25 bp, Mus musculus
cagatggttgagtgcactaaggcga

SEQ ID NO: 414382 - DNA, 25 bp, Mus musculus
cagatgtccttctccatgcgggaaa

SEQ ID NO: 414383 - DNA, 25 bp, Mus musculus
cagatgtcgttgagccttttgccac

SEQ ID NO: 414384 - DNA, 25 bp, Mus musculus
cagatgtctatggagggcttcagcc

SEQ ID NO: 414385 - DNA, 25 bp, Mus musculus
cagatgtcttcttgccccaccagag

SEQ ID NO: 414386 - DNA, 25 bp, Mus musculus
cagatgtgaaatgaagctggatgga

SEQ ID NO: 414387 - DNA, 25 bp, Mus musculus
cagatgtgacaaatgaccatggacc

SEQ ID NO: 414388 - DNA, 25 bp, Mus musculus
cagatgtgctgtgtggatacgccca

SEQ ID NO: 414389 - DNA, 25 bp, Mus musculus
cagatgtgggagctcaatcgacgcc

SEQ ID NO: 414390 - DNA, 25 bp, Mus musculus
cagatgtgtacagtgtcagccagca

SEQ ID NO: 414391 - DNA, 25 bp, Mus musculus
cagatgtgtctggtaggtcccctaa

SEQ ID NO: 414392 - DNA, 25 bp, Mus musculus
cagatgtttggacgcactttgccca

SEQ ID NO: 414393 - DNA, 25 bp, Mus musculus
cagatgttttccactggcagcggga

SEQ ID NO: 414394 - DNA, 25 bp, Mus musculus
cagatgttttgaaccattgtgtggg

SEQ ID NO: 414395 - DNA, 25 bp, Mus musculus
cagattaaacaaagtccctgagtac

SEQ ID NO: 414396 - DNA, 25 bp, Mus musculus
cagattaacctctaatgggcccgag

SEQ ID NO: 414397 - DNA, 25 bp, Mus musculus
cagattaactactgtctgtagtggg

SEQ ID NO: 414398 - DNA, 25 bp, Mus musculus
cagattacatataagtggcctccca

SEQ ID NO: 414399 - DNA, 25 bp, Mus musculus
cagattaggtgatgcaacccctgac

SEQ ID NO: 414400 - DNA, 25 bp, Mus musculus
cagattataatttaaatatccctgg

SEQ ID NO: 414401 - DNA, 25 bp, Mus musculus
cagattataggtggccacactggca

SEQ ID NO: 414402 - DNA, 25 bp, Mus musculus
cagattatgacagcgacttccaggc

SEQ ID NO: 414403 - DNA, 25 bp, Mus musculus
cagattcaacgttctggagggcgta

SEQ ID NO: 414404 - DNA, 25 bp, Mus musculus
cagattcaagtcgtggagcagctca

SEQ ID NO: 414405 - DNA, 25 bp, Mus musculus
cagattccaggagaggttgctgtga

SEQ ID NO: 414406 - DNA, 25 bp, Mus musculus
cagattcctctttatctatcagcag

SEQ ID NO: 414407 - DNA, 25 bp, Mus musculus
cagattctaacttgggagccgtcac

SEQ ID NO: 414408 - DNA, 25 bp, Mus musculus
cagattctgagggacatggcttcct

SEQ ID NO: 414409 - DNA, 25 bp, Mus musculus
cagattctgagtgcaccgtggagcc

SEQ ID NO: 414410 - DNA, 25 bp, Mus musculus
cagattctgcatgacagcctagtga

SEQ ID NO: 414411 - DNA, 25 bp, Mus musculus
cagattctgggttggtaaccctggg

SEQ ID NO: 414412 - DNA, 25 bp, Mus musculus
cagattgaaaacctcagagaagagc

SEQ ID NO: 414413 - DNA, 25 bp, Mus musculus
cagattgacaaaacaagccaggctt

SEQ ID NO: 414414 - DNA, 25 bp, Mus musculus
cagattgcgattgctggacatgagc

SEQ ID NO: 414415 - DNA, 25 bp, Mus musculus
cagattgctgcgtgacttccaggag

SEQ ID NO: 414416 - DNA, 25 bp, Mus musculus
cagattggaggatcggaaagaatcc

SEQ ID NO: 414417 - DNA, 25 bp, Mus musculus
cagattgggcctacaaaccggagtc

SEQ ID NO: 414418 - DNA, 25 bp, Mus musculus
cagattggttcatggtcaccgttca

SEQ ID NO: 414419 - DNA, 25 bp, Mus musculus
cagattgtcaatgcggaccctggat

SEQ ID NO: 414420 - DNA, 25 bp, Mus musculus
cagattgtccctggtaggtttccca

SEQ ID NO: 414421 - DNA, 25 bp, Mus musculus
cagattgtcctgtgcgtgtgtgagc

SEQ ID NO: 414422 - DNA, 25 bp, Mus musculus
cagattgtgtctccttgatatattc

SEQ ID NO: 414423 - DNA, 25 bp, Mus musculus
cagatttaagagcagctgtggccac

SEQ ID NO: 414424 - DNA, 25 bp, Mus musculus
cagatttagagaaagtggagaccgt

SEQ ID NO: 414425 - DNA, 25 bp, Mus musculus
cagatttccgtttgagtccccagct

SEQ ID NO: 414426 - DNA, 25 bp, Mus musculus
cagatttcttactcttgctcaaggg

SEQ ID NO: 414427 - DNA, 25 bp, Mus musculus
cagatttgaatagtcgacatggttg

SEQ ID NO: 414428 - DNA, 25 bp, Mus musculus
cagatttgcgctgtgaactccccaa

SEQ ID NO: 414429 - DNA, 25 bp, Mus musculus
cagatttggatttaagagcgggctc

SEQ ID NO: 414430 - DNA, 25 bp, Mus musculus
cagatttgtcagatggaccagtcac

SEQ ID NO: 414431 - DNA, 25 bp, Mus musculus
cagatttgtgggagcttgtaccgac

SEQ ID NO: 414432 - DNA, 25 bp, Mus musculus
cagatttgtgttgcagcgtccaggc

SEQ ID NO: 414433 - DNA, 25 bp, Mus musculus
cagatttgttttccgaagagaccac

SEQ ID NO: 414434 - DNA, 25 bp, Mus musculus
cagattttattcgagcgctggtgca

SEQ ID NO: 414435 - DNA, 25 bp, Mus musculus
cagattttcctattgcttgggcgga

SEQ ID NO: 414436 - DNA, 25 bp, Mus musculus
cagattttcgggagctgcacacagc

SEQ ID NO: 414437 - DNA, 25 bp, Mus musculus
cagattttgcatcatgagccagcca

SEQ ID NO: 414438 - DNA, 25 bp, Mus musculus
cagatttttatgagagggcacaagc

SEQ ID NO: 414439 - DNA, 25 bp, Mus musculus
cagcaaaagctctgggaacagccaa

SEQ ID NO: 414440 - DNA, 25 bp, Mus musculus
cagcaaaagggattcctcgatgccc

SEQ ID NO: 414441 - DNA, 25 bp, Mus musculus
cagcaaaagggcaagatgggagcaa

SEQ ID NO: 414442 - DNA, 25 bp, Mus musculus
cagcaaacacatacagtttctggag

SEQ ID NO: 414443 - DNA, 25 bp, Mus musculus
cagcaaacggacacttggaatgggc

SEQ ID NO: 414444 - DNA, 25 bp, Mus musculus
cagcaaactccctagcagagtgaat

SEQ ID NO: 414445 - DNA, 25 bp, Mus musculus
cagcaaaggcctcgagtaaacgctt

SEQ ID NO: 414446 - DNA, 25 bp, Mus musculus
cagcaaagtacaatagaacacgagt

SEQ ID NO: 414447 - DNA, 25 bp, Mus musculus
cagcaaagtgagatctagcctcagg

SEQ ID NO: 414448 - DNA, 25 bp, Mus musculus
cagcaaagtgcgcttctgcagcggc

SEQ ID NO: 414449 - DNA, 25 bp, Mus musculus
cagcaaatctagaaacgtcgtctcg

SEQ ID NO: 414450 - DNA, 25 bp, Mus musculus
cagcaaatggatgcgctaagccggt

SEQ ID NO: 414451 - DNA, 25 bp, Mus musculus
cagcaaattctggacattcacaaga

SEQ ID NO: 414452 - DNA, 25 bp, Mus musculus
cagcaacccaaagattgtgcagctc

SEQ ID NO: 414453 - DNA, 25 bp, Mus musculus
cagcaacgtaagctccctggaggta

SEQ ID NO: 414454 - DNA, 25 bp, Mus musculus
cagcaactagttgaaaacaaagcga

SEQ ID NO: 414455 - DNA, 25 bp, Mus musculus
cagcaactcacacggacacagagag

SEQ ID NO: 414456 - DNA, 25 bp, Mus musculus
cagcaactgaaacataacatcgagg

SEQ ID NO: 414457 - DNA, 25 bp, Mus musculus
cagcaactgttgaagtggccgccaa

SEQ ID NO: 414458 - DNA, 25 bp, Mus musculus
cagcaacttcttgtttgatgaaagc

SEQ ID NO: 414459 - DNA, 25 bp, Mus musculus
cagcaagaaaactttccctggaaca

SEQ ID NO: 414460 - DNA, 25 bp, Mus musculus
cagcaagacgactttcaggaaggga

SEQ ID NO: 414461 - DNA, 25 bp, Mus musculus
cagcaagatgaataaattgccagaa

SEQ ID NO: 414462 - DNA, 25 bp, Mus musculus
cagcaaggaacagatatcacagttc

SEQ ID NO: 414463 - DNA, 25 bp, Mus musculus
cagcaaggctcttaccagcggagga

SEQ ID NO: 414464 - DNA, 25 bp, Mus musculus
cagcaagtacttgacggcacggaac

SEQ ID NO: 414465 - DNA, 25 bp, Mus musculus
cagcaagtgagttacgggcagagcc

SEQ ID NO: 414466 - DNA, 25 bp, Mus musculus
cagcaagtgcttgtttgcagagaag

SEQ ID NO: 414467 - DNA, 25 bp, Mus musculus
cagcaagtttgagccctaggcggca

SEQ ID NO: 414468 - DNA, 25 bp, Mus musculus
cagcaataaagaggtggattcccag

SEQ ID NO: 414469 - DNA, 25 bp, Mus musculus
cagcaataatactgagcatgtgcac

SEQ ID NO: 414470 - DNA, 25 bp, Mus musculus
cagcaatacccaagcggtcaggaaa

SEQ ID NO: 414471 - DNA, 25 bp, Mus musculus
cagcaatcccatctggttgggagca

SEQ ID NO: 414472 - DNA, 25 bp, Mus musculus
cagcaatcctgcaaagtcagcctgg

SEQ ID NO: 414473 - DNA, 25 bp, Mus musculus
cagcaatctgcacctctgtagaagg

SEQ ID NO: 414474 - DNA, 25 bp, Mus musculus
cagcaatgcattggcaggaacacct

SEQ ID NO: 414475 - DNA, 25 bp, Mus musculus
cagcaatggaccagagtaaggatgc

SEQ ID NO: 414476 - DNA, 25 bp, Mus musculus
cagcaatggcctcagccgtgaaatc

SEQ ID NO: 414477 - DNA, 25 bp, Mus musculus
cagcaattatgtggaaacaccgaga

SEQ ID NO: 414478 - DNA, 25 bp, Mus musculus
cagcaattcttcctccctcatgtag

SEQ ID NO: 414479 - DNA, 25 bp, Mus musculus
cagcaatttaagagcagccacggga

SEQ ID NO: 414480 - DNA, 25 bp, Mus musculus
cagcaatttgccaagtacattacaa

SEQ ID NO: 414481 - DNA, 25 bp, Mus musculus
cagcacaacacaatggtaggtttct

SEQ ID NO: 414482 - DNA, 25 bp, Mus musculus
cagcacagagacagatagccagact

SEQ ID NO: 414483 - DNA, 25 bp, Mus musculus
cagcacagagccacatgagcagtaa

SEQ ID NO: 414484 - DNA, 25 bp, Mus musculus
cagcacagcacgcagcttcttctaa

SEQ ID NO: 414485 - DNA, 25 bp, Mus musculus
cagcacagcacgtgtacatatttca

SEQ ID NO: 414486 - DNA, 25 bp, Mus musculus
cagcacagcgtcatggtcaaaatct

SEQ ID NO: 414487 - DNA, 25 bp, Mus musculus
cagcacagcttcagttcatggttgg

SEQ ID NO: 414488 - DNA, 25 bp, Mus musculus
cagcacaggaaaatcaggagatcac

SEQ ID NO: 414489 - DNA, 25 bp, Mus musculus
cagcacaggcaacgtcaaactggag

SEQ ID NO: 414490 - DNA, 25 bp, Mus musculus
cagcacagggaccaatagtctccca

SEQ ID NO: 414491 - DNA, 25 bp, Mus musculus
cagcacagggcgagcacaatgctca

SEQ ID NO: 414492 - DNA, 25 bp, Mus musculus
cagcacagtcaataccggaagagcc

SEQ ID NO: 414493 - DNA, 25 bp, Mus musculus
cagcacagtgtgtccgagaggcatt

SEQ ID NO: 414494 - DNA, 25 bp, Mus musculus
cagcacatgatacgtggccttgacg

SEQ ID NO: 414495 - DNA, 25 bp, Mus musculus
cagcacatgggttcttgagcagtga

SEQ ID NO: 414496 - DNA, 25 bp, Mus musculus
cagcacattcatcaagctgtgtccc

SEQ ID NO: 414497 - DNA, 25 bp, Mus musculus
cagcacatttcagtctgctgcacag

SEQ ID NO: 414498 - DNA, 25 bp, Mus musculus
cagcaccacgaaaactactgggatc

SEQ ID NO: 414499 - DNA, 25 bp, Mus musculus
cagcaccccacaattcctagaatgg

SEQ ID NO: 414500 - DNA, 25 bp, Mus musculus
cagcacccgggtacatttgatggac

SEQ ID NO: 414501 - DNA, 25 bp, Mus musculus
cagcaccctatagaccaggtgtggt

SEQ ID NO: 414502 - DNA, 25 bp, Mus musculus
cagcacccttgtagaaagctaggca

SEQ ID NO: 414503 - DNA, 25 bp, Mus musculus
cagcaccgccctggtgtttttgtgt

SEQ ID NO: 414504 - DNA, 25 bp, Mus musculus
cagcaccgttggcatagacttcaag

SEQ ID NO: 414505 - DNA, 25 bp, Mus musculus
cagcacctatatggatgggcacacc

SEQ ID NO: 414506 - DNA, 25 bp, Mus musculus
cagcacctatgcctttctgagagga

SEQ ID NO: 414507 - DNA, 25 bp, Mus musculus
cagcacctcaaccaggaagcatttc

SEQ ID NO: 414508 - DNA, 25 bp, Mus musculus
cagcacctgcattcttctggctatg

SEQ ID NO: 414509 - DNA, 25 bp, Mus musculus
cagcacctggaaaactccgaattgt

SEQ ID NO: 414510 - DNA, 25 bp, Mus musculus
cagcacctggagcaaaataacttcg

SEQ ID NO: 414511 - DNA, 25 bp, Mus musculus
cagcacctggttgtgactctaggaa

SEQ ID NO: 414512 - DNA, 25 bp, Mus musculus
cagcaccttattgggaaggaacagc

SEQ ID NO: 414513 - DNA, 25 bp, Mus musculus
cagcacgaactgaaaaccggaggat

SEQ ID NO: 414514 - DNA, 25 bp, Mus musculus
cagcacgagtagatggtaaacattt

SEQ ID NO: 414515 - DNA, 25 bp, Mus musculus
cagcacgctggatcaagttcgagga

SEQ ID NO: 414516 - DNA, 25 bp, Mus musculus
cagcacggccgtctgcgtgatgcaa

SEQ ID NO: 414517 - DNA, 25 bp, Mus musculus
cagcacgtactcctgtgacagagcc

SEQ ID NO: 414518 - DNA, 25 bp, Mus musculus
cagcacgtatgtgggctctcatgca

SEQ ID NO: 414519 - DNA, 25 bp, Mus musculus
cagcacgtgggacagagataacgac

SEQ ID NO: 414520 - DNA, 25 bp, Mus musculus
cagcactcgaactcaggagacggag

SEQ ID NO: 414521 - DNA, 25 bp, Mus musculus
cagcactgatggatgatgggcccca

SEQ ID NO: 414522 - DNA, 25 bp, Mus musculus
cagcactgctattgttcttaatgga

SEQ ID NO: 414523 - DNA, 25 bp, Mus musculus
cagcactggctcacatctagcattc

SEQ ID NO: 414524 - DNA, 25 bp, Mus musculus
cagcactgggcttagactgaggtca

SEQ ID NO: 414525 - DNA, 25 bp, Mus musculus
cagcactgtgggtatcgacttcaaa

SEQ ID NO: 414526 - DNA, 25 bp, Mus musculus
cagcacttgggcaaaaggagcagca

SEQ ID NO: 414527 - DNA, 25 bp, Mus musculus
cagcacttgtcactgcctgtcttct

SEQ ID NO: 414528 - DNA, 25 bp, Mus musculus
cagcagaacagaaggcatgatggca

SEQ ID NO: 414529 - DNA, 25 bp, Mus musculus
cagcagaacatgaagggagttgttt

SEQ ID NO: 414530 - DNA, 25 bp, Mus musculus
cagcagaagccgtgcagagtgagca

SEQ ID NO: 414531 - DNA, 25 bp, Mus musculus
cagcagaagttcacccaacagggaa

SEQ ID NO: 414532 - DNA, 25 bp, Mus musculus
cagcagaagttgtggctacagcaaa

SEQ ID NO: 414533 - DNA, 25 bp, Mus musculus
cagcagaatgagttcagacgaccca

SEQ ID NO: 414534 - DNA, 25 bp, Mus musculus
cagcagacctttagtgtgaacccca

SEQ ID NO: 414535 - DNA, 25 bp, Mus musculus
cagcagactgactcatgcattggcg

SEQ ID NO: 414536 - DNA, 25 bp, Mus musculus
cagcagagcaattggaggtccccta

SEQ ID NO: 414537 - DNA, 25 bp, Mus musculus
cagcagagccggactatgtgcagcc

SEQ ID NO: 414538 - DNA, 25 bp, Mus musculus
cagcagagcctcgaccatttagcta

SEQ ID NO: 414539 - DNA, 25 bp, Mus musculus
cagcagaggtgctaattgtgacaac

SEQ ID NO: 414540 - DNA, 25 bp, Mus musculus
cagcagagtcatgtgtgcagcgcac

SEQ ID NO: 414541 - DNA, 25 bp, Mus musculus
cagcagagtggcgacatggacattc

SEQ ID NO: 414542 - DNA, 25 bp, Mus musculus
cagcagataactgacagccttgtat

SEQ ID NO: 414543 - DNA, 25 bp, Mus musculus
cagcagataatgagtgacccagcca

SEQ ID NO: 414544 - DNA, 25 bp, Mus musculus
cagcagatagaagacaggcagggcc

SEQ ID NO: 414545 - DNA, 25 bp, Mus musculus
cagcagatattccttcgagtggcca

SEQ ID NO: 414546 - DNA, 25 bp, Mus musculus
cagcagatgatcatggctcagagca

SEQ ID NO: 414547 - DNA, 25 bp, Mus musculus
cagcagatgcctgttgcctcaggag

SEQ ID NO: 414548 - DNA, 25 bp, Mus musculus
cagcagatgtggtgatgtaaatctc

SEQ ID NO: 414549 - DNA, 25 bp, Mus musculus
cagcagattgttcgagagactttcc

SEQ ID NO: 414550 - DNA, 25 bp, Mus musculus
cagcagcaatgtggatgatcctgga

SEQ ID NO: 414551 - DNA, 25 bp, Mus musculus
cagcagcacattttgttgtcctaaa

SEQ ID NO: 414552 - DNA, 25 bp, Mus musculus
cagcagcagaagactgagtgccaca

SEQ ID NO: 414553 - DNA, 25 bp, Mus musculus
cagcagcagctttgatgtgtcccag

SEQ ID NO: 414554 - DNA, 25 bp, Mus musculus
cagcagcaggacctcttaagttcag

SEQ ID NO: 414555 - DNA, 25 bp, Mus musculus
cagcagcagggagttgactagaagt

SEQ ID NO: 414556 - DNA, 25 bp, Mus musculus
cagcagcagtgttactgggaagcca

SEQ ID NO: 414557 - DNA, 25 bp, Mus musculus
cagcagcatcgcgtagaaacaaggg

SEQ ID NO: 414558 - DNA, 25 bp, Mus musculus
cagcagcatgacacagtgcacggga

SEQ ID NO: 414559 - DNA, 25 bp, Mus musculus
cagcagcatgcaaaggtggtaccgt

SEQ ID NO: 414560 - DNA, 25 bp, Mus musculus
cagcagccagtaggacgtgaggtct

SEQ ID NO: 414561 - DNA, 25 bp, Mus musculus
cagcagcccgtataggtattggtca

SEQ ID NO: 414562 - DNA, 25 bp, Mus musculus
cagcagcctccactgagtttgagaa

SEQ ID NO: 414563 - DNA, 25 bp, Mus musculus
cagcagcctccgtgtgtcagagaag

SEQ ID NO: 414564 - DNA, 25 bp, Mus musculus
cagcagcctctagtggaatgatcag

SEQ ID NO: 414565 - DNA, 25 bp, Mus musculus
cagcagcctggtatctcatagagaa

SEQ ID NO: 414566 - DNA, 25 bp, Mus musculus
cagcagcgagatggaaaatgaggtc

SEQ ID NO: 414567 - DNA, 25 bp, Mus musculus
cagcagcgcatttgactcagaagtc

SEQ ID NO: 414568 - DNA, 25 bp, Mus musculus
cagcagcggtctgcggaaatggcaa

SEQ ID NO: 414569 - DNA, 25 bp, Mus musculus
cagcagcgtgcgtcggtttgaaagc

SEQ ID NO: 414570 - DNA, 25 bp, Mus musculus
cagcagctaacttcacacggcggaa

SEQ ID NO: 414571 - DNA, 25 bp, Mus musculus
cagcagctaagaagtggaaccgacc

SEQ ID NO: 414572 - DNA, 25 bp, Mus musculus
cagcagctatgaactcttatgaagg

SEQ ID NO: 414573 - DNA, 25 bp, Mus musculus
cagcagctgtccttgcagcaggcca

SEQ ID NO: 414574 - DNA, 25 bp, Mus musculus
cagcagcttactttggcccaggagg

SEQ ID NO: 414575 - DNA, 25 bp, Mus musculus
cagcagcttgctcagaaggaaaagg

SEQ ID NO: 414576 - DNA, 25 bp, Mus musculus
cagcagctttctcttgggcagtaca

SEQ ID NO: 414577 - DNA, 25 bp, Mus musculus
cagcaggaaactgccaactggtcag

SEQ ID NO: 414578 - DNA, 25 bp, Mus musculus
cagcaggaatgaaaggtaggcagtc

SEQ ID NO: 414579 - DNA, 25 bp, Mus musculus
cagcaggacaggtactaaacccaga

SEQ ID NO: 414580 - DNA, 25 bp, Mus musculus
cagcaggacagtggaggacgtctat

SEQ ID NO: 414581 - DNA, 25 bp, Mus musculus
cagcaggacagtgggcagaacacaa

SEQ ID NO: 414582 - DNA, 25 bp, Mus musculus
cagcaggactgcactgtatggtgtg

SEQ ID NO: 414583 - DNA, 25 bp, Mus musculus
cagcaggagggtatcagtcaggtac

SEQ ID NO: 414584 - DNA, 25 bp, Mus musculus
cagcaggattctgtggcaacccatc

SEQ ID NO: 414585 - DNA, 25 bp, Mus musculus
cagcaggcagacaggatgggatacc

SEQ ID NO: 414586 - DNA, 25 bp, Mus musculus
cagcaggcatgcgtgaaacagacaa

SEQ ID NO: 414587 - DNA, 25 bp, Mus musculus
cagcaggccccttgagtggttgaga

SEQ ID NO: 414588 - DNA, 25 bp, Mus musculus
cagcaggcgagcaagaccgcggacc

SEQ ID NO: 414589 - DNA, 25 bp, Mus musculus
cagcagggccaggtcagatgatctc

SEQ ID NO: 414590 - DNA, 25 bp, Mus musculus
cagcagggctgtgcttgttctctca

SEQ ID NO: 414591 - DNA, 25 bp, Mus musculus
cagcagggtcgttgccattttggca

SEQ ID NO: 414592 - DNA, 25 bp, Mus musculus
cagcagtaaagagtcatctgtccca

SEQ ID NO: 414593 - DNA, 25 bp, Mus musculus
cagcagtaacaagaagccagggtat

SEQ ID NO: 414594 - DNA, 25 bp, Mus musculus
cagcagtacaaggactgtgccagcc

SEQ ID NO: 414595 - DNA, 25 bp, Mus musculus
cagcagtaccaggatacagagcacc

SEQ ID NO: 414596 - DNA, 25 bp, Mus musculus
cagcagtcacgtctgtgtaaagcca

SEQ ID NO: 414597 - DNA, 25 bp, Mus musculus
cagcagtcagcagtaatggcgcgga

SEQ ID NO: 414598 - DNA, 25 bp, Mus musculus
cagcagtcagcgatggtaatttacc

SEQ ID NO: 414599 - DNA, 25 bp, Mus musculus
cagcagtcagtcagcgaggccttat

SEQ ID NO: 414600 - DNA, 25 bp, Mus musculus
cagcagtcctgggtctgaccacgga

SEQ ID NO: 414601 - DNA, 25 bp, Mus musculus
cagcagtcgctcatggaatggagaa

SEQ ID NO: 414602 - DNA, 25 bp, Mus musculus
cagcagtctaaagctcccaagaatc

SEQ ID NO: 414603 - DNA, 25 bp, Mus musculus
cagcagtctgcaccattcaagatga

SEQ ID NO: 414604 - DNA, 25 bp, Mus musculus
cagcagtgaaatgcacgtattcggc

SEQ ID NO: 414605 - DNA, 25 bp, Mus musculus
cagcagtgaacaaacagtacatctc

SEQ ID NO: 414606 - DNA, 25 bp, Mus musculus
cagcagtgcagcaagactctggtac

SEQ ID NO: 414607 - DNA, 25 bp, Mus musculus
cagcagtgcatcaagcaagagctca

SEQ ID NO: 414608 - DNA, 25 bp, Mus musculus
cagcagtgccggagagtatggaatc

SEQ ID NO: 414609 - DNA, 25 bp, Mus musculus
cagcagtgctggagacaagttcagg

SEQ ID NO: 414610 - DNA, 25 bp, Mus musculus
cagcagtggttagagttcagggtca

SEQ ID NO: 414611 - DNA, 25 bp, Mus musculus
cagcagtgtgacgactcaccatgga

SEQ ID NO: 414612 - DNA, 25 bp, Mus musculus
cagcagtgtttcaggatgacgaacc

SEQ ID NO: 414613 - DNA, 25 bp, Mus musculus
cagcagttctttggattaatgggca

SEQ ID NO: 414614 - DNA, 25 bp, Mus musculus
cagcagttgaaagtcctagaggatc

SEQ ID NO: 414615 - DNA, 25 bp, Mus musculus
cagcagttgcaccttacatcttggc

SEQ ID NO: 414616 - DNA, 25 bp, Mus musculus
cagcagttgccccttagaatgtgga

SEQ ID NO: 414617 - DNA, 25 bp, Mus musculus
cagcagttgggatgcaggccaagaa

SEQ ID NO: 414618 - DNA, 25 bp, Mus musculus
cagcagttgggttcacgttccgttc

SEQ ID NO: 414619 - DNA, 25 bp, Mus musculus
cagcagtttcacgtggtttccccaa

SEQ ID NO: 414620 - DNA, 25 bp, Mus musculus
cagcagttttgagcagtggatgctg

SEQ ID NO: 414621 - DNA, 25 bp, Mus musculus
cagcataagtatcgcctctcctgga

SEQ ID NO: 414622 - DNA, 25 bp, Mus musculus
cagcataggcaaggcagatctcacc

SEQ ID NO: 414623 - DNA, 25 bp, Mus musculus
cagcatagggtgttccaaggaggta

SEQ ID NO: 414624 - DNA, 25 bp, Mus musculus
cagcataggtgggagttgctccaag

SEQ ID NO: 414625 - DNA, 25 bp, Mus musculus
cagcatatctggtttcttgacatga

SEQ ID NO: 414626 - DNA, 25 bp, Mus musculus
cagcatcaatgtgaggcctggtagc

SEQ ID NO: 414627 - DNA, 25 bp, Mus musculus
cagcatccaggagtgttgacaggct

SEQ ID NO: 414628 - DNA, 25 bp, Mus musculus
cagcatcctagggttgctggacgcc

SEQ ID NO: 414629 - DNA, 25 bp, Mus musculus
cagcatcgatgaagctgagtgtttc

SEQ ID NO: 414630 - DNA, 25 bp, Mus musculus
cagcatcgctgtggtctggcaagca

SEQ ID NO: 414631 - DNA, 25 bp, Mus musculus
cagcatctaatgaattctacgttac

SEQ ID NO: 414632 - DNA, 25 bp, Mus musculus
cagcatctcacagaggctgtcgcag

SEQ ID NO: 414633 - DNA, 25 bp, Mus musculus
cagcatctgactacctgtgcacctt

SEQ ID NO: 414634 - DNA, 25 bp, Mus musculus
cagcatctggcgacaaaggactgta

SEQ ID NO: 414635 - DNA, 25 bp, Mus musculus
cagcatcttagagcagtgccccaga

SEQ ID NO: 414636 - DNA, 25 bp, Mus musculus
cagcatcttgcttcactaatagttc

SEQ ID NO: 414637 - DNA, 25 bp, Mus musculus
cagcatgaagctctctccagatgga

SEQ ID NO: 414638 - DNA, 25 bp, Mus musculus
cagcatgaatcaggactcttgggac

SEQ ID NO: 414639 - DNA, 25 bp, Mus musculus
cagcatgactggacttgaagtcaag

SEQ ID NO: 414640 - DNA, 25 bp, Mus musculus
cagcatgccctgaagtgaccaaaat

SEQ ID NO: 414641 - DNA, 25 bp, Mus musculus
cagcatggagttaaagccgtgttca

SEQ ID NO: 414642 - DNA, 25 bp, Mus musculus
cagcatggccaagagcgtgaagtcc

SEQ ID NO: 414643 - DNA, 25 bp, Mus musculus
cagcatggcggagatgaagagcccc

SEQ ID NO: 414644 - DNA, 25 bp, Mus musculus
cagcatggctagcacggccttggaa

SEQ ID NO: 414645 - DNA, 25 bp, Mus musculus
cagcatggctctgcgtattccagaa

SEQ ID NO: 414646 - DNA, 25 bp, Mus musculus
cagcatgggatttggacatttctat

SEQ ID NO: 414647 - DNA, 25 bp, Mus musculus
cagcatgtctcaggccagcaagagg

SEQ ID NO: 414648 - DNA, 25 bp, Mus musculus
cagcatgtgctatggcagaaccaaa

SEQ ID NO: 414649 - DNA, 25 bp, Mus musculus
cagcatgtgtggtagagcttgatca

SEQ ID NO: 414650 - DNA, 25 bp, Mus musculus
cagcatgttctcgtttcaccggcaa

SEQ ID NO: 414651 - DNA, 25 bp, Mus musculus
cagcatgtttctgtacactgggaaa

SEQ ID NO: 414652 - DNA, 25 bp, Mus musculus
cagcatgtttgcaacactgaggtca

SEQ ID NO: 414653 - DNA, 25 bp, Mus musculus
cagcattaacaatatccttgtgttc

SEQ ID NO: 414654 - DNA, 25 bp, Mus musculus
cagcattagagctttgtaacgggta

SEQ ID NO: 414655 - DNA, 25 bp, Mus musculus
cagcattcatatggaggtggaatca

SEQ ID NO: 414656 - DNA, 25 bp, Mus musculus
cagcattcgcttatagtccacggac

SEQ ID NO: 414657 - DNA, 25 bp, Mus musculus
cagcattcggctttggttcttctaa

SEQ ID NO: 414658 - DNA, 25 bp, Mus musculus
cagcattctgcctactcctgggaga

SEQ ID NO: 414659 - DNA, 25 bp, Mus musculus
cagcattgaatgcagtaaaggttcc

SEQ ID NO: 414660 - DNA, 25 bp, Mus musculus
cagcattgagacatgtttgtaatcg

SEQ ID NO: 414661 - DNA, 25 bp, Mus musculus
cagcattggcgcgatcagttccgta

SEQ ID NO: 414662 - DNA, 25 bp, Mus musculus
cagcattgtaaaggaggctatagaa

SEQ ID NO: 414663 - DNA, 25 bp, Mus musculus
cagcattgtttccagagagactaag

SEQ ID NO: 414664 - DNA, 25 bp, Mus musculus
cagcatttcggaagcggagccatgt

SEQ ID NO: 414665 - DNA, 25 bp, Mus musculus
cagccaaagtccagttcaagaacaa

SEQ ID NO: 414666 - DNA, 25 bp, Mus musculus
cagccaaatctacatggagactagg

SEQ ID NO: 414667 - DNA, 25 bp, Mus musculus
cagccaaattatgggacattcagaa

SEQ ID NO: 414668 - DNA, 25 bp, Mus musculus
cagccaacacgccaaagtcatcttt

SEQ ID NO: 414669 - DNA, 25 bp, Mus musculus
cagccaacactgaggtcaagaccat

SEQ ID NO: 414670 - DNA, 25 bp, Mus musculus
cagccaacatcgtgaccctgtggaa

SEQ ID NO: 414671 - DNA, 25 bp, Mus musculus
cagccaagccaatgagatttgaaga

SEQ ID NO: 414672 - DNA, 25 bp, Mus musculus
cagccaaggacgacagggtgttcca

SEQ ID NO: 414673 - DNA, 25 bp, Mus musculus
cagccaaggcccacagtgaaatgct

SEQ ID NO: 414674 - DNA, 25 bp, Mus musculus
cagccaaggctagattgacactgag

SEQ ID NO: 414675 - DNA, 25 bp, Mus musculus
cagccaagtgttatagatgtccagc

SEQ ID NO: 414676 - DNA, 25 bp, Mus musculus
cagccaagttcaagggtcagcggat

SEQ ID NO: 414677 - DNA, 25 bp, Mus musculus
cagccaatgccgacctggaggtgaa

SEQ ID NO: 414678 - DNA, 25 bp, Mus musculus
cagccaatgctaaatgaccccagtt

SEQ ID NO: 414679 - DNA, 25 bp, Mus musculus
cagccacagacactgtgctcacaga

SEQ ID NO: 414680 - DNA, 25 bp, Mus musculus
cagccacaggactcaacggtatatt

SEQ ID NO: 414681 - DNA, 25 bp, Mus musculus
cagccacagtcttggatcccagaag

SEQ ID NO: 414682 - DNA, 25 bp, Mus musculus
cagccacagtggaagtaactttacc

SEQ ID NO: 414683 - DNA, 25 bp, Mus musculus
cagccacatgttgcaaggacaatcc

SEQ ID NO: 414684 - DNA, 25 bp, Mus musculus
cagccaccctgtgctattagcggag

SEQ ID NO: 414685 - DNA, 25 bp, Mus musculus
cagccaccgaacaggtctgctttca

SEQ ID NO: 414686 - DNA, 25 bp, Mus musculus
cagccaccgggtgaagaaatcgtgt

SEQ ID NO: 414687 - DNA, 25 bp, Mus musculus
cagccaccgtgtacaagatctgtgc

SEQ ID NO: 414688 - DNA, 25 bp, Mus musculus
cagccacctctgaattacactttaa

SEQ ID NO: 414689 - DNA, 25 bp, Mus musculus
cagccaccttggcatagacagggca

SEQ ID NO: 414690 - DNA, 25 bp, Mus musculus
cagccacgggcctggtgaaaaagga

SEQ ID NO: 414691 - DNA, 25 bp, Mus musculus
cagccactaagatgagaaggagcgc

SEQ ID NO: 414692 - DNA, 25 bp, Mus musculus
cagccactactcagctgggtgctga

SEQ ID NO: 414693 - DNA, 25 bp, Mus musculus
cagccactccgattgaccacgatta

SEQ ID NO: 414694 - DNA, 25 bp, Mus musculus
cagccactgcttgggaacacaggaa

SEQ ID NO: 414695 - DNA, 25 bp, Mus musculus
cagccacttcctttttggcagtgaa

SEQ ID NO: 414696 - DNA, 25 bp, Mus musculus
cagccagacacaagcactcgagtat

SEQ ID NO: 414697 - DNA, 25 bp, Mus musculus
cagccagagccaaagtcagagttcc

SEQ ID NO: 414698 - DNA, 25 bp, Mus musculus
cagccagagggcaatcatcagatgt

SEQ ID NO: 414699 - DNA, 25 bp, Mus musculus
cagccagaggtgacaagaaaggcca

SEQ ID NO: 414700 - DNA, 25 bp, Mus musculus
cagccagagtcaaactgatccttta

SEQ ID NO: 414701 - DNA, 25 bp, Mus musculus
cagccagagtggtccacacagggtc

SEQ ID NO: 414702 - DNA, 25 bp, Mus musculus
cagccagagttgaccctgagattca

SEQ ID NO: 414703 - DNA, 25 bp, Mus musculus
cagccagcagggtcaggataatcca

SEQ ID NO: 414704 - DNA, 25 bp, Mus musculus
cagccagcaggtctcgttctgcgtg

SEQ ID NO: 414705 - DNA, 25 bp, Mus musculus
cagccagcccggtacttcgggttcg

SEQ ID NO: 414706 - DNA, 25 bp, Mus musculus
cagccagcgcagagttccttcacag

SEQ ID NO: 414707 - DNA, 25 bp, Mus musculus
cagccagcgctgcatagagaaatcc

SEQ ID NO: 414708 - DNA, 25 bp, Mus musculus
cagccaggacattctgaagaccaga

SEQ ID NO: 414709 - DNA, 25 bp, Mus musculus
cagccaggacctgcagtggatggta

SEQ ID NO: 414710 - DNA, 25 bp, Mus musculus
cagccaggaggttctcagggtttaa

SEQ ID NO: 414711 - DNA, 25 bp, Mus musculus
cagccaggccaactgcaagattctg

SEQ ID NO: 414712 - DNA, 25 bp, Mus musculus
cagccagggccttcatattgttcct

SEQ ID NO: 414713 - DNA, 25 bp, Mus musculus
cagccagggtgccagtagatgttca

SEQ ID NO: 414714 - DNA, 25 bp, Mus musculus
cagccagggtgtacgagatgttcca

SEQ ID NO: 414715 - DNA, 25 bp, Mus musculus
cagccagtgggatgcatgaatacgg

SEQ ID NO: 414716 - DNA, 25 bp, Mus musculus
cagccagtgtcaagtgtactgccaa

SEQ ID NO: 414717 - DNA, 25 bp, Mus musculus
cagccatcaggtgacagataaaaac

SEQ ID NO: 414718 - DNA, 25 bp, Mus musculus
cagccatccacaaacaagaatggat

SEQ ID NO: 414719 - DNA, 25 bp, Mus musculus
cagccatctctctcctggacctggt

SEQ ID NO: 414720 - DNA, 25 bp, Mus musculus
cagccatgcgcggtgtcaacaatta

SEQ ID NO: 414721 - DNA, 25 bp, Mus musculus
cagccatggcaggttttgagttaca

SEQ ID NO: 414722 - DNA, 25 bp, Mus musculus
cagccatggctgtccgaatactctc

SEQ ID NO: 414723 - DNA, 25 bp, Mus musculus
cagccatgggaaagaaggtaagcca

SEQ ID NO: 414724 - DNA, 25 bp, Mus musculus
cagccatgtctgttatcaaagtgta

SEQ ID NO: 414725 - DNA, 25 bp, Mus musculus
cagccatgttgggagcacttgcagc

SEQ ID NO: 414726 - DNA, 25 bp, Mus musculus
cagccattcatgcattaggattata

SEQ ID NO: 414727 - DNA, 25 bp, Mus musculus
cagccattctggcttcatgccagag

SEQ ID NO: 414728 - DNA, 25 bp, Mus musculus
cagccattgaccagggcagaaccat

SEQ ID NO: 414729 - DNA, 25 bp, Mus musculus
cagcccaactccaagctggagaagg

SEQ ID NO: 414730 - DNA, 25 bp, Mus musculus
cagcccaagaaaaatttgaggagca

SEQ ID NO: 414731 - DNA, 25 bp, Mus musculus
cagcccaagaaggtacggcagagca

SEQ ID NO: 414732 - DNA, 25 bp, Mus musculus
cagcccaaggaagtatcgagattca

SEQ ID NO: 414733 - DNA, 25 bp, Mus musculus
cagcccaagtcactggaagatttga

SEQ ID NO: 414734 - DNA, 25 bp, Mus musculus
cagcccacagctgagagacattctt

SEQ ID NO: 414735 - DNA, 25 bp, Mus musculus
cagcccacagtggtttactgcgtgt

SEQ ID NO: 414736 - DNA, 25 bp, Mus musculus
cagcccacatcctgaagccaaagat

SEQ ID NO: 414737 - DNA, 25 bp, Mus musculus
cagcccactgaggacaggtgtcagg

SEQ ID NO: 414738 - DNA, 25 bp, Mus musculus
cagcccagaactcaatgcccgagaa

SEQ ID NO: 414739 - DNA, 25 bp, Mus musculus
cagcccaggaaagggcatgttttat

SEQ ID NO: 414740 - DNA, 25 bp, Mus musculus
cagcccaggagaacacatggcaggg

SEQ ID NO: 414741 - DNA, 25 bp, Mus musculus
cagcccaggagaatttggaccaccg

SEQ ID NO: 414742 - DNA, 25 bp, Mus musculus
cagcccaggcaagggatcagtggaa

SEQ ID NO: 414743 - DNA, 25 bp, Mus musculus
cagcccagggctagataacttctgc

SEQ ID NO: 414744 - DNA, 25 bp, Mus musculus
cagcccaggtcggtatgagcgtttc

SEQ ID NO: 414745 - DNA, 25 bp, Mus musculus
cagcccagtgtgtgttcaggtcctc

SEQ ID NO: 414746 - DNA, 25 bp, Mus musculus
cagcccagtttgtaggtttgcagat

SEQ ID NO: 414747 - DNA, 25 bp, Mus musculus
cagcccatgtgagagcatcttctag

SEQ ID NO: 414748 - DNA, 25 bp, Mus musculus
cagccccacagttgtaggttataag

SEQ ID NO: 414749 - DNA, 25 bp, Mus musculus
cagccccactacctgcaggaaggta

SEQ ID NO: 414750 - DNA, 25 bp, Mus musculus
cagccccaggaattactttttagcg

SEQ ID NO: 414751 - DNA, 25 bp, Mus musculus
cagccccatctaggaggcagggtag

SEQ ID NO: 414752 - DNA, 25 bp, Mus musculus
cagccccgggaaaagcagctaacat

SEQ ID NO: 414753 - DNA, 25 bp, Mus musculus
cagcccctggacagtgttgaccaaa

SEQ ID NO: 414754 - DNA, 25 bp, Mus musculus
cagcccctggattaggccctaggtt

SEQ ID NO: 414755 - DNA, 25 bp, Mus musculus
cagcccctggtgatactgttgacaa

SEQ ID NO: 414756 - DNA, 25 bp, Mus musculus
cagcccctttcaccagagtagtgcg

SEQ ID NO: 414757 - DNA, 25 bp, Mus musculus
cagcccgaggtctgagttccaagga

SEQ ID NO: 414758 - DNA, 25 bp, Mus musculus
cagcccgcgttttgggttttctgct

SEQ ID NO: 414759 - DNA, 25 bp, Mus musculus
cagcccgctgttcaaggcagttgta

SEQ ID NO: 414760 - DNA, 25 bp, Mus musculus
cagcccggctggtggtcggcgggtc

SEQ ID NO: 414761 - DNA, 25 bp, Mus musculus
cagcccgtcggtgaagcggtcttaa

SEQ ID NO: 414762 - DNA, 25 bp, Mus musculus
cagccctctaacactagataaggag

SEQ ID NO: 414763 - DNA, 25 bp, Mus musculus
cagccctgagcagttgagtgactac

SEQ ID NO: 414764 - DNA, 25 bp, Mus musculus
cagccctgagcctgctaacgaggaa

SEQ ID NO: 414765 - DNA, 25 bp, Mus musculus
cagccctgagggtgaagaaaaccac

SEQ ID NO: 414766 - DNA, 25 bp, Mus musculus
cagccctgatgcttctcactgagaa

SEQ ID NO: 414767 - DNA, 25 bp, Mus musculus
cagccctgctagagaatgaatgtca

SEQ ID NO: 414768 - DNA, 25 bp, Mus musculus
cagccctggaaacaagcgcaaggaa

SEQ ID NO: 414769 - DNA, 25 bp, Mus musculus
cagccctggctagtaagctctctaa

SEQ ID NO: 414770 - DNA, 25 bp, Mus musculus
cagcccttcagtttccagagctgtg

SEQ ID NO: 414771 - DNA, 25 bp, Mus musculus
cagcccttctgattcccacaatgag

SEQ ID NO: 414772 - DNA, 25 bp, Mus musculus
cagcccttctggaatgcgctgaccc

SEQ ID NO: 414773 - DNA, 25 bp, Mus musculus
cagccgaacggaagtgcaggatgta

SEQ ID NO: 414774 - DNA, 25 bp, Mus musculus
cagccgagcagtacaagatggacca

SEQ ID NO: 414775 - DNA, 25 bp, Mus musculus
cagccgcactggaggctgtcgctgt

SEQ ID NO: 414776 - DNA, 25 bp, Mus musculus
cagccgcctggacgaaagaatttag

SEQ ID NO: 414777 - DNA, 25 bp, Mus musculus
cagccgctcatggataggaacagga

SEQ ID NO: 414778 - DNA, 25 bp, Mus musculus
cagccgcttcaaggagaacatggag

SEQ ID NO: 414779 - DNA, 25 bp, Mus musculus
cagccgcttcgtgtggaacttgacc

SEQ ID NO: 414780 - DNA, 25 bp, Mus musculus
cagccggacgcgtcactatcagtga

SEQ ID NO: 414781 - DNA, 25 bp, Mus musculus
cagccggagcctctacaacttggga

SEQ ID NO: 414782 - DNA, 25 bp, Mus musculus
cagccggaggcttccagtatggttt

SEQ ID NO: 414783 - DNA, 25 bp, Mus musculus
cagccggatcgcttttccgttttgc

SEQ ID NO: 414784 - DNA, 25 bp, Mus musculus
cagccggatctggagttgaacgacc

SEQ ID NO: 414785 - DNA, 25 bp, Mus musculus
cagccggcagctcttctgtaagtga

SEQ ID NO: 414786 - DNA, 25 bp, Mus musculus
cagccggcccgtctaaggttttgat

SEQ ID NO: 414787 - DNA, 25 bp, Mus musculus
cagccgggaccgcttcctcaaggat

SEQ ID NO: 414788 - DNA, 25 bp, Mus musculus
cagccgggtctcatggattcgcagt

SEQ ID NO: 414789 - DNA, 25 bp, Mus musculus
cagccgggtggctaagaatcagtat

SEQ ID NO: 414790 - DNA, 25 bp, Mus musculus
cagccggtgagggaggactttcgta

SEQ ID NO: 414791 - DNA, 25 bp, Mus musculus
cagccggtgtacttcgtgtcagaga

SEQ ID NO: 414792 - DNA, 25 bp, Mus musculus
cagccgtagttaccgagtggaacag

SEQ ID NO: 414793 - DNA, 25 bp, Mus musculus
cagccgtcgctacttatcacctgag

SEQ ID NO: 414794 - DNA, 25 bp, Mus musculus
cagccgtctaagtatcagaaagaaa

SEQ ID NO: 414795 - DNA, 25 bp, Mus musculus
cagccgtgaaggtgcttgttgtcaa

SEQ ID NO: 414796 - DNA, 25 bp, Mus musculus
cagccgtgcactgaagcagatggga

SEQ ID NO: 414797 - DNA, 25 bp, Mus musculus
cagccgtggatgagatcaagctcct

SEQ ID NO: 414798 - DNA, 25 bp, Mus musculus
cagccgtggcagagatgtatcgaag

SEQ ID NO: 414799 - DNA, 25 bp, Mus musculus
cagccgtgggagctcaatcatgatt

SEQ ID NO: 414800 - DNA, 25 bp, Mus musculus
cagccgtgtcttgcatgtgttaagc

SEQ ID NO: 414801 - DNA, 25 bp, Mus musculus
cagccgtgtttcagcgtgcaagaga

SEQ ID NO: 414802 - DNA, 25 bp, Mus musculus
cagccgtttggtgaagcgtgaatac

SEQ ID NO: 414803 - DNA, 25 bp, Mus musculus
cagcctaagctttgacgttgtaaaa

SEQ ID NO: 414804 - DNA, 25 bp, Mus musculus
cagcctacaccaccctggagtttga

SEQ ID NO: 414805 - DNA, 25 bp, Mus musculus
cagcctacagcccttggaatcaaag

SEQ ID NO: 414806 - DNA, 25 bp, Mus musculus
cagcctacaggagatggtcaactat

SEQ ID NO: 414807 - DNA, 25 bp, Mus musculus
cagcctactggagatcaggatgact

SEQ ID NO: 414808 - DNA, 25 bp, Mus musculus
cagcctagagaaaggatgtgcaaga

SEQ ID NO: 414809 - DNA, 25 bp, Mus musculus
cagcctagctctagtttgaaagtgg

SEQ ID NO: 414810 - DNA, 25 bp, Mus musculus
cagcctaggcccctgtgaagtgaca

SEQ ID NO: 414811 - DNA, 25 bp, Mus musculus
cagcctaggctacagggcaagacct

SEQ ID NO: 414812 - DNA, 25 bp, Mus musculus
cagcctaggttagacgcttgtgcgg

SEQ ID NO: 414813 - DNA, 25 bp, Mus musculus
cagcctagtggaggagcgtgacttc

SEQ ID NO: 414814 - DNA, 25 bp, Mus musculus
cagcctatcctggaggtaagttagg

SEQ ID NO: 414815 - DNA, 25 bp, Mus musculus
cagcctattgtagcagcagtcacag

SEQ ID NO: 414816 - DNA, 25 bp, Mus musculus
cagcctattgtttctgggagagtaa

SEQ ID NO: 414817 - DNA, 25 bp, Mus musculus
cagcctcacactgatcactaaatgt

SEQ ID NO: 414818 - DNA, 25 bp, Mus musculus
cagcctcagattggctccagagctg

SEQ ID NO: 414819 - DNA, 25 bp, Mus musculus
cagcctcagcgcaggtgagcctgga

SEQ ID NO: 414820 - DNA, 25 bp, Mus musculus
cagcctccaaagtgcaagaataata

SEQ ID NO: 414821 - DNA, 25 bp, Mus musculus
cagcctccctcctaggtggagacgt

SEQ ID NO: 414822 - DNA, 25 bp, Mus musculus
cagcctccgaccatcgaggagcgat

SEQ ID NO: 414823 - DNA, 25 bp, Mus musculus
cagcctccgtgttttgtgtatgcaa

SEQ ID NO: 414824 - DNA, 25 bp, Mus musculus
cagcctcctttgtagctggacagca

SEQ ID NO: 414825 - DNA, 25 bp, Mus musculus
cagcctcgggctgaatgaatgagcc

SEQ ID NO: 414826 - DNA, 25 bp, Mus musculus
cagcctcggtacagcagcaatggta

SEQ ID NO: 414827 - DNA, 25 bp, Mus musculus
cagcctctggattgggatacaggga

SEQ ID NO: 414828 - DNA, 25 bp, Mus musculus
cagcctctggcttcttcagtgactg

SEQ ID NO: 414829 - DNA, 25 bp, Mus musculus
cagcctgagatccactgagtttatc

SEQ ID NO: 414830 - DNA, 25 bp, Mus musculus
cagcctgagtgccaaagtggtagcc

SEQ ID NO: 414831 - DNA, 25 bp, Mus musculus
cagcctgattgacatgcggagcata

SEQ ID NO: 414832 - DNA, 25 bp, Mus musculus
cagcctgatttatacacaaaaaaca

SEQ ID NO: 414833 - DNA, 25 bp, Mus musculus
cagcctgcagtagggaggcacatgc

SEQ ID NO: 414834 - DNA, 25 bp, Mus musculus
cagcctgcagttggataaacttgtc

SEQ ID NO: 414835 - DNA, 25 bp, Mus musculus
cagcctgccagctaatgtgtccaag

SEQ ID NO: 414836 - DNA, 25 bp, Mus musculus
cagcctgcgcaattacccggttatc

SEQ ID NO: 414837 - DNA, 25 bp, Mus musculus
cagcctgctggttatacagtagtta

SEQ ID NO: 414838 - DNA, 25 bp, Mus musculus
cagcctgctgtggtgggtaggccga

SEQ ID NO: 414839 - DNA, 25 bp, Mus musculus
cagcctgcttctactgcttccagaa

SEQ ID NO: 414840 - DNA, 25 bp, Mus musculus
cagcctgctttctgttacatccaga

SEQ ID NO: 414841 - DNA, 25 bp, Mus musculus
cagcctggacatggaaacctgtgaa

SEQ ID NO: 414842 - DNA, 25 bp, Mus musculus
cagcctggacattgccagagcccag

SEQ ID NO: 414843 - DNA, 25 bp, Mus musculus
cagcctggacgaggaactggaagat

SEQ ID NO: 414844 - DNA, 25 bp, Mus musculus
cagcctggctgaattgatgaactca

SEQ ID NO: 414845 - DNA, 25 bp, Mus musculus
cagcctggcttgttcctcctgggat

SEQ ID NO: 414846 - DNA, 25 bp, Mus musculus
cagcctgggcgtgctgaaggttcta

SEQ ID NO: 414847 - DNA, 25 bp, Mus musculus
cagcctggtacttgtcgtggagagc

SEQ ID NO: 414848 - DNA, 25 bp, Mus musculus
cagcctggtagcatccgcattgaag

SEQ ID NO: 414849 - DNA, 25 bp, Mus musculus
cagcctggtgagacagtaagtaacc

SEQ ID NO: 414850 - DNA, 25 bp, Mus musculus
cagcctgtaagactgtactggagac

SEQ ID NO: 414851 - DNA, 25 bp, Mus musculus
cagcctgtacagaggaggtctggaa

SEQ ID NO: 414852 - DNA, 25 bp, Mus musculus
cagcctgtagattccatcttaaagg

SEQ ID NO: 414853 - DNA, 25 bp, Mus musculus
cagcctgtctcaccacacattggag

SEQ ID NO: 414854 - DNA, 25 bp, Mus musculus
cagcctgtgcatgcccgttgcttta

SEQ ID NO: 414855 - DNA, 25 bp, Mus musculus
cagcctgttccaaacagtgatgctg

SEQ ID NO: 414856 - DNA, 25 bp, Mus musculus
cagcctgtttatcccatcacgggtg

SEQ ID NO: 414857 - DNA, 25 bp, Mus musculus
cagccttaaggtccagcttgccggg

SEQ ID NO: 414858 - DNA, 25 bp, Mus musculus
cagccttaggtgatgtgccacatta

SEQ ID NO: 414859 - DNA, 25 bp, Mus musculus
cagccttagtcactgattaaatgct

SEQ ID NO: 414860 - DNA, 25 bp, Mus musculus
cagccttatgccgtgagtacctaga

SEQ ID NO: 414861 - DNA, 25 bp, Mus musculus
cagccttcccacctcggagttcagg

SEQ ID NO: 414862 - DNA, 25 bp, Mus musculus
cagccttccgtcatggaaaggaggc

SEQ ID NO: 414863 - DNA, 25 bp, Mus musculus
cagccttcgatagggacatcctggg

SEQ ID NO: 414864 - DNA, 25 bp, Mus musculus
cagccttctgtgcttaggagcccgg

SEQ ID NO: 414865 - DNA, 25 bp, Mus musculus
cagccttgaaggtccagagcagaag

SEQ ID NO: 414866 - DNA, 25 bp, Mus musculus
cagccttgagcattttcttacaaag

SEQ ID NO: 414867 - DNA, 25 bp, Mus musculus
cagccttgatggtccgagattgatc

SEQ ID NO: 414868 - DNA, 25 bp, Mus musculus
cagccttgcgcgtgtggacgatttc

SEQ ID NO: 414869 - DNA, 25 bp, Mus musculus
cagccttggcaagtgcatggaacca

SEQ ID NO: 414870 - DNA, 25 bp, Mus musculus
cagccttgggtgacaaaccgacgag

SEQ ID NO: 414871 - DNA, 25 bp, Mus musculus
cagccttgtatgaacccagggtctt

SEQ ID NO: 414872 - DNA, 25 bp, Mus musculus
cagccttgttagttgcaggaccaca

SEQ ID NO: 414873 - DNA, 25 bp, Mus musculus
cagcctttctatgccgtggagaaga

SEQ ID NO: 414874 - DNA, 25 bp, Mus musculus
cagcctttgaagaacagttgagcca

SEQ ID NO: 414875 - DNA, 25 bp, Mus musculus
cagcctttgagtccagcagcgagga

SEQ ID NO: 414876 - DNA, 25 bp, Mus musculus
cagcctttgggtgagatttttaaga

SEQ ID NO: 414877 - DNA, 25 bp, Mus musculus
cagcctttgggttccaggacacaga

SEQ ID NO: 414878 - DNA, 25 bp, Mus musculus
cagcctttgtggagttgatggacca

SEQ ID NO: 414879 - DNA, 25 bp, Mus musculus
cagcgaaaatggttggcccaagcac

SEQ ID NO: 414880 - DNA, 25 bp, Mus musculus
cagcgaaacggccagaatgaattct

SEQ ID NO: 414881 - DNA, 25 bp, Mus musculus
cagcgaagattacaggcctatgaca

SEQ ID NO: 414882 - DNA, 25 bp, Mus musculus
cagcgacaatcacggcatcaagcct

SEQ ID NO: 414883 - DNA, 25 bp, Mus musculus
cagcgacacagcgtgtgctcacggg

SEQ ID NO: 414884 - DNA, 25 bp, Mus musculus
cagcgacacgcagatgaagctgctt

SEQ ID NO: 414885 - DNA, 25 bp, Mus musculus
cagcgacagcgactggaaggtcctt

SEQ ID NO: 414886 - DNA, 25 bp, Mus musculus
cagcgacaggtcatcttgaagaagg

SEQ ID NO: 414887 - DNA, 25 bp, Mus musculus
cagcgaccaggagattgacttcaag

SEQ ID NO: 414888 - DNA, 25 bp, Mus musculus
cagcgacctcaggaggagcattcac

SEQ ID NO: 414889 - DNA, 25 bp, Mus musculus
cagcgacgtgccagccagtggcgtt

SEQ ID NO: 414890 - DNA, 25 bp, Mus musculus
cagcgactgggaaagtaatggtccc

SEQ ID NO: 414891 - DNA, 25 bp, Mus musculus
cagcgagaacctttgacgagagcac

SEQ ID NO: 414892 - DNA, 25 bp, Mus musculus
cagcgagactctcgtctgtcttgga

SEQ ID NO: 414893 - DNA, 25 bp, Mus musculus
cagcgagatgtcagccagcgtttca

SEQ ID NO: 414894 - DNA, 25 bp, Mus musculus
cagcgagcaggagacagaatgacca

SEQ ID NO: 414895 - DNA, 25 bp, Mus musculus
cagcgagccacagctaacatgatca

SEQ ID NO: 414896 - DNA, 25 bp, Mus musculus
cagcgagcccttcaccttggtggag

SEQ ID NO: 414897 - DNA, 25 bp, Mus musculus
cagcgagccgagagttaactgcagc

SEQ ID NO: 414898 - DNA, 25 bp, Mus musculus
cagcgaggagctgcttctgtcgaga

SEQ ID NO: 414899 - DNA, 25 bp, Mus musculus
cagcgatatctcagatcctcacgag

SEQ ID NO: 414900 - DNA, 25 bp, Mus musculus
cagcgatgggtgaatccctgggatt

SEQ ID NO: 414901 - DNA, 25 bp, Mus musculus
cagcgatgtgactctggttgcctgg

SEQ ID NO: 414902 - DNA, 25 bp, Mus musculus
cagcgcaaagaggtggaagtgttca

SEQ ID NO: 414903 - DNA, 25 bp, Mus musculus
cagcgcaagggtgtctccagaaaat

SEQ ID NO: 414904 - DNA, 25 bp, Mus musculus
cagcgcacacaggtatttccgagat

SEQ ID NO: 414905 - DNA, 25 bp, Mus musculus
cagcgccatgtctgtgagcgagatc

SEQ ID NO: 414906 - DNA, 25 bp, Mus musculus
cagcgccctccacagtaacagtgaa

SEQ ID NO: 414907 - DNA, 25 bp, Mus musculus
cagcgccgctggtggagactatgct

SEQ ID NO: 414908 - DNA, 25 bp, Mus musculus
cagcgccggcatgagaaggactcta

SEQ ID NO: 414909 - DNA, 25 bp, Mus musculus
cagcgccgtttgatctcttccaaga

SEQ ID NO: 414910 - DNA, 25 bp, Mus musculus
cagcgcctggtacggattgtagccc

SEQ ID NO: 414911 - DNA, 25 bp, Mus musculus
cagcgccttgggtgtgtgacgtcac

SEQ ID NO: 414912 - DNA, 25 bp, Mus musculus
cagcgcgcgaatggtctggaccaac

SEQ ID NO: 414913 - DNA, 25 bp, Mus musculus
cagcgcgcttcatgctggtcaaaag

SEQ ID NO: 414914 - DNA, 25 bp, Mus musculus
cagcgcggtgacagcttgtggattg

SEQ ID NO: 414915 - DNA, 25 bp, Mus musculus
cagcgctcagaaccacggtcatctc

SEQ ID NO: 414916 - DNA, 25 bp, Mus musculus
cagcgctccctgaatgagctggaca

SEQ ID NO: 414917 - DNA, 25 bp, Mus musculus
cagcgctcttggaaaataaccccta

SEQ ID NO: 414918 - DNA, 25 bp, Mus musculus
cagcgctgcaggaagctcgcatgta

SEQ ID NO: 414919 - DNA, 25 bp, Mus musculus
cagcgctgggagtggaaaaattttc

SEQ ID NO: 414920 - DNA, 25 bp, Mus musculus
cagcgcttaggttgtatcttgaaga

SEQ ID NO: 414921 - DNA, 25 bp, Mus musculus
cagcggaaatgataggacaatttac

SEQ ID NO: 414922 - DNA, 25 bp, Mus musculus
cagcggaaccaggacgtcttccaga

SEQ ID NO: 414923 - DNA, 25 bp, Mus musculus
cagcggaacctgctagtggagaaca

SEQ ID NO: 414924 - DNA, 25 bp, Mus musculus
cagcggacagtcgtacaaggatgag

SEQ ID NO: 414925 - DNA, 25 bp, Mus musculus
cagcggatgcttgctgaactggcca

SEQ ID NO: 414926 - DNA, 25 bp, Mus musculus
cagcggcatacctgcgagtgtgaca

SEQ ID NO: 414927 - DNA, 25 bp, Mus musculus
cagcggcatggcttcggtgttcatg

SEQ ID NO: 414928 - DNA, 25 bp, Mus musculus
cagcggcgcacgagttctactttga

SEQ ID NO: 414929 - DNA, 25 bp, Mus musculus
cagcggcggtccttatcctattatg

SEQ ID NO: 414930 - DNA, 25 bp, Mus musculus
cagcggctccaccatcgagaagagc

SEQ ID NO: 414931 - DNA, 25 bp, Mus musculus
cagcggctggataacgagatggacc

SEQ ID NO: 414932 - DNA, 25 bp, Mus musculus
cagcggcttcagagacagtgtacct

SEQ ID NO: 414933 - DNA, 25 bp, Mus musculus
cagcggcttgatccgtcagaaacgg

SEQ ID NO: 414934 - DNA, 25 bp, Mus musculus
cagcgggaacaagtagtgaaggcca

SEQ ID NO: 414935 - DNA, 25 bp, Mus musculus
cagcgggaacacctatgcctatggg

SEQ ID NO: 414936 - DNA, 25 bp, Mus musculus
cagcgggacaggtcatatagaagag

SEQ ID NO: 414937 - DNA, 25 bp, Mus musculus
cagcgggctgcagaaacttagtcat

SEQ ID NO: 414938 - DNA, 25 bp, Mus musculus
cagcggtctgcctgagaatacatca

SEQ ID NO: 414939 - DNA, 25 bp, Mus musculus
cagcggtgctggtgaagattgcccc

SEQ ID NO: 414940 - DNA, 25 bp, Mus musculus
cagcggtggtgacttccttgtttaa

SEQ ID NO: 414941 - DNA, 25 bp, Mus musculus
cagcggtgtctatttcacaggagga

SEQ ID NO: 414942 - DNA, 25 bp, Mus musculus
cagcggttcccaactggagtacaga

SEQ ID NO: 414943 - DNA, 25 bp, Mus musculus
cagcggttgaagtcactccgggcct

SEQ ID NO: 414944 - DNA, 25 bp, Mus musculus
cagcgtaactattccctggaagcaa

SEQ ID NO: 414945 - DNA, 25 bp, Mus musculus
cagcgtacagccacgataatacagg

SEQ ID NO: 414946 - DNA, 25 bp, Mus musculus
cagcgtatagtccagagggtcagcc

SEQ ID NO: 414947 - DNA, 25 bp, Mus musculus
cagcgtatcgcagagtgcatggcca

SEQ ID NO: 414948 - DNA, 25 bp, Mus musculus
cagcgtcacgaaggcaacagaagtc

SEQ ID NO: 414949 - DNA, 25 bp, Mus musculus
cagcgtcactcggatcttatcatga

SEQ ID NO: 414950 - DNA, 25 bp, Mus musculus
cagcgtcccacagacagacatgagg

SEQ ID NO: 414951 - DNA, 25 bp, Mus musculus
cagcgtccgggtactctaggtctcg

SEQ ID NO: 414952 - DNA, 25 bp, Mus musculus
cagcgtcctagagtcctatgaaaag

SEQ ID NO: 414953 - DNA, 25 bp, Mus musculus
cagcgtcgactttagcgtgggcact

SEQ ID NO: 414954 - DNA, 25 bp, Mus musculus
cagcgtcgaggaacttggagatgta

SEQ ID NO: 414955 - DNA, 25 bp, Mus musculus
cagcgtcgtgactgttgatatggga

SEQ ID NO: 414956 - DNA, 25 bp, Mus musculus
cagcgtctcagctactggaggccaa

SEQ ID NO: 414957 - DNA, 25 bp, Mus musculus
cagcgtgatgctaggaatacatttc

SEQ ID NO: 414958 - DNA, 25 bp, Mus musculus
cagcgtgatggatggtgagaacccc

SEQ ID NO: 414959 - DNA, 25 bp, Mus musculus
cagcgtgcctgcctaccttggtggt

SEQ ID NO: 414960 - DNA, 25 bp, Mus musculus
cagcgtgcggattctcatcaaggga

SEQ ID NO: 414961 - DNA, 25 bp, Mus musculus
cagcgtggcatttatccgtcggaaa

SEQ ID NO: 414962 - DNA, 25 bp, Mus musculus
cagcgtggcccagatctttacagga

SEQ ID NO: 414963 - DNA, 25 bp, Mus musculus
cagcgtgggcaacgatgcgaacatc

SEQ ID NO: 414964 - DNA, 25 bp, Mus musculus
cagcgtgggcgagccctgtctacag

SEQ ID NO: 414965 - DNA, 25 bp, Mus musculus
cagcgtgggcttcttcaacttgagg

SEQ ID NO: 414966 - DNA, 25 bp, Mus musculus
cagcgtgtagggaaattgagtcccg

SEQ ID NO: 414967 - DNA, 25 bp, Mus musculus
cagcgtgtgatggagaaaggcccac

SEQ ID NO: 414968 - DNA, 25 bp, Mus musculus
cagcgtgtgggaaaacatgcatcca

SEQ ID NO: 414969 - DNA, 25 bp, Mus musculus
cagcgttagtacatgtgctcgagga

SEQ ID NO: 414970 - DNA, 25 bp, Mus musculus
cagcgttgccaatacgtggtgggcc

SEQ ID NO: 414971 - DNA, 25 bp, Mus musculus
cagcgttgctgcaggtgttcgccaa

SEQ ID NO: 414972 - DNA, 25 bp, Mus musculus
cagcgttgttctggtgtcctccgga

SEQ ID NO: 414973 - DNA, 25 bp, Mus musculus
cagcgtttcctcttcgcagctaggg

SEQ ID NO: 414974 - DNA, 25 bp, Mus musculus
cagcgtttgagcgactgagttctcg

SEQ ID NO: 414975 - DNA, 25 bp, Mus musculus
cagcgtttggcgtgctttctgctca

SEQ ID NO: 414976 - DNA, 25 bp, Mus musculus
cagcgtttgttatgaactcgggagt

SEQ ID NO: 414977 - DNA, 25 bp, Mus musculus
cagctaaaccgagacagaaggccct

SEQ ID NO: 414978 - DNA, 25 bp, Mus musculus
cagctaaagtgtttaaagaggaaca

SEQ ID NO: 414979 - DNA, 25 bp, Mus musculus
cagctaacctcggaaaggaatagtc

SEQ ID NO: 414980 - DNA, 25 bp, Mus musculus
cagctaactcctctggcctgtctta

SEQ ID NO: 414981 - DNA, 25 bp, Mus musculus
cagctaagctctgcctatgacaaaa

SEQ ID NO: 414982 - DNA, 25 bp, Mus musculus
cagctaagtgagtaccagaagagtc

SEQ ID NO: 414983 - DNA, 25 bp, Mus musculus
cagctaatcatcaacccaagagggt

SEQ ID NO: 414984 - DNA, 25 bp, Mus musculus
cagctacactggattctgtgtggaa

SEQ ID NO: 414985 - DNA, 25 bp, Mus musculus
cagctacagggatgctgtgctccga

SEQ ID NO: 414986 - DNA, 25 bp, Mus musculus
cagctacatcgcctacctcatggat

SEQ ID NO: 414987 - DNA, 25 bp, Mus musculus
cagctacctgagcaatgtgccttca

SEQ ID NO: 414988 - DNA, 25 bp, Mus musculus
cagctacctgtggactcgagatgag

SEQ ID NO: 414989 - DNA, 25 bp, Mus musculus
cagctacctgtgtctttcccgtgga

SEQ ID NO: 414990 - DNA, 25 bp, Mus musculus
cagctacgtgcagataaaccgagag

SEQ ID NO: 414991 - DNA, 25 bp, Mus musculus
cagctactcctctctaaactgtgtt

SEQ ID NO: 414992 - DNA, 25 bp, Mus musculus
cagctactggagtttgcagagtctc

SEQ ID NO: 414993 - DNA, 25 bp, Mus musculus
cagctagaaggtagaaccagtgcct

SEQ ID NO: 414994 - DNA, 25 bp, Mus musculus
cagctagacgtgctactgccgggtc

SEQ ID NO: 414995 - DNA, 25 bp, Mus musculus
cagctagagagagaacggcgtttgc

SEQ ID NO: 414996 - DNA, 25 bp, Mus musculus
cagctagagcgcagctgaggcacta

SEQ ID NO: 414997 - DNA, 25 bp, Mus musculus
cagctagagtgggaacctggagttc

SEQ ID NO: 414998 - DNA, 25 bp, Mus musculus
cagctagcaatggtaagggagtaac

SEQ ID NO: 414999 - DNA, 25 bp, Mus musculus
cagctagcatcagcaatggggcgca

SEQ ID NO: 415000 - DNA, 25 bp, Mus musculus
cagctagcgctatgtcttcttatcc

SEQ ID NO: 415001 - DNA, 25 bp, Mus musculus
cagctaggaacaccatccgcagagt

SEQ ID NO: 415002 - DNA, 25 bp, Mus musculus
cagctaggatagacaccatggaata

SEQ ID NO: 415003 - DNA, 25 bp, Mus musculus
cagctaggtctgctcaagacggaca

SEQ ID NO: 415004 - DNA, 25 bp, Mus musculus
cagctagtgggcactttgtttcacc

SEQ ID NO: 415005 - DNA, 25 bp, Mus musculus
cagctagttacagtctggacgttca

SEQ ID NO: 415006 - DNA, 25 bp, Mus musculus
cagctataatggaagcggttgtccg

SEQ ID NO: 415007 - DNA, 25 bp, Mus musculus
cagctatccggaaactgaaacagga

SEQ ID NO: 415008 - DNA, 25 bp, Mus musculus
cagctatcggagaaggaatgaccag

SEQ ID NO: 415009 - DNA, 25 bp, Mus musculus
cagctatgctgtggagaagccgctc

SEQ ID NO: 415010 - DNA, 25 bp, Mus musculus
cagctatgggaactatggctatgcc

SEQ ID NO: 415011 - DNA, 25 bp, Mus musculus
cagctattcattgttcctaaaagag

SEQ ID NO: 415012 - DNA, 25 bp, Mus musculus
cagctatttcactgtgggacttttc

SEQ ID NO: 415013 - DNA, 25 bp, Mus musculus
cagctcaaaagggaggcagatactt

SEQ ID NO: 415014 - DNA, 25 bp, Mus musculus
cagctcaaagtggtcaggtttcgcg

SEQ ID NO: 415015 - DNA, 25 bp, Mus musculus
cagctcaagtccagggcagatgtcc

SEQ ID NO: 415016 - DNA, 25 bp, Mus musculus
cagctcactgtgagatcgcttggaa

SEQ ID NO: 415017 - DNA, 25 bp, Mus musculus
cagctcagactgtcccaggaaagta

SEQ ID NO: 415018 - DNA, 25 bp, Mus musculus
cagctcagattctcaaaggagcttg

SEQ ID NO: 415019 - DNA, 25 bp, Mus musculus
cagctcagctctcttgaagctggga

SEQ ID NO: 415020 - DNA, 25 bp, Mus musculus
cagctcaggctacttggagagttca

SEQ ID NO: 415021 - DNA, 25 bp, Mus musculus
cagctcagggctgggcaatttgcca

SEQ ID NO: 415022 - DNA, 25 bp, Mus musculus
cagctcagtaactgtttggtaccag

SEQ ID NO: 415023 - DNA, 25 bp, Mus musculus
cagctcatagctaccaaagaccttg

SEQ ID NO: 415024 - DNA, 25 bp, Mus musculus
cagctcatcgtggaacttgtggtca

SEQ ID NO: 415025 - DNA, 25 bp, Mus musculus
cagctccaaggctgcttgccttgga

SEQ ID NO: 415026 - DNA, 25 bp, Mus musculus
cagctcccaagtccacagcagggta

SEQ ID NO: 415027 - DNA, 25 bp, Mus musculus
cagctccccgtgtggagataagtgg

SEQ ID NO: 415028 - DNA, 25 bp, Mus musculus
cagctccgactgttcgctgtcggcg

SEQ ID NO: 415029 - DNA, 25 bp, Mus musculus
cagctccgtagtgtcagtgcgcaga

SEQ ID NO: 415030 - DNA, 25 bp, Mus musculus
cagctcctggcacaggttgttcagg

SEQ ID NO: 415031 - DNA, 25 bp, Mus musculus
cagctccttcattcggcagggttgg

SEQ ID NO: 415032 - DNA, 25 bp, Mus musculus
cagctccttcccgtttctagaatgg

SEQ ID NO: 415033 - DNA, 25 bp, Mus musculus
cagctcgagggagcagctaagcgat

SEQ ID NO: 415034 - DNA, 25 bp, Mus musculus
cagctcggctgctgtgtgacctcga

SEQ ID NO: 415035 - DNA, 25 bp, Mus musculus
cagctcggtggtacatgacatttca

SEQ ID NO: 415036 - DNA, 25 bp, Mus musculus
cagctcgtgctgattttcgccggaa

SEQ ID NO: 415037 - DNA, 25 bp, Mus musculus
cagctcgtgggcagatgtgaacgtt

SEQ ID NO: 415038 - DNA, 25 bp, Mus musculus
cagctctcacctgggcttatcaaag

SEQ ID NO: 415039 - DNA, 25 bp, Mus musculus
cagctctcagcgtagcagctcgagg

SEQ ID NO: 415040 - DNA, 25 bp, Mus musculus
cagctctgctggaactggaaggcaa

SEQ ID NO: 415041 - DNA, 25 bp, Mus musculus
cagctctgggaggagtacttattct

SEQ ID NO: 415042 - DNA, 25 bp, Mus musculus
cagctctgggagtggacatcgtgaa

SEQ ID NO: 415043 - DNA, 25 bp, Mus musculus
cagctctgggcccttctatagggca

SEQ ID NO: 415044 - DNA, 25 bp, Mus musculus
cagctctgtgctgtggtacgagacc

SEQ ID NO: 415045 - DNA, 25 bp, Mus musculus
cagctctgttaaatggcctgggaga

SEQ ID NO: 415046 - DNA, 25 bp, Mus musculus
cagctctgtttgtcttgaggacaca

SEQ ID NO: 415047 - DNA, 25 bp, Mus musculus
cagctcttggaggttctggagcaaa

SEQ ID NO: 415048 - DNA, 25 bp, Mus musculus
cagctgaaagcttgcaactgccgag

SEQ ID NO: 415049 - DNA, 25 bp, Mus musculus
cagctgaaggtgactcctgggtgct

SEQ ID NO: 415050 - DNA, 25 bp, Mus musculus
cagctgaagtacagtcggccataag

SEQ ID NO: 415051 - DNA, 25 bp, Mus musculus
cagctgaattcaaaggtgccgtgga

SEQ ID NO: 415052 - DNA, 25 bp, Mus musculus
cagctgacactctcgggcagggaca

SEQ ID NO: 415053 - DNA, 25 bp, Mus musculus
cagctgacatcccagaatgaatccc

SEQ ID NO: 415054 - DNA, 25 bp, Mus musculus
cagctgacatgtttgctgatggcaa

SEQ ID NO: 415055 - DNA, 25 bp, Mus musculus
cagctgacgctcctcaaggcctttt

SEQ ID NO: 415056 - DNA, 25 bp, Mus musculus
cagctgactacgataaggacggcaa

SEQ ID NO: 415057 - DNA, 25 bp, Mus musculus
cagctgactcaggtaacgaccaaga

SEQ ID NO: 415058 - DNA, 25 bp, Mus musculus
cagctgagccgagagaagaggttca

SEQ ID NO: 415059 - DNA, 25 bp, Mus musculus
cagctgagcctgttatgcagagaaa

SEQ ID NO: 415060 - DNA, 25 bp, Mus musculus
cagctgaggaatatgcttcatttaa

SEQ ID NO: 415061 - DNA, 25 bp, Mus musculus
cagctgaggcactagagctccaggc

SEQ ID NO: 415062 - DNA, 25 bp, Mus musculus
cagctgagggagtcacaggtatccg

SEQ ID NO: 415063 - DNA, 25 bp, Mus musculus
cagctgatggagagctggtgaccct

SEQ ID NO: 415064 - DNA, 25 bp, Mus musculus
cagctgatggagcaggaatcagtca

SEQ ID NO: 415065 - DNA, 25 bp, Mus musculus
cagctgattactacgattatgggca

SEQ ID NO: 415066 - DNA, 25 bp, Mus musculus
cagctgcaagcacaaggatgaagaa

SEQ ID NO: 415067 - DNA, 25 bp, Mus musculus
cagctgcacagtagggacagcccaa

SEQ ID NO: 415068 - DNA, 25 bp, Mus musculus
cagctgcagacacagacatgacaac

SEQ ID NO: 415069 - DNA, 25 bp, Mus musculus
cagctgcagcagaaagggtacaact

SEQ ID NO: 415070 - DNA, 25 bp, Mus musculus
cagctgcaggaagaattagagggcc

SEQ ID NO: 415071 - DNA, 25 bp, Mus musculus
cagctgcagtccattcgaagagtcc

SEQ ID NO: 415072 - DNA, 25 bp, Mus musculus
cagctgcagtgttgcagtgagtgat

SEQ ID NO: 415073 - DNA, 25 bp, Mus musculus
cagctgcatctgttgggaccactaa

SEQ ID NO: 415074 - DNA, 25 bp, Mus musculus
cagctgcatgatgaagacttcctca

SEQ ID NO: 415075 - DNA, 25 bp, Mus musculus
cagctgcatgcacatcctgtcggag

SEQ ID NO: 415076 - DNA, 25 bp, Mus musculus
cagctgcatgggagaatgtggactc

SEQ ID NO: 415077 - DNA, 25 bp, Mus musculus
cagctgccacctttggggagatcag

SEQ ID NO: 415078 - DNA, 25 bp, Mus musculus
cagctgccagtttgtgggttggaac

SEQ ID NO: 415079 - DNA, 25 bp, Mus musculus
cagctgccatcatctctgagaggac

SEQ ID NO: 415080 - DNA, 25 bp, Mus musculus
cagctgcccgcctcgtgggccctgt

SEQ ID NO: 415081 - DNA, 25 bp, Mus musculus
cagctgccggctgtgtgcatttgat

SEQ ID NO: 415082 - DNA, 25 bp, Mus musculus
cagctgcctcagtggttccttttag

SEQ ID NO: 415083 - DNA, 25 bp, Mus musculus
cagctgcctggcactttcggcatga

SEQ ID NO: 415084 - DNA, 25 bp, Mus musculus
cagctgcgagccttcatgaggcgtg

SEQ ID NO: 415085 - DNA, 25 bp, Mus musculus
cagctgcgctgggtgaaacaaacaa

SEQ ID NO: 415086 - DNA, 25 bp, Mus musculus
cagctgcgtggagaggctcatttaa

SEQ ID NO: 415087 - DNA, 25 bp, Mus musculus
cagctgctatagtccctgaagcgca

SEQ ID NO: 415088 - DNA, 25 bp, Mus musculus
cagctgctgaggatagacgaccatg

SEQ ID NO: 415089 - DNA, 25 bp, Mus musculus
cagctgctgtgggacgttcatccaa

SEQ ID NO: 415090 - DNA, 25 bp, Mus musculus
cagctgcttagcaatgtgggtcata

SEQ ID NO: 415091 - DNA, 25 bp, Mus musculus
cagctgctttctacacattacttaa

SEQ ID NO: 415092 - DNA, 25 bp, Mus musculus
cagctggaagccaaacgagatgcct

SEQ ID NO: 415093 - DNA, 25 bp, Mus musculus
cagctggacacttgaacggcagtca

SEQ ID NO: 415094 - DNA, 25 bp, Mus musculus
cagctggagacaaacatggagacct

SEQ ID NO: 415095 - DNA, 25 bp, Mus musculus
cagctggagtcagtcagggagcaca

SEQ ID NO: 415096 - DNA, 25 bp, Mus musculus
cagctggatgttacaggcgtgcaaa

SEQ ID NO: 415097 - DNA, 25 bp, Mus musculus
cagctggattgacaccggactctca

SEQ ID NO: 415098 - DNA, 25 bp, Mus musculus
cagctggatttcgatgactacctca

SEQ ID NO: 415099 - DNA, 25 bp, Mus musculus
cagctggcacccactcaggagttga

SEQ ID NO: 415100 - DNA, 25 bp, Mus musculus
cagctggcagagaacagggaagttt

SEQ ID NO: 415101 - DNA, 25 bp, Mus musculus
cagctggcctacgaccaatggagaa

SEQ ID NO: 415102 - DNA, 25 bp, Mus musculus
cagctggctatgaagaaatatttcc

SEQ ID NO: 415103 - DNA, 25 bp, Mus musculus
cagctggcttgaatttagacctcta

SEQ ID NO: 415104 - DNA, 25 bp, Mus musculus
cagctgggagaagagatctggacaa

SEQ ID NO: 415105 - DNA, 25 bp, Mus musculus
cagctgggagaggtgagccctggct

SEQ ID NO: 415106 - DNA, 25 bp, Mus musculus
cagctgggagtcaagacactggcta

SEQ ID NO: 415107 - DNA, 25 bp, Mus musculus
cagctgggccaggttctagacaaac

SEQ ID NO: 415108 - DNA, 25 bp, Mus musculus
cagctggggccttaaagctcctggc

SEQ ID NO: 415109 - DNA, 25 bp, Mus musculus
cagctggtaccgcaatgatgtgcca

SEQ ID NO: 415110 - DNA, 25 bp, Mus musculus
cagctggtgccagacattgagttca

SEQ ID NO: 415111 - DNA, 25 bp, Mus musculus
cagctgtactgcaggactggatttc

SEQ ID NO: 415112 - DNA, 25 bp, Mus musculus
cagctgtagccgaggctgcaagcga

SEQ ID NO: 415113 - DNA, 25 bp, Mus musculus
cagctgtcaccgcatcaggagatgg

SEQ ID NO: 415114 - DNA, 25 bp, Mus musculus
cagctgtccggatactcagtccaga

SEQ ID NO: 415115 - DNA, 25 bp, Mus musculus
cagctgtcgtttgtagcaggatgcg

SEQ ID NO: 415116 - DNA, 25 bp, Mus musculus
cagctgtctgtgtgggtcctgtcaa

SEQ ID NO: 415117 - DNA, 25 bp, Mus musculus
cagctgtgaggaaggctttcagatc

SEQ ID NO: 415118 - DNA, 25 bp, Mus musculus
cagctgtgattaacggagaattcaa

SEQ ID NO: 415119 - DNA, 25 bp, Mus musculus
cagctgtggaaatgagggacaaccc

SEQ ID NO: 415120 - DNA, 25 bp, Mus musculus
cagctgtggactttgagggacccga

SEQ ID NO: 415121 - DNA, 25 bp, Mus musculus
cagctgtgggcactggaaccaagaa

SEQ ID NO: 415122 - DNA, 25 bp, Mus musculus
cagctgtgggctgtcactgtctact

SEQ ID NO: 415123 - DNA, 25 bp, Mus musculus
cagctgtgggcttgttctatggatc

SEQ ID NO: 415124 - DNA, 25 bp, Mus musculus
cagctgtgtggagtcctgcaactca

SEQ ID NO: 415125 - DNA, 25 bp, Mus musculus
cagctgtgtgtgaaggacaatgccc

SEQ ID NO: 415126 - DNA, 25 bp, Mus musculus
cagctgttacggatgcatgtgcgcc

SEQ ID NO: 415127 - DNA, 25 bp, Mus musculus
cagctgttcgggttttcactggaat

SEQ ID NO: 415128 - DNA, 25 bp, Mus musculus
cagctgttggctccaggtgttaaca

SEQ ID NO: 415129 - DNA, 25 bp, Mus musculus
cagctgtttaagagtttccgacggg

SEQ ID NO: 415130 - DNA, 25 bp, Mus musculus
cagctgtttaatggtgtgttctaca

SEQ ID NO: 415131 - DNA, 25 bp, Mus musculus
cagctgtttccaggatgtctagaag

SEQ ID NO: 415132 - DNA, 25 bp, Mus musculus
cagctgtttgagtttatcgaccgga

SEQ ID NO: 415133 - DNA, 25 bp, Mus musculus
cagctgttttcacagtatgggcgca

SEQ ID NO: 415134 - DNA, 25 bp, Mus musculus
cagcttaatactggtgctgggatct

SEQ ID NO: 415135 - DNA, 25 bp, Mus musculus
cagcttaatgcttacagcatcggtg

SEQ ID NO: 415136 - DNA, 25 bp, Mus musculus
cagcttacatgtgagtggcagtaca

SEQ ID NO: 415137 - DNA, 25 bp, Mus musculus
cagcttagaacctggaagtgcatcc

SEQ ID NO: 415138 - DNA, 25 bp, Mus musculus
cagcttagtggagggccatgtctca

SEQ ID NO: 415139 - DNA, 25 bp, Mus musculus
cagcttataaggcaagggcttggct

SEQ ID NO: 415140 - DNA, 25 bp, Mus musculus
cagcttatgtgaacgtaggccccag

SEQ ID NO: 415141 - DNA, 25 bp, Mus musculus
cagcttcaagtgagcatgatggacc

SEQ ID NO: 415142 - DNA, 25 bp, Mus musculus
cagcttcaccagaatttgttatcag

SEQ ID NO: 415143 - DNA, 25 bp, Mus musculus
cagcttcagcaccttcatggacggg

SEQ ID NO: 415144 - DNA, 25 bp, Mus musculus
cagcttcagggcttgagggtcccac

SEQ ID NO: 415145 - DNA, 25 bp, Mus musculus
cagcttcatcgaacaagtcgccgtg

SEQ ID NO: 415146 - DNA, 25 bp, Mus musculus
cagcttccaaagagataccgggcag

SEQ ID NO: 415147 - DNA, 25 bp, Mus musculus
cagcttccactcctgttctttaggg

SEQ ID NO: 415148 - DNA, 25 bp, Mus musculus
cagcttccagaaggatgcttaccaa

SEQ ID NO: 415149 - DNA, 25 bp, Mus musculus
cagcttcccaaggtggaggtgccaa

SEQ ID NO: 415150 - DNA, 25 bp, Mus musculus
cagcttcccacattgatgtcctcta

SEQ ID NO: 415151 - DNA, 25 bp, Mus musculus
cagcttccttcatcacgtgacaggg

SEQ ID NO: 415152 - DNA, 25 bp, Mus musculus
cagcttccttctgtgtattgtttgc

SEQ ID NO: 415153 - DNA, 25 bp, Mus musculus
cagcttcgagtccaaggatggcaca

SEQ ID NO: 415154 - DNA, 25 bp, Mus musculus
cagcttcggaagtgtgtggaccacc

SEQ ID NO: 415155 - DNA, 25 bp, Mus musculus
cagcttcggacacgcactgttcgag

SEQ ID NO: 415156 - DNA, 25 bp, Mus musculus
cagcttcgtgcatttcaaagaaggc

SEQ ID NO: 415157 - DNA, 25 bp, Mus musculus
cagcttctgatggtagggcagtttc

SEQ ID NO: 415158 - DNA, 25 bp, Mus musculus
cagcttctgcattggttgccctcat

SEQ ID NO: 415159 - DNA, 25 bp, Mus musculus
cagcttctgtgggatacaattgctt

SEQ ID NO: 415160 - DNA, 25 bp, Mus musculus
cagcttcttctaatattcccggata

SEQ ID NO: 415161 - DNA, 25 bp, Mus musculus
cagcttgaccgaactgtgggcagga

SEQ ID NO: 415162 - DNA, 25 bp, Mus musculus
cagcttgacgacttcttgggttgta

SEQ ID NO: 415163 - DNA, 25 bp, Mus musculus
cagcttgagcgctctgtttcgcgtc

SEQ ID NO: 415164 - DNA, 25 bp, Mus musculus
cagcttgatatgatatgtaatttcc

SEQ ID NO: 415165 - DNA, 25 bp, Mus musculus
cagcttgatcttacacggtgccgat

SEQ ID NO: 415166 - DNA, 25 bp, Mus musculus
cagcttgattgtgcggttctggcca

SEQ ID NO: 415167 - DNA, 25 bp, Mus musculus
cagcttgccctttgtgcgcagtgga

SEQ ID NO: 415168 - DNA, 25 bp, Mus musculus
cagcttgcggacaaaagcggtcctc

SEQ ID NO: 415169 - DNA, 25 bp, Mus musculus
cagcttgctgtggattagggagtac

SEQ ID NO: 415170 - DNA, 25 bp, Mus musculus
cagcttgcttatcaccatggaaatc

SEQ ID NO: 415171 - DNA, 25 bp, Mus musculus
cagcttgctttgcatccgagtccct

SEQ ID NO: 415172 - DNA, 25 bp, Mus musculus
cagcttggagctgaagttccattcc

SEQ ID NO: 415173 - DNA, 25 bp, Mus musculus
cagcttggcctgtttggtcatgagc

SEQ ID NO: 415174 - DNA, 25 bp, Mus musculus
cagcttgtcatgtgctgagagcaga

SEQ ID NO: 415175 - DNA, 25 bp, Mus musculus
cagcttgtctgaggtgtagcgagac

SEQ ID NO: 415176 - DNA, 25 bp, Mus musculus
cagcttgttacatccctgactcatg

SEQ ID NO: 415177 - DNA, 25 bp, Mus musculus
cagctttaacacaccattggagtca

SEQ ID NO: 415178 - DNA, 25 bp, Mus musculus
cagctttcgacatggactgaggacc

SEQ ID NO: 415179 - DNA, 25 bp, Mus musculus
cagctttcggcatccagtgggcact

SEQ ID NO: 415180 - DNA, 25 bp, Mus musculus
cagctttctacgactttgtgcacgc

SEQ ID NO: 415181 - DNA, 25 bp, Mus musculus
cagctttctgaggattcacggtata

SEQ ID NO: 415182 - DNA, 25 bp, Mus musculus
cagctttcttaaacggccagggaga

SEQ ID NO: 415183 - DNA, 25 bp, Mus musculus
cagctttgaggtccctctcttgaga

SEQ ID NO: 415184 - DNA, 25 bp, Mus musculus
cagctttgagttttggaggccggca

SEQ ID NO: 415185 - DNA, 25 bp, Mus musculus
cagctttggtcttgtaaccctgaag

SEQ ID NO: 415186 - DNA, 25 bp, Mus musculus
cagctttgtgtctggcggtggtaca

SEQ ID NO: 415187 - DNA, 25 bp, Mus musculus
cagcttttaccctagtgtggagaga

SEQ ID NO: 415188 - DNA, 25 bp, Mus musculus
cagcttttctgctttgcctgtccag

SEQ ID NO: 415189 - DNA, 25 bp, Mus musculus
cagcttttctgtataggctccggcc

SEQ ID NO: 415190 - DNA, 25 bp, Mus musculus
cagcttttgactttacggctccaag

SEQ ID NO: 415191 - DNA, 25 bp, Mus musculus
caggaaaaatgacaattgggaggca

SEQ ID NO: 415192 - DNA, 25 bp, Mus musculus
caggaaaagccgagctcactgtagg

SEQ ID NO: 415193 - DNA, 25 bp, Mus musculus
caggaaaaggcgctctcaagatggc

SEQ ID NO: 415194 - DNA, 25 bp, Mus musculus
caggaaaaggtacttgctgaacctg

SEQ ID NO: 415195 - DNA, 25 bp, Mus musculus
caggaaacaacataagcaacacggg

SEQ ID NO: 415196 - DNA, 25 bp, Mus musculus
caggaaaccggaagtgcacgttgcg

SEQ ID NO: 415197 - DNA, 25 bp, Mus musculus
caggaaacgcggcttctggtatgat

SEQ ID NO: 415198 - DNA, 25 bp, Mus musculus
caggaaacgggaagcctcgttctga

SEQ ID NO: 415199 - DNA, 25 bp, Mus musculus
caggaaacgggcagagcagatgctt

SEQ ID NO: 415200 - DNA, 25 bp, Mus musculus
caggaaactgataggtgagcagagc

SEQ ID NO: 415201 - DNA, 25 bp, Mus musculus
caggaaacttacatggaccggtggg

SEQ ID NO: 415202 - DNA, 25 bp, Mus musculus
caggaaagctagagacttcctcctg

SEQ ID NO: 415203 - DNA, 25 bp, Mus musculus
caggaaagtagtgtaactgctataa

SEQ ID NO: 415204 - DNA, 25 bp, Mus musculus
caggaaagtgtcagccagccgtttc

SEQ ID NO: 415205 - DNA, 25 bp, Mus musculus
caggaaagttggatgctgtatttga

SEQ ID NO: 415206 - DNA, 25 bp, Mus musculus
caggaaatagccagcatggagagac

SEQ ID NO: 415207 - DNA, 25 bp, Mus musculus
caggaaatcaacagcaggttcaggc

SEQ ID NO: 415208 - DNA, 25 bp, Mus musculus
caggaaatcccaggcaatgctaagc

SEQ ID NO: 415209 - DNA, 25 bp, Mus musculus
caggaaatgaatgcctcggctatga

SEQ ID NO: 415210 - DNA, 25 bp, Mus musculus
caggaaatgcactcggagaagatga

SEQ ID NO: 415211 - DNA, 25 bp, Mus musculus
caggaaatgtggaatacaccgtctt

SEQ ID NO: 415212 - DNA, 25 bp, Mus musculus
caggaacaaggctgataatgggtat

SEQ ID NO: 415213 - DNA, 25 bp, Mus musculus
caggaacaaggtccccaatatggcg

SEQ ID NO: 415214 - DNA, 25 bp, Mus musculus
caggaacaccctgagcaggctgtca

SEQ ID NO: 415215 - DNA, 25 bp, Mus musculus
caggaacaggcctctgaggttgaga

SEQ ID NO: 415216 - DNA, 25 bp, Mus musculus
caggaacaggctttggtcctaggaa

SEQ ID NO: 415217 - DNA, 25 bp, Mus musculus
caggaacagggaaggcaaaggactc

SEQ ID NO: 415218 - DNA, 25 bp, Mus musculus
caggaacatacagtcaatcaggagg

SEQ ID NO: 415219 - DNA, 25 bp, Mus musculus
caggaacatggcctctgctgtgagt

SEQ ID NO: 415220 - DNA, 25 bp, Mus musculus
caggaacatgtatcccagagccagt

SEQ ID NO: 415221 - DNA, 25 bp, Mus musculus
caggaacccttgattgtgacatggc

SEQ ID NO: 415222 - DNA, 25 bp, Mus musculus
caggaacctctggaacatcgggacc

SEQ ID NO: 415223 - DNA, 25 bp, Mus musculus
caggaactacgtggagatcatgccc

SEQ ID NO: 415224 - DNA, 25 bp, Mus musculus
caggaactcctgtagtgaccgagag

SEQ ID NO: 415225 - DNA, 25 bp, Mus musculus
caggaactctttcttcatggtagga

SEQ ID NO: 415226 - DNA, 25 bp, Mus musculus
caggaactgagagggaaggacgact

SEQ ID NO: 415227 - DNA, 25 bp, Mus musculus
caggaactgggatcctgtcgctgtg

SEQ ID NO: 415228 - DNA, 25 bp, Mus musculus
caggaactttgatgtctcgtgggac

SEQ ID NO: 415229 - DNA, 25 bp, Mus musculus
caggaagaagtttatcgcacccagg

SEQ ID NO: 415230 - DNA, 25 bp, Mus musculus
caggaagacctttgaagggaaagtg

SEQ ID NO: 415231 - DNA, 25 bp, Mus musculus
caggaagagctgcaattcagtggcc

SEQ ID NO: 415232 - DNA, 25 bp, Mus musculus
caggaagagtcccatcgtccatgta

SEQ ID NO: 415233 - DNA, 25 bp, Mus musculus
caggaagcaggctcaaggatgaaga

SEQ ID NO: 415234 - DNA, 25 bp, Mus musculus
caggaagccagaggccggaagaaaa

SEQ ID NO: 415235 - DNA, 25 bp, Mus musculus
caggaagctgatagattgaaaggac

SEQ ID NO: 415236 - DNA, 25 bp, Mus musculus
caggaagctgggttgcctgctgcaa

SEQ ID NO: 415237 - DNA, 25 bp, Mus musculus
caggaaggacgcaccctgtgctttg

SEQ ID NO: 415238 - DNA, 25 bp, Mus musculus
caggaaggatcattctgtgaacaag

SEQ ID NO: 415239 - DNA, 25 bp, Mus musculus
caggaaggatccaggccgtttgtga

SEQ ID NO: 415240 - DNA, 25 bp, Mus musculus
caggaagtctaagattggagccacc

SEQ ID NO: 415241 - DNA, 25 bp, Mus musculus
caggaagtctctgcctcgggtgtcc

SEQ ID NO: 415242 - DNA, 25 bp, Mus musculus
caggaagtgcccagtggtacgaaac

SEQ ID NO: 415243 - DNA, 25 bp, Mus musculus
caggaagtgctatgggctggaacac

SEQ ID NO: 415244 - DNA, 25 bp, Mus musculus
caggaatacccatgcgcagtgtctc

SEQ ID NO: 415245 - DNA, 25 bp, Mus musculus
caggaatacgacgaagctgggccct

SEQ ID NO: 415246 - DNA, 25 bp, Mus musculus
caggaatagaaaccgccgaaggatt

SEQ ID NO: 415247 - DNA, 25 bp, Mus musculus
caggaatcaacttggtggctccacc

SEQ ID NO: 415248 - DNA, 25 bp, Mus musculus
caggaatccagagacgcgctgtggt

SEQ ID NO: 415249 - DNA, 25 bp, Mus musculus
caggaatccccaagaccataggaac

SEQ ID NO: 415250 - DNA, 25 bp, Mus musculus
caggaatccgccctgtcaggagctt

SEQ ID NO: 415251 - DNA, 25 bp, Mus musculus
caggaatctatcagcaaggaggagc

SEQ ID NO: 415252 - DNA, 25 bp, Mus musculus
caggaatctgatacgtgtctacgcg

SEQ ID NO: 415253 - DNA, 25 bp, Mus musculus
caggaatgctgccaaggtcctacaa

SEQ ID NO: 415254 - DNA, 25 bp, Mus musculus
caggaattgctgtgcgataaatcgg

SEQ ID NO: 415255 - DNA, 25 bp, Mus musculus
caggaattggaaagcccggtatgcc

SEQ ID NO: 415256 - DNA, 25 bp, Mus musculus
caggaatttcttgcttggagctcag

SEQ ID NO: 415257 - DNA, 25 bp, Mus musculus
caggacaagcccgtctggatggagt

SEQ ID NO: 415258 - DNA, 25 bp, Mus musculus
caggacaaggatgtgactgatgaat

SEQ ID NO: 415259 - DNA, 25 bp, Mus musculus
caggacaagtccagtgcccagttgg

SEQ ID NO: 415260 - DNA, 25 bp, Mus musculus
caggacacactacaggttcgttggc

SEQ ID NO: 415261 - DNA, 25 bp, Mus musculus
caggacacatctactctggtgaagg

SEQ ID NO: 415262 - DNA, 25 bp, Mus musculus
caggacacgcttgtaagagtaatgc

SEQ ID NO: 415263 - DNA, 25 bp, Mus musculus
caggacactttgctacacatcagcg

SEQ ID NO: 415264 - DNA, 25 bp, Mus musculus
caggacagatggactcagaaaggag

SEQ ID NO: 415265 - DNA, 25 bp, Mus musculus
caggacagatgtggtcatgacctca

SEQ ID NO: 415266 - DNA, 25 bp, Mus musculus
caggacagctgtttgctcatcaacc

SEQ ID NO: 415267 - DNA, 25 bp, Mus musculus
caggacaggatggagaatcaagcaa

SEQ ID NO: 415268 - DNA, 25 bp, Mus musculus
caggacagtctgttgccatcgaagg

SEQ ID NO: 415269 - DNA, 25 bp, Mus musculus
caggacagttatacagcacacaggc

SEQ ID NO: 415270 - DNA, 25 bp, Mus musculus
caggacatccattcggctgatagcc

SEQ ID NO: 415271 - DNA, 25 bp, Mus musculus
caggacatcctggacgacagtggct

SEQ ID NO: 415272 - DNA, 25 bp, Mus musculus
caggacatgcctgaaaccgcaggtg

SEQ ID NO: 415273 - DNA, 25 bp, Mus musculus
caggacatggctgaaagggagctca

SEQ ID NO: 415274 - DNA, 25 bp, Mus musculus
caggacatgtgttaattgcttgaga

SEQ ID NO: 415275 - DNA, 25 bp, Mus musculus
caggacattctacagcgacttcgag

SEQ ID NO: 415276 - DNA, 25 bp, Mus musculus
caggaccaacgctacagtgtgcaga

SEQ ID NO: 415277 - DNA, 25 bp, Mus musculus
caggaccacaatccaagggcaggag

SEQ ID NO: 415278 - DNA, 25 bp, Mus musculus
caggaccagagacccagagatcaga

SEQ ID NO: 415279 - DNA, 25 bp, Mus musculus
caggaccagcaccatttcctaaggt

SEQ ID NO: 415280 - DNA, 25 bp, Mus musculus
caggaccagctgcaatgccagcagt

SEQ ID NO: 415281 - DNA, 25 bp, Mus musculus
caggacccacgcttggcaaaaatgg

SEQ ID NO: 415282 - DNA, 25 bp, Mus musculus
caggacccatgttgctgagtggaaa

SEQ ID NO: 415283 - DNA, 25 bp, Mus musculus
caggacccctttcgtgctaggcaag

SEQ ID NO: 415284 - DNA, 25 bp, Mus musculus
caggacccgctcaaggatctggtgt

SEQ ID NO: 415285 - DNA, 25 bp, Mus musculus
caggaccctgttctagagtcttggg

SEQ ID NO: 415286 - DNA, 25 bp, Mus musculus
caggaccgattccacttcaatgaga

SEQ ID NO: 415287 - DNA, 25 bp, Mus musculus
caggaccgtcgttttggccagtaag

SEQ ID NO: 415288 - DNA, 25 bp, Mus musculus
caggaccgttcacagctgcctatcg

SEQ ID NO: 415289 - DNA, 25 bp, Mus musculus
caggacctcatgcagtgtaacagca

SEQ ID NO: 415290 - DNA, 25 bp, Mus musculus
caggacctctgttgattgatcatgt

SEQ ID NO: 415291 - DNA, 25 bp, Mus musculus
caggacctgcgtaggaaagctgcga

SEQ ID NO: 415292 - DNA, 25 bp, Mus musculus
caggacctgctcagggcagagctat

SEQ ID NO: 415293 - DNA, 25 bp, Mus musculus
caggacctggtgagaccctcagctc

SEQ ID NO: 415294 - DNA, 25 bp, Mus musculus
caggaccttaaagtgtggacgagcc

SEQ ID NO: 415295 - DNA, 25 bp, Mus musculus
caggaccttctgctgcttcaccagg

SEQ ID NO: 415296 - DNA, 25 bp, Mus musculus
caggacctttgagttgtgttctcca

SEQ ID NO: 415297 - DNA, 25 bp, Mus musculus
caggacgacttgagagttagaggcc

SEQ ID NO: 415298 - DNA, 25 bp, Mus musculus
caggacgatgctggtgattgcccac

SEQ ID NO: 415299 - DNA, 25 bp, Mus musculus
caggacgatgtgctcatctccttcc

SEQ ID NO: 415300 - DNA, 25 bp, Mus musculus
caggacgctggctacaaagcctgca

SEQ ID NO: 415301 - DNA, 25 bp, Mus musculus
caggacgctgtcttcttgagggcca

SEQ ID NO: 415302 - DNA, 25 bp, Mus musculus
caggacggccgcatcttcatcggga

SEQ ID NO: 415303 - DNA, 25 bp, Mus musculus
caggacggcgatgggatcattaccc

SEQ ID NO: 415304 - DNA, 25 bp, Mus musculus
caggacggtccgtaacaacgtggct

SEQ ID NO: 415305 - DNA, 25 bp, Mus musculus
caggacgtgtttgaggctgccaaca

SEQ ID NO: 415306 - DNA, 25 bp, Mus musculus
caggactaataatggtgacaataca

SEQ ID NO: 415307 - DNA, 25 bp, Mus musculus
caggactcccggatatgagcgcaat

SEQ ID NO: 415308 - DNA, 25 bp, Mus musculus
caggactcgggcaaaacggaaatct

SEQ ID NO: 415309 - DNA, 25 bp, Mus musculus
caggactctggcctagacatcaggg

SEQ ID NO: 415310 - DNA, 25 bp, Mus musculus
caggactgaccctcatgtgcagaat

SEQ ID NO: 415311 - DNA, 25 bp, Mus musculus
caggactgcttctttgctgcaactc

SEQ ID NO: 415312 - DNA, 25 bp, Mus musculus
caggactggcgctgtgtgaacttca

SEQ ID NO: 415313 - DNA, 25 bp, Mus musculus
caggactggctcattcttagcaaca

SEQ ID NO: 415314 - DNA, 25 bp, Mus musculus
caggacttactgctcaccagagggt

SEQ ID NO: 415315 - DNA, 25 bp, Mus musculus
caggacttagccagaacttacccca

SEQ ID NO: 415316 - DNA, 25 bp, Mus musculus
caggacttgagctgccagggacata

SEQ ID NO: 415317 - DNA, 25 bp, Mus musculus
caggagaaagacaatgtgtgggact

SEQ ID NO: 415318 - DNA, 25 bp, Mus musculus
caggagaaagcaactttgaaagtag

SEQ ID NO: 415319 - DNA, 25 bp, Mus musculus
caggagaaatctgcacactgccagc

SEQ ID NO: 415320 - DNA, 25 bp, Mus musculus
caggagaagccaactgatttcagaa

SEQ ID NO: 415321 - DNA, 25 bp, Mus musculus
caggagaagctcgtcttcgagaacc

SEQ ID NO: 415322 - DNA, 25 bp, Mus musculus
caggagacaatttcagaggccatag

SEQ ID NO: 415323 - DNA, 25 bp, Mus musculus
caggagaccggccttaccagtgtga

SEQ ID NO: 415324 - DNA, 25 bp, Mus musculus
caggagaccttagggactgtcgtca

SEQ ID NO: 415325 - DNA, 25 bp, Mus musculus
caggagacgatgtgaggaatgcccc

SEQ ID NO: 415326 - DNA, 25 bp, Mus musculus
caggagactcgctgaatctgtaaac

SEQ ID NO: 415327 - DNA, 25 bp, Mus musculus
caggagagaagaaaacctaatgtgc

SEQ ID NO: 415328 - DNA, 25 bp, Mus musculus
caggagagaccaagattctctctgc

SEQ ID NO: 415329 - DNA, 25 bp, Mus musculus
caggagagagcaccacctgacctga

SEQ ID NO: 415330 - DNA, 25 bp, Mus musculus
caggagagcagacacctgacagacc

SEQ ID NO: 415331 - DNA, 25 bp, Mus musculus
caggagagccatatgtacagcaatc

SEQ ID NO: 415332 - DNA, 25 bp, Mus musculus
caggagagccgatagacaggtaaca

SEQ ID NO: 415333 - DNA, 25 bp, Mus musculus
caggagagtgctgatgttctgcgaa

SEQ ID NO: 415334 - DNA, 25 bp, Mus musculus
caggagatcagcaagccgagcatgt

SEQ ID NO: 415335 - DNA, 25 bp, Mus musculus
caggagatcagcacgatggagcaca

SEQ ID NO: 415336 - DNA, 25 bp, Mus musculus
caggagatcgcagttcctgtggcca

SEQ ID NO: 415337 - DNA, 25 bp, Mus musculus
caggagatgaagtccacaggctact

SEQ ID NO: 415338 - DNA, 25 bp, Mus musculus
caggagatgggatcgacaacagtcc

SEQ ID NO: 415339 - DNA, 25 bp, Mus musculus
caggagatgtggtctgcagatccct

SEQ ID NO: 415340 - DNA, 25 bp, Mus musculus
caggagattatgagctgcctgctgt

SEQ ID NO: 415341 - DNA, 25 bp, Mus musculus
caggagattgcgactttgaggccag

SEQ ID NO: 415342 - DNA, 25 bp, Mus musculus
caggagcaaaacaagccctaacttc

SEQ ID NO: 415343 - DNA, 25 bp, Mus musculus
caggagcaattcgacctctggtgtc

SEQ ID NO: 415344 - DNA, 25 bp, Mus musculus
caggagcacggagatgaagcagctt

SEQ ID NO: 415345 - DNA, 25 bp, Mus musculus
caggagcagctatcttgacgaggac

SEQ ID NO: 415346 - DNA, 25 bp, Mus musculus
caggagcatcaagtggaacgtggac

SEQ ID NO: 415347 - DNA, 25 bp, Mus musculus
caggagcatcagtccaggattgagc

SEQ ID NO: 415348 - DNA, 25 bp, Mus musculus
caggagccctaaactccaggctgga

SEQ ID NO: 415349 - DNA, 25 bp, Mus musculus
caggagcctctgactaggcggcaaa

SEQ ID NO: 415350 - DNA, 25 bp, Mus musculus
caggagccttaatgtggtgcacaca

SEQ ID NO: 415351 - DNA, 25 bp, Mus musculus
caggagccttcacggagcagattct

SEQ ID NO: 415352 - DNA, 25 bp, Mus musculus
caggagcgccttcccaaggagaaag

SEQ ID NO: 415353 - DNA, 25 bp, Mus musculus
caggagcgctcggatagcaaaacaa

SEQ ID NO: 415354 - DNA, 25 bp, Mus musculus
caggagcgggccaacgagctcatgc

SEQ ID NO: 415355 - DNA, 25 bp, Mus musculus
caggagcggttcagagcggttacac

SEQ ID NO: 415356 - DNA, 25 bp, Mus musculus
caggagcgtggcttggagcatttcc

SEQ ID NO: 415357 - DNA, 25 bp, Mus musculus
caggagcgtgtggatccccatgtct

SEQ ID NO: 415358 - DNA, 25 bp, Mus musculus
caggagctagtgcaagtcagtgcca

SEQ ID NO: 415359 - DNA, 25 bp, Mus musculus
caggagctgaatgaccgctttgcca

SEQ ID NO: 415360 - DNA, 25 bp, Mus musculus
caggagctgatgattgacgtcacca

SEQ ID NO: 415361 - DNA, 25 bp, Mus musculus
caggagctgctggaatcctcggaga

SEQ ID NO: 415362 - DNA, 25 bp, Mus musculus
caggagctgtcccacaggcgcgatg

SEQ ID NO: 415363 - DNA, 25 bp, Mus musculus
caggagctgtgctgcattctgggat

SEQ ID NO: 415364 - DNA, 25 bp, Mus musculus
caggagcttgttaatccattgctag

SEQ ID NO: 415365 - DNA, 25 bp, Mus musculus
caggaggaaacattcgatggacgcc

SEQ ID NO: 415366 - DNA, 25 bp, Mus musculus
caggaggaacatgaatggcaggcca

SEQ ID NO: 415367 - DNA, 25 bp, Mus musculus
caggaggaattgttgctgcgccacc

SEQ ID NO: 415368 - DNA, 25 bp, Mus musculus
caggaggacgcagtattcgaggcca

SEQ ID NO: 415369 - DNA, 25 bp, Mus musculus
caggaggatctgaagccatttggct

SEQ ID NO: 415370 - DNA, 25 bp, Mus musculus
caggaggcagccaggatttaataaa

SEQ ID NO: 415371 - DNA, 25 bp, Mus musculus
caggaggcagtgtcgttacagcaca

SEQ ID NO: 415372 - DNA, 25 bp, Mus musculus
caggaggcataagggacagatgcta

SEQ ID NO: 415373 - DNA, 25 bp, Mus musculus
caggaggcattgctacattctgtat

SEQ ID NO: 415374 - DNA, 25 bp, Mus musculus
caggaggcccaagtcatgaagaaac

SEQ ID NO: 415375 - DNA, 25 bp, Mus musculus
caggaggctctagaaaaagccaatc

SEQ ID NO: 415376 - DNA, 25 bp, Mus musculus
caggaggctgtgtccctgcaagtga

SEQ ID NO: 415377 - DNA, 25 bp, Mus musculus
caggagggactgtgtcctcgtccac

SEQ ID NO: 415378 - DNA, 25 bp, Mus musculus
caggagggcatgactttgtgagaca

SEQ ID NO: 415379 - DNA, 25 bp, Mus musculus
caggagggccgaatctttgcagaaa

SEQ ID NO: 415380 - DNA, 25 bp, Mus musculus
caggagggcctcgatatgcaaatga

SEQ ID NO: 415381 - DNA, 25 bp, Mus musculus
caggaggtgacatggacacacttca

SEQ ID NO: 415382 - DNA, 25 bp, Mus musculus
caggagtaactgaaaccagcgggac

SEQ ID NO: 415383 - DNA, 25 bp, Mus musculus
caggagtagctgatcaaaccaagga

SEQ ID NO: 415384 - DNA, 25 bp, Mus musculus
caggagtcagaacccatcaggagtg

SEQ ID NO: 415385 - DNA, 25 bp, Mus musculus
caggagtcaggcagctattgcctgg

SEQ ID NO: 415386 - DNA, 25 bp, Mus musculus
caggagtcagttatcacagaagctg

SEQ ID NO: 415387 - DNA, 25 bp, Mus musculus
caggagtccatcagcatgcctcaga

SEQ ID NO: 415388 - DNA, 25 bp, Mus musculus
caggagtctgaagatacagattgtg

SEQ ID NO: 415389 - DNA, 25 bp, Mus musculus
caggagtctggagtcagttcaaggc

SEQ ID NO: 415390 - DNA, 25 bp, Mus musculus
caggagtctggctagcctgggcaaa

SEQ ID NO: 415391 - DNA, 25 bp, Mus musculus
caggagtgatgtaccaggagagtct

SEQ ID NO: 415392 - DNA, 25 bp, Mus musculus
caggagtgcttcataaatatccaca

SEQ ID NO: 415393 - DNA, 25 bp, Mus musculus
caggagtgggcttagcaatgtgaca

SEQ ID NO: 415394 - DNA, 25 bp, Mus musculus
caggagttagggacagaatatatct

SEQ ID NO: 415395 - DNA, 25 bp, Mus musculus
caggagttgcttgactttgttgtaa

SEQ ID NO: 415396 - DNA, 25 bp, Mus musculus
caggagtttcatctccaccggcagg

SEQ ID NO: 415397 - DNA, 25 bp, Mus musculus
caggataaacatcatgaagctcacg

SEQ ID NO: 415398 - DNA, 25 bp, Mus musculus
caggatacagcacgtggaagatagc

SEQ ID NO: 415399 - DNA, 25 bp, Mus musculus
caggataccctctcgaatgcagtta

SEQ ID NO: 415400 - DNA, 25 bp, Mus musculus
caggatacgtgagcatacgctacag

SEQ ID NO: 415401 - DNA, 25 bp, Mus musculus
caggatactgttggtgtgttacacc

SEQ ID NO: 415402 - DNA, 25 bp, Mus musculus
caggatagaggttacagtgaggcac

SEQ ID NO: 415403 - DNA, 25 bp, Mus musculus
caggatagcatgtgagtatccctgg

SEQ ID NO: 415404 - DNA, 25 bp, Mus musculus
caggatagctcagggcgacacagag

SEQ ID NO: 415405 - DNA, 25 bp, Mus musculus
caggataggctggctgctggacaca

SEQ ID NO: 415406 - DNA, 25 bp, Mus musculus
caggatatcgaacagcagctgggct

SEQ ID NO: 415407 - DNA, 25 bp, Mus musculus
caggatatgaagtcttgcccaggct

SEQ ID NO: 415408 - DNA, 25 bp, Mus musculus
caggatattttacagcgggactcaa

SEQ ID NO: 415409 - DNA, 25 bp, Mus musculus
caggatcaacctgcggatacgagag

SEQ ID NO: 415410 - DNA, 25 bp, Mus musculus
caggatcactctaccctcgaagaag

SEQ ID NO: 415411 - DNA, 25 bp, Mus musculus
caggatccatgctgaaatttggaaa

SEQ ID NO: 415412 - DNA, 25 bp, Mus musculus
caggatcccgaataagctgcttcag

SEQ ID NO: 415413 - DNA, 25 bp, Mus musculus
caggatcccttatgactgatatatc

SEQ ID NO: 415414 - DNA, 25 bp, Mus musculus
caggatccgcaatcaatagccgaga

SEQ ID NO: 415415 - DNA, 25 bp, Mus musculus
caggatccgcaatccacgtgggcta

SEQ ID NO: 415416 - DNA, 25 bp, Mus musculus
caggatcctccatggttatgcttca

SEQ ID NO: 415417 - DNA, 25 bp, Mus musculus
caggatcctctgtgttgcaagtgac

SEQ ID NO: 415418 - DNA, 25 bp, Mus musculus
caggatcctgaaaccatgagcatgt

SEQ ID NO: 415419 - DNA, 25 bp, Mus musculus
caggatcgcttccacctcagtgagg

SEQ ID NO: 415420 - DNA, 25 bp, Mus musculus
caggatcgttaagcgctggtaacca

SEQ ID NO: 415421 - DNA, 25 bp, Mus musculus
caggatctcacgaaggatgaggcag

SEQ ID NO: 415422 - DNA, 25 bp, Mus musculus
caggatctcgactgcagacattgcc

SEQ ID NO: 415423 - DNA, 25 bp, Mus musculus
caggatctctccacagtcgtgcgga

SEQ ID NO: 415424 - DNA, 25 bp, Mus musculus
caggatctgccaaacgctatggcca

SEQ ID NO: 415425 - DNA, 25 bp, Mus musculus
caggatctgcctcgtctctgagtgc

SEQ ID NO: 415426 - DNA, 25 bp, Mus musculus
caggatctgtgactatcttcggcga

SEQ ID NO: 415427 - DNA, 25 bp, Mus musculus
caggatcttcagtggctcgtgcaac

SEQ ID NO: 415428 - DNA, 25 bp, Mus musculus
caggatgaccttcaactgcagagag

SEQ ID NO: 415429 - DNA, 25 bp, Mus musculus
caggatgacgaaccggcagtatttc

SEQ ID NO: 415430 - DNA, 25 bp, Mus musculus
caggatgactccacgacagaggaca

SEQ ID NO: 415431 - DNA, 25 bp, Mus musculus
caggatgactccttctttatccgga

SEQ ID NO: 415432 - DNA, 25 bp, Mus musculus
caggatgacttactttcacagctgt

SEQ ID NO: 415433 - DNA, 25 bp, Mus musculus
caggatgagccagaggtgccagtaa

SEQ ID NO: 415434 - DNA, 25 bp, Mus musculus
caggatgaggcatatgaccggcgtc

SEQ ID NO: 415435 - DNA, 25 bp, Mus musculus
caggatgagtaaagaggaagacgcc

SEQ ID NO: 415436 - DNA, 25 bp, Mus musculus
caggatgatgtctgcaaagggagca

SEQ ID NO: 415437 - DNA, 25 bp, Mus musculus
caggatgcagcaaggaaggaagccc

SEQ ID NO: 415438 - DNA, 25 bp, Mus musculus
caggatgccccagaatgcagtttct

SEQ ID NO: 415439 - DNA, 25 bp, Mus musculus
caggatgctacacgctggcactgag

SEQ ID NO: 415440 - DNA, 25 bp, Mus musculus
caggatgctggagaaaccttcgcca

SEQ ID NO: 415441 - DNA, 25 bp, Mus musculus
caggatgggagccagcatctatatg

SEQ ID NO: 415442 - DNA, 25 bp, Mus musculus
caggatggtgacagcgattcccaca

SEQ ID NO: 415443 - DNA, 25 bp, Mus musculus
caggatgtaaggtgagtgtcttccc

SEQ ID NO: 415444 - DNA, 25 bp, Mus musculus
caggatgtgccaaaagtgatccagc

SEQ ID NO: 415445 - DNA, 25 bp, Mus musculus
caggattaaggagcacccaggttca

SEQ ID NO: 415446 - DNA, 25 bp, Mus musculus
caggattaccaatcggccaagccgg

SEQ ID NO: 415447 - DNA, 25 bp, Mus musculus
caggattaccatgccgaaggaccaa

SEQ ID NO: 415448 - DNA, 25 bp, Mus musculus
caggattagggtgggacagtcagaa

SEQ ID NO: 415449 - DNA, 25 bp, Mus musculus
caggattatacactagctttgcagc

SEQ ID NO: 415450 - DNA, 25 bp, Mus musculus
caggattatcggtaaggttctcata

SEQ ID NO: 415451 - DNA, 25 bp, Mus musculus
caggattatggtctcccgttcggaa

SEQ ID NO: 415452 - DNA, 25 bp, Mus musculus
caggattctgagagcccttggaccg

SEQ ID NO: 415453 - DNA, 25 bp, Mus musculus
caggattgagcatgacggctgggca

SEQ ID NO: 415454 - DNA, 25 bp, Mus musculus
caggattggccaagatgacttacca

SEQ ID NO: 415455 - DNA, 25 bp, Mus musculus
caggattggttcacggacctcagtc

SEQ ID NO: 415456 - DNA, 25 bp, Mus musculus
caggatttctggttcaaagggtatg

SEQ ID NO: 415457 - DNA, 25 bp, Mus musculus
caggattttcgggaacaaaggcagc

SEQ ID NO: 415458 - DNA, 25 bp, Mus musculus
caggcaaaccatccataattcaaag

SEQ ID NO: 415459 - DNA, 25 bp, Mus musculus
caggcaaactctgaggaccggcatt

SEQ ID NO: 415460 - DNA, 25 bp, Mus musculus
caggcaaacttccagccaggtgagg

SEQ ID NO: 415461 - DNA, 25 bp, Mus musculus
caggcaaacttcgtcatcagagatg

SEQ ID NO: 415462 - DNA, 25 bp, Mus musculus
caggcaaaggcatcaggctgcgtca

SEQ ID NO: 415463 - DNA, 25 bp, Mus musculus
caggcaacattagaagacagtggga

SEQ ID NO: 415464 - DNA, 25 bp, Mus musculus
caggcaacctggacgctcctgaagg

SEQ ID NO: 415465 - DNA, 25 bp, Mus musculus
caggcaacttagcaaatggatccgg

SEQ ID NO: 415466 - DNA, 25 bp, Mus musculus
caggcaagaagagccttggacttac

SEQ ID NO: 415467 - DNA, 25 bp, Mus musculus
caggcaagctgatgaggcatggcat

SEQ ID NO: 415468 - DNA, 25 bp, Mus musculus
caggcaaggataagacagtaggcgc

SEQ ID NO: 415469 - DNA, 25 bp, Mus musculus
caggcaaggccatgactcactagag

SEQ ID NO: 415470 - DNA, 25 bp, Mus musculus
caggcaatacgaagcacagcagggt

SEQ ID NO: 415471 - DNA, 25 bp, Mus musculus
caggcaatctggcaaacgggcaaac

SEQ ID NO: 415472 - DNA, 25 bp, Mus musculus
caggcaatgcataaacacgtgggtc

SEQ ID NO: 415473 - DNA, 25 bp, Mus musculus
caggcaatggcttcgtagtatggag

SEQ ID NO: 415474 - DNA, 25 bp, Mus musculus
caggcacacacgctttgaggaacaa

SEQ ID NO: 415475 - DNA, 25 bp, Mus musculus
caggcacacgccatggtatccaggt

SEQ ID NO: 415476 - DNA, 25 bp, Mus musculus
caggcacagggcttgccagcatcgt

SEQ ID NO: 415477 - DNA, 25 bp, Mus musculus
caggcacagtgtttgtagttacagc

SEQ ID NO: 415478 - DNA, 25 bp, Mus musculus
caggcacatcttgtgagtacttcaa

SEQ ID NO: 415479 - DNA, 25 bp, Mus musculus
caggcacattactgcagcaaggagc

SEQ ID NO: 415480 - DNA, 25 bp, Mus musculus
caggcaccgtgaactcagaacagta

SEQ ID NO: 415481 - DNA, 25 bp, Mus musculus
caggcaccgtggcaattcttgagca

SEQ ID NO: 415482 - DNA, 25 bp, Mus musculus
caggcacctggatatagttctggac

SEQ ID NO: 415483 - DNA, 25 bp, Mus musculus
caggcacctgttcccttatgaggag

SEQ ID NO: 415484 - DNA, 25 bp, Mus musculus
caggcacgcaaagagtaccaggagc

SEQ ID NO: 415485 - DNA, 25 bp, Mus musculus
caggcacgcatgaggatctttggtc

SEQ ID NO: 415486 - DNA, 25 bp, Mus musculus
caggcacggctcaagacaggttgga

SEQ ID NO: 415487 - DNA, 25 bp, Mus musculus
caggcactaactccaacctcagggt

SEQ ID NO: 415488 - DNA, 25 bp, Mus musculus
caggcactgaaactcaacaacagga

SEQ ID NO: 415489 - DNA, 25 bp, Mus musculus
caggcactgatagagaaagacgcgt

SEQ ID NO: 415490 - DNA, 25 bp, Mus musculus
caggcactgctaggaatgtgtgtca

SEQ ID NO: 415491 - DNA, 25 bp, Mus musculus
caggcactggtgaaagccatcggga

SEQ ID NO: 415492 - DNA, 25 bp, Mus musculus
caggcactgtctaaataaattgaag

SEQ ID NO: 415493 - DNA, 25 bp, Mus musculus
caggcactgttggtcgaggcactcg

SEQ ID NO: 415494 - DNA, 25 bp, Mus musculus
caggcagaaagtgcaactgacgtgg

SEQ ID NO: 415495 - DNA, 25 bp, Mus musculus
caggcagaactcatggatgccgcag

SEQ ID NO: 415496 - DNA, 25 bp, Mus musculus
caggcagacaacataggcagaggta

SEQ ID NO: 415497 - DNA, 25 bp, Mus musculus
caggcagacggagcagggataccat

SEQ ID NO: 415498 - DNA, 25 bp, Mus musculus
caggcagatgatggtcgttaggcat

SEQ ID NO: 415499 - DNA, 25 bp, Mus musculus
caggcagcaggcctagtgactgcat

SEQ ID NO: 415500 - DNA, 25 bp, Mus musculus
caggcagcctaccagaacgacttgg

SEQ ID NO: 415501 - DNA, 25 bp, Mus musculus
caggcagccttgttccagggcgaga

SEQ ID NO: 415502 - DNA, 25 bp, Mus musculus
caggcagcctttgggcggtttagac

SEQ ID NO: 415503 - DNA, 25 bp, Mus musculus
caggcagcgacaggactcgaaagct

SEQ ID NO: 415504 - DNA, 25 bp, Mus musculus
caggcagcgcctacgtcatcgtgta

SEQ ID NO: 415505 - DNA, 25 bp, Mus musculus
caggcagcgctcttggaaaataacc

SEQ ID NO: 415506 - DNA, 25 bp, Mus musculus
caggcagctgactaggagggcatca

SEQ ID NO: 415507 - DNA, 25 bp, Mus musculus
caggcagctggttctgtgtccaaga

SEQ ID NO: 415508 - DNA, 25 bp, Mus musculus
caggcaggacggctcttagacatta

SEQ ID NO: 415509 - DNA, 25 bp, Mus musculus
caggcagggctttgtggtcccaaca

SEQ ID NO: 415510 - DNA, 25 bp, Mus musculus
caggcaggtctctggatgtctcctg

SEQ ID NO: 415511 - DNA, 25 bp, Mus musculus
caggcagtgatgtcgctgtccagct

SEQ ID NO: 415512 - DNA, 25 bp, Mus musculus
caggcagtgatgtttagagcaagca

SEQ ID NO: 415513 - DNA, 25 bp, Mus musculus
caggcagtgcagaccgcttttggcg

SEQ ID NO: 415514 - DNA, 25 bp, Mus musculus
caggcagtggaaacgcgtggtattt

SEQ ID NO: 415515 - DNA, 25 bp, Mus musculus
caggcagtgttgcaggccatcttca

SEQ ID NO: 415516 - DNA, 25 bp, Mus musculus
caggcagttagttgtgactcccaga

SEQ ID NO: 415517 - DNA, 25 bp, Mus musculus
caggcagttgtgattgggatcttca

SEQ ID NO: 415518 - DNA, 25 bp, Mus musculus
caggcatacatgtgatgcggcgctc

SEQ ID NO: 415519 - DNA, 25 bp, Mus musculus
caggcatctcctgagtttcccagaa

SEQ ID NO: 415520 - DNA, 25 bp, Mus musculus
caggcatctggagaactgaatcagc

SEQ ID NO: 415521 - DNA, 25 bp, Mus musculus
caggcatgaccctgcttctgggttc

SEQ ID NO: 415522 - DNA, 25 bp, Mus musculus
caggcatgctgatggagttttcacc

SEQ ID NO: 415523 - DNA, 25 bp, Mus musculus
caggcatggcgcgaattcttgtaac

SEQ ID NO: 415524 - DNA, 25 bp, Mus musculus
caggcattccgaaagaagtttgtca

SEQ ID NO: 415525 - DNA, 25 bp, Mus musculus
caggcatttaatcactggctgaaag

SEQ ID NO: 415526 - DNA, 25 bp, Mus musculus
caggccaaagtccaccatgtcaagt

SEQ ID NO: 415527 - DNA, 25 bp, Mus musculus
caggccaaagtccattcctggtggc

SEQ ID NO: 415528 - DNA, 25 bp, Mus musculus
caggccaagtcaaggaagccgtgaa

SEQ ID NO: 415529 - DNA, 25 bp, Mus musculus
caggccaagtgtctaactctagctc

SEQ ID NO: 415530 - DNA, 25 bp, Mus musculus
caggccacaggaagtcagttataca

SEQ ID NO: 415531 - DNA, 25 bp, Mus musculus
caggccacatcctcatgaagtgaag

SEQ ID NO: 415532 - DNA, 25 bp, Mus musculus
caggccactgatggtgttcttaacc

SEQ ID NO: 415533 - DNA, 25 bp, Mus musculus
caggccagccaatagtaatacatag

SEQ ID NO: 415534 - DNA, 25 bp, Mus musculus
caggccagcccaaggatatgatctc

SEQ ID NO: 415535 - DNA, 25 bp, Mus musculus
caggccaggagcgatttcacaccat

SEQ ID NO: 415536 - DNA, 25 bp, Mus musculus
caggccaggaggactacgatcgttt

SEQ ID NO: 415537 - DNA, 25 bp, Mus musculus
caggccaggccaacaagggcaagtg

SEQ ID NO: 415538 - DNA, 25 bp, Mus musculus
caggccaggtccaacgttgtcacat

SEQ ID NO: 415539 - DNA, 25 bp, Mus musculus
caggccagttcatccgagcagtgga

SEQ ID NO: 415540 - DNA, 25 bp, Mus musculus
caggccataggcctcaggcagagta

SEQ ID NO: 415541 - DNA, 25 bp, Mus musculus
caggccatcaagtgccctacaaggt

SEQ ID NO: 415542 - DNA, 25 bp, Mus musculus
caggccatcgccaccttgattgaga

SEQ ID NO: 415543 - DNA, 25 bp, Mus musculus
caggccatgcttctaggtagtgttc

SEQ ID NO: 415544 - DNA, 25 bp, Mus musculus
caggccatgttgaagctcttggagt

SEQ ID NO: 415545 - DNA, 25 bp, Mus musculus
caggcccaacggctgagattgacat

SEQ ID NO: 415546 - DNA, 25 bp, Mus musculus
caggcccagagacgtcagatatgac

SEQ ID NO: 415547 - DNA, 25 bp, Mus musculus
caggcccaggtagtacttaagatca

SEQ ID NO: 415548 - DNA, 25 bp, Mus musculus
caggccccagcagatacttctttgt

SEQ ID NO: 415549 - DNA, 25 bp, Mus musculus
caggccccgcttgcaggtttataga

SEQ ID NO: 415550 - DNA, 25 bp, Mus musculus
caggcccctctttgctatggcaaac

SEQ ID NO: 415551 - DNA, 25 bp, Mus musculus
caggcccctgctgaaggacttctta

SEQ ID NO: 415552 - DNA, 25 bp, Mus musculus
caggcccctttgttccagtacctgg

SEQ ID NO: 415553 - DNA, 25 bp, Mus musculus
caggcccgagccagtacaagagata

SEQ ID NO: 415554 - DNA, 25 bp, Mus musculus
caggcccgcgggagtttcactgcca

SEQ ID NO: 415555 - DNA, 25 bp, Mus musculus
caggcccggagctccttgctttcgg

SEQ ID NO: 415556 - DNA, 25 bp, Mus musculus
caggcccggagtgattctgtctcca

SEQ ID NO: 415557 - DNA, 25 bp, Mus musculus
caggccctcatagtggtggaagaca

SEQ ID NO: 415558 - DNA, 25 bp, Mus musculus
caggccctgatgttggttcttcaga

SEQ ID NO: 415559 - DNA, 25 bp, Mus musculus
caggccctggagagcattcaaatgg

SEQ ID NO: 415560 - DNA, 25 bp, Mus musculus
caggccctggggtaataaatcaaag

SEQ ID NO: 415561 - DNA, 25 bp, Mus musculus
caggccctggtttcattaggaagga

SEQ ID NO: 415562 - DNA, 25 bp, Mus musculus
caggccctgtcatatttgaaatacg

SEQ ID NO: 415563 - DNA, 25 bp, Mus musculus
caggcccttgtcagacaccacagaa

SEQ ID NO: 415564 - DNA, 25 bp, Mus musculus
caggccgacctggaactagactaca

SEQ ID NO: 415565 - DNA, 25 bp, Mus musculus
caggccgcactgacactcaaagtca

SEQ ID NO: 415566 - DNA, 25 bp, Mus musculus
caggccgcagtggatgagtcaccaa

SEQ ID NO: 415567 - DNA, 25 bp, Mus musculus
caggccggctgtaccaagatcatgg

SEQ ID NO: 415568 - DNA, 25 bp, Mus musculus
caggccgggccaaaacataagatgt

SEQ ID NO: 415569 - DNA, 25 bp, Mus musculus
caggccgttgtcagagctccatctt

SEQ ID NO: 415570 - DNA, 25 bp, Mus musculus
caggcctacacacagagttcatgta

SEQ ID NO: 415571 - DNA, 25 bp, Mus musculus
caggcctaggccatgggaacttgtc

SEQ ID NO: 415572 - DNA, 25 bp, Mus musculus
caggcctatatttgctccgtattct

SEQ ID NO: 415573 - DNA, 25 bp, Mus musculus
caggcctctacttcccagcaatgtg

SEQ ID NO: 415574 - DNA, 25 bp, Mus musculus
caggcctgactctcgggtaaaggca

SEQ ID NO: 415575 - DNA, 25 bp, Mus musculus
caggcctgcaattgctgtacttggg

SEQ ID NO: 415576 - DNA, 25 bp, Mus musculus
caggcctgctcaagtctctgcgctt

SEQ ID NO: 415577 - DNA, 25 bp, Mus musculus
caggcctgctttgggcttggcaaca

SEQ ID NO: 415578 - DNA, 25 bp, Mus musculus
caggcctggacatgagagtagtaca

SEQ ID NO: 415579 - DNA, 25 bp, Mus musculus
caggccttcatgcatatcgatcggg

SEQ ID NO: 415580 - DNA, 25 bp, Mus musculus
caggccttgcggaggcaccgctgaa

SEQ ID NO: 415581 - DNA, 25 bp, Mus musculus
caggccttgggtatctctgcagagg

SEQ ID NO: 415582 - DNA, 25 bp, Mus musculus
caggcctttccttggacaccttggc

SEQ ID NO: 415583 - DNA, 25 bp, Mus musculus
caggcctttgacgagatgctcagga

SEQ ID NO: 415584 - DNA, 25 bp, Mus musculus
caggcgaaggctgcgtagctgctaa

SEQ ID NO: 415585 - DNA, 25 bp, Mus musculus
caggcgacaaactggactcaaagtt

SEQ ID NO: 415586 - DNA, 25 bp, Mus musculus
caggcgaccaagatgggctggttcc

SEQ ID NO: 415587 - DNA, 25 bp, Mus musculus
caggcgacgtcaacgtgccgtagcg

SEQ ID NO: 415588 - DNA, 25 bp, Mus musculus
caggcgaggccttaaaaacagagga

SEQ ID NO: 415589 - DNA, 25 bp, Mus musculus
caggcgagtgccaacgggattatcc

SEQ ID NO: 415590 - DNA, 25 bp, Mus musculus
caggcgatcctctgcgagttcgaga

SEQ ID NO: 415591 - DNA, 25 bp, Mus musculus
caggcgatttgtgtgtctgttacag

SEQ ID NO: 415592 - DNA, 25 bp, Mus musculus
caggcgcaaggcaaattgaggaagc

SEQ ID NO: 415593 - DNA, 25 bp, Mus musculus
caggcgcacgcaccatgaatagata

SEQ ID NO: 415594 - DNA, 25 bp, Mus musculus
caggcgcatgtgattggaaaactca

SEQ ID NO: 415595 - DNA, 25 bp, Mus musculus
caggcgctctggaagtttgtaaaca

SEQ ID NO: 415596 - DNA, 25 bp, Mus musculus
caggcgctgtaaatagtctgacaaa

SEQ ID NO: 415597 - DNA, 25 bp, Mus musculus
caggcgctgtggaagtttataaagc

SEQ ID NO: 415598 - DNA, 25 bp, Mus musculus
caggcggaggatcttactatcacca

SEQ ID NO: 415599 - DNA, 25 bp, Mus musculus
caggcggagtgctcatggatgtcac

SEQ ID NO: 415600 - DNA, 25 bp, Mus musculus
caggcggctcgctgggtaaagcact

SEQ ID NO: 415601 - DNA, 25 bp, Mus musculus
caggcggcttctgctggtttcaaga

SEQ ID NO: 415602 - DNA, 25 bp, Mus musculus
caggcggtgacgttggcatctctaa

SEQ ID NO: 415603 - DNA, 25 bp, Mus musculus
caggcgtctctcagaagaaaggaac

SEQ ID NO: 415604 - DNA, 25 bp, Mus musculus
caggcgtggcgggtaatgctccttt

SEQ ID NO: 415605 - DNA, 25 bp, Mus musculus
caggcgtgtggtgagcagatactac

SEQ ID NO: 415606 - DNA, 25 bp, Mus musculus
caggcgttccggaagttcactaaat

SEQ ID NO: 415607 - DNA, 25 bp, Mus musculus
caggcgttggctagcatgaattcca

SEQ ID NO: 415608 - DNA, 25 bp, Mus musculus
caggctaaagacatcaacatggctt

SEQ ID NO: 415609 - DNA, 25 bp, Mus musculus
caggctaaatgagtgagaccttgtc

SEQ ID NO: 415610 - DNA, 25 bp, Mus musculus
caggctaactctgtcttagcatcac

SEQ ID NO: 415611 - DNA, 25 bp, Mus musculus
caggctaatgcttgaatctgcagta

SEQ ID NO: 415612 - DNA, 25 bp, Mus musculus
caggctaattgcaagggcgagcagt

SEQ ID NO: 415613 - DNA, 25 bp, Mus musculus
caggctaccacagatgttcttgaag

SEQ ID NO: 415614 - DNA, 25 bp, Mus musculus
caggctaccagttgacacgccaagg

SEQ ID NO: 415615 - DNA, 25 bp, Mus musculus
caggctaccatggacacatcagagg

SEQ ID NO: 415616 - DNA, 25 bp, Mus musculus
caggctacgatggttgcaacggaac

SEQ ID NO: 415617 - DNA, 25 bp, Mus musculus
caggctagacttatgttatctgggc

SEQ ID NO: 415618 - DNA, 25 bp, Mus musculus
caggctagcttaggccttcttgcaa

SEQ ID NO: 415619 - DNA, 25 bp, Mus musculus
caggctaggctacgatatcctttgc

SEQ ID NO: 415620 - DNA, 25 bp, Mus musculus
caggctagtcggtatcacctctatt

SEQ ID NO: 415621 - DNA, 25 bp, Mus musculus
caggctatccctatatcagagacaa

SEQ ID NO: 415622 - DNA, 25 bp, Mus musculus
caggctatgaaggtctgaaggtcaa

SEQ ID NO: 415623 - DNA, 25 bp, Mus musculus
caggctatggaaccagaatctctct

SEQ ID NO: 415624 - DNA, 25 bp, Mus musculus
caggctatggatgactgcgagttcc

SEQ ID NO: 415625 - DNA, 25 bp, Mus musculus
caggctcagacgcaaaagtcggtta

SEQ ID NO: 415626 - DNA, 25 bp, Mus musculus
caggctcagagggaacaagatcact

SEQ ID NO: 415627 - DNA, 25 bp, Mus musculus
caggctcaggatcttttgtatgtgg

SEQ ID NO: 415628 - DNA, 25 bp, Mus musculus
caggctcagtagactaagggactcc

SEQ ID NO: 415629 - DNA, 25 bp, Mus musculus
caggctcattgctgtatgttaagaa

SEQ ID NO: 415630 - DNA, 25 bp, Mus musculus
caggctcattgtgccttacgctggg

SEQ ID NO: 415631 - DNA, 25 bp, Mus musculus
caggctccagagtgacaacgagtac

SEQ ID NO: 415632 - DNA, 25 bp, Mus musculus
caggctccagataaaaccccagggt

SEQ ID NO: 415633 - DNA, 25 bp, Mus musculus
caggctccaggtgctgatccttcaa

SEQ ID NO: 415634 - DNA, 25 bp, Mus musculus
caggctccatgcagggtatttccga

SEQ ID NO: 415635 - DNA, 25 bp, Mus musculus
caggctccccgaaaggttctgagaa

SEQ ID NO: 415636 - DNA, 25 bp, Mus musculus
caggctcccgggatcggaatgtcaa

SEQ ID NO: 415637 - DNA, 25 bp, Mus musculus
caggctccggaggatgagaccatct

SEQ ID NO: 415638 - DNA, 25 bp, Mus musculus
caggctccgggagtaccattgtgca

SEQ ID NO: 415639 - DNA, 25 bp, Mus musculus
caggctcctgaaagggccattgagg

SEQ ID NO: 415640 - DNA, 25 bp, Mus musculus
caggctcctgaagaggatcttgtca

SEQ ID NO: 415641 - DNA, 25 bp, Mus musculus
caggctcctgtgtggcatttcagaa

SEQ ID NO: 415642 - DNA, 25 bp, Mus musculus
caggctcgctgtgtgcttgtccagt

SEQ ID NO: 415643 - DNA, 25 bp, Mus musculus
caggctcgttacaaggctgccagga

SEQ ID NO: 415644 - DNA, 25 bp, Mus musculus
caggctctgaatctcacgctgggca

SEQ ID NO: 415645 - DNA, 25 bp, Mus musculus
caggctctgccgcaggactcagtgc

SEQ ID NO: 415646 - DNA, 25 bp, Mus musculus
caggctctgctcagatgggaaccca

SEQ ID NO: 415647 - DNA, 25 bp, Mus musculus
caggctctgtgttaagtccatcggg

SEQ ID NO: 415648 - DNA, 25 bp, Mus musculus
caggctgaagtcatccaggagggca

SEQ ID NO: 415649 - DNA, 25 bp, Mus musculus
caggctgacaggaacatcccctgtc

SEQ ID NO: 415650 - DNA, 25 bp, Mus musculus
caggctgactggctactgcggaaca

SEQ ID NO: 415651 - DNA, 25 bp, Mus musculus
caggctgcacaagggtcttcttcca

SEQ ID NO: 415652 - DNA, 25 bp, Mus musculus
caggctgcactagtgcaccaagagg

SEQ ID NO: 415653 - DNA, 25 bp, Mus musculus
caggctgcccatctcgttgataaat

SEQ ID NO: 415654 - DNA, 25 bp, Mus musculus
caggctgccctcacctagtatggct

SEQ ID NO: 415655 - DNA, 25 bp, Mus musculus
caggctgctggaggtctatagacgc

SEQ ID NO: 415656 - DNA, 25 bp, Mus musculus
caggctgctggtgtaagcactatcc

SEQ ID NO: 415657 - DNA, 25 bp, Mus musculus
caggctggaacgtgctacattaaca

SEQ ID NO: 415658 - DNA, 25 bp, Mus musculus
caggctggaactacgcaatcgggtg

SEQ ID NO: 415659 - DNA, 25 bp, Mus musculus
caggctggacatccaccagggtaca

SEQ ID NO: 415660 - DNA, 25 bp, Mus musculus
caggctggacctcacagggaatgca

SEQ ID NO: 415661 - DNA, 25 bp, Mus musculus
caggctggacctgctagagagacgc

SEQ ID NO: 415662 - DNA, 25 bp, Mus musculus
caggctggccttaattcatgagacc

SEQ ID NO: 415663 - DNA, 25 bp, Mus musculus
caggctgggctttgtactcttttcc

SEQ ID NO: 415664 - DNA, 25 bp, Mus musculus
caggctgggtctagggagtcctcaa

SEQ ID NO: 415665 - DNA, 25 bp, Mus musculus
caggctggtcaaggtaaacgagaac

SEQ ID NO: 415666 - DNA, 25 bp, Mus musculus
caggctggtgcaggcgacttttagc

SEQ ID NO: 415667 - DNA, 25 bp, Mus musculus
caggctgtgcccgaaactggatcac

SEQ ID NO: 415668 - DNA, 25 bp, Mus musculus
caggcttacggtgccaagggattca

SEQ ID NO: 415669 - DNA, 25 bp, Mus musculus
caggcttacgtgttctgaccagaca

SEQ ID NO: 415670 - DNA, 25 bp, Mus musculus
caggcttaggaaacagtggaccatc

SEQ ID NO: 415671 - DNA, 25 bp, Mus musculus
caggcttaggttgagcaaacgggta

SEQ ID NO: 415672 - DNA, 25 bp, Mus musculus
caggcttagtcgctgtttactcaca

SEQ ID NO: 415673 - DNA, 25 bp, Mus musculus
caggcttatacgctccatattggga

SEQ ID NO: 415674 - DNA, 25 bp, Mus musculus
caggcttcagcttgatgggtcatcc

SEQ ID NO: 415675 - DNA, 25 bp, Mus musculus
caggcttctaggacagtctggatac

SEQ ID NO: 415676 - DNA, 25 bp, Mus musculus
caggcttctgagtcctctcttagta

SEQ ID NO: 415677 - DNA, 25 bp, Mus musculus
caggcttctggaatattcgcgaaag

SEQ ID NO: 415678 - DNA, 25 bp, Mus musculus
caggcttctggacgacaacatggac

SEQ ID NO: 415679 - DNA, 25 bp, Mus musculus
caggcttctggctgttccgggaaat

SEQ ID NO: 415680 - DNA, 25 bp, Mus musculus
caggcttgactctcgggagcactga

SEQ ID NO: 415681 - DNA, 25 bp, Mus musculus
caggcttgccctaaaccacagtaac

SEQ ID NO: 415682 - DNA, 25 bp, Mus musculus
caggcttgctagagatgaggacagt

SEQ ID NO: 415683 - DNA, 25 bp, Mus musculus
caggcttgcttcgacagcaggaaga

SEQ ID NO: 415684 - DNA, 25 bp, Mus musculus
caggctttaatgctacttttccaag

SEQ ID NO: 415685 - DNA, 25 bp, Mus musculus
caggctttcagagggtgacgtacga

SEQ ID NO: 415686 - DNA, 25 bp, Mus musculus
caggctttccttggtagcatcgcaa

SEQ ID NO: 415687 - DNA, 25 bp, Mus musculus
caggctttgaacaccagtgaatgac

SEQ ID NO: 415688 - DNA, 25 bp, Mus musculus
caggctttgtgatgatggtccccag

SEQ ID NO: 415689 - DNA, 25 bp, Mus musculus
caggcttttccattttcttacaggg

SEQ ID NO: 415690 - DNA, 25 bp, Mus musculus
cagggaaactggcaactgcatcagc

SEQ ID NO: 415691 - DNA, 25 bp, Mus musculus
cagggaaataacagatacgggcagc

SEQ ID NO: 415692 - DNA, 25 bp, Mus musculus
cagggaaatggtggtgttaagcaaa

SEQ ID NO: 415693 - DNA, 25 bp, Mus musculus
cagggaaattcttcagaaggcggca

SEQ ID NO: 415694 - DNA, 25 bp, Mus musculus
cagggaacaggctacagggtcttat

SEQ ID NO: 415695 - DNA, 25 bp, Mus musculus
cagggaacctccttgtgaacagcaa

SEQ ID NO: 415696 - DNA, 25 bp, Mus musculus
cagggaacctgtaaaccagataagc

SEQ ID NO: 415697 - DNA, 25 bp, Mus musculus
cagggaacgtgaaggtcctgcttca

SEQ ID NO: 415698 - DNA, 25 bp, Mus musculus
cagggaactatgcttcacaccggag

SEQ ID NO: 415699 - DNA, 25 bp, Mus musculus
cagggaactcctgggtgcaagagct

SEQ ID NO: 415700 - DNA, 25 bp, Mus musculus
cagggaagagtccacatagctatgc

SEQ ID NO: 415701 - DNA, 25 bp, Mus musculus
cagggaagcggctcctgtctaggca

SEQ ID NO: 415702 - DNA, 25 bp, Mus musculus
cagggaagggcgatcgagaagcaag

SEQ ID NO: 415703 - DNA, 25 bp, Mus musculus
cagggaagttttgctcagatcagac

SEQ ID NO: 415704 - DNA, 25 bp, Mus musculus
cagggaatgcacaaatatttattct

SEQ ID NO: 415705 - DNA, 25 bp, Mus musculus
cagggacaccaactgtttgagacaa

SEQ ID NO: 415706 - DNA, 25 bp, Mus musculus
cagggacacccccatgtaaggatgg

SEQ ID NO: 415707 - DNA, 25 bp, Mus musculus
cagggacaccttactctggagctgg

SEQ ID NO: 415708 - DNA, 25 bp, Mus musculus
cagggacactgagatctcatttggg

SEQ ID NO: 415709 - DNA, 25 bp, Mus musculus
cagggacactgatgggagccactgt

SEQ ID NO: 415710 - DNA, 25 bp, Mus musculus
cagggacagaaaaagttagctggga

SEQ ID NO: 415711 - DNA, 25 bp, Mus musculus
cagggacagtggattaagagaaaga

SEQ ID NO: 415712 - DNA, 25 bp, Mus musculus
cagggacagtttgttgccagcgccg

SEQ ID NO: 415713 - DNA, 25 bp, Mus musculus
cagggacatatactacggcattggg

SEQ ID NO: 415714 - DNA, 25 bp, Mus musculus
cagggacatggtgaacaggtgcaac

SEQ ID NO: 415715 - DNA, 25 bp, Mus musculus
cagggaccagaagcgtgacaacaat

SEQ ID NO: 415716 - DNA, 25 bp, Mus musculus
cagggaccaggcttagctgagagtt

SEQ ID NO: 415717 - DNA, 25 bp, Mus musculus
cagggaccatgccagaagtgcttct

SEQ ID NO: 415718 - DNA, 25 bp, Mus musculus
cagggaccattgatgctcacgagat

SEQ ID NO: 415719 - DNA, 25 bp, Mus musculus
cagggacccacgcagaattcagtct

SEQ ID NO: 415720 - DNA, 25 bp, Mus musculus
cagggacccctaaagctctggaagt

SEQ ID NO: 415721 - DNA, 25 bp, Mus musculus
cagggaccgatgctttaccaccaaa

SEQ ID NO: 415722 - DNA, 25 bp, Mus musculus
cagggaccgcgtatcagagctttga

SEQ ID NO: 415723 - DNA, 25 bp, Mus musculus
cagggacgaacctctggctgtgaat

SEQ ID NO: 415724 - DNA, 25 bp, Mus musculus
cagggacgagtttgcattccggtgt

SEQ ID NO: 415725 - DNA, 25 bp, Mus musculus
cagggactaatgttttgcctagagc

SEQ ID NO: 415726 - DNA, 25 bp, Mus musculus
cagggactcccagccatgtaggtgg

SEQ ID NO: 415727 - DNA, 25 bp, Mus musculus
cagggactccttgaccatcaaagaa

SEQ ID NO: 415728 - DNA, 25 bp, Mus musculus
cagggactctcaaatgtggcatggc

SEQ ID NO: 415729 - DNA, 25 bp, Mus musculus
cagggactctgaaaggcaggctgca

SEQ ID NO: 415730 - DNA, 25 bp, Mus musculus
cagggactctgccatcaaagctcag

SEQ ID NO: 415731 - DNA, 25 bp, Mus musculus
cagggactgatgtagggatatcttc

SEQ ID NO: 415732 - DNA, 25 bp, Mus musculus
cagggactggaaactctacataaga

SEQ ID NO: 415733 - DNA, 25 bp, Mus musculus
cagggacttgttgttcttcgccgag

SEQ ID NO: 415734 - DNA, 25 bp, Mus musculus
cagggactttgaactgcctgagagt

SEQ ID NO: 415735 - DNA, 25 bp, Mus musculus
cagggagaagtctgcctgtaagtgt

SEQ ID NO: 415736 - DNA, 25 bp, Mus musculus
cagggagagccagtgacaacagtct

SEQ ID NO: 415737 - DNA, 25 bp, Mus musculus
cagggagagcttgaaggacactcac

SEQ ID NO: 415738 - DNA, 25 bp, Mus musculus
cagggagcgctgtttaaagctgcag

SEQ ID NO: 415739 - DNA, 25 bp, Mus musculus
cagggagctagcagatgttgtaacc

SEQ ID NO: 415740 - DNA, 25 bp, Mus musculus
cagggagctgctaccactgtctact

SEQ ID NO: 415741 - DNA, 25 bp, Mus musculus
cagggagcttctgcctaacgttgca

SEQ ID NO: 415742 - DNA, 25 bp, Mus musculus
cagggaggaagaagtcgaagaatgc

SEQ ID NO: 415743 - DNA, 25 bp, Mus musculus
cagggaggatcgcaacaggaaaaca

SEQ ID NO: 415744 - DNA, 25 bp, Mus musculus
cagggagtgcaggaatgaaggaagg

SEQ ID NO: 415745 - DNA, 25 bp, Mus musculus
cagggagttcttcagacctggacca

SEQ ID NO: 415746 - DNA, 25 bp, Mus musculus
cagggataagaaaggcatggaccgt

SEQ ID NO: 415747 - DNA, 25 bp, Mus musculus
cagggataccatgccatccaggagt

SEQ ID NO: 415748 - DNA, 25 bp, Mus musculus
cagggatagcttgccagcccaattt

SEQ ID NO: 415749 - DNA, 25 bp, Mus musculus
cagggataggcacacagggctcatt

SEQ ID NO: 415750 - DNA, 25 bp, Mus musculus
cagggatatatcgtgagtctcaaga

SEQ ID NO: 415751 - DNA, 25 bp, Mus musculus
cagggatcgtgcaagcaaggaagca

SEQ ID NO: 415752 - DNA, 25 bp, Mus musculus
cagggatctactcaactcaggtcgt

SEQ ID NO: 415753 - DNA, 25 bp, Mus musculus
cagggatctggtatatacgtgacaa

SEQ ID NO: 415754 - DNA, 25 bp, Mus musculus
cagggatgcagagtaagagagcttc

SEQ ID NO: 415755 - DNA, 25 bp, Mus musculus
cagggatgcctggactcaacgaaat

SEQ ID NO: 415756 - DNA, 25 bp, Mus musculus
cagggatggtcctacactgccagtc

SEQ ID NO: 415757 - DNA, 25 bp, Mus musculus
cagggatggtcctgcaggaattaac

SEQ ID NO: 415758 - DNA, 25 bp, Mus musculus
cagggatgtgttaatgatgttgctt

SEQ ID NO: 415759 - DNA, 25 bp, Mus musculus
cagggattcgatgggaataccaaca

SEQ ID NO: 415760 - DNA, 25 bp, Mus musculus
cagggattgagttctgtctgtcaga

SEQ ID NO: 415761 - DNA, 25 bp, Mus musculus
cagggattttgagtagcacggtaca

SEQ ID NO: 415762 - DNA, 25 bp, Mus musculus
cagggcaaagatccgaaccgtgaag

SEQ ID NO: 415763 - DNA, 25 bp, Mus musculus
cagggcaacgggtccagaatcttca

SEQ ID NO: 415764 - DNA, 25 bp, Mus musculus
cagggcaagttattcgacagttcca

SEQ ID NO: 415765 - DNA, 25 bp, Mus musculus
cagggcaccactgtaatgttggcaa

SEQ ID NO: 415766 - DNA, 25 bp, Mus musculus
cagggcacccctgttcagacagtga

SEQ ID NO: 415767 - DNA, 25 bp, Mus musculus
cagggcactgacatatgctgctacc

SEQ ID NO: 415768 - DNA, 25 bp, Mus musculus
cagggcactggagactacgaacagt

SEQ ID NO: 415769 - DNA, 25 bp, Mus musculus
cagggcagcaaaccccaattctggg

SEQ ID NO: 415770 - DNA, 25 bp, Mus musculus
cagggcagctaggtcacaggtgaca

SEQ ID NO: 415771 - DNA, 25 bp, Mus musculus
cagggcagtccatcactgtgcagaa

SEQ ID NO: 415772 - DNA, 25 bp, Mus musculus
cagggcagtcgtaagccatctcaga

SEQ ID NO: 415773 - DNA, 25 bp, Mus musculus
cagggcagtgtgtttacggcatcca

SEQ ID NO: 415774 - DNA, 25 bp, Mus musculus
cagggcagttactaacttcatcttc

SEQ ID NO: 415775 - DNA, 25 bp, Mus musculus
cagggcataccccatgatagcaaga

SEQ ID NO: 415776 - DNA, 25 bp, Mus musculus
cagggcatcgtctcctatggaagca

SEQ ID NO: 415777 - DNA, 25 bp, Mus musculus
cagggcatctttgacactggatggc

SEQ ID NO: 415778 - DNA, 25 bp, Mus musculus
cagggcatgctgttggatattgttc

SEQ ID NO: 415779 - DNA, 25 bp, Mus musculus
cagggcattgcataccatgggaggt

SEQ ID NO: 415780 - DNA, 25 bp, Mus musculus
cagggcattggcagagcatgttcca

SEQ ID NO: 415781 - DNA, 25 bp, Mus musculus
cagggccacaggacccgcatctgga

SEQ ID NO: 415782 - DNA, 25 bp, Mus musculus
cagggccacccctaggaagtctatg

SEQ ID NO: 415783 - DNA, 25 bp, Mus musculus
cagggccactgctcttgacagaaga

SEQ ID NO: 415784 - DNA, 25 bp, Mus musculus
cagggccactggaatgagcaattac

SEQ ID NO: 415785 - DNA, 25 bp, Mus musculus
cagggcccacacaaaataaacttgg

SEQ ID NO: 415786 - DNA, 25 bp, Mus musculus
cagggcccacgtgatgagcagatgt

SEQ ID NO: 415787 - DNA, 25 bp, Mus musculus
cagggcccatatgatggagcaagag

SEQ ID NO: 415788 - DNA, 25 bp, Mus musculus
cagggcccggtgtgcaataaaaacg

SEQ ID NO: 415789 - DNA, 25 bp, Mus musculus
cagggccctggaaaaaagatcaagt

SEQ ID NO: 415790 - DNA, 25 bp, Mus musculus
cagggccgacggcatgaattcacag

SEQ ID NO: 415791 - DNA, 25 bp, Mus musculus
cagggccgacttctcttcttttggc

SEQ ID NO: 415792 - DNA, 25 bp, Mus musculus
cagggccgagcttttccagcaagta

SEQ ID NO: 415793 - DNA, 25 bp, Mus musculus
cagggccgccgttactatgtcaaca

SEQ ID NO: 415794 - DNA, 25 bp, Mus musculus
cagggccgggttaaacgacagatga

SEQ ID NO: 415795 - DNA, 25 bp, Mus musculus
cagggcctagacattcacgggaagt

SEQ ID NO: 415796 - DNA, 25 bp, Mus musculus
cagggcctcctgaagctcaatgcag

SEQ ID NO: 415797 - DNA, 25 bp, Mus musculus
cagggcctcgtaaacccaaggatat

SEQ ID NO: 415798 - DNA, 25 bp, Mus musculus
cagggcctctcttggccttgggcat

SEQ ID NO: 415799 - DNA, 25 bp, Mus musculus
cagggcctggtagcctccatagaat

SEQ ID NO: 415800 - DNA, 25 bp, Mus musculus
cagggcggcctcattgtgggaatca

SEQ ID NO: 415801 - DNA, 25 bp, Mus musculus
cagggcggctacctcaagatcttca

SEQ ID NO: 415802 - DNA, 25 bp, Mus musculus
cagggcggtccttagcagttcagca

SEQ ID NO: 415803 - DNA, 25 bp, Mus musculus
cagggcgttctctcgcgcctgtgga

SEQ ID NO: 415804 - DNA, 25 bp, Mus musculus
cagggctaccactagcgggtggtca

SEQ ID NO: 415805 - DNA, 25 bp, Mus musculus
cagggctactgaggagccactggcc

SEQ ID NO: 415806 - DNA, 25 bp, Mus musculus
cagggctagcctgatgtcatcggat

SEQ ID NO: 415807 - DNA, 25 bp, Mus musculus
cagggctaggtattgaatgtgactc

SEQ ID NO: 415808 - DNA, 25 bp, Mus musculus
cagggctccttgtatgactatttga

SEQ ID NO: 415809 - DNA, 25 bp, Mus musculus
cagggctgtgggtaagtgctcaaaa

SEQ ID NO: 415810 - DNA, 25 bp, Mus musculus
cagggcttaacaaaaggcagtcaaa

SEQ ID NO: 415811 - DNA, 25 bp, Mus musculus
cagggcttctggcattctaggaaaa

SEQ ID NO: 415812 - DNA, 25 bp, Mus musculus
cagggcttgaccccgcgattctttc

SEQ ID NO: 415813 - DNA, 25 bp, Mus musculus
cagggcttgcgatgtaagacttgca

SEQ ID NO: 415814 - DNA, 25 bp, Mus musculus
cagggcttgggaggcttagatggaa

SEQ ID NO: 415815 - DNA, 25 bp, Mus musculus
cagggctttcctgtacacttgtaac

SEQ ID NO: 415816 - DNA, 25 bp, Mus musculus
caggggccctggctcaccatgaaat

SEQ ID NO: 415817 - DNA, 25 bp, Mus musculus
cagggtaattatcttgcttgctcca

SEQ ID NO: 415818 - DNA, 25 bp, Mus musculus
cagggtaggatcaaaccagaccaaa

SEQ ID NO: 415819 - DNA, 25 bp, Mus musculus
cagggtcaagactgtggtgccccaa

SEQ ID NO: 415820 - DNA, 25 bp, Mus musculus
cagggtcacaatttgccgtaggcaa

SEQ ID NO: 415821 - DNA, 25 bp, Mus musculus
cagggtcacatggagcaagaaagcc

SEQ ID NO: 415822 - DNA, 25 bp, Mus musculus
cagggtcacgcccaagtaactgaag

SEQ ID NO: 415823 - DNA, 25 bp, Mus musculus
cagggtcactttggagagactgtac

SEQ ID NO: 415824 - DNA, 25 bp, Mus musculus
cagggtcagaggctaatggtctcca

SEQ ID NO: 415825 - DNA, 25 bp, Mus musculus
cagggtcagagtaaggctgcctgcc

SEQ ID NO: 415826 - DNA, 25 bp, Mus musculus
cagggtcagattaggaacatgagtc

SEQ ID NO: 415827 - DNA, 25 bp, Mus musculus
cagggtcatcgggaagcacaaaaca

SEQ ID NO: 415828 - DNA, 25 bp, Mus musculus
cagggtccattcaagtccaagtgtg

SEQ ID NO: 415829 - DNA, 25 bp, Mus musculus
cagggtccctaggtccagcaatgat

SEQ ID NO: 415830 - DNA, 25 bp, Mus musculus
cagggtcccttgctatttacccaag

SEQ ID NO: 415831 - DNA, 25 bp, Mus musculus
cagggtcctcaacacttcatagcag

SEQ ID NO: 415832 - DNA, 25 bp, Mus musculus
cagggtctccctgtgaacttggaat

SEQ ID NO: 415833 - DNA, 25 bp, Mus musculus
cagggtctggcggtacaagtgtcca

SEQ ID NO: 415834 - DNA, 25 bp, Mus musculus
cagggtcttatacatgctgagcaca

SEQ ID NO: 415835 - DNA, 25 bp, Mus musculus
cagggtcttatctcggtgagtcttc

SEQ ID NO: 415836 - DNA, 25 bp, Mus musculus
cagggtcttcagctgctatgtttac

SEQ ID NO: 415837 - DNA, 25 bp, Mus musculus
cagggtcttctcctgttgacctgag

SEQ ID NO: 415838 - DNA, 25 bp, Mus musculus
cagggtctttgttgccaccatcaga

SEQ ID NO: 415839 - DNA, 25 bp, Mus musculus
cagggtgacacaacatgaactttgg

SEQ ID NO: 415840 - DNA, 25 bp, Mus musculus
cagggtgaccccataatctagaaga

SEQ ID NO: 415841 - DNA, 25 bp, Mus musculus
cagggtgaccttcaatgactctgcc

SEQ ID NO: 415842 - DNA, 25 bp, Mus musculus
cagggtgcaatgtctctgttcatca

SEQ ID NO: 415843 - DNA, 25 bp, Mus musculus
cagggtgcggcatacaattgaggtc

SEQ ID NO: 415844 - DNA, 25 bp, Mus musculus
cagggtgctgctggtcatcgacgaa

SEQ ID NO: 415845 - DNA, 25 bp, Mus musculus
cagggtggcaccactgtgtctctcc

SEQ ID NO: 415846 - DNA, 25 bp, Mus musculus
cagggtgtccaacaacagagccatc

SEQ ID NO: 415847 - DNA, 25 bp, Mus musculus
cagggttaccagaaactgactgaca

SEQ ID NO: 415848 - DNA, 25 bp, Mus musculus
cagggttcactcacactatgtgtgc

SEQ ID NO: 415849 - DNA, 25 bp, Mus musculus
cagggttccagtgtttgctagccaa

SEQ ID NO: 415850 - DNA, 25 bp, Mus musculus
cagggttcccacatacccatgtctg

SEQ ID NO: 415851 - DNA, 25 bp, Mus musculus
cagggttcccgcagcaatggatgcc

SEQ ID NO: 415852 - DNA, 25 bp, Mus musculus
cagggttccggactgaatgcgaaaa

SEQ ID NO: 415853 - DNA, 25 bp, Mus musculus
cagggttcctgtcgtcctctgtcct

SEQ ID NO: 415854 - DNA, 25 bp, Mus musculus
cagggttcggctctccgcaaaagag

SEQ ID NO: 415855 - DNA, 25 bp, Mus musculus
cagggttctaaccatggctgcgagc

SEQ ID NO: 415856 - DNA, 25 bp, Mus musculus
cagggttctgccacctatgtaaagg

SEQ ID NO: 415857 - DNA, 25 bp, Mus musculus
cagggttgcagctgacttacgggat

SEQ ID NO: 415858 - DNA, 25 bp, Mus musculus
cagggttgctgatactcggaagcca

SEQ ID NO: 415859 - DNA, 25 bp, Mus musculus
cagggttggctttgaccttggaaag

SEQ ID NO: 415860 - DNA, 25 bp, Mus musculus
cagggttgtcgcgatggcattcgca

SEQ ID NO: 415861 - DNA, 25 bp, Mus musculus
cagggttgtggagaaggacggtgac

SEQ ID NO: 415862 - DNA, 25 bp, Mus musculus
cagggtttagcgctgcagttctcaa

SEQ ID NO: 415863 - DNA, 25 bp, Mus musculus
cagggtttatcaggcacactgggaa

SEQ ID NO: 415864 - DNA, 25 bp, Mus musculus
cagggtttcggatgagctgacacca

SEQ ID NO: 415865 - DNA, 25 bp, Mus musculus
cagggtttgagattcggcttcgcca

SEQ ID NO: 415866 - DNA, 25 bp, Mus musculus
cagggttttctgtccactgaacggt

SEQ ID NO: 415867 - DNA, 25 bp, Mus musculus
caggtaagctgtccatgtgtatgca

SEQ ID NO: 415868 - DNA, 25 bp, Mus musculus
caggtaagggcagtgtgatcagaat

SEQ ID NO: 415869 - DNA, 25 bp, Mus musculus
caggtaaggtgtccggcctgctgcc

SEQ ID NO: 415870 - DNA, 25 bp, Mus musculus
caggtaagtgtttccagatcttaac

SEQ ID NO: 415871 - DNA, 25 bp, Mus musculus
caggtaatcactaccagacatctta

SEQ ID NO: 415872 - DNA, 25 bp, Mus musculus
caggtaatggcaggagcagtctctc

SEQ ID NO: 415873 - DNA, 25 bp, Mus musculus
caggtaatgtggctcctggaccagc

SEQ ID NO: 415874 - DNA, 25 bp, Mus musculus
caggtaattgacaggcttgtgttgt

SEQ ID NO: 415875 - DNA, 25 bp, Mus musculus
caggtacagtggatatgaggctctc

SEQ ID NO: 415876 - DNA, 25 bp, Mus musculus
caggtacctagcttgtcgttaaact

SEQ ID NO: 415877 - DNA, 25 bp, Mus musculus
caggtacgtagcatagaagaactcc

SEQ ID NO: 415878 - DNA, 25 bp, Mus musculus
caggtacgtgcagtgtctcagatca

SEQ ID NO: 415879 - DNA, 25 bp, Mus musculus
caggtactctattttgtttgtagca

SEQ ID NO: 415880 - DNA, 25 bp, Mus musculus
caggtacttccttatactgctttaa

SEQ ID NO: 415881 - DNA, 25 bp, Mus musculus
caggtagaacatggacaaccgcagt

SEQ ID NO: 415882 - DNA, 25 bp, Mus musculus
caggtagagaagaaaagaatccgac

SEQ ID NO: 415883 - DNA, 25 bp, Mus musculus
caggtagccagagtggaccagcctt

SEQ ID NO: 415884 - DNA, 25 bp, Mus musculus
caggtagcccctgtgagacgtgaca

SEQ ID NO: 415885 - DNA, 25 bp, Mus musculus
caggtagccctgtgataatcccaag

SEQ ID NO: 415886 - DNA, 25 bp, Mus musculus
caggtagctcctggctgcaactggg

SEQ ID NO: 415887 - DNA, 25 bp, Mus musculus
caggtaggagatgctatttcagtga

SEQ ID NO: 415888 - DNA, 25 bp, Mus musculus
caggtagggctcagaggagccactt

SEQ ID NO: 415889 - DNA, 25 bp, Mus musculus
caggtagtgagtccgcccaggagca

SEQ ID NO: 415890 - DNA, 25 bp, Mus musculus
caggtatagaccaagatgtaaggac

SEQ ID NO: 415891 - DNA, 25 bp, Mus musculus
caggtatagatcagaagaactcccc

SEQ ID NO: 415892 - DNA, 25 bp, Mus musculus
caggtatatgtcttgcctccaccag

SEQ ID NO: 415893 - DNA, 25 bp, Mus musculus
caggtatcaaagcaacatgacgggt

SEQ ID NO: 415894 - DNA, 25 bp, Mus musculus
caggtatgctcagacctctcaggaa

SEQ ID NO: 415895 - DNA, 25 bp, Mus musculus
caggtatgctgtttaacttggagcc

SEQ ID NO: 415896 - DNA, 25 bp, Mus musculus
caggtatgcttcagggaggagcctc

SEQ ID NO: 415897 - DNA, 25 bp, Mus musculus
caggtattccatagcatcagcatgc

SEQ ID NO: 415898 - DNA, 25 bp, Mus musculus
caggtatttagggaacacgtaagca

SEQ ID NO: 415899 - DNA, 25 bp, Mus musculus
caggtcagccaagcagagagaggta

SEQ ID NO: 415900 - DNA, 25 bp, Mus musculus
caggtcagctcgctgcacatgcaga

SEQ ID NO: 415901 - DNA, 25 bp, Mus musculus
caggtcaggccatgcttctaggtag

SEQ ID NO: 415902 - DNA, 25 bp, Mus musculus
caggtcatgaggcttgccgacaagc

SEQ ID NO: 415903 - DNA, 25 bp, Mus musculus
caggtccaacctcagggaccgaggt

SEQ ID NO: 415904 - DNA, 25 bp, Mus musculus
caggtccatggcacacaaagtttgg

SEQ ID NO: 415905 - DNA, 25 bp, Mus musculus
caggtccccgtggtgtttgagaaca

SEQ ID NO: 415906 - DNA, 25 bp, Mus musculus
caggtccgccagtgaagaatgtcag

SEQ ID NO: 415907 - DNA, 25 bp, Mus musculus
caggtccggataggaggctgctaca

SEQ ID NO: 415908 - DNA, 25 bp, Mus musculus
caggtcctagactggtgtcatcagc

SEQ ID NO: 415909 - DNA, 25 bp, Mus musculus
caggtcctattggagctatggttac

SEQ ID NO: 415910 - DNA, 25 bp, Mus musculus
caggtcctggagtgctgcaaatgtc

SEQ ID NO: 415911 - DNA, 25 bp, Mus musculus
caggtcctgggaacatgcaaagcac

SEQ ID NO: 415912 - DNA, 25 bp, Mus musculus
caggtcctgtaagaagttgggccca

SEQ ID NO: 415913 - DNA, 25 bp, Mus musculus
caggtccttgtcaccctgctcagag

SEQ ID NO: 415914 - DNA, 25 bp, Mus musculus
caggtcgcgctgtctctttaagaac

SEQ ID NO: 415915 - DNA, 25 bp, Mus musculus
caggtctaccacttccttggatgag

SEQ ID NO: 415916 - DNA, 25 bp, Mus musculus
caggtctgcaacgttcccagtgaca

SEQ ID NO: 415917 - DNA, 25 bp, Mus musculus
caggtctggaagaaggcatagcatc

SEQ ID NO: 415918 - DNA, 25 bp, Mus musculus
caggtctgtctgatttcaagagggc

SEQ ID NO: 415919 - DNA, 25 bp, Mus musculus
caggtctgtctgctctgcagggcca

SEQ ID NO: 415920 - DNA, 25 bp, Mus musculus
caggtcttacctttggtaatgcctc

SEQ ID NO: 415921 - DNA, 25 bp, Mus musculus
caggtcttgtgcaggtagccatggc

SEQ ID NO: 415922 - DNA, 25 bp, Mus musculus
caggtgaacaggtgtctagcgagac

SEQ ID NO: 415923 - DNA, 25 bp, Mus musculus
caggtgaaccacacccagactatgg

SEQ ID NO: 415924 - DNA, 25 bp, Mus musculus
caggtgaagaatatcagagtttccc

SEQ ID NO: 415925 - DNA, 25 bp, Mus musculus
caggtgaagagccatcaaagtgctt

SEQ ID NO: 415926 - DNA, 25 bp, Mus musculus
caggtgaagccgagagaaacatcct

SEQ ID NO: 415927 - DNA, 25 bp, Mus musculus
caggtgacaggaggcaacttgcttt

SEQ ID NO: 415928 - DNA, 25 bp, Mus musculus
caggtgacagtccaattacatggcc

SEQ ID NO: 415929 - DNA, 25 bp, Mus musculus
caggtgactctgacaagcggcacag

SEQ ID NO: 415930 - DNA, 25 bp, Mus musculus
caggtgagcaaagcagggttccctg

SEQ ID NO: 415931 - DNA, 25 bp, Mus musculus
caggtgagcctggagtctccctgga

SEQ ID NO: 415932 - DNA, 25 bp, Mus musculus
caggtgaggcgccactcagttcaga

SEQ ID NO: 415933 - DNA, 25 bp, Mus musculus
caggtgatccgaagagaagagacat

SEQ ID NO: 415934 - DNA, 25 bp, Mus musculus
caggtgatcttccagtgccaattaa

SEQ ID NO: 415935 - DNA, 25 bp, Mus musculus
caggtgcacattcagaacgatgggc

SEQ ID NO: 415936 - DNA, 25 bp, Mus musculus
caggtgcaccaatgggttctccgag

SEQ ID NO: 415937 - DNA, 25 bp, Mus musculus
caggtgcaccctgatgacgtggaga

SEQ ID NO: 415938 - DNA, 25 bp, Mus musculus
caggtgcagagcgtggatgacatca

SEQ ID NO: 415939 - DNA, 25 bp, Mus musculus
caggtgcagctcatgggtcaaatca

SEQ ID NO: 415940 - DNA, 25 bp, Mus musculus
caggtgccaactgagaatggaagag

SEQ ID NO: 415941 - DNA, 25 bp, Mus musculus
caggtgccatctggagaatctctgg

SEQ ID NO: 415942 - DNA, 25 bp, Mus musculus
caggtgccgcagctaatcaagttca

SEQ ID NO: 415943 - DNA, 25 bp, Mus musculus
caggtgccgcctcgcccggaagaaa

SEQ ID NO: 415944 - DNA, 25 bp, Mus musculus
caggtgccggcaagacatatacaat

SEQ ID NO: 415945 - DNA, 25 bp, Mus musculus
caggtgccgtgttctcattgtgaca

SEQ ID NO: 415946 - DNA, 25 bp, Mus musculus
caggtgcgaccgtctgactgattcg

SEQ ID NO: 415947 - DNA, 25 bp, Mus musculus
caggtgctagcatgcaagccagggt

SEQ ID NO: 415948 - DNA, 25 bp, Mus musculus
caggtgctaggcattgtgggaaccc

SEQ ID NO: 415949 - DNA, 25 bp, Mus musculus
caggtgctcagtgggaactatagct

SEQ ID NO: 415950 - DNA, 25 bp, Mus musculus
caggtgctccaaaactcccaggatc

SEQ ID NO: 415951 - DNA, 25 bp, Mus musculus
caggtgctctcctggtccatgccag

SEQ ID NO: 415952 - DNA, 25 bp, Mus musculus
caggtgctggcatttctactcaaga

SEQ ID NO: 415953 - DNA, 25 bp, Mus musculus
caggtggatgttgaagcactttgga

SEQ ID NO: 415954 - DNA, 25 bp, Mus musculus
caggtggcacctagctggttagcag

SEQ ID NO: 415955 - DNA, 25 bp, Mus musculus
caggtggcagcaggattcgaaaaac

SEQ ID NO: 415956 - DNA, 25 bp, Mus musculus
caggtggcagccgacaatgcgatct

SEQ ID NO: 415957 - DNA, 25 bp, Mus musculus
caggtggcatcatgaaggcccgtgt

SEQ ID NO: 415958 - DNA, 25 bp, Mus musculus
caggtggccactgaccacgtgacag

SEQ ID NO: 415959 - DNA, 25 bp, Mus musculus
caggtggccagcagatacgtgattc

SEQ ID NO: 415960 - DNA, 25 bp, Mus musculus
caggtggcctacgaagactcggact

SEQ ID NO: 415961 - DNA, 25 bp, Mus musculus
caggtggctccgtcgattcagaaac

SEQ ID NO: 415962 - DNA, 25 bp, Mus musculus
caggtggctgtgtatgacaacaagg

SEQ ID NO: 415963 - DNA, 25 bp, Mus musculus
caggtggctgtttgcttgtcatcta

SEQ ID NO: 415964 - DNA, 25 bp, Mus musculus
caggtgggagacacgtccatgtagc

SEQ ID NO: 415965 - DNA, 25 bp, Mus musculus
caggtgggcaacagagtcacatgct

SEQ ID NO: 415966 - DNA, 25 bp, Mus musculus
caggtggtcagggaagcttgcatca

SEQ ID NO: 415967 - DNA, 25 bp, Mus musculus
caggtggtgcaggtgaacgactcca

SEQ ID NO: 415968 - DNA, 25 bp, Mus musculus
caggtggtgcgaaccgatggcttcc

SEQ ID NO: 415969 - DNA, 25 bp, Mus musculus
caggtgtccaacaagctcaagaagc

SEQ ID NO: 415970 - DNA, 25 bp, Mus musculus
caggtgtctggttcataaaggccac

SEQ ID NO: 415971 - DNA, 25 bp, Mus musculus
caggtgtgctgaaaaagagacttac

SEQ ID NO: 415972 - DNA, 25 bp, Mus musculus
caggtgtgctgagcttcacttccaa

SEQ ID NO: 415973 - DNA, 25 bp, Mus musculus
caggtgtggaatgtcaacgcctcac

SEQ ID NO: 415974 - DNA, 25 bp, Mus musculus
caggtgtgtgaatgagcaggtgaca

SEQ ID NO: 415975 - DNA, 25 bp, Mus musculus
caggtgtgtgagtcccagttccaaa

SEQ ID NO: 415976 - DNA, 25 bp, Mus musculus
caggtgtgtgctggactgcattccc

SEQ ID NO: 415977 - DNA, 25 bp, Mus musculus
caggtgttactgagccggaagcagc

SEQ ID NO: 415978 - DNA, 25 bp, Mus musculus
caggtgttcctgtggaaagagccac

SEQ ID NO: 415979 - DNA, 25 bp, Mus musculus
caggtgttctatgactggccagaga

SEQ ID NO: 415980 - DNA, 25 bp, Mus musculus
caggtgttgtttgctcttttgagac

SEQ ID NO: 415981 - DNA, 25 bp, Mus musculus
caggtgttttccaagtccagttcca

SEQ ID NO: 415982 - DNA, 25 bp, Mus musculus
caggttaaacacagcccatgcacaa

SEQ ID NO: 415983 - DNA, 25 bp, Mus musculus
caggttacagtgtgactcggagtca

SEQ ID NO: 415984 - DNA, 25 bp, Mus musculus
caggttaccccagattaatagcaga

SEQ ID NO: 415985 - DNA, 25 bp, Mus musculus
caggttacctagaagtggactacgg

SEQ ID NO: 415986 - DNA, 25 bp, Mus musculus
caggttattcatgatatcttggtgc

SEQ ID NO: 415987 - DNA, 25 bp, Mus musculus
caggttcaactctgtggtcaccaac

SEQ ID NO: 415988 - DNA, 25 bp, Mus musculus
caggttcagacatcttgggcatgac

SEQ ID NO: 415989 - DNA, 25 bp, Mus musculus
caggttcagagtggacatatcagca

SEQ ID NO: 415990 - DNA, 25 bp, Mus musculus
caggttcagcaatgacatccagcag

SEQ ID NO: 415991 - DNA, 25 bp, Mus musculus
caggttcagggcatgcagagttccc

SEQ ID NO: 415992 - DNA, 25 bp, Mus musculus
caggttccaggaacttcgattggac

SEQ ID NO: 415993 - DNA, 25 bp, Mus musculus
caggttccatgcacctgcgtgggta

SEQ ID NO: 415994 - DNA, 25 bp, Mus musculus
caggttcggagaagcctcgaggctt

SEQ ID NO: 415995 - DNA, 25 bp, Mus musculus
caggttctgcagtaacagctgtttc

SEQ ID NO: 415996 - DNA, 25 bp, Mus musculus
caggttctggacaacaggctgaggc

SEQ ID NO: 415997 - DNA, 25 bp, Mus musculus
caggttgagcttgtcacagcagcca

SEQ ID NO: 415998 - DNA, 25 bp, Mus musculus
caggttgctccccagtcgttgaata

SEQ ID NO: 415999 - DNA, 25 bp, Mus musculus
caggttggagctgacgtgattttca

SEQ ID NO: 416000 - DNA, 25 bp, Mus musculus
caggttgggcacaaacagaccatca

SEQ ID NO: 416001 - DNA, 25 bp, Mus musculus
caggttgtgaaagtggcatctccca

SEQ ID NO: 416002 - DNA, 25 bp, Mus musculus
caggttgttgaggaccatctgcaca

SEQ ID NO: 416003 - DNA, 25 bp, Mus musculus
caggtttacatcaccgccagtggag

SEQ ID NO: 416004 - DNA, 25 bp, Mus musculus
caggtttcagccaagtcccagagaa

SEQ ID NO: 416005 - DNA, 25 bp, Mus musculus
caggtttcccaggaacacgagggca

SEQ ID NO: 416006 - DNA, 25 bp, Mus musculus
caggtttgcagaaagactggtggcc

SEQ ID NO: 416007 - DNA, 25 bp, Mus musculus
caggtttgcagaggacaccgatagg

SEQ ID NO: 416008 - DNA, 25 bp, Mus musculus
caggtttgctttcggcactgacaga

SEQ ID NO: 416009 - DNA, 25 bp, Mus musculus
caggtttgggcagaaattacagcgt

SEQ ID NO: 416010 - DNA, 25 bp, Mus musculus
caggttttactgaagctgtggcgca

SEQ ID NO: 416011 - DNA, 25 bp, Mus musculus
caggtttttaatctctccggcattc

SEQ ID NO: 416012 - DNA, 25 bp, Mus musculus
caggtttttacagctttgacaggga

SEQ ID NO: 416013 - DNA, 25 bp, Mus musculus
caggtttttatagataaccatgaca

SEQ ID NO: 416014 - DNA, 25 bp, Mus musculus
caggttttttctagactccagaggg

SEQ ID NO: 416015 - DNA, 25 bp, Mus musculus
cagtaaaacacaatggctgctgagc

SEQ ID NO: 416016 - DNA, 25 bp, Mus musculus
cagtaaacgtttaaacacatagagg

SEQ ID NO: 416017 - DNA, 25 bp, Mus musculus
cagtaaagacaattgcctaaccgag

SEQ ID NO: 416018 - DNA, 25 bp, Mus musculus
cagtaaagacgaattccccgaggtg

SEQ ID NO: 416019 - DNA, 25 bp, Mus musculus
cagtaaagagtcatctgtcccaggc

SEQ ID NO: 416020 - DNA, 25 bp, Mus musculus
cagtaaagcacttcgggcagctggc

SEQ ID NO: 416021 - DNA, 25 bp, Mus musculus
cagtaaagcccaacagaggcagaag

SEQ ID NO: 416022 - DNA, 25 bp, Mus musculus
cagtaaaggcctctaggcacagccc

SEQ ID NO: 416023 - DNA, 25 bp, Mus musculus
cagtaaaggcttgcagtacggccag

SEQ ID NO: 416024 - DNA, 25 bp, Mus musculus
cagtaaataccagggccactgggca

SEQ ID NO: 416025 - DNA, 25 bp, Mus musculus
cagtaaatacctacccggagctggg

SEQ ID NO: 416026 - DNA, 25 bp, Mus musculus
cagtaaatcacttgggcggcagaac

SEQ ID NO: 416027 - DNA, 25 bp, Mus musculus
cagtaacaacgcaatcgcagtcgca

SEQ ID NO: 416028 - DNA, 25 bp, Mus musculus
cagtaacagtgaagatttctctgga

SEQ ID NO: 416029 - DNA, 25 bp, Mus musculus
cagtaacctgcatggaatgtgctag

SEQ ID NO: 416030 - DNA, 25 bp, Mus musculus
cagtaacctgctgaccagcggtgaa

SEQ ID NO: 416031 - DNA, 25 bp, Mus musculus
cagtaacggaaagaagactgggtga

SEQ ID NO: 416032 - DNA, 25 bp, Mus musculus
cagtaacgttgagtgacgcgtcccc

SEQ ID NO: 416033 - DNA, 25 bp, Mus musculus
cagtaactaactggtcagccattcc

SEQ ID NO: 416034 - DNA, 25 bp, Mus musculus
cagtaactgccgactcctggtggct

SEQ ID NO: 416035 - DNA, 25 bp, Mus musculus
cagtaacttcgtctgacctggagaa

SEQ ID NO: 416036 - DNA, 25 bp, Mus musculus
cagtaagaagcaccccaaagttgtc

SEQ ID NO: 416037 - DNA, 25 bp, Mus musculus
cagtaagcatcagtgcatccctgga

SEQ ID NO: 416038 - DNA, 25 bp, Mus musculus
cagtaagccaaatgaccctggagcg

SEQ ID NO: 416039 - DNA, 25 bp, Mus musculus
cagtaagctccaagaccagtggtcc

SEQ ID NO: 416040 - DNA, 25 bp, Mus musculus
cagtaaggactttccagactgagct

SEQ ID NO: 416041 - DNA, 25 bp, Mus musculus
cagtaaggctaaggtgcacctgtcc

SEQ ID NO: 416042 - DNA, 25 bp, Mus musculus
cagtaaggctctgtttcaaagggaa

SEQ ID NO: 416043 - DNA, 25 bp, Mus musculus
cagtaatccactgggctttacaaat

SEQ ID NO: 416044 - DNA, 25 bp, Mus musculus
cagtaatcgagaaggcgttgagaaa

SEQ ID NO: 416045 - DNA, 25 bp, Mus musculus
cagtaatgtatcctgtgcctgctga

SEQ ID NO: 416046 - DNA, 25 bp, Mus musculus
cagtaatgttgcatctgaggctgac

SEQ ID NO: 416047 - DNA, 25 bp, Mus musculus
cagtaattatgagttctgtgatacc

SEQ ID NO: 416048 - DNA, 25 bp, Mus musculus
cagtaattgtaaccatcgagccacc

SEQ ID NO: 416049 - DNA, 25 bp, Mus musculus
cagtaatttgtaggtctcagccagc

SEQ ID NO: 416050 - DNA, 25 bp, Mus musculus
cagtacaaaatcaccaccgttaggt

SEQ ID NO: 416051 - DNA, 25 bp, Mus musculus
cagtacaaagaaagggcggtgaaca

SEQ ID NO: 416052 - DNA, 25 bp, Mus musculus
cagtacaagagcatccctgtggagg

SEQ ID NO: 416053 - DNA, 25 bp, Mus musculus
cagtacacaataaacaccacggcgg

SEQ ID NO: 416054 - DNA, 25 bp, Mus musculus
cagtacagcttacaaagcaggccag

SEQ ID NO: 416055 - DNA, 25 bp, Mus musculus
cagtacagttatatagcactattta

SEQ ID NO: 416056 - DNA, 25 bp, Mus musculus
cagtacatgcgtgctggcaacggct

SEQ ID NO: 416057 - DNA, 25 bp, Mus musculus
cagtaccaagcctgtgtaatccact

SEQ ID NO: 416058 - DNA, 25 bp, Mus musculus
cagtaccagctttggaggtctcttc

SEQ ID NO: 416059 - DNA, 25 bp, Mus musculus
cagtaccagtggtatctgatggaac

SEQ ID NO: 416060 - DNA, 25 bp, Mus musculus
cagtaccatcggcacagtatcagta

SEQ ID NO: 416061 - DNA, 25 bp, Mus musculus
cagtaccatgctgtggcagtgcgca

SEQ ID NO: 416062 - DNA, 25 bp, Mus musculus
cagtacccatgaggagatcagaaga

SEQ ID NO: 416063 - DNA, 25 bp, Mus musculus
cagtacccggatgtgtatgcacgtg

SEQ ID NO: 416064 - DNA, 25 bp, Mus musculus
cagtaccctgttgtgtgtctcttct

SEQ ID NO: 416065 - DNA, 25 bp, Mus musculus
cagtacctgaatttaaccactgagc

SEQ ID NO: 416066 - DNA, 25 bp, Mus musculus
cagtacctgagactacacagaagcc

SEQ ID NO: 416067 - DNA, 25 bp, Mus musculus
cagtacctgatgaccaacagtgtgc

SEQ ID NO: 416068 - DNA, 25 bp, Mus musculus
cagtacctggcgtcatagaacacaa

SEQ ID NO: 416069 - DNA, 25 bp, Mus musculus
cagtacgccagcgacaaggctgcgt

SEQ ID NO: 416070 - DNA, 25 bp, Mus musculus
cagtacgtccagttagaccttcccg

SEQ ID NO: 416071 - DNA, 25 bp, Mus musculus
cagtactacgaagacaccagtggga

SEQ ID NO: 416072 - DNA, 25 bp, Mus musculus
cagtactctgggtcacttaggcttg

SEQ ID NO: 416073 - DNA, 25 bp, Mus musculus
cagtactgctgggtaataggtttcc

SEQ ID NO: 416074 - DNA, 25 bp, Mus musculus
cagtactgcttatgggaattgccct

SEQ ID NO: 416075 - DNA, 25 bp, Mus musculus
cagtactggactgctaataggacaa

SEQ ID NO: 416076 - DNA, 25 bp, Mus musculus
cagtactgtgagctctgaatcccaa

SEQ ID NO: 416077 - DNA, 25 bp, Mus musculus
cagtacttagtattacgaaaggatc

SEQ ID NO: 416078 - DNA, 25 bp, Mus musculus
cagtacttatgatctcccacggagc

SEQ ID NO: 416079 - DNA, 25 bp, Mus musculus
cagtacttcgtggagcctatgatgc

SEQ ID NO: 416080 - DNA, 25 bp, Mus musculus
cagtacttcgtgttacaaactaaag

SEQ ID NO: 416081 - DNA, 25 bp, Mus musculus
cagtacttgagttgcttaggtggaa

SEQ ID NO: 416082 - DNA, 25 bp, Mus musculus
cagtagacattattatggtggcccc

SEQ ID NO: 416083 - DNA, 25 bp, Mus musculus
cagtagacgagcatagccagctgcg

SEQ ID NO: 416084 - DNA, 25 bp, Mus musculus
cagtagacggtgactcagagctgca

SEQ ID NO: 416085 - DNA, 25 bp, Mus musculus
cagtagagattacaaagactttaag

SEQ ID NO: 416086 - DNA, 25 bp, Mus musculus
cagtagagctttttccgtggcattg

SEQ ID NO: 416087 - DNA, 25 bp, Mus musculus
cagtagagggagatgcttcacaaca

SEQ ID NO: 416088 - DNA, 25 bp, Mus musculus
cagtagataccacaagctgcgggct

SEQ ID NO: 416089 - DNA, 25 bp, Mus musculus
cagtagataggacaacagacgggtc

SEQ ID NO: 416090 - DNA, 25 bp, Mus musculus
cagtagatccttcctgatatggcct

SEQ ID NO: 416091 - DNA, 25 bp, Mus musculus
cagtagatgctaacctccagtggcc

SEQ ID NO: 416092 - DNA, 25 bp, Mus musculus
cagtagcaaattgtggtggattctt

SEQ ID NO: 416093 - DNA, 25 bp, Mus musculus
cagtagcaccgtcagcagctggatg

SEQ ID NO: 416094 - DNA, 25 bp, Mus musculus
cagtagcagtgtgaacagctggttc

SEQ ID NO: 416095 - DNA, 25 bp, Mus musculus
cagtagccgagagaagcgagagtca

SEQ ID NO: 416096 - DNA, 25 bp, Mus musculus
cagtagccggctatgtgtgcagatg

SEQ ID NO: 416097 - DNA, 25 bp, Mus musculus
cagtagcctgattcccttgatggag

SEQ ID NO: 416098 - DNA, 25 bp, Mus musculus
cagtagcgattgttaatggagcaag

SEQ ID NO: 416099 - DNA, 25 bp, Mus musculus
cagtagcggaaagtaaggctggccc

SEQ ID NO: 416100 - DNA, 25 bp, Mus musculus
cagtagcggtcctattcccttccgg

SEQ ID NO: 416101 - DNA, 25 bp, Mus musculus
cagtagctatgtgctcactgctgaa

SEQ ID NO: 416102 - DNA, 25 bp, Mus musculus
cagtagctcaggtagtcaagtgtca

SEQ ID NO: 416103 - DNA, 25 bp, Mus musculus
cagtagctgaagagccaataatgga

SEQ ID NO: 416104 - DNA, 25 bp, Mus musculus
cagtagctgatgtgcaatttggccc

SEQ ID NO: 416105 - DNA, 25 bp, Mus musculus
cagtagctgcgtttgcaagggctga

SEQ ID NO: 416106 - DNA, 25 bp, Mus musculus
cagtagcttccacccactgggaggt

SEQ ID NO: 416107 - DNA, 25 bp, Mus musculus
cagtagcttctagggtcttgggcag

SEQ ID NO: 416108 - DNA, 25 bp, Mus musculus
cagtaggacctgttgatatggataa

SEQ ID NO: 416109 - DNA, 25 bp, Mus musculus
cagtaggatcatttcaggcctggcc

SEQ ID NO: 416110 - DNA, 25 bp, Mus musculus
cagtaggatccaacgaggctgcgga

SEQ ID NO: 416111 - DNA, 25 bp, Mus musculus
cagtaggatctatcggcctcagaca

SEQ ID NO: 416112 - DNA, 25 bp, Mus musculus
cagtaggcaaaggaagatgatgtcg

SEQ ID NO: 416113 - DNA, 25 bp, Mus musculus
cagtaggcagttggagagaaatgtc

SEQ ID NO: 416114 - DNA, 25 bp, Mus musculus
cagtaggccgtcatcctgggtttcc

SEQ ID NO: 416115 - DNA, 25 bp, Mus musculus
cagtaggctctatggcgtccacagg

SEQ ID NO: 416116 - DNA, 25 bp, Mus musculus
cagtagggaccaaggtcgaggacct

SEQ ID NO: 416117 - DNA, 25 bp, Mus musculus
cagtagggacgttcagagtccagca

SEQ ID NO: 416118 - DNA, 25 bp, Mus musculus
cagtaggtaacatctgtaacgcttc

SEQ ID NO: 416119 - DNA, 25 bp, Mus musculus
cagtaggtacacacaagggcttcgt

SEQ ID NO: 416120 - DNA, 25 bp, Mus musculus
cagtaggttcgcatcaatgggtagt

SEQ ID NO: 416121 - DNA, 25 bp, Mus musculus
cagtagtacttcaaatacagggaac

SEQ ID NO: 416122 - DNA, 25 bp, Mus musculus
cagtagtctgtcgtcaggcttctga

SEQ ID NO: 416123 - DNA, 25 bp, Mus musculus
cagtagtgctttgaccgacaggagg

SEQ ID NO: 416124 - DNA, 25 bp, Mus musculus
cagtagttagaaagtggccatggcg

SEQ ID NO: 416125 - DNA, 25 bp, Mus musculus
cagtagttatagagaaagcgccaca

SEQ ID NO: 416126 - DNA, 25 bp, Mus musculus
cagtagttccggttcacttggatcg

SEQ ID NO: 416127 - DNA, 25 bp, Mus musculus
cagtagttgataatgtgcagcagcc

SEQ ID NO: 416128 - DNA, 25 bp, Mus musculus
cagtagttgtttccccagcctggag

SEQ ID NO: 416129 - DNA, 25 bp, Mus musculus
cagtatacttacttgggaggccagg

SEQ ID NO: 416130 - DNA, 25 bp, Mus musculus
cagtatagcagttcagccctgccat

SEQ ID NO: 416131 - DNA, 25 bp, Mus musculus
cagtataggtaaagccacgggcaga

SEQ ID NO: 416132 - DNA, 25 bp, Mus musculus
cagtatatgctgtgattgccccatg

SEQ ID NO: 416133 - DNA, 25 bp, Mus musculus
cagtatatttgatcatgtttcccct

SEQ ID NO: 416134 - DNA, 25 bp, Mus musculus
cagtatcagttaagaaaacaaagcg

SEQ ID NO: 416135 - DNA, 25 bp, Mus musculus
cagtatcatgtcaatgtgagtctgg

SEQ ID NO: 416136 - DNA, 25 bp, Mus musculus
cagtatccacgatgcagtcctgggc

SEQ ID NO: 416137 - DNA, 25 bp, Mus musculus
cagtatccagtttctgaggctcaga

SEQ ID NO: 416138 - DNA, 25 bp, Mus musculus
cagtatccccagaagtgagtcggca

SEQ ID NO: 416139 - DNA, 25 bp, Mus musculus
cagtatcccgcgattggtgtgacca

SEQ ID NO: 416140 - DNA, 25 bp, Mus musculus
cagtatccgaggacagtcaacctgg

SEQ ID NO: 416141 - DNA, 25 bp, Mus musculus
cagtatccggtgtttgtgggccaca

SEQ ID NO: 416142 - DNA, 25 bp, Mus musculus
cagtatcctggctgcgcactttggg

SEQ ID NO: 416143 - DNA, 25 bp, Mus musculus
cagtatctcgagaacctgggcttca

SEQ ID NO: 416144 - DNA, 25 bp, Mus musculus
cagtatctcttcttggtaagtaggg

SEQ ID NO: 416145 - DNA, 25 bp, Mus musculus
cagtatctgatagtgcagctgcttc

SEQ ID NO: 416146 - DNA, 25 bp, Mus musculus
cagtatctggagagcgatgaccacc

SEQ ID NO: 416147 - DNA, 25 bp, Mus musculus
cagtatctggccttgcctgagcgcg

SEQ ID NO: 416148 - DNA, 25 bp, Mus musculus
cagtatcttatagaacatttggcgg

SEQ ID NO: 416149 - DNA, 25 bp, Mus musculus
cagtatgacaaggatcgatggctct

SEQ ID NO: 416150 - DNA, 25 bp, Mus musculus
cagtatgagggctattgacatccat

SEQ ID NO: 416151 - DNA, 25 bp, Mus musculus
cagtatgatttgcacagagtcgacc

SEQ ID NO: 416152 - DNA, 25 bp, Mus musculus
cagtatgcccacattccagacagga

SEQ ID NO: 416153 - DNA, 25 bp, Mus musculus
cagtatgcctacaagcagcgtcgcg

SEQ ID NO: 416154 - DNA, 25 bp, Mus musculus
cagtatgctggctaaaggactttcc

SEQ ID NO: 416155 - DNA, 25 bp, Mus musculus
cagtatggcggcacggcagaccctg

SEQ ID NO: 416156 - DNA, 25 bp, Mus musculus
cagtatggcttaaccctcagtgacc

SEQ ID NO: 416157 - DNA, 25 bp, Mus musculus
cagtatgggtgtgcaatcttttagt

SEQ ID NO: 416158 - DNA, 25 bp, Mus musculus
cagtatggtgccttcctttgaggac

SEQ ID NO: 416159 - DNA, 25 bp, Mus musculus
cagtatgtgcgtctggattgtaaga

SEQ ID NO: 416160 - DNA, 25 bp, Mus musculus
cagtatgttcaaggagccacgcagg

SEQ ID NO: 416161 - DNA, 25 bp, Mus musculus
cagtatgttcgtagccctgggcgca

SEQ ID NO: 416162 - DNA, 25 bp, Mus musculus
cagtatgttgaccatgccttagtgg

SEQ ID NO: 416163 - DNA, 25 bp, Mus musculus
cagtattaactgttcagaaactacc

SEQ ID NO: 416164 - DNA, 25 bp, Mus musculus
cagtattacccctgtgtgtgctacc

SEQ ID NO: 416165 - DNA, 25 bp, Mus musculus
cagtattcatgtggactccgcctga

SEQ ID NO: 416166 - DNA, 25 bp, Mus musculus
cagtattctactcggcttgaagcag

SEQ ID NO: 416167 - DNA, 25 bp, Mus musculus
cagtattctatacattgttcgtagt

SEQ ID NO: 416168 - DNA, 25 bp, Mus musculus
cagtattctctcaaactgccagtag

SEQ ID NO: 416169 - DNA, 25 bp, Mus musculus
cagtattctggttctagaaagccag

SEQ ID NO: 416170 - DNA, 25 bp, Mus musculus
cagtattgaaatcgcagggctcaca

SEQ ID NO: 416171 - DNA, 25 bp, Mus musculus
cagtattggcttctcaggtctggag

SEQ ID NO: 416172 - DNA, 25 bp, Mus musculus
cagtattgtctattggtcctcagtc

SEQ ID NO: 416173 - DNA, 25 bp, Mus musculus
cagtatttcaaagtgattccagtgg

SEQ ID NO: 416174 - DNA, 25 bp, Mus musculus
cagtatttgactcctctgcagcaga

SEQ ID NO: 416175 - DNA, 25 bp, Mus musculus
cagtatttggagtcagggagataac

SEQ ID NO: 416176 - DNA, 25 bp, Mus musculus
cagtatttgtcaaagctgaaacagg

SEQ ID NO: 416177 - DNA, 25 bp, Mus musculus
cagtattttccgcaagggttgtgaa

SEQ ID NO: 416178 - DNA, 25 bp, Mus musculus
cagtcaactcatgcagaaacaagag

SEQ ID NO: 416179 - DNA, 25 bp, Mus musculus
cagtcaactctgagacagtcaatcc

SEQ ID NO: 416180 - DNA, 25 bp, Mus musculus
cagtcaactttctcgggatccctgg

SEQ ID NO: 416181 - DNA, 25 bp, Mus musculus
cagtcaaggcaagacagtactcggt

SEQ ID NO: 416182 - DNA, 25 bp, Mus musculus
cagtcaagtgcaaaggagaaaagga

SEQ ID NO: 416183 - DNA, 25 bp, Mus musculus
cagtcaagttaatgtgcctttcatc

SEQ ID NO: 416184 - DNA, 25 bp, Mus musculus
cagtcacaaatctatgggcgttccc

SEQ ID NO: 416185 - DNA, 25 bp, Mus musculus
cagtcacaccatgggtctgaggaag

SEQ ID NO: 416186 - DNA, 25 bp, Mus musculus
cagtcacagtgatcggaggcctcaa

SEQ ID NO: 416187 - DNA, 25 bp, Mus musculus
cagtcacccattgagtatcagcgga

SEQ ID NO: 416188 - DNA, 25 bp, Mus musculus
cagtcacctgaagatgtggctgtag

SEQ ID NO: 416189 - DNA, 25 bp, Mus musculus
cagtcacctgtgctcttgtcaaaga

SEQ ID NO: 416190 - DNA, 25 bp, Mus musculus
cagtcacggacttggatcatttaaa

SEQ ID NO: 416191 - DNA, 25 bp, Mus musculus
cagtcacgggctttgtgaacgtcca

SEQ ID NO: 416192 - DNA, 25 bp, Mus musculus
cagtcacgtggagctcttcgaagca

SEQ ID NO: 416193 - DNA, 25 bp, Mus musculus
cagtcactcggtaccgacacagcaa

SEQ ID NO: 416194 - DNA, 25 bp, Mus musculus
cagtcactgccctactatgtgtggt

SEQ ID NO: 416195 - DNA, 25 bp, Mus musculus
cagtcactggaatgctacctcaggc

SEQ ID NO: 416196 - DNA, 25 bp, Mus musculus
cagtcactgtgctacattgcctggc

SEQ ID NO: 416197 - DNA, 25 bp, Mus musculus
cagtcacttgctcactttgaagcga

SEQ ID NO: 416198 - DNA, 25 bp, Mus musculus
cagtcacttttaatgggctccggaa

SEQ ID NO: 416199 - DNA, 25 bp, Mus musculus
cagtcagaacaaaagttaccaccct

SEQ ID NO: 416200 - DNA, 25 bp, Mus musculus
cagtcagaagcgacttccgagctct

SEQ ID NO: 416201 - DNA, 25 bp, Mus musculus
cagtcagactatagaacagatggtt

SEQ ID NO: 416202 - DNA, 25 bp, Mus musculus
cagtcagagccccagtgtaaacaca

SEQ ID NO: 416203 - DNA, 25 bp, Mus musculus
cagtcagatgaagcagctcgctggg

SEQ ID NO: 416204 - DNA, 25 bp, Mus musculus
cagtcagcaaaaacaagcccaggtt

SEQ ID NO: 416205 - DNA, 25 bp, Mus musculus
cagtcaggaccagcaagagcaagaa

SEQ ID NO: 416206 - DNA, 25 bp, Mus musculus
cagtcaggagactaacaatgattca

SEQ ID NO: 416207 - DNA, 25 bp, Mus musculus
cagtcagggattccaggattctctg

SEQ ID NO: 416208 - DNA, 25 bp, Mus musculus
cagtcagggcaagaatccatctgct

SEQ ID NO: 416209 - DNA, 25 bp, Mus musculus
cagtcagggcctaaactcaggagca

SEQ ID NO: 416210 - DNA, 25 bp, Mus musculus
cagtcaggtgataatttatgcgtgc

SEQ ID NO: 416211 - DNA, 25 bp, Mus musculus
cagtcagtaagctttggccaggcca

SEQ ID NO: 416212 - DNA, 25 bp, Mus musculus
cagtcataaaaagcgcgtggctcca

SEQ ID NO: 416213 - DNA, 25 bp, Mus musculus
cagtcatagttgtaatagattctac

SEQ ID NO: 416214 - DNA, 25 bp, Mus musculus
cagtcatataagaatctggccttgg

SEQ ID NO: 416215 - DNA, 25 bp, Mus musculus
cagtcatatgcctgtctcagccgga

SEQ ID NO: 416216 - DNA, 25 bp, Mus musculus
cagtcatgactggaggctttgctac

SEQ ID NO: 416217 - DNA, 25 bp, Mus musculus
cagtcatgaggatttgtccctccag

SEQ ID NO: 416218 - DNA, 25 bp, Mus musculus
cagtcatggcctggaaatgggacct

SEQ ID NO: 416219 - DNA, 25 bp, Mus musculus
cagtcatgtcctgggagcttgtcaa

SEQ ID NO: 416220 - DNA, 25 bp, Mus musculus
cagtcattaacgctaacagggagga

SEQ ID NO: 416221 - DNA, 25 bp, Mus musculus
cagtcattatcaacagattgcacag

SEQ ID NO: 416222 - DNA, 25 bp, Mus musculus
cagtcattggtgtgcctatccggga

SEQ ID NO: 416223 - DNA, 25 bp, Mus musculus
cagtcattgtagaacccatggagca

SEQ ID NO: 416224 - DNA, 25 bp, Mus musculus
cagtcattgtgtatggttgagtccc

SEQ ID NO: 416225 - DNA, 25 bp, Mus musculus
cagtccaaaggaggtgtgcattaaa

SEQ ID NO: 416226 - DNA, 25 bp, Mus musculus
cagtccaagagtggagagtgttgct

SEQ ID NO: 416227 - DNA, 25 bp, Mus musculus
cagtccacagagtccctggtgcact

SEQ ID NO: 416228 - DNA, 25 bp, Mus musculus
cagtccagagctgcaagaattcagg

SEQ ID NO: 416229 - DNA, 25 bp, Mus musculus
cagtccagccatttctgaaggagca

SEQ ID NO: 416230 - DNA, 25 bp, Mus musculus
cagtccagggcccaattgtgttagc

SEQ ID NO: 416231 - DNA, 25 bp, Mus musculus
cagtccaggtaaccctctgtggtct

SEQ ID NO: 416232 - DNA, 25 bp, Mus musculus
cagtccagtgacagaagattcgccg

SEQ ID NO: 416233 - DNA, 25 bp, Mus musculus
cagtccagttctcaggattcagacc

SEQ ID NO: 416234 - DNA, 25 bp, Mus musculus
cagtccattataggtggtgccacct

SEQ ID NO: 416235 - DNA, 25 bp, Mus musculus
cagtcccaaagaaggcatgattaag

SEQ ID NO: 416236 - DNA, 25 bp, Mus musculus
cagtcccaacgaggctcaggaacaa

SEQ ID NO: 416237 - DNA, 25 bp, Mus musculus
cagtcccagcagcaagttcaacagg

SEQ ID NO: 416238 - DNA, 25 bp, Mus musculus
cagtccccagatcatgcccatttgt

SEQ ID NO: 416239 - DNA, 25 bp, Mus musculus
cagtccccagattatttctcctgta

SEQ ID NO: 416240 - DNA, 25 bp, Mus musculus
cagtcccttggaagtacagcgttgg

SEQ ID NO: 416241 - DNA, 25 bp, Mus musculus
cagtccgaagttggtctgagccagc

SEQ ID NO: 416242 - DNA, 25 bp, Mus musculus
cagtccgactggtttctactggcca

SEQ ID NO: 416243 - DNA, 25 bp, Mus musculus
cagtccggacacaggtttttagttg

SEQ ID NO: 416244 - DNA, 25 bp, Mus musculus
cagtccggaggagtatctagaacca

SEQ ID NO: 416245 - DNA, 25 bp, Mus musculus
cagtccggtgttgcagcttttccaa

SEQ ID NO: 416246 - DNA, 25 bp, Mus musculus
cagtccgtcattgcccagtggaagg

SEQ ID NO: 416247 - DNA, 25 bp, Mus musculus
cagtcctaactgtggtgttttcctc

SEQ ID NO: 416248 - DNA, 25 bp, Mus musculus
cagtcctaagctctctaccataggg

SEQ ID NO: 416249 - DNA, 25 bp, Mus musculus
cagtcctagggaagtatctcttcgg

SEQ ID NO: 416250 - DNA, 25 bp, Mus musculus
cagtcctagtggtgaagctgcttcc

SEQ ID NO: 416251 - DNA, 25 bp, Mus musculus
cagtcctcgctatccagagggtgaa

SEQ ID NO: 416252 - DNA, 25 bp, Mus musculus
cagtcctcgtgcatgagaacggcaa

SEQ ID NO: 416253 - DNA, 25 bp, Mus musculus
cagtcctgccctctggatcagtggg

SEQ ID NO: 416254 - DNA, 25 bp, Mus musculus
cagtcctgtcaataaggtggaaccc

SEQ ID NO: 416255 - DNA, 25 bp, Mus musculus
cagtccttgaagctggatatcccag

SEQ ID NO: 416256 - DNA, 25 bp, Mus musculus
cagtccttgttctccaacatgaaga

SEQ ID NO: 416257 - DNA, 25 bp, Mus musculus
cagtcgacgtccagaacctgaagag

SEQ ID NO: 416258 - DNA, 25 bp, Mus musculus
cagtcgactttggtgttgtcagtga

SEQ ID NO: 416259 - DNA, 25 bp, Mus musculus
cagtcgaggcagatcttggagcagc

SEQ ID NO: 416260 - DNA, 25 bp, Mus musculus
cagtcgatcaggatggtgcttccaa

SEQ ID NO: 416261 - DNA, 25 bp, Mus musculus
cagtcgatggaaggaaggctcgctc

SEQ ID NO: 416262 - DNA, 25 bp, Mus musculus
cagtcgcaggctgacacagggtttt

SEQ ID NO: 416263 - DNA, 25 bp, Mus musculus
cagtcgcggtcgcttcagtcgtcag

SEQ ID NO: 416264 - DNA, 25 bp, Mus musculus
cagtcgctggcgaagaataggcaca

SEQ ID NO: 416265 - DNA, 25 bp, Mus musculus
cagtcggaaccccatggcctttttg

SEQ ID NO: 416266 - DNA, 25 bp, Mus musculus
cagtcggatggctttcatggaagga

SEQ ID NO: 416267 - DNA, 25 bp, Mus musculus
cagtcggtatttgtccatcgtgaac

SEQ ID NO: 416268 - DNA, 25 bp, Mus musculus
cagtcgtaagcttccatatgggtac

SEQ ID NO: 416269 - DNA, 25 bp, Mus musculus
cagtcgtagaaagaaggccgtgtct

SEQ ID NO: 416270 - DNA, 25 bp, Mus musculus
cagtcgtcaagctggaaggtgacaa

SEQ ID NO: 416271 - DNA, 25 bp, Mus musculus
cagtcgtctccaggatctaagcaga

SEQ ID NO: 416272 - DNA, 25 bp, Mus musculus
cagtcgtgaggaaagtcgtcgtaac

SEQ ID NO: 416273 - DNA, 25 bp, Mus musculus
cagtcgttgacttagtttctaccaa

SEQ ID NO: 416274 - DNA, 25 bp, Mus musculus
cagtctaaggaaacgtgagcttggt

SEQ ID NO: 416275 - DNA, 25 bp, Mus musculus
cagtctagcagaacccatggcgtct

SEQ ID NO: 416276 - DNA, 25 bp, Mus musculus
cagtctagcagacggaacggagctc

SEQ ID NO: 416277 - DNA, 25 bp, Mus musculus
cagtctagcctactgacaggcaagc

SEQ ID NO: 416278 - DNA, 25 bp, Mus musculus
cagtctagcgttggaacttcctgcc

SEQ ID NO: 416279 - DNA, 25 bp, Mus musculus
cagtctatacccgatccacaggaga

SEQ ID NO: 416280 - DNA, 25 bp, Mus musculus
cagtctatcaggtgctccaggagca

SEQ ID NO: 416281 - DNA, 25 bp, Mus musculus
cagtctatgaggtgtcggtccgcga

SEQ ID NO: 416282 - DNA, 25 bp, Mus musculus
cagtctatggcgtctacagtgggaa

SEQ ID NO: 416283 - DNA, 25 bp, Mus musculus
cagtctatgtttgctccgcctgaca

SEQ ID NO: 416284 - DNA, 25 bp, Mus musculus
cagtctcaaagaggagcggatcaaa

SEQ ID NO: 416285 - DNA, 25 bp, Mus musculus
cagtctcacagccaaagtctctgtt

SEQ ID NO: 416286 - DNA, 25 bp, Mus musculus
cagtctcagatgctttcccgatggt

SEQ ID NO: 416287 - DNA, 25 bp, Mus musculus
cagtctcagctagagatccttcact

SEQ ID NO: 416288 - DNA, 25 bp, Mus musculus
cagtctcagttcagaaaattccaga

SEQ ID NO: 416289 - DNA, 25 bp, Mus musculus
cagtctcgtgcttccattggccaaa

SEQ ID NO: 416290 - DNA, 25 bp, Mus musculus
cagtctctactgtgctgccgtgttt

SEQ ID NO: 416291 - DNA, 25 bp, Mus musculus
cagtctctcttgtgtacctgtggca

SEQ ID NO: 416292 - DNA, 25 bp, Mus musculus
cagtctctttgaatgtgacggtgtt

SEQ ID NO: 416293 - DNA, 25 bp, Mus musculus
cagtctgaacgagaaagtggagatc

SEQ ID NO: 416294 - DNA, 25 bp, Mus musculus
cagtctgaagtgcacagtggtcccc

SEQ ID NO: 416295 - DNA, 25 bp, Mus musculus
cagtctgacagtaggttgtttgcat

SEQ ID NO: 416296 - DNA, 25 bp, Mus musculus
cagtctgagcccagcttcgggtgga

SEQ ID NO: 416297 - DNA, 25 bp, Mus musculus
cagtctgatcaaaccaaacaggctt

SEQ ID NO: 416298 - DNA, 25 bp, Mus musculus
cagtctgattctgagagcccgcaag

SEQ ID NO: 416299 - DNA, 25 bp, Mus musculus
cagtctgattggattacacttcaag

SEQ ID NO: 416300 - DNA, 25 bp, Mus musculus
cagtctgcagaggacgacgatgcta

SEQ ID NO: 416301 - DNA, 25 bp, Mus musculus
cagtctgcggcttcatttaccgtga

SEQ ID NO: 416302 - DNA, 25 bp, Mus musculus
cagtctgcgggtgtggcccatcatg

SEQ ID NO: 416303 - DNA, 25 bp, Mus musculus
cagtctgctcacatggctgcctatg

SEQ ID NO: 416304 - DNA, 25 bp, Mus musculus
cagtctgctttctattaatgtatca

SEQ ID NO: 416305 - DNA, 25 bp, Mus musculus
cagtctggaacggagtcaagcttgg

SEQ ID NO: 416306 - DNA, 25 bp, Mus musculus
cagtctggcttgctcgggctgcaaa

SEQ ID NO: 416307 - DNA, 25 bp, Mus musculus
cagtctgggcactacatttgggtcc

SEQ ID NO: 416308 - DNA, 25 bp, Mus musculus
cagtctgtcttagaaatggctgcaa

SEQ ID NO: 416309 - DNA, 25 bp, Mus musculus
cagtctgtgttaatgcggtgctggc

SEQ ID NO: 416310 - DNA, 25 bp, Mus musculus
cagtctgtttcctcttcgagtcttc

SEQ ID NO: 416311 - DNA, 25 bp, Mus musculus
cagtcttagagaggacatggccgca

SEQ ID NO: 416312 - DNA, 25 bp, Mus musculus
cagtcttaggaggatccagtgggtc

SEQ ID NO: 416313 - DNA, 25 bp, Mus musculus
cagtcttatgatcatggaacttcta

SEQ ID NO: 416314 - DNA, 25 bp, Mus musculus
cagtcttccaactttaccgctggga

SEQ ID NO: 416315 - DNA, 25 bp, Mus musculus
cagtcttctgtgctcgttcctgggt

SEQ ID NO: 416316 - DNA, 25 bp, Mus musculus
cagtcttgaaaacccagctgtggct

SEQ ID NO: 416317 - DNA, 25 bp, Mus musculus
cagtcttgcaggtgtcccgagggca

SEQ ID NO: 416318 - DNA, 25 bp, Mus musculus
cagtgaaaaagcagatttactggag

SEQ ID NO: 416319 - DNA, 25 bp, Mus musculus
cagtgaaaagaaaggctggtgagcc

SEQ ID NO: 416320 - DNA, 25 bp, Mus musculus
cagtgaaaatgaaatgcgccggagt

SEQ ID NO: 416321 - DNA, 25 bp, Mus musculus
cagtgaaagaggaagcaaccccagt

SEQ ID NO: 416322 - DNA, 25 bp, Mus musculus
cagtgaaagttaagtgccgagtgct

SEQ ID NO: 416323 - DNA, 25 bp, Mus musculus
cagtgaacaaacagtacatctctgt

SEQ ID NO: 416324 - DNA, 25 bp, Mus musculus
cagtgaacaaggctgtttctgtgct

SEQ ID NO: 416325 - DNA, 25 bp, Mus musculus
cagtgaactgttttgacatcttgga

SEQ ID NO: 416326 - DNA, 25 bp, Mus musculus
cagtgaacttgctgggcgatgagaa

SEQ ID NO: 416327 - DNA, 25 bp, Mus musculus
cagtgaagaaggattacacagactt

SEQ ID NO: 416328 - DNA, 25 bp, Mus musculus
cagtgaagagccagaccgtgttgcc

SEQ ID NO: 416329 - DNA, 25 bp, Mus musculus
cagtgaagccaaagatgacagtcca

SEQ ID NO: 416330 - DNA, 25 bp, Mus musculus
cagtgaagccatacctcacgagagc

SEQ ID NO: 416331 - DNA, 25 bp, Mus musculus
cagtgaagcttcttacgcactaaag

SEQ ID NO: 416332 - DNA, 25 bp, Mus musculus
cagtgaaggagcagaccaatgcggc

SEQ ID NO: 416333 - DNA, 25 bp, Mus musculus
cagtgaagggaaggcaaacagaacc

SEQ ID NO: 416334 - DNA, 25 bp, Mus musculus
cagtgaagttcaagtcctcggcgac

SEQ ID NO: 416335 - DNA, 25 bp, Mus musculus
cagtgaataagcctggccagtcggc

SEQ ID NO: 416336 - DNA, 25 bp, Mus musculus
cagtgaatcgaacagcccctcttca

SEQ ID NO: 416337 - DNA, 25 bp, Mus musculus
cagtgaatgcgcaaggtctccggta

SEQ ID NO: 416338 - DNA, 25 bp, Mus musculus
cagtgaatgtgtagaggtctctctc

SEQ ID NO: 416339 - DNA, 25 bp, Mus musculus
cagtgaattaaagaggtggccccaa

SEQ ID NO: 416340 - DNA, 25 bp, Mus musculus
cagtgaattgacctcctccagaaag

SEQ ID NO: 416341 - DNA, 25 bp, Mus musculus
cagtgacaagacagtgtacccgggc

SEQ ID NO: 416342 - DNA, 25 bp, Mus musculus
cagtgacaatgactcggacagcggc

SEQ ID NO: 416343 - DNA, 25 bp, Mus musculus
cagtgacacacggaggctgctgtgt

SEQ ID NO: 416344 - DNA, 25 bp, Mus musculus
cagtgacacctttggtggaattttg

SEQ ID NO: 416345 - DNA, 25 bp, Mus musculus
cagtgacatggaggagactcggcac

SEQ ID NO: 416346 - DNA, 25 bp, Mus musculus
cagtgacccacaatgaccaggaaag

SEQ ID NO: 416347 - DNA, 25 bp, Mus musculus
cagtgacccctgctaaaactgaggt

SEQ ID NO: 416348 - DNA, 25 bp, Mus musculus
cagtgaccctttgcggctcaggata

SEQ ID NO: 416349 - DNA, 25 bp, Mus musculus
cagtgaccgccttagaatctcagag

SEQ ID NO: 416350 - DNA, 25 bp, Mus musculus
cagtgaccgggagattatagcaccc

SEQ ID NO: 416351 - DNA, 25 bp, Mus musculus
cagtgaccgttgttgaccgtggaac

SEQ ID NO: 416352 - DNA, 25 bp, Mus musculus
cagtgacctcttttatctattctaa

SEQ ID NO: 416353 - DNA, 25 bp, Mus musculus
cagtgaccttcagcgagacacgaga

SEQ ID NO: 416354 - DNA, 25 bp, Mus musculus
cagtgacgcagtctccaaagaaagg

SEQ ID NO: 416355 - DNA, 25 bp, Mus musculus
cagtgacggtgccatcggccattac

SEQ ID NO: 416356 - DNA, 25 bp, Mus musculus
cagtgactacgtgaaggacatctac

SEQ ID NO: 416357 - DNA, 25 bp, Mus musculus
cagtgactcggagcgtttgaaacgc

SEQ ID NO: 416358 - DNA, 25 bp, Mus musculus
cagtgactctcgtccttctggaaga

SEQ ID NO: 416359 - DNA, 25 bp, Mus musculus
cagtgactgcatacacgaggctgtc

SEQ ID NO: 416360 - DNA, 25 bp, Mus musculus
cagtgactggctggcttactcggag

SEQ ID NO: 416361 - DNA, 25 bp, Mus musculus
cagtgactgggttggactgagtatc

SEQ ID NO: 416362 - DNA, 25 bp, Mus musculus
cagtgacttaggttctaatgggaca

SEQ ID NO: 416363 - DNA, 25 bp, Mus musculus
cagtgagaaaaagaccggaggtagc

SEQ ID NO: 416364 - DNA, 25 bp, Mus musculus
cagtgagacaagtggtatgtacccc

SEQ ID NO: 416365 - DNA, 25 bp, Mus musculus
cagtgagactggcaacgggaaacac

SEQ ID NO: 416366 - DNA, 25 bp, Mus musculus
cagtgagagcctatcaaagcagcaa

SEQ ID NO: 416367 - DNA, 25 bp, Mus musculus
cagtgagagtcatcttcaaggacac

SEQ ID NO: 416368 - DNA, 25 bp, Mus musculus
cagtgagcaggccaaagtccattcc

SEQ ID NO: 416369 - DNA, 25 bp, Mus musculus
cagtgagcatcgctaccaagaggcg

SEQ ID NO: 416370 - DNA, 25 bp, Mus musculus
cagtgagccacgagacttcatcgat

SEQ ID NO: 416371 - DNA, 25 bp, Mus musculus
cagtgagccgagcattggagtacaa

SEQ ID NO: 416372 - DNA, 25 bp, Mus musculus
cagtgagcgcgcacaggaacaggac

SEQ ID NO: 416373 - DNA, 25 bp, Mus musculus
cagtgagctagacttttcccttttc

SEQ ID NO: 416374 - DNA, 25 bp, Mus musculus
cagtgaggatgaagcacgtgctgcc

SEQ ID NO: 416375 - DNA, 25 bp, Mus musculus
cagtgaggtagcatgtttccttgac

SEQ ID NO: 416376 - DNA, 25 bp, Mus musculus
cagtgaggtgctatccgacatgaca

SEQ ID NO: 416377 - DNA, 25 bp, Mus musculus
cagtgaggtggtcagcttggagcac

SEQ ID NO: 416378 - DNA, 25 bp, Mus musculus
cagtgagtatcagggcaaggtgtcc

SEQ ID NO: 416379 - DNA, 25 bp, Mus musculus
cagtgagtcgattctgcaagggaac

SEQ ID NO: 416380 - DNA, 25 bp, Mus musculus
cagtgagtgaccaaggtccttgtcc

SEQ ID NO: 416381 - DNA, 25 bp, Mus musculus
cagtgagttcaaatttgtaagggcc

SEQ ID NO: 416382 - DNA, 25 bp, Mus musculus
cagtgagttctcatgtccagttcct

SEQ ID NO: 416383 - DNA, 25 bp, Mus musculus
cagtgagttgagtgtttgctaccca

SEQ ID NO: 416384 - DNA, 25 bp, Mus musculus
cagtgataggcgtagtgacagtgac

SEQ ID NO: 416385 - DNA, 25 bp, Mus musculus
cagtgatcttgtggaactggcccca

SEQ ID NO: 416386 - DNA, 25 bp, Mus musculus
cagtgatgatgcatggaggacagcc

SEQ ID NO: 416387 - DNA, 25 bp, Mus musculus
cagtgatgcacaggagttgcttgac

SEQ ID NO: 416388 - DNA, 25 bp, Mus musculus
cagtgatggtgctggcgaattctca

SEQ ID NO: 416389 - DNA, 25 bp, Mus musculus
cagtgatgtaccgtgccaagaaagc

SEQ ID NO: 416390 - DNA, 25 bp, Mus musculus
cagtgatgtgccagtccaaggattt

SEQ ID NO: 416391 - DNA, 25 bp, Mus musculus
cagtgattccgtgtcttttaaagca

SEQ ID NO: 416392 - DNA, 25 bp, Mus musculus
cagtgattctcattggtctgaagac

SEQ ID NO: 416393 - DNA, 25 bp, Mus musculus
cagtgattgactacgtgaagccctc

SEQ ID NO: 416394 - DNA, 25 bp, Mus musculus
cagtgattgatgaccgaccagcaga

SEQ ID NO: 416395 - DNA, 25 bp, Mus musculus
cagtgattggcctacagctccagaa

SEQ ID NO: 416396 - DNA, 25 bp, Mus musculus
cagtgatttaggcacccgctttgca

SEQ ID NO: 416397 - DNA, 25 bp, Mus musculus
cagtgatttcccacggtttccggag

SEQ ID NO: 416398 - DNA, 25 bp, Mus musculus
cagtgatttctgaactttccccaag

SEQ ID NO: 416399 - DNA, 25 bp, Mus musculus
cagtgcaacgcggtaaagacgggaa

SEQ ID NO: 416400 - DNA, 25 bp, Mus musculus
cagtgcacgggacattttcagtaaa

SEQ ID NO: 416401 - DNA, 25 bp, Mus musculus
cagtgcagagtccatcttcagaaac

SEQ ID NO: 416402 - DNA, 25 bp, Mus musculus
cagtgcagcgagaatagcgaagtca

SEQ ID NO: 416403 - DNA, 25 bp, Mus musculus
cagtgcagctacttacaccagggcg

SEQ ID NO: 416404 - DNA, 25 bp, Mus musculus
cagtgcaggccctcatggtgctgtc

SEQ ID NO: 416405 - DNA, 25 bp, Mus musculus
cagtgcatatgtctgcggaccgcag

SEQ ID NO: 416406 - DNA, 25 bp, Mus musculus
cagtgcatgctgtcccttacgtgag

SEQ ID NO: 416407 - DNA, 25 bp, Mus musculus
cagtgccaaaaggtagccagccgtt

SEQ ID NO: 416408 - DNA, 25 bp, Mus musculus
cagtgccaaagaagatgcaattgcc

SEQ ID NO: 416409 - DNA, 25 bp, Mus musculus
cagtgccaagcgcatcgaaagggtc

SEQ ID NO: 416410 - DNA, 25 bp, Mus musculus
cagtgccacaaacagggatgggcca

SEQ ID NO: 416411 - DNA, 25 bp, Mus musculus
cagtgccacgatgggtcagctgtac

SEQ ID NO: 416412 - DNA, 25 bp, Mus musculus
cagtgccacgtgatcccacagatgt

SEQ ID NO: 416413 - DNA, 25 bp, Mus musculus
cagtgccactgtcaaaagagccaag

SEQ ID NO: 416414 - DNA, 25 bp, Mus musculus
cagtgccagcgtttcctcacggaag

SEQ ID NO: 416415 - DNA, 25 bp, Mus musculus
cagtgccatctgtccctgaggcagc

SEQ ID NO: 416416 - DNA, 25 bp, Mus musculus
cagtgccatgcccaagtgatgagga

SEQ ID NO: 416417 - DNA, 25 bp, Mus musculus
cagtgcccaaatgcagtagtcctct

SEQ ID NO: 416418 - DNA, 25 bp, Mus musculus
cagtgcccacgggtcccagaggtgt

SEQ ID NO: 416419 - DNA, 25 bp, Mus musculus
cagtgcccagtttgaaaatagtacc

SEQ ID NO: 416420 - DNA, 25 bp, Mus musculus
cagtgcccggtttgccgcatttaca

SEQ ID NO: 416421 - DNA, 25 bp, Mus musculus
cagtgcccttagagtccagatgtga

SEQ ID NO: 416422 - DNA, 25 bp, Mus musculus
cagtgccgcagagctgttttacaga

SEQ ID NO: 416423 - DNA, 25 bp, Mus musculus
cagtgccgccgaaagagctatgggc

SEQ ID NO: 416424 - DNA, 25 bp, Mus musculus
cagtgccgcgcatctctatggatat

SEQ ID NO: 416425 - DNA, 25 bp, Mus musculus
cagtgccgctgggatgactctgtca

SEQ ID NO: 416426 - DNA, 25 bp, Mus musculus
cagtgcctaaagaacagctccggag

SEQ ID NO: 416427 - DNA, 25 bp, Mus musculus
cagtgcctatcttgtgggacagaga

SEQ ID NO: 416428 - DNA, 25 bp, Mus musculus
cagtgcctccttcttacctagagat

SEQ ID NO: 416429 - DNA, 25 bp, Mus musculus
cagtgcctgcggcagcgttggcctt

SEQ ID NO: 416430 - DNA, 25 bp, Mus musculus
cagtgcctggtgctactttcatatg

SEQ ID NO: 416431 - DNA, 25 bp, Mus musculus
cagtgcctgtccttcgagggctgag

SEQ ID NO: 416432 - DNA, 25 bp, Mus musculus
cagtgcctgtcgaagtgctggccaa

SEQ ID NO: 416433 - DNA, 25 bp, Mus musculus
cagtgcctgtgacatagcttagcaa

SEQ ID NO: 416434 - DNA, 25 bp, Mus musculus
cagtgcctgtgctcacaaagtgggg

SEQ ID NO: 416435 - DNA, 25 bp, Mus musculus
cagtgcctttcatgctagacatggc

SEQ ID NO: 416436 - DNA, 25 bp, Mus musculus
cagtgcgaccgattttcccaggagg

SEQ ID NO: 416437 - DNA, 25 bp, Mus musculus
cagtgcgagcgaaaacacagccttt

SEQ ID NO: 416438 - DNA, 25 bp, Mus musculus
cagtgcgagtcctctgttggaaagc

SEQ ID NO: 416439 - DNA, 25 bp, Mus musculus
cagtgcgccgccgattaaagaaagg

SEQ ID NO: 416440 - DNA, 25 bp, Mus musculus
cagtgcgccttttgctaggagtgtc

SEQ ID NO: 416441 - DNA, 25 bp, Mus musculus
cagtgcgctcaagtcagtggtggcc

SEQ ID NO: 416442 - DNA, 25 bp, Mus musculus
cagtgctacaaattaaggcttaccg

SEQ ID NO: 416443 - DNA, 25 bp, Mus musculus
cagtgctagatataaatgatgtcaa

SEQ ID NO: 416444 - DNA, 25 bp, Mus musculus
cagtgctatagtgtgggaaggtaac

SEQ ID NO: 416445 - DNA, 25 bp, Mus musculus
cagtgctcaccagagaggatgggct

SEQ ID NO: 416446 - DNA, 25 bp, Mus musculus
cagtgctctgagctttggtcccaga

SEQ ID NO: 416447 - DNA, 25 bp, Mus musculus
cagtgctggcccgattgaacagtga

SEQ ID NO: 416448 - DNA, 25 bp, Mus musculus
cagtgctggccgaggtgaacattaa

SEQ ID NO: 416449 - DNA, 25 bp, Mus musculus
cagtgctgggagcaataatttcttt

SEQ ID NO: 416450 - DNA, 25 bp, Mus musculus
cagtgctggtcaataggctccttgg

SEQ ID NO: 416451 - DNA, 25 bp, Mus musculus
cagtgctggtggaaacttagccgca

SEQ ID NO: 416452 - DNA, 25 bp, Mus musculus
cagtgctgtcacgaggcatggaggc

SEQ ID NO: 416453 - DNA, 25 bp, Mus musculus
cagtgctgtcgaaaagcccagggta

SEQ ID NO: 416454 - DNA, 25 bp, Mus musculus
cagtgctgtggcaacaagctgagga

SEQ ID NO: 416455 - DNA, 25 bp, Mus musculus
cagtgctgtgggagaaacttgaagt

SEQ ID NO: 416456 - DNA, 25 bp, Mus musculus
cagtgcttcaggattgcgttcgaca

SEQ ID NO: 416457 - DNA, 25 bp, Mus musculus
cagtgcttccgggtatgtagcccca

SEQ ID NO: 416458 - DNA, 25 bp, Mus musculus
cagtgcttctcaaggcctccatttc

SEQ ID NO: 416459 - DNA, 25 bp, Mus musculus
cagtgcttctgcagacctcagagcc

SEQ ID NO: 416460 - DNA, 25 bp, Mus musculus
cagtggaaacactacctctagaggc

SEQ ID NO: 416461 - DNA, 25 bp, Mus musculus
cagtggaaatggatccgagggccca

SEQ ID NO: 416462 - DNA, 25 bp, Mus musculus
cagtggaacagagatagcagcttgg

SEQ ID NO: 416463 - DNA, 25 bp, Mus musculus
cagtggaaccccagcccaagggtgt

SEQ ID NO: 416464 - DNA, 25 bp, Mus musculus
cagtggaagaaatgcacctctgcac

SEQ ID NO: 416465 - DNA, 25 bp, Mus musculus
cagtggaagacctggttgcagccaa

SEQ ID NO: 416466 - DNA, 25 bp, Mus musculus
cagtggaaggtgattactgaactgt

SEQ ID NO: 416467 - DNA, 25 bp, Mus musculus
cagtggaagttcatcatgtgccgga

SEQ ID NO: 416468 - DNA, 25 bp, Mus musculus
cagtggaccgcatcctaaaagcaag

SEQ ID NO: 416469 - DNA, 25 bp, Mus musculus
cagtggacctaggactctacaggct

SEQ ID NO: 416470 - DNA, 25 bp, Mus musculus
cagtggagaccccaaagatcctgct

SEQ ID NO: 416471 - DNA, 25 bp, Mus musculus
cagtggagactagaccggagcacgt

SEQ ID NO: 416472 - DNA, 25 bp, Mus musculus
cagtggagactttgatgacgggcac

SEQ ID NO: 416473 - DNA, 25 bp, Mus musculus
cagtggagaggtgtctgtcctgctt

SEQ ID NO: 416474 - DNA, 25 bp, Mus musculus
cagtggagcactgtcagtataggcc

SEQ ID NO: 416475 - DNA, 25 bp, Mus musculus
cagtggagcatcacacagagtttac

SEQ ID NO: 416476 - DNA, 25 bp, Mus musculus
cagtggagctccaatgacctggtag

SEQ ID NO: 416477 - DNA, 25 bp, Mus musculus
cagtggaggccatgtttcttcgttc

SEQ ID NO: 416478 - DNA, 25 bp, Mus musculus
cagtggaggcgctcaaagactctct

SEQ ID NO: 416479 - DNA, 25 bp, Mus musculus
cagtggaggtgacatcctgtgaaca

SEQ ID NO: 416480 - DNA, 25 bp, Mus musculus
cagtggagtccgaaagatcagcaga

SEQ ID NO: 416481 - DNA, 25 bp, Mus musculus
cagtggataatccaggatccctgaa

SEQ ID NO: 416482 - DNA, 25 bp, Mus musculus
cagtggatactgtagctctgggata

SEQ ID NO: 416483 - DNA, 25 bp, Mus musculus
cagtggatcatggatcatggacttc

SEQ ID NO: 416484 - DNA, 25 bp, Mus musculus
cagtggatcgccttgctacaaagag

SEQ ID NO: 416485 - DNA, 25 bp, Mus musculus
cagtggatctaaggctgtccatggc

SEQ ID NO: 416486 - DNA, 25 bp, Mus musculus
cagtggatggagtaaacaagcttcg

SEQ ID NO: 416487 - DNA, 25 bp, Mus musculus
cagtggattatcagaggaacctttg

SEQ ID NO: 416488 - DNA, 25 bp, Mus musculus
cagtggatttgatcgccatcggcag

SEQ ID NO: 416489 - DNA, 25 bp, Mus musculus
cagtggcaaagtaagttggaaagcg

SEQ ID NO: 416490 - DNA, 25 bp, Mus musculus
cagtggcaacacagaagtccctgga

SEQ ID NO: 416491 - DNA, 25 bp, Mus musculus
cagtggcaagaaagcggataccctc

SEQ ID NO: 416492 - DNA, 25 bp, Mus musculus
cagtggcaagccctatgttaagagc

SEQ ID NO: 416493 - DNA, 25 bp, Mus musculus
cagtggcaccctcttgacatgagcg

SEQ ID NO: 416494 - DNA, 25 bp, Mus musculus
cagtggcacggtactttgggatcaa

SEQ ID NO: 416495 - DNA, 25 bp, Mus musculus
cagtggcactgtcagcagctttgaa

SEQ ID NO: 416496 - DNA, 25 bp, Mus musculus
cagtggcacttccaaaaagctggca

SEQ ID NO: 416497 - DNA, 25 bp, Mus musculus
cagtggcagaatcatgtgggcacct

SEQ ID NO: 416498 - DNA, 25 bp, Mus musculus
cagtggccaacaagaccgtggagga

SEQ ID NO: 416499 - DNA, 25 bp, Mus musculus
cagtggccacggctacgaagtgcta

SEQ ID NO: 416500 - DNA, 25 bp, Mus musculus
cagtggccagacacactcaagtgcg

SEQ ID NO: 416501 - DNA, 25 bp, Mus musculus
cagtggccagcaacttaccttctgg

SEQ ID NO: 416502 - DNA, 25 bp, Mus musculus
cagtggccccgtgtttgtcaaggtc

SEQ ID NO: 416503 - DNA, 25 bp, Mus musculus
cagtggcctaagaatggacctccca

SEQ ID NO: 416504 - DNA, 25 bp, Mus musculus
cagtggcctggagtacttacctcag

SEQ ID NO: 416505 - DNA, 25 bp, Mus musculus
cagtggcggctctcgggctttgctt

SEQ ID NO: 416506 - DNA, 25 bp, Mus musculus
cagtggctactcctcaagcttcaaa

SEQ ID NO: 416507 - DNA, 25 bp, Mus musculus
cagtggctagctcttgccctccatt

SEQ ID NO: 416508 - DNA, 25 bp, Mus musculus
cagtggctatatctccctcaaggag

SEQ ID NO: 416509 - DNA, 25 bp, Mus musculus
cagtggctctttggctagtggatcc

SEQ ID NO: 416510 - DNA, 25 bp, Mus musculus
cagtggctgagcatggagctgtccc

SEQ ID NO: 416511 - DNA, 25 bp, Mus musculus
cagtggctgctgacctagaaatggc

SEQ ID NO: 416512 - DNA, 25 bp, Mus musculus
cagtggctggaagtacgtcttagat

SEQ ID NO: 416513 - DNA, 25 bp, Mus musculus
cagtggctggacatgaaggttcctc

SEQ ID NO: 416514 - DNA, 25 bp, Mus musculus
cagtggcttaccagcttggcagaca

SEQ ID NO: 416515 - DNA, 25 bp, Mus musculus
cagtggcttcagatccctggattgt

SEQ ID NO: 416516 - DNA, 25 bp, Mus musculus
cagtggcttccagtataacccgata

SEQ ID NO: 416517 - DNA, 25 bp, Mus musculus
cagtggcttccggtctcagagttta

SEQ ID NO: 416518 - DNA, 25 bp, Mus musculus
cagtgggacacaacaggcctttaca

SEQ ID NO: 416519 - DNA, 25 bp, Mus musculus
cagtgggacacggttgcctagggtt

SEQ ID NO: 416520 - DNA, 25 bp, Mus musculus
cagtgggagccattagtctaaccta

SEQ ID NO: 416521 - DNA, 25 bp, Mus musculus
cagtgggatctgtcagagcagagac

SEQ ID NO: 416522 - DNA, 25 bp, Mus musculus
cagtgggcagtggatgcctgcacca

SEQ ID NO: 416523 - DNA, 25 bp, Mus musculus
cagtgggccatcacatctcaggagg

SEQ ID NO: 416524 - DNA, 25 bp, Mus musculus
cagtgggcccacatgaagtcaggag

SEQ ID NO: 416525 - DNA, 25 bp, Mus musculus
cagtgggtggacaagacgccattta

SEQ ID NO: 416526 - DNA, 25 bp, Mus musculus
cagtgggttatgtattcaatgtatc

SEQ ID NO: 416527 - DNA, 25 bp, Mus musculus
cagtgggttttcaagacgaccagac

SEQ ID NO: 416528 - DNA, 25 bp, Mus musculus
cagtggtacatctatgggttcagcc

SEQ ID NO: 416529 - DNA, 25 bp, Mus musculus
cagtggtatggcatatgacagccgg

SEQ ID NO: 416530 - DNA, 25 bp, Mus musculus
cagtggtcacctgaatgagcaggag

SEQ ID NO: 416531 - DNA, 25 bp, Mus musculus
cagtggtcagaggagggtgtagcgt

SEQ ID NO: 416532 - DNA, 25 bp, Mus musculus
cagtggtccaagctagtttctcgaa

SEQ ID NO: 416533 - DNA, 25 bp, Mus musculus
cagtggtccattgcagccgaggttt

SEQ ID NO: 416534 - DNA, 25 bp, Mus musculus
cagtggtccctcaaagtagtagaag

SEQ ID NO: 416535 - DNA, 25 bp, Mus musculus
cagtggtccgaagggaggaataatc

SEQ ID NO: 416536 - DNA, 25 bp, Mus musculus
cagtggtctctgaagcgctatggtc

SEQ ID NO: 416537 - DNA, 25 bp, Mus musculus
cagtggtgcaaatatcatgtgcccg

SEQ ID NO: 416538 - DNA, 25 bp, Mus musculus
cagtggtgcatgagatagcctatca

SEQ ID NO: 416539 - DNA, 25 bp, Mus musculus
cagtggtgggcctctcatgtgcaga

SEQ ID NO: 416540 - DNA, 25 bp, Mus musculus
cagtggttaagcatgctggttgctc

SEQ ID NO: 416541 - DNA, 25 bp, Mus musculus
cagtggttatcaggagcagatggtc

SEQ ID NO: 416542 - DNA, 25 bp, Mus musculus
cagtggttccccttcaggctggtga

SEQ ID NO: 416543 - DNA, 25 bp, Mus musculus
cagtggttcctgaaaggcgagtgcc

SEQ ID NO: 416544 - DNA, 25 bp, Mus musculus
cagtggtttgcactctgcaggctcc

SEQ ID NO: 416545 - DNA, 25 bp, Mus musculus
cagtgtaaacgctgcactgagcgac

SEQ ID NO: 416546 - DNA, 25 bp, Mus musculus
cagtgtaaaggaagagctgagccct

SEQ ID NO: 416547 - DNA, 25 bp, Mus musculus
cagtgtaaaggccaaagctccagga

SEQ ID NO: 416548 - DNA, 25 bp, Mus musculus
cagtgtaacagtgatggagcttagc

SEQ ID NO: 416549 - DNA, 25 bp, Mus musculus
cagtgtaagaatgaattaagtcaaa

SEQ ID NO: 416550 - DNA, 25 bp, Mus musculus
cagtgtaagagtcaggaaagcctgt

SEQ ID NO: 416551 - DNA, 25 bp, Mus musculus
cagtgtactatgaagaaagcaaacc

SEQ ID NO: 416552 - DNA, 25 bp, Mus musculus
cagtgtactggagcagactgaagac

SEQ ID NO: 416553 - DNA, 25 bp, Mus musculus
cagtgtactgggacttcgaggcgaa

SEQ ID NO: 416554 - DNA, 25 bp, Mus musculus
cagtgtaggaagtggcatgcgaaaa

SEQ ID NO: 416555 - DNA, 25 bp, Mus musculus
cagtgtatacacctgccttgttgaa

SEQ ID NO: 416556 - DNA, 25 bp, Mus musculus
cagtgtatgccatgcgtgtcgggaa

SEQ ID NO: 416557 - DNA, 25 bp, Mus musculus
cagtgtcaagaaataccggcccaaa

SEQ ID NO: 416558 - DNA, 25 bp, Mus musculus
cagtgtcagcccaaccatggatggg

SEQ ID NO: 416559 - DNA, 25 bp, Mus musculus
cagtgtcagctgtacgagggccaga

SEQ ID NO: 416560 - DNA, 25 bp, Mus musculus
cagtgtcagggaagatacaagttga

SEQ ID NO: 416561 - DNA, 25 bp, Mus musculus
cagtgtcaggtgaccagtctccaag

SEQ ID NO: 416562 - DNA, 25 bp, Mus musculus
cagtgtcagtggttctgttggccaa

SEQ ID NO: 416563 - DNA, 25 bp, Mus musculus
cagtgtccattacttgtcttctaag

SEQ ID NO: 416564 - DNA, 25 bp, Mus musculus
cagtgtcccatagaggttccagaag

SEQ ID NO: 416565 - DNA, 25 bp, Mus musculus
cagtgtcccggtctgtaaaaagagc

SEQ ID NO: 416566 - DNA, 25 bp, Mus musculus
cagtgtccctatgcttgtgcccaga

SEQ ID NO: 416567 - DNA, 25 bp, Mus musculus
cagtgtccgattttgcttggtgtta

SEQ ID NO: 416568 - DNA, 25 bp, Mus musculus
cagtgtcctctgtgaatggtaccca

SEQ ID NO: 416569 - DNA, 25 bp, Mus musculus
cagtgtctaagcagcgatgggttca

SEQ ID NO: 416570 - DNA, 25 bp, Mus musculus
cagtgtctacagcagtgccttggca

SEQ ID NO: 416571 - DNA, 25 bp, Mus musculus
cagtgtctgctgagaagggaaactc

SEQ ID NO: 416572 - DNA, 25 bp, Mus musculus
cagtgtctggaggtgtatgtgtccc

SEQ ID NO: 416573 - DNA, 25 bp, Mus musculus
cagtgtcttcgatgtggttgccaac

SEQ ID NO: 416574 - DNA, 25 bp, Mus musculus
cagtgtctttgccagggtctcctac

SEQ ID NO: 416575 - DNA, 25 bp, Mus musculus
cagtgtgaagccaggattccccaaa

SEQ ID NO: 416576 - DNA, 25 bp, Mus musculus
cagtgtgactccctcccatagctac

SEQ ID NO: 416577 - DNA, 25 bp, Mus musculus
cagtgtgacttcaggtggcaacccc

SEQ ID NO: 416578 - DNA, 25 bp, Mus musculus
cagtgtgcacctaccgggagctgcg

SEQ ID NO: 416579 - DNA, 25 bp, Mus musculus
cagtgtgcagttaggcaggactcct

SEQ ID NO: 416580 - DNA, 25 bp, Mus musculus
cagtgtgcccatggaaacgtgagca

SEQ ID NO: 416581 - DNA, 25 bp, Mus musculus
cagtgtgccctgaagcagtgctgcg

SEQ ID NO: 416582 - DNA, 25 bp, Mus musculus
cagtgtgcctgtaccagagtttgcg

SEQ ID NO: 416583 - DNA, 25 bp, Mus musculus
cagtgtgcgcaccaagtcgagtgtc

SEQ ID NO: 416584 - DNA, 25 bp, Mus musculus
cagtgtgctagcgtacaggtgatcc

SEQ ID NO: 416585 - DNA, 25 bp, Mus musculus
cagtgtgctcacttctcacgtgtgg

SEQ ID NO: 416586 - DNA, 25 bp, Mus musculus
cagtgtggagccctagaatgtcagc

SEQ ID NO: 416587 - DNA, 25 bp, Mus musculus
cagtgtggctgtgttggtagcctca

SEQ ID NO: 416588 - DNA, 25 bp, Mus musculus
cagtgtgggcgtgcactgacagccc

SEQ ID NO: 416589 - DNA, 25 bp, Mus musculus
cagtgtggtggatcggaagaaccca

SEQ ID NO: 416590 - DNA, 25 bp, Mus musculus
cagtgtgtactctgcctgcaacgca

SEQ ID NO: 416591 - DNA, 25 bp, Mus musculus
cagtgtgtgacaggcagagtcgtcc

SEQ ID NO: 416592 - DNA, 25 bp, Mus musculus
cagtgtgttaccctcagattcatga

SEQ ID NO: 416593 - DNA, 25 bp, Mus musculus
cagtgttaacttcggaatccagtcc

SEQ ID NO: 416594 - DNA, 25 bp, Mus musculus
cagtgttacaagaggaaccgctgca

SEQ ID NO: 416595 - DNA, 25 bp, Mus musculus
cagtgttcagatccagaagtcaggg

SEQ ID NO: 416596 - DNA, 25 bp, Mus musculus
cagtgttcctccgagtgcggcatta

SEQ ID NO: 416597 - DNA, 25 bp, Mus musculus
cagtgttccttcagctgggactggg

SEQ ID NO: 416598 - DNA, 25 bp, Mus musculus
cagtgttctcctccctcatgctgga

SEQ ID NO: 416599 - DNA, 25 bp, Mus musculus
cagtgttctggttggtaaggcctca

SEQ ID NO: 416600 - DNA, 25 bp, Mus musculus
cagtgttgcagttagctggacttgg

SEQ ID NO: 416601 - DNA, 25 bp, Mus musculus
cagtgtttgcccatagccgggaagc

SEQ ID NO: 416602 - DNA, 25 bp, Mus musculus
cagtgtttgcttctctgatcgctga

SEQ ID NO: 416603 - DNA, 25 bp, Mus musculus
cagtgtttgggtttcctcgcagccg

SEQ ID NO: 416604 - DNA, 25 bp, Mus musculus
cagtgttttagaatcatcgtgtgag

SEQ ID NO: 416605 - DNA, 25 bp, Mus musculus
cagtgttttagcaagcacgaggcac

SEQ ID NO: 416606 - DNA, 25 bp, Mus musculus
cagtgttttcatgacgagtccctat

SEQ ID NO: 416607 - DNA, 25 bp, Mus musculus
cagttaaaacgtgcaaaaggttcag

SEQ ID NO: 416608 - DNA, 25 bp, Mus musculus
cagttaaaagctgtctggactcaca

SEQ ID NO: 416609 - DNA, 25 bp, Mus musculus
cagttaaactgcagctgggtggacc

SEQ ID NO: 416610 - DNA, 25 bp, Mus musculus
cagttaaccagatgacacgctgcta

SEQ ID NO: 416611 - DNA, 25 bp, Mus musculus
cagttaagagtggacagagcgacag

SEQ ID NO: 416612 - DNA, 25 bp, Mus musculus
cagttaagccttctcttggcggaga

SEQ ID NO: 416613 - DNA, 25 bp, Mus musculus
cagttaaggctggtgtccccattgg

SEQ ID NO: 416614 - DNA, 25 bp, Mus musculus
cagttaataacctcaggacaggcca

SEQ ID NO: 416615 - DNA, 25 bp, Mus musculus
cagttaatcgaggaaatgtccccac

SEQ ID NO: 416616 - DNA, 25 bp, Mus musculus
cagttaatctccgatttcagcgagc

SEQ ID NO: 416617 - DNA, 25 bp, Mus musculus
cagttacactgctgagggagaaaca

SEQ ID NO: 416618 - DNA, 25 bp, Mus musculus
cagttacagattgccagcctagggt

SEQ ID NO: 416619 - DNA, 25 bp, Mus musculus
cagttacagttttctatggtaccag

SEQ ID NO: 416620 - DNA, 25 bp, Mus musculus
cagttacatcctttgacattcttgc

SEQ ID NO: 416621 - DNA, 25 bp, Mus musculus
cagttacccaggagctctcgctgag

SEQ ID NO: 416622 - DNA, 25 bp, Mus musculus
cagttacctgttccaccaaagtgtg

SEQ ID NO: 416623 - DNA, 25 bp, Mus musculus
cagttacgacttggaggatccttga

SEQ ID NO: 416624 - DNA, 25 bp, Mus musculus
cagttacgggctccatcatgaggac

SEQ ID NO: 416625 - DNA, 25 bp, Mus musculus
cagttagaccttcccgcttttgctc

SEQ ID NO: 416626 - DNA, 25 bp, Mus musculus
cagttagatgtcagtgcgctcacca

SEQ ID NO: 416627 - DNA, 25 bp, Mus musculus
cagttagcgactgggccaacactta

SEQ ID NO: 416628 - DNA, 25 bp, Mus musculus
cagttaggagtttgcctgctgcacc

SEQ ID NO: 416629 - DNA, 25 bp, Mus musculus
cagttagtaacgagaccttgggcag

SEQ ID NO: 416630 - DNA, 25 bp, Mus musculus
cagttagtggcagatcacccagtgg

SEQ ID NO: 416631 - DNA, 25 bp, Mus musculus
cagttatactttgagcacctacagg

SEQ ID NO: 416632 - DNA, 25 bp, Mus musculus
cagttatagaattaaatgagtcagt

SEQ ID NO: 416633 - DNA, 25 bp, Mus musculus
cagttatagtttgagggagaatgaa

SEQ ID NO: 416634 - DNA, 25 bp, Mus musculus
cagttatcgacccagagtcaggcaa

SEQ ID NO: 416635 - DNA, 25 bp, Mus musculus
cagttatcgtagcacctcagcagca

SEQ ID NO: 416636 - DNA, 25 bp, Mus musculus
cagttatgtaatgatttgacttcac

SEQ ID NO: 416637 - DNA, 25 bp, Mus musculus
cagttattactcacagaagggccac

SEQ ID NO: 416638 - DNA, 25 bp, Mus musculus
cagttattcagtatcccaggtgctc

SEQ ID NO: 416639 - DNA, 25 bp, Mus musculus
cagttcaaattggtcctgctgggag

SEQ ID NO: 416640 - DNA, 25 bp, Mus musculus
cagttcaacatatgggaccgcgtcc

SEQ ID NO: 416641 - DNA, 25 bp, Mus musculus
cagttcaactggactgaagaaggca

SEQ ID NO: 416642 - DNA, 25 bp, Mus musculus
cagttcacagatcgttacccagagc

SEQ ID NO: 416643 - DNA, 25 bp, Mus musculus
cagttcacagctcgataccatgcag

SEQ ID NO: 416644 - DNA, 25 bp, Mus musculus
cagttcacaggtttagtcagtcacc

SEQ ID NO: 416645 - DNA, 25 bp, Mus musculus
cagttcacataggatatgaatggtg

SEQ ID NO: 416646 - DNA, 25 bp, Mus musculus
cagttcaccaacttctaggttaaag

SEQ ID NO: 416647 - DNA, 25 bp, Mus musculus
cagttcaccgtgtttggcagcgcga

SEQ ID NO: 416648 - DNA, 25 bp, Mus musculus
cagttcagaatgcaagactctgccc

SEQ ID NO: 416649 - DNA, 25 bp, Mus musculus
cagttcagctgtatgtgggtgccta

SEQ ID NO: 416650 - DNA, 25 bp, Mus musculus
cagttcaggacactgtgaaaagacc

SEQ ID NO: 416651 - DNA, 25 bp, Mus musculus
cagttcaggccaggagcaggctttc

SEQ ID NO: 416652 - DNA, 25 bp, Mus musculus
cagttcagtgtctcgtcttccagag

SEQ ID NO: 416653 - DNA, 25 bp, Mus musculus
cagttcatcagctaatttccatgtg

SEQ ID NO: 416654 - DNA, 25 bp, Mus musculus
cagttcatcgctttgtttgctttca

SEQ ID NO: 416655 - DNA, 25 bp, Mus musculus
cagttcatgaacaagagtctttcgg

SEQ ID NO: 416656 - DNA, 25 bp, Mus musculus
cagttcatgcacagagggtcagttc

SEQ ID NO: 416657 - DNA, 25 bp, Mus musculus
cagttcatggttggtaacaaggtgc

SEQ ID NO: 416658 - DNA, 25 bp, Mus musculus
cagttcattcacaagcctacacaac

SEQ ID NO: 416659 - DNA, 25 bp, Mus musculus
cagttccacggaagctcgggatgaa

SEQ ID NO: 416660 - DNA, 25 bp, Mus musculus
cagttccaggcactatatacctcgg

SEQ ID NO: 416661 - DNA, 25 bp, Mus musculus
cagttccaggtgttgctgcccaagg

SEQ ID NO: 416662 - DNA, 25 bp, Mus musculus
cagttccctcactgtctggtcaggg

SEQ ID NO: 416663 - DNA, 25 bp, Mus musculus
cagttccgagacgtggcaggtgaca

SEQ ID NO: 416664 - DNA, 25 bp, Mus musculus
cagttccgcacttgtttgccaggga

SEQ ID NO: 416665 - DNA, 25 bp, Mus musculus
cagttccgtagtagtggttagtcca

SEQ ID NO: 416666 - DNA, 25 bp, Mus musculus
cagttcctcccaagagtgtccgagg

SEQ ID NO: 416667 - DNA, 25 bp, Mus musculus
cagttcctttctggagaatctagag

SEQ ID NO: 416668 - DNA, 25 bp, Mus musculus
cagttcgaacacaataaggcgtcca

SEQ ID NO: 416669 - DNA, 25 bp, Mus musculus
cagttcgaatttgtgggctccgccc

SEQ ID NO: 416670 - DNA, 25 bp, Mus musculus
cagttcgacaaaccagacggcagta

SEQ ID NO: 416671 - DNA, 25 bp, Mus musculus
cagttcgaggagctatataaatcgg

SEQ ID NO: 416672 - DNA, 25 bp, Mus musculus
cagttcgctacgtggtgatctcaca

SEQ ID NO: 416673 - DNA, 25 bp, Mus musculus
cagttcggaaatgtaacggacagcc

SEQ ID NO: 416674 - DNA, 25 bp, Mus musculus
cagttctacgtggaagggctcgcct

SEQ ID NO: 416675 - DNA, 25 bp, Mus musculus
cagttctagataacatgctgtggca

SEQ ID NO: 416676 - DNA, 25 bp, Mus musculus
cagttctcagattcaccatgcctta

SEQ ID NO: 416677 - DNA, 25 bp, Mus musculus
cagttctccagacatccagctttga

SEQ ID NO: 416678 - DNA, 25 bp, Mus musculus
cagttctcctttgagggccccgaga

SEQ ID NO: 416679 - DNA, 25 bp, Mus musculus
cagttctgacaggagttatggtccc

SEQ ID NO: 416680 - DNA, 25 bp, Mus musculus
cagttctgcaggataaagcttcttc

SEQ ID NO: 416681 - DNA, 25 bp, Mus musculus
cagttctgcatgtagggttaaggcc

SEQ ID NO: 416682 - DNA, 25 bp, Mus musculus
cagttctgggtaaatctgctgttcc

SEQ ID NO: 416683 - DNA, 25 bp, Mus musculus
cagttctgtggaatatgagcctaaa

SEQ ID NO: 416684 - DNA, 25 bp, Mus musculus
cagttctgtggcacggtcagaccca

SEQ ID NO: 416685 - DNA, 25 bp, Mus musculus
cagttcttataaaaggactaatgga

SEQ ID NO: 416686 - DNA, 25 bp, Mus musculus
cagttcttcctagggtgttgcccag

SEQ ID NO: 416687 - DNA, 25 bp, Mus musculus
cagttcttcgcggagaccagtgaca

SEQ ID NO: 416688 - DNA, 25 bp, Mus musculus
cagttcttggagatgaccacaccca

SEQ ID NO: 416689 - DNA, 25 bp, Mus musculus
cagttcttgggaatgtaccggctta

SEQ ID NO: 416690 - DNA, 25 bp, Mus musculus
cagttctttggctttgacacggaga

SEQ ID NO: 416691 - DNA, 25 bp, Mus musculus
cagttgaaagagaacgtgcagctac

SEQ ID NO: 416692 - DNA, 25 bp, Mus musculus
cagttgaacctgagagggctctgga

SEQ ID NO: 416693 - DNA, 25 bp, Mus musculus
cagttgaagtctacacctggcttga

SEQ ID NO: 416694 - DNA, 25 bp, Mus musculus
cagttgacaagagccagatgggtgc

SEQ ID NO: 416695 - DNA, 25 bp, Mus musculus
cagttgacagcaagtaggagggccc

SEQ ID NO: 416696 - DNA, 25 bp, Mus musculus
cagttgacaggcttctcggatccag

SEQ ID NO: 416697 - DNA, 25 bp, Mus musculus
cagttgacagttggtcttccaggcc

SEQ ID NO: 416698 - DNA, 25 bp, Mus musculus
cagttgacattgcagcacccaggga

SEQ ID NO: 416699 - DNA, 25 bp, Mus musculus
cagttgaccttgtccattgtgccaa

SEQ ID NO: 416700 - DNA, 25 bp, Mus musculus
cagttgactggcagacaggccctat

SEQ ID NO: 416701 - DNA, 25 bp, Mus musculus
cagttgactggtatgaggcttcagc

SEQ ID NO: 416702 - DNA, 25 bp, Mus musculus
cagttgagactatgggaaaccctga

SEQ ID NO: 416703 - DNA, 25 bp, Mus musculus
cagttgagctgaagtctcaccatgg

SEQ ID NO: 416704 - DNA, 25 bp, Mus musculus
cagttgaggtcccatctctccagta

SEQ ID NO: 416705 - DNA, 25 bp, Mus musculus
cagttgaggtgatctttgagtgcct

SEQ ID NO: 416706 - DNA, 25 bp, Mus musculus
cagttgatttactatcagagatggg

SEQ ID NO: 416707 - DNA, 25 bp, Mus musculus
cagttgcaaggtatggcagttcccc

SEQ ID NO: 416708 - DNA, 25 bp, Mus musculus
cagttgcagaagttgggcctaccac

SEQ ID NO: 416709 - DNA, 25 bp, Mus musculus
cagttgcagtgctcaggttctccct

SEQ ID NO: 416710 - DNA, 25 bp, Mus musculus
cagttgccaaggagctcgagaggaa

SEQ ID NO: 416711 - DNA, 25 bp, Mus musculus
cagttgccaaggatgcggtttctca

SEQ ID NO: 416712 - DNA, 25 bp, Mus musculus
cagttgccataccatcgtctgagga

SEQ ID NO: 416713 - DNA, 25 bp, Mus musculus
cagttgccggagagaagcttctacc

SEQ ID NO: 416714 - DNA, 25 bp, Mus musculus
cagttgcctgtagcttcagaagatc

SEQ ID NO: 416715 - DNA, 25 bp, Mus musculus
cagttgctaccgtgagatgccaggc

SEQ ID NO: 416716 - DNA, 25 bp, Mus musculus
cagttgctggaatcaccttgttggc

SEQ ID NO: 416717 - DNA, 25 bp, Mus musculus
cagttgctgtcctgtttataggtag

SEQ ID NO: 416718 - DNA, 25 bp, Mus musculus
cagttgcttaatctaggaaggcgac

SEQ ID NO: 416719 - DNA, 25 bp, Mus musculus
cagttgctttcaggctcctttagat

SEQ ID NO: 416720 - DNA, 25 bp, Mus musculus
cagttggaactaaaacagcatcgga

SEQ ID NO: 416721 - DNA, 25 bp, Mus musculus
cagttggacaagcaatcccgcagag

SEQ ID NO: 416722 - DNA, 25 bp, Mus musculus
cagttggagccagaaacaatatgga

SEQ ID NO: 416723 - DNA, 25 bp, Mus musculus
cagttggcaccacgatattcacggg

SEQ ID NO: 416724 - DNA, 25 bp, Mus musculus
cagttggcacttcagcctgtcagga

SEQ ID NO: 416725 - DNA, 25 bp, Mus musculus
cagttggcagccaattcaatgcttc

SEQ ID NO: 416726 - DNA, 25 bp, Mus musculus
cagttggccccgttgcccatagagt

SEQ ID NO: 416727 - DNA, 25 bp, Mus musculus
cagttggctgacacttccaaatttc

SEQ ID NO: 416728 - DNA, 25 bp, Mus musculus
cagttgggcagagaacagcatgcgt

SEQ ID NO: 416729 - DNA, 25 bp, Mus musculus
cagttggtactgtgcacttcctgta

SEQ ID NO: 416730 - DNA, 25 bp, Mus musculus
cagttggtatgagttctaagggccc

SEQ ID NO: 416731 - DNA, 25 bp, Mus musculus
cagttggtctctggtggatagtgcc

SEQ ID NO: 416732 - DNA, 25 bp, Mus musculus
cagttgtagttttcaagacccagca

SEQ ID NO: 416733 - DNA, 25 bp, Mus musculus
cagttgtatgcaatgccccttcagc

SEQ ID NO: 416734 - DNA, 25 bp, Mus musculus
cagttgtcagagtcattaaccccgg

SEQ ID NO: 416735 - DNA, 25 bp, Mus musculus
cagttgtctgtggttcatggaaccc

SEQ ID NO: 416736 - DNA, 25 bp, Mus musculus
cagttgtgtggcatggagctgacca

SEQ ID NO: 416737 - DNA, 25 bp, Mus musculus
cagttgtttgatgagccgtagcagc

SEQ ID NO: 416738 - DNA, 25 bp, Mus musculus
cagttgtttgggaagcgcgacagca

SEQ ID NO: 416739 - DNA, 25 bp, Mus musculus
cagtttaaactgtgacacttccggt

SEQ ID NO: 416740 - DNA, 25 bp, Mus musculus
cagtttaactgtctcagaagggacc

SEQ ID NO: 416741 - DNA, 25 bp, Mus musculus
cagtttaataacgaggtcctgaagg

SEQ ID NO: 416742 - DNA, 25 bp, Mus musculus
cagtttaattattgggtgggcagcc

SEQ ID NO: 416743 - DNA, 25 bp, Mus musculus
cagtttacaactgggctgaggccac

SEQ ID NO: 416744 - DNA, 25 bp, Mus musculus
cagtttacaagtgccagtccatggg

SEQ ID NO: 416745 - DNA, 25 bp, Mus musculus
cagtttaccaaagatgccattcgga

SEQ ID NO: 416746 - DNA, 25 bp, Mus musculus
cagtttacggctatgttccgccgga

SEQ ID NO: 416747 - DNA, 25 bp, Mus musculus
cagtttagacacatggaggatccct

SEQ ID NO: 416748 - DNA, 25 bp, Mus musculus
cagtttagcccctatgtactacagg

SEQ ID NO: 416749 - DNA, 25 bp, Mus musculus
cagtttagggcatcgaggagccaca

SEQ ID NO: 416750 - DNA, 25 bp, Mus musculus
cagtttatagcttctcatgcaggga

SEQ ID NO: 416751 - DNA, 25 bp, Mus musculus
cagtttatgaagaagcggcgctatg

SEQ ID NO: 416752 - DNA, 25 bp, Mus musculus
cagtttcacagcagagaccagcgag

SEQ ID NO: 416753 - DNA, 25 bp, Mus musculus
cagtttcagttctttaaaggcacca

SEQ ID NO: 416754 - DNA, 25 bp, Mus musculus
cagtttcataatttcggcgggtcgg

SEQ ID NO: 416755 - DNA, 25 bp, Mus musculus
cagtttccaggcagaggaatatggg

SEQ ID NO: 416756 - DNA, 25 bp, Mus musculus
cagtttcccaaagtcatgagtctag

SEQ ID NO: 416757 - DNA, 25 bp, Mus musculus
cagtttccctactctcctatgaact

SEQ ID NO: 416758 - DNA, 25 bp, Mus musculus
cagtttccctatctgtaaagcgggc

SEQ ID NO: 416759 - DNA, 25 bp, Mus musculus
cagtttccgagatccggtggacgca

SEQ ID NO: 416760 - DNA, 25 bp, Mus musculus
cagtttcctgggtcagtcttgggaa

SEQ ID NO: 416761 - DNA, 25 bp, Mus musculus
cagtttcctggtgggatgtgcctca

SEQ ID NO: 416762 - DNA, 25 bp, Mus musculus
cagtttcgcggatctcggaagtgcg

SEQ ID NO: 416763 - DNA, 25 bp, Mus musculus
cagtttcgtttggagcagattcgca

SEQ ID NO: 416764 - DNA, 25 bp, Mus musculus
cagtttctcactcagaaggatcaag

SEQ ID NO: 416765 - DNA, 25 bp, Mus musculus
cagtttctctgatagcgatccggcg

SEQ ID NO: 416766 - DNA, 25 bp, Mus musculus
cagtttctgctttcagggacctgtg

SEQ ID NO: 416767 - DNA, 25 bp, Mus musculus
cagtttctggttgctgcgtctacta

SEQ ID NO: 416768 - DNA, 25 bp, Mus musculus
cagtttctgtctaatccggaacgta

SEQ ID NO: 416769 - DNA, 25 bp, Mus musculus
cagtttctttgcaacgccagcgaga

SEQ ID NO: 416770 - DNA, 25 bp, Mus musculus
cagtttctttgcagcaatttggccg

SEQ ID NO: 416771 - DNA, 25 bp, Mus musculus
cagtttgacaaagtgcgggaggaca

SEQ ID NO: 416772 - DNA, 25 bp, Mus musculus
cagtttgagatgcacgaccacgtga

SEQ ID NO: 416773 - DNA, 25 bp, Mus musculus
cagtttgatagtctccgtggtgcca

SEQ ID NO: 416774 - DNA, 25 bp, Mus musculus
cagtttgatgctactgcaccccggg

SEQ ID NO: 416775 - DNA, 25 bp, Mus musculus
cagtttgcaaagcaccgtccggtat

SEQ ID NO: 416776 - DNA, 25 bp, Mus musculus
cagtttgcacacttaaggtgttcac

SEQ ID NO: 416777 - DNA, 25 bp, Mus musculus
cagtttgcgcggagaacaaggtccc

SEQ ID NO: 416778 - DNA, 25 bp, Mus musculus
cagtttgctacgaggaaccccagca

SEQ ID NO: 416779 - DNA, 25 bp, Mus musculus
cagtttgctgaggttgctaacggta

SEQ ID NO: 416780 - DNA, 25 bp, Mus musculus
cagtttggacacttcctgtgagcag

SEQ ID NO: 416781 - DNA, 25 bp, Mus musculus
cagtttggagtgaaccatctgggcc

SEQ ID NO: 416782 - DNA, 25 bp, Mus musculus
cagtttggcagactaggacttccgg

SEQ ID NO: 416783 - DNA, 25 bp, Mus musculus
cagtttggtcaaccccgctaatcag

SEQ ID NO: 416784 - DNA, 25 bp, Mus musculus
cagtttgtcatcagagagctccaga

SEQ ID NO: 416785 - DNA, 25 bp, Mus musculus
cagtttgtggcagagtcacacatca

SEQ ID NO: 416786 - DNA, 25 bp, Mus musculus
cagtttgttctgtaactcgagagcc

SEQ ID NO: 416787 - DNA, 25 bp, Mus musculus
cagttttaaaggtggctccagggca

SEQ ID NO: 416788 - DNA, 25 bp, Mus musculus
cagttttaatacatcagacccttag

SEQ ID NO: 416789 - DNA, 25 bp, Mus musculus
cagttttataaatgcccttcgaggg

SEQ ID NO: 416790 - DNA, 25 bp, Mus musculus
cagttttcaacggaggagcagagcc

SEQ ID NO: 416791 - DNA, 25 bp, Mus musculus
cagttttctatacccagcagaggga

SEQ ID NO: 416792 - DNA, 25 bp, Mus musculus
cagttttctcagtgagccagctcag

SEQ ID NO: 416793 - DNA, 25 bp, Mus musculus
cagttttcttgtactgaggatcccc

SEQ ID NO: 416794 - DNA, 25 bp, Mus musculus
cagttttgatgaacccacttggcta

SEQ ID NO: 416795 - DNA, 25 bp, Mus musculus
cagttttgcccacagttccgagaga

SEQ ID NO: 416796 - DNA, 25 bp, Mus musculus
cagttttgggagatgcgagttttca

SEQ ID NO: 416797 - DNA, 25 bp, Mus musculus
cagtttttagccgttaggagatgtg

SEQ ID NO: 416798 - DNA, 25 bp, Mus musculus
cagtttttattcgagcagcgccagc

SEQ ID NO: 416799 - DNA, 25 bp, Mus musculus
cagtttttcgagacggcttacggca

SEQ ID NO: 416800 - DNA, 25 bp, Mus musculus
cagttttttgcttctgccagggagc

SEQ ID NO: 416801 - DNA, 25 bp, Mus musculus
cataaaacggcctgtgaccagcaga

SEQ ID NO: 416802 - DNA, 25 bp, Mus musculus
cataaaagccactgacccggatgaa

SEQ ID NO: 416803 - DNA, 25 bp, Mus musculus
cataaaaggactatggctgctgctc

SEQ ID NO: 416804 - DNA, 25 bp, Mus musculus
cataaaatatactgggaccaagccc

SEQ ID NO: 416805 - DNA, 25 bp, Mus musculus
cataaaattgcgctactgagactgt

SEQ ID NO: 416806 - DNA, 25 bp, Mus musculus
cataaacaactgctcagcgcctgct

SEQ ID NO: 416807 - DNA, 25 bp, Mus musculus
cataaacacaaatagcatttcaacc

SEQ ID NO: 416808 - DNA, 25 bp, Mus musculus
cataaacacttttgagaacaaacca

SEQ ID NO: 416809 - DNA, 25 bp, Mus musculus
cataaacagcaagagatggccaaga

SEQ ID NO: 416810 - DNA, 25 bp, Mus musculus
cataaacatacgtgtggaccccagg

SEQ ID NO: 416811 - DNA, 25 bp, Mus musculus
cataaacatgaggagtctggctgct

SEQ ID NO: 416812 - DNA, 25 bp, Mus musculus
cataaacatgtaaatgggaacagcc

SEQ ID NO: 416813 - DNA, 25 bp, Mus musculus
cataaacattgtggttgtgagccta

SEQ ID NO: 416814 - DNA, 25 bp, Mus musculus
cataaacgcgcaaagcggagtgctg

SEQ ID NO: 416815 - DNA, 25 bp, Mus musculus
cataaacgtcggtgggactaacgca

SEQ ID NO: 416816 - DNA, 25 bp, Mus musculus
cataaactccagaagggtgtctcac

SEQ ID NO: 416817 - DNA, 25 bp, Mus musculus
cataaactgcggaccgagggactct

SEQ ID NO: 416818 - DNA, 25 bp, Mus musculus
cataaagaccggaggaacagacgtt

SEQ ID NO: 416819 - DNA, 25 bp, Mus musculus
cataaaggctctcatgtagaaacga

SEQ ID NO: 416820 - DNA, 25 bp, Mus musculus
cataaagggtcctaagaagccgagc

SEQ ID NO: 416821 - DNA, 25 bp, Mus musculus
cataaaggtaaggtaggcaggagct

SEQ ID NO: 416822 - DNA, 25 bp, Mus musculus
cataaataagttctcagggcaaccc

SEQ ID NO: 416823 - DNA, 25 bp, Mus musculus
cataaatcaagcaggcagccggaac

SEQ ID NO: 416824 - DNA, 25 bp, Mus musculus
cataaatgtagatggtaagcatgtc

SEQ ID NO: 416825 - DNA, 25 bp, Mus musculus
cataaattattggtgacttggtggt

SEQ ID NO: 416826 - DNA, 25 bp, Mus musculus
cataaatttggtccaggaagcccca

SEQ ID NO: 416827 - DNA, 25 bp, Mus musculus
cataacaaatactgagctcttccgg

SEQ ID NO: 416828 - DNA, 25 bp, Mus musculus
cataacacgtgtgtgtcccagaagg

SEQ ID NO: 416829 - DNA, 25 bp, Mus musculus
cataacagctctgccgactagggaa

SEQ ID NO: 416830 - DNA, 25 bp, Mus musculus
cataacagggcttgctggcctaaca

SEQ ID NO: 416831 - DNA, 25 bp, Mus musculus
cataacagtccaacccagtgctagg

SEQ ID NO: 416832 - DNA, 25 bp, Mus musculus
cataacagtggtctgattgggtcca

SEQ ID NO: 416833 - DNA, 25 bp, Mus musculus
cataacattctgcagaggcgcctca

SEQ ID NO: 416834 - DNA, 25 bp, Mus musculus
cataaccgagcaaactgggtgaccg

SEQ ID NO: 416835 - DNA, 25 bp, Mus musculus
cataacctaccgttttctgtcttgg

SEQ ID NO: 416836 - DNA, 25 bp, Mus musculus
cataaccttagaggagagccacggg

SEQ ID NO: 416837 - DNA, 25 bp, Mus musculus
cataacgacctggaatctgtgcctc

SEQ ID NO: 416838 - DNA, 25 bp, Mus musculus
cataactcagaacactgtgaacggt

SEQ ID NO: 416839 - DNA, 25 bp, Mus musculus
cataactccctttgcagtcgggctg

SEQ ID NO: 416840 - DNA, 25 bp, Mus musculus
cataactgccattctcactggacca

SEQ ID NO: 416841 - DNA, 25 bp, Mus musculus
cataactggagtgaaagacgccatc

SEQ ID NO: 416842 - DNA, 25 bp, Mus musculus
cataacttgattctggacacgggca

SEQ ID NO: 416843 - DNA, 25 bp, Mus musculus
cataacttgcatggcttacctggag

SEQ ID NO: 416844 - DNA, 25 bp, Mus musculus
cataacttgcgaaaattcagccggg

SEQ ID NO: 416845 - DNA, 25 bp, Mus musculus
cataagaacttcagtgagggccttc

SEQ ID NO: 416846 - DNA, 25 bp, Mus musculus
cataagaagccttaacggttgccgg

SEQ ID NO: 416847 - DNA, 25 bp, Mus musculus
cataagaagtgccacaagctggtca

SEQ ID NO: 416848 - DNA, 25 bp, Mus musculus
cataagaattacctgtgcagcagtc

SEQ ID NO: 416849 - DNA, 25 bp, Mus musculus
cataagacagtagccaccgtggaag

SEQ ID NO: 416850 - DNA, 25 bp, Mus musculus
cataagagtgagcagaaccattccg

SEQ ID NO: 416851 - DNA, 25 bp, Mus musculus
cataagatggaagaccctcagcgca

SEQ ID NO: 416852 - DNA, 25 bp, Mus musculus
cataagatgttcaagtggagttcca

SEQ ID NO: 416853 - DNA, 25 bp, Mus musculus
cataagcattgaccggttcctggcg

SEQ ID NO: 416854 - DNA, 25 bp, Mus musculus
cataagccgtgcaggaatggagcca

SEQ ID NO: 416855 - DNA, 25 bp, Mus musculus
cataagcctgattacggagatacgc

SEQ ID NO: 416856 - DNA, 25 bp, Mus musculus
cataagcgaagagtaaggctgtccc

SEQ ID NO: 416857 - DNA, 25 bp, Mus musculus
cataagcggcagctagagagagacc

SEQ ID NO: 416858 - DNA, 25 bp, Mus musculus
cataagctccgccttcctggaagct

SEQ ID NO: 416859 - DNA, 25 bp, Mus musculus
cataagctgggcctgaactacaaca

SEQ ID NO: 416860 - DNA, 25 bp, Mus musculus
cataagctttccttataagtgggac

SEQ ID NO: 416861 - DNA, 25 bp, Mus musculus
cataaggacacagagggacgagttc

SEQ ID NO: 416862 - DNA, 25 bp, Mus musculus
cataaggaccactgtaccgcgtttc

SEQ ID NO: 416863 - DNA, 25 bp, Mus musculus
cataaggagaggacatgggatcctc

SEQ ID NO: 416864 - DNA, 25 bp, Mus musculus
cataagggcacctatgggctgctgc

SEQ ID NO: 416865 - DNA, 25 bp, Mus musculus
cataagggcaggaagagtcaacact

SEQ ID NO: 416866 - DNA, 25 bp, Mus musculus
cataagggccccagtgtaacctcag

SEQ ID NO: 416867 - DNA, 25 bp, Mus musculus
cataagggtgagtgccgtaggctcc

SEQ ID NO: 416868 - DNA, 25 bp, Mus musculus
cataaggttcctcagttaaggcgcc

SEQ ID NO: 416869 - DNA, 25 bp, Mus musculus
cataaggttcctgaatagcaagtgc

SEQ ID NO: 416870 - DNA, 25 bp, Mus musculus
cataaggttttcgatctgccagagt

SEQ ID NO: 416871 - DNA, 25 bp, Mus musculus
cataagtaacagtactgggcctgga

SEQ ID NO: 416872 - DNA, 25 bp, Mus musculus
cataagtaaccaagtaagtcacctc

SEQ ID NO: 416873 - DNA, 25 bp, Mus musculus
cataagtgaccgttttggcaggaat

SEQ ID NO: 416874 - DNA, 25 bp, Mus musculus
cataagtgtaacgtgtgctctcgga

SEQ ID NO: 416875 - DNA, 25 bp, Mus musculus
cataagttccaacattttaagcatc

SEQ ID NO: 416876 - DNA, 25 bp, Mus musculus
cataagttccgaggaggtgccctca

SEQ ID NO: 416877 - DNA, 25 bp, Mus musculus
cataatacatagctcccagaaggat

SEQ ID NO: 416878 - DNA, 25 bp, Mus musculus
cataatagccagagggcacggagga

SEQ ID NO: 416879 - DNA, 25 bp, Mus musculus
cataatagcccagtctcagtgggtg

SEQ ID NO: 416880 - DNA, 25 bp, Mus musculus
cataatcactgtgagggagcgccga

SEQ ID NO: 416881 - DNA, 25 bp, Mus musculus
cataatcagctacggtggtgcggac

SEQ ID NO: 416882 - DNA, 25 bp, Mus musculus
cataatccagtttgtgccagccgac

SEQ ID NO: 416883 - DNA, 25 bp, Mus musculus
cataatctcatagtggccagtccca

SEQ ID NO: 416884 - DNA, 25 bp, Mus musculus
cataatgaagctgagcccaagaagc

SEQ ID NO: 416885 - DNA, 25 bp, Mus musculus
cataatgaccatcttaggacacagt

SEQ ID NO: 416886 - DNA, 25 bp, Mus musculus
cataatgacgtcgatgaggacatcg

SEQ ID NO: 416887 - DNA, 25 bp, Mus musculus
cataatgagcttcgaggcacggtct

SEQ ID NO: 416888 - DNA, 25 bp, Mus musculus
cataatgagtgtccccaccaaggag

SEQ ID NO: 416889 - DNA, 25 bp, Mus musculus
cataatgccatgagactaacttgga

SEQ ID NO: 416890 - DNA, 25 bp, Mus musculus
cataatgctctcagggtatcccgag

SEQ ID NO: 416891 - DNA, 25 bp, Mus musculus
cataatggaacgtgcgcagctgaag

SEQ ID NO: 416892 - DNA, 25 bp, Mus musculus
cataatgggtaagttatacagaggt

SEQ ID NO: 416893 - DNA, 25 bp, Mus musculus
cataatgtcaagtggagctggctgg

SEQ ID NO: 416894 - DNA, 25 bp, Mus musculus
cataatgttcatggtggttggctgc

SEQ ID NO: 416895 - DNA, 25 bp, Mus musculus
cataattagatgtccaggctgcaga

SEQ ID NO: 416896 - DNA, 25 bp, Mus musculus
cataattgctttgacggacggtaag

SEQ ID NO: 416897 - DNA, 25 bp, Mus musculus
cataattgggagaaatgacacgtca

SEQ ID NO: 416898 - DNA, 25 bp, Mus musculus
catacaaactgcagggaaggaattc

SEQ ID NO: 416899 - DNA, 25 bp, Mus musculus
catacaaaggaaacgatgcgcttcg

SEQ ID NO: 416900 - DNA, 25 bp, Mus musculus
catacaaagttcgagttggtgctga

SEQ ID NO: 416901 - DNA, 25 bp, Mus musculus
catacaaatgcaccgagtgcggcca

SEQ ID NO: 416902 - DNA, 25 bp, Mus musculus
catacaacaagggtctcatccggag

SEQ ID NO: 416903 - DNA, 25 bp, Mus musculus
catacaactcactcgctgcttggct

SEQ ID NO: 416904 - DNA, 25 bp, Mus musculus
catacaagcaagaagtcaaaattta

SEQ ID NO: 416905 - DNA, 25 bp, Mus musculus
catacaagctgaagaaggcaacccc

SEQ ID NO: 416906 - DNA, 25 bp, Mus musculus
catacaagtcaggtggccatcaggg

SEQ ID NO: 416907 - DNA, 25 bp, Mus musculus
catacaagtgcactttatggcatag

SEQ ID NO: 416908 - DNA, 25 bp, Mus musculus
catacaataatctcaagagccctgt

SEQ ID NO: 416909 - DNA, 25 bp, Mus musculus
catacacactgactctgaactgggt

SEQ ID NO: 416910 - DNA, 25 bp, Mus musculus
catacacctgtctctgttcacgaag

SEQ ID NO: 416911 - DNA, 25 bp, Mus musculus
catacacttaaaaattggatcatgg

SEQ ID NO: 416912 - DNA, 25 bp, Mus musculus
catacagaatcagtggtggagaccc

SEQ ID NO: 416913 - DNA, 25 bp, Mus musculus
catacagagaagcatgcaagcagtg

SEQ ID NO: 416914 - DNA, 25 bp, Mus musculus
catacagcaccagcgtcatttcggg

SEQ ID NO: 416915 - DNA, 25 bp, Mus musculus
catacagccgctaaagaaatagccg

SEQ ID NO: 416916 - DNA, 25 bp, Mus musculus
catacagccttggagcagatgcgga

SEQ ID NO: 416917 - DNA, 25 bp, Mus musculus
catacaggatgaaattcgctcagtg

SEQ ID NO: 416918 - DNA, 25 bp, Mus musculus
catacaggcaccatatggctcctga

SEQ ID NO: 416919 - DNA, 25 bp, Mus musculus
catacaggcctctggaaaattccca

SEQ ID NO: 416920 - DNA, 25 bp, Mus musculus
catacaggtgcaactccaaggaagc

SEQ ID NO: 416921 - DNA, 25 bp, Mus musculus
catacagtacctgcattattgctcg

SEQ ID NO: 416922 - DNA, 25 bp, Mus musculus
catacagtagaacattggaggccga

SEQ ID NO: 416923 - DNA, 25 bp, Mus musculus
catacagtgggacagaacgaagcct

SEQ ID NO: 416924 - DNA, 25 bp, Mus musculus
catacagtgtggacagacaggttcc

SEQ ID NO: 416925 - DNA, 25 bp, Mus musculus
catacagttgcacccaagttgctga

SEQ ID NO: 416926 - DNA, 25 bp, Mus musculus
catacagttggaacagttgggcaca

SEQ ID NO: 416927 - DNA, 25 bp, Mus musculus
catacataacgagagccgcgtggac

SEQ ID NO: 416928 - DNA, 25 bp, Mus musculus
catacatcccgagagacagcaagaa

SEQ ID NO: 416929 - DNA, 25 bp, Mus musculus
catacatgctccgagtactgggcga

SEQ ID NO: 416930 - DNA, 25 bp, Mus musculus
catacatgctgacgctggaggacca

SEQ ID NO: 416931 - DNA, 25 bp, Mus musculus
catacatggcctctctacagaaagc

SEQ ID NO: 416932 - DNA, 25 bp, Mus musculus
catacatggctttggcaggtgaacc

SEQ ID NO: 416933 - DNA, 25 bp, Mus musculus
catacatggtctttagtgatttcca

SEQ ID NO: 416934 - DNA, 25 bp, Mus musculus
catacatgtactcgatgccttcaga

SEQ ID NO: 416935 - DNA, 25 bp, Mus musculus
catacatgtctagcagattctagca

SEQ ID NO: 416936 - DNA, 25 bp, Mus musculus
catacatgtgcagtatcctgatgag

SEQ ID NO: 416937 - DNA, 25 bp, Mus musculus
catacattataagctgtcacagagg

SEQ ID NO: 416938 - DNA, 25 bp, Mus musculus
catacattatgagccaatttttcta

SEQ ID NO: 416939 - DNA, 25 bp, Mus musculus
catacattccatgcccttaaagagg

SEQ ID NO: 416940 - DNA, 25 bp, Mus musculus
cataccaaaaggctgtcagctatgg

SEQ ID NO: 416941 - DNA, 25 bp, Mus musculus
cataccagacggacagacgttctgt

SEQ ID NO: 416942 - DNA, 25 bp, Mus musculus
cataccagaggaagtaattgcaaaa

SEQ ID NO: 416943 - DNA, 25 bp, Mus musculus
cataccagggtgttcgagtcaagga

SEQ ID NO: 416944 - DNA, 25 bp, Mus musculus
cataccatgggtcagggttccggac

SEQ ID NO: 416945 - DNA, 25 bp, Mus musculus
cataccatgtactgggcatcttgag

SEQ ID NO: 416946 - DNA, 25 bp, Mus musculus
cataccattgaggatctgaagaaca

SEQ ID NO: 416947 - DNA, 25 bp, Mus musculus
catacccagtcgcaaaccgttggcg

SEQ ID NO: 416948 - DNA, 25 bp, Mus musculus
catacccctgggtgcagtggacagg

SEQ ID NO: 416949 - DNA, 25 bp, Mus musculus
cataccctgtgagtgagtctcgggg

SEQ ID NO: 416950 - DNA, 25 bp, Mus musculus
catacccttcgtgtgtgttaaataa

SEQ ID NO: 416951 - DNA, 25 bp, Mus musculus
cataccgcatgaccaagggctggag

SEQ ID NO: 416952 - DNA, 25 bp, Mus musculus
cataccggacactcccaggctaggg

SEQ ID NO: 416953 - DNA, 25 bp, Mus musculus
cataccggctgtccaagagagtaca

SEQ ID NO: 416954 - DNA, 25 bp, Mus musculus
cataccgggattggtttcagagcaa

SEQ ID NO: 416955 - DNA, 25 bp, Mus musculus
cataccggtgttgtgttgctcgccg

SEQ ID NO: 416956 - DNA, 25 bp, Mus musculus
cataccgtaggatgttccagggcta

SEQ ID NO: 416957 - DNA, 25 bp, Mus musculus
catacctgacggagagagacacttt

SEQ ID NO: 416958 - DNA, 25 bp, Mus musculus
catacctgactttgcactgattctg

SEQ ID NO: 416959 - DNA, 25 bp, Mus musculus
catacctgatgattgctacctgtga

SEQ ID NO: 416960 - DNA, 25 bp, Mus musculus
catacctgctgctgtgcatggtgcc

SEQ ID NO: 416961 - DNA, 25 bp, Mus musculus
catacctggagctggaatctgaccc

SEQ ID NO: 416962 - DNA, 25 bp, Mus musculus
catacctggaggatgaggcgcagct

SEQ ID NO: 416963 - DNA, 25 bp, Mus musculus
catacctggagtcagccaagatggg

SEQ ID NO: 416964 - DNA, 25 bp, Mus musculus
catacctgggtctcgacaagaagaa

SEQ ID NO: 416965 - DNA, 25 bp, Mus musculus
catacctggtaaactcttgggcgcc

SEQ ID NO: 416966 - DNA, 25 bp, Mus musculus
catacctttggaatgtggaaatctg

SEQ ID NO: 416967 - DNA, 25 bp, Mus musculus
catacctttggagaagctcggccgt

SEQ ID NO: 416968 - DNA, 25 bp, Mus musculus
catacgaagcaagtaagcagccgcc

SEQ ID NO: 416969 - DNA, 25 bp, Mus musculus
catacgacatggcatctttgaggat

SEQ ID NO: 416970 - DNA, 25 bp, Mus musculus
catacgacgacgtgaggatcagtcc

SEQ ID NO: 416971 - DNA, 25 bp, Mus musculus
catacgatctgtgtctgggcaggct

SEQ ID NO: 416972 - DNA, 25 bp, Mus musculus
catacgatgaagtgaaagcgcgcct

SEQ ID NO: 416973 - DNA, 25 bp, Mus musculus
catacgatgtgtgtgagcaacctcc

SEQ ID NO: 416974 - DNA, 25 bp, Mus musculus
catacgcactagctgtcattgggct

SEQ ID NO: 416975 - DNA, 25 bp, Mus musculus
catacgcttggcgatggccagagct

SEQ ID NO: 416976 - DNA, 25 bp, Mus musculus
catacggagacactactggcaggat

SEQ ID NO: 416977 - DNA, 25 bp, Mus musculus
catacggagcatcttcagaccaggt

SEQ ID NO: 416978 - DNA, 25 bp, Mus musculus
catacggagtgtgcggctagtcaga

SEQ ID NO: 416979 - DNA, 25 bp, Mus musculus
catacggccgtctgacattttcgga

SEQ ID NO: 416980 - DNA, 25 bp, Mus musculus
catacggcgaatgctaggtctccca

SEQ ID NO: 416981 - DNA, 25 bp, Mus musculus
catacggcttggcacacaaggagga

SEQ ID NO: 416982 - DNA, 25 bp, Mus musculus
catacgggccagacttggtttgaga

SEQ ID NO: 416983 - DNA, 25 bp, Mus musculus
catactaataaactgggcacgctcc

SEQ ID NO: 416984 - DNA, 25 bp, Mus musculus
catactagctagagggtggctctgg

SEQ ID NO: 416985 - DNA, 25 bp, Mus musculus
catactaggcaagctggatcctcag

SEQ ID NO: 416986 - DNA, 25 bp, Mus musculus
catactatgaagactatagtgtcct

SEQ ID NO: 416987 - DNA, 25 bp, Mus musculus
catactatttttggccgagtgtgcc

SEQ ID NO: 416988 - DNA, 25 bp, Mus musculus
catactcgacaatgccatcaatggg

SEQ ID NO: 416989 - DNA, 25 bp, Mus musculus
catactcggtatgtgtgctgcctgg

SEQ ID NO: 416990 - DNA, 25 bp, Mus musculus
catactctcttaagcggtggcgccc

SEQ ID NO: 416991 - DNA, 25 bp, Mus musculus
catactctgctaaagtggccctgac

SEQ ID NO: 416992 - DNA, 25 bp, Mus musculus
catactgacctgcactcagagaaca

SEQ ID NO: 416993 - DNA, 25 bp, Mus musculus
catactgagggagaagctgaatgcc

SEQ ID NO: 416994 - DNA, 25 bp, Mus musculus
catactgatgaagaggcattgccct

SEQ ID NO: 416995 - DNA, 25 bp, Mus musculus
catactgattctgtctccagccaag

SEQ ID NO: 416996 - DNA, 25 bp, Mus musculus
catactgcaaccaatatggacagag

SEQ ID NO: 416997 - DNA, 25 bp, Mus musculus
catactgcagaagggagcatcctcg

SEQ ID NO: 416998 - DNA, 25 bp, Mus musculus
catactgggacaggcttgggcactc

SEQ ID NO: 416999 - DNA, 25 bp, Mus musculus
catactgggaggagaagactcgcgt

SEQ ID NO: 417000 - DNA, 25 bp, Mus musculus
catactggtcccttatatctggcag

SEQ ID NO: 417001 - DNA, 25 bp, Mus musculus
catactggtgatcatagtgaaagcc

SEQ ID NO: 417002 - DNA, 25 bp, Mus musculus
catactggtgcatgggaaggaggca

SEQ ID NO: 417003 - DNA, 25 bp, Mus musculus
catactgtgtgttcagccctgtgta

SEQ ID NO: 417004 - DNA, 25 bp, Mus musculus
catacttaaacatcaggcaggtggg

SEQ ID NO: 417005 - DNA, 25 bp, Mus musculus
catacttaaagagagtgcgggaagc

SEQ ID NO: 417006 - DNA, 25 bp, Mus musculus
catacttaacagaaactgagggatg

SEQ ID NO: 417007 - DNA, 25 bp, Mus musculus
catacttacggtcctgggaaatgta

SEQ ID NO: 417008 - DNA, 25 bp, Mus musculus
catacttcatgcactcccacgatga

SEQ ID NO: 417009 - DNA, 25 bp, Mus musculus
catacttcgagagtggctggtggca

SEQ ID NO: 417010 - DNA, 25 bp, Mus musculus
catacttctgcaatggagggaaagt

SEQ ID NO: 417011 - DNA, 25 bp, Mus musculus
catacttgatttgtgaacagagact

SEQ ID NO: 417012 - DNA, 25 bp, Mus musculus
catacttgctggatgccctaagaag

SEQ ID NO: 417013 - DNA, 25 bp, Mus musculus
catactttggaggacttccagcggg

SEQ ID NO: 417014 - DNA, 25 bp, Mus musculus
catactttgttttgatctcctgagg

SEQ ID NO: 417015 - DNA, 25 bp, Mus musculus
catactttttgtattccacctggtg

SEQ ID NO: 417016 - DNA, 25 bp, Mus musculus
catagaaaagctgatccacctggca

SEQ ID NO: 417017 - DNA, 25 bp, Mus musculus
catagaaactgctgaaactgccaca

SEQ ID NO: 417018 - DNA, 25 bp, Mus musculus
catagaaataatcactttggagaat

SEQ ID NO: 417019 - DNA, 25 bp, Mus musculus
catagaaatgagtgcctccggtcag

SEQ ID NO: 417020 - DNA, 25 bp, Mus musculus
catagaacagttacaaagacatgaa

SEQ ID NO: 417021 - DNA, 25 bp, Mus musculus
catagaacccgtcgaactgaagtaa

SEQ ID NO: 417022 - DNA, 25 bp, Mus musculus
catagaaccctaaagtctatttttg

SEQ ID NO: 417023 - DNA, 25 bp, Mus musculus
catagaaggaactgatagattggtc

SEQ ID NO: 417024 - DNA, 25 bp, Mus musculus
catagaatgcccctgctcatcaagg

SEQ ID NO: 417025 - DNA, 25 bp, Mus musculus
catagacaagtggtcccgaatgttc

SEQ ID NO: 417026 - DNA, 25 bp, Mus musculus
catagacactgcctgggtgctcctt

SEQ ID NO: 417027 - DNA, 25 bp, Mus musculus
catagacagggaatgtaattgcagc

SEQ ID NO: 417028 - DNA, 25 bp, Mus musculus
catagacagtgcttcaatgggtcct

SEQ ID NO: 417029 - DNA, 25 bp, Mus musculus
catagacatcctgttgggcagctcc

SEQ ID NO: 417030 - DNA, 25 bp, Mus musculus
catagacattcccagagcatggtgg

SEQ ID NO: 417031 - DNA, 25 bp, Mus musculus
catagaccgaggtgggcactgcgct

SEQ ID NO: 417032 - DNA, 25 bp, Mus musculus
catagacctcaaagatcgccaggga

SEQ ID NO: 417033 - DNA, 25 bp, Mus musculus
catagactgaggctgccagtgtctc

SEQ ID NO: 417034 - DNA, 25 bp, Mus musculus
catagactgctgtgaatagagacaa

SEQ ID NO: 417035 - DNA, 25 bp, Mus musculus
catagactggctgtgtaaaaaagaa

SEQ ID NO: 417036 - DNA, 25 bp, Mus musculus
catagagaacgaaccaccctttgag

SEQ ID NO: 417037 - DNA, 25 bp, Mus musculus
catagagaacgtaacacggacacgg

SEQ ID NO: 417038 - DNA, 25 bp, Mus musculus
catagagaagctgtgggaccagaca

SEQ ID NO: 417039 - DNA, 25 bp, Mus musculus
catagagacgctactggaggcggcc

SEQ ID NO: 417040 - DNA, 25 bp, Mus musculus
catagagaggagacaccatggatta

SEQ ID NO: 417041 - DNA, 25 bp, Mus musculus
catagagcaagctgcgtgtccgact

SEQ ID NO: 417042 - DNA, 25 bp, Mus musculus
catagagccaaagtacaggattcac

SEQ ID NO: 417043 - DNA, 25 bp, Mus musculus
catagagcgccagaaccaggagtat

SEQ ID NO: 417044 - DNA, 25 bp, Mus musculus
catagagctggctgttgtggatcct

SEQ ID NO: 417045 - DNA, 25 bp, Mus musculus
catagaggatgctgactctagagtg

SEQ ID NO: 417046 - DNA, 25 bp, Mus musculus
catagaggcatacaaccaagggcgg

SEQ ID NO: 417047 - DNA, 25 bp, Mus musculus
catagaggtctcagaggagggcact

SEQ ID NO: 417048 - DNA, 25 bp, Mus musculus
catagagtgaatggccctgacctgc

SEQ ID NO: 417049 - DNA, 25 bp, Mus musculus
catagagtgagacctgagaaggccc

SEQ ID NO: 417050 - DNA, 25 bp, Mus musculus
catagataacgaggacagggagaac

SEQ ID NO: 417051 - DNA, 25 bp, Mus musculus
catagataattctccagttggaact

SEQ ID NO: 417052 - DNA, 25 bp, Mus musculus
catagatacaggcttaggaggccct

SEQ ID NO: 417053 - DNA, 25 bp, Mus musculus
catagataccacatgcatctcgggc

SEQ ID NO: 417054 - DNA, 25 bp, Mus musculus
catagatatggatgctgttcacccc

SEQ ID NO: 417055 - DNA, 25 bp, Mus musculus
catagatattggttcagctactagc

SEQ ID NO: 417056 - DNA, 25 bp, Mus musculus
catagatcggattcaagttacgccc

SEQ ID NO: 417057 - DNA, 25 bp, Mus musculus
catagatgactgttggatggctccc

SEQ ID NO: 417058 - DNA, 25 bp, Mus musculus
catagatgccaatgacggtgcccaa

SEQ ID NO: 417059 - DNA, 25 bp, Mus musculus
catagcaaagctgatagcccacatt

SEQ ID NO: 417060 - DNA, 25 bp, Mus musculus
catagcaattgggtactgagtggga

SEQ ID NO: 417061 - DNA, 25 bp, Mus musculus
catagcactggcaagcgagaagccc

SEQ ID NO: 417062 - DNA, 25 bp, Mus musculus
catagcactttctgggagtgtggga

SEQ ID NO: 417063 - DNA, 25 bp, Mus musculus
catagcagcctagttaaaggcagcc

SEQ ID NO: 417064 - DNA, 25 bp, Mus musculus
catagcagctgggattctgggaacg

SEQ ID NO: 417065 - DNA, 25 bp, Mus musculus
catagcaggagtgcaaaagaaatcg

SEQ ID NO: 417066 - DNA, 25 bp, Mus musculus
catagcaggcgttgaagagaagtct

SEQ ID NO: 417067 - DNA, 25 bp, Mus musculus
catagcagtgtaaaggtccccgtga

SEQ ID NO: 417068 - DNA, 25 bp, Mus musculus
catagccacagcttgcactgagcca

SEQ ID NO: 417069 - DNA, 25 bp, Mus musculus
catagccaccagatgctgacaggat

SEQ ID NO: 417070 - DNA, 25 bp, Mus musculus
catagccacgtggatgaagcacaca

SEQ ID NO: 417071 - DNA, 25 bp, Mus musculus
catagccactttccattgtcagcca

SEQ ID NO: 417072 - DNA, 25 bp, Mus musculus
catagccagagagatgcagcctgtg

SEQ ID NO: 417073 - DNA, 25 bp, Mus musculus
catagccccggctcacagttcaaat

SEQ ID NO: 417074 - DNA, 25 bp, Mus musculus
catagccctggctgcaatatctggg

SEQ ID NO: 417075 - DNA, 25 bp, Mus musculus
catagccgcgatgcagaagaggtca

SEQ ID NO: 417076 - DNA, 25 bp, Mus musculus
catagcctcgtggacacctgtgtca

SEQ ID NO: 417077 - DNA, 25 bp, Mus musculus
catagcctggggagcggaacttttt

SEQ ID NO: 417078 - DNA, 25 bp, Mus musculus
catagcctggtgcatttccccaggc

SEQ ID NO: 417079 - DNA, 25 bp, Mus musculus
catagccttcacttggactccagaa

SEQ ID NO: 417080 - DNA, 25 bp, Mus musculus
catagcgcagttaccgcagcgtagg

SEQ ID NO: 417081 - DNA, 25 bp, Mus musculus
catagcgcggcagtggcgccttgta

SEQ ID NO: 417082 - DNA, 25 bp, Mus musculus
catagcgtcaagtaaagacagtggt

SEQ ID NO: 417083 - DNA, 25 bp, Mus musculus
catagctaaagctcgctggtgggct

SEQ ID NO: 417084 - DNA, 25 bp, Mus musculus
catagctaaggaaatgagtgaggcc

SEQ ID NO: 417085 - DNA, 25 bp, Mus musculus
catagctccagagcatgtgtgccgt

SEQ ID NO: 417086 - DNA, 25 bp, Mus musculus
catagctctagtccttacggatggg

SEQ ID NO: 417087 - DNA, 25 bp, Mus musculus
catagctgcatcctgaggttctgga

SEQ ID NO: 417088 - DNA, 25 bp, Mus musculus
catagctgcgcctgaagagtcagcc

SEQ ID NO: 417089 - DNA, 25 bp, Mus musculus
catagctgctgggaaagtgcgccac

SEQ ID NO: 417090 - DNA, 25 bp, Mus musculus
catagctggacagagcatcggaggc

SEQ ID NO: 417091 - DNA, 25 bp, Mus musculus
catagctgtcacaaagcgggtgtac

SEQ ID NO: 417092 - DNA, 25 bp, Mus musculus
catagcttgcagcagccaggttcca

SEQ ID NO: 417093 - DNA, 25 bp, Mus musculus
catagctttgatgtaacttgcaaga

SEQ ID NO: 417094 - DNA, 25 bp, Mus musculus
cataggaattagagggcgtggaaat

SEQ ID NO: 417095 - DNA, 25 bp, Mus musculus
cataggaatttctacccagggacac

SEQ ID NO: 417096 - DNA, 25 bp, Mus musculus
cataggaggctatcccgtggagaaa

SEQ ID NO: 417097 - DNA, 25 bp, Mus musculus
cataggagtcttatgtaaagaggtt

SEQ ID NO: 417098 - DNA, 25 bp, Mus musculus
cataggagtctttttgcactgtagg

SEQ ID NO: 417099 - DNA, 25 bp, Mus musculus
cataggatattggtcatcttgagct

SEQ ID NO: 417100 - DNA, 25 bp, Mus musculus
cataggatggctctagtcatacagt

SEQ ID NO: 417101 - DNA, 25 bp, Mus musculus
cataggattggtgggttattggcac

SEQ ID NO: 417102 - DNA, 25 bp, Mus musculus
cataggatttgcaaaaactgggctg

SEQ ID NO: 417103 - DNA, 25 bp, Mus musculus
cataggcaccgtattgcgtgagacg

SEQ ID NO: 417104 - DNA, 25 bp, Mus musculus
cataggcattctgggtactacagag

SEQ ID NO: 417105 - DNA, 25 bp, Mus musculus
cataggccaaaccagtgagatgtct

SEQ ID NO: 417106 - DNA, 25 bp, Mus musculus
cataggccagtccaagatgcgagag

SEQ ID NO: 417107 - DNA, 25 bp, Mus musculus
cataggctagaatagaatgtgtctg

SEQ ID NO: 417108 - DNA, 25 bp, Mus musculus
cataggctagagttcttctttaggg

SEQ ID NO: 417109 - DNA, 25 bp, Mus musculus
cataggctctggaaagaccctgacc

SEQ ID NO: 417110 - DNA, 25 bp, Mus musculus
cataggctcttggtctcgtgcaaag

SEQ ID NO: 417111 - DNA, 25 bp, Mus musculus
cataggctgatctgttcagcctgtc

SEQ ID NO: 417112 - DNA, 25 bp, Mus musculus
cataggctgcttcttaggactgcaa

SEQ ID NO: 417113 - DNA, 25 bp, Mus musculus
cataggctgtcatgctcacggagta

SEQ ID NO: 417114 - DNA, 25 bp, Mus musculus
catagggagtgttaagcctgcagca

SEQ ID NO: 417115 - DNA, 25 bp, Mus musculus
catagggcagtacgagcaatgtcgc

SEQ ID NO: 417116 - DNA, 25 bp, Mus musculus
catagggttgcttccagtgagtcga

SEQ ID NO: 417117 - DNA, 25 bp, Mus musculus
catagggtttatagattgtctcccc

SEQ ID NO: 417118 - DNA, 25 bp, Mus musculus
cataggtaggtagggcgtcatctcc

SEQ ID NO: 417119 - DNA, 25 bp, Mus musculus
cataggtctccgtgcgactaggagg

SEQ ID NO: 417120 - DNA, 25 bp, Mus musculus
cataggtgctattaaaggactgtcc

SEQ ID NO: 417121 - DNA, 25 bp, Mus musculus
cataggtgtgcttggctgcagaatc

SEQ ID NO: 417122 - DNA, 25 bp, Mus musculus
cataggtgttctttctaaagttggg

SEQ ID NO: 417123 - DNA, 25 bp, Mus musculus
cataggttgctgctaagatagccac

SEQ ID NO: 417124 - DNA, 25 bp, Mus musculus
cataggttgctggagccgaactgta

SEQ ID NO: 417125 - DNA, 25 bp, Mus musculus
catagtaatgaaaaacgggtctcca

SEQ ID NO: 417126 - DNA, 25 bp, Mus musculus
catagtagaaccagacttccggtca

SEQ ID NO: 417127 - DNA, 25 bp, Mus musculus
catagtaggatgacttcctggccct

SEQ ID NO: 417128 - DNA, 25 bp, Mus musculus
catagtaggctaggtgttcccaggc

SEQ ID NO: 417129 - DNA, 25 bp, Mus musculus
catagtagtgcattccccgagtcct

SEQ ID NO: 417130 - DNA, 25 bp, Mus musculus
catagtatctaatagtcaaattggg

SEQ ID NO: 417131 - DNA, 25 bp, Mus musculus
catagtatggtgtgacttgaggagc

SEQ ID NO: 417132 - DNA, 25 bp, Mus musculus
catagtcagcttggacgaactccga

SEQ ID NO: 417133 - DNA, 25 bp, Mus musculus
catagtcaggaaaccgggaggagct

SEQ ID NO: 417134 - DNA, 25 bp, Mus musculus
catagtcattgtctctcttcacggc

SEQ ID NO: 417135 - DNA, 25 bp, Mus musculus
catagtcccagtacttgccaacgtg

SEQ ID NO: 417136 - DNA, 25 bp, Mus musculus
catagtctcgtctttcctctacagg

SEQ ID NO: 417137 - DNA, 25 bp, Mus musculus
catagtctggagatgcagggcacct

SEQ ID NO: 417138 - DNA, 25 bp, Mus musculus
catagtgaaaccaaagaggcctccc

SEQ ID NO: 417139 - DNA, 25 bp, Mus musculus
catagtgaccaccaagatcccatct

SEQ ID NO: 417140 - DNA, 25 bp, Mus musculus
catagtgaggtacttggcagacccc

SEQ ID NO: 417141 - DNA, 25 bp, Mus musculus
catagtgcaaggtagggaagtcccc

SEQ ID NO: 417142 - DNA, 25 bp, Mus musculus
catagtgcatcccataccaaggaag

SEQ ID NO: 417143 - DNA, 25 bp, Mus musculus
catagtgctgaggtctgtttgggta

SEQ ID NO: 417144 - DNA, 25 bp, Mus musculus
catagtgctttggtacagggactcc

SEQ ID NO: 417145 - DNA, 25 bp, Mus musculus
catagtggaaccctatcagaggaca

SEQ ID NO: 417146 - DNA, 25 bp, Mus musculus
catagtggcttccaggtcgtaagga

SEQ ID NO: 417147 - DNA, 25 bp, Mus musculus
catagtggtggtatatcagctgccc

SEQ ID NO: 417148 - DNA, 25 bp, Mus musculus
catagtgtacaaaccggattgggac

SEQ ID NO: 417149 - DNA, 25 bp, Mus musculus
catagtgtaggatcatggcaagtct

SEQ ID NO: 417150 - DNA, 25 bp, Mus musculus
catagtgtatgcgtcagtgtccagc

SEQ ID NO: 417151 - DNA, 25 bp, Mus musculus
catagtgtctacagggaaaggccca

SEQ ID NO: 417152 - DNA, 25 bp, Mus musculus
catagtgtgcatcttacgcaaggca

SEQ ID NO: 417153 - DNA, 25 bp, Mus musculus
catagtgtgccaaagaaatgctgct

SEQ ID NO: 417154 - DNA, 25 bp, Mus musculus
catagtgttaccatagagttgcacc

SEQ ID NO: 417155 - DNA, 25 bp, Mus musculus
catagtgtttgagggacttgatctc

SEQ ID NO: 417156 - DNA, 25 bp, Mus musculus
catagttactataacatctgagtac

SEQ ID NO: 417157 - DNA, 25 bp, Mus musculus
catagttatgtctgcgagctgcggc

SEQ ID NO: 417158 - DNA, 25 bp, Mus musculus
catagttattggagcaggagtcacc

SEQ ID NO: 417159 - DNA, 25 bp, Mus musculus
catagttcagccagcgatggtgacc

SEQ ID NO: 417160 - DNA, 25 bp, Mus musculus
catagttccctactctacgtctggg

SEQ ID NO: 417161 - DNA, 25 bp, Mus musculus
catagttcgggttgtggctgccagc

SEQ ID NO: 417162 - DNA, 25 bp, Mus musculus
catagttgacaccaacccgatttgg

SEQ ID NO: 417163 - DNA, 25 bp, Mus musculus
catagttgactacatcgacgcgcag

SEQ ID NO: 417164 - DNA, 25 bp, Mus musculus
catagttgccataggatcagttacc

SEQ ID NO: 417165 - DNA, 25 bp, Mus musculus
catagttgggaccattatgctggaa

SEQ ID NO: 417166 - DNA, 25 bp, Mus musculus
catagtttcagaactcaaggaacaa

SEQ ID NO: 417167 - DNA, 25 bp, Mus musculus
catataaatatgtactcgggagcac

SEQ ID NO: 417168 - DNA, 25 bp, Mus musculus
catataacgcaagcagccaggtgtc

SEQ ID NO: 417169 - DNA, 25 bp, Mus musculus
catataagatctgctgttgccgctg

SEQ ID NO: 417170 - DNA, 25 bp, Mus musculus
catataagcggagcaagcgccagac

SEQ ID NO: 417171 - DNA, 25 bp, Mus musculus
catataagctggtgccgtaggcgaa

SEQ ID NO: 417172 - DNA, 25 bp, Mus musculus
catataaggtgatgacagttccacg

SEQ ID NO: 417173 - DNA, 25 bp, Mus musculus
catataccagcgtgtcgaaggcacc

SEQ ID NO: 417174 - DNA, 25 bp, Mus musculus
catataccctcagactgaccttgga

SEQ ID NO: 417175 - DNA, 25 bp, Mus musculus
catatacgaggagcagaagggacca

SEQ ID NO: 417176 - DNA, 25 bp, Mus musculus
catatacgatttagaccagcctggg

SEQ ID NO: 417177 - DNA, 25 bp, Mus musculus
catatacttggagaggttgaaaccc

SEQ ID NO: 417178 - DNA, 25 bp, Mus musculus
catatagaggacacctaaggctagg

SEQ ID NO: 417179 - DNA, 25 bp, Mus musculus
catataggcaattctttccgaggag

SEQ ID NO: 417180 - DNA, 25 bp, Mus musculus
catataggctggaacaggctgagac

SEQ ID NO: 417181 - DNA, 25 bp, Mus musculus
catatagtccaagtgtccagttcag

SEQ ID NO: 417182 - DNA, 25 bp, Mus musculus
catatagtccgtgttggaggcgccc

SEQ ID NO: 417183 - DNA, 25 bp, Mus musculus
catatataaaacgtgcagctgcctc

SEQ ID NO: 417184 - DNA, 25 bp, Mus musculus
catatatactcaggagaccatgtgg

SEQ ID NO: 417185 - DNA, 25 bp, Mus musculus
catatatatggaacaggcctgggca

SEQ ID NO: 417186 - DNA, 25 bp, Mus musculus
catatatgaagcacacaagcgcctg

SEQ ID NO: 417187 - DNA, 25 bp, Mus musculus
catatcaatggacaatggccgctcc

SEQ ID NO: 417188 - DNA, 25 bp, Mus musculus
catatcactgtgcattcaagactag

SEQ ID NO: 417189 - DNA, 25 bp, Mus musculus
catatcactgttggagcccagagca

SEQ ID NO: 417190 - DNA, 25 bp, Mus musculus
catatcagcatgttaccaaggtgga

SEQ ID NO: 417191 - DNA, 25 bp, Mus musculus
catatcataaaagatctcctgggca

SEQ ID NO: 417192 - DNA, 25 bp, Mus musculus
catatcatccatgcttcaaagtctt

SEQ ID NO: 417193 - DNA, 25 bp, Mus musculus
catatcatgggatggcctgcaaccc

SEQ ID NO: 417194 - DNA, 25 bp, Mus musculus
catatccagatcaccagagaagatg

SEQ ID NO: 417195 - DNA, 25 bp, Mus musculus
catatccgttggtagagaggagtca

SEQ ID NO: 417196 - DNA, 25 bp, Mus musculus
catatcctatgttggctgagaagag

SEQ ID NO: 417197 - DNA, 25 bp, Mus musculus
catatcctatttgtagagttggcga

SEQ ID NO: 417198 - DNA, 25 bp, Mus musculus
catatctcagacgtgatgccgaccg

SEQ ID NO: 417199 - DNA, 25 bp, Mus musculus
catatctgatggcttgaccctggct

SEQ ID NO: 417200 - DNA, 25 bp, Mus musculus
catatctgctatatggaagtaccca

SEQ ID NO: 417201 - DNA, 25 bp, Mus musculus
catatcttacagaaccagcgtggga

SEQ ID NO: 417202 - DNA, 25 bp, Mus musculus
catatgaacagcagcggtgggcact

SEQ ID NO: 417203 - DNA, 25 bp, Mus musculus
catatgaagatggtagccgcctgtc

SEQ ID NO: 417204 - DNA, 25 bp, Mus musculus
catatgaagtcccaagctaagccag

SEQ ID NO: 417205 - DNA, 25 bp, Mus musculus
catatgaatgtgtgggcagctgcct

SEQ ID NO: 417206 - DNA, 25 bp, Mus musculus
catatgacactccaaaaccagcggg

SEQ ID NO: 417207 - DNA, 25 bp, Mus musculus
catatgacaggacatgcgcctgggc

SEQ ID NO: 417208 - DNA, 25 bp, Mus musculus
catatgacctccatggctcctggga

SEQ ID NO: 417209 - DNA, 25 bp, Mus musculus
catatgagaagcttagagcctggac

SEQ ID NO: 417210 - DNA, 25 bp, Mus musculus
catatgagacagttaaaccaccgga

SEQ ID NO: 417211 - DNA, 25 bp, Mus musculus
catatgatgtaaaagtacgtgctca

SEQ ID NO: 417212 - DNA, 25 bp, Mus musculus
catatgatttctcttgattcaggcg

SEQ ID NO: 417213 - DNA, 25 bp, Mus musculus
catatgcaaaagcaggtgccgtggc

SEQ ID NO: 417214 - DNA, 25 bp, Mus musculus
catatgcagaaccagagtgcgccag

SEQ ID NO: 417215 - DNA, 25 bp, Mus musculus
catatgcatgcgtggccaggaacag

SEQ ID NO: 417216 - DNA, 25 bp, Mus musculus
catatgccaggttcgggaaaacagg

SEQ ID NO: 417217 - DNA, 25 bp, Mus musculus
catatgcgcagggaatgaaccgaac

SEQ ID NO: 417218 - DNA, 25 bp, Mus musculus
catatgcggtagacagacacagcct

SEQ ID NO: 417219 - DNA, 25 bp, Mus musculus
catatgctgctagtgccaaggacct

SEQ ID NO: 417220 - DNA, 25 bp, Mus musculus
catatgctgctgactttggcaacac

SEQ ID NO: 417221 - DNA, 25 bp, Mus musculus
catatgcttgccctgtcgagtcctg

SEQ ID NO: 417222 - DNA, 25 bp, Mus musculus
catatgcttgcttggctgactagaa

SEQ ID NO: 417223 - DNA, 25 bp, Mus musculus
catatgctttagtgatcggttcaca

SEQ ID NO: 417224 - DNA, 25 bp, Mus musculus
catatgctttcagggctatgggtct

SEQ ID NO: 417225 - DNA, 25 bp, Mus musculus
catatggaaagctgtgctcttgtac

SEQ ID NO: 417226 - DNA, 25 bp, Mus musculus
catatggaccagacccaaagagaga

SEQ ID NO: 417227 - DNA, 25 bp, Mus musculus
catatggagaacacatctgacctgg

SEQ ID NO: 417228 - DNA, 25 bp, Mus musculus
catatggccgccataaaggccctgc

SEQ ID NO: 417229 - DNA, 25 bp, Mus musculus
catatggcctagcttttggtctaca

SEQ ID NO: 417230 - DNA, 25 bp, Mus musculus
catatggctctgataggttggtaca

SEQ ID NO: 417231 - DNA, 25 bp, Mus musculus
catatgggatccacaaatttccttc

SEQ ID NO: 417232 - DNA, 25 bp, Mus musculus
catatgggattcttcttggataacc

SEQ ID NO: 417233 - DNA, 25 bp, Mus musculus
catatgggcccttcagagattggtc

SEQ ID NO: 417234 - DNA, 25 bp, Mus musculus
catatgggctgaattagacaaaaga

SEQ ID NO: 417235 - DNA, 25 bp, Mus musculus
catatggtactcaaaactggaacta

SEQ ID NO: 417236 - DNA, 25 bp, Mus musculus
catatggtaggaactcaatgggcaa

SEQ ID NO: 417237 - DNA, 25 bp, Mus musculus
catatggtcaagagtggcaccaccc

SEQ ID NO: 417238 - DNA, 25 bp, Mus musculus
catatgtatgcatcccagtggttcc

SEQ ID NO: 417239 - DNA, 25 bp, Mus musculus
catatgtcagggagatgcctgtata

SEQ ID NO: 417240 - DNA, 25 bp, Mus musculus
catatgtgaacatgtggcaccgtca

SEQ ID NO: 417241 - DNA, 25 bp, Mus musculus
catatgtgcagataccagcctggta

SEQ ID NO: 417242 - DNA, 25 bp, Mus musculus
catatgttaatgagacccggtgaca

SEQ ID NO: 417243 - DNA, 25 bp, Mus musculus
catattaagtctcagccagacaagg

SEQ ID NO: 417244 - DNA, 25 bp, Mus musculus
catattacttggcaacggcaccctc

SEQ ID NO: 417245 - DNA, 25 bp, Mus musculus
catattaggagcaccaaaggaccca

SEQ ID NO: 417246 - DNA, 25 bp, Mus musculus
catattagtgtgtcccgcaggtccg

SEQ ID NO: 417247 - DNA, 25 bp, Mus musculus
catattattaaggagggactgcaca

SEQ ID NO: 417248 - DNA, 25 bp, Mus musculus
catattcaagaaaccagaccctggt

SEQ ID NO: 417249 - DNA, 25 bp, Mus musculus
catattcagcaacaggtaatggctc

SEQ ID NO: 417250 - DNA, 25 bp, Mus musculus
catattccagggtgattctgggctc

SEQ ID NO: 417251 - DNA, 25 bp, Mus musculus
catattctgtaaagtcccctgagct

SEQ ID NO: 417252 - DNA, 25 bp, Mus musculus
catattgacaaatggtgccgggact

SEQ ID NO: 417253 - DNA, 25 bp, Mus musculus
catattgcgatagaacattgttgga

SEQ ID NO: 417254 - DNA, 25 bp, Mus musculus
catattgctaatggcacatctgaga

SEQ ID NO: 417255 - DNA, 25 bp, Mus musculus
catattggaaaaggtaatcttgtcg

SEQ ID NO: 417256 - DNA, 25 bp, Mus musculus
catattggagaggatgcgccttccc

SEQ ID NO: 417257 - DNA, 25 bp, Mus musculus
catattgtgccgaaagggcccagga

SEQ ID NO: 417258 - DNA, 25 bp, Mus musculus
catatttcagagagggactagtgca

SEQ ID NO: 417259 - DNA, 25 bp, Mus musculus
catatttcgtgtgaatttgggagag

SEQ ID NO: 417260 - DNA, 25 bp, Mus musculus
catatttctgctgaagaggctgtca

SEQ ID NO: 417261 - DNA, 25 bp, Mus musculus
catatttcttctggaatcggcctgg

SEQ ID NO: 417262 - DNA, 25 bp, Mus musculus
catatttgagaagtcagggtctgca

SEQ ID NO: 417263 - DNA, 25 bp, Mus musculus
catatttgcaacagcatccgcggct

SEQ ID NO: 417264 - DNA, 25 bp, Mus musculus
catatttggcgcctcgagtgtggac

SEQ ID NO: 417265 - DNA, 25 bp, Mus musculus
catatttggtgtgcggcctgtggac

SEQ ID NO: 417266 - DNA, 25 bp, Mus musculus
catatttgtacaatgcactgtgaga

SEQ ID NO: 417267 - DNA, 25 bp, Mus musculus
catcaaaagatctgacgccgaggag

SEQ ID NO: 417268 - DNA, 25 bp, Mus musculus
catcaaaagggaggcagtacgggct

SEQ ID NO: 417269 - DNA, 25 bp, Mus musculus
catcaaaataatagagtggtgttgc

SEQ ID NO: 417270 - DNA, 25 bp, Mus musculus
catcaaacacttcggttgggtctgg

SEQ ID NO: 417271 - DNA, 25 bp, Mus musculus
catcaaacagggagtcagaagcaca

SEQ ID NO: 417272 - DNA, 25 bp, Mus musculus
catcaaactcgaaggcaaagtgccc

SEQ ID NO: 417273 - DNA, 25 bp, Mus musculus
catcaaactgccaggccgagagtac

SEQ ID NO: 417274 - DNA, 25 bp, Mus musculus
catcaaactggaggcagcaagagct

SEQ ID NO: 417275 - DNA, 25 bp, Mus musculus
catcaaagaattgggagtcacacag

SEQ ID NO: 417276 - DNA, 25 bp, Mus musculus
catcaaagaggtagggctggcaaac

SEQ ID NO: 417277 - DNA, 25 bp, Mus musculus
catcaaagatgctgccctcaagtgg

SEQ ID NO: 417278 - DNA, 25 bp, Mus musculus
catcaaaggcagaggatgctggtct

SEQ ID NO: 417279 - DNA, 25 bp, Mus musculus
catcaaagtggagcgaaagcggctg

SEQ ID NO: 417280 - DNA, 25 bp, Mus musculus
catcaaattctgctgtgacagtgac

SEQ ID NO: 417281 - DNA, 25 bp, Mus musculus
catcaacaatcacagctagtgggca

SEQ ID NO: 417282 - DNA, 25 bp, Mus musculus
catcaacaatgacgacaacttctgc

SEQ ID NO: 417283 - DNA, 25 bp, Mus musculus
catcaacatgctggtgggagccata

SEQ ID NO: 417284 - DNA, 25 bp, Mus musculus
catcaacatgtctggctcggtttct

SEQ ID NO: 417285 - DNA, 25 bp, Mus musculus
catcaacattggttccgggctggcg

SEQ ID NO: 417286 - DNA, 25 bp, Mus musculus
catcaaccattagatgacattggga

SEQ ID NO: 417287 - DNA, 25 bp, Mus musculus
catcaacccggaagtgtgagaggca

SEQ ID NO: 417288 - DNA, 25 bp, Mus musculus
catcaacgaggtcattctgtcggcc

SEQ ID NO: 417289 - DNA, 25 bp, Mus musculus
catcaacgctgattgccccatgaga

SEQ ID NO: 417290 - DNA, 25 bp, Mus musculus
catcaacggccacttcctgaaggag

SEQ ID NO: 417291 - DNA, 25 bp, Mus musculus
catcaacggtttgcctgggttcgaa

SEQ ID NO: 417292 - DNA, 25 bp, Mus musculus
catcaactgagagggtggaggcaac

SEQ ID NO: 417293 - DNA, 25 bp, Mus musculus
catcaactgctagagtgctgttcca

SEQ ID NO: 417294 - DNA, 25 bp, Mus musculus
catcaactgggacataacatcaagg

SEQ ID NO: 417295 - DNA, 25 bp, Mus musculus
catcaactgggagacgaatccttcc

SEQ ID NO: 417296 - DNA, 25 bp, Mus musculus
catcaagaaacgcttcaaggtgctc

SEQ ID NO: 417297 - DNA, 25 bp, Mus musculus
catcaagaaggacaaagtgctgctc

SEQ ID NO: 417298 - DNA, 25 bp, Mus musculus
catcaagaatgacgcaactgcccag

SEQ ID NO: 417299 - DNA, 25 bp, Mus musculus
catcaagacgctgtggagtgaccct

SEQ ID NO: 417300 - DNA, 25 bp, Mus musculus
catcaagaggaaaggtgcatggccc

SEQ ID NO: 417301 - DNA, 25 bp, Mus musculus
catcaagatggaggagcacgccctt

SEQ ID NO: 417302 - DNA, 25 bp, Mus musculus
catcaagcaaagcaagtgagggttc

SEQ ID NO: 417303 - DNA, 25 bp, Mus musculus
catcaagcaggcactgaaggatggc

SEQ ID NO: 417304 - DNA, 25 bp, Mus musculus
catcaagcccgagaatgtgctgctg

SEQ ID NO: 417305 - DNA, 25 bp, Mus musculus
catcaagcccgcagcaagatctact

SEQ ID NO: 417306 - DNA, 25 bp, Mus musculus
catcaagcgatcagggaatgggctc

SEQ ID NO: 417307 - DNA, 25 bp, Mus musculus
catcaagcggtggagtgacagccaa

SEQ ID NO: 417308 - DNA, 25 bp, Mus musculus
catcaagcgtcatgtgaatgtcctg

SEQ ID NO: 417309 - DNA, 25 bp, Mus musculus
catcaaggagggagacctgagtacc

SEQ ID NO: 417310 - DNA, 25 bp, Mus musculus
catcaagggactgttggatcatgcc

SEQ ID NO: 417311 - DNA, 25 bp, Mus musculus
catcaaggggagtttgaccaatgct

SEQ ID NO: 417312 - DNA, 25 bp, Mus musculus
catcaagggtgatgccgatctcaaa

SEQ ID NO: 417313 - DNA, 25 bp, Mus musculus
catcaaggtgtctgagcatctggct

SEQ ID NO: 417314 - DNA, 25 bp, Mus musculus
catcaaggttcacaacgaggccact

SEQ ID NO: 417315 - DNA, 25 bp, Mus musculus
catcaaggttctgctggagtacgcc

SEQ ID NO: 417316 - DNA, 25 bp, Mus musculus
catcaagtaccgagggcagtatcag

SEQ ID NO: 417317 - DNA, 25 bp, Mus musculus
catcaagtgggtcctgccagggctt

SEQ ID NO: 417318 - DNA, 25 bp, Mus musculus
catcaagttgctgagtgaaatgaac

SEQ ID NO: 417319 - DNA, 25 bp, Mus musculus
catcaatgggacagcagaagcagtg

SEQ ID NO: 417320 - DNA, 25 bp, Mus musculus
catcaatgggcttgttaactgtctg

SEQ ID NO: 417321 - DNA, 25 bp, Mus musculus
catcaatggttccaactgggagggc

SEQ ID NO: 417322 - DNA, 25 bp, Mus musculus
catcaatgtccctgaagccggtctc

SEQ ID NO: 417323 - DNA, 25 bp, Mus musculus
catcacaagaaatactcggagccag

SEQ ID NO: 417324 - DNA, 25 bp, Mus musculus
catcacaagaactggcacgaggtca

SEQ ID NO: 417325 - DNA, 25 bp, Mus musculus
catcacaatagactgccctcggcta

SEQ ID NO: 417326 - DNA, 25 bp, Mus musculus
catcacacaaccttacaagacgctg

SEQ ID NO: 417327 - DNA, 25 bp, Mus musculus
catcacactgtgtaagaaagactgg

SEQ ID NO: 417328 - DNA, 25 bp, Mus musculus
catcacagaagtatgaagaggggcg

SEQ ID NO: 417329 - DNA, 25 bp, Mus musculus
catcacagggttatgacttgtcacg

SEQ ID NO: 417330 - DNA, 25 bp, Mus musculus
catcacaggtaagagacccgtggga

SEQ ID NO: 417331 - DNA, 25 bp, Mus musculus
catcacattggttgggctgctcagc

SEQ ID NO: 417332 - DNA, 25 bp, Mus musculus
catcaccaggatgcacctcttggat

SEQ ID NO: 417333 - DNA, 25 bp, Mus musculus
catcacccagtcaggagagtttgtc

SEQ ID NO: 417334 - DNA, 25 bp, Mus musculus
catcaccccatatcttatgatgctg

SEQ ID NO: 417335 - DNA, 25 bp, Mus musculus
catcaccctaccaggttgtagcatg

SEQ ID NO: 417336 - DNA, 25 bp, Mus musculus
catcacccttgcaggtcaggccatg

SEQ ID NO: 417337 - DNA, 25 bp, Mus musculus
catcacctgacacagtgtggtcagt

SEQ ID NO: 417338 - DNA, 25 bp, Mus musculus
catcacctgtgctgaagagggctgg

SEQ ID NO: 417339 - DNA, 25 bp, Mus musculus
catcacgaggctatgagagtcaggc

SEQ ID NO: 417340 - DNA, 25 bp, Mus musculus
catcacgggaggatggtctgcccct

SEQ ID NO: 417341 - DNA, 25 bp, Mus musculus
catcacgtgctacctagaggcacag

SEQ ID NO: 417342 - DNA, 25 bp, Mus musculus
catcactaacgtactcttggagagg

SEQ ID NO: 417343 - DNA, 25 bp, Mus musculus
catcactaagaggaggtatcgctgc

SEQ ID NO: 417344 - DNA, 25 bp, Mus musculus
catcactatgctggatgagcaaggg

SEQ ID NO: 417345 - DNA, 25 bp, Mus musculus
catcactcagtgtcctgggtggcaa

SEQ ID NO: 417346 - DNA, 25 bp, Mus musculus
catcactgagctgccggagaagtca

SEQ ID NO: 417347 - DNA, 25 bp, Mus musculus
catcactgtagaacttagcatgtac

SEQ ID NO: 417348 - DNA, 25 bp, Mus musculus
catcacttacaaggaacaggaggac

SEQ ID NO: 417349 - DNA, 25 bp, Mus musculus
catcacttcatggaactatgttggg

SEQ ID NO: 417350 - DNA, 25 bp, Mus musculus
catcacttgagttcgaaggagcaca

SEQ ID NO: 417351 - DNA, 25 bp, Mus musculus
catcagaaaaagtgagcccaggctt

SEQ ID NO: 417352 - DNA, 25 bp, Mus musculus
catcagaagggacatagaccaggtc

SEQ ID NO: 417353 - DNA, 25 bp, Mus musculus
catcagaagggagccagctgtggcc

SEQ ID NO: 417354 - DNA, 25 bp, Mus musculus
catcagaaggtcagaggtgatacct

SEQ ID NO: 417355 - DNA, 25 bp, Mus musculus
catcagacataccagaggaccaatt

SEQ ID NO: 417356 - DNA, 25 bp, Mus musculus
catcagacttagcatgtgttaaaaa

SEQ ID NO: 417357 - DNA, 25 bp, Mus musculus
catcagagaacgagaacgtattaca

SEQ ID NO: 417358 - DNA, 25 bp, Mus musculus
catcagagcccatctggtggaaaga

SEQ ID NO: 417359 - DNA, 25 bp, Mus musculus
catcagagcccctgtatctgtggct

SEQ ID NO: 417360 - DNA, 25 bp, Mus musculus
catcagagcgtgagcctggctgtgt

SEQ ID NO: 417361 - DNA, 25 bp, Mus musculus
catcagaggctcaacagtggcagct

SEQ ID NO: 417362 - DNA, 25 bp, Mus musculus
catcagaggcttcacacagggaaaa

SEQ ID NO: 417363 - DNA, 25 bp, Mus musculus
catcagattacggagggcagctttt

SEQ ID NO: 417364 - DNA, 25 bp, Mus musculus
catcagattagacccttctcagcca

SEQ ID NO: 417365 - DNA, 25 bp, Mus musculus
catcagatttgattggcccagaggc

SEQ ID NO: 417366 - DNA, 25 bp, Mus musculus
catcagcaaagggaccaaggactct

SEQ ID NO: 417367 - DNA, 25 bp, Mus musculus
catcagcaggatggatttcgggtcc

SEQ ID NO: 417368 - DNA, 25 bp, Mus musculus
catcagcagggacttctcaaaggtg

SEQ ID NO: 417369 - DNA, 25 bp, Mus musculus
catcagcatgcgtaagttgggagag

SEQ ID NO: 417370 - DNA, 25 bp, Mus musculus
catcagccaaactcgacaagtaaag

SEQ ID NO: 417371 - DNA, 25 bp, Mus musculus
catcagccacacctcgctggagtga

SEQ ID NO: 417372 - DNA, 25 bp, Mus musculus
catcagccctgaacgagtatgaggt

SEQ ID NO: 417373 - DNA, 25 bp, Mus musculus
catcagccgcaagaagttggagcac

SEQ ID NO: 417374 - DNA, 25 bp, Mus musculus
catcagccggatggaggagtcctct

SEQ ID NO: 417375 - DNA, 25 bp, Mus musculus
catcagcgatgaggcacagggtgac

SEQ ID NO: 417376 - DNA, 25 bp, Mus musculus
catcagcgttaaagagttgggcacc

SEQ ID NO: 417377 - DNA, 25 bp, Mus musculus
catcagctcgagtctctaaaggtct

SEQ ID NO: 417378 - DNA, 25 bp, Mus musculus
catcaggaaatcgaaagccaggctc

SEQ ID NO: 417379 - DNA, 25 bp, Mus musculus
catcaggaacttacatacagattaa

SEQ ID NO: 417380 - DNA, 25 bp, Mus musculus
catcaggacacagaggtaaagtctg

SEQ ID NO: 417381 - DNA, 25 bp, Mus musculus
catcaggactgagaatttggccaag

SEQ ID NO: 417382 - DNA, 25 bp, Mus musculus
catcaggatgagctgcaagactcca

SEQ ID NO: 417383 - DNA, 25 bp, Mus musculus
catcaggatgagtgccaatgccggt

SEQ ID NO: 417384 - DNA, 25 bp, Mus musculus
catcaggattctggcaggctgcacg

SEQ ID NO: 417385 - DNA, 25 bp, Mus musculus
catcaggcctcttctcattgtgagc

SEQ ID NO: 417386 - DNA, 25 bp, Mus musculus
catcaggcctggtatgcggcggaaa

SEQ ID NO: 417387 - DNA, 25 bp, Mus musculus
catcaggctcccttggcgtttcgga

SEQ ID NO: 417388 - DNA, 25 bp, Mus musculus
catcagggaccccacaaagaaaagg

SEQ ID NO: 417389 - DNA, 25 bp, Mus musculus
catcagggactagttctcaaggcca

SEQ ID NO: 417390 - DNA, 25 bp, Mus musculus
catcagggatgttatgcagagccac

SEQ ID NO: 417391 - DNA, 25 bp, Mus musculus
catcagggtttctaaagtgcggtcc

SEQ ID NO: 417392 - DNA, 25 bp, Mus musculus
catcaggtactctctgcgtgtgtgc

SEQ ID NO: 417393 - DNA, 25 bp, Mus musculus
catcaggtccccagtgttaggagga

SEQ ID NO: 417394 - DNA, 25 bp, Mus musculus
catcaggtctcggtttgtaagcaga

SEQ ID NO: 417395 - DNA, 25 bp, Mus musculus
catcaggtgacagataaaaacggtc

SEQ ID NO: 417396 - DNA, 25 bp, Mus musculus
catcaggtgggctcagacaggagac

SEQ ID NO: 417397 - DNA, 25 bp, Mus musculus
catcaggtgtctccaagtgacgctc

SEQ ID NO: 417398 - DNA, 25 bp, Mus musculus
catcagtaatagagagtccccagga

SEQ ID NO: 417399 - DNA, 25 bp, Mus musculus
catcagtattgcctttggcctctga

SEQ ID NO: 417400 - DNA, 25 bp, Mus musculus
catcagtcaactattagaaggcagc

SEQ ID NO: 417401 - DNA, 25 bp, Mus musculus
catcagtcaggaccgctacaggttg

SEQ ID NO: 417402 - DNA, 25 bp, Mus musculus
catcagtccaggcatgagtcagcgg

SEQ ID NO: 417403 - DNA, 25 bp, Mus musculus
catcagtgacacttctggcttggga

SEQ ID NO: 417404 - DNA, 25 bp, Mus musculus
catcagtgctgagagaatgttcgaa

SEQ ID NO: 417405 - DNA, 25 bp, Mus musculus
catcagtgctgggaaaatgacttgg

SEQ ID NO: 417406 - DNA, 25 bp, Mus musculus
catcagtggaaatcggagttgttgc

SEQ ID NO: 417407 - DNA, 25 bp, Mus musculus
catcagtggcagcacctcggttgaa

SEQ ID NO: 417408 - DNA, 25 bp, Mus musculus
catcagtggccgtcagaggaggcct

SEQ ID NO: 417409 - DNA, 25 bp, Mus musculus
catcagtgggtcaatggaatccgca

SEQ ID NO: 417410 - DNA, 25 bp, Mus musculus
catcagtggtgagttcatcggagcc

SEQ ID NO: 417411 - DNA, 25 bp, Mus musculus
catcagtgtcgccaggagcttcaaa

SEQ ID NO: 417412 - DNA, 25 bp, Mus musculus
catcagttagaaagggaaggccagc

SEQ ID NO: 417413 - DNA, 25 bp, Mus musculus
catcagttgctctaaggtagtaacc

SEQ ID NO: 417414 - DNA, 25 bp, Mus musculus
catcataagcgtgcagtaccctcag

SEQ ID NO: 417415 - DNA, 25 bp, Mus musculus
catcatacactttcgggaggccatc

SEQ ID NO: 417416 - DNA, 25 bp, Mus musculus
catcatacatcctgggaagggctcc

SEQ ID NO: 417417 - DNA, 25 bp, Mus musculus
catcataccagagtgtggaggaccc

SEQ ID NO: 417418 - DNA, 25 bp, Mus musculus
catcatagtaaggagtgtggctgca

SEQ ID NO: 417419 - DNA, 25 bp, Mus musculus
catcatatggtagaggccaggaacc

SEQ ID NO: 417420 - DNA, 25 bp, Mus musculus
catcatattctacctggccatcggg

SEQ ID NO: 417421 - DNA, 25 bp, Mus musculus
catcatcaaaagtagtgagagtcct

SEQ ID NO: 417422 - DNA, 25 bp, Mus musculus
catcatcaggcaagagagggcttcc

SEQ ID NO: 417423 - DNA, 25 bp, Mus musculus
catcatcaggtgctgggtctcagaa

SEQ ID NO: 417424 - DNA, 25 bp, Mus musculus
catcatcatcgtccaacgcttcaag

SEQ ID NO: 417425 - DNA, 25 bp, Mus musculus
catcatcatgatgcacgggcacgtg

SEQ ID NO: 417426 - DNA, 25 bp, Mus musculus
catcatcatgctggtcagtagggaa

SEQ ID NO: 417427 - DNA, 25 bp, Mus musculus
catcatccaggaagctcaaagagtc

SEQ ID NO: 417428 - DNA, 25 bp, Mus musculus
catcatccgcaagtttgagggccag

SEQ ID NO: 417429 - DNA, 25 bp, Mus musculus
catcatcctttgctggaaccaaggg

SEQ ID NO: 417430 - DNA, 25 bp, Mus musculus
catcatcgaagaagaacagaacaac

SEQ ID NO: 417431 - DNA, 25 bp, Mus musculus
catcatcgggcagtctcttcaggga

SEQ ID NO: 417432 - DNA, 25 bp, Mus musculus
catcatcgtcataggagaaggctcc

SEQ ID NO: 417433 - DNA, 25 bp, Mus musculus
catcatcgtcatggaaagccttgcc

SEQ ID NO: 417434 - DNA, 25 bp, Mus musculus
catcatctagatgggatcaaatcca

SEQ ID NO: 417435 - DNA, 25 bp, Mus musculus
catcatctcggaagtcaaggcccag

SEQ ID NO: 417436 - DNA, 25 bp, Mus musculus
catcatctgcgttagaaacctggga

SEQ ID NO: 417437 - DNA, 25 bp, Mus musculus
catcatctgtctgcacaacgttggg

SEQ ID NO: 417438 - DNA, 25 bp, Mus musculus
catcatcttgggactactggacata

SEQ ID NO: 417439 - DNA, 25 bp, Mus musculus
catcatgaacaacaggtggatcctc

SEQ ID NO: 417440 - DNA, 25 bp, Mus musculus
catcatgaacccagcacagagttac

SEQ ID NO: 417441 - DNA, 25 bp, Mus musculus
catcatgactaggaggctgtgttgc

SEQ ID NO: 417442 - DNA, 25 bp, Mus musculus
catcatgaggtggtgcaaagcaggt

SEQ ID NO: 417443 - DNA, 25 bp, Mus musculus
catcatgagtagaagactgggcatc

SEQ ID NO: 417444 - DNA, 25 bp, Mus musculus
catcatgatgaaccgagtgtgtaag

SEQ ID NO: 417445 - DNA, 25 bp, Mus musculus
catcatgcatgaagggcagagcgct

SEQ ID NO: 417446 - DNA, 25 bp, Mus musculus
catcatgccccgactgagtgaggag

SEQ ID NO: 417447 - DNA, 25 bp, Mus musculus
catcatgctcttcaccttgctggga

SEQ ID NO: 417448 - DNA, 25 bp, Mus musculus
catcatgctgatggacacatgctac

SEQ ID NO: 417449 - DNA, 25 bp, Mus musculus
catcatggaagagtgcattcagccc

SEQ ID NO: 417450 - DNA, 25 bp, Mus musculus
catcatggacgtggacatagaccct

SEQ ID NO: 417451 - DNA, 25 bp, Mus musculus
catcatggatcgcatggaagcgcca

SEQ ID NO: 417452 - DNA, 25 bp, Mus musculus
catcatggcatgtcctgtgcagaag

SEQ ID NO: 417453 - DNA, 25 bp, Mus musculus
catcatggcggaggtgtacacgctc

SEQ ID NO: 417454 - DNA, 25 bp, Mus musculus
catcatggcgggaaacgtggtatgc

SEQ ID NO: 417455 - DNA, 25 bp, Mus musculus
catcatgtacacagggagcacggct

SEQ ID NO: 417456 - DNA, 25 bp, Mus musculus
catcatgtcggagaagaagagccaa

SEQ ID NO: 417457 - DNA, 25 bp, Mus musculus
catcatgtgacatctccagtggagc

SEQ ID NO: 417458 - DNA, 25 bp, Mus musculus
catcatgtgtgtgggcagccagcat

SEQ ID NO: 417459 - DNA, 25 bp, Mus musculus
catcatgttgtttcgaaaggcctaa

SEQ ID NO: 417460 - DNA, 25 bp, Mus musculus
catcatgtttctgggccaggaggga

SEQ ID NO: 417461 - DNA, 25 bp, Mus musculus
catcattacgcccacagcgaaggga

SEQ ID NO: 417462 - DNA, 25 bp, Mus musculus
catcattatgaaccgctgggctctg

SEQ ID NO: 417463 - DNA, 25 bp, Mus musculus
catcattggaggtattatcgctgcc

SEQ ID NO: 417464 - DNA, 25 bp, Mus musculus
catcattggccttcgagggtgggtt

SEQ ID NO: 417465 - DNA, 25 bp, Mus musculus
catcattgtcaactgcgtggaggag

SEQ ID NO: 417466 - DNA, 25 bp, Mus musculus
catcattgtcagtatgggaatccac

SEQ ID NO: 417467 - DNA, 25 bp, Mus musculus
catcattgttgtggtctgctgtgtc

SEQ ID NO: 417468 - DNA, 25 bp, Mus musculus
catcatttggtctccggtgtgccgc

SEQ ID NO: 417469 - DNA, 25 bp, Mus musculus
catcattttccagagggattagtag

SEQ ID NO: 417470 - DNA, 25 bp, Mus musculus
catccaaaaagagtcgggaccaggc

SEQ ID NO: 417471 - DNA, 25 bp, Mus musculus
catccaaaatagactgcgaggccct

SEQ ID NO: 417472 - DNA, 25 bp, Mus musculus
catccaaacattggtgagtgtccgg

SEQ ID NO: 417473 - DNA, 25 bp, Mus musculus
catccaaagtacagggagtctctga

SEQ ID NO: 417474 - DNA, 25 bp, Mus musculus
catccaagaaaggacgtggtgccct

SEQ ID NO: 417475 - DNA, 25 bp, Mus musculus
catccaagaagtaagggacatggtc

SEQ ID NO: 417476 - DNA, 25 bp, Mus musculus
catccaagagcagacgagagaccat

SEQ ID NO: 417477 - DNA, 25 bp, Mus musculus
catccaagcaggaagtgcatgcagg

SEQ ID NO: 417478 - DNA, 25 bp, Mus musculus
catccaaggtgctatccgagtccag

SEQ ID NO: 417479 - DNA, 25 bp, Mus musculus
catccaagtgatccgaagggaggca

SEQ ID NO: 417480 - DNA, 25 bp, Mus musculus
catccaatcaatgaagaaagagtat

SEQ ID NO: 417481 - DNA, 25 bp, Mus musculus
catccaatgattggctgtaagtgtc

SEQ ID NO: 417482 - DNA, 25 bp, Mus musculus
catccacagtggattgttgacggcc

SEQ ID NO: 417483 - DNA, 25 bp, Mus musculus
catccaccctggtataagctctagg

SEQ ID NO: 417484 - DNA, 25 bp, Mus musculus
catccacggaggcaataatctctct

SEQ ID NO: 417485 - DNA, 25 bp, Mus musculus
catccacggtataggttgcatgctg

SEQ ID NO: 417486 - DNA, 25 bp, Mus musculus
catccacgtgtggtgaagaacccag

SEQ ID NO: 417487 - DNA, 25 bp, Mus musculus
catccactgagcagaactgggccaa

SEQ ID NO: 417488 - DNA, 25 bp, Mus musculus
catccactggtgagacggctaaaca

SEQ ID NO: 417489 - DNA, 25 bp, Mus musculus
catccactttgtgcaccgagacagg

SEQ ID NO: 417490 - DNA, 25 bp, Mus musculus
catccagaatgagaacacagtgccc

SEQ ID NO: 417491 - DNA, 25 bp, Mus musculus
catccagaatgcagctaggaccaca

SEQ ID NO: 417492 - DNA, 25 bp, Mus musculus
catccagaccagagctacgttaagt

SEQ ID NO: 417493 - DNA, 25 bp, Mus musculus
catccagacggttgaagaggcctct

SEQ ID NO: 417494 - DNA, 25 bp, Mus musculus
catccagatggtgagagaacttcac

SEQ ID NO: 417495 - DNA, 25 bp, Mus musculus
catccagcatggtgggacatcagca

SEQ ID NO: 417496 - DNA, 25 bp, Mus musculus
catccagcggttaagtcgaggtccc

SEQ ID NO: 417497 - DNA, 25 bp, Mus musculus
catccagctgagaagagctaaggaa

SEQ ID NO: 417498 - DNA, 25 bp, Mus musculus
catccagctggtgtgttctatcgca

SEQ ID NO: 417499 - DNA, 25 bp, Mus musculus
catccaggaggctgcgttgagcatc

SEQ ID NO: 417500 - DNA, 25 bp, Mus musculus
catccaggatggaggctttcctcta

SEQ ID NO: 417501 - DNA, 25 bp, Mus musculus
catccaggctgcatgaatgccaagc

SEQ ID NO: 417502 - DNA, 25 bp, Mus musculus
catccagggtgttggttggaacctc

SEQ ID NO: 417503 - DNA, 25 bp, Mus musculus
catccaggtaggcacagatctccag

SEQ ID NO: 417504 - DNA, 25 bp, Mus musculus
catccagtatggagacgctgccctg

SEQ ID NO: 417505 - DNA, 25 bp, Mus musculus
catccagtgtaattgttggttttct

SEQ ID NO: 417506 - DNA, 25 bp, Mus musculus
catccagttcacaggagccggaaag

SEQ ID NO: 417507 - DNA, 25 bp, Mus musculus
catccagtttctttataggagacag

SEQ ID NO: 417508 - DNA, 25 bp, Mus musculus
catccataaactagggagaacacct

SEQ ID NO: 417509 - DNA, 25 bp, Mus musculus
catccataggattttcaatggaaag

SEQ ID NO: 417510 - DNA, 25 bp, Mus musculus
catccatcctgcgtgtaacctgaag

SEQ ID NO: 417511 - DNA, 25 bp, Mus musculus
catccatgaaacgaaagctgccttt

SEQ ID NO: 417512 - DNA, 25 bp, Mus musculus
catccatgcgaggtttttgcagcaa

SEQ ID NO: 417513 - DNA, 25 bp, Mus musculus
catccatgcttatgtttgctgaaag

SEQ ID NO: 417514 - DNA, 25 bp, Mus musculus
catccatggactccgcaaggtggta

SEQ ID NO: 417515 - DNA, 25 bp, Mus musculus
catccatggataacccagggccttc

SEQ ID NO: 417516 - DNA, 25 bp, Mus musculus
catccatgggtgaaggtgaatctca

SEQ ID NO: 417517 - DNA, 25 bp, Mus musculus
catccattgcgtaaaagagagaccc

SEQ ID NO: 417518 - DNA, 25 bp, Mus musculus
catccattgtctaccgtgtggcgcg

SEQ ID NO: 417519 - DNA, 25 bp, Mus musculus
catccatttgcaagaaggcaggccg

SEQ ID NO: 417520 - DNA, 25 bp, Mus musculus
catcccaagaagattctgcatggct

SEQ ID NO: 417521 - DNA, 25 bp, Mus musculus
catcccaagcccagagagcgagttt

SEQ ID NO: 417522 - DNA, 25 bp, Mus musculus
catcccagagcttggcggagtgacc

SEQ ID NO: 417523 - DNA, 25 bp, Mus musculus
catcccagggagatttttgcagaca

SEQ ID NO: 417524 - DNA, 25 bp, Mus musculus
catcccagggttgcttttatgggaa

SEQ ID NO: 417525 - DNA, 25 bp, Mus musculus
catcccaggtacccgagtatccgag

SEQ ID NO: 417526 - DNA, 25 bp, Mus musculus
catcccagttgtaccagcttcctga

SEQ ID NO: 417527 - DNA, 25 bp, Mus musculus
catccccaaggtggagctggttcct

SEQ ID NO: 417528 - DNA, 25 bp, Mus musculus
catccccatggatagaacgctgatc

SEQ ID NO: 417529 - DNA, 25 bp, Mus musculus
catccccgagactgctgagaagtgg

SEQ ID NO: 417530 - DNA, 25 bp, Mus musculus
catcccctcggaaaagatctggcgg

SEQ ID NO: 417531 - DNA, 25 bp, Mus musculus
catcccctgcttaactctgaagatt

SEQ ID NO: 417532 - DNA, 25 bp, Mus musculus
catcccgaagcctgcacgtgaaggt

SEQ ID NO: 417533 - DNA, 25 bp, Mus musculus
catcccgaatttgtcttgaagagca

SEQ ID NO: 417534 - DNA, 25 bp, Mus musculus
catcccgcaaagtgaaagtggcagg

SEQ ID NO: 417535 - DNA, 25 bp, Mus musculus
catcccggaaggctcagtaaccaag

SEQ ID NO: 417536 - DNA, 25 bp, Mus musculus
catcccggtcttacatcttagtgag

SEQ ID NO: 417537 - DNA, 25 bp, Mus musculus
catcccgtgggtggacaacaatgtc

SEQ ID NO: 417538 - DNA, 25 bp, Mus musculus
catcccgtgttctacaagacccttt

SEQ ID NO: 417539 - DNA, 25 bp, Mus musculus
catccctaatggtgtggaaagctta

SEQ ID NO: 417540 - DNA, 25 bp, Mus musculus
catccctagggctttcatcctgagg

SEQ ID NO: 417541 - DNA, 25 bp, Mus musculus
catccctgagtcatcatcttcgaaa

SEQ ID NO: 417542 - DNA, 25 bp, Mus musculus
catcccttcctatgtgccagttagg

SEQ ID NO: 417543 - DNA, 25 bp, Mus musculus
catcccttgacctacgaagaagaag

SEQ ID NO: 417544 - DNA, 25 bp, Mus musculus
catcccttgcggagaggaagcaggt

SEQ ID NO: 417545 - DNA, 25 bp, Mus musculus
catcccttggacagactacattgct

SEQ ID NO: 417546 - DNA, 25 bp, Mus musculus
catccctttgctatcgagaacatca

SEQ ID NO: 417547 - DNA, 25 bp, Mus musculus
catccgacgtgaaggacatgtctaa

SEQ ID NO: 417548 - DNA, 25 bp, Mus musculus
catccgagaagctggtggagccttc

SEQ ID NO: 417549 - DNA, 25 bp, Mus musculus
catccgagatgccagtgcgctaggc

SEQ ID NO: 417550 - DNA, 25 bp, Mus musculus
catccgagtgtttgaggaagaccca

SEQ ID NO: 417551 - DNA, 25 bp, Mus musculus
catccgatatatccaccagtgggaa

SEQ ID NO: 417552 - DNA, 25 bp, Mus musculus
catccgatgacgctaggaccttgag

SEQ ID NO: 417553 - DNA, 25 bp, Mus musculus
catccgatggcctgaagaacttgaa

SEQ ID NO: 417554 - DNA, 25 bp, Mus musculus
catccgatggtagcgctcagcagat

SEQ ID NO: 417555 - DNA, 25 bp, Mus musculus
catccgcacgagagacaataaggtc

SEQ ID NO: 417556 - DNA, 25 bp, Mus musculus
catccgcctgctaagatgcctgtga

SEQ ID NO: 417557 - DNA, 25 bp, Mus musculus
catccgcggatgacattgaggcaat

SEQ ID NO: 417558 - DNA, 25 bp, Mus musculus
catccgctacatgagtggtggcaca

SEQ ID NO: 417559 - DNA, 25 bp, Mus musculus
catccggaacttgctgcagctggga

SEQ ID NO: 417560 - DNA, 25 bp, Mus musculus
catccgggaagtctgcaaagtggtc

SEQ ID NO: 417561 - DNA, 25 bp, Mus musculus
catccgggaataatgctagctttgg

SEQ ID NO: 417562 - DNA, 25 bp, Mus musculus
catccgggaccatcgtgcagattgt

SEQ ID NO: 417563 - DNA, 25 bp, Mus musculus
catccggttgaatggcagtccttgg

SEQ ID NO: 417564 - DNA, 25 bp, Mus musculus
catccgtaacaggagtgacagccgg

SEQ ID NO: 417565 - DNA, 25 bp, Mus musculus
catccgtgaactaaatgcctttgaa

SEQ ID NO: 417566 - DNA, 25 bp, Mus musculus
catccgtgacatgcagtggcaccag

SEQ ID NO: 417567 - DNA, 25 bp, Mus musculus
catccgtgagacaaagatcttatgc

SEQ ID NO: 417568 - DNA, 25 bp, Mus musculus
catccgtgcctatgagcagctggga

SEQ ID NO: 417569 - DNA, 25 bp, Mus musculus
catccgtgtgatagacctcagtgaa

SEQ ID NO: 417570 - DNA, 25 bp, Mus musculus
catccgttagagagtggtgacctga

SEQ ID NO: 417571 - DNA, 25 bp, Mus musculus
catccgttgggagtcatgagaggct

SEQ ID NO: 417572 - DNA, 25 bp, Mus musculus
catcctactgatcccatggtgtttt

SEQ ID NO: 417573 - DNA, 25 bp, Mus musculus
catcctagactatcgggcatcctgg

SEQ ID NO: 417574 - DNA, 25 bp, Mus musculus
catcctaggagaagacatggcagtg

SEQ ID NO: 417575 - DNA, 25 bp, Mus musculus
catcctaggagtgggaagatatgcc

SEQ ID NO: 417576 - DNA, 25 bp, Mus musculus
catcctaggctaagaggctgcctca

SEQ ID NO: 417577 - DNA, 25 bp, Mus musculus
catcctatgcttgggagtggctgaa

SEQ ID NO: 417578 - DNA, 25 bp, Mus musculus
catcctatgtcggtcgtggccttaa

SEQ ID NO: 417579 - DNA, 25 bp, Mus musculus
catcctcaaggagcaaggttcaacc

SEQ ID NO: 417580 - DNA, 25 bp, Mus musculus
catcctcatcttcaagggctcctga

SEQ ID NO: 417581 - DNA, 25 bp, Mus musculus
catcctccctgtcaactctgagtga

SEQ ID NO: 417582 - DNA, 25 bp, Mus musculus
catcctcgaagcaagttgtgtagca

SEQ ID NO: 417583 - DNA, 25 bp, Mus musculus
catcctcggaggtcaaggaggtcta

SEQ ID NO: 417584 - DNA, 25 bp, Mus musculus
catcctctaacacccatggcgatga

SEQ ID NO: 417585 - DNA, 25 bp, Mus musculus
catcctctgagaaggtactgaagac

SEQ ID NO: 417586 - DNA, 25 bp, Mus musculus
catcctctgatggaactgtgtgcac

SEQ ID NO: 417587 - DNA, 25 bp, Mus musculus
catcctctggttctgccgcagactt

SEQ ID NO: 417588 - DNA, 25 bp, Mus musculus
catcctgaacggtgagtggtcagta

SEQ ID NO: 417589 - DNA, 25 bp, Mus musculus
catcctgaagattgtcgtgcgggaa

SEQ ID NO: 417590 - DNA, 25 bp, Mus musculus
catcctgaaggctgaagccctggcc

SEQ ID NO: 417591 - DNA, 25 bp, Mus musculus
catcctgaagttgaccctgctctgg

SEQ ID NO: 417592 - DNA, 25 bp, Mus musculus
catcctgacagcagatttgtgtaac

SEQ ID NO: 417593 - DNA, 25 bp, Mus musculus
catcctgacccatgggaactgcggt

SEQ ID NO: 417594 - DNA, 25 bp, Mus musculus
catcctgagtattacgaggagatgg

SEQ ID NO: 417595 - DNA, 25 bp, Mus musculus
catcctgcagaagggttgggtcaga

SEQ ID NO: 417596 - DNA, 25 bp, Mus musculus
catcctgcgtgtggatccggtcaac

SEQ ID NO: 417597 - DNA, 25 bp, Mus musculus
catcctgctgcaaaagctcgctcgg

SEQ ID NO: 417598 - DNA, 25 bp, Mus musculus
catcctgcttcgagggacggtccat

SEQ ID NO: 417599 - DNA, 25 bp, Mus musculus
catcctggaacttgcgctgtacacc

SEQ ID NO: 417600 - DNA, 25 bp, Mus musculus
catcctggaagactggacagccatc

SEQ ID NO: 417601 - DNA, 25 bp, Mus musculus
catcctggactggtttgtgagacac

SEQ ID NO: 417602 - DNA, 25 bp, Mus musculus
catcctggagattactgcggtggaa

SEQ ID NO: 417603 - DNA, 25 bp, Mus musculus
catcctggcaaaagggcagtgggtc

SEQ ID NO: 417604 - DNA, 25 bp, Mus musculus
catcctggcagaggtgaatcaccct

SEQ ID NO: 417605 - DNA, 25 bp, Mus musculus
catcctggccatggaacagttcgaa

SEQ ID NO: 417606 - DNA, 25 bp, Mus musculus
catcctggcgcctggaaaccatagt

SEQ ID NO: 417607 - DNA, 25 bp, Mus musculus
catcctggctgcgaaaaggctttca

SEQ ID NO: 417608 - DNA, 25 bp, Mus musculus
catcctgggaggtttcctgcttgtg

SEQ ID NO: 417609 - DNA, 25 bp, Mus musculus
catcctgggatttgggtctgtcact

SEQ ID NO: 417610 - DNA, 25 bp, Mus musculus
catcctgggcttttgaagaggttag

SEQ ID NO: 417611 - DNA, 25 bp, Mus musculus
catcctgggttctgtcagtgagcag

SEQ ID NO: 417612 - DNA, 25 bp, Mus musculus
catcctggtcagtgtggtcagtcta

SEQ ID NO: 417613 - DNA, 25 bp, Mus musculus
catcctgtaagctaggcagctggcc

SEQ ID NO: 417614 - DNA, 25 bp, Mus musculus
catcctgtacaaagcggagggcgcg

SEQ ID NO: 417615 - DNA, 25 bp, Mus musculus
catcctgtactggttggcgccaggc

SEQ ID NO: 417616 - DNA, 25 bp, Mus musculus
catcctgtgctacaagtaaggaggg

SEQ ID NO: 417617 - DNA, 25 bp, Mus musculus
catcctgtgtcatttggaactcgag

SEQ ID NO: 417618 - DNA, 25 bp, Mus musculus
catcctgtgtttgggagtgggctca

SEQ ID NO: 417619 - DNA, 25 bp, Mus musculus
catcctgtttatgtccggcgtgcag

SEQ ID NO: 417620 - DNA, 25 bp, Mus musculus
catccttagttagctgtttaattca

SEQ ID NO: 417621 - DNA, 25 bp, Mus musculus
catccttatggtttcacacgggtga

SEQ ID NO: 417622 - DNA, 25 bp, Mus musculus
catccttcaggacatgagctgctgg

SEQ ID NO: 417623 - DNA, 25 bp, Mus musculus
catccttcagtctcgccgggaaagg

SEQ ID NO: 417624 - DNA, 25 bp, Mus musculus
catcgaagactaacgagagcccagt

SEQ ID NO: 417625 - DNA, 25 bp, Mus musculus
catcgaaggtggcaaaagcggcatt

SEQ ID NO: 417626 - DNA, 25 bp, Mus musculus
catcgaatctgacgcacagctgagg

SEQ ID NO: 417627 - DNA, 25 bp, Mus musculus
catcgacaaaatggacagtgggaca

SEQ ID NO: 417628 - DNA, 25 bp, Mus musculus
catcgacactgtaggcactgaaggc

SEQ ID NO: 417629 - DNA, 25 bp, Mus musculus
catcgacagctagaggagtccctgg

SEQ ID NO: 417630 - DNA, 25 bp, Mus musculus
catcgacatggagctggtgaaacgg

SEQ ID NO: 417631 - DNA, 25 bp, Mus musculus
catcgaccaatgtaccaacagaggg

SEQ ID NO: 417632 - DNA, 25 bp, Mus musculus
catcgacgggagtaatgactgaagc

SEQ ID NO: 417633 - DNA, 25 bp, Mus musculus
catcgactcaggtgtcaacgggcag

SEQ ID NO: 417634 - DNA, 25 bp, Mus musculus
catcgacttcttcaggttcaacgca

SEQ ID NO: 417635 - DNA, 25 bp, Mus musculus
catcgactttggagcagagggcaac

SEQ ID NO: 417636 - DNA, 25 bp, Mus musculus
catcgagaaatgaggagcgcgactc

SEQ ID NO: 417637 - DNA, 25 bp, Mus musculus
catcgagaacatcataggcgcggga

SEQ ID NO: 417638 - DNA, 25 bp, Mus musculus
catcgagacattaagccagggaacc

SEQ ID NO: 417639 - DNA, 25 bp, Mus musculus
catcgagagagaggtgccagattcc

SEQ ID NO: 417640 - DNA, 25 bp, Mus musculus
catcgagagggaaacggacgtcttc

SEQ ID NO: 417641 - DNA, 25 bp, Mus musculus
catcgagcatcttgtaaggcagtct

SEQ ID NO: 417642 - DNA, 25 bp, Mus musculus
catcgagctccagtttgcaaagtgc

SEQ ID NO: 417643 - DNA, 25 bp, Mus musculus
catcgaggacctgagtaaagccaga

SEQ ID NO: 417644 - DNA, 25 bp, Mus musculus
catcgaggactttgctgacctgggc

SEQ ID NO: 417645 - DNA, 25 bp, Mus musculus
catcgaggatctgccggaaaaggaa

SEQ ID NO: 417646 - DNA, 25 bp, Mus musculus
catcgaggcagcacggatattatca

SEQ ID NO: 417647 - DNA, 25 bp, Mus musculus
catcgagggcgtgaagtacattgca

SEQ ID NO: 417648 - DNA, 25 bp, Mus musculus
catcgaggtggacgaatacagctcc

SEQ ID NO: 417649 - DNA, 25 bp, Mus musculus
catcgagtaacatctgcatcaggcc

SEQ ID NO: 417650 - DNA, 25 bp, Mus musculus
catcgagtccctgattggagcaaac

SEQ ID NO: 417651 - DNA, 25 bp, Mus musculus
catcgagtcgtctggaagctacaag

SEQ ID NO: 417652 - DNA, 25 bp, Mus musculus
catcgagtgtcagtcagagagcggc

SEQ ID NO: 417653 - DNA, 25 bp, Mus musculus
catcgagttttgtgccgctggagct

SEQ ID NO: 417654 - DNA, 25 bp, Mus musculus
catcgataacatcctgcggcctgag

SEQ ID NO: 417655 - DNA, 25 bp, Mus musculus
catcgataagagcaaaagggacccc

SEQ ID NO: 417656 - DNA, 25 bp, Mus musculus
catcgataatcgtacaggctgcggt

SEQ ID NO: 417657 - DNA, 25 bp, Mus musculus
catcgatctgggtggccatactcac

SEQ ID NO: 417658 - DNA, 25 bp, Mus musculus
catcgatgagatagatggactcttc

SEQ ID NO: 417659 - DNA, 25 bp, Mus musculus
catcgatgctactatgaaggagctg

SEQ ID NO: 417660 - DNA, 25 bp, Mus musculus
catcgatggcaagctgaaagagctc

SEQ ID NO: 417661 - DNA, 25 bp, Mus musculus
catcgatggcatggtgtcatttcca

SEQ ID NO: 417662 - DNA, 25 bp, Mus musculus
catcgattgtgagagtgcagctaca

SEQ ID NO: 417663 - DNA, 25 bp, Mus musculus
catcgcaacactcggtcagtttcca

SEQ ID NO: 417664 - DNA, 25 bp, Mus musculus
catcgcaagatggaggtgaccggta

SEQ ID NO: 417665 - DNA, 25 bp, Mus musculus
catcgcaattactggttagcacaca

SEQ ID NO: 417666 - DNA, 25 bp, Mus musculus
catcgcacccgttctggagttggca

SEQ ID NO: 417667 - DNA, 25 bp, Mus musculus
catcgcacggaggagaattcgccta

SEQ ID NO: 417668 - DNA, 25 bp, Mus musculus
catcgcagagcgtcagacagtggca

SEQ ID NO: 417669 - DNA, 25 bp, Mus musculus
catcgccaaaagtacctggcctcgg

SEQ ID NO: 417670 - DNA, 25 bp, Mus musculus
catcgccaacactgtaagaaacaaa

SEQ ID NO: 417671 - DNA, 25 bp, Mus musculus
catcgccacagaggaaggcttcaag

SEQ ID NO: 417672 - DNA, 25 bp, Mus musculus
catcgccaggttgtctccgaataaa

SEQ ID NO: 417673 - DNA, 25 bp, Mus musculus
catcgccatgcaaggcctcattcgg

SEQ ID NO: 417674 - DNA, 25 bp, Mus musculus
catcgcccacagcaggtgagttaga

SEQ ID NO: 417675 - DNA, 25 bp, Mus musculus
catcgccctggtagaaaaggccctg

SEQ ID NO: 417676 - DNA, 25 bp, Mus musculus
catcgcctgcatcgtttgctttacc

SEQ ID NO: 417677 - DNA, 25 bp, Mus musculus
catcgcgaataaaagctgctgtcct

SEQ ID NO: 417678 - DNA, 25 bp, Mus musculus
catcgcgctgggtctaggttcaaca

SEQ ID NO: 417679 - DNA, 25 bp, Mus musculus
catcgcggtgatgaacatgtggccc

SEQ ID NO: 417680 - DNA, 25 bp, Mus musculus
catcgcgtgcctgtacgaggagaac

SEQ ID NO: 417681 - DNA, 25 bp, Mus musculus
catcgctcacatggaggccaaggga

SEQ ID NO: 417682 - DNA, 25 bp, Mus musculus
catcgctctgcctcaagagcctatt

SEQ ID NO: 417683 - DNA, 25 bp, Mus musculus
catcgctgaagtgcgccagagatca

SEQ ID NO: 417684 - DNA, 25 bp, Mus musculus
catcgctgatggagagagtgacgca

SEQ ID NO: 417685 - DNA, 25 bp, Mus musculus
catcgctggaattgccatggccctg

SEQ ID NO: 417686 - DNA, 25 bp, Mus musculus
catcgctggcttaggatcgggacta

SEQ ID NO: 417687 - DNA, 25 bp, Mus musculus
catcgctgtatgcagtaggttcgca

SEQ ID NO: 417688 - DNA, 25 bp, Mus musculus
catcgctgtgggaaccgactattgg

SEQ ID NO: 417689 - DNA, 25 bp, Mus musculus
catcgctgtgttccttgagttggcc

SEQ ID NO: 417690 - DNA, 25 bp, Mus musculus
catcgcttggctgtcatggctggcg

SEQ ID NO: 417691 - DNA, 25 bp, Mus musculus
catcggaacgatggtggtcaatgca

SEQ ID NO: 417692 - DNA, 25 bp, Mus musculus
catcggagcgctgtgtgatacttca

SEQ ID NO: 417693 - DNA, 25 bp, Mus musculus
catcggaggcctcttgtatgcactg

SEQ ID NO: 417694 - DNA, 25 bp, Mus musculus
catcggagtctcttgttctgttggc

SEQ ID NO: 417695 - DNA, 25 bp, Mus musculus
catcggatactctctggtgtgggct

SEQ ID NO: 417696 - DNA, 25 bp, Mus musculus
catcggatctgctgctgtgcttggc

SEQ ID NO: 417697 - DNA, 25 bp, Mus musculus
catcggatgcatcaaacatgcagcg

SEQ ID NO: 417698 - DNA, 25 bp, Mus musculus
catcggatttagctaccctgtggtc

SEQ ID NO: 417699 - DNA, 25 bp, Mus musculus
catcggcaacgagcggtctctgaaa

SEQ ID NO: 417700 - DNA, 25 bp, Mus musculus
catcggcaatcaagtcatcggtgtg

SEQ ID NO: 417701 - DNA, 25 bp, Mus musculus
catcggcattttgaacgaggtcaca

SEQ ID NO: 417702 - DNA, 25 bp, Mus musculus
catcggcgatctgcaggctacaaag

SEQ ID NO: 417703 - DNA, 25 bp, Mus musculus
catcggcgtcgtggtgggtcacatc

SEQ ID NO: 417704 - DNA, 25 bp, Mus musculus
catcggctgtcgaaacactgctgta

SEQ ID NO: 417705 - DNA, 25 bp, Mus musculus
catcgggaacattgaagagatcgca

SEQ ID NO: 417706 - DNA, 25 bp, Mus musculus
catcgggaatcaggagatgctgctg

SEQ ID NO: 417707 - DNA, 25 bp, Mus musculus
catcgggcagccaagctcaatgtgg

SEQ ID NO: 417708 - DNA, 25 bp, Mus musculus
catcgggcctaatgtctgcatggga

SEQ ID NO: 417709 - DNA, 25 bp, Mus musculus
catcgggcgcaaaaacacgcgtgtg

SEQ ID NO: 417710 - DNA, 25 bp, Mus musculus
catcgggctcaaggattcggtcaca

SEQ ID NO: 417711 - DNA, 25 bp, Mus musculus
catcgggctggatgagcttctcaag

SEQ ID NO: 417712 - DNA, 25 bp, Mus musculus
catcgggtacatattggctgcatcc

SEQ ID NO: 417713 - DNA, 25 bp, Mus musculus
catcgggtcctaaagccaggaggcc

SEQ ID NO: 417714 - DNA, 25 bp, Mus musculus
catcgggtgcggatgccttcttcga

SEQ ID NO: 417715 - DNA, 25 bp, Mus musculus
catcggtattacaggtcaagtggct

SEQ ID NO: 417716 - DNA, 25 bp, Mus musculus
catcggtccatggaagagtccttgg

SEQ ID NO: 417717 - DNA, 25 bp, Mus musculus
catcggtcctaaggagagagaggca

SEQ ID NO: 417718 - DNA, 25 bp, Mus musculus
catcggtctcaatcactggcagcag

SEQ ID NO: 417719 - DNA, 25 bp, Mus musculus
catcggtctgtgctggctactggca

SEQ ID NO: 417720 - DNA, 25 bp, Mus musculus
catcggtgaccttgacactgtgaag

SEQ ID NO: 417721 - DNA, 25 bp, Mus musculus
catcggtgagccagcattgcttgca

SEQ ID NO: 417722 - DNA, 25 bp, Mus musculus
catcggtgagtcctggtgttggctg

SEQ ID NO: 417723 - DNA, 25 bp, Mus musculus
catcggtgcatggtccacagtgtat

SEQ ID NO: 417724 - DNA, 25 bp, Mus musculus
catcggtggcttaggagtctcgaca

SEQ ID NO: 417725 - DNA, 25 bp, Mus musculus
catcgtacctttggagaaagaaaga

SEQ ID NO: 417726 - DNA, 25 bp, Mus musculus
catcgtatgcacttggagaccacat

SEQ ID NO: 417727 - DNA, 25 bp, Mus musculus
catcgtcacggagggcaagatctat

SEQ ID NO: 417728 - DNA, 25 bp, Mus musculus
catcgtcagaaataaggaagcagtt

SEQ ID NO: 417729 - DNA, 25 bp, Mus musculus
catcgtcagacacctcgagtgaagg

SEQ ID NO: 417730 - DNA, 25 bp, Mus musculus
catcgtccgggtatcaggcatgcag

SEQ ID NO: 417731 - DNA, 25 bp, Mus musculus
catcgtctcatctgtcccgttggag

SEQ ID NO: 417732 - DNA, 25 bp, Mus musculus
catcgtcttctggaacagttcaaat

SEQ ID NO: 417733 - DNA, 25 bp, Mus musculus
catcgtgcgcctgctgcagtgtgat

SEQ ID NO: 417734 - DNA, 25 bp, Mus musculus
catcgtgctctcgtttgtaggtctc

SEQ ID NO: 417735 - DNA, 25 bp, Mus musculus
catcgtggaaaagaagcctcggact

SEQ ID NO: 417736 - DNA, 25 bp, Mus musculus
catcgtggaagagcatgttcattca

SEQ ID NO: 417737 - DNA, 25 bp, Mus musculus
catcgtggaaggacttctgggcgcc

SEQ ID NO: 417738 - DNA, 25 bp, Mus musculus
catcgtggaattagcccaactgggc

SEQ ID NO: 417739 - DNA, 25 bp, Mus musculus
catcgtggagacagatacattcggc

SEQ ID NO: 417740 - DNA, 25 bp, Mus musculus
catcgtggccacgtgtaggacctaa

SEQ ID NO: 417741 - DNA, 25 bp, Mus musculus
catcgtgtgcaagatcctggcagac

SEQ ID NO: 417742 - DNA, 25 bp, Mus musculus
catcgtgtttgcgagcatcctggca

SEQ ID NO: 417743 - DNA, 25 bp, Mus musculus
catcgttccgaatggcagctggtca

SEQ ID NO: 417744 - DNA, 25 bp, Mus musculus
catcgttgaaggctattgggaccag

SEQ ID NO: 417745 - DNA, 25 bp, Mus musculus
catcgttgacgtggacgaggagcca

SEQ ID NO: 417746 - DNA, 25 bp, Mus musculus
catcgtttcctttctgaagtcagga

SEQ ID NO: 417747 - DNA, 25 bp, Mus musculus
catcgtttggtcactctggctaagc

SEQ ID NO: 417748 - DNA, 25 bp, Mus musculus
catcgtttggtcagtagtgcttcta

SEQ ID NO: 417749 - DNA, 25 bp, Mus musculus
catcgttttgcttctgtgggtgaca

SEQ ID NO: 417750 - DNA, 25 bp, Mus musculus
catctaaaagacaatgcaaggagct

SEQ ID NO: 417751 - DNA, 25 bp, Mus musculus
catctaagattttgcacactggtaa

SEQ ID NO: 417752 - DNA, 25 bp, Mus musculus
catctaaggaccagctagccggtgt

SEQ ID NO: 417753 - DNA, 25 bp, Mus musculus
catctaagggagtttatggcagctc

SEQ ID NO: 417754 - DNA, 25 bp, Mus musculus
catctaagtgccagattgtaccaca

SEQ ID NO: 417755 - DNA, 25 bp, Mus musculus
catctaatatgctctcctgggtggg

SEQ ID NO: 417756 - DNA, 25 bp, Mus musculus
catctaatctagttgtgtttgacaa

SEQ ID NO: 417757 - DNA, 25 bp, Mus musculus
catctaatggagtggaagcccctga

SEQ ID NO: 417758 - DNA, 25 bp, Mus musculus
catctacaacggacactcaggtggc

SEQ ID NO: 417759 - DNA, 25 bp, Mus musculus
catctacaactaggattgccactgg

SEQ ID NO: 417760 - DNA, 25 bp, Mus musculus
catctacagcgggaacgcaggttcc

SEQ ID NO: 417761 - DNA, 25 bp, Mus musculus
catctaccctactgtggagttcctg

SEQ ID NO: 417762 - DNA, 25 bp, Mus musculus
catctaccgtcttgagggctggcaa

SEQ ID NO: 417763 - DNA, 25 bp, Mus musculus
catctacctctgagcaagcctctga

SEQ ID NO: 417764 - DNA, 25 bp, Mus musculus
catctacctctttgggaaactacaa

SEQ ID NO: 417765 - DNA, 25 bp, Mus musculus
catctacgagtatggagccctcacc

SEQ ID NO: 417766 - DNA, 25 bp, Mus musculus
catctacgctgttcgtgctgcggca

SEQ ID NO: 417767 - DNA, 25 bp, Mus musculus
catctactaccaggccactgaggaa

SEQ ID NO: 417768 - DNA, 25 bp, Mus musculus
catctactatcggagcagcctgggt

SEQ ID NO: 417769 - DNA, 25 bp, Mus musculus
catctactatggtctggcggccaga

SEQ ID NO: 417770 - DNA, 25 bp, Mus musculus
catctactgggccatgcagggacag

SEQ ID NO: 417771 - DNA, 25 bp, Mus musculus
catctacttattacctacttaaagg

SEQ ID NO: 417772 - DNA, 25 bp, Mus musculus
catctacttcctgggtggcctgggc

SEQ ID NO: 417773 - DNA, 25 bp, Mus musculus
catctagaagggtgtggtttaagga

SEQ ID NO: 417774 - DNA, 25 bp, Mus musculus
catctagagcctggtaggacagaac

SEQ ID NO: 417775 - DNA, 25 bp, Mus musculus
catctagaggaggaaaacagtagcc

SEQ ID NO: 417776 - DNA, 25 bp, Mus musculus
catctagagtgcatggccggatgct

SEQ ID NO: 417777 - DNA, 25 bp, Mus musculus
catctaggacgagtagggctgtccg

SEQ ID NO: 417778 - DNA, 25 bp, Mus musculus
catctagggttggagttaatgtccg

SEQ ID NO: 417779 - DNA, 25 bp, Mus musculus
catctagtctctggtggagggaaac

SEQ ID NO: 417780 - DNA, 25 bp, Mus musculus
catctagtctgtgcttctcggagtc

SEQ ID NO: 417781 - DNA, 25 bp, Mus musculus
catctataaaaaaggccaccgttgg

SEQ ID NO: 417782 - DNA, 25 bp, Mus musculus
catctatcaaccagtgcctgcacgt

SEQ ID NO: 417783 - DNA, 25 bp, Mus musculus
catctatgatgttgaaatggacaca

SEQ ID NO: 417784 - DNA, 25 bp, Mus musculus
catctatgctttccgcagccaggag

SEQ ID NO: 417785 - DNA, 25 bp, Mus musculus
catctatgtagccagatactgtgca

SEQ ID NO: 417786 - DNA, 25 bp, Mus musculus
catctatttcttttcgggaccccag

SEQ ID NO: 417787 - DNA, 25 bp, Mus musculus
catctcaaaccacccatgtatataa

SEQ ID NO: 417788 - DNA, 25 bp, Mus musculus
catctcaccaagaaccctgtttgtg

SEQ ID NO: 417789 - DNA, 25 bp, Mus musculus
catctcaccaaggtatcgtgggcta

SEQ ID NO: 417790 - DNA, 25 bp, Mus musculus
catctcacgtgactgctggtctcct

SEQ ID NO: 417791 - DNA, 25 bp, Mus musculus
catctcactgctgacctatacaggg

SEQ ID NO: 417792 - DNA, 25 bp, Mus musculus
catctcagaatgattgtgcacacaa

SEQ ID NO: 417793 - DNA, 25 bp, Mus musculus
catctcagacaagagacagtgatgc

SEQ ID NO: 417794 - DNA, 25 bp, Mus musculus
catctcagataagtgcgatagctgg

SEQ ID NO: 417795 - DNA, 25 bp, Mus musculus
catctcaggatcatggattgtagga

SEQ ID NO: 417796 - DNA, 25 bp, Mus musculus
catctcagtggaggaagttcatgac

SEQ ID NO: 417797 - DNA, 25 bp, Mus musculus
catctcatagcaggaacacacacgg

SEQ ID NO: 417798 - DNA, 25 bp, Mus musculus
catctcatcactggaggcctggaca

SEQ ID NO: 417799 - DNA, 25 bp, Mus musculus
catctcatcgtagcccggaagaacg

SEQ ID NO: 417800 - DNA, 25 bp, Mus musculus
catctccaagtctggctggaggcac

SEQ ID NO: 417801 - DNA, 25 bp, Mus musculus
catctcccgcaacaaggagcagggc

SEQ ID NO: 417802 - DNA, 25 bp, Mus musculus
catctccctaggttactctagaaga

SEQ ID NO: 417803 - DNA, 25 bp, Mus musculus
catctccgacatgcagaattgccta

SEQ ID NO: 417804 - DNA, 25 bp, Mus musculus
catctccgcagttgggcaaaatgac

SEQ ID NO: 417805 - DNA, 25 bp, Mus musculus
catctccgtctgagggcaactgggt

SEQ ID NO: 417806 - DNA, 25 bp, Mus musculus
catctcctcggtgggaggatctgca

SEQ ID NO: 417807 - DNA, 25 bp, Mus musculus
catctcctgctcactgttgggcacg

SEQ ID NO: 417808 - DNA, 25 bp, Mus musculus
catctcctggaagggtactgggaca

SEQ ID NO: 417809 - DNA, 25 bp, Mus musculus
catctcctggttgctgggatcacag

SEQ ID NO: 417810 - DNA, 25 bp, Mus musculus
catctcgagttcagaggcagaccgt

SEQ ID NO: 417811 - DNA, 25 bp, Mus musculus
catctcggatgctggtgggttctga

SEQ ID NO: 417812 - DNA, 25 bp, Mus musculus
catctctagctgaccaatattggga

SEQ ID NO: 417813 - DNA, 25 bp, Mus musculus
catctctcaggagaaaatgaccgag

SEQ ID NO: 417814 - DNA, 25 bp, Mus musculus
catctctgtgatggtgtcaacttgg

SEQ ID NO: 417815 - DNA, 25 bp, Mus musculus
catctctgtggtagtagtggctgcc

SEQ ID NO: 417816 - DNA, 25 bp, Mus musculus
catctctgtgttgtagttcactcca

SEQ ID NO: 417817 - DNA, 25 bp, Mus musculus
catctctgttctcatgaagatcaca

SEQ ID NO: 417818 - DNA, 25 bp, Mus musculus
catctctttggactaaaggcggaca

SEQ ID NO: 417819 - DNA, 25 bp, Mus musculus
catctcttttgagggctgcttggcc

SEQ ID NO: 417820 - DNA, 25 bp, Mus musculus
catctgaagaagcaagataggagtt

SEQ ID NO: 417821 - DNA, 25 bp, Mus musculus
catctgaagagaggaaagggaaagc

SEQ ID NO: 417822 - DNA, 25 bp, Mus musculus
catctgaagctggtaggcgttcccc

SEQ ID NO: 417823 - DNA, 25 bp, Mus musculus
catctgaagtactaaggcaagggca

SEQ ID NO: 417824 - DNA, 25 bp, Mus musculus
catctgaagttgcagccggacagcg

SEQ ID NO: 417825 - DNA, 25 bp, Mus musculus
catctgacaagatcggtgtgaccac

SEQ ID NO: 417826 - DNA, 25 bp, Mus musculus
catctgactactgccatgtggaagg

SEQ ID NO: 417827 - DNA, 25 bp, Mus musculus
catctgagcctttaggaagcagcaa

SEQ ID NO: 417828 - DNA, 25 bp, Mus musculus
catctgagctggagtcaagggaaca

SEQ ID NO: 417829 - DNA, 25 bp, Mus musculus
catctgaggagatgaggcacggcac

SEQ ID NO: 417830 - DNA, 25 bp, Mus musculus
catctgagggaactccacttggaca

SEQ ID NO: 417831 - DNA, 25 bp, Mus musculus
catctgagggtgtaatgccttcgcc

SEQ ID NO: 417832 - DNA, 25 bp, Mus musculus
catctgagtagaaggtagaatgtag

SEQ ID NO: 417833 - DNA, 25 bp, Mus musculus
catctgatgtggatagacattcccc

SEQ ID NO: 417834 - DNA, 25 bp, Mus musculus
catctgatttgctggactttctgtc

SEQ ID NO: 417835 - DNA, 25 bp, Mus musculus
catctgcaagcaagttatatggagc

SEQ ID NO: 417836 - DNA, 25 bp, Mus musculus
catctgcacactgatagccatattg

SEQ ID NO: 417837 - DNA, 25 bp, Mus musculus
catctgcacataaggctgcatctct

SEQ ID NO: 417838 - DNA, 25 bp, Mus musculus
catctgcactttggaggcaccgcaa

SEQ ID NO: 417839 - DNA, 25 bp, Mus musculus
catctgcagacctgaagctaggcat

SEQ ID NO: 417840 - DNA, 25 bp, Mus musculus
catctgcagctgaaagacatcctca

SEQ ID NO: 417841 - DNA, 25 bp, Mus musculus
catctgccaaagagagtgccagtca

SEQ ID NO: 417842 - DNA, 25 bp, Mus musculus
catctgccactagaaaaaggccaaa

SEQ ID NO: 417843 - DNA, 25 bp, Mus musculus
catctgccatggagcttcggaggaa

SEQ ID NO: 417844 - DNA, 25 bp, Mus musculus
catctgcccaggtctttgttaggct

SEQ ID NO: 417845 - DNA, 25 bp, Mus musculus
catctgccgcagtgctaaggcccat

SEQ ID NO: 417846 - DNA, 25 bp, Mus musculus
catctgccgtagagcatgctgtgcg

SEQ ID NO: 417847 - DNA, 25 bp, Mus musculus
catctgccgtttcgaggccctgcag

SEQ ID NO: 417848 - DNA, 25 bp, Mus musculus
catctgcctggacgactacgaggag

SEQ ID NO: 417849 - DNA, 25 bp, Mus musculus
catctgcgaagcacagaaccaggcg

SEQ ID NO: 417850 - DNA, 25 bp, Mus musculus
catctgcgacagtgagaagctctcc

SEQ ID NO: 417851 - DNA, 25 bp, Mus musculus
catctgctacttcctggactacggg

SEQ ID NO: 417852 - DNA, 25 bp, Mus musculus
catctgctagtgtgggctgataaac

SEQ ID NO: 417853 - DNA, 25 bp, Mus musculus
catctgctgatgagcatcgaccgga

SEQ ID NO: 417854 - DNA, 25 bp, Mus musculus
catctgctggaagtgaggctggcta

SEQ ID NO: 417855 - DNA, 25 bp, Mus musculus
catctgctgttaccatcatggacac

SEQ ID NO: 417856 - DNA, 25 bp, Mus musculus
catctgcttgggagaggcggcttta

SEQ ID NO: 417857 - DNA, 25 bp, Mus musculus
catctggaagagcaaacggaagcct

SEQ ID NO: 417858 - DNA, 25 bp, Mus musculus
catctggaaggaggaaaacggcact

SEQ ID NO: 417859 - DNA, 25 bp, Mus musculus
catctggacatgcaatgttgaagga

SEQ ID NO: 417860 - DNA, 25 bp, Mus musculus
catctggacctggacttcgtgggca

SEQ ID NO: 417861 - DNA, 25 bp, Mus musculus
catctggagaatctctgggagcccg

SEQ ID NO: 417862 - DNA, 25 bp, Mus musculus
catctggagagtaaatggccaccac

SEQ ID NO: 417863 - DNA, 25 bp, Mus musculus
catctggagcccattgagttggcgg

SEQ ID NO: 417864 - DNA, 25 bp, Mus musculus
catctggagctgcatgagcttgctc

SEQ ID NO: 417865 - DNA, 25 bp, Mus musculus
catctggaggaaatgcaggtggaca

SEQ ID NO: 417866 - DNA, 25 bp, Mus musculus
catctggattttgacaatgccaaca

SEQ ID NO: 417867 - DNA, 25 bp, Mus musculus
catctggcaatggtggacggagcaa

SEQ ID NO: 417868 - DNA, 25 bp, Mus musculus
catctggcagattgtggaccccttg

SEQ ID NO: 417869 - DNA, 25 bp, Mus musculus
catctggcgttgttctcatgggcct

SEQ ID NO: 417870 - DNA, 25 bp, Mus musculus
catctggctggacccgaagcaatgt

SEQ ID NO: 417871 - DNA, 25 bp, Mus musculus
catctggcttccatgaaaaatttca

SEQ ID NO: 417872 - DNA, 25 bp, Mus musculus
catctgggctaccaactgggtgagc

SEQ ID NO: 417873 - DNA, 25 bp, Mus musculus
catctgggggaaaccgtgatgctca

SEQ ID NO: 417874 - DNA, 25 bp, Mus musculus
catctgggtgaagagcgttgtgtca

SEQ ID NO: 417875 - DNA, 25 bp, Mus musculus
catctgggttgatgctcatgcggac

SEQ ID NO: 417876 - DNA, 25 bp, Mus musculus
catctggtgcctccgtgtggactcg

SEQ ID NO: 417877 - DNA, 25 bp, Mus musculus
catctggtgctgtccatggggctgc

SEQ ID NO: 417878 - DNA, 25 bp, Mus musculus
catctggttattgagctggaagacc

SEQ ID NO: 417879 - DNA, 25 bp, Mus musculus
catctgtacaaaatgtatgagcggc

SEQ ID NO: 417880 - DNA, 25 bp, Mus musculus
catctgtagcattaacctgactgta

SEQ ID NO: 417881 - DNA, 25 bp, Mus musculus
catctgtcagagagacgttagcaca

SEQ ID NO: 417882 - DNA, 25 bp, Mus musculus
catctgtcagagaggaccatgctca

SEQ ID NO: 417883 - DNA, 25 bp, Mus musculus
catctgtcccgttggaggcaaaacc

SEQ ID NO: 417884 - DNA, 25 bp, Mus musculus
catctgtcgcttcgaggccttgcag

SEQ ID NO: 417885 - DNA, 25 bp, Mus musculus
catctgtctcttttgttctcgaggg

SEQ ID NO: 417886 - DNA, 25 bp, Mus musculus
catctgtgccaagagcctggcggtc

SEQ ID NO: 417887 - DNA, 25 bp, Mus musculus
catctgtgccatttccgcggtggag

SEQ ID NO: 417888 - DNA, 25 bp, Mus musculus
catctgtgcgaagtgtgaggtcaac

SEQ ID NO: 417889 - DNA, 25 bp, Mus musculus
catctgtggaaacatctgtagatct

SEQ ID NO: 417890 - DNA, 25 bp, Mus musculus
catctgtggctcttggatcctggaa

SEQ ID NO: 417891 - DNA, 25 bp, Mus musculus
catctgtgggatgcctgcattgtac

SEQ ID NO: 417892 - DNA, 25 bp, Mus musculus
catctgtgtagaagtggaccacggg

SEQ ID NO: 417893 - DNA, 25 bp, Mus musculus
catctgtgtaggcatcgtgtttcct

SEQ ID NO: 417894 - DNA, 25 bp, Mus musculus
catctgttgatacgagtgtcccctc

SEQ ID NO: 417895 - DNA, 25 bp, Mus musculus
catctgtttcgaattgtttgtgtca

SEQ ID NO: 417896 - DNA, 25 bp, Mus musculus
catctgttttcctggctcaaggcag

SEQ ID NO: 417897 - DNA, 25 bp, Mus musculus
catcttaaaactgcaacgtgaggag

SEQ ID NO: 417898 - DNA, 25 bp, Mus musculus
catcttaagcaaatagggaggttcc

SEQ ID NO: 417899 - DNA, 25 bp, Mus musculus
catcttacgcttcttgagggccagg

SEQ ID NO: 417900 - DNA, 25 bp, Mus musculus
catcttactgctgtacctggccgtg

SEQ ID NO: 417901 - DNA, 25 bp, Mus musculus
catcttagctctacgtcaccttctt

SEQ ID NO: 417902 - DNA, 25 bp, Mus musculus
catcttattctggtgctggagagca

SEQ ID NO: 417903 - DNA, 25 bp, Mus musculus
catcttattgaaagcccaggtcccc

SEQ ID NO: 417904 - DNA, 25 bp, Mus musculus
catcttcagcttgtagacacagcgg

SEQ ID NO: 417905 - DNA, 25 bp, Mus musculus
catcttcagtctgctggaggcgcgt

SEQ ID NO: 417906 - DNA, 25 bp, Mus musculus
catcttcatgcgtgaggagctagcg

SEQ ID NO: 417907 - DNA, 25 bp, Mus musculus
catcttcccggcctgtagttagcca

SEQ ID NO: 417908 - DNA, 25 bp, Mus musculus
catcttccggatgcacagggcaaag

SEQ ID NO: 417909 - DNA, 25 bp, Mus musculus
catcttccggcagtgaatggcacac

SEQ ID NO: 417910 - DNA, 25 bp, Mus musculus
catcttccggtggtgagcatgggaa

SEQ ID NO: 417911 - DNA, 25 bp, Mus musculus
catcttcgaggtgaaggccacggcg

SEQ ID NO: 417912 - DNA, 25 bp, Mus musculus
catcttcgataacttcaagctcaca

SEQ ID NO: 417913 - DNA, 25 bp, Mus musculus
catcttcgggtctagcttctcggga

SEQ ID NO: 417914 - DNA, 25 bp, Mus musculus
catcttcgtgtatgggccgctgacc

SEQ ID NO: 417915 - DNA, 25 bp, Mus musculus
catcttctagatctgagaatgggaa

SEQ ID NO: 417916 - DNA, 25 bp, Mus musculus
catcttctccatggttggtctgtac

SEQ ID NO: 417917 - DNA, 25 bp, Mus musculus
catcttctgcagagaatcgcccgaa

SEQ ID NO: 417918 - DNA, 25 bp, Mus musculus
catcttctgtgtacgtgccggacga

SEQ ID NO: 417919 - DNA, 25 bp, Mus musculus
catcttgacctagagaagcgagacc

SEQ ID NO: 417920 - DNA, 25 bp, Mus musculus
catcttgactgggacaacagtgtag

SEQ ID NO: 417921 - DNA, 25 bp, Mus musculus
catcttgattgtggtgggaagtcca

SEQ ID NO: 417922 - DNA, 25 bp, Mus musculus
catcttgcgtgaggtactcgggtcc

SEQ ID NO: 417923 - DNA, 25 bp, Mus musculus
catcttgctggactggagcatgcac

SEQ ID NO: 417924 - DNA, 25 bp, Mus musculus
catcttggaaactgggcagcgtccc

SEQ ID NO: 417925 - DNA, 25 bp, Mus musculus
catcttggaacccatgtccatggaa

SEQ ID NO: 417926 - DNA, 25 bp, Mus musculus
catcttggcacaatgagtatctctg

SEQ ID NO: 417927 - DNA, 25 bp, Mus musculus
catcttggctgggtatcgttttatc

SEQ ID NO: 417928 - DNA, 25 bp, Mus musculus
catcttgggccagcccgaggaagat

SEQ ID NO: 417929 - DNA, 25 bp, Mus musculus
catcttgggtgatgagaggtctaca

SEQ ID NO: 417930 - DNA, 25 bp, Mus musculus
catcttggtcatcctgtcggtggcc

SEQ ID NO: 417931 - DNA, 25 bp, Mus musculus
catcttgtagagagtaccagccttc

SEQ ID NO: 417932 - DNA, 25 bp, Mus musculus
catcttgtggttggtaatggcctca

SEQ ID NO: 417933 - DNA, 25 bp, Mus musculus
catcttgttgctgacctggacctgg

SEQ ID NO: 417934 - DNA, 25 bp, Mus musculus
catctttagcgtgggtctctgttcc

SEQ ID NO: 417935 - DNA, 25 bp, Mus musculus
catctttaggatgccttcagctgaa

SEQ ID NO: 417936 - DNA, 25 bp, Mus musculus
catctttgaagaataagcatagcag

SEQ ID NO: 417937 - DNA, 25 bp, Mus musculus
catctttgacgtggagctgctcagc

SEQ ID NO: 417938 - DNA, 25 bp, Mus musculus
catctttgacttggtagcactgagc

SEQ ID NO: 417939 - DNA, 25 bp, Mus musculus
catctttgaggtgaagtccacggcc

SEQ ID NO: 417940 - DNA, 25 bp, Mus musculus
catctttgcagagctactgggccga

SEQ ID NO: 417941 - DNA, 25 bp, Mus musculus
catctttgcatatggacagactggg

SEQ ID NO: 417942 - DNA, 25 bp, Mus musculus
catctttggaatacaatcgcaggca

SEQ ID NO: 417943 - DNA, 25 bp, Mus musculus
catctttggcttgggctgaggcccc

SEQ ID NO: 417944 - DNA, 25 bp, Mus musculus
catctttggtgaggagtctgctgca

SEQ ID NO: 417945 - DNA, 25 bp, Mus musculus
catctttgtggtccccacctggtag

SEQ ID NO: 417946 - DNA, 25 bp, Mus musculus
catcttttctttatggagagcccag

SEQ ID NO: 417947 - DNA, 25 bp, Mus musculus
catcttttgagtggccccaggaagg

SEQ ID NO: 417948 - DNA, 25 bp, Mus musculus
catcttttgtgtgtcggagtacgct

SEQ ID NO: 417949 - DNA, 25 bp, Mus musculus
catcttttgttggagaaggctgccg

SEQ ID NO: 417950 - DNA, 25 bp, Mus musculus
catgaaaaacagtacaaagcacctt

SEQ ID NO: 417951 - DNA, 25 bp, Mus musculus
catgaaaaagggtataggcctgcct

SEQ ID NO: 417952 - DNA, 25 bp, Mus musculus
catgaaaactgctaagacacttgtg

SEQ ID NO: 417953 - DNA, 25 bp, Mus musculus
catgaaaatcctcgtggccgtggcg

SEQ ID NO: 417954 - DNA, 25 bp, Mus musculus
catgaaaatctgttgacccatagag

SEQ ID NO: 417955 - DNA, 25 bp, Mus musculus
catgaaacaaagtgcgcagaagtcc

SEQ ID NO: 417956 - DNA, 25 bp, Mus musculus
catgaaacatgtctcaaagaaaggt

SEQ ID NO: 417957 - DNA, 25 bp, Mus musculus
catgaaacgctttgccattcgacgg

SEQ ID NO: 417958 - DNA, 25 bp, Mus musculus
catgaaactcaaaagtccgctggga

SEQ ID NO: 417959 - DNA, 25 bp, Mus musculus
catgaaactgtcatgatgccggtga

SEQ ID NO: 417960 - DNA, 25 bp, Mus musculus
catgaaagaagaaggtggctccgac

SEQ ID NO: 417961 - DNA, 25 bp, Mus musculus
catgaaagccccttcacggatgagg

SEQ ID NO: 417962 - DNA, 25 bp, Mus musculus
catgaaagcctttctgagtcacaaa

SEQ ID NO: 417963 - DNA, 25 bp, Mus musculus
catgaaagtaccagtgcctgcagag

SEQ ID NO: 417964 - DNA, 25 bp, Mus musculus
catgaaagtgtaaagattgccgggc

SEQ ID NO: 417965 - DNA, 25 bp, Mus musculus
catgaaagtgtggaacagagtcggc

SEQ ID NO: 417966 - DNA, 25 bp, Mus musculus
catgaaagtgttgaacttggcgctc

SEQ ID NO: 417967 - DNA, 25 bp, Mus musculus
catgaaatcgaagtcaacggcaccg

SEQ ID NO: 417968 - DNA, 25 bp, Mus musculus
catgaaatgattagaaggaagcaca

SEQ ID NO: 417969 - DNA, 25 bp, Mus musculus
catgaacacgcatcttgactcctgt

SEQ ID NO: 417970 - DNA, 25 bp, Mus musculus
catgaacagtaacaatctctcccga

SEQ ID NO: 417971 - DNA, 25 bp, Mus musculus
catgaacagtcaggtggatggtgta

SEQ ID NO: 417972 - DNA, 25 bp, Mus musculus
catgaacagtgaggagcagtactac

SEQ ID NO: 417973 - DNA, 25 bp, Mus musculus
catgaacatcttccggctgactggg

SEQ ID NO: 417974 - DNA, 25 bp, Mus musculus
catgaaccaacttgccactgagaac

SEQ ID NO: 417975 - DNA, 25 bp, Mus musculus
catgaaccaagtaagcacagacgac

SEQ ID NO: 417976 - DNA, 25 bp, Mus musculus
catgaaccacaggaaagagcagttt

SEQ ID NO: 417977 - DNA, 25 bp, Mus musculus
catgaaccccaactcacaggaatct

SEQ ID NO: 417978 - DNA, 25 bp, Mus musculus
catgaacgagtacctcctaaggagg

SEQ ID NO: 417979 - DNA, 25 bp, Mus musculus
catgaacgggtggtatgctgtagta

SEQ ID NO: 417980 - DNA, 25 bp, Mus musculus
catgaacgtacgcacgtgtggctca

SEQ ID NO: 417981 - DNA, 25 bp, Mus musculus
catgaacgtggtgtggaggaaggcc

SEQ ID NO: 417982 - DNA, 25 bp, Mus musculus
catgaactacctggaagatcggcgt

SEQ ID NO: 417983 - DNA, 25 bp, Mus musculus
catgaactattaactgaagggcgga

SEQ ID NO: 417984 - DNA, 25 bp, Mus musculus
catgaactcagtgaggtagggctga

SEQ ID NO: 417985 - DNA, 25 bp, Mus musculus
catgaactctggattgtctggcctc

SEQ ID NO: 417986 - DNA, 25 bp, Mus musculus
catgaactgcatgaaaggcccgctg

SEQ ID NO: 417987 - DNA, 25 bp, Mus musculus
catgaacttgcagaaagcgctggaa

SEQ ID NO: 417988 - DNA, 25 bp, Mus musculus
catgaagaaattgacctccgtaacc

SEQ ID NO: 417989 - DNA, 25 bp, Mus musculus
catgaagaatgaggagacgcagacc

SEQ ID NO: 417990 - DNA, 25 bp, Mus musculus
catgaagagtgtgtccagaagtacc

SEQ ID NO: 417991 - DNA, 25 bp, Mus musculus
catgaagatgaaagcgaagcctggc

SEQ ID NO: 417992 - DNA, 25 bp, Mus musculus
catgaagcagaagaacgagcgtcta

SEQ ID NO: 417993 - DNA, 25 bp, Mus musculus
catgaagcagcaatacgaggaagac

SEQ ID NO: 417994 - DNA, 25 bp, Mus musculus
catgaagcagcctcgtgtgtacaca

SEQ ID NO: 417995 - DNA, 25 bp, Mus musculus
catgaagccaatcaagccgaggtcc

SEQ ID NO: 417996 - DNA, 25 bp, Mus musculus
catgaagccgttggtcgtgttcgtt

SEQ ID NO: 417997 - DNA, 25 bp, Mus musculus
catgaagcgctttggaagtctgagg

SEQ ID NO: 417998 - DNA, 25 bp, Mus musculus
catgaagcgtgtgtgtaccaggaac

SEQ ID NO: 417999 - DNA, 25 bp, Mus musculus
catgaagctcatgaaagagggcctc

SEQ ID NO: 418000 - DNA, 25 bp, Mus musculus
catgaagctccccatgacaagggat

SEQ ID NO: 418001 - DNA, 25 bp, Mus musculus
catgaagctgcaagtcaaggtcgtc

SEQ ID NO: 418002 - DNA, 25 bp, Mus musculus
catgaagctgtacgcgctgtgcacc

SEQ ID NO: 418003 - DNA, 25 bp, Mus musculus
catgaaggaacacccggattacaag

SEQ ID NO: 418004 - DNA, 25 bp, Mus musculus
catgaaggacatctctggctgtgct

SEQ ID NO: 418005 - DNA, 25 bp, Mus musculus
catgaaggatttctccaagcatctg

SEQ ID NO: 418006 - DNA, 25 bp, Mus musculus
catgaaggcacataggtaaagggat

SEQ ID NO: 418007 - DNA, 25 bp, Mus musculus
catgaaggccaacgagatctctgtc

SEQ ID NO: 418008 - DNA, 25 bp, Mus musculus
catgaaggctctgattatttaatga

SEQ ID NO: 418009 - DNA, 25 bp, Mus musculus
catgaaggctgtccaggaaggaaac

SEQ ID NO: 418010 - DNA, 25 bp, Mus musculus
catgaaggcttcagacaagcaataa

SEQ ID NO: 418011 - DNA, 25 bp, Mus musculus
catgaaggtcctcctgctgctagca

SEQ ID NO: 418012 - DNA, 25 bp, Mus musculus
catgaaggtctatacgtacaaggga

SEQ ID NO: 418013 - DNA, 25 bp, Mus musculus
catgaaggttatgctgctacacggc

SEQ ID NO: 418014 - DNA, 25 bp, Mus musculus
catgaagtacaaagccggaggtcgc

SEQ ID NO: 418015 - DNA, 25 bp, Mus musculus
catgaagtagaccaaagggctgagc

SEQ ID NO: 418016 - DNA, 25 bp, Mus musculus
catgaagtctgaaacgatgtctctc

SEQ ID NO: 418017 - DNA, 25 bp, Mus musculus
catgaagtgcgggtgagatccagac

SEQ ID NO: 418018 - DNA, 25 bp, Mus musculus
catgaagtgtcactgtgagtacatc

SEQ ID NO: 418019 - DNA, 25 bp, Mus musculus
catgaagttgaatgccattggcccc

SEQ ID NO: 418020 - DNA, 25 bp, Mus musculus
catgaagtttcccaccggctttggt

SEQ ID NO: 418021 - DNA, 25 bp, Mus musculus
catgaatacgttcagcgtggtgcca

SEQ ID NO: 418022 - DNA, 25 bp, Mus musculus
catgaatatccgctgaggttggcca

SEQ ID NO: 418023 - DNA, 25 bp, Mus musculus
catgaatgagagtttccttttgtga

SEQ ID NO: 418024 - DNA, 25 bp, Mus musculus
catgaatgagctagacttaaattac

SEQ ID NO: 418025 - DNA, 25 bp, Mus musculus
catgaatgcagcaaagaggccccta

SEQ ID NO: 418026 - DNA, 25 bp, Mus musculus
catgaatgggcccaagaacatccca

SEQ ID NO: 418027 - DNA, 25 bp, Mus musculus
catgaatgtactgacgagccgaggc

SEQ ID NO: 418028 - DNA, 25 bp, Mus musculus
catgaattattcatggtccttgttt

SEQ ID NO: 418029 - DNA, 25 bp, Mus musculus
catgaattccatgggcgtcgtcaca

SEQ ID NO: 418030 - DNA, 25 bp, Mus musculus
catgaattcggccatggaggacagc

SEQ ID NO: 418031 - DNA, 25 bp, Mus musculus
catgaattctgggtggacaacagca

SEQ ID NO: 418032 - DNA, 25 bp, Mus musculus
catgaatttgcctgaggtttccaaa

SEQ ID NO: 418033 - DNA, 25 bp, Mus musculus
catgacaacatcatatatgaatggg

SEQ ID NO: 418034 - DNA, 25 bp, Mus musculus
catgacaagagacaagagggctgca

SEQ ID NO: 418035 - DNA, 25 bp, Mus musculus
catgacaagagtacacagtgggcca

SEQ ID NO: 418036 - DNA, 25 bp, Mus musculus
catgacaagtggtcctagggagccg

SEQ ID NO: 418037 - DNA, 25 bp, Mus musculus
catgacacaagaagatgcaggtagc

SEQ ID NO: 418038 - DNA, 25 bp, Mus musculus
catgacaccaacatgagagcccggg

SEQ ID NO: 418039 - DNA, 25 bp, Mus musculus
catgacacgactctgcctgaggagt

SEQ ID NO: 418040 - DNA, 25 bp, Mus musculus
catgacagatttgttcacaaaatgg

SEQ ID NO: 418041 - DNA, 25 bp, Mus musculus
catgacagcttcttgtggactttta

SEQ ID NO: 418042 - DNA, 25 bp, Mus musculus
catgacaggacagcggatggtgact

SEQ ID NO: 418043 - DNA, 25 bp, Mus musculus
catgacagggctgcatggagcaagc

SEQ ID NO: 418044 - DNA, 25 bp, Mus musculus
catgacatcatcagtcgagaatccc

SEQ ID NO: 418045 - DNA, 25 bp, Mus musculus
catgacatggactctatagctggtg

SEQ ID NO: 418046 - DNA, 25 bp, Mus musculus
catgaccaaacaaggaacctggagg

SEQ ID NO: 418047 - DNA, 25 bp, Mus musculus
catgaccacctgatgaatgtgagcc

SEQ ID NO: 418048 - DNA, 25 bp, Mus musculus
catgaccaggcacctttgtgtcgtg

SEQ ID NO: 418049 - DNA, 25 bp, Mus musculus
catgaccagggctagctaagagctc

SEQ ID NO: 418050 - DNA, 25 bp, Mus musculus
catgaccatggcctgtgaaactccc

SEQ ID NO: 418051 - DNA, 25 bp, Mus musculus
catgaccatgtcctccattgtgatg

SEQ ID NO: 418052 - DNA, 25 bp, Mus musculus
catgacccaggcagacaagttctct

SEQ ID NO: 418053 - DNA, 25 bp, Mus musculus
catgacccgaagtatgaggacgcca

SEQ ID NO: 418054 - DNA, 25 bp, Mus musculus
catgaccctatggagaaggcgaacc

SEQ ID NO: 418055 - DNA, 25 bp, Mus musculus
catgaccgttggcactgatagaatc

SEQ ID NO: 418056 - DNA, 25 bp, Mus musculus
catgacctaccaggcgacaagtggc

SEQ ID NO: 418057 - DNA, 25 bp, Mus musculus
catgacctcatggagcaggcatgag

SEQ ID NO: 418058 - DNA, 25 bp, Mus musculus
catgacctggcagagtaggttctag

SEQ ID NO: 418059 - DNA, 25 bp, Mus musculus
catgaccttatgtgccagtgctggc

SEQ ID NO: 418060 - DNA, 25 bp, Mus musculus
catgacgcatggctgaatgtggcaa

SEQ ID NO: 418061 - DNA, 25 bp, Mus musculus
catgacgctggtagatgagactaac

SEQ ID NO: 418062 - DNA, 25 bp, Mus musculus
catgacggagtttgtatgccttgat

SEQ ID NO: 418063 - DNA, 25 bp, Mus musculus
catgacggctgggaatgcagagaca

SEQ ID NO: 418064 - DNA, 25 bp, Mus musculus
catgacggtgagaggccactggttc

SEQ ID NO: 418065 - DNA, 25 bp, Mus musculus
catgacggtggtacatgttgcggca

SEQ ID NO: 418066 - DNA, 25 bp, Mus musculus
catgacgtgcgtggcctggtacatc

SEQ ID NO: 418067 - DNA, 25 bp, Mus musculus
catgacgtggatcaccctgggagaa

SEQ ID NO: 418068 - DNA, 25 bp, Mus musculus
catgactactcactttctgtgctgt

SEQ ID NO: 418069 - DNA, 25 bp, Mus musculus
catgactcagcagtttgtccgggtc

SEQ ID NO: 418070 - DNA, 25 bp, Mus musculus
catgactcatttcccaaatctggga

SEQ ID NO: 418071 - DNA, 25 bp, Mus musculus
catgactcgaggagagggaagcttc

SEQ ID NO: 418072 - DNA, 25 bp, Mus musculus
catgactctgtcaccagtcttctgg

SEQ ID NO: 418073 - DNA, 25 bp, Mus musculus
catgactcttgagatccgtgaagga

SEQ ID NO: 418074 - DNA, 25 bp, Mus musculus
catgactgaatggaaacaccagcgc

SEQ ID NO: 418075 - DNA, 25 bp, Mus musculus
catgactgagcgcagtgtgtgccac

SEQ ID NO: 418076 - DNA, 25 bp, Mus musculus
catgactgctgggtgagtgaagtct

SEQ ID NO: 418077 - DNA, 25 bp, Mus musculus
catgactggaggatgctggcccata

SEQ ID NO: 418078 - DNA, 25 bp, Mus musculus
catgacttccaagaacagacccgga

SEQ ID NO: 418079 - DNA, 25 bp, Mus musculus
catgacttccactgtgagtaaagga

SEQ ID NO: 418080 - DNA, 25 bp, Mus musculus
catgacttctaaaacgcaccttaca

SEQ ID NO: 418081 - DNA, 25 bp, Mus musculus
catgagaaactgaataaaagggaca

SEQ ID NO: 418082 - DNA, 25 bp, Mus musculus
catgagaaacttgaggccgcctcgt

SEQ ID NO: 418083 - DNA, 25 bp, Mus musculus
catgagaaccccaagaccagagttg

SEQ ID NO: 418084 - DNA, 25 bp, Mus musculus
catgagaaccgaaccagtgaggcta

SEQ ID NO: 418085 - DNA, 25 bp, Mus musculus
catgagaagagatggcaacggcact

SEQ ID NO: 418086 - DNA, 25 bp, Mus musculus
catgagaagatgttgtcgcagcccc

SEQ ID NO: 418087 - DNA, 25 bp, Mus musculus
catgagaattcgtggatcggcctga

SEQ ID NO: 418088 - DNA, 25 bp, Mus musculus
catgagacctgccttggtaaaggga

SEQ ID NO: 418089 - DNA, 25 bp, Mus musculus
catgagaccttgctacatccttcaa

SEQ ID NO: 418090 - DNA, 25 bp, Mus musculus
catgagagcatacctgtccagatga

SEQ ID NO: 418091 - DNA, 25 bp, Mus musculus
catgagagtaaagtccccagcagat

SEQ ID NO: 418092 - DNA, 25 bp, Mus musculus
catgagagtccgaaagtaagcctgg

SEQ ID NO: 418093 - DNA, 25 bp, Mus musculus
catgagatcatcacttcgattgaaa

SEQ ID NO: 418094 - DNA, 25 bp, Mus musculus
catgagatgtatcacttgatgctgg

SEQ ID NO: 418095 - DNA, 25 bp, Mus musculus
catgagcaacgatgacgcagtccga

SEQ ID NO: 418096 - DNA, 25 bp, Mus musculus
catgagcaagcagcaaacaggcagg

SEQ ID NO: 418097 - DNA, 25 bp, Mus musculus
catgagcacaggagcagtaggctgc

SEQ ID NO: 418098 - DNA, 25 bp, Mus musculus
catgagcacagtggtgaaagagacc

SEQ ID NO: 418099 - DNA, 25 bp, Mus musculus
catgagcacctagtgaccctgagaa

SEQ ID NO: 418100 - DNA, 25 bp, Mus musculus
catgagcagcgggtactgcagcctg

SEQ ID NO: 418101 - DNA, 25 bp, Mus musculus
catgagccagtgtaaaatgcagcaa

SEQ ID NO: 418102 - DNA, 25 bp, Mus musculus
catgagcctcttggaagcagatgcg

SEQ ID NO: 418103 - DNA, 25 bp, Mus musculus
catgagcgacggacgtcgggtctct

SEQ ID NO: 418104 - DNA, 25 bp, Mus musculus
catgagcgcatcgatgtagaaggtc

SEQ ID NO: 418105 - DNA, 25 bp, Mus musculus
catgagcgggaccttagcgaagatc

SEQ ID NO: 418106 - DNA, 25 bp, Mus musculus
catgagcgtcgctgcggtgtttcga

SEQ ID NO: 418107 - DNA, 25 bp, Mus musculus
catgagctgaaaatgaagggccctg

SEQ ID NO: 418108 - DNA, 25 bp, Mus musculus
catgagcttccaggtgattacggcc

SEQ ID NO: 418109 - DNA, 25 bp, Mus musculus
catgagcttgctcagttcgggatca

SEQ ID NO: 418110 - DNA, 25 bp, Mus musculus
catgaggaaactcgcatcactggaa

SEQ ID NO: 418111 - DNA, 25 bp, Mus musculus
catgaggaggttttctggtagctgc

SEQ ID NO: 418112 - DNA, 25 bp, Mus musculus
catgaggatctctgccacgcttctg

SEQ ID NO: 418113 - DNA, 25 bp, Mus musculus
catgaggcagacaggaacacagctt

SEQ ID NO: 418114 - DNA, 25 bp, Mus musculus
catgaggcagttgatggactacgca

SEQ ID NO: 418115 - DNA, 25 bp, Mus musculus
catgaggccagagataagcaaagac

SEQ ID NO: 418116 - DNA, 25 bp, Mus musculus
catgaggccccattcttggtagatc

SEQ ID NO: 418117 - DNA, 25 bp, Mus musculus
catgaggccccttgctgtgcctggg

SEQ ID NO: 418118 - DNA, 25 bp, Mus musculus
catgagggacatcttcaacgtagcc

SEQ ID NO: 418119 - DNA, 25 bp, Mus musculus
catgagggactaattggagtttgac

SEQ ID NO: 418120 - DNA, 25 bp, Mus musculus
catgagggatgcatgaacatggctg

SEQ ID NO: 418121 - DNA, 25 bp, Mus musculus
catgagggcactcgatggcaaatcc

SEQ ID NO: 418122 - DNA, 25 bp, Mus musculus
catgagggcagaagagcaaagccgc

SEQ ID NO: 418123 - DNA, 25 bp, Mus musculus
catgagggctgtgtccctattctaa

SEQ ID NO: 418124 - DNA, 25 bp, Mus musculus
catgaggtcgcggttaggaacagta

SEQ ID NO: 418125 - DNA, 25 bp, Mus musculus
catgaggtgctgcaaaactgcccac

SEQ ID NO: 418126 - DNA, 25 bp, Mus musculus
catgaggtggcagctttccgctatg

SEQ ID NO: 418127 - DNA, 25 bp, Mus musculus
catgaggtgtctgccaacgcaggac

SEQ ID NO: 418128 - DNA, 25 bp, Mus musculus
catgaggtgtggtcgaaagcttgcc

SEQ ID NO: 418129 - DNA, 25 bp, Mus musculus
catgaggttgcccttgcagacagga

SEQ ID NO: 418130 - DNA, 25 bp, Mus musculus
catgagtaaatgttattgggcatcc

SEQ ID NO: 418131 - DNA, 25 bp, Mus musculus
catgagtaatccatgtccgagactc

SEQ ID NO: 418132 - DNA, 25 bp, Mus musculus
catgagtaatgctgtacagaacata

SEQ ID NO: 418133 - DNA, 25 bp, Mus musculus
catgagtaccagacccgctactgag

SEQ ID NO: 418134 - DNA, 25 bp, Mus musculus
catgagtatcatcgacgtggtggcc

SEQ ID NO: 418135 - DNA, 25 bp, Mus musculus
catgagtcagcgtcccaaaagatgg

SEQ ID NO: 418136 - DNA, 25 bp, Mus musculus
catgagtccttttctcacttggtac

SEQ ID NO: 418137 - DNA, 25 bp, Mus musculus
catgagtgacagagctgcggcaagg

SEQ ID NO: 418138 - DNA, 25 bp, Mus musculus
catgagtgcggtggaagcagctacc

SEQ ID NO: 418139 - DNA, 25 bp, Mus musculus
catgagtgctgattttacaagtgag

SEQ ID NO: 418140 - DNA, 25 bp, Mus musculus
catgagtggatgtacacagaagcct

SEQ ID NO: 418141 - DNA, 25 bp, Mus musculus
catgagtgggttcgagcaacctatg

SEQ ID NO: 418142 - DNA, 25 bp, Mus musculus
catgagtgtccctttattccaaggc

SEQ ID NO: 418143 - DNA, 25 bp, Mus musculus
catgagtgtctatccgatgcaggca

SEQ ID NO: 418144 - DNA, 25 bp, Mus musculus
catgagttaacatcaatggctgttc

SEQ ID NO: 418145 - DNA, 25 bp, Mus musculus
catgagttatcaagccccgtggagt

SEQ ID NO: 418146 - DNA, 25 bp, Mus musculus
catgagttcttttaatgtgttggcc

SEQ ID NO: 418147 - DNA, 25 bp, Mus musculus
catgagttgacaaacgctgttggcc

SEQ ID NO: 418148 - DNA, 25 bp, Mus musculus
catgagttgctacccagctgagcgt

SEQ ID NO: 418149 - DNA, 25 bp, Mus musculus
catgagtttcagattcggcatccgg

SEQ ID NO: 418150 - DNA, 25 bp, Mus musculus
catgataagttctgctcttgtccca

SEQ ID NO: 418151 - DNA, 25 bp, Mus musculus
catgataattaccataatagtcccg

SEQ ID NO: 418152 - DNA, 25 bp, Mus musculus
catgatacatcttgtctttgaagat

SEQ ID NO: 418153 - DNA, 25 bp, Mus musculus
catgatacttcagctggacctggca

SEQ ID NO: 418154 - DNA, 25 bp, Mus musculus
catgatagatgcgatggaccggctg

SEQ ID NO: 418155 - DNA, 25 bp, Mus musculus
catgatatgtgcaggtggctcaggc

SEQ ID NO: 418156 - DNA, 25 bp, Mus musculus
catgatcaaagacaacggctggtaa

SEQ ID NO: 418157 - DNA, 25 bp, Mus musculus
catgatcaaggtggagttagaggcc

SEQ ID NO: 418158 - DNA, 25 bp, Mus musculus
catgatcactgtagagcaccagagc

SEQ ID NO: 418159 - DNA, 25 bp, Mus musculus
catgatcacttttgaccagggagga

SEQ ID NO: 418160 - DNA, 25 bp, Mus musculus
catgatcagcaagcaaatggctaag

SEQ ID NO: 418161 - DNA, 25 bp, Mus musculus
catgatcaggaaggaacacggagcc

SEQ ID NO: 418162 - DNA, 25 bp, Mus musculus
catgatcaggctcctcttagaggct

SEQ ID NO: 418163 - DNA, 25 bp, Mus musculus
catgatccgcaatgggctgctcagg

SEQ ID NO: 418164 - DNA, 25 bp, Mus musculus
catgatccgctgctggaagaaccgc

SEQ ID NO: 418165 - DNA, 25 bp, Mus musculus
catgatcctcaaggtagccgtggaa

SEQ ID NO: 418166 - DNA, 25 bp, Mus musculus
catgatcctcgctgaacggcagaaa

SEQ ID NO: 418167 - DNA, 25 bp, Mus musculus
catgatcctcgtggtggctgcaaag

SEQ ID NO: 418168 - DNA, 25 bp, Mus musculus
catgatcgagaagcccgcaaagaga

SEQ ID NO: 418169 - DNA, 25 bp, Mus musculus
catgatcgcttgtcacgcaaccgtg

SEQ ID NO: 418170 - DNA, 25 bp, Mus musculus
catgatcgtcaccttagtggcccgg

SEQ ID NO: 418171 - DNA, 25 bp, Mus musculus
catgatcgtggctgctatccaggca

SEQ ID NO: 418172 - DNA, 25 bp, Mus musculus
catgatctgataagctggaaaccca

SEQ ID NO: 418173 - DNA, 25 bp, Mus musculus
catgatctgtggctctgttctaaac

SEQ ID NO: 418174 - DNA, 25 bp, Mus musculus
catgatgaagcctggatgattctga

SEQ ID NO: 418175 - DNA, 25 bp, Mus musculus
catgatgacagaagcggagcaggac

SEQ ID NO: 418176 - DNA, 25 bp, Mus musculus
catgatgacatgtatatcctgggaa

SEQ ID NO: 418177 - DNA, 25 bp, Mus musculus
catgatgacgctacaccaagccaga

SEQ ID NO: 418178 - DNA, 25 bp, Mus musculus
catgatgactactggccacttgtaa

SEQ ID NO: 418179 - DNA, 25 bp, Mus musculus
catgatgagcattcagagtgttaac

SEQ ID NO: 418180 - DNA, 25 bp, Mus musculus
catgatgaggtatgggcagctcgac

SEQ ID NO: 418181 - DNA, 25 bp, Mus musculus
catgatgaggtgagctctaggtccc

SEQ ID NO: 418182 - DNA, 25 bp, Mus musculus
catgatgatgagttaactatccgag

SEQ ID NO: 418183 - DNA, 25 bp, Mus musculus
catgatgctgtgaggctgaaccgct

SEQ ID NO: 418184 - DNA, 25 bp, Mus musculus
catgatggatttggagaagcccacc

SEQ ID NO: 418185 - DNA, 25 bp, Mus musculus
catgatggcgtgttgcctgagcgac

SEQ ID NO: 418186 - DNA, 25 bp, Mus musculus
catgatgggacggaaccagactgct

SEQ ID NO: 418187 - DNA, 25 bp, Mus musculus
catgatgggagtcgccaagcagtac

SEQ ID NO: 418188 - DNA, 25 bp, Mus musculus
catgatgggattgcagctaaagact

SEQ ID NO: 418189 - DNA, 25 bp, Mus musculus
catgatgggcctggtcttcgagcca

SEQ ID NO: 418190 - DNA, 25 bp, Mus musculus
catgatggttggtcacctgccttag

SEQ ID NO: 418191 - DNA, 25 bp, Mus musculus
catgatgtcaagaaactggccagca

SEQ ID NO: 418192 - DNA, 25 bp, Mus musculus
catgatgtcgactctcagcagaaca

SEQ ID NO: 418193 - DNA, 25 bp, Mus musculus
catgatgtctgcacctggaagggtc

SEQ ID NO: 418194 - DNA, 25 bp, Mus musculus
catgattaaccgtggcgtgccaggg

SEQ ID NO: 418195 - DNA, 25 bp, Mus musculus
catgattagaactcccagacccaga

SEQ ID NO: 418196 - DNA, 25 bp, Mus musculus
catgattatactgagctgctggcac

SEQ ID NO: 418197 - DNA, 25 bp, Mus musculus
catgattctctctgtgcaccgagga

SEQ ID NO: 418198 - DNA, 25 bp, Mus musculus
catgattgatgattcgtccgctcgg

SEQ ID NO: 418199 - DNA, 25 bp, Mus musculus
catgattggcatggagcaccctgaa

SEQ ID NO: 418200 - DNA, 25 bp, Mus musculus
catgattgggaatagcagctgcggc

SEQ ID NO: 418201 - DNA, 25 bp, Mus musculus
catgattgggatcagtacctggtac

SEQ ID NO: 418202 - DNA, 25 bp, Mus musculus
catgcaaagaatgacccaaactggg

SEQ ID NO: 418203 - DNA, 25 bp, Mus musculus
catgcaacctcggagtggaagtcca

SEQ ID NO: 418204 - DNA, 25 bp, Mus musculus
catgcaactattcttagcctaggca

SEQ ID NO: 418205 - DNA, 25 bp, Mus musculus
catgcaactggaccaaggttgggcc

SEQ ID NO: 418206 - DNA, 25 bp, Mus musculus
catgcaagtgctaagtccgaacgga

SEQ ID NO: 418207 - DNA, 25 bp, Mus musculus
catgcaagtggttcctccgaggctg

SEQ ID NO: 418208 - DNA, 25 bp, Mus musculus
catgcaatatgaacagcacttgctc

SEQ ID NO: 418209 - DNA, 25 bp, Mus musculus
catgcaatgccacttggaagacctg

SEQ ID NO: 418210 - DNA, 25 bp, Mus musculus
catgcacaaaagttctaaggtcgag

SEQ ID NO: 418211 - DNA, 25 bp, Mus musculus
catgcacaacattgcagagaagaaa

SEQ ID NO: 418212 - DNA, 25 bp, Mus musculus
catgcacccctgttagtctgtatac

SEQ ID NO: 418213 - DNA, 25 bp, Mus musculus
catgcacctgcgtgggtatgcacgg

SEQ ID NO: 418214 - DNA, 25 bp, Mus musculus
catgcacgacgtgacacctggagag

SEQ ID NO: 418215 - DNA, 25 bp, Mus musculus
catgcacgccgtgggcacttcgggt

SEQ ID NO: 418216 - DNA, 25 bp, Mus musculus
catgcacgtcaagaaattggctgta

SEQ ID NO: 418217 - DNA, 25 bp, Mus musculus
catgcactgtgatgtctgacgcaac

SEQ ID NO: 418218 - DNA, 25 bp, Mus musculus
catgcactgtttacactcggcgggc

SEQ ID NO: 418219 - DNA, 25 bp, Mus musculus
catgcactttaaagagatatctcag

SEQ ID NO: 418220 - DNA, 25 bp, Mus musculus
catgcagaagaatcataggtacttt

SEQ ID NO: 418221 - DNA, 25 bp, Mus musculus
catgcagaatgtgctaagcggcaaa

SEQ ID NO: 418222 - DNA, 25 bp, Mus musculus
catgcagacagctggaacccttcgt

SEQ ID NO: 418223 - DNA, 25 bp, Mus musculus
catgcagagacagaatggagtgaag

SEQ ID NO: 418224 - DNA, 25 bp, Mus musculus
catgcagagtaaccgagtgagaccc

SEQ ID NO: 418225 - DNA, 25 bp, Mus musculus
catgcagagtatcaacgcgggcttc

SEQ ID NO: 418226 - DNA, 25 bp, Mus musculus
catgcagcacatggccaagaacgtt

SEQ ID NO: 418227 - DNA, 25 bp, Mus musculus
catgcagcacgggtgattttaccgt

SEQ ID NO: 418228 - DNA, 25 bp, Mus musculus
catgcagcagataggtgtcttttac

SEQ ID NO: 418229 - DNA, 25 bp, Mus musculus
catgcagcatgggtcaagtccacca

SEQ ID NO: 418230 - DNA, 25 bp, Mus musculus
catgcagccgtgatgaatccagaca

SEQ ID NO: 418231 - DNA, 25 bp, Mus musculus
catgcagcggccttttcagacgact

SEQ ID NO: 418232 - DNA, 25 bp, Mus musculus
catgcagctcgcatcctgtgtcaca

SEQ ID NO: 418233 - DNA, 25 bp, Mus musculus
catgcagctgcggatctacgagatc

SEQ ID NO: 418234 - DNA, 25 bp, Mus musculus
catgcaggaagacatgccccttggg

SEQ ID NO: 418235 - DNA, 25 bp, Mus musculus
catgcaggcactggtgagttggatc

SEQ ID NO: 418236 - DNA, 25 bp, Mus musculus
catgcaggcccgtggttatggttac

SEQ ID NO: 418237 - DNA, 25 bp, Mus musculus
catgcaggctacaaagcgatccaga

SEQ ID NO: 418238 - DNA, 25 bp, Mus musculus
catgcagggagttttgttgaaagct

SEQ ID NO: 418239 - DNA, 25 bp, Mus musculus
catgcagggtcaaggtagtagtacc

SEQ ID NO: 418240 - DNA, 25 bp, Mus musculus
catgcaggtattctacaaagttagg

SEQ ID NO: 418241 - DNA, 25 bp, Mus musculus
catgcagtcaagcaggcggaaacac

SEQ ID NO: 418242 - DNA, 25 bp, Mus musculus
catgcagtctccttttaaccagtta

SEQ ID NO: 418243 - DNA, 25 bp, Mus musculus
catgcagtctggagtaaataacaca

SEQ ID NO: 418244 - DNA, 25 bp, Mus musculus
catgcagtgacaataggagaagcct

SEQ ID NO: 418245 - DNA, 25 bp, Mus musculus
catgcagtggagaagataaatcccg

SEQ ID NO: 418246 - DNA, 25 bp, Mus musculus
catgcagttgcagccagcaggaact

SEQ ID NO: 418247 - DNA, 25 bp, Mus musculus
catgcatacattgggtatggtgtga

SEQ ID NO: 418248 - DNA, 25 bp, Mus musculus
catgcatactggcaaaacacccgta

SEQ ID NO: 418249 - DNA, 25 bp, Mus musculus
catgcatccgtgtggctgttccgag

SEQ ID NO: 418250 - DNA, 25 bp, Mus musculus
catgcatcggatttgtacctaagca

SEQ ID NO: 418251 - DNA, 25 bp, Mus musculus
catgcatcggctcatagctcgaagg

SEQ ID NO: 418252 - DNA, 25 bp, Mus musculus
catgcatcgggaagtgtgaacactc

SEQ ID NO: 418253 - DNA, 25 bp, Mus musculus
catgcatctgtgtaccgcggaggta

SEQ ID NO: 418254 - DNA, 25 bp, Mus musculus
catgcatgaccaatggagccatatg

SEQ ID NO: 418255 - DNA, 25 bp, Mus musculus
catgcatgaccagtgaagaaatgcc

SEQ ID NO: 418256 - DNA, 25 bp, Mus musculus
catgcatgatgagctctggtccaga

SEQ ID NO: 418257 - DNA, 25 bp, Mus musculus
catgcatgatgaggctgtgacccac

SEQ ID NO: 418258 - DNA, 25 bp, Mus musculus
catgcatgcatcagggtcgctgggt

SEQ ID NO: 418259 - DNA, 25 bp, Mus musculus
catgcatgccaaagggacaacggtc

SEQ ID NO: 418260 - DNA, 25 bp, Mus musculus
catgcatgctatactgctgccctgc

SEQ ID NO: 418261 - DNA, 25 bp, Mus musculus
catgcatggatacaggagaagctct

SEQ ID NO: 418262 - DNA, 25 bp, Mus musculus
catgcatggcttaagatgaaaagtc

SEQ ID NO: 418263 - DNA, 25 bp, Mus musculus
catgcatgggttttctacatctcag

SEQ ID NO: 418264 - DNA, 25 bp, Mus musculus
catgcatgtgactgtggtatctgga

SEQ ID NO: 418265 - DNA, 25 bp, Mus musculus
catgcatgtgtctgagtagagccga

SEQ ID NO: 418266 - DNA, 25 bp, Mus musculus
catgcattgaggagagcttccggcg

SEQ ID NO: 418267 - DNA, 25 bp, Mus musculus
catgcattgatacagattttagacc

SEQ ID NO: 418268 - DNA, 25 bp, Mus musculus
catgccaaaagactgctgtaagagc

SEQ ID NO: 418269 - DNA, 25 bp, Mus musculus
catgccaagtggttcttttccagag

SEQ ID NO: 418270 - DNA, 25 bp, Mus musculus
catgccaatgtgttaggatatacgc

SEQ ID NO: 418271 - DNA, 25 bp, Mus musculus
catgccacctgactggctgtacctg

SEQ ID NO: 418272 - DNA, 25 bp, Mus musculus
catgccactgggagcagaacaatgt

SEQ ID NO: 418273 - DNA, 25 bp, Mus musculus
catgccactgtgtcccatcgatgaa

SEQ ID NO: 418274 - DNA, 25 bp, Mus musculus
catgccagattgcttggagacagga

SEQ ID NO: 418275 - DNA, 25 bp, Mus musculus
catgccagcgactttgaagagtaaa

SEQ ID NO: 418276 - DNA, 25 bp, Mus musculus
catgccagcgttgcttaaaaccagc

SEQ ID NO: 418277 - DNA, 25 bp, Mus musculus
catgccaggcaatgaagagagtgct

SEQ ID NO: 418278 - DNA, 25 bp, Mus musculus
catgccagggcacctgctgcaagaa

SEQ ID NO: 418279 - DNA, 25 bp, Mus musculus
catgcccaaggtactgcagtggcta

SEQ ID NO: 418280 - DNA, 25 bp, Mus musculus
catgcccagaatacctgagctctga

SEQ ID NO: 418281 - DNA, 25 bp, Mus musculus
catgcccagatatgaagacctcgtt

SEQ ID NO: 418282 - DNA, 25 bp, Mus musculus
catgcccagatgtcagataggagct

SEQ ID NO: 418283 - DNA, 25 bp, Mus musculus
catgcccagcctctcataacatagg

SEQ ID NO: 418284 - DNA, 25 bp, Mus musculus
catgccccaagaacctaaggctttg

SEQ ID NO: 418285 - DNA, 25 bp, Mus musculus
catgccccagatcttcccagtgaga

SEQ ID NO: 418286 - DNA, 25 bp, Mus musculus
catgccccggaaacaaaagagtgac

SEQ ID NO: 418287 - DNA, 25 bp, Mus musculus
catgcccgcctctttgtagttttta

SEQ ID NO: 418288 - DNA, 25 bp, Mus musculus
catgcccggctctccacagagaatt

SEQ ID NO: 418289 - DNA, 25 bp, Mus musculus
catgcccgttgctttactttgattc

SEQ ID NO: 418290 - DNA, 25 bp, Mus musculus
catgccctcatgaactggactctgg

SEQ ID NO: 418291 - DNA, 25 bp, Mus musculus
catgccctggagagcttcagcttcc

SEQ ID NO: 418292 - DNA, 25 bp, Mus musculus
catgccgagaatgaaggaggcccat

SEQ ID NO: 418293 - DNA, 25 bp, Mus musculus
catgccgcctcccagttaaagaaaa

SEQ ID NO: 418294 - DNA, 25 bp, Mus musculus
catgccggacactaggacgctgtat

SEQ ID NO: 418295 - DNA, 25 bp, Mus musculus
catgccggcccagtccatgtgggag

SEQ ID NO: 418296 - DNA, 25 bp, Mus musculus
catgccggcccttgtagttgaggct

SEQ ID NO: 418297 - DNA, 25 bp, Mus musculus
catgccgtctcctcgaatagtgaaa

SEQ ID NO: 418298 - DNA, 25 bp, Mus musculus
catgcctagtgctgaggagctcaga

SEQ ID NO: 418299 - DNA, 25 bp, Mus musculus
catgcctggaaagcgactgaactgg

SEQ ID NO: 418300 - DNA, 25 bp, Mus musculus
catgcctgggcttctgaggtaaagg

SEQ ID NO: 418301 - DNA, 25 bp, Mus musculus
catgcctggtttgaggatggtttta

SEQ ID NO: 418302 - DNA, 25 bp, Mus musculus
catgcctgtgttactgggaaaccca

SEQ ID NO: 418303 - DNA, 25 bp, Mus musculus
catgccttcaggacctgtctccttg

SEQ ID NO: 418304 - DNA, 25 bp, Mus musculus
catgccttcggacttctttctgcag

SEQ ID NO: 418305 - DNA, 25 bp, Mus musculus
catgccttgcccttaagtggaacat

SEQ ID NO: 418306 - DNA, 25 bp, Mus musculus
catgccttgtttctcagttccctca

SEQ ID NO: 418307 - DNA, 25 bp, Mus musculus
catgcctttaactttaggatcctac

SEQ ID NO: 418308 - DNA, 25 bp, Mus musculus
catgcgagccatgaaaggagaagga

SEQ ID NO: 418309 - DNA, 25 bp, Mus musculus
catgcgagctctcctaaagccttgg

SEQ ID NO: 418310 - DNA, 25 bp, Mus musculus
catgcgagtctttgtgcggcctgcg

SEQ ID NO: 418311 - DNA, 25 bp, Mus musculus
catgcgattgctaagtcatctaagt

SEQ ID NO: 418312 - DNA, 25 bp, Mus musculus
catgcgcactgccaggtcagagtgt

SEQ ID NO: 418313 - DNA, 25 bp, Mus musculus
catgcgcagagttgtggtgagggac

SEQ ID NO: 418314 - DNA, 25 bp, Mus musculus
catgcgcagatatcgggaggcagct

SEQ ID NO: 418315 - DNA, 25 bp, Mus musculus
catgcgcagcccatttcgtgtagga

SEQ ID NO: 418316 - DNA, 25 bp, Mus musculus
catgcgccgtgacattctggagtac

SEQ ID NO: 418317 - DNA, 25 bp, Mus musculus
catgcgctgcaagggatcgtggatt

SEQ ID NO: 418318 - DNA, 25 bp, Mus musculus
catgcgctggagtctttggacaacc

SEQ ID NO: 418319 - DNA, 25 bp, Mus musculus
catgcgctgggagcacgttctgatc

SEQ ID NO: 418320 - DNA, 25 bp, Mus musculus
catgcggcctttggaagtgaagcta

SEQ ID NO: 418321 - DNA, 25 bp, Mus musculus
catgcggttcaagccactgtttaga

SEQ ID NO: 418322 - DNA, 25 bp, Mus musculus
catgcggttccaggtgcagatcagc

SEQ ID NO: 418323 - DNA, 25 bp, Mus musculus
catgcgtatttctgtccaaatccaa

SEQ ID NO: 418324 - DNA, 25 bp, Mus musculus
catgcgtctccacgtgcaagaggaa

SEQ ID NO: 418325 - DNA, 25 bp, Mus musculus
catgcgtgagcctgagagtcctagc

SEQ ID NO: 418326 - DNA, 25 bp, Mus musculus
catgcgtgcagggtagaggttaacc

SEQ ID NO: 418327 - DNA, 25 bp, Mus musculus
catgcgttgcttgggtttcacagaa

SEQ ID NO: 418328 - DNA, 25 bp, Mus musculus
catgctaacaagaaagagggaagtc

SEQ ID NO: 418329 - DNA, 25 bp, Mus musculus
catgctaacaatatgggcgtgccag

SEQ ID NO: 418330 - DNA, 25 bp, Mus musculus
catgctaaggagagggatccaggac

SEQ ID NO: 418331 - DNA, 25 bp, Mus musculus
catgctaattaagaagtgagtgacc

SEQ ID NO: 418332 - DNA, 25 bp, Mus musculus
catgctacaggcttcttcaggtggt

SEQ ID NO: 418333 - DNA, 25 bp, Mus musculus
catgctaccgtcagctctgtgtgtg

SEQ ID NO: 418334 - DNA, 25 bp, Mus musculus
catgctactgttaaagcgtgaggca

SEQ ID NO: 418335 - DNA, 25 bp, Mus musculus
catgctagatgctgggaatcaggaa

SEQ ID NO: 418336 - DNA, 25 bp, Mus musculus
catgctaggagggaaagtgattgct

SEQ ID NO: 418337 - DNA, 25 bp, Mus musculus
catgctagtgtgtggcatcggcaac

SEQ ID NO: 418338 - DNA, 25 bp, Mus musculus
catgctcacacgaatgtttcctgtg

SEQ ID NO: 418339 - DNA, 25 bp, Mus musculus
catgctcacgctggtgtgggaagta

SEQ ID NO: 418340 - DNA, 25 bp, Mus musculus
catgctcaggaaccaacagctgcag

SEQ ID NO: 418341 - DNA, 25 bp, Mus musculus
catgctcatatgaggtgctccaagc

SEQ ID NO: 418342 - DNA, 25 bp, Mus musculus
catgctcatgacaatggtgactgcc

SEQ ID NO: 418343 - DNA, 25 bp, Mus musculus
catgctccagagataggccttgcct

SEQ ID NO: 418344 - DNA, 25 bp, Mus musculus
catgctccataagcttgagtgaggc

SEQ ID NO: 418345 - DNA, 25 bp, Mus musculus
catgctcggttactccagagggaga

SEQ ID NO: 418346 - DNA, 25 bp, Mus musculus
catgctctaccgctacgtgctggag

SEQ ID NO: 418347 - DNA, 25 bp, Mus musculus
catgctctagagcaacaggactcct

SEQ ID NO: 418348 - DNA, 25 bp, Mus musculus
catgctctgctacccttagggcagc

SEQ ID NO: 418349 - DNA, 25 bp, Mus musculus
catgctctggtctgtcttcagcacg

SEQ ID NO: 418350 - DNA, 25 bp, Mus musculus
catgctgaagaaagacgcgctgacg

SEQ ID NO: 418351 - DNA, 25 bp, Mus musculus
catgctgaagatgagaatgggacta

SEQ ID NO: 418352 - DNA, 25 bp, Mus musculus
catgctgacccttaagagatgtggg

SEQ ID NO: 418353 - DNA, 25 bp, Mus musculus
catgctgagctaggcggcagctgta

SEQ ID NO: 418354 - DNA, 25 bp, Mus musculus
catgctgaggatcttcgtggactac

SEQ ID NO: 418355 - DNA, 25 bp, Mus musculus
catgctgatgatagtgcttgctgtc

SEQ ID NO: 418356 - DNA, 25 bp, Mus musculus
catgctgattatggtgcccgtgtcc

SEQ ID NO: 418357 - DNA, 25 bp, Mus musculus
catgctgcaactgcccttgggtgga

SEQ ID NO: 418358 - DNA, 25 bp, Mus musculus
catgctgcacttgaagaagagaccc

SEQ ID NO: 418359 - DNA, 25 bp, Mus musculus
catgctgcagcttgcggtcgacttc

SEQ ID NO: 418360 - DNA, 25 bp, Mus musculus
catgctgcagttagctttctgtaaa

SEQ ID NO: 418361 - DNA, 25 bp, Mus musculus
catgctgcctatgtgctcctgacgg

SEQ ID NO: 418362 - DNA, 25 bp, Mus musculus
catgctgcgaagatgtagtgcgccc

SEQ ID NO: 418363 - DNA, 25 bp, Mus musculus
catgctgcttcctgcctgggtggca

SEQ ID NO: 418364 - DNA, 25 bp, Mus musculus
catgctggactatctgcaggtgagc

SEQ ID NO: 418365 - DNA, 25 bp, Mus musculus
catgctggagatttaccacctgggc

SEQ ID NO: 418366 - DNA, 25 bp, Mus musculus
catgctggcaatctggcaactggac

SEQ ID NO: 418367 - DNA, 25 bp, Mus musculus
catgctggcacatgcacctgaaggg

SEQ ID NO: 418368 - DNA, 25 bp, Mus musculus
catgctggcagataacctagtggag

SEQ ID NO: 418369 - DNA, 25 bp, Mus musculus
catgctggctagctacgccgtctac

SEQ ID NO: 418370 - DNA, 25 bp, Mus musculus
catgctggctgaggaagactttacc

SEQ ID NO: 418371 - DNA, 25 bp, Mus musculus
catgctgggacctagtgctgctcac

SEQ ID NO: 418372 - DNA, 25 bp, Mus musculus
catgctgggacttgcagttctaatc

SEQ ID NO: 418373 - DNA, 25 bp, Mus musculus
catgctgggcagtccctctagcact

SEQ ID NO: 418374 - DNA, 25 bp, Mus musculus
catgctgggctgaggaaactgctgc

SEQ ID NO: 418375 - DNA, 25 bp, Mus musculus
catgctgggcttctatgggatccaa

SEQ ID NO: 418376 - DNA, 25 bp, Mus musculus
catgctgggtgaagatgactacacc

SEQ ID NO: 418377 - DNA, 25 bp, Mus musculus
catgctggtctggagcggaatcgaa

SEQ ID NO: 418378 - DNA, 25 bp, Mus musculus
catgctggtggtaggagtcatctcc

SEQ ID NO: 418379 - DNA, 25 bp, Mus musculus
catgctgtaagcgaacaagactccg

SEQ ID NO: 418380 - DNA, 25 bp, Mus musculus
catgctgtacaagatgctctcggaa

SEQ ID NO: 418381 - DNA, 25 bp, Mus musculus
catgctgtcctcagtatacaataag

SEQ ID NO: 418382 - DNA, 25 bp, Mus musculus
catgctgtcctgacactgccatggc

SEQ ID NO: 418383 - DNA, 25 bp, Mus musculus
catgctgtgcgtgtccctttgagaa

SEQ ID NO: 418384 - DNA, 25 bp, Mus musculus
catgctgtggagaacgctgaagacg

SEQ ID NO: 418385 - DNA, 25 bp, Mus musculus
catgctgtgggttggtgtagagtca

SEQ ID NO: 418386 - DNA, 25 bp, Mus musculus
catgctgttctgctacgggttcaca

SEQ ID NO: 418387 - DNA, 25 bp, Mus musculus
catgctgtttcaaggtgccaccgaa

SEQ ID NO: 418388 - DNA, 25 bp, Mus musculus
catgcttactgctaccatagatgga

SEQ ID NO: 418389 - DNA, 25 bp, Mus musculus
catgcttagcatgtacgtaggtctc

SEQ ID NO: 418390 - DNA, 25 bp, Mus musculus
catgcttatctgaggcggagccctg

SEQ ID NO: 418391 - DNA, 25 bp, Mus musculus
catgcttgcctggaccttactgtga

SEQ ID NO: 418392 - DNA, 25 bp, Mus musculus
catgcttgccttgagcttgcaatcc

SEQ ID NO: 418393 - DNA, 25 bp, Mus musculus
catgcttggatgtggtgtatctggc

SEQ ID NO: 418394 - DNA, 25 bp, Mus musculus
catgcttgggtgcaattggtctcct

SEQ ID NO: 418395 - DNA, 25 bp, Mus musculus
catgcttgtacctgtggaataaatc

SEQ ID NO: 418396 - DNA, 25 bp, Mus musculus
catgcttgtcaacatatgaactgaa

SEQ ID NO: 418397 - DNA, 25 bp, Mus musculus
catgcttgtgcttgtgattctgtcc

SEQ ID NO: 418398 - DNA, 25 bp, Mus musculus
catgcttgttttacatatctaagct

SEQ ID NO: 418399 - DNA, 25 bp, Mus musculus
catgctttctcgctggagctcagga

SEQ ID NO: 418400 - DNA, 25 bp, Mus musculus
catgctttcttgttgcgtatcccca

SEQ ID NO: 418401 - DNA, 25 bp, Mus musculus
catgctttgaaggtcatcgctgcca

SEQ ID NO: 418402 - DNA, 25 bp, Mus musculus
catgctttgtgacggctgagcacgt

SEQ ID NO: 418403 - DNA, 25 bp, Mus musculus
catgcttttgaagagtgactaagct

SEQ ID NO: 418404 - DNA, 25 bp, Mus musculus
catgcttttggatatgggcctaggc

SEQ ID NO: 418405 - DNA, 25 bp, Mus musculus
catggaaaagaagcctgcactctga

SEQ ID NO: 418406 - DNA, 25 bp, Mus musculus
catggaaaagcatatggagacgacc

SEQ ID NO: 418407 - DNA, 25 bp, Mus musculus
catggaaaagcatggctctgccctg

SEQ ID NO: 418408 - DNA, 25 bp, Mus musculus
catggaaaagggtgactgaggaacc

SEQ ID NO: 418409 - DNA, 25 bp, Mus musculus
catggaaaatctcccgaggagctgt

SEQ ID NO: 418410 - DNA, 25 bp, Mus musculus
catggaaacataaccctggactgac

SEQ ID NO: 418411 - DNA, 25 bp, Mus musculus
catggaaacccaaaggccgtgtgtg

SEQ ID NO: 418412 - DNA, 25 bp, Mus musculus
catggaaacttgatacgactggctg

SEQ ID NO: 418413 - DNA, 25 bp, Mus musculus
catggaaagtctgggtcttgagctc

SEQ ID NO: 418414 - DNA, 25 bp, Mus musculus
catggaaatcaatgtccgggccagg

SEQ ID NO: 418415 - DNA, 25 bp, Mus musculus
catggaaatcaccttggacatcagc

SEQ ID NO: 418416 - DNA, 25 bp, Mus musculus
catggaaatctagacaggctgacgt

SEQ ID NO: 418417 - DNA, 25 bp, Mus musculus
catggaaattagaagagcagagacc

SEQ ID NO: 418418 - DNA, 25 bp, Mus musculus
catggaacaagggaaaggaagaact

SEQ ID NO: 418419 - DNA, 25 bp, Mus musculus
catggaaccggaggtccaggtctgt

SEQ ID NO: 418420 - DNA, 25 bp, Mus musculus
catggaaccttaactgggagctgcc

SEQ ID NO: 418421 - DNA, 25 bp, Mus musculus
catggaacggatagacaagcgggct

SEQ ID NO: 418422 - DNA, 25 bp, Mus musculus
catggaacggtagccacccctgtgt

SEQ ID NO: 418423 - DNA, 25 bp, Mus musculus
catggaactgcactgatccccaggt

SEQ ID NO: 418424 - DNA, 25 bp, Mus musculus
catggaactttagtgaggactttgg

SEQ ID NO: 418425 - DNA, 25 bp, Mus musculus
catggaagaagggaagagtagactt

SEQ ID NO: 418426 - DNA, 25 bp, Mus musculus
catggaagaccctgctactgcttgg

SEQ ID NO: 418427 - DNA, 25 bp, Mus musculus
catggaagaccgtgaaccttgctac

SEQ ID NO: 418428 - DNA, 25 bp, Mus musculus
catggaagagcctggacgaaacgct

SEQ ID NO: 418429 - DNA, 25 bp, Mus musculus
catggaagatgacgcctaggaaagc

SEQ ID NO: 418430 - DNA, 25 bp, Mus musculus
catggaagatgagaacgagcaacta

SEQ ID NO: 418431 - DNA, 25 bp, Mus musculus
catggaaggacaaatcgctgtcagt

SEQ ID NO: 418432 - DNA, 25 bp, Mus musculus
catggaaggtctgctgacaagatgc

SEQ ID NO: 418433 - DNA, 25 bp, Mus musculus
catggaagtgtcagttggtaacccg

SEQ ID NO: 418434 - DNA, 25 bp, Mus musculus
catggaatatttcacctgggtctcc

SEQ ID NO: 418435 - DNA, 25 bp, Mus musculus
catggaatatttgagttggactgcc

SEQ ID NO: 418436 - DNA, 25 bp, Mus musculus
catggaatcacagagcaaagggaca

SEQ ID NO: 418437 - DNA, 25 bp, Mus musculus
catggaatgccaggtgacacaggac

SEQ ID NO: 418438 - DNA, 25 bp, Mus musculus
catggaatgccttcaactgcctggt

SEQ ID NO: 418439 - DNA, 25 bp, Mus musculus
catggaatggccttggaagtgtccc

SEQ ID NO: 418440 - DNA, 25 bp, Mus musculus
catggaatgttctaagtctctgagg

SEQ ID NO: 418441 - DNA, 25 bp, Mus musculus
catggacaaaagtcgcctggaccgg

SEQ ID NO: 418442 - DNA, 25 bp, Mus musculus
catggacaaggttctcactcaggga

SEQ ID NO: 418443 - DNA, 25 bp, Mus musculus
catggacacatcttagccgctgagc

SEQ ID NO: 418444 - DNA, 25 bp, Mus musculus
catggacacctacagcaagatgggc

SEQ ID NO: 418445 - DNA, 25 bp, Mus musculus
catggacactgcttctgacgacctc

SEQ ID NO: 418446 - DNA, 25 bp, Mus musculus
catggacagacactacccttaagga

SEQ ID NO: 418447 - DNA, 25 bp, Mus musculus
catggacagatccaatgagaccgcc

SEQ ID NO: 418448 - DNA, 25 bp, Mus musculus
catggacagattgaagtgcccgaac

SEQ ID NO: 418449 - DNA, 25 bp, Mus musculus
catggacagcgtttctagccgcgcg

SEQ ID NO: 418450 - DNA, 25 bp, Mus musculus
catggacagtaacagtgatgacaga

SEQ ID NO: 418451 - DNA, 25 bp, Mus musculus
catggacagtgaactacggtcggga

SEQ ID NO: 418452 - DNA, 25 bp, Mus musculus
catggacatcctgttatagaaaggc

SEQ ID NO: 418453 - DNA, 25 bp, Mus musculus
catggacatggcatctcctcacagc

SEQ ID NO: 418454 - DNA, 25 bp, Mus musculus
catggacatgggaaactacagtgaa

SEQ ID NO: 418455 - DNA, 25 bp, Mus musculus
catggaccacacacaacagctgtag

SEQ ID NO: 418456 - DNA, 25 bp, Mus musculus
catggaccactcatgatgctggccc

SEQ ID NO: 418457 - DNA, 25 bp, Mus musculus
catggaccaggatgtggaaagccca

SEQ ID NO: 418458 - DNA, 25 bp, Mus musculus
catggacccatatatcgaactgcgc

SEQ ID NO: 418459 - DNA, 25 bp, Mus musculus
catggacccgttggaagcagaagca

SEQ ID NO: 418460 - DNA, 25 bp, Mus musculus
catggaccgttttctcaccctgtga

SEQ ID NO: 418461 - DNA, 25 bp, Mus musculus
catggacctctttgtgactgtgtgc

SEQ ID NO: 418462 - DNA, 25 bp, Mus musculus
catggacctgcagtgggcatctcga

SEQ ID NO: 418463 - DNA, 25 bp, Mus musculus
catggacctgtcttttctgaggaat

SEQ ID NO: 418464 - DNA, 25 bp, Mus musculus
catggaccttggcacctggtagaag

SEQ ID NO: 418465 - DNA, 25 bp, Mus musculus
catggacgacgtttatgcgcctggg

SEQ ID NO: 418466 - DNA, 25 bp, Mus musculus
catggacgaggctagagacaatgcg

SEQ ID NO: 418467 - DNA, 25 bp, Mus musculus
catggacgattcctgggctgagctt

SEQ ID NO: 418468 - DNA, 25 bp, Mus musculus
catggacgccggtgtgactgaaagc

SEQ ID NO: 418469 - DNA, 25 bp, Mus musculus
catggacggcgtgctagctgatttc

SEQ ID NO: 418470 - DNA, 25 bp, Mus musculus
catggactacaatctgctgctgcaa

SEQ ID NO: 418471 - DNA, 25 bp, Mus musculus
catggactacagtttgtcatcaaag

SEQ ID NO: 418472 - DNA, 25 bp, Mus musculus
catggactacggcaacagagctgag

SEQ ID NO: 418473 - DNA, 25 bp, Mus musculus
catggactcccgaaactggtctggt

SEQ ID NO: 418474 - DNA, 25 bp, Mus musculus
catggactctttggtaggcctaggg

SEQ ID NO: 418475 - DNA, 25 bp, Mus musculus
catggactgaaaccacgagttagaa

SEQ ID NO: 418476 - DNA, 25 bp, Mus musculus
catggactgaggaccagataccctc

SEQ ID NO: 418477 - DNA, 25 bp, Mus musculus
catggactgcaacagctgcgtaagc

SEQ ID NO: 418478 - DNA, 25 bp, Mus musculus
catggactgggctgtaccgtggact

SEQ ID NO: 418479 - DNA, 25 bp, Mus musculus
catggactgtccgagcttgtgaaag

SEQ ID NO: 418480 - DNA, 25 bp, Mus musculus
catggactgtcttctgtttggaaca

SEQ ID NO: 418481 - DNA, 25 bp, Mus musculus
catggacttcactggcacactggct

SEQ ID NO: 418482 - DNA, 25 bp, Mus musculus
catggactttgggtaagagaaatct

SEQ ID NO: 418483 - DNA, 25 bp, Mus musculus
catggagaaaactgcactgcctgtg

SEQ ID NO: 418484 - DNA, 25 bp, Mus musculus
catggagaagaccaggatgcgcctt

SEQ ID NO: 418485 - DNA, 25 bp, Mus musculus
catggagaatgacctgaaattgagg

SEQ ID NO: 418486 - DNA, 25 bp, Mus musculus
catggagaatgagtaccgctgcaga

SEQ ID NO: 418487 - DNA, 25 bp, Mus musculus
catggagacgccaacaccattgtgt

SEQ ID NO: 418488 - DNA, 25 bp, Mus musculus
catggagactctcaagggctttgcg

SEQ ID NO: 418489 - DNA, 25 bp, Mus musculus
catggagagaaggtcctaacggtcc

SEQ ID NO: 418490 - DNA, 25 bp, Mus musculus
catggagagcagtggccatgctgca

SEQ ID NO: 418491 - DNA, 25 bp, Mus musculus
catggagagtccttctgtagcttga

SEQ ID NO: 418492 - DNA, 25 bp, Mus musculus
catggagagttgatggtctgtctgc

SEQ ID NO: 418493 - DNA, 25 bp, Mus musculus
catggagatccagccttcaagaggc

SEQ ID NO: 418494 - DNA, 25 bp, Mus musculus
catggagatccgcagtaccagacag

SEQ ID NO: 418495 - DNA, 25 bp, Mus musculus
catggagatccttgaccagaagtct

SEQ ID NO: 418496 - DNA, 25 bp, Mus musculus
catggagcagcctgatgatgagcca

SEQ ID NO: 418497 - DNA, 25 bp, Mus musculus
catggagcagtaaaccaggataatg

SEQ ID NO: 418498 - DNA, 25 bp, Mus musculus
catggagccaggtcagtccctgtca

SEQ ID NO: 418499 - DNA, 25 bp, Mus musculus
catggagccccaggataagtctgcg

SEQ ID NO: 418500 - DNA, 25 bp, Mus musculus
catggagcggttgcaccttgagatc

SEQ ID NO: 418501 - DNA, 25 bp, Mus musculus
catggagctcatcgttggcaagaag

SEQ ID NO: 418502 - DNA, 25 bp, Mus musculus
catggagctcttccttgtcactaac

SEQ ID NO: 418503 - DNA, 25 bp, Mus musculus
catggagctgccctttatgccagga

SEQ ID NO: 418504 - DNA, 25 bp, Mus musculus
catggagctgtcatgtgacccggca

SEQ ID NO: 418505 - DNA, 25 bp, Mus musculus
catggagcttcgtgtcagctgggcc

SEQ ID NO: 418506 - DNA, 25 bp, Mus musculus
catggaggaaaacacacccacacac

SEQ ID NO: 418507 - DNA, 25 bp, Mus musculus
catggaggaaggtctctaacccagg

SEQ ID NO: 418508 - DNA, 25 bp, Mus musculus
catggaggacaaaacctgtgaggcc

SEQ ID NO: 418509 - DNA, 25 bp, Mus musculus
catggaggagatcaagcaaggcatc

SEQ ID NO: 418510 - DNA, 25 bp, Mus musculus
catggaggattctgtctccgctcca

SEQ ID NO: 418511 - DNA, 25 bp, Mus musculus
catggaggattgacacggttggcac

SEQ ID NO: 418512 - DNA, 25 bp, Mus musculus
catggaggccttccatcaggaaggt

SEQ ID NO: 418513 - DNA, 25 bp, Mus musculus
catggaggctgaatacttgagctgc

SEQ ID NO: 418514 - DNA, 25 bp, Mus musculus
catggaggctttgtttcggcgccgc

SEQ ID NO: 418515 - DNA, 25 bp, Mus musculus
catggagggcaacaacacagagatc

SEQ ID NO: 418516 - DNA, 25 bp, Mus musculus
catggagggcaaggccgactttgct

SEQ ID NO: 418517 - DNA, 25 bp, Mus musculus
catggagggccttatagttcgggaa

SEQ ID NO: 418518 - DNA, 25 bp, Mus musculus
catggaggtcctcaaaggtggcacc

SEQ ID NO: 418519 - DNA, 25 bp, Mus musculus
catggaggtgctatgccgctgagaa

SEQ ID NO: 418520 - DNA, 25 bp, Mus musculus
catggaggttcaccgatcagacctg

SEQ ID NO: 418521 - DNA, 25 bp, Mus musculus
catggaggttcgtccagggtgcaac

SEQ ID NO: 418522 - DNA, 25 bp, Mus musculus
catggaggttctaacgggctgcaaa

SEQ ID NO: 418523 - DNA, 25 bp, Mus musculus
catggagtagacctggttaagcaga

SEQ ID NO: 418524 - DNA, 25 bp, Mus musculus
catggagtatctggtcaaggctctc

SEQ ID NO: 418525 - DNA, 25 bp, Mus musculus
catggagtcaagagtgaatggtcac

SEQ ID NO: 418526 - DNA, 25 bp, Mus musculus
catggagtcagagttggccaagccc

SEQ ID NO: 418527 - DNA, 25 bp, Mus musculus
catggagtcctgctagacaatgtcc

SEQ ID NO: 418528 - DNA, 25 bp, Mus musculus
catggatagccaccgaagcctggat

SEQ ID NO: 418529 - DNA, 25 bp, Mus musculus
catggatataaatgtacttgactgt

SEQ ID NO: 418530 - DNA, 25 bp, Mus musculus
catggatccaggaacgctgcagaga

SEQ ID NO: 418531 - DNA, 25 bp, Mus musculus
catggatcggcatcactacgagacc

SEQ ID NO: 418532 - DNA, 25 bp, Mus musculus
catggatctgtggagcgcaggcatc

SEQ ID NO: 418533 - DNA, 25 bp, Mus musculus
catggatgacggattttggctgccc

SEQ ID NO: 418534 - DNA, 25 bp, Mus musculus
catggatgattacttcccagttctc

SEQ ID NO: 418535 - DNA, 25 bp, Mus musculus
catggatgcaccagagacagagcgt

SEQ ID NO: 418536 - DNA, 25 bp, Mus musculus
catggatgcgcaaaactgtgcaggt

SEQ ID NO: 418537 - DNA, 25 bp, Mus musculus
catggatgttttgtaagtgttggca

SEQ ID NO: 418538 - DNA, 25 bp, Mus musculus
catggattattaaaaactggacacc

SEQ ID NO: 418539 - DNA, 25 bp, Mus musculus
catggattcggttcagtcaggagtg

SEQ ID NO: 418540 - DNA, 25 bp, Mus musculus
catggattggaaaccctgcaggcta

SEQ ID NO: 418541 - DNA, 25 bp, Mus musculus
catggattggaatgaggcagacgcc

SEQ ID NO: 418542 - DNA, 25 bp, Mus musculus
catggatttggaagaacgcacactc

SEQ ID NO: 418543 - DNA, 25 bp, Mus musculus
catggcaaatgacaacggtgggctc

SEQ ID NO: 418544 - DNA, 25 bp, Mus musculus
catggcaagacactggcgagagaca

SEQ ID NO: 418545 - DNA, 25 bp, Mus musculus
catggcaagcctacttccagagggt

SEQ ID NO: 418546 - DNA, 25 bp, Mus musculus
catggcaagtgttgtgtctcctggg

SEQ ID NO: 418547 - DNA, 25 bp, Mus musculus
catggcaatccagtacagactggaa

SEQ ID NO: 418548 - DNA, 25 bp, Mus musculus
catggcaattggtgacaggtggacc

SEQ ID NO: 418549 - DNA, 25 bp, Mus musculus
catggcacatgcagcagtgaggtcg

SEQ ID NO: 418550 - DNA, 25 bp, Mus musculus
catggcaccaaaccacctgagggaa

SEQ ID NO: 418551 - DNA, 25 bp, Mus musculus
catggcacgtaatggagactaccga

SEQ ID NO: 418552 - DNA, 25 bp, Mus musculus
catggcagaactgtgtctatggagc

SEQ ID NO: 418553 - DNA, 25 bp, Mus musculus
catggcagagggttacgatgccgca

SEQ ID NO: 418554 - DNA, 25 bp, Mus musculus
catggcagcacaaagtggacctgat

SEQ ID NO: 418555 - DNA, 25 bp, Mus musculus
catggcagcatttgcagggatgtgt

SEQ ID NO: 418556 - DNA, 25 bp, Mus musculus
catggcagctacaatcccttctgga

SEQ ID NO: 418557 - DNA, 25 bp, Mus musculus
catggcaggagagtaacaaggccca

SEQ ID NO: 418558 - DNA, 25 bp, Mus musculus
catggcagggcatatttgggagcta

SEQ ID NO: 418559 - DNA, 25 bp, Mus musculus
catggcaggtacatcggcaggctta

SEQ ID NO: 418560 - DNA, 25 bp, Mus musculus
catggcaggtttagccttttgactg

SEQ ID NO: 418561 - DNA, 25 bp, Mus musculus
catggcagtgccttttgtggaagac

SEQ ID NO: 418562 - DNA, 25 bp, Mus musculus
catggcagtggctaatgcaatgttt

SEQ ID NO: 418563 - DNA, 25 bp, Mus musculus
catggcataaacctgacttgggaac

SEQ ID NO: 418564 - DNA, 25 bp, Mus musculus
catggcatccagctacactcgggaa

SEQ ID NO: 418565 - DNA, 25 bp, Mus musculus
catggcatgagtgagttggtgaccc

SEQ ID NO: 418566 - DNA, 25 bp, Mus musculus
catggcatggaaccccttcgggaag

SEQ ID NO: 418567 - DNA, 25 bp, Mus musculus
catggcatggatcccaagttgggcc

SEQ ID NO: 418568 - DNA, 25 bp, Mus musculus
catggcatggtagaatgtatattgc

SEQ ID NO: 418569 - DNA, 25 bp, Mus musculus
catggcatgttcctagtccgggact

SEQ ID NO: 418570 - DNA, 25 bp, Mus musculus
catggcattccaggcgctaaaggtg

SEQ ID NO: 418571 - DNA, 25 bp, Mus musculus
catggcatttcatcctgatctctca

SEQ ID NO: 418572 - DNA, 25 bp, Mus musculus
catggccaaaaagtgctacaaggac

SEQ ID NO: 418573 - DNA, 25 bp, Mus musculus
catggccaacgaggaagatgctgac

SEQ ID NO: 418574 - DNA, 25 bp, Mus musculus
catggccaagagagtcaaagcgacc

SEQ ID NO: 418575 - DNA, 25 bp, Mus musculus
catggccaagatgcagactcagtag

SEQ ID NO: 418576 - DNA, 25 bp, Mus musculus
catggccacttgtgggactggcgtc

SEQ ID NO: 418577 - DNA, 25 bp, Mus musculus
catggccagcatcccctgaagaagt

SEQ ID NO: 418578 - DNA, 25 bp, Mus musculus
catggccagctaccaactatgtgga

SEQ ID NO: 418579 - DNA, 25 bp, Mus musculus
catggccaggtaacttcagtcttgt

SEQ ID NO: 418580 - DNA, 25 bp, Mus musculus
catggccagtcttaaggatcctcga

SEQ ID NO: 418581 - DNA, 25 bp, Mus musculus
catggccagtttctctgggtcttcc

SEQ ID NO: 418582 - DNA, 25 bp, Mus musculus
catggccagttttgacataggctag

SEQ ID NO: 418583 - DNA, 25 bp, Mus musculus
catggcccactacactgtctttaag

SEQ ID NO: 418584 - DNA, 25 bp, Mus musculus
catggccccgaagtatgtgctggaa

SEQ ID NO: 418585 - DNA, 25 bp, Mus musculus
catggcccttgtgccagagagtagc

SEQ ID NO: 418586 - DNA, 25 bp, Mus musculus
catggccgccggctcctgggtatct

SEQ ID NO: 418587 - DNA, 25 bp, Mus musculus
catggccgcttacgtgcacctcatg

SEQ ID NO: 418588 - DNA, 25 bp, Mus musculus
catggccggaatttggttcgaggaa

SEQ ID NO: 418589 - DNA, 25 bp, Mus musculus
catggcctccgatgttgaatgggac

SEQ ID NO: 418590 - DNA, 25 bp, Mus musculus
catggcctcggtggtggaatacaag

SEQ ID NO: 418591 - DNA, 25 bp, Mus musculus
catggcctgggctctagtgtgtaaa

SEQ ID NO: 418592 - DNA, 25 bp, Mus musculus
catggcgacgctgctaagggaaatc

SEQ ID NO: 418593 - DNA, 25 bp, Mus musculus
catggcgagaccactgtgtgaagcg

SEQ ID NO: 418594 - DNA, 25 bp, Mus musculus
catggcgagcgcatcatggcgatcg

SEQ ID NO: 418595 - DNA, 25 bp, Mus musculus
catggcgatgaagcgggccctttcc

SEQ ID NO: 418596 - DNA, 25 bp, Mus musculus
catggcgcagcccagtattaactgt

SEQ ID NO: 418597 - DNA, 25 bp, Mus musculus
catggcgcccaagtgaacctggata

SEQ ID NO: 418598 - DNA, 25 bp, Mus musculus
catggcgctggatgggatgatccta

SEQ ID NO: 418599 - DNA, 25 bp, Mus musculus
catggcggcggtaaagaccctaaat

SEQ ID NO: 418600 - DNA, 25 bp, Mus musculus
catggcggcttcaaactggcagtgc

SEQ ID NO: 418601 - DNA, 25 bp, Mus musculus
catggcgggaaaagcgagattatgt

SEQ ID NO: 418602 - DNA, 25 bp, Mus musculus
catggcgggagctggcatcattgtc

SEQ ID NO: 418603 - DNA, 25 bp, Mus musculus
catggcggtgagacttcctggatca

SEQ ID NO: 418604 - DNA, 25 bp, Mus musculus
catggcgtattagaggcagcagtgc

SEQ ID NO: 418605 - DNA, 25 bp, Mus musculus
catggcgtggagagctacttagact

SEQ ID NO: 418606 - DNA, 25 bp, Mus musculus
catggcgttgatatgacctcggtta

SEQ ID NO: 418607 - DNA, 25 bp, Mus musculus
catggctacatctgcaaatctggac

SEQ ID NO: 418608 - DNA, 25 bp, Mus musculus
catggctacatcttggctatcatta

SEQ ID NO: 418609 - DNA, 25 bp, Mus musculus
catggctagccatatctgttctcag

SEQ ID NO: 418610 - DNA, 25 bp, Mus musculus
catggctatcagacacagaaatttg

SEQ ID NO: 418611 - DNA, 25 bp, Mus musculus
catggctatcccagtaaattacgct

SEQ ID NO: 418612 - DNA, 25 bp, Mus musculus
catggctatggacctgtgataaggc

SEQ ID NO: 418613 - DNA, 25 bp, Mus musculus
catggctcaactttctgcccagagg

SEQ ID NO: 418614 - DNA, 25 bp, Mus musculus
catggctcaggatcagaccctggag

SEQ ID NO: 418615 - DNA, 25 bp, Mus musculus
catggctcatggcagaggtgctgca

SEQ ID NO: 418616 - DNA, 25 bp, Mus musculus
catggctcattaccagagactgtgg

SEQ ID NO: 418617 - DNA, 25 bp, Mus musculus
catggctccgtcttcatcgttggca

SEQ ID NO: 418618 - DNA, 25 bp, Mus musculus
catggctcggcagctacgtgagtac

SEQ ID NO: 418619 - DNA, 25 bp, Mus musculus
catggctgagatccgggacaacttc

SEQ ID NO: 418620 - DNA, 25 bp, Mus musculus
catggctgagctacaggttcgagac

SEQ ID NO: 418621 - DNA, 25 bp, Mus musculus
catggctgatagtcactctgaggca

SEQ ID NO: 418622 - DNA, 25 bp, Mus musculus
catggctgatctcgatggaactcct

SEQ ID NO: 418623 - DNA, 25 bp, Mus musculus
catggctgccaagatctgcagaaga

SEQ ID NO: 418624 - DNA, 25 bp, Mus musculus
catggctgccatctgggttctggac

SEQ ID NO: 418625 - DNA, 25 bp, Mus musculus
catggctgctcaaaacctgcctgag

SEQ ID NO: 418626 - DNA, 25 bp, Mus musculus
catggctggcattaaactaggtgtg

SEQ ID NO: 418627 - DNA, 25 bp, Mus musculus
catggctggcctgtacgaggagatt

SEQ ID NO: 418628 - DNA, 25 bp, Mus musculus
catggctgggctcatccctgctctg

SEQ ID NO: 418629 - DNA, 25 bp, Mus musculus
catggctgggtcttagcacagggtc

SEQ ID NO: 418630 - DNA, 25 bp, Mus musculus
catggctgtatcttcctggtgcaaa

SEQ ID NO: 418631 - DNA, 25 bp, Mus musculus
catggctgtcaaagtgtcccttcga

SEQ ID NO: 418632 - DNA, 25 bp, Mus musculus
catggctgtgtatgaccgtgcgacc

SEQ ID NO: 418633 - DNA, 25 bp, Mus musculus
catggctgtgtccagaaagtaggca

SEQ ID NO: 418634 - DNA, 25 bp, Mus musculus
catggcttcggtgttcatgtgcgga

SEQ ID NO: 418635 - DNA, 25 bp, Mus musculus
catggcttctccgactaaaggcggt

SEQ ID NO: 418636 - DNA, 25 bp, Mus musculus
catggcttggctacgtgaacagtgc

SEQ ID NO: 418637 - DNA, 25 bp, Mus musculus
catggcttggttcctgttgatctca

SEQ ID NO: 418638 - DNA, 25 bp, Mus musculus
catggcttttcaatatctgtagtgc

SEQ ID NO: 418639 - DNA, 25 bp, Mus musculus
catgggaaaggaagtcaagcagcac

SEQ ID NO: 418640 - DNA, 25 bp, Mus musculus
catgggaaatactgcacaactgaga

SEQ ID NO: 418641 - DNA, 25 bp, Mus musculus
catgggaacatccaagtcagttgtg

SEQ ID NO: 418642 - DNA, 25 bp, Mus musculus
catgggaacattctatgcagtcaag

SEQ ID NO: 418643 - DNA, 25 bp, Mus musculus
catgggaaccttcttcgacggagcc

SEQ ID NO: 418644 - DNA, 25 bp, Mus musculus
catgggaagccactgaggtatgctt

SEQ ID NO: 418645 - DNA, 25 bp, Mus musculus
catgggaagctgcttatggtaataa

SEQ ID NO: 418646 - DNA, 25 bp, Mus musculus
catgggaagggtcctactatctccc

SEQ ID NO: 418647 - DNA, 25 bp, Mus musculus
catgggaagttcatcgacacaggct

SEQ ID NO: 418648 - DNA, 25 bp, Mus musculus
catgggaatgccatgtcctggagat

SEQ ID NO: 418649 - DNA, 25 bp, Mus musculus
catgggacaactgggtagaagctaa

SEQ ID NO: 418650 - DNA, 25 bp, Mus musculus
catgggacaggatgcttttatggag

SEQ ID NO: 418651 - DNA, 25 bp, Mus musculus
catgggacagtgatccaatgccagc

SEQ ID NO: 418652 - DNA, 25 bp, Mus musculus
catgggacatgatcaggcctgagca

SEQ ID NO: 418653 - DNA, 25 bp, Mus musculus
catgggacatgctgggagaccttcc

SEQ ID NO: 418654 - DNA, 25 bp, Mus musculus
catgggaccagctgtacaggtagga

SEQ ID NO: 418655 - DNA, 25 bp, Mus musculus
catgggaccttctggcaacacaggg

SEQ ID NO: 418656 - DNA, 25 bp, Mus musculus
catgggactcataggctcaacaata

SEQ ID NO: 418657 - DNA, 25 bp, Mus musculus
catgggactgtgaagtgcaacggac

SEQ ID NO: 418658 - DNA, 25 bp, Mus musculus
catgggacttcctagctgggagacc

SEQ ID NO: 418659 - DNA, 25 bp, Mus musculus
catgggagaacaaatgcctggcaaa

SEQ ID NO: 418660 - DNA, 25 bp, Mus musculus
catgggagaagtaatgacctggaac

SEQ ID NO: 418661 - DNA, 25 bp, Mus musculus
catgggagacaaacccaggccatgt

SEQ ID NO: 418662 - DNA, 25 bp, Mus musculus
catgggagacctgctcattgatgac

SEQ ID NO: 418663 - DNA, 25 bp, Mus musculus
catgggagcttagttattacgccgc

SEQ ID NO: 418664 - DNA, 25 bp, Mus musculus
catgggagtctagttttttcacacc

SEQ ID NO: 418665 - DNA, 25 bp, Mus musculus
catgggatacattctcagtggcctt

SEQ ID NO: 418666 - DNA, 25 bp, Mus musculus
catgggatactctgattacaggaca

SEQ ID NO: 418667 - DNA, 25 bp, Mus musculus
catgggatcatctctcgggagcagg

SEQ ID NO: 418668 - DNA, 25 bp, Mus musculus
catgggatgggagtctattctgtgt

SEQ ID NO: 418669 - DNA, 25 bp, Mus musculus
catgggattattccagagggtctca

SEQ ID NO: 418670 - DNA, 25 bp, Mus musculus
catgggattgccctgcttctggaca

SEQ ID NO: 418671 - DNA, 25 bp, Mus musculus
catgggcagcaaacgcgatcctgaa

SEQ ID NO: 418672 - DNA, 25 bp, Mus musculus
catgggcagtatcctattggctaag

SEQ ID NO: 418673 - DNA, 25 bp, Mus musculus
catgggcagtatctcatcgggcacg

SEQ ID NO: 418674 - DNA, 25 bp, Mus musculus
catgggcagtcaaaatgagccgggt

SEQ ID NO: 418675 - DNA, 25 bp, Mus musculus
catgggcatgctcctacaatactcc

SEQ ID NO: 418676 - DNA, 25 bp, Mus musculus
catgggcatgggtcatctgctagcc

SEQ ID NO: 418677 - DNA, 25 bp, Mus musculus
catgggccactttgacagctctgct

SEQ ID NO: 418678 - DNA, 25 bp, Mus musculus
catgggccagtgctactacaacgag

SEQ ID NO: 418679 - DNA, 25 bp, Mus musculus
catgggcccacgactgtctctgaga

SEQ ID NO: 418680 - DNA, 25 bp, Mus musculus
catgggcccctcctattggttctga

SEQ ID NO: 418681 - DNA, 25 bp, Mus musculus
catgggcctcaagattacaagcgtg

SEQ ID NO: 418682 - DNA, 25 bp, Mus musculus
catgggcctggaattcaaaaagtac

SEQ ID NO: 418683 - DNA, 25 bp, Mus musculus
catgggccttaattcacagtgtgag

SEQ ID NO: 418684 - DNA, 25 bp, Mus musculus
catgggccttgtaggcttcatgatc

SEQ ID NO: 418685 - DNA, 25 bp, Mus musculus
catgggctagaagtgcatgtccgcc

SEQ ID NO: 418686 - DNA, 25 bp, Mus musculus
catgggctagctttggactctcctc

SEQ ID NO: 418687 - DNA, 25 bp, Mus musculus
catgggctatgaagacgaggaacgt

SEQ ID NO: 418688 - DNA, 25 bp, Mus musculus
catgggctgcttgggtgtcaccaga

SEQ ID NO: 418689 - DNA, 25 bp, Mus musculus
catgggctgtacatgctcttcctgc

SEQ ID NO: 418690 - DNA, 25 bp, Mus musculus
catgggcttcagaatcggagagaac

SEQ ID NO: 418691 - DNA, 25 bp, Mus musculus
catgggcttccctgcagtgtgtgca

SEQ ID NO: 418692 - DNA, 25 bp, Mus musculus
catgggcttcttacaggtgcttctc

SEQ ID NO: 418693 - DNA, 25 bp, Mus musculus
catgggcttgtccaacagcctggcg

SEQ ID NO: 418694 - DNA, 25 bp, Mus musculus
catgggtaagcttaatggccagcca

SEQ ID NO: 418695 - DNA, 25 bp, Mus musculus
catgggtactttttgactggtggct

SEQ ID NO: 418696 - DNA, 25 bp, Mus musculus
catgggtatgtcaaccagggtagcc

SEQ ID NO: 418697 - DNA, 25 bp, Mus musculus
catgggtccctatttcagatgctgg

SEQ ID NO: 418698 - DNA, 25 bp, Mus musculus
catgggtcccttagtaatcataggc

SEQ ID NO: 418699 - DNA, 25 bp, Mus musculus
catgggtctaactgctccgaggaga

SEQ ID NO: 418700 - DNA, 25 bp, Mus musculus
catgggtctcttaccaaggtcgcaa

SEQ ID NO: 418701 - DNA, 25 bp, Mus musculus
catgggtgcatgctggtctcaagtc

SEQ ID NO: 418702 - DNA, 25 bp, Mus musculus
catgggtgccaaagtagaactgcgt

SEQ ID NO: 418703 - DNA, 25 bp, Mus musculus
catgggtgctcagaatgcctcggga

SEQ ID NO: 418704 - DNA, 25 bp, Mus musculus
catgggtgtacatcctgctgcgcca

SEQ ID NO: 418705 - DNA, 25 bp, Mus musculus
catgggttatgatggagctccgtca

SEQ ID NO: 418706 - DNA, 25 bp, Mus musculus
catgggttcatcacttgggtcagga

SEQ ID NO: 418707 - DNA, 25 bp, Mus musculus
catgggttgccatggctaccgggac

SEQ ID NO: 418708 - DNA, 25 bp, Mus musculus
catgggttgcctccacgggttgcta

SEQ ID NO: 418709 - DNA, 25 bp, Mus musculus
catgggttgcctctcataaacggac

SEQ ID NO: 418710 - DNA, 25 bp, Mus musculus
catgggtttagctctgtgtttaggg

SEQ ID NO: 418711 - DNA, 25 bp, Mus musculus
catggtaacccggtaagagaggagc

SEQ ID NO: 418712 - DNA, 25 bp, Mus musculus
catggtacacagactggaatgagct

SEQ ID NO: 418713 - DNA, 25 bp, Mus musculus
catggtacctagcaggatcttctgg

SEQ ID NO: 418714 - DNA, 25 bp, Mus musculus
catggtacgagagaactaactccca

SEQ ID NO: 418715 - DNA, 25 bp, Mus musculus
catggtagacaacctggccttgcag

SEQ ID NO: 418716 - DNA, 25 bp, Mus musculus
catggtagccgcctagagaacttcc

SEQ ID NO: 418717 - DNA, 25 bp, Mus musculus
catggtagctccagatcagaagcag

SEQ ID NO: 418718 - DNA, 25 bp, Mus musculus
catggtagctgctggtgacacggct

SEQ ID NO: 418719 - DNA, 25 bp, Mus musculus
catggtatatcatctgggcgctccc

SEQ ID NO: 418720 - DNA, 25 bp, Mus musculus
catggtcaaaatcagcgtctacggc

SEQ ID NO: 418721 - DNA, 25 bp, Mus musculus
catggtcaaacagaaagccctgaga

SEQ ID NO: 418722 - DNA, 25 bp, Mus musculus
catggtcaaacgcttttgcaaacgg

SEQ ID NO: 418723 - DNA, 25 bp, Mus musculus
catggtcatctctgttgatgctgcc

SEQ ID NO: 418724 - DNA, 25 bp, Mus musculus
catggtcatgcgtgcctcagtgtca

SEQ ID NO: 418725 - DNA, 25 bp, Mus musculus
catggtcatgggaggacattggcca

SEQ ID NO: 418726 - DNA, 25 bp, Mus musculus
catggtccagaagagcggcatgtcc

SEQ ID NO: 418727 - DNA, 25 bp, Mus musculus
catggtccatatagcccctcttcta

SEQ ID NO: 418728 - DNA, 25 bp, Mus musculus
catggtccgggatcctcggctctta

SEQ ID NO: 418729 - DNA, 25 bp, Mus musculus
catggtcctaagtgaggaaggctac

SEQ ID NO: 418730 - DNA, 25 bp, Mus musculus
catggtcctagaagaacattagctc

SEQ ID NO: 418731 - DNA, 25 bp, Mus musculus
catggtcctcgggaaaagaaggcca

SEQ ID NO: 418732 - DNA, 25 bp, Mus musculus
catggtcggtcattccggcagcttc

SEQ ID NO: 418733 - DNA, 25 bp, Mus musculus
catggtctcctgttagactgtctac

SEQ ID NO: 418734 - DNA, 25 bp, Mus musculus
catggtctctcgcagtgaagtggac

SEQ ID NO: 418735 - DNA, 25 bp, Mus musculus
catggtctgcagagccttacaaggt

SEQ ID NO: 418736 - DNA, 25 bp, Mus musculus
catggtcttgtcttggtgaaggctc

SEQ ID NO: 418737 - DNA, 25 bp, Mus musculus
catggtctttctacagcggtacggc

SEQ ID NO: 418738 - DNA, 25 bp, Mus musculus
catggtgaaagcgtgtcagaactac

SEQ ID NO: 418739 - DNA, 25 bp, Mus musculus
catggtgaagctcaacaggtcccta

SEQ ID NO: 418740 - DNA, 25 bp, Mus musculus
catggtgacaccaactaagattgat

SEQ ID NO: 418741 - DNA, 25 bp, Mus musculus
catggtgaccttgactctcagagga

SEQ ID NO: 418742 - DNA, 25 bp, Mus musculus
catggtgacgaaactaatggatcgc

SEQ ID NO: 418743 - DNA, 25 bp, Mus musculus
catggtgagggctatgtgatctcct

SEQ ID NO: 418744 - DNA, 25 bp, Mus musculus
catggtgagtagcatcactgcgtcc

SEQ ID NO: 418745 - DNA, 25 bp, Mus musculus
catggtgagtatatcttagcactga

SEQ ID NO: 418746 - DNA, 25 bp, Mus musculus
catggtgataccctggcaagcttca

SEQ ID NO: 418747 - DNA, 25 bp, Mus musculus
catggtgatgtggtcttcgctggca

SEQ ID NO: 418748 - DNA, 25 bp, Mus musculus
catggtgcagatagaagcgggtcaa

SEQ ID NO: 418749 - DNA, 25 bp, Mus musculus
catggtgcagcctcctcagggagac

SEQ ID NO: 418750 - DNA, 25 bp, Mus musculus
catggtgcccctgagcctcttgagt

SEQ ID NO: 418751 - DNA, 25 bp, Mus musculus
catggtgctattccacgaaacattc

SEQ ID NO: 418752 - DNA, 25 bp, Mus musculus
catggtggaggcaaagtctgtcagc

SEQ ID NO: 418753 - DNA, 25 bp, Mus musculus
catggtggccgtggaaattctttca

SEQ ID NO: 418754 - DNA, 25 bp, Mus musculus
catggtggcgtatactcaaagtctc

SEQ ID NO: 418755 - DNA, 25 bp, Mus musculus
catggtgggacctcatatggccgga

SEQ ID NO: 418756 - DNA, 25 bp, Mus musculus
catggtggtagaacagtagctatga

SEQ ID NO: 418757 - DNA, 25 bp, Mus musculus
catggtggtctgtaagcaagtgccc

SEQ ID NO: 418758 - DNA, 25 bp, Mus musculus
catggtggtgagtagcctgtaaacc

SEQ ID NO: 418759 - DNA, 25 bp, Mus musculus
catggtggtggccactcttacaacc

SEQ ID NO: 418760 - DNA, 25 bp, Mus musculus
catggtgtctatggcctgcagcgga

SEQ ID NO: 418761 - DNA, 25 bp, Mus musculus
catggtgtgtataaaagaaggctca

SEQ ID NO: 418762 - DNA, 25 bp, Mus musculus
catggtgttgtcctatccgtgggct

SEQ ID NO: 418763 - DNA, 25 bp, Mus musculus
catggtgtttaaggacgtgctgctc

SEQ ID NO: 418764 - DNA, 25 bp, Mus musculus
catggttacatggagggacttgagc

SEQ ID NO: 418765 - DNA, 25 bp, Mus musculus
catggttagctccaggcctacagga

SEQ ID NO: 418766 - DNA, 25 bp, Mus musculus
catggttagttgttacttgggaatc

SEQ ID NO: 418767 - DNA, 25 bp, Mus musculus
catggttccagcaggatgggtctta

SEQ ID NO: 418768 - DNA, 25 bp, Mus musculus
catggttccataaattctacataaa

SEQ ID NO: 418769 - DNA, 25 bp, Mus musculus
catggttcggagatgtttcacaaaa

SEQ ID NO: 418770 - DNA, 25 bp, Mus musculus
catggttctctactgccaaaggtga

SEQ ID NO: 418771 - DNA, 25 bp, Mus musculus
catggttctgaccttcagtgccaaa

SEQ ID NO: 418772 - DNA, 25 bp, Mus musculus
catggttgctgctcagaaaggttac

SEQ ID NO: 418773 - DNA, 25 bp, Mus musculus
catggttgggctctctctttgcaaa

SEQ ID NO: 418774 - DNA, 25 bp, Mus musculus
catggttgttgcttcaagttgtccc

SEQ ID NO: 418775 - DNA, 25 bp, Mus musculus
catggtttccaggaccgtgtggcca

SEQ ID NO: 418776 - DNA, 25 bp, Mus musculus
catgtaaaatgcagaggagtcctgg

SEQ ID NO: 418777 - DNA, 25 bp, Mus musculus
catgtaaagggaggcgacgaagcca

SEQ ID NO: 418778 - DNA, 25 bp, Mus musculus
catgtaaagtaacggagaagagatc

SEQ ID NO: 418779 - DNA, 25 bp, Mus musculus
catgtaacggttaaaccagcctcgc

SEQ ID NO: 418780 - DNA, 25 bp, Mus musculus
catgtaactagcaaaagactgaggt

SEQ ID NO: 418781 - DNA, 25 bp, Mus musculus
catgtaagaatgctgtgggtgccaa

SEQ ID NO: 418782 - DNA, 25 bp, Mus musculus
catgtaagccttgcagaatccacgg

SEQ ID NO: 418783 - DNA, 25 bp, Mus musculus
catgtaagggcttgtgtgaaccacg

SEQ ID NO: 418784 - DNA, 25 bp, Mus musculus
catgtaagtactgataattgaaccc

SEQ ID NO: 418785 - DNA, 25 bp, Mus musculus
catgtaagtagggttcatgtaagca

SEQ ID NO: 418786 - DNA, 25 bp, Mus musculus
catgtaatgcctgatacaccggaga

SEQ ID NO: 418787 - DNA, 25 bp, Mus musculus
catgtaattagtttctgggccagca

SEQ ID NO: 418788 - DNA, 25 bp, Mus musculus
catgtaattcacagcccattggcac

SEQ ID NO: 418789 - DNA, 25 bp, Mus musculus
catgtaattgacgagacagaggcga

SEQ ID NO: 418790 - DNA, 25 bp, Mus musculus
catgtacaatgcttttggcaagccc

SEQ ID NO: 418791 - DNA, 25 bp, Mus musculus
catgtacaccaagatgaatgcggag

SEQ ID NO: 418792 - DNA, 25 bp, Mus musculus
catgtacaccaaggaaggaccgacg

SEQ ID NO: 418793 - DNA, 25 bp, Mus musculus
catgtacacgcctggagatgcctga

SEQ ID NO: 418794 - DNA, 25 bp, Mus musculus
catgtacacgctatccagagaaccc

SEQ ID NO: 418795 - DNA, 25 bp, Mus musculus
catgtacacggtcactggacgctgg

SEQ ID NO: 418796 - DNA, 25 bp, Mus musculus
catgtacagccaagagccttttgac

SEQ ID NO: 418797 - DNA, 25 bp, Mus musculus
catgtacatcttaccccagggcgag

SEQ ID NO: 418798 - DNA, 25 bp, Mus musculus
catgtacatgtggagaactcaggtc

SEQ ID NO: 418799 - DNA, 25 bp, Mus musculus
catgtacattgacaccgagggcacc

SEQ ID NO: 418800 - DNA, 25 bp, Mus musculus
catgtaccagaaagggcaagagacg

SEQ ID NO: 418801 - DNA, 25 bp, Mus musculus
catgtacccacaaatatacgagcaa

SEQ ID NO: 418802 - DNA, 25 bp, Mus musculus
catgtacccagacatccacttgcgg

SEQ ID NO: 418803 - DNA, 25 bp, Mus musculus
catgtaccctgtgacaattggaggc

SEQ ID NO: 418804 - DNA, 25 bp, Mus musculus
catgtaccgccaagtgattctagcc

SEQ ID NO: 418805 - DNA, 25 bp, Mus musculus
catgtactaaatttagtgtgtgcca

SEQ ID NO: 418806 - DNA, 25 bp, Mus musculus
catgtactgtgtgaaggcgcaggca

SEQ ID NO: 418807 - DNA, 25 bp, Mus musculus
catgtagaccttgtcctgtgccaaa

SEQ ID NO: 418808 - DNA, 25 bp, Mus musculus
catgtagacgctaacctttgctgaa

SEQ ID NO: 418809 - DNA, 25 bp, Mus musculus
catgtagagtgtgccagcacttctg

SEQ ID NO: 418810 - DNA, 25 bp, Mus musculus
catgtagcaagtatagccgcagggc

SEQ ID NO: 418811 - DNA, 25 bp, Mus musculus
catgtagcacaatcactgtaaacgt

SEQ ID NO: 418812 - DNA, 25 bp, Mus musculus
catgtagcctcacttagcccaggct

SEQ ID NO: 418813 - DNA, 25 bp, Mus musculus
catgtagcgtgcttagtaatgactg

SEQ ID NO: 418814 - DNA, 25 bp, Mus musculus
catgtaggactcagtgagaagagtg

SEQ ID NO: 418815 - DNA, 25 bp, Mus musculus
catgtaggagatagcaatgtcaagg

SEQ ID NO: 418816 - DNA, 25 bp, Mus musculus
catgtaggagccctgtagcttccct

SEQ ID NO: 418817 - DNA, 25 bp, Mus musculus
catgtaggctcatctgctcagaaag

SEQ ID NO: 418818 - DNA, 25 bp, Mus musculus
catgtagggataaaaagaactgtaa

SEQ ID NO: 418819 - DNA, 25 bp, Mus musculus
catgtagggttaaggcctcaggagt

SEQ ID NO: 418820 - DNA, 25 bp, Mus musculus
catgtagtcagattgtccccaggaa

SEQ ID NO: 418821 - DNA, 25 bp, Mus musculus
catgtagtgttcctgaccggtgcga

SEQ ID NO: 418822 - DNA, 25 bp, Mus musculus
catgtagttagtgataacccctgca

SEQ ID NO: 418823 - DNA, 25 bp, Mus musculus
catgtatcatgcgagcaagctgagc

SEQ ID NO: 418824 - DNA, 25 bp, Mus musculus
catgtatgcccgagaccgtagagat

SEQ ID NO: 418825 - DNA, 25 bp, Mus musculus
catgtatgcctactcgtcgggagga

SEQ ID NO: 418826 - DNA, 25 bp, Mus musculus
catgtatggccctcctggctgtgga

SEQ ID NO: 418827 - DNA, 25 bp, Mus musculus
catgtatggctgcacatcataagcg

SEQ ID NO: 418828 - DNA, 25 bp, Mus musculus
catgtatgggccctgggtccctgca

SEQ ID NO: 418829 - DNA, 25 bp, Mus musculus
catgtatgtcatcaagacatgtgca

SEQ ID NO: 418830 - DNA, 25 bp, Mus musculus
catgtatgtcgccatccaggcagtg

SEQ ID NO: 418831 - DNA, 25 bp, Mus musculus
catgtatttgtggacgaggcaggac

SEQ ID NO: 418832 - DNA, 25 bp, Mus musculus
catgtcaaaaaggtactgtatgccc

SEQ ID NO: 418833 - DNA, 25 bp, Mus musculus
catgtcacagctgcgcttctggctg

SEQ ID NO: 418834 - DNA, 25 bp, Mus musculus
catgtcaccgaagactatgtccagg

SEQ ID NO: 418835 - DNA, 25 bp, Mus musculus
catgtcagcagtggttccgaggtca

SEQ ID NO: 418836 - DNA, 25 bp, Mus musculus
catgtcagcccaagtctccaagtac

SEQ ID NO: 418837 - DNA, 25 bp, Mus musculus
catgtcaggaccatttggcggcgcc

SEQ ID NO: 418838 - DNA, 25 bp, Mus musculus
catgtcaggaggagcatggtcaccc

SEQ ID NO: 418839 - DNA, 25 bp, Mus musculus
catgtcagggtctcaagcctagggc

SEQ ID NO: 418840 - DNA, 25 bp, Mus musculus
catgtcagtgctctacgtctgggcc

SEQ ID NO: 418841 - DNA, 25 bp, Mus musculus
catgtcagtgctcttactggcccca

SEQ ID NO: 418842 - DNA, 25 bp, Mus musculus
catgtcattgaaggcctggctggat

SEQ ID NO: 418843 - DNA, 25 bp, Mus musculus
catgtccagaacaggtactgtcctc

SEQ ID NO: 418844 - DNA, 25 bp, Mus musculus
catgtccaggtctgcaagcaagcga

SEQ ID NO: 418845 - DNA, 25 bp, Mus musculus
catgtccaggtgttggccgggttcc

SEQ ID NO: 418846 - DNA, 25 bp, Mus musculus
catgtccagtggagaaggcgaaccc

SEQ ID NO: 418847 - DNA, 25 bp, Mus musculus
catgtccccagttccagacagtgtg

SEQ ID NO: 418848 - DNA, 25 bp, Mus musculus
catgtccgactatcagatgaaattt

SEQ ID NO: 418849 - DNA, 25 bp, Mus musculus
catgtcctggactgcaagagtgcca

SEQ ID NO: 418850 - DNA, 25 bp, Mus musculus
catgtcctggagatatacaatgtca

SEQ ID NO: 418851 - DNA, 25 bp, Mus musculus
catgtcctttgcgtttctggttcga

SEQ ID NO: 418852 - DNA, 25 bp, Mus musculus
catgtcgcagccacagaggatctgg

SEQ ID NO: 418853 - DNA, 25 bp, Mus musculus
catgtcggacaagtacggaggcaca

SEQ ID NO: 418854 - DNA, 25 bp, Mus musculus
catgtcgtgagcgttctggatgccc

SEQ ID NO: 418855 - DNA, 25 bp, Mus musculus
catgtcgtgtttgccctgagagccc

SEQ ID NO: 418856 - DNA, 25 bp, Mus musculus
catgtcgttttacgtgcggcccagc

SEQ ID NO: 418857 - DNA, 25 bp, Mus musculus
catgtctaaatggaggtactataat

SEQ ID NO: 418858 - DNA, 25 bp, Mus musculus
catgtctctgccaagccagccaaaa

SEQ ID NO: 418859 - DNA, 25 bp, Mus musculus
catgtctgacaaacccgatatggct

SEQ ID NO: 418860 - DNA, 25 bp, Mus musculus
catgtctgccaacggaactccgtga

SEQ ID NO: 418861 - DNA, 25 bp, Mus musculus
catgtctgctgtgccttggagtctt

SEQ ID NO: 418862 - DNA, 25 bp, Mus musculus
catgtctgggtatcccgggattggt

SEQ ID NO: 418863 - DNA, 25 bp, Mus musculus
catgtctgggtttactctgcttcaa

SEQ ID NO: 418864 - DNA, 25 bp, Mus musculus
catgtctggttattctctgtgcacc

SEQ ID NO: 418865 - DNA, 25 bp, Mus musculus
catgtctgtcccatgggaggtggaa

SEQ ID NO: 418866 - DNA, 25 bp, Mus musculus
catgtctgtgtctaccgagggtgct

SEQ ID NO: 418867 - DNA, 25 bp, Mus musculus
catgtcttagctagtcaggttcagg

SEQ ID NO: 418868 - DNA, 25 bp, Mus musculus
catgtcttcgcagagatgggagtta

SEQ ID NO: 418869 - DNA, 25 bp, Mus musculus
catgtcttctgtcgcagctgcacaa

SEQ ID NO: 418870 - DNA, 25 bp, Mus musculus
catgtcttggtggttctggtgctca

SEQ ID NO: 418871 - DNA, 25 bp, Mus musculus
catgtctttgctatagtgtgtctaa

SEQ ID NO: 418872 - DNA, 25 bp, Mus musculus
catgtgaaccatggattcgggctca

SEQ ID NO: 418873 - DNA, 25 bp, Mus musculus
catgtgaagaaccaatcgtcagccc

SEQ ID NO: 418874 - DNA, 25 bp, Mus musculus
catgtgaatgccctacaagagcagc

SEQ ID NO: 418875 - DNA, 25 bp, Mus musculus
catgtgacagcagtaacactagtgc

SEQ ID NO: 418876 - DNA, 25 bp, Mus musculus
catgtgaccatatccagcagagaga

SEQ ID NO: 418877 - DNA, 25 bp, Mus musculus
catgtgaccgaggacataaggaact

SEQ ID NO: 418878 - DNA, 25 bp, Mus musculus
catgtgacctccataaattgtcttt

SEQ ID NO: 418879 - DNA, 25 bp, Mus musculus
catgtgacgcattgatttctgggaa

SEQ ID NO: 418880 - DNA, 25 bp, Mus musculus
catgtgactagcgagattggagcag

SEQ ID NO: 418881 - DNA, 25 bp, Mus musculus
catgtgactggatggatagactccc

SEQ ID NO: 418882 - DNA, 25 bp, Mus musculus
catgtgacttctgaggtctaagcgg

SEQ ID NO: 418883 - DNA, 25 bp, Mus musculus
catgtgagaccaccatgtgagatca

SEQ ID NO: 418884 - DNA, 25 bp, Mus musculus
catgtgagatctgtgcctacgctgc

SEQ ID NO: 418885 - DNA, 25 bp, Mus musculus
catgtgagcatagaagtcaaccgca

SEQ ID NO: 418886 - DNA, 25 bp, Mus musculus
catgtgagctaaaccacggcagggt

SEQ ID NO: 418887 - DNA, 25 bp, Mus musculus
catgtgatctgcgtcttacctttgc

SEQ ID NO: 418888 - DNA, 25 bp, Mus musculus
catgtgcaactgtgtacggagaggc

SEQ ID NO: 418889 - DNA, 25 bp, Mus musculus
catgtgcactccatggcatgtatac

SEQ ID NO: 418890 - DNA, 25 bp, Mus musculus
catgtgcactggaagacgtggctcg

SEQ ID NO: 418891 - DNA, 25 bp, Mus musculus
catgtgccaccacgtgcagcttgga

SEQ ID NO: 418892 - DNA, 25 bp, Mus musculus
catgtgccactcaaataccagaggg

SEQ ID NO: 418893 - DNA, 25 bp, Mus musculus
catgtgccagaagctcaaatcggtg

SEQ ID NO: 418894 - DNA, 25 bp, Mus musculus
catgtgcccctggaatcgatcaagc

SEQ ID NO: 418895 - DNA, 25 bp, Mus musculus
catgtgccctgtagtgtgggatgct

SEQ ID NO: 418896 - DNA, 25 bp, Mus musculus
catgtgccgatgtaagagctagttc

SEQ ID NO: 418897 - DNA, 25 bp, Mus musculus
catgtgccgcaacaaacagaaggct

SEQ ID NO: 418898 - DNA, 25 bp, Mus musculus
catgtgccgggttcttggaatgtct

SEQ ID NO: 418899 - DNA, 25 bp, Mus musculus
catgtgccgttacagggaaatactg

SEQ ID NO: 418900 - DNA, 25 bp, Mus musculus
catgtgcctgtgataactcctgaaa

SEQ ID NO: 418901 - DNA, 25 bp, Mus musculus
catgtgcggagacaaggacacgctt

SEQ ID NO: 418902 - DNA, 25 bp, Mus musculus
catgtgcgtgggatcaagaagctgc

SEQ ID NO: 418903 - DNA, 25 bp, Mus musculus
catgtgctacagacacagtgctgcg

SEQ ID NO: 418904 - DNA, 25 bp, Mus musculus
catgtgctaggcgtctccagtgtga

SEQ ID NO: 418905 - DNA, 25 bp, Mus musculus
catgtgctatggctaagcatggccc

SEQ ID NO: 418906 - DNA, 25 bp, Mus musculus
catgtgctcagtgaggaccggctac

SEQ ID NO: 418907 - DNA, 25 bp, Mus musculus
catgtgctcccctgaagagagcggc

SEQ ID NO: 418908 - DNA, 25 bp, Mus musculus
catgtgctgagacttgtaacaaccg

SEQ ID NO: 418909 - DNA, 25 bp, Mus musculus
catgtgctgtctccgatactggtac

SEQ ID NO: 418910 - DNA, 25 bp, Mus musculus
catgtggaaagctaacttaagggtc

SEQ ID NO: 418911 - DNA, 25 bp, Mus musculus
catgtggaacatccattgtgtcccc

SEQ ID NO: 418912 - DNA, 25 bp, Mus musculus
catgtggacttatcagccctgggcg

SEQ ID NO: 418913 - DNA, 25 bp, Mus musculus
catgtggatagagtgttgctgttac

SEQ ID NO: 418914 - DNA, 25 bp, Mus musculus
catgtggatcttgttctacagcaaa

SEQ ID NO: 418915 - DNA, 25 bp, Mus musculus
catgtggatgctggcaagtcaacca

SEQ ID NO: 418916 - DNA, 25 bp, Mus musculus
catgtggatttatctcatccaaaca

SEQ ID NO: 418917 - DNA, 25 bp, Mus musculus
catgtggcaccaactgcacctgtag

SEQ ID NO: 418918 - DNA, 25 bp, Mus musculus
catgtggcaccatatctgagtagga

SEQ ID NO: 418919 - DNA, 25 bp, Mus musculus
catgtggcatgtagatgttacagga

SEQ ID NO: 418920 - DNA, 25 bp, Mus musculus
catgtggccctagacctgctgaaga

SEQ ID NO: 418921 - DNA, 25 bp, Mus musculus
catgtggccctgtgaagacgccgac

SEQ ID NO: 418922 - DNA, 25 bp, Mus musculus
catgtggcgccctaggtgggatcct

SEQ ID NO: 418923 - DNA, 25 bp, Mus musculus
catgtggcgtgttgcggattgatcc

SEQ ID NO: 418924 - DNA, 25 bp, Mus musculus
catgtggcttgggatctttgggatc

SEQ ID NO: 418925 - DNA, 25 bp, Mus musculus
catgtgggaatcagatgcagtagtc

SEQ ID NO: 418926 - DNA, 25 bp, Mus musculus
catgtgggactgtacagccgctgta

SEQ ID NO: 418927 - DNA, 25 bp, Mus musculus
catgtgggcccctgttctggcagat

SEQ ID NO: 418928 - DNA, 25 bp, Mus musculus
catgtgggccgtgtccaagcagtta

SEQ ID NO: 418929 - DNA, 25 bp, Mus musculus
catgtggtatttgcataaagtatca

SEQ ID NO: 418930 - DNA, 25 bp, Mus musculus
catgtggtcaagtgggccaaggcct

SEQ ID NO: 418931 - DNA, 25 bp, Mus musculus
catgtggtcactatcgcaggagaga

SEQ ID NO: 418932 - DNA, 25 bp, Mus musculus
catgtggtccccaatccgaggaaga

SEQ ID NO: 418933 - DNA, 25 bp, Mus musculus
catgtggttaaacctgtcccggcac

SEQ ID NO: 418934 - DNA, 25 bp, Mus musculus
catgtggtttgctggcggcttccac

SEQ ID NO: 418935 - DNA, 25 bp, Mus musculus
catgtggttttgtcctcagttttgt

SEQ ID NO: 418936 - DNA, 25 bp, Mus musculus
catgtgtaatggagacgtctggaga

SEQ ID NO: 418937 - DNA, 25 bp, Mus musculus
catgtgtacaaggagcggttcccaa

SEQ ID NO: 418938 - DNA, 25 bp, Mus musculus
catgtgtacctgtaggccagaggag

SEQ ID NO: 418939 - DNA, 25 bp, Mus musculus
catgtgtacggatgcgcggttctca

SEQ ID NO: 418940 - DNA, 25 bp, Mus musculus
catgtgtacttggtgcagggcttca

SEQ ID NO: 418941 - DNA, 25 bp, Mus musculus
catgtgtatgatggtgctggacccc

SEQ ID NO: 418942 - DNA, 25 bp, Mus musculus
catgtgtatgtcaaaccagaagaag

SEQ ID NO: 418943 - DNA, 25 bp, Mus musculus
catgtgtcaatcatgcctgggtgac

SEQ ID NO: 418944 - DNA, 25 bp, Mus musculus
catgtgtcaggaaaaggagcgtcaa

SEQ ID NO: 418945 - DNA, 25 bp, Mus musculus
catgtgtccaaccatgggcagtgca

SEQ ID NO: 418946 - DNA, 25 bp, Mus musculus
catgtgtgaggatgccctggtaccc

SEQ ID NO: 418947 - DNA, 25 bp, Mus musculus
catgtgtgcctgtgtcagagctcac

SEQ ID NO: 418948 - DNA, 25 bp, Mus musculus
catgtgtgcgcaatgtaagacttta

SEQ ID NO: 418949 - DNA, 25 bp, Mus musculus
catgtgtggactctaagcttgtcgc

SEQ ID NO: 418950 - DNA, 25 bp, Mus musculus
catgtgtggagttgggatcctcgtc

SEQ ID NO: 418951 - DNA, 25 bp, Mus musculus
catgtgtggccctaactagcctcga

SEQ ID NO: 418952 - DNA, 25 bp, Mus musculus
catgtgtggtagaagcattcgccta

SEQ ID NO: 418953 - DNA, 25 bp, Mus musculus
catgtgtgtccctcaggcagtggca

SEQ ID NO: 418954 - DNA, 25 bp, Mus musculus
catgtgttaagcagatactgcaaag

SEQ ID NO: 418955 - DNA, 25 bp, Mus musculus
catgtgttcaatcagcccaggtgta

SEQ ID NO: 418956 - DNA, 25 bp, Mus musculus
catgtgttccatgcgcacgcttgca

SEQ ID NO: 418957 - DNA, 25 bp, Mus musculus
catgtgttgcttaagtatgtccatc

SEQ ID NO: 418958 - DNA, 25 bp, Mus musculus
catgtgttgttctgcgtacttcctt

SEQ ID NO: 418959 - DNA, 25 bp, Mus musculus
catgtgtttcagcaaggagcccgca

SEQ ID NO: 418960 - DNA, 25 bp, Mus musculus
catgttaaggagcaccaagcaggga

SEQ ID NO: 418961 - DNA, 25 bp, Mus musculus
catgttaatgacgtggctgactgca

SEQ ID NO: 418962 - DNA, 25 bp, Mus musculus
catgttacaaaatgatagtggtctc

SEQ ID NO: 418963 - DNA, 25 bp, Mus musculus
catgttacaaccagaaaattagcag

SEQ ID NO: 418964 - DNA, 25 bp, Mus musculus
catgttacagcagatggacttcgcc

SEQ ID NO: 418965 - DNA, 25 bp, Mus musculus
catgttacggcaagaagtatgggcc

SEQ ID NO: 418966 - DNA, 25 bp, Mus musculus
catgttagagactggcgggagcaca

SEQ ID NO: 418967 - DNA, 25 bp, Mus musculus
catgttaggcaaggcaagtcctcca

SEQ ID NO: 418968 - DNA, 25 bp, Mus musculus
catgttagggcactagcagcacgga

SEQ ID NO: 418969 - DNA, 25 bp, Mus musculus
catgttatcacactgggctccgagc

SEQ ID NO: 418970 - DNA, 25 bp, Mus musculus
catgttcaaacatttccctttcggg

SEQ ID NO: 418971 - DNA, 25 bp, Mus musculus
catgttcaagctttgtcaccccaag

SEQ ID NO: 418972 - DNA, 25 bp, Mus musculus
catgttcacatggtctggcctggcc

SEQ ID NO: 418973 - DNA, 25 bp, Mus musculus
catgttcagtgtttgcaggttgacc

SEQ ID NO: 418974 - DNA, 25 bp, Mus musculus
catgttcatcgagccgtgagtcaca

SEQ ID NO: 418975 - DNA, 25 bp, Mus musculus
catgttccagattcagcggtcccga

SEQ ID NO: 418976 - DNA, 25 bp, Mus musculus
catgttccagtaatggaggcctcca

SEQ ID NO: 418977 - DNA, 25 bp, Mus musculus
catgttccccgcactgaggagacgg

SEQ ID NO: 418978 - DNA, 25 bp, Mus musculus
catgttcctccaaagctgactcatt

SEQ ID NO: 418979 - DNA, 25 bp, Mus musculus
catgttcctgggtaagatccttagc

SEQ ID NO: 418980 - DNA, 25 bp, Mus musculus
catgttcggccctcttctgtgcggt

SEQ ID NO: 418981 - DNA, 25 bp, Mus musculus
catgttctagactctgccgagcagg

SEQ ID NO: 418982 - DNA, 25 bp, Mus musculus
catgttctctgggaaatcgtggaaa

SEQ ID NO: 418983 - DNA, 25 bp, Mus musculus
catgttctgaaagggcagcgttgat

SEQ ID NO: 418984 - DNA, 25 bp, Mus musculus
catgttctgagacctatgctctgag

SEQ ID NO: 418985 - DNA, 25 bp, Mus musculus
catgttctgcgctgtgaccagagaa

SEQ ID NO: 418986 - DNA, 25 bp, Mus musculus
catgttcttgaagggacacgaaacc

SEQ ID NO: 418987 - DNA, 25 bp, Mus musculus
catgttctttggtatgcttagccga

SEQ ID NO: 418988 - DNA, 25 bp, Mus musculus
catgttgagtctccaggatgaggcc

SEQ ID NO: 418989 - DNA, 25 bp, Mus musculus
catgttgcccacctaaaccgtgctg

SEQ ID NO: 418990 - DNA, 25 bp, Mus musculus
catgttgcgtggcttcccgcgtgac

SEQ ID NO: 418991 - DNA, 25 bp, Mus musculus
catgttgctaacactgggtatggga

SEQ ID NO: 418992 - DNA, 25 bp, Mus musculus
catgttgctgtgactggcctgtgag

SEQ ID NO: 418993 - DNA, 25 bp, Mus musculus
catgttgcttctgtgcgagtctatc

SEQ ID NO: 418994 - DNA, 25 bp, Mus musculus
catgttggaaaagattgccgggccc

SEQ ID NO: 418995 - DNA, 25 bp, Mus musculus
catgttggctatgaaccgacagggc

SEQ ID NO: 418996 - DNA, 25 bp, Mus musculus
catgttgggcatgatcaggaactca

SEQ ID NO: 418997 - DNA, 25 bp, Mus musculus
catgttgtaagatgacaggatttcc

SEQ ID NO: 418998 - DNA, 25 bp, Mus musculus
catgttgtcatgaaggcccttgtga

SEQ ID NO: 418999 - DNA, 25 bp, Mus musculus
catgttgtgattttccttctctcca

SEQ ID NO: 419000 - DNA, 25 bp, Mus musculus
catgttgtgcgggacagacaccata

SEQ ID NO: 419001 - DNA, 25 bp, Mus musculus
catgttgtggttgcagactccggaa

SEQ ID NO: 419002 - DNA, 25 bp, Mus musculus
catgtttaccatggtccttgtcacc

SEQ ID NO: 419003 - DNA, 25 bp, Mus musculus
catgtttcacggactccctggatta

SEQ ID NO: 419004 - DNA, 25 bp, Mus musculus
catgtttcagccagctgggcacggc

SEQ ID NO: 419005 - DNA, 25 bp, Mus musculus
catgtttcctgtcagtgggatcgga

SEQ ID NO: 419006 - DNA, 25 bp, Mus musculus
catgtttcgggtacgaagaagcacc

SEQ ID NO: 419007 - DNA, 25 bp, Mus musculus
catgtttctagtagcgcttagcgaa

SEQ ID NO: 419008 - DNA, 25 bp, Mus musculus
catgtttgaatacactgggaagggc

SEQ ID NO: 419009 - DNA, 25 bp, Mus musculus
catgtttgagaacaagcggaacgca

SEQ ID NO: 419010 - DNA, 25 bp, Mus musculus
catgtttgaggtctacgggacaccg

SEQ ID NO: 419011 - DNA, 25 bp, Mus musculus
catgtttggcctgaagcagagaccc

SEQ ID NO: 419012 - DNA, 25 bp, Mus musculus
catgtttgggcatggaggctcgacc

SEQ ID NO: 419013 - DNA, 25 bp, Mus musculus
catgtttgtgaatgctcgtgcccga

SEQ ID NO: 419014 - DNA, 25 bp, Mus musculus
catgtttgtgggaagccaagctacc

SEQ ID NO: 419015 - DNA, 25 bp, Mus musculus
catgtttgtgtaatgtggatgccat

SEQ ID NO: 419016 - DNA, 25 bp, Mus musculus
catgtttgtgttcgcgatcctggga

SEQ ID NO: 419017 - DNA, 25 bp, Mus musculus
catgttttaagcagtgccgtggcac

SEQ ID NO: 419018 - DNA, 25 bp, Mus musculus
catgtttttgtactcgtgcgccggc

SEQ ID NO: 419019 - DNA, 25 bp, Mus musculus
cattaaaaaggcctggcgtgacctc

SEQ ID NO: 419020 - DNA, 25 bp, Mus musculus
cattaaaaagtccacggagcctgtc

SEQ ID NO: 419021 - DNA, 25 bp, Mus musculus
cattaaaccagagaacagttagacg

SEQ ID NO: 419022 - DNA, 25 bp, Mus musculus
cattaaacgaggaaagagactcggg

SEQ ID NO: 419023 - DNA, 25 bp, Mus musculus
cattaaagaactgagtcgggcttcg

SEQ ID NO: 419024 - DNA, 25 bp, Mus musculus
cattaaagcagaggctgggtgacct

SEQ ID NO: 419025 - DNA, 25 bp, Mus musculus
cattaaagcgctagagcactctgca

SEQ ID NO: 419026 - DNA, 25 bp, Mus musculus
cattaaatatggagatgctcacgtg

SEQ ID NO: 419027 - DNA, 25 bp, Mus musculus
cattaaatcagtattcagctgtagc

SEQ ID NO: 419028 - DNA, 25 bp, Mus musculus
cattaacactggatggcctcctgga

SEQ ID NO: 419029 - DNA, 25 bp, Mus musculus
cattaacaggaaggaacacaagctc

SEQ ID NO: 419030 - DNA, 25 bp, Mus musculus
cattaacaggagagagaggaacgag

SEQ ID NO: 419031 - DNA, 25 bp, Mus musculus
cattaacccaataagacagcttgca

SEQ ID NO: 419032 - DNA, 25 bp, Mus musculus
cattaaccggactgtgggctggaac

SEQ ID NO: 419033 - DNA, 25 bp, Mus musculus
cattaacgccaacgtgcaggtggcc

SEQ ID NO: 419034 - DNA, 25 bp, Mus musculus
cattaactctccgtagtttgcagaa

SEQ ID NO: 419035 - DNA, 25 bp, Mus musculus
cattaagaagattgggaaggcctcc

SEQ ID NO: 419036 - DNA, 25 bp, Mus musculus
cattaagatctataggaaggagccg

SEQ ID NO: 419037 - DNA, 25 bp, Mus musculus
cattaagcccaggttgtacccgtga

SEQ ID NO: 419038 - DNA, 25 bp, Mus musculus
cattaagctgaaccggagccagcga

SEQ ID NO: 419039 - DNA, 25 bp, Mus musculus
cattaaggactcgaagcaggagcac

SEQ ID NO: 419040 - DNA, 25 bp, Mus musculus
cattaaggagtggaatgccccggcg

SEQ ID NO: 419041 - DNA, 25 bp, Mus musculus
cattaaggcaatagagacaacatct

SEQ ID NO: 419042 - DNA, 25 bp, Mus musculus
cattaagggaaaggcgcactggcta

SEQ ID NO: 419043 - DNA, 25 bp, Mus musculus
cattaaggtacgtctggcttgccca

SEQ ID NO: 419044 - DNA, 25 bp, Mus musculus
cattaagtacgtattgcaggacccc

SEQ ID NO: 419045 - DNA, 25 bp, Mus musculus
cattaagtaggagactaaccgcgtg

SEQ ID NO: 419046 - DNA, 25 bp, Mus musculus
cattaagtgctgtcttgaaggccca

SEQ ID NO: 419047 - DNA, 25 bp, Mus musculus
cattaatacaggtctaagtcggttc

SEQ ID NO: 419048 - DNA, 25 bp, Mus musculus
cattaatacccgtgatgtgctggtg

SEQ ID NO: 419049 - DNA, 25 bp, Mus musculus
cattaatccgtatctgagtacctca

SEQ ID NO: 419050 - DNA, 25 bp, Mus musculus
cattaatcgcttctgcctcgtgaga

SEQ ID NO: 419051 - DNA, 25 bp, Mus musculus
cattaatgagtacttcctggtggga

SEQ ID NO: 419052 - DNA, 25 bp, Mus musculus
cattaatgatagtgtttataaccaa

SEQ ID NO: 419053 - DNA, 25 bp, Mus musculus
cattaatgtggacgatccggacgca

SEQ ID NO: 419054 - DNA, 25 bp, Mus musculus
cattacactttagaacgccggcctg

SEQ ID NO: 419055 - DNA, 25 bp, Mus musculus
cattacagacatttcagacaggcag

SEQ ID NO: 419056 - DNA, 25 bp, Mus musculus
cattacagcaattaggaaccacccc

SEQ ID NO: 419057 - DNA, 25 bp, Mus musculus
cattacagtacttcgcaggctgggc

SEQ ID NO: 419058 - DNA, 25 bp, Mus musculus
cattacagtataagcagccatgcct

SEQ ID NO: 419059 - DNA, 25 bp, Mus musculus
cattacagtgaggtggttgggcttt

SEQ ID NO: 419060 - DNA, 25 bp, Mus musculus
cattacatcgagtatggagccgcgg

SEQ ID NO: 419061 - DNA, 25 bp, Mus musculus
cattacatgactccagaagacttcg

SEQ ID NO: 419062 - DNA, 25 bp, Mus musculus
cattacatgagaaaaagagccgtcc

SEQ ID NO: 419063 - DNA, 25 bp, Mus musculus
cattacattatggagaagggatcac

SEQ ID NO: 419064 - DNA, 25 bp, Mus musculus
cattaccaactccagtatccagtga

SEQ ID NO: 419065 - DNA, 25 bp, Mus musculus
cattaccgggactgcatgggagaca

SEQ ID NO: 419066 - DNA, 25 bp, Mus musculus
cattacctacaaaggcggactgtgg

SEQ ID NO: 419067 - DNA, 25 bp, Mus musculus
cattacctggaagcatgtgtgaccc

SEQ ID NO: 419068 - DNA, 25 bp, Mus musculus
cattacgccgggttgtccaaggact

SEQ ID NO: 419069 - DNA, 25 bp, Mus musculus
cattacgggtacaaggtgcagttcc

SEQ ID NO: 419070 - DNA, 25 bp, Mus musculus
cattacggtggctaacactggctgc

SEQ ID NO: 419071 - DNA, 25 bp, Mus musculus
cattacggtgttcgctttgccaagg

SEQ ID NO: 419072 - DNA, 25 bp, Mus musculus
cattacggtgtttggctgaattcca

SEQ ID NO: 419073 - DNA, 25 bp, Mus musculus
cattacgtggacaatcaggactgca

SEQ ID NO: 419074 - DNA, 25 bp, Mus musculus
cattactaggtaggcaggcaaggca

SEQ ID NO: 419075 - DNA, 25 bp, Mus musculus
cattactgctggcttgactgatgca

SEQ ID NO: 419076 - DNA, 25 bp, Mus musculus
cattacttcatagacagggacgggc

SEQ ID NO: 419077 - DNA, 25 bp, Mus musculus
cattagaaaataagatctacctgtc

SEQ ID NO: 419078 - DNA, 25 bp, Mus musculus
cattagaagtctactcgagggtgtg

SEQ ID NO: 419079 - DNA, 25 bp, Mus musculus
cattagacttctggactggttcgag

SEQ ID NO: 419080 - DNA, 25 bp, Mus musculus
cattagagaagtccacagatagccc

SEQ ID NO: 419081 - DNA, 25 bp, Mus musculus
cattagagactgcactggaagccgg

SEQ ID NO: 419082 - DNA, 25 bp, Mus musculus
cattagagcttgatttaaaagggac

SEQ ID NO: 419083 - DNA, 25 bp, Mus musculus
cattagaggaaaacttggtggtggc

SEQ ID NO: 419084 - DNA, 25 bp, Mus musculus
cattagaggctacatgaagctcgcc

SEQ ID NO: 419085 - DNA, 25 bp, Mus musculus
cattagagtctagtgtcagagagct

SEQ ID NO: 419086 - DNA, 25 bp, Mus musculus
cattagagtgaaccctgtccagtgg

SEQ ID NO: 419087 - DNA, 25 bp, Mus musculus
cattagcaacaaggagcgggtggtc

SEQ ID NO: 419088 - DNA, 25 bp, Mus musculus
cattagcaatagcacagtacctgag

SEQ ID NO: 419089 - DNA, 25 bp, Mus musculus
cattagcagctgcttcatctagggt

SEQ ID NO: 419090 - DNA, 25 bp, Mus musculus
cattagcagttgaagaagtactatg

SEQ ID NO: 419091 - DNA, 25 bp, Mus musculus
cattagcattattgcccagggtctg

SEQ ID NO: 419092 - DNA, 25 bp, Mus musculus
cattagcattcttaagctctgaggc

SEQ ID NO: 419093 - DNA, 25 bp, Mus musculus
cattagccagcgtgaggagttcgag

SEQ ID NO: 419094 - DNA, 25 bp, Mus musculus
cattagctgaagacatcctccgaaa

SEQ ID NO: 419095 - DNA, 25 bp, Mus musculus
cattagctgctaggactcccatagg

SEQ ID NO: 419096 - DNA, 25 bp, Mus musculus
cattagctgctcagatgggcgaaca

SEQ ID NO: 419097 - DNA, 25 bp, Mus musculus
cattagctgctgagaccagtacgga

SEQ ID NO: 419098 - DNA, 25 bp, Mus musculus
cattagctggctagaggatccacat

SEQ ID NO: 419099 - DNA, 25 bp, Mus musculus
cattaggaatgcaagacgcggtgac

SEQ ID NO: 419100 - DNA, 25 bp, Mus musculus
cattaggacattgcgccttcggtgg

SEQ ID NO: 419101 - DNA, 25 bp, Mus musculus
cattaggaccctgcaggcgcagtgg

SEQ ID NO: 419102 - DNA, 25 bp, Mus musculus
cattaggattcaccattggaggatt

SEQ ID NO: 419103 - DNA, 25 bp, Mus musculus
cattaggcgtgatgagactgttgcc

SEQ ID NO: 419104 - DNA, 25 bp, Mus musculus
cattagggatttctgctggattctg

SEQ ID NO: 419105 - DNA, 25 bp, Mus musculus
cattagtagagtgtgaccccgagtc

SEQ ID NO: 419106 - DNA, 25 bp, Mus musculus
cattagtagtgtctccccagctaga

SEQ ID NO: 419107 - DNA, 25 bp, Mus musculus
cattagtgctcagatccagaccgtg

SEQ ID NO: 419108 - DNA, 25 bp, Mus musculus
cattagtggccacagcatggtatgg

SEQ ID NO: 419109 - DNA, 25 bp, Mus musculus
cattagtgtccatttcctgctgcct

SEQ ID NO: 419110 - DNA, 25 bp, Mus musculus
cattagtgtgtgtttcctcatggat

SEQ ID NO: 419111 - DNA, 25 bp, Mus musculus
cattagttgcaagatggtcacagcc

SEQ ID NO: 419112 - DNA, 25 bp, Mus musculus
cattataccctctgtaagcccctgc

SEQ ID NO: 419113 - DNA, 25 bp, Mus musculus
cattatactttttgccactggtacc

SEQ ID NO: 419114 - DNA, 25 bp, Mus musculus
cattatagagaagcctgctagctgg

SEQ ID NO: 419115 - DNA, 25 bp, Mus musculus
cattatataggtagagcgcaccgca

SEQ ID NO: 419116 - DNA, 25 bp, Mus musculus
cattatatggaaaaccacagttgta

SEQ ID NO: 419117 - DNA, 25 bp, Mus musculus
cattatcaaggaccaagatcgcaag

SEQ ID NO: 419118 - DNA, 25 bp, Mus musculus
cattatcagcaccagagacagcaga

SEQ ID NO: 419119 - DNA, 25 bp, Mus musculus
cattatcaggaaggagcccggacaa

SEQ ID NO: 419120 - DNA, 25 bp, Mus musculus
cattatccagcacgagggcttgcac

SEQ ID NO: 419121 - DNA, 25 bp, Mus musculus
cattatccggattcacctgctggca

SEQ ID NO: 419122 - DNA, 25 bp, Mus musculus
cattatccttttctgggtgctatgg

SEQ ID NO: 419123 - DNA, 25 bp, Mus musculus
cattatcgcgctgtgcatggagcaa

SEQ ID NO: 419124 - DNA, 25 bp, Mus musculus
cattatctacaactgtgcctcgcgg

SEQ ID NO: 419125 - DNA, 25 bp, Mus musculus
cattatctccactcaacagcgtgta

SEQ ID NO: 419126 - DNA, 25 bp, Mus musculus
cattatctcgtcgtgccaaagaagc

SEQ ID NO: 419127 - DNA, 25 bp, Mus musculus
cattatcttagacgagcccacggct

SEQ ID NO: 419128 - DNA, 25 bp, Mus musculus
cattatgaaagaggccattggcgct

SEQ ID NO: 419129 - DNA, 25 bp, Mus musculus
cattatgagacattccagggccggc

SEQ ID NO: 419130 - DNA, 25 bp, Mus musculus
cattatgagcaaaagagtctgtgtc

SEQ ID NO: 419131 - DNA, 25 bp, Mus musculus
cattatgaggagaacagcccaagcc

SEQ ID NO: 419132 - DNA, 25 bp, Mus musculus
cattatgatgctggagcaagactca

SEQ ID NO: 419133 - DNA, 25 bp, Mus musculus
cattatgctcgtgtaatcgggacca

SEQ ID NO: 419134 - DNA, 25 bp, Mus musculus
cattatgctgcctgaggatggccta

SEQ ID NO: 419135 - DNA, 25 bp, Mus musculus
cattatggaccaattagaagagaca

SEQ ID NO: 419136 - DNA, 25 bp, Mus musculus
cattatggacttatggaaaagcaga

SEQ ID NO: 419137 - DNA, 25 bp, Mus musculus
cattatggcaagtggtccggcggaa

SEQ ID NO: 419138 - DNA, 25 bp, Mus musculus
cattatggcctctttttctcctgga

SEQ ID NO: 419139 - DNA, 25 bp, Mus musculus
cattatggtaggaaagcaagcggca

SEQ ID NO: 419140 - DNA, 25 bp, Mus musculus
cattatgttagctggagaaggccgg

SEQ ID NO: 419141 - DNA, 25 bp, Mus musculus
cattatgttgtcagagaaaaagaag

SEQ ID NO: 419142 - DNA, 25 bp, Mus musculus
cattattacaaagtgcgctgggctg

SEQ ID NO: 419143 - DNA, 25 bp, Mus musculus
cattattagcagtgcggatgtgatc

SEQ ID NO: 419144 - DNA, 25 bp, Mus musculus
cattattagggtcaggagatgcaca

SEQ ID NO: 419145 - DNA, 25 bp, Mus musculus
cattattcccaaaggagcggcagag

SEQ ID NO: 419146 - DNA, 25 bp, Mus musculus
cattattcctgacactgagccgcac

SEQ ID NO: 419147 - DNA, 25 bp, Mus musculus
cattattgagaccattgcccgagcc

SEQ ID NO: 419148 - DNA, 25 bp, Mus musculus
cattattgagagctcagtatgctac

SEQ ID NO: 419149 - DNA, 25 bp, Mus musculus
cattattgatcctagcgctctcact

SEQ ID NO: 419150 - DNA, 25 bp, Mus musculus
cattattgtgtactggaaatttcta

SEQ ID NO: 419151 - DNA, 25 bp, Mus musculus
cattatttccaccagcacagcagag

SEQ ID NO: 419152 - DNA, 25 bp, Mus musculus
cattcaaaaaaggataaccccagct

SEQ ID NO: 419153 - DNA, 25 bp, Mus musculus
cattcaaaatgacaaaaggaggcac

SEQ ID NO: 419154 - DNA, 25 bp, Mus musculus
cattcaaagagacaagggactcgtt

SEQ ID NO: 419155 - DNA, 25 bp, Mus musculus
cattcaagactagtaaaaacaaaca

SEQ ID NO: 419156 - DNA, 25 bp, Mus musculus
cattcaagatccaggctggaaagtg

SEQ ID NO: 419157 - DNA, 25 bp, Mus musculus
cattcaagatggtactgagggcaca

SEQ ID NO: 419158 - DNA, 25 bp, Mus musculus
cattcaagcaagaggaacgcatgcg

SEQ ID NO: 419159 - DNA, 25 bp, Mus musculus
cattcaaggcctgcgatcaggtggc

SEQ ID NO: 419160 - DNA, 25 bp, Mus musculus
cattcaaggttagagagggcaggct

SEQ ID NO: 419161 - DNA, 25 bp, Mus musculus
cattcaagtgaaagatgtaggatca

SEQ ID NO: 419162 - DNA, 25 bp, Mus musculus
cattcaatggcgctgtgtgtcacca

SEQ ID NO: 419163 - DNA, 25 bp, Mus musculus
cattcacaggatatcaagaagagcc

SEQ ID NO: 419164 - DNA, 25 bp, Mus musculus
cattcacaggtcaggcagagtctcc

SEQ ID NO: 419165 - DNA, 25 bp, Mus musculus
cattcacagtcttcctgcgggtgcg

SEQ ID NO: 419166 - DNA, 25 bp, Mus musculus
cattcacataggaggcaagggtcac

SEQ ID NO: 419167 - DNA, 25 bp, Mus musculus
cattcacatcttaattgctagccta

SEQ ID NO: 419168 - DNA, 25 bp, Mus musculus
cattcacatgatgaggtatgggcag

SEQ ID NO: 419169 - DNA, 25 bp, Mus musculus
cattcacccaggagcagcgggatgt

SEQ ID NO: 419170 - DNA, 25 bp, Mus musculus
cattcactacaagggaacgaggaca

SEQ ID NO: 419171 - DNA, 25 bp, Mus musculus
cattcactactgagtctaattggtg

SEQ ID NO: 419172 - DNA, 25 bp, Mus musculus
cattcactgaggagaatcacgcatc

SEQ ID NO: 419173 - DNA, 25 bp, Mus musculus
cattcactgggtgtactctggctca

SEQ ID NO: 419174 - DNA, 25 bp, Mus musculus
cattcactggtgttgaacccgtgcc

SEQ ID NO: 419175 - DNA, 25 bp, Mus musculus
cattcagaaccatggacagcagcgc

SEQ ID NO: 419176 - DNA, 25 bp, Mus musculus
cattcagaagagcagcgcttgttct

SEQ ID NO: 419177 - DNA, 25 bp, Mus musculus
cattcagaagatccacgagtcccag

SEQ ID NO: 419178 - DNA, 25 bp, Mus musculus
cattcagaagttatagtggcatagt

SEQ ID NO: 419179 - DNA, 25 bp, Mus musculus
cattcagaagttattgcatctacca

SEQ ID NO: 419180 - DNA, 25 bp, Mus musculus
cattcagacggatgaaaagggccac

SEQ ID NO: 419181 - DNA, 25 bp, Mus musculus
cattcagacttgcatgggtgtgcaa

SEQ ID NO: 419182 - DNA, 25 bp, Mus musculus
cattcagcaagacaacatgtggtgg

SEQ ID NO: 419183 - DNA, 25 bp, Mus musculus
cattcagcagatggtgaacgagcac

SEQ ID NO: 419184 - DNA, 25 bp, Mus musculus
cattcagcagcaagcaaaagtgcat

SEQ ID NO: 419185 - DNA, 25 bp, Mus musculus
cattcagccaaagtgaggcggcgcc

SEQ ID NO: 419186 - DNA, 25 bp, Mus musculus
cattcagcggacaagcgaagttcta

SEQ ID NO: 419187 - DNA, 25 bp, Mus musculus
cattcaggaagtgccagctgcagga

SEQ ID NO: 419188 - DNA, 25 bp, Mus musculus
cattcaggagatgcacgtggtggcc

SEQ ID NO: 419189 - DNA, 25 bp, Mus musculus
cattcaggatggcagactcaaggca

SEQ ID NO: 419190 - DNA, 25 bp, Mus musculus
cattcagggcctcaagtggcagcat

SEQ ID NO: 419191 - DNA, 25 bp, Mus musculus
cattcagggctagtccatggcttgg

SEQ ID NO: 419192 - DNA, 25 bp, Mus musculus
cattcagggtccattgagaaagcag

SEQ ID NO: 419193 - DNA, 25 bp, Mus musculus
cattcaggtgctcgtcaagtggtac

SEQ ID NO: 419194 - DNA, 25 bp, Mus musculus
cattcagtgagcatcccgtgctggg

SEQ ID NO: 419195 - DNA, 25 bp, Mus musculus
cattcagtgggagagccggacttac

SEQ ID NO: 419196 - DNA, 25 bp, Mus musculus
cattcagtggtggatctgaagtgca

SEQ ID NO: 419197 - DNA, 25 bp, Mus musculus
cattcagtgtcccatgcatgcgtgc

SEQ ID NO: 419198 - DNA, 25 bp, Mus musculus
cattcagtgttggacaggcatctcc

SEQ ID NO: 419199 - DNA, 25 bp, Mus musculus
cattcagtttccgtgaggtggcccc

SEQ ID NO: 419200 - DNA, 25 bp, Mus musculus
cattcataatctagacctgggccca

SEQ ID NO: 419201 - DNA, 25 bp, Mus musculus
cattcataggcgcaaagctggagta

SEQ ID NO: 419202 - DNA, 25 bp, Mus musculus
cattcatcatgttctctgaccaaac

SEQ ID NO: 419203 - DNA, 25 bp, Mus musculus
cattcatctccagacctttagaggt

SEQ ID NO: 419204 - DNA, 25 bp, Mus musculus
cattcatctctggtacattccttca

SEQ ID NO: 419205 - DNA, 25 bp, Mus musculus
cattcatgcaagtcgcagcaggagg

SEQ ID NO: 419206 - DNA, 25 bp, Mus musculus
cattcatgggcatacgcatgggcat

SEQ ID NO: 419207 - DNA, 25 bp, Mus musculus
cattcatgtaccgtcaccagcagtg

SEQ ID NO: 419208 - DNA, 25 bp, Mus musculus
cattcatgtagtgcccatggaggac

SEQ ID NO: 419209 - DNA, 25 bp, Mus musculus
cattcattacttccggataccccgc

SEQ ID NO: 419210 - DNA, 25 bp, Mus musculus
cattcattcagccagctgctttgtt

SEQ ID NO: 419211 - DNA, 25 bp, Mus musculus
cattcattctttcagcacgtgcagg

SEQ ID NO: 419212 - DNA, 25 bp, Mus musculus
cattcattgaagaagggacaccgaa

SEQ ID NO: 419213 - DNA, 25 bp, Mus musculus
cattcatttatggtgggtgccttgg

SEQ ID NO: 419214 - DNA, 25 bp, Mus musculus
cattcatttggtactattgcagcac

SEQ ID NO: 419215 - DNA, 25 bp, Mus musculus
cattccaaaagtggtgcctcaggcc

SEQ ID NO: 419216 - DNA, 25 bp, Mus musculus
cattccaagaaaggctgaggtgttc

SEQ ID NO: 419217 - DNA, 25 bp, Mus musculus
cattccaagatttggtgggtgtaac

SEQ ID NO: 419218 - DNA, 25 bp, Mus musculus
cattccaagggaagaggaccacctg

SEQ ID NO: 419219 - DNA, 25 bp, Mus musculus
cattccaaggtgtcttcaagagtca

SEQ ID NO: 419220 - DNA, 25 bp, Mus musculus
cattccacagggtaaatagaggccc

SEQ ID NO: 419221 - DNA, 25 bp, Mus musculus
cattccagactgcacgggtgtccag

SEQ ID NO: 419222 - DNA, 25 bp, Mus musculus
cattccagtctcacctgcttcagtg

SEQ ID NO: 419223 - DNA, 25 bp, Mus musculus
cattccatcagaactcctagctagg

SEQ ID NO: 419224 - DNA, 25 bp, Mus musculus
cattccattcggtgtgggccagagc

SEQ ID NO: 419225 - DNA, 25 bp, Mus musculus
cattccatttggaggaggccttcgg

SEQ ID NO: 419226 - DNA, 25 bp, Mus musculus
cattcccaaggagcgctgtatctac

SEQ ID NO: 419227 - DNA, 25 bp, Mus musculus
cattcccattttcaagactgccagt

SEQ ID NO: 419228 - DNA, 25 bp, Mus musculus
cattcccggaaatacagccttctgg

SEQ ID NO: 419229 - DNA, 25 bp, Mus musculus
cattccctgaatacttggtagtgca

SEQ ID NO: 419230 - DNA, 25 bp, Mus musculus
cattccctgggagaggtcgacaagg

SEQ ID NO: 419231 - DNA, 25 bp, Mus musculus
cattcccttttcaacgtatttctgc

SEQ ID NO: 419232 - DNA, 25 bp, Mus musculus
cattccgaatagtccgtgatgcagg

SEQ ID NO: 419233 - DNA, 25 bp, Mus musculus
cattccgagagtaaagctatgtccc

SEQ ID NO: 419234 - DNA, 25 bp, Mus musculus
cattccggatgagtacttcaagcgc

SEQ ID NO: 419235 - DNA, 25 bp, Mus musculus
cattccggtgatagagctgtgcccc

SEQ ID NO: 419236 - DNA, 25 bp, Mus musculus
cattccgtgtattaggctccatgca

SEQ ID NO: 419237 - DNA, 25 bp, Mus musculus
cattccgtgttagtgtggtggaccc

SEQ ID NO: 419238 - DNA, 25 bp, Mus musculus
cattcctaaaggcacaacagtcatt

SEQ ID NO: 419239 - DNA, 25 bp, Mus musculus
cattcctaggctgcgatgaccggtt

SEQ ID NO: 419240 - DNA, 25 bp, Mus musculus
cattcctcggaggaaaagagccctc

SEQ ID NO: 419241 - DNA, 25 bp, Mus musculus
cattcctgaacctaagaggaggctc

SEQ ID NO: 419242 - DNA, 25 bp, Mus musculus
cattcctgcagaagggctggtgtcc

SEQ ID NO: 419243 - DNA, 25 bp, Mus musculus
cattcctggaggatcgactgacggt

SEQ ID NO: 419244 - DNA, 25 bp, Mus musculus
cattcctggaggctgcaatttggag

SEQ ID NO: 419245 - DNA, 25 bp, Mus musculus
cattcctggagttgacagtcatttc

SEQ ID NO: 419246 - DNA, 25 bp, Mus musculus
cattcctggtgatctggctggtcgg

SEQ ID NO: 419247 - DNA, 25 bp, Mus musculus
cattcctggtggtgctggcgcaatt

SEQ ID NO: 419248 - DNA, 25 bp, Mus musculus
cattcctgttcgtgggctgtggcga

SEQ ID NO: 419249 - DNA, 25 bp, Mus musculus
cattcctgttttgggatctgcagaa

SEQ ID NO: 419250 - DNA, 25 bp, Mus musculus
cattccttcacacagaggcggtttc

SEQ ID NO: 419251 - DNA, 25 bp, Mus musculus
cattccttcagctgcttttactggc

SEQ ID NO: 419252 - DNA, 25 bp, Mus musculus
cattccttctctatccggttcctgg

SEQ ID NO: 419253 - DNA, 25 bp, Mus musculus
cattccttctttaaatgtggcttca

SEQ ID NO: 419254 - DNA, 25 bp, Mus musculus
cattccttgagtctcaggtaaaagg

SEQ ID NO: 419255 - DNA, 25 bp, Mus musculus
cattcgaataattgggttgtacaac

SEQ ID NO: 419256 - DNA, 25 bp, Mus musculus
cattcgaattgtgctggttggacta

SEQ ID NO: 419257 - DNA, 25 bp, Mus musculus
cattcgacggaaagcccaattcaca

SEQ ID NO: 419258 - DNA, 25 bp, Mus musculus
cattcgagaagtataggcaaggcct

SEQ ID NO: 419259 - DNA, 25 bp, Mus musculus
cattcgaggttctcaaagcagagcc

SEQ ID NO: 419260 - DNA, 25 bp, Mus musculus
cattcgaggttgtgtatagcctggg

SEQ ID NO: 419261 - DNA, 25 bp, Mus musculus
cattcgatgcgtgcctttaaaatca

SEQ ID NO: 419262 - DNA, 25 bp, Mus musculus
cattcgatgggcattgtagtcctcc

SEQ ID NO: 419263 - DNA, 25 bp, Mus musculus
cattcgcaagttggtggtacaagac

SEQ ID NO: 419264 - DNA, 25 bp, Mus musculus
cattcgcagatttcagggcctgtct

SEQ ID NO: 419265 - DNA, 25 bp, Mus musculus
cattcgcatatgttaaagggaccac

SEQ ID NO: 419266 - DNA, 25 bp, Mus musculus
cattcgccatcctagtacttagagg

SEQ ID NO: 419267 - DNA, 25 bp, Mus musculus
cattcgcctctcaggtgacactgga

SEQ ID NO: 419268 - DNA, 25 bp, Mus musculus
cattcgcttcgaaaaggtgatcacc

SEQ ID NO: 419269 - DNA, 25 bp, Mus musculus
cattcgctttattggagggctcctc

SEQ ID NO: 419270 - DNA, 25 bp, Mus musculus
cattcggagcttgagcaaagggacc

SEQ ID NO: 419271 - DNA, 25 bp, Mus musculus
cattcggctcaagtacggtcagcga

SEQ ID NO: 419272 - DNA, 25 bp, Mus musculus
cattcgggcggatctgagcttgtct

SEQ ID NO: 419273 - DNA, 25 bp, Mus musculus
cattcggttgaattaaatcatgttt

SEQ ID NO: 419274 - DNA, 25 bp, Mus musculus
cattcggttgtggatctgatcagca

SEQ ID NO: 419275 - DNA, 25 bp, Mus musculus
cattcgtagcgatgtggaagaacca

SEQ ID NO: 419276 - DNA, 25 bp, Mus musculus
cattcgtgaaaaaaccagtgtcggc

SEQ ID NO: 419277 - DNA, 25 bp, Mus musculus
cattcgtggatcgagcaacaggtcc

SEQ ID NO: 419278 - DNA, 25 bp, Mus musculus
cattcgttgcatttagaggcccagc

SEQ ID NO: 419279 - DNA, 25 bp, Mus musculus
cattcgtttatggagagtctgggct

SEQ ID NO: 419280 - DNA, 25 bp, Mus musculus
cattctaaaggcatcagtggactac

SEQ ID NO: 419281 - DNA, 25 bp, Mus musculus
cattctaacgagtgaagacccggag

SEQ ID NO: 419282 - DNA, 25 bp, Mus musculus
cattctaattcaaaaggcttctctg

SEQ ID NO: 419283 - DNA, 25 bp, Mus musculus
cattctacgaagagaggtggcgctc

SEQ ID NO: 419284 - DNA, 25 bp, Mus musculus
cattctagaagtgttggtgcagtca

SEQ ID NO: 419285 - DNA, 25 bp, Mus musculus
cattctagccaatgcttccatgggc

SEQ ID NO: 419286 - DNA, 25 bp, Mus musculus
cattctagcttcaaggtaaacacaa

SEQ ID NO: 419287 - DNA, 25 bp, Mus musculus
cattctaggtgccttggaaagggac

SEQ ID NO: 419288 - DNA, 25 bp, Mus musculus
cattctaggttttgctggaggcgga

SEQ ID NO: 419289 - DNA, 25 bp, Mus musculus
cattctagtggaggcagacagtttg

SEQ ID NO: 419290 - DNA, 25 bp, Mus musculus
cattctagtggccaaagacagcttg

SEQ ID NO: 419291 - DNA, 25 bp, Mus musculus
cattctatctcgcagaggtgaagaa

SEQ ID NO: 419292 - DNA, 25 bp, Mus musculus
cattctatgatgattgaggcaccca

SEQ ID NO: 419293 - DNA, 25 bp, Mus musculus
cattctcagtgagtggtggatcctc

SEQ ID NO: 419294 - DNA, 25 bp, Mus musculus
cattctccggagacttatattccat

SEQ ID NO: 419295 - DNA, 25 bp, Mus musculus
cattctcctgggtctatggccacag

SEQ ID NO: 419296 - DNA, 25 bp, Mus musculus
cattctcgggatgtcacatgaccgc

SEQ ID NO: 419297 - DNA, 25 bp, Mus musculus
cattctcgggctgtgaagtcactga

SEQ ID NO: 419298 - DNA, 25 bp, Mus musculus
cattctcgtgggaaataagtgtgac

SEQ ID NO: 419299 - DNA, 25 bp, Mus musculus
cattctctcgaggtcagggcataac

SEQ ID NO: 419300 - DNA, 25 bp, Mus musculus
cattctctggacgtggacattcaca

SEQ ID NO: 419301 - DNA, 25 bp, Mus musculus
cattctctggccctgaaccgagagg

SEQ ID NO: 419302 - DNA, 25 bp, Mus musculus
cattctgactcaagtgaaaacgctc

SEQ ID NO: 419303 - DNA, 25 bp, Mus musculus
cattctgagaaacatcgcgtggttc

SEQ ID NO: 419304 - DNA, 25 bp, Mus musculus
cattctgagaatgtgataatcggca

SEQ ID NO: 419305 - DNA, 25 bp, Mus musculus
cattctgagaggatgcggtggaaca

SEQ ID NO: 419306 - DNA, 25 bp, Mus musculus
cattctgagcacactgtcgggaaga

SEQ ID NO: 419307 - DNA, 25 bp, Mus musculus
cattctgagcgtgccgctgtctgga

SEQ ID NO: 419308 - DNA, 25 bp, Mus musculus
cattctgagtggaaagtcctgcctc

SEQ ID NO: 419309 - DNA, 25 bp, Mus musculus
cattctgagtttgtccaagatggac

SEQ ID NO: 419310 - DNA, 25 bp, Mus musculus
cattctgatacatgcacctctgcct

SEQ ID NO: 419311 - DNA, 25 bp, Mus musculus
cattctgatcaactggccaggagga

SEQ ID NO: 419312 - DNA, 25 bp, Mus musculus
cattctgattgctctctcgtgaggg

SEQ ID NO: 419313 - DNA, 25 bp, Mus musculus
cattctgcaggagtgatgcccacgg

SEQ ID NO: 419314 - DNA, 25 bp, Mus musculus
cattctgcatatggtccaggagccc

SEQ ID NO: 419315 - DNA, 25 bp, Mus musculus
cattctgcatgttcctaggaagcca

SEQ ID NO: 419316 - DNA, 25 bp, Mus musculus
cattctgctggaccgatgtgggcac

SEQ ID NO: 419317 - DNA, 25 bp, Mus musculus
cattctggaacacttggaccgagac

SEQ ID NO: 419318 - DNA, 25 bp, Mus musculus
cattctggaatgctgtgacgggcta

SEQ ID NO: 419319 - DNA, 25 bp, Mus musculus
cattctggagacacaccggctatgt

SEQ ID NO: 419320 - DNA, 25 bp, Mus musculus
cattctggatgcatggaaggtcact

SEQ ID NO: 419321 - DNA, 25 bp, Mus musculus
cattctggcagagcacgtcagtggc

SEQ ID NO: 419322 - DNA, 25 bp, Mus musculus
cattctggcattagaaaaaagcctc

SEQ ID NO: 419323 - DNA, 25 bp, Mus musculus
cattctggcttgactgggtctcccc

SEQ ID NO: 419324 - DNA, 25 bp, Mus musculus
cattctgggaactactcttgtgagg

SEQ ID NO: 419325 - DNA, 25 bp, Mus musculus
cattctgggacacagtcaaggactc

SEQ ID NO: 419326 - DNA, 25 bp, Mus musculus
cattctgggcaagcactgattttcc

SEQ ID NO: 419327 - DNA, 25 bp, Mus musculus
cattctgggccactgtcatgtgtgc

SEQ ID NO: 419328 - DNA, 25 bp, Mus musculus
cattctggtcagtcctcctacatca

SEQ ID NO: 419329 - DNA, 25 bp, Mus musculus
cattctggtccatacgagcttcgga

SEQ ID NO: 419330 - DNA, 25 bp, Mus musculus
cattctgtagtctcttgcatgttgg

SEQ ID NO: 419331 - DNA, 25 bp, Mus musculus
cattctgtatgttgttgcctgagga

SEQ ID NO: 419332 - DNA, 25 bp, Mus musculus
cattctgtcacttgatagcagcgac

SEQ ID NO: 419333 - DNA, 25 bp, Mus musculus
cattctgtgctgtaaggtgtggatc

SEQ ID NO: 419334 - DNA, 25 bp, Mus musculus
cattctgtgtttgaccaattggctg

SEQ ID NO: 419335 - DNA, 25 bp, Mus musculus
cattctgttggaggagacgtgcccg

SEQ ID NO: 419336 - DNA, 25 bp, Mus musculus
cattcttcaggtggtctagggagcg

SEQ ID NO: 419337 - DNA, 25 bp, Mus musculus
cattcttctagttgacagggctatg

SEQ ID NO: 419338 - DNA, 25 bp, Mus musculus
cattcttctggagcttgaggcgccc

SEQ ID NO: 419339 - DNA, 25 bp, Mus musculus
cattcttcttcaatgtaagcaggcg

SEQ ID NO: 419340 - DNA, 25 bp, Mus musculus
cattcttgaaggtagagagacaaac

SEQ ID NO: 419341 - DNA, 25 bp, Mus musculus
cattcttgacaagaaggctgaagct

SEQ ID NO: 419342 - DNA, 25 bp, Mus musculus
cattcttggagtaccagggctggag

SEQ ID NO: 419343 - DNA, 25 bp, Mus musculus
cattcttgggccttgtaagaggcac

SEQ ID NO: 419344 - DNA, 25 bp, Mus musculus
cattctttgccgagcagctgacagc

SEQ ID NO: 419345 - DNA, 25 bp, Mus musculus
cattgaaaagatttctgacggcggc

SEQ ID NO: 419346 - DNA, 25 bp, Mus musculus
cattgaaaagtattgaagggcctcc

SEQ ID NO: 419347 - DNA, 25 bp, Mus musculus
cattgaaacctgcaaagagacggac

SEQ ID NO: 419348 - DNA, 25 bp, Mus musculus
cattgaaatacagcaagccaccagg

SEQ ID NO: 419349 - DNA, 25 bp, Mus musculus
cattgaaatggtgccacggactgcc

SEQ ID NO: 419350 - DNA, 25 bp, Mus musculus
cattgaacgagtcatcatgcctggg

SEQ ID NO: 419351 - DNA, 25 bp, Mus musculus
cattgaacgcttgtaattttcctgc

SEQ ID NO: 419352 - DNA, 25 bp, Mus musculus
cattgaacgggagctgcagtgcatg

SEQ ID NO: 419353 - DNA, 25 bp, Mus musculus
cattgaagaacatgcattttgctcc

SEQ ID NO: 419354 - DNA, 25 bp, Mus musculus
cattgaagagctcatgaaggacggt

SEQ ID NO: 419355 - DNA, 25 bp, Mus musculus
cattgaagatgggtaccggttgccc

SEQ ID NO: 419356 - DNA, 25 bp, Mus musculus
cattgaagctggcatcatcggagtc

SEQ ID NO: 419357 - DNA, 25 bp, Mus musculus
cattgaaggtgtgcatcgctgggct

SEQ ID NO: 419358 - DNA, 25 bp, Mus musculus
cattgaatggctgcgcttccgcgac

SEQ ID NO: 419359 - DNA, 25 bp, Mus musculus
cattgacaagtcaggtaggtgctgc

SEQ ID NO: 419360 - DNA, 25 bp, Mus musculus
cattgacagaacttgtagtaagcca

SEQ ID NO: 419361 - DNA, 25 bp, Mus musculus
cattgacagagtgactgcactcaca

SEQ ID NO: 419362 - DNA, 25 bp, Mus musculus
cattgaccagaacagggatgggatc

SEQ ID NO: 419363 - DNA, 25 bp, Mus musculus
cattgacctgccaggactctccagt

SEQ ID NO: 419364 - DNA, 25 bp, Mus musculus
cattgacctgcgtaaggctgcatcc

SEQ ID NO: 419365 - DNA, 25 bp, Mus musculus
cattgacgcaatatccctggagtgt

SEQ ID NO: 419366 - DNA, 25 bp, Mus musculus
cattgacgttctttgtgtggtagca

SEQ ID NO: 419367 - DNA, 25 bp, Mus musculus
cattgactacacttgcatgaggaag

SEQ ID NO: 419368 - DNA, 25 bp, Mus musculus
cattgactacgatcccctggagggc

SEQ ID NO: 419369 - DNA, 25 bp, Mus musculus
cattgactatgcattaccctgggac

SEQ ID NO: 419370 - DNA, 25 bp, Mus musculus
cattgactgaaagtgatccctgggt

SEQ ID NO: 419371 - DNA, 25 bp, Mus musculus
cattgactgtcaaactagaaaccgg

SEQ ID NO: 419372 - DNA, 25 bp, Mus musculus
cattgacttccgagatgaagacgga

SEQ ID NO: 419373 - DNA, 25 bp, Mus musculus
cattgactttctgtttgatcacacc

SEQ ID NO: 419374 - DNA, 25 bp, Mus musculus
cattgagaaccgtaggcaagaccct

SEQ ID NO: 419375 - DNA, 25 bp, Mus musculus
cattgagaactgttgcagggccgag

SEQ ID NO: 419376 - DNA, 25 bp, Mus musculus
cattgagaagccagttcaccaggga

SEQ ID NO: 419377 - DNA, 25 bp, Mus musculus
cattgagacagacccagtgtttacc

SEQ ID NO: 419378 - DNA, 25 bp, Mus musculus
cattgagacaggtaacagcagtgac

SEQ ID NO: 419379 - DNA, 25 bp, Mus musculus
cattgagagaagctgtcaagacatc

SEQ ID NO: 419380 - DNA, 25 bp, Mus musculus
cattgagatccagttgtctaccggc

SEQ ID NO: 419381 - DNA, 25 bp, Mus musculus
cattgagattccaaaagacgctttc

SEQ ID NO: 419382 - DNA, 25 bp, Mus musculus
cattgagcatttgtcccaacgggag

SEQ ID NO: 419383 - DNA, 25 bp, Mus musculus
cattgagcgccttatcctgccggct

SEQ ID NO: 419384 - DNA, 25 bp, Mus musculus
cattgagcgctttcacagtaaccca

SEQ ID NO: 419385 - DNA, 25 bp, Mus musculus
cattgagcggaagatccagctggga

SEQ ID NO: 419386 - DNA, 25 bp, Mus musculus
cattgagcggctaaactgtaataac

SEQ ID NO: 419387 - DNA, 25 bp, Mus musculus
cattgagcgtccagcagatgtggaa

SEQ ID NO: 419388 - DNA, 25 bp, Mus musculus
cattgaggacaccaaagagaagcga

SEQ ID NO: 419389 - DNA, 25 bp, Mus musculus
cattgaggacgtgctagcagctgcc

SEQ ID NO: 419390 - DNA, 25 bp, Mus musculus
cattgaggcatgtacacagctggga

SEQ ID NO: 419391 - DNA, 25 bp, Mus musculus
cattgaggccaatcgcaaagaggac

SEQ ID NO: 419392 - DNA, 25 bp, Mus musculus
cattgagggaccaaaagaggacata

SEQ ID NO: 419393 - DNA, 25 bp, Mus musculus
cattgaggtaagaccgtccccattc

SEQ ID NO: 419394 - DNA, 25 bp, Mus musculus
cattgaggtcgttgccatttcctgg

SEQ ID NO: 419395 - DNA, 25 bp, Mus musculus
cattgaggttccctgctctgaggac

SEQ ID NO: 419396 - DNA, 25 bp, Mus musculus
cattgaggttttactggtgtgcggt

SEQ ID NO: 419397 - DNA, 25 bp, Mus musculus
cattgagtatggaactgcatgagcc

SEQ ID NO: 419398 - DNA, 25 bp, Mus musculus
cattgagtcacctgtttgcacggac

SEQ ID NO: 419399 - DNA, 25 bp, Mus musculus
cattgagtccccacgaaaaggctgg

SEQ ID NO: 419400 - DNA, 25 bp, Mus musculus
cattgagtggttggatgacacctcc

SEQ ID NO: 419401 - DNA, 25 bp, Mus musculus
cattgagttccagggcaatagagct

SEQ ID NO: 419402 - DNA, 25 bp, Mus musculus
cattgataaggacagcaagacccgc

SEQ ID NO: 419403 - DNA, 25 bp, Mus musculus
cattgataatcaggagccgagttgc

SEQ ID NO: 419404 - DNA, 25 bp, Mus musculus
cattgatacaagaggagcaggctag

SEQ ID NO: 419405 - DNA, 25 bp, Mus musculus
cattgatacatttaagctcagcccc

SEQ ID NO: 419406 - DNA, 25 bp, Mus musculus
cattgatatcaacgatgtgacgccc

SEQ ID NO: 419407 - DNA, 25 bp, Mus musculus
cattgatatcgtgcgcgtgggagac

SEQ ID NO: 419408 - DNA, 25 bp, Mus musculus
cattgatgacaagtacagccgacgg

SEQ ID NO: 419409 - DNA, 25 bp, Mus musculus
cattgatgagaacattgagcgggct

SEQ ID NO: 419410 - DNA, 25 bp, Mus musculus
cattgatgagctgggaagaggaacc

SEQ ID NO: 419411 - DNA, 25 bp, Mus musculus
cattgatgagtgtgaagacaacccc

SEQ ID NO: 419412 - DNA, 25 bp, Mus musculus
cattgatgcacttagcagatgcggc

SEQ ID NO: 419413 - DNA, 25 bp, Mus musculus
cattgatgcctgcaaaggagactcc

SEQ ID NO: 419414 - DNA, 25 bp, Mus musculus
cattgatgcgcagacatttgctgac

SEQ ID NO: 419415 - DNA, 25 bp, Mus musculus
cattgatgcggtgttgctgctccag

SEQ ID NO: 419416 - DNA, 25 bp, Mus musculus
cattgatggaaagaatcgagggtcc

SEQ ID NO: 419417 - DNA, 25 bp, Mus musculus
cattgatgggcagatagactccgtg

SEQ ID NO: 419418 - DNA, 25 bp, Mus musculus
cattgatgtagcaggtaaaaggtgc

SEQ ID NO: 419419 - DNA, 25 bp, Mus musculus
cattgatgtctctgcccacgcattg

SEQ ID NO: 419420 - DNA, 25 bp, Mus musculus
cattgatgtgggtccaagttcggga

SEQ ID NO: 419421 - DNA, 25 bp, Mus musculus
cattgattcggaaggctggctgcac

SEQ ID NO: 419422 - DNA, 25 bp, Mus musculus
cattgattctgacccggtggatgag

SEQ ID NO: 419423 - DNA, 25 bp, Mus musculus
cattgattctgtacacgtgccacgg

SEQ ID NO: 419424 - DNA, 25 bp, Mus musculus
cattgcaaaagggtgctgagcccag

SEQ ID NO: 419425 - DNA, 25 bp, Mus musculus
cattgcagacccagacgatagaggc

SEQ ID NO: 419426 - DNA, 25 bp, Mus musculus
cattgcagaccttttgggtggtccc

SEQ ID NO: 419427 - DNA, 25 bp, Mus musculus
cattgcagagggaagcgtgaaccta

SEQ ID NO: 419428 - DNA, 25 bp, Mus musculus
cattgcagatgctgactcgagggcg

SEQ ID NO: 419429 - DNA, 25 bp, Mus musculus
cattgcagcaccgaagagaaggcct

SEQ ID NO: 419430 - DNA, 25 bp, Mus musculus
cattgcaggtgcgtctctgcagaag

SEQ ID NO: 419431 - DNA, 25 bp, Mus musculus
cattgcaggtgtcatggcgacgctt

SEQ ID NO: 419432 - DNA, 25 bp, Mus musculus
cattgcatcggctgaagttcctggg

SEQ ID NO: 419433 - DNA, 25 bp, Mus musculus
cattgcatctgacaagggaacccca

SEQ ID NO: 419434 - DNA, 25 bp, Mus musculus
cattgcatggcctcatcacctgatg

SEQ ID NO: 419435 - DNA, 25 bp, Mus musculus
cattgcattgctcggcgtctggaca

SEQ ID NO: 419436 - DNA, 25 bp, Mus musculus
cattgccaagatgcgcatggtggcc

SEQ ID NO: 419437 - DNA, 25 bp, Mus musculus
cattgccaaggagtagagagcctgg

SEQ ID NO: 419438 - DNA, 25 bp, Mus musculus
cattgccacgaggtatgcatgcagc

SEQ ID NO: 419439 - DNA, 25 bp, Mus musculus
cattgccacttaggattttcctccg

SEQ ID NO: 419440 - DNA, 25 bp, Mus musculus
cattgccagtgggactttgaaccag

SEQ ID NO: 419441 - DNA, 25 bp, Mus musculus
cattgcccacggacaaggtagcagc

SEQ ID NO: 419442 - DNA, 25 bp, Mus musculus
cattgcccagcatttcggaagcgga

SEQ ID NO: 419443 - DNA, 25 bp, Mus musculus
cattgccgattgaggtgtactgcca

SEQ ID NO: 419444 - DNA, 25 bp, Mus musculus
cattgccgtggaactctatagaggg

SEQ ID NO: 419445 - DNA, 25 bp, Mus musculus
cattgccgtggaggtgttcctgacc

SEQ ID NO: 419446 - DNA, 25 bp, Mus musculus
cattgcctaacagtcatggctctag

SEQ ID NO: 419447 - DNA, 25 bp, Mus musculus
cattgcctgagaagatgcggccagc

SEQ ID NO: 419448 - DNA, 25 bp, Mus musculus
cattgcctttgactagccacgcgtg

SEQ ID NO: 419449 - DNA, 25 bp, Mus musculus
cattgcgaagattgcggactacggg

SEQ ID NO: 419450 - DNA, 25 bp, Mus musculus
cattgcgactggagatcattgataa

SEQ ID NO: 419451 - DNA, 25 bp, Mus musculus
cattgcgaggtatctgcacgctgcc

SEQ ID NO: 419452 - DNA, 25 bp, Mus musculus
cattgcgatcgaggttgcactggca

SEQ ID NO: 419453 - DNA, 25 bp, Mus musculus
cattgcgcgttggttaactcccagg

SEQ ID NO: 419454 - DNA, 25 bp, Mus musculus
cattgctaagaggagagcgaaccag

SEQ ID NO: 419455 - DNA, 25 bp, Mus musculus
cattgctaagcagcacacgtgcaga

SEQ ID NO: 419456 - DNA, 25 bp, Mus musculus
cattgctaatcccaaagccgaggga

SEQ ID NO: 419457 - DNA, 25 bp, Mus musculus
cattgctacaaatactggaaggtca

SEQ ID NO: 419458 - DNA, 25 bp, Mus musculus
cattgctagatagtttctgggcagg

SEQ ID NO: 419459 - DNA, 25 bp, Mus musculus
cattgctaggaaagccacgggtctc

SEQ ID NO: 419460 - DNA, 25 bp, Mus musculus
cattgctagtggcatcacagctcag

SEQ ID NO: 419461 - DNA, 25 bp, Mus musculus
cattgctcagacttactggagggcc

SEQ ID NO: 419462 - DNA, 25 bp, Mus musculus
cattgctcttcgtcaagggtgcggt

SEQ ID NO: 419463 - DNA, 25 bp, Mus musculus
cattgctgacctagtgtgagctgaa

SEQ ID NO: 419464 - DNA, 25 bp, Mus musculus
cattgctgactatgaggtacacccc

SEQ ID NO: 419465 - DNA, 25 bp, Mus musculus
cattgctgagcatgtgccaaaggcc

SEQ ID NO: 419466 - DNA, 25 bp, Mus musculus
cattgctgagtaccaccgtgaagag

SEQ ID NO: 419467 - DNA, 25 bp, Mus musculus
cattgctgagtttttactgttgctg

SEQ ID NO: 419468 - DNA, 25 bp, Mus musculus
cattgctgccgagaaacgaggctcc

SEQ ID NO: 419469 - DNA, 25 bp, Mus musculus
cattgctgcctagtttgcaaatgga

SEQ ID NO: 419470 - DNA, 25 bp, Mus musculus
cattgctgcgtttgaccgtggctac

SEQ ID NO: 419471 - DNA, 25 bp, Mus musculus
cattgctgctatggatccctgtgta

SEQ ID NO: 419472 - DNA, 25 bp, Mus musculus
cattgctggaactgaaactacaacc

SEQ ID NO: 419473 - DNA, 25 bp, Mus musculus
cattgctggcttagttgctccctga

SEQ ID NO: 419474 - DNA, 25 bp, Mus musculus
cattgctgtcccacactctgatgac

SEQ ID NO: 419475 - DNA, 25 bp, Mus musculus
cattgctgtgccagagctgggaaga

SEQ ID NO: 419476 - DNA, 25 bp, Mus musculus
cattgctgtggaccgaaaacacggt

SEQ ID NO: 419477 - DNA, 25 bp, Mus musculus
cattgcttcaggaatctgctacacc

SEQ ID NO: 419478 - DNA, 25 bp, Mus musculus
cattggaaaagcatctggccgggct

SEQ ID NO: 419479 - DNA, 25 bp, Mus musculus
cattggaaagatctggctcacggtc

SEQ ID NO: 419480 - DNA, 25 bp, Mus musculus
cattggaaccaagtgcagctgggct

SEQ ID NO: 419481 - DNA, 25 bp, Mus musculus
cattggaagatgacaagcatggctg

SEQ ID NO: 419482 - DNA, 25 bp, Mus musculus
cattggaaggagtactcaccctggg

SEQ ID NO: 419483 - DNA, 25 bp, Mus musculus
cattggaatcctgaaagtagtggtt

SEQ ID NO: 419484 - DNA, 25 bp, Mus musculus
cattggacaactcagtacccactgg

SEQ ID NO: 419485 - DNA, 25 bp, Mus musculus
cattggacttatgaatgcaaaggga

SEQ ID NO: 419486 - DNA, 25 bp, Mus musculus
cattggagaatacagtcgccaggca

SEQ ID NO: 419487 - DNA, 25 bp, Mus musculus
cattggagacctaaatcgaagccta

SEQ ID NO: 419488 - DNA, 25 bp, Mus musculus
cattggagcccgcaacattgaagat

SEQ ID NO: 419489 - DNA, 25 bp, Mus musculus
cattggaggacgcacatagcatctg

SEQ ID NO: 419490 - DNA, 25 bp, Mus musculus
cattggaggtcttctgagagtagga

SEQ ID NO: 419491 - DNA, 25 bp, Mus musculus
cattggagtctgaagatgagaaccc

SEQ ID NO: 419492 - DNA, 25 bp, Mus musculus
cattggatcccacagcctattgcga

SEQ ID NO: 419493 - DNA, 25 bp, Mus musculus
cattggatctcacaagttcgaggcc

SEQ ID NO: 419494 - DNA, 25 bp, Mus musculus
cattggatgcttggaatatgaccca

SEQ ID NO: 419495 - DNA, 25 bp, Mus musculus
cattggattcatctctgccatgggc

SEQ ID NO: 419496 - DNA, 25 bp, Mus musculus
cattggattccgagagtgcttgaca

SEQ ID NO: 419497 - DNA, 25 bp, Mus musculus
cattggatttggagactacgtggca

SEQ ID NO: 419498 - DNA, 25 bp, Mus musculus
cattggcaaccctgatagctttggg

SEQ ID NO: 419499 - DNA, 25 bp, Mus musculus
cattggcaagattggcacagcagct

SEQ ID NO: 419500 - DNA, 25 bp, Mus musculus
cattggcacagtggcatgctcttgg

SEQ ID NO: 419501 - DNA, 25 bp, Mus musculus
cattggcacccgaaagcaagctgag

SEQ ID NO: 419502 - DNA, 25 bp, Mus musculus
cattggcacggatgtctacctacgg

SEQ ID NO: 419503 - DNA, 25 bp, Mus musculus
cattggcacgggtgattaaaagcat

SEQ ID NO: 419504 - DNA, 25 bp, Mus musculus
cattggcagcaatcacttcgtgggc

SEQ ID NO: 419505 - DNA, 25 bp, Mus musculus
cattggcagccataaccctagaaag

SEQ ID NO: 419506 - DNA, 25 bp, Mus musculus
cattggcagcccaggcgtgcctgga

SEQ ID NO: 419507 - DNA, 25 bp, Mus musculus
cattggcatgatagaagtggaccca

SEQ ID NO: 419508 - DNA, 25 bp, Mus musculus
cattggccaaaagccaggaattgct

SEQ ID NO: 419509 - DNA, 25 bp, Mus musculus
cattggccacatctgtcacagcgca

SEQ ID NO: 419510 - DNA, 25 bp, Mus musculus
cattggccatagttctcctcggtgc

SEQ ID NO: 419511 - DNA, 25 bp, Mus musculus
cattggccctgctacggttctgtgc

SEQ ID NO: 419512 - DNA, 25 bp, Mus musculus
cattggccgagacaactgagcgcaa

SEQ ID NO: 419513 - DNA, 25 bp, Mus musculus
cattggccgatacctgctgagtgtc

SEQ ID NO: 419514 - DNA, 25 bp, Mus musculus
cattggcctccagaactttgtaaca

SEQ ID NO: 419515 - DNA, 25 bp, Mus musculus
cattggcctcctcagagaaacggga

SEQ ID NO: 419516 - DNA, 25 bp, Mus musculus
cattggcctgagagatgtggagcct

SEQ ID NO: 419517 - DNA, 25 bp, Mus musculus
cattggcgcagctgcagaagcttga

SEQ ID NO: 419518 - DNA, 25 bp, Mus musculus
cattggcgcggtgaacaacatggac

SEQ ID NO: 419519 - DNA, 25 bp, Mus musculus
cattggcgtgtagtgtcttagtgtc

SEQ ID NO: 419520 - DNA, 25 bp, Mus musculus
cattggctacctcctacagcagtgg

SEQ ID NO: 419521 - DNA, 25 bp, Mus musculus
cattggctccctcaaagataaccgg

SEQ ID NO: 419522 - DNA, 25 bp, Mus musculus
cattggctccggctagaggttgaca

SEQ ID NO: 419523 - DNA, 25 bp, Mus musculus
cattggctcctcgtacatctggcgg

SEQ ID NO: 419524 - DNA, 25 bp, Mus musculus
cattggctctcaaactgagcatggg

SEQ ID NO: 419525 - DNA, 25 bp, Mus musculus
cattggctgcttctcagctgcggga

SEQ ID NO: 419526 - DNA, 25 bp, Mus musculus
cattggctgcttgtccagtgtaaaa

SEQ ID NO: 419527 - DNA, 25 bp, Mus musculus
cattggctgtgcagagctcaacaga

SEQ ID NO: 419528 - DNA, 25 bp, Mus musculus
cattggcttaaattgctggacagtc

SEQ ID NO: 419529 - DNA, 25 bp, Mus musculus
cattggcttccaagtgcggcagcga

SEQ ID NO: 419530 - DNA, 25 bp, Mus musculus
cattggcttgcgagacgtagaccct

SEQ ID NO: 419531 - DNA, 25 bp, Mus musculus
cattgggaaaacattggagctggag

SEQ ID NO: 419532 - DNA, 25 bp, Mus musculus
cattgggaacccagacaccatggat

SEQ ID NO: 419533 - DNA, 25 bp, Mus musculus
cattgggaacccagtagcaagacag

SEQ ID NO: 419534 - DNA, 25 bp, Mus musculus
cattgggagcgggtacatctttgcc

SEQ ID NO: 419535 - DNA, 25 bp, Mus musculus
cattgggatatcgaagcactgctta

SEQ ID NO: 419536 - DNA, 25 bp, Mus musculus
cattgggccctccatgcacttgtgg

SEQ ID NO: 419537 - DNA, 25 bp, Mus musculus
cattgggcctagtgctgctcgtgga

SEQ ID NO: 419538 - DNA, 25 bp, Mus musculus
cattgggctccaggcatcaccagga

SEQ ID NO: 419539 - DNA, 25 bp, Mus musculus
cattgggtcagtagtggatgaacac

SEQ ID NO: 419540 - DNA, 25 bp, Mus musculus
cattggtagtggctgtcccttcttc

SEQ ID NO: 419541 - DNA, 25 bp, Mus musculus
cattggtcacacatgcctctggaca

SEQ ID NO: 419542 - DNA, 25 bp, Mus musculus
cattggtcacactatataaagtttg

SEQ ID NO: 419543 - DNA, 25 bp, Mus musculus
cattggtcctgtcgagtctgtggca

SEQ ID NO: 419544 - DNA, 25 bp, Mus musculus
cattggtcgcagcagcaaagatttc

SEQ ID NO: 419545 - DNA, 25 bp, Mus musculus
cattggtcgtgagcctccatgttgg

SEQ ID NO: 419546 - DNA, 25 bp, Mus musculus
cattggtctggtgggccatttgcac

SEQ ID NO: 419547 - DNA, 25 bp, Mus musculus
cattggtctggttcagggcctccgg

SEQ ID NO: 419548 - DNA, 25 bp, Mus musculus
cattggtgaattgcctgctgcccct

SEQ ID NO: 419549 - DNA, 25 bp, Mus musculus
cattggtgacctgcctacctgttgc

SEQ ID NO: 419550 - DNA, 25 bp, Mus musculus
cattggtgatcctgaggttccttga

SEQ ID NO: 419551 - DNA, 25 bp, Mus musculus
cattggtgtccatgaacttgcggca

SEQ ID NO: 419552 - DNA, 25 bp, Mus musculus
cattggtgtcgccagggaacagcta

SEQ ID NO: 419553 - DNA, 25 bp, Mus musculus
cattggtgttaccttcacctcagaa

SEQ ID NO: 419554 - DNA, 25 bp, Mus musculus
cattggttcaacctagacaggacag

SEQ ID NO: 419555 - DNA, 25 bp, Mus musculus
cattggttcaattccacgcaaggag

SEQ ID NO: 419556 - DNA, 25 bp, Mus musculus
cattggttccaatatgaagatgccg

SEQ ID NO: 419557 - DNA, 25 bp, Mus musculus
cattggttctgtgggaaagcggttc

SEQ ID NO: 419558 - DNA, 25 bp, Mus musculus
cattggttgcacatcagctgggtcc

SEQ ID NO: 419559 - DNA, 25 bp, Mus musculus
cattggttgcgcctacagtgctgtt

SEQ ID NO: 419560 - DNA, 25 bp, Mus musculus
cattggtttctctgttaccctgggc

SEQ ID NO: 419561 - DNA, 25 bp, Mus musculus
cattgtaagcaagagcggtgggtca

SEQ ID NO: 419562 - DNA, 25 bp, Mus musculus
cattgtaatgcttagttctttgaac

SEQ ID NO: 419563 - DNA, 25 bp, Mus musculus
cattgtaccagatggtgcagccctg

SEQ ID NO: 419564 - DNA, 25 bp, Mus musculus
cattgtacccagacatgatatgtgt

SEQ ID NO: 419565 - DNA, 25 bp, Mus musculus
cattgtactagattccgtggttgac

SEQ ID NO: 419566 - DNA, 25 bp, Mus musculus
cattgtactgttctgccttgaaagg

SEQ ID NO: 419567 - DNA, 25 bp, Mus musculus
cattgtacttctagtggccgcggga

SEQ ID NO: 419568 - DNA, 25 bp, Mus musculus
cattgtagggagacatcagacaggc

SEQ ID NO: 419569 - DNA, 25 bp, Mus musculus
cattgtagggtttcagggccaccac

SEQ ID NO: 419570 - DNA, 25 bp, Mus musculus
cattgtagtggagaacctggcaggc

SEQ ID NO: 419571 - DNA, 25 bp, Mus musculus
cattgtataatgttcccgactcgca

SEQ ID NO: 419572 - DNA, 25 bp, Mus musculus
cattgtatcatcaggtgtgccacca

SEQ ID NO: 419573 - DNA, 25 bp, Mus musculus
cattgtcaagtttggtggcaggcac

SEQ ID NO: 419574 - DNA, 25 bp, Mus musculus
cattgtcaccgtgctgaaccagggc

SEQ ID NO: 419575 - DNA, 25 bp, Mus musculus
cattgtcactatcgaggctatgtgg

SEQ ID NO: 419576 - DNA, 25 bp, Mus musculus
cattgtcagagtggatcgagtgccc

SEQ ID NO: 419577 - DNA, 25 bp, Mus musculus
cattgtcagtagcatcgctgcaggg

SEQ ID NO: 419578 - DNA, 25 bp, Mus musculus
cattgtcatcctgcgcactttgagg

SEQ ID NO: 419579 - DNA, 25 bp, Mus musculus
cattgtcatggttcagggccaccgt

SEQ ID NO: 419580 - DNA, 25 bp, Mus musculus
cattgtccagttgaaccagtgtgta

SEQ ID NO: 419581 - DNA, 25 bp, Mus musculus
cattgtcccattttttgggcaagga

SEQ ID NO: 419582 - DNA, 25 bp, Mus musculus
cattgtccgagaacggccacgactt

SEQ ID NO: 419583 - DNA, 25 bp, Mus musculus
cattgtcctgctgactgcggtagcc

SEQ ID NO: 419584 - DNA, 25 bp, Mus musculus
cattgtcgagcaacattcactgcag

SEQ ID NO: 419585 - DNA, 25 bp, Mus musculus
cattgtcgcacatagccccttaggg

SEQ ID NO: 419586 - DNA, 25 bp, Mus musculus
cattgtcgcaggatgagtgactcca

SEQ ID NO: 419587 - DNA, 25 bp, Mus musculus
cattgtctatgcctacaggaaccga

SEQ ID NO: 419588 - DNA, 25 bp, Mus musculus
cattgtctggactgccaatcagtga

SEQ ID NO: 419589 - DNA, 25 bp, Mus musculus
cattgtcttgctatgtcgcccaacc

SEQ ID NO: 419590 - DNA, 25 bp, Mus musculus
cattgtcttgtgcagctcaggaacc

SEQ ID NO: 419591 - DNA, 25 bp, Mus musculus
cattgtgaacaaactccctgtgtga

SEQ ID NO: 419592 - DNA, 25 bp, Mus musculus
cattgtgacaagcaggcatgtcttg

SEQ ID NO: 419593 - DNA, 25 bp, Mus musculus
cattgtgacagcgtgcctgcaggct

SEQ ID NO: 419594 - DNA, 25 bp, Mus musculus
cattgtgagccaaagacagatccac

SEQ ID NO: 419595 - DNA, 25 bp, Mus musculus
cattgtgagcgctgcaacaagacac

SEQ ID NO: 419596 - DNA, 25 bp, Mus musculus
cattgtgatgaaggcagagagcaga

SEQ ID NO: 419597 - DNA, 25 bp, Mus musculus
cattgtgatgttggctggagcccac

SEQ ID NO: 419598 - DNA, 25 bp, Mus musculus
cattgtgattagcaaagggacccca

SEQ ID NO: 419599 - DNA, 25 bp, Mus musculus
cattgtgcccatgaataaaccgcag

SEQ ID NO: 419600 - DNA, 25 bp, Mus musculus
cattgtgcctgtcccacgagattca

SEQ ID NO: 419601 - DNA, 25 bp, Mus musculus
cattgtgcggaaggactatgatccc

SEQ ID NO: 419602 - DNA, 25 bp, Mus musculus
cattgtgctctttcgcctgcataag

SEQ ID NO: 419603 - DNA, 25 bp, Mus musculus
cattgtgctgcatgtggtccaggac

SEQ ID NO: 419604 - DNA, 25 bp, Mus musculus
cattgtgctttctacagtgtgggac

SEQ ID NO: 419605 - DNA, 25 bp, Mus musculus
cattgtggaacatgactatggagag

SEQ ID NO: 419606 - DNA, 25 bp, Mus musculus
cattgtggaaggaatcattcggagt

SEQ ID NO: 419607 - DNA, 25 bp, Mus musculus
cattgtggagctactgaccctggat

SEQ ID NO: 419608 - DNA, 25 bp, Mus musculus
cattgtggcccagtatagacctgaa

SEQ ID NO: 419609 - DNA, 25 bp, Mus musculus
cattgtggcggaatttaagcagggc

SEQ ID NO: 419610 - DNA, 25 bp, Mus musculus
cattgtgggccaaagtaacgagcgt

SEQ ID NO: 419611 - DNA, 25 bp, Mus musculus
cattgtggtaaaggtgcggtcgacc

SEQ ID NO: 419612 - DNA, 25 bp, Mus musculus
cattgtggtttacacggacagggaa

SEQ ID NO: 419613 - DNA, 25 bp, Mus musculus
cattgtgtactagtccatggcggct

SEQ ID NO: 419614 - DNA, 25 bp, Mus musculus
cattgtgtaggcatgcatgtatgtg

SEQ ID NO: 419615 - DNA, 25 bp, Mus musculus
cattgtgtcgctttcaacctcagga

SEQ ID NO: 419616 - DNA, 25 bp, Mus musculus
cattgtgtgacacaaaggaccttcc

SEQ ID NO: 419617 - DNA, 25 bp, Mus musculus
cattgtgtggtacgagactggcatc

SEQ ID NO: 419618 - DNA, 25 bp, Mus musculus
cattgtgtgttgttagtcctgtgac

SEQ ID NO: 419619 - DNA, 25 bp, Mus musculus
cattgtgtttggtcttaggcctaga

SEQ ID NO: 419620 - DNA, 25 bp, Mus musculus
cattgttactcaggtcgcttgtgga

SEQ ID NO: 419621 - DNA, 25 bp, Mus musculus
cattgttatcagacaggaggacctg

SEQ ID NO: 419622 - DNA, 25 bp, Mus musculus
cattgttcacaagagaagccgcttc

SEQ ID NO: 419623 - DNA, 25 bp, Mus musculus
cattgttctaggtgctatcaaaggc

SEQ ID NO: 419624 - DNA, 25 bp, Mus musculus
cattgttgatattcgcctctggcag

SEQ ID NO: 419625 - DNA, 25 bp, Mus musculus
cattgttgccgaagctgtagccgta

SEQ ID NO: 419626 - DNA, 25 bp, Mus musculus
cattgttggacatattaaagcagta

SEQ ID NO: 419627 - DNA, 25 bp, Mus musculus
cattgttgggcctgggaagcactaa

SEQ ID NO: 419628 - DNA, 25 bp, Mus musculus
cattgttggtaagcagtcccctgta

SEQ ID NO: 419629 - DNA, 25 bp, Mus musculus
cattgttggtgagggtcgtgcctac

SEQ ID NO: 419630 - DNA, 25 bp, Mus musculus
cattgtttccaaccatggcgggagg

SEQ ID NO: 419631 - DNA, 25 bp, Mus musculus
cattgttttgcatgactggtgatta

SEQ ID NO: 419632 - DNA, 25 bp, Mus musculus
catttaaaactgtggtgtcattcca

SEQ ID NO: 419633 - DNA, 25 bp, Mus musculus
catttaaaagcaaggatccgtgctg

SEQ ID NO: 419634 - DNA, 25 bp, Mus musculus
catttaaacaagcatgcgggccggt

SEQ ID NO: 419635 - DNA, 25 bp, Mus musculus
catttaaacgacaggctctcgtgga

SEQ ID NO: 419636 - DNA, 25 bp, Mus musculus
catttaaaggcagaatcaggctggg

SEQ ID NO: 419637 - DNA, 25 bp, Mus musculus
catttaaaggtgcagatatacccaa

SEQ ID NO: 419638 - DNA, 25 bp, Mus musculus
catttaaatacattgtgacctgtgt

SEQ ID NO: 419639 - DNA, 25 bp, Mus musculus
catttaacacaaagacaggctcggg

SEQ ID NO: 419640 - DNA, 25 bp, Mus musculus
catttaacatatggaaagctgtgct

SEQ ID NO: 419641 - DNA, 25 bp, Mus musculus
catttaagcttccagagcactcgag

SEQ ID NO: 419642 - DNA, 25 bp, Mus musculus
catttaagggaaactaaggcaccat

SEQ ID NO: 419643 - DNA, 25 bp, Mus musculus
catttaatcacagttcggaggaaga

SEQ ID NO: 419644 - DNA, 25 bp, Mus musculus
catttacaaaagcagtcagggctgc

SEQ ID NO: 419645 - DNA, 25 bp, Mus musculus
catttacaacctcgtgctgggcctg

SEQ ID NO: 419646 - DNA, 25 bp, Mus musculus
catttacaacctgggtgatcctggc

SEQ ID NO: 419647 - DNA, 25 bp, Mus musculus
catttacaagatggtttcgtccgtg

SEQ ID NO: 419648 - DNA, 25 bp, Mus musculus
catttacaagctgaacggcgtgtcc

SEQ ID NO: 419649 - DNA, 25 bp, Mus musculus
catttacacatgaccccaggtggcc

SEQ ID NO: 419650 - DNA, 25 bp, Mus musculus
catttacagaaggaagtgacagcca

SEQ ID NO: 419651 - DNA, 25 bp, Mus musculus
catttacagctgagtaacaggagcc

SEQ ID NO: 419652 - DNA, 25 bp, Mus musculus
catttaccagctgattgtcaccgca

SEQ ID NO: 419653 - DNA, 25 bp, Mus musculus
catttaccgacaagtggcgcatggg

SEQ ID NO: 419654 - DNA, 25 bp, Mus musculus
catttacctgaaaagcttatgattc

SEQ ID NO: 419655 - DNA, 25 bp, Mus musculus
catttacgacgacaagaaccacagg

SEQ ID NO: 419656 - DNA, 25 bp, Mus musculus
catttacgcgggaggcatcaagtcc

SEQ ID NO: 419657 - DNA, 25 bp, Mus musculus
catttacgggctgaccgtggagtca

SEQ ID NO: 419658 - DNA, 25 bp, Mus musculus
catttactcacaggactgcgcttgt

SEQ ID NO: 419659 - DNA, 25 bp, Mus musculus
catttacttcggtggacggcaggaa

SEQ ID NO: 419660 - DNA, 25 bp, Mus musculus
catttagcctagtacctttgcagtc

SEQ ID NO: 419661 - DNA, 25 bp, Mus musculus
catttagccttgtgtcttaagaatc

SEQ ID NO: 419662 - DNA, 25 bp, Mus musculus
catttaggaataagccagaggccac

SEQ ID NO: 419663 - DNA, 25 bp, Mus musculus
catttaggagtgagtaggagacaca

SEQ ID NO: 419664 - DNA, 25 bp, Mus musculus
catttagtgtgtcctgagagcagaa

SEQ ID NO: 419665 - DNA, 25 bp, Mus musculus
catttataagtattgaaggccaccc

SEQ ID NO: 419666 - DNA, 25 bp, Mus musculus
catttatcggccgtgagaagaggtc

SEQ ID NO: 419667 - DNA, 25 bp, Mus musculus
catttatctgtttgccagggctggg

SEQ ID NO: 419668 - DNA, 25 bp, Mus musculus
catttatgacgatgggaacctgctc

SEQ ID NO: 419669 - DNA, 25 bp, Mus musculus
catttatgaggaaacgccacacagc

SEQ ID NO: 419670 - DNA, 25 bp, Mus musculus
catttatgctgaagaccctgagcca

SEQ ID NO: 419671 - DNA, 25 bp, Mus musculus
catttattgggaggaactgagatca

SEQ ID NO: 419672 - DNA, 25 bp, Mus musculus
catttcaaaaatgtccgctgggcca

SEQ ID NO: 419673 - DNA, 25 bp, Mus musculus
catttcaaaacagcgggtcactgca

SEQ ID NO: 419674 - DNA, 25 bp, Mus musculus
catttcaaccttggccggaggatcc

SEQ ID NO: 419675 - DNA, 25 bp, Mus musculus
catttcaagatatgagaagagcctt

SEQ ID NO: 419676 - DNA, 25 bp, Mus musculus
catttcaaggaacccaacgcagagg

SEQ ID NO: 419677 - DNA, 25 bp, Mus musculus
catttcaaggtccatagcccactgg

SEQ ID NO: 419678 - DNA, 25 bp, Mus musculus
catttcacaggtttggccggctacc

SEQ ID NO: 419679 - DNA, 25 bp, Mus musculus
catttcagcagattccacaggcagg

SEQ ID NO: 419680 - DNA, 25 bp, Mus musculus
catttcagctccagtcagggcagac

SEQ ID NO: 419681 - DNA, 25 bp, Mus musculus
catttcaggagtcttaccaggtcta

SEQ ID NO: 419682 - DNA, 25 bp, Mus musculus
catttcaggcaatggcgacccttct

SEQ ID NO: 419683 - DNA, 25 bp, Mus musculus
catttcaggcgcgtctacaagaggc

SEQ ID NO: 419684 - DNA, 25 bp, Mus musculus
catttcaggtagaacacgtggcgca

SEQ ID NO: 419685 - DNA, 25 bp, Mus musculus
catttcagtccatgcagagctctgg

SEQ ID NO: 419686 - DNA, 25 bp, Mus musculus
catttcagtccatgtcgggaggctc

SEQ ID NO: 419687 - DNA, 25 bp, Mus musculus
catttcagttgccttgttgttccag

SEQ ID NO: 419688 - DNA, 25 bp, Mus musculus
catttcatctgggtgtgccacgcgg

SEQ ID NO: 419689 - DNA, 25 bp, Mus musculus
catttcatggcaacaaagcggagga

SEQ ID NO: 419690 - DNA, 25 bp, Mus musculus
catttcatgggaacaggctgacccc

SEQ ID NO: 419691 - DNA, 25 bp, Mus musculus
catttcatgtctgggcagcagccta

SEQ ID NO: 419692 - DNA, 25 bp, Mus musculus
catttccaagaagatgtcacagaga

SEQ ID NO: 419693 - DNA, 25 bp, Mus musculus
catttccagactgctcgatgcttgc

SEQ ID NO: 419694 - DNA, 25 bp, Mus musculus
catttccagagagacagaactagct

SEQ ID NO: 419695 - DNA, 25 bp, Mus musculus
catttccatggacaatctattgcgg

SEQ ID NO: 419696 - DNA, 25 bp, Mus musculus
catttcccaggaatgggtcagactt

SEQ ID NO: 419697 - DNA, 25 bp, Mus musculus
catttcccggaagagaagacaccct

SEQ ID NO: 419698 - DNA, 25 bp, Mus musculus
catttccctgtttttgctgtcaagc

SEQ ID NO: 419699 - DNA, 25 bp, Mus musculus
catttccgacatggagctcgcgctt

SEQ ID NO: 419700 - DNA, 25 bp, Mus musculus
catttccgagtgtaagtgttcctgc

SEQ ID NO: 419701 - DNA, 25 bp, Mus musculus
catttccgtcatgattcttgggcgt

SEQ ID NO: 419702 - DNA, 25 bp, Mus musculus
catttcctaaggacaagggcacatc

SEQ ID NO: 419703 - DNA, 25 bp, Mus musculus
catttcctaaggtccagcgtgcgac

SEQ ID NO: 419704 - DNA, 25 bp, Mus musculus
catttcctgagcacttccggtgaga

SEQ ID NO: 419705 - DNA, 25 bp, Mus musculus
catttccttccagatgaatagtgac

SEQ ID NO: 419706 - DNA, 25 bp, Mus musculus
catttcgggaagcatttggcaggta

SEQ ID NO: 419707 - DNA, 25 bp, Mus musculus
catttcgtgtaccagttcatgggcg

SEQ ID NO: 419708 - DNA, 25 bp, Mus musculus
catttctaaaagtggtgtccctggg

SEQ ID NO: 419709 - DNA, 25 bp, Mus musculus
catttctaagttgcccaggtcccgg

SEQ ID NO: 419710 - DNA, 25 bp, Mus musculus
catttctagcttacagaggtctccg

SEQ ID NO: 419711 - DNA, 25 bp, Mus musculus
catttctcagacaacctgtagatct

SEQ ID NO: 419712 - DNA, 25 bp, Mus musculus
catttctcaggaacttagacccagg

SEQ ID NO: 419713 - DNA, 25 bp, Mus musculus
catttctcaggtggtgggactagac

SEQ ID NO: 419714 - DNA, 25 bp, Mus musculus
catttctctcggagccaatagcggg

SEQ ID NO: 419715 - DNA, 25 bp, Mus musculus
catttctgacagactggccggcgtc

SEQ ID NO: 419716 - DNA, 25 bp, Mus musculus
catttctggccaacaaagggcttgt

SEQ ID NO: 419717 - DNA, 25 bp, Mus musculus
catttctgtaagagtatggctgtca

SEQ ID NO: 419718 - DNA, 25 bp, Mus musculus
catttctgtatcactgcggttctgg

SEQ ID NO: 419719 - DNA, 25 bp, Mus musculus
catttctgtatcttcgtgagcttct

SEQ ID NO: 419720 - DNA, 25 bp, Mus musculus
catttctgtcaaaggaagagtcttt

SEQ ID NO: 419721 - DNA, 25 bp, Mus musculus
catttctgtcttagcagatgctgcc

SEQ ID NO: 419722 - DNA, 25 bp, Mus musculus
catttcttcaggctaccatggcact

SEQ ID NO: 419723 - DNA, 25 bp, Mus musculus
catttcttcagggaggaaaccccag

SEQ ID NO: 419724 - DNA, 25 bp, Mus musculus
catttcttgctgctcagtctcctgc

SEQ ID NO: 419725 - DNA, 25 bp, Mus musculus
catttgaaaagcagtatcgtggacg

SEQ ID NO: 419726 - DNA, 25 bp, Mus musculus
catttgaatccttgaacaggttgcc

SEQ ID NO: 419727 - DNA, 25 bp, Mus musculus
catttgaattcgacccatggactct

SEQ ID NO: 419728 - DNA, 25 bp, Mus musculus
catttgactacgaggtcccactgag

SEQ ID NO: 419729 - DNA, 25 bp, Mus musculus
catttgagaaccagggcgagggctc

SEQ ID NO: 419730 - DNA, 25 bp, Mus musculus
catttgagcaggacattgagcgtgg

SEQ ID NO: 419731 - DNA, 25 bp, Mus musculus
catttgaggaagtacaacgaagccc

SEQ ID NO: 419732 - DNA, 25 bp, Mus musculus
catttgagtgataggagtcatcctg

SEQ ID NO: 419733 - DNA, 25 bp, Mus musculus
catttgatctgacttggatgagagt

SEQ ID NO: 419734 - DNA, 25 bp, Mus musculus
catttgatggacaggagcatctctt

SEQ ID NO: 419735 - DNA, 25 bp, Mus musculus
catttgatgggcctcgagggactct

SEQ ID NO: 419736 - DNA, 25 bp, Mus musculus
catttgattatctgcaccgactagg

SEQ ID NO: 419737 - DNA, 25 bp, Mus musculus
catttgcaacccctgtgttaaacca

SEQ ID NO: 419738 - DNA, 25 bp, Mus musculus
catttgcagtggatcttgggaacct

SEQ ID NO: 419739 - DNA, 25 bp, Mus musculus
catttgcatgcttgtcatttgtggt

SEQ ID NO: 419740 - DNA, 25 bp, Mus musculus
catttgccagagcagcatgcattgt

SEQ ID NO: 419741 - DNA, 25 bp, Mus musculus
catttgcctaggtcttgaacttaga

SEQ ID NO: 419742 - DNA, 25 bp, Mus musculus
catttgctgaagactcctgtgccgc

SEQ ID NO: 419743 - DNA, 25 bp, Mus musculus
catttgctgtctgctgactcggagc

SEQ ID NO: 419744 - DNA, 25 bp, Mus musculus
catttgcttaatcacggtagaatcc

SEQ ID NO: 419745 - DNA, 25 bp, Mus musculus
catttgcttagctgctggctgtgaa

SEQ ID NO: 419746 - DNA, 25 bp, Mus musculus
catttgcttctacggatcggaggag

SEQ ID NO: 419747 - DNA, 25 bp, Mus musculus
catttggaatcccttaggaaggaga

SEQ ID NO: 419748 - DNA, 25 bp, Mus musculus
catttggacacagaagcatagaccc

SEQ ID NO: 419749 - DNA, 25 bp, Mus musculus
catttggagagtagccccactggag

SEQ ID NO: 419750 - DNA, 25 bp, Mus musculus
catttggagctagttctcaccgacc

SEQ ID NO: 419751 - DNA, 25 bp, Mus musculus
catttggaggctgacgatttcctga

SEQ ID NO: 419752 - DNA, 25 bp, Mus musculus
catttggcactgcacatcgggctca

SEQ ID NO: 419753 - DNA, 25 bp, Mus musculus
catttggcccatcgtgaagtcagtc

SEQ ID NO: 419754 - DNA, 25 bp, Mus musculus
catttggccgccttcccatcttagg

SEQ ID NO: 419755 - DNA, 25 bp, Mus musculus
catttggcctaatggacgcggtcaa

SEQ ID NO: 419756 - DNA, 25 bp, Mus musculus
catttggctggcaacgtggacggca

SEQ ID NO: 419757 - DNA, 25 bp, Mus musculus
catttggctggtggctcgaagtaca

SEQ ID NO: 419758 - DNA, 25 bp, Mus musculus
catttgggacagttttgtgcagccc

SEQ ID NO: 419759 - DNA, 25 bp, Mus musculus
catttgggaccagaaagaacctgcc

SEQ ID NO: 419760 - DNA, 25 bp, Mus musculus
catttgggccattgttaggtagtct

SEQ ID NO: 419761 - DNA, 25 bp, Mus musculus
catttgggcgtatctcaccgggagg

SEQ ID NO: 419762 - DNA, 25 bp, Mus musculus
catttgggtggatgctcacactgac

SEQ ID NO: 419763 - DNA, 25 bp, Mus musculus
catttggtagatggaaaatccccac

SEQ ID NO: 419764 - DNA, 25 bp, Mus musculus
catttggtcactagatattgtaggc

SEQ ID NO: 419765 - DNA, 25 bp, Mus musculus
catttggtgaagactggcagcgagc

SEQ ID NO: 419766 - DNA, 25 bp, Mus musculus
catttggtgcacacatggaacaccc

SEQ ID NO: 419767 - DNA, 25 bp, Mus musculus
catttggtgccagaagacagtccac

SEQ ID NO: 419768 - DNA, 25 bp, Mus musculus
catttggtgtggtcagcagtagcgt

SEQ ID NO: 419769 - DNA, 25 bp, Mus musculus
catttggtgttggaaagcagccgac

SEQ ID NO: 419770 - DNA, 25 bp, Mus musculus
catttgtaaagcaccaagccaaagg

SEQ ID NO: 419771 - DNA, 25 bp, Mus musculus
catttgtaaccctggacctcggaag

SEQ ID NO: 419772 - DNA, 25 bp, Mus musculus
catttgtaccgatcagctaggcttg

SEQ ID NO: 419773 - DNA, 25 bp, Mus musculus
catttgtagagagaggcagttccag

SEQ ID NO: 419774 - DNA, 25 bp, Mus musculus
catttgtagggaagatctggctcac

SEQ ID NO: 419775 - DNA, 25 bp, Mus musculus
catttgtattgtttggcacagtaga

SEQ ID NO: 419776 - DNA, 25 bp, Mus musculus
catttgtccccactctcagaagact

SEQ ID NO: 419777 - DNA, 25 bp, Mus musculus
catttgtcctccttctgccaggcgt

SEQ ID NO: 419778 - DNA, 25 bp, Mus musculus
catttgtgagagtaaaccaagcccc

SEQ ID NO: 419779 - DNA, 25 bp, Mus musculus
catttgtgagcaggaagtatgcctc

SEQ ID NO: 419780 - DNA, 25 bp, Mus musculus
catttgtgaggatgattgctcccga

SEQ ID NO: 419781 - DNA, 25 bp, Mus musculus
catttgtgattccaactagtgggac

SEQ ID NO: 419782 - DNA, 25 bp, Mus musculus
catttgtggtccaagtcacggcgac

SEQ ID NO: 419783 - DNA, 25 bp, Mus musculus
catttgtggtgtttgcatgctcccc

SEQ ID NO: 419784 - DNA, 25 bp, Mus musculus
catttgtgtagcctagagttcagcc

SEQ ID NO: 419785 - DNA, 25 bp, Mus musculus
catttgttgaaaaaagcagagcttc

SEQ ID NO: 419786 - DNA, 25 bp, Mus musculus
cattttaaccgggtgcagtgggcgt

SEQ ID NO: 419787 - DNA, 25 bp, Mus musculus
cattttaagagtagtagtgtcttcc

SEQ ID NO: 419788 - DNA, 25 bp, Mus musculus
cattttaaggaggatatgggcagcc

SEQ ID NO: 419789 - DNA, 25 bp, Mus musculus
cattttaattgtccatgcatgcagg

SEQ ID NO: 419790 - DNA, 25 bp, Mus musculus
cattttaccatcatgactttaaaga

SEQ ID NO: 419791 - DNA, 25 bp, Mus musculus
cattttaccgctgtggtatccgtag

SEQ ID NO: 419792 - DNA, 25 bp, Mus musculus
cattttagaccctcccttgtagtag

SEQ ID NO: 419793 - DNA, 25 bp, Mus musculus
cattttagagcgacatcacctggaa

SEQ ID NO: 419794 - DNA, 25 bp, Mus musculus
cattttagatcagtctgcagtgtgg

SEQ ID NO: 419795 - DNA, 25 bp, Mus musculus
cattttagctaccaggaaccagtga

SEQ ID NO: 419796 - DNA, 25 bp, Mus musculus
cattttagggaaagatggccttgcc

SEQ ID NO: 419797 - DNA, 25 bp, Mus musculus
cattttagtcatcggcgtctgcacc

SEQ ID NO: 419798 - DNA, 25 bp, Mus musculus
cattttagtcattgaagtaacagct

SEQ ID NO: 419799 - DNA, 25 bp, Mus musculus
cattttagtgtaggcgccgtgctcg

SEQ ID NO: 419800 - DNA, 25 bp, Mus musculus
cattttataatgaagcctggtccac

SEQ ID NO: 419801 - DNA, 25 bp, Mus musculus
cattttatgccaagaagtgacagaa

SEQ ID NO: 419802 - DNA, 25 bp, Mus musculus
cattttatttactgacaactgtgaa

SEQ ID NO: 419803 - DNA, 25 bp, Mus musculus
cattttcaaacaggccatgaggcac

SEQ ID NO: 419804 - DNA, 25 bp, Mus musculus
cattttcaaacggaaggactgaagc

SEQ ID NO: 419805 - DNA, 25 bp, Mus musculus
cattttcaaggtctcccaagtttct

SEQ ID NO: 419806 - DNA, 25 bp, Mus musculus
cattttcaagttgggaactccctga

SEQ ID NO: 419807 - DNA, 25 bp, Mus musculus
cattttcacacatggtcagctggga

SEQ ID NO: 419808 - DNA, 25 bp, Mus musculus
cattttcacagcaaagaaggtgacg

SEQ ID NO: 419809 - DNA, 25 bp, Mus musculus
cattttcagccaccagagcgagtcg

SEQ ID NO: 419810 - DNA, 25 bp, Mus musculus
cattttcagggcaacatgaggacca

SEQ ID NO: 419811 - DNA, 25 bp, Mus musculus
cattttcattgcagaggcagtgggc

SEQ ID NO: 419812 - DNA, 25 bp, Mus musculus
cattttccactggaggcagcacctg

SEQ ID NO: 419813 - DNA, 25 bp, Mus musculus
cattttccagacagaggatcccgat

SEQ ID NO: 419814 - DNA, 25 bp, Mus musculus
cattttcccaggcaagggttgcaac

SEQ ID NO: 419815 - DNA, 25 bp, Mus musculus
cattttcccctggtctggtgtttgg

SEQ ID NO: 419816 - DNA, 25 bp, Mus musculus
cattttcccgctgagatgataccgg

SEQ ID NO: 419817 - DNA, 25 bp, Mus musculus
cattttccgcacaagacagaggcta

SEQ ID NO: 419818 - DNA, 25 bp, Mus musculus
cattttccggacagcatccatggtg

SEQ ID NO: 419819 - DNA, 25 bp, Mus musculus
cattttcctgacactgcagaatgga

SEQ ID NO: 419820 - DNA, 25 bp, Mus musculus
cattttcctggtggactgtcgctac

SEQ ID NO: 419821 - DNA, 25 bp, Mus musculus
cattttcgagtgaaggacccggagc

SEQ ID NO: 419822 - DNA, 25 bp, Mus musculus
cattttcggtcctctttggcgagca

SEQ ID NO: 419823 - DNA, 25 bp, Mus musculus
cattttcgtagtgacagagcattga

SEQ ID NO: 419824 - DNA, 25 bp, Mus musculus
cattttctcgcctaacatggcagtg

SEQ ID NO: 419825 - DNA, 25 bp, Mus musculus
cattttctgatattgctgcctcgga

SEQ ID NO: 419826 - DNA, 25 bp, Mus musculus
cattttctggaaagtctgctgggca

SEQ ID NO: 419827 - DNA, 25 bp, Mus musculus
cattttgcttcctaaccagagggtc

SEQ ID NO: 419828 - DNA, 25 bp, Mus musculus
cattttggacatggattctggaacc

SEQ ID NO: 419829 - DNA, 25 bp, Mus musculus
cattttggatgattcactggacttc

SEQ ID NO: 419830 - DNA, 25 bp, Mus musculus
cattttggcaacgactgggaggacc

SEQ ID NO: 419831 - DNA, 25 bp, Mus musculus
cattttggctatggccgaggccctg

SEQ ID NO: 419832 - DNA, 25 bp, Mus musculus
cattttgggaattctgtcagcgagg

SEQ ID NO: 419833 - DNA, 25 bp, Mus musculus
cattttggtagtgcctcctctggag

SEQ ID NO: 419834 - DNA, 25 bp, Mus musculus
cattttgtggcaagagttcggaacc

SEQ ID NO: 419835 - DNA, 25 bp, Mus musculus
cattttgtgtgaccacggagctcaa

SEQ ID NO: 419836 - DNA, 25 bp, Mus musculus
cattttgttccctgcagaccccaga

SEQ ID NO: 419837 - DNA, 25 bp, Mus musculus
catttttacgaggtgcacctgggcc

SEQ ID NO: 419838 - DNA, 25 bp, Mus musculus
catttttagtgaaaggaagcctgga

SEQ ID NO: 419839 - DNA, 25 bp, Mus musculus
catttttattgctggtaccctgtta

SEQ ID NO: 419840 - DNA, 25 bp, Mus musculus
catttttcatctctgcaaatacaag

SEQ ID NO: 419841 - DNA, 25 bp, Mus musculus
catttttcgatgaattgcgggaccc

SEQ ID NO: 419842 - DNA, 25 bp, Mus musculus
catttttgacagtttgcgaggcagc

SEQ ID NO: 419843 - DNA, 25 bp, Mus musculus
catttttgcaagattatgacacagc

SEQ ID NO: 419844 - DNA, 25 bp, Mus musculus
catttttggaagcaacatttaccag

SEQ ID NO: 419845 - DNA, 25 bp, Mus musculus
catttttggacgttggaagagctca

SEQ ID NO: 419846 - DNA, 25 bp, Mus musculus
catttttggtcatccttgagctagg

SEQ ID NO: 419847 - DNA, 25 bp, Mus musculus
cattttttgggcaaggaatgaatgc

SEQ ID NO: 419848 - DNA, 25 bp, Mus musculus
ccaaaaacagtgaagtcccaagatt

SEQ ID NO: 419849 - DNA, 25 bp, Mus musculus
ccaaaaacagttttagaggcagtct

SEQ ID NO: 419850 - DNA, 25 bp, Mus musculus
ccaaaaagacagaaggtgaacacag

SEQ ID NO: 419851 - DNA, 25 bp, Mus musculus
ccaaaaatctatgagaggcctgggc

SEQ ID NO: 419852 - DNA, 25 bp, Mus musculus
ccaaaagacgaagctgtgggtgccc

SEQ ID NO: 419853 - DNA, 25 bp, Mus musculus
ccaaaagagagactagtggcgcttg

SEQ ID NO: 419854 - DNA, 25 bp, Mus musculus
ccaaaaggaagaacatggcgcgcag

SEQ ID NO: 419855 - DNA, 25 bp, Mus musculus
ccaaaaggacgtgtagaggccttca

SEQ ID NO: 419856 - DNA, 25 bp, Mus musculus
ccaaaaggcttgtctggtgaccaag

SEQ ID NO: 419857 - DNA, 25 bp, Mus musculus
ccaaaagtgaaagtgagaggctgcc

SEQ ID NO: 419858 - DNA, 25 bp, Mus musculus
ccaaaagtggcaaggacgtcttcct

SEQ ID NO: 419859 - DNA, 25 bp, Mus musculus
ccaaaatagttgacagcgggcctgc

SEQ ID NO: 419860 - DNA, 25 bp, Mus musculus
ccaaaatggcagtgtaagtaccaac

SEQ ID NO: 419861 - DNA, 25 bp, Mus musculus
ccaaaatgggaaggtcagctgactc

SEQ ID NO: 419862 - DNA, 25 bp, Mus musculus
ccaaaatgggacagagaggaggctc

SEQ ID NO: 419863 - DNA, 25 bp, Mus musculus
ccaaaatgtacggtctgaagagcta

SEQ ID NO: 419864 - DNA, 25 bp, Mus musculus
ccaaaattgatcaaagactggacca

SEQ ID NO: 419865 - DNA, 25 bp, Mus musculus
ccaaacaacgatggagagaggctct

SEQ ID NO: 419866 - DNA, 25 bp, Mus musculus
ccaaacaaggaacggagtgagcagc

SEQ ID NO: 419867 - DNA, 25 bp, Mus musculus
ccaaacagaggagagacatgcggct

SEQ ID NO: 419868 - DNA, 25 bp, Mus musculus
ccaaacaggaaagcgaagacagaag

SEQ ID NO: 419869 - DNA, 25 bp, Mus musculus
ccaaacatgaaagggacaggcgaac

SEQ ID NO: 419870 - DNA, 25 bp, Mus musculus
ccaaacatgtggcacttcctgcagc

SEQ ID NO: 419871 - DNA, 25 bp, Mus musculus
ccaaacccacgcaggtcaaagaagc

SEQ ID NO: 419872 - DNA, 25 bp, Mus musculus
ccaaacccgagtaagtaatgtcaca

SEQ ID NO: 419873 - DNA, 25 bp, Mus musculus
ccaaaccgtggaggaaaacagcgat

SEQ ID NO: 419874 - DNA, 25 bp, Mus musculus
ccaaacgacaggttcagtgaagtac

SEQ ID NO: 419875 - DNA, 25 bp, Mus musculus
ccaaacgagttatgagggacccaag

SEQ ID NO: 419876 - DNA, 25 bp, Mus musculus
ccaaacgtagtcagggaggccagta

SEQ ID NO: 419877 - DNA, 25 bp, Mus musculus
ccaaacgtggtgaaagacatcagca

SEQ ID NO: 419878 - DNA, 25 bp, Mus musculus
ccaaactctcgaatcaaaggtgcaa

SEQ ID NO: 419879 - DNA, 25 bp, Mus musculus
ccaaactctctaggctttgctgctg

SEQ ID NO: 419880 - DNA, 25 bp, Mus musculus
ccaaactgcttggtgctgaagagaa

SEQ ID NO: 419881 - DNA, 25 bp, Mus musculus
ccaaactgtctaaggaggcggccgt

SEQ ID NO: 419882 - DNA, 25 bp, Mus musculus
ccaaagaaccctgcagaagaaaaga

SEQ ID NO: 419883 - DNA, 25 bp, Mus musculus
ccaaagactttgctcacgggtacag

SEQ ID NO: 419884 - DNA, 25 bp, Mus musculus
ccaaagagcagaaggcgttgcgcct

SEQ ID NO: 419885 - DNA, 25 bp, Mus musculus
ccaaagatccacgaaggcaagcagt

SEQ ID NO: 419886 - DNA, 25 bp, Mus musculus
ccaaagatcttgtgtacctggaatc

SEQ ID NO: 419887 - DNA, 25 bp, Mus musculus
ccaaagatgaccgactgaagttaag

SEQ ID NO: 419888 - DNA, 25 bp, Mus musculus
ccaaagatgcaaataggagcgccca

SEQ ID NO: 419889 - DNA, 25 bp, Mus musculus
ccaaagcagacatggcggacatttt

SEQ ID NO: 419890 - DNA, 25 bp, Mus musculus
ccaaagccaaggtgccttataagcc

SEQ ID NO: 419891 - DNA, 25 bp, Mus musculus
ccaaagccagctgaatggaggcgac

SEQ ID NO: 419892 - DNA, 25 bp, Mus musculus
ccaaagccagcttgagggtgataac

SEQ ID NO: 419893 - DNA, 25 bp, Mus musculus
ccaaagccatgggaggtgtgccctc

SEQ ID NO: 419894 - DNA, 25 bp, Mus musculus
ccaaagcccggttttgtgagaggat

SEQ ID NO: 419895 - DNA, 25 bp, Mus musculus
ccaaagccgccttagtgaagagcag

SEQ ID NO: 419896 - DNA, 25 bp, Mus musculus
ccaaagcctaatgcggagaatgcca

SEQ ID NO: 419897 - DNA, 25 bp, Mus musculus
ccaaagcggatcagggagggatacc

SEQ ID NO: 419898 - DNA, 25 bp, Mus musculus
ccaaagcgtgtctaatcctgagaag

SEQ ID NO: 419899 - DNA, 25 bp, Mus musculus
ccaaagctagggtctttgttatata

SEQ ID NO: 419900 - DNA, 25 bp, Mus musculus
ccaaagctggaggaaagccgcagat

SEQ ID NO: 419901 - DNA, 25 bp, Mus musculus
ccaaagctggattctgcggtgtaca

SEQ ID NO: 419902 - DNA, 25 bp, Mus musculus
ccaaagctgggagcagggtcctctt

SEQ ID NO: 419903 - DNA, 25 bp, Mus musculus
ccaaagcttgctgggttcggcgcga

SEQ ID NO: 419904 - DNA, 25 bp, Mus musculus
ccaaagctttctggaggtgaacaac

SEQ ID NO: 419905 - DNA, 25 bp, Mus musculus
ccaaaggaagccaggccggcaagac

SEQ ID NO: 419906 - DNA, 25 bp, Mus musculus
ccaaaggactgggtgcactgatgca

SEQ ID NO: 419907 - DNA, 25 bp, Mus musculus
ccaaaggagagacggttcaagctct

SEQ ID NO: 419908 - DNA, 25 bp, Mus musculus
ccaaaggccatgctaattgcagaga

SEQ ID NO: 419909 - DNA, 25 bp, Mus musculus
ccaaagggacgcatttctgaggata

SEQ ID NO: 419910 - DNA, 25 bp, Mus musculus
ccaaagggactgtggtgatgatacc

SEQ ID NO: 419911 - DNA, 25 bp, Mus musculus
ccaaagggctatgcgaagacgagtc

SEQ ID NO: 419912 - DNA, 25 bp, Mus musculus
ccaaagggttcaggaagaaggcgct

SEQ ID NO: 419913 - DNA, 25 bp, Mus musculus
ccaaaggtcagatgcctcagttcca

SEQ ID NO: 419914 - DNA, 25 bp, Mus musculus
ccaaaggtcaggatgcaggcactat

SEQ ID NO: 419915 - DNA, 25 bp, Mus musculus
ccaaaggtgtacagccgggcattgt

SEQ ID NO: 419916 - DNA, 25 bp, Mus musculus
ccaaaggttgcatgtggtagcagaa

SEQ ID NO: 419917 - DNA, 25 bp, Mus musculus
ccaaagtagtaaggacaagtcgcct

SEQ ID NO: 419918 - DNA, 25 bp, Mus musculus
ccaaagtagtggaaaaaggatgtct

SEQ ID NO: 419919 - DNA, 25 bp, Mus musculus
ccaaagtagtttgtattactgatag

SEQ ID NO: 419920 - DNA, 25 bp, Mus musculus
ccaaagtctgacatggatgcagaag

SEQ ID NO: 419921 - DNA, 25 bp, Mus musculus
ccaaagtctggttttgctgtggatg

SEQ ID NO: 419922 - DNA, 25 bp, Mus musculus
ccaaagtgttactaatggtaaagag

SEQ ID NO: 419923 - DNA, 25 bp, Mus musculus
ccaaagtgttattctccggcgctat

SEQ ID NO: 419924 - DNA, 25 bp, Mus musculus
ccaaagttccggctccagtggctgt

SEQ ID NO: 419925 - DNA, 25 bp, Mus musculus
ccaaagttctggctcagtggcaaca

SEQ ID NO: 419926 - DNA, 25 bp, Mus musculus
ccaaagtttccaggcaggtggtcca

SEQ ID NO: 419927 - DNA, 25 bp, Mus musculus
ccaaataatgggagatgtgcactgt

SEQ ID NO: 419928 - DNA, 25 bp, Mus musculus
ccaaatacatttcggacggccagtg

SEQ ID NO: 419929 - DNA, 25 bp, Mus musculus
ccaaatagatggaaccggcgataac

SEQ ID NO: 419930 - DNA, 25 bp, Mus musculus
ccaaatagctatagaggctgtgaac

SEQ ID NO: 419931 - DNA, 25 bp, Mus musculus
ccaaatatgcggtggattgcccgga

SEQ ID NO: 419932 - DNA, 25 bp, Mus musculus
ccaaatcaagaagatgccgcaattg

SEQ ID NO: 419933 - DNA, 25 bp, Mus musculus
ccaaatcatagtggccaactcaaag

SEQ ID NO: 419934 - DNA, 25 bp, Mus musculus
ccaaatcttcctgctagggctaggg

SEQ ID NO: 419935 - DNA, 25 bp, Mus musculus
ccaaatgacagtatgaccacaggca

SEQ ID NO: 419936 - DNA, 25 bp, Mus musculus
ccaaatgccctgtgcaaaacccagt

SEQ ID NO: 419937 - DNA, 25 bp, Mus musculus
ccaaatgctgagttgatgtcatccc

SEQ ID NO: 419938 - DNA, 25 bp, Mus musculus
ccaaatggcatcctgactgagtaca

SEQ ID NO: 419939 - DNA, 25 bp, Mus musculus
ccaaatgggaaactatgtaggtgtg

SEQ ID NO: 419940 - DNA, 25 bp, Mus musculus
ccaaatgggtgaaagcagcgatcaa

SEQ ID NO: 419941 - DNA, 25 bp, Mus musculus
ccaaattatacgacatggatggaca

SEQ ID NO: 419942 - DNA, 25 bp, Mus musculus
ccaaattcctgaggcgctgggagcc

SEQ ID NO: 419943 - DNA, 25 bp, Mus musculus
ccaaattgcataattgctacaggag

SEQ ID NO: 419944 - DNA, 25 bp, Mus musculus
ccaacaaattgaaggagcggaggct

SEQ ID NO: 419945 - DNA, 25 bp, Mus musculus
ccaacaagctaggatttcaaggcct

SEQ ID NO: 419946 - DNA, 25 bp, Mus musculus
ccaacaaggtggagacgtacaaaga

SEQ ID NO: 419947 - DNA, 25 bp, Mus musculus
ccaacaatcagtggcaggagcgcag

SEQ ID NO: 419948 - DNA, 25 bp, Mus musculus
ccaacaatgtggcagaaggctacag

SEQ ID NO: 419949 - DNA, 25 bp, Mus musculus
ccaacacaagtcaactgcaagagag

SEQ ID NO: 419950 - DNA, 25 bp, Mus musculus
ccaacaccatggatagagctgacac

SEQ ID NO: 419951 - DNA, 25 bp, Mus musculus
ccaacactggtgctcggatcatgat

SEQ ID NO: 419952 - DNA, 25 bp, Mus musculus
ccaacagagcgaagaggtggccaac

SEQ ID NO: 419953 - DNA, 25 bp, Mus musculus
ccaacagcgacagtggagaagagct

SEQ ID NO: 419954 - DNA, 25 bp, Mus musculus
ccaacagcgagggtgagcaagagta

SEQ ID NO: 419955 - DNA, 25 bp, Mus musculus
ccaacagtagaatgaagtggttccc

SEQ ID NO: 419956 - DNA, 25 bp, Mus musculus
ccaacagtaggagatgggcaggcca

SEQ ID NO: 419957 - DNA, 25 bp, Mus musculus
ccaacagtgtgtggtctcaagttag

SEQ ID NO: 419958 - DNA, 25 bp, Mus musculus
ccaacatccaagtgccagcggtggt

SEQ ID NO: 419959 - DNA, 25 bp, Mus musculus
ccaacatcctttctcgaagctactt

SEQ ID NO: 419960 - DNA, 25 bp, Mus musculus
ccaacatgaaagtggtgcggctgtc

SEQ ID NO: 419961 - DNA, 25 bp, Mus musculus
ccaacatgttgccttctcagaacta

SEQ ID NO: 419962 - DNA, 25 bp, Mus musculus
ccaacattcgcgagaggaagaggat

SEQ ID NO: 419963 - DNA, 25 bp, Mus musculus
ccaacatttgacgtgtgtgacacca

SEQ ID NO: 419964 - DNA, 25 bp, Mus musculus
ccaaccaaaccgcattcgtgtggat

SEQ ID NO: 419965 - DNA, 25 bp, Mus musculus
ccaaccaaagtctaactgtaggaag

SEQ ID NO: 419966 - DNA, 25 bp, Mus musculus
ccaaccagttgtgacgtccatggag

SEQ ID NO: 419967 - DNA, 25 bp, Mus musculus
ccaaccccaagtcgagcttctggaa

SEQ ID NO: 419968 - DNA, 25 bp, Mus musculus
ccaaccctagatcggattctgaacc

SEQ ID NO: 419969 - DNA, 25 bp, Mus musculus
ccaaccggctggtggagtccatgaa

SEQ ID NO: 419970 - DNA, 25 bp, Mus musculus
ccaacctaagggtgcaatggcagtg

SEQ ID NO: 419971 - DNA, 25 bp, Mus musculus
ccaacctgaactggctgcatgagag

SEQ ID NO: 419972 - DNA, 25 bp, Mus musculus
ccaacctggtgtgggagcacaagca

SEQ ID NO: 419973 - DNA, 25 bp, Mus musculus
ccaacctgtgtggatccagggcaca

SEQ ID NO: 419974 - DNA, 25 bp, Mus musculus
ccaacgcgcgcaaatacaaaggcgg

SEQ ID NO: 419975 - DNA, 25 bp, Mus musculus
ccaacggttcctctacgagaagcag

SEQ ID NO: 419976 - DNA, 25 bp, Mus musculus
ccaacgtgcaggtgactaggctgac

SEQ ID NO: 419977 - DNA, 25 bp, Mus musculus
ccaactaatgggtttcactgtagaa

SEQ ID NO: 419978 - DNA, 25 bp, Mus musculus
ccaactacgagaggctatcacacag

SEQ ID NO: 419979 - DNA, 25 bp, Mus musculus
ccaactagtgtgaaagatgatgacc

SEQ ID NO: 419980 - DNA, 25 bp, Mus musculus
ccaactatgggctgtaggctcctaa

SEQ ID NO: 419981 - DNA, 25 bp, Mus musculus
ccaactgcagcaagggtgacaataa

SEQ ID NO: 419982 - DNA, 25 bp, Mus musculus
ccaactgcgcgatggaacaaaacgc

SEQ ID NO: 419983 - DNA, 25 bp, Mus musculus
ccaactggcgtatagatagtattcg

SEQ ID NO: 419984 - DNA, 25 bp, Mus musculus
ccaactgggatcatacagagggaca

SEQ ID NO: 419985 - DNA, 25 bp, Mus musculus
ccaactggtagtatctgctgctgca

SEQ ID NO: 419986 - DNA, 25 bp, Mus musculus
ccaactggtccagagggagctacct

SEQ ID NO: 419987 - DNA, 25 bp, Mus musculus
ccaactggtcggaggatcttatgct

SEQ ID NO: 419988 - DNA, 25 bp, Mus musculus
ccaactgtaggatgtgagactttcc

SEQ ID NO: 419989 - DNA, 25 bp, Mus musculus
ccaactgtatgcaggtgaggacaag

SEQ ID NO: 419990 - DNA, 25 bp, Mus musculus
ccaactgtgagtacctcgggcgggt

SEQ ID NO: 419991 - DNA, 25 bp, Mus musculus
ccaactgtgatctcaggcggcaaat

SEQ ID NO: 419992 - DNA, 25 bp, Mus musculus
ccaactgtgatggttacgccggcct

SEQ ID NO: 419993 - DNA, 25 bp, Mus musculus
ccaacttcaagatagagcctccggg

SEQ ID NO: 419994 - DNA, 25 bp, Mus musculus
ccaacttctgcggtgggctacaaga

SEQ ID NO: 419995 - DNA, 25 bp, Mus musculus
ccaactttctcagtagaggaggagc

SEQ ID NO: 419996 - DNA, 25 bp, Mus musculus
ccaactttgaggagcacaggtcaca

SEQ ID NO: 419997 - DNA, 25 bp, Mus musculus
ccaagaaaaggacactgaaggcatc

SEQ ID NO: 419998 - DNA, 25 bp, Mus musculus
ccaagaacgcttccgaagcctgagg

SEQ ID NO: 419999 - DNA, 25 bp, Mus musculus
ccaagaagaaaagggtcacacgcgt

SEQ ID NO: 420000 - DNA, 25 bp, Mus musculus
ccaagaagaagtgggtccaggatgc

SEQ ID NO: 420001 - DNA, 25 bp, Mus musculus
ccaagaagaatccaagcgagggcgt

SEQ ID NO: 420002 - DNA, 25 bp, Mus musculus
ccaagaagactcgagtgaagctgcc

SEQ ID NO: 420003 - DNA, 25 bp, Mus musculus
ccaagaagagtctaggcaacaggcc

SEQ ID NO: 420004 - DNA, 25 bp, Mus musculus
ccaagaagcagaactaatgtcgtca

SEQ ID NO: 420005 - DNA, 25 bp, Mus musculus
ccaagaagctcctcatatgcaggaa

SEQ ID NO: 420006 - DNA, 25 bp, Mus musculus
ccaagaaggttttctgacgtgaatc

SEQ ID NO: 420007 - DNA, 25 bp, Mus musculus
ccaagaagttggttgtggccacaga

SEQ ID NO: 420008 - DNA, 25 bp, Mus musculus
ccaagaagttgttgcagaggtccac

SEQ ID NO: 420009 - DNA, 25 bp, Mus musculus
ccaagaatgtccgtgctcgtgctcg

SEQ ID NO: 420010 - DNA, 25 bp, Mus musculus
ccaagaattgctgggtcctctaacc

SEQ ID NO: 420011 - DNA, 25 bp, Mus musculus
ccaagacagctttggactccatgca

SEQ ID NO: 420012 - DNA, 25 bp, Mus musculus
ccaagaccttgggaagatcgcggtt

SEQ ID NO: 420013 - DNA, 25 bp, Mus musculus
ccaagacggatctctcaggacagga

SEQ ID NO: 420014 - DNA, 25 bp, Mus musculus
ccaagacgggctcgagaagtcttct

SEQ ID NO: 420015 - DNA, 25 bp, Mus musculus
ccaagactcctaatctgttcctttt

SEQ ID NO: 420016 - DNA, 25 bp, Mus musculus
ccaagactgaccaaggtgagaggca

SEQ ID NO: 420017 - DNA, 25 bp, Mus musculus
ccaagactgagctggttacggtcca

SEQ ID NO: 420018 - DNA, 25 bp, Mus musculus
ccaagacttgcaaagacgggacaag

SEQ ID NO: 420019 - DNA, 25 bp, Mus musculus
ccaagagacagagctccacaagcat

SEQ ID NO: 420020 - DNA, 25 bp, Mus musculus
ccaagagattggcactcagtgactc

SEQ ID NO: 420021 - DNA, 25 bp, Mus musculus
ccaagagcactcctttaggagttaa

SEQ ID NO: 420022 - DNA, 25 bp, Mus musculus
ccaagaggaaacttgggctctgtgg

SEQ ID NO: 420023 - DNA, 25 bp, Mus musculus
ccaagaggctcactgaaaacagagg

SEQ ID NO: 420024 - DNA, 25 bp, Mus musculus
ccaagaggctgggttggtagtccac

SEQ ID NO: 420025 - DNA, 25 bp, Mus musculus
ccaagaggctttgagctgtctagca

SEQ ID NO: 420026 - DNA, 25 bp, Mus musculus
ccaagagggacgtgtatcaggagcc

SEQ ID NO: 420027 - DNA, 25 bp, Mus musculus
ccaagaggtactagtggtgttaagt

SEQ ID NO: 420028 - DNA, 25 bp, Mus musculus
ccaagagtgtggttcctggtacagc

SEQ ID NO: 420029 - DNA, 25 bp, Mus musculus
ccaagagtgtttccaaagtggccct

SEQ ID NO: 420030 - DNA, 25 bp, Mus musculus
ccaagagttctgcagcctatgtggg

SEQ ID NO: 420031 - DNA, 25 bp, Mus musculus
ccaagataaagcagtatgggtgtgc

SEQ ID NO: 420032 - DNA, 25 bp, Mus musculus
ccaagatccagagcatgagagacca

SEQ ID NO: 420033 - DNA, 25 bp, Mus musculus
ccaagatctttgagcgggtgaggca

SEQ ID NO: 420034 - DNA, 25 bp, Mus musculus
ccaagatgatgattaggcccaagaa

SEQ ID NO: 420035 - DNA, 25 bp, Mus musculus
ccaagatgcagctagaggacaggcg

SEQ ID NO: 420036 - DNA, 25 bp, Mus musculus
ccaagatgcgtatcaggtcactgct

SEQ ID NO: 420037 - DNA, 25 bp, Mus musculus
ccaagatggcgtcgtggctgccgga

SEQ ID NO: 420038 - DNA, 25 bp, Mus musculus
ccaagatgtcggaccacagggagag

SEQ ID NO: 420039 - DNA, 25 bp, Mus musculus
ccaagatgtgggttgactcgggaac

SEQ ID NO: 420040 - DNA, 25 bp, Mus musculus
ccaagattaagcaagaggcggtccc

SEQ ID NO: 420041 - DNA, 25 bp, Mus musculus
ccaagattcacaagggaactgcaca

SEQ ID NO: 420042 - DNA, 25 bp, Mus musculus
ccaagattgaactttgtgaagagcg

SEQ ID NO: 420043 - DNA, 25 bp, Mus musculus
ccaagattgcctgaggagcatcgct

SEQ ID NO: 420044 - DNA, 25 bp, Mus musculus
ccaagcaaattagggacagcatgac

SEQ ID NO: 420045 - DNA, 25 bp, Mus musculus
ccaagcaagagtggagtgttaacca

SEQ ID NO: 420046 - DNA, 25 bp, Mus musculus
ccaagcaagccagataatgacagac

SEQ ID NO: 420047 - DNA, 25 bp, Mus musculus
ccaagcagaattgtgcgggcccata

SEQ ID NO: 420048 - DNA, 25 bp, Mus musculus
ccaagcagagttagaggcagattta

SEQ ID NO: 420049 - DNA, 25 bp, Mus musculus
ccaagcagcacttcccaggagaagc

SEQ ID NO: 420050 - DNA, 25 bp, Mus musculus
ccaagcaggagtcaaacgagtaccg

SEQ ID NO: 420051 - DNA, 25 bp, Mus musculus
ccaagcaggtgctgaaaggctcgcg

SEQ ID NO: 420052 - DNA, 25 bp, Mus musculus
ccaagcagtgttcaggaggactcca

SEQ ID NO: 420053 - DNA, 25 bp, Mus musculus
ccaagcatttgtgggtgagctagcc

SEQ ID NO: 420054 - DNA, 25 bp, Mus musculus
ccaagccctatttttctctgctttg

SEQ ID NO: 420055 - DNA, 25 bp, Mus musculus
ccaagcctcagatggacctgagggt

SEQ ID NO: 420056 - DNA, 25 bp, Mus musculus
ccaagcctgagaggaaagtcaccat

SEQ ID NO: 420057 - DNA, 25 bp, Mus musculus
ccaagcctggtgatccgagttcgat

SEQ ID NO: 420058 - DNA, 25 bp, Mus musculus
ccaagcgacggaggaattagccatc

SEQ ID NO: 420059 - DNA, 25 bp, Mus musculus
ccaagcggagaaactttgaagctgt

SEQ ID NO: 420060 - DNA, 25 bp, Mus musculus
ccaagcggaggcattcgtgcgcaga

SEQ ID NO: 420061 - DNA, 25 bp, Mus musculus
ccaagctatgaagtccgagggaggc

SEQ ID NO: 420062 - DNA, 25 bp, Mus musculus
ccaagctcagaagcaaggaagcttg

SEQ ID NO: 420063 - DNA, 25 bp, Mus musculus
ccaagctcatcgtggtggtgcgcga

SEQ ID NO: 420064 - DNA, 25 bp, Mus musculus
ccaagctcctctatggaaacagaag

SEQ ID NO: 420065 - DNA, 25 bp, Mus musculus
ccaagctgcgaatagagaaggccat

SEQ ID NO: 420066 - DNA, 25 bp, Mus musculus
ccaagctgctctcggtcgtggttgt

SEQ ID NO: 420067 - DNA, 25 bp, Mus musculus
ccaagctgctgtgggttcagaggca

SEQ ID NO: 420068 - DNA, 25 bp, Mus musculus
ccaagctggaacttactatggagcc

SEQ ID NO: 420069 - DNA, 25 bp, Mus musculus
ccaagctggacactaggatgcctct

SEQ ID NO: 420070 - DNA, 25 bp, Mus musculus
ccaagctgggatgtcgctcacgtgt

SEQ ID NO: 420071 - DNA, 25 bp, Mus musculus
ccaagctgggtcactacatggccat

SEQ ID NO: 420072 - DNA, 25 bp, Mus musculus
ccaagctggtcaccttgtgggacag

SEQ ID NO: 420073 - DNA, 25 bp, Mus musculus
ccaagctgtgcaaggactgtaaggt

SEQ ID NO: 420074 - DNA, 25 bp, Mus musculus
ccaagctgtgggatgcgagactacc

SEQ ID NO: 420075 - DNA, 25 bp, Mus musculus
ccaagcttgctacgacttctctgta

SEQ ID NO: 420076 - DNA, 25 bp, Mus musculus
ccaagctttgcgctgagacctgaaa

SEQ ID NO: 420077 - DNA, 25 bp, Mus musculus
ccaagcttttactctgggtctggga

SEQ ID NO: 420078 - DNA, 25 bp, Mus musculus
ccaaggaaaaatgctgggtcaacct

SEQ ID NO: 420079 - DNA, 25 bp, Mus musculus
ccaaggaactgggatttcaatttga

SEQ ID NO: 420080 - DNA, 25 bp, Mus musculus
ccaaggaaggactaggcactgccat

SEQ ID NO: 420081 - DNA, 25 bp, Mus musculus
ccaaggaagtagcagagcacactct

SEQ ID NO: 420082 - DNA, 25 bp, Mus musculus
ccaaggaagttctagctgaggccta

SEQ ID NO: 420083 - DNA, 25 bp, Mus musculus
ccaaggaatactgcaagggagggac

SEQ ID NO: 420084 - DNA, 25 bp, Mus musculus
ccaaggacctggcatcaagagatgt

SEQ ID NO: 420085 - DNA, 25 bp, Mus musculus
ccaaggacttgggacttcctagagt

SEQ ID NO: 420086 - DNA, 25 bp, Mus musculus
ccaaggagacaatgagaggaatatt

SEQ ID NO: 420087 - DNA, 25 bp, Mus musculus
ccaaggagatgcctacagccccata

SEQ ID NO: 420088 - DNA, 25 bp, Mus musculus
ccaaggagctgtgggaccagttcca

SEQ ID NO: 420089 - DNA, 25 bp, Mus musculus
ccaaggaggtaagcaaagctggtag

SEQ ID NO: 420090 - DNA, 25 bp, Mus musculus
ccaaggaggtttcagctgagcatgc

SEQ ID NO: 420091 - DNA, 25 bp, Mus musculus
ccaaggagtttgtgagacatcataa

SEQ ID NO: 420092 - DNA, 25 bp, Mus musculus
ccaaggatctgacttagcatggcag

SEQ ID NO: 420093 - DNA, 25 bp, Mus musculus
ccaaggatgcatttctaaggacaag

SEQ ID NO: 420094 - DNA, 25 bp, Mus musculus
ccaaggcagagtaaaggtcctaggt

SEQ ID NO: 420095 - DNA, 25 bp, Mus musculus
ccaaggcaggccaggtgggtgatgc

SEQ ID NO: 420096 - DNA, 25 bp, Mus musculus
ccaaggccaccttgtaagaaggagg

SEQ ID NO: 420097 - DNA, 25 bp, Mus musculus
ccaaggcctgttcagtctggagaca

SEQ ID NO: 420098 - DNA, 25 bp, Mus musculus
ccaaggccttgctcgtggaagggtt

SEQ ID NO: 420099 - DNA, 25 bp, Mus musculus
ccaaggcgaacagggaactttagag

SEQ ID NO: 420100 - DNA, 25 bp, Mus musculus
ccaaggcgcaaagggagctgctgtc

SEQ ID NO: 420101 - DNA, 25 bp, Mus musculus
ccaaggcggaggaagagttcaacat

SEQ ID NO: 420102 - DNA, 25 bp, Mus musculus
ccaaggcggatatttttagacagga

SEQ ID NO: 420103 - DNA, 25 bp, Mus musculus
ccaaggctaagggtaacgtgctgct

SEQ ID NO: 420104 - DNA, 25 bp, Mus musculus
ccaaggctagtgtcgctgctgtcag

SEQ ID NO: 420105 - DNA, 25 bp, Mus musculus
ccaaggctcaaccaagaaaggctag

SEQ ID NO: 420106 - DNA, 25 bp, Mus musculus
ccaaggctccggtttctggagagga

SEQ ID NO: 420107 - DNA, 25 bp, Mus musculus
ccaaggctcgcgacactaaggtatt

SEQ ID NO: 420108 - DNA, 25 bp, Mus musculus
ccaaggctggcactatttggcagca

SEQ ID NO: 420109 - DNA, 25 bp, Mus musculus
ccaaggctggtggaagcagtctgct

SEQ ID NO: 420110 - DNA, 25 bp, Mus musculus
ccaaggcttgatgctgaatgggctt

SEQ ID NO: 420111 - DNA, 25 bp, Mus musculus
ccaagggatcacattttaggagcag

SEQ ID NO: 420112 - DNA, 25 bp, Mus musculus
ccaagggatcagaattgtgtcagtg

SEQ ID NO: 420113 - DNA, 25 bp, Mus musculus
ccaagggcctcatggatgctggaca

SEQ ID NO: 420114 - DNA, 25 bp, Mus musculus
ccaagggctctctgaaggacatcta

SEQ ID NO: 420115 - DNA, 25 bp, Mus musculus
ccaagggtcaaagcccatggcaaga

SEQ ID NO: 420116 - DNA, 25 bp, Mus musculus
ccaagggtgaaggttggctagccct

SEQ ID NO: 420117 - DNA, 25 bp, Mus musculus
ccaagggtgactaccagaaggcact

SEQ ID NO: 420118 - DNA, 25 bp, Mus musculus
ccaagggtgtatccaagaaagagag

SEQ ID NO: 420119 - DNA, 25 bp, Mus musculus
ccaaggtcatctgacgggtggagac

SEQ ID NO: 420120 - DNA, 25 bp, Mus musculus
ccaaggtcatgctggattttccaaa

SEQ ID NO: 420121 - DNA, 25 bp, Mus musculus
ccaaggtcctgagagtgatgctact

SEQ ID NO: 420122 - DNA, 25 bp, Mus musculus
ccaaggtctagctagtgggttgaaa

SEQ ID NO: 420123 - DNA, 25 bp, Mus musculus
ccaaggtcttcgtggatgcccggga

SEQ ID NO: 420124 - DNA, 25 bp, Mus musculus
ccaaggtctttttgtgcagggccca

SEQ ID NO: 420125 - DNA, 25 bp, Mus musculus
ccaaggttaaactcgctcactgcta

SEQ ID NO: 420126 - DNA, 25 bp, Mus musculus
ccaaggttcttatctacagaagcca

SEQ ID NO: 420127 - DNA, 25 bp, Mus musculus
ccaaggttgtccgtgatcactcaga

SEQ ID NO: 420128 - DNA, 25 bp, Mus musculus
ccaagtaatgaattctcaacagaca

SEQ ID NO: 420129 - DNA, 25 bp, Mus musculus
ccaagtacgagcaacagagctatga

SEQ ID NO: 420130 - DNA, 25 bp, Mus musculus
ccaagtacttggaaaggacggtgct

SEQ ID NO: 420131 - DNA, 25 bp, Mus musculus
ccaagtagacataaggatggagggc

SEQ ID NO: 420132 - DNA, 25 bp, Mus musculus
ccaagtagctattatgtttccaacc

SEQ ID NO: 420133 - DNA, 25 bp, Mus musculus
ccaagtaggtctccccgaggcagag

SEQ ID NO: 420134 - DNA, 25 bp, Mus musculus
ccaagtaggtgagaggcgaccatgt

SEQ ID NO: 420135 - DNA, 25 bp, Mus musculus
ccaagtatggtgtgcagctgtgtgc

SEQ ID NO: 420136 - DNA, 25 bp, Mus musculus
ccaagtcacatgctgggtgtagcta

SEQ ID NO: 420137 - DNA, 25 bp, Mus musculus
ccaagtcaggccagagatggattct

SEQ ID NO: 420138 - DNA, 25 bp, Mus musculus
ccaagtcatcgtacagagggttcta

SEQ ID NO: 420139 - DNA, 25 bp, Mus musculus
ccaagtccgacgagaagggcaatca

SEQ ID NO: 420140 - DNA, 25 bp, Mus musculus
ccaagtcctcgagggttttcagaat

SEQ ID NO: 420141 - DNA, 25 bp, Mus musculus
ccaagtcctgtcaggatgggcagag

SEQ ID NO: 420142 - DNA, 25 bp, Mus musculus
ccaagtctcctgtggtataaaacca

SEQ ID NO: 420143 - DNA, 25 bp, Mus musculus
ccaagtctgtctgcgagggctgtca

SEQ ID NO: 420144 - DNA, 25 bp, Mus musculus
ccaagtgacgctccccagcagtgtg

SEQ ID NO: 420145 - DNA, 25 bp, Mus musculus
ccaagtgacggtccccgagtgtgaa

SEQ ID NO: 420146 - DNA, 25 bp, Mus musculus
ccaagtgccaaacggtctccaagga

SEQ ID NO: 420147 - DNA, 25 bp, Mus musculus
ccaagtgccgcgtacaaagggatcc

SEQ ID NO: 420148 - DNA, 25 bp, Mus musculus
ccaagtgctttggtacctagtactg

SEQ ID NO: 420149 - DNA, 25 bp, Mus musculus
ccaagtggaaagtgctcgtaccgga

SEQ ID NO: 420150 - DNA, 25 bp, Mus musculus
ccaagtggactgtgtccgggccaat

SEQ ID NO: 420151 - DNA, 25 bp, Mus musculus
ccaagtggagacgacagaagcgatc

SEQ ID NO: 420152 - DNA, 25 bp, Mus musculus
ccaagtgggctcacaagagtacagc

SEQ ID NO: 420153 - DNA, 25 bp, Mus musculus
ccaagtggtgcagtggttcatagac

SEQ ID NO: 420154 - DNA, 25 bp, Mus musculus
ccaagtggttccatagtggcagata

SEQ ID NO: 420155 - DNA, 25 bp, Mus musculus
ccaagtgtgcggaaggacatacagc

SEQ ID NO: 420156 - DNA, 25 bp, Mus musculus
ccaagtgtggaaaggcatgggtttc

SEQ ID NO: 420157 - DNA, 25 bp, Mus musculus
ccaagtgtgggatcgaggcttcccc

SEQ ID NO: 420158 - DNA, 25 bp, Mus musculus
ccaagttacataggtggcccagcaa

SEQ ID NO: 420159 - DNA, 25 bp, Mus musculus
ccaagttaggaggtcagagtggcct

SEQ ID NO: 420160 - DNA, 25 bp, Mus musculus
ccaagttatatggtgcacaaggaac

SEQ ID NO: 420161 - DNA, 25 bp, Mus musculus
ccaagttcccagaggagggcatctc

SEQ ID NO: 420162 - DNA, 25 bp, Mus musculus
ccaagttcctagattaaagtcatgc

SEQ ID NO: 420163 - DNA, 25 bp, Mus musculus
ccaagttcgggaggcaatggctgaa

SEQ ID NO: 420164 - DNA, 25 bp, Mus musculus
ccaataaagatgctcaaggtagctg

SEQ ID NO: 420165 - DNA, 25 bp, Mus musculus
ccaataactgaagggcggacatgac

SEQ ID NO: 420166 - DNA, 25 bp, Mus musculus
ccaataagaggaggatagcgatgca

SEQ ID NO: 420167 - DNA, 25 bp, Mus musculus
ccaataagcaacatgtaagatgtca

SEQ ID NO: 420168 - DNA, 25 bp, Mus musculus
ccaataagtggtatgaggaggtccg

SEQ ID NO: 420169 - DNA, 25 bp, Mus musculus
ccaatacgaacaggaggataagaag

SEQ ID NO: 420170 - DNA, 25 bp, Mus musculus
ccaataggctctttgcagagaacac

SEQ ID NO: 420171 - DNA, 25 bp, Mus musculus
ccaatagggcctgagcaagtcaagc

SEQ ID NO: 420172 - DNA, 25 bp, Mus musculus
ccaatagtcaacagagccagagcag

SEQ ID NO: 420173 - DNA, 25 bp, Mus musculus
ccaatagttactggcggattcgcgg

SEQ ID NO: 420174 - DNA, 25 bp, Mus musculus
ccaatataaggtggagggcttccct

SEQ ID NO: 420175 - DNA, 25 bp, Mus musculus
ccaatatgaacagcgtgggccctgg

SEQ ID NO: 420176 - DNA, 25 bp, Mus musculus
ccaatatgacttctggaccaagcgt

SEQ ID NO: 420177 - DNA, 25 bp, Mus musculus
ccaatcagccaactcctcggaaagt

SEQ ID NO: 420178 - DNA, 25 bp, Mus musculus
ccaatccagttgaggtgggcggcct

SEQ ID NO: 420179 - DNA, 25 bp, Mus musculus
ccaatctaagagtttctgggcttgg

SEQ ID NO: 420180 - DNA, 25 bp, Mus musculus
ccaatctcatgggaagagtgatgca

SEQ ID NO: 420181 - DNA, 25 bp, Mus musculus
ccaatctgtttgagaatgcgggcga

SEQ ID NO: 420182 - DNA, 25 bp, Mus musculus
ccaatgaaagggtcagggctcacag

SEQ ID NO: 420183 - DNA, 25 bp, Mus musculus
ccaatgaatagacagatcggcgatt

SEQ ID NO: 420184 - DNA, 25 bp, Mus musculus
ccaatgacaacggaggcaagatgct

SEQ ID NO: 420185 - DNA, 25 bp, Mus musculus
ccaatgaccgggagctgagcttcct

SEQ ID NO: 420186 - DNA, 25 bp, Mus musculus
ccaatgactcggaatgacggatgat

SEQ ID NO: 420187 - DNA, 25 bp, Mus musculus
ccaatgagatttgaagagtttctaa

SEQ ID NO: 420188 - DNA, 25 bp, Mus musculus
ccaatgaggccaagggagctgagtc

SEQ ID NO: 420189 - DNA, 25 bp, Mus musculus
ccaatgaggtgtatgagctggtgca

SEQ ID NO: 420190 - DNA, 25 bp, Mus musculus
ccaatgatgcacttctgccccagag

SEQ ID NO: 420191 - DNA, 25 bp, Mus musculus
ccaatgatggaataggagcctctcc

SEQ ID NO: 420192 - DNA, 25 bp, Mus musculus
ccaatgcagaagtgagcgtcccagt

SEQ ID NO: 420193 - DNA, 25 bp, Mus musculus
ccaatgcccgagatgagtccaagaa

SEQ ID NO: 420194 - DNA, 25 bp, Mus musculus
ccaatgctgaggtgggcccgttcat

SEQ ID NO: 420195 - DNA, 25 bp, Mus musculus
ccaatggagggtactgtgtcagagc

SEQ ID NO: 420196 - DNA, 25 bp, Mus musculus
ccaatgggtatcagctgggcaagac

SEQ ID NO: 420197 - DNA, 25 bp, Mus musculus
ccaatggtgagtggacgctctgtta

SEQ ID NO: 420198 - DNA, 25 bp, Mus musculus
ccaatggtggctgggaaactttcct

SEQ ID NO: 420199 - DNA, 25 bp, Mus musculus
ccaatggtgtgaagagaagtgaact

SEQ ID NO: 420200 - DNA, 25 bp, Mus musculus
ccaatgtaggccgagagtgctgcct

SEQ ID NO: 420201 - DNA, 25 bp, Mus musculus
ccaatgtcttctgtggtggccccgg

SEQ ID NO: 420202 - DNA, 25 bp, Mus musculus
ccaatgtgcatgtgtggtttcctac

SEQ ID NO: 420203 - DNA, 25 bp, Mus musculus
ccaatgtggtcggatgggcccctga

SEQ ID NO: 420204 - DNA, 25 bp, Mus musculus
ccaatgttcggttgggaggctccga

SEQ ID NO: 420205 - DNA, 25 bp, Mus musculus
ccaatgttttgaactggcgggcact

SEQ ID NO: 420206 - DNA, 25 bp, Mus musculus
ccaattactggtgaaagagtcctca

SEQ ID NO: 420207 - DNA, 25 bp, Mus musculus
ccaattagacaatcgtggaaacgtg

SEQ ID NO: 420208 - DNA, 25 bp, Mus musculus
ccaattaggaccaaggcagcctgca

SEQ ID NO: 420209 - DNA, 25 bp, Mus musculus
ccaattatcttgcttttgtgtgagg

SEQ ID NO: 420210 - DNA, 25 bp, Mus musculus
ccaattcctgttcatttttgagaca

SEQ ID NO: 420211 - DNA, 25 bp, Mus musculus
ccaattctagtatactgaaggagta

SEQ ID NO: 420212 - DNA, 25 bp, Mus musculus
ccaattcttggacaggaacgagtgc

SEQ ID NO: 420213 - DNA, 25 bp, Mus musculus
ccaattgccagtgaggatgaaacct

SEQ ID NO: 420214 - DNA, 25 bp, Mus musculus
ccaattggccaaggaggatactggg

SEQ ID NO: 420215 - DNA, 25 bp, Mus musculus
ccaattgtcgggtcgctctaagaaa

SEQ ID NO: 420216 - DNA, 25 bp, Mus musculus
ccaattgtgttagcaggaaagacca

SEQ ID NO: 420217 - DNA, 25 bp, Mus musculus
ccaatttcggcaggactcagtccag

SEQ ID NO: 420218 - DNA, 25 bp, Mus musculus
ccaatttctatagcacggtgggcag

SEQ ID NO: 420219 - DNA, 25 bp, Mus musculus
ccacaaagagagtagccgggttgac

SEQ ID NO: 420220 - DNA, 25 bp, Mus musculus
ccacaaaggtggcatcagtatacat

SEQ ID NO: 420221 - DNA, 25 bp, Mus musculus
ccacaagagtttatgaaagggcatg

SEQ ID NO: 420222 - DNA, 25 bp, Mus musculus
ccacaaggaaagagaccgctgcgtt

SEQ ID NO: 420223 - DNA, 25 bp, Mus musculus
ccacaaggagtggaagagcctgtct

SEQ ID NO: 420224 - DNA, 25 bp, Mus musculus
ccacaatgtgatgggtgacttccgc

SEQ ID NO: 420225 - DNA, 25 bp, Mus musculus
ccacacaaaaataaaaagtgactga

SEQ ID NO: 420226 - DNA, 25 bp, Mus musculus
ccacacaaggagctgcggttcatca

SEQ ID NO: 420227 - DNA, 25 bp, Mus musculus
ccacacaatgcagggaggagctgga

SEQ ID NO: 420228 - DNA, 25 bp, Mus musculus
ccacacatacaatgggacactggtt

SEQ ID NO: 420229 - DNA, 25 bp, Mus musculus
ccacacatgtggaagggtagaaact

SEQ ID NO: 420230 - DNA, 25 bp, Mus musculus
ccacacggagatcccagaaggaatt

SEQ ID NO: 420231 - DNA, 25 bp, Mus musculus
ccacactaattagcccggagtggaa

SEQ ID NO: 420232 - DNA, 25 bp, Mus musculus
ccacactatggagcatgaggacgtc

SEQ ID NO: 420233 - DNA, 25 bp, Mus musculus
ccacactgtctggagtaggagctgc

SEQ ID NO: 420234 - DNA, 25 bp, Mus musculus
ccacagaaagtgattgagcaaaatg

SEQ ID NO: 420235 - DNA, 25 bp, Mus musculus
ccacagaagggcagagacgctgatt

SEQ ID NO: 420236 - DNA, 25 bp, Mus musculus
ccacagaagtgacggagagttttcc

SEQ ID NO: 420237 - DNA, 25 bp, Mus musculus
ccacagaataattggaaagattagg

SEQ ID NO: 420238 - DNA, 25 bp, Mus musculus
ccacagacttggctggagttctaca

SEQ ID NO: 420239 - DNA, 25 bp, Mus musculus
ccacagagaacatttaggtcgcttc

SEQ ID NO: 420240 - DNA, 25 bp, Mus musculus
ccacagagactgatggcctgaccag

SEQ ID NO: 420241 - DNA, 25 bp, Mus musculus
ccacagaggcgaatgagagcgagct

SEQ ID NO: 420242 - DNA, 25 bp, Mus musculus
ccacagatccttgtacagtacttag

SEQ ID NO: 420243 - DNA, 25 bp, Mus musculus
ccacagcaaggacggcagagattat

SEQ ID NO: 420244 - DNA, 25 bp, Mus musculus
ccacagcagtctaaagttgattgag

SEQ ID NO: 420245 - DNA, 25 bp, Mus musculus
ccacagcatatgtgaccagcctggg

SEQ ID NO: 420246 - DNA, 25 bp, Mus musculus
ccacagcatgcatttgagtgagtgc

SEQ ID NO: 420247 - DNA, 25 bp, Mus musculus
ccacagcccaacatttagacggagc

SEQ ID NO: 420248 - DNA, 25 bp, Mus musculus
ccacagcgatttaaggccaagtcaa

SEQ ID NO: 420249 - DNA, 25 bp, Mus musculus
ccacagcggcgtcgaagaagattcg

SEQ ID NO: 420250 - DNA, 25 bp, Mus musculus
ccacaggagcgtgcatgcagaacta

SEQ ID NO: 420251 - DNA, 25 bp, Mus musculus
ccacaggcacagttttagggcttgc

SEQ ID NO: 420252 - DNA, 25 bp, Mus musculus
ccacaggcaggcgttgcttaacgat

SEQ ID NO: 420253 - DNA, 25 bp, Mus musculus
ccacaggcgcatccctagtagggct

SEQ ID NO: 420254 - DNA, 25 bp, Mus musculus
ccacagggattgacagtgccagcca

SEQ ID NO: 420255 - DNA, 25 bp, Mus musculus
ccacaggtaaatcagcagttggtac

SEQ ID NO: 420256 - DNA, 25 bp, Mus musculus
ccacaggtactagggtgcagcggaa

SEQ ID NO: 420257 - DNA, 25 bp, Mus musculus
ccacaggtatgtgcctgggattctg

SEQ ID NO: 420258 - DNA, 25 bp, Mus musculus
ccacaggtctattttccggagcaaa

SEQ ID NO: 420259 - DNA, 25 bp, Mus musculus
ccacagtataagaaggtgagctaaa

SEQ ID NO: 420260 - DNA, 25 bp, Mus musculus
ccacagtatgttctctttgcatatc

SEQ ID NO: 420261 - DNA, 25 bp, Mus musculus
ccacagtgcctattttcaggtctga

SEQ ID NO: 420262 - DNA, 25 bp, Mus musculus
ccacagtggaaaaggtcaagtctag

SEQ ID NO: 420263 - DNA, 25 bp, Mus musculus
ccacagtggagaacaagacgggatc

SEQ ID NO: 420264 - DNA, 25 bp, Mus musculus
ccacagtggtagttgtgggaccctc

SEQ ID NO: 420265 - DNA, 25 bp, Mus musculus
ccacagtggtcctgggaagtactgg

SEQ ID NO: 420266 - DNA, 25 bp, Mus musculus
ccacagtgtcagagactgaagctac

SEQ ID NO: 420267 - DNA, 25 bp, Mus musculus
ccacatagtaggaacacgggaggat

SEQ ID NO: 420268 - DNA, 25 bp, Mus musculus
ccacatcctggtgagctgagcagag

SEQ ID NO: 420269 - DNA, 25 bp, Mus musculus
ccacatcgtgtacaaggagggtcag

SEQ ID NO: 420270 - DNA, 25 bp, Mus musculus
ccacatgatggagaagacaccttaa

SEQ ID NO: 420271 - DNA, 25 bp, Mus musculus
ccacattcgtggtgctaagcatcag

SEQ ID NO: 420272 - DNA, 25 bp, Mus musculus
ccacattgatggtcgggaggaaagc

SEQ ID NO: 420273 - DNA, 25 bp, Mus musculus
ccacattgtgcttactgatgagcca

SEQ ID NO: 420274 - DNA, 25 bp, Mus musculus
ccacatttgtgtcagagggatcttt

SEQ ID NO: 420275 - DNA, 25 bp, Mus musculus
ccaccaacgggtggaattccttcat

SEQ ID NO: 420276 - DNA, 25 bp, Mus musculus
ccaccaaggactgaagatctgtacc

SEQ ID NO: 420277 - DNA, 25 bp, Mus musculus
ccaccaatgggatgaggcatagtct

SEQ ID NO: 420278 - DNA, 25 bp, Mus musculus
ccaccacggtgagtggccgggttca

SEQ ID NO: 420279 - DNA, 25 bp, Mus musculus
ccaccactggtagatgatgacttcc

SEQ ID NO: 420280 - DNA, 25 bp, Mus musculus
ccaccactgtgatgttagagcggaa

SEQ ID NO: 420281 - DNA, 25 bp, Mus musculus
ccaccacttcacagaagtggttttt

SEQ ID NO: 420282 - DNA, 25 bp, Mus musculus
ccaccagctgagtttgcattcttct

SEQ ID NO: 420283 - DNA, 25 bp, Mus musculus
ccaccagtacatggagggcttcaag

SEQ ID NO: 420284 - DNA, 25 bp, Mus musculus
ccaccagtgcgtttgagattgagcg

SEQ ID NO: 420285 - DNA, 25 bp, Mus musculus
ccaccatccgtgagaagagggcaaa

SEQ ID NO: 420286 - DNA, 25 bp, Mus musculus
ccaccatggcgtattagaggcagca

SEQ ID NO: 420287 - DNA, 25 bp, Mus musculus
ccaccattagaaacatagttacaga

SEQ ID NO: 420288 - DNA, 25 bp, Mus musculus
ccaccattcgagacttcgccgagga

SEQ ID NO: 420289 - DNA, 25 bp, Mus musculus
ccaccattgtgtaggcatgcatgta

SEQ ID NO: 420290 - DNA, 25 bp, Mus musculus
ccacccaggcaaacatactcgaatg

SEQ ID NO: 420291 - DNA, 25 bp, Mus musculus
ccacccaggtccaagtatgagccag

SEQ ID NO: 420292 - DNA, 25 bp, Mus musculus
ccacccagttttggaggaggctgta

SEQ ID NO: 420293 - DNA, 25 bp, Mus musculus
ccaccccttgaatcagaagctgctg

SEQ ID NO: 420294 - DNA, 25 bp, Mus musculus
ccacccgtgtggtaggaggctatct

SEQ ID NO: 420295 - DNA, 25 bp, Mus musculus
ccaccgacgtggttgaagagaacac

SEQ ID NO: 420296 - DNA, 25 bp, Mus musculus
ccaccgccgagtgagactgaggact

SEQ ID NO: 420297 - DNA, 25 bp, Mus musculus
ccaccgcgagtggaaaacggagatg

SEQ ID NO: 420298 - DNA, 25 bp, Mus musculus
ccaccgcggcggagccaatttggga

SEQ ID NO: 420299 - DNA, 25 bp, Mus musculus
ccaccgggacaatgacaggcgtaat

SEQ ID NO: 420300 - DNA, 25 bp, Mus musculus
ccaccgtgatgaactacaaggagtc

SEQ ID NO: 420301 - DNA, 25 bp, Mus musculus
ccaccgtggtgaatgatgagcgctt

SEQ ID NO: 420302 - DNA, 25 bp, Mus musculus
ccacctgaccggttagctgaacggg

SEQ ID NO: 420303 - DNA, 25 bp, Mus musculus
ccacctgagcggttgttgcaaagct

SEQ ID NO: 420304 - DNA, 25 bp, Mus musculus
ccacctgagtgtggacgtggtcttg

SEQ ID NO: 420305 - DNA, 25 bp, Mus musculus
ccacctgctcggactgagaaaactc

SEQ ID NO: 420306 - DNA, 25 bp, Mus musculus
ccacctggaggcaaagtcactattc

SEQ ID NO: 420307 - DNA, 25 bp, Mus musculus
ccacctggaggttcagtataaagct

SEQ ID NO: 420308 - DNA, 25 bp, Mus musculus
ccacctggagtgaagtgagcctgta

SEQ ID NO: 420309 - DNA, 25 bp, Mus musculus
ccacctgggcatctgaggacctttt

SEQ ID NO: 420310 - DNA, 25 bp, Mus musculus
ccacctgggtgacacagatgggacc

SEQ ID NO: 420311 - DNA, 25 bp, Mus musculus
ccacctgtgttgacgtcctgatgaa

SEQ ID NO: 420312 - DNA, 25 bp, Mus musculus
ccaccttccgttgggaggagattca

SEQ ID NO: 420313 - DNA, 25 bp, Mus musculus
ccaccttgatgacaccttgatgata

SEQ ID NO: 420314 - DNA, 25 bp, Mus musculus
ccaccttgccgagagaagcccaagg

SEQ ID NO: 420315 - DNA, 25 bp, Mus musculus
ccaccttgggatgagatgggagagg

SEQ ID NO: 420316 - DNA, 25 bp, Mus musculus
ccaccttggttggtctgatgtcaga

SEQ ID NO: 420317 - DNA, 25 bp, Mus musculus
ccaccttgtgggtcaggtgacatca

SEQ ID NO: 420318 - DNA, 25 bp, Mus musculus
ccacgacaaggccagggagtatgtt

SEQ ID NO: 420319 - DNA, 25 bp, Mus musculus
ccacgacatggacttcggagagaag

SEQ ID NO: 420320 - DNA, 25 bp, Mus musculus
ccacgacggatcagacccttgaact

SEQ ID NO: 420321 - DNA, 25 bp, Mus musculus
ccacgagtggaaaggtcatcccgac

SEQ ID NO: 420322 - DNA, 25 bp, Mus musculus
ccacgatcatggctgtgcagtttaa

SEQ ID NO: 420323 - DNA, 25 bp, Mus musculus
ccacgatggagttcttgtcacagca

SEQ ID NO: 420324 - DNA, 25 bp, Mus musculus
ccacgcacatggaggaaaagttact

SEQ ID NO: 420325 - DNA, 25 bp, Mus musculus
ccacgcggagtgtgtctggttacca

SEQ ID NO: 420326 - DNA, 25 bp, Mus musculus
ccacgctgtagagcaatgggaacaa

SEQ ID NO: 420327 - DNA, 25 bp, Mus musculus
ccacggactgtgcaaagtgtctgaa

SEQ ID NO: 420328 - DNA, 25 bp, Mus musculus
ccacggagaagaccaggttgagctt

SEQ ID NO: 420329 - DNA, 25 bp, Mus musculus
ccacggagggccaatatgagctgca

SEQ ID NO: 420330 - DNA, 25 bp, Mus musculus
ccacggatgagcctagagtttgcca

SEQ ID NO: 420331 - DNA, 25 bp, Mus musculus
ccacgggagttatcatgagcgtcaa

SEQ ID NO: 420332 - DNA, 25 bp, Mus musculus
ccacgggctcgctgttaattgaaaa

SEQ ID NO: 420333 - DNA, 25 bp, Mus musculus
ccacgggcttttggcagtgtagcca

SEQ ID NO: 420334 - DNA, 25 bp, Mus musculus
ccacggtacagtggcccgaggaatt

SEQ ID NO: 420335 - DNA, 25 bp, Mus musculus
ccacggtcaaggaggcaatcagttc

SEQ ID NO: 420336 - DNA, 25 bp, Mus musculus
ccacggtctttctacttcctgcggg

SEQ ID NO: 420337 - DNA, 25 bp, Mus musculus
ccacggtgagagcttatggaaccaa

SEQ ID NO: 420338 - DNA, 25 bp, Mus musculus
ccacggtggcttctgtcccaaggaa

SEQ ID NO: 420339 - DNA, 25 bp, Mus musculus
ccacggtgtgaagggctgaagcaaa

SEQ ID NO: 420340 - DNA, 25 bp, Mus musculus
ccacggttgaagcaggagaacccca

SEQ ID NO: 420341 - DNA, 25 bp, Mus musculus
ccacgtacatgggagtgcaaaggcc

SEQ ID NO: 420342 - DNA, 25 bp, Mus musculus
ccacgtccatgggtcaagccggttt

SEQ ID NO: 420343 - DNA, 25 bp, Mus musculus
ccacgtgctcaagaagaaaggctac

SEQ ID NO: 420344 - DNA, 25 bp, Mus musculus
ccacgtggccgttggtgtgaactgt

SEQ ID NO: 420345 - DNA, 25 bp, Mus musculus
ccactaagctctaccaaatggcaag

SEQ ID NO: 420346 - DNA, 25 bp, Mus musculus
ccactacacagagggagctgagttg

SEQ ID NO: 420347 - DNA, 25 bp, Mus musculus
ccactacagaggttggagttcctta

SEQ ID NO: 420348 - DNA, 25 bp, Mus musculus
ccactacctgggtgcgctggagcgc

SEQ ID NO: 420349 - DNA, 25 bp, Mus musculus
ccactactattatggcggcggcagt

SEQ ID NO: 420350 - DNA, 25 bp, Mus musculus
ccactaggccccaaagattcttttg

SEQ ID NO: 420351 - DNA, 25 bp, Mus musculus
ccactatagtccttagtgtaaagtg

SEQ ID NO: 420352 - DNA, 25 bp, Mus musculus
ccactatggccgaggaagaatctgc

SEQ ID NO: 420353 - DNA, 25 bp, Mus musculus
ccactatgggactggatacagacac

SEQ ID NO: 420354 - DNA, 25 bp, Mus musculus
ccactcacctaagacagtagggaga

SEQ ID NO: 420355 - DNA, 25 bp, Mus musculus
ccactcaggtggacggttcagcgaa

SEQ ID NO: 420356 - DNA, 25 bp, Mus musculus
ccactcatcatccaagggcggtggg

SEQ ID NO: 420357 - DNA, 25 bp, Mus musculus
ccactcggtcctgggaaaatgggca

SEQ ID NO: 420358 - DNA, 25 bp, Mus musculus
ccactctgatgctacatttatgcca

SEQ ID NO: 420359 - DNA, 25 bp, Mus musculus
ccactctggtggctgaaagctaagt

SEQ ID NO: 420360 - DNA, 25 bp, Mus musculus
ccactgacctcataggtaagggcat

SEQ ID NO: 420361 - DNA, 25 bp, Mus musculus
ccactgacgcggatgagggatacaa

SEQ ID NO: 420362 - DNA, 25 bp, Mus musculus
ccactgactacaagaggagcaaccc

SEQ ID NO: 420363 - DNA, 25 bp, Mus musculus
ccactgagagtataaggtccatgct

SEQ ID NO: 420364 - DNA, 25 bp, Mus musculus
ccactgaggctggactaaggattgg

SEQ ID NO: 420365 - DNA, 25 bp, Mus musculus
ccactgcctactaacaccaagaggg

SEQ ID NO: 420366 - DNA, 25 bp, Mus musculus
ccactgctatgggtacttccggaag

SEQ ID NO: 420367 - DNA, 25 bp, Mus musculus
ccactgctgttttggctgggaagaa

SEQ ID NO: 420368 - DNA, 25 bp, Mus musculus
ccactggagaacaaggagaaggaga

SEQ ID NO: 420369 - DNA, 25 bp, Mus musculus
ccactggagaatgtcttagaaatcc

SEQ ID NO: 420370 - DNA, 25 bp, Mus musculus
ccactggattagtgactgccatgct

SEQ ID NO: 420371 - DNA, 25 bp, Mus musculus
ccactgggcaaagccagtgtagcct

SEQ ID NO: 420372 - DNA, 25 bp, Mus musculus
ccactgggtctggttctcgcttagt

SEQ ID NO: 420373 - DNA, 25 bp, Mus musculus
ccactggtcggcctgtgtgccgtat

SEQ ID NO: 420374 - DNA, 25 bp, Mus musculus
ccactggtctttaattacgccactt

SEQ ID NO: 420375 - DNA, 25 bp, Mus musculus
ccactggtggcatagggacattact

SEQ ID NO: 420376 - DNA, 25 bp, Mus musculus
ccactgtgggcggaactgttcactg

SEQ ID NO: 420377 - DNA, 25 bp, Mus musculus
ccactgtttcactgagaagagccaa

SEQ ID NO: 420378 - DNA, 25 bp, Mus musculus
ccacttcaaatctgggtccttggag

SEQ ID NO: 420379 - DNA, 25 bp, Mus musculus
ccacttcatggtgtgatctcggcat

SEQ ID NO: 420380 - DNA, 25 bp, Mus musculus
ccacttccgccgtggcgcggcgagt

SEQ ID NO: 420381 - DNA, 25 bp, Mus musculus
ccacttccgggtggtgatcgtggac

SEQ ID NO: 420382 - DNA, 25 bp, Mus musculus
ccacttctccaaaagctgcagaggg

SEQ ID NO: 420383 - DNA, 25 bp, Mus musculus
ccacttctttgcatgtgagccagca

SEQ ID NO: 420384 - DNA, 25 bp, Mus musculus
ccacttgcctgggtgtgatgcacac

SEQ ID NO: 420385 - DNA, 25 bp, Mus musculus
ccacttgcgattgggaaatggtccc

SEQ ID NO: 420386 - DNA, 25 bp, Mus musculus
ccacttgggtgaaggcagctcagac

SEQ ID NO: 420387 - DNA, 25 bp, Mus musculus
ccacttgtgccggtggctccagagg

SEQ ID NO: 420388 - DNA, 25 bp, Mus musculus
ccactttcgaaagggatggtgaagt

SEQ ID NO: 420389 - DNA, 25 bp, Mus musculus
ccagaaaataggtcccatgggccac

SEQ ID NO: 420390 - DNA, 25 bp, Mus musculus
ccagaaaatgcatcgcacaagttag

SEQ ID NO: 420391 - DNA, 25 bp, Mus musculus
ccagaaaccagtcgctatgcagtga

SEQ ID NO: 420392 - DNA, 25 bp, Mus musculus
ccagaaacccttgcgcgcgtttgta

SEQ ID NO: 420393 - DNA, 25 bp, Mus musculus
ccagaaagaagccataagagagccc

SEQ ID NO: 420394 - DNA, 25 bp, Mus musculus
ccagaaagacctggcaggctgtagt

SEQ ID NO: 420395 - DNA, 25 bp, Mus musculus
ccagaaagccaagatgaaggccatc

SEQ ID NO: 420396 - DNA, 25 bp, Mus musculus
ccagaaaggcttatcagacagcagt

SEQ ID NO: 420397 - DNA, 25 bp, Mus musculus
ccagaaaggtacaacggagacaatg

SEQ ID NO: 420398 - DNA, 25 bp, Mus musculus
ccagaaagtgtctcctgttcagaaa

SEQ ID NO: 420399 - DNA, 25 bp, Mus musculus
ccagaaataagggagctcttgaccc

SEQ ID NO: 420400 - DNA, 25 bp, Mus musculus
ccagaaatccaaggatggcagttga

SEQ ID NO: 420401 - DNA, 25 bp, Mus musculus
ccagaacagtttaatggacagaaca

SEQ ID NO: 420402 - DNA, 25 bp, Mus musculus
ccagaaccatgtgtgcggagcggct

SEQ ID NO: 420403 - DNA, 25 bp, Mus musculus
ccagaaccggctacagaagatcatg

SEQ ID NO: 420404 - DNA, 25 bp, Mus musculus
ccagaaccgggtcatcatgatttga

SEQ ID NO: 420405 - DNA, 25 bp, Mus musculus
ccagaacgcaggttaagaggctccc

SEQ ID NO: 420406 - DNA, 25 bp, Mus musculus
ccagaactgcaagggaatcgacatc

SEQ ID NO: 420407 - DNA, 25 bp, Mus musculus
ccagaactgcgtagatgcgtacccc

SEQ ID NO: 420408 - DNA, 25 bp, Mus musculus
ccagaactgtgtggagctagactcg

SEQ ID NO: 420409 - DNA, 25 bp, Mus musculus
ccagaagaatatgtgagcaggccat

SEQ ID NO: 420410 - DNA, 25 bp, Mus musculus
ccagaagagaatctaaggaaggcca

SEQ ID NO: 420411 - DNA, 25 bp, Mus musculus
ccagaagagcgcagtgaagccatca

SEQ ID NO: 420412 - DNA, 25 bp, Mus musculus
ccagaagagttcagaggcgacctta

SEQ ID NO: 420413 - DNA, 25 bp, Mus musculus
ccagaagatggttggctaggcagca

SEQ ID NO: 420414 - DNA, 25 bp, Mus musculus
ccagaagcaaagacacgggggctac

SEQ ID NO: 420415 - DNA, 25 bp, Mus musculus
ccagaagccgaacaagtgagagtaa

SEQ ID NO: 420416 - DNA, 25 bp, Mus musculus
ccagaagcctcaagatagtacggag

SEQ ID NO: 420417 - DNA, 25 bp, Mus musculus
ccagaaggagccaagaaggttcgtc

SEQ ID NO: 420418 - DNA, 25 bp, Mus musculus
ccagaagggagattgaccgtgacca

SEQ ID NO: 420419 - DNA, 25 bp, Mus musculus
ccagaaggttagtgggtcatctgat

SEQ ID NO: 420420 - DNA, 25 bp, Mus musculus
ccagaagtacttggcttcggcggag

SEQ ID NO: 420421 - DNA, 25 bp, Mus musculus
ccagaagtatacagtgacctcaaca

SEQ ID NO: 420422 - DNA, 25 bp, Mus musculus
ccagaagtcacggatagggaaggcc

SEQ ID NO: 420423 - DNA, 25 bp, Mus musculus
ccagaagtcttgctctaaggtgact

SEQ ID NO: 420424 - DNA, 25 bp, Mus musculus
ccagaagtgccttagtggagacatt

SEQ ID NO: 420425 - DNA, 25 bp, Mus musculus
ccagaagtgtgtcctgtgtacatca

SEQ ID NO: 420426 - DNA, 25 bp, Mus musculus
ccagaagtgtttggtcccagcagca

SEQ ID NO: 420427 - DNA, 25 bp, Mus musculus
ccagaatcaagatcactgagctaaa

SEQ ID NO: 420428 - DNA, 25 bp, Mus musculus
ccagaatcagttgcctcttgtgagg

SEQ ID NO: 420429 - DNA, 25 bp, Mus musculus
ccagaatgaaaagcacgccagtgtc

SEQ ID NO: 420430 - DNA, 25 bp, Mus musculus
ccagaatggacgaacacgggtttat

SEQ ID NO: 420431 - DNA, 25 bp, Mus musculus
ccagaatggtagaaaatttgtcacc

SEQ ID NO: 420432 - DNA, 25 bp, Mus musculus
ccagaatggtgctgcagatgtccca

SEQ ID NO: 420433 - DNA, 25 bp, Mus musculus
ccagaatgttggattagtgagaaag

SEQ ID NO: 420434 - DNA, 25 bp, Mus musculus
ccagaattcctagcctttgagtcag

SEQ ID NO: 420435 - DNA, 25 bp, Mus musculus
ccagacaaagagtccctgaacctgt

SEQ ID NO: 420436 - DNA, 25 bp, Mus musculus
ccagacaacggtgagctgctatgtg

SEQ ID NO: 420437 - DNA, 25 bp, Mus musculus
ccagacaaggatagataggaagacc

SEQ ID NO: 420438 - DNA, 25 bp, Mus musculus
ccagacaatcctatgcagcaactag

SEQ ID NO: 420439 - DNA, 25 bp, Mus musculus
ccagacactaagatgtaggtaggga

SEQ ID NO: 420440 - DNA, 25 bp, Mus musculus
ccagacactgtctggatccagtgaa

SEQ ID NO: 420441 - DNA, 25 bp, Mus musculus
ccagacagcaggttctctagacagc

SEQ ID NO: 420442 - DNA, 25 bp, Mus musculus
ccagacaggaggatgaaagacagcc

SEQ ID NO: 420443 - DNA, 25 bp, Mus musculus
ccagacagggcgctgatgttttgaa

SEQ ID NO: 420444 - DNA, 25 bp, Mus musculus
ccagacagttgcctgtatgacctcg

SEQ ID NO: 420445 - DNA, 25 bp, Mus musculus
ccagacatgataagaggccaggaaa

SEQ ID NO: 420446 - DNA, 25 bp, Mus musculus
ccagacatggcgtttgaggcaatag

SEQ ID NO: 420447 - DNA, 25 bp, Mus musculus
ccagacatgtgtctcttctcttgtc

SEQ ID NO: 420448 - DNA, 25 bp, Mus musculus
ccagacatgttaggaggccagagca

SEQ ID NO: 420449 - DNA, 25 bp, Mus musculus
ccagaccagcaggatcacaaggcat

SEQ ID NO: 420450 - DNA, 25 bp, Mus musculus
ccagaccagcttctaagtaatgacc

SEQ ID NO: 420451 - DNA, 25 bp, Mus musculus
ccagaccctaggattgcctgttaga

SEQ ID NO: 420452 - DNA, 25 bp, Mus musculus
ccagacctccttgaatacatgcaga

SEQ ID NO: 420453 - DNA, 25 bp, Mus musculus
ccagacgacctgtgtgaaatgccca

SEQ ID NO: 420454 - DNA, 25 bp, Mus musculus
ccagacgggttactcatgggacgct

SEQ ID NO: 420455 - DNA, 25 bp, Mus musculus
ccagacgtcgtggtcaggtccttca

SEQ ID NO: 420456 - DNA, 25 bp, Mus musculus
ccagactaggttatgatcgctcaaa

SEQ ID NO: 420457 - DNA, 25 bp, Mus musculus
ccagactcacagtatggtgaactta

SEQ ID NO: 420458 - DNA, 25 bp, Mus musculus
ccagactctgtcctagccaagatga

SEQ ID NO: 420459 - DNA, 25 bp, Mus musculus
ccagacttcacacaggtgctggaag

SEQ ID NO: 420460 - DNA, 25 bp, Mus musculus
ccagacttcgtggaagaccagcaaa

SEQ ID NO: 420461 - DNA, 25 bp, Mus musculus
ccagacttgcaatccatggagcaga

SEQ ID NO: 420462 - DNA, 25 bp, Mus musculus
ccagactttatgaagcccaaggaca

SEQ ID NO: 420463 - DNA, 25 bp, Mus musculus
ccagactttgatggccctcgagaga

SEQ ID NO: 420464 - DNA, 25 bp, Mus musculus
ccagagaaatgaagtcctgagtggt

SEQ ID NO: 420465 - DNA, 25 bp, Mus musculus
ccagagaagtgtcttcggaggctca

SEQ ID NO: 420466 - DNA, 25 bp, Mus musculus
ccagagagcagtttccagaggtcct

SEQ ID NO: 420467 - DNA, 25 bp, Mus musculus
ccagagagctcgtacaagattgaag

SEQ ID NO: 420468 - DNA, 25 bp, Mus musculus
ccagagagggactccaatgagagac

SEQ ID NO: 420469 - DNA, 25 bp, Mus musculus
ccagagagggactttgcagagcatg

SEQ ID NO: 420470 - DNA, 25 bp, Mus musculus
ccagagagggtgtgtacagcatcca

SEQ ID NO: 420471 - DNA, 25 bp, Mus musculus
ccagagaggtgtacggcaaagagcc

SEQ ID NO: 420472 - DNA, 25 bp, Mus musculus
ccagagaggtgtagtaagcctgcat

SEQ ID NO: 420473 - DNA, 25 bp, Mus musculus
ccagagagtcactgaaagcggagct

SEQ ID NO: 420474 - DNA, 25 bp, Mus musculus
ccagagatcggtgcggcagcagctc

SEQ ID NO: 420475 - DNA, 25 bp, Mus musculus
ccagagatctggtgcagttacatct

SEQ ID NO: 420476 - DNA, 25 bp, Mus musculus
ccagagattgtgaggagcccctgac

SEQ ID NO: 420477 - DNA, 25 bp, Mus musculus
ccagagcaaagggaagggaagtctc

SEQ ID NO: 420478 - DNA, 25 bp, Mus musculus
ccagagcaagggagcaggaacaagt

SEQ ID NO: 420479 - DNA, 25 bp, Mus musculus
ccagagcagaagaggttcacatctg

SEQ ID NO: 420480 - DNA, 25 bp, Mus musculus
ccagagcagccaacatgggaaattt

SEQ ID NO: 420481 - DNA, 25 bp, Mus musculus
ccagagcaggattttttgacaagac

SEQ ID NO: 420482 - DNA, 25 bp, Mus musculus
ccagagcagtagtcaatggacaggc

SEQ ID NO: 420483 - DNA, 25 bp, Mus musculus
ccagagcagtctgaaggcacagcaa

SEQ ID NO: 420484 - DNA, 25 bp, Mus musculus
ccagagcagtgattccctacacgtt

SEQ ID NO: 420485 - DNA, 25 bp, Mus musculus
ccagagccgagtgcttgctcgcgat

SEQ ID NO: 420486 - DNA, 25 bp, Mus musculus
ccagagcgcgaaaggacacggagaa

SEQ ID NO: 420487 - DNA, 25 bp, Mus musculus
ccagagcgcttgagttaggttccta

SEQ ID NO: 420488 - DNA, 25 bp, Mus musculus
ccagagctacggaggcggttctagc

SEQ ID NO: 420489 - DNA, 25 bp, Mus musculus
ccagagctatggtgttggccagtca

SEQ ID NO: 420490 - DNA, 25 bp, Mus musculus
ccagagctccctacaaaaatgagtg

SEQ ID NO: 420491 - DNA, 25 bp, Mus musculus
ccagagctggaacttattgccattc

SEQ ID NO: 420492 - DNA, 25 bp, Mus musculus
ccagagctggcaatgcagaaatgcc

SEQ ID NO: 420493 - DNA, 25 bp, Mus musculus
ccagagctgtttattgccaccaaag

SEQ ID NO: 420494 - DNA, 25 bp, Mus musculus
ccagaggaagcaactaccggaggtt

SEQ ID NO: 420495 - DNA, 25 bp, Mus musculus
ccagaggaagcagacttaatgggct

SEQ ID NO: 420496 - DNA, 25 bp, Mus musculus
ccagaggaccgggactcttgccttt

SEQ ID NO: 420497 - DNA, 25 bp, Mus musculus
ccagaggactggaccggtgtttcaa

SEQ ID NO: 420498 - DNA, 25 bp, Mus musculus
ccagaggagctattccgcgaggtca

SEQ ID NO: 420499 - DNA, 25 bp, Mus musculus
ccagaggaggccaggaatcacataa

SEQ ID NO: 420500 - DNA, 25 bp, Mus musculus
ccagaggatctaagcatgatgccca

SEQ ID NO: 420501 - DNA, 25 bp, Mus musculus
ccagaggccagttttcaggacagtg

SEQ ID NO: 420502 - DNA, 25 bp, Mus musculus
ccagaggcctcggatcagacaatga

SEQ ID NO: 420503 - DNA, 25 bp, Mus musculus
ccagaggctgaactaaaccgggtgc

SEQ ID NO: 420504 - DNA, 25 bp, Mus musculus
ccagaggctgaagagtagggttcca

SEQ ID NO: 420505 - DNA, 25 bp, Mus musculus
ccagagggaccattcatcaggcaga

SEQ ID NO: 420506 - DNA, 25 bp, Mus musculus
ccagagggctggacagaactaacca

SEQ ID NO: 420507 - DNA, 25 bp, Mus musculus
ccagaggtatccacggtcaagttcc

SEQ ID NO: 420508 - DNA, 25 bp, Mus musculus
ccagaggtcttgagtcatggcagat

SEQ ID NO: 420509 - DNA, 25 bp, Mus musculus
ccagaggttgtcatctgccatgata

SEQ ID NO: 420510 - DNA, 25 bp, Mus musculus
ccagaggtttgcagtttgagagttc

SEQ ID NO: 420511 - DNA, 25 bp, Mus musculus
ccagagtaagcaggattcagggaga

SEQ ID NO: 420512 - DNA, 25 bp, Mus musculus
ccagagtagtgcgatgggccatcct

SEQ ID NO: 420513 - DNA, 25 bp, Mus musculus
ccagagtatttgtgggaccagcagc

SEQ ID NO: 420514 - DNA, 25 bp, Mus musculus
ccagagtccagagccgggcttggta

SEQ ID NO: 420515 - DNA, 25 bp, Mus musculus
ccagagtccctgaaagcggcttgct

SEQ ID NO: 420516 - DNA, 25 bp, Mus musculus
ccagagtgcctgtggaaaatgtcct

SEQ ID NO: 420517 - DNA, 25 bp, Mus musculus
ccagagtggaatagctgggcccagc

SEQ ID NO: 420518 - DNA, 25 bp, Mus musculus
ccagagtggctttggtgcagcagct

SEQ ID NO: 420519 - DNA, 25 bp, Mus musculus
ccagagtgtaaattcttggaaggca

SEQ ID NO: 420520 - DNA, 25 bp, Mus musculus
ccagagtgtctagaggatccagatg

SEQ ID NO: 420521 - DNA, 25 bp, Mus musculus
ccagagtttgccatgccagcatcag

SEQ ID NO: 420522 - DNA, 25 bp, Mus musculus
ccagataagcgacttgtccagagcc

SEQ ID NO: 420523 - DNA, 25 bp, Mus musculus
ccagatagagggattgttgggctac

SEQ ID NO: 420524 - DNA, 25 bp, Mus musculus
ccagatagcagggtacttgggctct

SEQ ID NO: 420525 - DNA, 25 bp, Mus musculus
ccagatcctgggtctgggaccacag

SEQ ID NO: 420526 - DNA, 25 bp, Mus musculus
ccagatcgcacaggaaatggagcca

SEQ ID NO: 420527 - DNA, 25 bp, Mus musculus
ccagatcggtacgttgggaactgtc

SEQ ID NO: 420528 - DNA, 25 bp, Mus musculus
ccagatctagagaaagcatcgtacc

SEQ ID NO: 420529 - DNA, 25 bp, Mus musculus
ccagatgaacaaggagtgaacattc

SEQ ID NO: 420530 - DNA, 25 bp, Mus musculus
ccagatgaccttgggaaatactcag

SEQ ID NO: 420531 - DNA, 25 bp, Mus musculus
ccagatgatgtgaaagagaacgtgt

SEQ ID NO: 420532 - DNA, 25 bp, Mus musculus
ccagatgcagtgcaaagtatacgac

SEQ ID NO: 420533 - DNA, 25 bp, Mus musculus
ccagatgctggctgcctctcagcgt

SEQ ID NO: 420534 - DNA, 25 bp, Mus musculus
ccagatgggccagcggaagcaaaag

SEQ ID NO: 420535 - DNA, 25 bp, Mus musculus
ccagatggtaagcagtaaaccctac

SEQ ID NO: 420536 - DNA, 25 bp, Mus musculus
ccagatgtctcaggagatcgaggtc

SEQ ID NO: 420537 - DNA, 25 bp, Mus musculus
ccagatgtgagagctctgtgtcatc

SEQ ID NO: 420538 - DNA, 25 bp, Mus musculus
ccagatgtgagcgtctcattttcaa

SEQ ID NO: 420539 - DNA, 25 bp, Mus musculus
ccagatgtggaaagtcagctcagca

SEQ ID NO: 420540 - DNA, 25 bp, Mus musculus
ccagattggcaagcacagtgtgaat

SEQ ID NO: 420541 - DNA, 25 bp, Mus musculus
ccagatttcctatttctagatgagg

SEQ ID NO: 420542 - DNA, 25 bp, Mus musculus
ccagcaaaagaaaaggtagcaccga

SEQ ID NO: 420543 - DNA, 25 bp, Mus musculus
ccagcaaaatgtgggtatgtttctg

SEQ ID NO: 420544 - DNA, 25 bp, Mus musculus
ccagcaaagatgtgggttccctgaa

SEQ ID NO: 420545 - DNA, 25 bp, Mus musculus
ccagcaacgtggctgcattatctcc

SEQ ID NO: 420546 - DNA, 25 bp, Mus musculus
ccagcaactcagacagggccgggat

SEQ ID NO: 420547 - DNA, 25 bp, Mus musculus
ccagcaagaaggaagtgagttggtc

SEQ ID NO: 420548 - DNA, 25 bp, Mus musculus
ccagcaagccaaggaaagaagtcag

SEQ ID NO: 420549 - DNA, 25 bp, Mus musculus
ccagcaagccttgggctcagctatg

SEQ ID NO: 420550 - DNA, 25 bp, Mus musculus
ccagcaagttgtgcatccaggtgat

SEQ ID NO: 420551 - DNA, 25 bp, Mus musculus
ccagcaatgggcgtacagagcaaaa

SEQ ID NO: 420552 - DNA, 25 bp, Mus musculus
ccagcacaggatgcgtacagttgaa

SEQ ID NO: 420553 - DNA, 25 bp, Mus musculus
ccagcaccatgctaagtgctgtggg

SEQ ID NO: 420554 - DNA, 25 bp, Mus musculus
ccagcaccatggagagaaacagttc

SEQ ID NO: 420555 - DNA, 25 bp, Mus musculus
ccagcactagctggagaggtctcct

SEQ ID NO: 420556 - DNA, 25 bp, Mus musculus
ccagcactccccagggatcaggtgt

SEQ ID NO: 420557 - DNA, 25 bp, Mus musculus
ccagcactgtggtttgcaaggggat

SEQ ID NO: 420558 - DNA, 25 bp, Mus musculus
ccagcacttctgataaaacgcatgt

SEQ ID NO: 420559 - DNA, 25 bp, Mus musculus
ccagcagaatctccgggcttatgga

SEQ ID NO: 420560 - DNA, 25 bp, Mus musculus
ccagcagacttgagcttggaactca

SEQ ID NO: 420561 - DNA, 25 bp, Mus musculus
ccagcagagggagcccagtacatgg

SEQ ID NO: 420562 - DNA, 25 bp, Mus musculus
ccagcagatagtcggacatgtacaa

SEQ ID NO: 420563 - DNA, 25 bp, Mus musculus
ccagcagatcccttgttgagcgcct

SEQ ID NO: 420564 - DNA, 25 bp, Mus musculus
ccagcagcaacaccgagactgcttt

SEQ ID NO: 420565 - DNA, 25 bp, Mus musculus
ccagcagcagtcagtacaggtcatg

SEQ ID NO: 420566 - DNA, 25 bp, Mus musculus
ccagcagcagtttcaacgagggcct

SEQ ID NO: 420567 - DNA, 25 bp, Mus musculus
ccagcagcattccatgagcagataa

SEQ ID NO: 420568 - DNA, 25 bp, Mus musculus
ccagcagctgttcgttcagacaaaa

SEQ ID NO: 420569 - DNA, 25 bp, Mus musculus
ccagcaggatgtatgaatgctaacc

SEQ ID NO: 420570 - DNA, 25 bp, Mus musculus
ccagcagggagaattttggaaccga

SEQ ID NO: 420571 - DNA, 25 bp, Mus musculus
ccagcagggagccaagcactttttc

SEQ ID NO: 420572 - DNA, 25 bp, Mus musculus
ccagcagtgcccacctgggtttgga

SEQ ID NO: 420573 - DNA, 25 bp, Mus musculus
ccagcagtgggaggaacattcctga

SEQ ID NO: 420574 - DNA, 25 bp, Mus musculus
ccagcagtgggtagagaatagtcca

SEQ ID NO: 420575 - DNA, 25 bp, Mus musculus
ccagcagtggtcagtttgtgtcaac

SEQ ID NO: 420576 - DNA, 25 bp, Mus musculus
ccagcagtttgaagactaaggcaag

SEQ ID NO: 420577 - DNA, 25 bp, Mus musculus
ccagcatagtttgtgtgtcctgcag

SEQ ID NO: 420578 - DNA, 25 bp, Mus musculus
ccagcatcctcaagagatggagcaa

SEQ ID NO: 420579 - DNA, 25 bp, Mus musculus
ccagcatctatatggattggctttg

SEQ ID NO: 420580 - DNA, 25 bp, Mus musculus
ccagcatctgctcgaggcattggca

SEQ ID NO: 420581 - DNA, 25 bp, Mus musculus
ccagcatgatgccagaggagatcga

SEQ ID NO: 420582 - DNA, 25 bp, Mus musculus
ccagcatgcagagcacatattccta

SEQ ID NO: 420583 - DNA, 25 bp, Mus musculus
ccagcatggacataaggactctaca

SEQ ID NO: 420584 - DNA, 25 bp, Mus musculus
ccagcatggatgcttcagatcggag

SEQ ID NO: 420585 - DNA, 25 bp, Mus musculus
ccagccaaagaatcttaaggaagtc

SEQ ID NO: 420586 - DNA, 25 bp, Mus musculus
ccagccaagaaaagtatcacagatg

SEQ ID NO: 420587 - DNA, 25 bp, Mus musculus
ccagccacacacattgcatgaggtg

SEQ ID NO: 420588 - DNA, 25 bp, Mus musculus
ccagccacgtggagaatgactacat

SEQ ID NO: 420589 - DNA, 25 bp, Mus musculus
ccagccagggctggttggaattgta

SEQ ID NO: 420590 - DNA, 25 bp, Mus musculus
ccagccaggtggtgtacaacagagt

SEQ ID NO: 420591 - DNA, 25 bp, Mus musculus
ccagccaggttgttggcgcgttaga

SEQ ID NO: 420592 - DNA, 25 bp, Mus musculus
ccagccatggcttcagaggattaca

SEQ ID NO: 420593 - DNA, 25 bp, Mus musculus
ccagccatgtctgggtatcccggga

SEQ ID NO: 420594 - DNA, 25 bp, Mus musculus
ccagcccagaggtgaagggttcaac

SEQ ID NO: 420595 - DNA, 25 bp, Mus musculus
ccagcccagggcactgtttctttat

SEQ ID NO: 420596 - DNA, 25 bp, Mus musculus
ccagccccttcgatttgataaagag

SEQ ID NO: 420597 - DNA, 25 bp, Mus musculus
ccagcccggttctcgggagaatgaa

SEQ ID NO: 420598 - DNA, 25 bp, Mus musculus
ccagcccgtcaccagctttttaagg

SEQ ID NO: 420599 - DNA, 25 bp, Mus musculus
ccagccctggattcgtgcgagagca

SEQ ID NO: 420600 - DNA, 25 bp, Mus musculus
ccagccctggtatatgaacattttg

SEQ ID NO: 420601 - DNA, 25 bp, Mus musculus
ccagccctggttactgtgggatgca

SEQ ID NO: 420602 - DNA, 25 bp, Mus musculus
ccagccgtaaggtttctagtcatct

SEQ ID NO: 420603 - DNA, 25 bp, Mus musculus
ccagccgtggaactgcactttgaca

SEQ ID NO: 420604 - DNA, 25 bp, Mus musculus
ccagcctacaggttgttctctgagc

SEQ ID NO: 420605 - DNA, 25 bp, Mus musculus
ccagcctcagggttcaagttcaaag

SEQ ID NO: 420606 - DNA, 25 bp, Mus musculus
ccagcctcgtccacataaagtgagt

SEQ ID NO: 420607 - DNA, 25 bp, Mus musculus
ccagcctgaggtagagggagctaac

SEQ ID NO: 420608 - DNA, 25 bp, Mus musculus
ccagcctgcaggtagaagaatgaca

SEQ ID NO: 420609 - DNA, 25 bp, Mus musculus
ccagcctgggatggttacagttagg

SEQ ID NO: 420610 - DNA, 25 bp, Mus musculus
ccagcctggtatactaggtgggtta

SEQ ID NO: 420611 - DNA, 25 bp, Mus musculus
ccagcctggtgcttcctctgtttgc

SEQ ID NO: 420612 - DNA, 25 bp, Mus musculus
ccagcctgtgaatgaattgtctctt

SEQ ID NO: 420613 - DNA, 25 bp, Mus musculus
ccagcctgtgcagggccatgttgga

SEQ ID NO: 420614 - DNA, 25 bp, Mus musculus
ccagccttctgagggatgtgcagct

SEQ ID NO: 420615 - DNA, 25 bp, Mus musculus
ccagccttgggtgtgctaggcaaaa

SEQ ID NO: 420616 - DNA, 25 bp, Mus musculus
ccagcgaaccacgtggagagatctt

SEQ ID NO: 420617 - DNA, 25 bp, Mus musculus
ccagcgaagctagactcacagtgag

SEQ ID NO: 420618 - DNA, 25 bp, Mus musculus
ccagcgacttgaagacggtttccca

SEQ ID NO: 420619 - DNA, 25 bp, Mus musculus
ccagcgataggccacattccagtaa

SEQ ID NO: 420620 - DNA, 25 bp, Mus musculus
ccagcgatctggacaaaggccaaga

SEQ ID NO: 420621 - DNA, 25 bp, Mus musculus
ccagcgcagctgtatcgagaatatt

SEQ ID NO: 420622 - DNA, 25 bp, Mus musculus
ccagcgccagcacaataaggacaag

SEQ ID NO: 420623 - DNA, 25 bp, Mus musculus
ccagcgcccggatagagtacttgag

SEQ ID NO: 420624 - DNA, 25 bp, Mus musculus
ccagcgcgtgactttaatgacttca

SEQ ID NO: 420625 - DNA, 25 bp, Mus musculus
ccagcgctcaaagggcaagcttcga

SEQ ID NO: 420626 - DNA, 25 bp, Mus musculus
ccagcgctgtgggaagtttctacaa

SEQ ID NO: 420627 - DNA, 25 bp, Mus musculus
ccagcggcctcaaggatggaataca

SEQ ID NO: 420628 - DNA, 25 bp, Mus musculus
ccagcgggtggcgtgaaaaactatg

SEQ ID NO: 420629 - DNA, 25 bp, Mus musculus
ccagcggtactgtaatgacgattgc

SEQ ID NO: 420630 - DNA, 25 bp, Mus musculus
ccagcggtaggcaagcttactatca

SEQ ID NO: 420631 - DNA, 25 bp, Mus musculus
ccagcggtattggaagtggcgacca

SEQ ID NO: 420632 - DNA, 25 bp, Mus musculus
ccagcgtgggtaccaagaaccagag

SEQ ID NO: 420633 - DNA, 25 bp, Mus musculus
ccagcgttgagctggccgtggctta

SEQ ID NO: 420634 - DNA, 25 bp, Mus musculus
ccagcgtttgttctgtgagttgtaa

SEQ ID NO: 420635 - DNA, 25 bp, Mus musculus
ccagctactattgttaatcctaatg

SEQ ID NO: 420636 - DNA, 25 bp, Mus musculus
ccagctagatatttttcgttgcagg

SEQ ID NO: 420637 - DNA, 25 bp, Mus musculus
ccagctaggccgactgcagtattca

SEQ ID NO: 420638 - DNA, 25 bp, Mus musculus
ccagctatgcaaagcgacggcgtct

SEQ ID NO: 420639 - DNA, 25 bp, Mus musculus
ccagctatgctgatgtgaccttcct

SEQ ID NO: 420640 - DNA, 25 bp, Mus musculus
ccagctatgggccttctcagtatta

SEQ ID NO: 420641 - DNA, 25 bp, Mus musculus
ccagctcacgagtatcaaggtttaa

SEQ ID NO: 420642 - DNA, 25 bp, Mus musculus
ccagctcagagaacgagagactcca

SEQ ID NO: 420643 - DNA, 25 bp, Mus musculus
ccagctcaggagctacttgatgaaa

SEQ ID NO: 420644 - DNA, 25 bp, Mus musculus
ccagctcaggcggaggaaagaccaa

SEQ ID NO: 420645 - DNA, 25 bp, Mus musculus
ccagctcagggaaaggcgaatcgct

SEQ ID NO: 420646 - DNA, 25 bp, Mus musculus
ccagctcccgatggacaggcatgtt

SEQ ID NO: 420647 - DNA, 25 bp, Mus musculus
ccagctcgggaatgattggcacaca

SEQ ID NO: 420648 - DNA, 25 bp, Mus musculus
ccagctctaatggttgctaagacta

SEQ ID NO: 420649 - DNA, 25 bp, Mus musculus
ccagctctcacaggataaggcttta

SEQ ID NO: 420650 - DNA, 25 bp, Mus musculus
ccagctctcagcgttatccttaggg

SEQ ID NO: 420651 - DNA, 25 bp, Mus musculus
ccagctctccctgggcatttggaaa

SEQ ID NO: 420652 - DNA, 25 bp, Mus musculus
ccagctctgatgaagtccaaggcca

SEQ ID NO: 420653 - DNA, 25 bp, Mus musculus
ccagctctgggaatctgcatgggca

SEQ ID NO: 420654 - DNA, 25 bp, Mus musculus
ccagctctgggggatgctgcagttc

SEQ ID NO: 420655 - DNA, 25 bp, Mus musculus
ccagctctgttgtgggcggaagtcc

SEQ ID NO: 420656 - DNA, 25 bp, Mus musculus
ccagctcttgttgaatgcccagggc

SEQ ID NO: 420657 - DNA, 25 bp, Mus musculus
ccagctgactacgaggagacaaatg

SEQ ID NO: 420658 - DNA, 25 bp, Mus musculus
ccagctgaggagaggcagtgagtcc

SEQ ID NO: 420659 - DNA, 25 bp, Mus musculus
ccagctgaggctgcaacaaaggagg

SEQ ID NO: 420660 - DNA, 25 bp, Mus musculus
ccagctgaggtgtttcaaggagtaa

SEQ ID NO: 420661 - DNA, 25 bp, Mus musculus
ccagctgcgggtgtgtacatagaaa

SEQ ID NO: 420662 - DNA, 25 bp, Mus musculus
ccagctgcggttggagttgagacaa

SEQ ID NO: 420663 - DNA, 25 bp, Mus musculus
ccagctgctggtgattaaccctaag

SEQ ID NO: 420664 - DNA, 25 bp, Mus musculus
ccagctggcccaacgaaatatatca

SEQ ID NO: 420665 - DNA, 25 bp, Mus musculus
ccagctggtccagaaaacaaacaca

SEQ ID NO: 420666 - DNA, 25 bp, Mus musculus
ccagctggtgctaggacttttcaca

SEQ ID NO: 420667 - DNA, 25 bp, Mus musculus
ccagctggtgggtgatcctctcaaa

SEQ ID NO: 420668 - DNA, 25 bp, Mus musculus
ccagctgtcatgcaggagtttgcca

SEQ ID NO: 420669 - DNA, 25 bp, Mus musculus
ccagctgtgaaggtgtgtgcctcta

SEQ ID NO: 420670 - DNA, 25 bp, Mus musculus
ccagctgtgcagagaacaaggcgtt

SEQ ID NO: 420671 - DNA, 25 bp, Mus musculus
ccagctgtgctatgagaggctctaa

SEQ ID NO: 420672 - DNA, 25 bp, Mus musculus
ccagctgtggttcagggacctctca

SEQ ID NO: 420673 - DNA, 25 bp, Mus musculus
ccagcttacaaactgtggatctcag

SEQ ID NO: 420674 - DNA, 25 bp, Mus musculus
ccagcttactgtcccttaagttcag

SEQ ID NO: 420675 - DNA, 25 bp, Mus musculus
ccagcttctggtggatcaggccaaa

SEQ ID NO: 420676 - DNA, 25 bp, Mus musculus
ccagcttggatcgactgagggtact

SEQ ID NO: 420677 - DNA, 25 bp, Mus musculus
ccagcttgtgtgctgcatgtcaaga

SEQ ID NO: 420678 - DNA, 25 bp, Mus musculus
ccagctttgatctagcttgaactca

SEQ ID NO: 420679 - DNA, 25 bp, Mus musculus
ccagctttggcacaaatcttcagaa

SEQ ID NO: 420680 - DNA, 25 bp, Mus musculus
ccagctttggtggagcaatcagcaa

SEQ ID NO: 420681 - DNA, 25 bp, Mus musculus
ccagcttttggcttcggagctcgaa

SEQ ID NO: 420682 - DNA, 25 bp, Mus musculus
ccagctttttcaggacattgcccag

SEQ ID NO: 420683 - DNA, 25 bp, Mus musculus
ccaggaaacggaaaggcaactgctc

SEQ ID NO: 420684 - DNA, 25 bp, Mus musculus
ccaggaaagccatgagtttggatgt

SEQ ID NO: 420685 - DNA, 25 bp, Mus musculus
ccaggaaatggctagagaatagtca

SEQ ID NO: 420686 - DNA, 25 bp, Mus musculus
ccaggaactcgggagaacgatcgtc

SEQ ID NO: 420687 - DNA, 25 bp, Mus musculus
ccaggaactggagtcactgatgttg

SEQ ID NO: 420688 - DNA, 25 bp, Mus musculus
ccaggaagatggaagtaccgcggaa

SEQ ID NO: 420689 - DNA, 25 bp, Mus musculus
ccaggaaggcagtccgcgagctcca

SEQ ID NO: 420690 - DNA, 25 bp, Mus musculus
ccaggaagggagtcgcgagcatcat

SEQ ID NO: 420691 - DNA, 25 bp, Mus musculus
ccaggaagggcatagagaaggaacc

SEQ ID NO: 420692 - DNA, 25 bp, Mus musculus
ccaggaaggtagaggcactaaagcc

SEQ ID NO: 420693 - DNA, 25 bp, Mus musculus
ccaggaagtcctgccatttataagt

SEQ ID NO: 420694 - DNA, 25 bp, Mus musculus
ccaggaatcccctttcaggagagaa

SEQ ID NO: 420695 - DNA, 25 bp, Mus musculus
ccaggaatcggataggtggtaccta

SEQ ID NO: 420696 - DNA, 25 bp, Mus musculus
ccaggaatctctccatatgctggga

SEQ ID NO: 420697 - DNA, 25 bp, Mus musculus
ccaggaatggagaatctaaacaaga

SEQ ID NO: 420698 - DNA, 25 bp, Mus musculus
ccaggaattccagagcacaagggtg

SEQ ID NO: 420699 - DNA, 25 bp, Mus musculus
ccaggaattggaggacatgcttgct

SEQ ID NO: 420700 - DNA, 25 bp, Mus musculus
ccaggacacctgatggcctttctct

SEQ ID NO: 420701 - DNA, 25 bp, Mus musculus
ccaggacagtacaattcgtgagcag

SEQ ID NO: 420702 - DNA, 25 bp, Mus musculus
ccaggacagtgctaaagtgactcag

SEQ ID NO: 420703 - DNA, 25 bp, Mus musculus
ccaggacatggaggtgatagagatc

SEQ ID NO: 420704 - DNA, 25 bp, Mus musculus
ccaggaccaagtagccaaggtggca

SEQ ID NO: 420705 - DNA, 25 bp, Mus musculus
ccaggaccccttatgtagtgtgcta

SEQ ID NO: 420706 - DNA, 25 bp, Mus musculus
ccaggactatatactcaaggaaggt

SEQ ID NO: 420707 - DNA, 25 bp, Mus musculus
ccaggactcactcctcagagacggg

SEQ ID NO: 420708 - DNA, 25 bp, Mus musculus
ccaggactgcatggaaggaactgct

SEQ ID NO: 420709 - DNA, 25 bp, Mus musculus
ccaggagaaaggtgatgaggcccca

SEQ ID NO: 420710 - DNA, 25 bp, Mus musculus
ccaggagaaatgaggactcggcgca

SEQ ID NO: 420711 - DNA, 25 bp, Mus musculus
ccaggagaaatgtgtgaccagtcag

SEQ ID NO: 420712 - DNA, 25 bp, Mus musculus
ccaggagaacattgtgggcgcagtc

SEQ ID NO: 420713 - DNA, 25 bp, Mus musculus
ccaggagaactttgagccattcatg

SEQ ID NO: 420714 - DNA, 25 bp, Mus musculus
ccaggagaccacaaagaagttagac

SEQ ID NO: 420715 - DNA, 25 bp, Mus musculus
ccaggagacggaaggctccaacata

SEQ ID NO: 420716 - DNA, 25 bp, Mus musculus
ccaggagaggttgctgtgacatatg

SEQ ID NO: 420717 - DNA, 25 bp, Mus musculus
ccaggagcataagagggacttcaca

SEQ ID NO: 420718 - DNA, 25 bp, Mus musculus
ccaggagcattcgaatgagccgagg

SEQ ID NO: 420719 - DNA, 25 bp, Mus musculus
ccaggagctactggccaagcttcgg

SEQ ID NO: 420720 - DNA, 25 bp, Mus musculus
ccaggagctgttgcaagtgactata

SEQ ID NO: 420721 - DNA, 25 bp, Mus musculus
ccaggagcttggaatattatcttta

SEQ ID NO: 420722 - DNA, 25 bp, Mus musculus
ccaggaggcagaattagtgaccatg

SEQ ID NO: 420723 - DNA, 25 bp, Mus musculus
ccaggaggcgaaacagaaggaagct

SEQ ID NO: 420724 - DNA, 25 bp, Mus musculus
ccaggaggcgttgaccctttgcctg

SEQ ID NO: 420725 - DNA, 25 bp, Mus musculus
ccaggagggcaagcataaaagaatg

SEQ ID NO: 420726 - DNA, 25 bp, Mus musculus
ccaggagggctgtttccagtaagca

SEQ ID NO: 420727 - DNA, 25 bp, Mus musculus
ccaggagggctttaaatttaacatg

SEQ ID NO: 420728 - DNA, 25 bp, Mus musculus
ccaggagggtctgctcttgggccac

SEQ ID NO: 420729 - DNA, 25 bp, Mus musculus
ccaggagtcaagctgtagagctaca

SEQ ID NO: 420730 - DNA, 25 bp, Mus musculus
ccaggagtcctgaagaataaagacc

SEQ ID NO: 420731 - DNA, 25 bp, Mus musculus
ccaggagtgaaattcagtctgtacc

SEQ ID NO: 420732 - DNA, 25 bp, Mus musculus
ccaggagtgacactgatacaggact

SEQ ID NO: 420733 - DNA, 25 bp, Mus musculus
ccaggagtgatgaacgcaagaggca

SEQ ID NO: 420734 - DNA, 25 bp, Mus musculus
ccaggagtgtgtttcagggcttgcc

SEQ ID NO: 420735 - DNA, 25 bp, Mus musculus
ccaggagttgaggaatccagaggac

SEQ ID NO: 420736 - DNA, 25 bp, Mus musculus
ccaggagtttgaccatttgccggcc

SEQ ID NO: 420737 - DNA, 25 bp, Mus musculus
ccaggatagcaagaatcattcaggc

SEQ ID NO: 420738 - DNA, 25 bp, Mus musculus
ccaggataggttgtacgggattctc

SEQ ID NO: 420739 - DNA, 25 bp, Mus musculus
ccaggatcagttgcccagaaggttc

SEQ ID NO: 420740 - DNA, 25 bp, Mus musculus
ccaggatcctcagttctgtgtggag

SEQ ID NO: 420741 - DNA, 25 bp, Mus musculus
ccaggatgagagaatattggcaaga

SEQ ID NO: 420742 - DNA, 25 bp, Mus musculus
ccaggatgatgacaaacctaagaac

SEQ ID NO: 420743 - DNA, 25 bp, Mus musculus
ccaggatgccactgctgaagagggc

SEQ ID NO: 420744 - DNA, 25 bp, Mus musculus
ccaggatgggagtcacaatttatca

SEQ ID NO: 420745 - DNA, 25 bp, Mus musculus
ccaggatgggcagctaaagggcttc

SEQ ID NO: 420746 - DNA, 25 bp, Mus musculus
ccaggatgtgagagccaagggctac

SEQ ID NO: 420747 - DNA, 25 bp, Mus musculus
ccaggattcggcagagctgttggcc

SEQ ID NO: 420748 - DNA, 25 bp, Mus musculus
ccaggattctcgagctaaggacaga

SEQ ID NO: 420749 - DNA, 25 bp, Mus musculus
ccaggatttaaggatcattagagat

SEQ ID NO: 420750 - DNA, 25 bp, Mus musculus
ccaggatttcttctgtgaaggccac

SEQ ID NO: 420751 - DNA, 25 bp, Mus musculus
ccaggattttcttacacggatgcaa

SEQ ID NO: 420752 - DNA, 25 bp, Mus musculus
ccaggcaagcggatgggaatcacaa

SEQ ID NO: 420753 - DNA, 25 bp, Mus musculus
ccaggcacccaggaattttatgtag

SEQ ID NO: 420754 - DNA, 25 bp, Mus musculus
ccaggcagagtgaggacctgtgctt

SEQ ID NO: 420755 - DNA, 25 bp, Mus musculus
ccaggcagcttaggaacagtgaggc

SEQ ID NO: 420756 - DNA, 25 bp, Mus musculus
ccaggcaggcttggccaaggctctg

SEQ ID NO: 420757 - DNA, 25 bp, Mus musculus
ccaggcagggtgtcaagtcgcaagt

SEQ ID NO: 420758 - DNA, 25 bp, Mus musculus
ccaggcagtgcagccagatttgcca

SEQ ID NO: 420759 - DNA, 25 bp, Mus musculus
ccaggcatcagggagaagagacact

SEQ ID NO: 420760 - DNA, 25 bp, Mus musculus
ccaggcatgcacaaagtacccttaa

SEQ ID NO: 420761 - DNA, 25 bp, Mus musculus
ccaggccagaaaggagcataggtgt

SEQ ID NO: 420762 - DNA, 25 bp, Mus musculus
ccaggccccgtctttgggatagata

SEQ ID NO: 420763 - DNA, 25 bp, Mus musculus
ccaggcctcagaaatgacttcttga

SEQ ID NO: 420764 - DNA, 25 bp, Mus musculus
ccaggcctgaggtggttctccgaaa

SEQ ID NO: 420765 - DNA, 25 bp, Mus musculus
ccaggcgcacctgtatggaaaggag

SEQ ID NO: 420766 - DNA, 25 bp, Mus musculus
ccaggcgctgttatcggcatagcca

SEQ ID NO: 420767 - DNA, 25 bp, Mus musculus
ccaggcggaatcaaagcaggtcagt

SEQ ID NO: 420768 - DNA, 25 bp, Mus musculus
ccaggcggagttctatcttttacca

SEQ ID NO: 420769 - DNA, 25 bp, Mus musculus
ccaggcggctgagctaggtcttgta

SEQ ID NO: 420770 - DNA, 25 bp, Mus musculus
ccaggcgtttctggatgtgagccac

SEQ ID NO: 420771 - DNA, 25 bp, Mus musculus
ccaggctctcggatcacatgaagga

SEQ ID NO: 420772 - DNA, 25 bp, Mus musculus
ccaggctgcagaaacgatggcggct

SEQ ID NO: 420773 - DNA, 25 bp, Mus musculus
ccaggctgcagggttcttagggtca

SEQ ID NO: 420774 - DNA, 25 bp, Mus musculus
ccaggctgctcccaagtcattattt

SEQ ID NO: 420775 - DNA, 25 bp, Mus musculus
ccaggctgggctaacttgcgattat

SEQ ID NO: 420776 - DNA, 25 bp, Mus musculus
ccaggctgtcgctttccaagagaaa

SEQ ID NO: 420777 - DNA, 25 bp, Mus musculus
ccaggctgtgcagcatgaggtcgaa

SEQ ID NO: 420778 - DNA, 25 bp, Mus musculus
ccaggcttcgtgactgcatgaaaaa

SEQ ID NO: 420779 - DNA, 25 bp, Mus musculus
ccaggcttgagcgtgagtttttaag

SEQ ID NO: 420780 - DNA, 25 bp, Mus musculus
ccagggaaaggtgtcttaaggcatc

SEQ ID NO: 420781 - DNA, 25 bp, Mus musculus
ccagggaacagcgatcaaaagtctt

SEQ ID NO: 420782 - DNA, 25 bp, Mus musculus
ccagggaacttttttgatgggctca

SEQ ID NO: 420783 - DNA, 25 bp, Mus musculus
ccagggaagacctgtcgagttgaca

SEQ ID NO: 420784 - DNA, 25 bp, Mus musculus
ccagggacaaggcagaaattttaga

SEQ ID NO: 420785 - DNA, 25 bp, Mus musculus
ccagggacctcctgcagaggaagaa

SEQ ID NO: 420786 - DNA, 25 bp, Mus musculus
ccagggagcagccttcttgcctctg

SEQ ID NO: 420787 - DNA, 25 bp, Mus musculus
ccagggagctcaacaaaacgggcaa

SEQ ID NO: 420788 - DNA, 25 bp, Mus musculus
ccagggagcttgctttagcttccct

SEQ ID NO: 420789 - DNA, 25 bp, Mus musculus
ccagggaggcagcactgtctactca

SEQ ID NO: 420790 - DNA, 25 bp, Mus musculus
ccagggaggccaacgtggagttatc

SEQ ID NO: 420791 - DNA, 25 bp, Mus musculus
ccagggaggtacatggcctctgtca

SEQ ID NO: 420792 - DNA, 25 bp, Mus musculus
ccagggaggtatgaccatatggacc

SEQ ID NO: 420793 - DNA, 25 bp, Mus musculus
ccagggagtatgttgaccacatgtt

SEQ ID NO: 420794 - DNA, 25 bp, Mus musculus
ccagggatccacttttgaagaagaa

SEQ ID NO: 420795 - DNA, 25 bp, Mus musculus
ccagggatcttagctaacggaaaca

SEQ ID NO: 420796 - DNA, 25 bp, Mus musculus
ccagggcagccactaaacttcaaag

SEQ ID NO: 420797 - DNA, 25 bp, Mus musculus
ccagggcagggcaaagtaaacttat

SEQ ID NO: 420798 - DNA, 25 bp, Mus musculus
ccagggcaggtgatttttgagtatg

SEQ ID NO: 420799 - DNA, 25 bp, Mus musculus
ccagggcatgggactcttgataatt

SEQ ID NO: 420800 - DNA, 25 bp, Mus musculus
ccagggccacggtcaacttggaagt

SEQ ID NO: 420801 - DNA, 25 bp, Mus musculus
ccagggccactgcagggagttacat

SEQ ID NO: 420802 - DNA, 25 bp, Mus musculus
ccagggccgtgcaggatattacagc

SEQ ID NO: 420803 - DNA, 25 bp, Mus musculus
ccagggcgatttcgatgagcacaca

SEQ ID NO: 420804 - DNA, 25 bp, Mus musculus
ccagggctcgctctagggttgaaaa

SEQ ID NO: 420805 - DNA, 25 bp, Mus musculus
ccagggctctggactgaaaaggttc

SEQ ID NO: 420806 - DNA, 25 bp, Mus musculus
ccagggctgcaaagcgtaggtacca

SEQ ID NO: 420807 - DNA, 25 bp, Mus musculus
ccagggctttatgcagacctactat

SEQ ID NO: 420808 - DNA, 25 bp, Mus musculus
ccagggcttttgaacaggaatgtcc

SEQ ID NO: 420809 - DNA, 25 bp, Mus musculus
ccagggcttttgatcgaggcattcg

SEQ ID NO: 420810 - DNA, 25 bp, Mus musculus
ccagggtagctgaagaattggcgca

SEQ ID NO: 420811 - DNA, 25 bp, Mus musculus
ccagggtcactgtacattaatctca

SEQ ID NO: 420812 - DNA, 25 bp, Mus musculus
ccagggtcagttgatgttccgggct

SEQ ID NO: 420813 - DNA, 25 bp, Mus musculus
ccagggtcattatacagaaatgcag

SEQ ID NO: 420814 - DNA, 25 bp, Mus musculus
ccagggtctgcctttttgtcgaaga

SEQ ID NO: 420815 - DNA, 25 bp, Mus musculus
ccagggtggccaccaagggtgagga

SEQ ID NO: 420816 - DNA, 25 bp, Mus musculus
ccagggtggcttgtgctctgacaga

SEQ ID NO: 420817 - DNA, 25 bp, Mus musculus
ccagggttgcacaggaggctgctct

SEQ ID NO: 420818 - DNA, 25 bp, Mus musculus
ccaggtaaaacagcatgccagcgac

SEQ ID NO: 420819 - DNA, 25 bp, Mus musculus
ccaggtaagtagagatggtcccctc

SEQ ID NO: 420820 - DNA, 25 bp, Mus musculus
ccaggtagagccagctaaggagtct

SEQ ID NO: 420821 - DNA, 25 bp, Mus musculus
ccaggtatggcatcaaatgtcttta

SEQ ID NO: 420822 - DNA, 25 bp, Mus musculus
ccaggtattgcttaaggagtttgtg

SEQ ID NO: 420823 - DNA, 25 bp, Mus musculus
ccaggtcaacccaagcacatgcatt

SEQ ID NO: 420824 - DNA, 25 bp, Mus musculus
ccaggtcaatgtgctgcccgagaga

SEQ ID NO: 420825 - DNA, 25 bp, Mus musculus
ccaggtcaggctcttaggacgtgta

SEQ ID NO: 420826 - DNA, 25 bp, Mus musculus
ccaggtcataggtcagatcgggtca

SEQ ID NO: 420827 - DNA, 25 bp, Mus musculus
ccaggtcattgacggcagctctgaa

SEQ ID NO: 420828 - DNA, 25 bp, Mus musculus
ccaggtccttctctggacgtttagc

SEQ ID NO: 420829 - DNA, 25 bp, Mus musculus
ccaggtccttgcctgcttctctatg

SEQ ID NO: 420830 - DNA, 25 bp, Mus musculus
ccaggtcggtatgagcgtttccagt

SEQ ID NO: 420831 - DNA, 25 bp, Mus musculus
ccaggtctacatggagaacaatgac

SEQ ID NO: 420832 - DNA, 25 bp, Mus musculus
ccaggtctcctataagagcagtacg

SEQ ID NO: 420833 - DNA, 25 bp, Mus musculus
ccaggtctgggtcggaaactcaagt

SEQ ID NO: 420834 - DNA, 25 bp, Mus musculus
ccaggtctggtttgagtttgaagga

SEQ ID NO: 420835 - DNA, 25 bp, Mus musculus
ccaggtctgtttcatccggacgcca

SEQ ID NO: 420836 - DNA, 25 bp, Mus musculus
ccaggtgactggcttgacggatatt

SEQ ID NO: 420837 - DNA, 25 bp, Mus musculus
ccaggtgactgggtagccattcgct

SEQ ID NO: 420838 - DNA, 25 bp, Mus musculus
ccaggtgcaggctgcctacggacag

SEQ ID NO: 420839 - DNA, 25 bp, Mus musculus
ccaggtggcagtgttcagatcttaa

SEQ ID NO: 420840 - DNA, 25 bp, Mus musculus
ccaggtggccagacataggtattca

SEQ ID NO: 420841 - DNA, 25 bp, Mus musculus
ccaggtggtcacaaaggtgcgtgca

SEQ ID NO: 420842 - DNA, 25 bp, Mus musculus
ccaggtggttggactatctgcctca

SEQ ID NO: 420843 - DNA, 25 bp, Mus musculus
ccaggtgtgccgacaagtgttcaaa

SEQ ID NO: 420844 - DNA, 25 bp, Mus musculus
ccaggtgttctccagccatgtagtg

SEQ ID NO: 420845 - DNA, 25 bp, Mus musculus
ccaggttataatgcggtgcttcaca

SEQ ID NO: 420846 - DNA, 25 bp, Mus musculus
ccaggttcgtgaagttcgcagagaa

SEQ ID NO: 420847 - DNA, 25 bp, Mus musculus
ccaggttctaatggacattgtcccg

SEQ ID NO: 420848 - DNA, 25 bp, Mus musculus
ccaggttgaggtctagcatgtccaa

SEQ ID NO: 420849 - DNA, 25 bp, Mus musculus
ccaggttggtggtgcagatagataa

SEQ ID NO: 420850 - DNA, 25 bp, Mus musculus
ccaggtttctttcaggtacgtgctg

SEQ ID NO: 420851 - DNA, 25 bp, Mus musculus
ccaggtttgtcacccggagttagca

SEQ ID NO: 420852 - DNA, 25 bp, Mus musculus
ccagtaaaacagctcaatggataaa

SEQ ID NO: 420853 - DNA, 25 bp, Mus musculus
ccagtaacaagagtagatgaaaggc

SEQ ID NO: 420854 - DNA, 25 bp, Mus musculus
ccagtaagagcgtcagatctcctaa

SEQ ID NO: 420855 - DNA, 25 bp, Mus musculus
ccagtaagcacccaatgagatggag

SEQ ID NO: 420856 - DNA, 25 bp, Mus musculus
ccagtaatgttaaagtagagactca

SEQ ID NO: 420857 - DNA, 25 bp, Mus musculus
ccagtaccagacaagtaagaaaaag

SEQ ID NO: 420858 - DNA, 25 bp, Mus musculus
ccagtacctgttgagcgggctccgt

SEQ ID NO: 420859 - DNA, 25 bp, Mus musculus
ccagtacgacaagggtctgtctttg

SEQ ID NO: 420860 - DNA, 25 bp, Mus musculus
ccagtactggcgagaagagacctat

SEQ ID NO: 420861 - DNA, 25 bp, Mus musculus
ccagtaggagcaagatggcttctga

SEQ ID NO: 420862 - DNA, 25 bp, Mus musculus
ccagtagtgagcagatcaggattcc

SEQ ID NO: 420863 - DNA, 25 bp, Mus musculus
ccagtagttacagttacgagggaca

SEQ ID NO: 420864 - DNA, 25 bp, Mus musculus
ccagtagttcttcaagcctcagcag

SEQ ID NO: 420865 - DNA, 25 bp, Mus musculus
ccagtagttgcctccagggcggaag

SEQ ID NO: 420866 - DNA, 25 bp, Mus musculus
ccagtatcatctgaggtacaagttg

SEQ ID NO: 420867 - DNA, 25 bp, Mus musculus
ccagtatcttcacaacggcaaggag

SEQ ID NO: 420868 - DNA, 25 bp, Mus musculus
ccagtatgatggacaggaggcccag

SEQ ID NO: 420869 - DNA, 25 bp, Mus musculus
ccagtatggcgcagaggttagacac

SEQ ID NO: 420870 - DNA, 25 bp, Mus musculus
ccagtatggtggctacgggtaccca

SEQ ID NO: 420871 - DNA, 25 bp, Mus musculus
ccagtattgcagttggacccagtgc

SEQ ID NO: 420872 - DNA, 25 bp, Mus musculus
ccagtattgctgtaagacgcctcca

SEQ ID NO: 420873 - DNA, 25 bp, Mus musculus
ccagtattggagacctgacaggcct

SEQ ID NO: 420874 - DNA, 25 bp, Mus musculus
ccagtattttgtgaaccagcggaaa

SEQ ID NO: 420875 - DNA, 25 bp, Mus musculus
ccagtcaagagcatagtgctgcagg

SEQ ID NO: 420876 - DNA, 25 bp, Mus musculus
ccagtcagaagagaggtatgcagca

SEQ ID NO: 420877 - DNA, 25 bp, Mus musculus
ccagtcagaggctatgcgtccatca

SEQ ID NO: 420878 - DNA, 25 bp, Mus musculus
ccagtcaggcgacaggaagtcagct

SEQ ID NO: 420879 - DNA, 25 bp, Mus musculus
ccagtcagggctttatggtttgacc

SEQ ID NO: 420880 - DNA, 25 bp, Mus musculus
ccagtcaggtacgtgcagtgtctca

SEQ ID NO: 420881 - DNA, 25 bp, Mus musculus
ccagtcagtaggatgtggtacccct

SEQ ID NO: 420882 - DNA, 25 bp, Mus musculus
ccagtccaaagagggaagcggccgt

SEQ ID NO: 420883 - DNA, 25 bp, Mus musculus
ccagtccgttatgttgatggctaca

SEQ ID NO: 420884 - DNA, 25 bp, Mus musculus
ccagtcgagcaaggcaaaccagtta

SEQ ID NO: 420885 - DNA, 25 bp, Mus musculus
ccagtctaagtgaatggccaccggg

SEQ ID NO: 420886 - DNA, 25 bp, Mus musculus
ccagtctccgcaacgttcgaagcaa

SEQ ID NO: 420887 - DNA, 25 bp, Mus musculus
ccagtctcctcaagaatgaggccag

SEQ ID NO: 420888 - DNA, 25 bp, Mus musculus
ccagtctctgaaaattgatccgtag

SEQ ID NO: 420889 - DNA, 25 bp, Mus musculus
ccagtctgagctgtgtgaagtgata

SEQ ID NO: 420890 - DNA, 25 bp, Mus musculus
ccagtctgatctttcgtggcaggca

SEQ ID NO: 420891 - DNA, 25 bp, Mus musculus
ccagtctggactggtgtaggatgta

SEQ ID NO: 420892 - DNA, 25 bp, Mus musculus
ccagtctggagcaagagtgaggtca

SEQ ID NO: 420893 - DNA, 25 bp, Mus musculus
ccagtctggtcctttcaacgttcca

SEQ ID NO: 420894 - DNA, 25 bp, Mus musculus
ccagtcttataagtccccaaagaag

SEQ ID NO: 420895 - DNA, 25 bp, Mus musculus
ccagtgaaaggcagaggaatccgaa

SEQ ID NO: 420896 - DNA, 25 bp, Mus musculus
ccagtgaacagaataaaggtgcctc

SEQ ID NO: 420897 - DNA, 25 bp, Mus musculus
ccagtgaagccttgacatggtccag

SEQ ID NO: 420898 - DNA, 25 bp, Mus musculus
ccagtgaaggcgacatgagcatctc

SEQ ID NO: 420899 - DNA, 25 bp, Mus musculus
ccagtgaatactgatgagaccatag

SEQ ID NO: 420900 - DNA, 25 bp, Mus musculus
ccagtgaatgcagatgtgtttctca

SEQ ID NO: 420901 - DNA, 25 bp, Mus musculus
ccagtgacaacaacaatacctctgt

SEQ ID NO: 420902 - DNA, 25 bp, Mus musculus
ccagtgacaatcagtggccggcaag

SEQ ID NO: 420903 - DNA, 25 bp, Mus musculus
ccagtgaccgatggctgctgaacca

SEQ ID NO: 420904 - DNA, 25 bp, Mus musculus
ccagtgagaagaaggtcaaagccgt

SEQ ID NO: 420905 - DNA, 25 bp, Mus musculus
ccagtgagaagttgtgtagagccca

SEQ ID NO: 420906 - DNA, 25 bp, Mus musculus
ccagtgagagccgtgacttatgtca

SEQ ID NO: 420907 - DNA, 25 bp, Mus musculus
ccagtgagggcaaaacgagggctct

SEQ ID NO: 420908 - DNA, 25 bp, Mus musculus
ccagtgatattcttgaaagaaggaa

SEQ ID NO: 420909 - DNA, 25 bp, Mus musculus
ccagtgatgagtccctgtcagtcga

SEQ ID NO: 420910 - DNA, 25 bp, Mus musculus
ccagtgatgttataagtatattgcc

SEQ ID NO: 420911 - DNA, 25 bp, Mus musculus
ccagtgattcgagctctaaagagtc

SEQ ID NO: 420912 - DNA, 25 bp, Mus musculus
ccagtgcaccgcttgctgtggagaa

SEQ ID NO: 420913 - DNA, 25 bp, Mus musculus
ccagtgcagtctacctaaagaggga

SEQ ID NO: 420914 - DNA, 25 bp, Mus musculus
ccagtgcatccagaagattgaaagt

SEQ ID NO: 420915 - DNA, 25 bp, Mus musculus
ccagtgccaggaatgtcgctttaag

SEQ ID NO: 420916 - DNA, 25 bp, Mus musculus
ccagtgcccgtcaaggaggagtttc

SEQ ID NO: 420917 - DNA, 25 bp, Mus musculus
ccagtgcctgttgcgctgtcggtgt

SEQ ID NO: 420918 - DNA, 25 bp, Mus musculus
ccagtgctagacatgattaattaga

SEQ ID NO: 420919 - DNA, 25 bp, Mus musculus
ccagtgctcacattccttcaaggac

SEQ ID NO: 420920 - DNA, 25 bp, Mus musculus
ccagtgctgcttggaaaatgggaaa

SEQ ID NO: 420921 - DNA, 25 bp, Mus musculus
ccagtgctgggctttctggcacaag

SEQ ID NO: 420922 - DNA, 25 bp, Mus musculus
ccagtgctgtggtgaggatcttcaa

SEQ ID NO: 420923 - DNA, 25 bp, Mus musculus
ccagtggaagttggtttagagccga

SEQ ID NO: 420924 - DNA, 25 bp, Mus musculus
ccagtggaatcctctaaaagttgca

SEQ ID NO: 420925 - DNA, 25 bp, Mus musculus
ccagtggactgtgtacgtgaagccc

SEQ ID NO: 420926 - DNA, 25 bp, Mus musculus
ccagtggagaatgagcccgtttgcc

SEQ ID NO: 420927 - DNA, 25 bp, Mus musculus
ccagtggagcgccagaatagaagca

SEQ ID NO: 420928 - DNA, 25 bp, Mus musculus
ccagtggagctgaaataaacggttg

SEQ ID NO: 420929 - DNA, 25 bp, Mus musculus
ccagtggccaggattgtgagaagaa

SEQ ID NO: 420930 - DNA, 25 bp, Mus musculus
ccagtggccatcgagaaggttaagc

SEQ ID NO: 420931 - DNA, 25 bp, Mus musculus
ccagtggccccagatataagctaga

SEQ ID NO: 420932 - DNA, 25 bp, Mus musculus
ccagtggctggtaggatgatcaaca

SEQ ID NO: 420933 - DNA, 25 bp, Mus musculus
ccagtggcttcattggtgggcacca

SEQ ID NO: 420934 - DNA, 25 bp, Mus musculus
ccagtgggaccgacatgtgatgaat

SEQ ID NO: 420935 - DNA, 25 bp, Mus musculus
ccagtgggtcccatagtgtcctcac

SEQ ID NO: 420936 - DNA, 25 bp, Mus musculus
ccagtgggtgggtctgctagggcaa

SEQ ID NO: 420937 - DNA, 25 bp, Mus musculus
ccagtgtaagaaataaacctgacag

SEQ ID NO: 420938 - DNA, 25 bp, Mus musculus
ccagtgtctgtatgatcaagttgta

SEQ ID NO: 420939 - DNA, 25 bp, Mus musculus
ccagtgtgaagaactccccaggttg

SEQ ID NO: 420940 - DNA, 25 bp, Mus musculus
ccagtgtgaagggtgacagcatgac

SEQ ID NO: 420941 - DNA, 25 bp, Mus musculus
ccagtgtggccatggaaaacctcca

SEQ ID NO: 420942 - DNA, 25 bp, Mus musculus
ccagtgtgggcaacctcgggatgcc

SEQ ID NO: 420943 - DNA, 25 bp, Mus musculus
ccagtgtgggtattgtgaacagtga

SEQ ID NO: 420944 - DNA, 25 bp, Mus musculus
ccagtgttacctagaagttaatgga

SEQ ID NO: 420945 - DNA, 25 bp, Mus musculus
ccagtgttccttggcacagggacag

SEQ ID NO: 420946 - DNA, 25 bp, Mus musculus
ccagtgttcggagaagatgccgcgc

SEQ ID NO: 420947 - DNA, 25 bp, Mus musculus
ccagtgttcgtcacaggcagagatt

SEQ ID NO: 420948 - DNA, 25 bp, Mus musculus
ccagtgttggaggttgaggaaacaa

SEQ ID NO: 420949 - DNA, 25 bp, Mus musculus
ccagttaattacactggctgaggca

SEQ ID NO: 420950 - DNA, 25 bp, Mus musculus
ccagttatgagttgtttagattcca

SEQ ID NO: 420951 - DNA, 25 bp, Mus musculus
ccagttattcttccgggcacagcca

SEQ ID NO: 420952 - DNA, 25 bp, Mus musculus
ccagttcagatggaaggtgtcaaac

SEQ ID NO: 420953 - DNA, 25 bp, Mus musculus
ccagttcagtcgaggtggagagcca

SEQ ID NO: 420954 - DNA, 25 bp, Mus musculus
ccagttcagtgaaagggacgtacac

SEQ ID NO: 420955 - DNA, 25 bp, Mus musculus
ccagttcagtgttaatatgtagtga

SEQ ID NO: 420956 - DNA, 25 bp, Mus musculus
ccagttccagggtgatgcagacgac

SEQ ID NO: 420957 - DNA, 25 bp, Mus musculus
ccagttccgactgtacgtctgagag

SEQ ID NO: 420958 - DNA, 25 bp, Mus musculus
ccagttccgatgcagaaaagaccca

SEQ ID NO: 420959 - DNA, 25 bp, Mus musculus
ccagttccggtaccatgtcagttcg

SEQ ID NO: 420960 - DNA, 25 bp, Mus musculus
ccagttcctccctcaagtaataaat

SEQ ID NO: 420961 - DNA, 25 bp, Mus musculus
ccagttctctggcttcgtgatacac

SEQ ID NO: 420962 - DNA, 25 bp, Mus musculus
ccagttgaaggtaatgggccactct

SEQ ID NO: 420963 - DNA, 25 bp, Mus musculus
ccagttgccagaattgggtggaagc

SEQ ID NO: 420964 - DNA, 25 bp, Mus musculus
ccagttgctgcagtagctacagtgc

SEQ ID NO: 420965 - DNA, 25 bp, Mus musculus
ccagttggaacgtactaagagcaga

SEQ ID NO: 420966 - DNA, 25 bp, Mus musculus
ccagttggcttactagggatgcttc

SEQ ID NO: 420967 - DNA, 25 bp, Mus musculus
ccagttgtaggcaggcacgtgtcct

SEQ ID NO: 420968 - DNA, 25 bp, Mus musculus
ccagttgtgataacgaggacaccca

SEQ ID NO: 420969 - DNA, 25 bp, Mus musculus
ccagttgtgccctatggagatccaa

SEQ ID NO: 420970 - DNA, 25 bp, Mus musculus
ccagttgtggaaagtgctgcactca

SEQ ID NO: 420971 - DNA, 25 bp, Mus musculus
ccagttgttgatcacccggactcag

SEQ ID NO: 420972 - DNA, 25 bp, Mus musculus
ccagtttagggcagatgaaagtttt

SEQ ID NO: 420973 - DNA, 25 bp, Mus musculus
ccagtttgaaaatagtaccaccagt

SEQ ID NO: 420974 - DNA, 25 bp, Mus musculus
ccagtttgcaaacccgctgaggtcc

SEQ ID NO: 420975 - DNA, 25 bp, Mus musculus
ccagtttggaacatgctaaagtaaa

SEQ ID NO: 420976 - DNA, 25 bp, Mus musculus
ccagtttgggtgaaaagaaggagct

SEQ ID NO: 420977 - DNA, 25 bp, Mus musculus
ccagtttgtgggttggaacattatt

SEQ ID NO: 420978 - DNA, 25 bp, Mus musculus
ccagtttgtgttccagcattgctca

SEQ ID NO: 420979 - DNA, 25 bp, Mus musculus
ccataaagaagggatcgtgcagact

SEQ ID NO: 420980 - DNA, 25 bp, Mus musculus
ccataacaagaataagcaggcccgc

SEQ ID NO: 420981 - DNA, 25 bp, Mus musculus
ccataacctgttattctatgtacat

SEQ ID NO: 420982 - DNA, 25 bp, Mus musculus
ccataaggcagaggttgagtccaac

SEQ ID NO: 420983 - DNA, 25 bp, Mus musculus
ccataagtggcaacgaagagcttca

SEQ ID NO: 420984 - DNA, 25 bp, Mus musculus
ccataataaagctctggaaggttca

SEQ ID NO: 420985 - DNA, 25 bp, Mus musculus
ccataatggccgcactgagttgtct

SEQ ID NO: 420986 - DNA, 25 bp, Mus musculus
ccataatggctgtctggcgggtgct

SEQ ID NO: 420987 - DNA, 25 bp, Mus musculus
ccataattacaccagcgggcgaagt

SEQ ID NO: 420988 - DNA, 25 bp, Mus musculus
ccatacaagtcagagggtcactgca

SEQ ID NO: 420989 - DNA, 25 bp, Mus musculus
ccatacagatgtcaaggtgcccgac

SEQ ID NO: 420990 - DNA, 25 bp, Mus musculus
ccatacaggtggtgagagctcgtaa

SEQ ID NO: 420991 - DNA, 25 bp, Mus musculus
ccataccagcagaagacaaagcaga

SEQ ID NO: 420992 - DNA, 25 bp, Mus musculus
ccataccgtggacccctcggagtgg

SEQ ID NO: 420993 - DNA, 25 bp, Mus musculus
ccatacgggaggacttcaaagctgc

SEQ ID NO: 420994 - DNA, 25 bp, Mus musculus
ccatagagtcagtgggagacgtgac

SEQ ID NO: 420995 - DNA, 25 bp, Mus musculus
ccatagagttctccctgagggctga

SEQ ID NO: 420996 - DNA, 25 bp, Mus musculus
ccatagatgcggatgcaggagctca

SEQ ID NO: 420997 - DNA, 25 bp, Mus musculus
ccatagcagcgtcccggcacagaga

SEQ ID NO: 420998 - DNA, 25 bp, Mus musculus
ccatagccactttcgggtgctgtga

SEQ ID NO: 420999 - DNA, 25 bp, Mus musculus
ccatagcgcggacggtctctgctgc

SEQ ID NO: 421000 - DNA, 25 bp, Mus musculus
ccatagctacccaaggcctaaggct

SEQ ID NO: 421001 - DNA, 25 bp, Mus musculus
ccatagctagacaacaggcagaagt

SEQ ID NO: 421002 - DNA, 25 bp, Mus musculus
ccatagggaagctggatgagcgtca

SEQ ID NO: 421003 - DNA, 25 bp, Mus musculus
ccatagggagcatccagcgagtgca

SEQ ID NO: 421004 - DNA, 25 bp, Mus musculus
ccataggtaaggatgcggcgagcca

SEQ ID NO: 421005 - DNA, 25 bp, Mus musculus
ccatagtggctagagctaagggagc

SEQ ID NO: 421006 - DNA, 25 bp, Mus musculus
ccatagtggtggcatgctggaacct

SEQ ID NO: 421007 - DNA, 25 bp, Mus musculus
ccatagttttctgacctggagtaaa

SEQ ID NO: 421008 - DNA, 25 bp, Mus musculus
ccatataagaggagataccatcccc

SEQ ID NO: 421009 - DNA, 25 bp, Mus musculus
ccatatactggactggaccggcggt

SEQ ID NO: 421010 - DNA, 25 bp, Mus musculus
ccatatagataagaacaaagccaag

SEQ ID NO: 421011 - DNA, 25 bp, Mus musculus
ccatatatggtgcagaagctcggaa

SEQ ID NO: 421012 - DNA, 25 bp, Mus musculus
ccatatcaaaaagaggccgcctgct

SEQ ID NO: 421013 - DNA, 25 bp, Mus musculus
ccatatcaggtatgtgagaagtcac

SEQ ID NO: 421014 - DNA, 25 bp, Mus musculus
ccatatctttaaaagcgaggccctg

SEQ ID NO: 421015 - DNA, 25 bp, Mus musculus
ccatatgacttgagatagcagtgct

SEQ ID NO: 421016 - DNA, 25 bp, Mus musculus
ccatatgagagttgtgcgagactac

SEQ ID NO: 421017 - DNA, 25 bp, Mus musculus
ccatatggacctgaggtggcggcaa

SEQ ID NO: 421018 - DNA, 25 bp, Mus musculus
ccatatgtggcagctttcaaagaag

SEQ ID NO: 421019 - DNA, 25 bp, Mus musculus
ccatatgtggttgagctgtgtgcac

SEQ ID NO: 421020 - DNA, 25 bp, Mus musculus
ccatattgactgaatctgagaagca

SEQ ID NO: 421021 - DNA, 25 bp, Mus musculus
ccatattggacacagctgagcagga

SEQ ID NO: 421022 - DNA, 25 bp, Mus musculus
ccatattgtggctaacaaatatctg

SEQ ID NO: 421023 - DNA, 25 bp, Mus musculus
ccatcaaagccgagaagcgctgtga

SEQ ID NO: 421024 - DNA, 25 bp, Mus musculus
ccatcaacggttagagccaggcaaa

SEQ ID NO: 421025 - DNA, 25 bp, Mus musculus
ccatcaagaaggcagaacaaagtcc

SEQ ID NO: 421026 - DNA, 25 bp, Mus musculus
ccatcaagaagtagacagtgtcctg

SEQ ID NO: 421027 - DNA, 25 bp, Mus musculus
ccatcaaggcataggaggattctct

SEQ ID NO: 421028 - DNA, 25 bp, Mus musculus
ccatcaaggtcatcaggcgcatgca

SEQ ID NO: 421029 - DNA, 25 bp, Mus musculus
ccatcacctgtgagggagcacgtgc

SEQ ID NO: 421030 - DNA, 25 bp, Mus musculus
ccatcacggatagaggaatacttaa

SEQ ID NO: 421031 - DNA, 25 bp, Mus musculus
ccatcacgggtggattcaggcaacc

SEQ ID NO: 421032 - DNA, 25 bp, Mus musculus
ccatcactcgcaaaggtgttgggca

SEQ ID NO: 421033 - DNA, 25 bp, Mus musculus
ccatcactgcaaggaaggaattctc

SEQ ID NO: 421034 - DNA, 25 bp, Mus musculus
ccatcagaggaagccgtttgatctc

SEQ ID NO: 421035 - DNA, 25 bp, Mus musculus
ccatcagcgttggagtagatgcgac

SEQ ID NO: 421036 - DNA, 25 bp, Mus musculus
ccatcagctatggagacagacagat

SEQ ID NO: 421037 - DNA, 25 bp, Mus musculus
ccatcaggtttagccaggaggagtc

SEQ ID NO: 421038 - DNA, 25 bp, Mus musculus
ccatcagtatgaatctccgggagca

SEQ ID NO: 421039 - DNA, 25 bp, Mus musculus
ccatcataggtcactgtggagctca

SEQ ID NO: 421040 - DNA, 25 bp, Mus musculus
ccatcatcaatgtcctgcagggtgt

SEQ ID NO: 421041 - DNA, 25 bp, Mus musculus
ccatcatctaatcccttcaagtcgt

SEQ ID NO: 421042 - DNA, 25 bp, Mus musculus
ccatcatgagatggctgaacaggca

SEQ ID NO: 421043 - DNA, 25 bp, Mus musculus
ccatcatgaggtggcagctttccgc

SEQ ID NO: 421044 - DNA, 25 bp, Mus musculus
ccatcatgcagtgggacaacagcac

SEQ ID NO: 421045 - DNA, 25 bp, Mus musculus
ccatcatggaagatcgaaagaatcc

SEQ ID NO: 421046 - DNA, 25 bp, Mus musculus
ccatcatggtaaggaaaggcaaact

SEQ ID NO: 421047 - DNA, 25 bp, Mus musculus
ccatcatttgaggtggcgcggactc

SEQ ID NO: 421048 - DNA, 25 bp, Mus musculus
ccatccactctggttgcttagcggg

SEQ ID NO: 421049 - DNA, 25 bp, Mus musculus
ccatccagtatgtgcagaagaacgg

SEQ ID NO: 421050 - DNA, 25 bp, Mus musculus
ccatccagtgaaagtcgggttgtct

SEQ ID NO: 421051 - DNA, 25 bp, Mus musculus
ccatcccacgaactgatgcaggcag

SEQ ID NO: 421052 - DNA, 25 bp, Mus musculus
ccatccccgagtgcagctgggtgtg

SEQ ID NO: 421053 - DNA, 25 bp, Mus musculus
ccatcccctgcttgtggagaaagga

SEQ ID NO: 421054 - DNA, 25 bp, Mus musculus
ccatcccgaggagtgcagtgaacct

SEQ ID NO: 421055 - DNA, 25 bp, Mus musculus
ccatcccgggcagggcaaagggaca

SEQ ID NO: 421056 - DNA, 25 bp, Mus musculus
ccatccgcaccagcttgaagagaaa

SEQ ID NO: 421057 - DNA, 25 bp, Mus musculus
ccatccgctgccttgggcctagagt

SEQ ID NO: 421058 - DNA, 25 bp, Mus musculus
ccatccggtggtgcattaatactcc

SEQ ID NO: 421059 - DNA, 25 bp, Mus musculus
ccatcctcactgtcaggcgacactt

SEQ ID NO: 421060 - DNA, 25 bp, Mus musculus
ccatcctcaggctattcatgttggg

SEQ ID NO: 421061 - DNA, 25 bp, Mus musculus
ccatcctcggaatgaagtgcaccag

SEQ ID NO: 421062 - DNA, 25 bp, Mus musculus
ccatcctgcacgttgaaaagggaag

SEQ ID NO: 421063 - DNA, 25 bp, Mus musculus
ccatcctgcctgaccataaaggagg

SEQ ID NO: 421064 - DNA, 25 bp, Mus musculus
ccatcctggagaaggtacaagggct

SEQ ID NO: 421065 - DNA, 25 bp, Mus musculus
ccatcctggagtgtaaactgtacga

SEQ ID NO: 421066 - DNA, 25 bp, Mus musculus
ccatcctggctcttgtggacggaca

SEQ ID NO: 421067 - DNA, 25 bp, Mus musculus
ccatccttttggtcagcctgtctag

SEQ ID NO: 421068 - DNA, 25 bp, Mus musculus
ccatcgacaagttcaccgggagggt

SEQ ID NO: 421069 - DNA, 25 bp, Mus musculus
ccatcgagaggcacgtgaaggtcat

SEQ ID NO: 421070 - DNA, 25 bp, Mus musculus
ccatcgagggcaccttaggatcgtc

SEQ ID NO: 421071 - DNA, 25 bp, Mus musculus
ccatcgatggcaaccgtagggaagg

SEQ ID NO: 421072 - DNA, 25 bp, Mus musculus
ccatcgcgctgaggagccaagtgta

SEQ ID NO: 421073 - DNA, 25 bp, Mus musculus
ccatcgctatgaggctttttcctag

SEQ ID NO: 421074 - DNA, 25 bp, Mus musculus
ccatcgctgcctccagagattagca

SEQ ID NO: 421075 - DNA, 25 bp, Mus musculus
ccatcgcttctctgtccaggctaag

SEQ ID NO: 421076 - DNA, 25 bp, Mus musculus
ccatcgggtatgcagtcctggagca

SEQ ID NO: 421077 - DNA, 25 bp, Mus musculus
ccatcgtggatagcatgaacgccca

SEQ ID NO: 421078 - DNA, 25 bp, Mus musculus
ccatcgtgtcggagggttgtctcca

SEQ ID NO: 421079 - DNA, 25 bp, Mus musculus
ccatcgtttccagggcaagagcaga

SEQ ID NO: 421080 - DNA, 25 bp, Mus musculus
ccatctaaagaggtgagcggtccga

SEQ ID NO: 421081 - DNA, 25 bp, Mus musculus
ccatctaccgtggaaaaccagtgga

SEQ ID NO: 421082 - DNA, 25 bp, Mus musculus
ccatctagctatgctggctggacag

SEQ ID NO: 421083 - DNA, 25 bp, Mus musculus
ccatctaggcgctgatggatgctgg

SEQ ID NO: 421084 - DNA, 25 bp, Mus musculus
ccatctagtcaagcaggccagtaag

SEQ ID NO: 421085 - DNA, 25 bp, Mus musculus
ccatctatgatacatttcccagcaa

SEQ ID NO: 421086 - DNA, 25 bp, Mus musculus
ccatctcagatatgcggaagagctg

SEQ ID NO: 421087 - DNA, 25 bp, Mus musculus
ccatctccgaggcagcttcttgttt

SEQ ID NO: 421088 - DNA, 25 bp, Mus musculus
ccatctcgctagctgtggagatggc

SEQ ID NO: 421089 - DNA, 25 bp, Mus musculus
ccatctcggaggctgcagactaagc

SEQ ID NO: 421090 - DNA, 25 bp, Mus musculus
ccatctctagatatcaacttcaatg

SEQ ID NO: 421091 - DNA, 25 bp, Mus musculus
ccatctctgaccacaggagtggagg

SEQ ID NO: 421092 - DNA, 25 bp, Mus musculus
ccatctctggaaactggaaggccaa

SEQ ID NO: 421093 - DNA, 25 bp, Mus musculus
ccatctctttatggaagccggcgag

SEQ ID NO: 421094 - DNA, 25 bp, Mus musculus
ccatctgcaacagggacccaaggtt

SEQ ID NO: 421095 - DNA, 25 bp, Mus musculus
ccatctgcaggttcgaggccttaca

SEQ ID NO: 421096 - DNA, 25 bp, Mus musculus
ccatctgctagtttattggaacatg

SEQ ID NO: 421097 - DNA, 25 bp, Mus musculus
ccatctgggacctcgtgctgggaag

SEQ ID NO: 421098 - DNA, 25 bp, Mus musculus
ccatctgggatcctgggctgctcag

SEQ ID NO: 421099 - DNA, 25 bp, Mus musculus
ccatctgtgggaagagcctggagtc

SEQ ID NO: 421100 - DNA, 25 bp, Mus musculus
ccatctgtgtgtctaagtgactgaa

SEQ ID NO: 421101 - DNA, 25 bp, Mus musculus
ccatctgttcaggattgctgtctgc

SEQ ID NO: 421102 - DNA, 25 bp, Mus musculus
ccatctgtttactgttcccctttga

SEQ ID NO: 421103 - DNA, 25 bp, Mus musculus
ccatcttcggaatgctgccaggaca

SEQ ID NO: 421104 - DNA, 25 bp, Mus musculus
ccatcttctgggaggtagcaggaaa

SEQ ID NO: 421105 - DNA, 25 bp, Mus musculus
ccatcttgagagtgcacagcactga

SEQ ID NO: 421106 - DNA, 25 bp, Mus musculus
ccatcttggagcagtagcagagcca

SEQ ID NO: 421107 - DNA, 25 bp, Mus musculus
ccatcttggtttgcaggaaggacga

SEQ ID NO: 421108 - DNA, 25 bp, Mus musculus
ccatcttgtcaggtgagggagtgaa

SEQ ID NO: 421109 - DNA, 25 bp, Mus musculus
ccatctttgggcagaggcagacgcc

SEQ ID NO: 421110 - DNA, 25 bp, Mus musculus
ccatgaaaagcatcgggactgggca

SEQ ID NO: 421111 - DNA, 25 bp, Mus musculus
ccatgaaagaagtcctgagcgtgca

SEQ ID NO: 421112 - DNA, 25 bp, Mus musculus
ccatgaaagctgataggatctttgc

SEQ ID NO: 421113 - DNA, 25 bp, Mus musculus
ccatgaaagggtatctggtggccat

SEQ ID NO: 421114 - DNA, 25 bp, Mus musculus
ccatgaaattgtgcaacccgggcgg

SEQ ID NO: 421115 - DNA, 25 bp, Mus musculus
ccatgaagacatggccccaggtgct

SEQ ID NO: 421116 - DNA, 25 bp, Mus musculus
ccatgaagaggtgcaaatcggacga

SEQ ID NO: 421117 - DNA, 25 bp, Mus musculus
ccatgaaggacgaggagtacgagca

SEQ ID NO: 421118 - DNA, 25 bp, Mus musculus
ccatgaaggagcagaaggacgagct

SEQ ID NO: 421119 - DNA, 25 bp, Mus musculus
ccatgaaggtgcgacttgtcacagt

SEQ ID NO: 421120 - DNA, 25 bp, Mus musculus
ccatgaagtatcagggtcaggctcg

SEQ ID NO: 421121 - DNA, 25 bp, Mus musculus
ccatgaatatggtggagctgcagca

SEQ ID NO: 421122 - DNA, 25 bp, Mus musculus
ccatgaatgagaagataccagagat

SEQ ID NO: 421123 - DNA, 25 bp, Mus musculus
ccatgacagtgtctcgtaagtggtc

SEQ ID NO: 421124 - DNA, 25 bp, Mus musculus
ccatgacagtgttcgggctatcctc

SEQ ID NO: 421125 - DNA, 25 bp, Mus musculus
ccatgacgacagaggaaagacggtg

SEQ ID NO: 421126 - DNA, 25 bp, Mus musculus
ccatgacggagtaagtatgcagcag

SEQ ID NO: 421127 - DNA, 25 bp, Mus musculus
ccatgactctcacaggtggcagcta

SEQ ID NO: 421128 - DNA, 25 bp, Mus musculus
ccatgagaaatataagcggaccttg

SEQ ID NO: 421129 - DNA, 25 bp, Mus musculus
ccatgagagataaggactgagtgcc

SEQ ID NO: 421130 - DNA, 25 bp, Mus musculus
ccatgaggcgtatcattttatcgac

SEQ ID NO: 421131 - DNA, 25 bp, Mus musculus
ccatgaggctggaatacacgggagt

SEQ ID NO: 421132 - DNA, 25 bp, Mus musculus
ccatgaggtaatgtggctgcagcat

SEQ ID NO: 421133 - DNA, 25 bp, Mus musculus
ccatgagtagtttggacccacggga

SEQ ID NO: 421134 - DNA, 25 bp, Mus musculus
ccatgagtctcgagggaaagccaag

SEQ ID NO: 421135 - DNA, 25 bp, Mus musculus
ccatgagtgcagtggtaggcgacca

SEQ ID NO: 421136 - DNA, 25 bp, Mus musculus
ccatgagttctttgaacatgagtga

SEQ ID NO: 421137 - DNA, 25 bp, Mus musculus
ccatgataacctgcgaatgactgcc

SEQ ID NO: 421138 - DNA, 25 bp, Mus musculus
ccatgatcagtgctagcggactaga

SEQ ID NO: 421139 - DNA, 25 bp, Mus musculus
ccatgatcgatgtctgctgagagaa

SEQ ID NO: 421140 - DNA, 25 bp, Mus musculus
ccatgatgacgagggagcagataca

SEQ ID NO: 421141 - DNA, 25 bp, Mus musculus
ccatgatggagctgggtgctcagca

SEQ ID NO: 421142 - DNA, 25 bp, Mus musculus
ccatgattgcttgcccaaggaggcg

SEQ ID NO: 421143 - DNA, 25 bp, Mus musculus
ccatgcacagaagggaaggagtaca

SEQ ID NO: 421144 - DNA, 25 bp, Mus musculus
ccatgcacttgtgggaaggtagccc

SEQ ID NO: 421145 - DNA, 25 bp, Mus musculus
ccatgcagacagagacggcttgaca

SEQ ID NO: 421146 - DNA, 25 bp, Mus musculus
ccatgcagacatcaagacgggctac

SEQ ID NO: 421147 - DNA, 25 bp, Mus musculus
ccatgcagatgagacctggtttcta

SEQ ID NO: 421148 - DNA, 25 bp, Mus musculus
ccatgcatgttagacaaagccttga

SEQ ID NO: 421149 - DNA, 25 bp, Mus musculus
ccatgccaaccgcacagtggcaggg

SEQ ID NO: 421150 - DNA, 25 bp, Mus musculus
ccatgccagagaaggtcaggtcacc

SEQ ID NO: 421151 - DNA, 25 bp, Mus musculus
ccatgccatcgaagctgagaagttt

SEQ ID NO: 421152 - DNA, 25 bp, Mus musculus
ccatgccgagcgagatcaaagggct

SEQ ID NO: 421153 - DNA, 25 bp, Mus musculus
ccatgccggtcaaaggaggtagcaa

SEQ ID NO: 421154 - DNA, 25 bp, Mus musculus
ccatgcctacagtgtcttaagacgc

SEQ ID NO: 421155 - DNA, 25 bp, Mus musculus
ccatgcgacctggaggaactacaga

SEQ ID NO: 421156 - DNA, 25 bp, Mus musculus
ccatgctacatgagaccaggagtcc

SEQ ID NO: 421157 - DNA, 25 bp, Mus musculus
ccatgctatgccaagagccagtggc

SEQ ID NO: 421158 - DNA, 25 bp, Mus musculus
ccatgctcagtgtggatgatttcca

SEQ ID NO: 421159 - DNA, 25 bp, Mus musculus
ccatgctgatgagtacctagaagtc

SEQ ID NO: 421160 - DNA, 25 bp, Mus musculus
ccatgctgcagctgaagggtcgagt

SEQ ID NO: 421161 - DNA, 25 bp, Mus musculus
ccatgctgtcatacctcacgggaaa

SEQ ID NO: 421162 - DNA, 25 bp, Mus musculus
ccatgcttgtacacagaggccagag

SEQ ID NO: 421163 - DNA, 25 bp, Mus musculus
ccatggaaacgttctgagacaggcg

SEQ ID NO: 421164 - DNA, 25 bp, Mus musculus
ccatggaaagttgggtacatgaacc

SEQ ID NO: 421165 - DNA, 25 bp, Mus musculus
ccatggaacgcgacggctccagtgg

SEQ ID NO: 421166 - DNA, 25 bp, Mus musculus
ccatggaaggagtgaagtcctgttc

SEQ ID NO: 421167 - DNA, 25 bp, Mus musculus
ccatggaataaagagttacagaact

SEQ ID NO: 421168 - DNA, 25 bp, Mus musculus
ccatggacccatagattttttgaca

SEQ ID NO: 421169 - DNA, 25 bp, Mus musculus
ccatggacgtatgtttggaggtgca

SEQ ID NO: 421170 - DNA, 25 bp, Mus musculus
ccatggactgaggattcgtgcattc

SEQ ID NO: 421171 - DNA, 25 bp, Mus musculus
ccatggagacaagaggacacgagtt

SEQ ID NO: 421172 - DNA, 25 bp, Mus musculus
ccatggagagctagctgtaagcagt

SEQ ID NO: 421173 - DNA, 25 bp, Mus musculus
ccatggagagcttcactgggtacca

SEQ ID NO: 421174 - DNA, 25 bp, Mus musculus
ccatggagatgggaagatgacagcc

SEQ ID NO: 421175 - DNA, 25 bp, Mus musculus
ccatggagccgagaagagcagcttt

SEQ ID NO: 421176 - DNA, 25 bp, Mus musculus
ccatggagccggtgtttgtgtgcca

SEQ ID NO: 421177 - DNA, 25 bp, Mus musculus
ccatggataggactcagacaacaga

SEQ ID NO: 421178 - DNA, 25 bp, Mus musculus
ccatggatcaggtcaactggctgtc

SEQ ID NO: 421179 - DNA, 25 bp, Mus musculus
ccatggatccattcagtttctagac

SEQ ID NO: 421180 - DNA, 25 bp, Mus musculus
ccatggatgggttttgtgatcagca

SEQ ID NO: 421181 - DNA, 25 bp, Mus musculus
ccatggatggtcaaaactgagcagc

SEQ ID NO: 421182 - DNA, 25 bp, Mus musculus
ccatggattctacagtggaggatgc

SEQ ID NO: 421183 - DNA, 25 bp, Mus musculus
ccatggcaaaatctggagagagtaa

SEQ ID NO: 421184 - DNA, 25 bp, Mus musculus
ccatggcagaaagttgtagggcgtc

SEQ ID NO: 421185 - DNA, 25 bp, Mus musculus
ccatggcatccagtgcccagagaaa

SEQ ID NO: 421186 - DNA, 25 bp, Mus musculus
ccatggcggaacagaagagcctctc

SEQ ID NO: 421187 - DNA, 25 bp, Mus musculus
ccatggcggacgctccactttaggg

SEQ ID NO: 421188 - DNA, 25 bp, Mus musculus
ccatggcggagaagaggcagctctt

SEQ ID NO: 421189 - DNA, 25 bp, Mus musculus
ccatggctctggacgggataaggat

SEQ ID NO: 421190 - DNA, 25 bp, Mus musculus
ccatgggaaagcaaacggtgaaccg

SEQ ID NO: 421191 - DNA, 25 bp, Mus musculus
ccatgggaaatgaagcagctactgc

SEQ ID NO: 421192 - DNA, 25 bp, Mus musculus
ccatgggaagtgttactgtggaaac

SEQ ID NO: 421193 - DNA, 25 bp, Mus musculus
ccatgggacagacagaatgatcctc

SEQ ID NO: 421194 - DNA, 25 bp, Mus musculus
ccatgggagggaggcattcatctac

SEQ ID NO: 421195 - DNA, 25 bp, Mus musculus
ccatgggatgcaggcggctctttgt

SEQ ID NO: 421196 - DNA, 25 bp, Mus musculus
ccatgggcaccaatgaatacttgtc

SEQ ID NO: 421197 - DNA, 25 bp, Mus musculus
ccatgggcgcagcaggtgtatacta

SEQ ID NO: 421198 - DNA, 25 bp, Mus musculus
ccatgggtatatctaaactgcggcc

SEQ ID NO: 421199 - DNA, 25 bp, Mus musculus
ccatgggtcagagcttaggaagtcc

SEQ ID NO: 421200 - DNA, 25 bp, Mus musculus
ccatgggtccacgtgtgatgcggct

SEQ ID NO: 421201 - DNA, 25 bp, Mus musculus
ccatgggtcgacagaaggagttgat

SEQ ID NO: 421202 - DNA, 25 bp, Mus musculus
ccatggtacagctaatgcagcagta

SEQ ID NO: 421203 - DNA, 25 bp, Mus musculus
ccatggtaggcaggtcagcaaggac

SEQ ID NO: 421204 - DNA, 25 bp, Mus musculus
ccatggtattggagggcgggtgcag

SEQ ID NO: 421205 - DNA, 25 bp, Mus musculus
ccatggtgagcgagtttccgggtcc

SEQ ID NO: 421206 - DNA, 25 bp, Mus musculus
ccatggtggactactacgaggtgct

SEQ ID NO: 421207 - DNA, 25 bp, Mus musculus
ccatggtggagcctatgagtatcga

SEQ ID NO: 421208 - DNA, 25 bp, Mus musculus
ccatggtgtcctgctgaatctaaaa

SEQ ID NO: 421209 - DNA, 25 bp, Mus musculus
ccatgtaaaattaatgcagttctcg

SEQ ID NO: 421210 - DNA, 25 bp, Mus musculus
ccatgtaggtggtctctggaagata

SEQ ID NO: 421211 - DNA, 25 bp, Mus musculus
ccatgtattagaagcgcaggaccta

SEQ ID NO: 421212 - DNA, 25 bp, Mus musculus
ccatgtattgggagaaacggcggaa

SEQ ID NO: 421213 - DNA, 25 bp, Mus musculus
ccatgtcattgaatggtcagtgttg

SEQ ID NO: 421214 - DNA, 25 bp, Mus musculus
ccatgtccaggtccatctctgtaat

SEQ ID NO: 421215 - DNA, 25 bp, Mus musculus
ccatgtcgagaccatatttcaaaga

SEQ ID NO: 421216 - DNA, 25 bp, Mus musculus
ccatgtctctagttccatgagggag

SEQ ID NO: 421217 - DNA, 25 bp, Mus musculus
ccatgtctgacgatgtccaggatga

SEQ ID NO: 421218 - DNA, 25 bp, Mus musculus
ccatgtctgagcacaggagtcgttc

SEQ ID NO: 421219 - DNA, 25 bp, Mus musculus
ccatgtctgcgttggattcaggaag

SEQ ID NO: 421220 - DNA, 25 bp, Mus musculus
ccatgtcttagttggatgtccctga

SEQ ID NO: 421221 - DNA, 25 bp, Mus musculus
ccatgtgagctgagtactggctgct

SEQ ID NO: 421222 - DNA, 25 bp, Mus musculus
ccatgtgattggaaaccggctcaaa

SEQ ID NO: 421223 - DNA, 25 bp, Mus musculus
ccatgtgggtgctgttaatgagcca

SEQ ID NO: 421224 - DNA, 25 bp, Mus musculus
ccatgtgtatgcaagtggctatgca

SEQ ID NO: 421225 - DNA, 25 bp, Mus musculus
ccatgtgtgggtacaagtcttgtca

SEQ ID NO: 421226 - DNA, 25 bp, Mus musculus
ccatgtgtgtgtaagccagaggacc

SEQ ID NO: 421227 - DNA, 25 bp, Mus musculus
ccatgttcctagagttgatgagtcc

SEQ ID NO: 421228 - DNA, 25 bp, Mus musculus
ccatgttctctaggagtccccagga

SEQ ID NO: 421229 - DNA, 25 bp, Mus musculus
ccatgttgatcagctcacggaggag

SEQ ID NO: 421230 - DNA, 25 bp, Mus musculus
ccatgttgggtaagtgtgtgtgcct

SEQ ID NO: 421231 - DNA, 25 bp, Mus musculus
ccatgttgttggtagcctgaggcag

SEQ ID NO: 421232 - DNA, 25 bp, Mus musculus
ccattaaagtgagtgcgctaacgca

SEQ ID NO: 421233 - DNA, 25 bp, Mus musculus
ccattaaccattagtaagatgatat

SEQ ID NO: 421234 - DNA, 25 bp, Mus musculus
ccattaactcattttctcagcagta

SEQ ID NO: 421235 - DNA, 25 bp, Mus musculus
ccattaatagatccgagctggatcc

SEQ ID NO: 421236 - DNA, 25 bp, Mus musculus
ccattacagatgtcaccaggactca

SEQ ID NO: 421237 - DNA, 25 bp, Mus musculus
ccattacagatgtgttgcagaagct

SEQ ID NO: 421238 - DNA, 25 bp, Mus musculus
ccattacatagataggatcaaggtc

SEQ ID NO: 421239 - DNA, 25 bp, Mus musculus
ccattacatgtgttgggcacccggg

SEQ ID NO: 421240 - DNA, 25 bp, Mus musculus
ccattaccagtgaggacgtggcaga

SEQ ID NO: 421241 - DNA, 25 bp, Mus musculus
ccattacgatggctacttggctaaa

SEQ ID NO: 421242 - DNA, 25 bp, Mus musculus
ccattactccggaggagggcaggct

SEQ ID NO: 421243 - DNA, 25 bp, Mus musculus
ccattactggtctgtgcaggtgcca

SEQ ID NO: 421244 - DNA, 25 bp, Mus musculus
ccattagactcagctgtgaggcatt

SEQ ID NO: 421245 - DNA, 25 bp, Mus musculus
ccattatatgtacgtggctacggca

SEQ ID NO: 421246 - DNA, 25 bp, Mus musculus
ccattattcctcaagattcctcaga

SEQ ID NO: 421247 - DNA, 25 bp, Mus musculus
ccattattgagtttgcaggcccagt

SEQ ID NO: 421248 - DNA, 25 bp, Mus musculus
ccattcaaagagctctgtactccat

SEQ ID NO: 421249 - DNA, 25 bp, Mus musculus
ccattcagaaataggctgctacctc

SEQ ID NO: 421250 - DNA, 25 bp, Mus musculus
ccattcagcaggagcgatcgcagga

SEQ ID NO: 421251 - DNA, 25 bp, Mus musculus
ccattcatctatgaggtatgagcaa

SEQ ID NO: 421252 - DNA, 25 bp, Mus musculus
ccattcatggatgcgctagcagcca

SEQ ID NO: 421253 - DNA, 25 bp, Mus musculus
ccattcattgagaagtccaggagat

SEQ ID NO: 421254 - DNA, 25 bp, Mus musculus
ccattccgtttgcatccagaacaga

SEQ ID NO: 421255 - DNA, 25 bp, Mus musculus
ccattcctaaggactgccatccaaa

SEQ ID NO: 421256 - DNA, 25 bp, Mus musculus
ccattcggtagtctagctgactcca

SEQ ID NO: 421257 - DNA, 25 bp, Mus musculus
ccattctgaattgacgcggtactcc

SEQ ID NO: 421258 - DNA, 25 bp, Mus musculus
ccattctgcatagggtagctgctcc

SEQ ID NO: 421259 - DNA, 25 bp, Mus musculus
ccattgaacttctgtagggaaagcc

SEQ ID NO: 421260 - DNA, 25 bp, Mus musculus
ccattgaatctgagtatgaatatac

SEQ ID NO: 421261 - DNA, 25 bp, Mus musculus
ccattgaatgtgttaggtctgcttg

SEQ ID NO: 421262 - DNA, 25 bp, Mus musculus
ccattgacatgatcgaggcctaaca

SEQ ID NO: 421263 - DNA, 25 bp, Mus musculus
ccattgaccccaccaggaagcagaa

SEQ ID NO: 421264 - DNA, 25 bp, Mus musculus
ccattgagagaagtaaccaggagca

SEQ ID NO: 421265 - DNA, 25 bp, Mus musculus
ccattgagggctctggacgcacaga

SEQ ID NO: 421266 - DNA, 25 bp, Mus musculus
ccattgatggcagtgacggtgtaac

SEQ ID NO: 421267 - DNA, 25 bp, Mus musculus
ccattgcatgtggattggcaccaaa

SEQ ID NO: 421268 - DNA, 25 bp, Mus musculus
ccattgcggtggacaggtacatcac

SEQ ID NO: 421269 - DNA, 25 bp, Mus musculus
ccattgctagaaactcgggctgaag

SEQ ID NO: 421270 - DNA, 25 bp, Mus musculus
ccattgctggagcaggcatcctgta

SEQ ID NO: 421271 - DNA, 25 bp, Mus musculus
ccattgctgtgtgggcttagagcca

SEQ ID NO: 421272 - DNA, 25 bp, Mus musculus
ccattgcttgacatgggccgcttga

SEQ ID NO: 421273 - DNA, 25 bp, Mus musculus
ccattgcttggttgatctttgctca

SEQ ID NO: 421274 - DNA, 25 bp, Mus musculus
ccattggaccttgtctgtagtatca

SEQ ID NO: 421275 - DNA, 25 bp, Mus musculus
ccattggccacttgcgggatgagca

SEQ ID NO: 421276 - DNA, 25 bp, Mus musculus
ccattggcccagagggggtccatca

SEQ ID NO: 421277 - DNA, 25 bp, Mus musculus
ccattggcctgtgtagagatgccca

SEQ ID NO: 421278 - DNA, 25 bp, Mus musculus
ccattggctgccttgggattcacgc

SEQ ID NO: 421279 - DNA, 25 bp, Mus musculus
ccattggctgttcacaccgcgtctg

SEQ ID NO: 421280 - DNA, 25 bp, Mus musculus
ccattgggttgtacttgaggcagga

SEQ ID NO: 421281 - DNA, 25 bp, Mus musculus
ccattggtgatgtaacaaggacgtc

SEQ ID NO: 421282 - DNA, 25 bp, Mus musculus
ccattggtgtggacttcgcgctgaa

SEQ ID NO: 421283 - DNA, 25 bp, Mus musculus
ccattgtagccttgcgacccagagt

SEQ ID NO: 421284 - DNA, 25 bp, Mus musculus
ccattgtcttggcagataaaggtca

SEQ ID NO: 421285 - DNA, 25 bp, Mus musculus
ccattgtgagagatgcctttggacc

SEQ ID NO: 421286 - DNA, 25 bp, Mus musculus
ccattgtggtggtgagctccttgct

SEQ ID NO: 421287 - DNA, 25 bp, Mus musculus
ccattgtgtacaagtgtgggccgca

SEQ ID NO: 421288 - DNA, 25 bp, Mus musculus
ccattgtgtgggttctggtatcgaa

SEQ ID NO: 421289 - DNA, 25 bp, Mus musculus
ccattgttcaggattaagcgagcca

SEQ ID NO: 421290 - DNA, 25 bp, Mus musculus
ccattgttgatactgtggactcaga

SEQ ID NO: 421291 - DNA, 25 bp, Mus musculus
ccatttagaggagaacccaggtgtc

SEQ ID NO: 421292 - DNA, 25 bp, Mus musculus
ccatttcgatggaagcgggtacgcc

SEQ ID NO: 421293 - DNA, 25 bp, Mus musculus
ccatttctgaggagcaagcttgttc

SEQ ID NO: 421294 - DNA, 25 bp, Mus musculus
ccatttctgctgaggaataaacagc

SEQ ID NO: 421295 - DNA, 25 bp, Mus musculus
ccatttctggactaggcggttgctt

SEQ ID NO: 421296 - DNA, 25 bp, Mus musculus
ccatttcttcggtgacaagtggagc

SEQ ID NO: 421297 - DNA, 25 bp, Mus musculus
ccatttgaaacagatagcacaggag

SEQ ID NO: 421298 - DNA, 25 bp, Mus musculus
ccatttgactggtgtggtcccttac

SEQ ID NO: 421299 - DNA, 25 bp, Mus musculus
ccatttgaggaagaaattggccagc

SEQ ID NO: 421300 - DNA, 25 bp, Mus musculus
ccatttgggagtgatccgggacttc

SEQ ID NO: 421301 - DNA, 25 bp, Mus musculus
ccatttgtccaagctcaggccgtta

SEQ ID NO: 421302 - DNA, 25 bp, Mus musculus
ccatttgtggatgagcgaaggctgc

SEQ ID NO: 421303 - DNA, 25 bp, Mus musculus
ccatttgtgtacgaggatcttccca

SEQ ID NO: 421304 - DNA, 25 bp, Mus musculus
ccattttaaggaccgtctggccacg

SEQ ID NO: 421305 - DNA, 25 bp, Mus musculus
ccattttactggcactgatcagaga

SEQ ID NO: 421306 - DNA, 25 bp, Mus musculus
ccattttatttctaatgtaggcaga

SEQ ID NO: 421307 - DNA, 25 bp, Mus musculus
ccattttgccaagggagctttagcc

SEQ ID NO: 421308 - DNA, 25 bp, Mus musculus
ccatttttctagaagagagcgggag

SEQ ID NO: 421309 - DNA, 25 bp, Mus musculus
cccaaaaagctaaacagtgatggag

SEQ ID NO: 421310 - DNA, 25 bp, Mus musculus
cccaaacagaggcagagtgtacagc

SEQ ID NO: 421311 - DNA, 25 bp, Mus musculus
cccaaacagaggtgataccaagcaa

SEQ ID NO: 421312 - DNA, 25 bp, Mus musculus
cccaaaccactatgagacgctgtgt

SEQ ID NO: 421313 - DNA, 25 bp, Mus musculus
cccaaactgacatccaatattaaat

SEQ ID NO: 421314 - DNA, 25 bp, Mus musculus
cccaaactggtgtcattacggaaca

SEQ ID NO: 421315 - DNA, 25 bp, Mus musculus
cccaaactttgtggaggctgtgtcc

SEQ ID NO: 421316 - DNA, 25 bp, Mus musculus
cccaaagacatcaggtgactccagt

SEQ ID NO: 421317 - DNA, 25 bp, Mus musculus
cccaaagagaaagcatgaaagaact

SEQ ID NO: 421318 - DNA, 25 bp, Mus musculus
cccaaagcaaaaagtcgggagctag

SEQ ID NO: 421319 - DNA, 25 bp, Mus musculus
cccaaaggcttggatctggaccggc

SEQ ID NO: 421320 - DNA, 25 bp, Mus musculus
cccaaaggtactgcggcattgctga

SEQ ID NO: 421321 - DNA, 25 bp, Mus musculus
cccaaaggttgcttgaggagatcca

SEQ ID NO: 421322 - DNA, 25 bp, Mus musculus
cccaaagtacttacgaaagaagcag

SEQ ID NO: 421323 - DNA, 25 bp, Mus musculus
cccaaagtagaagagtgcaaggcac

SEQ ID NO: 421324 - DNA, 25 bp, Mus musculus
cccaaagtggcagtagggaatagga

SEQ ID NO: 421325 - DNA, 25 bp, Mus musculus
cccaaagttggccagaagtgcatca

SEQ ID NO: 421326 - DNA, 25 bp, Mus musculus
cccaaagtttaggaggcgctgcagt

SEQ ID NO: 421327 - DNA, 25 bp, Mus musculus
cccaaatactgttggaagagagctg

SEQ ID NO: 421328 - DNA, 25 bp, Mus musculus
cccaaatagacgagagccgagtgtc

SEQ ID NO: 421329 - DNA, 25 bp, Mus musculus
cccaaatgctgggaataattgcgga

SEQ ID NO: 421330 - DNA, 25 bp, Mus musculus
cccaaatgggcctggacgagtgtca

SEQ ID NO: 421331 - DNA, 25 bp, Mus musculus
cccaacaccaagaggcaagcacaga

SEQ ID NO: 421332 - DNA, 25 bp, Mus musculus
cccaacaggaggacaattcatgaac

SEQ ID NO: 421333 - DNA, 25 bp, Mus musculus
cccaacatagaagacaggagtgaga

SEQ ID NO: 421334 - DNA, 25 bp, Mus musculus
cccaacgagaagagtatgaggctac

SEQ ID NO: 421335 - DNA, 25 bp, Mus musculus
cccaacggtgaggtttctgtgacac

SEQ ID NO: 421336 - DNA, 25 bp, Mus musculus
cccaactcttaggagcctgatgtaa

SEQ ID NO: 421337 - DNA, 25 bp, Mus musculus
cccaacttgaaggtgcggtccaggt

SEQ ID NO: 421338 - DNA, 25 bp, Mus musculus
cccaagactaaggaggaagcagaca

SEQ ID NO: 421339 - DNA, 25 bp, Mus musculus
cccaagagatgagccaaggatgtgg

SEQ ID NO: 421340 - DNA, 25 bp, Mus musculus
cccaagagatggaagataggtgact

SEQ ID NO: 421341 - DNA, 25 bp, Mus musculus
cccaagagatggaagtcggacttca

SEQ ID NO: 421342 - DNA, 25 bp, Mus musculus
cccaagagcagttgcctgagggaga

SEQ ID NO: 421343 - DNA, 25 bp, Mus musculus
cccaagagggactggctttctgaga

SEQ ID NO: 421344 - DNA, 25 bp, Mus musculus
cccaagatgtgctggttccctggca

SEQ ID NO: 421345 - DNA, 25 bp, Mus musculus
cccaagatttggaggcttcaggcaa

SEQ ID NO: 421346 - DNA, 25 bp, Mus musculus
cccaagcgaacaagagcagggctag

SEQ ID NO: 421347 - DNA, 25 bp, Mus musculus
cccaaggaatgagatacacagagcc

SEQ ID NO: 421348 - DNA, 25 bp, Mus musculus
cccaaggaggttccttagtatggtg

SEQ ID NO: 421349 - DNA, 25 bp, Mus musculus
cccaaggcctcttattaagtgagaa

SEQ ID NO: 421350 - DNA, 25 bp, Mus musculus
cccaaggcgacacagagggttagct

SEQ ID NO: 421351 - DNA, 25 bp, Mus musculus
cccaaggctaaagggcataagtgac

SEQ ID NO: 421352 - DNA, 25 bp, Mus musculus
cccaagggatggctattattcaggt

SEQ ID NO: 421353 - DNA, 25 bp, Mus musculus
cccaagggcccgcatactttctggg

SEQ ID NO: 421354 - DNA, 25 bp, Mus musculus
cccaagggcgctgtctggttgctct

SEQ ID NO: 421355 - DNA, 25 bp, Mus musculus
cccaagggtgagattcggtcagcca

SEQ ID NO: 421356 - DNA, 25 bp, Mus musculus
cccaagggtgccatgaagtgctgct

SEQ ID NO: 421357 - DNA, 25 bp, Mus musculus
cccaaggtggttaattttgcatgga

SEQ ID NO: 421358 - DNA, 25 bp, Mus musculus
cccaagtagagagtgagtgagtgcc

SEQ ID NO: 421359 - DNA, 25 bp, Mus musculus
cccaagtaggcaggcgccagtggtt

SEQ ID NO: 421360 - DNA, 25 bp, Mus musculus
cccaagtcgctcttcagagagtgag

SEQ ID NO: 421361 - DNA, 25 bp, Mus musculus
cccaagtctccgtggtaggtgacaa

SEQ ID NO: 421362 - DNA, 25 bp, Mus musculus
cccaagtcttctcttataatggagg

SEQ ID NO: 421363 - DNA, 25 bp, Mus musculus
cccaagtgaaaaccgcgacgacctg

SEQ ID NO: 421364 - DNA, 25 bp, Mus musculus
cccaagtgggtgatgaatgtggcca

SEQ ID NO: 421365 - DNA, 25 bp, Mus musculus
cccaagtgtcattctggctgaacag

SEQ ID NO: 421366 - DNA, 25 bp, Mus musculus
cccaagtgtcttcaatggccacaag

SEQ ID NO: 421367 - DNA, 25 bp, Mus musculus
cccaagttcctagattaaagtcatg

SEQ ID NO: 421368 - DNA, 25 bp, Mus musculus
cccaagttggtgtcaaaagccatca

SEQ ID NO: 421369 - DNA, 25 bp, Mus musculus
cccaataccctcttatatatagcag

SEQ ID NO: 421370 - DNA, 25 bp, Mus musculus
cccaatatggcggtgatgatcaagt

SEQ ID NO: 421371 - DNA, 25 bp, Mus musculus
cccaatcagacaagtgcccgtaatc

SEQ ID NO: 421372 - DNA, 25 bp, Mus musculus
cccaatgaacgagaagaacaccgct

SEQ ID NO: 421373 - DNA, 25 bp, Mus musculus
cccaatgctggatgagagaggttac

SEQ ID NO: 421374 - DNA, 25 bp, Mus musculus
cccaatggccagtgacaaatgttga

SEQ ID NO: 421375 - DNA, 25 bp, Mus musculus
cccaatggccgtgtggatatagcac

SEQ ID NO: 421376 - DNA, 25 bp, Mus musculus
cccaatgtagatctcggccctgtgg

SEQ ID NO: 421377 - DNA, 25 bp, Mus musculus
cccaatgtggcctgggaagaagtcg

SEQ ID NO: 421378 - DNA, 25 bp, Mus musculus
cccaattctgtcagtcattacttta

SEQ ID NO: 421379 - DNA, 25 bp, Mus musculus
cccaattgggaggagagcctgtaca

SEQ ID NO: 421380 - DNA, 25 bp, Mus musculus
cccaatttcatgtcctttctcttat

SEQ ID NO: 421381 - DNA, 25 bp, Mus musculus
cccacaaggagcagaaccaggttct

SEQ ID NO: 421382 - DNA, 25 bp, Mus musculus
cccacaatgggatgtttgaggcgaa

SEQ ID NO: 421383 - DNA, 25 bp, Mus musculus
cccacacagatctgagctactcgtt

SEQ ID NO: 421384 - DNA, 25 bp, Mus musculus
cccacactggaaggagaaaatagac

SEQ ID NO: 421385 - DNA, 25 bp, Mus musculus
cccacagagtggcatttgttgaaaa

SEQ ID NO: 421386 - DNA, 25 bp, Mus musculus
cccacagatcgtcggaaagcagcta

SEQ ID NO: 421387 - DNA, 25 bp, Mus musculus
cccacagcagaagggagcatgtctc

SEQ ID NO: 421388 - DNA, 25 bp, Mus musculus
cccacagcaggaaggaggtcggatt

SEQ ID NO: 421389 - DNA, 25 bp, Mus musculus
cccacagcatgaagggataaaccta

SEQ ID NO: 421390 - DNA, 25 bp, Mus musculus
cccacagcttggtaaaagttttgct

SEQ ID NO: 421391 - DNA, 25 bp, Mus musculus
cccacagggaactctgaggctggtt

SEQ ID NO: 421392 - DNA, 25 bp, Mus musculus
cccacagtgagaatccagtagctat

SEQ ID NO: 421393 - DNA, 25 bp, Mus musculus
cccacataggaactagctagataat

SEQ ID NO: 421394 - DNA, 25 bp, Mus musculus
cccacattgggcttgtggaatggat

SEQ ID NO: 421395 - DNA, 25 bp, Mus musculus
cccacatttgcagttggccaagagg

SEQ ID NO: 421396 - DNA, 25 bp, Mus musculus
cccaccagaggaggacgatgatgtt

SEQ ID NO: 421397 - DNA, 25 bp, Mus musculus
cccaccagagggactttatgagaaa

SEQ ID NO: 421398 - DNA, 25 bp, Mus musculus
cccaccaggatataagggtctcaga

SEQ ID NO: 421399 - DNA, 25 bp, Mus musculus
cccaccatgttccttgccatgatga

SEQ ID NO: 421400 - DNA, 25 bp, Mus musculus
cccacccctgattgtcaggatcgaa

SEQ ID NO: 421401 - DNA, 25 bp, Mus musculus
cccacctggttgaggtacagcacga

SEQ ID NO: 421402 - DNA, 25 bp, Mus musculus
cccacgaccgtgtgcttcttgcgag

SEQ ID NO: 421403 - DNA, 25 bp, Mus musculus
cccacgatgagtgaaccagaggtca

SEQ ID NO: 421404 - DNA, 25 bp, Mus musculus
cccacgcgggtgacatacattttat

SEQ ID NO: 421405 - DNA, 25 bp, Mus musculus
cccacggaggtcacaaggtcaaggt

SEQ ID NO: 421406 - DNA, 25 bp, Mus musculus
cccacggagttcgagtttgtcacca

SEQ ID NO: 421407 - DNA, 25 bp, Mus musculus
cccacggcggaggatctagatgcca

SEQ ID NO: 421408 - DNA, 25 bp, Mus musculus
cccacgggagctagtcagaagaagt

SEQ ID NO: 421409 - DNA, 25 bp, Mus musculus
cccacggtggcatgtttcaaagctg

SEQ ID NO: 421410 - DNA, 25 bp, Mus musculus
cccacggtggtccttgagcaagtca

SEQ ID NO: 421411 - DNA, 25 bp, Mus musculus
cccacgtgatgagcagatgtcttaa

SEQ ID NO: 421412 - DNA, 25 bp, Mus musculus
cccactacctgaggaatgtcatgta

SEQ ID NO: 421413 - DNA, 25 bp, Mus musculus
cccactgaacagctgtgcactggtc

SEQ ID NO: 421414 - DNA, 25 bp, Mus musculus
cccactgacattgtcaaaaggctct

SEQ ID NO: 421415 - DNA, 25 bp, Mus musculus
cccactgagcaaggcctgtatgaca

SEQ ID NO: 421416 - DNA, 25 bp, Mus musculus
cccactgctgagtctgcagagagct

SEQ ID NO: 421417 - DNA, 25 bp, Mus musculus
cccactgggttgaggccaatctgta

SEQ ID NO: 421418 - DNA, 25 bp, Mus musculus
cccacttatccgtggtaggcctgcg

SEQ ID NO: 421419 - DNA, 25 bp, Mus musculus
cccacttggcgggagatgttccggt

SEQ ID NO: 421420 - DNA, 25 bp, Mus musculus
cccagaaaaggaaatctcgtccaga

SEQ ID NO: 421421 - DNA, 25 bp, Mus musculus
cccagaaaatgagagatatcccgtg

SEQ ID NO: 421422 - DNA, 25 bp, Mus musculus
cccagaaagctaagtggtgactcta

SEQ ID NO: 421423 - DNA, 25 bp, Mus musculus
cccagaagatggaaaagcggatatt

SEQ ID NO: 421424 - DNA, 25 bp, Mus musculus
cccagaagctgccttggcctgaaga

SEQ ID NO: 421425 - DNA, 25 bp, Mus musculus
cccagaaggaagacaggatgccgat

SEQ ID NO: 421426 - DNA, 25 bp, Mus musculus
cccagaaggagacaagaaggaccca

SEQ ID NO: 421427 - DNA, 25 bp, Mus musculus
cccagaagggtaccgagatgagcat

SEQ ID NO: 421428 - DNA, 25 bp, Mus musculus
cccagaaggtatatgtactaaattg

SEQ ID NO: 421429 - DNA, 25 bp, Mus musculus
cccagaagtttcttagtagcagaga

SEQ ID NO: 421430 - DNA, 25 bp, Mus musculus
cccagaagttttacaccgagtatat

SEQ ID NO: 421431 - DNA, 25 bp, Mus musculus
cccagaataatagtggaataggatt

SEQ ID NO: 421432 - DNA, 25 bp, Mus musculus
cccagaatgagtgcaggaagctaca

SEQ ID NO: 421433 - DNA, 25 bp, Mus musculus
cccagaatggagtcgccaaggagga

SEQ ID NO: 421434 - DNA, 25 bp, Mus musculus
cccagacagtggtgagaatgcccag

SEQ ID NO: 421435 - DNA, 25 bp, Mus musculus
cccagacatcagtgggtcaagcagg

SEQ ID NO: 421436 - DNA, 25 bp, Mus musculus
cccagacctggagtgatcaagacca

SEQ ID NO: 421437 - DNA, 25 bp, Mus musculus
cccagacggagttgtgatccgtgac

SEQ ID NO: 421438 - DNA, 25 bp, Mus musculus
cccagacgggagatttaagatgcta

SEQ ID NO: 421439 - DNA, 25 bp, Mus musculus
cccagactacagtaatactcaacaa

SEQ ID NO: 421440 - DNA, 25 bp, Mus musculus
cccagactgcggttcacggatttat

SEQ ID NO: 421441 - DNA, 25 bp, Mus musculus
cccagagaagtgaagtgaggtgccc

SEQ ID NO: 421442 - DNA, 25 bp, Mus musculus
cccagagcttcagggacaatgatgt

SEQ ID NO: 421443 - DNA, 25 bp, Mus musculus
cccagagcttctcaaatataacgaa

SEQ ID NO: 421444 - DNA, 25 bp, Mus musculus
cccagaggacatgattgaggcagcc

SEQ ID NO: 421445 - DNA, 25 bp, Mus musculus
cccagaggcctgagaacagaggtca

SEQ ID NO: 421446 - DNA, 25 bp, Mus musculus
cccagaggcctggagagtaaaggaa

SEQ ID NO: 421447 - DNA, 25 bp, Mus musculus
cccagaggctggtgaattcttagaa

SEQ ID NO: 421448 - DNA, 25 bp, Mus musculus
cccagagggaaggaccagaagaatc

SEQ ID NO: 421449 - DNA, 25 bp, Mus musculus
cccagagggaggacactgggatcca

SEQ ID NO: 421450 - DNA, 25 bp, Mus musculus
cccagaggtggctggtcttgccaaa

SEQ ID NO: 421451 - DNA, 25 bp, Mus musculus
cccagaggttgagctgagcagcagc

SEQ ID NO: 421452 - DNA, 25 bp, Mus musculus
cccagagtccagtcgtggccagtgt

SEQ ID NO: 421453 - DNA, 25 bp, Mus musculus
cccagagtcccttgtttctgacagg

SEQ ID NO: 421454 - DNA, 25 bp, Mus musculus
cccagagtggaagcagccgtgtact

SEQ ID NO: 421455 - DNA, 25 bp, Mus musculus
cccagagtgttatgcccagttctcg

SEQ ID NO: 421456 - DNA, 25 bp, Mus musculus
cccagagtgttgatatatgtggagc

SEQ ID NO: 421457 - DNA, 25 bp, Mus musculus
cccagagttctatggtcttcccaag

SEQ ID NO: 421458 - DNA, 25 bp, Mus musculus
cccagagttttctccggagagcaga

SEQ ID NO: 421459 - DNA, 25 bp, Mus musculus
cccagataattaaggacgtcccact

SEQ ID NO: 421460 - DNA, 25 bp, Mus musculus
cccagatagtctcatttttcaagag

SEQ ID NO: 421461 - DNA, 25 bp, Mus musculus
cccagatgcaataaggaggtgccta

SEQ ID NO: 421462 - DNA, 25 bp, Mus musculus
cccagatgccatttctagattcagt

SEQ ID NO: 421463 - DNA, 25 bp, Mus musculus
cccagatgctcgtgtgagatagaca

SEQ ID NO: 421464 - DNA, 25 bp, Mus musculus
cccagatggatcatatcacctcaga

SEQ ID NO: 421465 - DNA, 25 bp, Mus musculus
cccagatgggactgagactgcttcc

SEQ ID NO: 421466 - DNA, 25 bp, Mus musculus
cccagatgggactttggaggctctt

SEQ ID NO: 421467 - DNA, 25 bp, Mus musculus
cccagattatatgtgtgcgcgcgca

SEQ ID NO: 421468 - DNA, 25 bp, Mus musculus
cccagcaacctgatttcaacctatg

SEQ ID NO: 421469 - DNA, 25 bp, Mus musculus
cccagcacagagacagatagccaga

SEQ ID NO: 421470 - DNA, 25 bp, Mus musculus
cccagcaggaacttagagcagccta

SEQ ID NO: 421471 - DNA, 25 bp, Mus musculus
cccagcagggaagcactgcagactg

SEQ ID NO: 421472 - DNA, 25 bp, Mus musculus
cccagcagggactgttactcaacct

SEQ ID NO: 421473 - DNA, 25 bp, Mus musculus
cccagcagggttctacgattacacc

SEQ ID NO: 421474 - DNA, 25 bp, Mus musculus
cccagccaagggactagcgaggcat

SEQ ID NO: 421475 - DNA, 25 bp, Mus musculus
cccagccaatggtagtgttaagata

SEQ ID NO: 421476 - DNA, 25 bp, Mus musculus
cccagccacggaattggctacagga

SEQ ID NO: 421477 - DNA, 25 bp, Mus musculus
cccagccagatgtcagggaagagct

SEQ ID NO: 421478 - DNA, 25 bp, Mus musculus
cccagcccactgtgagtggtactac

SEQ ID NO: 421479 - DNA, 25 bp, Mus musculus
cccagccgctcaggtgggtatagga

SEQ ID NO: 421480 - DNA, 25 bp, Mus musculus
cccagcgagcaatgtataatgagac

SEQ ID NO: 421481 - DNA, 25 bp, Mus musculus
cccagctagggcacaataaagttat

SEQ ID NO: 421482 - DNA, 25 bp, Mus musculus
cccagctatgtgtttatggtgtggt

SEQ ID NO: 421483 - DNA, 25 bp, Mus musculus
cccagctgatcgtggaagagtgtcc

SEQ ID NO: 421484 - DNA, 25 bp, Mus musculus
cccagctgcagaggattcagtcaaa

SEQ ID NO: 421485 - DNA, 25 bp, Mus musculus
cccagctgcctggtggaatcgcagg

SEQ ID NO: 421486 - DNA, 25 bp, Mus musculus
cccagctgctgaggttggataacat

SEQ ID NO: 421487 - DNA, 25 bp, Mus musculus
cccagctggaacagaaaacgtacca

SEQ ID NO: 421488 - DNA, 25 bp, Mus musculus
cccagctgtgagtaagagttagcct

SEQ ID NO: 421489 - DNA, 25 bp, Mus musculus
cccagcttccttcagacagagagga

SEQ ID NO: 421490 - DNA, 25 bp, Mus musculus
cccagcttcgggatgaattttgatc

SEQ ID NO: 421491 - DNA, 25 bp, Mus musculus
cccagcttctaggaaaaggtcgaga

SEQ ID NO: 421492 - DNA, 25 bp, Mus musculus
cccaggaaagggatgcacagtgcga

SEQ ID NO: 421493 - DNA, 25 bp, Mus musculus
cccaggaaatctgaactttgttctc

SEQ ID NO: 421494 - DNA, 25 bp, Mus musculus
cccaggaaggttttcaggcagtgcc

SEQ ID NO: 421495 - DNA, 25 bp, Mus musculus
cccaggaagtgctagggatataatt

SEQ ID NO: 421496 - DNA, 25 bp, Mus musculus
cccaggaatagaggcaaaaggagtt

SEQ ID NO: 421497 - DNA, 25 bp, Mus musculus
cccaggaatctcttgtgaggatcta

SEQ ID NO: 421498 - DNA, 25 bp, Mus musculus
cccaggaatgggtaaagaagcaatc

SEQ ID NO: 421499 - DNA, 25 bp, Mus musculus
cccaggaattgttaggagaccacgc

SEQ ID NO: 421500 - DNA, 25 bp, Mus musculus
cccaggacaggaagatgtggcttgt

SEQ ID NO: 421501 - DNA, 25 bp, Mus musculus
cccaggaccgaaggctcaggatttg

SEQ ID NO: 421502 - DNA, 25 bp, Mus musculus
cccaggacctgatttggcaagactg

SEQ ID NO: 421503 - DNA, 25 bp, Mus musculus
cccaggagcaggctgggcatccagg

SEQ ID NO: 421504 - DNA, 25 bp, Mus musculus
cccaggagggctctagaagacttcc

SEQ ID NO: 421505 - DNA, 25 bp, Mus musculus
cccaggatagtagtcagagttcaca

SEQ ID NO: 421506 - DNA, 25 bp, Mus musculus
cccaggatgagatgaggccttgtat

SEQ ID NO: 421507 - DNA, 25 bp, Mus musculus
cccaggcaagacgtaggctaatgag

SEQ ID NO: 421508 - DNA, 25 bp, Mus musculus
cccaggcaatgatagtcccaaagaa

SEQ ID NO: 421509 - DNA, 25 bp, Mus musculus
cccaggcagctggtggcaatcagaa

SEQ ID NO: 421510 - DNA, 25 bp, Mus musculus
cccaggccaggaaagccgtggagca

SEQ ID NO: 421511 - DNA, 25 bp, Mus musculus
cccaggccaggaaccatttgaaagg

SEQ ID NO: 421512 - DNA, 25 bp, Mus musculus
cccaggccgctaaatacaggtgcta

SEQ ID NO: 421513 - DNA, 25 bp, Mus musculus
cccaggccggagaagttagttgtgc

SEQ ID NO: 421514 - DNA, 25 bp, Mus musculus
cccaggcgctttgtgcagtagcaaa

SEQ ID NO: 421515 - DNA, 25 bp, Mus musculus
cccaggctagcgtttggactgtttt

SEQ ID NO: 421516 - DNA, 25 bp, Mus musculus
cccaggctctggctaagtacttgaa

SEQ ID NO: 421517 - DNA, 25 bp, Mus musculus
cccaggctggaagagttaattccgg

SEQ ID NO: 421518 - DNA, 25 bp, Mus musculus
cccaggctgggaagagctatagcca

SEQ ID NO: 421519 - DNA, 25 bp, Mus musculus
cccaggctggtaaaggtcatgccac

SEQ ID NO: 421520 - DNA, 25 bp, Mus musculus
cccaggctgtgaatgccaggccgcg

SEQ ID NO: 421521 - DNA, 25 bp, Mus musculus
cccaggcttgcgtttctcattgaaa

SEQ ID NO: 421522 - DNA, 25 bp, Mus musculus
cccagggaaaggaactgtggctagc

SEQ ID NO: 421523 - DNA, 25 bp, Mus musculus
cccagggacagtgatttaagacatc

SEQ ID NO: 421524 - DNA, 25 bp, Mus musculus
cccagggactaggatcagggtgcca

SEQ ID NO: 421525 - DNA, 25 bp, Mus musculus
cccagggctgggtgatgtttgtgtc

SEQ ID NO: 421526 - DNA, 25 bp, Mus musculus
cccagggctttagacattctagaaa

SEQ ID NO: 421527 - DNA, 25 bp, Mus musculus
cccagggtgtcctggacgtccagcg

SEQ ID NO: 421528 - DNA, 25 bp, Mus musculus
cccagggttgttggtggctattgac

SEQ ID NO: 421529 - DNA, 25 bp, Mus musculus
cccaggtaaggagcgctgcgcagaa

SEQ ID NO: 421530 - DNA, 25 bp, Mus musculus
cccaggtagtaacggcacagaatgc

SEQ ID NO: 421531 - DNA, 25 bp, Mus musculus
cccaggtatgaggctgttggccagc

SEQ ID NO: 421532 - DNA, 25 bp, Mus musculus
cccaggtcaagggtcacggcaagaa

SEQ ID NO: 421533 - DNA, 25 bp, Mus musculus
cccaggtcctgtgctctactttgaa

SEQ ID NO: 421534 - DNA, 25 bp, Mus musculus
cccaggtctctaaagatctgtggtg

SEQ ID NO: 421535 - DNA, 25 bp, Mus musculus
cccaggtctttatgtatggacacaa

SEQ ID NO: 421536 - DNA, 25 bp, Mus musculus
cccaggtgatgggttactaaggatc

SEQ ID NO: 421537 - DNA, 25 bp, Mus musculus
cccaggtgcagtctgtgcgtcgcat

SEQ ID NO: 421538 - DNA, 25 bp, Mus musculus
cccaggtgccgatggaagtccttaa

SEQ ID NO: 421539 - DNA, 25 bp, Mus musculus
cccaggttatgctatggttctaaaa

SEQ ID NO: 421540 - DNA, 25 bp, Mus musculus
cccaggtttgctctgtcgtctgctg

SEQ ID NO: 421541 - DNA, 25 bp, Mus musculus
cccagtaaacggaatgagcggatta

SEQ ID NO: 421542 - DNA, 25 bp, Mus musculus
cccagtaatcgtgtaagggaccatt

SEQ ID NO: 421543 - DNA, 25 bp, Mus musculus
cccagtaatggtaggaggagatgca

SEQ ID NO: 421544 - DNA, 25 bp, Mus musculus
cccagtagaattctctgatagtaaa

SEQ ID NO: 421545 - DNA, 25 bp, Mus musculus
cccagtatcttgagagccaggcaga

SEQ ID NO: 421546 - DNA, 25 bp, Mus musculus
cccagtatgctagcagctgaactgc

SEQ ID NO: 421547 - DNA, 25 bp, Mus musculus
cccagtcaaccctgagaaatcttgg

SEQ ID NO: 421548 - DNA, 25 bp, Mus musculus
cccagtctgagagtgttggacagcc

SEQ ID NO: 421549 - DNA, 25 bp, Mus musculus
cccagtgaccataggaggcaagatt

SEQ ID NO: 421550 - DNA, 25 bp, Mus musculus
cccagtgcagcatggaggtctacca

SEQ ID NO: 421551 - DNA, 25 bp, Mus musculus
cccagtgcagggatttgatatagca

SEQ ID NO: 421552 - DNA, 25 bp, Mus musculus
cccagtgctaaggttaaccgtgtat

SEQ ID NO: 421553 - DNA, 25 bp, Mus musculus
cccagtgctgaggtgctaggtaaac

SEQ ID NO: 421554 - DNA, 25 bp, Mus musculus
cccagtggagacaatcagctgattg

SEQ ID NO: 421555 - DNA, 25 bp, Mus musculus
cccagtggagcgtggtgtaattaga

SEQ ID NO: 421556 - DNA, 25 bp, Mus musculus
cccagtggatgagtgtgacgacgac

SEQ ID NO: 421557 - DNA, 25 bp, Mus musculus
cccagtggccaagtgtttcggatca

SEQ ID NO: 421558 - DNA, 25 bp, Mus musculus
cccagtggtcgttggctttatcaga

SEQ ID NO: 421559 - DNA, 25 bp, Mus musculus
cccagtgtggtatctgttgcaaaac

SEQ ID NO: 421560 - DNA, 25 bp, Mus musculus
cccagtgtgtagtgatccaagccca

SEQ ID NO: 421561 - DNA, 25 bp, Mus musculus
cccagtgttcttggccatgagctca

SEQ ID NO: 421562 - DNA, 25 bp, Mus musculus
cccagtgttgctgcagatgtccaag

SEQ ID NO: 421563 - DNA, 25 bp, Mus musculus
cccagttctgaaggcaaagtccaaa

SEQ ID NO: 421564 - DNA, 25 bp, Mus musculus
cccagttggaggatgagtagatgcc

SEQ ID NO: 421565 - DNA, 25 bp, Mus musculus
cccagtttgcattccccaggtggca

SEQ ID NO: 421566 - DNA, 25 bp, Mus musculus
cccagtttggcggacaagttcttca

SEQ ID NO: 421567 - DNA, 25 bp, Mus musculus
cccagtttggtgctgcagtctgtcc

SEQ ID NO: 421568 - DNA, 25 bp, Mus musculus
cccagttttctatagggagacagca

SEQ ID NO: 421569 - DNA, 25 bp, Mus musculus
cccataaggataggatgagactctc

SEQ ID NO: 421570 - DNA, 25 bp, Mus musculus
cccatacggtaagctggccagtgaa

SEQ ID NO: 421571 - DNA, 25 bp, Mus musculus
cccatactcggtctggcgcctgtgt

SEQ ID NO: 421572 - DNA, 25 bp, Mus musculus
cccatagacagctgtgtgagttgct

SEQ ID NO: 421573 - DNA, 25 bp, Mus musculus
cccatagggagaatggttctagctc

SEQ ID NO: 421574 - DNA, 25 bp, Mus musculus
cccatagttcacagaggtaaggaaa

SEQ ID NO: 421575 - DNA, 25 bp, Mus musculus
cccatatacatatctgcacaactga

SEQ ID NO: 421576 - DNA, 25 bp, Mus musculus
cccatatcaagcgtcatctgcaatg

SEQ ID NO: 421577 - DNA, 25 bp, Mus musculus
cccatcctgggcacagagaaacaaa

SEQ ID NO: 421578 - DNA, 25 bp, Mus musculus
cccatcgttcgtactggcagtggag

SEQ ID NO: 421579 - DNA, 25 bp, Mus musculus
cccatctatgagttccggtgacaga

SEQ ID NO: 421580 - DNA, 25 bp, Mus musculus
cccatctatgtgtcggcggaaggca

SEQ ID NO: 421581 - DNA, 25 bp, Mus musculus
cccatctggcgggtagagtgctttg

SEQ ID NO: 421582 - DNA, 25 bp, Mus musculus
cccatctgtggtggataccgttacc

SEQ ID NO: 421583 - DNA, 25 bp, Mus musculus
cccatgacaacagtaagaaatgagg

SEQ ID NO: 421584 - DNA, 25 bp, Mus musculus
cccatgagactggtggattttccta

SEQ ID NO: 421585 - DNA, 25 bp, Mus musculus
cccatgagcagggtatcaagtctcc

SEQ ID NO: 421586 - DNA, 25 bp, Mus musculus
cccatgagcggacggttcaaagacc

SEQ ID NO: 421587 - DNA, 25 bp, Mus musculus
cccatgagggtgacggtgataagaa

SEQ ID NO: 421588 - DNA, 25 bp, Mus musculus
cccatgatatcagtgaagtgctctc

SEQ ID NO: 421589 - DNA, 25 bp, Mus musculus
cccatgatgccacttcactgttgag

SEQ ID NO: 421590 - DNA, 25 bp, Mus musculus
cccatgctaatgtggtgatctgcta

SEQ ID NO: 421591 - DNA, 25 bp, Mus musculus
cccatgctacgaagcgggaacctca

SEQ ID NO: 421592 - DNA, 25 bp, Mus musculus
cccatgctagcgcttcaaagacggc

SEQ ID NO: 421593 - DNA, 25 bp, Mus musculus
cccatgctgacgtggcttcagatca

SEQ ID NO: 421594 - DNA, 25 bp, Mus musculus
cccatggaaagtggagcccatgctg

SEQ ID NO: 421595 - DNA, 25 bp, Mus musculus
cccatggagtcttggatttgctaca

SEQ ID NO: 421596 - DNA, 25 bp, Mus musculus
cccatggcatctaaggcagaggaaa

SEQ ID NO: 421597 - DNA, 25 bp, Mus musculus
cccatgggccctgagttgataatga

SEQ ID NO: 421598 - DNA, 25 bp, Mus musculus
cccatgtaggcccagaaccatctgt

SEQ ID NO: 421599 - DNA, 25 bp, Mus musculus
cccatgtgcaaatataaagtgcgca

SEQ ID NO: 421600 - DNA, 25 bp, Mus musculus
cccatgtggtggagatcagcagcct

SEQ ID NO: 421601 - DNA, 25 bp, Mus musculus
cccatgttcgctacaggaaacattt

SEQ ID NO: 421602 - DNA, 25 bp, Mus musculus
cccattaaaactcagtgcgcggtga

SEQ ID NO: 421603 - DNA, 25 bp, Mus musculus
cccattagaggatgactgagcagca

SEQ ID NO: 421604 - DNA, 25 bp, Mus musculus
cccattcattgtactctcagaagag

SEQ ID NO: 421605 - DNA, 25 bp, Mus musculus
cccattcggataaaagcagttcaca

SEQ ID NO: 421606 - DNA, 25 bp, Mus musculus
cccattctcctaacgggctgagctt

SEQ ID NO: 421607 - DNA, 25 bp, Mus musculus
cccattctgatgagagaagactgtg

SEQ ID NO: 421608 - DNA, 25 bp, Mus musculus
cccattgagcaacagggcaccggat

SEQ ID NO: 421609 - DNA, 25 bp, Mus musculus
cccattgagggcacagagtgtatca

SEQ ID NO: 421610 - DNA, 25 bp, Mus musculus
cccattgagtactgcaagcctctca

SEQ ID NO: 421611 - DNA, 25 bp, Mus musculus
cccattgctgcgttctgcgctgctg

SEQ ID NO: 421612 - DNA, 25 bp, Mus musculus
cccattggaggtaactggccctgca

SEQ ID NO: 421613 - DNA, 25 bp, Mus musculus
cccattgttgcggtggtaaatcttc

SEQ ID NO: 421614 - DNA, 25 bp, Mus musculus
cccatttacaggctacggacgagtt

SEQ ID NO: 421615 - DNA, 25 bp, Mus musculus
cccatttggagaacttagtgatcgc

SEQ ID NO: 421616 - DNA, 25 bp, Mus musculus
cccatttgtgataagggatgtgcta

SEQ ID NO: 421617 - DNA, 25 bp, Mus musculus
cccattttcaagactgccagtctgg

SEQ ID NO: 421618 - DNA, 25 bp, Mus musculus
cccattttcaggtcgaaaccctctg

SEQ ID NO: 421619 - DNA, 25 bp, Mus musculus
ccccaaaaattgagagtgcacaaaa

SEQ ID NO: 421620 - DNA, 25 bp, Mus musculus
ccccaaaggagagctttgctgtaaa

SEQ ID NO: 421621 - DNA, 25 bp, Mus musculus
ccccaaagtgatgtgcagaaatgag

SEQ ID NO: 421622 - DNA, 25 bp, Mus musculus
ccccaaccaactcagtgtaagagtc

SEQ ID NO: 421623 - DNA, 25 bp, Mus musculus
ccccaagatgaagattcggcgcagg

SEQ ID NO: 421624 - DNA, 25 bp, Mus musculus
ccccaagatgatctgaaagatgaat

SEQ ID NO: 421625 - DNA, 25 bp, Mus musculus
ccccaagctgagtagcagtcgacat

SEQ ID NO: 421626 - DNA, 25 bp, Mus musculus
ccccaaggatttataggcagctaat

SEQ ID NO: 421627 - DNA, 25 bp, Mus musculus
ccccaaggcgtggagtgtttgcact

SEQ ID NO: 421628 - DNA, 25 bp, Mus musculus
ccccaagggatgtggaaagcgatca

SEQ ID NO: 421629 - DNA, 25 bp, Mus musculus
ccccaagggtgtgatgctgagtcaa

SEQ ID NO: 421630 - DNA, 25 bp, Mus musculus
ccccaagtaccgtggcggtggagat

SEQ ID NO: 421631 - DNA, 25 bp, Mus musculus
ccccaagtggccgaaggagactgta

SEQ ID NO: 421632 - DNA, 25 bp, Mus musculus
ccccaagttaatgaggcgtacgccg

SEQ ID NO: 421633 - DNA, 25 bp, Mus musculus
ccccaatgattagagacccaagagc

SEQ ID NO: 421634 - DNA, 25 bp, Mus musculus
ccccaatgcccttcatggcagagac

SEQ ID NO: 421635 - DNA, 25 bp, Mus musculus
ccccaatggactgggaggcattgga

SEQ ID NO: 421636 - DNA, 25 bp, Mus musculus
ccccacaagcatacaggcacagtat

SEQ ID NO: 421637 - DNA, 25 bp, Mus musculus
ccccacgggagagaaaatgcttgct

SEQ ID NO: 421638 - DNA, 25 bp, Mus musculus
ccccactaacagtgcaaatcttggg

SEQ ID NO: 421639 - DNA, 25 bp, Mus musculus
ccccagaagaaataacaagccctat

SEQ ID NO: 421640 - DNA, 25 bp, Mus musculus
ccccagagactggtcgacaactgga

SEQ ID NO: 421641 - DNA, 25 bp, Mus musculus
ccccagagattgcaaacggctatgt

SEQ ID NO: 421642 - DNA, 25 bp, Mus musculus
ccccagagccagaagtgagcgggac

SEQ ID NO: 421643 - DNA, 25 bp, Mus musculus
ccccagaggtccaaagaggacatta

SEQ ID NO: 421644 - DNA, 25 bp, Mus musculus
ccccagatacagaacagttaattac

SEQ ID NO: 421645 - DNA, 25 bp, Mus musculus
ccccagatcggtgagaaagccttga

SEQ ID NO: 421646 - DNA, 25 bp, Mus musculus
ccccagatggtcttttatctctttg

SEQ ID NO: 421647 - DNA, 25 bp, Mus musculus
ccccagcaagtgatccagaaagtga

SEQ ID NO: 421648 - DNA, 25 bp, Mus musculus
ccccagcaataggaaggacagtagt

SEQ ID NO: 421649 - DNA, 25 bp, Mus musculus
ccccagcagcgccaattactgtgtg

SEQ ID NO: 421650 - DNA, 25 bp, Mus musculus
ccccagcctcgtgaataattgaaag

SEQ ID NO: 421651 - DNA, 25 bp, Mus musculus
ccccagcggataagccacaagtgct

SEQ ID NO: 421652 - DNA, 25 bp, Mus musculus
ccccagcggctgtggagtctgcgaa

SEQ ID NO: 421653 - DNA, 25 bp, Mus musculus
ccccagcgtatagtggatgtggcca

SEQ ID NO: 421654 - DNA, 25 bp, Mus musculus
ccccaggaatgacacggaatctgct

SEQ ID NO: 421655 - DNA, 25 bp, Mus musculus
ccccaggcaaaggaagacgtagact

SEQ ID NO: 421656 - DNA, 25 bp, Mus musculus
ccccagggaaggctcttgcatcctg

SEQ ID NO: 421657 - DNA, 25 bp, Mus musculus
ccccagggagcagtgacagtaagac

SEQ ID NO: 421658 - DNA, 25 bp, Mus musculus
ccccagggatttcaggatcgttaag

SEQ ID NO: 421659 - DNA, 25 bp, Mus musculus
ccccagggcaaagtgaaggtgtcat

SEQ ID NO: 421660 - DNA, 25 bp, Mus musculus
ccccagggtcgactgtgacaggaca

SEQ ID NO: 421661 - DNA, 25 bp, Mus musculus
ccccaggtcagagagcattcgagaa

SEQ ID NO: 421662 - DNA, 25 bp, Mus musculus
ccccaggtcagcaaggtgaagtcag

SEQ ID NO: 421663 - DNA, 25 bp, Mus musculus
ccccaggtcgtgtgtattcagtaga

SEQ ID NO: 421664 - DNA, 25 bp, Mus musculus
ccccaggttaggctgcaaacaatct

SEQ ID NO: 421665 - DNA, 25 bp, Mus musculus
ccccagtcctgtgagattctttgaa

SEQ ID NO: 421666 - DNA, 25 bp, Mus musculus
ccccagtgtgggtctgcacactgca

SEQ ID NO: 421667 - DNA, 25 bp, Mus musculus
ccccagttcaactacaagagtcgag

SEQ ID NO: 421668 - DNA, 25 bp, Mus musculus
ccccagtttggaggcctgtctagat

SEQ ID NO: 421669 - DNA, 25 bp, Mus musculus
ccccagtttgtgtgtaggataaaat

SEQ ID NO: 421670 - DNA, 25 bp, Mus musculus
ccccatagatatggcaatggtagtc

SEQ ID NO: 421671 - DNA, 25 bp, Mus musculus
ccccatcatgggaagaatgccacga

SEQ ID NO: 421672 - DNA, 25 bp, Mus musculus
ccccatgcgtggtgaatctgtgaca

SEQ ID NO: 421673 - DNA, 25 bp, Mus musculus
ccccatggatgtgtgcgtccggcat

SEQ ID NO: 421674 - DNA, 25 bp, Mus musculus
ccccatgggttacaaggcttatcgc

SEQ ID NO: 421675 - DNA, 25 bp, Mus musculus
ccccatgtacatagaaaccgtggta

SEQ ID NO: 421676 - DNA, 25 bp, Mus musculus
ccccattcattcagtggtggatctg

SEQ ID NO: 421677 - DNA, 25 bp, Mus musculus
ccccattggaggctggattgtagaa

SEQ ID NO: 421678 - DNA, 25 bp, Mus musculus
ccccatttgagggtgggctgtctca

SEQ ID NO: 421679 - DNA, 25 bp, Mus musculus
ccccatttgtgtaaggagaaggttg

SEQ ID NO: 421680 - DNA, 25 bp, Mus musculus
ccccgaagctggagatcaaggtcaa

SEQ ID NO: 421681 - DNA, 25 bp, Mus musculus
ccccgaagtggtctgtagttgccct

SEQ ID NO: 421682 - DNA, 25 bp, Mus musculus
ccccgacacagtgaagtggtctaga

SEQ ID NO: 421683 - DNA, 25 bp, Mus musculus
ccccgacatggtggactacaggaga

SEQ ID NO: 421684 - DNA, 25 bp, Mus musculus
ccccgagctaggagagatcaagagt

SEQ ID NO: 421685 - DNA, 25 bp, Mus musculus
ccccgaggaaggtgctgcacgctgg

SEQ ID NO: 421686 - DNA, 25 bp, Mus musculus
ccccgaggtggtatacagtgcccat

SEQ ID NO: 421687 - DNA, 25 bp, Mus musculus
ccccgagtggtatcaagtggagctg

SEQ ID NO: 421688 - DNA, 25 bp, Mus musculus
ccccgagtgtgggtgagggctctag

SEQ ID NO: 421689 - DNA, 25 bp, Mus musculus
ccccgattatgagcacatggagtac

SEQ ID NO: 421690 - DNA, 25 bp, Mus musculus
ccccgcatcgggaagtggtttgact

SEQ ID NO: 421691 - DNA, 25 bp, Mus musculus
ccccgcctgcttggagagaaaaaat

SEQ ID NO: 421692 - DNA, 25 bp, Mus musculus
ccccgcctgggtgaaatgacaagaa

SEQ ID NO: 421693 - DNA, 25 bp, Mus musculus
ccccggaactggaggtgtacattct

SEQ ID NO: 421694 - DNA, 25 bp, Mus musculus
ccccggagctgtacagtagcctgga

SEQ ID NO: 421695 - DNA, 25 bp, Mus musculus
ccccggagtggtacataggagatca

SEQ ID NO: 421696 - DNA, 25 bp, Mus musculus
ccccggatgacctgtgtgagaagat

SEQ ID NO: 421697 - DNA, 25 bp, Mus musculus
ccccggatgctgagtggcgaaaaaa

SEQ ID NO: 421698 - DNA, 25 bp, Mus musculus
ccccggattagagcccatggcaaga

SEQ ID NO: 421699 - DNA, 25 bp, Mus musculus
ccccggccggagtccatttgcataa

SEQ ID NO: 421700 - DNA, 25 bp, Mus musculus
ccccggccgggtgtttgtgtgagtg

SEQ ID NO: 421701 - DNA, 25 bp, Mus musculus
ccccgggaagacctgattggcttga

SEQ ID NO: 421702 - DNA, 25 bp, Mus musculus
ccccgggacgcttcgcagaggagtc

SEQ ID NO: 421703 - DNA, 25 bp, Mus musculus
ccccgggatcctgagcatagaagaa

SEQ ID NO: 421704 - DNA, 25 bp, Mus musculus
ccccgggatgctcgtcttactgtca

SEQ ID NO: 421705 - DNA, 25 bp, Mus musculus
ccccgggctgcgcttaaatagtgaa

SEQ ID NO: 421706 - DNA, 25 bp, Mus musculus
ccccggtggagagcgacatggtctc

SEQ ID NO: 421707 - DNA, 25 bp, Mus musculus
ccccggtgtgtcctctcagggacga

SEQ ID NO: 421708 - DNA, 25 bp, Mus musculus
ccccggtgttttcatcctggatgct

SEQ ID NO: 421709 - DNA, 25 bp, Mus musculus
ccccgtccattgtttgaagtcttca

SEQ ID NO: 421710 - DNA, 25 bp, Mus musculus
ccccgtgaaggaatatttagccaag

SEQ ID NO: 421711 - DNA, 25 bp, Mus musculus
ccccgtgctaggtggattaaagtca

SEQ ID NO: 421712 - DNA, 25 bp, Mus musculus
ccccgtggaggtgagtagatgcttc

SEQ ID NO: 421713 - DNA, 25 bp, Mus musculus
ccccgtggctggaaagagtggcaat

SEQ ID NO: 421714 - DNA, 25 bp, Mus musculus
ccccgtggtcaagatggtgatgcaa

SEQ ID NO: 421715 - DNA, 25 bp, Mus musculus
ccccgtggtggcaactgctatgaag

SEQ ID NO: 421716 - DNA, 25 bp, Mus musculus
ccccgttggagatggtatgatttgg

SEQ ID NO: 421717 - DNA, 25 bp, Mus musculus
ccccgttggtgatgaaaggcctgaa

SEQ ID NO: 421718 - DNA, 25 bp, Mus musculus
cccctaagggtgaggcaaaggctca

SEQ ID NO: 421719 - DNA, 25 bp, Mus musculus
cccctaatgaggaggaacaggccct

SEQ ID NO: 421720 - DNA, 25 bp, Mus musculus
cccctaatgccagtgtgaaaaagaa

SEQ ID NO: 421721 - DNA, 25 bp, Mus musculus
cccctatgctgggtcaaatccaggg

SEQ ID NO: 421722 - DNA, 25 bp, Mus musculus
cccctatgttgtagaattcctaaag

SEQ ID NO: 421723 - DNA, 25 bp, Mus musculus
cccctcaccatgcattgcctgtgga

SEQ ID NO: 421724 - DNA, 25 bp, Mus musculus
cccctcctcaaatatttaatcgtgg

SEQ ID NO: 421725 - DNA, 25 bp, Mus musculus
cccctctcagggaatctggaaagat

SEQ ID NO: 421726 - DNA, 25 bp, Mus musculus
cccctctctgacacttgatttggat

SEQ ID NO: 421727 - DNA, 25 bp, Mus musculus
cccctctgcatggaactgaaatgtt

SEQ ID NO: 421728 - DNA, 25 bp, Mus musculus
cccctctgtgatgtgccctaggaga

SEQ ID NO: 421729 - DNA, 25 bp, Mus musculus
cccctcttccactggaagtttgtct

SEQ ID NO: 421730 - DNA, 25 bp, Mus musculus
cccctcttggaggtgtgttcaataa

SEQ ID NO: 421731 - DNA, 25 bp, Mus musculus
cccctgaaggaaaagggcttgtgcg

SEQ ID NO: 421732 - DNA, 25 bp, Mus musculus
cccctgaaggagatctaccctgact

SEQ ID NO: 421733 - DNA, 25 bp, Mus musculus
cccctgaaggagatgtctgacagca

SEQ ID NO: 421734 - DNA, 25 bp, Mus musculus
cccctgaatgtgacggtgatccgca

SEQ ID NO: 421735 - DNA, 25 bp, Mus musculus
cccctgagaacgtgagcaaaaactt

SEQ ID NO: 421736 - DNA, 25 bp, Mus musculus
cccctgaggacggagatctgttggc

SEQ ID NO: 421737 - DNA, 25 bp, Mus musculus
cccctgagtcttggtgggtggacat

SEQ ID NO: 421738 - DNA, 25 bp, Mus musculus
cccctgcagaagagattcaggtacc

SEQ ID NO: 421739 - DNA, 25 bp, Mus musculus
cccctgccgtggaatctacctgttt

SEQ ID NO: 421740 - DNA, 25 bp, Mus musculus
cccctgcctgttggtagtgaataca

SEQ ID NO: 421741 - DNA, 25 bp, Mus musculus
cccctgcgagggactatgatggaga

SEQ ID NO: 421742 - DNA, 25 bp, Mus musculus
cccctgctggaaatgccggaagaaa

SEQ ID NO: 421743 - DNA, 25 bp, Mus musculus
cccctggaaaagaccgattctgaga

SEQ ID NO: 421744 - DNA, 25 bp, Mus musculus
cccctggaaagagggctggtgctca

SEQ ID NO: 421745 - DNA, 25 bp, Mus musculus
cccctggaaagctaggcattggctt

SEQ ID NO: 421746 - DNA, 25 bp, Mus musculus
cccctggaagaagagaaatttggct

SEQ ID NO: 421747 - DNA, 25 bp, Mus musculus
cccctggatgcaatgatgcagtgca

SEQ ID NO: 421748 - DNA, 25 bp, Mus musculus
cccctggatggagctggattaaaac

SEQ ID NO: 421749 - DNA, 25 bp, Mus musculus
cccctggatgtctaaagtgaagcgg

SEQ ID NO: 421750 - DNA, 25 bp, Mus musculus
cccctgggagatggtagagacttga

SEQ ID NO: 421751 - DNA, 25 bp, Mus musculus
cccctgggtcaggatgtgcaaagcc

SEQ ID NO: 421752 - DNA, 25 bp, Mus musculus
cccctgggtgatggagaagcaacca

SEQ ID NO: 421753 - DNA, 25 bp, Mus musculus
cccctggtgggatgaagtgtcttta

SEQ ID NO: 421754 - DNA, 25 bp, Mus musculus
cccctggttagcagtggtcaagaac

SEQ ID NO: 421755 - DNA, 25 bp, Mus musculus
cccctgtcaaggaggccttgaagtc

SEQ ID NO: 421756 - DNA, 25 bp, Mus musculus
cccctgtcaagtgtctggagtctgg

SEQ ID NO: 421757 - DNA, 25 bp, Mus musculus
cccctgtgccccttaattattagag

SEQ ID NO: 421758 - DNA, 25 bp, Mus musculus
cccctgtgccgtggaaatgtgacta

SEQ ID NO: 421759 - DNA, 25 bp, Mus musculus
cccctgtggccgtaggaatgaacat

SEQ ID NO: 421760 - DNA, 25 bp, Mus musculus
cccctgtgggagatgcgctaactgt

SEQ ID NO: 421761 - DNA, 25 bp, Mus musculus
cccctgttgcaagtacatgaaatga

SEQ ID NO: 421762 - DNA, 25 bp, Mus musculus
ccccttaacatctccttagttcagt

SEQ ID NO: 421763 - DNA, 25 bp, Mus musculus
ccccttaactcttggctggctggtc

SEQ ID NO: 421764 - DNA, 25 bp, Mus musculus
ccccttaagacagttcgactggttg

SEQ ID NO: 421765 - DNA, 25 bp, Mus musculus
ccccttcgggtgctgaaaagctacg

SEQ ID NO: 421766 - DNA, 25 bp, Mus musculus
ccccttcttgggatttcactctgtc

SEQ ID NO: 421767 - DNA, 25 bp, Mus musculus
ccccttgaagtaggaggtgctaaca

SEQ ID NO: 421768 - DNA, 25 bp, Mus musculus
ccccttgtgcccctgtagctggtgg

SEQ ID NO: 421769 - DNA, 25 bp, Mus musculus
cccctttgatgggaaaagataagct

SEQ ID NO: 421770 - DNA, 25 bp, Mus musculus
cccctttgcacgtgggaagcttcaa

SEQ ID NO: 421771 - DNA, 25 bp, Mus musculus
ccccttttcgtgtgatgtgttactg

SEQ ID NO: 421772 - DNA, 25 bp, Mus musculus
ccccttttgtccaccagagttgcta

SEQ ID NO: 421773 - DNA, 25 bp, Mus musculus
cccgaaacgggagcaagtctgatca

SEQ ID NO: 421774 - DNA, 25 bp, Mus musculus
cccgaaagaaccgagagagcctggg

SEQ ID NO: 421775 - DNA, 25 bp, Mus musculus
cccgaaggttctgtagatgaagaca

SEQ ID NO: 421776 - DNA, 25 bp, Mus musculus
cccgaagtgcctgtaaacggaagcg

SEQ ID NO: 421777 - DNA, 25 bp, Mus musculus
cccgaatgtggatcctgaggcctac

SEQ ID NO: 421778 - DNA, 25 bp, Mus musculus
cccgaattaacaaggcagagtggtc

SEQ ID NO: 421779 - DNA, 25 bp, Mus musculus
cccgacagtacctggaggcttttgc

SEQ ID NO: 421780 - DNA, 25 bp, Mus musculus
cccgacatgggttggaatccgtgac

SEQ ID NO: 421781 - DNA, 25 bp, Mus musculus
cccgaccagcggtaatagatttgag

SEQ ID NO: 421782 - DNA, 25 bp, Mus musculus
cccgaccctgtgtttgagagtatct

SEQ ID NO: 421783 - DNA, 25 bp, Mus musculus
cccgaccgtctttgtctcatgagaa

SEQ ID NO: 421784 - DNA, 25 bp, Mus musculus
cccgagagctttgtgaaggaggacc

SEQ ID NO: 421785 - DNA, 25 bp, Mus musculus
cccgagcagcgcactttggagacgt

SEQ ID NO: 421786 - DNA, 25 bp, Mus musculus
cccgagcccaagcttagtaacttca

SEQ ID NO: 421787 - DNA, 25 bp, Mus musculus
cccgagccctgatggaaagagatgc

SEQ ID NO: 421788 - DNA, 25 bp, Mus musculus
cccgagcgacacaccagaagttatg

SEQ ID NO: 421789 - DNA, 25 bp, Mus musculus
cccgagctttcgtggcgtaatgcct

SEQ ID NO: 421790 - DNA, 25 bp, Mus musculus
cccgaggacaaggtaagctggccct

SEQ ID NO: 421791 - DNA, 25 bp, Mus musculus
cccgaggattcttctggcaggtgct

SEQ ID NO: 421792 - DNA, 25 bp, Mus musculus
cccgaggctggatctcagggacgtc

SEQ ID NO: 421793 - DNA, 25 bp, Mus musculus
cccgagggatgctcactggtgctag

SEQ ID NO: 421794 - DNA, 25 bp, Mus musculus
cccgagtcaagaagtcctggaggaa

SEQ ID NO: 421795 - DNA, 25 bp, Mus musculus
cccgagtctggcgtgatggtcaaaa

SEQ ID NO: 421796 - DNA, 25 bp, Mus musculus
cccgagtgaggttgtgctggaccca

SEQ ID NO: 421797 - DNA, 25 bp, Mus musculus
cccgagtgttgcctgggatagtcca

SEQ ID NO: 421798 - DNA, 25 bp, Mus musculus
cccgagttgccaagagacacagtat

SEQ ID NO: 421799 - DNA, 25 bp, Mus musculus
cccgagttgtgaaagctgcgacgta

SEQ ID NO: 421800 - DNA, 25 bp, Mus musculus
cccgagtttccgctctgaagccaga

SEQ ID NO: 421801 - DNA, 25 bp, Mus musculus
cccgatactgagtttgcctattgaa

SEQ ID NO: 421802 - DNA, 25 bp, Mus musculus
cccgatattcaggatcttcttcaag

SEQ ID NO: 421803 - DNA, 25 bp, Mus musculus
cccgatgaggttggtgttgcacaaa

SEQ ID NO: 421804 - DNA, 25 bp, Mus musculus
cccgatgagtacttggacacctgga

SEQ ID NO: 421805 - DNA, 25 bp, Mus musculus
cccgattagcctagcaactgtagat

SEQ ID NO: 421806 - DNA, 25 bp, Mus musculus
cccgattcggagtcgcgcgactgag

SEQ ID NO: 421807 - DNA, 25 bp, Mus musculus
cccgattgaatgctttgtgaccaga

SEQ ID NO: 421808 - DNA, 25 bp, Mus musculus
cccgattgtacaggagagctttcta

SEQ ID NO: 421809 - DNA, 25 bp, Mus musculus
cccgcaacgtgactgtgaatgagac

SEQ ID NO: 421810 - DNA, 25 bp, Mus musculus
cccgcaatgcaggatgagagagtca

SEQ ID NO: 421811 - DNA, 25 bp, Mus musculus
cccgcactgggtaacggagaacaca

SEQ ID NO: 421812 - DNA, 25 bp, Mus musculus
cccgcagaagggagagcaaagtgcc

SEQ ID NO: 421813 - DNA, 25 bp, Mus musculus
cccgcagcctgcagttggataaact

SEQ ID NO: 421814 - DNA, 25 bp, Mus musculus
cccgcagctgtttccaggatgtcta

SEQ ID NO: 421815 - DNA, 25 bp, Mus musculus
cccgcagtcctccagagatgctgga

SEQ ID NO: 421816 - DNA, 25 bp, Mus musculus
cccgcagttgtctcactgagtttct

SEQ ID NO: 421817 - DNA, 25 bp, Mus musculus
cccgcattatcctgattcccaaaga

SEQ ID NO: 421818 - DNA, 25 bp, Mus musculus
cccgccagcgtctagaaactcttga

SEQ ID NO: 421819 - DNA, 25 bp, Mus musculus
cccgccctgtgcatctgactttata

SEQ ID NO: 421820 - DNA, 25 bp, Mus musculus
cccgccgagttggaagcagggcata

SEQ ID NO: 421821 - DNA, 25 bp, Mus musculus
cccgccggcaccatgatggaggaga

SEQ ID NO: 421822 - DNA, 25 bp, Mus musculus
cccgccgtcagtggaaacatattta

SEQ ID NO: 421823 - DNA, 25 bp, Mus musculus
cccgcctgactgatcttgagatgaa

SEQ ID NO: 421824 - DNA, 25 bp, Mus musculus
cccgcctgcagtagctgcgtttgca

SEQ ID NO: 421825 - DNA, 25 bp, Mus musculus
cccgcctggatggactgaggaatcg

SEQ ID NO: 421826 - DNA, 25 bp, Mus musculus
cccgcgagatgatgcaggacgtgtc

SEQ ID NO: 421827 - DNA, 25 bp, Mus musculus
cccgcgccctccttgatggatgaga

SEQ ID NO: 421828 - DNA, 25 bp, Mus musculus
cccgcggacgacatgtttgagcatc

SEQ ID NO: 421829 - DNA, 25 bp, Mus musculus
cccgcggctgcttcacgagtgggta

SEQ ID NO: 421830 - DNA, 25 bp, Mus musculus
cccgcgggcagaatgagacagagcc

SEQ ID NO: 421831 - DNA, 25 bp, Mus musculus
cccgcgtgccctggatagagcaaat

SEQ ID NO: 421832 - DNA, 25 bp, Mus musculus
cccgcgtgctaatggtggaccgcaa

SEQ ID NO: 421833 - DNA, 25 bp, Mus musculus
cccgctcccaagtgtctgttgtaaa

SEQ ID NO: 421834 - DNA, 25 bp, Mus musculus
cccgctgaacccaaggtgaaacttg

SEQ ID NO: 421835 - DNA, 25 bp, Mus musculus
cccgctgcaatcttctgcactagag

SEQ ID NO: 421836 - DNA, 25 bp, Mus musculus
cccgctgccatttgagcctgcctag

SEQ ID NO: 421837 - DNA, 25 bp, Mus musculus
cccgctgctgggatgtcaggcaaca

SEQ ID NO: 421838 - DNA, 25 bp, Mus musculus
cccgctgtgcgcttgacttaagaga

SEQ ID NO: 421839 - DNA, 25 bp, Mus musculus
cccgcttgataaagagtaaagttca

SEQ ID NO: 421840 - DNA, 25 bp, Mus musculus
cccggaacaccttctaagagagcta

SEQ ID NO: 421841 - DNA, 25 bp, Mus musculus
cccggaacgttgttgctgctggaca

SEQ ID NO: 421842 - DNA, 25 bp, Mus musculus
cccggaagcagaggaacagatgtca

SEQ ID NO: 421843 - DNA, 25 bp, Mus musculus
cccggacagcggtgagagagtctct

SEQ ID NO: 421844 - DNA, 25 bp, Mus musculus
cccggaccgcagagaagaggaatct

SEQ ID NO: 421845 - DNA, 25 bp, Mus musculus
cccggacgccgggaagaagcaattg

SEQ ID NO: 421846 - DNA, 25 bp, Mus musculus
cccggagagggctcattgacgtgaa

SEQ ID NO: 421847 - DNA, 25 bp, Mus musculus
cccggagattcaaggacagagctta

SEQ ID NO: 421848 - DNA, 25 bp, Mus musculus
cccggaggcccaacgacatttatgt

SEQ ID NO: 421849 - DNA, 25 bp, Mus musculus
cccggagggacgacatagttgctga

SEQ ID NO: 421850 - DNA, 25 bp, Mus musculus
cccggagggattgcctcaagtgctg

SEQ ID NO: 421851 - DNA, 25 bp, Mus musculus
cccggagttccaggtagaaagaatg

SEQ ID NO: 421852 - DNA, 25 bp, Mus musculus
cccggagttcccacgctggtagtgt

SEQ ID NO: 421853 - DNA, 25 bp, Mus musculus
cccggatatacacaaggagcgcatt

SEQ ID NO: 421854 - DNA, 25 bp, Mus musculus
cccggatgaccaagtgtgagtgtaa

SEQ ID NO: 421855 - DNA, 25 bp, Mus musculus
cccggattgaaaaggcgcagtgcat

SEQ ID NO: 421856 - DNA, 25 bp, Mus musculus
cccggatttgctcctgttaatgaag

SEQ ID NO: 421857 - DNA, 25 bp, Mus musculus
cccggcaagccacctcagtttggaa

SEQ ID NO: 421858 - DNA, 25 bp, Mus musculus
cccggccggtgcttcatgaaaaaga

SEQ ID NO: 421859 - DNA, 25 bp, Mus musculus
cccggcctcctataaggactatatg

SEQ ID NO: 421860 - DNA, 25 bp, Mus musculus
cccggcggagtgcaacatcaaagtg

SEQ ID NO: 421861 - DNA, 25 bp, Mus musculus
cccggcgtacagacacattgctgat

SEQ ID NO: 421862 - DNA, 25 bp, Mus musculus
cccggctcctgatggtgaatatagc

SEQ ID NO: 421863 - DNA, 25 bp, Mus musculus
cccggctggatgctgaactagtgaa

SEQ ID NO: 421864 - DNA, 25 bp, Mus musculus
cccggctgtaggatactgacacgct

SEQ ID NO: 421865 - DNA, 25 bp, Mus musculus
cccggcttgctgatgcatggaacaa

SEQ ID NO: 421866 - DNA, 25 bp, Mus musculus
cccgggaacgcgaaggtcttgagca

SEQ ID NO: 421867 - DNA, 25 bp, Mus musculus
cccgggaagtggtgcagttttctca

SEQ ID NO: 421868 - DNA, 25 bp, Mus musculus
cccgggagagcagaagaacgtctta

SEQ ID NO: 421869 - DNA, 25 bp, Mus musculus
cccgggagcgatataagagagacaa

SEQ ID NO: 421870 - DNA, 25 bp, Mus musculus
cccgggagctggatgagaagccttc

SEQ ID NO: 421871 - DNA, 25 bp, Mus musculus
cccgggaggtcatcgacagcatcat

SEQ ID NO: 421872 - DNA, 25 bp, Mus musculus
cccgggatcacgacaatcaggagat

SEQ ID NO: 421873 - DNA, 25 bp, Mus musculus
cccgggcatgtatgcccctggaggt

SEQ ID NO: 421874 - DNA, 25 bp, Mus musculus
cccgggccagttgcaggtagaatga

SEQ ID NO: 421875 - DNA, 25 bp, Mus musculus
cccgggctcgcttttctgaaggctt

SEQ ID NO: 421876 - DNA, 25 bp, Mus musculus
cccgggctgggagatcaaaatcgac

SEQ ID NO: 421877 - DNA, 25 bp, Mus musculus
cccgggtcagcctagcaagtgtgtc

SEQ ID NO: 421878 - DNA, 25 bp, Mus musculus
cccgggtcaggtatgtcctctggtc

SEQ ID NO: 421879 - DNA, 25 bp, Mus musculus
cccgggtcgcagttccagtgggcat

SEQ ID NO: 421880 - DNA, 25 bp, Mus musculus
cccgggtgagacagtgaacgaatcc

SEQ ID NO: 421881 - DNA, 25 bp, Mus musculus
cccgggtgcccttgaagagcagtct

SEQ ID NO: 421882 - DNA, 25 bp, Mus musculus
cccgggtgtcatagatcctggccat

SEQ ID NO: 421883 - DNA, 25 bp, Mus musculus
cccgggttgcaggatcagatttgga

SEQ ID NO: 421884 - DNA, 25 bp, Mus musculus
cccgggttgttactcggtgccagca

SEQ ID NO: 421885 - DNA, 25 bp, Mus musculus
cccggtaccggatgagctcaacttt

SEQ ID NO: 421886 - DNA, 25 bp, Mus musculus
cccggtcaagtccaagtcatgcgag

SEQ ID NO: 421887 - DNA, 25 bp, Mus musculus
cccggtgaactcgagagatcatgtc

SEQ ID NO: 421888 - DNA, 25 bp, Mus musculus
cccggtgagccgatcaagatggagc

SEQ ID NO: 421889 - DNA, 25 bp, Mus musculus
cccggtgccagaagctgaggagctc

SEQ ID NO: 421890 - DNA, 25 bp, Mus musculus
cccggtgcctcattactgggttaat

SEQ ID NO: 421891 - DNA, 25 bp, Mus musculus
cccggtgcttcgtcgcgggttcgct

SEQ ID NO: 421892 - DNA, 25 bp, Mus musculus
cccggtggccatcaaggagttaaga

SEQ ID NO: 421893 - DNA, 25 bp, Mus musculus
cccggttccgagacagcaaaagctt

SEQ ID NO: 421894 - DNA, 25 bp, Mus musculus
cccggttgagaagatagacaggctt

SEQ ID NO: 421895 - DNA, 25 bp, Mus musculus
cccggtttgcagacgacgagctaat

SEQ ID NO: 421896 - DNA, 25 bp, Mus musculus
cccgtatcctcagagtaaaagttgt

SEQ ID NO: 421897 - DNA, 25 bp, Mus musculus
cccgtatgaagtttggccagagagc

SEQ ID NO: 421898 - DNA, 25 bp, Mus musculus
cccgtcaggtgctatgagctgctca

SEQ ID NO: 421899 - DNA, 25 bp, Mus musculus
cccgtcatgcaggaggagcacagct

SEQ ID NO: 421900 - DNA, 25 bp, Mus musculus
cccgtcctcagaacacagacttgtt

SEQ ID NO: 421901 - DNA, 25 bp, Mus musculus
cccgtcctggagtcagcccgggttg

SEQ ID NO: 421902 - DNA, 25 bp, Mus musculus
cccgtgactgtctgttaggaagcct

SEQ ID NO: 421903 - DNA, 25 bp, Mus musculus
cccgtgatgtgctggtgaatagcaa

SEQ ID NO: 421904 - DNA, 25 bp, Mus musculus
cccgtgcccggatagagcttcatga

SEQ ID NO: 421905 - DNA, 25 bp, Mus musculus
cccgtgccggcaaaaagagctcttc

SEQ ID NO: 421906 - DNA, 25 bp, Mus musculus
cccgtgcctgctcaggcctatattt

SEQ ID NO: 421907 - DNA, 25 bp, Mus musculus
cccgtggaaagaagaaacagataca

SEQ ID NO: 421908 - DNA, 25 bp, Mus musculus
cccgtgggctaggtttgtatagata

SEQ ID NO: 421909 - DNA, 25 bp, Mus musculus
cccgtggtcggtggcatcctgttct

SEQ ID NO: 421910 - DNA, 25 bp, Mus musculus
cccgtggtgggaaagtctaatctag

SEQ ID NO: 421911 - DNA, 25 bp, Mus musculus
cccgtgtggaatgaactggcatcct

SEQ ID NO: 421912 - DNA, 25 bp, Mus musculus
cccgtgtgggaggacaagcactctt

SEQ ID NO: 421913 - DNA, 25 bp, Mus musculus
cccgtgttgggatgtctgtcaatgc

SEQ ID NO: 421914 - DNA, 25 bp, Mus musculus
cccgttcaagtttaagctgcagcca

SEQ ID NO: 421915 - DNA, 25 bp, Mus musculus
cccgttcataggctacttagtagac

SEQ ID NO: 421916 - DNA, 25 bp, Mus musculus
ccctaaaattcgctgtggccctcgg

SEQ ID NO: 421917 - DNA, 25 bp, Mus musculus
ccctaaatccaagtgggagtgtgca

SEQ ID NO: 421918 - DNA, 25 bp, Mus musculus
ccctaatggatgttatcgcgatgag

SEQ ID NO: 421919 - DNA, 25 bp, Mus musculus
ccctaattgctcaccgttattcggc

SEQ ID NO: 421920 - DNA, 25 bp, Mus musculus
ccctacccagtcgaagaaagagaag

SEQ ID NO: 421921 - DNA, 25 bp, Mus musculus
ccctacctacaaatggaagcggcag

SEQ ID NO: 421922 - DNA, 25 bp, Mus musculus
ccctagaactggagtgtgtgcctga

SEQ ID NO: 421923 - DNA, 25 bp, Mus musculus
ccctagacctttattgtgagcactg

SEQ ID NO: 421924 - DNA, 25 bp, Mus musculus
ccctagactaaaagagaacatgact

SEQ ID NO: 421925 - DNA, 25 bp, Mus musculus
ccctagatacttggggacacctgga

SEQ ID NO: 421926 - DNA, 25 bp, Mus musculus
ccctagataggaagaggtgcctctg

SEQ ID NO: 421927 - DNA, 25 bp, Mus musculus
ccctagatgttgttaacggcctgct

SEQ ID NO: 421928 - DNA, 25 bp, Mus musculus
ccctagctctgttaataggaataaa

SEQ ID NO: 421929 - DNA, 25 bp, Mus musculus
ccctaggagtctggagtagagatct

SEQ ID NO: 421930 - DNA, 25 bp, Mus musculus
ccctaggatggtgggactaagctgt

SEQ ID NO: 421931 - DNA, 25 bp, Mus musculus
ccctaggctggaagttggagtgacc

SEQ ID NO: 421932 - DNA, 25 bp, Mus musculus
ccctagggtttccatgtcagatgca

SEQ ID NO: 421933 - DNA, 25 bp, Mus musculus
ccctagtcatgaagctggcagtatg

SEQ ID NO: 421934 - DNA, 25 bp, Mus musculus
ccctagtggatgagagagctcccga

SEQ ID NO: 421935 - DNA, 25 bp, Mus musculus
ccctagtgggtacatatctgaagat

SEQ ID NO: 421936 - DNA, 25 bp, Mus musculus
ccctagttcaagctcccttcggagt

SEQ ID NO: 421937 - DNA, 25 bp, Mus musculus
ccctagtttcagaggcacggaggat

SEQ ID NO: 421938 - DNA, 25 bp, Mus musculus
ccctataaggtttggaatcaggcaa

SEQ ID NO: 421939 - DNA, 25 bp, Mus musculus
ccctataggcaggtatccacagtaa

SEQ ID NO: 421940 - DNA, 25 bp, Mus musculus
ccctatatatccagcagtgggaggt

SEQ ID NO: 421941 - DNA, 25 bp, Mus musculus
ccctatatgcatgcgctagcggcgg

SEQ ID NO: 421942 - DNA, 25 bp, Mus musculus
ccctatcgagagctgtcaggccgag

SEQ ID NO: 421943 - DNA, 25 bp, Mus musculus
ccctatcggtgtgtggagattgcca

SEQ ID NO: 421944 - DNA, 25 bp, Mus musculus
ccctatgtgatggagaaggcggcac

SEQ ID NO: 421945 - DNA, 25 bp, Mus musculus
ccctatgtgcgctcccagaagctaa

SEQ ID NO: 421946 - DNA, 25 bp, Mus musculus
ccctcaaaggactcgaacacagtgt

SEQ ID NO: 421947 - DNA, 25 bp, Mus musculus
ccctcaaagttgtggaaccctggct

SEQ ID NO: 421948 - DNA, 25 bp, Mus musculus
ccctcaacaggatggacagcagtca

SEQ ID NO: 421949 - DNA, 25 bp, Mus musculus
ccctcaaggagcagagcatacagct

SEQ ID NO: 421950 - DNA, 25 bp, Mus musculus
ccctcaaggtgtccgtgtggagcaa

SEQ ID NO: 421951 - DNA, 25 bp, Mus musculus
ccctcaatggctacccacgggagga

SEQ ID NO: 421952 - DNA, 25 bp, Mus musculus
ccctcaccactctgtactgtgagtg

SEQ ID NO: 421953 - DNA, 25 bp, Mus musculus
ccctcaccaggctgtagagttccat

SEQ ID NO: 421954 - DNA, 25 bp, Mus musculus
ccctcacgggcctgtgacagaagct

SEQ ID NO: 421955 - DNA, 25 bp, Mus musculus
ccctcacgggtctgcaattatttga

SEQ ID NO: 421956 - DNA, 25 bp, Mus musculus
ccctcactaagaccccagttttgat

SEQ ID NO: 421957 - DNA, 25 bp, Mus musculus
ccctcactgtgagtgtaatacttaa

SEQ ID NO: 421958 - DNA, 25 bp, Mus musculus
ccctcagatgctgcgttggagtgct

SEQ ID NO: 421959 - DNA, 25 bp, Mus musculus
ccctcagcagtaagagccggagttc

SEQ ID NO: 421960 - DNA, 25 bp, Mus musculus
ccctcagcgatgtagaagaccttca

SEQ ID NO: 421961 - DNA, 25 bp, Mus musculus
ccctcaggagtaggcaggtactgtt

SEQ ID NO: 421962 - DNA, 25 bp, Mus musculus
ccctcaggcgtttggtcatagcaac

SEQ ID NO: 421963 - DNA, 25 bp, Mus musculus
ccctcagttggagatgtttggatga

SEQ ID NO: 421964 - DNA, 25 bp, Mus musculus
ccctcatactacaggtgagttctct

SEQ ID NO: 421965 - DNA, 25 bp, Mus musculus
ccctcatctggcctatgcatgtggt

SEQ ID NO: 421966 - DNA, 25 bp, Mus musculus
ccctcatgaccatcaccggagtggg

SEQ ID NO: 421967 - DNA, 25 bp, Mus musculus
ccctcatgagttgtgcctggaattc

SEQ ID NO: 421968 - DNA, 25 bp, Mus musculus
ccctcattccagtgacctcagtggt

SEQ ID NO: 421969 - DNA, 25 bp, Mus musculus
ccctccaaatgggaaagctgcaggt

SEQ ID NO: 421970 - DNA, 25 bp, Mus musculus
ccctccagaatgagctgtgtcagct

SEQ ID NO: 421971 - DNA, 25 bp, Mus musculus
ccctcccggtattttgtcacagtat

SEQ ID NO: 421972 - DNA, 25 bp, Mus musculus
ccctccgctgtgaactgcaagttaa

SEQ ID NO: 421973 - DNA, 25 bp, Mus musculus
ccctccgggagaagatgctgccttg

SEQ ID NO: 421974 - DNA, 25 bp, Mus musculus
ccctcctatgagaggcagagatgct

SEQ ID NO: 421975 - DNA, 25 bp, Mus musculus
ccctcctggaggtttgtgggctcat

SEQ ID NO: 421976 - DNA, 25 bp, Mus musculus
ccctcctggtgaatgctgggaagag

SEQ ID NO: 421977 - DNA, 25 bp, Mus musculus
ccctccttccctgctaaccaaagag

SEQ ID NO: 421978 - DNA, 25 bp, Mus musculus
ccctcgaatctcagtgtggacacag

SEQ ID NO: 421979 - DNA, 25 bp, Mus musculus
ccctcgagtaggatggtagcacgca

SEQ ID NO: 421980 - DNA, 25 bp, Mus musculus
ccctcgatggcagtttctatgacaa

SEQ ID NO: 421981 - DNA, 25 bp, Mus musculus
ccctcgcagccaagggttttgggag

SEQ ID NO: 421982 - DNA, 25 bp, Mus musculus
ccctcgcgtgttcttatcttttgga

SEQ ID NO: 421983 - DNA, 25 bp, Mus musculus
ccctcgggcagaagaaagatcgcta

SEQ ID NO: 421984 - DNA, 25 bp, Mus musculus
ccctcgggtagagatggcaggcttt

SEQ ID NO: 421985 - DNA, 25 bp, Mus musculus
ccctcggttcaaaaagctggcagat

SEQ ID NO: 421986 - DNA, 25 bp, Mus musculus
ccctcgtgtggtcttacttgactct

SEQ ID NO: 421987 - DNA, 25 bp, Mus musculus
ccctctatgctggacgcggtgttag

SEQ ID NO: 421988 - DNA, 25 bp, Mus musculus
ccctctccgttctgtgaggatacag

SEQ ID NO: 421989 - DNA, 25 bp, Mus musculus
ccctctcgcaggacgtggaacttgg

SEQ ID NO: 421990 - DNA, 25 bp, Mus musculus
ccctctgacatggaagacgattacg

SEQ ID NO: 421991 - DNA, 25 bp, Mus musculus
ccctctgatggctgacacgcattct

SEQ ID NO: 421992 - DNA, 25 bp, Mus musculus
ccctctgcttgactggttggaataa

SEQ ID NO: 421993 - DNA, 25 bp, Mus musculus
ccctctggaggcgaaatggttgtca

SEQ ID NO: 421994 - DNA, 25 bp, Mus musculus
ccctctggtatatcggtaagtaatt

SEQ ID NO: 421995 - DNA, 25 bp, Mus musculus
ccctctgtaggtatttgatgtccag

SEQ ID NO: 421996 - DNA, 25 bp, Mus musculus
ccctcttatatatagcagatgtgca

SEQ ID NO: 421997 - DNA, 25 bp, Mus musculus
ccctcttcaaggtacgggatcgaga

SEQ ID NO: 421998 - DNA, 25 bp, Mus musculus
ccctcttcaggagaactgatttcaa

SEQ ID NO: 421999 - DNA, 25 bp, Mus musculus
ccctcttcagtttggcgcccagtgg

SEQ ID NO: 422000 - DNA, 25 bp, Mus musculus
ccctcttgtgcaggaccatggagca

SEQ ID NO: 422001 - DNA, 25 bp, Mus musculus
ccctctttctggctgcccaaggtgg

SEQ ID NO: 422002 - DNA, 25 bp, Mus musculus
ccctgaactgtttggatggctaaga

SEQ ID NO: 422003 - DNA, 25 bp, Mus musculus
ccctgaacttctgggcacaagattt

SEQ ID NO: 422004 - DNA, 25 bp, Mus musculus
ccctgaagaagtaccatggctggct

SEQ ID NO: 422005 - DNA, 25 bp, Mus musculus
ccctgaagaccgaagcgtgagcgat

SEQ ID NO: 422006 - DNA, 25 bp, Mus musculus
ccctgaagataaagaagccgatgat

SEQ ID NO: 422007 - DNA, 25 bp, Mus musculus
ccctgaaggctagattgcatgatta

SEQ ID NO: 422008 - DNA, 25 bp, Mus musculus
ccctgaagtaagatgagcgtgatgc

SEQ ID NO: 422009 - DNA, 25 bp, Mus musculus
ccctgaagtggccagatgggcggaa

SEQ ID NO: 422010 - DNA, 25 bp, Mus musculus
ccctgaatggcgtggtgaaactcca

SEQ ID NO: 422011 - DNA, 25 bp, Mus musculus
ccctgaatgtcagcgtgggaggcaa

SEQ ID NO: 422012 - DNA, 25 bp, Mus musculus
ccctgaattggtgcccaaggacgcg

SEQ ID NO: 422013 - DNA, 25 bp, Mus musculus
ccctgacatggctaaagacttggaa

SEQ ID NO: 422014 - DNA, 25 bp, Mus musculus
ccctgaccctgctgaccttgtgttt

SEQ ID NO: 422015 - DNA, 25 bp, Mus musculus
ccctgactggtacggtgcccagaat

SEQ ID NO: 422016 - DNA, 25 bp, Mus musculus
ccctgagacggaaagtttctcaact

SEQ ID NO: 422017 - DNA, 25 bp, Mus musculus
ccctgagagaggtggaacagcttca

SEQ ID NO: 422018 - DNA, 25 bp, Mus musculus
ccctgaggcgtagaaaagagcaaga

SEQ ID NO: 422019 - DNA, 25 bp, Mus musculus
ccctgagtcatatcttcaagagtca

SEQ ID NO: 422020 - DNA, 25 bp, Mus musculus
ccctgagtgctaggaatgacaagcc

SEQ ID NO: 422021 - DNA, 25 bp, Mus musculus
ccctgagttctcctggttcaaacca

SEQ ID NO: 422022 - DNA, 25 bp, Mus musculus
ccctgataaactattgtatgtgagg

SEQ ID NO: 422023 - DNA, 25 bp, Mus musculus
ccctgatggccgaagtgttggagac

SEQ ID NO: 422024 - DNA, 25 bp, Mus musculus
ccctgatggtgttcagctaagctct

SEQ ID NO: 422025 - DNA, 25 bp, Mus musculus
ccctgcaatggcaggaatttatgga

SEQ ID NO: 422026 - DNA, 25 bp, Mus musculus
ccctgcaccggagcgaatgctggag

SEQ ID NO: 422027 - DNA, 25 bp, Mus musculus
ccctgcaggaggtgataagctttga

SEQ ID NO: 422028 - DNA, 25 bp, Mus musculus
ccctgcaggattacgaggctggcca

SEQ ID NO: 422029 - DNA, 25 bp, Mus musculus
ccctgcaggcgatgcccgaggctga

SEQ ID NO: 422030 - DNA, 25 bp, Mus musculus
ccctgcagggtttcaaggaaggcaa

SEQ ID NO: 422031 - DNA, 25 bp, Mus musculus
ccctgcattcaaggtaaaggcgagt

SEQ ID NO: 422032 - DNA, 25 bp, Mus musculus
ccctgccagcagagatgtaagaaca

SEQ ID NO: 422033 - DNA, 25 bp, Mus musculus
ccctgccagtccatgggatacagca

SEQ ID NO: 422034 - DNA, 25 bp, Mus musculus
ccctgccgagggagctagtgtaaaa

SEQ ID NO: 422035 - DNA, 25 bp, Mus musculus
ccctgccttgcttttccgtgggaca

SEQ ID NO: 422036 - DNA, 25 bp, Mus musculus
ccctgcgacaggtagatggcatcta

SEQ ID NO: 422037 - DNA, 25 bp, Mus musculus
ccctgcgtaaggaggtgtgccaact

SEQ ID NO: 422038 - DNA, 25 bp, Mus musculus
ccctgctcaacatttcctggtggaa

SEQ ID NO: 422039 - DNA, 25 bp, Mus musculus
ccctgctcagaagtgtggtgtccag

SEQ ID NO: 422040 - DNA, 25 bp, Mus musculus
ccctgctgacgctcactgtgttctt

SEQ ID NO: 422041 - DNA, 25 bp, Mus musculus
ccctgctggcagtggtcctggtttt

SEQ ID NO: 422042 - DNA, 25 bp, Mus musculus
ccctgctggctctgtgagaaatgac

SEQ ID NO: 422043 - DNA, 25 bp, Mus musculus
ccctgctgtagacgtggctgtaaaa

SEQ ID NO: 422044 - DNA, 25 bp, Mus musculus
ccctggaactgcagacggatgagct

SEQ ID NO: 422045 - DNA, 25 bp, Mus musculus
ccctggaagggcatgtttaacgaca

SEQ ID NO: 422046 - DNA, 25 bp, Mus musculus
ccctggaaggtgtcagaggtgccaa

SEQ ID NO: 422047 - DNA, 25 bp, Mus musculus
ccctggacacatccttgggaaggct

SEQ ID NO: 422048 - DNA, 25 bp, Mus musculus
ccctggacacggagatgtagatttc

SEQ ID NO: 422049 - DNA, 25 bp, Mus musculus
ccctggacacgggttctgaacgcat

SEQ ID NO: 422050 - DNA, 25 bp, Mus musculus
ccctggactatgtggtgagcaatgc

SEQ ID NO: 422051 - DNA, 25 bp, Mus musculus
ccctggactgggaggcacaaatggt

SEQ ID NO: 422052 - DNA, 25 bp, Mus musculus
ccctggactggtatctgtttaatat

SEQ ID NO: 422053 - DNA, 25 bp, Mus musculus
ccctggagcgatctgtgaattgacc

SEQ ID NO: 422054 - DNA, 25 bp, Mus musculus
ccctggaggcagatctattgacaaa

SEQ ID NO: 422055 - DNA, 25 bp, Mus musculus
ccctggatacagagaatggagcgat

SEQ ID NO: 422056 - DNA, 25 bp, Mus musculus
ccctggatagtctggtctggagctg

SEQ ID NO: 422057 - DNA, 25 bp, Mus musculus
ccctggatcagcaagaggcgttcgc

SEQ ID NO: 422058 - DNA, 25 bp, Mus musculus
ccctggatggacacgcgtacctttg

SEQ ID NO: 422059 - DNA, 25 bp, Mus musculus
ccctggcaaccgagagaaagtcatc

SEQ ID NO: 422060 - DNA, 25 bp, Mus musculus
ccctggcagaagacaacatgggcag

SEQ ID NO: 422061 - DNA, 25 bp, Mus musculus
ccctggcattggcttggtgattact

SEQ ID NO: 422062 - DNA, 25 bp, Mus musculus
ccctggcgagccagctgtgagtaat

SEQ ID NO: 422063 - DNA, 25 bp, Mus musculus
ccctggctaggagctgacctcttgt

SEQ ID NO: 422064 - DNA, 25 bp, Mus musculus
ccctggctgacatgttggagactcc

SEQ ID NO: 422065 - DNA, 25 bp, Mus musculus
ccctgggaggcgtcaggttcctttg

SEQ ID NO: 422066 - DNA, 25 bp, Mus musculus
ccctgggagtggattatgaatttga

SEQ ID NO: 422067 - DNA, 25 bp, Mus musculus
ccctgggatgaaagaagctgaaggt

SEQ ID NO: 422068 - DNA, 25 bp, Mus musculus
ccctgggccttgttgggatccggct

SEQ ID NO: 422069 - DNA, 25 bp, Mus musculus
ccctggtaacagttgacatgttccg

SEQ ID NO: 422070 - DNA, 25 bp, Mus musculus
ccctggtcacttctgaggagatgag

SEQ ID NO: 422071 - DNA, 25 bp, Mus musculus
ccctggtcagggatgttaggaaata

SEQ ID NO: 422072 - DNA, 25 bp, Mus musculus
ccctggtctgaactggatgtgagca

SEQ ID NO: 422073 - DNA, 25 bp, Mus musculus
ccctggtctgctgagtggttttctg

SEQ ID NO: 422074 - DNA, 25 bp, Mus musculus
ccctggtgaggtatgctatagatcc

SEQ ID NO: 422075 - DNA, 25 bp, Mus musculus
ccctgtaaagtgatgagtgagtgcc

SEQ ID NO: 422076 - DNA, 25 bp, Mus musculus
ccctgtacgatgagagcaccaagct

SEQ ID NO: 422077 - DNA, 25 bp, Mus musculus
ccctgtacttacaaatgaactatta

SEQ ID NO: 422078 - DNA, 25 bp, Mus musculus
ccctgtagaagtaagatagcctgtc

SEQ ID NO: 422079 - DNA, 25 bp, Mus musculus
ccctgtcatcagagggcgaggaaga

SEQ ID NO: 422080 - DNA, 25 bp, Mus musculus
ccctgtccaggagggtgagccaaga

SEQ ID NO: 422081 - DNA, 25 bp, Mus musculus
ccctgtccaggttaatgtgtgcata

SEQ ID NO: 422082 - DNA, 25 bp, Mus musculus
ccctgtccttggtgaacgaggctca

SEQ ID NO: 422083 - DNA, 25 bp, Mus musculus
ccctgtcggagaacatgctaagcca

SEQ ID NO: 422084 - DNA, 25 bp, Mus musculus
ccctgtcgtgggtggtgctattgat

SEQ ID NO: 422085 - DNA, 25 bp, Mus musculus
ccctgtctgtagaacttgtgactga

SEQ ID NO: 422086 - DNA, 25 bp, Mus musculus
ccctgtgaattaagtgcctgcagag

SEQ ID NO: 422087 - DNA, 25 bp, Mus musculus
ccctgtgacgggattctgttcagta

SEQ ID NO: 422088 - DNA, 25 bp, Mus musculus
ccctgtgcaggacatgaagactgga

SEQ ID NO: 422089 - DNA, 25 bp, Mus musculus
ccctgtgccgaggtgttgaactcta

SEQ ID NO: 422090 - DNA, 25 bp, Mus musculus
ccctgtgcggcactctagatgagaa

SEQ ID NO: 422091 - DNA, 25 bp, Mus musculus
ccctgtggaacagaaaaagcgcaag

SEQ ID NO: 422092 - DNA, 25 bp, Mus musculus
ccctgtgggcaacggagcaatgaaa

SEQ ID NO: 422093 - DNA, 25 bp, Mus musculus
ccctgtggtaccaggcagtgaccca

SEQ ID NO: 422094 - DNA, 25 bp, Mus musculus
ccctgtggtgaagacatgtgtcccc

SEQ ID NO: 422095 - DNA, 25 bp, Mus musculus
ccctgtgtacaagagccatgggaca

SEQ ID NO: 422096 - DNA, 25 bp, Mus musculus
ccctgttgaccgtggactgtttgag

SEQ ID NO: 422097 - DNA, 25 bp, Mus musculus
ccctgttgatccgaagagagctgac

SEQ ID NO: 422098 - DNA, 25 bp, Mus musculus
ccctgttgtagcaaatctgaatggc

SEQ ID NO: 422099 - DNA, 25 bp, Mus musculus
cccttaaaattagagagcttgagac

SEQ ID NO: 422100 - DNA, 25 bp, Mus musculus
cccttaaacagggatcaggtcttgc

SEQ ID NO: 422101 - DNA, 25 bp, Mus musculus
cccttaagatgcacgatggaattgt

SEQ ID NO: 422102 - DNA, 25 bp, Mus musculus
cccttaaggaaagctgaggcggaag

SEQ ID NO: 422103 - DNA, 25 bp, Mus musculus
cccttaatggccatgttagacgtga

SEQ ID NO: 422104 - DNA, 25 bp, Mus musculus
cccttcaactggtctttggaacata

SEQ ID NO: 422105 - DNA, 25 bp, Mus musculus
cccttcaaggtgagcaagtggatgg

SEQ ID NO: 422106 - DNA, 25 bp, Mus musculus
cccttccaaaatgtgggcttctctg

SEQ ID NO: 422107 - DNA, 25 bp, Mus musculus
cccttccacattgcccatgggctca

SEQ ID NO: 422108 - DNA, 25 bp, Mus musculus
cccttcctgctgatgagtgagacgt

SEQ ID NO: 422109 - DNA, 25 bp, Mus musculus
cccttccttgtaggatgtggtcggg

SEQ ID NO: 422110 - DNA, 25 bp, Mus musculus
cccttcgatgacctgaaaatctccg

SEQ ID NO: 422111 - DNA, 25 bp, Mus musculus
cccttctcagcttaggtcctcagag

SEQ ID NO: 422112 - DNA, 25 bp, Mus musculus
cccttctccacgagcggcagaggag

SEQ ID NO: 422113 - DNA, 25 bp, Mus musculus
cccttctgctgagctttaaaaataa

SEQ ID NO: 422114 - DNA, 25 bp, Mus musculus
cccttctggtcagctctgagtgaaa

SEQ ID NO: 422115 - DNA, 25 bp, Mus musculus
cccttgagaaggacacagacagtat

SEQ ID NO: 422116 - DNA, 25 bp, Mus musculus
cccttgagaaggtgttcgtatctgt

SEQ ID NO: 422117 - DNA, 25 bp, Mus musculus
cccttgagatgctgaaatcttcagg

SEQ ID NO: 422118 - DNA, 25 bp, Mus musculus
cccttgagcactgggcatgggaaaa

SEQ ID NO: 422119 - DNA, 25 bp, Mus musculus
cccttgagtgcgtgcgcatacatgt

SEQ ID NO: 422120 - DNA, 25 bp, Mus musculus
cccttgatgtatcaaagcctttgat

SEQ ID NO: 422121 - DNA, 25 bp, Mus musculus
cccttgcaaggcctttctagaatca

SEQ ID NO: 422122 - DNA, 25 bp, Mus musculus
cccttgcactgaggtgcacacagtg

SEQ ID NO: 422123 - DNA, 25 bp, Mus musculus
cccttgcacttcagacaagctgtgg

SEQ ID NO: 422124 - DNA, 25 bp, Mus musculus
cccttgccttagagagctgggacaa

SEQ ID NO: 422125 - DNA, 25 bp, Mus musculus
cccttgcgtgcgtggtgaacatggc

SEQ ID NO: 422126 - DNA, 25 bp, Mus musculus
cccttgctccggaggagtacagccg

SEQ ID NO: 422127 - DNA, 25 bp, Mus musculus
cccttggatagcctgactctggaaa

SEQ ID NO: 422128 - DNA, 25 bp, Mus musculus
cccttgggatatgagtgctgaagcc

SEQ ID NO: 422129 - DNA, 25 bp, Mus musculus
cccttgggtaaggtgtgcctgctaa

SEQ ID NO: 422130 - DNA, 25 bp, Mus musculus
cccttgtgcatcttggctgcagctg

SEQ ID NO: 422131 - DNA, 25 bp, Mus musculus
cccttgttaatggtgtgcccgtgcc

SEQ ID NO: 422132 - DNA, 25 bp, Mus musculus
cccttgttggcctggttctcctgct

SEQ ID NO: 422133 - DNA, 25 bp, Mus musculus
cccttgtttccaggatggtgatccg

SEQ ID NO: 422134 - DNA, 25 bp, Mus musculus
ccctttactggttgtagtcctgacg

SEQ ID NO: 422135 - DNA, 25 bp, Mus musculus
ccctttagagagatagcaggcagct

SEQ ID NO: 422136 - DNA, 25 bp, Mus musculus
ccctttatgaagcagatttaaacaa

SEQ ID NO: 422137 - DNA, 25 bp, Mus musculus
ccctttattttgaaagaggagctct

SEQ ID NO: 422138 - DNA, 25 bp, Mus musculus
ccctttcccattagtgagaataaat

SEQ ID NO: 422139 - DNA, 25 bp, Mus musculus
ccctttcctgagtccaagccagttt

SEQ ID NO: 422140 - DNA, 25 bp, Mus musculus
ccctttcttaggacgatgtctcacc

SEQ ID NO: 422141 - DNA, 25 bp, Mus musculus
ccctttgaagtggaaatgaaatctc

SEQ ID NO: 422142 - DNA, 25 bp, Mus musculus
ccctttgcacgtgcgcactgggtgt

SEQ ID NO: 422143 - DNA, 25 bp, Mus musculus
ccctttgcggactccgtggaggctc

SEQ ID NO: 422144 - DNA, 25 bp, Mus musculus
ccctttgctggagaagactgatcac

SEQ ID NO: 422145 - DNA, 25 bp, Mus musculus
ccctttggggctgcgctgtatcgaa

SEQ ID NO: 422146 - DNA, 25 bp, Mus musculus
ccctttgtcatggaagttgtctgtc

SEQ ID NO: 422147 - DNA, 25 bp, Mus musculus
ccctttgtccccacagagtgaatgt

SEQ ID NO: 422148 - DNA, 25 bp, Mus musculus
cccttttagagagtgtggaagcgtc

SEQ ID NO: 422149 - DNA, 25 bp, Mus musculus
cccttttattgagtgggcacggcca

SEQ ID NO: 422150 - DNA, 25 bp, Mus musculus
cccttttctgtgcttagagttagca

SEQ ID NO: 422151 - DNA, 25 bp, Mus musculus
cccttttgcttttgcacggtgagag

SEQ ID NO: 422152 - DNA, 25 bp, Mus musculus
ccctttttaacagatgtagatgtcc

SEQ ID NO: 422153 - DNA, 25 bp, Mus musculus
ccgaaacactgacttacgctgggca

SEQ ID NO: 422154 - DNA, 25 bp, Mus musculus
ccgaaacatgtgacgaggagcccgt

SEQ ID NO: 422155 - DNA, 25 bp, Mus musculus
ccgaaactctacaaaggggacagag

SEQ ID NO: 422156 - DNA, 25 bp, Mus musculus
ccgaaagtcagagaaggaacgccta

SEQ ID NO: 422157 - DNA, 25 bp, Mus musculus
ccgaaattgcgaggactgagcgtcg

SEQ ID NO: 422158 - DNA, 25 bp, Mus musculus
ccgaagcctacatctcagtggagga

SEQ ID NO: 422159 - DNA, 25 bp, Mus musculus
ccgaagctcatcatggccggagcag

SEQ ID NO: 422160 - DNA, 25 bp, Mus musculus
ccgaaggctgccatgggtaacatag

SEQ ID NO: 422161 - DNA, 25 bp, Mus musculus
ccgaagtgaactgggcaaacctgac

SEQ ID NO: 422162 - DNA, 25 bp, Mus musculus
ccgaagtgctgacacatgatgtgcc

SEQ ID NO: 422163 - DNA, 25 bp, Mus musculus
ccgaatactctctgtgtagactggg

SEQ ID NO: 422164 - DNA, 25 bp, Mus musculus
ccgaataggtaaaaagcactgtagc

SEQ ID NO: 422165 - DNA, 25 bp, Mus musculus
ccgaatccgagtggtggacgccaat

SEQ ID NO: 422166 - DNA, 25 bp, Mus musculus
ccgaatccggtatgtgcagagtctc

SEQ ID NO: 422167 - DNA, 25 bp, Mus musculus
ccgaatcctggttgggagcctggaa

SEQ ID NO: 422168 - DNA, 25 bp, Mus musculus
ccgaatcttccagggatgaaggcat

SEQ ID NO: 422169 - DNA, 25 bp, Mus musculus
ccgaatgcgtaaactgtggctgacc

SEQ ID NO: 422170 - DNA, 25 bp, Mus musculus
ccgaatggaggctgtaagactgcgt

SEQ ID NO: 422171 - DNA, 25 bp, Mus musculus
ccgaatggcttttttgcgaactgca

SEQ ID NO: 422172 - DNA, 25 bp, Mus musculus
ccgaattggcgcgatataacatata

SEQ ID NO: 422173 - DNA, 25 bp, Mus musculus
ccgacaaagtgtggcgtctggacct

SEQ ID NO: 422174 - DNA, 25 bp, Mus musculus
ccgacaatcgtaagctgtggagagc

SEQ ID NO: 422175 - DNA, 25 bp, Mus musculus
ccgacacctgcatgagtacatggag

SEQ ID NO: 422176 - DNA, 25 bp, Mus musculus
ccgacactgggcttcaacatcaaga

SEQ ID NO: 422177 - DNA, 25 bp, Mus musculus
ccgacagacagagccgcaagctgga

SEQ ID NO: 422178 - DNA, 25 bp, Mus musculus
ccgacagtgatggtccaaaggaaaa

SEQ ID NO: 422179 - DNA, 25 bp, Mus musculus
ccgacgactgctatttgaagccata

SEQ ID NO: 422180 - DNA, 25 bp, Mus musculus
ccgacgagatcctttgcgagggcga

SEQ ID NO: 422181 - DNA, 25 bp, Mus musculus
ccgacgagttgtaaatcttgaagac

SEQ ID NO: 422182 - DNA, 25 bp, Mus musculus
ccgacgatgccgtgtacgagctcaa

SEQ ID NO: 422183 - DNA, 25 bp, Mus musculus
ccgacgcctgggtgatgctggacat

SEQ ID NO: 422184 - DNA, 25 bp, Mus musculus
ccgacgcggtggagcttcgagaact

SEQ ID NO: 422185 - DNA, 25 bp, Mus musculus
ccgacggagccatgagagagtacaa

SEQ ID NO: 422186 - DNA, 25 bp, Mus musculus
ccgactactgctgtcttcaggagca

SEQ ID NO: 422187 - DNA, 25 bp, Mus musculus
ccgactatgtaggaacggacagtgc

SEQ ID NO: 422188 - DNA, 25 bp, Mus musculus
ccgactcgtcggatgagaacagcga

SEQ ID NO: 422189 - DNA, 25 bp, Mus musculus
ccgactcttactactggtggcacag

SEQ ID NO: 422190 - DNA, 25 bp, Mus musculus
ccgactgggcgactgagaaaatctc

SEQ ID NO: 422191 - DNA, 25 bp, Mus musculus
ccgactgtggcgagaaagtgactct

SEQ ID NO: 422192 - DNA, 25 bp, Mus musculus
ccgacttgaccggagagtttgagaa

SEQ ID NO: 422193 - DNA, 25 bp, Mus musculus
ccgactttgggataatgagctgcag

SEQ ID NO: 422194 - DNA, 25 bp, Mus musculus
ccgagaacccatggctgacagagta

SEQ ID NO: 422195 - DNA, 25 bp, Mus musculus
ccgagaagttgtgatcggaagagtt

SEQ ID NO: 422196 - DNA, 25 bp, Mus musculus
ccgagacaactattcagagagggct

SEQ ID NO: 422197 - DNA, 25 bp, Mus musculus
ccgagacaggaataggttggatcac

SEQ ID NO: 422198 - DNA, 25 bp, Mus musculus
ccgagacaggacgatgtgctcatct

SEQ ID NO: 422199 - DNA, 25 bp, Mus musculus
ccgagaccaaatccctgagtttcag

SEQ ID NO: 422200 - DNA, 25 bp, Mus musculus
ccgagactgcttttacctctgtcct

SEQ ID NO: 422201 - DNA, 25 bp, Mus musculus
ccgagagaacgaagaggcgcctttg

SEQ ID NO: 422202 - DNA, 25 bp, Mus musculus
ccgagaggcattctggaaaatgaag

SEQ ID NO: 422203 - DNA, 25 bp, Mus musculus
ccgagagtcatcttgtcagctgtca

SEQ ID NO: 422204 - DNA, 25 bp, Mus musculus
ccgagatatcacaaagccctgctat

SEQ ID NO: 422205 - DNA, 25 bp, Mus musculus
ccgagatcacgttgcagatggtgca

SEQ ID NO: 422206 - DNA, 25 bp, Mus musculus
ccgagatcgggcagaagcagaagtt

SEQ ID NO: 422207 - DNA, 25 bp, Mus musculus
ccgagatgagtaatcgcaccatgat

SEQ ID NO: 422208 - DNA, 25 bp, Mus musculus
ccgagatgctactccgggacctggt

SEQ ID NO: 422209 - DNA, 25 bp, Mus musculus
ccgagccacgagagaggagactttc

SEQ ID NO: 422210 - DNA, 25 bp, Mus musculus
ccgagcccgcagctgtttccaggat

SEQ ID NO: 422211 - DNA, 25 bp, Mus musculus
ccgagccgaggttgaggaatacgat

SEQ ID NO: 422212 - DNA, 25 bp, Mus musculus
ccgagcctgcgaactttataaagaa

SEQ ID NO: 422213 - DNA, 25 bp, Mus musculus
ccgagctagtaattacagttttaag

SEQ ID NO: 422214 - DNA, 25 bp, Mus musculus
ccgagctgaaaaaggtcgtggccct

SEQ ID NO: 422215 - DNA, 25 bp, Mus musculus
ccgagctgtgtgtttagtgcaatga

SEQ ID NO: 422216 - DNA, 25 bp, Mus musculus
ccgaggaaccgtatggcgactgtcc

SEQ ID NO: 422217 - DNA, 25 bp, Mus musculus
ccgaggaattgctgattcttgccct

SEQ ID NO: 422218 - DNA, 25 bp, Mus musculus
ccgaggacttcgtgtgtgactacca

SEQ ID NO: 422219 - DNA, 25 bp, Mus musculus
ccgaggagaccggagctggtcagaa

SEQ ID NO: 422220 - DNA, 25 bp, Mus musculus
ccgaggagactgcatttgttgttga

SEQ ID NO: 422221 - DNA, 25 bp, Mus musculus
ccgaggagaggctcgagttatgccc

SEQ ID NO: 422222 - DNA, 25 bp, Mus musculus
ccgaggagcacaagcagccatagtt

SEQ ID NO: 422223 - DNA, 25 bp, Mus musculus
ccgaggattcctcccagcgtggtgt

SEQ ID NO: 422224 - DNA, 25 bp, Mus musculus
ccgaggcgctgcttgttcaacaata

SEQ ID NO: 422225 - DNA, 25 bp, Mus musculus
ccgaggctcttgtaacccgacagtg

SEQ ID NO: 422226 - DNA, 25 bp, Mus musculus
ccgagggtggtatctaggtctgaac

SEQ ID NO: 422227 - DNA, 25 bp, Mus musculus
ccgaggtggatcacaagcagagtca

SEQ ID NO: 422228 - DNA, 25 bp, Mus musculus
ccgagtaaggaacagctagtggcat

SEQ ID NO: 422229 - DNA, 25 bp, Mus musculus
ccgagtacctaagattgcgcgaagt

SEQ ID NO: 422230 - DNA, 25 bp, Mus musculus
ccgagtacgctgtgatgagaactac

SEQ ID NO: 422231 - DNA, 25 bp, Mus musculus
ccgagtagaagttagtaagctgaaa

SEQ ID NO: 422232 - DNA, 25 bp, Mus musculus
ccgagtatgctcttgggtggaaacg

SEQ ID NO: 422233 - DNA, 25 bp, Mus musculus
ccgagtcaagaagaccaaggcagct

SEQ ID NO: 422234 - DNA, 25 bp, Mus musculus
ccgagtcaagagtaggattgtagga

SEQ ID NO: 422235 - DNA, 25 bp, Mus musculus
ccgagtcatgtcaaagagtgggcac

SEQ ID NO: 422236 - DNA, 25 bp, Mus musculus
ccgagtgatagggtgaggcgaggcc

SEQ ID NO: 422237 - DNA, 25 bp, Mus musculus
ccgagtgccaggtttccacgcatat

SEQ ID NO: 422238 - DNA, 25 bp, Mus musculus
ccgagttaccggagtgtcgtgcacg

SEQ ID NO: 422239 - DNA, 25 bp, Mus musculus
ccgagttcaactgcacgagggctca

SEQ ID NO: 422240 - DNA, 25 bp, Mus musculus
ccgagttggtcagtgtggtcttgtc

SEQ ID NO: 422241 - DNA, 25 bp, Mus musculus
ccgatacatgttctcgatcttcaga

SEQ ID NO: 422242 - DNA, 25 bp, Mus musculus
ccgatagacgcttatgagggccgct

SEQ ID NO: 422243 - DNA, 25 bp, Mus musculus
ccgatatgctttgtacgatgccacg

SEQ ID NO: 422244 - DNA, 25 bp, Mus musculus
ccgatcagaaaaagcagcaccgttg

SEQ ID NO: 422245 - DNA, 25 bp, Mus musculus
ccgatcccgaaggagaaggtgcttt

SEQ ID NO: 422246 - DNA, 25 bp, Mus musculus
ccgatcgcccggtgcataggcgcag

SEQ ID NO: 422247 - DNA, 25 bp, Mus musculus
ccgatgaaactgaagcccgatattc

SEQ ID NO: 422248 - DNA, 25 bp, Mus musculus
ccgatgaatggtgcgacagcggcct

SEQ ID NO: 422249 - DNA, 25 bp, Mus musculus
ccgatgacttcgactgggacttgat

SEQ ID NO: 422250 - DNA, 25 bp, Mus musculus
ccgatgatatgtggtaaagccgctc

SEQ ID NO: 422251 - DNA, 25 bp, Mus musculus
ccgatgcgttagctcctggtggacc

SEQ ID NO: 422252 - DNA, 25 bp, Mus musculus
ccgatggagccacattttgcaggat

SEQ ID NO: 422253 - DNA, 25 bp, Mus musculus
ccgatgtcagttctaaggattctca

SEQ ID NO: 422254 - DNA, 25 bp, Mus musculus
ccgattattctttaggagtacctga

SEQ ID NO: 422255 - DNA, 25 bp, Mus musculus
ccgattggacatgagcgtgagcgcc

SEQ ID NO: 422256 - DNA, 25 bp, Mus musculus
ccgatttgaccagaaaggagacgtt

SEQ ID NO: 422257 - DNA, 25 bp, Mus musculus
ccgcaagattcggattgttgacccc

SEQ ID NO: 422258 - DNA, 25 bp, Mus musculus
ccgcaagctggagccgggagggttt

SEQ ID NO: 422259 - DNA, 25 bp, Mus musculus
ccgcagagagccaagttaaaataaa

SEQ ID NO: 422260 - DNA, 25 bp, Mus musculus
ccgcagagcctaggcagtaagtaca

SEQ ID NO: 422261 - DNA, 25 bp, Mus musculus
ccgcaggtcgtccttgagagctcgt

SEQ ID NO: 422262 - DNA, 25 bp, Mus musculus
ccgcaggtggctaaggctggatttt

SEQ ID NO: 422263 - DNA, 25 bp, Mus musculus
ccgcagtagggtatggaccattcca

SEQ ID NO: 422264 - DNA, 25 bp, Mus musculus
ccgcatagaaaaagagggtaggcct

SEQ ID NO: 422265 - DNA, 25 bp, Mus musculus
ccgcataggtgcgtgtcctacaact

SEQ ID NO: 422266 - DNA, 25 bp, Mus musculus
ccgcatggaaatggtcatctaaggg

SEQ ID NO: 422267 - DNA, 25 bp, Mus musculus
ccgcatggattctgctggattcagt

SEQ ID NO: 422268 - DNA, 25 bp, Mus musculus
ccgccaaaacgcctcgtatcttgta

SEQ ID NO: 422269 - DNA, 25 bp, Mus musculus
ccgccaacaaaggtggtgagtactg

SEQ ID NO: 422270 - DNA, 25 bp, Mus musculus
ccgccacaagcctgggaagtttgaa

SEQ ID NO: 422271 - DNA, 25 bp, Mus musculus
ccgccacttaagacagaactctctg

SEQ ID NO: 422272 - DNA, 25 bp, Mus musculus
ccgccagacagaggtgtttaatttt

SEQ ID NO: 422273 - DNA, 25 bp, Mus musculus
ccgccaggatggacgtgttcatgaa

SEQ ID NO: 422274 - DNA, 25 bp, Mus musculus
ccgccccagccttagccaattagga

SEQ ID NO: 422275 - DNA, 25 bp, Mus musculus
ccgccctgtcggtagtggctgctta

SEQ ID NO: 422276 - DNA, 25 bp, Mus musculus
ccgccgaagcattaccagaagggtt

SEQ ID NO: 422277 - DNA, 25 bp, Mus musculus
ccgccgagagtgagagactggacat

SEQ ID NO: 422278 - DNA, 25 bp, Mus musculus
ccgccgagtaagatgctgtccagca

SEQ ID NO: 422279 - DNA, 25 bp, Mus musculus
ccgccgatctgtggaccaggatttg

SEQ ID NO: 422280 - DNA, 25 bp, Mus musculus
ccgccgctagatggcagctggcaga

SEQ ID NO: 422281 - DNA, 25 bp, Mus musculus
ccgccgcttagacagactcctttga

SEQ ID NO: 422282 - DNA, 25 bp, Mus musculus
ccgccgctttgtgtctgggagataa

SEQ ID NO: 422283 - DNA, 25 bp, Mus musculus
ccgccgggtgtctgtggctcgattc

SEQ ID NO: 422284 - DNA, 25 bp, Mus musculus
ccgccgtgggcatctgctgcagcga

SEQ ID NO: 422285 - DNA, 25 bp, Mus musculus
ccgcctccgaggtgttgagaccgag

SEQ ID NO: 422286 - DNA, 25 bp, Mus musculus
ccgcctgcattgagctggagcagca

SEQ ID NO: 422287 - DNA, 25 bp, Mus musculus
ccgcctgggtggcaaaaggtatcca

SEQ ID NO: 422288 - DNA, 25 bp, Mus musculus
ccgccttgtcggacacggagatcca

SEQ ID NO: 422289 - DNA, 25 bp, Mus musculus
ccgcgaatctaaccactgctctgtg

SEQ ID NO: 422290 - DNA, 25 bp, Mus musculus
ccgcgacatcgtgctcaagagtggt

SEQ ID NO: 422291 - DNA, 25 bp, Mus musculus
ccgcgacgtgaggagcatcttcgag

SEQ ID NO: 422292 - DNA, 25 bp, Mus musculus
ccgcgacgtggctgtgaagagacta

SEQ ID NO: 422293 - DNA, 25 bp, Mus musculus
ccgcgcaaaggcatctacagtttta

SEQ ID NO: 422294 - DNA, 25 bp, Mus musculus
ccgcgcagccttttttgtggatgta

SEQ ID NO: 422295 - DNA, 25 bp, Mus musculus
ccgcgccacgatagactgctctgtt

SEQ ID NO: 422296 - DNA, 25 bp, Mus musculus
ccgcgccgctgagtagcagcaagga

SEQ ID NO: 422297 - DNA, 25 bp, Mus musculus
ccgcgctgtcgctgcagtcatggct

SEQ ID NO: 422298 - DNA, 25 bp, Mus musculus
ccgcggagaagccatagctaaggaa

SEQ ID NO: 422299 - DNA, 25 bp, Mus musculus
ccgcggagtaccaaggcccttgtgg

SEQ ID NO: 422300 - DNA, 25 bp, Mus musculus
ccgcggcaaggcttgacagtgctca

SEQ ID NO: 422301 - DNA, 25 bp, Mus musculus
ccgcggctggcgagatgttcaagaa

SEQ ID NO: 422302 - DNA, 25 bp, Mus musculus
ccgcgggaagctctgtcagcagtat

SEQ ID NO: 422303 - DNA, 25 bp, Mus musculus
ccgcgtcccggactctctgttggga

SEQ ID NO: 422304 - DNA, 25 bp, Mus musculus
ccgcgtgatgaagactggaggctac

SEQ ID NO: 422305 - DNA, 25 bp, Mus musculus
ccgcgtgggcactgtcatgagaatt

SEQ ID NO: 422306 - DNA, 25 bp, Mus musculus
ccgctaatcagcaatcaagtccgtt

SEQ ID NO: 422307 - DNA, 25 bp, Mus musculus
ccgctacagttgcagtttttcatga

SEQ ID NO: 422308 - DNA, 25 bp, Mus musculus
ccgctagtgttgcacacgaagctga

SEQ ID NO: 422309 - DNA, 25 bp, Mus musculus
ccgctatgcaggatgttgatgtgat

SEQ ID NO: 422310 - DNA, 25 bp, Mus musculus
ccgctatgtccctgagcattcctga

SEQ ID NO: 422311 - DNA, 25 bp, Mus musculus
ccgctcacagtcgactttggttgaa

SEQ ID NO: 422312 - DNA, 25 bp, Mus musculus
ccgctcagcgagatctacaagttca

SEQ ID NO: 422313 - DNA, 25 bp, Mus musculus
ccgctcaggtccagacccaggaggg

SEQ ID NO: 422314 - DNA, 25 bp, Mus musculus
ccgctccttcagaaaacctgacaga

SEQ ID NO: 422315 - DNA, 25 bp, Mus musculus
ccgctcgagctttcccgggataagt

SEQ ID NO: 422316 - DNA, 25 bp, Mus musculus
ccgctctggctagcgcctgggtagt

SEQ ID NO: 422317 - DNA, 25 bp, Mus musculus
ccgctcttggtgttatgtgaagacc

SEQ ID NO: 422318 - DNA, 25 bp, Mus musculus
ccgctgagcgctgtagtggacttct

SEQ ID NO: 422319 - DNA, 25 bp, Mus musculus
ccgctgataagcaaggatgaggtcc

SEQ ID NO: 422320 - DNA, 25 bp, Mus musculus
ccgctgccctgaatgtaacgtgaag

SEQ ID NO: 422321 - DNA, 25 bp, Mus musculus
ccgctgccggcacctttctggctgt

SEQ ID NO: 422322 - DNA, 25 bp, Mus musculus
ccgctgccgtgtgctggtgacatca

SEQ ID NO: 422323 - DNA, 25 bp, Mus musculus
ccgctgcctgcgagtttttggacat

SEQ ID NO: 422324 - DNA, 25 bp, Mus musculus
ccgctgctgccgaatggcttaagaa

SEQ ID NO: 422325 - DNA, 25 bp, Mus musculus
ccgctgctgctagatgggaagaagt

SEQ ID NO: 422326 - DNA, 25 bp, Mus musculus
ccgctggatgaatgtgaggaactct

SEQ ID NO: 422327 - DNA, 25 bp, Mus musculus
ccgctggctagatcctgggtggacc

SEQ ID NO: 422328 - DNA, 25 bp, Mus musculus
ccgctggctggctgtcgcacggttc

SEQ ID NO: 422329 - DNA, 25 bp, Mus musculus
ccgctgtcgctgtccgcggtgctga

SEQ ID NO: 422330 - DNA, 25 bp, Mus musculus
ccgctgtgacaaacctggtgggcca

SEQ ID NO: 422331 - DNA, 25 bp, Mus musculus
ccgcttattggtccccggtggcgat

SEQ ID NO: 422332 - DNA, 25 bp, Mus musculus
ccgcttctaagataaccgagaattt

SEQ ID NO: 422333 - DNA, 25 bp, Mus musculus
ccgcttctgggctaagtggctaagt

SEQ ID NO: 422334 - DNA, 25 bp, Mus musculus
ccgcttctggggactgatggcaaaa

SEQ ID NO: 422335 - DNA, 25 bp, Mus musculus
ccgcttgttgctgtgggaaatgcca

SEQ ID NO: 422336 - DNA, 25 bp, Mus musculus
ccgctttgaagaggcgagcaccatg

SEQ ID NO: 422337 - DNA, 25 bp, Mus musculus
ccgctttgaggaagtggcctggtcc

SEQ ID NO: 422338 - DNA, 25 bp, Mus musculus
ccgctttgtaagaggcacattggca

SEQ ID NO: 422339 - DNA, 25 bp, Mus musculus
ccgcttttacttgctgttgctgaaa

SEQ ID NO: 422340 - DNA, 25 bp, Mus musculus
ccggaaactttttcctgagcgctca

SEQ ID NO: 422341 - DNA, 25 bp, Mus musculus
ccggaacctgggataggtggatcta

SEQ ID NO: 422342 - DNA, 25 bp, Mus musculus
ccggaagacctgctttttgcagcca

SEQ ID NO: 422343 - DNA, 25 bp, Mus musculus
ccggaagagcattcacaggtgtcct

SEQ ID NO: 422344 - DNA, 25 bp, Mus musculus
ccggaaggaccatcaccagtgtaga

SEQ ID NO: 422345 - DNA, 25 bp, Mus musculus
ccggaaggctgtttgcccaaggcga

SEQ ID NO: 422346 - DNA, 25 bp, Mus musculus
ccggaatctttgagcgtctgtttaa

SEQ ID NO: 422347 - DNA, 25 bp, Mus musculus
ccggacaaccatccgcctgttagaa

SEQ ID NO: 422348 - DNA, 25 bp, Mus musculus
ccggacagcgggaaccagtctccgg

SEQ ID NO: 422349 - DNA, 25 bp, Mus musculus
ccggacctgtcttatctgcgagaga

SEQ ID NO: 422350 - DNA, 25 bp, Mus musculus
ccggacgtgtatgactggccagagt

SEQ ID NO: 422351 - DNA, 25 bp, Mus musculus
ccggactcccagactgtggatagca

SEQ ID NO: 422352 - DNA, 25 bp, Mus musculus
ccggactcggtatgaactgcaggaa

SEQ ID NO: 422353 - DNA, 25 bp, Mus musculus
ccggactgagtcaggtgcagtttta

SEQ ID NO: 422354 - DNA, 25 bp, Mus musculus
ccggagaacagtggtccagacagtt

SEQ ID NO: 422355 - DNA, 25 bp, Mus musculus
ccggagagtcatcgcagccttctat

SEQ ID NO: 422356 - DNA, 25 bp, Mus musculus
ccggagatttaagcgagaactggag

SEQ ID NO: 422357 - DNA, 25 bp, Mus musculus
ccggagcaattttcagggcaccaag

SEQ ID NO: 422358 - DNA, 25 bp, Mus musculus
ccggaggaggaagttcttggataca

SEQ ID NO: 422359 - DNA, 25 bp, Mus musculus
ccggaggatggtgctgcccaagacc

SEQ ID NO: 422360 - DNA, 25 bp, Mus musculus
ccggaggcccattgatctgtgatag

SEQ ID NO: 422361 - DNA, 25 bp, Mus musculus
ccggaggctcctttcccgggctgag

SEQ ID NO: 422362 - DNA, 25 bp, Mus musculus
ccggagtccatttgcataattggat

SEQ ID NO: 422363 - DNA, 25 bp, Mus musculus
ccggatagtatagggttccagaact

SEQ ID NO: 422364 - DNA, 25 bp, Mus musculus
ccggatgatttggaacttggagaac

SEQ ID NO: 422365 - DNA, 25 bp, Mus musculus
ccggatggagctaaaggcggatcag

SEQ ID NO: 422366 - DNA, 25 bp, Mus musculus
ccggatgggatcacgcaatggagtc

SEQ ID NO: 422367 - DNA, 25 bp, Mus musculus
ccggattaaagcagggacgcgtgca

SEQ ID NO: 422368 - DNA, 25 bp, Mus musculus
ccggcaaaaagagctcttcaagtac

SEQ ID NO: 422369 - DNA, 25 bp, Mus musculus
ccggcaatttcatggaggacgagca

SEQ ID NO: 422370 - DNA, 25 bp, Mus musculus
ccggcacctaatcctgatgtgtttt

SEQ ID NO: 422371 - DNA, 25 bp, Mus musculus
ccggcacctgggaatcatttgaatt

SEQ ID NO: 422372 - DNA, 25 bp, Mus musculus
ccggcactgatactccttaacagaa

SEQ ID NO: 422373 - DNA, 25 bp, Mus musculus
ccggcagcaaggcttactgatagca

SEQ ID NO: 422374 - DNA, 25 bp, Mus musculus
ccggcagggttctgccaaggcgcca

SEQ ID NO: 422375 - DNA, 25 bp, Mus musculus
ccggcatcccagacaactctaaaat

SEQ ID NO: 422376 - DNA, 25 bp, Mus musculus
ccggcatcgttctcctgttgttcct

SEQ ID NO: 422377 - DNA, 25 bp, Mus musculus
ccggcatttggaggtacttgaacaa

SEQ ID NO: 422378 - DNA, 25 bp, Mus musculus
ccggccagcctttgggtgagatttt

SEQ ID NO: 422379 - DNA, 25 bp, Mus musculus
ccggccgcaggtgctgtactatgca

SEQ ID NO: 422380 - DNA, 25 bp, Mus musculus
ccggccggttgctatcggccgtgct

SEQ ID NO: 422381 - DNA, 25 bp, Mus musculus
ccggccgtttgtgttgcttcagaca

SEQ ID NO: 422382 - DNA, 25 bp, Mus musculus
ccggcctcttccagcaggtgggcgt

SEQ ID NO: 422383 - DNA, 25 bp, Mus musculus
ccggcctgcctttgactcattgctg

SEQ ID NO: 422384 - DNA, 25 bp, Mus musculus
ccggccttgagccaatggagctgct

SEQ ID NO: 422385 - DNA, 25 bp, Mus musculus
ccggcgacaaggaagacagtaggac

SEQ ID NO: 422386 - DNA, 25 bp, Mus musculus
ccggcgactggaagtcccgagagtt

SEQ ID NO: 422387 - DNA, 25 bp, Mus musculus
ccggcgactggccagggaggaccct

SEQ ID NO: 422388 - DNA, 25 bp, Mus musculus
ccggcgagactcacaagctggtggt

SEQ ID NO: 422389 - DNA, 25 bp, Mus musculus
ccggcgcatcgggaacaacttcatg

SEQ ID NO: 422390 - DNA, 25 bp, Mus musculus
ccggcgcgttctcaccaatgtcaat

SEQ ID NO: 422391 - DNA, 25 bp, Mus musculus
ccggcggcggcttcaagtctgagat

SEQ ID NO: 422392 - DNA, 25 bp, Mus musculus
ccggcggcgtcagcaagaagttcgt

SEQ ID NO: 422393 - DNA, 25 bp, Mus musculus
ccggctaagtcgttcaggctgttac

SEQ ID NO: 422394 - DNA, 25 bp, Mus musculus
ccggctagcaaagatcgaaggtcta

SEQ ID NO: 422395 - DNA, 25 bp, Mus musculus
ccggctcagcggagacagaaagtgc

SEQ ID NO: 422396 - DNA, 25 bp, Mus musculus
ccggctctgagaaggacgagtcaca

SEQ ID NO: 422397 - DNA, 25 bp, Mus musculus
ccggctctggcttaacggtgtgcag

SEQ ID NO: 422398 - DNA, 25 bp, Mus musculus
ccggctgcccaacgagaaggagatt

SEQ ID NO: 422399 - DNA, 25 bp, Mus musculus
ccggctgctgagacgcatcgcagag

SEQ ID NO: 422400 - DNA, 25 bp, Mus musculus
ccggctgctggaaaataagattggt

SEQ ID NO: 422401 - DNA, 25 bp, Mus musculus
ccggctgctgggaatctgggctttc

SEQ ID NO: 422402 - DNA, 25 bp, Mus musculus
ccggctggagagacacgatgtgacc

SEQ ID NO: 422403 - DNA, 25 bp, Mus musculus
ccggctggagttgggcgttttctct

SEQ ID NO: 422404 - DNA, 25 bp, Mus musculus
ccggctgtaccaacgtgtgctatga

SEQ ID NO: 422405 - DNA, 25 bp, Mus musculus
ccggctgtgtcccagatctgcaaga

SEQ ID NO: 422406 - DNA, 25 bp, Mus musculus
ccgggaaacaagcaggaaagtcaca

SEQ ID NO: 422407 - DNA, 25 bp, Mus musculus
ccgggaaccacttctgggctgctaa

SEQ ID NO: 422408 - DNA, 25 bp, Mus musculus
ccgggaaccgaatgtttgcgtgtga

SEQ ID NO: 422409 - DNA, 25 bp, Mus musculus
ccgggaactggaaagactgtgacta

SEQ ID NO: 422410 - DNA, 25 bp, Mus musculus
ccgggaagcctggatcgtacctgat

SEQ ID NO: 422411 - DNA, 25 bp, Mus musculus
ccgggaaggagctgctaaaaggatc

SEQ ID NO: 422412 - DNA, 25 bp, Mus musculus
ccgggactcggactatgacatggac

SEQ ID NO: 422413 - DNA, 25 bp, Mus musculus
ccgggactgcctcttgctgctatct

SEQ ID NO: 422414 - DNA, 25 bp, Mus musculus
ccgggacttgtgctctctggaacca

SEQ ID NO: 422415 - DNA, 25 bp, Mus musculus
ccgggagactcaatcaaggcattaa

SEQ ID NO: 422416 - DNA, 25 bp, Mus musculus
ccgggagctagcttgtcggatcgcc

SEQ ID NO: 422417 - DNA, 25 bp, Mus musculus
ccgggaggttctgatctcagaggct

SEQ ID NO: 422418 - DNA, 25 bp, Mus musculus
ccgggatatcggtgccatagctcaa

SEQ ID NO: 422419 - DNA, 25 bp, Mus musculus
ccgggatcttgggtgactagcagca

SEQ ID NO: 422420 - DNA, 25 bp, Mus musculus
ccgggatgaaaaactggaccagctt

SEQ ID NO: 422421 - DNA, 25 bp, Mus musculus
ccgggatggcagagtcagacctcat

SEQ ID NO: 422422 - DNA, 25 bp, Mus musculus
ccgggatgttattgccctgccacca

SEQ ID NO: 422423 - DNA, 25 bp, Mus musculus
ccgggcagagcaccagaaagagctt

SEQ ID NO: 422424 - DNA, 25 bp, Mus musculus
ccgggcagcatatcctcctaagaag

SEQ ID NO: 422425 - DNA, 25 bp, Mus musculus
ccgggcagcgccaatgaaagctttt

SEQ ID NO: 422426 - DNA, 25 bp, Mus musculus
ccgggccagcaaaatgcggagcagc

SEQ ID NO: 422427 - DNA, 25 bp, Mus musculus
ccgggccatatagtccaagtgtcca

SEQ ID NO: 422428 - DNA, 25 bp, Mus musculus
ccgggccatgatagaggagtttgac

SEQ ID NO: 422429 - DNA, 25 bp, Mus musculus
ccgggccgtgcccaatgaagataga

SEQ ID NO: 422430 - DNA, 25 bp, Mus musculus
ccgggctcgctttggagaccgaata

SEQ ID NO: 422431 - DNA, 25 bp, Mus musculus
ccgggctctggaatcttgctcgaca

SEQ ID NO: 422432 - DNA, 25 bp, Mus musculus
ccgggctgcagctgcgactaaatcc

SEQ ID NO: 422433 - DNA, 25 bp, Mus musculus
ccgggctgtgaagcgggcaatttca

SEQ ID NO: 422434 - DNA, 25 bp, Mus musculus
ccgggtaggccatgacctgaaggat

SEQ ID NO: 422435 - DNA, 25 bp, Mus musculus
ccgggtccatgcacttcagagggag

SEQ ID NO: 422436 - DNA, 25 bp, Mus musculus
ccgggtgccccgagattcctgagcg

SEQ ID NO: 422437 - DNA, 25 bp, Mus musculus
ccgggtgctgtatggaaaacctaag

SEQ ID NO: 422438 - DNA, 25 bp, Mus musculus
ccgggtgtaagcatgcacatggtac

SEQ ID NO: 422439 - DNA, 25 bp, Mus musculus
ccgggtgtcagtattccaggagtga

SEQ ID NO: 422440 - DNA, 25 bp, Mus musculus
ccgggttctgaaggactgagtgact

SEQ ID NO: 422441 - DNA, 25 bp, Mus musculus
ccgggttggtgtactgctcagagca

SEQ ID NO: 422442 - DNA, 25 bp, Mus musculus
ccgggtttcgggacttgatgcaatc

SEQ ID NO: 422443 - DNA, 25 bp, Mus musculus
ccgggtttgaccgtgctgcaagcag

SEQ ID NO: 422444 - DNA, 25 bp, Mus musculus
ccggtactgaacgtggcaaagaact

SEQ ID NO: 422445 - DNA, 25 bp, Mus musculus
ccggtagtacggcaacagatatgga

SEQ ID NO: 422446 - DNA, 25 bp, Mus musculus
ccggtagtgacagcttcaggagacc

SEQ ID NO: 422447 - DNA, 25 bp, Mus musculus
ccggtcattacttgtttgaaaagcg

SEQ ID NO: 422448 - DNA, 25 bp, Mus musculus
ccggtcctatgaggcagtggcagct

SEQ ID NO: 422449 - DNA, 25 bp, Mus musculus
ccggtctacaccagcaacagtggga

SEQ ID NO: 422450 - DNA, 25 bp, Mus musculus
ccggtctcaagtgtcatggctgcct

SEQ ID NO: 422451 - DNA, 25 bp, Mus musculus
ccggtgactcacaaacgcccatttt

SEQ ID NO: 422452 - DNA, 25 bp, Mus musculus
ccggtggcaccggaagaatgctatg

SEQ ID NO: 422453 - DNA, 25 bp, Mus musculus
ccggtggcgatctttgggagaccaa

SEQ ID NO: 422454 - DNA, 25 bp, Mus musculus
ccggtgggcagatcgagctacgttc

SEQ ID NO: 422455 - DNA, 25 bp, Mus musculus
ccggtgggtccagagccgtctgtct

SEQ ID NO: 422456 - DNA, 25 bp, Mus musculus
ccggtggtgttcatcagcttgctgc

SEQ ID NO: 422457 - DNA, 25 bp, Mus musculus
ccggtgtctacacgagggtctcaca

SEQ ID NO: 422458 - DNA, 25 bp, Mus musculus
ccggttacaggcgaatggcacactt

SEQ ID NO: 422459 - DNA, 25 bp, Mus musculus
ccggttcggagagccggatagtata

SEQ ID NO: 422460 - DNA, 25 bp, Mus musculus
ccggttgctcggaagcttcagtcga

SEQ ID NO: 422461 - DNA, 25 bp, Mus musculus
ccggttggaacttttgcagtgttgg

SEQ ID NO: 422462 - DNA, 25 bp, Mus musculus
ccggttgtagtgagaaagattgaac

SEQ ID NO: 422463 - DNA, 25 bp, Mus musculus
ccggttgtcagtctccggacgcgca

SEQ ID NO: 422464 - DNA, 25 bp, Mus musculus
ccggtttatgtggagcacaggaagt

SEQ ID NO: 422465 - DNA, 25 bp, Mus musculus
ccggttttcgctagagggcgcatca

SEQ ID NO: 422466 - DNA, 25 bp, Mus musculus
ccgtaacagctgtaaccccgagtgg

SEQ ID NO: 422467 - DNA, 25 bp, Mus musculus
ccgtaacatggtggtcaaggcctgt

SEQ ID NO: 422468 - DNA, 25 bp, Mus musculus
ccgtaactgcactgaagaaggctgg

SEQ ID NO: 422469 - DNA, 25 bp, Mus musculus
ccgtaattcctatgtagctggccag

SEQ ID NO: 422470 - DNA, 25 bp, Mus musculus
ccgtactgcggagtctggaaagtta

SEQ ID NO: 422471 - DNA, 25 bp, Mus musculus
ccgtagatggagaccattgcagaaa

SEQ ID NO: 422472 - DNA, 25 bp, Mus musculus
ccgtagcatgcacattgaatccgca

SEQ ID NO: 422473 - DNA, 25 bp, Mus musculus
ccgtagccgtattgacccatggagc

SEQ ID NO: 422474 - DNA, 25 bp, Mus musculus
ccgtagtcccggtgcagaagagtga

SEQ ID NO: 422475 - DNA, 25 bp, Mus musculus
ccgtagtgtcgggacaacgctgact

SEQ ID NO: 422476 - DNA, 25 bp, Mus musculus
ccgtagttctggttgttgtgcctaa

SEQ ID NO: 422477 - DNA, 25 bp, Mus musculus
ccgtagtttagggtatggagcaagt

SEQ ID NO: 422478 - DNA, 25 bp, Mus musculus
ccgtatttctgtgcccagcagtgtg

SEQ ID NO: 422479 - DNA, 25 bp, Mus musculus
ccgtcaagtccactgtgcaggaaga

SEQ ID NO: 422480 - DNA, 25 bp, Mus musculus
ccgtcagaggctggcagatgtagct

SEQ ID NO: 422481 - DNA, 25 bp, Mus musculus
ccgtcagcgtcaaagggatggtcca

SEQ ID NO: 422482 - DNA, 25 bp, Mus musculus
ccgtcagggctcgttcttgtagtgg

SEQ ID NO: 422483 - DNA, 25 bp, Mus musculus
ccgtccagggcgaagaagttgctct

SEQ ID NO: 422484 - DNA, 25 bp, Mus musculus
ccgtccgcagtgaattccaaggctg

SEQ ID NO: 422485 - DNA, 25 bp, Mus musculus
ccgtcgaagtgctggagaagtctct

SEQ ID NO: 422486 - DNA, 25 bp, Mus musculus
ccgtcgagtcgggagtcaacatgct

SEQ ID NO: 422487 - DNA, 25 bp, Mus musculus
ccgtcggttgctttgagagtggtca

SEQ ID NO: 422488 - DNA, 25 bp, Mus musculus
ccgtctatagaggaagtcaccacag

SEQ ID NO: 422489 - DNA, 25 bp, Mus musculus
ccgtctcagtcggaacaggcagtga

SEQ ID NO: 422490 - DNA, 25 bp, Mus musculus
ccgtctcatttgaactggtttatca

SEQ ID NO: 422491 - DNA, 25 bp, Mus musculus
ccgtctcctctctttgcaggcgagg

SEQ ID NO: 422492 - DNA, 25 bp, Mus musculus
ccgtctcctggacctggatcctgag

SEQ ID NO: 422493 - DNA, 25 bp, Mus musculus
ccgtctctggaactgagctggtaga

SEQ ID NO: 422494 - DNA, 25 bp, Mus musculus
ccgtctgatgacatgggaagcctgc

SEQ ID NO: 422495 - DNA, 25 bp, Mus musculus
ccgtctgggaggacaggcacaagta

SEQ ID NO: 422496 - DNA, 25 bp, Mus musculus
ccgtctggtggacatctcggcctca

SEQ ID NO: 422497 - DNA, 25 bp, Mus musculus
ccgtcttaaggagcgtgagtgagcc

SEQ ID NO: 422498 - DNA, 25 bp, Mus musculus
ccgtcttcacaagcggaagtgggcg

SEQ ID NO: 422499 - DNA, 25 bp, Mus musculus
ccgtcttttctccaaggcataccaa

SEQ ID NO: 422500 - DNA, 25 bp, Mus musculus
ccgtgaacaagcagggtgacagcat

SEQ ID NO: 422501 - DNA, 25 bp, Mus musculus
ccgtgaacaagggaaacagagcgtt

SEQ ID NO: 422502 - DNA, 25 bp, Mus musculus
ccgtgaacaccatgaagaactcgct

SEQ ID NO: 422503 - DNA, 25 bp, Mus musculus
ccgtgaactgaatgtagggaacctg

SEQ ID NO: 422504 - DNA, 25 bp, Mus musculus
ccgtgaacttatagggctggagtta

SEQ ID NO: 422505 - DNA, 25 bp, Mus musculus
ccgtgaatggatgtctactgagcca

SEQ ID NO: 422506 - DNA, 25 bp, Mus musculus
ccgtgaatgtgctgtccggtgacaa

SEQ ID NO: 422507 - DNA, 25 bp, Mus musculus
ccgtgacataaaataagactaaata

SEQ ID NO: 422508 - DNA, 25 bp, Mus musculus
ccgtgaccgacagtgaccagggatt

SEQ ID NO: 422509 - DNA, 25 bp, Mus musculus
ccgtgagactgagactggatgcaga

SEQ ID NO: 422510 - DNA, 25 bp, Mus musculus
ccgtgagagcggatcctttaagaac

SEQ ID NO: 422511 - DNA, 25 bp, Mus musculus
ccgtgaggcgttgccgtcagtcagc

SEQ ID NO: 422512 - DNA, 25 bp, Mus musculus
ccgtgagggccgaattgagactgtc

SEQ ID NO: 422513 - DNA, 25 bp, Mus musculus
ccgtgatgaacttcctgggcccaaa

SEQ ID NO: 422514 - DNA, 25 bp, Mus musculus
ccgtgatgacggacaaagactgcca

SEQ ID NO: 422515 - DNA, 25 bp, Mus musculus
ccgtgatgcttatgagattcgccta

SEQ ID NO: 422516 - DNA, 25 bp, Mus musculus
ccgtgatggaatggaccatgacatc

SEQ ID NO: 422517 - DNA, 25 bp, Mus musculus
ccgtgcaagtgttctcaaggtccga

SEQ ID NO: 422518 - DNA, 25 bp, Mus musculus
ccgtgccggaccagggatcgtgcaa

SEQ ID NO: 422519 - DNA, 25 bp, Mus musculus
ccgtgctgaacgagctggtgtctgt

SEQ ID NO: 422520 - DNA, 25 bp, Mus musculus
ccgtggagaacaacagcctgaacat

SEQ ID NO: 422521 - DNA, 25 bp, Mus musculus
ccgtggagcacgacaagttcattga

SEQ ID NO: 422522 - DNA, 25 bp, Mus musculus
ccgtggaggccatccgagagctgaa

SEQ ID NO: 422523 - DNA, 25 bp, Mus musculus
ccgtggagtgcttcggctgaaagcc

SEQ ID NO: 422524 - DNA, 25 bp, Mus musculus
ccgtggcaccacagctatgtagtag

SEQ ID NO: 422525 - DNA, 25 bp, Mus musculus
ccgtggcagcaccatcaagtacctg

SEQ ID NO: 422526 - DNA, 25 bp, Mus musculus
ccgtggcattggctattacctggaa

SEQ ID NO: 422527 - DNA, 25 bp, Mus musculus
ccgtggcggcccaggatgagttcta

SEQ ID NO: 422528 - DNA, 25 bp, Mus musculus
ccgtgggcactggagacaattgtct

SEQ ID NO: 422529 - DNA, 25 bp, Mus musculus
ccgtgggtcctagaagccaagtctc

SEQ ID NO: 422530 - DNA, 25 bp, Mus musculus
ccgtggtcatgaggctggtgctccc

SEQ ID NO: 422531 - DNA, 25 bp, Mus musculus
ccgtggtgcaagtggttcagcccaa

SEQ ID NO: 422532 - DNA, 25 bp, Mus musculus
ccgtggttacacatcaggcagcttt

SEQ ID NO: 422533 - DNA, 25 bp, Mus musculus
ccgtggttcccagagtttgagagca

SEQ ID NO: 422534 - DNA, 25 bp, Mus musculus
ccgtgtccatattcgagtatctgta

SEQ ID NO: 422535 - DNA, 25 bp, Mus musculus
ccgtgtcgaagcgagagtccaagtc

SEQ ID NO: 422536 - DNA, 25 bp, Mus musculus
ccgtgtcgcaatctacaaagcctca

SEQ ID NO: 422537 - DNA, 25 bp, Mus musculus
ccgtgtcggccagcagagatgtgca

SEQ ID NO: 422538 - DNA, 25 bp, Mus musculus
ccgtgtcttcttcacaggcgttggc

SEQ ID NO: 422539 - DNA, 25 bp, Mus musculus
ccgtgtgctgcagaaactcgttgag

SEQ ID NO: 422540 - DNA, 25 bp, Mus musculus
ccgtgtgtgcgcagcctttgctttg

SEQ ID NO: 422541 - DNA, 25 bp, Mus musculus
ccgtgtgttgtctccatcgctatga

SEQ ID NO: 422542 - DNA, 25 bp, Mus musculus
ccgtgtttccatgaagtgtaattac

SEQ ID NO: 422543 - DNA, 25 bp, Mus musculus
ccgttaagaactgagagtgagggtt

SEQ ID NO: 422544 - DNA, 25 bp, Mus musculus
ccgttaggttcatgtgtgttctgga

SEQ ID NO: 422545 - DNA, 25 bp, Mus musculus
ccgttatgatggatgtttacatgtc

SEQ ID NO: 422546 - DNA, 25 bp, Mus musculus
ccgttcaagcaaacaggatctggca

SEQ ID NO: 422547 - DNA, 25 bp, Mus musculus
ccgttcagattcagtccggagccca

SEQ ID NO: 422548 - DNA, 25 bp, Mus musculus
ccgttcaggtgcttcgggactggat

SEQ ID NO: 422549 - DNA, 25 bp, Mus musculus
ccgttcagtgcacacagggcttggc

SEQ ID NO: 422550 - DNA, 25 bp, Mus musculus
ccgttcatgccacgtgacctagcaa

SEQ ID NO: 422551 - DNA, 25 bp, Mus musculus
ccgttctccataccccaaattctag

SEQ ID NO: 422552 - DNA, 25 bp, Mus musculus
ccgttgcatcagtgccatgggacat

SEQ ID NO: 422553 - DNA, 25 bp, Mus musculus
ccgttggtagtacaaggccacttga

SEQ ID NO: 422554 - DNA, 25 bp, Mus musculus
ccgttgtgttttcctcccagatgca

SEQ ID NO: 422555 - DNA, 25 bp, Mus musculus
ccgttgttcttgatcttcgtgctgg

SEQ ID NO: 422556 - DNA, 25 bp, Mus musculus
ccgttgttgagaataccatgattga

SEQ ID NO: 422557 - DNA, 25 bp, Mus musculus
ccgttgttggctggaattttgtcca

SEQ ID NO: 422558 - DNA, 25 bp, Mus musculus
ccgtttagagtcagctggcacagca

SEQ ID NO: 422559 - DNA, 25 bp, Mus musculus
ccgtttagcgtgatgtgcaagttcc

SEQ ID NO: 422560 - DNA, 25 bp, Mus musculus
ccgtttctgtgaacatgggctgtcc

SEQ ID NO: 422561 - DNA, 25 bp, Mus musculus
ccgtttgagcacgatgaagagatca

SEQ ID NO: 422562 - DNA, 25 bp, Mus musculus
ccgtttgtcctcacagaagtaatgc

SEQ ID NO: 422563 - DNA, 25 bp, Mus musculus
ccgttttcagaagggagccatgtcc

SEQ ID NO: 422564 - DNA, 25 bp, Mus musculus
ccgttttcccgtgtgttagccatgg

SEQ ID NO: 422565 - DNA, 25 bp, Mus musculus
cctaaaaggcaaccagctctgggag

SEQ ID NO: 422566 - DNA, 25 bp, Mus musculus
cctaaaccacagtaactccctgagt

SEQ ID NO: 422567 - DNA, 25 bp, Mus musculus
cctaaacctgaaagggtgccactgt

SEQ ID NO: 422568 - DNA, 25 bp, Mus musculus
cctaaacttgaaccatcagatgcat

SEQ ID NO: 422569 - DNA, 25 bp, Mus musculus
cctaaagacggcagaaggaaagtgc

SEQ ID NO: 422570 - DNA, 25 bp, Mus musculus
cctaaaggactggagggcttagcca

SEQ ID NO: 422571 - DNA, 25 bp, Mus musculus
cctaaaggctatcggtggatgtcaa

SEQ ID NO: 422572 - DNA, 25 bp, Mus musculus
cctaaagtggaatgtgacacgtgac

SEQ ID NO: 422573 - DNA, 25 bp, Mus musculus
cctaaagtgtgtgagaatgctgccc

SEQ ID NO: 422574 - DNA, 25 bp, Mus musculus
cctaaataatacatgtctgaaacac

SEQ ID NO: 422575 - DNA, 25 bp, Mus musculus
cctaaataatgagcctacgcgggaa

SEQ ID NO: 422576 - DNA, 25 bp, Mus musculus
cctaaatgagaagctcgagggtgag

SEQ ID NO: 422577 - DNA, 25 bp, Mus musculus
cctaaatgtggttcaggattcaagc

SEQ ID NO: 422578 - DNA, 25 bp, Mus musculus
cctaaccctgtggaaatggactgga

SEQ ID NO: 422579 - DNA, 25 bp, Mus musculus
cctaaccgaggaagcagagctgcct

SEQ ID NO: 422580 - DNA, 25 bp, Mus musculus
cctaacgggctgagctttgtgtctg

SEQ ID NO: 422581 - DNA, 25 bp, Mus musculus
cctaacgtgcagaggaagatccatg

SEQ ID NO: 422582 - DNA, 25 bp, Mus musculus
cctaactaagacacaaggttgtata

SEQ ID NO: 422583 - DNA, 25 bp, Mus musculus
cctaactctagatgcaccttggtgt

SEQ ID NO: 422584 - DNA, 25 bp, Mus musculus
cctaactgagttgatgaaccccagg

SEQ ID NO: 422585 - DNA, 25 bp, Mus musculus
cctaagaaatttttgatttgtcact

SEQ ID NO: 422586 - DNA, 25 bp, Mus musculus
cctaagaacatctataatggcccga

SEQ ID NO: 422587 - DNA, 25 bp, Mus musculus
cctaagaactgaaagggaccctgat

SEQ ID NO: 422588 - DNA, 25 bp, Mus musculus
cctaagacaggtagggctcagagga

SEQ ID NO: 422589 - DNA, 25 bp, Mus musculus
cctaagagagcaacacctatgggtg

SEQ ID NO: 422590 - DNA, 25 bp, Mus musculus
cctaagaggaggctcctgtagctga

SEQ ID NO: 422591 - DNA, 25 bp, Mus musculus
cctaagaggtgctgagttctggaca

SEQ ID NO: 422592 - DNA, 25 bp, Mus musculus
cctaagagtacccagcttgtcagca

SEQ ID NO: 422593 - DNA, 25 bp, Mus musculus
cctaagataaagaagaaccagagcg

SEQ ID NO: 422594 - DNA, 25 bp, Mus musculus
cctaagatttagcaccggaggctcc

SEQ ID NO: 422595 - DNA, 25 bp, Mus musculus
cctaagcatggcactgcacatgatt

SEQ ID NO: 422596 - DNA, 25 bp, Mus musculus
cctaagcctcggaaaagcatggtga

SEQ ID NO: 422597 - DNA, 25 bp, Mus musculus
cctaagcgactgtgtgggtcaaatc

SEQ ID NO: 422598 - DNA, 25 bp, Mus musculus
cctaagctggtcttggtggcacgca

SEQ ID NO: 422599 - DNA, 25 bp, Mus musculus
cctaagctgttttgggcactggtcg

SEQ ID NO: 422600 - DNA, 25 bp, Mus musculus
cctaagcttgtttgtgtatgtaatt

SEQ ID NO: 422601 - DNA, 25 bp, Mus musculus
cctaaggaagctaagagtggacccg

SEQ ID NO: 422602 - DNA, 25 bp, Mus musculus
cctaaggaatgaagaacaggtggcc

SEQ ID NO: 422603 - DNA, 25 bp, Mus musculus
cctaaggatggctacactggagaaa

SEQ ID NO: 422604 - DNA, 25 bp, Mus musculus
cctaaggcgcagaaggcacgggctt

SEQ ID NO: 422605 - DNA, 25 bp, Mus musculus
cctaaggctatcagaggcgttgtcc

SEQ ID NO: 422606 - DNA, 25 bp, Mus musculus
cctaaggctggtgaaggcaggccct

SEQ ID NO: 422607 - DNA, 25 bp, Mus musculus
cctaaggcttaagcaaagaagggca

SEQ ID NO: 422608 - DNA, 25 bp, Mus musculus
cctaaggtcagtagctgctctctgc

SEQ ID NO: 422609 - DNA, 25 bp, Mus musculus
cctaagtcaggaatcagcgtggtca

SEQ ID NO: 422610 - DNA, 25 bp, Mus musculus
cctaagtctgtgtgaactggatacc

SEQ ID NO: 422611 - DNA, 25 bp, Mus musculus
cctaagtgtgaacatgagtcgctga

SEQ ID NO: 422612 - DNA, 25 bp, Mus musculus
cctaagttagatctctgggacccac

SEQ ID NO: 422613 - DNA, 25 bp, Mus musculus
cctaagttctgatcttggttccaag

SEQ ID NO: 422614 - DNA, 25 bp, Mus musculus
cctaatagctgctgtgtatataaca

SEQ ID NO: 422615 - DNA, 25 bp, Mus musculus
cctaatcacagacgagaggctgcag

SEQ ID NO: 422616 - DNA, 25 bp, Mus musculus
cctaatcatggagttcctgcctgga

SEQ ID NO: 422617 - DNA, 25 bp, Mus musculus
cctaatctgaaggaaatgtaccatc

SEQ ID NO: 422618 - DNA, 25 bp, Mus musculus
cctaatggcctgaactctggtcaga

SEQ ID NO: 422619 - DNA, 25 bp, Mus musculus
cctaatggccttggagaaacgcgtg

SEQ ID NO: 422620 - DNA, 25 bp, Mus musculus
cctaatgtgaatatgcgctgccaaa

SEQ ID NO: 422621 - DNA, 25 bp, Mus musculus
cctaatgtgctaggccatgctggcc

SEQ ID NO: 422622 - DNA, 25 bp, Mus musculus
cctaatgttagagaggtgtgttgct

SEQ ID NO: 422623 - DNA, 25 bp, Mus musculus
cctaatttgggctttttgagatatg

SEQ ID NO: 422624 - DNA, 25 bp, Mus musculus
cctacaacatggtggtgagtagcct

SEQ ID NO: 422625 - DNA, 25 bp, Mus musculus
cctacaaggagttattcatgatgtc

SEQ ID NO: 422626 - DNA, 25 bp, Mus musculus
cctacaaggcgtatgagcagaagcc

SEQ ID NO: 422627 - DNA, 25 bp, Mus musculus
cctacaagggtactcacaagcactg

SEQ ID NO: 422628 - DNA, 25 bp, Mus musculus
cctacaagttagaccaggatgggca

SEQ ID NO: 422629 - DNA, 25 bp, Mus musculus
cctacacagaggatagaaggccgca

SEQ ID NO: 422630 - DNA, 25 bp, Mus musculus
cctacaccaggaatgagcaggctca

SEQ ID NO: 422631 - DNA, 25 bp, Mus musculus
cctacacgatatggagactgggaac

SEQ ID NO: 422632 - DNA, 25 bp, Mus musculus
cctacactgagacaaggtgggcctt

SEQ ID NO: 422633 - DNA, 25 bp, Mus musculus
cctacactgggatgggaacacatca

SEQ ID NO: 422634 - DNA, 25 bp, Mus musculus
cctacactgggtgtggctgtaaacc

SEQ ID NO: 422635 - DNA, 25 bp, Mus musculus
cctacagaaaggaacgagtcagact

SEQ ID NO: 422636 - DNA, 25 bp, Mus musculus
cctacagaccggatgaagcagattg

SEQ ID NO: 422637 - DNA, 25 bp, Mus musculus
cctacagcaggcgtcattgaaactc

SEQ ID NO: 422638 - DNA, 25 bp, Mus musculus
cctacagcagtactattaaagatta

SEQ ID NO: 422639 - DNA, 25 bp, Mus musculus
cctacaggatgaccgtgattcttct

SEQ ID NO: 422640 - DNA, 25 bp, Mus musculus
cctacaggccagtctaatagaggaa

SEQ ID NO: 422641 - DNA, 25 bp, Mus musculus
cctacagtgctgctgaggatgcgct

SEQ ID NO: 422642 - DNA, 25 bp, Mus musculus
cctacagtggatagaagacactctg

SEQ ID NO: 422643 - DNA, 25 bp, Mus musculus
cctacagtggatgcgaagctgcgat

SEQ ID NO: 422644 - DNA, 25 bp, Mus musculus
cctacagtgtggttgtcaggcaccc

SEQ ID NO: 422645 - DNA, 25 bp, Mus musculus
cctacatggatggttggcggctcag

SEQ ID NO: 422646 - DNA, 25 bp, Mus musculus
cctacatggtacgagagaactaact

SEQ ID NO: 422647 - DNA, 25 bp, Mus musculus
cctacattgtctggactgccaatca

SEQ ID NO: 422648 - DNA, 25 bp, Mus musculus
cctacattttgttttaagcccactg

SEQ ID NO: 422649 - DNA, 25 bp, Mus musculus
cctaccaagggatgtgggcattctc

SEQ ID NO: 422650 - DNA, 25 bp, Mus musculus
cctaccaatgtgatgtgctctgtgc

SEQ ID NO: 422651 - DNA, 25 bp, Mus musculus
cctaccactgggagaattagataat

SEQ ID NO: 422652 - DNA, 25 bp, Mus musculus
cctaccgcctagaggtcagtcttct

SEQ ID NO: 422653 - DNA, 25 bp, Mus musculus
cctaccggatcctggcagaaacttc

SEQ ID NO: 422654 - DNA, 25 bp, Mus musculus
cctaccgtactggtctgaagagaca

SEQ ID NO: 422655 - DNA, 25 bp, Mus musculus
cctacctagagggaaggcgttgctc

SEQ ID NO: 422656 - DNA, 25 bp, Mus musculus
cctacctaggtggatgggtgaatgc

SEQ ID NO: 422657 - DNA, 25 bp, Mus musculus
cctacctctgcaagaggttcctggg

SEQ ID NO: 422658 - DNA, 25 bp, Mus musculus
cctacctgaaggataaagagccgag

SEQ ID NO: 422659 - DNA, 25 bp, Mus musculus
cctacctggaggtcgcatgaggctc

SEQ ID NO: 422660 - DNA, 25 bp, Mus musculus
cctacctgtggagtgtttaatgttc

SEQ ID NO: 422661 - DNA, 25 bp, Mus musculus
cctacgacgatacggctatgactca

SEQ ID NO: 422662 - DNA, 25 bp, Mus musculus
cctacgagtggttcggagacttcgc

SEQ ID NO: 422663 - DNA, 25 bp, Mus musculus
cctacgctatgccaagatgaagaca

SEQ ID NO: 422664 - DNA, 25 bp, Mus musculus
cctacggagtaggtgtgctgaaccg

SEQ ID NO: 422665 - DNA, 25 bp, Mus musculus
cctacgtgctgtggacttcgcggag

SEQ ID NO: 422666 - DNA, 25 bp, Mus musculus
cctacgtggtctacgagaacatgaa

SEQ ID NO: 422667 - DNA, 25 bp, Mus musculus
cctacgtgtgactgaaggctgggac

SEQ ID NO: 422668 - DNA, 25 bp, Mus musculus
cctacgtgtggatctggctgggact

SEQ ID NO: 422669 - DNA, 25 bp, Mus musculus
cctacgtgtgtctttctgtgcccca

SEQ ID NO: 422670 - DNA, 25 bp, Mus musculus
cctactactgatgaccaacttgtta

SEQ ID NO: 422671 - DNA, 25 bp, Mus musculus
cctactatactcatgaagaggaggt

SEQ ID NO: 422672 - DNA, 25 bp, Mus musculus
cctactatatgcacctggaacggga

SEQ ID NO: 422673 - DNA, 25 bp, Mus musculus
cctactcaggcaagaacattggact

SEQ ID NO: 422674 - DNA, 25 bp, Mus musculus
cctactctaacgtggcagacatcct

SEQ ID NO: 422675 - DNA, 25 bp, Mus musculus
cctactctacagaggcaagctcttg

SEQ ID NO: 422676 - DNA, 25 bp, Mus musculus
cctactctcaggcagcgctatggtt

SEQ ID NO: 422677 - DNA, 25 bp, Mus musculus
cctactgctcatcagggaggttgac

SEQ ID NO: 422678 - DNA, 25 bp, Mus musculus
cctactgctgcgacaactgtgggaa

SEQ ID NO: 422679 - DNA, 25 bp, Mus musculus
cctactggactactgctggtgagaa

SEQ ID NO: 422680 - DNA, 25 bp, Mus musculus
cctactggtgtcaggaggcttggat

SEQ ID NO: 422681 - DNA, 25 bp, Mus musculus
cctactgtaagaacgcggcaaggca

SEQ ID NO: 422682 - DNA, 25 bp, Mus musculus
cctacttccatatctcagtgatgac

SEQ ID NO: 422683 - DNA, 25 bp, Mus musculus
cctacttctctgactggttccagca

SEQ ID NO: 422684 - DNA, 25 bp, Mus musculus
cctacttgatggacgtgctggccaa

SEQ ID NO: 422685 - DNA, 25 bp, Mus musculus
cctacttgcaagagcgaccctggat

SEQ ID NO: 422686 - DNA, 25 bp, Mus musculus
cctacttttgtgattattgggtcct

SEQ ID NO: 422687 - DNA, 25 bp, Mus musculus
cctagaaatggtatggtcttttaag

SEQ ID NO: 422688 - DNA, 25 bp, Mus musculus
cctagaagagagtagctgtgtgaac

SEQ ID NO: 422689 - DNA, 25 bp, Mus musculus
cctagaagatgcagacgcggacgat

SEQ ID NO: 422690 - DNA, 25 bp, Mus musculus
cctagaagccaagtctcctgtggta

SEQ ID NO: 422691 - DNA, 25 bp, Mus musculus
cctagaaggtagtgatgacaaagct

SEQ ID NO: 422692 - DNA, 25 bp, Mus musculus
cctagaagtagagttggctgccaaa

SEQ ID NO: 422693 - DNA, 25 bp, Mus musculus
cctagaagttcgagatggagccagt

SEQ ID NO: 422694 - DNA, 25 bp, Mus musculus
cctagaatggaattgtgagtccagg

SEQ ID NO: 422695 - DNA, 25 bp, Mus musculus
cctagacacagccatgaaacggatg

SEQ ID NO: 422696 - DNA, 25 bp, Mus musculus
cctagaccaagaacaagcatcccag

SEQ ID NO: 422697 - DNA, 25 bp, Mus musculus
cctagaccaagattgactggctggg

SEQ ID NO: 422698 - DNA, 25 bp, Mus musculus
cctagacgagggatggatgatgacc

SEQ ID NO: 422699 - DNA, 25 bp, Mus musculus
cctagactggctaaaaaatgcaata

SEQ ID NO: 422700 - DNA, 25 bp, Mus musculus
cctagactgggcagatctaccttta

SEQ ID NO: 422701 - DNA, 25 bp, Mus musculus
cctagagaagtggatccgtgtggcc

SEQ ID NO: 422702 - DNA, 25 bp, Mus musculus
cctagagagagagttcagcatggcc

SEQ ID NO: 422703 - DNA, 25 bp, Mus musculus
cctagagcacagacgaggagccagg

SEQ ID NO: 422704 - DNA, 25 bp, Mus musculus
cctagagcatggttctccatggtcc

SEQ ID NO: 422705 - DNA, 25 bp, Mus musculus
cctagaggcagacgctgcattgcac

SEQ ID NO: 422706 - DNA, 25 bp, Mus musculus
cctagaggccgaaaggatgcattcc

SEQ ID NO: 422707 - DNA, 25 bp, Mus musculus
cctagaggtggccagcattgaccat

SEQ ID NO: 422708 - DNA, 25 bp, Mus musculus
cctagagtacctccccagagaagaa

SEQ ID NO: 422709 - DNA, 25 bp, Mus musculus
cctagagttatttggatgcacgaga

SEQ ID NO: 422710 - DNA, 25 bp, Mus musculus
cctagagttgcttactgcccctcaa

SEQ ID NO: 422711 - DNA, 25 bp, Mus musculus
cctagataccagcacaagccggtga

SEQ ID NO: 422712 - DNA, 25 bp, Mus musculus
cctagatagggaagaacagaggtct

SEQ ID NO: 422713 - DNA, 25 bp, Mus musculus
cctagatcagtagaggattttactc

SEQ ID NO: 422714 - DNA, 25 bp, Mus musculus
cctagatgctagaggattgaggcag

SEQ ID NO: 422715 - DNA, 25 bp, Mus musculus
cctagattgggaagaaaccggcaga

SEQ ID NO: 422716 - DNA, 25 bp, Mus musculus
cctagcacaggatcagagaaggtcc

SEQ ID NO: 422717 - DNA, 25 bp, Mus musculus
cctagccatcagaagctggtttctt

SEQ ID NO: 422718 - DNA, 25 bp, Mus musculus
cctagcccgggatgagaaattgcaa

SEQ ID NO: 422719 - DNA, 25 bp, Mus musculus
cctagccgagcgcacttggtttcag

SEQ ID NO: 422720 - DNA, 25 bp, Mus musculus
cctagcctgggagcatgatcgtgga

SEQ ID NO: 422721 - DNA, 25 bp, Mus musculus
cctagcgatcgtttttggtccaact

SEQ ID NO: 422722 - DNA, 25 bp, Mus musculus
cctagcgcattgaggatcagtggta

SEQ ID NO: 422723 - DNA, 25 bp, Mus musculus
cctagcgcttgcttgtaggagctgc

SEQ ID NO: 422724 - DNA, 25 bp, Mus musculus
cctagcgtggctctggaaactgact

SEQ ID NO: 422725 - DNA, 25 bp, Mus musculus
cctagcgtgtgtcaggtcttagctt

SEQ ID NO: 422726 - DNA, 25 bp, Mus musculus
cctagctgccgcttttgtgccgcag

SEQ ID NO: 422727 - DNA, 25 bp, Mus musculus
cctagctgcgtaagaggctggaagc

SEQ ID NO: 422728 - DNA, 25 bp, Mus musculus
cctagctggtataacgaaagccgac

SEQ ID NO: 422729 - DNA, 25 bp, Mus musculus
cctagctgtggaagccggattcgac

SEQ ID NO: 422730 - DNA, 25 bp, Mus musculus
cctagcttcaggatcccatggatgc

SEQ ID NO: 422731 - DNA, 25 bp, Mus musculus
cctaggaaccagtggttgtgtcggc

SEQ ID NO: 422732 - DNA, 25 bp, Mus musculus
cctaggaagaactaaagatgaatcc

SEQ ID NO: 422733 - DNA, 25 bp, Mus musculus
cctaggaccggtaattgcgtccgca

SEQ ID NO: 422734 - DNA, 25 bp, Mus musculus
cctaggacttcggacatcggagcgg

SEQ ID NO: 422735 - DNA, 25 bp, Mus musculus
cctaggagagcttaatgggcaaatc

SEQ ID NO: 422736 - DNA, 25 bp, Mus musculus
cctaggcctagctgccgcttttgtg

SEQ ID NO: 422737 - DNA, 25 bp, Mus musculus
cctaggcgactgaagactgcaggag

SEQ ID NO: 422738 - DNA, 25 bp, Mus musculus
cctaggctcagggatgcttgcagtg

SEQ ID NO: 422739 - DNA, 25 bp, Mus musculus
cctaggctgtagagtgaaggtcacc

SEQ ID NO: 422740 - DNA, 25 bp, Mus musculus
cctaggcttggattacacagtgctg

SEQ ID NO: 422741 - DNA, 25 bp, Mus musculus
cctagggccagtagacaagtaccga

SEQ ID NO: 422742 - DNA, 25 bp, Mus musculus
cctagggcctgggacaaaaggactg

SEQ ID NO: 422743 - DNA, 25 bp, Mus musculus
cctagggtctaatcttcttggcaaa

SEQ ID NO: 422744 - DNA, 25 bp, Mus musculus
cctagggtttgtgtctgtctgggac

SEQ ID NO: 422745 - DNA, 25 bp, Mus musculus
cctaggtcctcagggaattcagtgt

SEQ ID NO: 422746 - DNA, 25 bp, Mus musculus
cctaggtctagaggagctgccaaaa

SEQ ID NO: 422747 - DNA, 25 bp, Mus musculus
cctaggtctggctcaatgagatgtg

SEQ ID NO: 422748 - DNA, 25 bp, Mus musculus
cctaggtgcagaagagacagaccga

SEQ ID NO: 422749 - DNA, 25 bp, Mus musculus
cctaggttatcaattggacgggcag

SEQ ID NO: 422750 - DNA, 25 bp, Mus musculus
cctaggtttaaatgctgggacacgt

SEQ ID NO: 422751 - DNA, 25 bp, Mus musculus
cctagtaactggctggcatgcacca

SEQ ID NO: 422752 - DNA, 25 bp, Mus musculus
cctagtactgagataaaacaggcta

SEQ ID NO: 422753 - DNA, 25 bp, Mus musculus
cctagtagcagttaagagggctctc

SEQ ID NO: 422754 - DNA, 25 bp, Mus musculus
cctagtagggacttgagtgcacgtc

SEQ ID NO: 422755 - DNA, 25 bp, Mus musculus
cctagtaggtgagcccgatggacaa

SEQ ID NO: 422756 - DNA, 25 bp, Mus musculus
cctagtataccgcacgaatgtttct

SEQ ID NO: 422757 - DNA, 25 bp, Mus musculus
cctagtattaatagcacagttccag

SEQ ID NO: 422758 - DNA, 25 bp, Mus musculus
cctagtctgcataatctgccgggct

SEQ ID NO: 422759 - DNA, 25 bp, Mus musculus
cctagtgacctgatttcaatcatca

SEQ ID NO: 422760 - DNA, 25 bp, Mus musculus
cctagtgagcaatcagaggaggacc

SEQ ID NO: 422761 - DNA, 25 bp, Mus musculus
cctagtgccctcaggcggtcatgta

SEQ ID NO: 422762 - DNA, 25 bp, Mus musculus
cctagtgctggagccgcaggaatca

SEQ ID NO: 422763 - DNA, 25 bp, Mus musculus
cctagtgcttggtaacaagagctga

SEQ ID NO: 422764 - DNA, 25 bp, Mus musculus
cctagtggccaacctctatgtggtg

SEQ ID NO: 422765 - DNA, 25 bp, Mus musculus
cctagtggcgccgagaagataaact

SEQ ID NO: 422766 - DNA, 25 bp, Mus musculus
cctagtggcttggtaatggaaggac

SEQ ID NO: 422767 - DNA, 25 bp, Mus musculus
cctagtgtggaagccggactttgcc

SEQ ID NO: 422768 - DNA, 25 bp, Mus musculus
cctagttcagaggtgagctgagttc

SEQ ID NO: 422769 - DNA, 25 bp, Mus musculus
cctagtttctgagtggaggcaaatg

SEQ ID NO: 422770 - DNA, 25 bp, Mus musculus
cctataaagagaatcctgggcacat

SEQ ID NO: 422771 - DNA, 25 bp, Mus musculus
cctataagaagtctgaatggccctt

SEQ ID NO: 422772 - DNA, 25 bp, Mus musculus
cctataaggtggacatgactgtgca

SEQ ID NO: 422773 - DNA, 25 bp, Mus musculus
cctataccagctagtggcagaaaaa

SEQ ID NO: 422774 - DNA, 25 bp, Mus musculus
cctatacgatgggagagctcggacg

SEQ ID NO: 422775 - DNA, 25 bp, Mus musculus
cctatacgtgtcaaaccagctggaa

SEQ ID NO: 422776 - DNA, 25 bp, Mus musculus
cctatactggctgtggtgggaatga

SEQ ID NO: 422777 - DNA, 25 bp, Mus musculus
cctataggcctattgggagttggac

SEQ ID NO: 422778 - DNA, 25 bp, Mus musculus
cctatagggctaaatcacagtcgga

SEQ ID NO: 422779 - DNA, 25 bp, Mus musculus
cctatatacagatcaggactcctat

SEQ ID NO: 422780 - DNA, 25 bp, Mus musculus
cctatatgaccgtctggcagaggtg

SEQ ID NO: 422781 - DNA, 25 bp, Mus musculus
cctatatggccatcacaggtgcagt

SEQ ID NO: 422782 - DNA, 25 bp, Mus musculus
cctatattgacgaccacgtgcggag

SEQ ID NO: 422783 - DNA, 25 bp, Mus musculus
cctatccagcagaaagcaagtatct

SEQ ID NO: 422784 - DNA, 25 bp, Mus musculus
cctatccctgcggaggaggtgaaga

SEQ ID NO: 422785 - DNA, 25 bp, Mus musculus
cctatctagaagtggctgcatcaca

SEQ ID NO: 422786 - DNA, 25 bp, Mus musculus
cctatgaaacagcatctttgaaaac

SEQ ID NO: 422787 - DNA, 25 bp, Mus musculus
cctatgaacatctacgggaagtcgt

SEQ ID NO: 422788 - DNA, 25 bp, Mus musculus
cctatgaacctttattcttgggaag

SEQ ID NO: 422789 - DNA, 25 bp, Mus musculus
cctatgaagactgtatggacctgct

SEQ ID NO: 422790 - DNA, 25 bp, Mus musculus
cctatgaatatgagtgggcaccacc

SEQ ID NO: 422791 - DNA, 25 bp, Mus musculus
cctatgaccctttggctgaccttac

SEQ ID NO: 422792 - DNA, 25 bp, Mus musculus
cctatgactattccagggaggtgac

SEQ ID NO: 422793 - DNA, 25 bp, Mus musculus
cctatgagaagtgcagggctctagc

SEQ ID NO: 422794 - DNA, 25 bp, Mus musculus
cctatgagtgtatctgcgggcctga

SEQ ID NO: 422795 - DNA, 25 bp, Mus musculus
cctatgattacggaagccttattgg

SEQ ID NO: 422796 - DNA, 25 bp, Mus musculus
cctatgcaaggacggtgtggaccaa

SEQ ID NO: 422797 - DNA, 25 bp, Mus musculus
cctatgcccggctttctggtagaga

SEQ ID NO: 422798 - DNA, 25 bp, Mus musculus
cctatggaactagaggccctgcagt

SEQ ID NO: 422799 - DNA, 25 bp, Mus musculus
cctatggagatgacggagaagatgc

SEQ ID NO: 422800 - DNA, 25 bp, Mus musculus
cctatggcaccttcgggatggaatg

SEQ ID NO: 422801 - DNA, 25 bp, Mus musculus
cctatgggaaccagaagagcgtatc

SEQ ID NO: 422802 - DNA, 25 bp, Mus musculus
cctatgggaggagtcctcagtccct

SEQ ID NO: 422803 - DNA, 25 bp, Mus musculus
cctatgggctgctgtcgggataccc

SEQ ID NO: 422804 - DNA, 25 bp, Mus musculus
cctatggttgctgctgctggcccgt

SEQ ID NO: 422805 - DNA, 25 bp, Mus musculus
cctatgtcaaaaaggttagttcctg

SEQ ID NO: 422806 - DNA, 25 bp, Mus musculus
cctatgttggcgacagcaagcgtgc

SEQ ID NO: 422807 - DNA, 25 bp, Mus musculus
cctattacgatgtgatgactacggg

SEQ ID NO: 422808 - DNA, 25 bp, Mus musculus
cctattccaagaccacgcagatctg

SEQ ID NO: 422809 - DNA, 25 bp, Mus musculus
cctattgagagatcgagagctgttc

SEQ ID NO: 422810 - DNA, 25 bp, Mus musculus
cctattgctactgggatgcggagaa

SEQ ID NO: 422811 - DNA, 25 bp, Mus musculus
cctatttagaggcacgaggaaatcc

SEQ ID NO: 422812 - DNA, 25 bp, Mus musculus
cctatttggcgtgacggacagaggc

SEQ ID NO: 422813 - DNA, 25 bp, Mus musculus
cctatttggtgcaaaggagacaatg

SEQ ID NO: 422814 - DNA, 25 bp, Mus musculus
cctattttaggctccgtgctctgtc

SEQ ID NO: 422815 - DNA, 25 bp, Mus musculus
cctcaaaagaatgttgatccgaaac

SEQ ID NO: 422816 - DNA, 25 bp, Mus musculus
cctcaaaatggaagcctcgttgcct

SEQ ID NO: 422817 - DNA, 25 bp, Mus musculus
cctcaaactccgtagcagagactga

SEQ ID NO: 422818 - DNA, 25 bp, Mus musculus
cctcaaagaagtcggcctttgcaca

SEQ ID NO: 422819 - DNA, 25 bp, Mus musculus
cctcaaagagggtggtgaccgacac

SEQ ID NO: 422820 - DNA, 25 bp, Mus musculus
cctcaaaggttgtgagatgctctta

SEQ ID NO: 422821 - DNA, 25 bp, Mus musculus
cctcaaatgggtggcctatggctat

SEQ ID NO: 422822 - DNA, 25 bp, Mus musculus
cctcaaatttagatgggcaccgatc

SEQ ID NO: 422823 - DNA, 25 bp, Mus musculus
cctcaacatggaactgcgcaagaca

SEQ ID NO: 422824 - DNA, 25 bp, Mus musculus
cctcaaccaggaagcatttcaccat

SEQ ID NO: 422825 - DNA, 25 bp, Mus musculus
cctcaacggatatctgggccctgtg

SEQ ID NO: 422826 - DNA, 25 bp, Mus musculus
cctcaacttctgagaggctaagaat

SEQ ID NO: 422827 - DNA, 25 bp, Mus musculus
cctcaagaacaagttatcgagtggg

SEQ ID NO: 422828 - DNA, 25 bp, Mus musculus
cctcaagagaatccagagtcacaaa

SEQ ID NO: 422829 - DNA, 25 bp, Mus musculus
cctcaagggagatgaagccacggtc

SEQ ID NO: 422830 - DNA, 25 bp, Mus musculus
cctcaagggattccagctgcccgta

SEQ ID NO: 422831 - DNA, 25 bp, Mus musculus
cctcaagggtggaaagtgaacagca

SEQ ID NO: 422832 - DNA, 25 bp, Mus musculus
cctcaaggtcagtggtcagaagtag

SEQ ID NO: 422833 - DNA, 25 bp, Mus musculus
cctcaatgacatgagtgttccccag

SEQ ID NO: 422834 - DNA, 25 bp, Mus musculus
cctcaatgataaagacgtgtgccct

SEQ ID NO: 422835 - DNA, 25 bp, Mus musculus
cctcaatggagatgcggtcgtatca

SEQ ID NO: 422836 - DNA, 25 bp, Mus musculus
cctcaattccgtgcagatgggcgcg

SEQ ID NO: 422837 - DNA, 25 bp, Mus musculus
cctcaattgccaggaaaggacaaga

SEQ ID NO: 422838 - DNA, 25 bp, Mus musculus
cctcaccagtctttttggaacataa

SEQ ID NO: 422839 - DNA, 25 bp, Mus musculus
cctcagaaacttagagagactttgt

SEQ ID NO: 422840 - DNA, 25 bp, Mus musculus
cctcagaagggtaagtattgaactc

SEQ ID NO: 422841 - DNA, 25 bp, Mus musculus
cctcagacggaagatgggctacttt

SEQ ID NO: 422842 - DNA, 25 bp, Mus musculus
cctcagagctgttgtgtggcaagca

SEQ ID NO: 422843 - DNA, 25 bp, Mus musculus
cctcagagtgtgctaggaagtcccc

SEQ ID NO: 422844 - DNA, 25 bp, Mus musculus
cctcagcaaattgggagaacttggg

SEQ ID NO: 422845 - DNA, 25 bp, Mus musculus
cctcagcacgtgcaatgacctcatt

SEQ ID NO: 422846 - DNA, 25 bp, Mus musculus
cctcagcctatttactatttctctg

SEQ ID NO: 422847 - DNA, 25 bp, Mus musculus
cctcagcctgtaagtatctgtgggt

SEQ ID NO: 422848 - DNA, 25 bp, Mus musculus
cctcagcgagatgaagacctttgtc

SEQ ID NO: 422849 - DNA, 25 bp, Mus musculus
cctcagcggacccagattactgtcg

SEQ ID NO: 422850 - DNA, 25 bp, Mus musculus
cctcagcggcagtgttctgtgtgca

SEQ ID NO: 422851 - DNA, 25 bp, Mus musculus
cctcagctaggtggtggccaagact

SEQ ID NO: 422852 - DNA, 25 bp, Mus musculus
cctcagctgggcctaagatggacct

SEQ ID NO: 422853 - DNA, 25 bp, Mus musculus
cctcaggacagcatttggccgcctt

SEQ ID NO: 422854 - DNA, 25 bp, Mus musculus
cctcaggacgatgcagggagcggta

SEQ ID NO: 422855 - DNA, 25 bp, Mus musculus
cctcaggaggccctgtcaactgaca

SEQ ID NO: 422856 - DNA, 25 bp, Mus musculus
cctcaggagtgcatgaccgttggca

SEQ ID NO: 422857 - DNA, 25 bp, Mus musculus
cctcaggcgagcctgtggttttgaa

SEQ ID NO: 422858 - DNA, 25 bp, Mus musculus
cctcaggcggactcaatggaagacc

SEQ ID NO: 422859 - DNA, 25 bp, Mus musculus
cctcaggctctggaattaaacacgg

SEQ ID NO: 422860 - DNA, 25 bp, Mus musculus
cctcagggatgttcactgagcctgc

SEQ ID NO: 422861 - DNA, 25 bp, Mus musculus
cctcaggtaatgaacggcccagagt

SEQ ID NO: 422862 - DNA, 25 bp, Mus musculus
cctcaggtagcatgacgagccgtta

SEQ ID NO: 422863 - DNA, 25 bp, Mus musculus
cctcagtccggcagcctttaaggag

SEQ ID NO: 422864 - DNA, 25 bp, Mus musculus
cctcagtctcagtgaaatttccatt

SEQ ID NO: 422865 - DNA, 25 bp, Mus musculus
cctcagtgggctgtctcagcgggct

SEQ ID NO: 422866 - DNA, 25 bp, Mus musculus
cctcagtggtcatttgaccaatcag

SEQ ID NO: 422867 - DNA, 25 bp, Mus musculus
cctcagttgaagttattcatccagg

SEQ ID NO: 422868 - DNA, 25 bp, Mus musculus
cctcagttgggaggaggaattcacc

SEQ ID NO: 422869 - DNA, 25 bp, Mus musculus
cctcagtttccttaggctttaagat

SEQ ID NO: 422870 - DNA, 25 bp, Mus musculus
cctcatagtggagaagggaatcgac

SEQ ID NO: 422871 - DNA, 25 bp, Mus musculus
cctcatatgcgctgtgtcctgtaga

SEQ ID NO: 422872 - DNA, 25 bp, Mus musculus
cctcatcggatagcatgtctctaaa

SEQ ID NO: 422873 - DNA, 25 bp, Mus musculus
cctcatctatgtgaagggccgcggg

SEQ ID NO: 422874 - DNA, 25 bp, Mus musculus
cctcatctgagaaggaacgcgcaag

SEQ ID NO: 422875 - DNA, 25 bp, Mus musculus
cctcatctgggtggtggacagcgcc

SEQ ID NO: 422876 - DNA, 25 bp, Mus musculus
cctcatctgtcattgggaactgctg

SEQ ID NO: 422877 - DNA, 25 bp, Mus musculus
cctcatgagggttacgaggtgctca

SEQ ID NO: 422878 - DNA, 25 bp, Mus musculus
cctcatggagatggtagcgagctga

SEQ ID NO: 422879 - DNA, 25 bp, Mus musculus
cctcatggatatctgaagccttgtg

SEQ ID NO: 422880 - DNA, 25 bp, Mus musculus
cctcatgtgcccatttgcattgtgg

SEQ ID NO: 422881 - DNA, 25 bp, Mus musculus
cctcatgtgggcctgcaaagcttgc

SEQ ID NO: 422882 - DNA, 25 bp, Mus musculus
cctcattccctcgtgaagaggaggt

SEQ ID NO: 422883 - DNA, 25 bp, Mus musculus
cctcattgacgtggaagatgtggaa

SEQ ID NO: 422884 - DNA, 25 bp, Mus musculus
cctcatttgcagacggaagtgttca

SEQ ID NO: 422885 - DNA, 25 bp, Mus musculus
cctccaaaaggagaagtgcattgcc

SEQ ID NO: 422886 - DNA, 25 bp, Mus musculus
cctccaagctagaagagacgttgcc

SEQ ID NO: 422887 - DNA, 25 bp, Mus musculus
cctccaaggagccaagtaaacgcca

SEQ ID NO: 422888 - DNA, 25 bp, Mus musculus
cctccaagggctcatgaactaaaat

SEQ ID NO: 422889 - DNA, 25 bp, Mus musculus
cctccacatactccatgcagatgag

SEQ ID NO: 422890 - DNA, 25 bp, Mus musculus
cctccaccccatcatgggaagaatg

SEQ ID NO: 422891 - DNA, 25 bp, Mus musculus
cctccagagctgtgggaacctcggg

SEQ ID NO: 422892 - DNA, 25 bp, Mus musculus
cctccagcacaacaggcaatgcata

SEQ ID NO: 422893 - DNA, 25 bp, Mus musculus
cctccagcttcttgcggttcagctt

SEQ ID NO: 422894 - DNA, 25 bp, Mus musculus
cctccaggacctatgcagcactaaa

SEQ ID NO: 422895 - DNA, 25 bp, Mus musculus
cctccaggattatcggtaaggttct

SEQ ID NO: 422896 - DNA, 25 bp, Mus musculus
cctccagggacaaagacaattacgt

SEQ ID NO: 422897 - DNA, 25 bp, Mus musculus
cctccaggtagagagtacagcccat

SEQ ID NO: 422898 - DNA, 25 bp, Mus musculus
cctccagtctgctagtgggacactg

SEQ ID NO: 422899 - DNA, 25 bp, Mus musculus
cctccataatatcaagttgtaggga

SEQ ID NO: 422900 - DNA, 25 bp, Mus musculus
cctccatcctgctgggtcttggtgt

SEQ ID NO: 422901 - DNA, 25 bp, Mus musculus
cctccattaggcctgtgtagttcat

SEQ ID NO: 422902 - DNA, 25 bp, Mus musculus
cctcccacaggtacgtgctgagacg

SEQ ID NO: 422903 - DNA, 25 bp, Mus musculus
cctcccagctggcaccaaatgtggg

SEQ ID NO: 422904 - DNA, 25 bp, Mus musculus
cctcccatgaacacatgagctttat

SEQ ID NO: 422905 - DNA, 25 bp, Mus musculus
cctcccattctgaataagtctcttg

SEQ ID NO: 422906 - DNA, 25 bp, Mus musculus
cctccccaagaaattccacatggaa

SEQ ID NO: 422907 - DNA, 25 bp, Mus musculus
cctccccgcagtgatggatgacaga

SEQ ID NO: 422908 - DNA, 25 bp, Mus musculus
cctcccctcggtgtgaaaagatgaa

SEQ ID NO: 422909 - DNA, 25 bp, Mus musculus
cctccccttagagttgagcatctgt

SEQ ID NO: 422910 - DNA, 25 bp, Mus musculus
cctcccgagatgtgggtccgctggt

SEQ ID NO: 422911 - DNA, 25 bp, Mus musculus
cctccctcagggatgttcactgagc

SEQ ID NO: 422912 - DNA, 25 bp, Mus musculus
cctccctgataatggaagattattc

SEQ ID NO: 422913 - DNA, 25 bp, Mus musculus
cctccctgatgctgctggcggtgct

SEQ ID NO: 422914 - DNA, 25 bp, Mus musculus
cctccctgcgcaagaagatggtgaa

SEQ ID NO: 422915 - DNA, 25 bp, Mus musculus
cctccctgttatggttgctgggcga

SEQ ID NO: 422916 - DNA, 25 bp, Mus musculus
cctcccttgaggttcactgacgtga

SEQ ID NO: 422917 - DNA, 25 bp, Mus musculus
cctccgaaagggtgtgtatgtgccc

SEQ ID NO: 422918 - DNA, 25 bp, Mus musculus
cctccgactggtgtgagtagtaaga

SEQ ID NO: 422919 - DNA, 25 bp, Mus musculus
cctccgaggatgtgcagcgcagcgt

SEQ ID NO: 422920 - DNA, 25 bp, Mus musculus
cctccgaggctggaaagacgtgcac

SEQ ID NO: 422921 - DNA, 25 bp, Mus musculus
cctccgatgaggaaggtagttcttc

SEQ ID NO: 422922 - DNA, 25 bp, Mus musculus
cctccgatggaaagcaagacgacag

SEQ ID NO: 422923 - DNA, 25 bp, Mus musculus
cctccgctgggtgtactgtctgcgt

SEQ ID NO: 422924 - DNA, 25 bp, Mus musculus
cctccggctgcttaataatggcgtg

SEQ ID NO: 422925 - DNA, 25 bp, Mus musculus
cctccgtaaagaaggatggccaggg

SEQ ID NO: 422926 - DNA, 25 bp, Mus musculus
cctccgtcggttctcaatgaaaaag

SEQ ID NO: 422927 - DNA, 25 bp, Mus musculus
cctccgtgggaagttcaagcgtcct

SEQ ID NO: 422928 - DNA, 25 bp, Mus musculus
cctccgtggtgacttggcatcgctt

SEQ ID NO: 422929 - DNA, 25 bp, Mus musculus
cctccgtgtgatgggccgtgtctgt

SEQ ID NO: 422930 - DNA, 25 bp, Mus musculus
cctccgtgtggagtagggacttgaa

SEQ ID NO: 422931 - DNA, 25 bp, Mus musculus
cctcctaccagaagcgtagctttgg

SEQ ID NO: 422932 - DNA, 25 bp, Mus musculus
cctcctagaagggatgaggcaggca

SEQ ID NO: 422933 - DNA, 25 bp, Mus musculus
cctcctagtgtcattcaaagaaacc

SEQ ID NO: 422934 - DNA, 25 bp, Mus musculus
cctcctattggagtgtgtatgcaga

SEQ ID NO: 422935 - DNA, 25 bp, Mus musculus
cctcctcagggtggcgggcatctag

SEQ ID NO: 422936 - DNA, 25 bp, Mus musculus
cctcctcggtggctgagtaaactag

SEQ ID NO: 422937 - DNA, 25 bp, Mus musculus
cctcctcttctgagttttagattta

SEQ ID NO: 422938 - DNA, 25 bp, Mus musculus
cctcctgagggttatcttctgacga

SEQ ID NO: 422939 - DNA, 25 bp, Mus musculus
cctcctgccaggtgggaaaggacct

SEQ ID NO: 422940 - DNA, 25 bp, Mus musculus
cctcctgcgaaagcctggaagcaaa

SEQ ID NO: 422941 - DNA, 25 bp, Mus musculus
cctcctgctgcctggtgttgcctct

SEQ ID NO: 422942 - DNA, 25 bp, Mus musculus
cctcctggccatagacgaagaagag

SEQ ID NO: 422943 - DNA, 25 bp, Mus musculus
cctcctgggaggcaataagctggtc

SEQ ID NO: 422944 - DNA, 25 bp, Mus musculus
cctcctgggataaagataagataca

SEQ ID NO: 422945 - DNA, 25 bp, Mus musculus
cctcctggtgagaaaggacctccca

SEQ ID NO: 422946 - DNA, 25 bp, Mus musculus
cctcctgtgcattatgatggagacc

SEQ ID NO: 422947 - DNA, 25 bp, Mus musculus
cctccttccgtgagaagaaccaaga

SEQ ID NO: 422948 - DNA, 25 bp, Mus musculus
cctcctttgggctgctttattgtgt

SEQ ID NO: 422949 - DNA, 25 bp, Mus musculus
cctcgaaggccagtgtaaggatgcc

SEQ ID NO: 422950 - DNA, 25 bp, Mus musculus
cctcgagagccctgagtgaaggcgc

SEQ ID NO: 422951 - DNA, 25 bp, Mus musculus
cctcgagagtctgggttacaaccat

SEQ ID NO: 422952 - DNA, 25 bp, Mus musculus
cctcgagattaagactggacatgct

SEQ ID NO: 422953 - DNA, 25 bp, Mus musculus
cctcgagccagtgagcatgtttgga

SEQ ID NO: 422954 - DNA, 25 bp, Mus musculus
cctcgagctcagtgggcttttgccc

SEQ ID NO: 422955 - DNA, 25 bp, Mus musculus
cctcgagctgaaggcgctgtgtatt

SEQ ID NO: 422956 - DNA, 25 bp, Mus musculus
cctcgaggatcgacagggttttctg

SEQ ID NO: 422957 - DNA, 25 bp, Mus musculus
cctcgattgaactggtggaaactga

SEQ ID NO: 422958 - DNA, 25 bp, Mus musculus
cctcgcagaacgtgctcaatgggca

SEQ ID NO: 422959 - DNA, 25 bp, Mus musculus
cctcgcagacacaagattactatcc

SEQ ID NO: 422960 - DNA, 25 bp, Mus musculus
cctcgcatatttagttcctgtattc

SEQ ID NO: 422961 - DNA, 25 bp, Mus musculus
cctcgctatttgcaggtcagtaaaa

SEQ ID NO: 422962 - DNA, 25 bp, Mus musculus
cctcgctgtgggaggagcttctcct

SEQ ID NO: 422963 - DNA, 25 bp, Mus musculus
cctcgcttaataagacgtttgtcct

SEQ ID NO: 422964 - DNA, 25 bp, Mus musculus
cctcgcttgggaatgaacactttca

SEQ ID NO: 422965 - DNA, 25 bp, Mus musculus
cctcggaacaacaagcaggcgttac

SEQ ID NO: 422966 - DNA, 25 bp, Mus musculus
cctcggaagagaatgccaagtggca

SEQ ID NO: 422967 - DNA, 25 bp, Mus musculus
cctcggaatgactacagatctgaag

SEQ ID NO: 422968 - DNA, 25 bp, Mus musculus
cctcggacgtgcgtgcgtgagtgcg

SEQ ID NO: 422969 - DNA, 25 bp, Mus musculus
cctcggagcacagcttaaggctagt

SEQ ID NO: 422970 - DNA, 25 bp, Mus musculus
cctcggcctccctggtgaatgtgaa

SEQ ID NO: 422971 - DNA, 25 bp, Mus musculus
cctcggcggtgttgcagaggtcctt

SEQ ID NO: 422972 - DNA, 25 bp, Mus musculus
cctcggctgggtccttgatcttcaa

SEQ ID NO: 422973 - DNA, 25 bp, Mus musculus
cctcggcttcattcaaggcgggagg

SEQ ID NO: 422974 - DNA, 25 bp, Mus musculus
cctcgggaaggcctaagcaagttgc

SEQ ID NO: 422975 - DNA, 25 bp, Mus musculus
cctcgggagagaaaatgaatggctc

SEQ ID NO: 422976 - DNA, 25 bp, Mus musculus
cctcgggcacaaattgaggctggag

SEQ ID NO: 422977 - DNA, 25 bp, Mus musculus
cctcgggtgaaatgacctgaagata

SEQ ID NO: 422978 - DNA, 25 bp, Mus musculus
cctcggtaccggtggatgtgatgcc

SEQ ID NO: 422979 - DNA, 25 bp, Mus musculus
cctcggtgtgccttctactataatg

SEQ ID NO: 422980 - DNA, 25 bp, Mus musculus
cctcggtgtggctgacattcgcgca

SEQ ID NO: 422981 - DNA, 25 bp, Mus musculus
cctcggtttagagaactgtgtgcta

SEQ ID NO: 422982 - DNA, 25 bp, Mus musculus
cctcgtaaaaggacgcggagcagca

SEQ ID NO: 422983 - DNA, 25 bp, Mus musculus
cctcgtggagaaggtgagcagtcct

SEQ ID NO: 422984 - DNA, 25 bp, Mus musculus
cctcgtgggactggttggaaacatc

SEQ ID NO: 422985 - DNA, 25 bp, Mus musculus
cctcgtggtcggaatcgtgatcatc

SEQ ID NO: 422986 - DNA, 25 bp, Mus musculus
cctcgttcctgttgtgtacttggtg

SEQ ID NO: 422987 - DNA, 25 bp, Mus musculus
cctcgtttcgaggtccagttgcact

SEQ ID NO: 422988 - DNA, 25 bp, Mus musculus
cctctaatgttatggcggactgcct

SEQ ID NO: 422989 - DNA, 25 bp, Mus musculus
cctctacatggactataataggatg

SEQ ID NO: 422990 - DNA, 25 bp, Mus musculus
cctctaccacaggagaaggacaagt

SEQ ID NO: 422991 - DNA, 25 bp, Mus musculus
cctctacgggcaactctgttgtgta

SEQ ID NO: 422992 - DNA, 25 bp, Mus musculus
cctctagacatgacggctgggaatg

SEQ ID NO: 422993 - DNA, 25 bp, Mus musculus
cctctagcgctgagcctgaaccttg

SEQ ID NO: 422994 - DNA, 25 bp, Mus musculus
cctctagctgctgacttgctgggaa

SEQ ID NO: 422995 - DNA, 25 bp, Mus musculus
cctctaggagctgctgactagcctg

SEQ ID NO: 422996 - DNA, 25 bp, Mus musculus
cctctaggtcacaggctgagtcacc

SEQ ID NO: 422997 - DNA, 25 bp, Mus musculus
cctctagtgaggcaaactgggtaca

SEQ ID NO: 422998 - DNA, 25 bp, Mus musculus
cctctatcataatctggcctttggt

SEQ ID NO: 422999 - DNA, 25 bp, Mus musculus
cctctatgagacttgaaaatacccg

SEQ ID NO: 423000 - DNA, 25 bp, Mus musculus
cctctatggtggatgaagcagctca

SEQ ID NO: 423001 - DNA, 25 bp, Mus musculus
cctctatgtagtcggtgggcacaca

SEQ ID NO: 423002 - DNA, 25 bp, Mus musculus
cctctcagcgtttggcgtgctttct

SEQ ID NO: 423003 - DNA, 25 bp, Mus musculus
cctctcccaaatgtgatgatgcaat

SEQ ID NO: 423004 - DNA, 25 bp, Mus musculus
cctctcccggcgtgaagaagagccg

SEQ ID NO: 423005 - DNA, 25 bp, Mus musculus
cctctccttctgttccttgaaagga

SEQ ID NO: 423006 - DNA, 25 bp, Mus musculus
cctctcggagttgcacctggagcag

SEQ ID NO: 423007 - DNA, 25 bp, Mus musculus
cctctcggtgagaaatggcttcggc

SEQ ID NO: 423008 - DNA, 25 bp, Mus musculus
cctctctaagtcacagtaggaatga

SEQ ID NO: 423009 - DNA, 25 bp, Mus musculus
cctctctcgggctctgtgcttcagt

SEQ ID NO: 423010 - DNA, 25 bp, Mus musculus
cctctctcgtgtcccgcagggaaaa

SEQ ID NO: 423011 - DNA, 25 bp, Mus musculus
cctctctgagggaaggatcaactac

SEQ ID NO: 423012 - DNA, 25 bp, Mus musculus
cctctgaaatgttgtcacggaatct

SEQ ID NO: 423013 - DNA, 25 bp, Mus musculus
cctctgaaggacaggattcactgcg

SEQ ID NO: 423014 - DNA, 25 bp, Mus musculus
cctctgacagattgggtgggcgatt

SEQ ID NO: 423015 - DNA, 25 bp, Mus musculus
cctctgaccatgtcgctgcaagtgt

SEQ ID NO: 423016 - DNA, 25 bp, Mus musculus
cctctgacttcatcaagcctgggaa

SEQ ID NO: 423017 - DNA, 25 bp, Mus musculus
cctctgagatcgttctggtcggcca

SEQ ID NO: 423018 - DNA, 25 bp, Mus musculus
cctctgagcaagaaggacagcgtca

SEQ ID NO: 423019 - DNA, 25 bp, Mus musculus
cctctgagcgtgtgttgggatgacc

SEQ ID NO: 423020 - DNA, 25 bp, Mus musculus
cctctgaggcatcccgtgtgtcatg

SEQ ID NO: 423021 - DNA, 25 bp, Mus musculus
cctctgaggtccagggaattgccac

SEQ ID NO: 423022 - DNA, 25 bp, Mus musculus
cctctgataatggaattggtgcccc

SEQ ID NO: 423023 - DNA, 25 bp, Mus musculus
cctctgatggccgaggtgatccgag

SEQ ID NO: 423024 - DNA, 25 bp, Mus musculus
cctctgatggctcccttaggtgaag

SEQ ID NO: 423025 - DNA, 25 bp, Mus musculus
cctctgattggctcggctgctgaaa

SEQ ID NO: 423026 - DNA, 25 bp, Mus musculus
cctctgcctctgaagcaaaggcagg

SEQ ID NO: 423027 - DNA, 25 bp, Mus musculus
cctctgccttgcttggtgggaccag

SEQ ID NO: 423028 - DNA, 25 bp, Mus musculus
cctctgcgagtatgatgaacaagac

SEQ ID NO: 423029 - DNA, 25 bp, Mus musculus
cctctgcggaggatgtgtacgactg

SEQ ID NO: 423030 - DNA, 25 bp, Mus musculus
cctctgcggctgctagtcaggcaat

SEQ ID NO: 423031 - DNA, 25 bp, Mus musculus
cctctgcggctttcagtaaatacag

SEQ ID NO: 423032 - DNA, 25 bp, Mus musculus
cctctgctgcctgggtgcagttgtc

SEQ ID NO: 423033 - DNA, 25 bp, Mus musculus
cctctgctgctttcggcaaagtggg

SEQ ID NO: 423034 - DNA, 25 bp, Mus musculus
cctctgctggttcctggacgaggca

SEQ ID NO: 423035 - DNA, 25 bp, Mus musculus
cctctgctggtttagtgcccgcact

SEQ ID NO: 423036 - DNA, 25 bp, Mus musculus
cctctgctgttgaaattttgtcaca

SEQ ID NO: 423037 - DNA, 25 bp, Mus musculus
cctctggacacctggagggctggac

SEQ ID NO: 423038 - DNA, 25 bp, Mus musculus
cctctggacgaggaatggtagccac

SEQ ID NO: 423039 - DNA, 25 bp, Mus musculus
cctctggactgctggtgttaaggca

SEQ ID NO: 423040 - DNA, 25 bp, Mus musculus
cctctggagaaaaggtgctgcacct

SEQ ID NO: 423041 - DNA, 25 bp, Mus musculus
cctctggatgatctagtgagcgaac

SEQ ID NO: 423042 - DNA, 25 bp, Mus musculus
cctctggatggagtgtgcgacacac

SEQ ID NO: 423043 - DNA, 25 bp, Mus musculus
cctctggcgctgtgtgtgtcattcc

SEQ ID NO: 423044 - DNA, 25 bp, Mus musculus
cctctgggaagagtggaccaacttg

SEQ ID NO: 423045 - DNA, 25 bp, Mus musculus
cctctgggagaaacgcaagcaactg

SEQ ID NO: 423046 - DNA, 25 bp, Mus musculus
cctctgggatgtgagagatagttga

SEQ ID NO: 423047 - DNA, 25 bp, Mus musculus
cctctgggctggatactgggaaacc

SEQ ID NO: 423048 - DNA, 25 bp, Mus musculus
cctctggtcggaagcatagccactc

SEQ ID NO: 423049 - DNA, 25 bp, Mus musculus
cctctggtgagaaactgcgtgtcct

SEQ ID NO: 423050 - DNA, 25 bp, Mus musculus
cctctggtgcaggttgctacaggca

SEQ ID NO: 423051 - DNA, 25 bp, Mus musculus
cctctggtggtagaaagctgcatcc

SEQ ID NO: 423052 - DNA, 25 bp, Mus musculus
cctctggttgataaggaatgctgga

SEQ ID NO: 423053 - DNA, 25 bp, Mus musculus
cctctggtttactatgctgtgggaa

SEQ ID NO: 423054 - DNA, 25 bp, Mus musculus
cctctgtcaggagatcgaattcatg

SEQ ID NO: 423055 - DNA, 25 bp, Mus musculus
cctctgtgaaatgagacaactcgac

SEQ ID NO: 423056 - DNA, 25 bp, Mus musculus
cctctgtgctggtatcagaaaagca

SEQ ID NO: 423057 - DNA, 25 bp, Mus musculus
cctctgttaagcttcctgggagact

SEQ ID NO: 423058 - DNA, 25 bp, Mus musculus
cctctgttaccatctgtgggcctta

SEQ ID NO: 423059 - DNA, 25 bp, Mus musculus
cctctgttgacaagaaggacaaagc

SEQ ID NO: 423060 - DNA, 25 bp, Mus musculus
cctcttagtggatgtgttggcaacc

SEQ ID NO: 423061 - DNA, 25 bp, Mus musculus
cctcttcagcttacagtgggaccca

SEQ ID NO: 423062 - DNA, 25 bp, Mus musculus
cctcttcatgggacatctgggcaga

SEQ ID NO: 423063 - DNA, 25 bp, Mus musculus
cctcttctgggatgctctaccatgt

SEQ ID NO: 423064 - DNA, 25 bp, Mus musculus
cctcttcttgtaagcacacttggag

SEQ ID NO: 423065 - DNA, 25 bp, Mus musculus
cctcttgaaacacgagaaaattggg

SEQ ID NO: 423066 - DNA, 25 bp, Mus musculus
cctcttgaaagtagccggtgggatg

SEQ ID NO: 423067 - DNA, 25 bp, Mus musculus
cctcttgacttagaaatggacctga

SEQ ID NO: 423068 - DNA, 25 bp, Mus musculus
cctcttggagcggttgacggacttg

SEQ ID NO: 423069 - DNA, 25 bp, Mus musculus
cctcttggaggccatatttgttgtt

SEQ ID NO: 423070 - DNA, 25 bp, Mus musculus
cctcttgggtggctcaggtattcct

SEQ ID NO: 423071 - DNA, 25 bp, Mus musculus
cctcttgtaaacttggaatagctaa

SEQ ID NO: 423072 - DNA, 25 bp, Mus musculus
cctcttgtttgatggccagccctta

SEQ ID NO: 423073 - DNA, 25 bp, Mus musculus
cctctttgctatgggaacttggaca

SEQ ID NO: 423074 - DNA, 25 bp, Mus musculus
cctctttggaaacaggattagttag

SEQ ID NO: 423075 - DNA, 25 bp, Mus musculus
cctctttgggttgatactgaacttt

SEQ ID NO: 423076 - DNA, 25 bp, Mus musculus
cctcttttgaggctctagctggcta

SEQ ID NO: 423077 - DNA, 25 bp, Mus musculus
cctgaaaactagcagaggaattgcc

SEQ ID NO: 423078 - DNA, 25 bp, Mus musculus
cctgaaaactttccgggcgctgctc

SEQ ID NO: 423079 - DNA, 25 bp, Mus musculus
cctgaaaaggtttcactggacagca

SEQ ID NO: 423080 - DNA, 25 bp, Mus musculus
cctgaaacagttgaggatgtccgaa

SEQ ID NO: 423081 - DNA, 25 bp, Mus musculus
cctgaaacatctttaactgcagaac

SEQ ID NO: 423082 - DNA, 25 bp, Mus musculus
cctgaaaccagaggaacagcctatg

SEQ ID NO: 423083 - DNA, 25 bp, Mus musculus
cctgaaacctgctggaccttgctgg

SEQ ID NO: 423084 - DNA, 25 bp, Mus musculus
cctgaaacttaaagcaaggagcctg

SEQ ID NO: 423085 - DNA, 25 bp, Mus musculus
cctgaaagagctgtacctggtgtcc

SEQ ID NO: 423086 - DNA, 25 bp, Mus musculus
cctgaaagatattgagacggcctgc

SEQ ID NO: 423087 - DNA, 25 bp, Mus musculus
cctgaaaggcttagagaactggctg

SEQ ID NO: 423088 - DNA, 25 bp, Mus musculus
cctgaaatgcatgaagagaaaccca

SEQ ID NO: 423089 - DNA, 25 bp, Mus musculus
cctgaaatggcgtgcattgcagcta

SEQ ID NO: 423090 - DNA, 25 bp, Mus musculus
cctgaaattcgcaaggacccgggag

SEQ ID NO: 423091 - DNA, 25 bp, Mus musculus
cctgaacagcgggtggacaagattt

SEQ ID NO: 423092 - DNA, 25 bp, Mus musculus
cctgaaccccacctggaatgaagta

SEQ ID NO: 423093 - DNA, 25 bp, Mus musculus
cctgaaccctgagaatgtgctgaaa

SEQ ID NO: 423094 - DNA, 25 bp, Mus musculus
cctgaactcttaggtgacattgcca

SEQ ID NO: 423095 - DNA, 25 bp, Mus musculus
cctgaactcttggtccagatggacg

SEQ ID NO: 423096 - DNA, 25 bp, Mus musculus
cctgaactgtactgcccagaaggag

SEQ ID NO: 423097 - DNA, 25 bp, Mus musculus
cctgaacttggccatggacgcgctg

SEQ ID NO: 423098 - DNA, 25 bp, Mus musculus
cctgaagaaaactccgatgggcatt

SEQ ID NO: 423099 - DNA, 25 bp, Mus musculus
cctgaagaaaggcatagtgacaaga

SEQ ID NO: 423100 - DNA, 25 bp, Mus musculus
cctgaagaagagatacatggacgac

SEQ ID NO: 423101 - DNA, 25 bp, Mus musculus
cctgaagaagcgctaaggaggccca

SEQ ID NO: 423102 - DNA, 25 bp, Mus musculus
cctgaagacaggaagacaccaagtg

SEQ ID NO: 423103 - DNA, 25 bp, Mus musculus
cctgaagactcgcacagaggaagaa

SEQ ID NO: 423104 - DNA, 25 bp, Mus musculus
cctgaagactgtccgggccatttgg

SEQ ID NO: 423105 - DNA, 25 bp, Mus musculus
cctgaagacttgattggagggcagt

SEQ ID NO: 423106 - DNA, 25 bp, Mus musculus
cctgaagagagctatactggtgcca

SEQ ID NO: 423107 - DNA, 25 bp, Mus musculus
cctgaagagcatgatcaaggaggtg

SEQ ID NO: 423108 - DNA, 25 bp, Mus musculus
cctgaagagggctgattgggtccca

SEQ ID NO: 423109 - DNA, 25 bp, Mus musculus
cctgaagatagaaagtgagacccct

SEQ ID NO: 423110 - DNA, 25 bp, Mus musculus
cctgaagcaaccctctcctgggaag

SEQ ID NO: 423111 - DNA, 25 bp, Mus musculus
cctgaagcagatcgtgaagcatgac

SEQ ID NO: 423112 - DNA, 25 bp, Mus musculus
cctgaagcagtttatccaatcacag

SEQ ID NO: 423113 - DNA, 25 bp, Mus musculus
cctgaagccaaaggaaatgggatct

SEQ ID NO: 423114 - DNA, 25 bp, Mus musculus
cctgaagcgcagttggatgctgaac

SEQ ID NO: 423115 - DNA, 25 bp, Mus musculus
cctgaaggacctcgtgatgctggat

SEQ ID NO: 423116 - DNA, 25 bp, Mus musculus
cctgaaggagaaagacggccatgtc

SEQ ID NO: 423117 - DNA, 25 bp, Mus musculus
cctgaaggagctggacgactactat

SEQ ID NO: 423118 - DNA, 25 bp, Mus musculus
cctgaaggataaagagccgagtgct

SEQ ID NO: 423119 - DNA, 25 bp, Mus musculus
cctgaaggatatgatgctctactgc

SEQ ID NO: 423120 - DNA, 25 bp, Mus musculus
cctgaagggaacaccaggagggctt

SEQ ID NO: 423121 - DNA, 25 bp, Mus musculus
cctgaaggggtcagtcccaatacct

SEQ ID NO: 423122 - DNA, 25 bp, Mus musculus
cctgaagtacagtggtgggctagtc

SEQ ID NO: 423123 - DNA, 25 bp, Mus musculus
cctgaagtactacaccaaggaggag

SEQ ID NO: 423124 - DNA, 25 bp, Mus musculus
cctgaagtaggagcgaaaggcagcc

SEQ ID NO: 423125 - DNA, 25 bp, Mus musculus
cctgaagtcggaatacagcgaggag

SEQ ID NO: 423126 - DNA, 25 bp, Mus musculus
cctgaagtctcagtgtgacatggac

SEQ ID NO: 423127 - DNA, 25 bp, Mus musculus
cctgaagttggcaccggctgaagaa

SEQ ID NO: 423128 - DNA, 25 bp, Mus musculus
cctgaatcggaataaattcggcggg

SEQ ID NO: 423129 - DNA, 25 bp, Mus musculus
cctgaatctgatggcgaaactggag

SEQ ID NO: 423130 - DNA, 25 bp, Mus musculus
cctgaatgacacctggccccagttt

SEQ ID NO: 423131 - DNA, 25 bp, Mus musculus
cctgaatgcccttgttgcagcggta

SEQ ID NO: 423132 - DNA, 25 bp, Mus musculus
cctgaatgtattggagcagtgcccc

SEQ ID NO: 423133 - DNA, 25 bp, Mus musculus
cctgaatgtgggtgtggatcctccg

SEQ ID NO: 423134 - DNA, 25 bp, Mus musculus
cctgaattcgggaggtggagcaatc

SEQ ID NO: 423135 - DNA, 25 bp, Mus musculus
cctgacacagtcaagatcgaacaaa

SEQ ID NO: 423136 - DNA, 25 bp, Mus musculus
cctgacacggttagagccatctgga

SEQ ID NO: 423137 - DNA, 25 bp, Mus musculus
cctgacacttctgatatggaggcag

SEQ ID NO: 423138 - DNA, 25 bp, Mus musculus
cctgacagaaagtggctactcaaga

SEQ ID NO: 423139 - DNA, 25 bp, Mus musculus
cctgacagctagagtgttggaagag

SEQ ID NO: 423140 - DNA, 25 bp, Mus musculus
cctgacatacaggaaagggcggcca

SEQ ID NO: 423141 - DNA, 25 bp, Mus musculus
cctgacatagcaggaagggatactg

SEQ ID NO: 423142 - DNA, 25 bp, Mus musculus
cctgaccaatactaaaacctgcggt

SEQ ID NO: 423143 - DNA, 25 bp, Mus musculus
cctgaccaccataccctgagaaaga

SEQ ID NO: 423144 - DNA, 25 bp, Mus musculus
cctgacccctgatccattggagaaa

SEQ ID NO: 423145 - DNA, 25 bp, Mus musculus
cctgaccctaacgaggagactgtgg

SEQ ID NO: 423146 - DNA, 25 bp, Mus musculus
cctgacctctggctaagatttctga

SEQ ID NO: 423147 - DNA, 25 bp, Mus musculus
cctgacctgctgaggaagatcgcaa

SEQ ID NO: 423148 - DNA, 25 bp, Mus musculus
cctgaccttttgcactctcgtctat

SEQ ID NO: 423149 - DNA, 25 bp, Mus musculus
cctgacgacttttctggatggacac

SEQ ID NO: 423150 - DNA, 25 bp, Mus musculus
cctgacgctgagaagtaaagtctcc

SEQ ID NO: 423151 - DNA, 25 bp, Mus musculus
cctgacggcctagggaaatccttgc

SEQ ID NO: 423152 - DNA, 25 bp, Mus musculus
cctgacgggctatagcaggactgcc

SEQ ID NO: 423153 - DNA, 25 bp, Mus musculus
cctgacggtgaacaagaggttacct

SEQ ID NO: 423154 - DNA, 25 bp, Mus musculus
cctgactccatctgctttggagaaa

SEQ ID NO: 423155 - DNA, 25 bp, Mus musculus
cctgactcggaaagttagtgtctgc

SEQ ID NO: 423156 - DNA, 25 bp, Mus musculus
cctgactggcgagaactggatgacg

SEQ ID NO: 423157 - DNA, 25 bp, Mus musculus
cctgactggtacactcgggaggtga

SEQ ID NO: 423158 - DNA, 25 bp, Mus musculus
cctgactgtgtggactcggaaaacg

SEQ ID NO: 423159 - DNA, 25 bp, Mus musculus
cctgacttagccagcattgttgaca

SEQ ID NO: 423160 - DNA, 25 bp, Mus musculus
cctgacttctgggacaattgccatt

SEQ ID NO: 423161 - DNA, 25 bp, Mus musculus
cctgagaacttcacctcggagggcg

SEQ ID NO: 423162 - DNA, 25 bp, Mus musculus
cctgagaagtggaatggcaggatat

SEQ ID NO: 423163 - DNA, 25 bp, Mus musculus
cctgagaatgcggagatcaccctga

SEQ ID NO: 423164 - DNA, 25 bp, Mus musculus
cctgagacagctgtagatgacaacc

SEQ ID NO: 423165 - DNA, 25 bp, Mus musculus
cctgagaccgaaaaggacttgcgac

SEQ ID NO: 423166 - DNA, 25 bp, Mus musculus
cctgagacgcttgcctttgagtgga

SEQ ID NO: 423167 - DNA, 25 bp, Mus musculus
cctgagacgtggagagtaccctgac

SEQ ID NO: 423168 - DNA, 25 bp, Mus musculus
cctgagactgaactcctgggagaca

SEQ ID NO: 423169 - DNA, 25 bp, Mus musculus
cctgagactgaagaagacgttgggc

SEQ ID NO: 423170 - DNA, 25 bp, Mus musculus
cctgagagactgttgcccctgtgaa

SEQ ID NO: 423171 - DNA, 25 bp, Mus musculus
cctgagagaggagaaggtgaccaac

SEQ ID NO: 423172 - DNA, 25 bp, Mus musculus
cctgagagatacaagaaaagtcccg

SEQ ID NO: 423173 - DNA, 25 bp, Mus musculus
cctgagagccatgtcgcgtctgatc

SEQ ID NO: 423174 - DNA, 25 bp, Mus musculus
cctgagagccgacatcggtcctcga

SEQ ID NO: 423175 - DNA, 25 bp, Mus musculus
cctgagagcctgaactaaggacgat

SEQ ID NO: 423176 - DNA, 25 bp, Mus musculus
cctgagaggacactgtagagacccg

SEQ ID NO: 423177 - DNA, 25 bp, Mus musculus
cctgagagtgctagagaaacatggg

SEQ ID NO: 423178 - DNA, 25 bp, Mus musculus
cctgagagttcccaagtagcctgaa

SEQ ID NO: 423179 - DNA, 25 bp, Mus musculus
cctgagataggtatcgtgcagccca

SEQ ID NO: 423180 - DNA, 25 bp, Mus musculus
cctgagatcctatgatcctgggcgt

SEQ ID NO: 423181 - DNA, 25 bp, Mus musculus
cctgagatgccaggaacagaatggc

SEQ ID NO: 423182 - DNA, 25 bp, Mus musculus
cctgagatgcttgtgaagagatgga

SEQ ID NO: 423183 - DNA, 25 bp, Mus musculus
cctgagatggaagctaggctgctga

SEQ ID NO: 423184 - DNA, 25 bp, Mus musculus
cctgagcaacctaccaagaagtggg

SEQ ID NO: 423185 - DNA, 25 bp, Mus musculus
cctgagcatccatgtttttataaga

SEQ ID NO: 423186 - DNA, 25 bp, Mus musculus
cctgagccagaagcgcactggtaaa

SEQ ID NO: 423187 - DNA, 25 bp, Mus musculus
cctgagccctatgggcagaggctct

SEQ ID NO: 423188 - DNA, 25 bp, Mus musculus
cctgagcctgcatagtggaagagat

SEQ ID NO: 423189 - DNA, 25 bp, Mus musculus
cctgagcggcccattagatgagacc

SEQ ID NO: 423190 - DNA, 25 bp, Mus musculus
cctgagctagtaaatattatggcac

SEQ ID NO: 423191 - DNA, 25 bp, Mus musculus
cctgagctgcgtcaaggcttttgca

SEQ ID NO: 423192 - DNA, 25 bp, Mus musculus
cctgagcttacctgacatgtgggca

SEQ ID NO: 423193 - DNA, 25 bp, Mus musculus
cctgagcttagtggttgtcagcgct

SEQ ID NO: 423194 - DNA, 25 bp, Mus musculus
cctgagcttcctctaccggtggata

SEQ ID NO: 423195 - DNA, 25 bp, Mus musculus
cctgagcttgactagggcagcactc

SEQ ID NO: 423196 - DNA, 25 bp, Mus musculus
cctgagctttgtgatcgtggtaccc

SEQ ID NO: 423197 - DNA, 25 bp, Mus musculus
cctgagcttttatttctgttttggg

SEQ ID NO: 423198 - DNA, 25 bp, Mus musculus
cctgaggacatgtgcttgagtgact

SEQ ID NO: 423199 - DNA, 25 bp, Mus musculus
cctgaggacgacttagctggcatct

SEQ ID NO: 423200 - DNA, 25 bp, Mus musculus
cctgaggactgagaaccagatcatg

SEQ ID NO: 423201 - DNA, 25 bp, Mus musculus
cctgaggagtagtgctttgtcccaa

SEQ ID NO: 423202 - DNA, 25 bp, Mus musculus
cctgaggcacctgcggaattctgtc

SEQ ID NO: 423203 - DNA, 25 bp, Mus musculus
cctgaggctaatttgctgggcaggt

SEQ ID NO: 423204 - DNA, 25 bp, Mus musculus
cctgagggacagtggtgagtccacg

SEQ ID NO: 423205 - DNA, 25 bp, Mus musculus
cctgagggagccagtagtaaaggtc

SEQ ID NO: 423206 - DNA, 25 bp, Mus musculus
cctgagggctcaaggacagattcgc

SEQ ID NO: 423207 - DNA, 25 bp, Mus musculus
cctgaggtagatgcaaaggtccgga

SEQ ID NO: 423208 - DNA, 25 bp, Mus musculus
cctgaggtccacgaagcctgggaca

SEQ ID NO: 423209 - DNA, 25 bp, Mus musculus
cctgaggtgcccaaggatcttgtac

SEQ ID NO: 423210 - DNA, 25 bp, Mus musculus
cctgaggtgccctggattctaatcc

SEQ ID NO: 423211 - DNA, 25 bp, Mus musculus
cctgagtacattgatcgcattgcca

SEQ ID NO: 423212 - DNA, 25 bp, Mus musculus
cctgagtcacttggagagcgcggat

SEQ ID NO: 423213 - DNA, 25 bp, Mus musculus
cctgagtcaggccaagacattcatg

SEQ ID NO: 423214 - DNA, 25 bp, Mus musculus
cctgagttactgtccccagtgaggg

SEQ ID NO: 423215 - DNA, 25 bp, Mus musculus
cctgagttcatgaagacgggcgcca

SEQ ID NO: 423216 - DNA, 25 bp, Mus musculus
cctgataaaagaccggcttgcccta

SEQ ID NO: 423217 - DNA, 25 bp, Mus musculus
cctgatacagtggaaggctggagcc

SEQ ID NO: 423218 - DNA, 25 bp, Mus musculus
cctgatactgctgaccccaaaatga

SEQ ID NO: 423219 - DNA, 25 bp, Mus musculus
cctgatagagggagctctggccact

SEQ ID NO: 423220 - DNA, 25 bp, Mus musculus
cctgatagtaagcaatggtggcgac

SEQ ID NO: 423221 - DNA, 25 bp, Mus musculus
cctgatagtcttgaagatgcatggg

SEQ ID NO: 423222 - DNA, 25 bp, Mus musculus
cctgatagttgatgacaagccctga

SEQ ID NO: 423223 - DNA, 25 bp, Mus musculus
cctgatatctggtatgaagctgccc

SEQ ID NO: 423224 - DNA, 25 bp, Mus musculus
cctgatatggtctggccctaatgcc

SEQ ID NO: 423225 - DNA, 25 bp, Mus musculus
cctgatatttgacctggacggactt

SEQ ID NO: 423226 - DNA, 25 bp, Mus musculus
cctgatcacaggtagcggaggaaga

SEQ ID NO: 423227 - DNA, 25 bp, Mus musculus
cctgatcactaatgggatgggttca

SEQ ID NO: 423228 - DNA, 25 bp, Mus musculus
cctgatcatcaagaacgtgcgtctg

SEQ ID NO: 423229 - DNA, 25 bp, Mus musculus
cctgatccattggagaaaaagctgg

SEQ ID NO: 423230 - DNA, 25 bp, Mus musculus
cctgatcctgatgagcaagtgcttg

SEQ ID NO: 423231 - DNA, 25 bp, Mus musculus
cctgatcctttgagacctttgcaag

SEQ ID NO: 423232 - DNA, 25 bp, Mus musculus
cctgatctagctccccagtctgagt

SEQ ID NO: 423233 - DNA, 25 bp, Mus musculus
cctgatctgacaagcccgggaaaga

SEQ ID NO: 423234 - DNA, 25 bp, Mus musculus
cctgatctgcaggtgacagacagtg

SEQ ID NO: 423235 - DNA, 25 bp, Mus musculus
cctgatctgtggttgagtggcccag

SEQ ID NO: 423236 - DNA, 25 bp, Mus musculus
cctgatctttgaagtgccctggtgt

SEQ ID NO: 423237 - DNA, 25 bp, Mus musculus
cctgatgagagggtaaaataggttg

SEQ ID NO: 423238 - DNA, 25 bp, Mus musculus
cctgatgagcaaggtgaaccccgag

SEQ ID NO: 423239 - DNA, 25 bp, Mus musculus
cctgatgatcttgtacataattggt

SEQ ID NO: 423240 - DNA, 25 bp, Mus musculus
cctgatgatgaactagacgacctct

SEQ ID NO: 423241 - DNA, 25 bp, Mus musculus
cctgatgatttcaaggtgagggaat

SEQ ID NO: 423242 - DNA, 25 bp, Mus musculus
cctgatgctggattcaaggtaactg

SEQ ID NO: 423243 - DNA, 25 bp, Mus musculus
cctgatgctgtaaccctggccaaga

SEQ ID NO: 423244 - DNA, 25 bp, Mus musculus
cctgatggcactgtaacgctgcatg

SEQ ID NO: 423245 - DNA, 25 bp, Mus musculus
cctgatggccacttaatgcaaggcg

SEQ ID NO: 423246 - DNA, 25 bp, Mus musculus
cctgatggtcttggtggtgataagc

SEQ ID NO: 423247 - DNA, 25 bp, Mus musculus
cctgatggtggccttggacctgaac

SEQ ID NO: 423248 - DNA, 25 bp, Mus musculus
cctgatgtgtgacaccggtggccct

SEQ ID NO: 423249 - DNA, 25 bp, Mus musculus
cctgattctatgatcttgggcatgt

SEQ ID NO: 423250 - DNA, 25 bp, Mus musculus
cctgattggcttcccaactactggg

SEQ ID NO: 423251 - DNA, 25 bp, Mus musculus
cctgattgtcaggatcgaatggagt

SEQ ID NO: 423252 - DNA, 25 bp, Mus musculus
cctgatttacatttcccctccaagt

SEQ ID NO: 423253 - DNA, 25 bp, Mus musculus
cctgattttgcctggagaagcgcat

SEQ ID NO: 423254 - DNA, 25 bp, Mus musculus
cctgcaaagggaagggaccggtgag

SEQ ID NO: 423255 - DNA, 25 bp, Mus musculus
cctgcaaagtggacatgtgggctac

SEQ ID NO: 423256 - DNA, 25 bp, Mus musculus
cctgcaacatggtggagtgccctga

SEQ ID NO: 423257 - DNA, 25 bp, Mus musculus
cctgcaacctggtcagagaggaagt

SEQ ID NO: 423258 - DNA, 25 bp, Mus musculus
cctgcaactactcaatgtgggcgaa

SEQ ID NO: 423259 - DNA, 25 bp, Mus musculus
cctgcaagaatggtgccggcagcag

SEQ ID NO: 423260 - DNA, 25 bp, Mus musculus
cctgcaagcagacgagcctagattg

SEQ ID NO: 423261 - DNA, 25 bp, Mus musculus
cctgcaaggaaatgagaaccgcctg

SEQ ID NO: 423262 - DNA, 25 bp, Mus musculus
cctgcaaggcatttggaacggcact

SEQ ID NO: 423263 - DNA, 25 bp, Mus musculus
cctgcaaggtatattctatgggctc

SEQ ID NO: 423264 - DNA, 25 bp, Mus musculus
cctgcacagcaagggtagaagcttt

SEQ ID NO: 423265 - DNA, 25 bp, Mus musculus
cctgcacagggtacatcctatagaa

SEQ ID NO: 423266 - DNA, 25 bp, Mus musculus
cctgcaccatgaggcggagtggcac

SEQ ID NO: 423267 - DNA, 25 bp, Mus musculus
cctgcacccagtactcatgtcggag

SEQ ID NO: 423268 - DNA, 25 bp, Mus musculus
cctgcaccgtctaccgggctgggag

SEQ ID NO: 423269 - DNA, 25 bp, Mus musculus
cctgcacggagtgtttgtggccgaa

SEQ ID NO: 423270 - DNA, 25 bp, Mus musculus
cctgcagagtctgaggcgattcctg

SEQ ID NO: 423271 - DNA, 25 bp, Mus musculus
cctgcagagtgctgtggtcaccaaa

SEQ ID NO: 423272 - DNA, 25 bp, Mus musculus
cctgcagcagagataagagcgtgtg

SEQ ID NO: 423273 - DNA, 25 bp, Mus musculus
cctgcagcggtgcactaccttggga

SEQ ID NO: 423274 - DNA, 25 bp, Mus musculus
cctgcagctcatgtgtgaatgcaga

SEQ ID NO: 423275 - DNA, 25 bp, Mus musculus
cctgcagctggcctgttcaatgcca

SEQ ID NO: 423276 - DNA, 25 bp, Mus musculus
cctgcagctgggtcatggacttaaa

SEQ ID NO: 423277 - DNA, 25 bp, Mus musculus
cctgcaggaaggtatctcaaagtta

SEQ ID NO: 423278 - DNA, 25 bp, Mus musculus
cctgcaggacagacagagtcgagcc

SEQ ID NO: 423279 - DNA, 25 bp, Mus musculus
cctgcaggagctcaccatcatcgag

SEQ ID NO: 423280 - DNA, 25 bp, Mus musculus
cctgcaggaggagattgaaaactac

SEQ ID NO: 423281 - DNA, 25 bp, Mus musculus
cctgcaggatgagcttcggaactcc

SEQ ID NO: 423282 - DNA, 25 bp, Mus musculus
cctgcaggctctatcgggtatttcc

SEQ ID NO: 423283 - DNA, 25 bp, Mus musculus
cctgcaggctgcatgagcgaagttc

SEQ ID NO: 423284 - DNA, 25 bp, Mus musculus
cctgcagggaagtagacgagcctct

SEQ ID NO: 423285 - DNA, 25 bp, Mus musculus
cctgcagggcaaaggagtgctccat

SEQ ID NO: 423286 - DNA, 25 bp, Mus musculus
cctgcagggtggtgagtagttaaca

SEQ ID NO: 423287 - DNA, 25 bp, Mus musculus
cctgcagggtgtgaataaagtgact

SEQ ID NO: 423288 - DNA, 25 bp, Mus musculus
cctgcagtaattgtggagaactccg

SEQ ID NO: 423289 - DNA, 25 bp, Mus musculus
cctgcagtgtttatgctgaccatca

SEQ ID NO: 423290 - DNA, 25 bp, Mus musculus
cctgcagttggtttcttatgggaga

SEQ ID NO: 423291 - DNA, 25 bp, Mus musculus
cctgcatagcattgaacgggcggac

SEQ ID NO: 423292 - DNA, 25 bp, Mus musculus
cctgcatcaattgagcgagttcaag

SEQ ID NO: 423293 - DNA, 25 bp, Mus musculus
cctgcatcagtggaccaagggtggc

SEQ ID NO: 423294 - DNA, 25 bp, Mus musculus
cctgcatctgtaaggtgtgcggcaa

SEQ ID NO: 423295 - DNA, 25 bp, Mus musculus
cctgcatgagggaagagccatctct

SEQ ID NO: 423296 - DNA, 25 bp, Mus musculus
cctgcatggaatgtgctagtgtgtt

SEQ ID NO: 423297 - DNA, 25 bp, Mus musculus
cctgcatgtgtggtgtggacgcttc

SEQ ID NO: 423298 - DNA, 25 bp, Mus musculus
cctgcattcaaggttagagagggca

SEQ ID NO: 423299 - DNA, 25 bp, Mus musculus
cctgcatttatgtgcatcatgtaca

SEQ ID NO: 423300 - DNA, 25 bp, Mus musculus
cctgccaagatagaacggcttcgtg

SEQ ID NO: 423301 - DNA, 25 bp, Mus musculus
cctgccaatgccatggacctgtctt

SEQ ID NO: 423302 - DNA, 25 bp, Mus musculus
cctgccagaaaggtgggactcatac

SEQ ID NO: 423303 - DNA, 25 bp, Mus musculus
cctgccagagccacggaggtgtgga

SEQ ID NO: 423304 - DNA, 25 bp, Mus musculus
cctgccagcgggttttcagcttctc

SEQ ID NO: 423305 - DNA, 25 bp, Mus musculus
cctgccaggtggacacatcagctgt

SEQ ID NO: 423306 - DNA, 25 bp, Mus musculus
cctgccagtccttggaaaccatggg

SEQ ID NO: 423307 - DNA, 25 bp, Mus musculus
cctgccattcagacatggtcaattc

SEQ ID NO: 423308 - DNA, 25 bp, Mus musculus
cctgccatttggaggagcgggaata

SEQ ID NO: 423309 - DNA, 25 bp, Mus musculus
cctgcccacctgtgggaactgggca

SEQ ID NO: 423310 - DNA, 25 bp, Mus musculus
cctgcccagcctaggtagtaagggt

SEQ ID NO: 423311 - DNA, 25 bp, Mus musculus
cctgccccggctctctttgtaggag

SEQ ID NO: 423312 - DNA, 25 bp, Mus musculus
cctgcccgtaagaagccatggtggt

SEQ ID NO: 423313 - DNA, 25 bp, Mus musculus
cctgccctgggctgaaggtgcaaaa

SEQ ID NO: 423314 - DNA, 25 bp, Mus musculus
cctgccctgggtgatctggagactc

SEQ ID NO: 423315 - DNA, 25 bp, Mus musculus
cctgccctgtaagggttgtgaggaa

SEQ ID NO: 423316 - DNA, 25 bp, Mus musculus
cctgccctttaatgcgcccaagtga

SEQ ID NO: 423317 - DNA, 25 bp, Mus musculus
cctgccgacaccagagtcgctgaga

SEQ ID NO: 423318 - DNA, 25 bp, Mus musculus
cctgccgagatggagtaccttaact

SEQ ID NO: 423319 - DNA, 25 bp, Mus musculus
cctgccgatatagcagagaaaagca

SEQ ID NO: 423320 - DNA, 25 bp, Mus musculus
cctgccgggcttgtggtgacgtcat

SEQ ID NO: 423321 - DNA, 25 bp, Mus musculus
cctgccggtgcatgtctaaactgga

SEQ ID NO: 423322 - DNA, 25 bp, Mus musculus
cctgcctagggaagactggtcagaa

SEQ ID NO: 423323 - DNA, 25 bp, Mus musculus
cctgcctatgaggtagtgaagggaa

SEQ ID NO: 423324 - DNA, 25 bp, Mus musculus
cctgcctcaggaacaggagagaaga

SEQ ID NO: 423325 - DNA, 25 bp, Mus musculus
cctgcctccagcaaaaccggaagtg

SEQ ID NO: 423326 - DNA, 25 bp, Mus musculus
cctgcctcgagtccggcctttttat

SEQ ID NO: 423327 - DNA, 25 bp, Mus musculus
cctgcctcggtggacaaagaagatg

SEQ ID NO: 423328 - DNA, 25 bp, Mus musculus
cctgcctcgttggtggccactggaa

SEQ ID NO: 423329 - DNA, 25 bp, Mus musculus
cctgcctgcccttgcgattaataaa

SEQ ID NO: 423330 - DNA, 25 bp, Mus musculus
cctgcctgcgaagatgttggaaata

SEQ ID NO: 423331 - DNA, 25 bp, Mus musculus
cctgcctggctcttggttagaagac

SEQ ID NO: 423332 - DNA, 25 bp, Mus musculus
cctgcctgggcaagctgcatgggct

SEQ ID NO: 423333 - DNA, 25 bp, Mus musculus
cctgccttagtagtgggacagacca

SEQ ID NO: 423334 - DNA, 25 bp, Mus musculus
cctgccttgcggctcagcgagtagt

SEQ ID NO: 423335 - DNA, 25 bp, Mus musculus
cctgcctttgggatgagctggtagt

SEQ ID NO: 423336 - DNA, 25 bp, Mus musculus
cctgcgaaggcacatgagaatacac

SEQ ID NO: 423337 - DNA, 25 bp, Mus musculus
cctgcgaaggcaccaggaaaatgtc

SEQ ID NO: 423338 - DNA, 25 bp, Mus musculus
cctgcgaagggaggtgacaaagcct

SEQ ID NO: 423339 - DNA, 25 bp, Mus musculus
cctgcgaatcctcttggcattgaaa

SEQ ID NO: 423340 - DNA, 25 bp, Mus musculus
cctgcgaccggtggagttcaagact

SEQ ID NO: 423341 - DNA, 25 bp, Mus musculus
cctgcgacgacgacatagatggcga

SEQ ID NO: 423342 - DNA, 25 bp, Mus musculus
cctgcgagaatgctggataaatgcc

SEQ ID NO: 423343 - DNA, 25 bp, Mus musculus
cctgcgagatgctaggcgtggacaa

SEQ ID NO: 423344 - DNA, 25 bp, Mus musculus
cctgcgagcattggaagggtccttc

SEQ ID NO: 423345 - DNA, 25 bp, Mus musculus
cctgcgatgagctgccggtctatga

SEQ ID NO: 423346 - DNA, 25 bp, Mus musculus
cctgcgcagctgctaagaagcctgt

SEQ ID NO: 423347 - DNA, 25 bp, Mus musculus
cctgcgcagctgctcggttcagaga

SEQ ID NO: 423348 - DNA, 25 bp, Mus musculus
cctgcgcagtggaggtcacctattt

SEQ ID NO: 423349 - DNA, 25 bp, Mus musculus
cctgcggaggagtcgtcgcgtcaaa

SEQ ID NO: 423350 - DNA, 25 bp, Mus musculus
cctgcggaggcaaaaaactgctcaa

SEQ ID NO: 423351 - DNA, 25 bp, Mus musculus
cctgcggcggcattttttagtcact

SEQ ID NO: 423352 - DNA, 25 bp, Mus musculus
cctgcggcgttatggacgagacacc

SEQ ID NO: 423353 - DNA, 25 bp, Mus musculus
cctgcggctgcttttggacacgacc

SEQ ID NO: 423354 - DNA, 25 bp, Mus musculus
cctgcgggacgatgggatcatgtac

SEQ ID NO: 423355 - DNA, 25 bp, Mus musculus
cctgcgggctgtggaacggattcct

SEQ ID NO: 423356 - DNA, 25 bp, Mus musculus
cctgcggtccgatgagctcagactc

SEQ ID NO: 423357 - DNA, 25 bp, Mus musculus
cctgcggtccttccgagagagagct

SEQ ID NO: 423358 - DNA, 25 bp, Mus musculus
cctgcggtggcaagcgtctgctctt

SEQ ID NO: 423359 - DNA, 25 bp, Mus musculus
cctgcgtagtgatttgtgaacttgg

SEQ ID NO: 423360 - DNA, 25 bp, Mus musculus
cctgcgtcggagtttggaagccatc

SEQ ID NO: 423361 - DNA, 25 bp, Mus musculus
cctgcgtgaggagtcattccggcgc

SEQ ID NO: 423362 - DNA, 25 bp, Mus musculus
cctgcgtgatctttattacctgggc

SEQ ID NO: 423363 - DNA, 25 bp, Mus musculus
cctgcgttgcaagaggacagtgctg

SEQ ID NO: 423364 - DNA, 25 bp, Mus musculus
cctgctaagagggatgcatggctgc

SEQ ID NO: 423365 - DNA, 25 bp, Mus musculus
cctgctaagtcagagccttgggctg

SEQ ID NO: 423366 - DNA, 25 bp, Mus musculus
cctgctacaatcagtggctgggaac

SEQ ID NO: 423367 - DNA, 25 bp, Mus musculus
cctgctacgtgcagagaccctgtct

SEQ ID NO: 423368 - DNA, 25 bp, Mus musculus
cctgctaggctgaaacatactatga

SEQ ID NO: 423369 - DNA, 25 bp, Mus musculus
cctgctagggccctgagtgaagaca

SEQ ID NO: 423370 - DNA, 25 bp, Mus musculus
cctgctcagtgacatatcacgttct

SEQ ID NO: 423371 - DNA, 25 bp, Mus musculus
cctgctcattgaggccatgctatag

SEQ ID NO: 423372 - DNA, 25 bp, Mus musculus
cctgctccagcgatcagagcgtcaa

SEQ ID NO: 423373 - DNA, 25 bp, Mus musculus
cctgctcccgaagagtaaagcttgc

SEQ ID NO: 423374 - DNA, 25 bp, Mus musculus
cctgctcctggaaaagaatgtaaac

SEQ ID NO: 423375 - DNA, 25 bp, Mus musculus
cctgctcgctgaaacagttgtatgc

SEQ ID NO: 423376 - DNA, 25 bp, Mus musculus
cctgctcggcagacggagatatcta

SEQ ID NO: 423377 - DNA, 25 bp, Mus musculus
cctgctctacaagatcgttcgcggg

SEQ ID NO: 423378 - DNA, 25 bp, Mus musculus
cctgctctaggatatgatgacatgc

SEQ ID NO: 423379 - DNA, 25 bp, Mus musculus
cctgctctgaaattggaaggatggg

SEQ ID NO: 423380 - DNA, 25 bp, Mus musculus
cctgctctgaattaggaatgtgggc

SEQ ID NO: 423381 - DNA, 25 bp, Mus musculus
cctgctctgatgctggcatttcatg

SEQ ID NO: 423382 - DNA, 25 bp, Mus musculus
cctgctgaaaacaggcgtaactgta

SEQ ID NO: 423383 - DNA, 25 bp, Mus musculus
cctgctgacagcctaagaagtgatg

SEQ ID NO: 423384 - DNA, 25 bp, Mus musculus
cctgctgacatgtgggtggctgcca

SEQ ID NO: 423385 - DNA, 25 bp, Mus musculus
cctgctgagatgtggtgaacagtct

SEQ ID NO: 423386 - DNA, 25 bp, Mus musculus
cctgctgagcttgtgcactgtgtca

SEQ ID NO: 423387 - DNA, 25 bp, Mus musculus
cctgctgagttagatgacctccaag

SEQ ID NO: 423388 - DNA, 25 bp, Mus musculus
cctgctgatgaacaactagatgggt

SEQ ID NO: 423389 - DNA, 25 bp, Mus musculus
cctgctgctgaagtttcactttttg

SEQ ID NO: 423390 - DNA, 25 bp, Mus musculus
cctgctggaagggtatgacaacaaa

SEQ ID NO: 423391 - DNA, 25 bp, Mus musculus
cctgctggacttgtcagacctggga

SEQ ID NO: 423392 - DNA, 25 bp, Mus musculus
cctgctggccagacttcagagcaaa

SEQ ID NO: 423393 - DNA, 25 bp, Mus musculus
cctgctggcttttaggaataggacc

SEQ ID NO: 423394 - DNA, 25 bp, Mus musculus
cctgctgggcgcaaagtgggtctca

SEQ ID NO: 423395 - DNA, 25 bp, Mus musculus
cctgctggtagctgccttcttggag

SEQ ID NO: 423396 - DNA, 25 bp, Mus musculus
cctgctggttggatgtccagggtca

SEQ ID NO: 423397 - DNA, 25 bp, Mus musculus
cctgctgtggaggtgcctcagtacg

SEQ ID NO: 423398 - DNA, 25 bp, Mus musculus
cctgctgtgggcaaatgataagttg

SEQ ID NO: 423399 - DNA, 25 bp, Mus musculus
cctgcttcagcagagtactggaatc

SEQ ID NO: 423400 - DNA, 25 bp, Mus musculus
cctgcttccacacttcaagggtact

SEQ ID NO: 423401 - DNA, 25 bp, Mus musculus
cctgcttcgccggacttgagtcttt

SEQ ID NO: 423402 - DNA, 25 bp, Mus musculus
cctgcttggctcagtgttttcatga

SEQ ID NO: 423403 - DNA, 25 bp, Mus musculus
cctgcttgtgactcgctctgtctgt

SEQ ID NO: 423404 - DNA, 25 bp, Mus musculus
cctgcttgttttgtgcagtgttgta

SEQ ID NO: 423405 - DNA, 25 bp, Mus musculus
cctgctttaatggagggacctgctt

SEQ ID NO: 423406 - DNA, 25 bp, Mus musculus
cctgctttcttctccttcaaacaat

SEQ ID NO: 423407 - DNA, 25 bp, Mus musculus
cctgctttttgcgaagggcttccct

SEQ ID NO: 423408 - DNA, 25 bp, Mus musculus
cctggaaaagtctaagccttctgga

SEQ ID NO: 423409 - DNA, 25 bp, Mus musculus
cctggaaagggacaggttcatgctt

SEQ ID NO: 423410 - DNA, 25 bp, Mus musculus
cctggaaataggcttcaacttggtc

SEQ ID NO: 423411 - DNA, 25 bp, Mus musculus
cctggaaatcagatgaggcacctca

SEQ ID NO: 423412 - DNA, 25 bp, Mus musculus
cctggaaatcctggcagaagtgaga

SEQ ID NO: 423413 - DNA, 25 bp, Mus musculus
cctggaacaaatgggctcactggcg

SEQ ID NO: 423414 - DNA, 25 bp, Mus musculus
cctggaacagtcttggctcatgcct

SEQ ID NO: 423415 - DNA, 25 bp, Mus musculus
cctggaacatgtcctgtactgtaag

SEQ ID NO: 423416 - DNA, 25 bp, Mus musculus
cctggaacctgagaagtgggcaaga

SEQ ID NO: 423417 - DNA, 25 bp, Mus musculus
cctggaactcagattcttgtgcttc

SEQ ID NO: 423418 - DNA, 25 bp, Mus musculus
cctggaactgctacatgtgcgggca

SEQ ID NO: 423419 - DNA, 25 bp, Mus musculus
cctggaagaaagaatgcaaagtccc

SEQ ID NO: 423420 - DNA, 25 bp, Mus musculus
cctggaagagaacatcttgctgctg

SEQ ID NO: 423421 - DNA, 25 bp, Mus musculus
cctggaagagctcggtgggtgcagc

SEQ ID NO: 423422 - DNA, 25 bp, Mus musculus
cctggaagaggagatagagcgcaac

SEQ ID NO: 423423 - DNA, 25 bp, Mus musculus
cctggaagagggatgggaacaacct

SEQ ID NO: 423424 - DNA, 25 bp, Mus musculus
cctggaagcgcgagccgtgcgcttt

SEQ ID NO: 423425 - DNA, 25 bp, Mus musculus
cctggaaggaaactaacatggcccg

SEQ ID NO: 423426 - DNA, 25 bp, Mus musculus
cctggaaggaacaacaagaagtagc

SEQ ID NO: 423427 - DNA, 25 bp, Mus musculus
cctggaaggccaccaaggacaatag

SEQ ID NO: 423428 - DNA, 25 bp, Mus musculus
cctggaaggtcgagagtgtataccc

SEQ ID NO: 423429 - DNA, 25 bp, Mus musculus
cctggaaggtctgtcagtgtactgg

SEQ ID NO: 423430 - DNA, 25 bp, Mus musculus
cctggaagtacaaggccaagaactc

SEQ ID NO: 423431 - DNA, 25 bp, Mus musculus
cctggaagtgcaccaaggacgagat

SEQ ID NO: 423432 - DNA, 25 bp, Mus musculus
cctggaataaggatctcggaatgga

SEQ ID NO: 423433 - DNA, 25 bp, Mus musculus
cctggaataccagaagaggagaagt

SEQ ID NO: 423434 - DNA, 25 bp, Mus musculus
cctggaattggttgcatttagtact

SEQ ID NO: 423435 - DNA, 25 bp, Mus musculus
cctggacaacagcaatgagaactcg

SEQ ID NO: 423436 - DNA, 25 bp, Mus musculus
cctggacaagccgagatgcagagca

SEQ ID NO: 423437 - DNA, 25 bp, Mus musculus
cctggacaaggagtcccagcaacgt

SEQ ID NO: 423438 - DNA, 25 bp, Mus musculus
cctggacagatacttggtgaacact

SEQ ID NO: 423439 - DNA, 25 bp, Mus musculus
cctggacagcgaactggaagggatc

SEQ ID NO: 423440 - DNA, 25 bp, Mus musculus
cctggacagggtgtgcgagtcaata

SEQ ID NO: 423441 - DNA, 25 bp, Mus musculus
cctggacatcgcacaagaggcatac

SEQ ID NO: 423442 - DNA, 25 bp, Mus musculus
cctggaccatgatttgctaagagct

SEQ ID NO: 423443 - DNA, 25 bp, Mus musculus
cctggaccattgagggaaataaact

SEQ ID NO: 423444 - DNA, 25 bp, Mus musculus
cctggacccagaaggaatggctaaa

SEQ ID NO: 423445 - DNA, 25 bp, Mus musculus
cctggaccctgtcagagtggcttct

SEQ ID NO: 423446 - DNA, 25 bp, Mus musculus
cctggacccttgtggagaacttgca

SEQ ID NO: 423447 - DNA, 25 bp, Mus musculus
cctggacctccttgggatacgggag

SEQ ID NO: 423448 - DNA, 25 bp, Mus musculus
cctggacctgcgacgtgagatcatt

SEQ ID NO: 423449 - DNA, 25 bp, Mus musculus
cctggacgaagctcaacagattcct

SEQ ID NO: 423450 - DNA, 25 bp, Mus musculus
cctggacgcctgtgagcaagataaa

SEQ ID NO: 423451 - DNA, 25 bp, Mus musculus
cctggacggagtggttcgacaacga

SEQ ID NO: 423452 - DNA, 25 bp, Mus musculus
cctggacggcctcaaaaagctgggc

SEQ ID NO: 423453 - DNA, 25 bp, Mus musculus
cctggactacattctgggaggctgc

SEQ ID NO: 423454 - DNA, 25 bp, Mus musculus
cctggactattgactggcctaggaa

SEQ ID NO: 423455 - DNA, 25 bp, Mus musculus
cctggactgttcttatgtgggcccc

SEQ ID NO: 423456 - DNA, 25 bp, Mus musculus
cctggacttccctgaaattcactag

SEQ ID NO: 423457 - DNA, 25 bp, Mus musculus
cctggacttctgcataaaaaggagc

SEQ ID NO: 423458 - DNA, 25 bp, Mus musculus
cctggacttggagtgtgtggaccct

SEQ ID NO: 423459 - DNA, 25 bp, Mus musculus
cctggagaaaagtacagcgggcttc

SEQ ID NO: 423460 - DNA, 25 bp, Mus musculus
cctggagaacggacagtccctgagc

SEQ ID NO: 423461 - DNA, 25 bp, Mus musculus
cctggagaagctgaacatgcaagcc

SEQ ID NO: 423462 - DNA, 25 bp, Mus musculus
cctggagaccgtagaccctggtggt

SEQ ID NO: 423463 - DNA, 25 bp, Mus musculus
cctggagagaaggaagtagctaaaa

SEQ ID NO: 423464 - DNA, 25 bp, Mus musculus
cctggagagatccttggagagctac

SEQ ID NO: 423465 - DNA, 25 bp, Mus musculus
cctggagagcaggagactgagaccc

SEQ ID NO: 423466 - DNA, 25 bp, Mus musculus
cctggagagcattgccgtggccaaa

SEQ ID NO: 423467 - DNA, 25 bp, Mus musculus
cctggagagttaggtatcagctgcc

SEQ ID NO: 423468 - DNA, 25 bp, Mus musculus
cctggagatagagctacagtccctc

SEQ ID NO: 423469 - DNA, 25 bp, Mus musculus
cctggagattacaaagacggctgca

SEQ ID NO: 423470 - DNA, 25 bp, Mus musculus
cctggagcaaactcaagtcgggtcg

SEQ ID NO: 423471 - DNA, 25 bp, Mus musculus
cctggagcaacgctgaagagctaag

SEQ ID NO: 423472 - DNA, 25 bp, Mus musculus
cctggagcaagatgttgagcggcat

SEQ ID NO: 423473 - DNA, 25 bp, Mus musculus
cctggagcagcaggacgacctgtac

SEQ ID NO: 423474 - DNA, 25 bp, Mus musculus
cctggagcctacgtcgtcgggagac

SEQ ID NO: 423475 - DNA, 25 bp, Mus musculus
cctggagcgctttgtggccatgaac

SEQ ID NO: 423476 - DNA, 25 bp, Mus musculus
cctggagctgggaaatctgatgaca

SEQ ID NO: 423477 - DNA, 25 bp, Mus musculus
cctggagcttgttgctgttctcttg

SEQ ID NO: 423478 - DNA, 25 bp, Mus musculus
cctggagctttgacctctggaggct

SEQ ID NO: 423479 - DNA, 25 bp, Mus musculus
cctggaggaagccaacaaggtgttc

SEQ ID NO: 423480 - DNA, 25 bp, Mus musculus
cctggaggaaggatcaagttggtac

SEQ ID NO: 423481 - DNA, 25 bp, Mus musculus
cctggaggagatgagttggtaaata

SEQ ID NO: 423482 - DNA, 25 bp, Mus musculus
cctggaggaggaaagacgaatcaac

SEQ ID NO: 423483 - DNA, 25 bp, Mus musculus
cctggaggaggaacgaattctggct

SEQ ID NO: 423484 - DNA, 25 bp, Mus musculus
cctggaggataattttagttcagcc

SEQ ID NO: 423485 - DNA, 25 bp, Mus musculus
cctggaggatggaagcactgactat

SEQ ID NO: 423486 - DNA, 25 bp, Mus musculus
cctggaggatttcccgatggatgct

SEQ ID NO: 423487 - DNA, 25 bp, Mus musculus
cctggaggcggtgaacatcaaggca

SEQ ID NO: 423488 - DNA, 25 bp, Mus musculus
cctggagtacagcaagcgtcgaacc

SEQ ID NO: 423489 - DNA, 25 bp, Mus musculus
cctggagtatctagcacctggagtt

SEQ ID NO: 423490 - DNA, 25 bp, Mus musculus
cctggagtcaatcgcaatggcttca

SEQ ID NO: 423491 - DNA, 25 bp, Mus musculus
cctggagtcattaagtggttctgcc

SEQ ID NO: 423492 - DNA, 25 bp, Mus musculus
cctggagtccagtcgccaaagcagg

SEQ ID NO: 423493 - DNA, 25 bp, Mus musculus
cctggagtgcgacatggataacatc

SEQ ID NO: 423494 - DNA, 25 bp, Mus musculus
cctggagtggtggtcaacctcccta

SEQ ID NO: 423495 - DNA, 25 bp, Mus musculus
cctggagtttgaattccgacctgac

SEQ ID NO: 423496 - DNA, 25 bp, Mus musculus
cctggataaccaaagacattcattt

SEQ ID NO: 423497 - DNA, 25 bp, Mus musculus
cctggataaggagtatgatgagtgc

SEQ ID NO: 423498 - DNA, 25 bp, Mus musculus
cctggatacagagcggagccatcat

SEQ ID NO: 423499 - DNA, 25 bp, Mus musculus
cctggatactagtcaagccgtaaga

SEQ ID NO: 423500 - DNA, 25 bp, Mus musculus
cctggatattagatggacgaagcct

SEQ ID NO: 423501 - DNA, 25 bp, Mus musculus
cctggatcaaccagtcaccatgatt

SEQ ID NO: 423502 - DNA, 25 bp, Mus musculus
cctggatccctaaggaggaggcgct

SEQ ID NO: 423503 - DNA, 25 bp, Mus musculus
cctggatcggaggagaaacgtgttc

SEQ ID NO: 423504 - DNA, 25 bp, Mus musculus
cctggatgcccagaatatcgtagct

SEQ ID NO: 423505 - DNA, 25 bp, Mus musculus
cctggatgccgagtggaggaacctc

SEQ ID NO: 423506 - DNA, 25 bp, Mus musculus
cctggatgcttgtttccactggtat

SEQ ID NO: 423507 - DNA, 25 bp, Mus musculus
cctggatgggatctgcctcagcgaa

SEQ ID NO: 423508 - DNA, 25 bp, Mus musculus
cctggatggtacgaagctggtctct

SEQ ID NO: 423509 - DNA, 25 bp, Mus musculus
cctggatgtcatgaaagagcgttcc

SEQ ID NO: 423510 - DNA, 25 bp, Mus musculus
cctggattatatcatgggtggctgc

SEQ ID NO: 423511 - DNA, 25 bp, Mus musculus
cctggattccagagagattggagat

SEQ ID NO: 423512 - DNA, 25 bp, Mus musculus
cctggattccgatattgtgtggcca

SEQ ID NO: 423513 - DNA, 25 bp, Mus musculus
cctggattgggctttggaacttctg

SEQ ID NO: 423514 - DNA, 25 bp, Mus musculus
cctggatttaactggcgactatttt

SEQ ID NO: 423515 - DNA, 25 bp, Mus musculus
cctggatttggctatggcattgctg

SEQ ID NO: 423516 - DNA, 25 bp, Mus musculus
cctggcaagatcaacaacgtggagc

SEQ ID NO: 423517 - DNA, 25 bp, Mus musculus
cctggcacatgggagacgttctggt

SEQ ID NO: 423518 - DNA, 25 bp, Mus musculus
cctggcaccgggtctaaactagaat

SEQ ID NO: 423519 - DNA, 25 bp, Mus musculus
cctggcactggagacaaagggtcaa

SEQ ID NO: 423520 - DNA, 25 bp, Mus musculus
cctggcagagcgagttggaatcatc

SEQ ID NO: 423521 - DNA, 25 bp, Mus musculus
cctggcagagggatggaagcaacca

SEQ ID NO: 423522 - DNA, 25 bp, Mus musculus
cctggcagcggagttggagactctc

SEQ ID NO: 423523 - DNA, 25 bp, Mus musculus
cctggcagcggttcctagctgggca

SEQ ID NO: 423524 - DNA, 25 bp, Mus musculus
cctggcaggctgtagtgtgctagaa

SEQ ID NO: 423525 - DNA, 25 bp, Mus musculus
cctggcaggtcatcaaaggcgttct

SEQ ID NO: 423526 - DNA, 25 bp, Mus musculus
cctggcagtatcacataaaactgga

SEQ ID NO: 423527 - DNA, 25 bp, Mus musculus
cctggcatcggcatcgaggactctg

SEQ ID NO: 423528 - DNA, 25 bp, Mus musculus
cctggcatctgcagtggccgcgatg

SEQ ID NO: 423529 - DNA, 25 bp, Mus musculus
cctggcatgagaacagacatcctga

SEQ ID NO: 423530 - DNA, 25 bp, Mus musculus
cctggccaaactgaagccggagaag

SEQ ID NO: 423531 - DNA, 25 bp, Mus musculus
cctggccaaagtgacaagaaagctg

SEQ ID NO: 423532 - DNA, 25 bp, Mus musculus
cctggccagtctactttggagctca

SEQ ID NO: 423533 - DNA, 25 bp, Mus musculus
cctggccgagactagcttcctgaaa

SEQ ID NO: 423534 - DNA, 25 bp, Mus musculus
cctggccgctttctatggtgatgca

SEQ ID NO: 423535 - DNA, 25 bp, Mus musculus
cctggcctccgggtaactagtgctt

SEQ ID NO: 423536 - DNA, 25 bp, Mus musculus
cctggcctgagctatctgggacttt

SEQ ID NO: 423537 - DNA, 25 bp, Mus musculus
cctggcctgcttgtgaggcgttttc

SEQ ID NO: 423538 - DNA, 25 bp, Mus musculus
cctggcctggattattgggcgagtc

SEQ ID NO: 423539 - DNA, 25 bp, Mus musculus
cctggccttggtgattgctgtcagc

SEQ ID NO: 423540 - DNA, 25 bp, Mus musculus
cctggcgcatgtggtattcgggctt

SEQ ID NO: 423541 - DNA, 25 bp, Mus musculus
cctggcggctacagtgaaggcagca

SEQ ID NO: 423542 - DNA, 25 bp, Mus musculus
cctggcgggcatatgacacggtttc

SEQ ID NO: 423543 - DNA, 25 bp, Mus musculus
cctggcgggccgaaaagttctgctc

SEQ ID NO: 423544 - DNA, 25 bp, Mus musculus
cctggcggtgcccatcattatcaag

SEQ ID NO: 423545 - DNA, 25 bp, Mus musculus
cctggcgttggaagtggctcagcac

SEQ ID NO: 423546 - DNA, 25 bp, Mus musculus
cctggctacgtcgaaaatgtggcct

SEQ ID NO: 423547 - DNA, 25 bp, Mus musculus
cctggctagagcagactctgtggga

SEQ ID NO: 423548 - DNA, 25 bp, Mus musculus
cctggctagcaagcagcctgcggtt

SEQ ID NO: 423549 - DNA, 25 bp, Mus musculus
cctggctcctctaggtgcaggcaga

SEQ ID NO: 423550 - DNA, 25 bp, Mus musculus
cctggctgattaaaagaaattactc

SEQ ID NO: 423551 - DNA, 25 bp, Mus musculus
cctggctgccagcaagatgagctga

SEQ ID NO: 423552 - DNA, 25 bp, Mus musculus
cctggctgccatgtcgagaccatat

SEQ ID NO: 423553 - DNA, 25 bp, Mus musculus
cctggctgctttcaggtaagtcctc

SEQ ID NO: 423554 - DNA, 25 bp, Mus musculus
cctggctggctccaaggtgaaataa

SEQ ID NO: 423555 - DNA, 25 bp, Mus musculus
cctggctgggtacattggctcattt

SEQ ID NO: 423556 - DNA, 25 bp, Mus musculus
cctggctgggttggtagacctcgct

SEQ ID NO: 423557 - DNA, 25 bp, Mus musculus
cctggctgtcccctaacttgggaag

SEQ ID NO: 423558 - DNA, 25 bp, Mus musculus
cctggcttagccgagtgactggact

SEQ ID NO: 423559 - DNA, 25 bp, Mus musculus
cctggcttccacaaacgaggcactg

SEQ ID NO: 423560 - DNA, 25 bp, Mus musculus
cctggcttgggaaggcccgagtcca

SEQ ID NO: 423561 - DNA, 25 bp, Mus musculus
cctggctttctggtattggcgtgag

SEQ ID NO: 423562 - DNA, 25 bp, Mus musculus
cctggctttgagctaggagctgaca

SEQ ID NO: 423563 - DNA, 25 bp, Mus musculus
cctgggaaaggccacactgtggctc

SEQ ID NO: 423564 - DNA, 25 bp, Mus musculus
cctgggaaccaaggcagtctttgta

SEQ ID NO: 423565 - DNA, 25 bp, Mus musculus
cctgggaaccggtcatcagcctttg

SEQ ID NO: 423566 - DNA, 25 bp, Mus musculus
cctgggaactgagtatgtacatcgc

SEQ ID NO: 423567 - DNA, 25 bp, Mus musculus
cctgggaacttcagaggtggcgcca

SEQ ID NO: 423568 - DNA, 25 bp, Mus musculus
cctgggaagcccaaaactggcaaga

SEQ ID NO: 423569 - DNA, 25 bp, Mus musculus
cctgggaagcgttcagccatctgga

SEQ ID NO: 423570 - DNA, 25 bp, Mus musculus
cctgggaatcctgcatggacgctga

SEQ ID NO: 423571 - DNA, 25 bp, Mus musculus
cctgggaatgatgctgaagacctac

SEQ ID NO: 423572 - DNA, 25 bp, Mus musculus
cctgggacccagtaagagaagagac

SEQ ID NO: 423573 - DNA, 25 bp, Mus musculus
cctgggacccatggtcttgcgcatg

SEQ ID NO: 423574 - DNA, 25 bp, Mus musculus
cctgggaccgcacactgattgagaa

SEQ ID NO: 423575 - DNA, 25 bp, Mus musculus
cctgggactaactctgggacaagac

SEQ ID NO: 423576 - DNA, 25 bp, Mus musculus
cctgggactcgtcaaggaactttga

SEQ ID NO: 423577 - DNA, 25 bp, Mus musculus
cctgggactggctgcggttaccctg

SEQ ID NO: 423578 - DNA, 25 bp, Mus musculus
cctgggactgggacaatgacaccac

SEQ ID NO: 423579 - DNA, 25 bp, Mus musculus
cctgggactgtgatcacggagcact

SEQ ID NO: 423580 - DNA, 25 bp, Mus musculus
cctgggactttgactcgtgggcaca

SEQ ID NO: 423581 - DNA, 25 bp, Mus musculus
cctgggagaattaccgaagcactac

SEQ ID NO: 423582 - DNA, 25 bp, Mus musculus
cctgggagcatgatcgtggacaagc

SEQ ID NO: 423583 - DNA, 25 bp, Mus musculus
cctgggagctctcatgtggttctct

SEQ ID NO: 423584 - DNA, 25 bp, Mus musculus
cctgggaggacagaaccctgtagac

SEQ ID NO: 423585 - DNA, 25 bp, Mus musculus
cctgggaggagcacatcttttctgc

SEQ ID NO: 423586 - DNA, 25 bp, Mus musculus
cctgggaggcatcctttgtggcact

SEQ ID NO: 423587 - DNA, 25 bp, Mus musculus
cctgggaggcctgaataggacgttc

SEQ ID NO: 423588 - DNA, 25 bp, Mus musculus
cctgggatgagatgccctgacgatc

SEQ ID NO: 423589 - DNA, 25 bp, Mus musculus
cctgggcaaagaggaggtcatagca

SEQ ID NO: 423590 - DNA, 25 bp, Mus musculus
cctgggcaacattggcagtggactt

SEQ ID NO: 423591 - DNA, 25 bp, Mus musculus
cctgggcaagatatctcgggaacct

SEQ ID NO: 423592 - DNA, 25 bp, Mus musculus
cctgggcaagctgcatgggctagct

SEQ ID NO: 423593 - DNA, 25 bp, Mus musculus
cctgggcaagtcagaacagtgatct

SEQ ID NO: 423594 - DNA, 25 bp, Mus musculus
cctgggcactgtgaatgaataagcc

SEQ ID NO: 423595 - DNA, 25 bp, Mus musculus
cctgggcagacttctactgggatat

SEQ ID NO: 423596 - DNA, 25 bp, Mus musculus
cctgggcagcggagagtatacagcc

SEQ ID NO: 423597 - DNA, 25 bp, Mus musculus
cctgggcaggtggtatcactaattc

SEQ ID NO: 423598 - DNA, 25 bp, Mus musculus
cctgggcatccatcaactgccagta

SEQ ID NO: 423599 - DNA, 25 bp, Mus musculus
cctgggccagatcgtaccgtggttc

SEQ ID NO: 423600 - DNA, 25 bp, Mus musculus
cctgggccagcatctgactacctgt

SEQ ID NO: 423601 - DNA, 25 bp, Mus musculus
cctgggccagttgcattttggcttg

SEQ ID NO: 423602 - DNA, 25 bp, Mus musculus
cctgggcgaaaagcataagcgtagc

SEQ ID NO: 423603 - DNA, 25 bp, Mus musculus
cctgggcgcataccactgagcaaga

SEQ ID NO: 423604 - DNA, 25 bp, Mus musculus
cctgggcgtacctgatggagtgtcc

SEQ ID NO: 423605 - DNA, 25 bp, Mus musculus
cctgggcgtgttaaaatggagcttc

SEQ ID NO: 423606 - DNA, 25 bp, Mus musculus
cctgggctacacgtcggatgagacc

SEQ ID NO: 423607 - DNA, 25 bp, Mus musculus
cctgggctacatggaaagcccatgt

SEQ ID NO: 423608 - DNA, 25 bp, Mus musculus
cctgggctcaagaatccaagagatg

SEQ ID NO: 423609 - DNA, 25 bp, Mus musculus
cctgggctggcttgcttctgaacta

SEQ ID NO: 423610 - DNA, 25 bp, Mus musculus
cctgggcttgtctgtgcatctttaa

SEQ ID NO: 423611 - DNA, 25 bp, Mus musculus
cctgggtacccgagagaataatgca

SEQ ID NO: 423612 - DNA, 25 bp, Mus musculus
cctgggtactgtaggttcactgtgg

SEQ ID NO: 423613 - DNA, 25 bp, Mus musculus
cctgggtccccgtgtatctgtatgt

SEQ ID NO: 423614 - DNA, 25 bp, Mus musculus
cctgggtccgagaaacagtcgcact

SEQ ID NO: 423615 - DNA, 25 bp, Mus musculus
cctgggtccggagagttctgctgat

SEQ ID NO: 423616 - DNA, 25 bp, Mus musculus
cctgggtgaggccttgaagttgagg

SEQ ID NO: 423617 - DNA, 25 bp, Mus musculus
cctgggtgagtggaagccacacaga

SEQ ID NO: 423618 - DNA, 25 bp, Mus musculus
cctgggtggcagatcattagaaaaa

SEQ ID NO: 423619 - DNA, 25 bp, Mus musculus
cctgggtgtagcacatttggagcct

SEQ ID NO: 423620 - DNA, 25 bp, Mus musculus
cctgggtgtctgaatgggcatgcta

SEQ ID NO: 423621 - DNA, 25 bp, Mus musculus
cctgggtgtgtgctaagatgtctta

SEQ ID NO: 423622 - DNA, 25 bp, Mus musculus
cctgggtgtttcctgcagaggccaa

SEQ ID NO: 423623 - DNA, 25 bp, Mus musculus
cctgggttcggattttggcttcaca

SEQ ID NO: 423624 - DNA, 25 bp, Mus musculus
cctgggttgacctaatgattgcctt

SEQ ID NO: 423625 - DNA, 25 bp, Mus musculus
cctggtaacgcgagaaagatggaca

SEQ ID NO: 423626 - DNA, 25 bp, Mus musculus
cctggtaacgtctctgctgctgcta

SEQ ID NO: 423627 - DNA, 25 bp, Mus musculus
cctggtacaggaggtgtttcgttcg

SEQ ID NO: 423628 - DNA, 25 bp, Mus musculus
cctggtagccccagatggatcatat

SEQ ID NO: 423629 - DNA, 25 bp, Mus musculus
cctggtaggctgagacacagaacag

SEQ ID NO: 423630 - DNA, 25 bp, Mus musculus
cctggtagtcatactaaaaggtgaa

SEQ ID NO: 423631 - DNA, 25 bp, Mus musculus
cctggtatcattaaagcggctgctc

SEQ ID NO: 423632 - DNA, 25 bp, Mus musculus
cctggtatccaagtcagaagtgctg

SEQ ID NO: 423633 - DNA, 25 bp, Mus musculus
cctggtatccacaggagccattaga

SEQ ID NO: 423634 - DNA, 25 bp, Mus musculus
cctggtcaagacaaattcacgtttg

SEQ ID NO: 423635 - DNA, 25 bp, Mus musculus
cctggtcacagtgtcctgagttgca

SEQ ID NO: 423636 - DNA, 25 bp, Mus musculus
cctggtcacttcttggagcctcctg

SEQ ID NO: 423637 - DNA, 25 bp, Mus musculus
cctggtcagagcaccggaagttcct

SEQ ID NO: 423638 - DNA, 25 bp, Mus musculus
cctggtcagctttatgaaggaggca

SEQ ID NO: 423639 - DNA, 25 bp, Mus musculus
cctggtcaggttgtggcgaaagtcc

SEQ ID NO: 423640 - DNA, 25 bp, Mus musculus
cctggtcatccaccctgaggaggaa

SEQ ID NO: 423641 - DNA, 25 bp, Mus musculus
cctggtcatgagttatgggatgtcc

SEQ ID NO: 423642 - DNA, 25 bp, Mus musculus
cctggtccctgcttgttttgtgcag

SEQ ID NO: 423643 - DNA, 25 bp, Mus musculus
cctggtccgttaagaactgagagtg

SEQ ID NO: 423644 - DNA, 25 bp, Mus musculus
cctggtcctaaagggattatgtgcc

SEQ ID NO: 423645 - DNA, 25 bp, Mus musculus
cctggtccttctacctaggctgggt

SEQ ID NO: 423646 - DNA, 25 bp, Mus musculus
cctggtcgacaagaacagacgtctc

SEQ ID NO: 423647 - DNA, 25 bp, Mus musculus
cctggtctcactgttctaagatgtc

SEQ ID NO: 423648 - DNA, 25 bp, Mus musculus
cctggtctttggaagcaacgacgac

SEQ ID NO: 423649 - DNA, 25 bp, Mus musculus
cctggtgaaagacgccaagatctgt

SEQ ID NO: 423650 - DNA, 25 bp, Mus musculus
cctggtgaagcccagaacttcgagg

SEQ ID NO: 423651 - DNA, 25 bp, Mus musculus
cctggtgaatctgtgctgcacggaa

SEQ ID NO: 423652 - DNA, 25 bp, Mus musculus
cctggtgaccagacaaacggatgca

SEQ ID NO: 423653 - DNA, 25 bp, Mus musculus
cctggtgagaggattgtgtccccaa

SEQ ID NO: 423654 - DNA, 25 bp, Mus musculus
cctggtgaggaaagagtgtgcaaac

SEQ ID NO: 423655 - DNA, 25 bp, Mus musculus
cctggtgatcctgaaaaactaggag

SEQ ID NO: 423656 - DNA, 25 bp, Mus musculus
cctggtgccaacaaagagacggtga

SEQ ID NO: 423657 - DNA, 25 bp, Mus musculus
cctggtgccacatgctgacaactgc

SEQ ID NO: 423658 - DNA, 25 bp, Mus musculus
cctggtgcccagagaccttggtacg

SEQ ID NO: 423659 - DNA, 25 bp, Mus musculus
cctggtgcccgtgatgaatgactgc

SEQ ID NO: 423660 - DNA, 25 bp, Mus musculus
cctggtgcgaagtactgggagaaat

SEQ ID NO: 423661 - DNA, 25 bp, Mus musculus
cctggtgcggtggtcagaaaagacc

SEQ ID NO: 423662 - DNA, 25 bp, Mus musculus
cctggtgctacctacattcggaaga

SEQ ID NO: 423663 - DNA, 25 bp, Mus musculus
cctggtggactcagagaaggatgca

SEQ ID NO: 423664 - DNA, 25 bp, Mus musculus
cctggtggagaaagcattggcctat

SEQ ID NO: 423665 - DNA, 25 bp, Mus musculus
cctggtggccaacagacaaggaagt

SEQ ID NO: 423666 - DNA, 25 bp, Mus musculus
cctggtggccctgaaaaagtttgtg

SEQ ID NO: 423667 - DNA, 25 bp, Mus musculus
cctggtggccgtgaaaatgctccga

SEQ ID NO: 423668 - DNA, 25 bp, Mus musculus
cctggtggcctggagtgatctgact

SEQ ID NO: 423669 - DNA, 25 bp, Mus musculus
cctggtggcgttgctgctcttggca

SEQ ID NO: 423670 - DNA, 25 bp, Mus musculus
cctggtgggccatcgtaagacttct

SEQ ID NO: 423671 - DNA, 25 bp, Mus musculus
cctggtggtcttcaaacaacacggg

SEQ ID NO: 423672 - DNA, 25 bp, Mus musculus
cctggtggtgaaagacccaagcatc

SEQ ID NO: 423673 - DNA, 25 bp, Mus musculus
cctggtgtaccaatagaaggccctc

SEQ ID NO: 423674 - DNA, 25 bp, Mus musculus
cctggtgtgccgaagtgccatagaa

SEQ ID NO: 423675 - DNA, 25 bp, Mus musculus
cctggtgtggaacctaagaggccct

SEQ ID NO: 423676 - DNA, 25 bp, Mus musculus
cctggtgtgggactacagcctgcaa

SEQ ID NO: 423677 - DNA, 25 bp, Mus musculus
cctggtgttgcatgcagagcctgaa

SEQ ID NO: 423678 - DNA, 25 bp, Mus musculus
cctggtgttgtgatgccaggtcact

SEQ ID NO: 423679 - DNA, 25 bp, Mus musculus
cctggtgtttccctgcaagctgcat

SEQ ID NO: 423680 - DNA, 25 bp, Mus musculus
cctggttaactgtggaagagaggcc

SEQ ID NO: 423681 - DNA, 25 bp, Mus musculus
cctggttaagaacaaaatctgatgt

SEQ ID NO: 423682 - DNA, 25 bp, Mus musculus
cctggttacagctccacgataggaa

SEQ ID NO: 423683 - DNA, 25 bp, Mus musculus
cctggttactatggtgaagctagct

SEQ ID NO: 423684 - DNA, 25 bp, Mus musculus
cctggttattgtttgcaagcataag

SEQ ID NO: 423685 - DNA, 25 bp, Mus musculus
cctggttccctaaaggcctcagagc

SEQ ID NO: 423686 - DNA, 25 bp, Mus musculus
cctggttcgggagatatggcactac

SEQ ID NO: 423687 - DNA, 25 bp, Mus musculus
cctggttgcagcgagttgagctctt

SEQ ID NO: 423688 - DNA, 25 bp, Mus musculus
cctggttggctggaaagcaaagaaa

SEQ ID NO: 423689 - DNA, 25 bp, Mus musculus
cctgtaaaagatgcccaagtacgag

SEQ ID NO: 423690 - DNA, 25 bp, Mus musculus
cctgtaagtggcaggaggtgaccca

SEQ ID NO: 423691 - DNA, 25 bp, Mus musculus
cctgtaatgccagcatggagctgtg

SEQ ID NO: 423692 - DNA, 25 bp, Mus musculus
cctgtaattgagtgtgcgcatgcca

SEQ ID NO: 423693 - DNA, 25 bp, Mus musculus
cctgtacaacctgcatgacatgttc

SEQ ID NO: 423694 - DNA, 25 bp, Mus musculus
cctgtacacagatagccttagaatt

SEQ ID NO: 423695 - DNA, 25 bp, Mus musculus
cctgtacagggcaaccaaagtgata

SEQ ID NO: 423696 - DNA, 25 bp, Mus musculus
cctgtaccgtagtcaagtggagcca

SEQ ID NO: 423697 - DNA, 25 bp, Mus musculus
cctgtacctaggaatgaatgagcga

SEQ ID NO: 423698 - DNA, 25 bp, Mus musculus
cctgtactaggaaaggatggagtcc

SEQ ID NO: 423699 - DNA, 25 bp, Mus musculus
cctgtactgctattctcacgtggac

SEQ ID NO: 423700 - DNA, 25 bp, Mus musculus
cctgtagaacctgtgagatcattgc

SEQ ID NO: 423701 - DNA, 25 bp, Mus musculus
cctgtagattggctttagtgtgccc

SEQ ID NO: 423702 - DNA, 25 bp, Mus musculus
cctgtagccctcaataaaggcagct

SEQ ID NO: 423703 - DNA, 25 bp, Mus musculus
cctgtagcctgaccgcactagtggt

SEQ ID NO: 423704 - DNA, 25 bp, Mus musculus
cctgtagctttgcagctggcttccc

SEQ ID NO: 423705 - DNA, 25 bp, Mus musculus
cctgtagtaagatggactcctgagc

SEQ ID NO: 423706 - DNA, 25 bp, Mus musculus
cctgtagtcccagggccattattgg

SEQ ID NO: 423707 - DNA, 25 bp, Mus musculus
cctgtagtgaaagtgacccttccat

SEQ ID NO: 423708 - DNA, 25 bp, Mus musculus
cctgtagtggttgcatcctgggcgc

SEQ ID NO: 423709 - DNA, 25 bp, Mus musculus
cctgtataaggacgcccaggaggcc

SEQ ID NO: 423710 - DNA, 25 bp, Mus musculus
cctgtatacttcgatttggcaccaa

SEQ ID NO: 423711 - DNA, 25 bp, Mus musculus
cctgtatgacgacattgtgccttga

SEQ ID NO: 423712 - DNA, 25 bp, Mus musculus
cctgtattagattaggtaccattag

SEQ ID NO: 423713 - DNA, 25 bp, Mus musculus
cctgtattgtgagagttcagagtta

SEQ ID NO: 423714 - DNA, 25 bp, Mus musculus
cctgtcacaggattttatagagtgt

SEQ ID NO: 423715 - DNA, 25 bp, Mus musculus
cctgtcactgtaacactagaagggt

SEQ ID NO: 423716 - DNA, 25 bp, Mus musculus
cctgtcactgtgaggaatgcagctc

SEQ ID NO: 423717 - DNA, 25 bp, Mus musculus
cctgtcagacccatgccaagcagaa

SEQ ID NO: 423718 - DNA, 25 bp, Mus musculus
cctgtcagatgtggttgtttaaaca

SEQ ID NO: 423719 - DNA, 25 bp, Mus musculus
cctgtcatcatggagctagagcgtc

SEQ ID NO: 423720 - DNA, 25 bp, Mus musculus
cctgtcatgggtaaagcctggctca

SEQ ID NO: 423721 - DNA, 25 bp, Mus musculus
cctgtccaagcaccccgaaatttga

SEQ ID NO: 423722 - DNA, 25 bp, Mus musculus
cctgtccctgatcacaggtagcgga

SEQ ID NO: 423723 - DNA, 25 bp, Mus musculus
cctgtccgaggagatataaataact

SEQ ID NO: 423724 - DNA, 25 bp, Mus musculus
cctgtcctgaaggtgctggtctgag

SEQ ID NO: 423725 - DNA, 25 bp, Mus musculus
cctgtcggtgatgctggtgcgcaac

SEQ ID NO: 423726 - DNA, 25 bp, Mus musculus
cctgtctaaggatgtgctgtaccca

SEQ ID NO: 423727 - DNA, 25 bp, Mus musculus
cctgtctaggcaagggatcgaccat

SEQ ID NO: 423728 - DNA, 25 bp, Mus musculus
cctgtctaggcagtagaggaaaggc

SEQ ID NO: 423729 - DNA, 25 bp, Mus musculus
cctgtctatggctggtgaagtcacc

SEQ ID NO: 423730 - DNA, 25 bp, Mus musculus
cctgtctctaggctttaatgactga

SEQ ID NO: 423731 - DNA, 25 bp, Mus musculus
cctgtctctgttcacgaagagatag

SEQ ID NO: 423732 - DNA, 25 bp, Mus musculus
cctgtctgaagacccggatattttc

SEQ ID NO: 423733 - DNA, 25 bp, Mus musculus
cctgtctgataagaatctggtggcc

SEQ ID NO: 423734 - DNA, 25 bp, Mus musculus
cctgtctgcggtgactccgtgctga

SEQ ID NO: 423735 - DNA, 25 bp, Mus musculus
cctgtctgggtattttaaactgatg

SEQ ID NO: 423736 - DNA, 25 bp, Mus musculus
cctgtctgtttttatagcgctttta

SEQ ID NO: 423737 - DNA, 25 bp, Mus musculus
cctgtcttccttaatctttgtctga

SEQ ID NO: 423738 - DNA, 25 bp, Mus musculus
cctgtcttctgaggttggaaaccca

SEQ ID NO: 423739 - DNA, 25 bp, Mus musculus
cctgtctttgtcaagctagttggaa

SEQ ID NO: 423740 - DNA, 25 bp, Mus musculus
cctgtgaaaccttctgtgtgggaga

SEQ ID NO: 423741 - DNA, 25 bp, Mus musculus
cctgtgaagcctgacactgtggaga

SEQ ID NO: 423742 - DNA, 25 bp, Mus musculus
cctgtgaatgggatgatcagaccct

SEQ ID NO: 423743 - DNA, 25 bp, Mus musculus
cctgtgacagtcatccctgtggaat

SEQ ID NO: 423744 - DNA, 25 bp, Mus musculus
cctgtgagaccaacagcctgacggg

SEQ ID NO: 423745 - DNA, 25 bp, Mus musculus
cctgtgagaccgtggatgaaaacac

SEQ ID NO: 423746 - DNA, 25 bp, Mus musculus
cctgtgagataaagattgattggtc

SEQ ID NO: 423747 - DNA, 25 bp, Mus musculus
cctgtgagatctccatgtaaactct

SEQ ID NO: 423748 - DNA, 25 bp, Mus musculus
cctgtgagatgggtttaaaactgta

SEQ ID NO: 423749 - DNA, 25 bp, Mus musculus
cctgtgagccgatgggaagtcttcc

SEQ ID NO: 423750 - DNA, 25 bp, Mus musculus
cctgtgagctgacaaaggaccgctt

SEQ ID NO: 423751 - DNA, 25 bp, Mus musculus
cctgtgaggaactagtgtgcagcct

SEQ ID NO: 423752 - DNA, 25 bp, Mus musculus
cctgtgaggcttatggacggattct

SEQ ID NO: 423753 - DNA, 25 bp, Mus musculus
cctgtgagtagagcggaccctggat

SEQ ID NO: 423754 - DNA, 25 bp, Mus musculus
cctgtgagtcacatagcctagcatc

SEQ ID NO: 423755 - DNA, 25 bp, Mus musculus
cctgtgatcagcttcacataacagt

SEQ ID NO: 423756 - DNA, 25 bp, Mus musculus
cctgtgatcaggagctgtaaagttc

SEQ ID NO: 423757 - DNA, 25 bp, Mus musculus
cctgtgatctcactgaaataggcta

SEQ ID NO: 423758 - DNA, 25 bp, Mus musculus
cctgtgatgcccaatgtgatctaca

SEQ ID NO: 423759 - DNA, 25 bp, Mus musculus
cctgtgcaaacagtcagtggccagc

SEQ ID NO: 423760 - DNA, 25 bp, Mus musculus
cctgtgcacctgatgtagcaagtca

SEQ ID NO: 423761 - DNA, 25 bp, Mus musculus
cctgtgcactcagtagggcagtgtg

SEQ ID NO: 423762 - DNA, 25 bp, Mus musculus
cctgtgccagatgtgagagctctgt

SEQ ID NO: 423763 - DNA, 25 bp, Mus musculus
cctgtgccatgccttacatggtctt

SEQ ID NO: 423764 - DNA, 25 bp, Mus musculus
cctgtgcccagctaggatagacacc

SEQ ID NO: 423765 - DNA, 25 bp, Mus musculus
cctgtgcgccgggaacttgaatgat

SEQ ID NO: 423766 - DNA, 25 bp, Mus musculus
cctgtgcgtctcctcccagaagact

SEQ ID NO: 423767 - DNA, 25 bp, Mus musculus
cctgtgcgttgctaatgtttgtgag

SEQ ID NO: 423768 - DNA, 25 bp, Mus musculus
cctgtgctttgctgtggacctggaa

SEQ ID NO: 423769 - DNA, 25 bp, Mus musculus
cctgtgctttggaccgtggtgcgaa

SEQ ID NO: 423770 - DNA, 25 bp, Mus musculus
cctgtggaaagaagaaccctgtgtc

SEQ ID NO: 423771 - DNA, 25 bp, Mus musculus
cctgtggaagccagacaaccaactt

SEQ ID NO: 423772 - DNA, 25 bp, Mus musculus
cctgtggaatgaggaagggcttggg

SEQ ID NO: 423773 - DNA, 25 bp, Mus musculus
cctgtggaccaactgctgcgaaaag

SEQ ID NO: 423774 - DNA, 25 bp, Mus musculus
cctgtggacgacgtgaagattctta

SEQ ID NO: 423775 - DNA, 25 bp, Mus musculus
cctgtggacgatgatatcaacgggc

SEQ ID NO: 423776 - DNA, 25 bp, Mus musculus
cctgtggagccttagatgccctttg

SEQ ID NO: 423777 - DNA, 25 bp, Mus musculus
cctgtggcaaagtcaaaagcgtctg

SEQ ID NO: 423778 - DNA, 25 bp, Mus musculus
cctgtggccggaagagaaagtgatc

SEQ ID NO: 423779 - DNA, 25 bp, Mus musculus
cctgtggccggtagtgacagcttca

SEQ ID NO: 423780 - DNA, 25 bp, Mus musculus
cctgtggccttggtgccagtgctgt

SEQ ID NO: 423781 - DNA, 25 bp, Mus musculus
cctgtggctggcagaggaatgctca

SEQ ID NO: 423782 - DNA, 25 bp, Mus musculus
cctgtgggaagggatatgcactacc

SEQ ID NO: 423783 - DNA, 25 bp, Mus musculus
cctgtgggacagaaatcaatttaat

SEQ ID NO: 423784 - DNA, 25 bp, Mus musculus
cctgtgggccgacctgtgaagtata

SEQ ID NO: 423785 - DNA, 25 bp, Mus musculus
cctgtgggctgatcacgttgaccga

SEQ ID NO: 423786 - DNA, 25 bp, Mus musculus
cctgtggtactttattgcgggagca

SEQ ID NO: 423787 - DNA, 25 bp, Mus musculus
cctgtggtagaaaaacgtgctgtgc

SEQ ID NO: 423788 - DNA, 25 bp, Mus musculus
cctgtggtcactcctggttcccgag

SEQ ID NO: 423789 - DNA, 25 bp, Mus musculus
cctgtggtgtgacgagaaccttcct

SEQ ID NO: 423790 - DNA, 25 bp, Mus musculus
cctgtggttatctcaacatagcaga

SEQ ID NO: 423791 - DNA, 25 bp, Mus musculus
cctgtggttgccagtgtgttggaca

SEQ ID NO: 423792 - DNA, 25 bp, Mus musculus
cctgtgtacagcatggtgaacgggc

SEQ ID NO: 423793 - DNA, 25 bp, Mus musculus
cctgtgtagaccagttaatctccga

SEQ ID NO: 423794 - DNA, 25 bp, Mus musculus
cctgtgtcacccaaggcaagtagca

SEQ ID NO: 423795 - DNA, 25 bp, Mus musculus
cctgtgtccttgtggcggctctgaa

SEQ ID NO: 423796 - DNA, 25 bp, Mus musculus
cctgtgtcgagagtgtgccaaccta

SEQ ID NO: 423797 - DNA, 25 bp, Mus musculus
cctgtgtcgggaacttggagacctc

SEQ ID NO: 423798 - DNA, 25 bp, Mus musculus
cctgtgtctggtttatgcagttggt

SEQ ID NO: 423799 - DNA, 25 bp, Mus musculus
cctgtgtgacatctccaaggtggac

SEQ ID NO: 423800 - DNA, 25 bp, Mus musculus
cctgtgtgccccagcgcggtgtgtt

SEQ ID NO: 423801 - DNA, 25 bp, Mus musculus
cctgtgtgccgtatgggttggaact

SEQ ID NO: 423802 - DNA, 25 bp, Mus musculus
cctgtgtggcatcctcaggatcatt

SEQ ID NO: 423803 - DNA, 25 bp, Mus musculus
cctgtgtgggagaaaaatactggcc

SEQ ID NO: 423804 - DNA, 25 bp, Mus musculus
cctgtgtgggagaccatcgtgtgca

SEQ ID NO: 423805 - DNA, 25 bp, Mus musculus
cctgtgtgtgcccttagttatctaa

SEQ ID NO: 423806 - DNA, 25 bp, Mus musculus
cctgtgtttgggatagtgctgctca

SEQ ID NO: 423807 - DNA, 25 bp, Mus musculus
cctgttaaaccccagcagccagaat

SEQ ID NO: 423808 - DNA, 25 bp, Mus musculus
cctgttacatgaggaagctgtcagc

SEQ ID NO: 423809 - DNA, 25 bp, Mus musculus
cctgttaccgctaccttctaggtca

SEQ ID NO: 423810 - DNA, 25 bp, Mus musculus
cctgttagccgtgtggatcgtttcc

SEQ ID NO: 423811 - DNA, 25 bp, Mus musculus
cctgttaggctgtgatctcctctaa

SEQ ID NO: 423812 - DNA, 25 bp, Mus musculus
cctgttatggagttgttagactggt

SEQ ID NO: 423813 - DNA, 25 bp, Mus musculus
cctgttcaactgtaatagagatgcc

SEQ ID NO: 423814 - DNA, 25 bp, Mus musculus
cctgttcagaggaaggaaagtctac

SEQ ID NO: 423815 - DNA, 25 bp, Mus musculus
cctgttccacacaataggatgagta

SEQ ID NO: 423816 - DNA, 25 bp, Mus musculus
cctgttccctcaatcttgtcatgag

SEQ ID NO: 423817 - DNA, 25 bp, Mus musculus
cctgttcgctgctttcatgatgctg

SEQ ID NO: 423818 - DNA, 25 bp, Mus musculus
cctgttctctagcttttctctcaag

SEQ ID NO: 423819 - DNA, 25 bp, Mus musculus
cctgttctgcgctttgctaaggaag

SEQ ID NO: 423820 - DNA, 25 bp, Mus musculus
cctgttgacaagagaaggtttgagc

SEQ ID NO: 423821 - DNA, 25 bp, Mus musculus
cctgttgactatggagggtccctcg

SEQ ID NO: 423822 - DNA, 25 bp, Mus musculus
cctgttgaggtggaaacagctcagc

SEQ ID NO: 423823 - DNA, 25 bp, Mus musculus
cctgttgagtcagatcttcaggaaa

SEQ ID NO: 423824 - DNA, 25 bp, Mus musculus
cctgttgatgagttagtgtgattcc

SEQ ID NO: 423825 - DNA, 25 bp, Mus musculus
cctgttgcataaggatgaggatctg

SEQ ID NO: 423826 - DNA, 25 bp, Mus musculus
cctgttgccatgactgaagacttga

SEQ ID NO: 423827 - DNA, 25 bp, Mus musculus
cctgttgcgctgtcggtgtggccct

SEQ ID NO: 423828 - DNA, 25 bp, Mus musculus
cctgttgcttctagaccatggccaa

SEQ ID NO: 423829 - DNA, 25 bp, Mus musculus
cctgttgggcttgcagcctgagccg

SEQ ID NO: 423830 - DNA, 25 bp, Mus musculus
cctgttggtacccagatggccctga

SEQ ID NO: 423831 - DNA, 25 bp, Mus musculus
cctgttgtgtcttttaagctgaaca

SEQ ID NO: 423832 - DNA, 25 bp, Mus musculus
cctgtttatcccatcacgggtggat

SEQ ID NO: 423833 - DNA, 25 bp, Mus musculus
cctgtttcagcacaagctaagtcat

SEQ ID NO: 423834 - DNA, 25 bp, Mus musculus
cctgtttctgggataagtttcggct

SEQ ID NO: 423835 - DNA, 25 bp, Mus musculus
cctgtttctttcaaaggagtgtgta

SEQ ID NO: 423836 - DNA, 25 bp, Mus musculus
cctgtttgacatctttagcgtgggt

SEQ ID NO: 423837 - DNA, 25 bp, Mus musculus
cctgtttgagaagcgcaagcggctc

SEQ ID NO: 423838 - DNA, 25 bp, Mus musculus
cctgtttggactgaatgcgccatta

SEQ ID NO: 423839 - DNA, 25 bp, Mus musculus
cctgtttggcgcgactcttgggacc

SEQ ID NO: 423840 - DNA, 25 bp, Mus musculus
cctgtttggctacatggaggacctg

SEQ ID NO: 423841 - DNA, 25 bp, Mus musculus
cctgttttcactaggctctgggtgc

SEQ ID NO: 423842 - DNA, 25 bp, Mus musculus
cctgttttcaggcttccagaggctc

SEQ ID NO: 423843 - DNA, 25 bp, Mus musculus
ccttaaaaaatccaagagaggagca

SEQ ID NO: 423844 - DNA, 25 bp, Mus musculus
ccttaaaaagccctgtctgcaccag

SEQ ID NO: 423845 - DNA, 25 bp, Mus musculus
ccttaaaaggaacgaagtggagctg

SEQ ID NO: 423846 - DNA, 25 bp, Mus musculus
ccttaaaagtatggagcgacgtcac

SEQ ID NO: 423847 - DNA, 25 bp, Mus musculus
ccttaaacgacgagaagcaatgggt

SEQ ID NO: 423848 - DNA, 25 bp, Mus musculus
ccttaaagaaggtcaggtgtgcacc

SEQ ID NO: 423849 - DNA, 25 bp, Mus musculus
ccttaaagaggatgcagtgggtcct

SEQ ID NO: 423850 - DNA, 25 bp, Mus musculus
ccttaaagccacctgcagagctgga

SEQ ID NO: 423851 - DNA, 25 bp, Mus musculus
ccttaaagggacactagtgtgatgc

SEQ ID NO: 423852 - DNA, 25 bp, Mus musculus
ccttaagaatgcttgcggcgctcct

SEQ ID NO: 423853 - DNA, 25 bp, Mus musculus
ccttaaggaagcaatacttatgata

SEQ ID NO: 423854 - DNA, 25 bp, Mus musculus
ccttaaggagcagaaagcgtccgct

SEQ ID NO: 423855 - DNA, 25 bp, Mus musculus
ccttaagtcaagagagcgtggagtt

SEQ ID NO: 423856 - DNA, 25 bp, Mus musculus
ccttaataaatctagtggcagtggc

SEQ ID NO: 423857 - DNA, 25 bp, Mus musculus
ccttaataaatgagtaatccttagc

SEQ ID NO: 423858 - DNA, 25 bp, Mus musculus
ccttaataaggaggatgaaccagct

SEQ ID NO: 423859 - DNA, 25 bp, Mus musculus
ccttaatgaatgagaacacagggct

SEQ ID NO: 423860 - DNA, 25 bp, Mus musculus
ccttaatgaggctactagagagttc

SEQ ID NO: 423861 - DNA, 25 bp, Mus musculus
ccttaatgctattctgggacccaca

SEQ ID NO: 423862 - DNA, 25 bp, Mus musculus
ccttaatgtgtgcttgtttttcaga

SEQ ID NO: 423863 - DNA, 25 bp, Mus musculus
ccttaatgtttacagcgcgggctcc

SEQ ID NO: 423864 - DNA, 25 bp, Mus musculus
ccttaattacatcctactcgatggg

SEQ ID NO: 423865 - DNA, 25 bp, Mus musculus
ccttacacagtctgggaggcaggac

SEQ ID NO: 423866 - DNA, 25 bp, Mus musculus
ccttacattgcttcactgaggtgtg

SEQ ID NO: 423867 - DNA, 25 bp, Mus musculus
ccttactgctctgtgaggatggaca

SEQ ID NO: 423868 - DNA, 25 bp, Mus musculus
ccttacttgggaagtcacatgacaa

SEQ ID NO: 423869 - DNA, 25 bp, Mus musculus
ccttagaagagatagccgagctgca

SEQ ID NO: 423870 - DNA, 25 bp, Mus musculus
ccttagagttgagcatctgtttgcc

SEQ ID NO: 423871 - DNA, 25 bp, Mus musculus
ccttagatgaggtcgatgttccacg

SEQ ID NO: 423872 - DNA, 25 bp, Mus musculus
ccttagcaaccccaacgtggaagtg

SEQ ID NO: 423873 - DNA, 25 bp, Mus musculus
ccttagcagaacagcatgatcagtc

SEQ ID NO: 423874 - DNA, 25 bp, Mus musculus
ccttagcgaagctgtgacctctttc

SEQ ID NO: 423875 - DNA, 25 bp, Mus musculus
ccttaggacgtgattggcaaagctc

SEQ ID NO: 423876 - DNA, 25 bp, Mus musculus
ccttaggagttctagaggtgcccct

SEQ ID NO: 423877 - DNA, 25 bp, Mus musculus
ccttaggattctatgtctggctgcc

SEQ ID NO: 423878 - DNA, 25 bp, Mus musculus
ccttaggctgttgataggaaaaaca

SEQ ID NO: 423879 - DNA, 25 bp, Mus musculus
ccttaggtgagttagccaggagcca

SEQ ID NO: 423880 - DNA, 25 bp, Mus musculus
ccttagtcctcacccttgccagggt

SEQ ID NO: 423881 - DNA, 25 bp, Mus musculus
ccttagtgacaagacttcgttggac

SEQ ID NO: 423882 - DNA, 25 bp, Mus musculus
ccttagtgcatgatatggtagccca

SEQ ID NO: 423883 - DNA, 25 bp, Mus musculus
ccttagtgcgaatggagggagcctc

SEQ ID NO: 423884 - DNA, 25 bp, Mus musculus
ccttagtggagatgcaggccagcat

SEQ ID NO: 423885 - DNA, 25 bp, Mus musculus
ccttataaggtgaatgaggaagtga

SEQ ID NO: 423886 - DNA, 25 bp, Mus musculus
ccttatcagcatggcgggaacatca

SEQ ID NO: 423887 - DNA, 25 bp, Mus musculus
ccttatccatcatagcccactggga

SEQ ID NO: 423888 - DNA, 25 bp, Mus musculus
ccttatgaaggttagtagaaaatct

SEQ ID NO: 423889 - DNA, 25 bp, Mus musculus
ccttatgaagtctgggatctagcgc

SEQ ID NO: 423890 - DNA, 25 bp, Mus musculus
ccttatgacaggatgctaaagaaga

SEQ ID NO: 423891 - DNA, 25 bp, Mus musculus
ccttatgagaagatgtccagctagc

SEQ ID NO: 423892 - DNA, 25 bp, Mus musculus
ccttatgatctcttgtggaactgta

SEQ ID NO: 423893 - DNA, 25 bp, Mus musculus
ccttatgcaaactggtgggtcgtca

SEQ ID NO: 423894 - DNA, 25 bp, Mus musculus
ccttatgccggaaggatgctggaga

SEQ ID NO: 423895 - DNA, 25 bp, Mus musculus
ccttatggaagtagtaatgacccct

SEQ ID NO: 423896 - DNA, 25 bp, Mus musculus
ccttatgggcaggaagcaagacccc

SEQ ID NO: 423897 - DNA, 25 bp, Mus musculus
ccttatggttccagagcggtagcac

SEQ ID NO: 423898 - DNA, 25 bp, Mus musculus
ccttattccaccataagaatttggg

SEQ ID NO: 423899 - DNA, 25 bp, Mus musculus
ccttattgatgagcggaaccctgac

SEQ ID NO: 423900 - DNA, 25 bp, Mus musculus
ccttcaaactgcgtggcctggtgga

SEQ ID NO: 423901 - DNA, 25 bp, Mus musculus
ccttcaaagaaaagggcagctgtgt

SEQ ID NO: 423902 - DNA, 25 bp, Mus musculus
ccttcaaaggaatcaactcagtggt

SEQ ID NO: 423903 - DNA, 25 bp, Mus musculus
ccttcaaaggctgcagagtggctgg

SEQ ID NO: 423904 - DNA, 25 bp, Mus musculus
ccttcaaagtggtggtgatctcagc

SEQ ID NO: 423905 - DNA, 25 bp, Mus musculus
ccttcaaatcttagaagtggagtct

SEQ ID NO: 423906 - DNA, 25 bp, Mus musculus
ccttcaacggtcgaggaggtcctgg

SEQ ID NO: 423907 - DNA, 25 bp, Mus musculus
ccttcaagaggtggagatgctggac

SEQ ID NO: 423908 - DNA, 25 bp, Mus musculus
ccttcaagatgaggacacggtggct

SEQ ID NO: 423909 - DNA, 25 bp, Mus musculus
ccttcaaggagccacatgtgtcgaa

SEQ ID NO: 423910 - DNA, 25 bp, Mus musculus
ccttcaaggagctggtatacgagac

SEQ ID NO: 423911 - DNA, 25 bp, Mus musculus
ccttcaaggaggcaaagactggagc

SEQ ID NO: 423912 - DNA, 25 bp, Mus musculus
ccttcaaggcggagatcaagaagac

SEQ ID NO: 423913 - DNA, 25 bp, Mus musculus
ccttcaagtgtgagtcaagggagac

SEQ ID NO: 423914 - DNA, 25 bp, Mus musculus
ccttcacaacaatgaggcgggcaga

SEQ ID NO: 423915 - DNA, 25 bp, Mus musculus
ccttcacacggatgggctcttcaca

SEQ ID NO: 423916 - DNA, 25 bp, Mus musculus
ccttcacctcaggagtgggctttag

SEQ ID NO: 423917 - DNA, 25 bp, Mus musculus
ccttcacgtgtttaccgcagcaaaa

SEQ ID NO: 423918 - DNA, 25 bp, Mus musculus
ccttcactggtggactgtaatgtat

SEQ ID NO: 423919 - DNA, 25 bp, Mus musculus
ccttcagacaggttatctcagttac

SEQ ID NO: 423920 - DNA, 25 bp, Mus musculus
ccttcagagaacttgagtacacagc

SEQ ID NO: 423921 - DNA, 25 bp, Mus musculus
ccttcagagcggagagaagcttccg

SEQ ID NO: 423922 - DNA, 25 bp, Mus musculus
ccttcagatggtgtgggtgaaccgc

SEQ ID NO: 423923 - DNA, 25 bp, Mus musculus
ccttcagcccctgagtaatgtggaa

SEQ ID NO: 423924 - DNA, 25 bp, Mus musculus
ccttcaggaggagcttagcgacgtc

SEQ ID NO: 423925 - DNA, 25 bp, Mus musculus
ccttcaggcggcttcgttatgatgc

SEQ ID NO: 423926 - DNA, 25 bp, Mus musculus
ccttcaggctggaccaaatttggta

SEQ ID NO: 423927 - DNA, 25 bp, Mus musculus
ccttcagggagggaaccttggctag

SEQ ID NO: 423928 - DNA, 25 bp, Mus musculus
ccttcagtaaggagagcaagccgtt

SEQ ID NO: 423929 - DNA, 25 bp, Mus musculus
ccttcagtgatgagagggagttctc

SEQ ID NO: 423930 - DNA, 25 bp, Mus musculus
ccttcagtgcttgctggctatcatt

SEQ ID NO: 423931 - DNA, 25 bp, Mus musculus
ccttcatcggctagaagagggcccc

SEQ ID NO: 423932 - DNA, 25 bp, Mus musculus
ccttcatcttttcgagggtgctggg

SEQ ID NO: 423933 - DNA, 25 bp, Mus musculus
ccttcatgcaggtagcgagatggga

SEQ ID NO: 423934 - DNA, 25 bp, Mus musculus
ccttcatgctggacagtgcggccat

SEQ ID NO: 423935 - DNA, 25 bp, Mus musculus
ccttcattgatggtggcggcagcgt

SEQ ID NO: 423936 - DNA, 25 bp, Mus musculus
ccttcattgtgagttgtctgacccc

SEQ ID NO: 423937 - DNA, 25 bp, Mus musculus
ccttcattttagagatgggcgtgtc

SEQ ID NO: 423938 - DNA, 25 bp, Mus musculus
ccttccaaattcgaataagccatga

SEQ ID NO: 423939 - DNA, 25 bp, Mus musculus
ccttccaagcctgagtacagagaga

SEQ ID NO: 423940 - DNA, 25 bp, Mus musculus
ccttccaagggacagtacagagtgc

SEQ ID NO: 423941 - DNA, 25 bp, Mus musculus
ccttccaccttatccagtcggtatt

SEQ ID NO: 423942 - DNA, 25 bp, Mus musculus
ccttccagaatgtgagcggcctaga

SEQ ID NO: 423943 - DNA, 25 bp, Mus musculus
ccttccagcttcagcaaagagaggg

SEQ ID NO: 423944 - DNA, 25 bp, Mus musculus
ccttccagggtatcttactgattgt

SEQ ID NO: 423945 - DNA, 25 bp, Mus musculus
ccttccagtgagtggtaatacacac

SEQ ID NO: 423946 - DNA, 25 bp, Mus musculus
ccttccagttcacgacagagcggtc

SEQ ID NO: 423947 - DNA, 25 bp, Mus musculus
ccttcccggcgctatggactgcggg

SEQ ID NO: 423948 - DNA, 25 bp, Mus musculus
ccttcccggtgaacaagcgagagtc

SEQ ID NO: 423949 - DNA, 25 bp, Mus musculus
ccttccctgagagtctagtcttagt

SEQ ID NO: 423950 - DNA, 25 bp, Mus musculus
ccttcccttcggtgagtggcgtgca

SEQ ID NO: 423951 - DNA, 25 bp, Mus musculus
ccttccgaggtatccaaagatcttg

SEQ ID NO: 423952 - DNA, 25 bp, Mus musculus
ccttccgtggcaaggtggcaacaca

SEQ ID NO: 423953 - DNA, 25 bp, Mus musculus
ccttccgtggcgacatgtaatacat

SEQ ID NO: 423954 - DNA, 25 bp, Mus musculus
ccttcctacacagtcagttgtttaa

SEQ ID NO: 423955 - DNA, 25 bp, Mus musculus
ccttcctagttccagaggaatggtg

SEQ ID NO: 423956 - DNA, 25 bp, Mus musculus
ccttcctcagcgataaagaaaggat

SEQ ID NO: 423957 - DNA, 25 bp, Mus musculus
ccttcctccagatcccagagatgag

SEQ ID NO: 423958 - DNA, 25 bp, Mus musculus
ccttcctggtgctcggagcgcgagc

SEQ ID NO: 423959 - DNA, 25 bp, Mus musculus
ccttcctgttacaaacagagaagag

SEQ ID NO: 423960 - DNA, 25 bp, Mus musculus
ccttccttaatttgccaagtattgc

SEQ ID NO: 423961 - DNA, 25 bp, Mus musculus
ccttccttatacagctgtcccttga

SEQ ID NO: 423962 - DNA, 25 bp, Mus musculus
ccttccttcgggtatgctcaggcta

SEQ ID NO: 423963 - DNA, 25 bp, Mus musculus
ccttccttgaagagtgtggacctgg

SEQ ID NO: 423964 - DNA, 25 bp, Mus musculus
ccttccttgcagccgtgtgcagcgg

SEQ ID NO: 423965 - DNA, 25 bp, Mus musculus
ccttcgaaagatggattctgttgac

SEQ ID NO: 423966 - DNA, 25 bp, Mus musculus
ccttcgagcacaggtagcggcatta

SEQ ID NO: 423967 - DNA, 25 bp, Mus musculus
ccttcgagcacctgtggagttctct

SEQ ID NO: 423968 - DNA, 25 bp, Mus musculus
ccttcgagcggctggtggatgccat

SEQ ID NO: 423969 - DNA, 25 bp, Mus musculus
ccttcgaggtaagagtcctatttca

SEQ ID NO: 423970 - DNA, 25 bp, Mus musculus
ccttcgagtacagatgggcgtgccg

SEQ ID NO: 423971 - DNA, 25 bp, Mus musculus
ccttcgatgtagatgggccccacta

SEQ ID NO: 423972 - DNA, 25 bp, Mus musculus
ccttcgatttgataaagagtactta

SEQ ID NO: 423973 - DNA, 25 bp, Mus musculus
ccttcgcagctccagtagtcagtct

SEQ ID NO: 423974 - DNA, 25 bp, Mus musculus
ccttcgcggcctcagaggattggct

SEQ ID NO: 423975 - DNA, 25 bp, Mus musculus
ccttcggaaggctcaggtgtgattc

SEQ ID NO: 423976 - DNA, 25 bp, Mus musculus
ccttcggagcacacaaagctgagct

SEQ ID NO: 423977 - DNA, 25 bp, Mus musculus
ccttcggcagaaggtcagccgatct

SEQ ID NO: 423978 - DNA, 25 bp, Mus musculus
ccttcgggaggatcagacatggccc

SEQ ID NO: 423979 - DNA, 25 bp, Mus musculus
ccttcgggcacagaaaaaacagtct

SEQ ID NO: 423980 - DNA, 25 bp, Mus musculus
ccttcgggcacgcaaggatcgagtt

SEQ ID NO: 423981 - DNA, 25 bp, Mus musculus
ccttcgtacaggtaacagcagtatg

SEQ ID NO: 423982 - DNA, 25 bp, Mus musculus
ccttcgtcaggacagcgggatgcca

SEQ ID NO: 423983 - DNA, 25 bp, Mus musculus
ccttcgtggacctgggagcttgctg

SEQ ID NO: 423984 - DNA, 25 bp, Mus musculus
ccttcgttgtgagaaatatgtaaag

SEQ ID NO: 423985 - DNA, 25 bp, Mus musculus
ccttctaagaaggaataggccgagg

SEQ ID NO: 423986 - DNA, 25 bp, Mus musculus
ccttctaagagtgggaggccccgat

SEQ ID NO: 423987 - DNA, 25 bp, Mus musculus
ccttctagagtagcttatggcaaaa

SEQ ID NO: 423988 - DNA, 25 bp, Mus musculus
ccttctagccaggtaggactggatg

SEQ ID NO: 423989 - DNA, 25 bp, Mus musculus
ccttctagtcacttgccatgaggga

SEQ ID NO: 423990 - DNA, 25 bp, Mus musculus
ccttctatagaaaggtctgggccaa

SEQ ID NO: 423991 - DNA, 25 bp, Mus musculus
ccttctatgatgagagcgatcctga

SEQ ID NO: 423992 - DNA, 25 bp, Mus musculus
ccttctatgcatggacgggcctgtg

SEQ ID NO: 423993 - DNA, 25 bp, Mus musculus
ccttctatgtggtggagtgcatcgc

SEQ ID NO: 423994 - DNA, 25 bp, Mus musculus
ccttctcaccaccagttaagtgttg

SEQ ID NO: 423995 - DNA, 25 bp, Mus musculus
ccttctcacggttaacttccagtca

SEQ ID NO: 423996 - DNA, 25 bp, Mus musculus
ccttctcagatggagcgcagcataa

SEQ ID NO: 423997 - DNA, 25 bp, Mus musculus
ccttctccagatggtgatactgtga

SEQ ID NO: 423998 - DNA, 25 bp, Mus musculus
ccttctccagggaaatgagggcaaa

SEQ ID NO: 423999 - DNA, 25 bp, Mus musculus
ccttctccgggaacagagtagggtg

SEQ ID NO: 424000 - DNA, 25 bp, Mus musculus
ccttctccgtgtcgacgatcggtgg

SEQ ID NO: 424001 - DNA, 25 bp, Mus musculus
ccttctctcagaatgtgtggctttg

SEQ ID NO: 424002 - DNA, 25 bp, Mus musculus
ccttctctgtcctacgctgtcataa

SEQ ID NO: 424003 - DNA, 25 bp, Mus musculus
ccttctctgtctcctcgtggtgtgg

SEQ ID NO: 424004 - DNA, 25 bp, Mus musculus
ccttctgaaggcagcgatggcagca

SEQ ID NO: 424005 - DNA, 25 bp, Mus musculus
ccttctgagacatgcagtcaaaatt

SEQ ID NO: 424006 - DNA, 25 bp, Mus musculus
ccttctgagggagctgcgctacctg

SEQ ID NO: 424007 - DNA, 25 bp, Mus musculus
ccttctgagtgctgacgttaagtca

SEQ ID NO: 424008 - DNA, 25 bp, Mus musculus
ccttctgcaatccttgtaaaaaata

SEQ ID NO: 424009 - DNA, 25 bp, Mus musculus
ccttctgctgcctgcggttggacaa

SEQ ID NO: 424010 - DNA, 25 bp, Mus musculus
ccttctggaaggagcgatcgtatct

SEQ ID NO: 424011 - DNA, 25 bp, Mus musculus
ccttctggatttggtgagcacactg

SEQ ID NO: 424012 - DNA, 25 bp, Mus musculus
ccttctggctgcctaagaagagtag

SEQ ID NO: 424013 - DNA, 25 bp, Mus musculus
ccttctgggcagagaacgttgggaa

SEQ ID NO: 424014 - DNA, 25 bp, Mus musculus
ccttctgggtctgagaggtatcagc

SEQ ID NO: 424015 - DNA, 25 bp, Mus musculus
ccttctggtcatgtcacaggttgac

SEQ ID NO: 424016 - DNA, 25 bp, Mus musculus
ccttctgtgctccataatgatgact

SEQ ID NO: 424017 - DNA, 25 bp, Mus musculus
ccttctgtgtgcagctgtgctgctt

SEQ ID NO: 424018 - DNA, 25 bp, Mus musculus
ccttcttaggactcgcgtggtgcga

SEQ ID NO: 424019 - DNA, 25 bp, Mus musculus
ccttcttcatgagtggccagagcct

SEQ ID NO: 424020 - DNA, 25 bp, Mus musculus
ccttcttgaagaggcgagaggcttg

SEQ ID NO: 424021 - DNA, 25 bp, Mus musculus
ccttcttgagatcctgtgtatctgc

SEQ ID NO: 424022 - DNA, 25 bp, Mus musculus
ccttcttgcgatacactctggtgct

SEQ ID NO: 424023 - DNA, 25 bp, Mus musculus
ccttcttgggttgcatgggctcaat

SEQ ID NO: 424024 - DNA, 25 bp, Mus musculus
ccttcttggttctactgagtgggca

SEQ ID NO: 424025 - DNA, 25 bp, Mus musculus
ccttcttgttagaagagccactcca

SEQ ID NO: 424026 - DNA, 25 bp, Mus musculus
ccttctttcatagcccttggtgctg

SEQ ID NO: 424027 - DNA, 25 bp, Mus musculus
ccttctttgaactggatggccgtcc

SEQ ID NO: 424028 - DNA, 25 bp, Mus musculus
ccttgaaacctgaaaagctattggg

SEQ ID NO: 424029 - DNA, 25 bp, Mus musculus
ccttgaaatcagagtgccgcttgct

SEQ ID NO: 424030 - DNA, 25 bp, Mus musculus
ccttgaaattcgagatcggctggca

SEQ ID NO: 424031 - DNA, 25 bp, Mus musculus
ccttgaacaaggcaaatatggtttt

SEQ ID NO: 424032 - DNA, 25 bp, Mus musculus
ccttgaacaggttgccaggatgcat

SEQ ID NO: 424033 - DNA, 25 bp, Mus musculus
ccttgaacctgacctaacggaggat

SEQ ID NO: 424034 - DNA, 25 bp, Mus musculus
ccttgaacgaagtggcagggaaaga

SEQ ID NO: 424035 - DNA, 25 bp, Mus musculus
ccttgaactcaagacagttcttctg

SEQ ID NO: 424036 - DNA, 25 bp, Mus musculus
ccttgaagacaagtgggccagcgga

SEQ ID NO: 424037 - DNA, 25 bp, Mus musculus
ccttgaagacggagcggctgagtcc

SEQ ID NO: 424038 - DNA, 25 bp, Mus musculus
ccttgaaggcctcagagaagtcgac

SEQ ID NO: 424039 - DNA, 25 bp, Mus musculus
ccttgaaggcctggtctcgctgtct

SEQ ID NO: 424040 - DNA, 25 bp, Mus musculus
ccttgaagtctgaattccggccagt

SEQ ID NO: 424041 - DNA, 25 bp, Mus musculus
ccttgaagttgaggttggcttgtct

SEQ ID NO: 424042 - DNA, 25 bp, Mus musculus
ccttgaataccagggtgggcaccaa

SEQ ID NO: 424043 - DNA, 25 bp, Mus musculus
ccttgaatctgctcctggcttagga

SEQ ID NO: 424044 - DNA, 25 bp, Mus musculus
ccttgaatctttgtggctcccactg

SEQ ID NO: 424045 - DNA, 25 bp, Mus musculus
ccttgaattttggtagcgaaagaag

SEQ ID NO: 424046 - DNA, 25 bp, Mus musculus
ccttgacaggcgaggactcaggatg

SEQ ID NO: 424047 - DNA, 25 bp, Mus musculus
ccttgacagtgggaagagacgcctt

SEQ ID NO: 424048 - DNA, 25 bp, Mus musculus
ccttgaccatcaggtgtgacaccaa

SEQ ID NO: 424049 - DNA, 25 bp, Mus musculus
ccttgacctggatagtatgatgagc

SEQ ID NO: 424050 - DNA, 25 bp, Mus musculus
ccttgactccaggtagaagaaatac

SEQ ID NO: 424051 - DNA, 25 bp, Mus musculus
ccttgagaaggagtcgaaggtcaac

SEQ ID NO: 424052 - DNA, 25 bp, Mus musculus
ccttgagacaccgaggtactgccgg

SEQ ID NO: 424053 - DNA, 25 bp, Mus musculus
ccttgagagatgattcctggcggac

SEQ ID NO: 424054 - DNA, 25 bp, Mus musculus
ccttgagagtctgaagaggtcacag

SEQ ID NO: 424055 - DNA, 25 bp, Mus musculus
ccttgagcctgaaatccgaatagtg

SEQ ID NO: 424056 - DNA, 25 bp, Mus musculus
ccttgagctgtcctggttactgtga

SEQ ID NO: 424057 - DNA, 25 bp, Mus musculus
ccttgaggaattcccctggtgagaa

SEQ ID NO: 424058 - DNA, 25 bp, Mus musculus
ccttgaggccatgaggatgtcctga

SEQ ID NO: 424059 - DNA, 25 bp, Mus musculus
ccttgaggctgaacggaaccgatac

SEQ ID NO: 424060 - DNA, 25 bp, Mus musculus
ccttgagggaaagcaggcaacttct

SEQ ID NO: 424061 - DNA, 25 bp, Mus musculus
ccttgagtttttgtgaccatggtaa

SEQ ID NO: 424062 - DNA, 25 bp, Mus musculus
ccttgataagaatgagcagtgcacc

SEQ ID NO: 424063 - DNA, 25 bp, Mus musculus
ccttgatatacactgcggcggaccg

SEQ ID NO: 424064 - DNA, 25 bp, Mus musculus
ccttgatccggcagaagcggcaggc

SEQ ID NO: 424065 - DNA, 25 bp, Mus musculus
ccttgatcgcggagggttaccctat

SEQ ID NO: 424066 - DNA, 25 bp, Mus musculus
ccttgatgcaagctaaagtcatttg

SEQ ID NO: 424067 - DNA, 25 bp, Mus musculus
ccttgatggagaggaggccaaatcc

SEQ ID NO: 424068 - DNA, 25 bp, Mus musculus
ccttgatggaggagcagtgacagaa

SEQ ID NO: 424069 - DNA, 25 bp, Mus musculus
ccttgatggctgttgggaagaaaag

SEQ ID NO: 424070 - DNA, 25 bp, Mus musculus
ccttgatttgcagctgaggtcgcag

SEQ ID NO: 424071 - DNA, 25 bp, Mus musculus
ccttgcaaataaatagcctcttgga

SEQ ID NO: 424072 - DNA, 25 bp, Mus musculus
ccttgcaagaaaagacctgtcctga

SEQ ID NO: 424073 - DNA, 25 bp, Mus musculus
ccttgcagaagaccgtgtgtacaca

SEQ ID NO: 424074 - DNA, 25 bp, Mus musculus
ccttgcagcagttgagggacctact

SEQ ID NO: 424075 - DNA, 25 bp, Mus musculus
ccttgcagcatgacgaggagcacct

SEQ ID NO: 424076 - DNA, 25 bp, Mus musculus
ccttgcaggactggcagcattgcct

SEQ ID NO: 424077 - DNA, 25 bp, Mus musculus
ccttgcaggccctttaggagggagc

SEQ ID NO: 424078 - DNA, 25 bp, Mus musculus
ccttgcagggcaggcactatatgaa

SEQ ID NO: 424079 - DNA, 25 bp, Mus musculus
ccttgccaaggtgagctgtaggcct

SEQ ID NO: 424080 - DNA, 25 bp, Mus musculus
ccttgccagtggaaaatgagatcgc

SEQ ID NO: 424081 - DNA, 25 bp, Mus musculus
ccttgccgggacagcaacagagctg

SEQ ID NO: 424082 - DNA, 25 bp, Mus musculus
ccttgccgtgggtctttactatgaa

SEQ ID NO: 424083 - DNA, 25 bp, Mus musculus
ccttgcctttttgggagagctgcca

SEQ ID NO: 424084 - DNA, 25 bp, Mus musculus
ccttgcggaggtggaatttagtgct

SEQ ID NO: 424085 - DNA, 25 bp, Mus musculus
ccttgcgtgcatgcgtggacaccgg

SEQ ID NO: 424086 - DNA, 25 bp, Mus musculus
ccttgctagataggctgacaacaga

SEQ ID NO: 424087 - DNA, 25 bp, Mus musculus
ccttgctagggattttgggccacga

SEQ ID NO: 424088 - DNA, 25 bp, Mus musculus
ccttgctagtaccagcctatatggg

SEQ ID NO: 424089 - DNA, 25 bp, Mus musculus
ccttgctagtgtgggaggcctctac

SEQ ID NO: 424090 - DNA, 25 bp, Mus musculus
ccttgctcttagtccaagaccatga

SEQ ID NO: 424091 - DNA, 25 bp, Mus musculus
ccttgctggaggacaggtgcagcct

SEQ ID NO: 424092 - DNA, 25 bp, Mus musculus
ccttgctgggatgcgatgagctctc

SEQ ID NO: 424093 - DNA, 25 bp, Mus musculus
ccttgcttaaatgtctctttatcag

SEQ ID NO: 424094 - DNA, 25 bp, Mus musculus
ccttgcttgtcgtccgtgctgtcgc

SEQ ID NO: 424095 - DNA, 25 bp, Mus musculus
ccttggaaagcgactctgatgacag

SEQ ID NO: 424096 - DNA, 25 bp, Mus musculus
ccttggaacttggaaacagctacac

SEQ ID NO: 424097 - DNA, 25 bp, Mus musculus
ccttggaagtcgtgccgagtgtccc

SEQ ID NO: 424098 - DNA, 25 bp, Mus musculus
ccttggaagtgcgtggtgagactcc

SEQ ID NO: 424099 - DNA, 25 bp, Mus musculus
ccttggacaagagatgcctgggcat

SEQ ID NO: 424100 - DNA, 25 bp, Mus musculus
ccttggaccgctgaaaagggcctga

SEQ ID NO: 424101 - DNA, 25 bp, Mus musculus
ccttggaccggagcagttgccagat

SEQ ID NO: 424102 - DNA, 25 bp, Mus musculus
ccttggacctatagtgctgggactc

SEQ ID NO: 424103 - DNA, 25 bp, Mus musculus
ccttggactctttcgagttggcaga

SEQ ID NO: 424104 - DNA, 25 bp, Mus musculus
ccttggactgcgcaaagaagctgta

SEQ ID NO: 424105 - DNA, 25 bp, Mus musculus
ccttggactgggtaaaactgatgct

SEQ ID NO: 424106 - DNA, 25 bp, Mus musculus
ccttggagaaaagctctgctgccct

SEQ ID NO: 424107 - DNA, 25 bp, Mus musculus
ccttggagaagagactgcaagatgc

SEQ ID NO: 424108 - DNA, 25 bp, Mus musculus
ccttggagaccaagagatgtgatta

SEQ ID NO: 424109 - DNA, 25 bp, Mus musculus
ccttggagaggtacctagactacgc

SEQ ID NO: 424110 - DNA, 25 bp, Mus musculus
ccttggagcagggacaatggcctct

SEQ ID NO: 424111 - DNA, 25 bp, Mus musculus
ccttggagcagtcttcggaaaacga

SEQ ID NO: 424112 - DNA, 25 bp, Mus musculus
ccttggagctggatcattggattca

SEQ ID NO: 424113 - DNA, 25 bp, Mus musculus
ccttggaggacacagaatgcagtac

SEQ ID NO: 424114 - DNA, 25 bp, Mus musculus
ccttggaggaccagaacgagacaat

SEQ ID NO: 424115 - DNA, 25 bp, Mus musculus
ccttggagtaggaggcctcagaaac

SEQ ID NO: 424116 - DNA, 25 bp, Mus musculus
ccttggagtttgacactatgcagat

SEQ ID NO: 424117 - DNA, 25 bp, Mus musculus
ccttggatacgtaattgcgggtgcg

SEQ ID NO: 424118 - DNA, 25 bp, Mus musculus
ccttggatagagtaagttggctcca

SEQ ID NO: 424119 - DNA, 25 bp, Mus musculus
ccttggatcggtgctgttacgggaa

SEQ ID NO: 424120 - DNA, 25 bp, Mus musculus
ccttggatggaatagaaagagagcc

SEQ ID NO: 424121 - DNA, 25 bp, Mus musculus
ccttggattcggacagactctgaac

SEQ ID NO: 424122 - DNA, 25 bp, Mus musculus
ccttggcagggaacaaagctgacct

SEQ ID NO: 424123 - DNA, 25 bp, Mus musculus
ccttggcatggagcaagcctggact

SEQ ID NO: 424124 - DNA, 25 bp, Mus musculus
ccttggccagcagagatgtatagca

SEQ ID NO: 424125 - DNA, 25 bp, Mus musculus
ccttggccatcaactgttgcaggga

SEQ ID NO: 424126 - DNA, 25 bp, Mus musculus
ccttggccatgggacagtgatccaa

SEQ ID NO: 424127 - DNA, 25 bp, Mus musculus
ccttggcgagcaatactacaaagat

SEQ ID NO: 424128 - DNA, 25 bp, Mus musculus
ccttggcgtccaactggtgggctac

SEQ ID NO: 424129 - DNA, 25 bp, Mus musculus
ccttggctcactagtcattgtaaaa

SEQ ID NO: 424130 - DNA, 25 bp, Mus musculus
ccttggctcgcgtcacgtgctgata

SEQ ID NO: 424131 - DNA, 25 bp, Mus musculus
ccttggctgaatggaggaacatctc

SEQ ID NO: 424132 - DNA, 25 bp, Mus musculus
ccttggctgaggaccgaggttcaat

SEQ ID NO: 424133 - DNA, 25 bp, Mus musculus
ccttggctgtgaagaggactttgcc

SEQ ID NO: 424134 - DNA, 25 bp, Mus musculus
ccttggcttccagcagcttgtcaga

SEQ ID NO: 424135 - DNA, 25 bp, Mus musculus
ccttggcttccatatcagcctaggg

SEQ ID NO: 424136 - DNA, 25 bp, Mus musculus
ccttgggaatcatcgggtggctcac

SEQ ID NO: 424137 - DNA, 25 bp, Mus musculus
ccttgggaatgaaactgggctctca

SEQ ID NO: 424138 - DNA, 25 bp, Mus musculus
ccttgggagctcagattggcatcga

SEQ ID NO: 424139 - DNA, 25 bp, Mus musculus
ccttgggaggtactagttgctttga

SEQ ID NO: 424140 - DNA, 25 bp, Mus musculus
ccttgggagtccttcttgtgacagt

SEQ ID NO: 424141 - DNA, 25 bp, Mus musculus
ccttgggatgtggatacagtttgca

SEQ ID NO: 424142 - DNA, 25 bp, Mus musculus
ccttgggcagggtgtttgatatttc

SEQ ID NO: 424143 - DNA, 25 bp, Mus musculus
ccttgggcccacacagaaatctcat

SEQ ID NO: 424144 - DNA, 25 bp, Mus musculus
ccttgggcctattttcatttcgact

SEQ ID NO: 424145 - DNA, 25 bp, Mus musculus
ccttgggtaggtgctgggatattcc

SEQ ID NO: 424146 - DNA, 25 bp, Mus musculus
ccttgggtcctctttggtgctctca

SEQ ID NO: 424147 - DNA, 25 bp, Mus musculus
ccttgggttgagttaaagcgatgtc

SEQ ID NO: 424148 - DNA, 25 bp, Mus musculus
ccttggtaagccagtaattcaggcc

SEQ ID NO: 424149 - DNA, 25 bp, Mus musculus
ccttggtacaagatgggctggccct

SEQ ID NO: 424150 - DNA, 25 bp, Mus musculus
ccttggtacgtgtcggtgaatggca

SEQ ID NO: 424151 - DNA, 25 bp, Mus musculus
ccttggtagatggtgaggagcccca

SEQ ID NO: 424152 - DNA, 25 bp, Mus musculus
ccttggtagcagctgatgccttaga

SEQ ID NO: 424153 - DNA, 25 bp, Mus musculus
ccttggtatctcaatcaggaaggaa

SEQ ID NO: 424154 - DNA, 25 bp, Mus musculus
ccttggtcagtgctgggctttttct

SEQ ID NO: 424155 - DNA, 25 bp, Mus musculus
ccttggtcattttggctatggccga

SEQ ID NO: 424156 - DNA, 25 bp, Mus musculus
ccttggtcgcgcttaacgtgggagt

SEQ ID NO: 424157 - DNA, 25 bp, Mus musculus
ccttggtctgtagtatggcgtgccc

SEQ ID NO: 424158 - DNA, 25 bp, Mus musculus
ccttggtgcttggtttgaagcacat

SEQ ID NO: 424159 - DNA, 25 bp, Mus musculus
ccttggtggccagtgaacagcattc

SEQ ID NO: 424160 - DNA, 25 bp, Mus musculus
ccttggtgtcagaagacgacatccc

SEQ ID NO: 424161 - DNA, 25 bp, Mus musculus
ccttgtaacttcaggcaagatgtcg

SEQ ID NO: 424162 - DNA, 25 bp, Mus musculus
ccttgtaatgtgattctgggaccct

SEQ ID NO: 424163 - DNA, 25 bp, Mus musculus
ccttgtactgggtggaagactagtc

SEQ ID NO: 424164 - DNA, 25 bp, Mus musculus
ccttgtagatttgctgaccgtgtca

SEQ ID NO: 424165 - DNA, 25 bp, Mus musculus
ccttgtatgatactggctccgggac

SEQ ID NO: 424166 - DNA, 25 bp, Mus musculus
ccttgtcaacagtcttgggctagct

SEQ ID NO: 424167 - DNA, 25 bp, Mus musculus
ccttgtcagcccttgtcagtggaga

SEQ ID NO: 424168 - DNA, 25 bp, Mus musculus
ccttgtcaggccagagctatagcac

SEQ ID NO: 424169 - DNA, 25 bp, Mus musculus
ccttgtccggttgtgggtgagcatc

SEQ ID NO: 424170 - DNA, 25 bp, Mus musculus
ccttgtcctacggataagttgtggt

SEQ ID NO: 424171 - DNA, 25 bp, Mus musculus
ccttgtcggtcaaaagtgaagcgct

SEQ ID NO: 424172 - DNA, 25 bp, Mus musculus
ccttgtctagtggaaaattagggtg

SEQ ID NO: 424173 - DNA, 25 bp, Mus musculus
ccttgtctcagggactcagggctgg

SEQ ID NO: 424174 - DNA, 25 bp, Mus musculus
ccttgtctgtgttggtgaccatcga

SEQ ID NO: 424175 - DNA, 25 bp, Mus musculus
ccttgtgaacaagagcccgaggaag

SEQ ID NO: 424176 - DNA, 25 bp, Mus musculus
ccttgtgaatatgtcgaagcagcca

SEQ ID NO: 424177 - DNA, 25 bp, Mus musculus
ccttgtgcacctgtgaccgcaggaa

SEQ ID NO: 424178 - DNA, 25 bp, Mus musculus
ccttgtgcaggggacattagaaaat

SEQ ID NO: 424179 - DNA, 25 bp, Mus musculus
ccttgtgcctacacagggtgatgca

SEQ ID NO: 424180 - DNA, 25 bp, Mus musculus
ccttgtgcggaaggagcatacatct

SEQ ID NO: 424181 - DNA, 25 bp, Mus musculus
ccttgtggcggctctgaaaagctgg

SEQ ID NO: 424182 - DNA, 25 bp, Mus musculus
ccttgtggcgttagctgattattct

SEQ ID NO: 424183 - DNA, 25 bp, Mus musculus
ccttgtggctgggtgagaaatacta

SEQ ID NO: 424184 - DNA, 25 bp, Mus musculus
ccttgtgggagaaagtggccgttgt

SEQ ID NO: 424185 - DNA, 25 bp, Mus musculus
ccttgtgtctgcacgacctgtggaa

SEQ ID NO: 424186 - DNA, 25 bp, Mus musculus
ccttgtgtgaaagcatgaggcagag

SEQ ID NO: 424187 - DNA, 25 bp, Mus musculus
ccttgtgtgccttacagggtgaaca

SEQ ID NO: 424188 - DNA, 25 bp, Mus musculus
ccttgttactatcgtggccgcatga

SEQ ID NO: 424189 - DNA, 25 bp, Mus musculus
ccttgttcatttgaagttgaggaga

SEQ ID NO: 424190 - DNA, 25 bp, Mus musculus
ccttgttgagtgtgaggcgctgccc

SEQ ID NO: 424191 - DNA, 25 bp, Mus musculus
ccttgttgctcagaggatgctgaac

SEQ ID NO: 424192 - DNA, 25 bp, Mus musculus
ccttgttgttcaggtgggtaggaat

SEQ ID NO: 424193 - DNA, 25 bp, Mus musculus
ccttgttttctgtcagtgagtagac

SEQ ID NO: 424194 - DNA, 25 bp, Mus musculus
cctttaagagcagggactattgggc

SEQ ID NO: 424195 - DNA, 25 bp, Mus musculus
cctttaagaggtcattggcatctga

SEQ ID NO: 424196 - DNA, 25 bp, Mus musculus
cctttaagcttgactttagagacct

SEQ ID NO: 424197 - DNA, 25 bp, Mus musculus
cctttaaggctgacgttcgggctcg

SEQ ID NO: 424198 - DNA, 25 bp, Mus musculus
cctttaatgattggaagtggcaggc

SEQ ID NO: 424199 - DNA, 25 bp, Mus musculus
cctttacaccagctgtgacaacaga

SEQ ID NO: 424200 - DNA, 25 bp, Mus musculus
cctttacgagatagggttggatcgg

SEQ ID NO: 424201 - DNA, 25 bp, Mus musculus
cctttagacagagagcgagcttcag

SEQ ID NO: 424202 - DNA, 25 bp, Mus musculus
cctttagatatagcagggccctcaa

SEQ ID NO: 424203 - DNA, 25 bp, Mus musculus
cctttagcaggtggaacgcggagtc

SEQ ID NO: 424204 - DNA, 25 bp, Mus musculus
cctttatagacatgtgggctgcacc

SEQ ID NO: 424205 - DNA, 25 bp, Mus musculus
cctttatccaaggagagcctgaact

SEQ ID NO: 424206 - DNA, 25 bp, Mus musculus
cctttatctgcgactccagcgcggg

SEQ ID NO: 424207 - DNA, 25 bp, Mus musculus
cctttcaaggacagggagttgccag

SEQ ID NO: 424208 - DNA, 25 bp, Mus musculus
cctttcaagttagcagcttgatatg

SEQ ID NO: 424209 - DNA, 25 bp, Mus musculus
cctttcagctgtagtggctcctgga

SEQ ID NO: 424210 - DNA, 25 bp, Mus musculus
cctttcaggaagcattacggacccg

SEQ ID NO: 424211 - DNA, 25 bp, Mus musculus
cctttcagggacgatgcgcgagtac

SEQ ID NO: 424212 - DNA, 25 bp, Mus musculus
cctttcagtacttctcagaaacgat

SEQ ID NO: 424213 - DNA, 25 bp, Mus musculus
cctttcagtgagtctaccattacga

SEQ ID NO: 424214 - DNA, 25 bp, Mus musculus
cctttcattcaattgcctgggcaga

SEQ ID NO: 424215 - DNA, 25 bp, Mus musculus
cctttcattggcaagacggtcgaca

SEQ ID NO: 424216 - DNA, 25 bp, Mus musculus
cctttccaacgagcaggagcgcagt

SEQ ID NO: 424217 - DNA, 25 bp, Mus musculus
cctttccaatctgaaaacaggattg

SEQ ID NO: 424218 - DNA, 25 bp, Mus musculus
cctttccacgtgtggatcaggatgt

SEQ ID NO: 424219 - DNA, 25 bp, Mus musculus
cctttccatgtgcaaggtgtctgca

SEQ ID NO: 424220 - DNA, 25 bp, Mus musculus
cctttcccagaacaaccttggtatg

SEQ ID NO: 424221 - DNA, 25 bp, Mus musculus
cctttcccaggtactaagagccaag

SEQ ID NO: 424222 - DNA, 25 bp, Mus musculus
cctttcctcgatgacgtatactgct

SEQ ID NO: 424223 - DNA, 25 bp, Mus musculus
cctttccttccagggtatcttactg

SEQ ID NO: 424224 - DNA, 25 bp, Mus musculus
cctttccttcgaggttgaagctagc

SEQ ID NO: 424225 - DNA, 25 bp, Mus musculus
cctttcgagaacatgtggcctggga

SEQ ID NO: 424226 - DNA, 25 bp, Mus musculus
cctttcggagagacaagtaaccatt

SEQ ID NO: 424227 - DNA, 25 bp, Mus musculus
cctttcgttagagcaagagactttc

SEQ ID NO: 424228 - DNA, 25 bp, Mus musculus
cctttctacgtggtacagctggtca

SEQ ID NO: 424229 - DNA, 25 bp, Mus musculus
cctttctcaccgatgtgggaaggaa

SEQ ID NO: 424230 - DNA, 25 bp, Mus musculus
cctttctgaagacacggcatcggac

SEQ ID NO: 424231 - DNA, 25 bp, Mus musculus
cctttctgccaaagtcagtgctggt

SEQ ID NO: 424232 - DNA, 25 bp, Mus musculus
cctttctgcccgaaaatgctattgg

SEQ ID NO: 424233 - DNA, 25 bp, Mus musculus
cctttctgcgtctgggagcttggaa

SEQ ID NO: 424234 - DNA, 25 bp, Mus musculus
cctttctgctgctggtagggattta

SEQ ID NO: 424235 - DNA, 25 bp, Mus musculus
cctttctggcttccttcatggctat

SEQ ID NO: 424236 - DNA, 25 bp, Mus musculus
cctttctgtatggtagagaaataga

SEQ ID NO: 424237 - DNA, 25 bp, Mus musculus
cctttcttatttgcccttcgatgac

SEQ ID NO: 424238 - DNA, 25 bp, Mus musculus
cctttcttcagatggatgattagtg

SEQ ID NO: 424239 - DNA, 25 bp, Mus musculus
cctttgaaaacacagcttggcgact

SEQ ID NO: 424240 - DNA, 25 bp, Mus musculus
cctttgaaagaatcaggctgctcag

SEQ ID NO: 424241 - DNA, 25 bp, Mus musculus
cctttgaaagatgaacagtgtagcc

SEQ ID NO: 424242 - DNA, 25 bp, Mus musculus
cctttgacatgaaccaagtggctgc

SEQ ID NO: 424243 - DNA, 25 bp, Mus musculus
cctttgacgtgaacatgaagccggt

SEQ ID NO: 424244 - DNA, 25 bp, Mus musculus
cctttgactgtcaggagtgggccga

SEQ ID NO: 424245 - DNA, 25 bp, Mus musculus
cctttgagctggatcagcaggcctt

SEQ ID NO: 424246 - DNA, 25 bp, Mus musculus
cctttgaggctggtgtgtgactaga

SEQ ID NO: 424247 - DNA, 25 bp, Mus musculus
cctttgaggttgaccatgaagatgc

SEQ ID NO: 424248 - DNA, 25 bp, Mus musculus
cctttgagtcagaacggcaagaact

SEQ ID NO: 424249 - DNA, 25 bp, Mus musculus
cctttgatgaggtaacaattcctgc

SEQ ID NO: 424250 - DNA, 25 bp, Mus musculus
cctttgatgggccagggaacactct

SEQ ID NO: 424251 - DNA, 25 bp, Mus musculus
cctttgatgttctgactggtgtgtc

SEQ ID NO: 424252 - DNA, 25 bp, Mus musculus
cctttgattggtgcgctacagtatg

SEQ ID NO: 424253 - DNA, 25 bp, Mus musculus
cctttgcagctctgtttgggaagga

SEQ ID NO: 424254 - DNA, 25 bp, Mus musculus
cctttgccatcggaggctccgggag

SEQ ID NO: 424255 - DNA, 25 bp, Mus musculus
cctttgccgctgtgtggacgcggct

SEQ ID NO: 424256 - DNA, 25 bp, Mus musculus
cctttgcctagtgcagggagccatc

SEQ ID NO: 424257 - DNA, 25 bp, Mus musculus
cctttgcctccctgagtactaggat

SEQ ID NO: 424258 - DNA, 25 bp, Mus musculus
cctttgcgcctgtgctcctgatgta

SEQ ID NO: 424259 - DNA, 25 bp, Mus musculus
cctttgcgcgagcaaaatggcggcc

SEQ ID NO: 424260 - DNA, 25 bp, Mus musculus
cctttgctccacatgctgggtgctg

SEQ ID NO: 424261 - DNA, 25 bp, Mus musculus
cctttggaaactggtagagactgca

SEQ ID NO: 424262 - DNA, 25 bp, Mus musculus
cctttggaccattggactatgagag

SEQ ID NO: 424263 - DNA, 25 bp, Mus musculus
cctttggagacatcacagatattca

SEQ ID NO: 424264 - DNA, 25 bp, Mus musculus
cctttggagcaagttagggcacaag

SEQ ID NO: 424265 - DNA, 25 bp, Mus musculus
cctttggaggaaccacttagacact

SEQ ID NO: 424266 - DNA, 25 bp, Mus musculus
cctttggataaactggctagttagc

SEQ ID NO: 424267 - DNA, 25 bp, Mus musculus
cctttggatcttgtcgggctttcca

SEQ ID NO: 424268 - DNA, 25 bp, Mus musculus
cctttggatttcaggtgtggagata

SEQ ID NO: 424269 - DNA, 25 bp, Mus musculus
cctttggcagggaattacggacagc

SEQ ID NO: 424270 - DNA, 25 bp, Mus musculus
cctttggcatcctagttcagagaga

SEQ ID NO: 424271 - DNA, 25 bp, Mus musculus
cctttggcctgctgggtcaagaaca

SEQ ID NO: 424272 - DNA, 25 bp, Mus musculus
cctttgggagtgcaaggcttctcca

SEQ ID NO: 424273 - DNA, 25 bp, Mus musculus
cctttgggatcaatgcggctagcct

SEQ ID NO: 424274 - DNA, 25 bp, Mus musculus
cctttgggtcgtagtggcttcctga

SEQ ID NO: 424275 - DNA, 25 bp, Mus musculus
cctttggtggttccctggagagtct

SEQ ID NO: 424276 - DNA, 25 bp, Mus musculus
cctttggtgtcttcccttgtggaga

SEQ ID NO: 424277 - DNA, 25 bp, Mus musculus
cctttgtaatctgctgccagccgtg

SEQ ID NO: 424278 - DNA, 25 bp, Mus musculus
cctttgtccaactgggctgagctga

SEQ ID NO: 424279 - DNA, 25 bp, Mus musculus
cctttgtcctgagaaatgtgctttg

SEQ ID NO: 424280 - DNA, 25 bp, Mus musculus
cctttgtcgtacagctgagtgggca

SEQ ID NO: 424281 - DNA, 25 bp, Mus musculus
cctttgtctcagtggatgcttccga

SEQ ID NO: 424282 - DNA, 25 bp, Mus musculus
cctttgtggaaagcgccaaccgtga

SEQ ID NO: 424283 - DNA, 25 bp, Mus musculus
cctttgtggcaaacccgatgtggct

SEQ ID NO: 424284 - DNA, 25 bp, Mus musculus
cctttgttaagtatcaggcatagac

SEQ ID NO: 424285 - DNA, 25 bp, Mus musculus
cctttgttcactgcggcctggtggg

SEQ ID NO: 424286 - DNA, 25 bp, Mus musculus
cctttgttcaggtagaggccccaga

SEQ ID NO: 424287 - DNA, 25 bp, Mus musculus
cctttgttcgaatgctggccccaga

SEQ ID NO: 424288 - DNA, 25 bp, Mus musculus
ccttttaacttgacagactatgctt

SEQ ID NO: 424289 - DNA, 25 bp, Mus musculus
ccttttaagtcagtctgatgctgag

SEQ ID NO: 424290 - DNA, 25 bp, Mus musculus
ccttttacaccagagaaagcgaaag

SEQ ID NO: 424291 - DNA, 25 bp, Mus musculus
ccttttagaaactgagcctgtctgt

SEQ ID NO: 424292 - DNA, 25 bp, Mus musculus
ccttttagcaagatggactctcccg

SEQ ID NO: 424293 - DNA, 25 bp, Mus musculus
ccttttaggatcctccctgatagag

SEQ ID NO: 424294 - DNA, 25 bp, Mus musculus
ccttttataagcaacagttcctgtg

SEQ ID NO: 424295 - DNA, 25 bp, Mus musculus
ccttttcaagcttgggagccgcgaa

SEQ ID NO: 424296 - DNA, 25 bp, Mus musculus
ccttttcagggtggacctcagcact

SEQ ID NO: 424297 - DNA, 25 bp, Mus musculus
ccttttccagttctgtggatctacc

SEQ ID NO: 424298 - DNA, 25 bp, Mus musculus
ccttttcccgggtgcagatctgtga

SEQ ID NO: 424299 - DNA, 25 bp, Mus musculus
ccttttcccttagcggaggcggcag

SEQ ID NO: 424300 - DNA, 25 bp, Mus musculus
ccttttcgaaacaggctcaggtagc

SEQ ID NO: 424301 - DNA, 25 bp, Mus musculus
ccttttcggtgtagcctttgcaact

SEQ ID NO: 424302 - DNA, 25 bp, Mus musculus
ccttttctggcagcaggcgtatcaa

SEQ ID NO: 424303 - DNA, 25 bp, Mus musculus
ccttttcttgggagactgtcagtcc

SEQ ID NO: 424304 - DNA, 25 bp, Mus musculus
ccttttcttgttggcgctgctgacc

SEQ ID NO: 424305 - DNA, 25 bp, Mus musculus
ccttttgacagaggatgagacgacc

SEQ ID NO: 424306 - DNA, 25 bp, Mus musculus
ccttttgactgtgctttgagaggaa

SEQ ID NO: 424307 - DNA, 25 bp, Mus musculus
ccttttgagaaagccatggcgaagt

SEQ ID NO: 424308 - DNA, 25 bp, Mus musculus
ccttttgatggacctcagagtagca

SEQ ID NO: 424309 - DNA, 25 bp, Mus musculus
ccttttgattgtttacttcagctac

SEQ ID NO: 424310 - DNA, 25 bp, Mus musculus
ccttttgctgcgattggaggctaca

SEQ ID NO: 424311 - DNA, 25 bp, Mus musculus
ccttttgctgtatgtagattgggca

SEQ ID NO: 424312 - DNA, 25 bp, Mus musculus
ccttttgcttccagcacttttgcaa

SEQ ID NO: 424313 - DNA, 25 bp, Mus musculus
ccttttggagtgacaggaaggaaag

SEQ ID NO: 424314 - DNA, 25 bp, Mus musculus
ccttttgggaaaatgtgctgatgca

SEQ ID NO: 424315 - DNA, 25 bp, Mus musculus
ccttttggtaactgtactgacgtga

SEQ ID NO: 424316 - DNA, 25 bp, Mus musculus
ccttttggtagatgagatgggcctt

SEQ ID NO: 424317 - DNA, 25 bp, Mus musculus
ccttttgtgtaagcatgagtaccag

SEQ ID NO: 424318 - DNA, 25 bp, Mus musculus
ccttttgttaggaatcatcagtctc

SEQ ID NO: 424319 - DNA, 25 bp, Mus musculus
cctttttagggagttgcctggcaca

SEQ ID NO: 424320 - DNA, 25 bp, Mus musculus
cgaaaaacatctcggtgaccccagg

SEQ ID NO: 424321 - DNA, 25 bp, Mus musculus
cgaaaaatggacgaactgggctcca

SEQ ID NO: 424322 - DNA, 25 bp, Mus musculus
cgaaaacagagttcccaggatgaag

SEQ ID NO: 424323 - DNA, 25 bp, Mus musculus
cgaaaactgtgactccaagcggtgt

SEQ ID NO: 424324 - DNA, 25 bp, Mus musculus
cgaaaacttgttcagagaattggac

SEQ ID NO: 424325 - DNA, 25 bp, Mus musculus
cgaaaagacgctcaacagtgggcct

SEQ ID NO: 424326 - DNA, 25 bp, Mus musculus
cgaaaagactgcaagaggcggaact

SEQ ID NO: 424327 - DNA, 25 bp, Mus musculus
cgaaaagtgagagattagttgagcc

SEQ ID NO: 424328 - DNA, 25 bp, Mus musculus
cgaaaatgctctggaagccccggtt

SEQ ID NO: 424329 - DNA, 25 bp, Mus musculus
cgaaaccatcaaggcggaattagtc

SEQ ID NO: 424330 - DNA, 25 bp, Mus musculus
cgaaaccctgtgtccttggaggaag

SEQ ID NO: 424331 - DNA, 25 bp, Mus musculus
cgaaaccgggcatctgggggcctct

SEQ ID NO: 424332 - DNA, 25 bp, Mus musculus
cgaaacctgtcatcgtggaccggcg

SEQ ID NO: 424333 - DNA, 25 bp, Mus musculus
cgaaacgctggcttgcacaactggt

SEQ ID NO: 424334 - DNA, 25 bp, Mus musculus
cgaaactactatggctgcgggcaga

SEQ ID NO: 424335 - DNA, 25 bp, Mus musculus
cgaaactggatcacctggagagaag

SEQ ID NO: 424336 - DNA, 25 bp, Mus musculus
cgaaagatttgctgcttgggaccac

SEQ ID NO: 424337 - DNA, 25 bp, Mus musculus
cgaaagcagataagagccgatgggc

SEQ ID NO: 424338 - DNA, 25 bp, Mus musculus
cgaaagccggcaagtgctgctgctg

SEQ ID NO: 424339 - DNA, 25 bp, Mus musculus
cgaaagctccgggtttgcgttgcca

SEQ ID NO: 424340 - DNA, 25 bp, Mus musculus
cgaaagctcttgtaagtatgcggag

SEQ ID NO: 424341 - DNA, 25 bp, Mus musculus
cgaaaggctttgtaccacatctggc

SEQ ID NO: 424342 - DNA, 25 bp, Mus musculus
cgaaagtgtgagagcaagaaacccc

SEQ ID NO: 424343 - DNA, 25 bp, Mus musculus
cgaaatccatcaaaaaatatagcct

SEQ ID NO: 424344 - DNA, 25 bp, Mus musculus
cgaaatcccgaagaagagtgagcct

SEQ ID NO: 424345 - DNA, 25 bp, Mus musculus
cgaaatccgtcaagctccagtgtga

SEQ ID NO: 424346 - DNA, 25 bp, Mus musculus
cgaaatcggagacactgaggatgcc

SEQ ID NO: 424347 - DNA, 25 bp, Mus musculus
cgaaatggagtcatgcagggcctgt

SEQ ID NO: 424348 - DNA, 25 bp, Mus musculus
cgaaatgtatatggggcttgtagtc

SEQ ID NO: 424349 - DNA, 25 bp, Mus musculus
cgaaattgcggttgctagcccaaaa

SEQ ID NO: 424350 - DNA, 25 bp, Mus musculus
cgaaattgctgtggactggaccagc

SEQ ID NO: 424351 - DNA, 25 bp, Mus musculus
cgaacaaactgcctctgataaaaat

SEQ ID NO: 424352 - DNA, 25 bp, Mus musculus
cgaacaagagcagggctagatggcc

SEQ ID NO: 424353 - DNA, 25 bp, Mus musculus
cgaacaaggctttcatgatacatct

SEQ ID NO: 424354 - DNA, 25 bp, Mus musculus
cgaacacgtttgtggcagagctaaa

SEQ ID NO: 424355 - DNA, 25 bp, Mus musculus
cgaacactgagtggtatggagtcct

SEQ ID NO: 424356 - DNA, 25 bp, Mus musculus
cgaacagagatcttgcggagccgga

SEQ ID NO: 424357 - DNA, 25 bp, Mus musculus
cgaacatttctatgtggcactaaag

SEQ ID NO: 424358 - DNA, 25 bp, Mus musculus
cgaaccactggattagtgactgcca

SEQ ID NO: 424359 - DNA, 25 bp, Mus musculus
cgaacccaggttctgatgtgacgtg

SEQ ID NO: 424360 - DNA, 25 bp, Mus musculus
cgaaccggcagtatttcccactgag

SEQ ID NO: 424361 - DNA, 25 bp, Mus musculus
cgaacggaccggatttccgctgcat

SEQ ID NO: 424362 - DNA, 25 bp, Mus musculus
cgaacggagagtcattgtgcctgca

SEQ ID NO: 424363 - DNA, 25 bp, Mus musculus
cgaacgtcttacatcccggaggaga

SEQ ID NO: 424364 - DNA, 25 bp, Mus musculus
cgaactaagtactgggagctcacct

SEQ ID NO: 424365 - DNA, 25 bp, Mus musculus
cgaactagcattgagaaccgtgtga

SEQ ID NO: 424366 - DNA, 25 bp, Mus musculus
cgaactctgcagtgtgcaatgaaga

SEQ ID NO: 424367 - DNA, 25 bp, Mus musculus
cgaagaaacaaatataaggcgtcct

SEQ ID NO: 424368 - DNA, 25 bp, Mus musculus
cgaagaaaggctccaagaaagccat

SEQ ID NO: 424369 - DNA, 25 bp, Mus musculus
cgaagaagacggaaagtgacccgct

SEQ ID NO: 424370 - DNA, 25 bp, Mus musculus
cgaagaaggtacattagtgaagaac

SEQ ID NO: 424371 - DNA, 25 bp, Mus musculus
cgaagacgccggagcgctttgtgca

SEQ ID NO: 424372 - DNA, 25 bp, Mus musculus
cgaagactagagaccagcaccatgt

SEQ ID NO: 424373 - DNA, 25 bp, Mus musculus
cgaagacttagctctgggaaggtgc

SEQ ID NO: 424374 - DNA, 25 bp, Mus musculus
cgaagagatcaaaacccagaaggtc

SEQ ID NO: 424375 - DNA, 25 bp, Mus musculus
cgaagagcggttgtgtggcctccat

SEQ ID NO: 424376 - DNA, 25 bp, Mus musculus
cgaagagctacgaagtcgcacggta

SEQ ID NO: 424377 - DNA, 25 bp, Mus musculus
cgaagagcttcgagcagagacggca

SEQ ID NO: 424378 - DNA, 25 bp, Mus musculus
cgaagaggacgctctactgtgacta

SEQ ID NO: 424379 - DNA, 25 bp, Mus musculus
cgaagatggtgtgttctctctggca

SEQ ID NO: 424380 - DNA, 25 bp, Mus musculus
cgaagcaaacgggaagagataagga

SEQ ID NO: 424381 - DNA, 25 bp, Mus musculus
cgaagcacgtggaacccgggagatt

SEQ ID NO: 424382 - DNA, 25 bp, Mus musculus
cgaagccccttgttgctggatgcat

SEQ ID NO: 424383 - DNA, 25 bp, Mus musculus
cgaagccgtgaaatacagcgtaact

SEQ ID NO: 424384 - DNA, 25 bp, Mus musculus
cgaagcctccaattaagcggcagga

SEQ ID NO: 424385 - DNA, 25 bp, Mus musculus
cgaagcgcctgactccgacaatggc

SEQ ID NO: 424386 - DNA, 25 bp, Mus musculus
cgaagcgcggatctcggtagctggt

SEQ ID NO: 424387 - DNA, 25 bp, Mus musculus
cgaagcgcttgagctggaaggacct

SEQ ID NO: 424388 - DNA, 25 bp, Mus musculus
cgaagcgtaaggaagttctgtgcca

SEQ ID NO: 424389 - DNA, 25 bp, Mus musculus
cgaagctactttctttgctgctcag

SEQ ID NO: 424390 - DNA, 25 bp, Mus musculus
cgaagctattgtgggcatgggatcc

SEQ ID NO: 424391 - DNA, 25 bp, Mus musculus
cgaagctctgccgtctgaagggaag

SEQ ID NO: 424392 - DNA, 25 bp, Mus musculus
cgaagctgcgccagcgcacgtgcat

SEQ ID NO: 424393 - DNA, 25 bp, Mus musculus
cgaagcttgtctttagggctcggat

SEQ ID NO: 424394 - DNA, 25 bp, Mus musculus
cgaaggactcttgatggtgtgtgac

SEQ ID NO: 424395 - DNA, 25 bp, Mus musculus
cgaaggattacattctccacggaga

SEQ ID NO: 424396 - DNA, 25 bp, Mus musculus
cgaaggcacggtgttcgaccgcagt

SEQ ID NO: 424397 - DNA, 25 bp, Mus musculus
cgaagggcaccttgcttcccactga

SEQ ID NO: 424398 - DNA, 25 bp, Mus musculus
cgaagggtcgctagatgggatccca

SEQ ID NO: 424399 - DNA, 25 bp, Mus musculus
cgaagggtttctacacgagcgtcaa

SEQ ID NO: 424400 - DNA, 25 bp, Mus musculus
cgaaggtagccagtcacaaggttct

SEQ ID NO: 424401 - DNA, 25 bp, Mus musculus
cgaaggtcaatttaagcgggctgcc

SEQ ID NO: 424402 - DNA, 25 bp, Mus musculus
cgaaggtcaccaagcccaagaaggt

SEQ ID NO: 424403 - DNA, 25 bp, Mus musculus
cgaaggtgacagcaatcaaggccga

SEQ ID NO: 424404 - DNA, 25 bp, Mus musculus
cgaaggtggacagcttacagtctca

SEQ ID NO: 424405 - DNA, 25 bp, Mus musculus
cgaagttggagaaggcagacatcct

SEQ ID NO: 424406 - DNA, 25 bp, Mus musculus
cgaagttttaccaagcagtggctgc

SEQ ID NO: 424407 - DNA, 25 bp, Mus musculus
cgaataactgagtctggtgtgggct

SEQ ID NO: 424408 - DNA, 25 bp, Mus musculus
cgaatagtcctggttgtctgggtct

SEQ ID NO: 424409 - DNA, 25 bp, Mus musculus
cgaatcacagaaactcccaaggcga

SEQ ID NO: 424410 - DNA, 25 bp, Mus musculus
cgaatcaccgaaaaaggctgggcca

SEQ ID NO: 424411 - DNA, 25 bp, Mus musculus
cgaatccagggtggttggtctacaa

SEQ ID NO: 424412 - DNA, 25 bp, Mus musculus
cgaatccttcctagtctctgagata

SEQ ID NO: 424413 - DNA, 25 bp, Mus musculus
cgaatcttcaagtgggtgcctgtgg

SEQ ID NO: 424414 - DNA, 25 bp, Mus musculus
cgaatgactcgtttgttaagggaca

SEQ ID NO: 424415 - DNA, 25 bp, Mus musculus
cgaatgccccaacctgaagctgaag

SEQ ID NO: 424416 - DNA, 25 bp, Mus musculus
cgaatgctatttgctcccaggccag

SEQ ID NO: 424417 - DNA, 25 bp, Mus musculus
cgaatgctgtgagacttgtttgcct

SEQ ID NO: 424418 - DNA, 25 bp, Mus musculus
cgaatggaaggaatgtcagaaagct

SEQ ID NO: 424419 - DNA, 25 bp, Mus musculus
cgaatggcagcaccggcatactgct

SEQ ID NO: 424420 - DNA, 25 bp, Mus musculus
cgaatgggagtcttctgctgccgca

SEQ ID NO: 424421 - DNA, 25 bp, Mus musculus
cgaatgtacatgttccacgcgggat

SEQ ID NO: 424422 - DNA, 25 bp, Mus musculus
cgaatgtcccatgcacctggaggat

SEQ ID NO: 424423 - DNA, 25 bp, Mus musculus
cgaatgttacgggaacgagctgcct

SEQ ID NO: 424424 - DNA, 25 bp, Mus musculus
cgaattctgccttctgatgcctgta

SEQ ID NO: 424425 - DNA, 25 bp, Mus musculus
cgaattgattttggagacgcgaagc

SEQ ID NO: 424426 - DNA, 25 bp, Mus musculus
cgaattggagatgaactggacagca

SEQ ID NO: 424427 - DNA, 25 bp, Mus musculus
cgacaaatatcatgagagcgtggct

SEQ ID NO: 424428 - DNA, 25 bp, Mus musculus
cgacaacaggaaaggagcctgtcac

SEQ ID NO: 424429 - DNA, 25 bp, Mus musculus
cgacaactttgccttggagtggagc

SEQ ID NO: 424430 - DNA, 25 bp, Mus musculus
cgacaagtcggaagagccctcaaat

SEQ ID NO: 424431 - DNA, 25 bp, Mus musculus
cgacaatggccgagcttggtgaagc

SEQ ID NO: 424432 - DNA, 25 bp, Mus musculus
cgacaattccgtgccgagtgacaga

SEQ ID NO: 424433 - DNA, 25 bp, Mus musculus
cgacacagagcagcatggagagact

SEQ ID NO: 424434 - DNA, 25 bp, Mus musculus
cgacacgagagccaccaaactcggg

SEQ ID NO: 424435 - DNA, 25 bp, Mus musculus
cgacactggactgcgaaacaccttt

SEQ ID NO: 424436 - DNA, 25 bp, Mus musculus
cgacagacagaggaggtgactacat

SEQ ID NO: 424437 - DNA, 25 bp, Mus musculus
cgacagatgaaacaacccgcagctt

SEQ ID NO: 424438 - DNA, 25 bp, Mus musculus
cgacagctgcacttggcactggctt

SEQ ID NO: 424439 - DNA, 25 bp, Mus musculus
cgacagtatgatcggaggcacccaa

SEQ ID NO: 424440 - DNA, 25 bp, Mus musculus
cgacagtgagagtggcgtggatgac

SEQ ID NO: 424441 - DNA, 25 bp, Mus musculus
cgacatagctagtaaatgaccatgc

SEQ ID NO: 424442 - DNA, 25 bp, Mus musculus
cgacatcgagattacccgggaggag

SEQ ID NO: 424443 - DNA, 25 bp, Mus musculus
cgacatcggtcctcgacttagtgcg

SEQ ID NO: 424444 - DNA, 25 bp, Mus musculus
cgacatggtctcaggagcgcggctc

SEQ ID NO: 424445 - DNA, 25 bp, Mus musculus
cgacattgatgatgacgggttccca

SEQ ID NO: 424446 - DNA, 25 bp, Mus musculus
cgacattgtgccttgattgccagag

SEQ ID NO: 424447 - DNA, 25 bp, Mus musculus
cgaccaaggacagccgcagggagct

SEQ ID NO: 424448 - DNA, 25 bp, Mus musculus
cgaccatggctctaatgtgcacaga

SEQ ID NO: 424449 - DNA, 25 bp, Mus musculus
cgaccattcctaactaagtctcgag

SEQ ID NO: 424450 - DNA, 25 bp, Mus musculus
cgaccattggagagcagttcacaga

SEQ ID NO: 424451 - DNA, 25 bp, Mus musculus
cgacccctgctacctgatcaatgag

SEQ ID NO: 424452 - DNA, 25 bp, Mus musculus
cgacccgcagcggaaccaagtgggt

SEQ ID NO: 424453 - DNA, 25 bp, Mus musculus
cgaccctgggtcggccaggaactga

SEQ ID NO: 424454 - DNA, 25 bp, Mus musculus
cgaccctttcttgaagtatttggag

SEQ ID NO: 424455 - DNA, 25 bp, Mus musculus
cgaccggtgagcaatggaaaggact

SEQ ID NO: 424456 - DNA, 25 bp, Mus musculus
cgacctgaacgacgctctggatgag

SEQ ID NO: 424457 - DNA, 25 bp, Mus musculus
cgacctggccaagcaagactgtggt

SEQ ID NO: 424458 - DNA, 25 bp, Mus musculus
cgacctggcctcagttaccactatg

SEQ ID NO: 424459 - DNA, 25 bp, Mus musculus
cgacctgtcgggaaaggagacactt

SEQ ID NO: 424460 - DNA, 25 bp, Mus musculus
cgaccttcaagatgtggcccagctg

SEQ ID NO: 424461 - DNA, 25 bp, Mus musculus
cgaccttctgaatgtctgagtcccc

SEQ ID NO: 424462 - DNA, 25 bp, Mus musculus
cgaccttggctttctacgtgcagca

SEQ ID NO: 424463 - DNA, 25 bp, Mus musculus
cgaccttggtaagaaaacagatatt

SEQ ID NO: 424464 - DNA, 25 bp, Mus musculus
cgacctttaaattaaactgacacat

SEQ ID NO: 424465 - DNA, 25 bp, Mus musculus
cgacgaacggctggcactgagtagc

SEQ ID NO: 424466 - DNA, 25 bp, Mus musculus
cgacgaagatgacgagctgcagcta

SEQ ID NO: 424467 - DNA, 25 bp, Mus musculus
cgacggccctcagaagctattgaag

SEQ ID NO: 424468 - DNA, 25 bp, Mus musculus
cgacggcgccagaaaacttacagag

SEQ ID NO: 424469 - DNA, 25 bp, Mus musculus
cgacgggaccatgacggagtaagta

SEQ ID NO: 424470 - DNA, 25 bp, Mus musculus
cgacgtccgtgcagcggagaagcag

SEQ ID NO: 424471 - DNA, 25 bp, Mus musculus
cgacgtgccaaccaagacaaggatt

SEQ ID NO: 424472 - DNA, 25 bp, Mus musculus
cgactacagtaaggaacgccagcta

SEQ ID NO: 424473 - DNA, 25 bp, Mus musculus
cgactacatggaggctttaacccga

SEQ ID NO: 424474 - DNA, 25 bp, Mus musculus
cgactatgcaagttctggaaaccct

SEQ ID NO: 424475 - DNA, 25 bp, Mus musculus
cgactattatcgtgagggccagggc

SEQ ID NO: 424476 - DNA, 25 bp, Mus musculus
cgactattggctgtactccagaggg

SEQ ID NO: 424477 - DNA, 25 bp, Mus musculus
cgactcaaaaagtatgtgcaactga

SEQ ID NO: 424478 - DNA, 25 bp, Mus musculus
cgactcctccggaaatcgagagact

SEQ ID NO: 424479 - DNA, 25 bp, Mus musculus
cgactcggagaagcgaacggacatc

SEQ ID NO: 424480 - DNA, 25 bp, Mus musculus
cgactcttgggaccagaggactagt

SEQ ID NO: 424481 - DNA, 25 bp, Mus musculus
cgactgaactttgcaatgaaaataa

SEQ ID NO: 424482 - DNA, 25 bp, Mus musculus
cgactgctatttgaagccataacaa

SEQ ID NO: 424483 - DNA, 25 bp, Mus musculus
cgactggatgaggaacaccggctta

SEQ ID NO: 424484 - DNA, 25 bp, Mus musculus
cgactggcaaagaagaaagctgacc

SEQ ID NO: 424485 - DNA, 25 bp, Mus musculus
cgactggctgtggatgagttattct

SEQ ID NO: 424486 - DNA, 25 bp, Mus musculus
cgactggtgtcatcgctgctggcct

SEQ ID NO: 424487 - DNA, 25 bp, Mus musculus
cgactgtgtgggtcacgatgtagcc

SEQ ID NO: 424488 - DNA, 25 bp, Mus musculus
cgactgtttgtctgattgcatcggg

SEQ ID NO: 424489 - DNA, 25 bp, Mus musculus
cgacttccgaaataagatcattcta

SEQ ID NO: 424490 - DNA, 25 bp, Mus musculus
cgacttccgcttctggaagagtctg

SEQ ID NO: 424491 - DNA, 25 bp, Mus musculus
cgacttctgtattgtgggaaactca

SEQ ID NO: 424492 - DNA, 25 bp, Mus musculus
cgacttcttgggttgtattattatt

SEQ ID NO: 424493 - DNA, 25 bp, Mus musculus
cgacttgcccctaacttccgatggg

SEQ ID NO: 424494 - DNA, 25 bp, Mus musculus
cgacttgggtgaccagtgaagccta

SEQ ID NO: 424495 - DNA, 25 bp, Mus musculus
cgactttcgatatgcaacggccaag

SEQ ID NO: 424496 - DNA, 25 bp, Mus musculus
cgagaaagtcctactggcaggagct

SEQ ID NO: 424497 - DNA, 25 bp, Mus musculus
cgagaacagtgtggatggtgagaga

SEQ ID NO: 424498 - DNA, 25 bp, Mus musculus
cgagaaccagccgaatcgctagttt

SEQ ID NO: 424499 - DNA, 25 bp, Mus musculus
cgagaacgaggaagagatcatacgc

SEQ ID NO: 424500 - DNA, 25 bp, Mus musculus
cgagaacggctctggtagtcgacgc

SEQ ID NO: 424501 - DNA, 25 bp, Mus musculus
cgagaactacaaagacaatggcggt

SEQ ID NO: 424502 - DNA, 25 bp, Mus musculus
cgagaactgcagcagctcccatggg

SEQ ID NO: 424503 - DNA, 25 bp, Mus musculus
cgagaactggagtaggtcgtgtact

SEQ ID NO: 424504 - DNA, 25 bp, Mus musculus
cgagaacttcacaagcagcacaggt

SEQ ID NO: 424505 - DNA, 25 bp, Mus musculus
cgagaagagtatttaaccggtgtca

SEQ ID NO: 424506 - DNA, 25 bp, Mus musculus
cgagaagtccctggaaaagctttca

SEQ ID NO: 424507 - DNA, 25 bp, Mus musculus
cgagaatagcgaagatccggagcct

SEQ ID NO: 424508 - DNA, 25 bp, Mus musculus
cgagaattgaacagatggacaaagc

SEQ ID NO: 424509 - DNA, 25 bp, Mus musculus
cgagacaaaagactgcgtggatgca

SEQ ID NO: 424510 - DNA, 25 bp, Mus musculus
cgagaccattgggagctatacctgc

SEQ ID NO: 424511 - DNA, 25 bp, Mus musculus
cgagaccgcacgcagagcgtgaaca

SEQ ID NO: 424512 - DNA, 25 bp, Mus musculus
cgagacctgaaagctggcaacgtgc

SEQ ID NO: 424513 - DNA, 25 bp, Mus musculus
cgagaccttcgactgccttttcgag

SEQ ID NO: 424514 - DNA, 25 bp, Mus musculus
cgagactgctcaaacacgaaaggaa

SEQ ID NO: 424515 - DNA, 25 bp, Mus musculus
cgagacttaattgcatcctctgtga

SEQ ID NO: 424516 - DNA, 25 bp, Mus musculus
cgagagaaggatcgtctgcttgcca

SEQ ID NO: 424517 - DNA, 25 bp, Mus musculus
cgagagacatgtccctgtgtagacc

SEQ ID NO: 424518 - DNA, 25 bp, Mus musculus
cgagagagatgtcaaaaccagccca

SEQ ID NO: 424519 - DNA, 25 bp, Mus musculus
cgagagagtagcatcgcacgagcct

SEQ ID NO: 424520 - DNA, 25 bp, Mus musculus
cgagagatccgcctgactcagaagg

SEQ ID NO: 424521 - DNA, 25 bp, Mus musculus
cgagagatcgtgttgcccatggagc

SEQ ID NO: 424522 - DNA, 25 bp, Mus musculus
cgagagcggactttacaacacgggc

SEQ ID NO: 424523 - DNA, 25 bp, Mus musculus
cgagagctcattatacagccaggat

SEQ ID NO: 424524 - DNA, 25 bp, Mus musculus
cgagagctgcattgagaagcctgtc

SEQ ID NO: 424525 - DNA, 25 bp, Mus musculus
cgagagctggccaacgatgagctaa

SEQ ID NO: 424526 - DNA, 25 bp, Mus musculus
cgagaggagtttccagacaggatca

SEQ ID NO: 424527 - DNA, 25 bp, Mus musculus
cgagagggaaaagtatagacaggcc

SEQ ID NO: 424528 - DNA, 25 bp, Mus musculus
cgagagtaacgtgcatccgagagga

SEQ ID NO: 424529 - DNA, 25 bp, Mus musculus
cgagagtcacttccattcaaatggg

SEQ ID NO: 424530 - DNA, 25 bp, Mus musculus
cgagagtccaccaaaaaagccgaga

SEQ ID NO: 424531 - DNA, 25 bp, Mus musculus
cgagagtctcacctccaagttgcaa

SEQ ID NO: 424532 - DNA, 25 bp, Mus musculus
cgagagttagaagaaatccgcacca

SEQ ID NO: 424533 - DNA, 25 bp, Mus musculus
cgagagttcgggtcgctttgctgcc

SEQ ID NO: 424534 - DNA, 25 bp, Mus musculus
cgagataagacaaaggtactgagct

SEQ ID NO: 424535 - DNA, 25 bp, Mus musculus
cgagatccggacgtgtgacagctat

SEQ ID NO: 424536 - DNA, 25 bp, Mus musculus
cgagatctaccagtttcttcaggcg

SEQ ID NO: 424537 - DNA, 25 bp, Mus musculus
cgagatgactcagcggctaaaggcg

SEQ ID NO: 424538 - DNA, 25 bp, Mus musculus
cgagatgttccaccaagtttgggca

SEQ ID NO: 424539 - DNA, 25 bp, Mus musculus
cgagattttcgaccgctatggagag

SEQ ID NO: 424540 - DNA, 25 bp, Mus musculus
cgagattttgaactatgtactggag

SEQ ID NO: 424541 - DNA, 25 bp, Mus musculus
cgagcaaaactatgtaacttagaga

SEQ ID NO: 424542 - DNA, 25 bp, Mus musculus
cgagcaaatcgaggactgtgagagc

SEQ ID NO: 424543 - DNA, 25 bp, Mus musculus
cgagcaagccatacgttgtaaggca

SEQ ID NO: 424544 - DNA, 25 bp, Mus musculus
cgagcacggccatcaagatccagtt

SEQ ID NO: 424545 - DNA, 25 bp, Mus musculus
cgagcagagggacgattattaacca

SEQ ID NO: 424546 - DNA, 25 bp, Mus musculus
cgagcagccacattagttacttgaa

SEQ ID NO: 424547 - DNA, 25 bp, Mus musculus
cgagcagcgcgtacagatccatttg

SEQ ID NO: 424548 - DNA, 25 bp, Mus musculus
cgagcaggcgatgtccaccattaaa

SEQ ID NO: 424549 - DNA, 25 bp, Mus musculus
cgagccaagatgcattccagtgaag

SEQ ID NO: 424550 - DNA, 25 bp, Mus musculus
cgagccaagatgttgcggaatctgc

SEQ ID NO: 424551 - DNA, 25 bp, Mus musculus
cgagccagagcggaagtggattcta

SEQ ID NO: 424552 - DNA, 25 bp, Mus musculus
cgagcctgcggctccagatgcagta

SEQ ID NO: 424553 - DNA, 25 bp, Mus musculus
cgagcctggaaaatggtaaatgatc

SEQ ID NO: 424554 - DNA, 25 bp, Mus musculus
cgagcgcctcaagactatcaagaag

SEQ ID NO: 424555 - DNA, 25 bp, Mus musculus
cgagcgcctcgtagatatcatttgt

SEQ ID NO: 424556 - DNA, 25 bp, Mus musculus
cgagcgcctgcaatacgtgttcggg

SEQ ID NO: 424557 - DNA, 25 bp, Mus musculus
cgagcgcgatgcatccctcatctta

SEQ ID NO: 424558 - DNA, 25 bp, Mus musculus
cgagcgcggcatggaatctcttaaa

SEQ ID NO: 424559 - DNA, 25 bp, Mus musculus
cgagcggagctggttgagccttcaa

SEQ ID NO: 424560 - DNA, 25 bp, Mus musculus
cgagcggcttacagaatgacagtct

SEQ ID NO: 424561 - DNA, 25 bp, Mus musculus
cgagcggtagaaatgggcaactgca

SEQ ID NO: 424562 - DNA, 25 bp, Mus musculus
cgagcgtgcgcgtctgtatgccgca

SEQ ID NO: 424563 - DNA, 25 bp, Mus musculus
cgagctcacccggtctctagaggga

SEQ ID NO: 424564 - DNA, 25 bp, Mus musculus
cgagctccaggttgtgtccgattct

SEQ ID NO: 424565 - DNA, 25 bp, Mus musculus
cgagctccgggatggacttcaacta

SEQ ID NO: 424566 - DNA, 25 bp, Mus musculus
cgagctgacggtgctcaaggacccg

SEQ ID NO: 424567 - DNA, 25 bp, Mus musculus
cgagctgagccgaagaagacttgca

SEQ ID NO: 424568 - DNA, 25 bp, Mus musculus
cgagctggagatggcgaaaatccag

SEQ ID NO: 424569 - DNA, 25 bp, Mus musculus
cgagctggcccagtatggcatcatt

SEQ ID NO: 424570 - DNA, 25 bp, Mus musculus
cgagctgtggtgagacggctcatca

SEQ ID NO: 424571 - DNA, 25 bp, Mus musculus
cgagcttcactgtgctccggaagaa

SEQ ID NO: 424572 - DNA, 25 bp, Mus musculus
cgagcttctggatgaacaatgttct

SEQ ID NO: 424573 - DNA, 25 bp, Mus musculus
cgagctttttcaccgacgcagagag

SEQ ID NO: 424574 - DNA, 25 bp, Mus musculus
cgaggaacacttgctgccgagaaca

SEQ ID NO: 424575 - DNA, 25 bp, Mus musculus
cgaggaaccaactgataagagtcca

SEQ ID NO: 424576 - DNA, 25 bp, Mus musculus
cgaggaacctctagtgaatggcaca

SEQ ID NO: 424577 - DNA, 25 bp, Mus musculus
cgaggaactccccatttgaaggcca

SEQ ID NO: 424578 - DNA, 25 bp, Mus musculus
cgaggaagcgtgtgtcttgcctcag

SEQ ID NO: 424579 - DNA, 25 bp, Mus musculus
cgaggaattcatgatcagttgccag

SEQ ID NO: 424580 - DNA, 25 bp, Mus musculus
cgaggacatctctgcggactaaagt

SEQ ID NO: 424581 - DNA, 25 bp, Mus musculus
cgaggaccacttgcttccgagggta

SEQ ID NO: 424582 - DNA, 25 bp, Mus musculus
cgaggagaagaatacgcccaaagct

SEQ ID NO: 424583 - DNA, 25 bp, Mus musculus
cgaggagaagggaccacagtttgac

SEQ ID NO: 424584 - DNA, 25 bp, Mus musculus
cgaggagcccatcgccttcttggcg

SEQ ID NO: 424585 - DNA, 25 bp, Mus musculus
cgaggagctccccacgtatgaggaa

SEQ ID NO: 424586 - DNA, 25 bp, Mus musculus
cgaggaggccctacgctatatcact

SEQ ID NO: 424587 - DNA, 25 bp, Mus musculus
cgaggagtcaacgttctaggaagct

SEQ ID NO: 424588 - DNA, 25 bp, Mus musculus
cgaggagtcaggacagtcatacaca

SEQ ID NO: 424589 - DNA, 25 bp, Mus musculus
cgaggagtgtcgtcgtcacgtgaca

SEQ ID NO: 424590 - DNA, 25 bp, Mus musculus
cgaggatgactctgtgcacgcgtac

SEQ ID NO: 424591 - DNA, 25 bp, Mus musculus
cgaggatgagtcttagtccagagct

SEQ ID NO: 424592 - DNA, 25 bp, Mus musculus
cgaggatttgagaaccagcacggga

SEQ ID NO: 424593 - DNA, 25 bp, Mus musculus
cgaggcagactaatgcagggagaaa

SEQ ID NO: 424594 - DNA, 25 bp, Mus musculus
cgaggcatacatctccatggagggc

SEQ ID NO: 424595 - DNA, 25 bp, Mus musculus
cgaggccaaaactcgcggagggtca

SEQ ID NO: 424596 - DNA, 25 bp, Mus musculus
cgaggccataaagcgggataccagc

SEQ ID NO: 424597 - DNA, 25 bp, Mus musculus
cgaggcgtcgacgtctctgtgtgca

SEQ ID NO: 424598 - DNA, 25 bp, Mus musculus
cgaggctcgaccctgtggactcata

SEQ ID NO: 424599 - DNA, 25 bp, Mus musculus
cgaggctctacttcctggagactgg

SEQ ID NO: 424600 - DNA, 25 bp, Mus musculus
cgaggctgcacggagaattaagacg

SEQ ID NO: 424601 - DNA, 25 bp, Mus musculus
cgaggcttcctgcacgtgaggcaaa

SEQ ID NO: 424602 - DNA, 25 bp, Mus musculus
cgaggcttctgcgagggattcttaa

SEQ ID NO: 424603 - DNA, 25 bp, Mus musculus
cgaggcttcttgcagcatctctgag

SEQ ID NO: 424604 - DNA, 25 bp, Mus musculus
cgagggaccctggaagtctattaca

SEQ ID NO: 424605 - DNA, 25 bp, Mus musculus
cgagggactgttccggacctatgat

SEQ ID NO: 424606 - DNA, 25 bp, Mus musculus
cgagggcaaggtaccaatgatagtg

SEQ ID NO: 424607 - DNA, 25 bp, Mus musculus
cgagggcaccattttctgagggagt

SEQ ID NO: 424608 - DNA, 25 bp, Mus musculus
cgagggccattgtgtctgtgcagct

SEQ ID NO: 424609 - DNA, 25 bp, Mus musculus
cgagggcgacctttgattgacagaa

SEQ ID NO: 424610 - DNA, 25 bp, Mus musculus
cgagggctttttcatgagtaggaca

SEQ ID NO: 424611 - DNA, 25 bp, Mus musculus
cgagggtcaatttcttagggcgaca

SEQ ID NO: 424612 - DNA, 25 bp, Mus musculus
cgagggtcgcgagctactgatcgcc

SEQ ID NO: 424613 - DNA, 25 bp, Mus musculus
cgaggtcgaactacaaatgccagag

SEQ ID NO: 424614 - DNA, 25 bp, Mus musculus
cgaggtctaacattattactgaagc

SEQ ID NO: 424615 - DNA, 25 bp, Mus musculus
cgaggtgaccttacacgccgtgagt

SEQ ID NO: 424616 - DNA, 25 bp, Mus musculus
cgaggtgagctatgaggtcatcgca

SEQ ID NO: 424617 - DNA, 25 bp, Mus musculus
cgaggtggcccaaggtctatgcgat

SEQ ID NO: 424618 - DNA, 25 bp, Mus musculus
cgaggttgctgctcgcagagccgtc

SEQ ID NO: 424619 - DNA, 25 bp, Mus musculus
cgaggtttcgggatgcacagactgc

SEQ ID NO: 424620 - DNA, 25 bp, Mus musculus
cgagtacaagcgaagcgtgctgcta

SEQ ID NO: 424621 - DNA, 25 bp, Mus musculus
cgagtaccatcgtcaaagtcagcat

SEQ ID NO: 424622 - DNA, 25 bp, Mus musculus
cgagtaggaccgagctgctgcagac

SEQ ID NO: 424623 - DNA, 25 bp, Mus musculus
cgagtatctgtattctgatgtgcaa

SEQ ID NO: 424624 - DNA, 25 bp, Mus musculus
cgagtcagggcatcttgcacgggaa

SEQ ID NO: 424625 - DNA, 25 bp, Mus musculus
cgagtcccaggtagctttgagtgca

SEQ ID NO: 424626 - DNA, 25 bp, Mus musculus
cgagtccccggtgaaagagaaggct

SEQ ID NO: 424627 - DNA, 25 bp, Mus musculus
cgagtccgatggtcttcctggcgag

SEQ ID NO: 424628 - DNA, 25 bp, Mus musculus
cgagtctggtgaacatctgtcggcc

SEQ ID NO: 424629 - DNA, 25 bp, Mus musculus
cgagtgaaacccgatgcttgtgggc

SEQ ID NO: 424630 - DNA, 25 bp, Mus musculus
cgagtgactgaattctgccggcaaa

SEQ ID NO: 424631 - DNA, 25 bp, Mus musculus
cgagtgagattctgtttcctggagc

SEQ ID NO: 424632 - DNA, 25 bp, Mus musculus
cgagtgagtcctgagacaaagtgtg

SEQ ID NO: 424633 - DNA, 25 bp, Mus musculus
cgagtgcctgcttcgcttggcggcc

SEQ ID NO: 424634 - DNA, 25 bp, Mus musculus
cgagtgcggttcaaagcgtctggcc

SEQ ID NO: 424635 - DNA, 25 bp, Mus musculus
cgagtgctgagcgaggcatccctcg

SEQ ID NO: 424636 - DNA, 25 bp, Mus musculus
cgagtggagatcttccaccaaggcc

SEQ ID NO: 424637 - DNA, 25 bp, Mus musculus
cgagtgtaacctgcaggctctggat

SEQ ID NO: 424638 - DNA, 25 bp, Mus musculus
cgagtgtatagcagcgagggcatcc

SEQ ID NO: 424639 - DNA, 25 bp, Mus musculus
cgagtgtcctacatcaaagctgtgg

SEQ ID NO: 424640 - DNA, 25 bp, Mus musculus
cgagtgtgaacagctggaaaggtcc

SEQ ID NO: 424641 - DNA, 25 bp, Mus musculus
cgagttatgtgccttgggtcccaag

SEQ ID NO: 424642 - DNA, 25 bp, Mus musculus
cgagttccgcgcagcccagcggttt

SEQ ID NO: 424643 - DNA, 25 bp, Mus musculus
cgagttctatgatccgacggtgccg

SEQ ID NO: 424644 - DNA, 25 bp, Mus musculus
cgagttctggtgaaggccttaggca

SEQ ID NO: 424645 - DNA, 25 bp, Mus musculus
cgagttctttgtggactgaagcatg

SEQ ID NO: 424646 - DNA, 25 bp, Mus musculus
cgagttgcccgaggatctacatatt

SEQ ID NO: 424647 - DNA, 25 bp, Mus musculus
cgagttggcactccgcgatgcagct

SEQ ID NO: 424648 - DNA, 25 bp, Mus musculus
cgagttggtttctacggatcccgat

SEQ ID NO: 424649 - DNA, 25 bp, Mus musculus
cgagtttaccgagttccagatgtca

SEQ ID NO: 424650 - DNA, 25 bp, Mus musculus
cgagtttggaattattgaggcctcc

SEQ ID NO: 424651 - DNA, 25 bp, Mus musculus
cgagttttacctcagcagtgcagga

SEQ ID NO: 424652 - DNA, 25 bp, Mus musculus
cgataaagcggctgacagatccagg

SEQ ID NO: 424653 - DNA, 25 bp, Mus musculus
cgataacgatgatgacgacaactct

SEQ ID NO: 424654 - DNA, 25 bp, Mus musculus
cgataatggcacatcaccagcgctg

SEQ ID NO: 424655 - DNA, 25 bp, Mus musculus
cgatacctccatgtacgacagtgaa

SEQ ID NO: 424656 - DNA, 25 bp, Mus musculus
cgatacctgaatggctgggataaca

SEQ ID NO: 424657 - DNA, 25 bp, Mus musculus
cgatacgggagctcaaagtgtgtct

SEQ ID NO: 424658 - DNA, 25 bp, Mus musculus
cgatactacagcaagtgggcggcgc

SEQ ID NO: 424659 - DNA, 25 bp, Mus musculus
cgatactgaactacaggccggaggg

SEQ ID NO: 424660 - DNA, 25 bp, Mus musculus
cgatagatctagttccctggaaggc

SEQ ID NO: 424661 - DNA, 25 bp, Mus musculus
cgatagatgactgtggtacggaacc

SEQ ID NO: 424662 - DNA, 25 bp, Mus musculus
cgatagcacccatcggctagatgct

SEQ ID NO: 424663 - DNA, 25 bp, Mus musculus
cgatatctgagtctccaggtgggca

SEQ ID NO: 424664 - DNA, 25 bp, Mus musculus
cgatatgagtcctgcgaagcgctgg

SEQ ID NO: 424665 - DNA, 25 bp, Mus musculus
cgatatgctggacaacgggatcaca

SEQ ID NO: 424666 - DNA, 25 bp, Mus musculus
cgatatgtgggaagactggcacccc

SEQ ID NO: 424667 - DNA, 25 bp, Mus musculus
cgatattaaggaccgctcgacgctg

SEQ ID NO: 424668 - DNA, 25 bp, Mus musculus
cgatcagaagaaacgttggaaggac

SEQ ID NO: 424669 - DNA, 25 bp, Mus musculus
cgatcagatcctgagcggtcccgaa

SEQ ID NO: 424670 - DNA, 25 bp, Mus musculus
cgatcagtgcggttggctggttcca

SEQ ID NO: 424671 - DNA, 25 bp, Mus musculus
cgatcatagatctggataaaggttc

SEQ ID NO: 424672 - DNA, 25 bp, Mus musculus
cgatcatccctcaaagctcagcgtg

SEQ ID NO: 424673 - DNA, 25 bp, Mus musculus
cgatcatcgggcgttctaacaaggg

SEQ ID NO: 424674 - DNA, 25 bp, Mus musculus
cgatccataatgtccgaagagctag

SEQ ID NO: 424675 - DNA, 25 bp, Mus musculus
cgatcccgaaggcaagtactggctg

SEQ ID NO: 424676 - DNA, 25 bp, Mus musculus
cgatcccgtacagctaatgtccagg

SEQ ID NO: 424677 - DNA, 25 bp, Mus musculus
cgatccgccgcttcagagctgggtg

SEQ ID NO: 424678 - DNA, 25 bp, Mus musculus
cgatcgagcaaagcattgagcagga

SEQ ID NO: 424679 - DNA, 25 bp, Mus musculus
cgatcgatctgcgtctcaatgtctc

SEQ ID NO: 424680 - DNA, 25 bp, Mus musculus
cgatcgggacagcatgcagaaagta

SEQ ID NO: 424681 - DNA, 25 bp, Mus musculus
cgatcgggcggccaaagcggctgca

SEQ ID NO: 424682 - DNA, 25 bp, Mus musculus
cgatcgttacttaggtggcagggaa

SEQ ID NO: 424683 - DNA, 25 bp, Mus musculus
cgatctctagtgatggaagccccaa

SEQ ID NO: 424684 - DNA, 25 bp, Mus musculus
cgatctgaagcgagagcctgaacct

SEQ ID NO: 424685 - DNA, 25 bp, Mus musculus
cgatctgagggcatgggttccaccc

SEQ ID NO: 424686 - DNA, 25 bp, Mus musculus
cgatctgatttgactggatgttgct

SEQ ID NO: 424687 - DNA, 25 bp, Mus musculus
cgatctgtacccatgactgagggca

SEQ ID NO: 424688 - DNA, 25 bp, Mus musculus
cgatcttggcaagtccgccagggat

SEQ ID NO: 424689 - DNA, 25 bp, Mus musculus
cgatcttgtacagtggaggccgtca

SEQ ID NO: 424690 - DNA, 25 bp, Mus musculus
cgatgactaccgaccaatgaaggag

SEQ ID NO: 424691 - DNA, 25 bp, Mus musculus
cgatgagctattggaattggacagt

SEQ ID NO: 424692 - DNA, 25 bp, Mus musculus
cgatgatcttgcaaagcaccagagc

SEQ ID NO: 424693 - DNA, 25 bp, Mus musculus
cgatgatgagggtttcagagccgat

SEQ ID NO: 424694 - DNA, 25 bp, Mus musculus
cgatgatggagaaccgagcttgccc

SEQ ID NO: 424695 - DNA, 25 bp, Mus musculus
cgatgcagcactcgagaattactct

SEQ ID NO: 424696 - DNA, 25 bp, Mus musculus
cgatgcagctctggccactgtagag

SEQ ID NO: 424697 - DNA, 25 bp, Mus musculus
cgatgccgcactgtctgtagctgag

SEQ ID NO: 424698 - DNA, 25 bp, Mus musculus
cgatgcgcgtccagtgactgggaca

SEQ ID NO: 424699 - DNA, 25 bp, Mus musculus
cgatgcttgcgaagaagcccgtgaa

SEQ ID NO: 424700 - DNA, 25 bp, Mus musculus
cgatggaaaagagcaccctggagct

SEQ ID NO: 424701 - DNA, 25 bp, Mus musculus
cgatggcaaccagggcagtgtcgct

SEQ ID NO: 424702 - DNA, 25 bp, Mus musculus
cgatggcaataacacagactctgag

SEQ ID NO: 424703 - DNA, 25 bp, Mus musculus
cgatggcctgtgaatatagggctaa

SEQ ID NO: 424704 - DNA, 25 bp, Mus musculus
cgatggctacctacagtctggcgaa

SEQ ID NO: 424705 - DNA, 25 bp, Mus musculus
cgatggctctcgacacagtggagac

SEQ ID NO: 424706 - DNA, 25 bp, Mus musculus
cgatgggttctcgttcattggcaac

SEQ ID NO: 424707 - DNA, 25 bp, Mus musculus
cgatggtcactacagaacaggatcc

SEQ ID NO: 424708 - DNA, 25 bp, Mus musculus
cgatggtcactggaaggtctgccca

SEQ ID NO: 424709 - DNA, 25 bp, Mus musculus
cgatgtacctggcttactgtgcaaa

SEQ ID NO: 424710 - DNA, 25 bp, Mus musculus
cgatgtacggacaccagggatggct

SEQ ID NO: 424711 - DNA, 25 bp, Mus musculus
cgatgtcacacttctccagggaggt

SEQ ID NO: 424712 - DNA, 25 bp, Mus musculus
cgatgtgatcattcctagaggtgcc

SEQ ID NO: 424713 - DNA, 25 bp, Mus musculus
cgatgttgagagaatggaagaagcc

SEQ ID NO: 424714 - DNA, 25 bp, Mus musculus
cgatgttgtttgaaagagtcaccca

SEQ ID NO: 424715 - DNA, 25 bp, Mus musculus
cgattacagatacagaagctactcc

SEQ ID NO: 424716 - DNA, 25 bp, Mus musculus
cgattatacacagaggcctgggaca

SEQ ID NO: 424717 - DNA, 25 bp, Mus musculus
cgattcacagcaggcctcatagggt

SEQ ID NO: 424718 - DNA, 25 bp, Mus musculus
cgattccgatgagaggtaattgact

SEQ ID NO: 424719 - DNA, 25 bp, Mus musculus
cgattcgccgaactggtcctggaga

SEQ ID NO: 424720 - DNA, 25 bp, Mus musculus
cgattctccagaactacagagggtg

SEQ ID NO: 424721 - DNA, 25 bp, Mus musculus
cgattcttcaatgtgcggaaccgag

SEQ ID NO: 424722 - DNA, 25 bp, Mus musculus
cgattgcagcaggaggatgacagct

SEQ ID NO: 424723 - DNA, 25 bp, Mus musculus
cgattgctagggacaagcggctgtc

SEQ ID NO: 424724 - DNA, 25 bp, Mus musculus
cgattgctttcaacaactgtgaaaa

SEQ ID NO: 424725 - DNA, 25 bp, Mus musculus
cgattgtcctcaaaagatgtaactg

SEQ ID NO: 424726 - DNA, 25 bp, Mus musculus
cgatttatgctaaccaagctgcaaa

SEQ ID NO: 424727 - DNA, 25 bp, Mus musculus
cgatttccgcagttctcagcccgat

SEQ ID NO: 424728 - DNA, 25 bp, Mus musculus
cgatttctgaatattttggaatccc

SEQ ID NO: 424729 - DNA, 25 bp, Mus musculus
cgatttgctgtcgaagaacgaggct

SEQ ID NO: 424730 - DNA, 25 bp, Mus musculus
cgatttggcggaagatcgcgagcaa

SEQ ID NO: 424731 - DNA, 25 bp, Mus musculus
cgatttggtcaaggcacgggtcgac

SEQ ID NO: 424732 - DNA, 25 bp, Mus musculus
cgcaaaaattcacgcgagctgccct

SEQ ID NO: 424733 - DNA, 25 bp, Mus musculus
cgcaaacgatcaagttacattctga

SEQ ID NO: 424734 - DNA, 25 bp, Mus musculus
cgcaaagactggaaccctgatgagc

SEQ ID NO: 424735 - DNA, 25 bp, Mus musculus
cgcaaagagatggagtaagacccgc

SEQ ID NO: 424736 - DNA, 25 bp, Mus musculus
cgcaaagcagacatgctcgagaagg

SEQ ID NO: 424737 - DNA, 25 bp, Mus musculus
cgcaaaggaaagctgcggccgtcac

SEQ ID NO: 424738 - DNA, 25 bp, Mus musculus
cgcaaagttactccggcagctgaag

SEQ ID NO: 424739 - DNA, 25 bp, Mus musculus
cgcaacattgaagatgaccccaaga

SEQ ID NO: 424740 - DNA, 25 bp, Mus musculus
cgcaactacatcctgctgctgggta

SEQ ID NO: 424741 - DNA, 25 bp, Mus musculus
cgcaacttgaactgtgaggcgggca

SEQ ID NO: 424742 - DNA, 25 bp, Mus musculus
cgcaagaatcagagacgggaaagct

SEQ ID NO: 424743 - DNA, 25 bp, Mus musculus
cgcaagacgctgtcggtgaagctga

SEQ ID NO: 424744 - DNA, 25 bp, Mus musculus
cgcaagactaggaggtacggtgttt

SEQ ID NO: 424745 - DNA, 25 bp, Mus musculus
cgcaagagagtagaaggcacagcca

SEQ ID NO: 424746 - DNA, 25 bp, Mus musculus
cgcaagatgctggacgctaaggaac

SEQ ID NO: 424747 - DNA, 25 bp, Mus musculus
cgcaagcaacatctggtgaaggcca

SEQ ID NO: 424748 - DNA, 25 bp, Mus musculus
cgcaagccggctatttcgggctctt

SEQ ID NO: 424749 - DNA, 25 bp, Mus musculus
cgcaagcgtgtctccaatgtgatga

SEQ ID NO: 424750 - DNA, 25 bp, Mus musculus
cgcaaggatgccgaagactggttct

SEQ ID NO: 424751 - DNA, 25 bp, Mus musculus
cgcaagggagcacaacaaggtccaa

SEQ ID NO: 424752 - DNA, 25 bp, Mus musculus
cgcaatccacgtgggctagagcata

SEQ ID NO: 424753 - DNA, 25 bp, Mus musculus
cgcacagtgcacagtgaatgaccta

SEQ ID NO: 424754 - DNA, 25 bp, Mus musculus
cgcaccatgtgggatcttcgggaga

SEQ ID NO: 424755 - DNA, 25 bp, Mus musculus
cgcaccgccagacagaggtgtttaa

SEQ ID NO: 424756 - DNA, 25 bp, Mus musculus
cgcaccgggcgcttggtcagcctgt

SEQ ID NO: 424757 - DNA, 25 bp, Mus musculus
cgcacctgctggaggccgagagaca

SEQ ID NO: 424758 - DNA, 25 bp, Mus musculus
cgcacgcggctcaatagttctcatg

SEQ ID NO: 424759 - DNA, 25 bp, Mus musculus
cgcacgcgggagacgaagctaattc

SEQ ID NO: 424760 - DNA, 25 bp, Mus musculus
cgcacgcgtgtaccctacttctgat

SEQ ID NO: 424761 - DNA, 25 bp, Mus musculus
cgcacgctaggatgaggccgacttc

SEQ ID NO: 424762 - DNA, 25 bp, Mus musculus
cgcacgggtcggaaatagatgttga

SEQ ID NO: 424763 - DNA, 25 bp, Mus musculus
cgcacgtgccagagaaaagggccta

SEQ ID NO: 424764 - DNA, 25 bp, Mus musculus
cgcacgttggctctcatcgtgtgca

SEQ ID NO: 424765 - DNA, 25 bp, Mus musculus
cgcactacgctcagagctcaggtat

SEQ ID NO: 424766 - DNA, 25 bp, Mus musculus
cgcactcaggtggttatgtcagtga

SEQ ID NO: 424767 - DNA, 25 bp, Mus musculus
cgcagaaagattaagggcgcttccc

SEQ ID NO: 424768 - DNA, 25 bp, Mus musculus
cgcagaattgcctctccggatagga

SEQ ID NO: 424769 - DNA, 25 bp, Mus musculus
cgcagacgacggctgggtggcggca

SEQ ID NO: 424770 - DNA, 25 bp, Mus musculus
cgcagacgcgtctgggtctcggcac

SEQ ID NO: 424771 - DNA, 25 bp, Mus musculus
cgcagagaccgctgtgtcctgtgtg

SEQ ID NO: 424772 - DNA, 25 bp, Mus musculus
cgcagagagccaaggcgaaaaggca

SEQ ID NO: 424773 - DNA, 25 bp, Mus musculus
cgcagagatgtttcaggtccaggac

SEQ ID NO: 424774 - DNA, 25 bp, Mus musculus
cgcagaggcccagtgatcaagatca

SEQ ID NO: 424775 - DNA, 25 bp, Mus musculus
cgcagagggcgatttacaagcacaa

SEQ ID NO: 424776 - DNA, 25 bp, Mus musculus
cgcagatagtgaacgagacagacct

SEQ ID NO: 424777 - DNA, 25 bp, Mus musculus
cgcagcagggctggaaagaacttta

SEQ ID NO: 424778 - DNA, 25 bp, Mus musculus
cgcagccttgaacttcagtcctggc

SEQ ID NO: 424779 - DNA, 25 bp, Mus musculus
cgcagcgcaggtccatcagattaga

SEQ ID NO: 424780 - DNA, 25 bp, Mus musculus
cgcagcgggaaactagagggaagcc

SEQ ID NO: 424781 - DNA, 25 bp, Mus musculus
cgcagcgtgctgagattccgagaag

SEQ ID NO: 424782 - DNA, 25 bp, Mus musculus
cgcagctgaaactaagtatgtgtga

SEQ ID NO: 424783 - DNA, 25 bp, Mus musculus
cgcagcttgaagacatccataagag

SEQ ID NO: 424784 - DNA, 25 bp, Mus musculus
cgcaggacttgggaggaccacttgt

SEQ ID NO: 424785 - DNA, 25 bp, Mus musculus
cgcaggaggatcaacagcagtgtca

SEQ ID NO: 424786 - DNA, 25 bp, Mus musculus
cgcaggaggttctgaacataactcc

SEQ ID NO: 424787 - DNA, 25 bp, Mus musculus
cgcaggatcacccaaagagctggtc

SEQ ID NO: 424788 - DNA, 25 bp, Mus musculus
cgcaggcagcaaagaggcaagatcc

SEQ ID NO: 424789 - DNA, 25 bp, Mus musculus
cgcaggccatgcttgcactcaggta

SEQ ID NO: 424790 - DNA, 25 bp, Mus musculus
cgcaggccgagatgctactccggga

SEQ ID NO: 424791 - DNA, 25 bp, Mus musculus
cgcaggcgacatgaaagaaggcaac

SEQ ID NO: 424792 - DNA, 25 bp, Mus musculus
cgcagggtctcgcatctttgtggaa

SEQ ID NO: 424793 - DNA, 25 bp, Mus musculus
cgcaggtaggtctccaggcagcctg

SEQ ID NO: 424794 - DNA, 25 bp, Mus musculus
cgcaggtagtagaacggaagatcca

SEQ ID NO: 424795 - DNA, 25 bp, Mus musculus
cgcaggtcccctatgttgaaattct

SEQ ID NO: 424796 - DNA, 25 bp, Mus musculus
cgcaggtgctgtttgctggctacaa

SEQ ID NO: 424797 - DNA, 25 bp, Mus musculus
cgcaggttctacacccggaaggatg

SEQ ID NO: 424798 - DNA, 25 bp, Mus musculus
cgcagtctgggattggtgcagtccc

SEQ ID NO: 424799 - DNA, 25 bp, Mus musculus
cgcagtgacaacctgggtagccctg

SEQ ID NO: 424800 - DNA, 25 bp, Mus musculus
cgcagtgacgagaagaaacggcaca

SEQ ID NO: 424801 - DNA, 25 bp, Mus musculus
cgcagtgcccaggtaacggtccttt

SEQ ID NO: 424802 - DNA, 25 bp, Mus musculus
cgcagtggaggtcacctatttcccc

SEQ ID NO: 424803 - DNA, 25 bp, Mus musculus
cgcagtggccaaatcgaaggtgtac

SEQ ID NO: 424804 - DNA, 25 bp, Mus musculus
cgcagttgatcgtagaggtagtctc

SEQ ID NO: 424805 - DNA, 25 bp, Mus musculus
cgcagttggctataagacggatgaa

SEQ ID NO: 424806 - DNA, 25 bp, Mus musculus
cgcatacgtgtaggaagctctggcc

SEQ ID NO: 424807 - DNA, 25 bp, Mus musculus
cgcatccagcacctttagcaagcag

SEQ ID NO: 424808 - DNA, 25 bp, Mus musculus
cgcatccgctcggaacgctgcttcg

SEQ ID NO: 424809 - DNA, 25 bp, Mus musculus
cgcatcgatgtagaaggtcaccact

SEQ ID NO: 424810 - DNA, 25 bp, Mus musculus
cgcatcggtggtgtgcacgcagaca

SEQ ID NO: 424811 - DNA, 25 bp, Mus musculus
cgcatcttcggcctcaagaagcgca

SEQ ID NO: 424812 - DNA, 25 bp, Mus musculus
cgcatgatgagaaaggtactgctct

SEQ ID NO: 424813 - DNA, 25 bp, Mus musculus
cgcatgctgtgcgtgtgacggccac

SEQ ID NO: 424814 - DNA, 25 bp, Mus musculus
cgcatggcaacgtggaatcagatct

SEQ ID NO: 424815 - DNA, 25 bp, Mus musculus
cgcatggtcaagcagggagtggaga

SEQ ID NO: 424816 - DNA, 25 bp, Mus musculus
cgcattagtcttagccccagggcaa

SEQ ID NO: 424817 - DNA, 25 bp, Mus musculus
cgcatttatggctggtgtttctccc

SEQ ID NO: 424818 - DNA, 25 bp, Mus musculus
cgccaaagctgataggaggagacct

SEQ ID NO: 424819 - DNA, 25 bp, Mus musculus
cgccaactgtgtacctgctgcacta

SEQ ID NO: 424820 - DNA, 25 bp, Mus musculus
cgccaagctgcctgtcagaaagaca

SEQ ID NO: 424821 - DNA, 25 bp, Mus musculus
cgccaagtacgggaagcacaagtct

SEQ ID NO: 424822 - DNA, 25 bp, Mus musculus
cgccactcggagagacgtgcatcaa

SEQ ID NO: 424823 - DNA, 25 bp, Mus musculus
cgccacttcggaagaccctgagtct

SEQ ID NO: 424824 - DNA, 25 bp, Mus musculus
cgccagacaggagtcctagatttaa

SEQ ID NO: 424825 - DNA, 25 bp, Mus musculus
cgccagagcgggtcttggcagtttt

SEQ ID NO: 424826 - DNA, 25 bp, Mus musculus
cgccagctacttgcaatgcagtgca

SEQ ID NO: 424827 - DNA, 25 bp, Mus musculus
cgccaggtcctagggcacaagttca

SEQ ID NO: 424828 - DNA, 25 bp, Mus musculus
cgccatgaatggtgtcgcagctgcc

SEQ ID NO: 424829 - DNA, 25 bp, Mus musculus
cgccatgccgaggaacactcggtgt

SEQ ID NO: 424830 - DNA, 25 bp, Mus musculus
cgccatggaaattaatgtggagaaa

SEQ ID NO: 424831 - DNA, 25 bp, Mus musculus
cgccatggatgccaaggtcggctct

SEQ ID NO: 424832 - DNA, 25 bp, Mus musculus
cgccatttatacgatagcggagaaa

SEQ ID NO: 424833 - DNA, 25 bp, Mus musculus
cgccatttctcggtgtctctggaga

SEQ ID NO: 424834 - DNA, 25 bp, Mus musculus
cgccattttggctgcatatatgatt

SEQ ID NO: 424835 - DNA, 25 bp, Mus musculus
cgcccaagcttggtgatgcattgtg

SEQ ID NO: 424836 - DNA, 25 bp, Mus musculus
cgcccagcttggagaagtggagaat

SEQ ID NO: 424837 - DNA, 25 bp, Mus musculus
cgcccaggccgaatgaagatgcaca

SEQ ID NO: 424838 - DNA, 25 bp, Mus musculus
cgcccagggctttctctgagatggc

SEQ ID NO: 424839 - DNA, 25 bp, Mus musculus
cgcccagtgtgagctgaacacggat

SEQ ID NO: 424840 - DNA, 25 bp, Mus musculus
cgcccatggtggatgcgtctagatg

SEQ ID NO: 424841 - DNA, 25 bp, Mus musculus
cgccccgggaggttctgatctcaga

SEQ ID NO: 424842 - DNA, 25 bp, Mus musculus
cgcccctaaaatctagtcagtatgc

SEQ ID NO: 424843 - DNA, 25 bp, Mus musculus
cgcccggatgtgcacgaaaatggaa

SEQ ID NO: 424844 - DNA, 25 bp, Mus musculus
cgcccgtttggtgatatcgaggaaa

SEQ ID NO: 424845 - DNA, 25 bp, Mus musculus
cgccctcctgtggtaataagctggt

SEQ ID NO: 424846 - DNA, 25 bp, Mus musculus
cgccctctccagtcatgggtgcggg

SEQ ID NO: 424847 - DNA, 25 bp, Mus musculus
cgccctgcgggctcagcggattcag

SEQ ID NO: 424848 - DNA, 25 bp, Mus musculus
cgccctgggttgtggttctgtagca

SEQ ID NO: 424849 - DNA, 25 bp, Mus musculus
cgccctggtagatggccaggcccta

SEQ ID NO: 424850 - DNA, 25 bp, Mus musculus
cgccctgtactgcacttagaatgat

SEQ ID NO: 424851 - DNA, 25 bp, Mus musculus
cgcccttggttgagacgagcactcc

SEQ ID NO: 424852 - DNA, 25 bp, Mus musculus
cgccgaaaccgatgtcagtactgca

SEQ ID NO: 424853 - DNA, 25 bp, Mus musculus
cgccgaatgaaatggaaacgcagca

SEQ ID NO: 424854 - DNA, 25 bp, Mus musculus
cgccgagacctggaaaaagacgtgt

SEQ ID NO: 424855 - DNA, 25 bp, Mus musculus
cgccgcaggcaggaatgttctcaga

SEQ ID NO: 424856 - DNA, 25 bp, Mus musculus
cgccgcatgcatgggacaggatgct

SEQ ID NO: 424857 - DNA, 25 bp, Mus musculus
cgccgccgcgcctcgaagtttggtg

SEQ ID NO: 424858 - DNA, 25 bp, Mus musculus
cgccgcctccaccattgtataatgt

SEQ ID NO: 424859 - DNA, 25 bp, Mus musculus
cgccgcggctgcttctccggctgag

SEQ ID NO: 424860 - DNA, 25 bp, Mus musculus
cgccggagaggcatccacagcagcg

SEQ ID NO: 424861 - DNA, 25 bp, Mus musculus
cgccggaggtgtatcaagcgctcat

SEQ ID NO: 424862 - DNA, 25 bp, Mus musculus
cgccggcagctttcgtaaaggagta

SEQ ID NO: 424863 - DNA, 25 bp, Mus musculus
cgccggccagcctttgggtgagatt

SEQ ID NO: 424864 - DNA, 25 bp, Mus musculus
cgccggcgcgcgttgcgtgttttca

SEQ ID NO: 424865 - DNA, 25 bp, Mus musculus
cgccgtacttgcaggaaagcagccc

SEQ ID NO: 424866 - DNA, 25 bp, Mus musculus
cgccgtcaagaccaccagaaagttt

SEQ ID NO: 424867 - DNA, 25 bp, Mus musculus
cgccgtgaggtgagttcctgtgtcc

SEQ ID NO: 424868 - DNA, 25 bp, Mus musculus
cgcctatgatttccatgctggagga

SEQ ID NO: 424869 - DNA, 25 bp, Mus musculus
cgcctcccgagcagcaggaaggagc

SEQ ID NO: 424870 - DNA, 25 bp, Mus musculus
cgcctcgctcaccatctggaagaag

SEQ ID NO: 424871 - DNA, 25 bp, Mus musculus
cgcctcgggcgatgtcagatattgt

SEQ ID NO: 424872 - DNA, 25 bp, Mus musculus
cgcctgaaagcggttcctggaagag

SEQ ID NO: 424873 - DNA, 25 bp, Mus musculus
cgcctgcatttttctccgaaagggt

SEQ ID NO: 424874 - DNA, 25 bp, Mus musculus
cgcctgctactgaaactgggaatta

SEQ ID NO: 424875 - DNA, 25 bp, Mus musculus
cgcctggaacccgtgaagaatcatg

SEQ ID NO: 424876 - DNA, 25 bp, Mus musculus
cgcctggaggagaaagtcaagaccc

SEQ ID NO: 424877 - DNA, 25 bp, Mus musculus
cgcctgggaggctttgatgagaccc

SEQ ID NO: 424878 - DNA, 25 bp, Mus musculus
cgcctggtgaaagagacccggatct

SEQ ID NO: 424879 - DNA, 25 bp, Mus musculus
cgcctggtgcggctatgaatgccca

SEQ ID NO: 424880 - DNA, 25 bp, Mus musculus
cgcctgtacagagagatcagtggac

SEQ ID NO: 424881 - DNA, 25 bp, Mus musculus
cgcctgtcaggaccgtgaggaacat

SEQ ID NO: 424882 - DNA, 25 bp, Mus musculus
cgccttcccgattgagagagctgca

SEQ ID NO: 424883 - DNA, 25 bp, Mus musculus
cgccttctgctatgttgagcttttc

SEQ ID NO: 424884 - DNA, 25 bp, Mus musculus
cgccttgaggatctgaaggaatact

SEQ ID NO: 424885 - DNA, 25 bp, Mus musculus
cgccttgcacgtaggtcatgtgaca

SEQ ID NO: 424886 - DNA, 25 bp, Mus musculus
cgcctttcgctagagagccggtctt

SEQ ID NO: 424887 - DNA, 25 bp, Mus musculus
cgcgaaaggacacggagaagccacc

SEQ ID NO: 424888 - DNA, 25 bp, Mus musculus
cgcgaaaggtccaggtgacaactta

SEQ ID NO: 424889 - DNA, 25 bp, Mus musculus
cgcgaactgcgtcagatggaaccct

SEQ ID NO: 424890 - DNA, 25 bp, Mus musculus
cgcgaagtgggaatgagaggcaagc

SEQ ID NO: 424891 - DNA, 25 bp, Mus musculus
cgcgaccgcctccatgaagcgtaag

SEQ ID NO: 424892 - DNA, 25 bp, Mus musculus
cgcgacctggtagatggcccaagta

SEQ ID NO: 424893 - DNA, 25 bp, Mus musculus
cgcgactcggtggtacaagttcgga

SEQ ID NO: 424894 - DNA, 25 bp, Mus musculus
cgcgagctgagtggaatcccgtcta

SEQ ID NO: 424895 - DNA, 25 bp, Mus musculus
cgcgaggacacgtccttgaggcccg

SEQ ID NO: 424896 - DNA, 25 bp, Mus musculus
cgcgaggcaccggtgccagagttta

SEQ ID NO: 424897 - DNA, 25 bp, Mus musculus
cgcgatcaagtttgggcctggcaca

SEQ ID NO: 424898 - DNA, 25 bp, Mus musculus
cgcgatgagagatgtattccgattc

SEQ ID NO: 424899 - DNA, 25 bp, Mus musculus
cgcgcaaggaggtcatgcagactaa

SEQ ID NO: 424900 - DNA, 25 bp, Mus musculus
cgcgcaggagggtttctgcgtcttc

SEQ ID NO: 424901 - DNA, 25 bp, Mus musculus
cgcgcagtttagctcagagggtcca

SEQ ID NO: 424902 - DNA, 25 bp, Mus musculus
cgcgccaattggaagctgcagagtg

SEQ ID NO: 424903 - DNA, 25 bp, Mus musculus
cgcgccaccgtgaagaaggagtttg

SEQ ID NO: 424904 - DNA, 25 bp, Mus musculus
cgcgcccgggttgagaatatcattc

SEQ ID NO: 424905 - DNA, 25 bp, Mus musculus
cgcgcccgtctggaggttaagccaa

SEQ ID NO: 424906 - DNA, 25 bp, Mus musculus
cgcgccgcccggaaggagattttcg

SEQ ID NO: 424907 - DNA, 25 bp, Mus musculus
cgcgccgcggcgttctcggttacag

SEQ ID NO: 424908 - DNA, 25 bp, Mus musculus
cgcgcctcgaagtttggtggctaat

SEQ ID NO: 424909 - DNA, 25 bp, Mus musculus
cgcgcctcgcagctcaaagtgaaga

SEQ ID NO: 424910 - DNA, 25 bp, Mus musculus
cgcgcgagtagcatccttggtggca

SEQ ID NO: 424911 - DNA, 25 bp, Mus musculus
cgcgcgcaagagtcactagtctaaa

SEQ ID NO: 424912 - DNA, 25 bp, Mus musculus
cgcgcggccctctgggaagtgctac

SEQ ID NO: 424913 - DNA, 25 bp, Mus musculus
cgcgctgatattaacggtggccaca

SEQ ID NO: 424914 - DNA, 25 bp, Mus musculus
cgcgctgcgctctacatcttggtgc

SEQ ID NO: 424915 - DNA, 25 bp, Mus musculus
cgcgctgctgcttaagtgcatggaa

SEQ ID NO: 424916 - DNA, 25 bp, Mus musculus
cgcgctgggaaaaggcaacaaatgc

SEQ ID NO: 424917 - DNA, 25 bp, Mus musculus
cgcgctgggcgacaagagttttcaa

SEQ ID NO: 424918 - DNA, 25 bp, Mus musculus
cgcgctgtgagtatacaactgcatt

SEQ ID NO: 424919 - DNA, 25 bp, Mus musculus
cgcgcttgacagtgcaccttgatct

SEQ ID NO: 424920 - DNA, 25 bp, Mus musculus
cgcgctttacggacctggaagaatt

SEQ ID NO: 424921 - DNA, 25 bp, Mus musculus
cgcggaagctatgcctggcagtgct

SEQ ID NO: 424922 - DNA, 25 bp, Mus musculus
cgcggacagagctactgatgccaat

SEQ ID NO: 424923 - DNA, 25 bp, Mus musculus
cgcggacgggctgtgatgactaaca

SEQ ID NO: 424924 - DNA, 25 bp, Mus musculus
cgcggagagccgcaatgacagcatc

SEQ ID NO: 424925 - DNA, 25 bp, Mus musculus
cgcggaggtggaaagtcctaccaag

SEQ ID NO: 424926 - DNA, 25 bp, Mus musculus
cgcggaggtggcaggtatcacattt

SEQ ID NO: 424927 - DNA, 25 bp, Mus musculus
cgcggatccgagtgcacaagatgta

SEQ ID NO: 424928 - DNA, 25 bp, Mus musculus
cgcggcaggagttcgaaagtatcta

SEQ ID NO: 424929 - DNA, 25 bp, Mus musculus
cgcggctattgcaaccatcaagaca

SEQ ID NO: 424930 - DNA, 25 bp, Mus musculus
cgcggctgatgacgctccagagaca

SEQ ID NO: 424931 - DNA, 25 bp, Mus musculus
cgcggctggatgtgtgtgacgcctg

SEQ ID NO: 424932 - DNA, 25 bp, Mus musculus
cgcggcttccgcttgatttattaat

SEQ ID NO: 424933 - DNA, 25 bp, Mus musculus
cgcgggcattgcagtgggattctac

SEQ ID NO: 424934 - DNA, 25 bp, Mus musculus
cgcgggcctgagaaaactcgggcat

SEQ ID NO: 424935 - DNA, 25 bp, Mus musculus
cgcgggcgccaagtactttttcaag

SEQ ID NO: 424936 - DNA, 25 bp, Mus musculus
cgcgggtccttcttgtgcagataaa

SEQ ID NO: 424937 - DNA, 25 bp, Mus musculus
cgcggtcaatctcctacaggcggtg

SEQ ID NO: 424938 - DNA, 25 bp, Mus musculus
cgcgtaagagagaataatactggct

SEQ ID NO: 424939 - DNA, 25 bp, Mus musculus
cgcgtagacggaggcgctccggaca

SEQ ID NO: 424940 - DNA, 25 bp, Mus musculus
cgcgtaggagcgtgtgtcttgaaac

SEQ ID NO: 424941 - DNA, 25 bp, Mus musculus
cgcgtgaccactgcaggcaggaatg

SEQ ID NO: 424942 - DNA, 25 bp, Mus musculus
cgcgtgagttgaaacattggtcaca

SEQ ID NO: 424943 - DNA, 25 bp, Mus musculus
cgcgtggcccacgtgagtcctgttg

SEQ ID NO: 424944 - DNA, 25 bp, Mus musculus
cgcgtgtacgatctgtggcaaaatg

SEQ ID NO: 424945 - DNA, 25 bp, Mus musculus
cgcgtgtttgtctcaggtctcggaa

SEQ ID NO: 424946 - DNA, 25 bp, Mus musculus
cgcgtttgaggaggtgcaactgcca

SEQ ID NO: 424947 - DNA, 25 bp, Mus musculus
cgcgttttggagaccttggccctga

SEQ ID NO: 424948 - DNA, 25 bp, Mus musculus
cgctaaggtgtattttcagagatgc

SEQ ID NO: 424949 - DNA, 25 bp, Mus musculus
cgctaagtaagacctgaggaagcag

SEQ ID NO: 424950 - DNA, 25 bp, Mus musculus
cgctactactttgggtgctgtgaga

SEQ ID NO: 424951 - DNA, 25 bp, Mus musculus
cgctactccgtgtctccctgagatg

SEQ ID NO: 424952 - DNA, 25 bp, Mus musculus
cgctactcggaggaagactgtacct

SEQ ID NO: 424953 - DNA, 25 bp, Mus musculus
cgctacttctgtgtaaccggtttca

SEQ ID NO: 424954 - DNA, 25 bp, Mus musculus
cgctagtggccgcagaaggttcctt

SEQ ID NO: 424955 - DNA, 25 bp, Mus musculus
cgctagtttctctccagcaagaaaa

SEQ ID NO: 424956 - DNA, 25 bp, Mus musculus
cgctatatcacggagcagcggcgac

SEQ ID NO: 424957 - DNA, 25 bp, Mus musculus
cgctatgctgcgaaaggacacttgt

SEQ ID NO: 424958 - DNA, 25 bp, Mus musculus
cgctcaagctgaagtgggatccggc

SEQ ID NO: 424959 - DNA, 25 bp, Mus musculus
cgctcactatagatgggacctgatg

SEQ ID NO: 424960 - DNA, 25 bp, Mus musculus
cgctcagacagcgactatgacatgt

SEQ ID NO: 424961 - DNA, 25 bp, Mus musculus
cgctcagcatgtacgccagcgtgct

SEQ ID NO: 424962 - DNA, 25 bp, Mus musculus
cgctcaggctgaggcatctggctct

SEQ ID NO: 424963 - DNA, 25 bp, Mus musculus
cgctcatgccccactctgaaaaaag

SEQ ID NO: 424964 - DNA, 25 bp, Mus musculus
cgctcatgtttgcagaaggttggca

SEQ ID NO: 424965 - DNA, 25 bp, Mus musculus
cgctccgctagcctggatgtggcat

SEQ ID NO: 424966 - DNA, 25 bp, Mus musculus
cgctccgtaggatgagccctttctc

SEQ ID NO: 424967 - DNA, 25 bp, Mus musculus
cgctcctctggctcgagtccgtgtt

SEQ ID NO: 424968 - DNA, 25 bp, Mus musculus
cgctcgacggtgttggtactccaaa

SEQ ID NO: 424969 - DNA, 25 bp, Mus musculus
cgctcgacgtttgcaagggtttccg

SEQ ID NO: 424970 - DNA, 25 bp, Mus musculus
cgctcgaggagtttttgacctggaa

SEQ ID NO: 424971 - DNA, 25 bp, Mus musculus
cgctcgctcaggtgttggaaataaa

SEQ ID NO: 424972 - DNA, 25 bp, Mus musculus
cgctcgctgcaagtgctggaaggct

SEQ ID NO: 424973 - DNA, 25 bp, Mus musculus
cgctcggaagaaagtaacgtgaaag

SEQ ID NO: 424974 - DNA, 25 bp, Mus musculus
cgctcggtgttcagtttcatgcagg

SEQ ID NO: 424975 - DNA, 25 bp, Mus musculus
cgctctacatcttggtgcgggtagt

SEQ ID NO: 424976 - DNA, 25 bp, Mus musculus
cgctctgagggcgagaaaatccgaa

SEQ ID NO: 424977 - DNA, 25 bp, Mus musculus
cgctcttgccctatgttttcgatga

SEQ ID NO: 424978 - DNA, 25 bp, Mus musculus
cgctctttgccccaggagtctgaag

SEQ ID NO: 424979 - DNA, 25 bp, Mus musculus
cgctctttgtagtgctggtgatcat

SEQ ID NO: 424980 - DNA, 25 bp, Mus musculus
cgctgaaattccaggcagtgggaga

SEQ ID NO: 424981 - DNA, 25 bp, Mus musculus
cgctgaactgcaattggatccctaa

SEQ ID NO: 424982 - DNA, 25 bp, Mus musculus
cgctgaagtgcctcaggacgatgca

SEQ ID NO: 424983 - DNA, 25 bp, Mus musculus
cgctgacaataaagatgtaccattt

SEQ ID NO: 424984 - DNA, 25 bp, Mus musculus
cgctgacagtggtgataacgcccaa

SEQ ID NO: 424985 - DNA, 25 bp, Mus musculus
cgctgagcagcctaaaccggaggtg

SEQ ID NO: 424986 - DNA, 25 bp, Mus musculus
cgctgagcccatgaggtaaaacgca

SEQ ID NO: 424987 - DNA, 25 bp, Mus musculus
cgctgaggagagagttacgcgccct

SEQ ID NO: 424988 - DNA, 25 bp, Mus musculus
cgctgatagaaagaggtaattgcac

SEQ ID NO: 424989 - DNA, 25 bp, Mus musculus
cgctgatatcacaagccacctggat

SEQ ID NO: 424990 - DNA, 25 bp, Mus musculus
cgctgatgcactgcctatgagcact

SEQ ID NO: 424991 - DNA, 25 bp, Mus musculus
cgctgatttgcttaactggtgggac

SEQ ID NO: 424992 - DNA, 25 bp, Mus musculus
cgctgcaacaatgggaacgggactt

SEQ ID NO: 424993 - DNA, 25 bp, Mus musculus
cgctgcacatcactaatgccttgga

SEQ ID NO: 424994 - DNA, 25 bp, Mus musculus
cgctgcccatggactgaatgtttgc

SEQ ID NO: 424995 - DNA, 25 bp, Mus musculus
cgctgccgggctgagttagacttct

SEQ ID NO: 424996 - DNA, 25 bp, Mus musculus
cgctgcgagcacaagtggccaaact

SEQ ID NO: 424997 - DNA, 25 bp, Mus musculus
cgctgctggagctactgacgcggcc

SEQ ID NO: 424998 - DNA, 25 bp, Mus musculus
cgctgcttaactccactttattcca

SEQ ID NO: 424999 - DNA, 25 bp, Mus musculus
cgctggaaggagtgaagcctctcca

SEQ ID NO: 425000 - DNA, 25 bp, Mus musculus
cgctggagggaaccgatcgtaacct

SEQ ID NO: 425001 - DNA, 25 bp, Mus musculus
cgctggcaggtcatcacggtcatta

SEQ ID NO: 425002 - DNA, 25 bp, Mus musculus
cgctggcctgcgtgctttggtgtat

SEQ ID NO: 425003 - DNA, 25 bp, Mus musculus
cgctggcttccgttgctgtggctaa

SEQ ID NO: 425004 - DNA, 25 bp, Mus musculus
cgctgggacccaaaagactacgaag

SEQ ID NO: 425005 - DNA, 25 bp, Mus musculus
cgctgggagaatgctgctccgccga

SEQ ID NO: 425006 - DNA, 25 bp, Mus musculus
cgctgggattcattccgagttcaag

SEQ ID NO: 425007 - DNA, 25 bp, Mus musculus
cgctgggcactgaaattctgttttt

SEQ ID NO: 425008 - DNA, 25 bp, Mus musculus
cgctgggccagctgacaggttatga

SEQ ID NO: 425009 - DNA, 25 bp, Mus musculus
cgctgtccaggcagcgtctcaggac

SEQ ID NO: 425010 - DNA, 25 bp, Mus musculus
cgctgtcttaggtggaaagtatatc

SEQ ID NO: 425011 - DNA, 25 bp, Mus musculus
cgctgtgagcgagtacaacaagggc

SEQ ID NO: 425012 - DNA, 25 bp, Mus musculus
cgctgtgctcctatctagaagtggc

SEQ ID NO: 425013 - DNA, 25 bp, Mus musculus
cgctgtggactacgatcgctctgga

SEQ ID NO: 425014 - DNA, 25 bp, Mus musculus
cgctgtgggccatgcaactcctttg

SEQ ID NO: 425015 - DNA, 25 bp, Mus musculus
cgctgttaataacggtgggcccctg

SEQ ID NO: 425016 - DNA, 25 bp, Mus musculus
cgctgttgtgaagccacgtcgacct

SEQ ID NO: 425017 - DNA, 25 bp, Mus musculus
cgcttaagaccgtgctaggcaacaa

SEQ ID NO: 425018 - DNA, 25 bp, Mus musculus
cgcttaccaaccagatcgacgagaa

SEQ ID NO: 425019 - DNA, 25 bp, Mus musculus
cgcttagagcatgtgactgtgttcc

SEQ ID NO: 425020 - DNA, 25 bp, Mus musculus
cgcttaggagggaattcaggatact

SEQ ID NO: 425021 - DNA, 25 bp, Mus musculus
cgcttatgaagtatgctatttcccc

SEQ ID NO: 425022 - DNA, 25 bp, Mus musculus
cgcttcaagcgtttcgggagtgcca

SEQ ID NO: 425023 - DNA, 25 bp, Mus musculus
cgcttcactcccctatgactaagga

SEQ ID NO: 425024 - DNA, 25 bp, Mus musculus
cgcttcgcaatggacgccgcgttga

SEQ ID NO: 425025 - DNA, 25 bp, Mus musculus
cgcttcgccgaggatatgttggaga

SEQ ID NO: 425026 - DNA, 25 bp, Mus musculus
cgcttctttgaggagtgtgacccca

SEQ ID NO: 425027 - DNA, 25 bp, Mus musculus
cgcttgagatttgtaacggactgag

SEQ ID NO: 425028 - DNA, 25 bp, Mus musculus
cgcttgatgaaccagttgatagacc

SEQ ID NO: 425029 - DNA, 25 bp, Mus musculus
cgcttgcacagggacagggaatgaa

SEQ ID NO: 425030 - DNA, 25 bp, Mus musculus
cgcttgctcattcatcagggactgc

SEQ ID NO: 425031 - DNA, 25 bp, Mus musculus
cgcttggaactaaactgctgctctg

SEQ ID NO: 425032 - DNA, 25 bp, Mus musculus
cgcttggagagcagctctgctttct

SEQ ID NO: 425033 - DNA, 25 bp, Mus musculus
cgcttgggagaatggcatggccttc

SEQ ID NO: 425034 - DNA, 25 bp, Mus musculus
cgctttataaagatggagtcagagt

SEQ ID NO: 425035 - DNA, 25 bp, Mus musculus
cgctttcacgaaataggcaccgaga

SEQ ID NO: 425036 - DNA, 25 bp, Mus musculus
cgctttcatcttacgtggcaaacca

SEQ ID NO: 425037 - DNA, 25 bp, Mus musculus
cgctttctttgcatgctagctgagc

SEQ ID NO: 425038 - DNA, 25 bp, Mus musculus
cgctttgcaaaggacaggctcacgg

SEQ ID NO: 425039 - DNA, 25 bp, Mus musculus
cgctttgggatcacgggctatggca

SEQ ID NO: 425040 - DNA, 25 bp, Mus musculus
cgctttgtggatgcccgtgagatca

SEQ ID NO: 425041 - DNA, 25 bp, Mus musculus
cgcttttgccggtgctggtactcaa

SEQ ID NO: 425042 - DNA, 25 bp, Mus musculus
cggaaaaacacgagacattagtgat

SEQ ID NO: 425043 - DNA, 25 bp, Mus musculus
cggaacctgtgcttctgctgggtgt

SEQ ID NO: 425044 - DNA, 25 bp, Mus musculus
cggaacgatggtggtcaatgcagaa

SEQ ID NO: 425045 - DNA, 25 bp, Mus musculus
cggaactctggtaagggcttcctag

SEQ ID NO: 425046 - DNA, 25 bp, Mus musculus
cggaagaaatctccccatcggcggt

SEQ ID NO: 425047 - DNA, 25 bp, Mus musculus
cggaagaagaaacggcaatcgctca

SEQ ID NO: 425048 - DNA, 25 bp, Mus musculus
cggaagacattcaagcaggactagc

SEQ ID NO: 425049 - DNA, 25 bp, Mus musculus
cggaagatgcagttgtacgtggcta

SEQ ID NO: 425050 - DNA, 25 bp, Mus musculus
cggaagatggcgtcggcacctgtct

SEQ ID NO: 425051 - DNA, 25 bp, Mus musculus
cggaagcgtccaaaaatgtatagca

SEQ ID NO: 425052 - DNA, 25 bp, Mus musculus
cggaaggacattacagcagaggcaa

SEQ ID NO: 425053 - DNA, 25 bp, Mus musculus
cggaaggactgcaaacagtgggtat

SEQ ID NO: 425054 - DNA, 25 bp, Mus musculus
cggaagggacgctgcattgactttt

SEQ ID NO: 425055 - DNA, 25 bp, Mus musculus
cggaagtcatttaactcattctcag

SEQ ID NO: 425056 - DNA, 25 bp, Mus musculus
cggaagtgatcctcgagaacctact

SEQ ID NO: 425057 - DNA, 25 bp, Mus musculus
cggaagtggtaagactgacgtgtcc

SEQ ID NO: 425058 - DNA, 25 bp, Mus musculus
cggaatatcatagacgttggcagac

SEQ ID NO: 425059 - DNA, 25 bp, Mus musculus
cggaatgaacgagggcccactgact

SEQ ID NO: 425060 - DNA, 25 bp, Mus musculus
cggacaaaccctgtggttcagagga

SEQ ID NO: 425061 - DNA, 25 bp, Mus musculus
cggacaagcgggtaattagagcccg

SEQ ID NO: 425062 - DNA, 25 bp, Mus musculus
cggacaatgacaaggagacccaggg

SEQ ID NO: 425063 - DNA, 25 bp, Mus musculus
cggacaccatcaagatccatcttgg

SEQ ID NO: 425064 - DNA, 25 bp, Mus musculus
cggacacggagctcacggacgtccg

SEQ ID NO: 425065 - DNA, 25 bp, Mus musculus
cggacactgtctctagctcaaggaa

SEQ ID NO: 425066 - DNA, 25 bp, Mus musculus
cggacagagaagttcgagccctgga

SEQ ID NO: 425067 - DNA, 25 bp, Mus musculus
cggacagcatcggtcctaaggagag

SEQ ID NO: 425068 - DNA, 25 bp, Mus musculus
cggacattcagggtgcctctttggg

SEQ ID NO: 425069 - DNA, 25 bp, Mus musculus
cggacattggctttctgcgcacaga

SEQ ID NO: 425070 - DNA, 25 bp, Mus musculus
cggaccaaaacccagaagctggtgc

SEQ ID NO: 425071 - DNA, 25 bp, Mus musculus
cggaccgtagctgtcggtcggactc

SEQ ID NO: 425072 - DNA, 25 bp, Mus musculus
cggacctggcgtcaagccctctaag

SEQ ID NO: 425073 - DNA, 25 bp, Mus musculus
cggacctttctcagcaagatcctca

SEQ ID NO: 425074 - DNA, 25 bp, Mus musculus
cggacgagtctctgttagcgcagcg

SEQ ID NO: 425075 - DNA, 25 bp, Mus musculus
cggacgctgtgatcggcttatgacc

SEQ ID NO: 425076 - DNA, 25 bp, Mus musculus
cggacggcccctatgcgctaattgt

SEQ ID NO: 425077 - DNA, 25 bp, Mus musculus
cggacggtgcgctaacgggaacatt

SEQ ID NO: 425078 - DNA, 25 bp, Mus musculus
cggacgtgcgcatcaccggctgagc

SEQ ID NO: 425079 - DNA, 25 bp, Mus musculus
cggacgttgatcaaagccttcggca

SEQ ID NO: 425080 - DNA, 25 bp, Mus musculus
cggactagggaaacttgaaggctgc

SEQ ID NO: 425081 - DNA, 25 bp, Mus musculus
cggactctctgttgggacagagccg

SEQ ID NO: 425082 - DNA, 25 bp, Mus musculus
cggacttctgggaacgtttggagca

SEQ ID NO: 425083 - DNA, 25 bp, Mus musculus
cggagaaagggctctttggacttag

SEQ ID NO: 425084 - DNA, 25 bp, Mus musculus
cggagaagctgaggacgcgtcctca

SEQ ID NO: 425085 - DNA, 25 bp, Mus musculus
cggagaagtccatgctgtcgaagct

SEQ ID NO: 425086 - DNA, 25 bp, Mus musculus
cggagaatatcaccaacgtggaggt

SEQ ID NO: 425087 - DNA, 25 bp, Mus musculus
cggagaattacaagcaccgcggaat

SEQ ID NO: 425088 - DNA, 25 bp, Mus musculus
cggagactgatgaactggccacctt

SEQ ID NO: 425089 - DNA, 25 bp, Mus musculus
cggagagaagttctctcgggatttc

SEQ ID NO: 425090 - DNA, 25 bp, Mus musculus
cggagatgggccacggttagtccac

SEQ ID NO: 425091 - DNA, 25 bp, Mus musculus
cggagattatcctgtggcctggcat

SEQ ID NO: 425092 - DNA, 25 bp, Mus musculus
cggagcattccttgacttgacagga

SEQ ID NO: 425093 - DNA, 25 bp, Mus musculus
cggagccagaggtccttaaaggagc

SEQ ID NO: 425094 - DNA, 25 bp, Mus musculus
cggagccctcccaggtctatgtggc

SEQ ID NO: 425095 - DNA, 25 bp, Mus musculus
cggagctaatgggactgcgttcaca

SEQ ID NO: 425096 - DNA, 25 bp, Mus musculus
cggagctctatttcaacgtggacaa

SEQ ID NO: 425097 - DNA, 25 bp, Mus musculus
cggagctgccggaattgctgaagca

SEQ ID NO: 425098 - DNA, 25 bp, Mus musculus
cggagctgcctcagcaagtagtgca

SEQ ID NO: 425099 - DNA, 25 bp, Mus musculus
cggagcttccttcattgtgcgcaca

SEQ ID NO: 425100 - DNA, 25 bp, Mus musculus
cggaggaaagctcaacccagacccg

SEQ ID NO: 425101 - DNA, 25 bp, Mus musculus
cggaggacaagaaaacatgagtgac

SEQ ID NO: 425102 - DNA, 25 bp, Mus musculus
cggaggagcccagtatgtttcttaa

SEQ ID NO: 425103 - DNA, 25 bp, Mus musculus
cggaggcaaaggtgcttctgagaac

SEQ ID NO: 425104 - DNA, 25 bp, Mus musculus
cggaggccgccataaacattttgaa

SEQ ID NO: 425105 - DNA, 25 bp, Mus musculus
cggaggcctggttgcacaatgtaca

SEQ ID NO: 425106 - DNA, 25 bp, Mus musculus
cggaggctctcaccccagactggga

SEQ ID NO: 425107 - DNA, 25 bp, Mus musculus
cggagggccatcctttacagtcgga

SEQ ID NO: 425108 - DNA, 25 bp, Mus musculus
cggagggtcagcagaattcacgaac

SEQ ID NO: 425109 - DNA, 25 bp, Mus musculus
cggagggtcagctgctgccaacaac

SEQ ID NO: 425110 - DNA, 25 bp, Mus musculus
cggagtcaggctaaacggagtttca

SEQ ID NO: 425111 - DNA, 25 bp, Mus musculus
cggagtcagtgacaccattcttgcc

SEQ ID NO: 425112 - DNA, 25 bp, Mus musculus
cggagtccccgttgtccgtcgctgg

SEQ ID NO: 425113 - DNA, 25 bp, Mus musculus
cggagtcctggaactatgacagcaa

SEQ ID NO: 425114 - DNA, 25 bp, Mus musculus
cggagtcggccgacatgttcgacaa

SEQ ID NO: 425115 - DNA, 25 bp, Mus musculus
cggagtctaggataccaagaagttc

SEQ ID NO: 425116 - DNA, 25 bp, Mus musculus
cggagtcttccgcagagtggcttca

SEQ ID NO: 425117 - DNA, 25 bp, Mus musculus
cggagtttcattcttacctcttgcc

SEQ ID NO: 425118 - DNA, 25 bp, Mus musculus
cggatcaaaccggaaccagagcctt

SEQ ID NO: 425119 - DNA, 25 bp, Mus musculus
cggatcatacaaggccaggactgct

SEQ ID NO: 425120 - DNA, 25 bp, Mus musculus
cggatcatccgggaagcaacggtgt

SEQ ID NO: 425121 - DNA, 25 bp, Mus musculus
cggatcattgttccacaatgacata

SEQ ID NO: 425122 - DNA, 25 bp, Mus musculus
cggatcccgggacttcaacatgtat

SEQ ID NO: 425123 - DNA, 25 bp, Mus musculus
cggatccgagaaaagcaccttgctg

SEQ ID NO: 425124 - DNA, 25 bp, Mus musculus
cggatccgccgctggaggaccactg

SEQ ID NO: 425125 - DNA, 25 bp, Mus musculus
cggatccgctgcactggtgcttttg

SEQ ID NO: 425126 - DNA, 25 bp, Mus musculus
cggatcctctggtcggaagcatagc

SEQ ID NO: 425127 - DNA, 25 bp, Mus musculus
cggatctcgagagtagcttttgcta

SEQ ID NO: 425128 - DNA, 25 bp, Mus musculus
cggatctgcacttcgggaggtctct

SEQ ID NO: 425129 - DNA, 25 bp, Mus musculus
cggatctgttcgcaagtgctttttt

SEQ ID NO: 425130 - DNA, 25 bp, Mus musculus
cggatgacagcaggcattaagggct

SEQ ID NO: 425131 - DNA, 25 bp, Mus musculus
cggatgaccctgagattggagaaag

SEQ ID NO: 425132 - DNA, 25 bp, Mus musculus
cggatgagtgggagcgcggagctgc

SEQ ID NO: 425133 - DNA, 25 bp, Mus musculus
cggatgatccagagtgtgccctgca

SEQ ID NO: 425134 - DNA, 25 bp, Mus musculus
cggatgctgcctaccctgcggttaa

SEQ ID NO: 425135 - DNA, 25 bp, Mus musculus
cggatgtgtgggtagcatctcacca

SEQ ID NO: 425136 - DNA, 25 bp, Mus musculus
cggattactggatcgacggctctaa

SEQ ID NO: 425137 - DNA, 25 bp, Mus musculus
cggattatagtctcgctctctcgct

SEQ ID NO: 425138 - DNA, 25 bp, Mus musculus
cggattccagagaagtgggttttgt

SEQ ID NO: 425139 - DNA, 25 bp, Mus musculus
cggattccctggaaaatatcattag

SEQ ID NO: 425140 - DNA, 25 bp, Mus musculus
cggattgcacattccacgagcttgg

SEQ ID NO: 425141 - DNA, 25 bp, Mus musculus
cggcaaagagattgtcgacctggtc

SEQ ID NO: 425142 - DNA, 25 bp, Mus musculus
cggcaaagcagagcacgaggctcaa

SEQ ID NO: 425143 - DNA, 25 bp, Mus musculus
cggcaacggattccagagtgtatca

SEQ ID NO: 425144 - DNA, 25 bp, Mus musculus
cggcaacttttcctcggaagaagag

SEQ ID NO: 425145 - DNA, 25 bp, Mus musculus
cggcaagcggcttaacagaggacat

SEQ ID NO: 425146 - DNA, 25 bp, Mus musculus
cggcaaggcacttagggaatgaagc

SEQ ID NO: 425147 - DNA, 25 bp, Mus musculus
cggcaattatgccaccttggacggg

SEQ ID NO: 425148 - DNA, 25 bp, Mus musculus
cggcacaggcggtcgtttatgagca

SEQ ID NO: 425149 - DNA, 25 bp, Mus musculus
cggcacccaggtccatttttagtct

SEQ ID NO: 425150 - DNA, 25 bp, Mus musculus
cggcactatggcatgagcaaagggt

SEQ ID NO: 425151 - DNA, 25 bp, Mus musculus
cggcactgagtgaaaatgtcgtcca

SEQ ID NO: 425152 - DNA, 25 bp, Mus musculus
cggcagaatcgtggcctggtagata

SEQ ID NO: 425153 - DNA, 25 bp, Mus musculus
cggcagacatcctcctgcgtaggga

SEQ ID NO: 425154 - DNA, 25 bp, Mus musculus
cggcagacgggaaacagcgtattca

SEQ ID NO: 425155 - DNA, 25 bp, Mus musculus
cggcagagaggagtggctgggcgct

SEQ ID NO: 425156 - DNA, 25 bp, Mus musculus
cggcagccgggctgagagtcgcgcg

SEQ ID NO: 425157 - DNA, 25 bp, Mus musculus
cggcaggcaggcaaacagtgatcac

SEQ ID NO: 425158 - DNA, 25 bp, Mus musculus
cggcagggtctaacccggagtagct

SEQ ID NO: 425159 - DNA, 25 bp, Mus musculus
cggcagtagcaccagcggccaattt

SEQ ID NO: 425160 - DNA, 25 bp, Mus musculus
cggcagtttcgctaccaggacgcgg

SEQ ID NO: 425161 - DNA, 25 bp, Mus musculus
cggcataccgggactctggaggctt

SEQ ID NO: 425162 - DNA, 25 bp, Mus musculus
cggcatcgcagcaactttttgcgga

SEQ ID NO: 425163 - DNA, 25 bp, Mus musculus
cggcatgcgggacggacttctacat

SEQ ID NO: 425164 - DNA, 25 bp, Mus musculus
cggcatttttgtggacgacgcaaga

SEQ ID NO: 425165 - DNA, 25 bp, Mus musculus
cggccaagccctaggacagtgtaat

SEQ ID NO: 425166 - DNA, 25 bp, Mus musculus
cggccacgtcttccaccaagaaaga

SEQ ID NO: 425167 - DNA, 25 bp, Mus musculus
cggccagcgtaaccccaggtgaagt

SEQ ID NO: 425168 - DNA, 25 bp, Mus musculus
cggccatccgcaagaagctggtggt

SEQ ID NO: 425169 - DNA, 25 bp, Mus musculus
cggccatcgctgcagttcagagaaa

SEQ ID NO: 425170 - DNA, 25 bp, Mus musculus
cggccatgtttgtggcgcgcagcat

SEQ ID NO: 425171 - DNA, 25 bp, Mus musculus
cggccccggcggatgttgacattgt

SEQ ID NO: 425172 - DNA, 25 bp, Mus musculus
cggccccggtcacaatggacagttt

SEQ ID NO: 425173 - DNA, 25 bp, Mus musculus
cggcccctcggacaacaaacgagat

SEQ ID NO: 425174 - DNA, 25 bp, Mus musculus
cggccctgaatgacttttcctgaag

SEQ ID NO: 425175 - DNA, 25 bp, Mus musculus
cggccgagacggtgaataaagttgt

SEQ ID NO: 425176 - DNA, 25 bp, Mus musculus
cggccgagttcccatggtacagtag

SEQ ID NO: 425177 - DNA, 25 bp, Mus musculus
cggccgcactggaagcccgaacaag

SEQ ID NO: 425178 - DNA, 25 bp, Mus musculus
cggccgccaagaagatcctgatcaa

SEQ ID NO: 425179 - DNA, 25 bp, Mus musculus
cggccgccatgtctaaatacgtgaa

SEQ ID NO: 425180 - DNA, 25 bp, Mus musculus
cggccggagtccatttgcataattg

SEQ ID NO: 425181 - DNA, 25 bp, Mus musculus
cggccggagttggacccagtataca

SEQ ID NO: 425182 - DNA, 25 bp, Mus musculus
cggcctagggaagcacggagttcta

SEQ ID NO: 425183 - DNA, 25 bp, Mus musculus
cggcctgaagctacgcaagtctgag

SEQ ID NO: 425184 - DNA, 25 bp, Mus musculus
cggcctgccatgagttctttgaaca

SEQ ID NO: 425185 - DNA, 25 bp, Mus musculus
cggcctggggattctgaagacaaaa

SEQ ID NO: 425186 - DNA, 25 bp, Mus musculus
cggcctttttatgctgtcgggtgca

SEQ ID NO: 425187 - DNA, 25 bp, Mus musculus
cggcgaacctcagtacgtgcagtat

SEQ ID NO: 425188 - DNA, 25 bp, Mus musculus
cggcgaatttgaggactcggtgttc

SEQ ID NO: 425189 - DNA, 25 bp, Mus musculus
cggcgagtgccaataaatgttcctt

SEQ ID NO: 425190 - DNA, 25 bp, Mus musculus
cggcgatggccctggattgcttgct

SEQ ID NO: 425191 - DNA, 25 bp, Mus musculus
cggcgatggcttccaaaacagaatc

SEQ ID NO: 425192 - DNA, 25 bp, Mus musculus
cggcgattttctggagcgagctctc

SEQ ID NO: 425193 - DNA, 25 bp, Mus musculus
cggcgccgagagtattgcaagttca

SEQ ID NO: 425194 - DNA, 25 bp, Mus musculus
cggcgctgcggcacctttaagacga

SEQ ID NO: 425195 - DNA, 25 bp, Mus musculus
cggcggctgaagtttctcttttgca

SEQ ID NO: 425196 - DNA, 25 bp, Mus musculus
cggcggtcggtgtgctccgaatata

SEQ ID NO: 425197 - DNA, 25 bp, Mus musculus
cggcggtgagacatgggcttcctta

SEQ ID NO: 425198 - DNA, 25 bp, Mus musculus
cggcggtgtcgccaaaagggcgtcg

SEQ ID NO: 425199 - DNA, 25 bp, Mus musculus
cggcgtccgccattagccttcaaga

SEQ ID NO: 425200 - DNA, 25 bp, Mus musculus
cggcgttccgccaataccagatgaa

SEQ ID NO: 425201 - DNA, 25 bp, Mus musculus
cggcgttcgtctccaagtcttttga

SEQ ID NO: 425202 - DNA, 25 bp, Mus musculus
cggctaccgacaccttccttcatta

SEQ ID NO: 425203 - DNA, 25 bp, Mus musculus
cggctactcaggtggaaagattatc

SEQ ID NO: 425204 - DNA, 25 bp, Mus musculus
cggctataaaaagaacatgggtgaa

SEQ ID NO: 425205 - DNA, 25 bp, Mus musculus
cggctatcatgtctctcctggtgtc

SEQ ID NO: 425206 - DNA, 25 bp, Mus musculus
cggctcagcagattgggagaggcgg

SEQ ID NO: 425207 - DNA, 25 bp, Mus musculus
cggctcctcccgtgcggtggagaaa

SEQ ID NO: 425208 - DNA, 25 bp, Mus musculus
cggctctggaggcagttcggagggc

SEQ ID NO: 425209 - DNA, 25 bp, Mus musculus
cggctgcggcctggcgggcgttctg

SEQ ID NO: 425210 - DNA, 25 bp, Mus musculus
cggctgcgtgccttcaggtccaggc

SEQ ID NO: 425211 - DNA, 25 bp, Mus musculus
cggctgctgtaaggtctgcgctaaa

SEQ ID NO: 425212 - DNA, 25 bp, Mus musculus
cggctggaagcccactataattgta

SEQ ID NO: 425213 - DNA, 25 bp, Mus musculus
cggctggacattttgctggtgccat

SEQ ID NO: 425214 - DNA, 25 bp, Mus musculus
cggctggtgacgtgtattataattg

SEQ ID NO: 425215 - DNA, 25 bp, Mus musculus
cggcttcaaacaggaccaagctggt

SEQ ID NO: 425216 - DNA, 25 bp, Mus musculus
cggcttcctgcatggccttcggaga

SEQ ID NO: 425217 - DNA, 25 bp, Mus musculus
cggcttctcaaatgttggcctatag

SEQ ID NO: 425218 - DNA, 25 bp, Mus musculus
cggcttctgggaacgacaagggcaa

SEQ ID NO: 425219 - DNA, 25 bp, Mus musculus
cggcttggttctgcctggatgcaca

SEQ ID NO: 425220 - DNA, 25 bp, Mus musculus
cgggaaagcacaaggcacacggctt

SEQ ID NO: 425221 - DNA, 25 bp, Mus musculus
cgggaacaccatggctgcagctaat

SEQ ID NO: 425222 - DNA, 25 bp, Mus musculus
cgggaacgcaaagctggctgcaaga

SEQ ID NO: 425223 - DNA, 25 bp, Mus musculus
cgggaactatactgcctggtctgaa

SEQ ID NO: 425224 - DNA, 25 bp, Mus musculus
cgggaagacgcttttgctggagcaa

SEQ ID NO: 425225 - DNA, 25 bp, Mus musculus
cgggaagcctcgttctgagaatgac

SEQ ID NO: 425226 - DNA, 25 bp, Mus musculus
cgggaagtattagtccatctgagca

SEQ ID NO: 425227 - DNA, 25 bp, Mus musculus
cgggaatttaggcaccttctattca

SEQ ID NO: 425228 - DNA, 25 bp, Mus musculus
cgggacaagttgctatctgagacct

SEQ ID NO: 425229 - DNA, 25 bp, Mus musculus
cgggaccttaagtgtgagaacgcct

SEQ ID NO: 425230 - DNA, 25 bp, Mus musculus
cgggacctttctggccactgcagag

SEQ ID NO: 425231 - DNA, 25 bp, Mus musculus
cgggactcactggactggacttcta

SEQ ID NO: 425232 - DNA, 25 bp, Mus musculus
cgggagacatacaactcactcgctg

SEQ ID NO: 425233 - DNA, 25 bp, Mus musculus
cgggagagaagttaccatagctgct

SEQ ID NO: 425234 - DNA, 25 bp, Mus musculus
cgggagcactgaattttggagctga

SEQ ID NO: 425235 - DNA, 25 bp, Mus musculus
cgggagccactcctgtaaggacact

SEQ ID NO: 425236 - DNA, 25 bp, Mus musculus
cgggagccgctagtacactggtgca

SEQ ID NO: 425237 - DNA, 25 bp, Mus musculus
cgggagccggtgacagctcctctga

SEQ ID NO: 425238 - DNA, 25 bp, Mus musculus
cgggagcctggcctgtaacttataa

SEQ ID NO: 425239 - DNA, 25 bp, Mus musculus
cgggaggacatcacttggagacgac

SEQ ID NO: 425240 - DNA, 25 bp, Mus musculus
cgggaggctccaccatagactgaat

SEQ ID NO: 425241 - DNA, 25 bp, Mus musculus
cgggaggtctccagtccttcagcct

SEQ ID NO: 425242 - DNA, 25 bp, Mus musculus
cgggagttctccctacctggatagg

SEQ ID NO: 425243 - DNA, 25 bp, Mus musculus
cgggatatctctgtctaaaggaata

SEQ ID NO: 425244 - DNA, 25 bp, Mus musculus
cgggatccacgttattgcttagaaa

SEQ ID NO: 425245 - DNA, 25 bp, Mus musculus
cgggatcctcggctcttaaagtcac

SEQ ID NO: 425246 - DNA, 25 bp, Mus musculus
cgggatcggaaactgtactgcaaac

SEQ ID NO: 425247 - DNA, 25 bp, Mus musculus
cgggattacagaaagacacggcact

SEQ ID NO: 425248 - DNA, 25 bp, Mus musculus
cgggattcccctagtcgtgttcact

SEQ ID NO: 425249 - DNA, 25 bp, Mus musculus
cgggcaaagcgctctcgtagctgtc

SEQ ID NO: 425250 - DNA, 25 bp, Mus musculus
cgggcaacgatctgatggagctcaa

SEQ ID NO: 425251 - DNA, 25 bp, Mus musculus
cgggcacccatagatggtctgtcaa

SEQ ID NO: 425252 - DNA, 25 bp, Mus musculus
cgggcaccgggaacatgacaatgaa

SEQ ID NO: 425253 - DNA, 25 bp, Mus musculus
cgggcacctttcctacgactctagt

SEQ ID NO: 425254 - DNA, 25 bp, Mus musculus
cgggcactggtaaggagcgatcaac

SEQ ID NO: 425255 - DNA, 25 bp, Mus musculus
cgggcagccgggatttaaattcact

SEQ ID NO: 425256 - DNA, 25 bp, Mus musculus
cgggcattgtccaaaacagtccgga

SEQ ID NO: 425257 - DNA, 25 bp, Mus musculus
cgggccaagctgaacgtgaacgaaa

SEQ ID NO: 425258 - DNA, 25 bp, Mus musculus
cgggccaccgttcctgatgctgtgc

SEQ ID NO: 425259 - DNA, 25 bp, Mus musculus
cgggccagcagcatcctaagagtgg

SEQ ID NO: 425260 - DNA, 25 bp, Mus musculus
cgggcccacggcttcaagatcatga

SEQ ID NO: 425261 - DNA, 25 bp, Mus musculus
cgggccccaccttgcagtatgacaa

SEQ ID NO: 425262 - DNA, 25 bp, Mus musculus
cgggccctgcgcatcgttagattca

SEQ ID NO: 425263 - DNA, 25 bp, Mus musculus
cgggccctggctgaatatatgacgg

SEQ ID NO: 425264 - DNA, 25 bp, Mus musculus
cgggccgccttgagctacagaatga

SEQ ID NO: 425265 - DNA, 25 bp, Mus musculus
cgggccgtaggcctgactcctcaga

SEQ ID NO: 425266 - DNA, 25 bp, Mus musculus
cgggcctccacttgcaggatgctgc

SEQ ID NO: 425267 - DNA, 25 bp, Mus musculus
cgggcctgcatcaattgagcgagtt

SEQ ID NO: 425268 - DNA, 25 bp, Mus musculus
cgggcctgctagctgtcaacgatga

SEQ ID NO: 425269 - DNA, 25 bp, Mus musculus
cgggcgactgttgatcagccacgag

SEQ ID NO: 425270 - DNA, 25 bp, Mus musculus
cgggcgatgtgtagcgactttcgca

SEQ ID NO: 425271 - DNA, 25 bp, Mus musculus
cgggcgggcaggtctgtttcaccat

SEQ ID NO: 425272 - DNA, 25 bp, Mus musculus
cgggcggtctcctgcggtgaattac

SEQ ID NO: 425273 - DNA, 25 bp, Mus musculus
cgggctcaaactcggatcactgtag

SEQ ID NO: 425274 - DNA, 25 bp, Mus musculus
cgggctccacacacgcctggagggt

SEQ ID NO: 425275 - DNA, 25 bp, Mus musculus
cgggctcttatggaatgctcggaac

SEQ ID NO: 425276 - DNA, 25 bp, Mus musculus
cgggctgaacacactgcgcataaat

SEQ ID NO: 425277 - DNA, 25 bp, Mus musculus
cgggctgcgaagatgctgtgggttt

SEQ ID NO: 425278 - DNA, 25 bp, Mus musculus
cgggctgtggacaggtacgtttaca

SEQ ID NO: 425279 - DNA, 25 bp, Mus musculus
cgggcttagcgcaaactcagaggca

SEQ ID NO: 425280 - DNA, 25 bp, Mus musculus
cgggcttatggaattcctgaaattc

SEQ ID NO: 425281 - DNA, 25 bp, Mus musculus
cgggcttccaggtctgcggctctga

SEQ ID NO: 425282 - DNA, 25 bp, Mus musculus
cgggcttcccaaatgagtacgatga

SEQ ID NO: 425283 - DNA, 25 bp, Mus musculus
cgggcttgtagcaggaggcggtgca

SEQ ID NO: 425284 - DNA, 25 bp, Mus musculus
cgggtaaaacgtcatcgctggagat

SEQ ID NO: 425285 - DNA, 25 bp, Mus musculus
cgggtaattagcttcctgccagaac

SEQ ID NO: 425286 - DNA, 25 bp, Mus musculus
cgggtagtagctgaagtccagtagt

SEQ ID NO: 425287 - DNA, 25 bp, Mus musculus
cgggtatcactaactcggccatgga

SEQ ID NO: 425288 - DNA, 25 bp, Mus musculus
cgggtcacagaatggttaaagcagc

SEQ ID NO: 425289 - DNA, 25 bp, Mus musculus
cgggtcagccatggttgtgtcagca

SEQ ID NO: 425290 - DNA, 25 bp, Mus musculus
cgggtcatcatgatttgattcctag

SEQ ID NO: 425291 - DNA, 25 bp, Mus musculus
cgggtccacttcgtgcttggctgca

SEQ ID NO: 425292 - DNA, 25 bp, Mus musculus
cgggtcctggatgaagaagagtaca

SEQ ID NO: 425293 - DNA, 25 bp, Mus musculus
cgggtgctgacggtactgtttgaac

SEQ ID NO: 425294 - DNA, 25 bp, Mus musculus
cgggtggagactacgtcatcttcga

SEQ ID NO: 425295 - DNA, 25 bp, Mus musculus
cgggttagattttcggtgcctgcgt

SEQ ID NO: 425296 - DNA, 25 bp, Mus musculus
cgggttcgccggactatggaataca

SEQ ID NO: 425297 - DNA, 25 bp, Mus musculus
cgggttcgctcgctagctatctgga

SEQ ID NO: 425298 - DNA, 25 bp, Mus musculus
cggtaaactcactgtcgctcgccgg

SEQ ID NO: 425299 - DNA, 25 bp, Mus musculus
cggtaaccgctgagagctggcgtac

SEQ ID NO: 425300 - DNA, 25 bp, Mus musculus
cggtaaggttctcatatctgttgac

SEQ ID NO: 425301 - DNA, 25 bp, Mus musculus
cggtaagtgcgctgatccaggtcac

SEQ ID NO: 425302 - DNA, 25 bp, Mus musculus
cggtaatctcctccgagttgtagct

SEQ ID NO: 425303 - DNA, 25 bp, Mus musculus
cggtacagtctagatctgtgtggca

SEQ ID NO: 425304 - DNA, 25 bp, Mus musculus
cggtagagctcctgccacatgtgaa

SEQ ID NO: 425305 - DNA, 25 bp, Mus musculus
cggtaggttgctagactgtctgaga

SEQ ID NO: 425306 - DNA, 25 bp, Mus musculus
cggtattccatggagagctggcttc

SEQ ID NO: 425307 - DNA, 25 bp, Mus musculus
cggtattttacgtgatcactggagg

SEQ ID NO: 425308 - DNA, 25 bp, Mus musculus
cggtcactatactctgacacagagg

SEQ ID NO: 425309 - DNA, 25 bp, Mus musculus
cggtcagagttgtgagggactccaa

SEQ ID NO: 425310 - DNA, 25 bp, Mus musculus
cggtccagggcggcctagtctgcat

SEQ ID NO: 425311 - DNA, 25 bp, Mus musculus
cggtcctatgagaaagatgtgggca

SEQ ID NO: 425312 - DNA, 25 bp, Mus musculus
cggtcgttcagagcctgcagctgct

SEQ ID NO: 425313 - DNA, 25 bp, Mus musculus
cggtctactccaacccagagggctt

SEQ ID NO: 425314 - DNA, 25 bp, Mus musculus
cggtctctgagagccaactggtgga

SEQ ID NO: 425315 - DNA, 25 bp, Mus musculus
cggtctctgatagagcggaggcttc

SEQ ID NO: 425316 - DNA, 25 bp, Mus musculus
cggtctgatgcagccagaggaagac

SEQ ID NO: 425317 - DNA, 25 bp, Mus musculus
cggtctgggatgttagtgcagctac

SEQ ID NO: 425318 - DNA, 25 bp, Mus musculus
cggtctggtcgagttgggcctctct

SEQ ID NO: 425319 - DNA, 25 bp, Mus musculus
cggtcttgactgttttgtggtcttc

SEQ ID NO: 425320 - DNA, 25 bp, Mus musculus
cggtcttgagactggcctctgtagt

SEQ ID NO: 425321 - DNA, 25 bp, Mus musculus
cggtgaaactagacgaactggcaaa

SEQ ID NO: 425322 - DNA, 25 bp, Mus musculus
cggtgaaatggcaggagtacgcatc

SEQ ID NO: 425323 - DNA, 25 bp, Mus musculus
cggtgaagaacaacatcgagtggct

SEQ ID NO: 425324 - DNA, 25 bp, Mus musculus
cggtgacttcgcattcccagatgaa

SEQ ID NO: 425325 - DNA, 25 bp, Mus musculus
cggtgagacttcctggatcacactg

SEQ ID NO: 425326 - DNA, 25 bp, Mus musculus
cggtgatcgagccttcaaccctggg

SEQ ID NO: 425327 - DNA, 25 bp, Mus musculus
cggtgatgatcaagtccctgactcg

SEQ ID NO: 425328 - DNA, 25 bp, Mus musculus
cggtgcaataggacaaagcaggttg

SEQ ID NO: 425329 - DNA, 25 bp, Mus musculus
cggtgccagagtttactgacccata

SEQ ID NO: 425330 - DNA, 25 bp, Mus musculus
cggtgcctcgatgggcatcttgctc

SEQ ID NO: 425331 - DNA, 25 bp, Mus musculus
cggtgccttgcggacttctcggtta

SEQ ID NO: 425332 - DNA, 25 bp, Mus musculus
cggtgcgctcctgtatgcagtgaca

SEQ ID NO: 425333 - DNA, 25 bp, Mus musculus
cggtgcggagagatcatgtttgact

SEQ ID NO: 425334 - DNA, 25 bp, Mus musculus
cggtgcggagtatcccagggcttcc

SEQ ID NO: 425335 - DNA, 25 bp, Mus musculus
cggtgctaacaaaggaatcggattc

SEQ ID NO: 425336 - DNA, 25 bp, Mus musculus
cggtgcttgggtggcacattttcaa

SEQ ID NO: 425337 - DNA, 25 bp, Mus musculus
cggtggcattgaactgaagcttggc

SEQ ID NO: 425338 - DNA, 25 bp, Mus musculus
cggtggcccacacggctaggatata

SEQ ID NO: 425339 - DNA, 25 bp, Mus musculus
cggtggcccagtaccaatgcgtcat

SEQ ID NO: 425340 - DNA, 25 bp, Mus musculus
cggtggtattgtcatctgcgaagca

SEQ ID NO: 425341 - DNA, 25 bp, Mus musculus
cggtggtcatctggagatgaagccc

SEQ ID NO: 425342 - DNA, 25 bp, Mus musculus
cggtggtccaggagcgcttgaggcg

SEQ ID NO: 425343 - DNA, 25 bp, Mus musculus
cggtgtacgagttagagaacttcca

SEQ ID NO: 425344 - DNA, 25 bp, Mus musculus
cggtgtcaccgagagtatcctagca

SEQ ID NO: 425345 - DNA, 25 bp, Mus musculus
cggtgtctctggagacccgtcctct

SEQ ID NO: 425346 - DNA, 25 bp, Mus musculus
cggtgtgggatacctgcacattgca

SEQ ID NO: 425347 - DNA, 25 bp, Mus musculus
cggtgttcagtttcatgcaggctct

SEQ ID NO: 425348 - DNA, 25 bp, Mus musculus
cggttaagtttgtgcgctcgcagcc

SEQ ID NO: 425349 - DNA, 25 bp, Mus musculus
cggttatatgattgctctgggatcc

SEQ ID NO: 425350 - DNA, 25 bp, Mus musculus
cggttattcacagagaggaggccct

SEQ ID NO: 425351 - DNA, 25 bp, Mus musculus
cggttcagcgaggaagaatgcctcc

SEQ ID NO: 425352 - DNA, 25 bp, Mus musculus
cggttccaaacctactgagcagaga

SEQ ID NO: 425353 - DNA, 25 bp, Mus musculus
cggttcgtgcccttgctagccacta

SEQ ID NO: 425354 - DNA, 25 bp, Mus musculus
cggttgtgaactttgtccagagagc

SEQ ID NO: 425355 - DNA, 25 bp, Mus musculus
cggtttatgtgtcttcgggagctca

SEQ ID NO: 425356 - DNA, 25 bp, Mus musculus
cggtttgcgtccttctcggtctgaa

SEQ ID NO: 425357 - DNA, 25 bp, Mus musculus
cgtaaaaccgacactgaaagctgcc

SEQ ID NO: 425358 - DNA, 25 bp, Mus musculus
cgtaaaatctatatgcacctgagcc

SEQ ID NO: 425359 - DNA, 25 bp, Mus musculus
cgtaaacagggtgagtatggagtat

SEQ ID NO: 425360 - DNA, 25 bp, Mus musculus
cgtaaaggagctcccgaaatggcgc

SEQ ID NO: 425361 - DNA, 25 bp, Mus musculus
cgtaaaggcgcacttaatccatgag

SEQ ID NO: 425362 - DNA, 25 bp, Mus musculus
cgtaaagtgaggacaggattctgcc

SEQ ID NO: 425363 - DNA, 25 bp, Mus musculus
cgtaaatgtgattcagggcgcccag

SEQ ID NO: 425364 - DNA, 25 bp, Mus musculus
cgtaacaaagatctgcctcgagtca

SEQ ID NO: 425365 - DNA, 25 bp, Mus musculus
cgtaacaagcatgggcagctggcct

SEQ ID NO: 425366 - DNA, 25 bp, Mus musculus
cgtaaggcgttattcacgagtgcac

SEQ ID NO: 425367 - DNA, 25 bp, Mus musculus
cgtaagggtaagaagtgctcttcac

SEQ ID NO: 425368 - DNA, 25 bp, Mus musculus
cgtaaggtcaccctgtgggaaacag

SEQ ID NO: 425369 - DNA, 25 bp, Mus musculus
cgtaagtgccaaaacctctcttgga

SEQ ID NO: 425370 - DNA, 25 bp, Mus musculus
cgtaagtgcttctgtttttcccgag

SEQ ID NO: 425371 - DNA, 25 bp, Mus musculus
cgtaatctacgaccttgggcaagct

SEQ ID NO: 425372 - DNA, 25 bp, Mus musculus
cgtaatgtcacagagggagaggccc

SEQ ID NO: 425373 - DNA, 25 bp, Mus musculus
cgtaattccccgttagcagctctaa

SEQ ID NO: 425374 - DNA, 25 bp, Mus musculus
cgtacaaatcaacaccaagcgaagg

SEQ ID NO: 425375 - DNA, 25 bp, Mus musculus
cgtacaagattgagctgagccttca

SEQ ID NO: 425376 - DNA, 25 bp, Mus musculus
cgtacaagggacttctactgtttat

SEQ ID NO: 425377 - DNA, 25 bp, Mus musculus
cgtacaatttattagggagcttcaa

SEQ ID NO: 425378 - DNA, 25 bp, Mus musculus
cgtacactttcttgagaacatggga

SEQ ID NO: 425379 - DNA, 25 bp, Mus musculus
cgtacaggctggttccgtttagtgg

SEQ ID NO: 425380 - DNA, 25 bp, Mus musculus
cgtacaggtcgcacggctccgggac

SEQ ID NO: 425381 - DNA, 25 bp, Mus musculus
cgtacaggtcgtgtctccaagcact

SEQ ID NO: 425382 - DNA, 25 bp, Mus musculus
cgtacagtaacaacaaggagctctt

SEQ ID NO: 425383 - DNA, 25 bp, Mus musculus
cgtacagtggaaggacaggaccagc

SEQ ID NO: 425384 - DNA, 25 bp, Mus musculus
cgtacatcaaggaccacctactttt

SEQ ID NO: 425385 - DNA, 25 bp, Mus musculus
cgtacatgagtctttgtcttttaag

SEQ ID NO: 425386 - DNA, 25 bp, Mus musculus
cgtacatgggagtgcaaaggccgat

SEQ ID NO: 425387 - DNA, 25 bp, Mus musculus
cgtaccaagctgtgcgatgtccatg

SEQ ID NO: 425388 - DNA, 25 bp, Mus musculus
cgtaccccggtatgttcatggccct

SEQ ID NO: 425389 - DNA, 25 bp, Mus musculus
cgtaccgcgaagtgcagaagctgat

SEQ ID NO: 425390 - DNA, 25 bp, Mus musculus
cgtaccgggacagcaagatgactcg

SEQ ID NO: 425391 - DNA, 25 bp, Mus musculus
cgtaccgtggtcttgcttctgagaa

SEQ ID NO: 425392 - DNA, 25 bp, Mus musculus
cgtaccgtgtctttccaagcgaagg

SEQ ID NO: 425393 - DNA, 25 bp, Mus musculus
cgtacctgagtactctgggaagcag

SEQ ID NO: 425394 - DNA, 25 bp, Mus musculus
cgtactctggccgaaagcacagcaa

SEQ ID NO: 425395 - DNA, 25 bp, Mus musculus
cgtactgatgtatgccactggaccc

SEQ ID NO: 425396 - DNA, 25 bp, Mus musculus
cgtactggcggtgcacagaaccttc

SEQ ID NO: 425397 - DNA, 25 bp, Mus musculus
cgtactgtcactagttactgtttga

SEQ ID NO: 425398 - DNA, 25 bp, Mus musculus
cgtacttagagttggagggcctgcc

SEQ ID NO: 425399 - DNA, 25 bp, Mus musculus
cgtacttcatcaatagaagaggtca

SEQ ID NO: 425400 - DNA, 25 bp, Mus musculus
cgtacttctctgcatccgtgaaggg

SEQ ID NO: 425401 - DNA, 25 bp, Mus musculus
cgtagaaggccagaaggactcctgc

SEQ ID NO: 425402 - DNA, 25 bp, Mus musculus
cgtagacctgtttgacctggagagc

SEQ ID NO: 425403 - DNA, 25 bp, Mus musculus
cgtagaggactatgggatgacacac

SEQ ID NO: 425404 - DNA, 25 bp, Mus musculus
cgtagatgcgtaccccactttcctt

SEQ ID NO: 425405 - DNA, 25 bp, Mus musculus
cgtagcccggcgttctgtggcagta

SEQ ID NO: 425406 - DNA, 25 bp, Mus musculus
cgtagccctatctcggtacagcgga

SEQ ID NO: 425407 - DNA, 25 bp, Mus musculus
cgtagcgagaatttagcaaaggatg

SEQ ID NO: 425408 - DNA, 25 bp, Mus musculus
cgtagcggagagaattgaggcaaaa

SEQ ID NO: 425409 - DNA, 25 bp, Mus musculus
cgtaggaggctcatgcgggatttca

SEQ ID NO: 425410 - DNA, 25 bp, Mus musculus
cgtaggatctacagacagggtcagg

SEQ ID NO: 425411 - DNA, 25 bp, Mus musculus
cgtaggccactcctcctggagagaa

SEQ ID NO: 425412 - DNA, 25 bp, Mus musculus
cgtaggctccgctgtagctcgcaat

SEQ ID NO: 425413 - DNA, 25 bp, Mus musculus
cgtagggactccgttttggatggct

SEQ ID NO: 425414 - DNA, 25 bp, Mus musculus
cgtaggtacgtcaacccagggtctg

SEQ ID NO: 425415 - DNA, 25 bp, Mus musculus
cgtagtacaggccttagaattcatg

SEQ ID NO: 425416 - DNA, 25 bp, Mus musculus
cgtagtcacatagcttcctttcaag

SEQ ID NO: 425417 - DNA, 25 bp, Mus musculus
cgtagtctagagtcatggctttctc

SEQ ID NO: 425418 - DNA, 25 bp, Mus musculus
cgtagttgagttaccccaggaggat

SEQ ID NO: 425419 - DNA, 25 bp, Mus musculus
cgtataaggctgcttctcttgaaag

SEQ ID NO: 425420 - DNA, 25 bp, Mus musculus
cgtataggcagttcccagatcgcag

SEQ ID NO: 425421 - DNA, 25 bp, Mus musculus
cgtatgaccggcaatctagagttgc

SEQ ID NO: 425422 - DNA, 25 bp, Mus musculus
cgtatgactacgatgatggtgagcc

SEQ ID NO: 425423 - DNA, 25 bp, Mus musculus
cgtatgataaggaggtgcacagcca

SEQ ID NO: 425424 - DNA, 25 bp, Mus musculus
cgtatgcggaacctcaagtttgcca

SEQ ID NO: 425425 - DNA, 25 bp, Mus musculus
cgtatgtctcaaggaggtgcacccc

SEQ ID NO: 425426 - DNA, 25 bp, Mus musculus
cgtattacaaaagcatggtttccat

SEQ ID NO: 425427 - DNA, 25 bp, Mus musculus
cgtattatgtctgcactccgaagga

SEQ ID NO: 425428 - DNA, 25 bp, Mus musculus
cgtattctgcgcaacaagatcggca

SEQ ID NO: 425429 - DNA, 25 bp, Mus musculus
cgtattgcgtgagacgaaccggacg

SEQ ID NO: 425430 - DNA, 25 bp, Mus musculus
cgtattgtgaccgttggcagcccag

SEQ ID NO: 425431 - DNA, 25 bp, Mus musculus
cgtatttaagcagagttagggagga

SEQ ID NO: 425432 - DNA, 25 bp, Mus musculus
cgtcaaaaacttttgagcatgtgac

SEQ ID NO: 425433 - DNA, 25 bp, Mus musculus
cgtcaaactgttcggcatggtcaaa

SEQ ID NO: 425434 - DNA, 25 bp, Mus musculus
cgtcaaatcagagtgtaagtttttc

SEQ ID NO: 425435 - DNA, 25 bp, Mus musculus
cgtcaacacgttacagaaagccgct

SEQ ID NO: 425436 - DNA, 25 bp, Mus musculus
cgtcaacatgatcgccgcgcaacta

SEQ ID NO: 425437 - DNA, 25 bp, Mus musculus
cgtcaacttaagctcagtctcctgc

SEQ ID NO: 425438 - DNA, 25 bp, Mus musculus
cgtcaccaccttctgcacagttgtg

SEQ ID NO: 425439 - DNA, 25 bp, Mus musculus
cgtcacctactaccggctggaggag

SEQ ID NO: 425440 - DNA, 25 bp, Mus musculus
cgtcacctcaagattcccaagggct

SEQ ID NO: 425441 - DNA, 25 bp, Mus musculus
cgtcaccttctttcatagcccttgg

SEQ ID NO: 425442 - DNA, 25 bp, Mus musculus
cgtcacgaatccttcggctcatggg

SEQ ID NO: 425443 - DNA, 25 bp, Mus musculus
cgtcactgctggagtggccagttca

SEQ ID NO: 425444 - DNA, 25 bp, Mus musculus
cgtcactggccatagccttaaggaa

SEQ ID NO: 425445 - DNA, 25 bp, Mus musculus
cgtcagaaagcaacgggagatcctc

SEQ ID NO: 425446 - DNA, 25 bp, Mus musculus
cgtcagaggagagcagatcaggacc

SEQ ID NO: 425447 - DNA, 25 bp, Mus musculus
cgtcagcagtgaggacagagctcca

SEQ ID NO: 425448 - DNA, 25 bp, Mus musculus
cgtcagccagcaggctatttaagca

SEQ ID NO: 425449 - DNA, 25 bp, Mus musculus
cgtcagcgggcttccaaaaaccatg

SEQ ID NO: 425450 - DNA, 25 bp, Mus musculus
cgtcatccaggaacttgagtggcat

SEQ ID NO: 425451 - DNA, 25 bp, Mus musculus
cgtcatctgcatcatcgccagcgtg

SEQ ID NO: 425452 - DNA, 25 bp, Mus musculus
cgtcattaacaaggagcgcaaaggg

SEQ ID NO: 425453 - DNA, 25 bp, Mus musculus
cgtcattggtcagatagtggtccga

SEQ ID NO: 425454 - DNA, 25 bp, Mus musculus
cgtcattttctgtcatactcactca

SEQ ID NO: 425455 - DNA, 25 bp, Mus musculus
cgtccacagttggagaccgccttgt

SEQ ID NO: 425456 - DNA, 25 bp, Mus musculus
cgtccagcgcgctgataaccaagcg

SEQ ID NO: 425457 - DNA, 25 bp, Mus musculus
cgtccagcgtgcttacacttactaa

SEQ ID NO: 425458 - DNA, 25 bp, Mus musculus
cgtccagggcgtcagtgttagtaat

SEQ ID NO: 425459 - DNA, 25 bp, Mus musculus
cgtccatcactcattattcacaaca

SEQ ID NO: 425460 - DNA, 25 bp, Mus musculus
cgtccattggactgagaacaggttc

SEQ ID NO: 425461 - DNA, 25 bp, Mus musculus
cgtcccaagggatgctgatactgtc

SEQ ID NO: 425462 - DNA, 25 bp, Mus musculus
cgtcccgatggactacaggaagagt

SEQ ID NO: 425463 - DNA, 25 bp, Mus musculus
cgtccggtatctacgtagaggagac

SEQ ID NO: 425464 - DNA, 25 bp, Mus musculus
cgtccgtgcagcacctagggctgag

SEQ ID NO: 425465 - DNA, 25 bp, Mus musculus
cgtccgtgtgaaatacccagggcat

SEQ ID NO: 425466 - DNA, 25 bp, Mus musculus
cgtccgttaggtagtcaagttgaga

SEQ ID NO: 425467 - DNA, 25 bp, Mus musculus
cgtcctacagctaaagaacttttga

SEQ ID NO: 425468 - DNA, 25 bp, Mus musculus
cgtcctcaactacatggcgggcaag

SEQ ID NO: 425469 - DNA, 25 bp, Mus musculus
cgtcctcactgacgaggcctttgag

SEQ ID NO: 425470 - DNA, 25 bp, Mus musculus
cgtcctcgtgggagacactggagaa

SEQ ID NO: 425471 - DNA, 25 bp, Mus musculus
cgtcctctacgatctccacatagga

SEQ ID NO: 425472 - DNA, 25 bp, Mus musculus
cgtcctggcacgaggagtgtttgca

SEQ ID NO: 425473 - DNA, 25 bp, Mus musculus
cgtcctggccactggaaaggtcgag

SEQ ID NO: 425474 - DNA, 25 bp, Mus musculus
cgtcctgtactccagctagcaaagg

SEQ ID NO: 425475 - DNA, 25 bp, Mus musculus
cgtccttatccgtgggaactgggca

SEQ ID NO: 425476 - DNA, 25 bp, Mus musculus
cgtcgagagtcagaactcaggttca

SEQ ID NO: 425477 - DNA, 25 bp, Mus musculus
cgtcgcattgtgctgtccaacatga

SEQ ID NO: 425478 - DNA, 25 bp, Mus musculus
cgtcgccgccagtgctttcctggtt

SEQ ID NO: 425479 - DNA, 25 bp, Mus musculus
cgtcggaaacctttactagagtgca

SEQ ID NO: 425480 - DNA, 25 bp, Mus musculus
cgtcggtacacgtggagcagataac

SEQ ID NO: 425481 - DNA, 25 bp, Mus musculus
cgtcgtggccggaggagaaaataca

SEQ ID NO: 425482 - DNA, 25 bp, Mus musculus
cgtcgttgcgcgtcctcagtattta

SEQ ID NO: 425483 - DNA, 25 bp, Mus musculus
cgtctaattgtgtcggccctgagga

SEQ ID NO: 425484 - DNA, 25 bp, Mus musculus
cgtctagagaggtcttggtttctca

SEQ ID NO: 425485 - DNA, 25 bp, Mus musculus
cgtctagatttagaattaagcgaca

SEQ ID NO: 425486 - DNA, 25 bp, Mus musculus
cgtctcagagttaggaacagcctgg

SEQ ID NO: 425487 - DNA, 25 bp, Mus musculus
cgtctccggaattgctgcgctgcag

SEQ ID NO: 425488 - DNA, 25 bp, Mus musculus
cgtctcgtgatggacgccgaggcct

SEQ ID NO: 425489 - DNA, 25 bp, Mus musculus
cgtctctttcctaagaactgatgga

SEQ ID NO: 425490 - DNA, 25 bp, Mus musculus
cgtctgaatgaagatgactgcctca

SEQ ID NO: 425491 - DNA, 25 bp, Mus musculus
cgtctgagcgggtctccggagttca

SEQ ID NO: 425492 - DNA, 25 bp, Mus musculus
cgtctgctacgagaaagctgttccc

SEQ ID NO: 425493 - DNA, 25 bp, Mus musculus
cgtctggccaagatgttacagctca

SEQ ID NO: 425494 - DNA, 25 bp, Mus musculus
cgtctgtaggagagccaagccgctg

SEQ ID NO: 425495 - DNA, 25 bp, Mus musculus
cgtctgtgcaccttcttcgggctaa

SEQ ID NO: 425496 - DNA, 25 bp, Mus musculus
cgtcttcagcaaggtgtacaaagcc

SEQ ID NO: 425497 - DNA, 25 bp, Mus musculus
cgtcttcgagaaatacgggcgcgtc

SEQ ID NO: 425498 - DNA, 25 bp, Mus musculus
cgtgaacagataaggcagcttcgca

SEQ ID NO: 425499 - DNA, 25 bp, Mus musculus
cgtgaacggaacagatgaggcagct

SEQ ID NO: 425500 - DNA, 25 bp, Mus musculus
cgtgaacggttgaagaacatgactc

SEQ ID NO: 425501 - DNA, 25 bp, Mus musculus
cgtgaagatatacgcatgcccggat

SEQ ID NO: 425502 - DNA, 25 bp, Mus musculus
cgtgaagccaaaggacctaggactt

SEQ ID NO: 425503 - DNA, 25 bp, Mus musculus
cgtgaagccagcagatgcttgccta

SEQ ID NO: 425504 - DNA, 25 bp, Mus musculus
cgtgaaggctccttagggcctatga

SEQ ID NO: 425505 - DNA, 25 bp, Mus musculus
cgtgaagtcctggtccgtcgagagt

SEQ ID NO: 425506 - DNA, 25 bp, Mus musculus
cgtgacaaacagacatctcaatagg

SEQ ID NO: 425507 - DNA, 25 bp, Mus musculus
cgtgacaatgccgtctgaactggag

SEQ ID NO: 425508 - DNA, 25 bp, Mus musculus
cgtgacagaaatcgacaagggctct

SEQ ID NO: 425509 - DNA, 25 bp, Mus musculus
cgtgacatcaccgaggctttggcca

SEQ ID NO: 425510 - DNA, 25 bp, Mus musculus
cgtgaccaagctatccccagaaaag

SEQ ID NO: 425511 - DNA, 25 bp, Mus musculus
cgtgaccggacagaactggactttc

SEQ ID NO: 425512 - DNA, 25 bp, Mus musculus
cgtgaccggcaccttcattgagaaa

SEQ ID NO: 425513 - DNA, 25 bp, Mus musculus
cgtgacggagtcttcacacggacta

SEQ ID NO: 425514 - DNA, 25 bp, Mus musculus
cgtgacgttgcccacactgttggtc

SEQ ID NO: 425515 - DNA, 25 bp, Mus musculus
cgtgactcgttcgtgggctgttaga

SEQ ID NO: 425516 - DNA, 25 bp, Mus musculus
cgtgagaaccccagaccgttggtgt

SEQ ID NO: 425517 - DNA, 25 bp, Mus musculus
cgtgagacccaagaaagagagagac

SEQ ID NO: 425518 - DNA, 25 bp, Mus musculus
cgtgagcccagacagaaaggagcct

SEQ ID NO: 425519 - DNA, 25 bp, Mus musculus
cgtgagcctctaaaagcaaatgtgc

SEQ ID NO: 425520 - DNA, 25 bp, Mus musculus
cgtgagcgtctctagtttcctgggc

SEQ ID NO: 425521 - DNA, 25 bp, Mus musculus
cgtgagcttcaaacatggagggaac

SEQ ID NO: 425522 - DNA, 25 bp, Mus musculus
cgtgaggagccggttggtgtggtca

SEQ ID NO: 425523 - DNA, 25 bp, Mus musculus
cgtgaggcacgcatgacagagaaac

SEQ ID NO: 425524 - DNA, 25 bp, Mus musculus
cgtgaggtcctaccaatactgaggg

SEQ ID NO: 425525 - DNA, 25 bp, Mus musculus
cgtgagtctgaaccatgccaattgc

SEQ ID NO: 425526 - DNA, 25 bp, Mus musculus
cgtgagtgatcactttagatcttgg

SEQ ID NO: 425527 - DNA, 25 bp, Mus musculus
cgtgagttgtaagatatagactgct

SEQ ID NO: 425528 - DNA, 25 bp, Mus musculus
cgtgataccattctgatttcctcag

SEQ ID NO: 425529 - DNA, 25 bp, Mus musculus
cgtgatcacttgcaatggctctggc

SEQ ID NO: 425530 - DNA, 25 bp, Mus musculus
cgtgatcgtcacaaccttacctgat

SEQ ID NO: 425531 - DNA, 25 bp, Mus musculus
cgtgatctgagtgtcactaacaagg

SEQ ID NO: 425532 - DNA, 25 bp, Mus musculus
cgtgatggaccgatacgaggccgaa

SEQ ID NO: 425533 - DNA, 25 bp, Mus musculus
cgtgatggcagggattatcggaact

SEQ ID NO: 425534 - DNA, 25 bp, Mus musculus
cgtgattaatctcccggaacggtga

SEQ ID NO: 425535 - DNA, 25 bp, Mus musculus
cgtgattgtccgaggaggagcccat

SEQ ID NO: 425536 - DNA, 25 bp, Mus musculus
cgtgcaaagaggttgggccagtttc

SEQ ID NO: 425537 - DNA, 25 bp, Mus musculus
cgtgcacacgggaagaccataaggg

SEQ ID NO: 425538 - DNA, 25 bp, Mus musculus
cgtgcacacttcaggttaatcggca

SEQ ID NO: 425539 - DNA, 25 bp, Mus musculus
cgtgcacagaatcggaaggccatca

SEQ ID NO: 425540 - DNA, 25 bp, Mus musculus
cgtgcactacagatgggacctgatg

SEQ ID NO: 425541 - DNA, 25 bp, Mus musculus
cgtgcagatcgcagttctaggaacc

SEQ ID NO: 425542 - DNA, 25 bp, Mus musculus
cgtgcagcacggtgtacctgttttt

SEQ ID NO: 425543 - DNA, 25 bp, Mus musculus
cgtgcatatacgtgaaagtggcttt

SEQ ID NO: 425544 - DNA, 25 bp, Mus musculus
cgtgcatcgtttctccctgtagagg

SEQ ID NO: 425545 - DNA, 25 bp, Mus musculus
cgtgcatctacccaagtggtagacc

SEQ ID NO: 425546 - DNA, 25 bp, Mus musculus
cgtgcatgtggagactagaggttaa

SEQ ID NO: 425547 - DNA, 25 bp, Mus musculus
cgtgcatgttagtgcctggtgcctg

SEQ ID NO: 425548 - DNA, 25 bp, Mus musculus
cgtgccaagcgaaggtatgctgcgt

SEQ ID NO: 425549 - DNA, 25 bp, Mus musculus
cgtgccaagctgacctcgtgaagga

SEQ ID NO: 425550 - DNA, 25 bp, Mus musculus
cgtgccaatgcagccgggaaatcgc

SEQ ID NO: 425551 - DNA, 25 bp, Mus musculus
cgtgccatcggcaacatcgagctgg

SEQ ID NO: 425552 - DNA, 25 bp, Mus musculus
cgtgccccggctcagtagcgttggg

SEQ ID NO: 425553 - DNA, 25 bp, Mus musculus
cgtgcccgggctgaactctttgaga

SEQ ID NO: 425554 - DNA, 25 bp, Mus musculus
cgtgccctaccgcttttcgacagat

SEQ ID NO: 425555 - DNA, 25 bp, Mus musculus
cgtgccctgcatggacaacactgtg

SEQ ID NO: 425556 - DNA, 25 bp, Mus musculus
cgtgcctacgtgacctggatgacca

SEQ ID NO: 425557 - DNA, 25 bp, Mus musculus
cgtgcctggcgttctgatccctgaa

SEQ ID NO: 425558 - DNA, 25 bp, Mus musculus
cgtgcctgtcaggagcagatcgaag

SEQ ID NO: 425559 - DNA, 25 bp, Mus musculus
cgtgcgcaaacgtgtatgcacacac

SEQ ID NO: 425560 - DNA, 25 bp, Mus musculus
cgtgcgcaggcagtggcatcatcat

SEQ ID NO: 425561 - DNA, 25 bp, Mus musculus
cgtgcgccacagataccgagaacat

SEQ ID NO: 425562 - DNA, 25 bp, Mus musculus
cgtgcgcgtcctgcctagggtttgt

SEQ ID NO: 425563 - DNA, 25 bp, Mus musculus
cgtgcgctgccatgctatactttca

SEQ ID NO: 425564 - DNA, 25 bp, Mus musculus
cgtgcggcagcgataaaaccctaaa

SEQ ID NO: 425565 - DNA, 25 bp, Mus musculus
cgtgcgggactcgtatgtggccata

SEQ ID NO: 425566 - DNA, 25 bp, Mus musculus
cgtgcgtgtctttgtctccctgtcc

SEQ ID NO: 425567 - DNA, 25 bp, Mus musculus
cgtgcgttgcttacactagtgtgga

SEQ ID NO: 425568 - DNA, 25 bp, Mus musculus
cgtgcgtttgcgagctggaaagcca

SEQ ID NO: 425569 - DNA, 25 bp, Mus musculus
cgtgctagactgtgtgtcaagcccc

SEQ ID NO: 425570 - DNA, 25 bp, Mus musculus
cgtgctagccaagcccaaactgtgg

SEQ ID NO: 425571 - DNA, 25 bp, Mus musculus
cgtgctatggtgtgaactctgggac

SEQ ID NO: 425572 - DNA, 25 bp, Mus musculus
cgtgctcagtagcatccactgtgtt

SEQ ID NO: 425573 - DNA, 25 bp, Mus musculus
cgtgctccctgcatccagaaggttt

SEQ ID NO: 425574 - DNA, 25 bp, Mus musculus
cgtgctcggacagcgggctgcttca

SEQ ID NO: 425575 - DNA, 25 bp, Mus musculus
cgtgctcggctgactaaaaccttag

SEQ ID NO: 425576 - DNA, 25 bp, Mus musculus
cgtgctctggttcgcgcctacttgg

SEQ ID NO: 425577 - DNA, 25 bp, Mus musculus
cgtgctgacaggtacagtggcctca

SEQ ID NO: 425578 - DNA, 25 bp, Mus musculus
cgtgctgaggattgaactcctgtcc

SEQ ID NO: 425579 - DNA, 25 bp, Mus musculus
cgtgctgcaattccaaaaggtctga

SEQ ID NO: 425580 - DNA, 25 bp, Mus musculus
cgtgctgccattcgaagagaactaa

SEQ ID NO: 425581 - DNA, 25 bp, Mus musculus
cgtgctgcctgcctgcattcctgtt

SEQ ID NO: 425582 - DNA, 25 bp, Mus musculus
cgtgctggcagggatggcaaaccat

SEQ ID NO: 425583 - DNA, 25 bp, Mus musculus
cgtgctggcgttgaacatgctgtgc

SEQ ID NO: 425584 - DNA, 25 bp, Mus musculus
cgtgctgtagcaactatcggaccca

SEQ ID NO: 425585 - DNA, 25 bp, Mus musculus
cgtggaaaccacacttcgggagaca

SEQ ID NO: 425586 - DNA, 25 bp, Mus musculus
cgtggaaacgtggaggaagaatctc

SEQ ID NO: 425587 - DNA, 25 bp, Mus musculus
cgtggaaactcggaaactctcgcgc

SEQ ID NO: 425588 - DNA, 25 bp, Mus musculus
cgtggaacctccgtttgatgactca

SEQ ID NO: 425589 - DNA, 25 bp, Mus musculus
cgtggacagaccaataacgccgctt

SEQ ID NO: 425590 - DNA, 25 bp, Mus musculus
cgtggacatgcaggtacttcggaat

SEQ ID NO: 425591 - DNA, 25 bp, Mus musculus
cgtggacccaaggagtgctcgcttc

SEQ ID NO: 425592 - DNA, 25 bp, Mus musculus
cgtggactgcatagtatcacttggg

SEQ ID NO: 425593 - DNA, 25 bp, Mus musculus
cgtggaggtgcacacattagtcttc

SEQ ID NO: 425594 - DNA, 25 bp, Mus musculus
cgtggagtcccgtcccataggtggc

SEQ ID NO: 425595 - DNA, 25 bp, Mus musculus
cgtggagttctcttcgctcaaaaca

SEQ ID NO: 425596 - DNA, 25 bp, Mus musculus
cgtggatcacgaagggaatgttgct

SEQ ID NO: 425597 - DNA, 25 bp, Mus musculus
cgtggatcgcacaatgactctggaa

SEQ ID NO: 425598 - DNA, 25 bp, Mus musculus
cgtggcaagaaatggacgatcagaa

SEQ ID NO: 425599 - DNA, 25 bp, Mus musculus
cgtggcagacttgaccgagcaatat

SEQ ID NO: 425600 - DNA, 25 bp, Mus musculus
cgtggcagccagttgatgatgatca

SEQ ID NO: 425601 - DNA, 25 bp, Mus musculus
cgtggccacgagtcctccatgaaga

SEQ ID NO: 425602 - DNA, 25 bp, Mus musculus
cgtggccacggctctctaggttagg

SEQ ID NO: 425603 - DNA, 25 bp, Mus musculus
cgtggcctaggcctcctaagctggc

SEQ ID NO: 425604 - DNA, 25 bp, Mus musculus
cgtggcctctgcttggctgagatga

SEQ ID NO: 425605 - DNA, 25 bp, Mus musculus
cgtggcgcactcaaactcatctaga

SEQ ID NO: 425606 - DNA, 25 bp, Mus musculus
cgtggctagtttgagtgacagatgc

SEQ ID NO: 425607 - DNA, 25 bp, Mus musculus
cgtggctgccggagactctgtttga

SEQ ID NO: 425608 - DNA, 25 bp, Mus musculus
cgtggcttgcaagtgtgacatagga

SEQ ID NO: 425609 - DNA, 25 bp, Mus musculus
cgtgggaaaccctgatctgcagata

SEQ ID NO: 425610 - DNA, 25 bp, Mus musculus
cgtgggacaggaatagaggaaactc

SEQ ID NO: 425611 - DNA, 25 bp, Mus musculus
cgtgggcatcgcagccatggtgctt

SEQ ID NO: 425612 - DNA, 25 bp, Mus musculus
cgtgggcattgtacacacctgtagc

SEQ ID NO: 425613 - DNA, 25 bp, Mus musculus
cgtgggccaagtgaatgacagtcct

SEQ ID NO: 425614 - DNA, 25 bp, Mus musculus
cgtgggcccagcgttgtaataaagt

SEQ ID NO: 425615 - DNA, 25 bp, Mus musculus
cgtgggctgaggctctgcataaact

SEQ ID NO: 425616 - DNA, 25 bp, Mus musculus
cgtgggtatgtctaggctgttgcca

SEQ ID NO: 425617 - DNA, 25 bp, Mus musculus
cgtgggtcacatatccagaagtctt

SEQ ID NO: 425618 - DNA, 25 bp, Mus musculus
cgtgggtcccgagtggcagttgtaa

SEQ ID NO: 425619 - DNA, 25 bp, Mus musculus
cgtgggtgcacaaagaaatgcaaac

SEQ ID NO: 425620 - DNA, 25 bp, Mus musculus
cgtgggtgcaccgaaggcagattct

SEQ ID NO: 425621 - DNA, 25 bp, Mus musculus
cgtgggttgaggcttgtactgggac

SEQ ID NO: 425622 - DNA, 25 bp, Mus musculus
cgtggtaacacatgcgttgcttggg

SEQ ID NO: 425623 - DNA, 25 bp, Mus musculus
cgtggtacccgtgccagtgccagtt

SEQ ID NO: 425624 - DNA, 25 bp, Mus musculus
cgtggtacgttcaggtgaggaccaa

SEQ ID NO: 425625 - DNA, 25 bp, Mus musculus
cgtggtcccttagaacgcaggtgga

SEQ ID NO: 425626 - DNA, 25 bp, Mus musculus
cgtggtgccaggtattccgagactt

SEQ ID NO: 425627 - DNA, 25 bp, Mus musculus
cgtggtgcctactgtaccgtggaga

SEQ ID NO: 425628 - DNA, 25 bp, Mus musculus
cgtggtgcgggctgcgggatgtgta

SEQ ID NO: 425629 - DNA, 25 bp, Mus musculus
cgtggtggtcactccactgcgggct

SEQ ID NO: 425630 - DNA, 25 bp, Mus musculus
cgtggtgtaattagatgactccaag

SEQ ID NO: 425631 - DNA, 25 bp, Mus musculus
cgtggtgttcaggatcctgtatcca

SEQ ID NO: 425632 - DNA, 25 bp, Mus musculus
cgtggttactcacaaacgtctgtaa

SEQ ID NO: 425633 - DNA, 25 bp, Mus musculus
cgtggttatggttacaggccaggca

SEQ ID NO: 425634 - DNA, 25 bp, Mus musculus
cgtggttcctctatgccgggacgga

SEQ ID NO: 425635 - DNA, 25 bp, Mus musculus
cgtggttgtttacaacagcaacaca

SEQ ID NO: 425636 - DNA, 25 bp, Mus musculus
cgtggttttgagatctgcatttcag

SEQ ID NO: 425637 - DNA, 25 bp, Mus musculus
cgtgtaaccctcacggcaacgggct

SEQ ID NO: 425638 - DNA, 25 bp, Mus musculus
cgtgtaagccaagcctttctcggaa

SEQ ID NO: 425639 - DNA, 25 bp, Mus musculus
cgtgtacgagctcaacagcaaggag

SEQ ID NO: 425640 - DNA, 25 bp, Mus musculus
cgtgtactccatagcggatcgcagc

SEQ ID NO: 425641 - DNA, 25 bp, Mus musculus
cgtgtagatgcagggaactcaacct

SEQ ID NO: 425642 - DNA, 25 bp, Mus musculus
cgtgtcacaagaaatgctcccgctg

SEQ ID NO: 425643 - DNA, 25 bp, Mus musculus
cgtgtcacctctgcaaagggatggg

SEQ ID NO: 425644 - DNA, 25 bp, Mus musculus
cgtgtcagcccggagctcagtcatt

SEQ ID NO: 425645 - DNA, 25 bp, Mus musculus
cgtgtcatcggcaaaggcggcaaaa

SEQ ID NO: 425646 - DNA, 25 bp, Mus musculus
cgtgtcatctgcatagtggtctcca

SEQ ID NO: 425647 - DNA, 25 bp, Mus musculus
cgtgtcctcttctgctaatcaattc

SEQ ID NO: 425648 - DNA, 25 bp, Mus musculus
cgtgtctaccataaccgccagaggt

SEQ ID NO: 425649 - DNA, 25 bp, Mus musculus
cgtgtctgggacatgtttttctgtg

SEQ ID NO: 425650 - DNA, 25 bp, Mus musculus
cgtgtcttcagtaacggcgtagaga

SEQ ID NO: 425651 - DNA, 25 bp, Mus musculus
cgtgtcttctgtccagtccgaagga

SEQ ID NO: 425652 - DNA, 25 bp, Mus musculus
cgtgtcttctgttcacagattcagg

SEQ ID NO: 425653 - DNA, 25 bp, Mus musculus
cgtgtgaacattctgacttctgtcc

SEQ ID NO: 425654 - DNA, 25 bp, Mus musculus
cgtgtgcaaaatcagccccgaggaa

SEQ ID NO: 425655 - DNA, 25 bp, Mus musculus
cgtgtgcatagaaaagggactcagt

SEQ ID NO: 425656 - DNA, 25 bp, Mus musculus
cgtgtgcgaggaagccaggtaaact

SEQ ID NO: 425657 - DNA, 25 bp, Mus musculus
cgtgtggccccatgccctgtgatct

SEQ ID NO: 425658 - DNA, 25 bp, Mus musculus
cgtgtgggcctctgcgctttgtgaa

SEQ ID NO: 425659 - DNA, 25 bp, Mus musculus
cgtgtgtacgccaacgagagttcgg

SEQ ID NO: 425660 - DNA, 25 bp, Mus musculus
cgtgtgtgacaccaatgctgtattg

SEQ ID NO: 425661 - DNA, 25 bp, Mus musculus
cgtgtgtgacctcagggctgcacct

SEQ ID NO: 425662 - DNA, 25 bp, Mus musculus
cgtgtgtgtaccaggaactcaccag

SEQ ID NO: 425663 - DNA, 25 bp, Mus musculus
cgtgttaataagcagagactcgagc

SEQ ID NO: 425664 - DNA, 25 bp, Mus musculus
cgtgttcaactgtctgtgcgccggg

SEQ ID NO: 425665 - DNA, 25 bp, Mus musculus
cgtgttcagaaggagatgtaaatgc

SEQ ID NO: 425666 - DNA, 25 bp, Mus musculus
cgtgttccctaccatctgctttgga

SEQ ID NO: 425667 - DNA, 25 bp, Mus musculus
cgtgttgaccgaaaggtgcagctgt

SEQ ID NO: 425668 - DNA, 25 bp, Mus musculus
cgtgttgactcaaaactcgctgggc

SEQ ID NO: 425669 - DNA, 25 bp, Mus musculus
cgtgttgtgccctacctggatgagc

SEQ ID NO: 425670 - DNA, 25 bp, Mus musculus
cgtgtttccttactgcatcgagcca

SEQ ID NO: 425671 - DNA, 25 bp, Mus musculus
cgtgtttgttaccattgtctggcac

SEQ ID NO: 425672 - DNA, 25 bp, Mus musculus
cgttaaagagtgaaagcctagtgcc

SEQ ID NO: 425673 - DNA, 25 bp, Mus musculus
cgttacagtatatcttttcacgtga

SEQ ID NO: 425674 - DNA, 25 bp, Mus musculus
cgttaccagtttcaggccctgcttc

SEQ ID NO: 425675 - DNA, 25 bp, Mus musculus
cgttagccagtgagaacatccccag

SEQ ID NO: 425676 - DNA, 25 bp, Mus musculus
cgttaggcatcctcatgacctggca

SEQ ID NO: 425677 - DNA, 25 bp, Mus musculus
cgttagggatagacgggagtattca

SEQ ID NO: 425678 - DNA, 25 bp, Mus musculus
cgttaggtattgctcaggaaagtcc

SEQ ID NO: 425679 - DNA, 25 bp, Mus musculus
cgttatcgactacatcctggacctg

SEQ ID NO: 425680 - DNA, 25 bp, Mus musculus
cgttattatcttgaggcgcagaagg

SEQ ID NO: 425681 - DNA, 25 bp, Mus musculus
cgttattgtgtgtctgtctccctgc

SEQ ID NO: 425682 - DNA, 25 bp, Mus musculus
cgttcaacaggcaaaccagcagctg

SEQ ID NO: 425683 - DNA, 25 bp, Mus musculus
cgttcaatgaactgagagtctccct

SEQ ID NO: 425684 - DNA, 25 bp, Mus musculus
cgttcaatgagctgacggtgcccat

SEQ ID NO: 425685 - DNA, 25 bp, Mus musculus
cgttcacacgtagctgggaaatctc

SEQ ID NO: 425686 - DNA, 25 bp, Mus musculus
cgttcacatacagaaatgacgctgg

SEQ ID NO: 425687 - DNA, 25 bp, Mus musculus
cgttcagtcaagagacagtgcagcc

SEQ ID NO: 425688 - DNA, 25 bp, Mus musculus
cgttcattctgataagacttaatgg

SEQ ID NO: 425689 - DNA, 25 bp, Mus musculus
cgttccagaaggttagtgggtcatc

SEQ ID NO: 425690 - DNA, 25 bp, Mus musculus
cgttccgtgacaagcatttaccgag

SEQ ID NO: 425691 - DNA, 25 bp, Mus musculus
cgttcctcaaagaggcgtgcctgct

SEQ ID NO: 425692 - DNA, 25 bp, Mus musculus
cgttcctcagcaggatcatggcagg

SEQ ID NO: 425693 - DNA, 25 bp, Mus musculus
cgttcgcaatgatcaagggctacct

SEQ ID NO: 425694 - DNA, 25 bp, Mus musculus
cgttcgggctttggatcacgctata

SEQ ID NO: 425695 - DNA, 25 bp, Mus musculus
cgttcggtcactcgagtcgcaggct

SEQ ID NO: 425696 - DNA, 25 bp, Mus musculus
cgttctccaagactctcagcaagac

SEQ ID NO: 425697 - DNA, 25 bp, Mus musculus
cgttctgagaatgacattgaccttc

SEQ ID NO: 425698 - DNA, 25 bp, Mus musculus
cgttctgcagcttcttcggaggcga

SEQ ID NO: 425699 - DNA, 25 bp, Mus musculus
cgttctgctgcgacaatgacattga

SEQ ID NO: 425700 - DNA, 25 bp, Mus musculus
cgttctggagacagcgcatcgggat

SEQ ID NO: 425701 - DNA, 25 bp, Mus musculus
cgttctggttctgagctgcgtctgc

SEQ ID NO: 425702 - DNA, 25 bp, Mus musculus
cgttctgtatgggaggtcttaggac

SEQ ID NO: 425703 - DNA, 25 bp, Mus musculus
cgttctgtcaacaggcttcagatga

SEQ ID NO: 425704 - DNA, 25 bp, Mus musculus
cgttctgttcctgttggcttacaca

SEQ ID NO: 425705 - DNA, 25 bp, Mus musculus
cgttcttagaaatcacatgctggga

SEQ ID NO: 425706 - DNA, 25 bp, Mus musculus
cgttcttatcgggagcacagccaga

SEQ ID NO: 425707 - DNA, 25 bp, Mus musculus
cgttcttgctcttcgagggcgagaa

SEQ ID NO: 425708 - DNA, 25 bp, Mus musculus
cgttgaccgaaagctaccctctgtt

SEQ ID NO: 425709 - DNA, 25 bp, Mus musculus
cgttgaccgatgcacaaagactctg

SEQ ID NO: 425710 - DNA, 25 bp, Mus musculus
cgttgacggtaatgcggactgccat

SEQ ID NO: 425711 - DNA, 25 bp, Mus musculus
cgttgaggcttatatgggaaataca

SEQ ID NO: 425712 - DNA, 25 bp, Mus musculus
cgttgatatgatcaaagtatgacca

SEQ ID NO: 425713 - DNA, 25 bp, Mus musculus
cgttgatgaaagcttgactgaggcc

SEQ ID NO: 425714 - DNA, 25 bp, Mus musculus
cgttgctagtctggttctcctggga

SEQ ID NO: 425715 - DNA, 25 bp, Mus musculus
cgttggaggcaaaaccataggccag

SEQ ID NO: 425716 - DNA, 25 bp, Mus musculus
cgttggagtgctgggtgtaacttct

SEQ ID NO: 425717 - DNA, 25 bp, Mus musculus
cgttggcagtgagctttcctctaat

SEQ ID NO: 425718 - DNA, 25 bp, Mus musculus
cgttgtcacatctggcatgtgggag

SEQ ID NO: 425719 - DNA, 25 bp, Mus musculus
cgttgtcggtatcggtcttcagcaa

SEQ ID NO: 425720 - DNA, 25 bp, Mus musculus
cgttgtgaggtcagagaaacttgct

SEQ ID NO: 425721 - DNA, 25 bp, Mus musculus
cgttgtgtctatctagtccagccga

SEQ ID NO: 425722 - DNA, 25 bp, Mus musculus
cgttgtttgcttcccgagggcgcct

SEQ ID NO: 425723 - DNA, 25 bp, Mus musculus
cgtttaaactcgaagctgcccaggg

SEQ ID NO: 425724 - DNA, 25 bp, Mus musculus
cgtttaactggcactcgggctgagc

SEQ ID NO: 425725 - DNA, 25 bp, Mus musculus
cgtttactggcgaaagctctgcaca

SEQ ID NO: 425726 - DNA, 25 bp, Mus musculus
cgtttactgtcggtatcgcggccag

SEQ ID NO: 425727 - DNA, 25 bp, Mus musculus
cgtttacttgagatacccatggtgc

SEQ ID NO: 425728 - DNA, 25 bp, Mus musculus
cgtttagtgggaaatgacatcagga

SEQ ID NO: 425729 - DNA, 25 bp, Mus musculus
cgtttatcatgttctggttggactc

SEQ ID NO: 425730 - DNA, 25 bp, Mus musculus
cgtttatgtgttcaaaggagatgaa

SEQ ID NO: 425731 - DNA, 25 bp, Mus musculus
cgtttattccaaggactgggcagcc

SEQ ID NO: 425732 - DNA, 25 bp, Mus musculus
cgtttatttcatgattgccagagtg

SEQ ID NO: 425733 - DNA, 25 bp, Mus musculus
cgtttcataacggagtgtaggctag

SEQ ID NO: 425734 - DNA, 25 bp, Mus musculus
cgtttcctgatatgcaccgaccgaa

SEQ ID NO: 425735 - DNA, 25 bp, Mus musculus
cgtttcgcaaagcaccgggcagata

SEQ ID NO: 425736 - DNA, 25 bp, Mus musculus
cgtttcggaagagtgagatctgact

SEQ ID NO: 425737 - DNA, 25 bp, Mus musculus
cgtttcgggccgatcaagtgcatcc

SEQ ID NO: 425738 - DNA, 25 bp, Mus musculus
cgtttctaacccaagtcacagggag

SEQ ID NO: 425739 - DNA, 25 bp, Mus musculus
cgtttctccaaggtaattgtggccg

SEQ ID NO: 425740 - DNA, 25 bp, Mus musculus
cgtttctctcgggaaagtagaggca

SEQ ID NO: 425741 - DNA, 25 bp, Mus musculus
cgtttctgacagagcaaacagcaac

SEQ ID NO: 425742 - DNA, 25 bp, Mus musculus
cgtttctgcttctgaacaccctaat

SEQ ID NO: 425743 - DNA, 25 bp, Mus musculus
cgtttctggaactggagcttgtgcc

SEQ ID NO: 425744 - DNA, 25 bp, Mus musculus
cgtttcttggatgtcaacagtcaca

SEQ ID NO: 425745 - DNA, 25 bp, Mus musculus
cgtttgatttccctgacgacagcca

SEQ ID NO: 425746 - DNA, 25 bp, Mus musculus
cgtttgcaagttctgtggccgccac

SEQ ID NO: 425747 - DNA, 25 bp, Mus musculus
cgtttgcagaaattctcctagagaa

SEQ ID NO: 425748 - DNA, 25 bp, Mus musculus
cgtttgccgggcagctgtagaccct

SEQ ID NO: 425749 - DNA, 25 bp, Mus musculus
cgtttgctaacggatggaacccaga

SEQ ID NO: 425750 - DNA, 25 bp, Mus musculus
cgtttgctcccagaggtttctgaca

SEQ ID NO: 425751 - DNA, 25 bp, Mus musculus
cgtttgctgcagtccgaagccatca

SEQ ID NO: 425752 - DNA, 25 bp, Mus musculus
cgtttgtccccagacagcatggtga

SEQ ID NO: 425753 - DNA, 25 bp, Mus musculus
cgttttacacgaggcacagcggctc

SEQ ID NO: 425754 - DNA, 25 bp, Mus musculus
cgttttagagccatgttcccgctgc

SEQ ID NO: 425755 - DNA, 25 bp, Mus musculus
cgttttaggctcaatccaggaggag

SEQ ID NO: 425756 - DNA, 25 bp, Mus musculus
cgttttccgtaatggcacctgcgct

SEQ ID NO: 425757 - DNA, 25 bp, Mus musculus
cgttttcgcgaactgctggagctca

SEQ ID NO: 425758 - DNA, 25 bp, Mus musculus
cgttttgaaaagcattgttccttgg

SEQ ID NO: 425759 - DNA, 25 bp, Mus musculus
cgttttgaccatggccgggagcttg

SEQ ID NO: 425760 - DNA, 25 bp, Mus musculus
cgtttttcttactaggccagcaggc

SEQ ID NO: 425761 - DNA, 25 bp, Mus musculus
ctaaaactctgccacaaggaacaag

SEQ ID NO: 425762 - DNA, 25 bp, Mus musculus
ctaaaagcctcctctgggactgcag

SEQ ID NO: 425763 - DNA, 25 bp, Mus musculus
ctaaaagtcctttcactgtgggcgt

SEQ ID NO: 425764 - DNA, 25 bp, Mus musculus
ctaaaatacagaaacttggatctgg

SEQ ID NO: 425765 - DNA, 25 bp, Mus musculus
ctaaaatttgttttgactctgctcc

SEQ ID NO: 425766 - DNA, 25 bp, Mus musculus
ctaaacactgggttccgagacgcac

SEQ ID NO: 425767 - DNA, 25 bp, Mus musculus
ctaaactcatgaagaaggctatcag

SEQ ID NO: 425768 - DNA, 25 bp, Mus musculus
ctaaactgaatcctagccaaaaggc

SEQ ID NO: 425769 - DNA, 25 bp, Mus musculus
ctaaacttgtgctcggcggcagggt

SEQ ID NO: 425770 - DNA, 25 bp, Mus musculus
ctaaagaagacacgtggcagaagct

SEQ ID NO: 425771 - DNA, 25 bp, Mus musculus
ctaaagattatgcacttctgacagg

SEQ ID NO: 425772 - DNA, 25 bp, Mus musculus
ctaaaggcgcttgcggccaacctga

SEQ ID NO: 425773 - DNA, 25 bp, Mus musculus
ctaaaggctgaaaaggccagactcc

SEQ ID NO: 425774 - DNA, 25 bp, Mus musculus
ctaaaggtaagtgggtctgctcaac

SEQ ID NO: 425775 - DNA, 25 bp, Mus musculus
ctaaagtcatcagaggaggaagcct

SEQ ID NO: 425776 - DNA, 25 bp, Mus musculus
ctaaagttgacagccaatggccgga

SEQ ID NO: 425777 - DNA, 25 bp, Mus musculus
ctaaatgcactcttcgctagcccgg

SEQ ID NO: 425778 - DNA, 25 bp, Mus musculus
ctaaatttttgcactgttcaggaca

SEQ ID NO: 425779 - DNA, 25 bp, Mus musculus
ctaacaaaccctggactggtatctg

SEQ ID NO: 425780 - DNA, 25 bp, Mus musculus
ctaacaaagggaatcggactgcgcg

SEQ ID NO: 425781 - DNA, 25 bp, Mus musculus
ctaacagccttcctgggctacaagg

SEQ ID NO: 425782 - DNA, 25 bp, Mus musculus
ctaacagctgttttcccctccaagg

SEQ ID NO: 425783 - DNA, 25 bp, Mus musculus
ctaacagtgggctgtggcaacgcaa

SEQ ID NO: 425784 - DNA, 25 bp, Mus musculus
ctaacatggaggacgtatacgcggt

SEQ ID NO: 425785 - DNA, 25 bp, Mus musculus
ctaaccgtgaggctgaggatgaccc

SEQ ID NO: 425786 - DNA, 25 bp, Mus musculus
ctaacgaaggcctgacagccccggg

SEQ ID NO: 425787 - DNA, 25 bp, Mus musculus
ctaacgctgggaaattggaggccct

SEQ ID NO: 425788 - DNA, 25 bp, Mus musculus
ctaactctgaggtggccctgaccaa

SEQ ID NO: 425789 - DNA, 25 bp, Mus musculus
ctaactgacacgagcaaataaacaa

SEQ ID NO: 425790 - DNA, 25 bp, Mus musculus
ctaactggaaatcggctggtgcgcc

SEQ ID NO: 425791 - DNA, 25 bp, Mus musculus
ctaacttcatcacaactcaacctga

SEQ ID NO: 425792 - DNA, 25 bp, Mus musculus
ctaactttatggtttatggtagaag

SEQ ID NO: 425793 - DNA, 25 bp, Mus musculus
ctaagaaagcggacgacaaggccaa

SEQ ID NO: 425794 - DNA, 25 bp, Mus musculus
ctaagaaccgccagcgccagggctg

SEQ ID NO: 425795 - DNA, 25 bp, Mus musculus
ctaagaacctggttctctgtgtctg

SEQ ID NO: 425796 - DNA, 25 bp, Mus musculus
ctaagaaggagactgccaagccggc

SEQ ID NO: 425797 - DNA, 25 bp, Mus musculus
ctaagaagtacgtacccagggctgc

SEQ ID NO: 425798 - DNA, 25 bp, Mus musculus
ctaagaatccgctggtgaagccgcc

SEQ ID NO: 425799 - DNA, 25 bp, Mus musculus
ctaagaatcgagtccgcaggcaacg

SEQ ID NO: 425800 - DNA, 25 bp, Mus musculus
ctaagacaccatgggcagagtccca

SEQ ID NO: 425801 - DNA, 25 bp, Mus musculus
ctaagagcacctattaggtgtggcc

SEQ ID NO: 425802 - DNA, 25 bp, Mus musculus
ctaagaggggcaccctgtgcccact

SEQ ID NO: 425803 - DNA, 25 bp, Mus musculus
ctaagcattgcccttgcgatgggaa

SEQ ID NO: 425804 - DNA, 25 bp, Mus musculus
ctaagcgcggaagctatgcctggca

SEQ ID NO: 425805 - DNA, 25 bp, Mus musculus
ctaagcggcaaagcctgaaggtctc

SEQ ID NO: 425806 - DNA, 25 bp, Mus musculus
ctaagctctctaccatagggaagat

SEQ ID NO: 425807 - DNA, 25 bp, Mus musculus
ctaagctggcaatgggacgtcacgt

SEQ ID NO: 425808 - DNA, 25 bp, Mus musculus
ctaaggaccaagaaggaggactgcc

SEQ ID NO: 425809 - DNA, 25 bp, Mus musculus
ctaaggagtattggacccagcggcg

SEQ ID NO: 425810 - DNA, 25 bp, Mus musculus
ctaaggcaaaagaagacaagcagtt

SEQ ID NO: 425811 - DNA, 25 bp, Mus musculus
ctaaggctgccccaagagattgctt

SEQ ID NO: 425812 - DNA, 25 bp, Mus musculus
ctaagggagccaagagaaatacgtt

SEQ ID NO: 425813 - DNA, 25 bp, Mus musculus
ctaagggcatagtcagggtaccaac

SEQ ID NO: 425814 - DNA, 25 bp, Mus musculus
ctaaggtaaagcacaccagggatcc

SEQ ID NO: 425815 - DNA, 25 bp, Mus musculus
ctaaggtaattgttgctcggcatca

SEQ ID NO: 425816 - DNA, 25 bp, Mus musculus
ctaaggtcttgtgccagcatctacc

SEQ ID NO: 425817 - DNA, 25 bp, Mus musculus
ctaaggtgggaagcttgctgcaagt

SEQ ID NO: 425818 - DNA, 25 bp, Mus musculus
ctaaggtttgactaaggagggcaca

SEQ ID NO: 425819 - DNA, 25 bp, Mus musculus
ctaaggtttttatctactgcagagg

SEQ ID NO: 425820 - DNA, 25 bp, Mus musculus
ctaagtattgtctgtccttgggcaa

SEQ ID NO: 425821 - DNA, 25 bp, Mus musculus
ctaagtgtgcataatgtagctgcca

SEQ ID NO: 425822 - DNA, 25 bp, Mus musculus
ctaagttcaattccagttgaggtcc

SEQ ID NO: 425823 - DNA, 25 bp, Mus musculus
ctaagttgtccggtagagggcagcc

SEQ ID NO: 425824 - DNA, 25 bp, Mus musculus
ctaagttttatcagaataactgcac

SEQ ID NO: 425825 - DNA, 25 bp, Mus musculus
ctaataaaggacaagggattgcggc

SEQ ID NO: 425826 - DNA, 25 bp, Mus musculus
ctaatacagcatgtggaagaagaca

SEQ ID NO: 425827 - DNA, 25 bp, Mus musculus
ctaatagaacaggttgaagtccgcc

SEQ ID NO: 425828 - DNA, 25 bp, Mus musculus
ctaatagaatagaatgctagccacc

SEQ ID NO: 425829 - DNA, 25 bp, Mus musculus
ctaatagctgtagcggttgggcccc

SEQ ID NO: 425830 - DNA, 25 bp, Mus musculus
ctaatatcctggacagcatccgcaa

SEQ ID NO: 425831 - DNA, 25 bp, Mus musculus
ctaatgaaccggaggccggaaggct

SEQ ID NO: 425832 - DNA, 25 bp, Mus musculus
ctaatgaccccaagagctacgaggc

SEQ ID NO: 425833 - DNA, 25 bp, Mus musculus
ctaatgcagaattgggtaggatggc

SEQ ID NO: 425834 - DNA, 25 bp, Mus musculus
ctaatgcatccacgctgcttggaag

SEQ ID NO: 425835 - DNA, 25 bp, Mus musculus
ctaatgccaatgtgtcgggaagcca

SEQ ID NO: 425836 - DNA, 25 bp, Mus musculus
ctaatgccctattgagaaactcaag

SEQ ID NO: 425837 - DNA, 25 bp, Mus musculus
ctaatgctgagcaccgactgaggac

SEQ ID NO: 425838 - DNA, 25 bp, Mus musculus
ctaatgtctgtctcaagacacagga

SEQ ID NO: 425839 - DNA, 25 bp, Mus musculus
ctaatgttggcgagggtagatccca

SEQ ID NO: 425840 - DNA, 25 bp, Mus musculus
ctaattggagctgtaaaacaccacc

SEQ ID NO: 425841 - DNA, 25 bp, Mus musculus
ctaattgggtatctgcgatgagtca

SEQ ID NO: 425842 - DNA, 25 bp, Mus musculus
ctaatttgaacaggcctaggacgcg

SEQ ID NO: 425843 - DNA, 25 bp, Mus musculus
ctacaaatggaagcggcaggtgacc

SEQ ID NO: 425844 - DNA, 25 bp, Mus musculus
ctacaacgaccccaagtgctgcgat

SEQ ID NO: 425845 - DNA, 25 bp, Mus musculus
ctacaagacgctgaccatggccaag

SEQ ID NO: 425846 - DNA, 25 bp, Mus musculus
ctacaagttggccagggatgccgcc

SEQ ID NO: 425847 - DNA, 25 bp, Mus musculus
ctacaatcgtgaggaggacgctgcc

SEQ ID NO: 425848 - DNA, 25 bp, Mus musculus
ctacaatgtcaccagggagcgctgc

SEQ ID NO: 425849 - DNA, 25 bp, Mus musculus
ctacacagctagttcaaaaccagcc

SEQ ID NO: 425850 - DNA, 25 bp, Mus musculus
ctacacatggtacaagggcgggcaa

SEQ ID NO: 425851 - DNA, 25 bp, Mus musculus
ctacacatgtgtggtacgccggcac

SEQ ID NO: 425852 - DNA, 25 bp, Mus musculus
ctacacgtcggtgctgaagcgggca

SEQ ID NO: 425853 - DNA, 25 bp, Mus musculus
ctacactactgagaagaagccgccg

SEQ ID NO: 425854 - DNA, 25 bp, Mus musculus
ctacacttggccagagagggcaggc

SEQ ID NO: 425855 - DNA, 25 bp, Mus musculus
ctacagaatgtaggaggagcctccc

SEQ ID NO: 425856 - DNA, 25 bp, Mus musculus
ctacagaggaatggaggctaggcat

SEQ ID NO: 425857 - DNA, 25 bp, Mus musculus
ctacagcagtcgtgatacctccggg

SEQ ID NO: 425858 - DNA, 25 bp, Mus musculus
ctacagccaagggagcgtcaacagg

SEQ ID NO: 425859 - DNA, 25 bp, Mus musculus
ctacagccacggagagtaatgaagc

SEQ ID NO: 425860 - DNA, 25 bp, Mus musculus
ctacaggaagggaacttgcaagact

SEQ ID NO: 425861 - DNA, 25 bp, Mus musculus
ctacaggagaacagcaaatttgact

SEQ ID NO: 425862 - DNA, 25 bp, Mus musculus
ctacaggcgtcgtttcgcggtcgcg

SEQ ID NO: 425863 - DNA, 25 bp, Mus musculus
ctacaggctggaggccattgttact

SEQ ID NO: 425864 - DNA, 25 bp, Mus musculus
ctacagggtgagaagatccagggcc

SEQ ID NO: 425865 - DNA, 25 bp, Mus musculus
ctacaggttctatttggaattcaga

SEQ ID NO: 425866 - DNA, 25 bp, Mus musculus
ctacagtcagagacatgttaagaga

SEQ ID NO: 425867 - DNA, 25 bp, Mus musculus
ctacatagttatggccggatttgct

SEQ ID NO: 425868 - DNA, 25 bp, Mus musculus
ctacatcaacgagaagagggacttc

SEQ ID NO: 425869 - DNA, 25 bp, Mus musculus
ctacatcagtggtccccgagtgcaa

SEQ ID NO: 425870 - DNA, 25 bp, Mus musculus
ctacatgaacatgactccccggagg

SEQ ID NO: 425871 - DNA, 25 bp, Mus musculus
ctacatggatgagaagaacggcccc

SEQ ID NO: 425872 - DNA, 25 bp, Mus musculus
ctacatggcggtgcagacaagcgag

SEQ ID NO: 425873 - DNA, 25 bp, Mus musculus
ctacattctatgttcgggagccagt

SEQ ID NO: 425874 - DNA, 25 bp, Mus musculus
ctacattgtaagttccgggccagtc

SEQ ID NO: 425875 - DNA, 25 bp, Mus musculus
ctacattttaactctggctggcaac

SEQ ID NO: 425876 - DNA, 25 bp, Mus musculus
ctaccaactatgtggactcaatgcg

SEQ ID NO: 425877 - DNA, 25 bp, Mus musculus
ctaccaagtccctgagctgatgtcc

SEQ ID NO: 425878 - DNA, 25 bp, Mus musculus
ctaccaccggctctggcttaacggt

SEQ ID NO: 425879 - DNA, 25 bp, Mus musculus
ctaccagagcacagagaggccatgg

SEQ ID NO: 425880 - DNA, 25 bp, Mus musculus
ctaccagcatctgcaggaaggccag

SEQ ID NO: 425881 - DNA, 25 bp, Mus musculus
ctaccatggacacatcagaggagga

SEQ ID NO: 425882 - DNA, 25 bp, Mus musculus
ctaccatgtccctagggccgctgaa

SEQ ID NO: 425883 - DNA, 25 bp, Mus musculus
ctacccacaggtcagcttctaggaa

SEQ ID NO: 425884 - DNA, 25 bp, Mus musculus
ctacccacctggctatgcctttgat

SEQ ID NO: 425885 - DNA, 25 bp, Mus musculus
ctaccccaggaaacgcggcttctgg

SEQ ID NO: 425886 - DNA, 25 bp, Mus musculus
ctaccctgaagctgtcacaattaat

SEQ ID NO: 425887 - DNA, 25 bp, Mus musculus
ctaccgggtggtgcttcttggagac

SEQ ID NO: 425888 - DNA, 25 bp, Mus musculus
ctacctatgggaactgggagacggc

SEQ ID NO: 425889 - DNA, 25 bp, Mus musculus
ctacctgaaaaacataatggaagca

SEQ ID NO: 425890 - DNA, 25 bp, Mus musculus
ctacctgagagggagagattcaaca

SEQ ID NO: 425891 - DNA, 25 bp, Mus musculus
ctacctggaccgaaagccgaatctg

SEQ ID NO: 425892 - DNA, 25 bp, Mus musculus
ctacctggtgtagtgataggatccc

SEQ ID NO: 425893 - DNA, 25 bp, Mus musculus
ctacgaaggcgaatttgtggatgga

SEQ ID NO: 425894 - DNA, 25 bp, Mus musculus
ctacgagatagagaccaatgggacc

SEQ ID NO: 425895 - DNA, 25 bp, Mus musculus
ctacgaggtaatgcgaggaggtcac

SEQ ID NO: 425896 - DNA, 25 bp, Mus musculus
ctacgattacacctatggctatggg

SEQ ID NO: 425897 - DNA, 25 bp, Mus musculus
ctacgcgcgtgcgagtacaagggca

SEQ ID NO: 425898 - DNA, 25 bp, Mus musculus
ctacgggtggtatgttcgaagagcc

SEQ ID NO: 425899 - DNA, 25 bp, Mus musculus
ctacgtgtgtgaggattgcggctac

SEQ ID NO: 425900 - DNA, 25 bp, Mus musculus
ctactacgtgcctagaggaggtcgc

SEQ ID NO: 425901 - DNA, 25 bp, Mus musculus
ctactactggtcagcctgttctcta

SEQ ID NO: 425902 - DNA, 25 bp, Mus musculus
ctactagtgaggagaggacggccat

SEQ ID NO: 425903 - DNA, 25 bp, Mus musculus
ctactagttgtatggtggtgatctc

SEQ ID NO: 425904 - DNA, 25 bp, Mus musculus
ctactatgtctaaccaggcttgcca

SEQ ID NO: 425905 - DNA, 25 bp, Mus musculus
ctactatgtgtgtaactcactggga

SEQ ID NO: 425906 - DNA, 25 bp, Mus musculus
ctactatgttaagcggcagccagcc

SEQ ID NO: 425907 - DNA, 25 bp, Mus musculus
ctactccgagagcaagatggtcatc

SEQ ID NO: 425908 - DNA, 25 bp, Mus musculus
ctactcggaagaccgctgcagctgg

SEQ ID NO: 425909 - DNA, 25 bp, Mus musculus
ctactcgtcggaggaaagcagctgc

SEQ ID NO: 425910 - DNA, 25 bp, Mus musculus
ctactctagtggcttcggtggcaaa

SEQ ID NO: 425911 - DNA, 25 bp, Mus musculus
ctactgaaggagaacgctgtgccca

SEQ ID NO: 425912 - DNA, 25 bp, Mus musculus
ctactgagtcagcccagcctggaca

SEQ ID NO: 425913 - DNA, 25 bp, Mus musculus
ctactgctgagtgccagtgaatgca

SEQ ID NO: 425914 - DNA, 25 bp, Mus musculus
ctactgctgccaccggtgtcaggag

SEQ ID NO: 425915 - DNA, 25 bp, Mus musculus
ctactggcatgggaacaagttctct

SEQ ID NO: 425916 - DNA, 25 bp, Mus musculus
ctactgtactgtggagctgcggcca

SEQ ID NO: 425917 - DNA, 25 bp, Mus musculus
ctactgtgcagtcgccccagagctg

SEQ ID NO: 425918 - DNA, 25 bp, Mus musculus
ctacttcgcggcttacgggagcagc

SEQ ID NO: 425919 - DNA, 25 bp, Mus musculus
ctacttcgtgtaaaacctggcaggg

SEQ ID NO: 425920 - DNA, 25 bp, Mus musculus
ctactttgtccctgcacgtccctgt

SEQ ID NO: 425921 - DNA, 25 bp, Mus musculus
ctagaaaagtcagagcccaggcaag

SEQ ID NO: 425922 - DNA, 25 bp, Mus musculus
ctagaacgttcagcggagcagggtc

SEQ ID NO: 425923 - DNA, 25 bp, Mus musculus
ctagaacgttttttgtttcacagtg

SEQ ID NO: 425924 - DNA, 25 bp, Mus musculus
ctagaaggctggactgaggccagac

SEQ ID NO: 425925 - DNA, 25 bp, Mus musculus
ctagaagggctagctgtttcagagc

SEQ ID NO: 425926 - DNA, 25 bp, Mus musculus
ctagaagtggctgcatcacaaggag

SEQ ID NO: 425927 - DNA, 25 bp, Mus musculus
ctagaatgctatgtccagcggaggg

SEQ ID NO: 425928 - DNA, 25 bp, Mus musculus
ctagaatttagagctcgggtgggtc

SEQ ID NO: 425929 - DNA, 25 bp, Mus musculus
ctagacaacctagggaagatggcgc

SEQ ID NO: 425930 - DNA, 25 bp, Mus musculus
ctagacacctctctgctgcagacgg

SEQ ID NO: 425931 - DNA, 25 bp, Mus musculus
ctagacccagctttatgcaggcggg

SEQ ID NO: 425932 - DNA, 25 bp, Mus musculus
ctagacctcccttgccggagaagaa

SEQ ID NO: 425933 - DNA, 25 bp, Mus musculus
ctagacctgggtcccctgtgggaat

SEQ ID NO: 425934 - DNA, 25 bp, Mus musculus
ctagactagcctggcccaaagagct

SEQ ID NO: 425935 - DNA, 25 bp, Mus musculus
ctagactgtgtaattgccaactgca

SEQ ID NO: 425936 - DNA, 25 bp, Mus musculus
ctagagaagcggcaacagtggcaca

SEQ ID NO: 425937 - DNA, 25 bp, Mus musculus
ctagagagagattccacgagcgctg

SEQ ID NO: 425938 - DNA, 25 bp, Mus musculus
ctagagagctaagtgtgcagttgcc

SEQ ID NO: 425939 - DNA, 25 bp, Mus musculus
ctagagatcaagttccagtaccggg

SEQ ID NO: 425940 - DNA, 25 bp, Mus musculus
ctagagcagtgctggtcaataggct

SEQ ID NO: 425941 - DNA, 25 bp, Mus musculus
ctagagcatagggtcagaagactcc

SEQ ID NO: 425942 - DNA, 25 bp, Mus musculus
ctagagcccaaaggcaggagtgtcc

SEQ ID NO: 425943 - DNA, 25 bp, Mus musculus
ctagagctgcgagctgagggtcctc

SEQ ID NO: 425944 - DNA, 25 bp, Mus musculus
ctagaggactgagaatggagagccc

SEQ ID NO: 425945 - DNA, 25 bp, Mus musculus
ctagagtcccaaagcgagaaccgga

SEQ ID NO: 425946 - DNA, 25 bp, Mus musculus
ctagagtctagtaatcaggcacctg

SEQ ID NO: 425947 - DNA, 25 bp, Mus musculus
ctagatatgtccagaacccgctgct

SEQ ID NO: 425948 - DNA, 25 bp, Mus musculus
ctagatcgtgatgaggaaagggcct

SEQ ID NO: 425949 - DNA, 25 bp, Mus musculus
ctagatctctggaacaccgggagcc

SEQ ID NO: 425950 - DNA, 25 bp, Mus musculus
ctagatgacagagggctcaggctcc

SEQ ID NO: 425951 - DNA, 25 bp, Mus musculus
ctagatgaggatactcagactgtaa

SEQ ID NO: 425952 - DNA, 25 bp, Mus musculus
ctagattagttttgggagcgcagca

SEQ ID NO: 425953 - DNA, 25 bp, Mus musculus
ctagattggactggtaggatggctc

SEQ ID NO: 425954 - DNA, 25 bp, Mus musculus
ctagcaaaagttgtagcgccaggct

SEQ ID NO: 425955 - DNA, 25 bp, Mus musculus
ctagcaagtatgatgggcgagttcc

SEQ ID NO: 425956 - DNA, 25 bp, Mus musculus
ctagcactactagggagagccacca

SEQ ID NO: 425957 - DNA, 25 bp, Mus musculus
ctagcaggaaaactgtaaccgtggg

SEQ ID NO: 425958 - DNA, 25 bp, Mus musculus
ctagcatttactcttacagcgttga

SEQ ID NO: 425959 - DNA, 25 bp, Mus musculus
ctagccaaagatggagagtgtccca

SEQ ID NO: 425960 - DNA, 25 bp, Mus musculus
ctagccaaggtagccacctctggga

SEQ ID NO: 425961 - DNA, 25 bp, Mus musculus
ctagcctgggcaaagaggaggtcat

SEQ ID NO: 425962 - DNA, 25 bp, Mus musculus
ctagcgacctccagagggccaggat

SEQ ID NO: 425963 - DNA, 25 bp, Mus musculus
ctagcggctacagaggaattgcatc

SEQ ID NO: 425964 - DNA, 25 bp, Mus musculus
ctagctaagatgaggcaagaagagt

SEQ ID NO: 425965 - DNA, 25 bp, Mus musculus
ctagctacggccaaaagactggtgg

SEQ ID NO: 425966 - DNA, 25 bp, Mus musculus
ctagctagtaaaattggcatgacac

SEQ ID NO: 425967 - DNA, 25 bp, Mus musculus
ctagctgaaggctcacgaagggtcg

SEQ ID NO: 425968 - DNA, 25 bp, Mus musculus
ctagctgagtcagagcctggattgg

SEQ ID NO: 425969 - DNA, 25 bp, Mus musculus
ctagctgagttatccacagggtaca

SEQ ID NO: 425970 - DNA, 25 bp, Mus musculus
ctagctgcagccaagtgtcggaacc

SEQ ID NO: 425971 - DNA, 25 bp, Mus musculus
ctagcttgacggactgcattgggac

SEQ ID NO: 425972 - DNA, 25 bp, Mus musculus
ctagcttgggccgagcagaaacaca

SEQ ID NO: 425973 - DNA, 25 bp, Mus musculus
ctaggaaaaggtcgagaaagtgctc

SEQ ID NO: 425974 - DNA, 25 bp, Mus musculus
ctaggaaagctggtgcagacagacc

SEQ ID NO: 425975 - DNA, 25 bp, Mus musculus
ctaggaactgtcgaaggtctggcca

SEQ ID NO: 425976 - DNA, 25 bp, Mus musculus
ctaggaatgccctgctatttcagca

SEQ ID NO: 425977 - DNA, 25 bp, Mus musculus
ctaggagcagttggccagtccgact

SEQ ID NO: 425978 - DNA, 25 bp, Mus musculus
ctaggagctccggttctgtcggagc

SEQ ID NO: 425979 - DNA, 25 bp, Mus musculus
ctaggagggccgaggaatagaaata

SEQ ID NO: 425980 - DNA, 25 bp, Mus musculus
ctaggagggtaaccatggcaactgt

SEQ ID NO: 425981 - DNA, 25 bp, Mus musculus
ctaggatgtgctgtagtaggaagac

SEQ ID NO: 425982 - DNA, 25 bp, Mus musculus
ctaggcagaggttgcagacttgcat

SEQ ID NO: 425983 - DNA, 25 bp, Mus musculus
ctaggcaggattcagtgtggatact

SEQ ID NO: 425984 - DNA, 25 bp, Mus musculus
ctaggcatcatcgacaagcaggaag

SEQ ID NO: 425985 - DNA, 25 bp, Mus musculus
ctaggccgacgctggcactgcaagg

SEQ ID NO: 425986 - DNA, 25 bp, Mus musculus
ctaggcggcagctgtaagaggcggc

SEQ ID NO: 425987 - DNA, 25 bp, Mus musculus
ctaggctctggtgtgatggaactca

SEQ ID NO: 425988 - DNA, 25 bp, Mus musculus
ctaggcttggacagcccacctttct

SEQ ID NO: 425989 - DNA, 25 bp, Mus musculus
ctagggacccagactgcagagaatg

SEQ ID NO: 425990 - DNA, 25 bp, Mus musculus
ctagggagaggccaactcggatacc

SEQ ID NO: 425991 - DNA, 25 bp, Mus musculus
ctagggatcgtgttgggactttgac

SEQ ID NO: 425992 - DNA, 25 bp, Mus musculus
ctagggcaacaagcagggtaggtcc

SEQ ID NO: 425993 - DNA, 25 bp, Mus musculus
ctagggcagcaggaaaagagcgatc

SEQ ID NO: 425994 - DNA, 25 bp, Mus musculus
ctagggcggcgattccaggtgcatc

SEQ ID NO: 425995 - DNA, 25 bp, Mus musculus
ctagggtgtttatctctgatgataa

SEQ ID NO: 425996 - DNA, 25 bp, Mus musculus
ctaggtgatttgacctgctggtgcc

SEQ ID NO: 425997 - DNA, 25 bp, Mus musculus
ctaggttaggagagcccagagcagc

SEQ ID NO: 425998 - DNA, 25 bp, Mus musculus
ctaggtttggttgggttctgagtct

SEQ ID NO: 425999 - DNA, 25 bp, Mus musculus
ctagtaagcttgagccgggaggccc

SEQ ID NO: 426000 - DNA, 25 bp, Mus musculus
ctagtactgacttataggagggtcc

SEQ ID NO: 426001 - DNA, 25 bp, Mus musculus
ctagtatcaacaggcacatacatgc

SEQ ID NO: 426002 - DNA, 25 bp, Mus musculus
ctagtctgtactcctcagagggtgg

SEQ ID NO: 426003 - DNA, 25 bp, Mus musculus
ctagtgctggcaggtgcaagcccaa

SEQ ID NO: 426004 - DNA, 25 bp, Mus musculus
ctagtggctggcttgtgggtaaccc

SEQ ID NO: 426005 - DNA, 25 bp, Mus musculus
ctagtgggtaaggaacgctgcctgc

SEQ ID NO: 426006 - DNA, 25 bp, Mus musculus
ctagtgtacataggccttaggctca

SEQ ID NO: 426007 - DNA, 25 bp, Mus musculus
ctagtgtatctatttcatcattgaa

SEQ ID NO: 426008 - DNA, 25 bp, Mus musculus
ctagtgtccgggaatcaggagatcc

SEQ ID NO: 426009 - DNA, 25 bp, Mus musculus
ctagttgtagattcagttcctctcc

SEQ ID NO: 426010 - DNA, 25 bp, Mus musculus
ctataactgggagggcgaatacttc

SEQ ID NO: 426011 - DNA, 25 bp, Mus musculus
ctataactttgtgctgctgccgcgg

SEQ ID NO: 426012 - DNA, 25 bp, Mus musculus
ctataagaggatcgtcaccaggccc

SEQ ID NO: 426013 - DNA, 25 bp, Mus musculus
ctataagatgatcgagtgggcccgc

SEQ ID NO: 426014 - DNA, 25 bp, Mus musculus
ctataaggatgaacagggcagactc

SEQ ID NO: 426015 - DNA, 25 bp, Mus musculus
ctataagtttatgccacaggtttac

SEQ ID NO: 426016 - DNA, 25 bp, Mus musculus
ctataatcccagagccggtggaggc

SEQ ID NO: 426017 - DNA, 25 bp, Mus musculus
ctatacaatgagttctgagccagcc

SEQ ID NO: 426018 - DNA, 25 bp, Mus musculus
ctatacctacagtattgtcatggtg

SEQ ID NO: 426019 - DNA, 25 bp, Mus musculus
ctatagaactacatgctgagggaca

SEQ ID NO: 426020 - DNA, 25 bp, Mus musculus
ctatagaagacaggcctggctccga

SEQ ID NO: 426021 - DNA, 25 bp, Mus musculus
ctatagagtactttccataagtggg

SEQ ID NO: 426022 - DNA, 25 bp, Mus musculus
ctatagatcctgtgcccctgtgtga

SEQ ID NO: 426023 - DNA, 25 bp, Mus musculus
ctatagcaactgtcatgaagaaagc

SEQ ID NO: 426024 - DNA, 25 bp, Mus musculus
ctatagccgacggttctggcaggga

SEQ ID NO: 426025 - DNA, 25 bp, Mus musculus
ctataggtaagactgtgaagtttaa

SEQ ID NO: 426026 - DNA, 25 bp, Mus musculus
ctatatagacccatacaagctgctg

SEQ ID NO: 426027 - DNA, 25 bp, Mus musculus
ctatatagcctagggaatggcacca

SEQ ID NO: 426028 - DNA, 25 bp, Mus musculus
ctatatccaatgtttgggtgctggg

SEQ ID NO: 426029 - DNA, 25 bp, Mus musculus
ctatattcagcaaaaaggctcaaaa

SEQ ID NO: 426030 - DNA, 25 bp, Mus musculus
ctatatttcccgagcactctctaaa

SEQ ID NO: 426031 - DNA, 25 bp, Mus musculus
ctatcaagagtgagatgaaaacgca

SEQ ID NO: 426032 - DNA, 25 bp, Mus musculus
ctatcagtagcgcatttaatcggtt

SEQ ID NO: 426033 - DNA, 25 bp, Mus musculus
ctatcatagagcctggcgggttcag

SEQ ID NO: 426034 - DNA, 25 bp, Mus musculus
ctatccagggaagatcaccgagggc

SEQ ID NO: 426035 - DNA, 25 bp, Mus musculus
ctatccatgaaaggcctggctggcg

SEQ ID NO: 426036 - DNA, 25 bp, Mus musculus
ctatcccagtggaaagagtgccccg

SEQ ID NO: 426037 - DNA, 25 bp, Mus musculus
ctatcctgagttgcaaaggactgaa

SEQ ID NO: 426038 - DNA, 25 bp, Mus musculus
ctatcggcgtgagtaaccagcggga

SEQ ID NO: 426039 - DNA, 25 bp, Mus musculus
ctatctcagaattggtttagaaatc

SEQ ID NO: 426040 - DNA, 25 bp, Mus musculus
ctatctctgctcgtgtgtttgggca

SEQ ID NO: 426041 - DNA, 25 bp, Mus musculus
ctatctgaatggtgaatatcgagcc

SEQ ID NO: 426042 - DNA, 25 bp, Mus musculus
ctatgaagaatggaggcgggaacac

SEQ ID NO: 426043 - DNA, 25 bp, Mus musculus
ctatgacaagaagggagattgccgc

SEQ ID NO: 426044 - DNA, 25 bp, Mus musculus
ctatgacacgtatgagaggccccgg

SEQ ID NO: 426045 - DNA, 25 bp, Mus musculus
ctatgacgagcatgaagggccagcc

SEQ ID NO: 426046 - DNA, 25 bp, Mus musculus
ctatgacgatgggtacggtactgcc

SEQ ID NO: 426047 - DNA, 25 bp, Mus musculus
ctatgacggcagactcagagctgaa

SEQ ID NO: 426048 - DNA, 25 bp, Mus musculus
ctatgacgtcatactaacacctgta

SEQ ID NO: 426049 - DNA, 25 bp, Mus musculus
ctatgagatggtatggccctgttca

SEQ ID NO: 426050 - DNA, 25 bp, Mus musculus
ctatgagcagcgctaccacagtggg

SEQ ID NO: 426051 - DNA, 25 bp, Mus musculus
ctatgagcgcgtaagcaagaggctg

SEQ ID NO: 426052 - DNA, 25 bp, Mus musculus
ctatgagggcgggaacaagtaccag

SEQ ID NO: 426053 - DNA, 25 bp, Mus musculus
ctatgatacgaagcccggtctttcc

SEQ ID NO: 426054 - DNA, 25 bp, Mus musculus
ctatgatctacggttgctgctggca

SEQ ID NO: 426055 - DNA, 25 bp, Mus musculus
ctatgatgagagatggcccatgtcc

SEQ ID NO: 426056 - DNA, 25 bp, Mus musculus
ctatgatgatgtccgaggccctgct

SEQ ID NO: 426057 - DNA, 25 bp, Mus musculus
ctatgatttgcctgctgagctagca

SEQ ID NO: 426058 - DNA, 25 bp, Mus musculus
ctatgcaacattgcgaagaggaccc

SEQ ID NO: 426059 - DNA, 25 bp, Mus musculus
ctatgctcagaggaaaggctacttt

SEQ ID NO: 426060 - DNA, 25 bp, Mus musculus
ctatgctctgtgtctcagggagctg

SEQ ID NO: 426061 - DNA, 25 bp, Mus musculus
ctatgctgcttggatgggactggca

SEQ ID NO: 426062 - DNA, 25 bp, Mus musculus
ctatggaaagttctagcaacagtga

SEQ ID NO: 426063 - DNA, 25 bp, Mus musculus
ctatggaacaaagtactggagccgg

SEQ ID NO: 426064 - DNA, 25 bp, Mus musculus
ctatggagcccaagctacatgtagt

SEQ ID NO: 426065 - DNA, 25 bp, Mus musculus
ctatggaggccgctgtaaaacccgg

SEQ ID NO: 426066 - DNA, 25 bp, Mus musculus
ctatggataactacaccgtggcccc

SEQ ID NO: 426067 - DNA, 25 bp, Mus musculus
ctatggatcagaaaagggtgcgcct

SEQ ID NO: 426068 - DNA, 25 bp, Mus musculus
ctatggccggattgagcgagaacac

SEQ ID NO: 426069 - DNA, 25 bp, Mus musculus
ctatggcgaaaatgctgcttgtccc

SEQ ID NO: 426070 - DNA, 25 bp, Mus musculus
ctatggctgccagggagaaattctc

SEQ ID NO: 426071 - DNA, 25 bp, Mus musculus
ctatggtcctgagcactgggtcaca

SEQ ID NO: 426072 - DNA, 25 bp, Mus musculus
ctatggtctcatggtcttgtcttgg

SEQ ID NO: 426073 - DNA, 25 bp, Mus musculus
ctatggtgcggaaacctgctgcggc

SEQ ID NO: 426074 - DNA, 25 bp, Mus musculus
ctatggttacaaaagctgggaagcc

SEQ ID NO: 426075 - DNA, 25 bp, Mus musculus
ctatggttcaggagggccaagcttg

SEQ ID NO: 426076 - DNA, 25 bp, Mus musculus
ctatgtacatgggaataatggctcc

SEQ ID NO: 426077 - DNA, 25 bp, Mus musculus
ctatgtatagatgtgcggccaggcc

SEQ ID NO: 426078 - DNA, 25 bp, Mus musculus
ctatgtggaccactttgccgccgag

SEQ ID NO: 426079 - DNA, 25 bp, Mus musculus
ctatgtggagggagtgcagaattcc

SEQ ID NO: 426080 - DNA, 25 bp, Mus musculus
ctatgtgtcacaccctgagcgttgg

SEQ ID NO: 426081 - DNA, 25 bp, Mus musculus
ctatgtgtgcggtgaagagcagccc

SEQ ID NO: 426082 - DNA, 25 bp, Mus musculus
ctatgttaactgttgcctctgtctc

SEQ ID NO: 426083 - DNA, 25 bp, Mus musculus
ctatgttcggcctcgggccgccaga

SEQ ID NO: 426084 - DNA, 25 bp, Mus musculus
ctatgttggaggttgtaagaatgcc

SEQ ID NO: 426085 - DNA, 25 bp, Mus musculus
ctatgttttagctgtgcccaccgca

SEQ ID NO: 426086 - DNA, 25 bp, Mus musculus
ctattacaagaacgctggcatcggt

SEQ ID NO: 426087 - DNA, 25 bp, Mus musculus
ctattagttcaagagccagatggac

SEQ ID NO: 426088 - DNA, 25 bp, Mus musculus
ctattattctagatcgaagactgga

SEQ ID NO: 426089 - DNA, 25 bp, Mus musculus
ctattccctggaagcaagaattaag

SEQ ID NO: 426090 - DNA, 25 bp, Mus musculus
ctattcgcagccgagcttcacggtg

SEQ ID NO: 426091 - DNA, 25 bp, Mus musculus
ctattgaaacatacaaaggtggacc

SEQ ID NO: 426092 - DNA, 25 bp, Mus musculus
ctattgaagtatagaatgggtccca

SEQ ID NO: 426093 - DNA, 25 bp, Mus musculus
ctattgatgcagtttagggtccaca

SEQ ID NO: 426094 - DNA, 25 bp, Mus musculus
ctattgggacccttgtgctcagcgt

SEQ ID NO: 426095 - DNA, 25 bp, Mus musculus
ctattgtggttctccacagctggaa

SEQ ID NO: 426096 - DNA, 25 bp, Mus musculus
ctattgtgtacagagccccatgggc

SEQ ID NO: 426097 - DNA, 25 bp, Mus musculus
ctatttaggaactgggtgacagaac

SEQ ID NO: 426098 - DNA, 25 bp, Mus musculus
ctattttacaaagggaggagcagac

SEQ ID NO: 426099 - DNA, 25 bp, Mus musculus
ctattttgctgacccatacttacgg

SEQ ID NO: 426100 - DNA, 25 bp, Mus musculus
ctatttttaggtatgggtgagagca

SEQ ID NO: 426101 - DNA, 25 bp, Mus musculus
ctcaaaaaagattctggttccagcc

SEQ ID NO: 426102 - DNA, 25 bp, Mus musculus
ctcaaaaggcttcggcggctctact

SEQ ID NO: 426103 - DNA, 25 bp, Mus musculus
ctcaaacttagggagagatcctcag

SEQ ID NO: 426104 - DNA, 25 bp, Mus musculus
ctcaaagtgattaaagtgggctgct

SEQ ID NO: 426105 - DNA, 25 bp, Mus musculus
ctcaaagtgtggtcattggtcaacc

SEQ ID NO: 426106 - DNA, 25 bp, Mus musculus
ctcaacgagggcacccggaggaaag

SEQ ID NO: 426107 - DNA, 25 bp, Mus musculus
ctcaagacagccttccgtggacggg

SEQ ID NO: 426108 - DNA, 25 bp, Mus musculus
ctcaagccagcctgcaccagatgag

SEQ ID NO: 426109 - DNA, 25 bp, Mus musculus
ctcaagctcttgtggatggcctaca

SEQ ID NO: 426110 - DNA, 25 bp, Mus musculus
ctcaagggaatctcacagctcggtg

SEQ ID NO: 426111 - DNA, 25 bp, Mus musculus
ctcaaggtggaacaggctataatct

SEQ ID NO: 426112 - DNA, 25 bp, Mus musculus
ctcaagtagagtggtgtcggagtac

SEQ ID NO: 426113 - DNA, 25 bp, Mus musculus
ctcaagtgctgtaggacagcaagac

SEQ ID NO: 426114 - DNA, 25 bp, Mus musculus
ctcaagttcttgtgccgcgagcgcg

SEQ ID NO: 426115 - DNA, 25 bp, Mus musculus
ctcaatagaaagtgacgaatttgac

SEQ ID NO: 426116 - DNA, 25 bp, Mus musculus
ctcaatagggcaacggaaggtatcc

SEQ ID NO: 426117 - DNA, 25 bp, Mus musculus
ctcacaaagacctgggccaagagcc

SEQ ID NO: 426118 - DNA, 25 bp, Mus musculus
ctcacaaagacgtcagagttggctt

SEQ ID NO: 426119 - DNA, 25 bp, Mus musculus
ctcacaaagctggaagaagcgagag

SEQ ID NO: 426120 - DNA, 25 bp, Mus musculus
ctcacaacatctataaaggaatctg

SEQ ID NO: 426121 - DNA, 25 bp, Mus musculus
ctcacagactaaatgcttatggtac

SEQ ID NO: 426122 - DNA, 25 bp, Mus musculus
ctcacagaggaaggctgtagctcca

SEQ ID NO: 426123 - DNA, 25 bp, Mus musculus
ctcacagaggagtccggatcagcac

SEQ ID NO: 426124 - DNA, 25 bp, Mus musculus
ctcaccaagagtacgtatgttataa

SEQ ID NO: 426125 - DNA, 25 bp, Mus musculus
ctcacccagagagcgggacatgggt

SEQ ID NO: 426126 - DNA, 25 bp, Mus musculus
ctcacccaggcagagcagggcttgg

SEQ ID NO: 426127 - DNA, 25 bp, Mus musculus
ctcaccgaggagtcacagagtgtgg

SEQ ID NO: 426128 - DNA, 25 bp, Mus musculus
ctcaccgagggcagggagaagttca

SEQ ID NO: 426129 - DNA, 25 bp, Mus musculus
ctcaccggaagttcggagccagagg

SEQ ID NO: 426130 - DNA, 25 bp, Mus musculus
ctcacctaaaactgcaagacatcca

SEQ ID NO: 426131 - DNA, 25 bp, Mus musculus
ctcacctccgcagagagtggggaca

SEQ ID NO: 426132 - DNA, 25 bp, Mus musculus
ctcacgctgtcgatggcggtggcca

SEQ ID NO: 426133 - DNA, 25 bp, Mus musculus
ctcacggtggaagctgagaactgac

SEQ ID NO: 426134 - DNA, 25 bp, Mus musculus
ctcacgtccatgtccgtggcggtgg

SEQ ID NO: 426135 - DNA, 25 bp, Mus musculus
ctcacgtggacattgcttgggctca

SEQ ID NO: 426136 - DNA, 25 bp, Mus musculus
ctcacgtgtggtgcgggcaatctgc

SEQ ID NO: 426137 - DNA, 25 bp, Mus musculus
ctcactcggtggcagcgcgcaaaga

SEQ ID NO: 426138 - DNA, 25 bp, Mus musculus
ctcactgcaggaaagtacagcattc

SEQ ID NO: 426139 - DNA, 25 bp, Mus musculus
ctcactggagataaagaaatgttgg

SEQ ID NO: 426140 - DNA, 25 bp, Mus musculus
ctcactgtaggcagcgcagggccca

SEQ ID NO: 426141 - DNA, 25 bp, Mus musculus
ctcactgtggatgggaggctctgcc

SEQ ID NO: 426142 - DNA, 25 bp, Mus musculus
ctcagaaaaggcgtccgggaacagt

SEQ ID NO: 426143 - DNA, 25 bp, Mus musculus
ctcagaaaaggctgggaacttaccg

SEQ ID NO: 426144 - DNA, 25 bp, Mus musculus
ctcagaaacctaaggagaggctatc

SEQ ID NO: 426145 - DNA, 25 bp, Mus musculus
ctcagaaagaaagacattactcagg

SEQ ID NO: 426146 - DNA, 25 bp, Mus musculus
ctcagaacattagagggtggcctgt

SEQ ID NO: 426147 - DNA, 25 bp, Mus musculus
ctcagaacgtgagctgggcggacct

SEQ ID NO: 426148 - DNA, 25 bp, Mus musculus
ctcagaagccgtcagctgtccacag

SEQ ID NO: 426149 - DNA, 25 bp, Mus musculus
ctcagaagtctaagcagccagcacg

SEQ ID NO: 426150 - DNA, 25 bp, Mus musculus
ctcagaagtggtgatcaagatgcct

SEQ ID NO: 426151 - DNA, 25 bp, Mus musculus
ctcagacagatggagagagtccttg

SEQ ID NO: 426152 - DNA, 25 bp, Mus musculus
ctcagagaagaaatgctggataccc

SEQ ID NO: 426153 - DNA, 25 bp, Mus musculus
ctcagagcagaaggctggcatggca

SEQ ID NO: 426154 - DNA, 25 bp, Mus musculus
ctcagagcagcaaagggtagcattt

SEQ ID NO: 426155 - DNA, 25 bp, Mus musculus
ctcagaggaaagtcatcgagcaatg

SEQ ID NO: 426156 - DNA, 25 bp, Mus musculus
ctcagaggcaacaggtgcaacggag

SEQ ID NO: 426157 - DNA, 25 bp, Mus musculus
ctcagagggaagcacagtagacatt

SEQ ID NO: 426158 - DNA, 25 bp, Mus musculus
ctcagagggaggaactaaaggcact

SEQ ID NO: 426159 - DNA, 25 bp, Mus musculus
ctcagaggtgcaggcatccaggtac

SEQ ID NO: 426160 - DNA, 25 bp, Mus musculus
ctcagaggtgctccgtgggcaaacc

SEQ ID NO: 426161 - DNA, 25 bp, Mus musculus
ctcagatggtagtaggagagaagca

SEQ ID NO: 426162 - DNA, 25 bp, Mus musculus
ctcagattcagactcagcttcaggg

SEQ ID NO: 426163 - DNA, 25 bp, Mus musculus
ctcagcaaccgctctaaagccattg

SEQ ID NO: 426164 - DNA, 25 bp, Mus musculus
ctcagcaccgcggagtcaggctaaa

SEQ ID NO: 426165 - DNA, 25 bp, Mus musculus
ctcagcacgtccgaggatgatgggt

SEQ ID NO: 426166 - DNA, 25 bp, Mus musculus
ctcagccctgcaacctcttttattt

SEQ ID NO: 426167 - DNA, 25 bp, Mus musculus
ctcagcctccaagggacatggcatt

SEQ ID NO: 426168 - DNA, 25 bp, Mus musculus
ctcagcctggaaggactgtgctgga

SEQ ID NO: 426169 - DNA, 25 bp, Mus musculus
ctcagcgtgactgtggaagaattct

SEQ ID NO: 426170 - DNA, 25 bp, Mus musculus
ctcagctttgagtagggacccagga

SEQ ID NO: 426171 - DNA, 25 bp, Mus musculus
ctcaggaagaagctcaagacggccc

SEQ ID NO: 426172 - DNA, 25 bp, Mus musculus
ctcaggagcaaaggcagatacatct

SEQ ID NO: 426173 - DNA, 25 bp, Mus musculus
ctcaggaggaccctcaaagtctgcc

SEQ ID NO: 426174 - DNA, 25 bp, Mus musculus
ctcaggaggctgaaactgaattgct

SEQ ID NO: 426175 - DNA, 25 bp, Mus musculus
ctcaggccaggtcctcagagaagaa

SEQ ID NO: 426176 - DNA, 25 bp, Mus musculus
ctcaggcgtgtagggagtaaatcta

SEQ ID NO: 426177 - DNA, 25 bp, Mus musculus
ctcaggctggtgctgaaggtcctaa

SEQ ID NO: 426178 - DNA, 25 bp, Mus musculus
ctcaggctgtgagtactggaactcc

SEQ ID NO: 426179 - DNA, 25 bp, Mus musculus
ctcaggctttgtgggccttgctaat

SEQ ID NO: 426180 - DNA, 25 bp, Mus musculus
ctcaggtggtctgtaagggcaagca

SEQ ID NO: 426181 - DNA, 25 bp, Mus musculus
ctcaggttaatccaggtaacacagc

SEQ ID NO: 426182 - DNA, 25 bp, Mus musculus
ctcagtatcatgtaggaatttaaaa

SEQ ID NO: 426183 - DNA, 25 bp, Mus musculus
ctcagtcgtaagctgacttctgctt

SEQ ID NO: 426184 - DNA, 25 bp, Mus musculus
ctcagtctcccgagtgccaggtttc

SEQ ID NO: 426185 - DNA, 25 bp, Mus musculus
ctcagtctgactggctgggaccgac

SEQ ID NO: 426186 - DNA, 25 bp, Mus musculus
ctcagtctgagggtagaaccggcca

SEQ ID NO: 426187 - DNA, 25 bp, Mus musculus
ctcagtgaacgtgcgggagaagccc

SEQ ID NO: 426188 - DNA, 25 bp, Mus musculus
ctcagtgactggtaagctgtggttc

SEQ ID NO: 426189 - DNA, 25 bp, Mus musculus
ctcagtgagatgacggaggccgaac

SEQ ID NO: 426190 - DNA, 25 bp, Mus musculus
ctcagtggatctgagtcctccatgt

SEQ ID NO: 426191 - DNA, 25 bp, Mus musculus
ctcagtggctgtggctggaccatga

SEQ ID NO: 426192 - DNA, 25 bp, Mus musculus
ctcagtgggcgagatggcctccaac

SEQ ID NO: 426193 - DNA, 25 bp, Mus musculus
ctcagtgtccagtgatttgctggga

SEQ ID NO: 426194 - DNA, 25 bp, Mus musculus
ctcagtgtttcatgttgtcataaaa

SEQ ID NO: 426195 - DNA, 25 bp, Mus musculus
ctcagttcatgaatggagccatagg

SEQ ID NO: 426196 - DNA, 25 bp, Mus musculus
ctcagttgcagagaggcattaatac

SEQ ID NO: 426197 - DNA, 25 bp, Mus musculus
ctcagttttccggacgcagcgcgga

SEQ ID NO: 426198 - DNA, 25 bp, Mus musculus
ctcatacgtatttgacttagtcaga

SEQ ID NO: 426199 - DNA, 25 bp, Mus musculus
ctcatcaaagtggagagcgcgagcg

SEQ ID NO: 426200 - DNA, 25 bp, Mus musculus
ctcatcacctttggcgagggcgtgg

SEQ ID NO: 426201 - DNA, 25 bp, Mus musculus
ctcatcatagttggccagaataggg

SEQ ID NO: 426202 - DNA, 25 bp, Mus musculus
ctcatcattataagacaagggtgcc

SEQ ID NO: 426203 - DNA, 25 bp, Mus musculus
ctcatcatttcaacgggctccaggg

SEQ ID NO: 426204 - DNA, 25 bp, Mus musculus
ctcatccagagtcacagcagcagtc

SEQ ID NO: 426205 - DNA, 25 bp, Mus musculus
ctcatccctcctggtgagcagcaga

SEQ ID NO: 426206 - DNA, 25 bp, Mus musculus
ctcatcgtgggttcaggtttcaaca

SEQ ID NO: 426207 - DNA, 25 bp, Mus musculus
ctcatcgttcgtggcgagggcctgc

SEQ ID NO: 426208 - DNA, 25 bp, Mus musculus
ctcatctaaggacagcagggaaact

SEQ ID NO: 426209 - DNA, 25 bp, Mus musculus
ctcatgaccatgtgcttcacttact

SEQ ID NO: 426210 - DNA, 25 bp, Mus musculus
ctcatgcagacattgagccccggaa

SEQ ID NO: 426211 - DNA, 25 bp, Mus musculus
ctcatgtgatccctagaaaagtctg

SEQ ID NO: 426212 - DNA, 25 bp, Mus musculus
ctcatgtggtatagtgtaataattc

SEQ ID NO: 426213 - DNA, 25 bp, Mus musculus
ctcattaagacaacgcaggccgctg

SEQ ID NO: 426214 - DNA, 25 bp, Mus musculus
ctcattaccttcagtgtgaacacaa

SEQ ID NO: 426215 - DNA, 25 bp, Mus musculus
ctcattagggctgggctgagagcac

SEQ ID NO: 426216 - DNA, 25 bp, Mus musculus
ctcattcaagtttgggatggagtcc

SEQ ID NO: 426217 - DNA, 25 bp, Mus musculus
ctcattggcaaggaagggcggaacc

SEQ ID NO: 426218 - DNA, 25 bp, Mus musculus
ctccaagcccaggtaaggagcgctg

SEQ ID NO: 426219 - DNA, 25 bp, Mus musculus
ctccaagtagcaaagtgtcagatcc

SEQ ID NO: 426220 - DNA, 25 bp, Mus musculus
ctccaattgtatttcaggttgcaac

SEQ ID NO: 426221 - DNA, 25 bp, Mus musculus
ctccacacaagacggctagtcattg

SEQ ID NO: 426222 - DNA, 25 bp, Mus musculus
ctccacagacggaagctgcacagtc

SEQ ID NO: 426223 - DNA, 25 bp, Mus musculus
ctccactcggtgacgcggagagctg

SEQ ID NO: 426224 - DNA, 25 bp, Mus musculus
ctccactgaagaatggcagttctta

SEQ ID NO: 426225 - DNA, 25 bp, Mus musculus
ctccactttcattcccttctaggga

SEQ ID NO: 426226 - DNA, 25 bp, Mus musculus
ctccagacacatggaaagatggtgc

SEQ ID NO: 426227 - DNA, 25 bp, Mus musculus
ctccagagaggatgttatagcagtc

SEQ ID NO: 426228 - DNA, 25 bp, Mus musculus
ctccagaggccgaagaattgcaaat

SEQ ID NO: 426229 - DNA, 25 bp, Mus musculus
ctccagatccaacggaagaactgta

SEQ ID NO: 426230 - DNA, 25 bp, Mus musculus
ctccagccaggcctgaccagggatt

SEQ ID NO: 426231 - DNA, 25 bp, Mus musculus
ctccagctccacagaatttaacaca

SEQ ID NO: 426232 - DNA, 25 bp, Mus musculus
ctccaggaagggagctctgcaccct

SEQ ID NO: 426233 - DNA, 25 bp, Mus musculus
ctccaggaatcaggcagtgggtccc

SEQ ID NO: 426234 - DNA, 25 bp, Mus musculus
ctccaggagagtcaaccggtgtcac

SEQ ID NO: 426235 - DNA, 25 bp, Mus musculus
ctccaggccagaggtgcctggtagt

SEQ ID NO: 426236 - DNA, 25 bp, Mus musculus
ctccaggccgaggacgcgatggctg

SEQ ID NO: 426237 - DNA, 25 bp, Mus musculus
ctccaggcggaggaggatcttgcct

SEQ ID NO: 426238 - DNA, 25 bp, Mus musculus
ctccaggctggcttcggcttgctaa

SEQ ID NO: 426239 - DNA, 25 bp, Mus musculus
ctccagggagcctcgccggcttgga

SEQ ID NO: 426240 - DNA, 25 bp, Mus musculus
ctccaggttcagtgcgagaccacac

SEQ ID NO: 426241 - DNA, 25 bp, Mus musculus
ctccagtcagaaagagggacccggg

SEQ ID NO: 426242 - DNA, 25 bp, Mus musculus
ctccagtgacactgatacccctggt

SEQ ID NO: 426243 - DNA, 25 bp, Mus musculus
ctccagttggagagagccgcagaaa

SEQ ID NO: 426244 - DNA, 25 bp, Mus musculus
ctccatcaggcttgggttgctcaca

SEQ ID NO: 426245 - DNA, 25 bp, Mus musculus
ctccatggcgattccagccgggaag

SEQ ID NO: 426246 - DNA, 25 bp, Mus musculus
ctccatggtcgtgagaggactttgg

SEQ ID NO: 426247 - DNA, 25 bp, Mus musculus
ctccattttatgaatgagaccagga

SEQ ID NO: 426248 - DNA, 25 bp, Mus musculus
ctcccagatatactgctctttcaca

SEQ ID NO: 426249 - DNA, 25 bp, Mus musculus
ctcccaggagtctgagcgtgtgcgt

SEQ ID NO: 426250 - DNA, 25 bp, Mus musculus
ctcccagttgggaaacagctaagca

SEQ ID NO: 426251 - DNA, 25 bp, Mus musculus
ctcccataggagaacagtatagtgt

SEQ ID NO: 426252 - DNA, 25 bp, Mus musculus
ctcccattcaaaagatgccgaaggg

SEQ ID NO: 426253 - DNA, 25 bp, Mus musculus
ctccccacagggtgatgctgagttc

SEQ ID NO: 426254 - DNA, 25 bp, Mus musculus
ctccccagagttagcacagacggtg

SEQ ID NO: 426255 - DNA, 25 bp, Mus musculus
ctccccagggctgcaaggattcggg

SEQ ID NO: 426256 - DNA, 25 bp, Mus musculus
ctcccctgggcttcagtgctgcgtg

SEQ ID NO: 426257 - DNA, 25 bp, Mus musculus
ctcccgaaggttctaggcttatact

SEQ ID NO: 426258 - DNA, 25 bp, Mus musculus
ctcccgagaaaacagccgctgacaa

SEQ ID NO: 426259 - DNA, 25 bp, Mus musculus
ctcccgagaaaagagtgagatcgtg

SEQ ID NO: 426260 - DNA, 25 bp, Mus musculus
ctcccgatggagattgaaagtggct

SEQ ID NO: 426261 - DNA, 25 bp, Mus musculus
ctcccgccacggagctaagtgggca

SEQ ID NO: 426262 - DNA, 25 bp, Mus musculus
ctcccgcctgttttactgcagaggg

SEQ ID NO: 426263 - DNA, 25 bp, Mus musculus
ctcccggagcccagggacagagctg

SEQ ID NO: 426264 - DNA, 25 bp, Mus musculus
ctcccgggtgttgtggaactaactg

SEQ ID NO: 426265 - DNA, 25 bp, Mus musculus
ctcccggtgcgagcgaggaggcggt

SEQ ID NO: 426266 - DNA, 25 bp, Mus musculus
ctccctcccatgtactgagatgaag

SEQ ID NO: 426267 - DNA, 25 bp, Mus musculus
ctccctccgggagagctagtacaag

SEQ ID NO: 426268 - DNA, 25 bp, Mus musculus
ctccctctaggagtccagtagtgct

SEQ ID NO: 426269 - DNA, 25 bp, Mus musculus
ctccctttgggatcctaagagaaca

SEQ ID NO: 426270 - DNA, 25 bp, Mus musculus
ctccgaaagggttttgctgagaaca

SEQ ID NO: 426271 - DNA, 25 bp, Mus musculus
ctccgaggcccaggtggacatctgt

SEQ ID NO: 426272 - DNA, 25 bp, Mus musculus
ctccgagtgggtacaagcaaataac

SEQ ID NO: 426273 - DNA, 25 bp, Mus musculus
ctccgcggaggaagaaaaatcgact

SEQ ID NO: 426274 - DNA, 25 bp, Mus musculus
ctccggaggagtacagccgccgagc

SEQ ID NO: 426275 - DNA, 25 bp, Mus musculus
ctccggatttcggaggcctgtacaa

SEQ ID NO: 426276 - DNA, 25 bp, Mus musculus
ctccgggcctccagaggaggtcgaa

SEQ ID NO: 426277 - DNA, 25 bp, Mus musculus
ctccgggctacaggctacagactta

SEQ ID NO: 426278 - DNA, 25 bp, Mus musculus
ctccgggcttggtgctccatgcgaa

SEQ ID NO: 426279 - DNA, 25 bp, Mus musculus
ctccgttatccttagtgttgtggtc

SEQ ID NO: 426280 - DNA, 25 bp, Mus musculus
ctcctaagcgcggaagctatgcctg

SEQ ID NO: 426281 - DNA, 25 bp, Mus musculus
ctcctatcagagtttgtttctaatg

SEQ ID NO: 426282 - DNA, 25 bp, Mus musculus
ctcctcctggacagtgacgagcggc

SEQ ID NO: 426283 - DNA, 25 bp, Mus musculus
ctcctcgtgtccacacatggtaaag

SEQ ID NO: 426284 - DNA, 25 bp, Mus musculus
ctcctctccttaaggcagcagaaca

SEQ ID NO: 426285 - DNA, 25 bp, Mus musculus
ctcctctgtactgcgcctggaggaa

SEQ ID NO: 426286 - DNA, 25 bp, Mus musculus
ctcctcttgacagagaactgaggcg

SEQ ID NO: 426287 - DNA, 25 bp, Mus musculus
ctcctgacttctatgaactgaactg

SEQ ID NO: 426288 - DNA, 25 bp, Mus musculus
ctcctgagcggagtcaacaagtact

SEQ ID NO: 426289 - DNA, 25 bp, Mus musculus
ctcctgatggtaatctagtgtaaca

SEQ ID NO: 426290 - DNA, 25 bp, Mus musculus
ctcctgccttgtacagacagggaaa

SEQ ID NO: 426291 - DNA, 25 bp, Mus musculus
ctcctgccttgtggatgggatgtga

SEQ ID NO: 426292 - DNA, 25 bp, Mus musculus
ctcctggaaatgtcgggcatgtgga

SEQ ID NO: 426293 - DNA, 25 bp, Mus musculus
ctcctggcgttctttgtaagtaact

SEQ ID NO: 426294 - DNA, 25 bp, Mus musculus
ctcctgggatcctgtaattctggca

SEQ ID NO: 426295 - DNA, 25 bp, Mus musculus
ctcctgggtatctggaagcatcact

SEQ ID NO: 426296 - DNA, 25 bp, Mus musculus
ctcctggtgaccatgacagaactgg

SEQ ID NO: 426297 - DNA, 25 bp, Mus musculus
ctcctgtgaaatgttctgcattctg

SEQ ID NO: 426298 - DNA, 25 bp, Mus musculus
ctcctgtgtgagtgttatctgtgaa

SEQ ID NO: 426299 - DNA, 25 bp, Mus musculus
ctccttagggttctgttttgacaca

SEQ ID NO: 426300 - DNA, 25 bp, Mus musculus
ctccttcggacagtttacagtgttc

SEQ ID NO: 426301 - DNA, 25 bp, Mus musculus
ctccttctaggcctataggttgcaa

SEQ ID NO: 426302 - DNA, 25 bp, Mus musculus
ctccttgcagttccgggaccctgag

SEQ ID NO: 426303 - DNA, 25 bp, Mus musculus
ctccttggtaatgagcttgcctagc

SEQ ID NO: 426304 - DNA, 25 bp, Mus musculus
ctccttgttttctagatgtctatac

SEQ ID NO: 426305 - DNA, 25 bp, Mus musculus
ctcctttgtcccttcctgtctgagg

SEQ ID NO: 426306 - DNA, 25 bp, Mus musculus
ctccttttggaagcctgaagcgtgg

SEQ ID NO: 426307 - DNA, 25 bp, Mus musculus
ctcctttttgcctgtttccagcgta

SEQ ID NO: 426308 - DNA, 25 bp, Mus musculus
ctcgaaccggaagtcgctgcagcgg

SEQ ID NO: 426309 - DNA, 25 bp, Mus musculus
ctcgagcggcagtcagagcaacaga

SEQ ID NO: 426310 - DNA, 25 bp, Mus musculus
ctcgaggaggactgcagagagccaa

SEQ ID NO: 426311 - DNA, 25 bp, Mus musculus
ctcgaggcgtggtggttttttgctt

SEQ ID NO: 426312 - DNA, 25 bp, Mus musculus
ctcgaggtgccggagtcggagccaa

SEQ ID NO: 426313 - DNA, 25 bp, Mus musculus
ctcgagtgaaggcattagcagcagt

SEQ ID NO: 426314 - DNA, 25 bp, Mus musculus
ctcgagttccgcttggtcactgtga

SEQ ID NO: 426315 - DNA, 25 bp, Mus musculus
ctcgcactagctacggactgctggg

SEQ ID NO: 426316 - DNA, 25 bp, Mus musculus
ctcgcaggtttcagacggtggccaa

SEQ ID NO: 426317 - DNA, 25 bp, Mus musculus
ctcgcgtaggattctgggagacgct

SEQ ID NO: 426318 - DNA, 25 bp, Mus musculus
ctcgctaaaaatggcggcgcccagt

SEQ ID NO: 426319 - DNA, 25 bp, Mus musculus
ctcgctgaataagacggtgggactc

SEQ ID NO: 426320 - DNA, 25 bp, Mus musculus
ctcgcttaggtctgaagcggctgct

SEQ ID NO: 426321 - DNA, 25 bp, Mus musculus
ctcgcttggagagggcagttttgaa

SEQ ID NO: 426322 - DNA, 25 bp, Mus musculus
ctcgcttttaccagtctactctaag

SEQ ID NO: 426323 - DNA, 25 bp, Mus musculus
ctcgctttttagaaaatgcagagtc

SEQ ID NO: 426324 - DNA, 25 bp, Mus musculus
ctcggaaccttttggcctacatggg

SEQ ID NO: 426325 - DNA, 25 bp, Mus musculus
ctcggaaggaggtgaatgatgtctt

SEQ ID NO: 426326 - DNA, 25 bp, Mus musculus
ctcggaagtcgaggacagtggctac

SEQ ID NO: 426327 - DNA, 25 bp, Mus musculus
ctcggaatggaagaagcatcgtgac

SEQ ID NO: 426328 - DNA, 25 bp, Mus musculus
ctcggacagtaccatcggcacagta

SEQ ID NO: 426329 - DNA, 25 bp, Mus musculus
ctcggaggcaagaacacaagggaca

SEQ ID NO: 426330 - DNA, 25 bp, Mus musculus
ctcggagtcacgttttggagagaca

SEQ ID NO: 426331 - DNA, 25 bp, Mus musculus
ctcggagtgccgcagcctgatccag

SEQ ID NO: 426332 - DNA, 25 bp, Mus musculus
ctcggatcccctctatcggtgcggg

SEQ ID NO: 426333 - DNA, 25 bp, Mus musculus
ctcggcacgagtttccaaggaacac

SEQ ID NO: 426334 - DNA, 25 bp, Mus musculus
ctcggcagggagagcttgagcgcga

SEQ ID NO: 426335 - DNA, 25 bp, Mus musculus
ctcggccctccgtgatgaaatggtt

SEQ ID NO: 426336 - DNA, 25 bp, Mus musculus
ctcggcttagcccacctacagggag

SEQ ID NO: 426337 - DNA, 25 bp, Mus musculus
ctcgggagacctgcctaagggaact

SEQ ID NO: 426338 - DNA, 25 bp, Mus musculus
ctcgggagcgaaggcggagccagcg

SEQ ID NO: 426339 - DNA, 25 bp, Mus musculus
ctcgggcatctcctgacgcagagtg

SEQ ID NO: 426340 - DNA, 25 bp, Mus musculus
ctcgggcgcgcccagtctaagattc

SEQ ID NO: 426341 - DNA, 25 bp, Mus musculus
ctcgggtggcgctgagctccctgct

SEQ ID NO: 426342 - DNA, 25 bp, Mus musculus
ctcgggtgggactctgcagctgctt

SEQ ID NO: 426343 - DNA, 25 bp, Mus musculus
ctcggtatgtgtgctgcctggcgct

SEQ ID NO: 426344 - DNA, 25 bp, Mus musculus
ctcggtcactggcatgctgtccaag

SEQ ID NO: 426345 - DNA, 25 bp, Mus musculus
ctcggtcagaggacgatgcggcttc

SEQ ID NO: 426346 - DNA, 25 bp, Mus musculus
ctcggtgttaaaaagcagtctaagg

SEQ ID NO: 426347 - DNA, 25 bp, Mus musculus
ctcggtttctgaggaacgctgaggt

SEQ ID NO: 426348 - DNA, 25 bp, Mus musculus
ctcgtatgttcctgttgatttgtgc

SEQ ID NO: 426349 - DNA, 25 bp, Mus musculus
ctcgtgcagggtacaagcaggacca

SEQ ID NO: 426350 - DNA, 25 bp, Mus musculus
ctcgtggctgaacccgaagcgcaag

SEQ ID NO: 426351 - DNA, 25 bp, Mus musculus
ctcgtgggctcctcaaagattgcag

SEQ ID NO: 426352 - DNA, 25 bp, Mus musculus
ctcgttcttgtagtgggtgcagcaa

SEQ ID NO: 426353 - DNA, 25 bp, Mus musculus
ctctaaagatctgtggtgtcctgtt

SEQ ID NO: 426354 - DNA, 25 bp, Mus musculus
ctctaactatttacactgatggctg

SEQ ID NO: 426355 - DNA, 25 bp, Mus musculus
ctctaacttctacagcgccgtgggt

SEQ ID NO: 426356 - DNA, 25 bp, Mus musculus
ctctaagcagcccaggtgagccttg

SEQ ID NO: 426357 - DNA, 25 bp, Mus musculus
ctctaagggcttgctgagtgaagca

SEQ ID NO: 426358 - DNA, 25 bp, Mus musculus
ctctaaggtaagagccctgccgcct

SEQ ID NO: 426359 - DNA, 25 bp, Mus musculus
ctctacagtgtctgtcccttgcact

SEQ ID NO: 426360 - DNA, 25 bp, Mus musculus
ctctactctgcctggcgaggactct

SEQ ID NO: 426361 - DNA, 25 bp, Mus musculus
ctctactctttattctctgctgaga

SEQ ID NO: 426362 - DNA, 25 bp, Mus musculus
ctctactgaatgactaccgagttcc

SEQ ID NO: 426363 - DNA, 25 bp, Mus musculus
ctctagaaaatggtggaaacgggat

SEQ ID NO: 426364 - DNA, 25 bp, Mus musculus
ctctagacctataagcagactcaag

SEQ ID NO: 426365 - DNA, 25 bp, Mus musculus
ctctagagtgccgtaggtgccacat

SEQ ID NO: 426366 - DNA, 25 bp, Mus musculus
ctctagcccatatgccccaatgtag

SEQ ID NO: 426367 - DNA, 25 bp, Mus musculus
ctctaggaagccagcacggtgagat

SEQ ID NO: 426368 - DNA, 25 bp, Mus musculus
ctctaggaggtaggtgaagatttca

SEQ ID NO: 426369 - DNA, 25 bp, Mus musculus
ctctagtgatgtgaaatagacatca

SEQ ID NO: 426370 - DNA, 25 bp, Mus musculus
ctctatctttctgaaagggctccca

SEQ ID NO: 426371 - DNA, 25 bp, Mus musculus
ctctatgaaaaacgagatcttatca

SEQ ID NO: 426372 - DNA, 25 bp, Mus musculus
ctctatggagttccgacaaatggtg

SEQ ID NO: 426373 - DNA, 25 bp, Mus musculus
ctctcaaatgaaacaagtgtcagtc

SEQ ID NO: 426374 - DNA, 25 bp, Mus musculus
ctctcaagggagacagcagcgtgtg

SEQ ID NO: 426375 - DNA, 25 bp, Mus musculus
ctctcacagccaaactcaggatttt

SEQ ID NO: 426376 - DNA, 25 bp, Mus musculus
ctctcacagtggtgggggccatgcc

SEQ ID NO: 426377 - DNA, 25 bp, Mus musculus
ctctcacatggaggttcgtccaggg

SEQ ID NO: 426378 - DNA, 25 bp, Mus musculus
ctctcacgtttctgccccatttggg

SEQ ID NO: 426379 - DNA, 25 bp, Mus musculus
ctctcagacacagcggcagctttga

SEQ ID NO: 426380 - DNA, 25 bp, Mus musculus
ctctcagggacgagtttgcattccg

SEQ ID NO: 426381 - DNA, 25 bp, Mus musculus
ctctcagggataggcacacagggct

SEQ ID NO: 426382 - DNA, 25 bp, Mus musculus
ctctcagggctcaccatgcgttggg

SEQ ID NO: 426383 - DNA, 25 bp, Mus musculus
ctctcaggtcacgtggcctggcaga

SEQ ID NO: 426384 - DNA, 25 bp, Mus musculus
ctctcatcaggtggctgggacacaa

SEQ ID NO: 426385 - DNA, 25 bp, Mus musculus
ctctcatcttgccaaggagtgctgg

SEQ ID NO: 426386 - DNA, 25 bp, Mus musculus
ctctcatctttgtgggaggatacca

SEQ ID NO: 426387 - DNA, 25 bp, Mus musculus
ctctcatgcaaatgtgccttcttag

SEQ ID NO: 426388 - DNA, 25 bp, Mus musculus
ctctcatttactggtggcgggcggc

SEQ ID NO: 426389 - DNA, 25 bp, Mus musculus
ctctccacctcatgaagccgttggt

SEQ ID NO: 426390 - DNA, 25 bp, Mus musculus
ctctccccaggtgggattgtgctca

SEQ ID NO: 426391 - DNA, 25 bp, Mus musculus
ctctccgcagggagcgagttcccgg

SEQ ID NO: 426392 - DNA, 25 bp, Mus musculus
ctctccgggattgtggtgggtgtcg

SEQ ID NO: 426393 - DNA, 25 bp, Mus musculus
ctctcctagaaccacttggaatgaa

SEQ ID NO: 426394 - DNA, 25 bp, Mus musculus
ctctcctggcaggatgaggcgtgca

SEQ ID NO: 426395 - DNA, 25 bp, Mus musculus
ctctcctggccttggcgggatcggc

SEQ ID NO: 426396 - DNA, 25 bp, Mus musculus
ctctcctgtcttttgattggaaaca

SEQ ID NO: 426397 - DNA, 25 bp, Mus musculus
ctctcgcgcctgtggatgctcagcg

SEQ ID NO: 426398 - DNA, 25 bp, Mus musculus
ctctcggaagagtttgatgatacac

SEQ ID NO: 426399 - DNA, 25 bp, Mus musculus
ctctcggagttcacagctggtcgca

SEQ ID NO: 426400 - DNA, 25 bp, Mus musculus
ctctcgggaggtcaagtcaattaca

SEQ ID NO: 426401 - DNA, 25 bp, Mus musculus
ctctcgggcgaaacgggctcttgta

SEQ ID NO: 426402 - DNA, 25 bp, Mus musculus
ctctcgggtacaaagagcgcgcggt

SEQ ID NO: 426403 - DNA, 25 bp, Mus musculus
ctctcggtgccctggaatgcttttc

SEQ ID NO: 426404 - DNA, 25 bp, Mus musculus
ctctctaataagcagagccttgctg

SEQ ID NO: 426405 - DNA, 25 bp, Mus musculus
ctctctcagtgctgaatcagcaact

SEQ ID NO: 426406 - DNA, 25 bp, Mus musculus
ctctctccgaggtgctgaacctgac

SEQ ID NO: 426407 - DNA, 25 bp, Mus musculus
ctctctctgagagtctgggacagga

SEQ ID NO: 426408 - DNA, 25 bp, Mus musculus
ctctctggaagtgagcaggcagcca

SEQ ID NO: 426409 - DNA, 25 bp, Mus musculus
ctctctggctgtagaggaccatggc

SEQ ID NO: 426410 - DNA, 25 bp, Mus musculus
ctctctggtgtagccaggaaagtaa

SEQ ID NO: 426411 - DNA, 25 bp, Mus musculus
ctctctgtaaataaagcctgttggt

SEQ ID NO: 426412 - DNA, 25 bp, Mus musculus
ctctctgtgacctcggtgtggccca

SEQ ID NO: 426413 - DNA, 25 bp, Mus musculus
ctctctgtgcgagcctaaacttaga

SEQ ID NO: 426414 - DNA, 25 bp, Mus musculus
ctctctgtggacaaagctgctggac

SEQ ID NO: 426415 - DNA, 25 bp, Mus musculus
ctctctgtgggtcaccagcagagga

SEQ ID NO: 426416 - DNA, 25 bp, Mus musculus
ctctcttagtaggaggtgcccacac

SEQ ID NO: 426417 - DNA, 25 bp, Mus musculus
ctctcttcagctctcacagcggatg

SEQ ID NO: 426418 - DNA, 25 bp, Mus musculus
ctctcttcaggcttcattggtgcta

SEQ ID NO: 426419 - DNA, 25 bp, Mus musculus
ctctcttggccttgggcatggtggt

SEQ ID NO: 426420 - DNA, 25 bp, Mus musculus
ctctcttgtcttcagcccgtggctg

SEQ ID NO: 426421 - DNA, 25 bp, Mus musculus
ctctgaaaaggtgtgtgctatgtac

SEQ ID NO: 426422 - DNA, 25 bp, Mus musculus
ctctgaaagaatgttgtgggcgctc

SEQ ID NO: 426423 - DNA, 25 bp, Mus musculus
ctctgaactgagtaagacggccgcg

SEQ ID NO: 426424 - DNA, 25 bp, Mus musculus
ctctgaagtgtcagaagggaattat

SEQ ID NO: 426425 - DNA, 25 bp, Mus musculus
ctctgagaactgaggaggcacccat

SEQ ID NO: 426426 - DNA, 25 bp, Mus musculus
ctctgagaatgaggacctgtgggca

SEQ ID NO: 426427 - DNA, 25 bp, Mus musculus
ctctgagatggaccctatatgtgga

SEQ ID NO: 426428 - DNA, 25 bp, Mus musculus
ctctgagctgcggagtgggaaccct

SEQ ID NO: 426429 - DNA, 25 bp, Mus musculus
ctctgagctgggacataaggaaggc

SEQ ID NO: 426430 - DNA, 25 bp, Mus musculus
ctctgaggcttggagaatacacacc

SEQ ID NO: 426431 - DNA, 25 bp, Mus musculus
ctctgagggtgccaatgtcggaata

SEQ ID NO: 426432 - DNA, 25 bp, Mus musculus
ctctgagtggcctgaagggtgacct

SEQ ID NO: 426433 - DNA, 25 bp, Mus musculus
ctctgagtgggttcacaggatacca

SEQ ID NO: 426434 - DNA, 25 bp, Mus musculus
ctctgatcaaaggtgggccatggga

SEQ ID NO: 426435 - DNA, 25 bp, Mus musculus
ctctgatcagggactgttccccgtt

SEQ ID NO: 426436 - DNA, 25 bp, Mus musculus
ctctgcaatgatccggctctgagga

SEQ ID NO: 426437 - DNA, 25 bp, Mus musculus
ctctgcacttagacatgtagagcac

SEQ ID NO: 426438 - DNA, 25 bp, Mus musculus
ctctgcagggctgaaggtcactcca

SEQ ID NO: 426439 - DNA, 25 bp, Mus musculus
ctctgcatggtggatattatttttc

SEQ ID NO: 426440 - DNA, 25 bp, Mus musculus
ctctgcatgtgacttctgaggtcta

SEQ ID NO: 426441 - DNA, 25 bp, Mus musculus
ctctgccaggaaagacacggttgta

SEQ ID NO: 426442 - DNA, 25 bp, Mus musculus
ctctgccagtacaagtgcagcgacg

SEQ ID NO: 426443 - DNA, 25 bp, Mus musculus
ctctgcgcgaggcttatggaaagca

SEQ ID NO: 426444 - DNA, 25 bp, Mus musculus
ctctgctcttccaggctggactgct

SEQ ID NO: 426445 - DNA, 25 bp, Mus musculus
ctctgctgagatgtgccgggaccta

SEQ ID NO: 426446 - DNA, 25 bp, Mus musculus
ctctgctgagggagaacttgtaccc

SEQ ID NO: 426447 - DNA, 25 bp, Mus musculus
ctctgctgcagatttgaggagtatc

SEQ ID NO: 426448 - DNA, 25 bp, Mus musculus
ctctgctggaggacttccgttcgga

SEQ ID NO: 426449 - DNA, 25 bp, Mus musculus
ctctgcttatgagacagcaacaact

SEQ ID NO: 426450 - DNA, 25 bp, Mus musculus
ctctggaaaattcccacgagcacag

SEQ ID NO: 426451 - DNA, 25 bp, Mus musculus
ctctggaaggcactggtaatgaata

SEQ ID NO: 426452 - DNA, 25 bp, Mus musculus
ctctggacacaaggctactggaaaa

SEQ ID NO: 426453 - DNA, 25 bp, Mus musculus
ctctggagatgagccggcaggaatc

SEQ ID NO: 426454 - DNA, 25 bp, Mus musculus
ctctggaggccatagtcatggaagg

SEQ ID NO: 426455 - DNA, 25 bp, Mus musculus
ctctggagtagagaaatggagactg

SEQ ID NO: 426456 - DNA, 25 bp, Mus musculus
ctctggagtcgagccctagaggagc

SEQ ID NO: 426457 - DNA, 25 bp, Mus musculus
ctctggcgacttggcagttttggga

SEQ ID NO: 426458 - DNA, 25 bp, Mus musculus
ctctggctatacaagtctgatggtc

SEQ ID NO: 426459 - DNA, 25 bp, Mus musculus
ctctggctggatggagaggccacat

SEQ ID NO: 426460 - DNA, 25 bp, Mus musculus
ctctggctgttgtcctggtttgtga

SEQ ID NO: 426461 - DNA, 25 bp, Mus musculus
ctctgggaagcaggcttactcaaga

SEQ ID NO: 426462 - DNA, 25 bp, Mus musculus
ctctgggaagtgctaccctgcgcct

SEQ ID NO: 426463 - DNA, 25 bp, Mus musculus
ctctgggacacttctgtacctgaga

SEQ ID NO: 426464 - DNA, 25 bp, Mus musculus
ctctgggatccggagcgaccaggac

SEQ ID NO: 426465 - DNA, 25 bp, Mus musculus
ctctgggccgttgcttagggtgtct

SEQ ID NO: 426466 - DNA, 25 bp, Mus musculus
ctctgggcgagctctgcatccgcgt

SEQ ID NO: 426467 - DNA, 25 bp, Mus musculus
ctctgggctcccagaagagctagtg

SEQ ID NO: 426468 - DNA, 25 bp, Mus musculus
ctctgggtaaaagagagatggtctc

SEQ ID NO: 426469 - DNA, 25 bp, Mus musculus
ctctgggtcgcgctggtcttcgaac

SEQ ID NO: 426470 - DNA, 25 bp, Mus musculus
ctctgggtggatttgcatggcgtca

SEQ ID NO: 426471 - DNA, 25 bp, Mus musculus
ctctgggtgggaaagtcatcactcc

SEQ ID NO: 426472 - DNA, 25 bp, Mus musculus
ctctggtctgagttagctggtgcct

SEQ ID NO: 426473 - DNA, 25 bp, Mus musculus
ctctggtgtctgaggagtgtgaacc

SEQ ID NO: 426474 - DNA, 25 bp, Mus musculus
ctctgtaaaactcagaagtttggtt

SEQ ID NO: 426475 - DNA, 25 bp, Mus musculus
ctctgtaccttcagcaggactccag

SEQ ID NO: 426476 - DNA, 25 bp, Mus musculus
ctctgtagatgctaaggcgggctct

SEQ ID NO: 426477 - DNA, 25 bp, Mus musculus
ctctgtagcttcttgggtggtgatg

SEQ ID NO: 426478 - DNA, 25 bp, Mus musculus
ctctgtcaaggcgggtaaggccaag

SEQ ID NO: 426479 - DNA, 25 bp, Mus musculus
ctctgtcctgccagccggagagaag

SEQ ID NO: 426480 - DNA, 25 bp, Mus musculus
ctctgtccttcctagttgcagggaa

SEQ ID NO: 426481 - DNA, 25 bp, Mus musculus
ctctgtgagagacttgggctgcaac

SEQ ID NO: 426482 - DNA, 25 bp, Mus musculus
ctctgtgctaccttggccgactggg

SEQ ID NO: 426483 - DNA, 25 bp, Mus musculus
ctctgtgctgcagtgatctgaatac

SEQ ID NO: 426484 - DNA, 25 bp, Mus musculus
ctctgtggtatgtttggaatttttc

SEQ ID NO: 426485 - DNA, 25 bp, Mus musculus
ctctgtggtttgagcaatgtctgaa

SEQ ID NO: 426486 - DNA, 25 bp, Mus musculus
ctctgtgtgcgctaggtgaccggta

SEQ ID NO: 426487 - DNA, 25 bp, Mus musculus
ctctgttccttgaggctcatgggcc

SEQ ID NO: 426488 - DNA, 25 bp, Mus musculus
ctctgttctttcaggaagtgtagca

SEQ ID NO: 426489 - DNA, 25 bp, Mus musculus
ctctgttgccgtggtgaaggttaat

SEQ ID NO: 426490 - DNA, 25 bp, Mus musculus
ctcttaatgagtgtgcgtgtgcttg

SEQ ID NO: 426491 - DNA, 25 bp, Mus musculus
ctcttacaaccacagacagattgag

SEQ ID NO: 426492 - DNA, 25 bp, Mus musculus
ctcttagacaacattcatgcccagg

SEQ ID NO: 426493 - DNA, 25 bp, Mus musculus
ctcttagctgatcaaagtcatcctg

SEQ ID NO: 426494 - DNA, 25 bp, Mus musculus
ctcttagggcacaaggagggactag

SEQ ID NO: 426495 - DNA, 25 bp, Mus musculus
ctcttcaggagagcgaatgaactgt

SEQ ID NO: 426496 - DNA, 25 bp, Mus musculus
ctcttcccaagcagccggagcggag

SEQ ID NO: 426497 - DNA, 25 bp, Mus musculus
ctcttcctcttctaatccaggttag

SEQ ID NO: 426498 - DNA, 25 bp, Mus musculus
ctcttcgctcggcaagctcaacaag

SEQ ID NO: 426499 - DNA, 25 bp, Mus musculus
ctcttctccatgattcttgtcgtct

SEQ ID NO: 426500 - DNA, 25 bp, Mus musculus
ctcttctccttgtaaacagatttgg

SEQ ID NO: 426501 - DNA, 25 bp, Mus musculus
ctcttctgatgtgtcagggacagtg

SEQ ID NO: 426502 - DNA, 25 bp, Mus musculus
ctcttgcagtggaaaggactggaca

SEQ ID NO: 426503 - DNA, 25 bp, Mus musculus
ctcttggagaggacctagtttttgt

SEQ ID NO: 426504 - DNA, 25 bp, Mus musculus
ctcttggtgggtacagggcaagtta

SEQ ID NO: 426505 - DNA, 25 bp, Mus musculus
ctcttgtagcaaatgggaacaaaca

SEQ ID NO: 426506 - DNA, 25 bp, Mus musculus
ctcttgtatctgtgacactgaggag

SEQ ID NO: 426507 - DNA, 25 bp, Mus musculus
ctcttgtgaagaagtcaggacatct

SEQ ID NO: 426508 - DNA, 25 bp, Mus musculus
ctctttagccgtgtgtgaagacatc

SEQ ID NO: 426509 - DNA, 25 bp, Mus musculus
ctctttctttgactggagtggacca

SEQ ID NO: 426510 - DNA, 25 bp, Mus musculus
ctctttggagggtccaggccttgtc

SEQ ID NO: 426511 - DNA, 25 bp, Mus musculus
ctctttggaggtacagggccagcga

SEQ ID NO: 426512 - DNA, 25 bp, Mus musculus
ctcttttcactgcttcataagaggg

SEQ ID NO: 426513 - DNA, 25 bp, Mus musculus
ctcttttcagttgcgcgtgcgtgcg

SEQ ID NO: 426514 - DNA, 25 bp, Mus musculus
ctcttttggaacttggagatgtttc

SEQ ID NO: 426515 - DNA, 25 bp, Mus musculus
ctgaaaaagtagaaggatccatgac

SEQ ID NO: 426516 - DNA, 25 bp, Mus musculus
ctgaaaagaaacagcttggtgcttg

SEQ ID NO: 426517 - DNA, 25 bp, Mus musculus
ctgaaaagggccaggggagtactct

SEQ ID NO: 426518 - DNA, 25 bp, Mus musculus
ctgaaactgagtgagtgctggccct

SEQ ID NO: 426519 - DNA, 25 bp, Mus musculus
ctgaaagtcaagacacaggctggca

SEQ ID NO: 426520 - DNA, 25 bp, Mus musculus
ctgaaagtccctccaagaaagttga

SEQ ID NO: 426521 - DNA, 25 bp, Mus musculus
ctgaaatagaggagctggaccggtc

SEQ ID NO: 426522 - DNA, 25 bp, Mus musculus
ctgaaatccgcgtcgagtgtaaggc

SEQ ID NO: 426523 - DNA, 25 bp, Mus musculus
ctgaaatgaacgttcctggcgcgcc

SEQ ID NO: 426524 - DNA, 25 bp, Mus musculus
ctgaacaagttactgagcggctgga

SEQ ID NO: 426525 - DNA, 25 bp, Mus musculus
ctgaacacaacagtagccccgggaa

SEQ ID NO: 426526 - DNA, 25 bp, Mus musculus
ctgaacacactgaacccaaaaccct

SEQ ID NO: 426527 - DNA, 25 bp, Mus musculus
ctgaacagaacgaacaagggcgacc

SEQ ID NO: 426528 - DNA, 25 bp, Mus musculus
ctgaaccagatgcaccgcttaggcc

SEQ ID NO: 426529 - DNA, 25 bp, Mus musculus
ctgaaccgcaacctgcgcgggctgt

SEQ ID NO: 426530 - DNA, 25 bp, Mus musculus
ctgaacctgaccctccactgcatcg

SEQ ID NO: 426531 - DNA, 25 bp, Mus musculus
ctgaacggtccccaagtctccaatt

SEQ ID NO: 426532 - DNA, 25 bp, Mus musculus
ctgaactatcaggagggtcctcgta

SEQ ID NO: 426533 - DNA, 25 bp, Mus musculus
ctgaagaaattgagtccccgagcgc

SEQ ID NO: 426534 - DNA, 25 bp, Mus musculus
ctgaagactgtaatatgcaaagcac

SEQ ID NO: 426535 - DNA, 25 bp, Mus musculus
ctgaagagaggaaagggaaagccaa

SEQ ID NO: 426536 - DNA, 25 bp, Mus musculus
ctgaagagcgtgatcccgtgccatt

SEQ ID NO: 426537 - DNA, 25 bp, Mus musculus
ctgaagaggagatcgaccgactgga

SEQ ID NO: 426538 - DNA, 25 bp, Mus musculus
ctgaagatacgtaccagcacgggcc

SEQ ID NO: 426539 - DNA, 25 bp, Mus musculus
ctgaagcagccagtttttgcctgtt

SEQ ID NO: 426540 - DNA, 25 bp, Mus musculus
ctgaagcatgctcttgtcgtgacct

SEQ ID NO: 426541 - DNA, 25 bp, Mus musculus
ctgaagcatttctggccagtgggaa

SEQ ID NO: 426542 - DNA, 25 bp, Mus musculus
ctgaagccttggaaacgacactggg

SEQ ID NO: 426543 - DNA, 25 bp, Mus musculus
ctgaagcttggaagatatttgcaca

SEQ ID NO: 426544 - DNA, 25 bp, Mus musculus
ctgaaggacttcttaccgcagccaa

SEQ ID NO: 426545 - DNA, 25 bp, Mus musculus
ctgaaggagacctattcccagctcg

SEQ ID NO: 426546 - DNA, 25 bp, Mus musculus
ctgaaggcagacaacatgatccgga

SEQ ID NO: 426547 - DNA, 25 bp, Mus musculus
ctgaaggccgtggttctgacctggc

SEQ ID NO: 426548 - DNA, 25 bp, Mus musculus
ctgaaggcgctctgggcactcgcag

SEQ ID NO: 426549 - DNA, 25 bp, Mus musculus
ctgaaggcttgacacatcccgagga

SEQ ID NO: 426550 - DNA, 25 bp, Mus musculus
ctgaagggactgagggattttcgcc

SEQ ID NO: 426551 - DNA, 25 bp, Mus musculus
ctgaagtaccgagtttgcttagctg

SEQ ID NO: 426552 - DNA, 25 bp, Mus musculus
ctgaagtggaacaggaccgagtgcc

SEQ ID NO: 426553 - DNA, 25 bp, Mus musculus
ctgaataaacctggagagccccggg

SEQ ID NO: 426554 - DNA, 25 bp, Mus musculus
ctgaataatggagccggctgccgct

SEQ ID NO: 426555 - DNA, 25 bp, Mus musculus
ctgaatcgtcaaaaagccaaaagtg

SEQ ID NO: 426556 - DNA, 25 bp, Mus musculus
ctgaatgatgcaaaggcaagggacc

SEQ ID NO: 426557 - DNA, 25 bp, Mus musculus
ctgaatgcaagcttgatggacggcg

SEQ ID NO: 426558 - DNA, 25 bp, Mus musculus
ctgaattccggccagtgagcaggac

SEQ ID NO: 426559 - DNA, 25 bp, Mus musculus
ctgaattcttttcatactcaagagg

SEQ ID NO: 426560 - DNA, 25 bp, Mus musculus
ctgaattttctctgttcggcatgaa

SEQ ID NO: 426561 - DNA, 25 bp, Mus musculus
ctgacaaggtagaagctgcacgggc

SEQ ID NO: 426562 - DNA, 25 bp, Mus musculus
ctgacaccaggttgtgttctttgcc

SEQ ID NO: 426563 - DNA, 25 bp, Mus musculus
ctgacagcagatttgtgtaacctgc

SEQ ID NO: 426564 - DNA, 25 bp, Mus musculus
ctgacagctctgcattagtgggaaa

SEQ ID NO: 426565 - DNA, 25 bp, Mus musculus
ctgacagtagaagaattgaaggcct

SEQ ID NO: 426566 - DNA, 25 bp, Mus musculus
ctgacatttcccttgaccgagagga

SEQ ID NO: 426567 - DNA, 25 bp, Mus musculus
ctgaccaatagtagtccggcgcggg

SEQ ID NO: 426568 - DNA, 25 bp, Mus musculus
ctgacccagcctctcagggacacta

SEQ ID NO: 426569 - DNA, 25 bp, Mus musculus
ctgaccccagccagcgtagacagtt

SEQ ID NO: 426570 - DNA, 25 bp, Mus musculus
ctgaccccgagaagatacccagctt

SEQ ID NO: 426571 - DNA, 25 bp, Mus musculus
ctgaccggatgggaatcgctaaagg

SEQ ID NO: 426572 - DNA, 25 bp, Mus musculus
ctgacctgatgggactgggccttgc

SEQ ID NO: 426573 - DNA, 25 bp, Mus musculus
ctgaccttgaactgctaaaggagct

SEQ ID NO: 426574 - DNA, 25 bp, Mus musculus
ctgaccttgtgtttggtgctgctcg

SEQ ID NO: 426575 - DNA, 25 bp, Mus musculus
ctgacgaaccaggaggataccgacg

SEQ ID NO: 426576 - DNA, 25 bp, Mus musculus
ctgacgaagacgacgaccgggatgt

SEQ ID NO: 426577 - DNA, 25 bp, Mus musculus
ctgacgatcctccaggtccctgaat

SEQ ID NO: 426578 - DNA, 25 bp, Mus musculus
ctgacgctgagtgttggccaattcc

SEQ ID NO: 426579 - DNA, 25 bp, Mus musculus
ctgacgggcaacactctgagggaag

SEQ ID NO: 426580 - DNA, 25 bp, Mus musculus
ctgacggttcctcagtgggcccaag

SEQ ID NO: 426581 - DNA, 25 bp, Mus musculus
ctgactctgcatctggaaacacata

SEQ ID NO: 426582 - DNA, 25 bp, Mus musculus
ctgactcttgactcttgtttttctt

SEQ ID NO: 426583 - DNA, 25 bp, Mus musculus
ctgactgaagctcggatgggtcccc

SEQ ID NO: 426584 - DNA, 25 bp, Mus musculus
ctgactgagcggtgtgtgccctaca

SEQ ID NO: 426585 - DNA, 25 bp, Mus musculus
ctgacttcataaaccgcgggctgcc

SEQ ID NO: 426586 - DNA, 25 bp, Mus musculus
ctgacttgaatgcagcaaaaagttg

SEQ ID NO: 426587 - DNA, 25 bp, Mus musculus
ctgactttcactggcgcttagggac

SEQ ID NO: 426588 - DNA, 25 bp, Mus musculus
ctgagaaacaagagcccgtgacgga

SEQ ID NO: 426589 - DNA, 25 bp, Mus musculus
ctgagaacctgggccagggagacaa

SEQ ID NO: 426590 - DNA, 25 bp, Mus musculus
ctgagaactcagaaggaacgggact

SEQ ID NO: 426591 - DNA, 25 bp, Mus musculus
ctgagaagctaataagcagcactcc

SEQ ID NO: 426592 - DNA, 25 bp, Mus musculus
ctgagaatttattccccaaagagtc

SEQ ID NO: 426593 - DNA, 25 bp, Mus musculus
ctgagacaggaaagtgttaccatac

SEQ ID NO: 426594 - DNA, 25 bp, Mus musculus
ctgagacagggatggcaagtgctct

SEQ ID NO: 426595 - DNA, 25 bp, Mus musculus
ctgagacatctctgcagcccggcag

SEQ ID NO: 426596 - DNA, 25 bp, Mus musculus
ctgagactttagagccaaggcctgg

SEQ ID NO: 426597 - DNA, 25 bp, Mus musculus
ctgagagaggtagaactgaaaatcg

SEQ ID NO: 426598 - DNA, 25 bp, Mus musculus
ctgagagcccgcatggagagcactt

SEQ ID NO: 426599 - DNA, 25 bp, Mus musculus
ctgagagcgcctggtacacagggaa

SEQ ID NO: 426600 - DNA, 25 bp, Mus musculus
ctgagaggcagagagccgggaatcc

SEQ ID NO: 426601 - DNA, 25 bp, Mus musculus
ctgagaggcttaactaaatgggacc

SEQ ID NO: 426602 - DNA, 25 bp, Mus musculus
ctgagagtcagaaggcatggaagcc

SEQ ID NO: 426603 - DNA, 25 bp, Mus musculus
ctgagagttgagaccggttggaact

SEQ ID NO: 426604 - DNA, 25 bp, Mus musculus
ctgagataaggaaagcagccactgc

SEQ ID NO: 426605 - DNA, 25 bp, Mus musculus
ctgagataatttccaagcgatcaaa

SEQ ID NO: 426606 - DNA, 25 bp, Mus musculus
ctgagatccttcgaggtaagagtcc

SEQ ID NO: 426607 - DNA, 25 bp, Mus musculus
ctgagattacagagccaggctgtcc

SEQ ID NO: 426608 - DNA, 25 bp, Mus musculus
ctgagattgccaccggttctgcgcg

SEQ ID NO: 426609 - DNA, 25 bp, Mus musculus
ctgagattgccctgggaaggtccgt

SEQ ID NO: 426610 - DNA, 25 bp, Mus musculus
ctgagcaaaggtctgaagcgcaagc

SEQ ID NO: 426611 - DNA, 25 bp, Mus musculus
ctgagcacgcagaaagtgtgtgatc

SEQ ID NO: 426612 - DNA, 25 bp, Mus musculus
ctgagcagatggcacaatatgaaac

SEQ ID NO: 426613 - DNA, 25 bp, Mus musculus
ctgagcagctatggctgcggcgata

SEQ ID NO: 426614 - DNA, 25 bp, Mus musculus
ctgagcatcaaggaagagcatttgc

SEQ ID NO: 426615 - DNA, 25 bp, Mus musculus
ctgagcatgtattcctgtgtctggt

SEQ ID NO: 426616 - DNA, 25 bp, Mus musculus
ctgagccagagctcgtggacctgct

SEQ ID NO: 426617 - DNA, 25 bp, Mus musculus
ctgagccaggccatgaaactgccca

SEQ ID NO: 426618 - DNA, 25 bp, Mus musculus
ctgagccgagaacccttgcgcgatg

SEQ ID NO: 426619 - DNA, 25 bp, Mus musculus
ctgagccggaagatgagccctccaa

SEQ ID NO: 426620 - DNA, 25 bp, Mus musculus
ctgagccggaatgcacaagtgctgg

SEQ ID NO: 426621 - DNA, 25 bp, Mus musculus
ctgagcctgggctcaccggctgatc

SEQ ID NO: 426622 - DNA, 25 bp, Mus musculus
ctgagcgagctgagaaccgaggaca

SEQ ID NO: 426623 - DNA, 25 bp, Mus musculus
ctgagcgccggcaaccgcgacaagg

SEQ ID NO: 426624 - DNA, 25 bp, Mus musculus
ctgagcgctcagagtccgagacgga

SEQ ID NO: 426625 - DNA, 25 bp, Mus musculus
ctgagctcagctgtcccctgtggga

SEQ ID NO: 426626 - DNA, 25 bp, Mus musculus
ctgagctgctggagaacacactgga

SEQ ID NO: 426627 - DNA, 25 bp, Mus musculus
ctgaggaagcgaagatgccccaact

SEQ ID NO: 426628 - DNA, 25 bp, Mus musculus
ctgaggacctgcgactagactgacc

SEQ ID NO: 426629 - DNA, 25 bp, Mus musculus
ctgaggactgcaggctaatgcttga

SEQ ID NO: 426630 - DNA, 25 bp, Mus musculus
ctgaggaggcctctgaacagtccgc

SEQ ID NO: 426631 - DNA, 25 bp, Mus musculus
ctgaggaggtatccacatggccctt

SEQ ID NO: 426632 - DNA, 25 bp, Mus musculus
ctgaggatcaaggactagtactgac

SEQ ID NO: 426633 - DNA, 25 bp, Mus musculus
ctgaggatcagcaggcgcgtgtcct

SEQ ID NO: 426634 - DNA, 25 bp, Mus musculus
ctgaggcacgtgatgaccaagctgg

SEQ ID NO: 426635 - DNA, 25 bp, Mus musculus
ctgaggcagcaactttacccagagg

SEQ ID NO: 426636 - DNA, 25 bp, Mus musculus
ctgaggcttgtgtacatagtgtatt

SEQ ID NO: 426637 - DNA, 25 bp, Mus musculus
ctgagggaccacagcgctccatcgg

SEQ ID NO: 426638 - DNA, 25 bp, Mus musculus
ctgaggtctacaaaacggcacgggc

SEQ ID NO: 426639 - DNA, 25 bp, Mus musculus
ctgaggtctattgcagagaggtgac

SEQ ID NO: 426640 - DNA, 25 bp, Mus musculus
ctgaggtggccacaccccggcaggg

SEQ ID NO: 426641 - DNA, 25 bp, Mus musculus
ctgaggtggccctgtagggattacc

SEQ ID NO: 426642 - DNA, 25 bp, Mus musculus
ctgagtagcagctgccccatagtat

SEQ ID NO: 426643 - DNA, 25 bp, Mus musculus
ctgagtccactgcagcaagccgtga

SEQ ID NO: 426644 - DNA, 25 bp, Mus musculus
ctgagtccttacctgtttcgggcga

SEQ ID NO: 426645 - DNA, 25 bp, Mus musculus
ctgagtgagtgtgcctggactcagt

SEQ ID NO: 426646 - DNA, 25 bp, Mus musculus
ctgagttaatgaatgaaggattatc

SEQ ID NO: 426647 - DNA, 25 bp, Mus musculus
ctgagttccttgtggcgttagctga

SEQ ID NO: 426648 - DNA, 25 bp, Mus musculus
ctgagttcttcgtgagtgactgggc

SEQ ID NO: 426649 - DNA, 25 bp, Mus musculus
ctgatagatattactcgagagggcc

SEQ ID NO: 426650 - DNA, 25 bp, Mus musculus
ctgataggtcccacgtcagggaagg

SEQ ID NO: 426651 - DNA, 25 bp, Mus musculus
ctgatagtcccagggaacgcgcaat

SEQ ID NO: 426652 - DNA, 25 bp, Mus musculus
ctgatatctgtagacacttgaggac

SEQ ID NO: 426653 - DNA, 25 bp, Mus musculus
ctgatatgcggaagaataatttgcc

SEQ ID NO: 426654 - DNA, 25 bp, Mus musculus
ctgatcacaggctgaatgaagccaa

SEQ ID NO: 426655 - DNA, 25 bp, Mus musculus
ctgatcagctttgctaaaagttagt

SEQ ID NO: 426656 - DNA, 25 bp, Mus musculus
ctgatcccaggagcgtactgggcaa

SEQ ID NO: 426657 - DNA, 25 bp, Mus musculus
ctgatctgaacaggcgagccaacgg

SEQ ID NO: 426658 - DNA, 25 bp, Mus musculus
ctgatcttaactcggtggtgcctga

SEQ ID NO: 426659 - DNA, 25 bp, Mus musculus
ctgatgacactcacacactcttact

SEQ ID NO: 426660 - DNA, 25 bp, Mus musculus
ctgatgagaacgctgactggaaact

SEQ ID NO: 426661 - DNA, 25 bp, Mus musculus
ctgatgagacagtgagtggagaact

SEQ ID NO: 426662 - DNA, 25 bp, Mus musculus
ctgatgaggcatctgttttagagac

SEQ ID NO: 426663 - DNA, 25 bp, Mus musculus
ctgatggaacgcgatagacgtatct

SEQ ID NO: 426664 - DNA, 25 bp, Mus musculus
ctgatggactgcatggtatggagta

SEQ ID NO: 426665 - DNA, 25 bp, Mus musculus
ctgatggagaatactaagaaggccc

SEQ ID NO: 426666 - DNA, 25 bp, Mus musculus
ctgatggagacaaaggcacgaaagt

SEQ ID NO: 426667 - DNA, 25 bp, Mus musculus
ctgatggagtgcacagcggaacacc

SEQ ID NO: 426668 - DNA, 25 bp, Mus musculus
ctgatggagtgcctttgtacccgcc

SEQ ID NO: 426669 - DNA, 25 bp, Mus musculus
ctgatgggagatgccgctcatgcca

SEQ ID NO: 426670 - DNA, 25 bp, Mus musculus
ctgatgtcgaggtccccaggaaacc

SEQ ID NO: 426671 - DNA, 25 bp, Mus musculus
ctgatgtgaaacctcgaagccaccc

SEQ ID NO: 426672 - DNA, 25 bp, Mus musculus
ctgatgtgcggctgcggagatctct

SEQ ID NO: 426673 - DNA, 25 bp, Mus musculus
ctgatgttgctgagaggagtaccct

SEQ ID NO: 426674 - DNA, 25 bp, Mus musculus
ctgatgtttgtgaagaacttagtaa

SEQ ID NO: 426675 - DNA, 25 bp, Mus musculus
ctgattagcgagattgagtaccggc

SEQ ID NO: 426676 - DNA, 25 bp, Mus musculus
ctgattcagggtttgaacacaggac

SEQ ID NO: 426677 - DNA, 25 bp, Mus musculus
ctgattgaagcagggttacagaggc

SEQ ID NO: 426678 - DNA, 25 bp, Mus musculus
ctgatttagcattgttacttactgg

SEQ ID NO: 426679 - DNA, 25 bp, Mus musculus
ctgatttcacaatatcgtggcagag

SEQ ID NO: 426680 - DNA, 25 bp, Mus musculus
ctgattttagaagaagctgaaaagc

SEQ ID NO: 426681 - DNA, 25 bp, Mus musculus
ctgcaacagtgtgagtgagagctct

SEQ ID NO: 426682 - DNA, 25 bp, Mus musculus
ctgcaacgctcacacgatcatcggg

SEQ ID NO: 426683 - DNA, 25 bp, Mus musculus
ctgcaacttcagcatccccgaggaa

SEQ ID NO: 426684 - DNA, 25 bp, Mus musculus
ctgcaagacggacttcctcttactg

SEQ ID NO: 426685 - DNA, 25 bp, Mus musculus
ctgcacaaggactgtggcttccggg

SEQ ID NO: 426686 - DNA, 25 bp, Mus musculus
ctgcacactcaaaagcaagtgccaa

SEQ ID NO: 426687 - DNA, 25 bp, Mus musculus
ctgcacatattttcagttgcaagaa

SEQ ID NO: 426688 - DNA, 25 bp, Mus musculus
ctgcaccttgcctgtagccagctct

SEQ ID NO: 426689 - DNA, 25 bp, Mus musculus
ctgcacgctcccaggccaagaaaga

SEQ ID NO: 426690 - DNA, 25 bp, Mus musculus
ctgcactagtgcaccaagaggctgc

SEQ ID NO: 426691 - DNA, 25 bp, Mus musculus
ctgcactggagaaagatggtactga

SEQ ID NO: 426692 - DNA, 25 bp, Mus musculus
ctgcactggtgcttttgccagccca

SEQ ID NO: 426693 - DNA, 25 bp, Mus musculus
ctgcacttagcagccagggaattgg

SEQ ID NO: 426694 - DNA, 25 bp, Mus musculus
ctgcagacatggtagtgttcctggg

SEQ ID NO: 426695 - DNA, 25 bp, Mus musculus
ctgcagagggcaggacacaagaaaa

SEQ ID NO: 426696 - DNA, 25 bp, Mus musculus
ctgcagatgcttgggagccaccgta

SEQ ID NO: 426697 - DNA, 25 bp, Mus musculus
ctgcagcactacttccctcgggaat

SEQ ID NO: 426698 - DNA, 25 bp, Mus musculus
ctgcagcagtcaagcggcctctctt

SEQ ID NO: 426699 - DNA, 25 bp, Mus musculus
ctgcagcagtgaaaggagatgttgt

SEQ ID NO: 426700 - DNA, 25 bp, Mus musculus
ctgcagcatgcagggtttaagataa

SEQ ID NO: 426701 - DNA, 25 bp, Mus musculus
ctgcagccatgaagagcctcggtct

SEQ ID NO: 426702 - DNA, 25 bp, Mus musculus
ctgcagccctcggtttctctccaag

SEQ ID NO: 426703 - DNA, 25 bp, Mus musculus
ctgcagcggcagaagtgaaccttgt

SEQ ID NO: 426704 - DNA, 25 bp, Mus musculus
ctgcagctgccgaggaaaagcgtcc

SEQ ID NO: 426705 - DNA, 25 bp, Mus musculus
ctgcaggaattaactgaagaggatc

SEQ ID NO: 426706 - DNA, 25 bp, Mus musculus
ctgcaggagggaaaggtattcctct

SEQ ID NO: 426707 - DNA, 25 bp, Mus musculus
ctgcaggagggcgacattcaggtct

SEQ ID NO: 426708 - DNA, 25 bp, Mus musculus
ctgcaggcagcgaggccaaaactcg

SEQ ID NO: 426709 - DNA, 25 bp, Mus musculus
ctgcaggccaagaggcagcggatcc

SEQ ID NO: 426710 - DNA, 25 bp, Mus musculus
ctgcaggcgcagtggaaggcccaca

SEQ ID NO: 426711 - DNA, 25 bp, Mus musculus
ctgcagggccagttttgaagttatg

SEQ ID NO: 426712 - DNA, 25 bp, Mus musculus
ctgcagtaggtagggcttatttgcc

SEQ ID NO: 426713 - DNA, 25 bp, Mus musculus
ctgcagtgatgcctccatggtctac

SEQ ID NO: 426714 - DNA, 25 bp, Mus musculus
ctgcagttccgggagcaggaggtgc

SEQ ID NO: 426715 - DNA, 25 bp, Mus musculus
ctgcatagagggagctagccctggc

SEQ ID NO: 426716 - DNA, 25 bp, Mus musculus
ctgcatatggtagtgtgagtttgtc

SEQ ID NO: 426717 - DNA, 25 bp, Mus musculus
ctgcatcaccctctgatatgttggg

SEQ ID NO: 426718 - DNA, 25 bp, Mus musculus
ctgcatcatgattgtgggagctact

SEQ ID NO: 426719 - DNA, 25 bp, Mus musculus
ctgcatcgcagcctcttgctggaac

SEQ ID NO: 426720 - DNA, 25 bp, Mus musculus
ctgcatctgtaagtatgaactgtca

SEQ ID NO: 426721 - DNA, 25 bp, Mus musculus
ctgcatctgtgaaggaaattatttc

SEQ ID NO: 426722 - DNA, 25 bp, Mus musculus
ctgcatgcctgggaaagtgaggtca

SEQ ID NO: 426723 - DNA, 25 bp, Mus musculus
ctgcatggtatggagtaaagtaggc

SEQ ID NO: 426724 - DNA, 25 bp, Mus musculus
ctgcatgtggctgcgctccaggtca

SEQ ID NO: 426725 - DNA, 25 bp, Mus musculus
ctgccaaagtggctgcgtctgactg

SEQ ID NO: 426726 - DNA, 25 bp, Mus musculus
ctgccaacattctcttcagtgctgg

SEQ ID NO: 426727 - DNA, 25 bp, Mus musculus
ctgccaagagagtatcggaaccgct

SEQ ID NO: 426728 - DNA, 25 bp, Mus musculus
ctgccacaagaaaacgtcagctgtt

SEQ ID NO: 426729 - DNA, 25 bp, Mus musculus
ctgccacagttaagacgaagatttt

SEQ ID NO: 426730 - DNA, 25 bp, Mus musculus
ctgccacctagctacctgggacctg

SEQ ID NO: 426731 - DNA, 25 bp, Mus musculus
ctgccaggccgtgggacttgaaagt

SEQ ID NO: 426732 - DNA, 25 bp, Mus musculus
ctgccattgaaggtacggcgcacgg

SEQ ID NO: 426733 - DNA, 25 bp, Mus musculus
ctgcccaaggactgtgactctggga

SEQ ID NO: 426734 - DNA, 25 bp, Mus musculus
ctgcccacgaaggagtcaaaactgg

SEQ ID NO: 426735 - DNA, 25 bp, Mus musculus
ctgccccgccagcaacaattggtgg

SEQ ID NO: 426736 - DNA, 25 bp, Mus musculus
ctgccccggccgctaaggtgtattt

SEQ ID NO: 426737 - DNA, 25 bp, Mus musculus
ctgcccctccagttgtgcttgcttt

SEQ ID NO: 426738 - DNA, 25 bp, Mus musculus
ctgcccgttcgctgagcgcgcggat

SEQ ID NO: 426739 - DNA, 25 bp, Mus musculus
ctgccctgggctaccgtttgcctgg

SEQ ID NO: 426740 - DNA, 25 bp, Mus musculus
ctgccctgtgctggacggacggcta

SEQ ID NO: 426741 - DNA, 25 bp, Mus musculus
ctgccgaggtcagcaggcaccagtg

SEQ ID NO: 426742 - DNA, 25 bp, Mus musculus
ctgccgctcggcgtcgcctggtagc

SEQ ID NO: 426743 - DNA, 25 bp, Mus musculus
ctgccgctctcatgtgccaagtgtg

SEQ ID NO: 426744 - DNA, 25 bp, Mus musculus
ctgccgtcggtgatgctgaagctct

SEQ ID NO: 426745 - DNA, 25 bp, Mus musculus
ctgcctagggaatgcgaaagcggtc

SEQ ID NO: 426746 - DNA, 25 bp, Mus musculus
ctgcctagtatccagcatcccttgg

SEQ ID NO: 426747 - DNA, 25 bp, Mus musculus
ctgcctcgccgagcaggctttgaga

SEQ ID NO: 426748 - DNA, 25 bp, Mus musculus
ctgcctctgataaaaatatacctga

SEQ ID NO: 426749 - DNA, 25 bp, Mus musculus
ctgcctgggcgcaaacatcctgaga

SEQ ID NO: 426750 - DNA, 25 bp, Mus musculus
ctgcctgttctgcacaaaggatggg

SEQ ID NO: 426751 - DNA, 25 bp, Mus musculus
ctgccttagggaacatgcacttttc

SEQ ID NO: 426752 - DNA, 25 bp, Mus musculus
ctgccttatgagaagattctcagaa

SEQ ID NO: 426753 - DNA, 25 bp, Mus musculus
ctgcgaagacgggaagactggcctt

SEQ ID NO: 426754 - DNA, 25 bp, Mus musculus
ctgcgagaacagaagtggccgtcct

SEQ ID NO: 426755 - DNA, 25 bp, Mus musculus
ctgcgagtgcgtgcccaactgcgag

SEQ ID NO: 426756 - DNA, 25 bp, Mus musculus
ctgcgatgagtcagacacactttca

SEQ ID NO: 426757 - DNA, 25 bp, Mus musculus
ctgcgattttattgagctatggctg

SEQ ID NO: 426758 - DNA, 25 bp, Mus musculus
ctgcgcagattttctgagctgagag

SEQ ID NO: 426759 - DNA, 25 bp, Mus musculus
ctgcgcccaagaggccgaagctgga

SEQ ID NO: 426760 - DNA, 25 bp, Mus musculus
ctgcgccggtgcatctgtaacatct

SEQ ID NO: 426761 - DNA, 25 bp, Mus musculus
ctgcgccgtggcttggcgaaccctg

SEQ ID NO: 426762 - DNA, 25 bp, Mus musculus
ctgcgccttccggtatggccgggaa

SEQ ID NO: 426763 - DNA, 25 bp, Mus musculus
ctgcgcgcgctggtagaactgagaa

SEQ ID NO: 426764 - DNA, 25 bp, Mus musculus
ctgcgcgtgggcaggaacaggacca

SEQ ID NO: 426765 - DNA, 25 bp, Mus musculus
ctgcgctgcagatgtacgaatacca

SEQ ID NO: 426766 - DNA, 25 bp, Mus musculus
ctgcgctgtatcgaaggtgttgtct

SEQ ID NO: 426767 - DNA, 25 bp, Mus musculus
ctgcggcacaccagaagagccttgt

SEQ ID NO: 426768 - DNA, 25 bp, Mus musculus
ctgcggcctggctcgggttgtcctt

SEQ ID NO: 426769 - DNA, 25 bp, Mus musculus
ctgcgggaacggaaaagcctcaact

SEQ ID NO: 426770 - DNA, 25 bp, Mus musculus
ctgcggttcatgtatggtgtttgcc

SEQ ID NO: 426771 - DNA, 25 bp, Mus musculus
ctgcgtaaagtgatggccccaggct

SEQ ID NO: 426772 - DNA, 25 bp, Mus musculus
ctgcgtaattcgaattgacttggtt

SEQ ID NO: 426773 - DNA, 25 bp, Mus musculus
ctgcgtaggaccagggaccggaagt

SEQ ID NO: 426774 - DNA, 25 bp, Mus musculus
ctgcgtattatctttctatggcgaa

SEQ ID NO: 426775 - DNA, 25 bp, Mus musculus
ctgcgtgaatcacaccccgatgctg

SEQ ID NO: 426776 - DNA, 25 bp, Mus musculus
ctgcgtgagtgagacagactgctga

SEQ ID NO: 426777 - DNA, 25 bp, Mus musculus
ctgcgtgcgaggagcacccctaagg

SEQ ID NO: 426778 - DNA, 25 bp, Mus musculus
ctgcgtgtgtgcacggtagccccga

SEQ ID NO: 426779 - DNA, 25 bp, Mus musculus
ctgctacgagttgggatttctaaaa

SEQ ID NO: 426780 - DNA, 25 bp, Mus musculus
ctgctaggagctggactggaacacc

SEQ ID NO: 426781 - DNA, 25 bp, Mus musculus
ctgctagtatggagactaaggtggc

SEQ ID NO: 426782 - DNA, 25 bp, Mus musculus
ctgctagtgtggtttctgtgagccc

SEQ ID NO: 426783 - DNA, 25 bp, Mus musculus
ctgctcatctttgggctgccaggat

SEQ ID NO: 426784 - DNA, 25 bp, Mus musculus
ctgctcccagggaccagaataagta

SEQ ID NO: 426785 - DNA, 25 bp, Mus musculus
ctgctcctgccctcttcacttctgg

SEQ ID NO: 426786 - DNA, 25 bp, Mus musculus
ctgctcctgtgtggctggtactgtg

SEQ ID NO: 426787 - DNA, 25 bp, Mus musculus
ctgctcggaggcgacttggtgctcc

SEQ ID NO: 426788 - DNA, 25 bp, Mus musculus
ctgctcgggcgctgctgctaaggct

SEQ ID NO: 426789 - DNA, 25 bp, Mus musculus
ctgctctgggcctggacgagggaga

SEQ ID NO: 426790 - DNA, 25 bp, Mus musculus
ctgctctgtatttgtaagtcggata

SEQ ID NO: 426791 - DNA, 25 bp, Mus musculus
ctgctcttggctccgggaaggcact

SEQ ID NO: 426792 - DNA, 25 bp, Mus musculus
ctgctgacgtacgaggaagtggcca

SEQ ID NO: 426793 - DNA, 25 bp, Mus musculus
ctgctgagacagtggaaacaatgcc

SEQ ID NO: 426794 - DNA, 25 bp, Mus musculus
ctgctgagctgagtcgcagggagca

SEQ ID NO: 426795 - DNA, 25 bp, Mus musculus
ctgctgcagcagatcttatgaggct

SEQ ID NO: 426796 - DNA, 25 bp, Mus musculus
ctgctgccctcctgaggtctgtctt

SEQ ID NO: 426797 - DNA, 25 bp, Mus musculus
ctgctgcggatacctgtgcccaaca

SEQ ID NO: 426798 - DNA, 25 bp, Mus musculus
ctgctgctcattgggattgctgcct

SEQ ID NO: 426799 - DNA, 25 bp, Mus musculus
ctgctggagcaacacggcgatgact

SEQ ID NO: 426800 - DNA, 25 bp, Mus musculus
ctgctggagccggaatcggacgtct

SEQ ID NO: 426801 - DNA, 25 bp, Mus musculus
ctgctggaggcggattccccggctg

SEQ ID NO: 426802 - DNA, 25 bp, Mus musculus
ctgctgggtcctctacgacatgacc

SEQ ID NO: 426803 - DNA, 25 bp, Mus musculus
ctgctggtagggatttaaagttgga

SEQ ID NO: 426804 - DNA, 25 bp, Mus musculus
ctgctggtgtactcgtgaggtgttt

SEQ ID NO: 426805 - DNA, 25 bp, Mus musculus
ctgctggttcctggacgaggcagct

SEQ ID NO: 426806 - DNA, 25 bp, Mus musculus
ctgctgtgagtggttacttgggtcc

SEQ ID NO: 426807 - DNA, 25 bp, Mus musculus
ctgctgtggcatagctggtcctttg

SEQ ID NO: 426808 - DNA, 25 bp, Mus musculus
ctgctgtgtaaacgacccggaccta

SEQ ID NO: 426809 - DNA, 25 bp, Mus musculus
ctgctgtgtgcacgtcctcacgact

SEQ ID NO: 426810 - DNA, 25 bp, Mus musculus
ctgctgtgttatggtttgatgggaa

SEQ ID NO: 426811 - DNA, 25 bp, Mus musculus
ctgctgttcaagatggaagaagcca

SEQ ID NO: 426812 - DNA, 25 bp, Mus musculus
ctgcttagcagggagggatcctgat

SEQ ID NO: 426813 - DNA, 25 bp, Mus musculus
ctgcttcaggcaccggagctagaga

SEQ ID NO: 426814 - DNA, 25 bp, Mus musculus
ctgcttcttatgtctggtgctaggc

SEQ ID NO: 426815 - DNA, 25 bp, Mus musculus
ctgcttgccctctgggagcccaaac

SEQ ID NO: 426816 - DNA, 25 bp, Mus musculus
ctgcttgcggactcccgggtcatgg

SEQ ID NO: 426817 - DNA, 25 bp, Mus musculus
ctgcttggaggccttaataaaggcg

SEQ ID NO: 426818 - DNA, 25 bp, Mus musculus
ctgcttggcaactcaccttcaccgg

SEQ ID NO: 426819 - DNA, 25 bp, Mus musculus
ctgcttggctaactgatgcccggac

SEQ ID NO: 426820 - DNA, 25 bp, Mus musculus
ctgcttgttcgttctggaggtgtga

SEQ ID NO: 426821 - DNA, 25 bp, Mus musculus
ctggaaaaagcaaggacgccaattt

SEQ ID NO: 426822 - DNA, 25 bp, Mus musculus
ctggaaaactactacaacttgggca

SEQ ID NO: 426823 - DNA, 25 bp, Mus musculus
ctggaaaagttgagtctgggtttgc

SEQ ID NO: 426824 - DNA, 25 bp, Mus musculus
ctggaaagatgttagaatcgaagcc

SEQ ID NO: 426825 - DNA, 25 bp, Mus musculus
ctggaaagtgtggtggtcctgaccc

SEQ ID NO: 426826 - DNA, 25 bp, Mus musculus
ctggaacaggcaggatccccatctg

SEQ ID NO: 426827 - DNA, 25 bp, Mus musculus
ctggaaccttgatggctgttgggaa

SEQ ID NO: 426828 - DNA, 25 bp, Mus musculus
ctggaactgtggcacctgctggaca

SEQ ID NO: 426829 - DNA, 25 bp, Mus musculus
ctggaagaacccctgctgccttctg

SEQ ID NO: 426830 - DNA, 25 bp, Mus musculus
ctggaagaattggatgaagtcatca

SEQ ID NO: 426831 - DNA, 25 bp, Mus musculus
ctggaagagaggatacccggctagt

SEQ ID NO: 426832 - DNA, 25 bp, Mus musculus
ctggaagcagagggacccacctgag

SEQ ID NO: 426833 - DNA, 25 bp, Mus musculus
ctggaaggctgcgtgtctccccaga

SEQ ID NO: 426834 - DNA, 25 bp, Mus musculus
ctggaagtgaatgttctgagagctt

SEQ ID NO: 426835 - DNA, 25 bp, Mus musculus
ctggaagttacttttcacatttctg

SEQ ID NO: 426836 - DNA, 25 bp, Mus musculus
ctggaattaggcgtgtttgttacca

SEQ ID NO: 426837 - DNA, 25 bp, Mus musculus
ctggaattagggtacaggcagttgt

SEQ ID NO: 426838 - DNA, 25 bp, Mus musculus
ctggacaacatttctctgagctgca

SEQ ID NO: 426839 - DNA, 25 bp, Mus musculus
ctggacaagaggaacggaagagcat

SEQ ID NO: 426840 - DNA, 25 bp, Mus musculus
ctggacaatgacacggagaccgact

SEQ ID NO: 426841 - DNA, 25 bp, Mus musculus
ctggacactcttgagacgaacaggg

SEQ ID NO: 426842 - DNA, 25 bp, Mus musculus
ctggacagagtcaccaccctggatg

SEQ ID NO: 426843 - DNA, 25 bp, Mus musculus
ctggacagcagggtggcccgccaaa

SEQ ID NO: 426844 - DNA, 25 bp, Mus musculus
ctggacagctttggcggtgcgccct

SEQ ID NO: 426845 - DNA, 25 bp, Mus musculus
ctggacaggagggatgaaggaatca

SEQ ID NO: 426846 - DNA, 25 bp, Mus musculus
ctggacagggatgcgtggacctcct

SEQ ID NO: 426847 - DNA, 25 bp, Mus musculus
ctggaccacctagggctgaccatag

SEQ ID NO: 426848 - DNA, 25 bp, Mus musculus
ctggaccaggcgcaaggcaaattga

SEQ ID NO: 426849 - DNA, 25 bp, Mus musculus
ctggaccgcagctctcacagtggtg

SEQ ID NO: 426850 - DNA, 25 bp, Mus musculus
ctggactcccggtagcggccagctg

SEQ ID NO: 426851 - DNA, 25 bp, Mus musculus
ctggagaagactgagtgtcagctct

SEQ ID NO: 426852 - DNA, 25 bp, Mus musculus
ctggagaagcgaagcgacagcctgt

SEQ ID NO: 426853 - DNA, 25 bp, Mus musculus
ctggagaatagaagtgcacaccgct

SEQ ID NO: 426854 - DNA, 25 bp, Mus musculus
ctggagactttgctggaggacaccc

SEQ ID NO: 426855 - DNA, 25 bp, Mus musculus
ctggagagagagtgaatccttgtgc

SEQ ID NO: 426856 - DNA, 25 bp, Mus musculus
ctggagagattcaagaagtagccac

SEQ ID NO: 426857 - DNA, 25 bp, Mus musculus
ctggagaggaccagaaggctcgcac

SEQ ID NO: 426858 - DNA, 25 bp, Mus musculus
ctggagaggagcgagttacgggtct

SEQ ID NO: 426859 - DNA, 25 bp, Mus musculus
ctggagatattcgacagttgccccg

SEQ ID NO: 426860 - DNA, 25 bp, Mus musculus
ctggagatctgagcacagcagtctg

SEQ ID NO: 426861 - DNA, 25 bp, Mus musculus
ctggagatggagttcaaacgcggcc

SEQ ID NO: 426862 - DNA, 25 bp, Mus musculus
ctggagattcaaggaggagctgaca

SEQ ID NO: 426863 - DNA, 25 bp, Mus musculus
ctggagctaagtacggtggcgcaca

SEQ ID NO: 426864 - DNA, 25 bp, Mus musculus
ctggagctttggaaacataaatgca

SEQ ID NO: 426865 - DNA, 25 bp, Mus musculus
ctggaggacaaggagggcacgttgc

SEQ ID NO: 426866 - DNA, 25 bp, Mus musculus
ctggaggcagcaccgacagaacttg

SEQ ID NO: 426867 - DNA, 25 bp, Mus musculus
ctggaggcccgaacgggagccttct

SEQ ID NO: 426868 - DNA, 25 bp, Mus musculus
ctggaggcgcctgaaagcggttcct

SEQ ID NO: 426869 - DNA, 25 bp, Mus musculus
ctggaggctatcagctgaatgaggc

SEQ ID NO: 426870 - DNA, 25 bp, Mus musculus
ctggaggctggagaattccaatggc

SEQ ID NO: 426871 - DNA, 25 bp, Mus musculus
ctggaggtactggtgtgttcaagtc

SEQ ID NO: 426872 - DNA, 25 bp, Mus musculus
ctggaggtggcttgtgtatctgtca

SEQ ID NO: 426873 - DNA, 25 bp, Mus musculus
ctggagtacccacccttcgatgagg

SEQ ID NO: 426874 - DNA, 25 bp, Mus musculus
ctggagtactgtgggaaccgccgat

SEQ ID NO: 426875 - DNA, 25 bp, Mus musculus
ctggagtcacatgtagtagtggacc

SEQ ID NO: 426876 - DNA, 25 bp, Mus musculus
ctggagtccttgcaccttcagtctc

SEQ ID NO: 426877 - DNA, 25 bp, Mus musculus
ctggagtgagaggtgagctctttat

SEQ ID NO: 426878 - DNA, 25 bp, Mus musculus
ctggagtgaggattacccggagaac

SEQ ID NO: 426879 - DNA, 25 bp, Mus musculus
ctggatagttatgcttcatgaagcc

SEQ ID NO: 426880 - DNA, 25 bp, Mus musculus
ctggatctgccgcatgctaatcctc

SEQ ID NO: 426881 - DNA, 25 bp, Mus musculus
ctggatgacactgatgccctgggca

SEQ ID NO: 426882 - DNA, 25 bp, Mus musculus
ctggatgccggtattggctggaact

SEQ ID NO: 426883 - DNA, 25 bp, Mus musculus
ctggattacacaacgaggctctact

SEQ ID NO: 426884 - DNA, 25 bp, Mus musculus
ctggcaaggctaaggtggagacacc

SEQ ID NO: 426885 - DNA, 25 bp, Mus musculus
ctggcaccaggtagatatgtggtgc

SEQ ID NO: 426886 - DNA, 25 bp, Mus musculus
ctggcacgaggagcatgagtattac

SEQ ID NO: 426887 - DNA, 25 bp, Mus musculus
ctggcactgccacaatgagctaggt

SEQ ID NO: 426888 - DNA, 25 bp, Mus musculus
ctggcacttgtctgggaactggcga

SEQ ID NO: 426889 - DNA, 25 bp, Mus musculus
ctggcagaaggctgtgctcttcgga

SEQ ID NO: 426890 - DNA, 25 bp, Mus musculus
ctggcagcagcggaccaggcctggg

SEQ ID NO: 426891 - DNA, 25 bp, Mus musculus
ctggcaggcagtgtaacaaatcaag

SEQ ID NO: 426892 - DNA, 25 bp, Mus musculus
ctggcaggtatgagcccctgaggtc

SEQ ID NO: 426893 - DNA, 25 bp, Mus musculus
ctggcagtatgcttgccacggtgaa

SEQ ID NO: 426894 - DNA, 25 bp, Mus musculus
ctggcagtgagtcttgacttccctt

SEQ ID NO: 426895 - DNA, 25 bp, Mus musculus
ctggcatacaggttctgagggttct

SEQ ID NO: 426896 - DNA, 25 bp, Mus musculus
ctggcatattacttcaccgagctga

SEQ ID NO: 426897 - DNA, 25 bp, Mus musculus
ctggcatctgagtttcatgacatta

SEQ ID NO: 426898 - DNA, 25 bp, Mus musculus
ctggcatgcagtcgcccttagcaaa

SEQ ID NO: 426899 - DNA, 25 bp, Mus musculus
ctggcatgcgtttggtaaaccgtag

SEQ ID NO: 426900 - DNA, 25 bp, Mus musculus
ctggccacggataaaggaacacctc

SEQ ID NO: 426901 - DNA, 25 bp, Mus musculus
ctggccagagcttcgaggtcatcct

SEQ ID NO: 426902 - DNA, 25 bp, Mus musculus
ctggcccggcatgctgcctgctgct

SEQ ID NO: 426903 - DNA, 25 bp, Mus musculus
ctggcccgtgggaagacgattcctg

SEQ ID NO: 426904 - DNA, 25 bp, Mus musculus
ctggccctggtagcaattataaact

SEQ ID NO: 426905 - DNA, 25 bp, Mus musculus
ctggccgagagagcttacctgtgaa

SEQ ID NO: 426906 - DNA, 25 bp, Mus musculus
ctggcctacaactcacgctatagac

SEQ ID NO: 426907 - DNA, 25 bp, Mus musculus
ctggcctggctacctcgagtgtaca

SEQ ID NO: 426908 - DNA, 25 bp, Mus musculus
ctggcctgggaaatgcctcgctttc

SEQ ID NO: 426909 - DNA, 25 bp, Mus musculus
ctggcctggtacacgaccgtgatac

SEQ ID NO: 426910 - DNA, 25 bp, Mus musculus
ctggcctgtgtcacctgagcagtga

SEQ ID NO: 426911 - DNA, 25 bp, Mus musculus
ctggccttgctgcttgtgggttctt

SEQ ID NO: 426912 - DNA, 25 bp, Mus musculus
ctggcctttgaaggctgggaatcta

SEQ ID NO: 426913 - DNA, 25 bp, Mus musculus
ctggcgaaccgtgctgaaaacccgg

SEQ ID NO: 426914 - DNA, 25 bp, Mus musculus
ctggcgctgcttcccaagggtgtcc

SEQ ID NO: 426915 - DNA, 25 bp, Mus musculus
ctggcgctggatacgaatagacact

SEQ ID NO: 426916 - DNA, 25 bp, Mus musculus
ctggcgtgggaatcctgtctgcgaa

SEQ ID NO: 426917 - DNA, 25 bp, Mus musculus
ctggctacaactccacaaggcggtt

SEQ ID NO: 426918 - DNA, 25 bp, Mus musculus
ctggctaggatgcacactggtttta

SEQ ID NO: 426919 - DNA, 25 bp, Mus musculus
ctggctagggagaaacagaatgctc

SEQ ID NO: 426920 - DNA, 25 bp, Mus musculus
ctggctcacatgctggagggattct

SEQ ID NO: 426921 - DNA, 25 bp, Mus musculus
ctggctcccgaaagtcacgcgtgta

SEQ ID NO: 426922 - DNA, 25 bp, Mus musculus
ctggctcctgcaggagtttggaagc

SEQ ID NO: 426923 - DNA, 25 bp, Mus musculus
ctggctcgcctagaagctaggaatg

SEQ ID NO: 426924 - DNA, 25 bp, Mus musculus
ctggctctgggagagtctactcatg

SEQ ID NO: 426925 - DNA, 25 bp, Mus musculus
ctggctgatggctgtcgattgactt

SEQ ID NO: 426926 - DNA, 25 bp, Mus musculus
ctggctgcagctcggaaaggtttct

SEQ ID NO: 426927 - DNA, 25 bp, Mus musculus
ctggctgccaccactatgaaaactc

SEQ ID NO: 426928 - DNA, 25 bp, Mus musculus
ctggctgctggctcgatggtcgata

SEQ ID NO: 426929 - DNA, 25 bp, Mus musculus
ctggctggacactcgagaaagacgg

SEQ ID NO: 426930 - DNA, 25 bp, Mus musculus
ctggctggccagcatctatctctct

SEQ ID NO: 426931 - DNA, 25 bp, Mus musculus
ctggctggccctgaatgttttacga

SEQ ID NO: 426932 - DNA, 25 bp, Mus musculus
ctggctggccgctgctcatgttctg

SEQ ID NO: 426933 - DNA, 25 bp, Mus musculus
ctggctgtcgcacggttcccagtgc

SEQ ID NO: 426934 - DNA, 25 bp, Mus musculus
ctggctgtgaatgcgcttgtctgac

SEQ ID NO: 426935 - DNA, 25 bp, Mus musculus
ctggcttttcccctagatagagggt

SEQ ID NO: 426936 - DNA, 25 bp, Mus musculus
ctggcttttcctagacatgagttga

SEQ ID NO: 426937 - DNA, 25 bp, Mus musculus
ctgggaaatttgatggttcaggaca

SEQ ID NO: 426938 - DNA, 25 bp, Mus musculus
ctgggaacaaagtttcagccgtgtc

SEQ ID NO: 426939 - DNA, 25 bp, Mus musculus
ctgggaactacggttgctggagaca

SEQ ID NO: 426940 - DNA, 25 bp, Mus musculus
ctgggaagctgccacccgaagagtt

SEQ ID NO: 426941 - DNA, 25 bp, Mus musculus
ctgggaagttcatcagagcattcac

SEQ ID NO: 426942 - DNA, 25 bp, Mus musculus
ctgggaatctgcaccgaggaagctg

SEQ ID NO: 426943 - DNA, 25 bp, Mus musculus
ctgggaattgaggacgtacactgct

SEQ ID NO: 426944 - DNA, 25 bp, Mus musculus
ctgggactccaggtttctcttcaag

SEQ ID NO: 426945 - DNA, 25 bp, Mus musculus
ctgggagagaaaggccggttcatac

SEQ ID NO: 426946 - DNA, 25 bp, Mus musculus
ctgggagagatggaggccgaacggc

SEQ ID NO: 426947 - DNA, 25 bp, Mus musculus
ctgggaggaccttaacttctgtgcc

SEQ ID NO: 426948 - DNA, 25 bp, Mus musculus
ctgggagtcggcatgtcgcaagacc

SEQ ID NO: 426949 - DNA, 25 bp, Mus musculus
ctgggataattacgcccaggaaagg

SEQ ID NO: 426950 - DNA, 25 bp, Mus musculus
ctgggatgggatgtgcgaataccct

SEQ ID NO: 426951 - DNA, 25 bp, Mus musculus
ctgggattacaaggctccagtaaaa

SEQ ID NO: 426952 - DNA, 25 bp, Mus musculus
ctgggattctcaagaggacggtctt

SEQ ID NO: 426953 - DNA, 25 bp, Mus musculus
ctgggcaaagtcctgaaagcgtggg

SEQ ID NO: 426954 - DNA, 25 bp, Mus musculus
ctgggcaactaagaatggctgggaa

SEQ ID NO: 426955 - DNA, 25 bp, Mus musculus
ctgggcacggtctgcaggcactcct

SEQ ID NO: 426956 - DNA, 25 bp, Mus musculus
ctgggcactgagatctgggagaaca

SEQ ID NO: 426957 - DNA, 25 bp, Mus musculus
ctgggcagacagtagaatctgggca

SEQ ID NO: 426958 - DNA, 25 bp, Mus musculus
ctgggcagccatccagacttcaggg

SEQ ID NO: 426959 - DNA, 25 bp, Mus musculus
ctgggcagcgaggacacagaggttc

SEQ ID NO: 426960 - DNA, 25 bp, Mus musculus
ctgggcaggcagactacgaaaataa

SEQ ID NO: 426961 - DNA, 25 bp, Mus musculus
ctgggcatggaaactggctgccagc

SEQ ID NO: 426962 - DNA, 25 bp, Mus musculus
ctgggcattgcctactacgtgagtg

SEQ ID NO: 426963 - DNA, 25 bp, Mus musculus
ctgggccagatcactccattcctga

SEQ ID NO: 426964 - DNA, 25 bp, Mus musculus
ctgggcccagaagaatgaccaaggg

SEQ ID NO: 426965 - DNA, 25 bp, Mus musculus
ctgggccctggagctcaagcagtga

SEQ ID NO: 426966 - DNA, 25 bp, Mus musculus
ctgggccgaccatgctactacgaga

SEQ ID NO: 426967 - DNA, 25 bp, Mus musculus
ctgggccggcgctctagcaaggatt

SEQ ID NO: 426968 - DNA, 25 bp, Mus musculus
ctgggcctgggcactcaggcctgct

SEQ ID NO: 426969 - DNA, 25 bp, Mus musculus
ctgggctcaggaacacagatggaca

SEQ ID NO: 426970 - DNA, 25 bp, Mus musculus
ctgggctctatcaaacgtgtcttaa

SEQ ID NO: 426971 - DNA, 25 bp, Mus musculus
ctgggctgcccaggctagacaggca

SEQ ID NO: 426972 - DNA, 25 bp, Mus musculus
ctgggtaacctctatccgagccgcg

SEQ ID NO: 426973 - DNA, 25 bp, Mus musculus
ctgggtactactgtcaacgtgaata

SEQ ID NO: 426974 - DNA, 25 bp, Mus musculus
ctgggtcaggaagtggccacagtca

SEQ ID NO: 426975 - DNA, 25 bp, Mus musculus
ctgggtcagtcgaaggagagctcct

SEQ ID NO: 426976 - DNA, 25 bp, Mus musculus
ctgggtcgtgaggtaagttgaatct

SEQ ID NO: 426977 - DNA, 25 bp, Mus musculus
ctgggtctcggcacgcgcagtgctc

SEQ ID NO: 426978 - DNA, 25 bp, Mus musculus
ctgggtctcttagtagctgataggg

SEQ ID NO: 426979 - DNA, 25 bp, Mus musculus
ctgggtctgagagtctgaatgctgc

SEQ ID NO: 426980 - DNA, 25 bp, Mus musculus
ctgggtctgcccactaagaagatga

SEQ ID NO: 426981 - DNA, 25 bp, Mus musculus
ctgggtgacttggtgttgactctgc

SEQ ID NO: 426982 - DNA, 25 bp, Mus musculus
ctgggttctatcctcagctatggga

SEQ ID NO: 426983 - DNA, 25 bp, Mus musculus
ctgggtttggtgtgcatgcttgtaa

SEQ ID NO: 426984 - DNA, 25 bp, Mus musculus
ctggtaaagcctgcaaagactgggt

SEQ ID NO: 426985 - DNA, 25 bp, Mus musculus
ctggtaactccgaccgagggcttcg

SEQ ID NO: 426986 - DNA, 25 bp, Mus musculus
ctggtagaaggcgtcaaagtcgaac

SEQ ID NO: 426987 - DNA, 25 bp, Mus musculus
ctggtagatgactacagcgacagag

SEQ ID NO: 426988 - DNA, 25 bp, Mus musculus
ctggtatgtgaagatgaagtgctaa

SEQ ID NO: 426989 - DNA, 25 bp, Mus musculus
ctggtcaagtgcaggtccagggtct

SEQ ID NO: 426990 - DNA, 25 bp, Mus musculus
ctggtcccgaagaaagcgatggaga

SEQ ID NO: 426991 - DNA, 25 bp, Mus musculus
ctggtcggacggaaacgctccgccg

SEQ ID NO: 426992 - DNA, 25 bp, Mus musculus
ctggtcgggatgaaggaactgcccc

SEQ ID NO: 426993 - DNA, 25 bp, Mus musculus
ctggtctccttcagaggtgtgtgac

SEQ ID NO: 426994 - DNA, 25 bp, Mus musculus
ctggtgatgccatcgagccagcgcc

SEQ ID NO: 426995 - DNA, 25 bp, Mus musculus
ctggtgcagtgaacattgtgctttt

SEQ ID NO: 426996 - DNA, 25 bp, Mus musculus
ctggtgccaccaaagtttatgctat

SEQ ID NO: 426997 - DNA, 25 bp, Mus musculus
ctggtgcggtcctagaagggccaac

SEQ ID NO: 426998 - DNA, 25 bp, Mus musculus
ctggtgctgcgccatggctgctgct

SEQ ID NO: 426999 - DNA, 25 bp, Mus musculus
ctggtgctgttgtcctcctgcgctc

SEQ ID NO: 427000 - DNA, 25 bp, Mus musculus
ctggtggagccaagagagtgacctc

SEQ ID NO: 427001 - DNA, 25 bp, Mus musculus
ctggtggcacgagtgggcttcccaa

SEQ ID NO: 427002 - DNA, 25 bp, Mus musculus
ctggtggcctcgtgcaagtgcaagc

SEQ ID NO: 427003 - DNA, 25 bp, Mus musculus
ctggtggctatcacgggcgcccagt

SEQ ID NO: 427004 - DNA, 25 bp, Mus musculus
ctggtgggatccattgacagagaca

SEQ ID NO: 427005 - DNA, 25 bp, Mus musculus
ctggtgggtcttgcctgtgacagca

SEQ ID NO: 427006 - DNA, 25 bp, Mus musculus
ctggtggtgggcagcggcatcgcgg

SEQ ID NO: 427007 - DNA, 25 bp, Mus musculus
ctggtgtcaggtacaaggcggctcc

SEQ ID NO: 427008 - DNA, 25 bp, Mus musculus
ctggtgtcgcttagccactgtgccc

SEQ ID NO: 427009 - DNA, 25 bp, Mus musculus
ctggtgtcttgggaatgcccttgga

SEQ ID NO: 427010 - DNA, 25 bp, Mus musculus
ctggtgtgaagcatgcggtagttct

SEQ ID NO: 427011 - DNA, 25 bp, Mus musculus
ctggtgtgactgttcaaaagactat

SEQ ID NO: 427012 - DNA, 25 bp, Mus musculus
ctggtgtgagattcgagccctggac

SEQ ID NO: 427013 - DNA, 25 bp, Mus musculus
ctggttaagcagaaacactgaccta

SEQ ID NO: 427014 - DNA, 25 bp, Mus musculus
ctggttcaaaacacatcctggatgc

SEQ ID NO: 427015 - DNA, 25 bp, Mus musculus
ctggttcaaaccagaccacgaccta

SEQ ID NO: 427016 - DNA, 25 bp, Mus musculus
ctggttcagccagaggtttctttga

SEQ ID NO: 427017 - DNA, 25 bp, Mus musculus
ctggttccaggagaaggctataccc

SEQ ID NO: 427018 - DNA, 25 bp, Mus musculus
ctggttgctagcaagctggctggct

SEQ ID NO: 427019 - DNA, 25 bp, Mus musculus
ctggttggcgtggtggctactctca

SEQ ID NO: 427020 - DNA, 25 bp, Mus musculus
ctggtttctgaatctggcggtggcc

SEQ ID NO: 427021 - DNA, 25 bp, Mus musculus
ctggtttctggtaaataggctgtac

SEQ ID NO: 427022 - DNA, 25 bp, Mus musculus
ctggtttggaagtccaaaagtgagc

SEQ ID NO: 427023 - DNA, 25 bp, Mus musculus
ctggtttgtctctaacattgatggg

SEQ ID NO: 427024 - DNA, 25 bp, Mus musculus
ctgtaaaacatgtattgtacgttac

SEQ ID NO: 427025 - DNA, 25 bp, Mus musculus
ctgtaaagccaggagaccgggtgct

SEQ ID NO: 427026 - DNA, 25 bp, Mus musculus
ctgtaaataagtcttggaagaatgg

SEQ ID NO: 427027 - DNA, 25 bp, Mus musculus
ctgtaaatctaacttgggcctgccc

SEQ ID NO: 427028 - DNA, 25 bp, Mus musculus
ctgtaaattagggagcaagtgtccc

SEQ ID NO: 427029 - DNA, 25 bp, Mus musculus
ctgtaacaagtacacacgaactgtg

SEQ ID NO: 427030 - DNA, 25 bp, Mus musculus
ctgtaattagtttccaatcacctgg

SEQ ID NO: 427031 - DNA, 25 bp, Mus musculus
ctgtacatgcgctgttatgctgtgg

SEQ ID NO: 427032 - DNA, 25 bp, Mus musculus
ctgtacgaagaaagcaacgagttgc

SEQ ID NO: 427033 - DNA, 25 bp, Mus musculus
ctgtacggccgcaggtaggtctcca

SEQ ID NO: 427034 - DNA, 25 bp, Mus musculus
ctgtactaaagtccggaaggtgtcg

SEQ ID NO: 427035 - DNA, 25 bp, Mus musculus
ctgtactacaccagcttcagcctgg

SEQ ID NO: 427036 - DNA, 25 bp, Mus musculus
ctgtactggcgcatctaccgggaga

SEQ ID NO: 427037 - DNA, 25 bp, Mus musculus
ctgtagacacagagaccaacttggt

SEQ ID NO: 427038 - DNA, 25 bp, Mus musculus
ctgtagatgcttgggagctaaaact

SEQ ID NO: 427039 - DNA, 25 bp, Mus musculus
ctgtagattcgaaatccttaaaggg

SEQ ID NO: 427040 - DNA, 25 bp, Mus musculus
ctgtagctacgagtgatttctggac

SEQ ID NO: 427041 - DNA, 25 bp, Mus musculus
ctgtagctttggtttatagggagga

SEQ ID NO: 427042 - DNA, 25 bp, Mus musculus
ctgtaggactccgtggctgccagtg

SEQ ID NO: 427043 - DNA, 25 bp, Mus musculus
ctgtagggattacccgccagcctgt

SEQ ID NO: 427044 - DNA, 25 bp, Mus musculus
ctgtagtcatgcatatttctttaga

SEQ ID NO: 427045 - DNA, 25 bp, Mus musculus
ctgtagttagccacgccggagccag

SEQ ID NO: 427046 - DNA, 25 bp, Mus musculus
ctgtatcgtggaggacactgtgcct

SEQ ID NO: 427047 - DNA, 25 bp, Mus musculus
ctgtattattgaggcagcttggctc

SEQ ID NO: 427048 - DNA, 25 bp, Mus musculus
ctgtattcaccgaggtggccccagc

SEQ ID NO: 427049 - DNA, 25 bp, Mus musculus
ctgtattttgaagttttggtatcca

SEQ ID NO: 427050 - DNA, 25 bp, Mus musculus
ctgtcacacagtaggaattgttcac

SEQ ID NO: 427051 - DNA, 25 bp, Mus musculus
ctgtcacagcttttgaggacttcgt

SEQ ID NO: 427052 - DNA, 25 bp, Mus musculus
ctgtcacagggcagagagacttctt

SEQ ID NO: 427053 - DNA, 25 bp, Mus musculus
ctgtcacagtcaagaaagaagtcca

SEQ ID NO: 427054 - DNA, 25 bp, Mus musculus
ctgtcaggagagaggaggtccttcc

SEQ ID NO: 427055 - DNA, 25 bp, Mus musculus
ctgtcataacttctccgggaaaagg

SEQ ID NO: 427056 - DNA, 25 bp, Mus musculus
ctgtccacagagtgcgatgcggtga

SEQ ID NO: 427057 - DNA, 25 bp, Mus musculus
ctgtccacatccaccatccctttgt

SEQ ID NO: 427058 - DNA, 25 bp, Mus musculus
ctgtccacgacaacggaagtgccca

SEQ ID NO: 427059 - DNA, 25 bp, Mus musculus
ctgtccagatggatcagctataaag

SEQ ID NO: 427060 - DNA, 25 bp, Mus musculus
ctgtccatcagtaagaaagagtgtc

SEQ ID NO: 427061 - DNA, 25 bp, Mus musculus
ctgtccctgggtaggcaactgtgtg

SEQ ID NO: 427062 - DNA, 25 bp, Mus musculus
ctgtccggaaagagaaaggcctgcc

SEQ ID NO: 427063 - DNA, 25 bp, Mus musculus
ctgtccggaacgtcagcagagagga

SEQ ID NO: 427064 - DNA, 25 bp, Mus musculus
ctgtcctcaggatctgggaaactcc

SEQ ID NO: 427065 - DNA, 25 bp, Mus musculus
ctgtcctgtgtctaagcagtcctag

SEQ ID NO: 427066 - DNA, 25 bp, Mus musculus
ctgtccttgtgacccacgcgggtgc

SEQ ID NO: 427067 - DNA, 25 bp, Mus musculus
ctgtctacatagttatggccggatt

SEQ ID NO: 427068 - DNA, 25 bp, Mus musculus
ctgtctcccaggctttgaaaggtag

SEQ ID NO: 427069 - DNA, 25 bp, Mus musculus
ctgtctcctggaagcatgggtgcga

SEQ ID NO: 427070 - DNA, 25 bp, Mus musculus
ctgtctctacagaagcacctggagg

SEQ ID NO: 427071 - DNA, 25 bp, Mus musculus
ctgtctgaagtgagcaatcaagtcc

SEQ ID NO: 427072 - DNA, 25 bp, Mus musculus
ctgtctgtgtctccccagtgctaga

SEQ ID NO: 427073 - DNA, 25 bp, Mus musculus
ctgtcttgagactgggaccatgtaa

SEQ ID NO: 427074 - DNA, 25 bp, Mus musculus
ctgtcttggtttaggaacttagtga

SEQ ID NO: 427075 - DNA, 25 bp, Mus musculus
ctgtgaaatgagaacggttctgtct

SEQ ID NO: 427076 - DNA, 25 bp, Mus musculus
ctgtgaaattgtatcaaaagcaaac

SEQ ID NO: 427077 - DNA, 25 bp, Mus musculus
ctgtgaagagactgtggctggccct

SEQ ID NO: 427078 - DNA, 25 bp, Mus musculus
ctgtgacaccacagggaccgggttc

SEQ ID NO: 427079 - DNA, 25 bp, Mus musculus
ctgtgaccgaggattggctgttgaa

SEQ ID NO: 427080 - DNA, 25 bp, Mus musculus
ctgtgaccgtgaggaagactgtccc

SEQ ID NO: 427081 - DNA, 25 bp, Mus musculus
ctgtgagcaggcgatttgtgtgtct

SEQ ID NO: 427082 - DNA, 25 bp, Mus musculus
ctgtgaggaagacaatgaagacgcc

SEQ ID NO: 427083 - DNA, 25 bp, Mus musculus
ctgtgagtaaaggaaacagttggtt

SEQ ID NO: 427084 - DNA, 25 bp, Mus musculus
ctgtgatgggaaccccgcataaagc

SEQ ID NO: 427085 - DNA, 25 bp, Mus musculus
ctgtgatgtggtagctgagccagcc

SEQ ID NO: 427086 - DNA, 25 bp, Mus musculus
ctgtgcaaaggtggcttcgcagccc

SEQ ID NO: 427087 - DNA, 25 bp, Mus musculus
ctgtgcattcaagactagtaaaaac

SEQ ID NO: 427088 - DNA, 25 bp, Mus musculus
ctgtgccagctccagattcgcggcg

SEQ ID NO: 427089 - DNA, 25 bp, Mus musculus
ctgtgccaggaagacgacagcctga

SEQ ID NO: 427090 - DNA, 25 bp, Mus musculus
ctgtgccgagtatgtgaagaataca

SEQ ID NO: 427091 - DNA, 25 bp, Mus musculus
ctgtgcctttgggagtgcaaggctt

SEQ ID NO: 427092 - DNA, 25 bp, Mus musculus
ctgtgcgaccgcactgtgccttcag

SEQ ID NO: 427093 - DNA, 25 bp, Mus musculus
ctgtgcgtgacaagagtgggaccct

SEQ ID NO: 427094 - DNA, 25 bp, Mus musculus
ctgtgcgtgagctcctgggtttcct

SEQ ID NO: 427095 - DNA, 25 bp, Mus musculus
ctgtgctcaaatgccgcacggcagg

SEQ ID NO: 427096 - DNA, 25 bp, Mus musculus
ctgtgctccagagaaaatccaacag

SEQ ID NO: 427097 - DNA, 25 bp, Mus musculus
ctgtgctccagccaagatcctctgc

SEQ ID NO: 427098 - DNA, 25 bp, Mus musculus
ctgtgctctcaaccgtgtgggtcag

SEQ ID NO: 427099 - DNA, 25 bp, Mus musculus
ctgtgctgaagctgacctgtggtga

SEQ ID NO: 427100 - DNA, 25 bp, Mus musculus
ctgtgctgctgggttattgacaggc

SEQ ID NO: 427101 - DNA, 25 bp, Mus musculus
ctgtgctggagcttctgagggcacc

SEQ ID NO: 427102 - DNA, 25 bp, Mus musculus
ctgtgcttctacagggcgctgggct

SEQ ID NO: 427103 - DNA, 25 bp, Mus musculus
ctgtggaagattatataatagcctc

SEQ ID NO: 427104 - DNA, 25 bp, Mus musculus
ctgtggaattcctgcccagtcacag

SEQ ID NO: 427105 - DNA, 25 bp, Mus musculus
ctgtggacaaggtaagagcagagct

SEQ ID NO: 427106 - DNA, 25 bp, Mus musculus
ctgtggacaggtgatccatcccttt

SEQ ID NO: 427107 - DNA, 25 bp, Mus musculus
ctgtggaccagggaattgcgaggcc

SEQ ID NO: 427108 - DNA, 25 bp, Mus musculus
ctgtggacgcttgtggaggaaaccc

SEQ ID NO: 427109 - DNA, 25 bp, Mus musculus
ctgtggagactggaaaccgatggcc

SEQ ID NO: 427110 - DNA, 25 bp, Mus musculus
ctgtggaggaaagctgggaatctat

SEQ ID NO: 427111 - DNA, 25 bp, Mus musculus
ctgtggataactctgatgtgaactc

SEQ ID NO: 427112 - DNA, 25 bp, Mus musculus
ctgtggccgcttgtgagatatggct

SEQ ID NO: 427113 - DNA, 25 bp, Mus musculus
ctgtggctctttgtccagggttagg

SEQ ID NO: 427114 - DNA, 25 bp, Mus musculus
ctgtggctttcctcagagtgatcgg

SEQ ID NO: 427115 - DNA, 25 bp, Mus musculus
ctgtgggagctctgcaacaagtgca

SEQ ID NO: 427116 - DNA, 25 bp, Mus musculus
ctgtgggagggctcgcggctctcgc

SEQ ID NO: 427117 - DNA, 25 bp, Mus musculus
ctgtggtcctgatgagattgacaac

SEQ ID NO: 427118 - DNA, 25 bp, Mus musculus
ctgtggtcgaccaggttgacctgga

SEQ ID NO: 427119 - DNA, 25 bp, Mus musculus
ctgtggtgacaagctgaaactaata

SEQ ID NO: 427120 - DNA, 25 bp, Mus musculus
ctgtggttgcaagaaaggtgacgca

SEQ ID NO: 427121 - DNA, 25 bp, Mus musculus
ctgtgtaagaaagactggaagggaa

SEQ ID NO: 427122 - DNA, 25 bp, Mus musculus
ctgtgtactctctgggccgcctggt

SEQ ID NO: 427123 - DNA, 25 bp, Mus musculus
ctgtgtataccctggggacaccggg

SEQ ID NO: 427124 - DNA, 25 bp, Mus musculus
ctgtgtatctgctttcaatttgtag

SEQ ID NO: 427125 - DNA, 25 bp, Mus musculus
ctgtgtatgaatgcccaggcctggc

SEQ ID NO: 427126 - DNA, 25 bp, Mus musculus
ctgtgtcaatgatcaaactgtggaa

SEQ ID NO: 427127 - DNA, 25 bp, Mus musculus
ctgtgtcacccgcagggataccact

SEQ ID NO: 427128 - DNA, 25 bp, Mus musculus
ctgtgtctcctccagcatcggagga

SEQ ID NO: 427129 - DNA, 25 bp, Mus musculus
ctgtgtcttgcagggagatggaaca

SEQ ID NO: 427130 - DNA, 25 bp, Mus musculus
ctgtgtgaccacagccctctggacg

SEQ ID NO: 427131 - DNA, 25 bp, Mus musculus
ctgtgtgcagcagcatccgtggcct

SEQ ID NO: 427132 - DNA, 25 bp, Mus musculus
ctgtgtgctgtagagaggtcctgct

SEQ ID NO: 427133 - DNA, 25 bp, Mus musculus
ctgtgtggtggcttcagtgttctgt

SEQ ID NO: 427134 - DNA, 25 bp, Mus musculus
ctgtgtgtcaagtaagtcaaggcca

SEQ ID NO: 427135 - DNA, 25 bp, Mus musculus
ctgtgttgacagctggaagatctta

SEQ ID NO: 427136 - DNA, 25 bp, Mus musculus
ctgtgtttgaagataagtttaggcc

SEQ ID NO: 427137 - DNA, 25 bp, Mus musculus
ctgttaaggaacgtgggcagtctcc

SEQ ID NO: 427138 - DNA, 25 bp, Mus musculus
ctgttacaggaggacacacatccct

SEQ ID NO: 427139 - DNA, 25 bp, Mus musculus
ctgttactagactttccagagttgc

SEQ ID NO: 427140 - DNA, 25 bp, Mus musculus
ctgttagatgagatggtgactgcca

SEQ ID NO: 427141 - DNA, 25 bp, Mus musculus
ctgttagccttcatctgggaccctg

SEQ ID NO: 427142 - DNA, 25 bp, Mus musculus
ctgttatcgtggactggaccaggca

SEQ ID NO: 427143 - DNA, 25 bp, Mus musculus
ctgttattttgatgctgtgatttga

SEQ ID NO: 427144 - DNA, 25 bp, Mus musculus
ctgttcacagttgccggctggagca

SEQ ID NO: 427145 - DNA, 25 bp, Mus musculus
ctgttcgcaatctgggagcctggga

SEQ ID NO: 427146 - DNA, 25 bp, Mus musculus
ctgttctctctcagggttcccgggc

SEQ ID NO: 427147 - DNA, 25 bp, Mus musculus
ctgttctgagacgggctaaagggcc

SEQ ID NO: 427148 - DNA, 25 bp, Mus musculus
ctgttcttagcacccaggttatgct

SEQ ID NO: 427149 - DNA, 25 bp, Mus musculus
ctgttgaacacgtaaagatctatta

SEQ ID NO: 427150 - DNA, 25 bp, Mus musculus
ctgttgaacatacttggagtagctg

SEQ ID NO: 427151 - DNA, 25 bp, Mus musculus
ctgttgatctggtctccccggcaga

SEQ ID NO: 427152 - DNA, 25 bp, Mus musculus
ctgttgatggaatgtgaccagctgc

SEQ ID NO: 427153 - DNA, 25 bp, Mus musculus
ctgttgctgtgctgaaaaataccat

SEQ ID NO: 427154 - DNA, 25 bp, Mus musculus
ctgttgggagtttctgcatctgggc

SEQ ID NO: 427155 - DNA, 25 bp, Mus musculus
ctgttgtagtaagaaagggtcatcc

SEQ ID NO: 427156 - DNA, 25 bp, Mus musculus
ctgtttagatcactgtatgaagaac

SEQ ID NO: 427157 - DNA, 25 bp, Mus musculus
ctgtttagctcacccatggcttcag

SEQ ID NO: 427158 - DNA, 25 bp, Mus musculus
ctgtttattctggaaagggcttgac

SEQ ID NO: 427159 - DNA, 25 bp, Mus musculus
ctgtttcctcatctgaaacgttggg

SEQ ID NO: 427160 - DNA, 25 bp, Mus musculus
ctgtttcctgggaaggcttgaccca

SEQ ID NO: 427161 - DNA, 25 bp, Mus musculus
ctgtttcctgtatttacctggctcc

SEQ ID NO: 427162 - DNA, 25 bp, Mus musculus
ctgtttcgcagacccacaggcctat

SEQ ID NO: 427163 - DNA, 25 bp, Mus musculus
ctgtttgaccgtgagtgccgccgtg

SEQ ID NO: 427164 - DNA, 25 bp, Mus musculus
ctgtttgacgagatgcctggaccca

SEQ ID NO: 427165 - DNA, 25 bp, Mus musculus
ctgtttgagcctattcataattatc

SEQ ID NO: 427166 - DNA, 25 bp, Mus musculus
ctgtttgcctgctgactgcgccgtg

SEQ ID NO: 427167 - DNA, 25 bp, Mus musculus
ctgtttgggaaatgggagttttgct

SEQ ID NO: 427168 - DNA, 25 bp, Mus musculus
ctgtttggtaccagccattggcgat

SEQ ID NO: 427169 - DNA, 25 bp, Mus musculus
ctgtttgtgcctcccaggaagctgc

SEQ ID NO: 427170 - DNA, 25 bp, Mus musculus
ctgtttgtttgctcatggcagggtc

SEQ ID NO: 427171 - DNA, 25 bp, Mus musculus
cttaaagacactagggcaggcgcca

SEQ ID NO: 427172 - DNA, 25 bp, Mus musculus
cttaaagacgcttctcttggacctt

SEQ ID NO: 427173 - DNA, 25 bp, Mus musculus
cttaaagatgaaccccagcagactg

SEQ ID NO: 427174 - DNA, 25 bp, Mus musculus
cttaaagtgcttccctccgacgagg

SEQ ID NO: 427175 - DNA, 25 bp, Mus musculus
cttaacagcaggaaacctccacttg

SEQ ID NO: 427176 - DNA, 25 bp, Mus musculus
cttaacgttcgctttctgtcacaga

SEQ ID NO: 427177 - DNA, 25 bp, Mus musculus
cttaactgcttattttcccactgta

SEQ ID NO: 427178 - DNA, 25 bp, Mus musculus
cttaagattcattaaggtgggcctc

SEQ ID NO: 427179 - DNA, 25 bp, Mus musculus
cttaagatttgagcgaggtggagct

SEQ ID NO: 427180 - DNA, 25 bp, Mus musculus
cttaagcaagtttcttcgaatacct

SEQ ID NO: 427181 - DNA, 25 bp, Mus musculus
cttaagcagctggttgacagacgca

SEQ ID NO: 427182 - DNA, 25 bp, Mus musculus
cttaagctctgaggcacgagtcacc

SEQ ID NO: 427183 - DNA, 25 bp, Mus musculus
cttaagctgagccttaagtggcagc

SEQ ID NO: 427184 - DNA, 25 bp, Mus musculus
cttaaggagtaagaactttgctggg

SEQ ID NO: 427185 - DNA, 25 bp, Mus musculus
cttaaggctagtgggaaacctctct

SEQ ID NO: 427186 - DNA, 25 bp, Mus musculus
cttaagtagaggagctggttggccc

SEQ ID NO: 427187 - DNA, 25 bp, Mus musculus
cttaagtgataatgtaaaggattgc

SEQ ID NO: 427188 - DNA, 25 bp, Mus musculus
cttaagtgatgatgagccgtctgcc

SEQ ID NO: 427189 - DNA, 25 bp, Mus musculus
cttaatagacctgagagacttcgtt

SEQ ID NO: 427190 - DNA, 25 bp, Mus musculus
cttaatgtgtagagacgagccggac

SEQ ID NO: 427191 - DNA, 25 bp, Mus musculus
cttaattgctgtagggactcattcc

SEQ ID NO: 427192 - DNA, 25 bp, Mus musculus
cttaattgggctagaatgtgtgtgc

SEQ ID NO: 427193 - DNA, 25 bp, Mus musculus
cttacacagagggagccaggcatgt

SEQ ID NO: 427194 - DNA, 25 bp, Mus musculus
cttacagagggttatcagggcctgg

SEQ ID NO: 427195 - DNA, 25 bp, Mus musculus
cttacaggaaatagatggagcgctc

SEQ ID NO: 427196 - DNA, 25 bp, Mus musculus
cttacatatgttagagctgctccag

SEQ ID NO: 427197 - DNA, 25 bp, Mus musculus
cttacatgatctcctagctggctgg

SEQ ID NO: 427198 - DNA, 25 bp, Mus musculus
cttacatgttcaggcgagctcccag

SEQ ID NO: 427199 - DNA, 25 bp, Mus musculus
cttacatgttgctgttaagaagcca

SEQ ID NO: 427200 - DNA, 25 bp, Mus musculus
cttaccaaaggacgtatctgaggat

SEQ ID NO: 427201 - DNA, 25 bp, Mus musculus
cttaccagaaggaggagtgtcatca

SEQ ID NO: 427202 - DNA, 25 bp, Mus musculus
cttaccatggaagaagggaagagta

SEQ ID NO: 427203 - DNA, 25 bp, Mus musculus
cttaccggtgagactgggcttggac

SEQ ID NO: 427204 - DNA, 25 bp, Mus musculus
cttacgccgtgggagaagaggacct

SEQ ID NO: 427205 - DNA, 25 bp, Mus musculus
cttacgctgcaaggatacggccaca

SEQ ID NO: 427206 - DNA, 25 bp, Mus musculus
cttacggagggaagaaaccactgca

SEQ ID NO: 427207 - DNA, 25 bp, Mus musculus
cttacggcaaaggtatcatctgtct

SEQ ID NO: 427208 - DNA, 25 bp, Mus musculus
cttacggccggcaagaatggatgta

SEQ ID NO: 427209 - DNA, 25 bp, Mus musculus
cttacgggcagacgtgtattctgtc

SEQ ID NO: 427210 - DNA, 25 bp, Mus musculus
cttacgggtagagagctgagcaaac

SEQ ID NO: 427211 - DNA, 25 bp, Mus musculus
cttacgttggtggtgccaggctgcc

SEQ ID NO: 427212 - DNA, 25 bp, Mus musculus
cttactaagtcatattagagttcag

SEQ ID NO: 427213 - DNA, 25 bp, Mus musculus
cttactaatatagctgtgccacaga

SEQ ID NO: 427214 - DNA, 25 bp, Mus musculus
cttactccaggaaatgatttgtctc

SEQ ID NO: 427215 - DNA, 25 bp, Mus musculus
cttactctgagatgtggtctatgca

SEQ ID NO: 427216 - DNA, 25 bp, Mus musculus
cttactctgtccaacccctgtggta

SEQ ID NO: 427217 - DNA, 25 bp, Mus musculus
cttactgaagaggaccgggatgact

SEQ ID NO: 427218 - DNA, 25 bp, Mus musculus
cttactgacgctgccttgagacagg

SEQ ID NO: 427219 - DNA, 25 bp, Mus musculus
cttactgtcaggcaacggtgggcca

SEQ ID NO: 427220 - DNA, 25 bp, Mus musculus
cttacttaagtgagcaagacttgcg

SEQ ID NO: 427221 - DNA, 25 bp, Mus musculus
cttacttaatatagatccaactggc

SEQ ID NO: 427222 - DNA, 25 bp, Mus musculus
cttacttctggagggccaggtctct

SEQ ID NO: 427223 - DNA, 25 bp, Mus musculus
cttagaaaggtgaagccgcgggatc

SEQ ID NO: 427224 - DNA, 25 bp, Mus musculus
cttagacactgcatacgggaaggag

SEQ ID NO: 427225 - DNA, 25 bp, Mus musculus
cttagactgggtttatgacctgggc

SEQ ID NO: 427226 - DNA, 25 bp, Mus musculus
cttagagagtgtttagcaggatgaa

SEQ ID NO: 427227 - DNA, 25 bp, Mus musculus
cttagagatgcccaaaaattgtggg

SEQ ID NO: 427228 - DNA, 25 bp, Mus musculus
cttagagatggctcccaatgtcccc

SEQ ID NO: 427229 - DNA, 25 bp, Mus musculus
cttagagggtttgctccagcgggac

SEQ ID NO: 427230 - DNA, 25 bp, Mus musculus
cttagagtctgcagtagtcgttacc

SEQ ID NO: 427231 - DNA, 25 bp, Mus musculus
cttagataacccttcctccaggaag

SEQ ID NO: 427232 - DNA, 25 bp, Mus musculus
cttagcaaggcagctgcccagtgga

SEQ ID NO: 427233 - DNA, 25 bp, Mus musculus
cttagcaccagtccattctcttgga

SEQ ID NO: 427234 - DNA, 25 bp, Mus musculus
cttagcagccatggaggagagatct

SEQ ID NO: 427235 - DNA, 25 bp, Mus musculus
cttagcccttaaccagtgcccaatt

SEQ ID NO: 427236 - DNA, 25 bp, Mus musculus
cttagcgttcagcaaagtcaaagga

SEQ ID NO: 427237 - DNA, 25 bp, Mus musculus
cttaggactggagcctggataacca

SEQ ID NO: 427238 - DNA, 25 bp, Mus musculus
cttaggagactgcaccgcaagcact

SEQ ID NO: 427239 - DNA, 25 bp, Mus musculus
cttaggagatgcttgtaggagtgac

SEQ ID NO: 427240 - DNA, 25 bp, Mus musculus
cttaggcagcaatgagggcaactcc

SEQ ID NO: 427241 - DNA, 25 bp, Mus musculus
cttagggagaaggaacgacagctgc

SEQ ID NO: 427242 - DNA, 25 bp, Mus musculus
cttagggcttcagcagtgcgcgtgc

SEQ ID NO: 427243 - DNA, 25 bp, Mus musculus
cttaggtctaagcaaggccatctgg

SEQ ID NO: 427244 - DNA, 25 bp, Mus musculus
cttaggttgtttctgtctgaggttc

SEQ ID NO: 427245 - DNA, 25 bp, Mus musculus
cttagtagtgaaaccgaatgtgtcc

SEQ ID NO: 427246 - DNA, 25 bp, Mus musculus
cttagtcgagcttgggctgctgagt

SEQ ID NO: 427247 - DNA, 25 bp, Mus musculus
cttagtgaggcgcagcactggctca

SEQ ID NO: 427248 - DNA, 25 bp, Mus musculus
cttagtgggccggatgatttggaac

SEQ ID NO: 427249 - DNA, 25 bp, Mus musculus
cttagttatgccaggcctagggagg

SEQ ID NO: 427250 - DNA, 25 bp, Mus musculus
cttagtttcttcagcgagtcgccgg

SEQ ID NO: 427251 - DNA, 25 bp, Mus musculus
cttataacaaccctgtgccccgtgg

SEQ ID NO: 427252 - DNA, 25 bp, Mus musculus
cttataaccaaacggagaagcctgt

SEQ ID NO: 427253 - DNA, 25 bp, Mus musculus
cttataatggaggaacaaggcaatt

SEQ ID NO: 427254 - DNA, 25 bp, Mus musculus
cttatagaccaaccatcagggcaga

SEQ ID NO: 427255 - DNA, 25 bp, Mus musculus
cttatatagtgcgagccccatggcc

SEQ ID NO: 427256 - DNA, 25 bp, Mus musculus
cttatatcacccgaccagaggcaga

SEQ ID NO: 427257 - DNA, 25 bp, Mus musculus
cttatatcttgaaaactgggccgta

SEQ ID NO: 427258 - DNA, 25 bp, Mus musculus
cttatcaacaataggagctggtgca

SEQ ID NO: 427259 - DNA, 25 bp, Mus musculus
cttatcaacggaggcatagctgtct

SEQ ID NO: 427260 - DNA, 25 bp, Mus musculus
cttatcaagaccaaatgtctgaggt

SEQ ID NO: 427261 - DNA, 25 bp, Mus musculus
cttatctagtatgcacgtgggccca

SEQ ID NO: 427262 - DNA, 25 bp, Mus musculus
cttatctgggtgaagacgtctcgca

SEQ ID NO: 427263 - DNA, 25 bp, Mus musculus
cttatgaagagattaacgatactgg

SEQ ID NO: 427264 - DNA, 25 bp, Mus musculus
cttatgacaacttcggactagatcc

SEQ ID NO: 427265 - DNA, 25 bp, Mus musculus
cttatgccaatgaggaacgccagga

SEQ ID NO: 427266 - DNA, 25 bp, Mus musculus
cttatgccatgagttcctgcgaggg

SEQ ID NO: 427267 - DNA, 25 bp, Mus musculus
cttatgtaaggacgaagccagtgac

SEQ ID NO: 427268 - DNA, 25 bp, Mus musculus
cttattgggaaggaacagctgtgat

SEQ ID NO: 427269 - DNA, 25 bp, Mus musculus
cttattgtcgaatgagaagcgatct

SEQ ID NO: 427270 - DNA, 25 bp, Mus musculus
cttatttcttgcataaagcaaggca

SEQ ID NO: 427271 - DNA, 25 bp, Mus musculus
cttatttgatatagccagagccacc

SEQ ID NO: 427272 - DNA, 25 bp, Mus musculus
cttcaaagaaacatcaaaaacctgg

SEQ ID NO: 427273 - DNA, 25 bp, Mus musculus
cttcaacaacaccatctccaatgta

SEQ ID NO: 427274 - DNA, 25 bp, Mus musculus
cttcaacgtgcgagaggccatgggc

SEQ ID NO: 427275 - DNA, 25 bp, Mus musculus
cttcaagaagatcctctgccgtggg

SEQ ID NO: 427276 - DNA, 25 bp, Mus musculus
cttcaagccaccagccaatgagaac

SEQ ID NO: 427277 - DNA, 25 bp, Mus musculus
cttcaataaggagacagcagcggct

SEQ ID NO: 427278 - DNA, 25 bp, Mus musculus
cttcaattcaccttatgggtatttg

SEQ ID NO: 427279 - DNA, 25 bp, Mus musculus
cttcactaagtcagaaattaaatgg

SEQ ID NO: 427280 - DNA, 25 bp, Mus musculus
cttcactggtgaggacagaaggcgt

SEQ ID NO: 427281 - DNA, 25 bp, Mus musculus
cttcacttccactcagagctctgaa

SEQ ID NO: 427282 - DNA, 25 bp, Mus musculus
cttcagaaatgagagtgcacagcct

SEQ ID NO: 427283 - DNA, 25 bp, Mus musculus
cttcagaacattcaggtactgggac

SEQ ID NO: 427284 - DNA, 25 bp, Mus musculus
cttcagaatgaaatggttactgcac

SEQ ID NO: 427285 - DNA, 25 bp, Mus musculus
cttcagaatgaacgcgcacaggcct

SEQ ID NO: 427286 - DNA, 25 bp, Mus musculus
cttcagaccaagcatttaaagaaca

SEQ ID NO: 427287 - DNA, 25 bp, Mus musculus
cttcagacgaagatgggaattctca

SEQ ID NO: 427288 - DNA, 25 bp, Mus musculus
cttcagagcaccatgtttttctggg

SEQ ID NO: 427289 - DNA, 25 bp, Mus musculus
cttcagaggtgcaaatcgacgggac

SEQ ID NO: 427290 - DNA, 25 bp, Mus musculus
cttcagcagtcatcaggacaaaggg

SEQ ID NO: 427291 - DNA, 25 bp, Mus musculus
cttcagctaaagagacacggagtgc

SEQ ID NO: 427292 - DNA, 25 bp, Mus musculus
cttcagctgcggtgcagagaggacc

SEQ ID NO: 427293 - DNA, 25 bp, Mus musculus
cttcaggacaaatgtagcgaacccc

SEQ ID NO: 427294 - DNA, 25 bp, Mus musculus
cttcaggagcgaacatggaccagtg

SEQ ID NO: 427295 - DNA, 25 bp, Mus musculus
cttcaggcaccatgaggagcgccat

SEQ ID NO: 427296 - DNA, 25 bp, Mus musculus
cttcaggcgccagaggatcaagaga

SEQ ID NO: 427297 - DNA, 25 bp, Mus musculus
cttcaggtaagcgaatccgtggcac

SEQ ID NO: 427298 - DNA, 25 bp, Mus musculus
cttcagtccttcagtctttatcctg

SEQ ID NO: 427299 - DNA, 25 bp, Mus musculus
cttcagtgaagggactatggtgtca

SEQ ID NO: 427300 - DNA, 25 bp, Mus musculus
cttcataacagagagggtcccagcc

SEQ ID NO: 427301 - DNA, 25 bp, Mus musculus
cttcatacccgatgtacagtctctg

SEQ ID NO: 427302 - DNA, 25 bp, Mus musculus
cttcatagtactggagcgggcatta

SEQ ID NO: 427303 - DNA, 25 bp, Mus musculus
cttcatattactgtctgtggaggca

SEQ ID NO: 427304 - DNA, 25 bp, Mus musculus
cttcatcaacgccaaagaaatgacc

SEQ ID NO: 427305 - DNA, 25 bp, Mus musculus
cttcatccacaacgcggacgagcgg

SEQ ID NO: 427306 - DNA, 25 bp, Mus musculus
cttcatggcttctgtgctttatgga

SEQ ID NO: 427307 - DNA, 25 bp, Mus musculus
cttcatgggtgcctcagagccagac

SEQ ID NO: 427308 - DNA, 25 bp, Mus musculus
cttcatgtgcataattagattaaag

SEQ ID NO: 427309 - DNA, 25 bp, Mus musculus
cttcatgtggagtgggaaaacacca

SEQ ID NO: 427310 - DNA, 25 bp, Mus musculus
cttccaaaatacaactggaatctgt

SEQ ID NO: 427311 - DNA, 25 bp, Mus musculus
cttccaaaggaagcaatgatgtggc

SEQ ID NO: 427312 - DNA, 25 bp, Mus musculus
cttccactgagctatatttacccca

SEQ ID NO: 427313 - DNA, 25 bp, Mus musculus
cttccactgtatagcctgatgtgtt

SEQ ID NO: 427314 - DNA, 25 bp, Mus musculus
cttccacttgtaccggccacaggag

SEQ ID NO: 427315 - DNA, 25 bp, Mus musculus
cttccagaagctcctctcgacggtg

SEQ ID NO: 427316 - DNA, 25 bp, Mus musculus
cttccagatggagtgtcgaggccgc

SEQ ID NO: 427317 - DNA, 25 bp, Mus musculus
cttccagcaaaagaagaaccttcgc

SEQ ID NO: 427318 - DNA, 25 bp, Mus musculus
cttccagccagaagtgtggtcctca

SEQ ID NO: 427319 - DNA, 25 bp, Mus musculus
cttccaggagcattcgaatgagccg

SEQ ID NO: 427320 - DNA, 25 bp, Mus musculus
cttccagggctaggtgatttgttgg

SEQ ID NO: 427321 - DNA, 25 bp, Mus musculus
cttccaggtatccagccttggctgc

SEQ ID NO: 427322 - DNA, 25 bp, Mus musculus
cttccagtagtaattgtagcgccaa

SEQ ID NO: 427323 - DNA, 25 bp, Mus musculus
cttccagttcgttcctccaggacaa

SEQ ID NO: 427324 - DNA, 25 bp, Mus musculus
cttccagttgatgcagtgcggcgca

SEQ ID NO: 427325 - DNA, 25 bp, Mus musculus
cttccattctaggaggcaggcggcc

SEQ ID NO: 427326 - DNA, 25 bp, Mus musculus
cttcccggtccggaggtgcagcgaa

SEQ ID NO: 427327 - DNA, 25 bp, Mus musculus
cttccctcaagcactgatgcagttg

SEQ ID NO: 427328 - DNA, 25 bp, Mus musculus
cttccctgttcaggtcagtttagaa

SEQ ID NO: 427329 - DNA, 25 bp, Mus musculus
cttccgaagcctgaggacgccattt

SEQ ID NO: 427330 - DNA, 25 bp, Mus musculus
cttccgaggagtaaagggcaccact

SEQ ID NO: 427331 - DNA, 25 bp, Mus musculus
cttcctaagcctctactgacagcaa

SEQ ID NO: 427332 - DNA, 25 bp, Mus musculus
cttcctccgcgacagagaagctggg

SEQ ID NO: 427333 - DNA, 25 bp, Mus musculus
cttcctctgcaaaaatgggcctggt

SEQ ID NO: 427334 - DNA, 25 bp, Mus musculus
cttcctctgcctactagactaacaa

SEQ ID NO: 427335 - DNA, 25 bp, Mus musculus
cttcctgaaccaagcagttgtgaaa

SEQ ID NO: 427336 - DNA, 25 bp, Mus musculus
cttcctgcagcgtctgcaacatcta

SEQ ID NO: 427337 - DNA, 25 bp, Mus musculus
cttcctgggctgagttatgaatgac

SEQ ID NO: 427338 - DNA, 25 bp, Mus musculus
cttcctggtgaagaaagctagcgac

SEQ ID NO: 427339 - DNA, 25 bp, Mus musculus
cttccttaaggaagcataggacgat

SEQ ID NO: 427340 - DNA, 25 bp, Mus musculus
cttccttagaagtggcaaagtgccc

SEQ ID NO: 427341 - DNA, 25 bp, Mus musculus
cttccttcgacgcaaaacagacttt

SEQ ID NO: 427342 - DNA, 25 bp, Mus musculus
cttccttgaaggaggtataagacct

SEQ ID NO: 427343 - DNA, 25 bp, Mus musculus
cttcgaaataatcctggagggacca

SEQ ID NO: 427344 - DNA, 25 bp, Mus musculus
cttcgaaggtgcacatgatccggcc

SEQ ID NO: 427345 - DNA, 25 bp, Mus musculus
cttcgacggaatccccagagagaag

SEQ ID NO: 427346 - DNA, 25 bp, Mus musculus
cttcgatactaccaaatgcaaaggc

SEQ ID NO: 427347 - DNA, 25 bp, Mus musculus
cttcgatgagtatgggcgccccttt

SEQ ID NO: 427348 - DNA, 25 bp, Mus musculus
cttcgatttggacctagtgggaaca

SEQ ID NO: 427349 - DNA, 25 bp, Mus musculus
cttcgcgccctgctacctggataac

SEQ ID NO: 427350 - DNA, 25 bp, Mus musculus
cttcgcggtgctggagtacgagaca

SEQ ID NO: 427351 - DNA, 25 bp, Mus musculus
cttcggaatcaaggcaagcccaggc

SEQ ID NO: 427352 - DNA, 25 bp, Mus musculus
cttcggaatggcacaaaggttgtcc

SEQ ID NO: 427353 - DNA, 25 bp, Mus musculus
cttcggacacacaggacgggtgctg

SEQ ID NO: 427354 - DNA, 25 bp, Mus musculus
cttcggctcgggacccgcggcttgt

SEQ ID NO: 427355 - DNA, 25 bp, Mus musculus
cttcgggtatgctcaggctaggatg

SEQ ID NO: 427356 - DNA, 25 bp, Mus musculus
cttcggttccctcggtcactggcat

SEQ ID NO: 427357 - DNA, 25 bp, Mus musculus
cttcggtttcacaactatgaaatgg

SEQ ID NO: 427358 - DNA, 25 bp, Mus musculus
cttcgtcgttggctaggttttggat

SEQ ID NO: 427359 - DNA, 25 bp, Mus musculus
cttcgtgaccaagagaaactactgg

SEQ ID NO: 427360 - DNA, 25 bp, Mus musculus
cttcgtgactgcatgaaaaagctaa

SEQ ID NO: 427361 - DNA, 25 bp, Mus musculus
cttcgtggactacagggacctaatc

SEQ ID NO: 427362 - DNA, 25 bp, Mus musculus
cttcgttcatgtgcagcgggacccg

SEQ ID NO: 427363 - DNA, 25 bp, Mus musculus
cttctaaaagcgcttaaactgggag

SEQ ID NO: 427364 - DNA, 25 bp, Mus musculus
cttctacaataaaacgggagcgtgc

SEQ ID NO: 427365 - DNA, 25 bp, Mus musculus
cttctagcgagcaagcagtggccct

SEQ ID NO: 427366 - DNA, 25 bp, Mus musculus
cttctaggttaaagaagagaagcac

SEQ ID NO: 427367 - DNA, 25 bp, Mus musculus
cttctcatcaacaatgcgggcgtga

SEQ ID NO: 427368 - DNA, 25 bp, Mus musculus
cttctcatctcatcgttgccaagag

SEQ ID NO: 427369 - DNA, 25 bp, Mus musculus
cttctcatggctggtgagtgtcccc

SEQ ID NO: 427370 - DNA, 25 bp, Mus musculus
cttctccaggttgaccgaggcgtgc

SEQ ID NO: 427371 - DNA, 25 bp, Mus musculus
cttctcccgggacgcttagctcttg

SEQ ID NO: 427372 - DNA, 25 bp, Mus musculus
cttctcctgtcaggccgggataact

SEQ ID NO: 427373 - DNA, 25 bp, Mus musculus
cttctcggtgtatcaggccagcgca

SEQ ID NO: 427374 - DNA, 25 bp, Mus musculus
cttctctgggaggatgtacatcagg

SEQ ID NO: 427375 - DNA, 25 bp, Mus musculus
cttctctgtggaaagctcgggccct

SEQ ID NO: 427376 - DNA, 25 bp, Mus musculus
cttctctgtgtttggaactgtcatc

SEQ ID NO: 427377 - DNA, 25 bp, Mus musculus
cttctgactgcatggtgaactttca

SEQ ID NO: 427378 - DNA, 25 bp, Mus musculus
cttctgagcttcgtgggagtgtccc

SEQ ID NO: 427379 - DNA, 25 bp, Mus musculus
cttctgaggcagagtgagtgtcgga

SEQ ID NO: 427380 - DNA, 25 bp, Mus musculus
cttctgattccggaaaccctgtgat

SEQ ID NO: 427381 - DNA, 25 bp, Mus musculus
cttctgcagaggattgagtttgagc

SEQ ID NO: 427382 - DNA, 25 bp, Mus musculus
cttctgcatccgcatctatacttga

SEQ ID NO: 427383 - DNA, 25 bp, Mus musculus
cttctgccaaatagtgcatattatg

SEQ ID NO: 427384 - DNA, 25 bp, Mus musculus
cttctgccaaggcaaagctgatggg

SEQ ID NO: 427385 - DNA, 25 bp, Mus musculus
cttctgctagcaggtaggctcttct

SEQ ID NO: 427386 - DNA, 25 bp, Mus musculus
cttctgctgatgagacccagcgcta

SEQ ID NO: 427387 - DNA, 25 bp, Mus musculus
cttctggaagaagttgattcttgtc

SEQ ID NO: 427388 - DNA, 25 bp, Mus musculus
cttctggaagatacgaggatgggcc

SEQ ID NO: 427389 - DNA, 25 bp, Mus musculus
cttctggcagacagggaagtatgca

SEQ ID NO: 427390 - DNA, 25 bp, Mus musculus
cttctgggaaactacgggcgactct

SEQ ID NO: 427391 - DNA, 25 bp, Mus musculus
cttctgggaaagagctagagccact

SEQ ID NO: 427392 - DNA, 25 bp, Mus musculus
cttctggtcagtgtctaatctgatc

SEQ ID NO: 427393 - DNA, 25 bp, Mus musculus
cttctggtgtgcagacagagtactc

SEQ ID NO: 427394 - DNA, 25 bp, Mus musculus
cttctgtcccttggagcggcgggct

SEQ ID NO: 427395 - DNA, 25 bp, Mus musculus
cttctgtgaggagcggagctgcact

SEQ ID NO: 427396 - DNA, 25 bp, Mus musculus
cttctgtgggcaggtgaaagcccta

SEQ ID NO: 427397 - DNA, 25 bp, Mus musculus
cttcttcagcttccttcgacgcaaa

SEQ ID NO: 427398 - DNA, 25 bp, Mus musculus
cttcttcagctttgagcgtgggcca

SEQ ID NO: 427399 - DNA, 25 bp, Mus musculus
cttcttcaggctctcccgtgccgga

SEQ ID NO: 427400 - DNA, 25 bp, Mus musculus
cttcttgcagagagagcgaggttaa

SEQ ID NO: 427401 - DNA, 25 bp, Mus musculus
cttcttggcagagagcactagaggc

SEQ ID NO: 427402 - DNA, 25 bp, Mus musculus
cttcttgggtttagcgattagtgcc

SEQ ID NO: 427403 - DNA, 25 bp, Mus musculus
cttcttggtaagtagggttaggcat

SEQ ID NO: 427404 - DNA, 25 bp, Mus musculus
cttctttagccaggatgagcgcgcc

SEQ ID NO: 427405 - DNA, 25 bp, Mus musculus
cttctttctgcaggctgctcatcag

SEQ ID NO: 427406 - DNA, 25 bp, Mus musculus
cttctttgagcggagtggcctggcc

SEQ ID NO: 427407 - DNA, 25 bp, Mus musculus
cttctttggtcttaagtctgtctgc

SEQ ID NO: 427408 - DNA, 25 bp, Mus musculus
cttgaaaatcgaacagaacaacaac

SEQ ID NO: 427409 - DNA, 25 bp, Mus musculus
cttgaaacttcacagaggcaaaggc

SEQ ID NO: 427410 - DNA, 25 bp, Mus musculus
cttgaaagtgatgggctgaagctag

SEQ ID NO: 427411 - DNA, 25 bp, Mus musculus
cttgaaagtgggtcagctaaccgtg

SEQ ID NO: 427412 - DNA, 25 bp, Mus musculus
cttgaacaacgcttacgcccgggat

SEQ ID NO: 427413 - DNA, 25 bp, Mus musculus
cttgaacagcagagagacccagact

SEQ ID NO: 427414 - DNA, 25 bp, Mus musculus
cttgaacggcagtcagatggtcccc

SEQ ID NO: 427415 - DNA, 25 bp, Mus musculus
cttgaacgtcacaagccatggagag

SEQ ID NO: 427416 - DNA, 25 bp, Mus musculus
cttgaactacaaggccgggagggat

SEQ ID NO: 427417 - DNA, 25 bp, Mus musculus
cttgaactcgtggtgaagctggccc

SEQ ID NO: 427418 - DNA, 25 bp, Mus musculus
cttgaactttgcgtagtcacatagc

SEQ ID NO: 427419 - DNA, 25 bp, Mus musculus
cttgaagccagccaaacgggagact

SEQ ID NO: 427420 - DNA, 25 bp, Mus musculus
cttgaagcgcgtgggaccgaacact

SEQ ID NO: 427421 - DNA, 25 bp, Mus musculus
cttgaagctcatacgccaggtggac

SEQ ID NO: 427422 - DNA, 25 bp, Mus musculus
cttgacatacaggttgagaaactgc

SEQ ID NO: 427423 - DNA, 25 bp, Mus musculus
cttgacatggatttagaggagcacc

SEQ ID NO: 427424 - DNA, 25 bp, Mus musculus
cttgactctggaccgctctgcctaa

SEQ ID NO: 427425 - DNA, 25 bp, Mus musculus
cttgactggcctggagatgaccact

SEQ ID NO: 427426 - DNA, 25 bp, Mus musculus
cttgactgtaacaaaacaatggtgt

SEQ ID NO: 427427 - DNA, 25 bp, Mus musculus
cttgagaaaaagtcgatgcctggga

SEQ ID NO: 427428 - DNA, 25 bp, Mus musculus
cttgagaaacaaggacgtgagggct

SEQ ID NO: 427429 - DNA, 25 bp, Mus musculus
cttgagaactaggttgggaccatgg

SEQ ID NO: 427430 - DNA, 25 bp, Mus musculus
cttgagacctgtaggaaaagactct

SEQ ID NO: 427431 - DNA, 25 bp, Mus musculus
cttgagcagaagagtacgcggtgct

SEQ ID NO: 427432 - DNA, 25 bp, Mus musculus
cttgagcatatgaggcttgtgggac

SEQ ID NO: 427433 - DNA, 25 bp, Mus musculus
cttgagcgcgaggttgaccggcggc

SEQ ID NO: 427434 - DNA, 25 bp, Mus musculus
cttgagcgtaaacatgtcaggttcg

SEQ ID NO: 427435 - DNA, 25 bp, Mus musculus
cttgaggaacccgtgaaagagggca

SEQ ID NO: 427436 - DNA, 25 bp, Mus musculus
cttgaggaagtagaatccagcttac

SEQ ID NO: 427437 - DNA, 25 bp, Mus musculus
cttgaggagccaccatacacgcata

SEQ ID NO: 427438 - DNA, 25 bp, Mus musculus
cttgaggcaggaaggcacaccgttt

SEQ ID NO: 427439 - DNA, 25 bp, Mus musculus
cttgaggcaggccaagcaaggacca

SEQ ID NO: 427440 - DNA, 25 bp, Mus musculus
cttgaggctcacacaaaggaggcgc

SEQ ID NO: 427441 - DNA, 25 bp, Mus musculus
cttgagggcctctggttacagtgcc

SEQ ID NO: 427442 - DNA, 25 bp, Mus musculus
cttgaggtgcaggaaggcattgccc

SEQ ID NO: 427443 - DNA, 25 bp, Mus musculus
cttgagtagagagaaatgattgggc

SEQ ID NO: 427444 - DNA, 25 bp, Mus musculus
cttgagtgttttgcaggctctgcag

SEQ ID NO: 427445 - DNA, 25 bp, Mus musculus
cttgagttcaccatggcggcctggg

SEQ ID NO: 427446 - DNA, 25 bp, Mus musculus
cttgataccaaacacttaaggaggg

SEQ ID NO: 427447 - DNA, 25 bp, Mus musculus
cttgatgaaatacgtgacagccacc

SEQ ID NO: 427448 - DNA, 25 bp, Mus musculus
cttgatggtttctacagggcgtggc

SEQ ID NO: 427449 - DNA, 25 bp, Mus musculus
cttgattcaggcgagttctggctgg

SEQ ID NO: 427450 - DNA, 25 bp, Mus musculus
cttgcaaagtcagggtccatggcgg

SEQ ID NO: 427451 - DNA, 25 bp, Mus musculus
cttgcaactgtttgccgggactctg

SEQ ID NO: 427452 - DNA, 25 bp, Mus musculus
cttgcaccagtattgaggcggacga

SEQ ID NO: 427453 - DNA, 25 bp, Mus musculus
cttgcaccattcagaaataggctgc

SEQ ID NO: 427454 - DNA, 25 bp, Mus musculus
cttgcagagccatggttgtggccta

SEQ ID NO: 427455 - DNA, 25 bp, Mus musculus
cttgcagcagaactcgccagctggt

SEQ ID NO: 427456 - DNA, 25 bp, Mus musculus
cttgcagctgcctgggccctgtcgg

SEQ ID NO: 427457 - DNA, 25 bp, Mus musculus
cttgcaggctccaaatcatctggct

SEQ ID NO: 427458 - DNA, 25 bp, Mus musculus
cttgcagtttcagacgacagtggga

SEQ ID NO: 427459 - DNA, 25 bp, Mus musculus
cttgcattaggtgatccaggagccc

SEQ ID NO: 427460 - DNA, 25 bp, Mus musculus
cttgccacggtgaaggtagaagatg

SEQ ID NO: 427461 - DNA, 25 bp, Mus musculus
cttgccagaaaagtgaagaacgttg

SEQ ID NO: 427462 - DNA, 25 bp, Mus musculus
cttgccagagatgatcaggatggta

SEQ ID NO: 427463 - DNA, 25 bp, Mus musculus
cttgccccgtgaggtcagtcacgtg

SEQ ID NO: 427464 - DNA, 25 bp, Mus musculus
cttgccgggagacctacctgagtga

SEQ ID NO: 427465 - DNA, 25 bp, Mus musculus
cttgcctcccaccacataatagttg

SEQ ID NO: 427466 - DNA, 25 bp, Mus musculus
cttgcctgaggtaggagtcttccgg

SEQ ID NO: 427467 - DNA, 25 bp, Mus musculus
cttgcctgcctaggtctgctttggg

SEQ ID NO: 427468 - DNA, 25 bp, Mus musculus
cttgcgagaaagttacctgtggccg

SEQ ID NO: 427469 - DNA, 25 bp, Mus musculus
cttgcgaggcaaccggcgttcatat

SEQ ID NO: 427470 - DNA, 25 bp, Mus musculus
cttgcgcaggtcttatgcaggcttc

SEQ ID NO: 427471 - DNA, 25 bp, Mus musculus
cttgcgctcgcagtgccaaaaggcg

SEQ ID NO: 427472 - DNA, 25 bp, Mus musculus
cttgcgctggcatgatctacctggg

SEQ ID NO: 427473 - DNA, 25 bp, Mus musculus
cttgcgctgtacaccgggctaggct

SEQ ID NO: 427474 - DNA, 25 bp, Mus musculus
cttgcggagggcagaagccaatctg

SEQ ID NO: 427475 - DNA, 25 bp, Mus musculus
cttgctcgggagtcatagggttcag

SEQ ID NO: 427476 - DNA, 25 bp, Mus musculus
cttgctctgggaatgcgaccggaca

SEQ ID NO: 427477 - DNA, 25 bp, Mus musculus
cttgctctttgactgggctccacga

SEQ ID NO: 427478 - DNA, 25 bp, Mus musculus
cttgctgacccgacaccggtgcttt

SEQ ID NO: 427479 - DNA, 25 bp, Mus musculus
cttgctgagcaagctgtcacgatct

SEQ ID NO: 427480 - DNA, 25 bp, Mus musculus
cttgctgagcataaaacttgggacc

SEQ ID NO: 427481 - DNA, 25 bp, Mus musculus
cttgctgagtgctgcccacgtcctg

SEQ ID NO: 427482 - DNA, 25 bp, Mus musculus
cttgctgctgttggccgacaaagtg

SEQ ID NO: 427483 - DNA, 25 bp, Mus musculus
cttgctggagtagtgcgctgcctgt

SEQ ID NO: 427484 - DNA, 25 bp, Mus musculus
cttgctggctgtcaaaggctcttga

SEQ ID NO: 427485 - DNA, 25 bp, Mus musculus
cttgctgggaaggttagcggtgagt

SEQ ID NO: 427486 - DNA, 25 bp, Mus musculus
cttgctgtcatgaactccccgcagg

SEQ ID NO: 427487 - DNA, 25 bp, Mus musculus
cttgcttacaactactgaccccgag

SEQ ID NO: 427488 - DNA, 25 bp, Mus musculus
cttgcttagagggaaatacacattt

SEQ ID NO: 427489 - DNA, 25 bp, Mus musculus
cttgcttcaagaagcctggtcctgg

SEQ ID NO: 427490 - DNA, 25 bp, Mus musculus
cttgcttctacgacacctgctggag

SEQ ID NO: 427491 - DNA, 25 bp, Mus musculus
cttggaacatggaggtgagtgtcct

SEQ ID NO: 427492 - DNA, 25 bp, Mus musculus
cttggaagatgatacggagaggccc

SEQ ID NO: 427493 - DNA, 25 bp, Mus musculus
cttggaagttgctgtgccacgccca

SEQ ID NO: 427494 - DNA, 25 bp, Mus musculus
cttggaatgtcagcttacaatggag

SEQ ID NO: 427495 - DNA, 25 bp, Mus musculus
cttggacaagtgagtaccgagctat

SEQ ID NO: 427496 - DNA, 25 bp, Mus musculus
cttggacacaagcacctgaggagac

SEQ ID NO: 427497 - DNA, 25 bp, Mus musculus
cttggaccttcctgcagagctgaga

SEQ ID NO: 427498 - DNA, 25 bp, Mus musculus
cttggacggagaagccagctgtgct

SEQ ID NO: 427499 - DNA, 25 bp, Mus musculus
cttggactggcaacagagggttcat

SEQ ID NO: 427500 - DNA, 25 bp, Mus musculus
cttggacttcaaaagcgagggctca

SEQ ID NO: 427501 - DNA, 25 bp, Mus musculus
cttggagaataaggtcagaactacc

SEQ ID NO: 427502 - DNA, 25 bp, Mus musculus
cttggagaccagcaagtattgtcct

SEQ ID NO: 427503 - DNA, 25 bp, Mus musculus
cttggagattgaacgccgccggatg

SEQ ID NO: 427504 - DNA, 25 bp, Mus musculus
cttggagccagcagatagtcggaca

SEQ ID NO: 427505 - DNA, 25 bp, Mus musculus
cttggagcgtcacaaagaggtgtcc

SEQ ID NO: 427506 - DNA, 25 bp, Mus musculus
cttggagggcaagcagatacggttc

SEQ ID NO: 427507 - DNA, 25 bp, Mus musculus
cttggagggcgcaggatatcagcct

SEQ ID NO: 427508 - DNA, 25 bp, Mus musculus
cttggaggtatccttctggtgagct

SEQ ID NO: 427509 - DNA, 25 bp, Mus musculus
cttggagtcatgcatgacaccatga

SEQ ID NO: 427510 - DNA, 25 bp, Mus musculus
cttggataaatggttgcctgcacca

SEQ ID NO: 427511 - DNA, 25 bp, Mus musculus
cttggatgagaaaagcggcagcttc

SEQ ID NO: 427512 - DNA, 25 bp, Mus musculus
cttggattctcttgggccccgtcat

SEQ ID NO: 427513 - DNA, 25 bp, Mus musculus
cttggattctttatgcagctgagga

SEQ ID NO: 427514 - DNA, 25 bp, Mus musculus
cttggcaagcgaggcacactggtat

SEQ ID NO: 427515 - DNA, 25 bp, Mus musculus
cttggcagatcttacagagcagcag

SEQ ID NO: 427516 - DNA, 25 bp, Mus musculus
cttggcagccgcttcatgacaggaa

SEQ ID NO: 427517 - DNA, 25 bp, Mus musculus
cttggcagcctttgactcaggtgct

SEQ ID NO: 427518 - DNA, 25 bp, Mus musculus
cttggcaggtgctttggctttcctc

SEQ ID NO: 427519 - DNA, 25 bp, Mus musculus
cttggcattagaaaggtgaaaatcc

SEQ ID NO: 427520 - DNA, 25 bp, Mus musculus
cttggccaatgggaatgacactatt

SEQ ID NO: 427521 - DNA, 25 bp, Mus musculus
cttggcccagagaccgagaagattg

SEQ ID NO: 427522 - DNA, 25 bp, Mus musculus
cttggccccgactgaaaacttcaca

SEQ ID NO: 427523 - DNA, 25 bp, Mus musculus
cttggcccctagagcttccagctga

SEQ ID NO: 427524 - DNA, 25 bp, Mus musculus
cttggcccggtggatacagactgtc

SEQ ID NO: 427525 - DNA, 25 bp, Mus musculus
cttggcctctgttgagtgggactca

SEQ ID NO: 427526 - DNA, 25 bp, Mus musculus
cttggcctgcagtccctcagtctga

SEQ ID NO: 427527 - DNA, 25 bp, Mus musculus
cttggcctgcctgtttggaaatgaa

SEQ ID NO: 427528 - DNA, 25 bp, Mus musculus
cttggcgaaccctgggagagatgga

SEQ ID NO: 427529 - DNA, 25 bp, Mus musculus
cttggctcagggtacagggtgactt

SEQ ID NO: 427530 - DNA, 25 bp, Mus musculus
cttggctggaacaggagcggcttca

SEQ ID NO: 427531 - DNA, 25 bp, Mus musculus
cttggctgggagtcagagagatgac

SEQ ID NO: 427532 - DNA, 25 bp, Mus musculus
cttggcttaccacctgcctgggcat

SEQ ID NO: 427533 - DNA, 25 bp, Mus musculus
cttggcttggtgtgtatcttactgt

SEQ ID NO: 427534 - DNA, 25 bp, Mus musculus
cttgggaatagaagcagagagaatg

SEQ ID NO: 427535 - DNA, 25 bp, Mus musculus
cttgggactgatgctggtgacaacc

SEQ ID NO: 427536 - DNA, 25 bp, Mus musculus
cttgggaggcctgtacgggatcata

SEQ ID NO: 427537 - DNA, 25 bp, Mus musculus
cttgggatcccagtgtgtagactgc

SEQ ID NO: 427538 - DNA, 25 bp, Mus musculus
cttgggatctgggacacggagactt

SEQ ID NO: 427539 - DNA, 25 bp, Mus musculus
cttgggatgtctggcccctgagcaa

SEQ ID NO: 427540 - DNA, 25 bp, Mus musculus
cttgggcacaggaattgactcagga

SEQ ID NO: 427541 - DNA, 25 bp, Mus musculus
cttgggcaccaacagagagagctct

SEQ ID NO: 427542 - DNA, 25 bp, Mus musculus
cttgggcagaacatacagggtggtc

SEQ ID NO: 427543 - DNA, 25 bp, Mus musculus
cttgggcagccctgtagaagttagg

SEQ ID NO: 427544 - DNA, 25 bp, Mus musculus
cttgggccccagatccgagtgattc

SEQ ID NO: 427545 - DNA, 25 bp, Mus musculus
cttgggcgctggtgtgccttctgct

SEQ ID NO: 427546 - DNA, 25 bp, Mus musculus
cttgggctaagctgtagggcgccct

SEQ ID NO: 427547 - DNA, 25 bp, Mus musculus
cttggggccagctgattggcacaga

SEQ ID NO: 427548 - DNA, 25 bp, Mus musculus
cttgggtagacgataatctgaggac

SEQ ID NO: 427549 - DNA, 25 bp, Mus musculus
cttgggtgggtaaaagcagctgtct

SEQ ID NO: 427550 - DNA, 25 bp, Mus musculus
cttggtacttggagacgggagacac

SEQ ID NO: 427551 - DNA, 25 bp, Mus musculus
cttggtagaagaacagcttctttga

SEQ ID NO: 427552 - DNA, 25 bp, Mus musculus
cttggtccctgaagcccggatggta

SEQ ID NO: 427553 - DNA, 25 bp, Mus musculus
cttggtcgtctatgaatggagtgca

SEQ ID NO: 427554 - DNA, 25 bp, Mus musculus
cttggtctccaggtgagtggtccaa

SEQ ID NO: 427555 - DNA, 25 bp, Mus musculus
cttggtctgaaaccgcatctgcttg

SEQ ID NO: 427556 - DNA, 25 bp, Mus musculus
cttggtgagtttttagagcttaaga

SEQ ID NO: 427557 - DNA, 25 bp, Mus musculus
cttggtgctaggtccacataggccc

SEQ ID NO: 427558 - DNA, 25 bp, Mus musculus
cttggtgctcatgaccagggagaag

SEQ ID NO: 427559 - DNA, 25 bp, Mus musculus
cttggtggagttaactgcctgaagc

SEQ ID NO: 427560 - DNA, 25 bp, Mus musculus
cttggtggatgtgagcgcctacagt

SEQ ID NO: 427561 - DNA, 25 bp, Mus musculus
cttggtggcaagtgtgcgccatctt

SEQ ID NO: 427562 - DNA, 25 bp, Mus musculus
cttggttagataggaggcaggttac

SEQ ID NO: 427563 - DNA, 25 bp, Mus musculus
cttggttggttcagccacaagcaca

SEQ ID NO: 427564 - DNA, 25 bp, Mus musculus
cttggttgtttttgctcgaaggctc

SEQ ID NO: 427565 - DNA, 25 bp, Mus musculus
cttggtttcctcagcatcaatgtga

SEQ ID NO: 427566 - DNA, 25 bp, Mus musculus
cttgtaagataatgaaggctgctgc

SEQ ID NO: 427567 - DNA, 25 bp, Mus musculus
cttgtaaggaaagagtttgtagcca

SEQ ID NO: 427568 - DNA, 25 bp, Mus musculus
cttgtaatgaaagcaaggtgacgtc

SEQ ID NO: 427569 - DNA, 25 bp, Mus musculus
cttgtacaacaaggttatgctctgc

SEQ ID NO: 427570 - DNA, 25 bp, Mus musculus
cttgtacctgctccggaaggcttgg

SEQ ID NO: 427571 - DNA, 25 bp, Mus musculus
cttgtactgggcagggaacctgtag

SEQ ID NO: 427572 - DNA, 25 bp, Mus musculus
cttgtaggcagtactcggagcccct

SEQ ID NO: 427573 - DNA, 25 bp, Mus musculus
cttgtatgttgtaggcccaaaggcc

SEQ ID NO: 427574 - DNA, 25 bp, Mus musculus
cttgtcagccgggaacgggtgactt

SEQ ID NO: 427575 - DNA, 25 bp, Mus musculus
cttgtcatgaggtgtaattaactca

SEQ ID NO: 427576 - DNA, 25 bp, Mus musculus
cttgtcccctcttccatgcttatga

SEQ ID NO: 427577 - DNA, 25 bp, Mus musculus
cttgtcctgttgagaaccccgaggt

SEQ ID NO: 427578 - DNA, 25 bp, Mus musculus
cttgtcctttctataagcggttgtg

SEQ ID NO: 427579 - DNA, 25 bp, Mus musculus
cttgtctgaagggtgtgggctctcc

SEQ ID NO: 427580 - DNA, 25 bp, Mus musculus
cttgtcttaggatgtcgtggcctcc

SEQ ID NO: 427581 - DNA, 25 bp, Mus musculus
cttgtcttcagtgttgggcctccca

SEQ ID NO: 427582 - DNA, 25 bp, Mus musculus
cttgtcttgacaccatagaggtggc

SEQ ID NO: 427583 - DNA, 25 bp, Mus musculus
cttgtgaaccacagggtcccttgct

SEQ ID NO: 427584 - DNA, 25 bp, Mus musculus
cttgtgaagaagagaatgacagact

SEQ ID NO: 427585 - DNA, 25 bp, Mus musculus
cttgtgaagtgagcgaaacagccca

SEQ ID NO: 427586 - DNA, 25 bp, Mus musculus
cttgtgagaatatccccgggcactg

SEQ ID NO: 427587 - DNA, 25 bp, Mus musculus
cttgtgagagggacgctgaatgtca

SEQ ID NO: 427588 - DNA, 25 bp, Mus musculus
cttgtgagatgtccccttttgaagg

SEQ ID NO: 427589 - DNA, 25 bp, Mus musculus
cttgtgagtggcttgcagaagcaca

SEQ ID NO: 427590 - DNA, 25 bp, Mus musculus
cttgtgatgcggcaatgagctctgc

SEQ ID NO: 427591 - DNA, 25 bp, Mus musculus
cttgtgcccaccctcagaggtgcaa

SEQ ID NO: 427592 - DNA, 25 bp, Mus musculus
cttgtgccttgattgctcccgctgg

SEQ ID NO: 427593 - DNA, 25 bp, Mus musculus
cttgtgctcacagaggtcagagtga

SEQ ID NO: 427594 - DNA, 25 bp, Mus musculus
cttgtgctgcgtctccaggttgcgc

SEQ ID NO: 427595 - DNA, 25 bp, Mus musculus
cttgtggaatggatttagtagggta

SEQ ID NO: 427596 - DNA, 25 bp, Mus musculus
cttgtggcctacctagcagttgctc

SEQ ID NO: 427597 - DNA, 25 bp, Mus musculus
cttgtggtcagcagagtcggttatt

SEQ ID NO: 427598 - DNA, 25 bp, Mus musculus
cttgtggttacgctaggaatccctc

SEQ ID NO: 427599 - DNA, 25 bp, Mus musculus
cttgtgtaacaaaagtgacggatcc

SEQ ID NO: 427600 - DNA, 25 bp, Mus musculus
cttgtgtgaattcctgggcctggca

SEQ ID NO: 427601 - DNA, 25 bp, Mus musculus
cttgtgtttggtgctgctcgttggc

SEQ ID NO: 427602 - DNA, 25 bp, Mus musculus
cttgttaacagcgaagacggtgcac

SEQ ID NO: 427603 - DNA, 25 bp, Mus musculus
cttgttacagagagcgtcactcgcc

SEQ ID NO: 427604 - DNA, 25 bp, Mus musculus
cttgttctcagaaggctaccagccc

SEQ ID NO: 427605 - DNA, 25 bp, Mus musculus
cttgtttactgggtatctgatttcc

SEQ ID NO: 427606 - DNA, 25 bp, Mus musculus
cttgtttcagataccacagacctgg

SEQ ID NO: 427607 - DNA, 25 bp, Mus musculus
cttgttttctattagctttgcaggg

SEQ ID NO: 427608 - DNA, 25 bp, Mus musculus
ctttaaaagtgttggaataatacag

SEQ ID NO: 427609 - DNA, 25 bp, Mus musculus
ctttaaagaggaggagaccgccaca

SEQ ID NO: 427610 - DNA, 25 bp, Mus musculus
ctttaaagttcgtgggatctggagc

SEQ ID NO: 427611 - DNA, 25 bp, Mus musculus
ctttaaatcaggtgcccagaacgtt

SEQ ID NO: 427612 - DNA, 25 bp, Mus musculus
ctttaacaatcaggagatggccgag

SEQ ID NO: 427613 - DNA, 25 bp, Mus musculus
ctttaactgtgtatggctgctgggc

SEQ ID NO: 427614 - DNA, 25 bp, Mus musculus
ctttaaggtaaggaaggcgtgctct

SEQ ID NO: 427615 - DNA, 25 bp, Mus musculus
ctttacaagagagtgcgaccatggc

SEQ ID NO: 427616 - DNA, 25 bp, Mus musculus
ctttacaaggatgcacagggccagc

SEQ ID NO: 427617 - DNA, 25 bp, Mus musculus
ctttacttgggttctactgtcgatc

SEQ ID NO: 427618 - DNA, 25 bp, Mus musculus
ctttagaaagaacggacagcgttgc

SEQ ID NO: 427619 - DNA, 25 bp, Mus musculus
ctttagagtttcctagacatggagg

SEQ ID NO: 427620 - DNA, 25 bp, Mus musculus
ctttagatgtaatgctttttagctc

SEQ ID NO: 427621 - DNA, 25 bp, Mus musculus
ctttagcagttaatagtcccagtac

SEQ ID NO: 427622 - DNA, 25 bp, Mus musculus
ctttaggcacagtcggcaggagatc

SEQ ID NO: 427623 - DNA, 25 bp, Mus musculus
ctttagtcctaactctgaaggcaga

SEQ ID NO: 427624 - DNA, 25 bp, Mus musculus
ctttagttccaagaagagcatcgga

SEQ ID NO: 427625 - DNA, 25 bp, Mus musculus
ctttataagtcagtgagccaggcac

SEQ ID NO: 427626 - DNA, 25 bp, Mus musculus
ctttatagagtctcaccattggacc

SEQ ID NO: 427627 - DNA, 25 bp, Mus musculus
ctttatcagtcagtgcccgcagagg

SEQ ID NO: 427628 - DNA, 25 bp, Mus musculus
ctttatctatcagcagctccatcag

SEQ ID NO: 427629 - DNA, 25 bp, Mus musculus
ctttatctctttagcattcggaggg

SEQ ID NO: 427630 - DNA, 25 bp, Mus musculus
ctttatgcaaaagcaatgtttagct

SEQ ID NO: 427631 - DNA, 25 bp, Mus musculus
ctttatgtcccctcagcagaggtgg

SEQ ID NO: 427632 - DNA, 25 bp, Mus musculus
ctttatgtgcaggtgagtccagcgt

SEQ ID NO: 427633 - DNA, 25 bp, Mus musculus
ctttattgaattagggccagagccc

SEQ ID NO: 427634 - DNA, 25 bp, Mus musculus
ctttatttgttgtcgagtgggatgg

SEQ ID NO: 427635 - DNA, 25 bp, Mus musculus
ctttcagagaggtgatgacattaat

SEQ ID NO: 427636 - DNA, 25 bp, Mus musculus
ctttcagagtgatgcaacagacgac

SEQ ID NO: 427637 - DNA, 25 bp, Mus musculus
ctttcagccgcactagagcacagcg

SEQ ID NO: 427638 - DNA, 25 bp, Mus musculus
ctttcaggccctatcggagcatgct

SEQ ID NO: 427639 - DNA, 25 bp, Mus musculus
ctttcaggtggtgtgccttcaggca

SEQ ID NO: 427640 - DNA, 25 bp, Mus musculus
ctttcagtctggagaggaagacatg

SEQ ID NO: 427641 - DNA, 25 bp, Mus musculus
ctttcagtttcagtagctctgcggt

SEQ ID NO: 427642 - DNA, 25 bp, Mus musculus
ctttcatcccggacatcagtgggct

SEQ ID NO: 427643 - DNA, 25 bp, Mus musculus
ctttcatccctgtaggacatccctg

SEQ ID NO: 427644 - DNA, 25 bp, Mus musculus
ctttcatcctgtatatgcattgagg

SEQ ID NO: 427645 - DNA, 25 bp, Mus musculus
ctttcatggcaggtagagcagctta

SEQ ID NO: 427646 - DNA, 25 bp, Mus musculus
ctttccaaagactgagggccctcat

SEQ ID NO: 427647 - DNA, 25 bp, Mus musculus
ctttccagccccagatggtctttta

SEQ ID NO: 427648 - DNA, 25 bp, Mus musculus
ctttccaggtagcaaagacagttgg

SEQ ID NO: 427649 - DNA, 25 bp, Mus musculus
ctttcccacgagtagaatcctgagg

SEQ ID NO: 427650 - DNA, 25 bp, Mus musculus
ctttcccctctgacatggaagacga

SEQ ID NO: 427651 - DNA, 25 bp, Mus musculus
ctttccctgcttatatccactctgg

SEQ ID NO: 427652 - DNA, 25 bp, Mus musculus
ctttccgagggagactatgcacggt

SEQ ID NO: 427653 - DNA, 25 bp, Mus musculus
ctttccgcaaattaacaagcctcgg

SEQ ID NO: 427654 - DNA, 25 bp, Mus musculus
ctttccttaggaggcgtaagctggc

SEQ ID NO: 427655 - DNA, 25 bp, Mus musculus
ctttcgacatggactgaggaccaga

SEQ ID NO: 427656 - DNA, 25 bp, Mus musculus
ctttcgagcgaaaggcagagtccct

SEQ ID NO: 427657 - DNA, 25 bp, Mus musculus
ctttcgcccatggtgagggctatgt

SEQ ID NO: 427658 - DNA, 25 bp, Mus musculus
ctttcgccctggagcggtgcgcgat

SEQ ID NO: 427659 - DNA, 25 bp, Mus musculus
ctttcgctcgctaagggaggcagga

SEQ ID NO: 427660 - DNA, 25 bp, Mus musculus
ctttcggactgctcagatccaaatg

SEQ ID NO: 427661 - DNA, 25 bp, Mus musculus
ctttcggagacgaggaacagctgac

SEQ ID NO: 427662 - DNA, 25 bp, Mus musculus
ctttcggcggcagtaagaagggcaa

SEQ ID NO: 427663 - DNA, 25 bp, Mus musculus
ctttcgtgaatgtgactgttggatc

SEQ ID NO: 427664 - DNA, 25 bp, Mus musculus
ctttctaaaaccacttgaggcttct

SEQ ID NO: 427665 - DNA, 25 bp, Mus musculus
ctttctccctcggtccgtgccatat

SEQ ID NO: 427666 - DNA, 25 bp, Mus musculus
ctttctcgagtaggcctggtgctgc

SEQ ID NO: 427667 - DNA, 25 bp, Mus musculus
ctttctctgagatggcagtgaagta

SEQ ID NO: 427668 - DNA, 25 bp, Mus musculus
ctttctctgtcagcttgggtctggg

SEQ ID NO: 427669 - DNA, 25 bp, Mus musculus
ctttctgaggagatggatagccttc

SEQ ID NO: 427670 - DNA, 25 bp, Mus musculus
ctttctgatcttaaactgccttgca

SEQ ID NO: 427671 - DNA, 25 bp, Mus musculus
ctttctgattggctgtgcaccctgc

SEQ ID NO: 427672 - DNA, 25 bp, Mus musculus
ctttctgcccgatggtgggtagcga

SEQ ID NO: 427673 - DNA, 25 bp, Mus musculus
ctttctggaaacaagtctggaagcc

SEQ ID NO: 427674 - DNA, 25 bp, Mus musculus
ctttctggaagaggcgcaactggta

SEQ ID NO: 427675 - DNA, 25 bp, Mus musculus
ctttctggaggaatggaggcctgtc

SEQ ID NO: 427676 - DNA, 25 bp, Mus musculus
ctttctgtcagtagagcactagatg

SEQ ID NO: 427677 - DNA, 25 bp, Mus musculus
ctttcttggtactatactatgaaga

SEQ ID NO: 427678 - DNA, 25 bp, Mus musculus
ctttgaaaaggccacaagggctgct

SEQ ID NO: 427679 - DNA, 25 bp, Mus musculus
ctttgaaaataagaggtgtgtgcac

SEQ ID NO: 427680 - DNA, 25 bp, Mus musculus
ctttgaaaatgagatggccacggcc

SEQ ID NO: 427681 - DNA, 25 bp, Mus musculus
ctttgaaagcactcggtcggcagcc

SEQ ID NO: 427682 - DNA, 25 bp, Mus musculus
ctttgaaagtactggaccgctggcc

SEQ ID NO: 427683 - DNA, 25 bp, Mus musculus
ctttgaaataaacctgcgactgcca

SEQ ID NO: 427684 - DNA, 25 bp, Mus musculus
ctttgaaatgagacgttgtgaggtc

SEQ ID NO: 427685 - DNA, 25 bp, Mus musculus
ctttgaagccagtgagacatttttc

SEQ ID NO: 427686 - DNA, 25 bp, Mus musculus
ctttgaagctgacaacgaggacgac

SEQ ID NO: 427687 - DNA, 25 bp, Mus musculus
ctttgaatctaaaacagaggagtca

SEQ ID NO: 427688 - DNA, 25 bp, Mus musculus
ctttgaatgtgtgcagatcatccct

SEQ ID NO: 427689 - DNA, 25 bp, Mus musculus
ctttgacaagtagtgactgaaaaag

SEQ ID NO: 427690 - DNA, 25 bp, Mus musculus
ctttgacctcaggatgacgagaagg

SEQ ID NO: 427691 - DNA, 25 bp, Mus musculus
ctttgacgggaagtatgcgagcccc

SEQ ID NO: 427692 - DNA, 25 bp, Mus musculus
ctttgactgaaatgtgtggcgggca

SEQ ID NO: 427693 - DNA, 25 bp, Mus musculus
ctttgactggagtggaccagtggac

SEQ ID NO: 427694 - DNA, 25 bp, Mus musculus
ctttgagaagatccctgccgagacc

SEQ ID NO: 427695 - DNA, 25 bp, Mus musculus
ctttgagagatcgactgcagcagca

SEQ ID NO: 427696 - DNA, 25 bp, Mus musculus
ctttgagattgcctcctgttctgaa

SEQ ID NO: 427697 - DNA, 25 bp, Mus musculus
ctttgagcacgagtaccgcagtggc

SEQ ID NO: 427698 - DNA, 25 bp, Mus musculus
ctttgagcttgaggctggcggcctt

SEQ ID NO: 427699 - DNA, 25 bp, Mus musculus
ctttgaggccctgaagcgtcggact

SEQ ID NO: 427700 - DNA, 25 bp, Mus musculus
ctttgatagtaaggagaggtaccag

SEQ ID NO: 427701 - DNA, 25 bp, Mus musculus
ctttgatatcagtggccagggcccc

SEQ ID NO: 427702 - DNA, 25 bp, Mus musculus
ctttgatcatgtgagggcccgagga

SEQ ID NO: 427703 - DNA, 25 bp, Mus musculus
ctttgatgccatcctgcagacagct

SEQ ID NO: 427704 - DNA, 25 bp, Mus musculus
ctttgcaaaaatgacctggagccct

SEQ ID NO: 427705 - DNA, 25 bp, Mus musculus
ctttgcaaatgtgtacctagcagat

SEQ ID NO: 427706 - DNA, 25 bp, Mus musculus
ctttgcacaaggagaaggctgcgct

SEQ ID NO: 427707 - DNA, 25 bp, Mus musculus
ctttgcacagctccctactgagtca

SEQ ID NO: 427708 - DNA, 25 bp, Mus musculus
ctttgcagatggaagcctcgggttc

SEQ ID NO: 427709 - DNA, 25 bp, Mus musculus
ctttgcatcgcttggctgtcatggc

SEQ ID NO: 427710 - DNA, 25 bp, Mus musculus
ctttgcatggcctctcgggacgtga

SEQ ID NO: 427711 - DNA, 25 bp, Mus musculus
ctttgcatggtgagaagccacagac

SEQ ID NO: 427712 - DNA, 25 bp, Mus musculus
ctttgcatttggtgttctcagagac

SEQ ID NO: 427713 - DNA, 25 bp, Mus musculus
ctttgccacccatgaagttccgtga

SEQ ID NO: 427714 - DNA, 25 bp, Mus musculus
ctttgccctaccaggaggctctaga

SEQ ID NO: 427715 - DNA, 25 bp, Mus musculus
ctttgcctatagtgacagccgtgtg

SEQ ID NO: 427716 - DNA, 25 bp, Mus musculus
ctttgcgaggaggtggtaagaacct

SEQ ID NO: 427717 - DNA, 25 bp, Mus musculus
ctttgcgggcgctgctaatcggcca

SEQ ID NO: 427718 - DNA, 25 bp, Mus musculus
ctttgctaacaaagatggcggctgc

SEQ ID NO: 427719 - DNA, 25 bp, Mus musculus
ctttgctagataaggaggcgaaccc

SEQ ID NO: 427720 - DNA, 25 bp, Mus musculus
ctttggaaaaagctcgcctggaact

SEQ ID NO: 427721 - DNA, 25 bp, Mus musculus
ctttggaagatcagcggccaggcct

SEQ ID NO: 427722 - DNA, 25 bp, Mus musculus
ctttggactttcaaacaagtttgag

SEQ ID NO: 427723 - DNA, 25 bp, Mus musculus
ctttggagacctgcgcatgcgtgta

SEQ ID NO: 427724 - DNA, 25 bp, Mus musculus
ctttggagactacggctgcagacct

SEQ ID NO: 427725 - DNA, 25 bp, Mus musculus
ctttggaggcagagaagcgatcatc

SEQ ID NO: 427726 - DNA, 25 bp, Mus musculus
ctttggaggtagtcatatttcgggc

SEQ ID NO: 427727 - DNA, 25 bp, Mus musculus
ctttggatgagttggagaagttacc

SEQ ID NO: 427728 - DNA, 25 bp, Mus musculus
ctttggcagaaacaagggtcaggac

SEQ ID NO: 427729 - DNA, 25 bp, Mus musculus
ctttggcccgcggagatttggtgtc

SEQ ID NO: 427730 - DNA, 25 bp, Mus musculus
ctttggccgccgcttaactctggga

SEQ ID NO: 427731 - DNA, 25 bp, Mus musculus
ctttggcctcaagctggaccggatc

SEQ ID NO: 427732 - DNA, 25 bp, Mus musculus
ctttggcctggtggactcagagaag

SEQ ID NO: 427733 - DNA, 25 bp, Mus musculus
ctttggcgagagctccaccgagagt

SEQ ID NO: 427734 - DNA, 25 bp, Mus musculus
ctttggctatggtatatttgggtac

SEQ ID NO: 427735 - DNA, 25 bp, Mus musculus
ctttggctgcccagcggctgtgagt

SEQ ID NO: 427736 - DNA, 25 bp, Mus musculus
ctttgggacagggacgaagctgact

SEQ ID NO: 427737 - DNA, 25 bp, Mus musculus
ctttgggagagctagcacccgtgca

SEQ ID NO: 427738 - DNA, 25 bp, Mus musculus
ctttgggcaagagctccaggagctg

SEQ ID NO: 427739 - DNA, 25 bp, Mus musculus
ctttgggctgtgtttcgatctggga

SEQ ID NO: 427740 - DNA, 25 bp, Mus musculus
ctttggtcatgtgccgttacaggga

SEQ ID NO: 427741 - DNA, 25 bp, Mus musculus
ctttggtgccttggtggcctcttta

SEQ ID NO: 427742 - DNA, 25 bp, Mus musculus
ctttggttaccagcctctgagggtc

SEQ ID NO: 427743 - DNA, 25 bp, Mus musculus
ctttgtaaccttatctggaatccgg

SEQ ID NO: 427744 - DNA, 25 bp, Mus musculus
ctttgtaaggaatgtgatcacggga

SEQ ID NO: 427745 - DNA, 25 bp, Mus musculus
ctttgtcccaagaaatgatgagatg

SEQ ID NO: 427746 - DNA, 25 bp, Mus musculus
ctttgtccctacgaggagcgcggat

SEQ ID NO: 427747 - DNA, 25 bp, Mus musculus
ctttgtgacgcagaagaccttgagc

SEQ ID NO: 427748 - DNA, 25 bp, Mus musculus
ctttgtgagctgcttgccttgtgac

SEQ ID NO: 427749 - DNA, 25 bp, Mus musculus
ctttgtgatggacgaacacgcccga

SEQ ID NO: 427750 - DNA, 25 bp, Mus musculus
ctttgtggcgtgagatctctgggcc

SEQ ID NO: 427751 - DNA, 25 bp, Mus musculus
ctttgtggctcaacttcgacggcga

SEQ ID NO: 427752 - DNA, 25 bp, Mus musculus
ctttgtgggaacctggaagcttgtc

SEQ ID NO: 427753 - DNA, 25 bp, Mus musculus
ctttgtgtcggcacttacggtcgtg

SEQ ID NO: 427754 - DNA, 25 bp, Mus musculus
ctttgttacatgaagtccgctggga

SEQ ID NO: 427755 - DNA, 25 bp, Mus musculus
ctttgttgagactttataaagagcg

SEQ ID NO: 427756 - DNA, 25 bp, Mus musculus
ctttgtttccagaggccagctaggc

SEQ ID NO: 427757 - DNA, 25 bp, Mus musculus
cttttaaaacatgtcccattgcttt

SEQ ID NO: 427758 - DNA, 25 bp, Mus musculus
cttttaaactgtagccaggccaggt

SEQ ID NO: 427759 - DNA, 25 bp, Mus musculus
cttttaactccagcatgagagaggc

SEQ ID NO: 427760 - DNA, 25 bp, Mus musculus
cttttaatccatatcttgaggcagg

SEQ ID NO: 427761 - DNA, 25 bp, Mus musculus
cttttacggcgagcaggtggactac

SEQ ID NO: 427762 - DNA, 25 bp, Mus musculus
cttttactgtgcgtggacagtcact

SEQ ID NO: 427763 - DNA, 25 bp, Mus musculus
cttttagaaaaatgagatggtccca

SEQ ID NO: 427764 - DNA, 25 bp, Mus musculus
cttttagacaatcatgaccagcggg

SEQ ID NO: 427765 - DNA, 25 bp, Mus musculus
cttttagatactctgctaggcacct

SEQ ID NO: 427766 - DNA, 25 bp, Mus musculus
cttttagatcaacccaagcctcctg

SEQ ID NO: 427767 - DNA, 25 bp, Mus musculus
cttttagggaaagacagcagtgacc

SEQ ID NO: 427768 - DNA, 25 bp, Mus musculus
cttttagtgagttgatctttatccc

SEQ ID NO: 427769 - DNA, 25 bp, Mus musculus
cttttagttaagacccgcagcacac

SEQ ID NO: 427770 - DNA, 25 bp, Mus musculus
cttttatcagctcagaaagactggt

SEQ ID NO: 427771 - DNA, 25 bp, Mus musculus
cttttcatcggaggcatggaggtcg

SEQ ID NO: 427772 - DNA, 25 bp, Mus musculus
cttttcatctcagcctagtgatgag

SEQ ID NO: 427773 - DNA, 25 bp, Mus musculus
cttttccactttgctaaggagtgtc

SEQ ID NO: 427774 - DNA, 25 bp, Mus musculus
cttttccagacatggattccaagtt

SEQ ID NO: 427775 - DNA, 25 bp, Mus musculus
cttttcccagaacggctgggcgccg

SEQ ID NO: 427776 - DNA, 25 bp, Mus musculus
cttttcccgggcagagacagtggca

SEQ ID NO: 427777 - DNA, 25 bp, Mus musculus
cttttcgtgaactctagggtgttgg

SEQ ID NO: 427778 - DNA, 25 bp, Mus musculus
cttttctatgagaccgaagcccgga

SEQ ID NO: 427779 - DNA, 25 bp, Mus musculus
cttttctggagaagacacctgctgc

SEQ ID NO: 427780 - DNA, 25 bp, Mus musculus
cttttgaactcaagggaggaggaat

SEQ ID NO: 427781 - DNA, 25 bp, Mus musculus
cttttgaagacagctgaggcgggct

SEQ ID NO: 427782 - DNA, 25 bp, Mus musculus
cttttgaagccggtcctgggacaag

SEQ ID NO: 427783 - DNA, 25 bp, Mus musculus
cttttgacttccaagagcactgggc

SEQ ID NO: 427784 - DNA, 25 bp, Mus musculus
cttttgatgcgaatgagacccactt

SEQ ID NO: 427785 - DNA, 25 bp, Mus musculus
cttttgcgggacagaggaacagatc

SEQ ID NO: 427786 - DNA, 25 bp, Mus musculus
cttttgctaaatggcgttgctggcg

SEQ ID NO: 427787 - DNA, 25 bp, Mus musculus
cttttgggaaactgagctgagcatc

SEQ ID NO: 427788 - DNA, 25 bp, Mus musculus
cttttgtggctgagtcgggaatcct

SEQ ID NO: 427789 - DNA, 25 bp, Mus musculus
cttttgttgagtttgagttggcaga

SEQ ID NO: 427790 - DNA, 25 bp, Mus musculus
ctttttaaatcaagcccttgaatgg

SEQ ID NO: 427791 - DNA, 25 bp, Mus musculus
ctttttagtgtcatggagctggctc

SEQ ID NO: 427792 - DNA, 25 bp, Mus musculus
ctttttcttccgcaggagctgaaga

SEQ ID NO: 427793 - DNA, 25 bp, Mus musculus
ctttttgctggtcctcagagattgg

SEQ ID NO: 427794 - DNA, 25 bp, Mus musculus
cttttttgaggactattagagtgaa

SEQ ID NO: 427795 - DNA, 25 bp, Mus musculus
gaaaaaaccgcacagttctactcct

SEQ ID NO: 427796 - DNA, 25 bp, Mus musculus
gaaaaaagattagtgctgaccctgc

SEQ ID NO: 427797 - DNA, 25 bp, Mus musculus
gaaaaaagtagctgctccaggaaag

SEQ ID NO: 427798 - DNA, 25 bp, Mus musculus
gaaaaaagtcttagctctctctcca

SEQ ID NO: 427799 - DNA, 25 bp, Mus musculus
gaaaaaatgactactaagaggccgt

SEQ ID NO: 427800 - DNA, 25 bp, Mus musculus
gaaaaaatgaggttcaaagagcaac

SEQ ID NO: 427801 - DNA, 25 bp, Mus musculus
gaaaaaatggctgatgcttggctat

SEQ ID NO: 427802 - DNA, 25 bp, Mus musculus
gaaaaacaaatcctcggcgtgtcgg

SEQ ID NO: 427803 - DNA, 25 bp, Mus musculus
gaaaaacaacagcagtgtttcggtc

SEQ ID NO: 427804 - DNA, 25 bp, Mus musculus
gaaaaacactggtgacggtggagcc

SEQ ID NO: 427805 - DNA, 25 bp, Mus musculus
gaaaaacagatgcaagtgtcccctt

SEQ ID NO: 427806 - DNA, 25 bp, Mus musculus
gaaaaacaggaagtattctgtgctg

SEQ ID NO: 427807 - DNA, 25 bp, Mus musculus
gaaaaaccaacgctcctggatcggc

SEQ ID NO: 427808 - DNA, 25 bp, Mus musculus
gaaaaaccatcactagagctgagga

SEQ ID NO: 427809 - DNA, 25 bp, Mus musculus
gaaaaacccggagagaacactgagc

SEQ ID NO: 427810 - DNA, 25 bp, Mus musculus
gaaaaaccgctatgtggtgctgaaa

SEQ ID NO: 427811 - DNA, 25 bp, Mus musculus
gaaaaacgaagtcaagcacgtttct

SEQ ID NO: 427812 - DNA, 25 bp, Mus musculus
gaaaaacgacttctcccaacaggag

SEQ ID NO: 427813 - DNA, 25 bp, Mus musculus
gaaaaacgtgctggtggtggctctc

SEQ ID NO: 427814 - DNA, 25 bp, Mus musculus
gaaaaacgtgttgagagcaattgtc

SEQ ID NO: 427815 - DNA, 25 bp, Mus musculus
gaaaaactcatgatccgcttgggcc

SEQ ID NO: 427816 - DNA, 25 bp, Mus musculus
gaaaaactcttacccaggactcctg

SEQ ID NO: 427817 - DNA, 25 bp, Mus musculus
gaaaaactggatgcctctgcctcac

SEQ ID NO: 427818 - DNA, 25 bp, Mus musculus
gaaaaactgtgttacgtcgccctgg

SEQ ID NO: 427819 - DNA, 25 bp, Mus musculus
gaaaaactgttccagatcgtgcctg

SEQ ID NO: 427820 - DNA, 25 bp, Mus musculus
gaaaaacttactgcagaccctgata

SEQ ID NO: 427821 - DNA, 25 bp, Mus musculus
gaaaaactttctaagtgcctgggag

SEQ ID NO: 427822 - DNA, 25 bp, Mus musculus
gaaaaactttgtgcaccgcgacctg

SEQ ID NO: 427823 - DNA, 25 bp, Mus musculus
gaaaaagaaagagtcccgcatgaac

SEQ ID NO: 427824 - DNA, 25 bp, Mus musculus
gaaaaagaccaaggattctgcttca

SEQ ID NO: 427825 - DNA, 25 bp, Mus musculus
gaaaaagactcccatggcatcagca

SEQ ID NO: 427826 - DNA, 25 bp, Mus musculus
gaaaaagatcctgatatgttttgtg

SEQ ID NO: 427827 - DNA, 25 bp, Mus musculus
gaaaaagattcctccgggtgctgaa

SEQ ID NO: 427828 - DNA, 25 bp, Mus musculus
gaaaaagcacttccctcagataaca

SEQ ID NO: 427829 - DNA, 25 bp, Mus musculus
gaaaaagcagatataccagtaatga

SEQ ID NO: 427830 - DNA, 25 bp, Mus musculus
gaaaaagcgcaagatgtccttgttg

SEQ ID NO: 427831 - DNA, 25 bp, Mus musculus
gaaaaagctgactggtggagccaac

SEQ ID NO: 427832 - DNA, 25 bp, Mus musculus
gaaaaagctgcgaaggtcaaatcca

SEQ ID NO: 427833 - DNA, 25 bp, Mus musculus
gaaaaagctggaagtgacctactgt

SEQ ID NO: 427834 - DNA, 25 bp, Mus musculus
gaaaaagctggtatccaagcggtcc

SEQ ID NO: 427835 - DNA, 25 bp, Mus musculus
gaaaaaggacccaagtgacactgat

SEQ ID NO: 427836 - DNA, 25 bp, Mus musculus
gaaaaaggagacttctgcacccagt

SEQ ID NO: 427837 - DNA, 25 bp, Mus musculus
gaaaaaggattagccactgcagtcc

SEQ ID NO: 427838 - DNA, 25 bp, Mus musculus
gaaaaaggcagagctctaggagaca

SEQ ID NO: 427839 - DNA, 25 bp, Mus musculus
gaaaaaggcatcaggccatggtgca

SEQ ID NO: 427840 - DNA, 25 bp, Mus musculus
gaaaaagggcaggtacatggctctg

SEQ ID NO: 427841 - DNA, 25 bp, Mus musculus
gaaaaaggtcatatcgagtggaagc

SEQ ID NO: 427842 - DNA, 25 bp, Mus musculus
gaaaaaggtggaacagccagttggt

SEQ ID NO: 427843 - DNA, 25 bp, Mus musculus
gaaaaaggttgcaacacaagaaggc

SEQ ID NO: 427844 - DNA, 25 bp, Mus musculus
gaaaaagtaactttgcgtgcagccc

SEQ ID NO: 427845 - DNA, 25 bp, Mus musculus
gaaaaagtactacaaggccatcctg

SEQ ID NO: 427846 - DNA, 25 bp, Mus musculus
gaaaaagtacttctgcctcttaagg

SEQ ID NO: 427847 - DNA, 25 bp, Mus musculus
gaaaaagtatagtgatccaggccct

SEQ ID NO: 427848 - DNA, 25 bp, Mus musculus
gaaaaagtatttcccagccgagagg

SEQ ID NO: 427849 - DNA, 25 bp, Mus musculus
gaaaaagtcactcctgaccaagagg

SEQ ID NO: 427850 - DNA, 25 bp, Mus musculus
gaaaaagtcctgtctttgcaacctg

SEQ ID NO: 427851 - DNA, 25 bp, Mus musculus
gaaaaagtgcaatacctcactcgct

SEQ ID NO: 427852 - DNA, 25 bp, Mus musculus
gaaaaagtgctgcatcctcaccgag

SEQ ID NO: 427853 - DNA, 25 bp, Mus musculus
gaaaaagttcccctgtcgcctgtgt

SEQ ID NO: 427854 - DNA, 25 bp, Mus musculus
gaaaaataacggaggtatcgctgcc

SEQ ID NO: 427855 - DNA, 25 bp, Mus musculus
gaaaaatacattctcagggcctgct

SEQ ID NO: 427856 - DNA, 25 bp, Mus musculus
gaaaaatacccaggtgacaagcact

SEQ ID NO: 427857 - DNA, 25 bp, Mus musculus
gaaaaatccctaacctcactccatg

SEQ ID NO: 427858 - DNA, 25 bp, Mus musculus
gaaaaatccggcttcaggataccac

SEQ ID NO: 427859 - DNA, 25 bp, Mus musculus
gaaaaatcgacttgggctgcagcct

SEQ ID NO: 427860 - DNA, 25 bp, Mus musculus
gaaaaatcgctgcatggacatcctg

SEQ ID NO: 427861 - DNA, 25 bp, Mus musculus
gaaaaatctagcctggtagtgaagt

SEQ ID NO: 427862 - DNA, 25 bp, Mus musculus
gaaaaatctcttgaggctgcacctg

SEQ ID NO: 427863 - DNA, 25 bp, Mus musculus
gaaaaatgaaactctggaccacctg

SEQ ID NO: 427864 - DNA, 25 bp, Mus musculus
gaaaaatgacaccaggcttgcccag

SEQ ID NO: 427865 - DNA, 25 bp, Mus musculus
gaaaaatgccatgaagaatctctgg

SEQ ID NO: 427866 - DNA, 25 bp, Mus musculus
gaaaaatggccagtgataccccagg

SEQ ID NO: 427867 - DNA, 25 bp, Mus musculus
gaaaaatggcgaatagtttgctggg

SEQ ID NO: 427868 - DNA, 25 bp, Mus musculus
gaaaaatgggctgagagattacctg

SEQ ID NO: 427869 - DNA, 25 bp, Mus musculus
gaaaaatggtcttcctgagggtaca

SEQ ID NO: 427870 - DNA, 25 bp, Mus musculus
gaaaaatgttggaatagcttttcag

SEQ ID NO: 427871 - DNA, 25 bp, Mus musculus
gaaaacaaacacaatcaggcgatat

SEQ ID NO: 427872 - DNA, 25 bp, Mus musculus
gaaaacaaagtgttttccatgtctg

SEQ ID NO: 427873 - DNA, 25 bp, Mus musculus
gaaaacaacatttgcgtggcacacg

SEQ ID NO: 427874 - DNA, 25 bp, Mus musculus
gaaaacacaccttcctgttcagctg

SEQ ID NO: 427875 - DNA, 25 bp, Mus musculus
gaaaacacatatgggttgcagcctg

SEQ ID NO: 427876 - DNA, 25 bp, Mus musculus
gaaaacaccgtcctgaaggctgctg

SEQ ID NO: 427877 - DNA, 25 bp, Mus musculus
gaaaacacctgctccaatgctcaca

SEQ ID NO: 427878 - DNA, 25 bp, Mus musculus
gaaaacactgctgtccattggaggg

SEQ ID NO: 427879 - DNA, 25 bp, Mus musculus
gaaaacagaacagcggagtcttaag

SEQ ID NO: 427880 - DNA, 25 bp, Mus musculus
gaaaacagacaagtctcctggcacg

SEQ ID NO: 427881 - DNA, 25 bp, Mus musculus
gaaaacagaggccaacattggtaca

SEQ ID NO: 427882 - DNA, 25 bp, Mus musculus
gaaaacagcagcattctacccacag

SEQ ID NO: 427883 - DNA, 25 bp, Mus musculus
gaaaacagctccaagggcgctgaag

SEQ ID NO: 427884 - DNA, 25 bp, Mus musculus
gaaaacagctttgccagaccctggg

SEQ ID NO: 427885 - DNA, 25 bp, Mus musculus
gaaaacaggcgactatctctggagg

SEQ ID NO: 427886 - DNA, 25 bp, Mus musculus
gaaaacaggcgatccctctggtgaa

SEQ ID NO: 427887 - DNA, 25 bp, Mus musculus
gaaaacagggatgtcttgctagcca

SEQ ID NO: 427888 - DNA, 25 bp, Mus musculus
gaaaacaggtgggacaaagttcctg

SEQ ID NO: 427889 - DNA, 25 bp, Mus musculus
gaaaacagtacagcctccagctggt

SEQ ID NO: 427890 - DNA, 25 bp, Mus musculus
gaaaacagtgctgaagaacaggctc

SEQ ID NO: 427891 - DNA, 25 bp, Mus musculus
gaaaacatccatcaatgccactaaa

SEQ ID NO: 427892 - DNA, 25 bp, Mus musculus
gaaaacatgaggaggtgtcggccac

SEQ ID NO: 427893 - DNA, 25 bp, Mus musculus
gaaaacatggtgcactcgggagtat

SEQ ID NO: 427894 - DNA, 25 bp, Mus musculus
gaaaacattaacttgaagacaatgg

SEQ ID NO: 427895 - DNA, 25 bp, Mus musculus
gaaaacattaccgtctgtagctggg

SEQ ID NO: 427896 - DNA, 25 bp, Mus musculus
gaaaaccaagccagaggatgccaat

SEQ ID NO: 427897 - DNA, 25 bp, Mus musculus
gaaaaccaaggagcaggcatcgcat

SEQ ID NO: 427898 - DNA, 25 bp, Mus musculus
gaaaaccagggctatgttaatagac

SEQ ID NO: 427899 - DNA, 25 bp, Mus musculus
gaaaaccatcgcattgtgaagggta

SEQ ID NO: 427900 - DNA, 25 bp, Mus musculus
gaaaaccatgattgtcctcgcagaa

SEQ ID NO: 427901 - DNA, 25 bp, Mus musculus
gaaaaccattctgtgaagggtccct

SEQ ID NO: 427902 - DNA, 25 bp, Mus musculus
gaaaaccatttccatgctcagcgtg

SEQ ID NO: 427903 - DNA, 25 bp, Mus musculus
gaaaacccattctgggcaagcactg

SEQ ID NO: 427904 - DNA, 25 bp, Mus musculus
gaaaaccccatgtaggacaagctca

SEQ ID NO: 427905 - DNA, 25 bp, Mus musculus
gaaaacccgaatctcctcagtcttg

SEQ ID NO: 427906 - DNA, 25 bp, Mus musculus
gaaaacccgacttgcttcagtatag

SEQ ID NO: 427907 - DNA, 25 bp, Mus musculus
gaaaaccctcaggttgacgcgcaac

SEQ ID NO: 427908 - DNA, 25 bp, Mus musculus
gaaaaccctttcctggatagccctg

SEQ ID NO: 427909 - DNA, 25 bp, Mus musculus
gaaaaccgagaagatcctcacagag

SEQ ID NO: 427910 - DNA, 25 bp, Mus musculus
gaaaaccgagtggttagctaccagt

SEQ ID NO: 427911 - DNA, 25 bp, Mus musculus
gaaaaccgagttttgagcaccacca

SEQ ID NO: 427912 - DNA, 25 bp, Mus musculus
gaaaaccgcagaggaaaagtcaggc

SEQ ID NO: 427913 - DNA, 25 bp, Mus musculus
gaaaaccgcttactctctagtcctt

SEQ ID NO: 427914 - DNA, 25 bp, Mus musculus
gaaaaccggagattacagcgcaaat

SEQ ID NO: 427915 - DNA, 25 bp, Mus musculus
gaaaaccgtgtcctgggctgtgacc

SEQ ID NO: 427916 - DNA, 25 bp, Mus musculus
gaaaacctcatggacaccttcagga

SEQ ID NO: 427917 - DNA, 25 bp, Mus musculus
gaaaacctcctcttggatgaaaggg

SEQ ID NO: 427918 - DNA, 25 bp, Mus musculus
gaaaacctcgacagtcctgctgcca

SEQ ID NO: 427919 - DNA, 25 bp, Mus musculus
gaaaacctgcctgtgggtacacgag

SEQ ID NO: 427920 - DNA, 25 bp, Mus musculus
gaaaacctggagagctgaagaagag

SEQ ID NO: 427921 - DNA, 25 bp, Mus musculus
gaaaacctgggtcgtgtgttcctgt

SEQ ID NO: 427922 - DNA, 25 bp, Mus musculus
gaaaacctgtcagcaaacatgggag

SEQ ID NO: 427923 - DNA, 25 bp, Mus musculus
gaaaaccttagttcagatccagaca

SEQ ID NO: 427924 - DNA, 25 bp, Mus musculus
gaaaaccttccaggtggagacactg

SEQ ID NO: 427925 - DNA, 25 bp, Mus musculus
gaaaaccttcgacttgtgaggctga

SEQ ID NO: 427926 - DNA, 25 bp, Mus musculus
gaaaaccttttcagcttccagacgg

SEQ ID NO: 427927 - DNA, 25 bp, Mus musculus
gaaaaccttttttgattgactcaca

SEQ ID NO: 427928 - DNA, 25 bp, Mus musculus
gaaaacgaggattccagcgtgcaca

SEQ ID NO: 427929 - DNA, 25 bp, Mus musculus
gaaaacgagtcctggtgattggcct

SEQ ID NO: 427930 - DNA, 25 bp, Mus musculus
gaaaacgatgaatttgcgagcacgg

SEQ ID NO: 427931 - DNA, 25 bp, Mus musculus
gaaaacgatgagatcgaggccggca

SEQ ID NO: 427932 - DNA, 25 bp, Mus musculus
gaaaacgccgtggaacatgactgtg

SEQ ID NO: 427933 - DNA, 25 bp, Mus musculus
gaaaacgctacacacactgactgga

SEQ ID NO: 427934 - DNA, 25 bp, Mus musculus
gaaaacgcttcaccatctggagaca

SEQ ID NO: 427935 - DNA, 25 bp, Mus musculus
gaaaacggagacttcaactggatcg

SEQ ID NO: 427936 - DNA, 25 bp, Mus musculus
gaaaacgtggctgcttcaaggatcc

SEQ ID NO: 427937 - DNA, 25 bp, Mus musculus
gaaaacgtgggaataaatgtatcag

SEQ ID NO: 427938 - DNA, 25 bp, Mus musculus
gaaaactaaagtcatttcaggatct

SEQ ID NO: 427939 - DNA, 25 bp, Mus musculus
gaaaactaacagcttgaagctcctg

SEQ ID NO: 427940 - DNA, 25 bp, Mus musculus
gaaaactacaacagatcacaatacg

SEQ ID NO: 427941 - DNA, 25 bp, Mus musculus
gaaaactacactgctaagccctgga

SEQ ID NO: 427942 - DNA, 25 bp, Mus musculus
gaaaactacagcgtggtctcctggg

SEQ ID NO: 427943 - DNA, 25 bp, Mus musculus
gaaaactactgtctaattgtgggcc

SEQ ID NO: 427944 - DNA, 25 bp, Mus musculus
gaaaactcaaccgagcatgccatga

SEQ ID NO: 427945 - DNA, 25 bp, Mus musculus
gaaaactcactctcatgttccgggt

SEQ ID NO: 427946 - DNA, 25 bp, Mus musculus
gaaaactcagggtcttcttccatct

SEQ ID NO: 427947 - DNA, 25 bp, Mus musculus
gaaaactcatatgctcggtgtgcaa

SEQ ID NO: 427948 - DNA, 25 bp, Mus musculus
gaaaactccactggtgtcaaccggg

SEQ ID NO: 427949 - DNA, 25 bp, Mus musculus
gaaaactccgtcatggactcagact

SEQ ID NO: 427950 - DNA, 25 bp, Mus musculus
gaaaactcctcttcgctcagctgaa

SEQ ID NO: 427951 - DNA, 25 bp, Mus musculus
gaaaactcctgacacacacgctgga

SEQ ID NO: 427952 - DNA, 25 bp, Mus musculus
gaaaactcgagattgccttcggaag

SEQ ID NO: 427953 - DNA, 25 bp, Mus musculus
gaaaactctagtctttaggccagca

SEQ ID NO: 427954 - DNA, 25 bp, Mus musculus
gaaaactctgccatgtggtccccaa

SEQ ID NO: 427955 - DNA, 25 bp, Mus musculus
gaaaactgatctggtgtgcctaact

SEQ ID NO: 427956 - DNA, 25 bp, Mus musculus
gaaaactgccatgaagcatctcagg

SEQ ID NO: 427957 - DNA, 25 bp, Mus musculus
gaaaactgcccaactcataggaatg

SEQ ID NO: 427958 - DNA, 25 bp, Mus musculus
gaaaactgcggctgtgacgagtcac

SEQ ID NO: 427959 - DNA, 25 bp, Mus musculus
gaaaactgctgtccacctagtgtta

SEQ ID NO: 427960 - DNA, 25 bp, Mus musculus
gaaaactggcactgctagactccag

SEQ ID NO: 427961 - DNA, 25 bp, Mus musculus
gaaaactgggtaactgcgcaggcct

SEQ ID NO: 427962 - DNA, 25 bp, Mus musculus
gaaaactgttaatgcatgactttgc

SEQ ID NO: 427963 - DNA, 25 bp, Mus musculus
gaaaacttagcttcatcagcgtggg

SEQ ID NO: 427964 - DNA, 25 bp, Mus musculus
gaaaacttgcatctgccaatgagtc

SEQ ID NO: 427965 - DNA, 25 bp, Mus musculus
gaaaacttgtgcctaaacatggtga

SEQ ID NO: 427966 - DNA, 25 bp, Mus musculus
gaaaactttgtactggtagccactg

SEQ ID NO: 427967 - DNA, 25 bp, Mus musculus
gaaaacttttctgggtgctgaagac

SEQ ID NO: 427968 - DNA, 25 bp, Mus musculus
gaaaagaaaacgtcaccgtggccag

SEQ ID NO: 427969 - DNA, 25 bp, Mus musculus
gaaaagaaacttcgcatggacctag

SEQ ID NO: 427970 - DNA, 25 bp, Mus musculus
gaaaagaacaagcaccctatgggag

SEQ ID NO: 427971 - DNA, 25 bp, Mus musculus
gaaaagaacattgggctgagactca

SEQ ID NO: 427972 - DNA, 25 bp, Mus musculus
gaaaagaaccatgcgtgggagctgc

SEQ ID NO: 427973 - DNA, 25 bp, Mus musculus
gaaaagaactccctggtcttccagc

SEQ ID NO: 427974 - DNA, 25 bp, Mus musculus
gaaaagaagctaccatttgatcagt

SEQ ID NO: 427975 - DNA, 25 bp, Mus musculus
gaaaagaagtcacctggacgctcca

SEQ ID NO: 427976 - DNA, 25 bp, Mus musculus
gaaaagaagttgctccatggctact

SEQ ID NO: 427977 - DNA, 25 bp, Mus musculus
gaaaagaattcaggaatgtccctgg

SEQ ID NO: 427978 - DNA, 25 bp, Mus musculus
gaaaagaatttcctacgccagaagc

SEQ ID NO: 427979 - DNA, 25 bp, Mus musculus
gaaaagaatttgacgctggtaccag

SEQ ID NO: 427980 - DNA, 25 bp, Mus musculus
gaaaagaccatttgcacgagaagcc

SEQ ID NO: 427981 - DNA, 25 bp, Mus musculus
gaaaagaccccacaggaatggatcc

SEQ ID NO: 427982 - DNA, 25 bp, Mus musculus
gaaaagacctcctcgctacaaggga

SEQ ID NO: 427983 - DNA, 25 bp, Mus musculus
gaaaagactccaactctctcggatg

SEQ ID NO: 427984 - DNA, 25 bp, Mus musculus
gaaaagagacaagtgctcctgcctg

SEQ ID NO: 427985 - DNA, 25 bp, Mus musculus
gaaaagagagctccatcatgcctgg

SEQ ID NO: 427986 - DNA, 25 bp, Mus musculus
gaaaagagcccagcaaatccaggaa

SEQ ID NO: 427987 - DNA, 25 bp, Mus musculus
gaaaagagccctgtgaataactcag

SEQ ID NO: 427988 - DNA, 25 bp, Mus musculus
gaaaagagcccttcctacggcgtgc

SEQ ID NO: 427989 - DNA, 25 bp, Mus musculus
gaaaagagcctatttcccctagagc

SEQ ID NO: 427990 - DNA, 25 bp, Mus musculus
gaaaagatcctggtctgactgccca

SEQ ID NO: 427991 - DNA, 25 bp, Mus musculus
gaaaagatctacgttgagccctcct

SEQ ID NO: 427992 - DNA, 25 bp, Mus musculus
gaaaagatggatagctcctaacaac

SEQ ID NO: 427993 - DNA, 25 bp, Mus musculus
gaaaagatggtaaatcccaccacgg

SEQ ID NO: 427994 - DNA, 25 bp, Mus musculus
gaaaagcaaagtcgtaaatcatagt

SEQ ID NO: 427995 - DNA, 25 bp, Mus musculus
gaaaagcaactcatggaaacaaagc

SEQ ID NO: 427996 - DNA, 25 bp, Mus musculus
gaaaagcacagaccttggatacatg

SEQ ID NO: 427997 - DNA, 25 bp, Mus musculus
gaaaagcacagtacatctgggtcag

SEQ ID NO: 427998 - DNA, 25 bp, Mus musculus
gaaaagcacgttcttgcgcatgctg

SEQ ID NO: 427999 - DNA, 25 bp, Mus musculus
gaaaagcagaatagaggattcctcg

SEQ ID NO: 428000 - DNA, 25 bp, Mus musculus
gaaaagcaggatactcactcgcact

SEQ ID NO: 428001 - DNA, 25 bp, Mus musculus
gaaaagcagggcagatatcagggca

SEQ ID NO: 428002 - DNA, 25 bp, Mus musculus
gaaaagcaggtgtccagtcgagcag

SEQ ID NO: 428003 - DNA, 25 bp, Mus musculus
gaaaagcagttcaaccaggaatgga

SEQ ID NO: 428004 - DNA, 25 bp, Mus musculus
gaaaagcatgagtatggccgcggca

SEQ ID NO: 428005 - DNA, 25 bp, Mus musculus
gaaaagcattccctagacacaaatt

SEQ ID NO: 428006 - DNA, 25 bp, Mus musculus
gaaaagccaggctccacatggaagt

SEQ ID NO: 428007 - DNA, 25 bp, Mus musculus
gaaaagccccgagtgaagtctgtgc

SEQ ID NO: 428008 - DNA, 25 bp, Mus musculus
gaaaagccctcacctagaacacagg

SEQ ID NO: 428009 - DNA, 25 bp, Mus musculus
gaaaagccctggatattgcccgcca

SEQ ID NO: 428010 - DNA, 25 bp, Mus musculus
gaaaagccgaccatgaagacagatg

SEQ ID NO: 428011 - DNA, 25 bp, Mus musculus
gaaaagccttcagtatcgtcaggag

SEQ ID NO: 428012 - DNA, 25 bp, Mus musculus
gaaaagccttcgcaccatggaacag

SEQ ID NO: 428013 - DNA, 25 bp, Mus musculus
gaaaagcctttctatgggcaaagcc

SEQ ID NO: 428014 - DNA, 25 bp, Mus musculus
gaaaagcgccaagtacatctgcctg

SEQ ID NO: 428015 - DNA, 25 bp, Mus musculus
gaaaagcgcctctccaaagtagaca

SEQ ID NO: 428016 - DNA, 25 bp, Mus musculus
gaaaagcgccttgacgatccagcta

SEQ ID NO: 428017 - DNA, 25 bp, Mus musculus
gaaaagcgctacacaacagatgcca

SEQ ID NO: 428018 - DNA, 25 bp, Mus musculus
gaaaagcggcccacactaagaaagg

SEQ ID NO: 428019 - DNA, 25 bp, Mus musculus
gaaaagcggctgactgatcctgggt

SEQ ID NO: 428020 - DNA, 25 bp, Mus musculus
gaaaagcgtgttttggcacctctct

SEQ ID NO: 428021 - DNA, 25 bp, Mus musculus
gaaaagcgttctcttgatctacact

SEQ ID NO: 428022 - DNA, 25 bp, Mus musculus
gaaaagctaagcatgggtctcagca

SEQ ID NO: 428023 - DNA, 25 bp, Mus musculus
gaaaagctaagttcacagtcgctgg

SEQ ID NO: 428024 - DNA, 25 bp, Mus musculus
gaaaagctacccagtagagcttggg

SEQ ID NO: 428025 - DNA, 25 bp, Mus musculus
gaaaagctcaatgtcctcctggacg

SEQ ID NO: 428026 - DNA, 25 bp, Mus musculus
gaaaagctcagcacaaaccgatcag

SEQ ID NO: 428027 - DNA, 25 bp, Mus musculus
gaaaagctgagttgtgtgcccgtgc

SEQ ID NO: 428028 - DNA, 25 bp, Mus musculus
gaaaagctgatggaactctctgagg

SEQ ID NO: 428029 - DNA, 25 bp, Mus musculus
gaaaagctgctagctccattgacca

SEQ ID NO: 428030 - DNA, 25 bp, Mus musculus
gaaaagctgcttaaaggcgacgcgt

SEQ ID NO: 428031 - DNA, 25 bp, Mus musculus
gaaaagctgggctacaacctgaaca

SEQ ID NO: 428032 - DNA, 25 bp, Mus musculus
gaaaagctgtacttcccaggctgaa

SEQ ID NO: 428033 - DNA, 25 bp, Mus musculus
gaaaagcttatgacgcaggctgacc

SEQ ID NO: 428034 - DNA, 25 bp, Mus musculus
gaaaagcttatgcaccatcagggtg

SEQ ID NO: 428035 - DNA, 25 bp, Mus musculus
gaaaagcttccttgagatgatgcag

SEQ ID NO: 428036 - DNA, 25 bp, Mus musculus
gaaaagcttcttccgctggaggatc

SEQ ID NO: 428037 - DNA, 25 bp, Mus musculus
gaaaagcttgcgttgctcattgcct

SEQ ID NO: 428038 - DNA, 25 bp, Mus musculus
gaaaaggaacgcctacatatggaat

SEQ ID NO: 428039 - DNA, 25 bp, Mus musculus
gaaaaggaccggatcattacagcca

SEQ ID NO: 428040 - DNA, 25 bp, Mus musculus
gaaaaggacctttgccagagacttg

SEQ ID NO: 428041 - DNA, 25 bp, Mus musculus
gaaaaggacttggtaggttgagctt

SEQ ID NO: 428042 - DNA, 25 bp, Mus musculus
gaaaaggagcgtcaaaggtgacctt

SEQ ID NO: 428043 - DNA, 25 bp, Mus musculus
gaaaaggaggcagcgttcctaacca

SEQ ID NO: 428044 - DNA, 25 bp, Mus musculus
gaaaaggaggccaattcccctgaga

SEQ ID NO: 428045 - DNA, 25 bp, Mus musculus
gaaaaggaggctcatactccccgga

SEQ ID NO: 428046 - DNA, 25 bp, Mus musculus
gaaaaggatacaccaccatctcaaa

SEQ ID NO: 428047 - DNA, 25 bp, Mus musculus
gaaaaggattggcacccagtctccg

SEQ ID NO: 428048 - DNA, 25 bp, Mus musculus
gaaaaggcaccagaaccgtttgagg

SEQ ID NO: 428049 - DNA, 25 bp, Mus musculus
gaaaaggcactactggagattggac

SEQ ID NO: 428050 - DNA, 25 bp, Mus musculus
gaaaaggcaggcaggtatcgacacc

SEQ ID NO: 428051 - DNA, 25 bp, Mus musculus
gaaaaggcatgcgtactgtgacacc

SEQ ID NO: 428052 - DNA, 25 bp, Mus musculus
gaaaaggccaaggagatctacatga

SEQ ID NO: 428053 - DNA, 25 bp, Mus musculus
gaaaaggccactttggtcctggtgc

SEQ ID NO: 428054 - DNA, 25 bp, Mus musculus
gaaaaggcccccgtgtctgtggcct

SEQ ID NO: 428055 - DNA, 25 bp, Mus musculus
gaaaaggccttcagtgtccacggag

SEQ ID NO: 428056 - DNA, 25 bp, Mus musculus
gaaaaggctactatccggccagcaa

SEQ ID NO: 428057 - DNA, 25 bp, Mus musculus
gaaaaggctcgggacgatggccctt

SEQ ID NO: 428058 - DNA, 25 bp, Mus musculus
gaaaaggcttcatcaggacgcggtg

SEQ ID NO: 428059 - DNA, 25 bp, Mus musculus
gaaaaggcttctactgctgccaccg

SEQ ID NO: 428060 - DNA, 25 bp, Mus musculus
gaaaaggcttctcactcaggcatga

SEQ ID NO: 428061 - DNA, 25 bp, Mus musculus
gaaaaggctttctgaactccagccg

SEQ ID NO: 428062 - DNA, 25 bp, Mus musculus
gaaaagggagcaagcctctgaggct

SEQ ID NO: 428063 - DNA, 25 bp, Mus musculus
gaaaagggcatccacagacttgagg

SEQ ID NO: 428064 - DNA, 25 bp, Mus musculus
gaaaagggcctgatgctctggccag

SEQ ID NO: 428065 - DNA, 25 bp, Mus musculus
gaaaagggcctgcactacaaaggga

SEQ ID NO: 428066 - DNA, 25 bp, Mus musculus
gaaaagggcgacttcaacggtcaga

SEQ ID NO: 428067 - DNA, 25 bp, Mus musculus
gaaaaggtaaccaagcaagggctgt

SEQ ID NO: 428068 - DNA, 25 bp, Mus musculus
gaaaaggtcacttcacacgccatag

SEQ ID NO: 428069 - DNA, 25 bp, Mus musculus
gaaaaggtcattgctgtccagaaga

SEQ ID NO: 428070 - DNA, 25 bp, Mus musculus
gaaaaggtcccgtagagaatcacag

SEQ ID NO: 428071 - DNA, 25 bp, Mus musculus
gaaaaggtgccatttctgtcctgag

SEQ ID NO: 428072 - DNA, 25 bp, Mus musculus
gaaaaggtgtgacccctgtagccac

SEQ ID NO: 428073 - DNA, 25 bp, Mus musculus
gaaaaggttccgctcatacaaaggg

SEQ ID NO: 428074 - DNA, 25 bp, Mus musculus
gaaaaggttcgctcagctgtgcaga

SEQ ID NO: 428075 - DNA, 25 bp, Mus musculus
gaaaaggtttctctctacagaggtg

SEQ ID NO: 428076 - DNA, 25 bp, Mus musculus
gaaaagtacaaggattcagcccaga

SEQ ID NO: 428077 - DNA, 25 bp, Mus musculus
gaaaagtacatcttgcctccaaatt

SEQ ID NO: 428078 - DNA, 25 bp, Mus musculus
gaaaagtacctatccaggccttggg

SEQ ID NO: 428079 - DNA, 25 bp, Mus musculus
gaaaagtagctgagccatcaccacc

SEQ ID NO: 428080 - DNA, 25 bp, Mus musculus
gaaaagtcaagaacaagagctcccc

SEQ ID NO: 428081 - DNA, 25 bp, Mus musculus
gaaaagtcagactgccaggcttggt

SEQ ID NO: 428082 - DNA, 25 bp, Mus musculus
gaaaagtcagccaaagtcacacagt

SEQ ID NO: 428083 - DNA, 25 bp, Mus musculus
gaaaagtcccgaagcgacctaggat

SEQ ID NO: 428084 - DNA, 25 bp, Mus musculus
gaaaagtcgtaaagtctgtcctgga

SEQ ID NO: 428085 - DNA, 25 bp, Mus musculus
gaaaagtcgttactttatgaagcaa

SEQ ID NO: 428086 - DNA, 25 bp, Mus musculus
gaaaagtctcagctaatctcaggga

SEQ ID NO: 428087 - DNA, 25 bp, Mus musculus
gaaaagtctcccgtgaagtctcctg

SEQ ID NO: 428088 - DNA, 25 bp, Mus musculus
gaaaagtctgcacaagggctacact

SEQ ID NO: 428089 - DNA, 25 bp, Mus musculus
gaaaagtcttcttcgccttagtggt

SEQ ID NO: 428090 - DNA, 25 bp, Mus musculus
gaaaagtctttcattctctacatgc

SEQ ID NO: 428091 - DNA, 25 bp, Mus musculus
gaaaagtgcaaaactcctaaggcca

SEQ ID NO: 428092 - DNA, 25 bp, Mus musculus
gaaaagtgccagcaacagctgccag

SEQ ID NO: 428093 - DNA, 25 bp, Mus musculus
gaaaagtgctttatctgctgcaaaa

SEQ ID NO: 428094 - DNA, 25 bp, Mus musculus
gaaaagtggacttcggctgttccgc

SEQ ID NO: 428095 - DNA, 25 bp, Mus musculus
gaaaagtgtcacctaaaggccaaga

SEQ ID NO: 428096 - DNA, 25 bp, Mus musculus
gaaaagttactcagcttagaaagcg

SEQ ID NO: 428097 - DNA, 25 bp, Mus musculus
gaaaagttagcccttggactgacag

SEQ ID NO: 428098 - DNA, 25 bp, Mus musculus
gaaaagttcaaggtgctggccagca

SEQ ID NO: 428099 - DNA, 25 bp, Mus musculus
gaaaagttcctctgcagagtgcccg

SEQ ID NO: 428100 - DNA, 25 bp, Mus musculus
gaaaagtttgaacttgtgggtcctg

SEQ ID NO: 428101 - DNA, 25 bp, Mus musculus
gaaaataacagaagaagacctccag

SEQ ID NO: 428102 - DNA, 25 bp, Mus musculus
gaaaataacatggtattggccaatt

SEQ ID NO: 428103 - DNA, 25 bp, Mus musculus
gaaaataagggctcttcaggagagc

SEQ ID NO: 428104 - DNA, 25 bp, Mus musculus
gaaaatacacggtccatggatccag

SEQ ID NO: 428105 - DNA, 25 bp, Mus musculus
gaaaatacagtcttctatcctgcca

SEQ ID NO: 428106 - DNA, 25 bp, Mus musculus
gaaaatacccaaatgtcgatgctag

SEQ ID NO: 428107 - DNA, 25 bp, Mus musculus
gaaaatacccaccagccatctagag

SEQ ID NO: 428108 - DNA, 25 bp, Mus musculus
gaaaatacccagcactccttcaatg

SEQ ID NO: 428109 - DNA, 25 bp, Mus musculus
gaaaataccggaagagcgtcctgaa

SEQ ID NO: 428110 - DNA, 25 bp, Mus musculus
gaaaatactcaggaagcaccacaga

SEQ ID NO: 428111 - DNA, 25 bp, Mus musculus
gaaaatagaagacctgcggcagtgc

SEQ ID NO: 428112 - DNA, 25 bp, Mus musculus
gaaaatagagaagaccaagatcccg

SEQ ID NO: 428113 - DNA, 25 bp, Mus musculus
gaaaatagcaactctgacccgaggg

SEQ ID NO: 428114 - DNA, 25 bp, Mus musculus
gaaaatagctcactgggtcctcaca

SEQ ID NO: 428115 - DNA, 25 bp, Mus musculus
gaaaatagtatgctgttcacctcag

SEQ ID NO: 428116 - DNA, 25 bp, Mus musculus
gaaaatatgaagtcggagatggccc

SEQ ID NO: 428117 - DNA, 25 bp, Mus musculus
gaaaatatgctaagccctgtgctca

SEQ ID NO: 428118 - DNA, 25 bp, Mus musculus
gaaaatatgggtttctacggcacat

SEQ ID NO: 428119 - DNA, 25 bp, Mus musculus
gaaaatattaacaatgcagcctctg

SEQ ID NO: 428120 - DNA, 25 bp, Mus musculus
gaaaatattatctttggagattgca

SEQ ID NO: 428121 - DNA, 25 bp, Mus musculus
gaaaatattccagtaatgttcctgg

SEQ ID NO: 428122 - DNA, 25 bp, Mus musculus
gaaaatattctagggcatccagtgc

SEQ ID NO: 428123 - DNA, 25 bp, Mus musculus
gaaaatattgttgggtggcgtcact

SEQ ID NO: 428124 - DNA, 25 bp, Mus musculus
gaaaatatttggaagtcagagttag

SEQ ID NO: 428125 - DNA, 25 bp, Mus musculus
gaaaatcaatcccaccgctagtctg

SEQ ID NO: 428126 - DNA, 25 bp, Mus musculus
gaaaatcaccctgataccgaaggag

SEQ ID NO: 428127 - DNA, 25 bp, Mus musculus
gaaaatcacgttggttagagctgga

SEQ ID NO: 428128 - DNA, 25 bp, Mus musculus
gaaaatcactgcttattatatggac

SEQ ID NO: 428129 - DNA, 25 bp, Mus musculus
gaaaatcagaggtcagaatccagag

SEQ ID NO: 428130 - DNA, 25 bp, Mus musculus
gaaaatcagcctgcaaggtagctca

SEQ ID NO: 428131 - DNA, 25 bp, Mus musculus
gaaaatcagtattgaggacaatccg

SEQ ID NO: 428132 - DNA, 25 bp, Mus musculus
gaaaatcataggtcatctcactggg

SEQ ID NO: 428133 - DNA, 25 bp, Mus musculus
gaaaatccactctaagtcttgttgg

SEQ ID NO: 428134 - DNA, 25 bp, Mus musculus
gaaaatccagcgtctccgtgaagtc

SEQ ID NO: 428135 - DNA, 25 bp, Mus musculus
gaaaatccaggatcacaggccatgt

SEQ ID NO: 428136 - DNA, 25 bp, Mus musculus
gaaaatccattgctggtaccactgg

SEQ ID NO: 428137 - DNA, 25 bp, Mus musculus
gaaaatccatttgccagtctgacag

SEQ ID NO: 428138 - DNA, 25 bp, Mus musculus
gaaaatcccaagatcccacatgcag

SEQ ID NO: 428139 - DNA, 25 bp, Mus musculus
gaaaatccccgctgctctcaaagaa

SEQ ID NO: 428140 - DNA, 25 bp, Mus musculus
gaaaatcccctcagatgggcgctgg

SEQ ID NO: 428141 - DNA, 25 bp, Mus musculus
gaaaatccctatacggtggacagcc

SEQ ID NO: 428142 - DNA, 25 bp, Mus musculus
gaaaatccctgctcttgatgacgag

SEQ ID NO: 428143 - DNA, 25 bp, Mus musculus
gaaaatccctgggtctctggagact

SEQ ID NO: 428144 - DNA, 25 bp, Mus musculus
gaaaatccgaaggaatattacaagc

SEQ ID NO: 428145 - DNA, 25 bp, Mus musculus
gaaaatccgtaggtgtggtgaccac

SEQ ID NO: 428146 - DNA, 25 bp, Mus musculus
gaaaatccgtttcctcgagagcaat

SEQ ID NO: 428147 - DNA, 25 bp, Mus musculus
gaaaatcgacctgaaagaacgccca

SEQ ID NO: 428148 - DNA, 25 bp, Mus musculus
gaaaatcgagaaggtgcgggtcctc

SEQ ID NO: 428149 - DNA, 25 bp, Mus musculus
gaaaatcgccgtgaagatggtgcac

SEQ ID NO: 428150 - DNA, 25 bp, Mus musculus
gaaaatcggccgaactacatgcagg

SEQ ID NO: 428151 - DNA, 25 bp, Mus musculus
gaaaatctccggcaaaccactgcta

SEQ ID NO: 428152 - DNA, 25 bp, Mus musculus
gaaaatctgctactattcaacaggg

SEQ ID NO: 428153 - DNA, 25 bp, Mus musculus
gaaaatctggcaagcactatcaatg

SEQ ID NO: 428154 - DNA, 25 bp, Mus musculus
gaaaatctgggcatgatcaccttga

SEQ ID NO: 428155 - DNA, 25 bp, Mus musculus
gaaaatcttcacgagacaagctcag

SEQ ID NO: 428156 - DNA, 25 bp, Mus musculus
gaaaatcttgacctagcagatgtgg

SEQ ID NO: 428157 - DNA, 25 bp, Mus musculus
gaaaatgaaatacagctaagagcgc

SEQ ID NO: 428158 - DNA, 25 bp, Mus musculus
gaaaatgaacactgcctcttgaggg

SEQ ID NO: 428159 - DNA, 25 bp, Mus musculus
gaaaatgaacctagcatccggatgt

SEQ ID NO: 428160 - DNA, 25 bp, Mus musculus
gaaaatgaagaaaccggcctctcag

SEQ ID NO: 428161 - DNA, 25 bp, Mus musculus
gaaaatgaagagtatccgggagacc

SEQ ID NO: 428162 - DNA, 25 bp, Mus musculus
gaaaatgacaagagcatccgaggtg

SEQ ID NO: 428163 - DNA, 25 bp, Mus musculus
gaaaatgacagttcgggcagtcact

SEQ ID NO: 428164 - DNA, 25 bp, Mus musculus
gaaaatgaccaggaaaataggtcac

SEQ ID NO: 428165 - DNA, 25 bp, Mus musculus
gaaaatgactcttctctgaagacgg

SEQ ID NO: 428166 - DNA, 25 bp, Mus musculus
gaaaatgagccatggaggcattcct

SEQ ID NO: 428167 - DNA, 25 bp, Mus musculus
gaaaatgagctgaccttgcgccaga

SEQ ID NO: 428168 - DNA, 25 bp, Mus musculus
gaaaatgatagcctccgctggcagc

SEQ ID NO: 428169 - DNA, 25 bp, Mus musculus
gaaaatgatgcggacatggctgctg

SEQ ID NO: 428170 - DNA, 25 bp, Mus musculus
gaaaatgcaaaagcgctctcagggc

SEQ ID NO: 428171 - DNA, 25 bp, Mus musculus
gaaaatgcaaacctttaactgcctg

SEQ ID NO: 428172 - DNA, 25 bp, Mus musculus
gaaaatgcaatcaagggcgctcctt

SEQ ID NO: 428173 - DNA, 25 bp, Mus musculus
gaaaatgcacacacctcatggccag

SEQ ID NO: 428174 - DNA, 25 bp, Mus musculus
gaaaatgcaccgatacaccgtggct

SEQ ID NO: 428175 - DNA, 25 bp, Mus musculus
gaaaatgcagatgaccgagaggcca

SEQ ID NO: 428176 - DNA, 25 bp, Mus musculus
gaaaatgcaggtggaaacatcacat

SEQ ID NO: 428177 - DNA, 25 bp, Mus musculus
gaaaatgcagtttcccacctgccaa

SEQ ID NO: 428178 - DNA, 25 bp, Mus musculus
gaaaatgcccagttgttgaaagctc

SEQ ID NO: 428179 - DNA, 25 bp, Mus musculus
gaaaatgcccctaaaagtcgtctgc

SEQ ID NO: 428180 - DNA, 25 bp, Mus musculus
gaaaatgccgaagatgccgatggaa

SEQ ID NO: 428181 - DNA, 25 bp, Mus musculus
gaaaatgccgataccgcgtctagaa

SEQ ID NO: 428182 - DNA, 25 bp, Mus musculus
gaaaatgctgtatggttcgagcccc

SEQ ID NO: 428183 - DNA, 25 bp, Mus musculus
gaaaatggaagacactgctcctgac

SEQ ID NO: 428184 - DNA, 25 bp, Mus musculus
gaaaatggacaaaaccaccgtgctg

SEQ ID NO: 428185 - DNA, 25 bp, Mus musculus
gaaaatggaccccacaggaaaactg

SEQ ID NO: 428186 - DNA, 25 bp, Mus musculus
gaaaatggacccctgtgacaactgc

SEQ ID NO: 428187 - DNA, 25 bp, Mus musculus
gaaaatggagaaccctgctggcact

SEQ ID NO: 428188 - DNA, 25 bp, Mus musculus
gaaaatggccagctggagtgtcccc

SEQ ID NO: 428189 - DNA, 25 bp, Mus musculus
gaaaatggcccaggaactctacatg

SEQ ID NO: 428190 - DNA, 25 bp, Mus musculus
gaaaatggccccactggatctgctt

SEQ ID NO: 428191 - DNA, 25 bp, Mus musculus
gaaaatggcccttctccaggtcgga

SEQ ID NO: 428192 - DNA, 25 bp, Mus musculus
gaaaatggctcaggcatccgtcagc

SEQ ID NO: 428193 - DNA, 25 bp, Mus musculus
gaaaatggctcatcctatggtctcc

SEQ ID NO: 428194 - DNA, 25 bp, Mus musculus
gaaaatgggcatctcagctgctccg

SEQ ID NO: 428195 - DNA, 25 bp, Mus musculus
gaaaatgggccaacaccgtcccctg

SEQ ID NO: 428196 - DNA, 25 bp, Mus musculus
gaaaatgggccagaacttggtgagc

SEQ ID NO: 428197 - DNA, 25 bp, Mus musculus
gaaaatgggttactgaagatcttaa

SEQ ID NO: 428198 - DNA, 25 bp, Mus musculus
gaaaatggtccagcttgataacggc

SEQ ID NO: 428199 - DNA, 25 bp, Mus musculus
gaaaatggtgacctagacctcagag

SEQ ID NO: 428200 - DNA, 25 bp, Mus musculus
gaaaatggtttatcagaggattccc

SEQ ID NO: 428201 - DNA, 25 bp, Mus musculus
gaaaatggttttacagcggcagaga

SEQ ID NO: 428202 - DNA, 25 bp, Mus musculus
gaaaatgtcctagttgaagtccatg

SEQ ID NO: 428203 - DNA, 25 bp, Mus musculus
gaaaatgtcgtccatagcagcgtcc

SEQ ID NO: 428204 - DNA, 25 bp, Mus musculus
gaaaatgtctggtaaagcacgtgct

SEQ ID NO: 428205 - DNA, 25 bp, Mus musculus
gaaaatgtcttggaacttagtggtt

SEQ ID NO: 428206 - DNA, 25 bp, Mus musculus
gaaaatgtctttgtaccctcctcag

SEQ ID NO: 428207 - DNA, 25 bp, Mus musculus
gaaaatgtgcacttcagctacgctg

SEQ ID NO: 428208 - DNA, 25 bp, Mus musculus
gaaaatgtgtctcgctaaccgtgca

SEQ ID NO: 428209 - DNA, 25 bp, Mus musculus
gaaaatgttggagggtttccagatc

SEQ ID NO: 428210 - DNA, 25 bp, Mus musculus
gaaaatgtttagacgtcgtgcagcc

SEQ ID NO: 428211 - DNA, 25 bp, Mus musculus
gaaaatgtttgctgagcggctgcag

SEQ ID NO: 428212 - DNA, 25 bp, Mus musculus
gaaaattaaggaccaacagcctggg

SEQ ID NO: 428213 - DNA, 25 bp, Mus musculus
gaaaattagtcatcaacctccgagg

SEQ ID NO: 428214 - DNA, 25 bp, Mus musculus
gaaaattatgacttggcccttagct

SEQ ID NO: 428215 - DNA, 25 bp, Mus musculus
gaaaattcaaagaagtcgccgaggc

SEQ ID NO: 428216 - DNA, 25 bp, Mus musculus
gaaaattctatccagggtcgcagcc

SEQ ID NO: 428217 - DNA, 25 bp, Mus musculus
gaaaattctccttcgatcctcacac

SEQ ID NO: 428218 - DNA, 25 bp, Mus musculus
gaaaattctccttcgggcacagtaa

SEQ ID NO: 428219 - DNA, 25 bp, Mus musculus
gaaaattcttgagggcacgagagcc

SEQ ID NO: 428220 - DNA, 25 bp, Mus musculus
gaaaattgagcgacaaacgctgtca

SEQ ID NO: 428221 - DNA, 25 bp, Mus musculus
gaaaattgctgtcccaactatgagg

SEQ ID NO: 428222 - DNA, 25 bp, Mus musculus
gaaaattgtagacatgaagcgggcc

SEQ ID NO: 428223 - DNA, 25 bp, Mus musculus
gaaaattgtgatcctatttaatact

SEQ ID NO: 428224 - DNA, 25 bp, Mus musculus
gaaaatttccgtataaccagtgaag

SEQ ID NO: 428225 - DNA, 25 bp, Mus musculus
gaaaatttctgctcttcacccaggg

SEQ ID NO: 428226 - DNA, 25 bp, Mus musculus
gaaaatttgttatcgctgtcttagg

SEQ ID NO: 428227 - DNA, 25 bp, Mus musculus
gaaaatttgtttcagccgtctaagt

SEQ ID NO: 428228 - DNA, 25 bp, Mus musculus
gaaacaaacatcagcaggacactag

SEQ ID NO: 428229 - DNA, 25 bp, Mus musculus
gaaacaaaccgtgggtatctggcca

SEQ ID NO: 428230 - DNA, 25 bp, Mus musculus
gaaacaaagacgcttctggccgctg

SEQ ID NO: 428231 - DNA, 25 bp, Mus musculus
gaaacaaagagagaagggtcacaaa

SEQ ID NO: 428232 - DNA, 25 bp, Mus musculus
gaaacaaagcgctccatcaacgagg

SEQ ID NO: 428233 - DNA, 25 bp, Mus musculus
gaaacaaatactgacacgtgtgcat

SEQ ID NO: 428234 - DNA, 25 bp, Mus musculus
gaaacaaatgcttaaggacctagtt

SEQ ID NO: 428235 - DNA, 25 bp, Mus musculus
gaaacaaatttgatcacggcgctga

SEQ ID NO: 428236 - DNA, 25 bp, Mus musculus
gaaacaacaaagcacaggatactgg

SEQ ID NO: 428237 - DNA, 25 bp, Mus musculus
gaaacaacacctgtggagtcaccaa

SEQ ID NO: 428238 - DNA, 25 bp, Mus musculus
gaaacaacacgtatgctgaacccca

SEQ ID NO: 428239 - DNA, 25 bp, Mus musculus
gaaacaaccaaacaggggcatagag

SEQ ID NO: 428240 - DNA, 25 bp, Mus musculus
gaaacaaccctacagctctctggag

SEQ ID NO: 428241 - DNA, 25 bp, Mus musculus
gaaacaactcgcattaccagcggag

SEQ ID NO: 428242 - DNA, 25 bp, Mus musculus
gaaacaacttcaccctgctgacgaa

SEQ ID NO: 428243 - DNA, 25 bp, Mus musculus
gaaacaagaatgctctcctgcgcct

SEQ ID NO: 428244 - DNA, 25 bp, Mus musculus
gaaacaagcaagagcaatgaccaat

SEQ ID NO: 428245 - DNA, 25 bp, Mus musculus
gaaacaagccagtgaaagagcccca

SEQ ID NO: 428246 - DNA, 25 bp, Mus musculus
gaaacaagctgccaccgagagagat

SEQ ID NO: 428247 - DNA, 25 bp, Mus musculus
gaaacaaggcgcaaccactgtctga

SEQ ID NO: 428248 - DNA, 25 bp, Mus musculus
gaaacaaggtctctgcatggctctg

SEQ ID NO: 428249 - DNA, 25 bp, Mus musculus
gaaacaaggtctgctgaagggctgt

SEQ ID NO: 428250 - DNA, 25 bp, Mus musculus
gaaacaaggttgacaagtcctgaag

SEQ ID NO: 428251 - DNA, 25 bp, Mus musculus
gaaacaagtctgtgagcccaacggt

SEQ ID NO: 428252 - DNA, 25 bp, Mus musculus
gaaacaagtgcctctcggtgctgaa

SEQ ID NO: 428253 - DNA, 25 bp, Mus musculus
gaaacaataatggatgctgcccaca

SEQ ID NO: 428254 - DNA, 25 bp, Mus musculus
gaaacaatggcttcatctggatagg

SEQ ID NO: 428255 - DNA, 25 bp, Mus musculus
gaaacaattcctatggagggtatgc

SEQ ID NO: 428256 - DNA, 25 bp, Mus musculus
gaaacaattgaagactgctgggacc

SEQ ID NO: 428257 - DNA, 25 bp, Mus musculus
gaaacaatttctccagcactgggtg

SEQ ID NO: 428258 - DNA, 25 bp, Mus musculus
gaaacacaacctacggcaaacagag

SEQ ID NO: 428259 - DNA, 25 bp, Mus musculus
gaaacacaactgtctaatgggccaa

SEQ ID NO: 428260 - DNA, 25 bp, Mus musculus
gaaacacaagagctgctatcggagg

SEQ ID NO: 428261 - DNA, 25 bp, Mus musculus
gaaacacaagttctaggtccaatgg

SEQ ID NO: 428262 - DNA, 25 bp, Mus musculus
gaaacacaagttggcacaggttggc

SEQ ID NO: 428263 - DNA, 25 bp, Mus musculus
gaaacacacctcttcatgtggcctg

SEQ ID NO: 428264 - DNA, 25 bp, Mus musculus
gaaacacactgtattgagaacggcc

SEQ ID NO: 428265 - DNA, 25 bp, Mus musculus
gaaacacagacgtagcttgcagaca

SEQ ID NO: 428266 - DNA, 25 bp, Mus musculus
gaaacacagtagagcttcaggcaga

SEQ ID NO: 428267 - DNA, 25 bp, Mus musculus
gaaacacagtagtagcatgcccttg

SEQ ID NO: 428268 - DNA, 25 bp, Mus musculus
gaaacacagtgtggcggtctaacca

SEQ ID NO: 428269 - DNA, 25 bp, Mus musculus
gaaacacatatttctcctgctggaa

SEQ ID NO: 428270 - DNA, 25 bp, Mus musculus
gaaacacatccggacttacaagcag

SEQ ID NO: 428271 - DNA, 25 bp, Mus musculus
gaaacacatgtgaccattacctcga

SEQ ID NO: 428272 - DNA, 25 bp, Mus musculus
gaaacacattctcaagccatcagcg

SEQ ID NO: 428273 - DNA, 25 bp, Mus musculus
gaaacaccacggttcacagtactga

SEQ ID NO: 428274 - DNA, 25 bp, Mus musculus
gaaacaccgtgatcctgtttgtgcc

SEQ ID NO: 428275 - DNA, 25 bp, Mus musculus
gaaacacctcagctccaggtcaagg

SEQ ID NO: 428276 - DNA, 25 bp, Mus musculus
gaaacacctgtgtcagctgcagcaa

SEQ ID NO: 428277 - DNA, 25 bp, Mus musculus
gaaacacgaccagcaattgagaaac

SEQ ID NO: 428278 - DNA, 25 bp, Mus musculus
gaaacactaaagactggacctcaag

SEQ ID NO: 428279 - DNA, 25 bp, Mus musculus
gaaacactaagactgaggcctccaa

SEQ ID NO: 428280 - DNA, 25 bp, Mus musculus
gaaacactacgttcccattaagaga

SEQ ID NO: 428281 - DNA, 25 bp, Mus musculus
gaaacactcagtgatggaaggcagc

SEQ ID NO: 428282 - DNA, 25 bp, Mus musculus
gaaacactcatcgatgtggcgagga

SEQ ID NO: 428283 - DNA, 25 bp, Mus musculus
gaaacactgcataggggagaagtta

SEQ ID NO: 428284 - DNA, 25 bp, Mus musculus
gaaacactggctggatagctcggcc

SEQ ID NO: 428285 - DNA, 25 bp, Mus musculus
gaaacactgggagcttccgacaaga

SEQ ID NO: 428286 - DNA, 25 bp, Mus musculus
gaaacacttgctgcatttacgggct

SEQ ID NO: 428287 - DNA, 25 bp, Mus musculus
gaaacagacaggcaaatgcatcggc

SEQ ID NO: 428288 - DNA, 25 bp, Mus musculus
gaaacagaccagttctccatgtggg

SEQ ID NO: 428289 - DNA, 25 bp, Mus musculus
gaaacagaccctaattggaactgag

SEQ ID NO: 428290 - DNA, 25 bp, Mus musculus
gaaacagacgccaggacagaggctt

SEQ ID NO: 428291 - DNA, 25 bp, Mus musculus
gaaacagagcagactatcttgccat

SEQ ID NO: 428292 - DNA, 25 bp, Mus musculus
gaaacagagcccattgatgtcgctg

SEQ ID NO: 428293 - DNA, 25 bp, Mus musculus
gaaacagagtcttcaagtcttccac

SEQ ID NO: 428294 - DNA, 25 bp, Mus musculus
gaaacagagttcactggctgagcct

SEQ ID NO: 428295 - DNA, 25 bp, Mus musculus
gaaacagatacaataatggatgaga

SEQ ID NO: 428296 - DNA, 25 bp, Mus musculus
gaaacagatcactactccaatggag

SEQ ID NO: 428297 - DNA, 25 bp, Mus musculus
gaaacagcaacccttttgtcctggg

SEQ ID NO: 428298 - DNA, 25 bp, Mus musculus
gaaacagcaactcatacggtgcttg

SEQ ID NO: 428299 - DNA, 25 bp, Mus musculus
gaaacagcactagatgaaatccggc

SEQ ID NO: 428300 - DNA, 25 bp, Mus musculus
gaaacagcagagaggtcatcccata

SEQ ID NO: 428301 - DNA, 25 bp, Mus musculus
gaaacagcagtgagcttctaagtca

SEQ ID NO: 428302 - DNA, 25 bp, Mus musculus
gaaacagccctttagagctttaact

SEQ ID NO: 428303 - DNA, 25 bp, Mus musculus
gaaacagcgcattcctaaagtggcc

SEQ ID NO: 428304 - DNA, 25 bp, Mus musculus
gaaacagcgcctgagcaagaagctg

SEQ ID NO: 428305 - DNA, 25 bp, Mus musculus
gaaacagctatatcatgtcaacatg

SEQ ID NO: 428306 - DNA, 25 bp, Mus musculus
gaaacaggaagtaaccaggatggga

SEQ ID NO: 428307 - DNA, 25 bp, Mus musculus
gaaacaggacatgtcggagcatcct

SEQ ID NO: 428308 - DNA, 25 bp, Mus musculus
gaaacaggacctcggagatgtactg

SEQ ID NO: 428309 - DNA, 25 bp, Mus musculus
gaaacaggatctgcaacagaagcct

SEQ ID NO: 428310 - DNA, 25 bp, Mus musculus
gaaacaggcgccacattgagaagaa

SEQ ID NO: 428311 - DNA, 25 bp, Mus musculus
gaaacagggagaccacttcatgaac

SEQ ID NO: 428312 - DNA, 25 bp, Mus musculus
gaaacagggcaaggtgaacatctca

SEQ ID NO: 428313 - DNA, 25 bp, Mus musculus
gaaacagggcagtaaataccttaca

SEQ ID NO: 428314 - DNA, 25 bp, Mus musculus
gaaacagtacaaacagagcctggcg

SEQ ID NO: 428315 - DNA, 25 bp, Mus musculus
gaaacagtcactatccggaggttgc

SEQ ID NO: 428316 - DNA, 25 bp, Mus musculus
gaaacagtctgtttcccgctgttga

SEQ ID NO: 428317 - DNA, 25 bp, Mus musculus
gaaacagtggccttccagtgcaaag

SEQ ID NO: 428318 - DNA, 25 bp, Mus musculus
gaaacagttagaagagagtcaccct

SEQ ID NO: 428319 - DNA, 25 bp, Mus musculus
gaaacagttgtcagtgggcaaagcc

SEQ ID NO: 428320 - DNA, 25 bp, Mus musculus
gaaacataccaagtgtcttcccatc

SEQ ID NO: 428321 - DNA, 25 bp, Mus musculus
gaaacatacgtgaaagtcgctggtc

SEQ ID NO: 428322 - DNA, 25 bp, Mus musculus
gaaacatagttacagaatgtaacca

SEQ ID NO: 428323 - DNA, 25 bp, Mus musculus
gaaacatataacctgtgtgaaagga

SEQ ID NO: 428324 - DNA, 25 bp, Mus musculus
gaaacatattgctgctcacgcccaa

SEQ ID NO: 428325 - DNA, 25 bp, Mus musculus
gaaacatcaagagttggacacctgg

SEQ ID NO: 428326 - DNA, 25 bp, Mus musculus
gaaacatcagctgtcctactctggg

SEQ ID NO: 428327 - DNA, 25 bp, Mus musculus
gaaacatcatggactagcatcccca

SEQ ID NO: 428328 - DNA, 25 bp, Mus musculus
gaaacatcccaacgtgatccaggag

SEQ ID NO: 428329 - DNA, 25 bp, Mus musculus
gaaacatccgatactctgtgccaga

SEQ ID NO: 428330 - DNA, 25 bp, Mus musculus
gaaacatccgtacactcttgtagtg

SEQ ID NO: 428331 - DNA, 25 bp, Mus musculus
gaaacatcgctggagatagctcgct

SEQ ID NO: 428332 - DNA, 25 bp, Mus musculus
gaaacatcgggaagcgtacctacag

SEQ ID NO: 428333 - DNA, 25 bp, Mus musculus
gaaacatcgggcaaaacagctcaag

SEQ ID NO: 428334 - DNA, 25 bp, Mus musculus
gaaacatctccccacgaactgaagg

SEQ ID NO: 428335 - DNA, 25 bp, Mus musculus
gaaacatctgcagatctcccaggag

SEQ ID NO: 428336 - DNA, 25 bp, Mus musculus
gaaacatctgcaggacgtgggtact

SEQ ID NO: 428337 - DNA, 25 bp, Mus musculus
gaaacatctgcagggagaacagcgt

SEQ ID NO: 428338 - DNA, 25 bp, Mus musculus
gaaacatcttactcacccagaggag

SEQ ID NO: 428339 - DNA, 25 bp, Mus musculus
gaaacatgacttctcgaatccaccc

SEQ ID NO: 428340 - DNA, 25 bp, Mus musculus
gaaacatgtgcttttacgcctccaa

SEQ ID NO: 428341 - DNA, 25 bp, Mus musculus
gaaacattaagtgccatccccaggg

SEQ ID NO: 428342 - DNA, 25 bp, Mus musculus
gaaacattcaactcctgctgtgcag

SEQ ID NO: 428343 - DNA, 25 bp, Mus musculus
gaaacattccatcaaggtcagcgtg

SEQ ID NO: 428344 - DNA, 25 bp, Mus musculus
gaaacattgaactagccctgctgga

SEQ ID NO: 428345 - DNA, 25 bp, Mus musculus
gaaacatttgatgctatgaagaatt

SEQ ID NO: 428346 - DNA, 25 bp, Mus musculus
gaaacatttggctacacgaggcatc

SEQ ID NO: 428347 - DNA, 25 bp, Mus musculus
gaaacattttcagatcatcaagcgc

SEQ ID NO: 428348 - DNA, 25 bp, Mus musculus
gaaacattttgagagtacacacggt

SEQ ID NO: 428349 - DNA, 25 bp, Mus musculus
gaaaccaaaatcaataagtcgtgcc

SEQ ID NO: 428350 - DNA, 25 bp, Mus musculus
gaaaccaaagagctgggcatccagg

SEQ ID NO: 428351 - DNA, 25 bp, Mus musculus
gaaaccaacaaaaagcctcaagaag

SEQ ID NO: 428352 - DNA, 25 bp, Mus musculus
gaaaccaacctaggagccaagaagc

SEQ ID NO: 428353 - DNA, 25 bp, Mus musculus
gaaaccaacctgtctaagctccgga

SEQ ID NO: 428354 - DNA, 25 bp, Mus musculus
gaaaccaacgtagggaaccagacag

SEQ ID NO: 428355 - DNA, 25 bp, Mus musculus
gaaaccaacttacccactgcagcat

SEQ ID NO: 428356 - DNA, 25 bp, Mus musculus
gaaaccaagtgactggagcctccct

SEQ ID NO: 428357 - DNA, 25 bp, Mus musculus
gaaaccacattggaaaactgctact

SEQ ID NO: 428358 - DNA, 25 bp, Mus musculus
gaaaccaccgaaaccaaggatccag

SEQ ID NO: 428359 - DNA, 25 bp, Mus musculus
gaaaccaccttattcgtacatcgcc

SEQ ID NO: 428360 - DNA, 25 bp, Mus musculus
gaaaccacgcctaaaatcccaagat

SEQ ID NO: 428361 - DNA, 25 bp, Mus musculus
gaaaccacgcgtcctactacaaaga

SEQ ID NO: 428362 - DNA, 25 bp, Mus musculus
gaaaccacggccatcagaagcagat

SEQ ID NO: 428363 - DNA, 25 bp, Mus musculus
gaaaccacgggccaagtaagacaca

SEQ ID NO: 428364 - DNA, 25 bp, Mus musculus
gaaaccacttgtgaagagtatggga

SEQ ID NO: 428365 - DNA, 25 bp, Mus musculus
gaaaccagaaagaacccctctgaag

SEQ ID NO: 428366 - DNA, 25 bp, Mus musculus
gaaaccagccgtgtctacacatggg

SEQ ID NO: 428367 - DNA, 25 bp, Mus musculus
gaaaccagctgcatgtcaggacaag

SEQ ID NO: 428368 - DNA, 25 bp, Mus musculus
gaaaccaggaattgtacagatgacc

SEQ ID NO: 428369 - DNA, 25 bp, Mus musculus
gaaaccagggcagtaaccaaatact

SEQ ID NO: 428370 - DNA, 25 bp, Mus musculus
gaaaccagggtcaggcgaggaccaa

SEQ ID NO: 428371 - DNA, 25 bp, Mus musculus
gaaaccaggtggtacatcctgtggg

SEQ ID NO: 428372 - DNA, 25 bp, Mus musculus
gaaaccagtgtgtgggatttcctca

SEQ ID NO: 428373 - DNA, 25 bp, Mus musculus
gaaaccagttgcgatacgcccagag

SEQ ID NO: 428374 - DNA, 25 bp, Mus musculus
gaaaccagtttcctcccattgcagc

SEQ ID NO: 428375 - DNA, 25 bp, Mus musculus
gaaaccatagctctttctttttggc

SEQ ID NO: 428376 - DNA, 25 bp, Mus musculus
gaaaccatcacacagttcctgcgag

SEQ ID NO: 428377 - DNA, 25 bp, Mus musculus
gaaaccatccttgtatacccttcag

SEQ ID NO: 428378 - DNA, 25 bp, Mus musculus
gaaaccatgagttcactgtgccctg

SEQ ID NO: 428379 - DNA, 25 bp, Mus musculus
gaaaccatgcttatgagccgctcgc

SEQ ID NO: 428380 - DNA, 25 bp, Mus musculus
gaaaccatgttcacaggacctgttc

SEQ ID NO: 428381 - DNA, 25 bp, Mus musculus
gaaaccattcagcacgtttgggtga

SEQ ID NO: 428382 - DNA, 25 bp, Mus musculus
gaaaccattcctatgaaagctatgc

SEQ ID NO: 428383 - DNA, 25 bp, Mus musculus
gaaaccattgacctgcacatagacc

SEQ ID NO: 428384 - DNA, 25 bp, Mus musculus
gaaaccattgatcgagagacctcgg

SEQ ID NO: 428385 - DNA, 25 bp, Mus musculus
gaaacccaacgagaagacacaagtg

SEQ ID NO: 428386 - DNA, 25 bp, Mus musculus
gaaacccaaggtgcggaaaagtctg

SEQ ID NO: 428387 - DNA, 25 bp, Mus musculus
gaaacccaagtcctagcacgaagct

SEQ ID NO: 428388 - DNA, 25 bp, Mus musculus
gaaacccacactgctgttccgggaa

SEQ ID NO: 428389 - DNA, 25 bp, Mus musculus
gaaacccaccctagaaatgactgcg

SEQ ID NO: 428390 - DNA, 25 bp, Mus musculus
gaaacccagaggctaatcaaggctg

SEQ ID NO: 428391 - DNA, 25 bp, Mus musculus
gaaacccagatttgcaggccatcag

SEQ ID NO: 428392 - DNA, 25 bp, Mus musculus
gaaacccagcgaagagggacctgtt

SEQ ID NO: 428393 - DNA, 25 bp, Mus musculus
gaaacccagcggctaaagactgccg

SEQ ID NO: 428394 - DNA, 25 bp, Mus musculus
gaaacccagctcctccaaatagtcg

SEQ ID NO: 428395 - DNA, 25 bp, Mus musculus
gaaacccaggctttcattagggcac

SEQ ID NO: 428396 - DNA, 25 bp, Mus musculus
gaaacccagggactgctgctgagaa

SEQ ID NO: 428397 - DNA, 25 bp, Mus musculus
gaaacccatcagtcaaggaggcatc

SEQ ID NO: 428398 - DNA, 25 bp, Mus musculus
gaaacccattgtgctcatgaagcca

SEQ ID NO: 428399 - DNA, 25 bp, Mus musculus
gaaaccccagctgatgtaacaagga

SEQ ID NO: 428400 - DNA, 25 bp, Mus musculus
gaaaccccagtgattcgctccttgt

SEQ ID NO: 428401 - DNA, 25 bp, Mus musculus
gaaaccccgccccaattaagcaatg

SEQ ID NO: 428402 - DNA, 25 bp, Mus musculus
gaaaccccgctgaattccatgatag

SEQ ID NO: 428403 - DNA, 25 bp, Mus musculus
gaaaccccgtgttgtcagaggagcc

SEQ ID NO: 428404 - DNA, 25 bp, Mus musculus
gaaacccctcctgaaagcaagaatg

SEQ ID NO: 428405 - DNA, 25 bp, Mus musculus
gaaacccctgttgattggagagcta

SEQ ID NO: 428406 - DNA, 25 bp, Mus musculus
gaaacccgagctctgtttcagctgg

SEQ ID NO: 428407 - DNA, 25 bp, Mus musculus
gaaacccgctcttatgtaatgcaag

SEQ ID NO: 428408 - DNA, 25 bp, Mus musculus
gaaacccgtggagtgtagttactgt

SEQ ID NO: 428409 - DNA, 25 bp, Mus musculus
gaaaccctaagctgaaacgaaatgc

SEQ ID NO: 428410 - DNA, 25 bp, Mus musculus
gaaaccctacaccatgtcatagatg

SEQ ID NO: 428411 - DNA, 25 bp, Mus musculus
gaaaccctacaggaagtcactctgg

SEQ ID NO: 428412 - DNA, 25 bp, Mus musculus
gaaaccctcagataaatccatgtgg

SEQ ID NO: 428413 - DNA, 25 bp, Mus musculus
gaaaccctcagtcctttggtagctg

SEQ ID NO: 428414 - DNA, 25 bp, Mus musculus
gaaaccctctgttccaagagctgct

SEQ ID NO: 428415 - DNA, 25 bp, Mus musculus
gaaaccctctttctgcatcgcggac

SEQ ID NO: 428416 - DNA, 25 bp, Mus musculus
gaaaccctgaggaaagtggactctg

SEQ ID NO: 428417 - DNA, 25 bp, Mus musculus
gaaaccctggtaaagacaaagctat

SEQ ID NO: 428418 - DNA, 25 bp, Mus musculus
gaaaccctggttagcagagtcttaa

SEQ ID NO: 428419 - DNA, 25 bp, Mus musculus
gaaaccctgtactaggccatgagga

SEQ ID NO: 428420 - DNA, 25 bp, Mus musculus
gaaaccctgttggagcatgaccaga

SEQ ID NO: 428421 - DNA, 25 bp, Mus musculus
gaaaccgacttccagatttcttact

SEQ ID NO: 428422 - DNA, 25 bp, Mus musculus
gaaaccgatttattcaacaggtggc

SEQ ID NO: 428423 - DNA, 25 bp, Mus musculus
gaaaccgcccctttctgtgacactg

SEQ ID NO: 428424 - DNA, 25 bp, Mus musculus
gaaaccgctatgaagttcctctctg

SEQ ID NO: 428425 - DNA, 25 bp, Mus musculus
gaaaccggcatacaacttctggagg

SEQ ID NO: 428426 - DNA, 25 bp, Mus musculus
gaaaccgtgaggtgtacgtagccct

SEQ ID NO: 428427 - DNA, 25 bp, Mus musculus
gaaaccgtgggtcctagaagccaag

SEQ ID NO: 428428 - DNA, 25 bp, Mus musculus
gaaaccgtggtatttcgtctgtgaa

SEQ ID NO: 428429 - DNA, 25 bp, Mus musculus
gaaaccgtgtcacctgaatccctag

SEQ ID NO: 428430 - DNA, 25 bp, Mus musculus
gaaacctaatgtaattcggtctcca

SEQ ID NO: 428431 - DNA, 25 bp, Mus musculus
gaaacctacattcccaaagaacatg

SEQ ID NO: 428432 - DNA, 25 bp, Mus musculus
gaaacctacccctgtgttctctcag

SEQ ID NO: 428433 - DNA, 25 bp, Mus musculus
gaaacctcagaaacgcatggtgacg

SEQ ID NO: 428434 - DNA, 25 bp, Mus musculus
gaaacctcaggtgtcggccttggag

SEQ ID NO: 428435 - DNA, 25 bp, Mus musculus
gaaacctcctcacgtttggctcaag

SEQ ID NO: 428436 - DNA, 25 bp, Mus musculus
gaaacctcgagtggtgctggctcca

SEQ ID NO: 428437 - DNA, 25 bp, Mus musculus
gaaacctcggatagctgttgaccaa

SEQ ID NO: 428438 - DNA, 25 bp, Mus musculus
gaaacctcggtgatttactagagaa

SEQ ID NO: 428439 - DNA, 25 bp, Mus musculus
gaaacctctacttactctagatagc

SEQ ID NO: 428440 - DNA, 25 bp, Mus musculus
gaaacctctcatgtggagcctgctg

SEQ ID NO: 428441 - DNA, 25 bp, Mus musculus
gaaacctctttatcggtcattccac

SEQ ID NO: 428442 - DNA, 25 bp, Mus musculus
gaaacctctttgctctgagaaacca

SEQ ID NO: 428443 - DNA, 25 bp, Mus musculus
gaaacctgagcaggctcctggctga

SEQ ID NO: 428444 - DNA, 25 bp, Mus musculus
gaaacctgccagtacttgcgggaag

SEQ ID NO: 428445 - DNA, 25 bp, Mus musculus
gaaacctgcccgagatgagggccta

SEQ ID NO: 428446 - DNA, 25 bp, Mus musculus
gaaacctggagtcgtgcgcatctcg

SEQ ID NO: 428447 - DNA, 25 bp, Mus musculus
gaaacctggcccctttgtgaaagag

SEQ ID NO: 428448 - DNA, 25 bp, Mus musculus
gaaacctggctcatgctgctataag

SEQ ID NO: 428449 - DNA, 25 bp, Mus musculus
gaaacctgggacgaggctttacgcg

SEQ ID NO: 428450 - DNA, 25 bp, Mus musculus
gaaacctgggtatgtccatgcgcgt

SEQ ID NO: 428451 - DNA, 25 bp, Mus musculus
gaaacctggtcaagacaaattcacg

SEQ ID NO: 428452 - DNA, 25 bp, Mus musculus
gaaacctggtcagcaagcacctgag

SEQ ID NO: 428453 - DNA, 25 bp, Mus musculus
gaaacctgtcggagatcaagctgct

SEQ ID NO: 428454 - DNA, 25 bp, Mus musculus
gaaacctgttgctttggcgcgtgga

SEQ ID NO: 428455 - DNA, 25 bp, Mus musculus
gaaaccttacggttgtggcattgaa

SEQ ID NO: 428456 - DNA, 25 bp, Mus musculus
gaaaccttatacctgcagtgagtgc

SEQ ID NO: 428457 - DNA, 25 bp, Mus musculus
gaaaccttcaggagtcaccgtgtgg

SEQ ID NO: 428458 - DNA, 25 bp, Mus musculus
gaaaccttcatctaaaaggcgaggg

SEQ ID NO: 428459 - DNA, 25 bp, Mus musculus
gaaaccttcccttagctctatctgc

SEQ ID NO: 428460 - DNA, 25 bp, Mus musculus
gaaaccttgacaccacagacactgg

SEQ ID NO: 428461 - DNA, 25 bp, Mus musculus
gaaaccttgcccatcttccgggatg

SEQ ID NO: 428462 - DNA, 25 bp, Mus musculus
gaaaccttgccgctgttgtccgagg

SEQ ID NO: 428463 - DNA, 25 bp, Mus musculus
gaaaccttgctatgctggaaatgct

SEQ ID NO: 428464 - DNA, 25 bp, Mus musculus
gaaaccttggatgaggaaccttcag

SEQ ID NO: 428465 - DNA, 25 bp, Mus musculus
gaaacgaaaacagagttcccaggat

SEQ ID NO: 428466 - DNA, 25 bp, Mus musculus
gaaacgaaatgtatccaatgtggcc

SEQ ID NO: 428467 - DNA, 25 bp, Mus musculus
gaaacgacagtgtattcaggcagaa

SEQ ID NO: 428468 - DNA, 25 bp, Mus musculus
gaaacgacatctttagagctggcct

SEQ ID NO: 428469 - DNA, 25 bp, Mus musculus
gaaacgacattaacaggagcagcta

SEQ ID NO: 428470 - DNA, 25 bp, Mus musculus
gaaacgacgtttggaacctgatcag

SEQ ID NO: 428471 - DNA, 25 bp, Mus musculus
gaaacgagagcaaacactccagggc

SEQ ID NO: 428472 - DNA, 25 bp, Mus musculus
gaaacgagattatagaagcacccat

SEQ ID NO: 428473 - DNA, 25 bp, Mus musculus
gaaacgaggaagcaaggtcccatga

SEQ ID NO: 428474 - DNA, 25 bp, Mus musculus
gaaacgagtgccaagaaatcccgaa

SEQ ID NO: 428475 - DNA, 25 bp, Mus musculus
gaaacgatacagcaagatcacctgg

SEQ ID NO: 428476 - DNA, 25 bp, Mus musculus
gaaacgatggacaccagaagctacc

SEQ ID NO: 428477 - DNA, 25 bp, Mus musculus
gaaacgatttctaatgaggagccac

SEQ ID NO: 428478 - DNA, 25 bp, Mus musculus
gaaacgcaaggatctgcttcaacgc

SEQ ID NO: 428479 - DNA, 25 bp, Mus musculus
gaaacgcaatgctgtatggctacca

SEQ ID NO: 428480 - DNA, 25 bp, Mus musculus
gaaacgcactattggtagaaccttg

SEQ ID NO: 428481 - DNA, 25 bp, Mus musculus
gaaacgcatagagcctgtcctcatt

SEQ ID NO: 428482 - DNA, 25 bp, Mus musculus
gaaacgcatggactagttcccctga

SEQ ID NO: 428483 - DNA, 25 bp, Mus musculus
gaaacgcatggtgacgatatgacca

SEQ ID NO: 428484 - DNA, 25 bp, Mus musculus
gaaacgccagcaagaggaggtcaac

SEQ ID NO: 428485 - DNA, 25 bp, Mus musculus
gaaacgccataagtctccaagtaca

SEQ ID NO: 428486 - DNA, 25 bp, Mus musculus
gaaacgcccttctatggcgaggagg

SEQ ID NO: 428487 - DNA, 25 bp, Mus musculus
gaaacgccggcggtgcttctctgac

SEQ ID NO: 428488 - DNA, 25 bp, Mus musculus
gaaacgccgggatatgacaaatggg

SEQ ID NO: 428489 - DNA, 25 bp, Mus musculus
gaaacgcctagagtcccaacgtgag

SEQ ID NO: 428490 - DNA, 25 bp, Mus musculus
gaaacgccttccaagagtaactcga

SEQ ID NO: 428491 - DNA, 25 bp, Mus musculus
gaaacgcgtggctctgaagatgaca

SEQ ID NO: 428492 - DNA, 25 bp, Mus musculus
gaaacgctatcccaagaactgcctg

SEQ ID NO: 428493 - DNA, 25 bp, Mus musculus
gaaacgctattgaagaggatctgtc

SEQ ID NO: 428494 - DNA, 25 bp, Mus musculus
gaaacgctgaagctcaaaggcactg

SEQ ID NO: 428495 - DNA, 25 bp, Mus musculus
gaaacgctgcaacatcaccaaagag

SEQ ID NO: 428496 - DNA, 25 bp, Mus musculus
gaaacgctgctctagaggaacggaa

SEQ ID NO: 428497 - DNA, 25 bp, Mus musculus
gaaacgcttcacgttcgtgctggcg

SEQ ID NO: 428498 - DNA, 25 bp, Mus musculus
gaaacggaaccggtctgacacggag

SEQ ID NO: 428499 - DNA, 25 bp, Mus musculus
gaaacggacgattagaagccatgtg

SEQ ID NO: 428500 - DNA, 25 bp, Mus musculus
gaaacggactatctctatgaagacc

SEQ ID NO: 428501 - DNA, 25 bp, Mus musculus
gaaacggactcgttcagtggaaact

SEQ ID NO: 428502 - DNA, 25 bp, Mus musculus
gaaacggagacgataacactgctgc

SEQ ID NO: 428503 - DNA, 25 bp, Mus musculus
gaaacggagtctaccttgccaagct

SEQ ID NO: 428504 - DNA, 25 bp, Mus musculus
gaaacggcaacacttcggtcaggat

SEQ ID NO: 428505 - DNA, 25 bp, Mus musculus
gaaacggcatcaggagacaaatgag

SEQ ID NO: 428506 - DNA, 25 bp, Mus musculus
gaaacggcttagagctactgcagaa

SEQ ID NO: 428507 - DNA, 25 bp, Mus musculus
gaaacggcttggacaggagttcacc

SEQ ID NO: 428508 - DNA, 25 bp, Mus musculus
gaaacggctttcctccagtgacaat

SEQ ID NO: 428509 - DNA, 25 bp, Mus musculus
gaaacgggacatctctgcatctgag

SEQ ID NO: 428510 - DNA, 25 bp, Mus musculus
gaaacgggagaaggaacactgcgac

SEQ ID NO: 428511 - DNA, 25 bp, Mus musculus
gaaacgggagatgatgctgagaaac

SEQ ID NO: 428512 - DNA, 25 bp, Mus musculus
gaaacgggatttgaacataagagct

SEQ ID NO: 428513 - DNA, 25 bp, Mus musculus
gaaacggtcatgagaatcgcaagca

SEQ ID NO: 428514 - DNA, 25 bp, Mus musculus
gaaacggtcctgtgagtcaacccaa

SEQ ID NO: 428515 - DNA, 25 bp, Mus musculus
gaaacggttcctgtcgacctactag

SEQ ID NO: 428516 - DNA, 25 bp, Mus musculus
gaaacgtattcgtctctctctgaag

SEQ ID NO: 428517 - DNA, 25 bp, Mus musculus
gaaacgtctgagtgctgaaaaccca

SEQ ID NO: 428518 - DNA, 25 bp, Mus musculus
gaaacgtctggaaaccgtctgggag

SEQ ID NO: 428519 - DNA, 25 bp, Mus musculus
gaaacgtgagcttggtgaggaatca

SEQ ID NO: 428520 - DNA, 25 bp, Mus musculus
gaaacgtgctctaccttgcaaacag

SEQ ID NO: 428521 - DNA, 25 bp, Mus musculus
gaaacgtggagcacggaagttgctc

SEQ ID NO: 428522 - DNA, 25 bp, Mus musculus
gaaacgtggctgtctatcgccgcta

SEQ ID NO: 428523 - DNA, 25 bp, Mus musculus
gaaacgtgtatgatccgcagaacct

SEQ ID NO: 428524 - DNA, 25 bp, Mus musculus
gaaacgttcgccttcctgatgtcct

SEQ ID NO: 428525 - DNA, 25 bp, Mus musculus
gaaacgttctcctgctttttaagtg

SEQ ID NO: 428526 - DNA, 25 bp, Mus musculus
gaaacgttgaacacagcggaccttg

SEQ ID NO: 428527 - DNA, 25 bp, Mus musculus
gaaacgtttcatctctgctcccggc

SEQ ID NO: 428528 - DNA, 25 bp, Mus musculus
gaaactaagaatggtcctgcagccc

SEQ ID NO: 428529 - DNA, 25 bp, Mus musculus
gaaactaagacttcgagtggaccgt

SEQ ID NO: 428530 - DNA, 25 bp, Mus musculus
gaaactacaccatgtggccccttgg

SEQ ID NO: 428531 - DNA, 25 bp, Mus musculus
gaaactacagtgttcgagtccgggc

SEQ ID NO: 428532 - DNA, 25 bp, Mus musculus
gaaactaccgtggagatcccaactg

SEQ ID NO: 428533 - DNA, 25 bp, Mus musculus
gaaactacgagaattccagtccaca

SEQ ID NO: 428534 - DNA, 25 bp, Mus musculus
gaaactacggcacaccaccaggttt

SEQ ID NO: 428535 - DNA, 25 bp, Mus musculus
gaaactactgctttgtacctccctg

SEQ ID NO: 428536 - DNA, 25 bp, Mus musculus
gaaactagctactttcagccagagg

SEQ ID NO: 428537 - DNA, 25 bp, Mus musculus
gaaactaggcgcagtcagatagcag

SEQ ID NO: 428538 - DNA, 25 bp, Mus musculus
gaaactatatgaatgcgggctccag

SEQ ID NO: 428539 - DNA, 25 bp, Mus musculus
gaaactatcaacagggcagctacgt

SEQ ID NO: 428540 - DNA, 25 bp, Mus musculus
gaaactatctcctaatagcatgtcc

SEQ ID NO: 428541 - DNA, 25 bp, Mus musculus
gaaactatgacaactacaggcgagc

SEQ ID NO: 428542 - DNA, 25 bp, Mus musculus
gaaactatgccctaactgaggaacc

SEQ ID NO: 428543 - DNA, 25 bp, Mus musculus
gaaactattggttatcccagaggga

SEQ ID NO: 428544 - DNA, 25 bp, Mus musculus
gaaactcaaagcacaattactgcct

SEQ ID NO: 428545 - DNA, 25 bp, Mus musculus
gaaactcaacccaaaaggaagtgct

SEQ ID NO: 428546 - DNA, 25 bp, Mus musculus
gaaactcaagcattagcactgcggg

SEQ ID NO: 428547 - DNA, 25 bp, Mus musculus
gaaactcaagtcagcatctcaaacg

SEQ ID NO: 428548 - DNA, 25 bp, Mus musculus
gaaactcaggcagaaccagctagat

SEQ ID NO: 428549 - DNA, 25 bp, Mus musculus
gaaactcattgccagggaagacctg

SEQ ID NO: 428550 - DNA, 25 bp, Mus musculus
gaaactcatttcagggcccgtaagg

SEQ ID NO: 428551 - DNA, 25 bp, Mus musculus
gaaactccaaacagggcttgcgatg

SEQ ID NO: 428552 - DNA, 25 bp, Mus musculus
gaaactccatttcccagaagcctga

SEQ ID NO: 428553 - DNA, 25 bp, Mus musculus
gaaactccgctgtagagctctgctg

SEQ ID NO: 428554 - DNA, 25 bp, Mus musculus
gaaactccgtgaaatggttcccgag

SEQ ID NO: 428555 - DNA, 25 bp, Mus musculus
gaaactcctagtgaacatgctgtgc

SEQ ID NO: 428556 - DNA, 25 bp, Mus musculus
gaaactccttctcttactattcaaa

SEQ ID NO: 428557 - DNA, 25 bp, Mus musculus
gaaactcgaagcaaacctactcagg

SEQ ID NO: 428558 - DNA, 25 bp, Mus musculus
gaaactcggaaatcccagcctgtga

SEQ ID NO: 428559 - DNA, 25 bp, Mus musculus
gaaactcggcagagttatcactcca

SEQ ID NO: 428560 - DNA, 25 bp, Mus musculus
gaaactcggtgaacatctggtgtca

SEQ ID NO: 428561 - DNA, 25 bp, Mus musculus
gaaactcgtgttccatgggccagca

SEQ ID NO: 428562 - DNA, 25 bp, Mus musculus
gaaactctcccacggaaactgctgg

SEQ ID NO: 428563 - DNA, 25 bp, Mus musculus
gaaactctcgaaagtggtgccgccg

SEQ ID NO: 428564 - DNA, 25 bp, Mus musculus
gaaactctgggccatcgatcgacaa

SEQ ID NO: 428565 - DNA, 25 bp, Mus musculus
gaaactctgtgaaactcgcagtttc

SEQ ID NO: 428566 - DNA, 25 bp, Mus musculus
gaaactcttcatttacctgcacaag

SEQ ID NO: 428567 - DNA, 25 bp, Mus musculus
gaaactcttgataacataccaggga

SEQ ID NO: 428568 - DNA, 25 bp, Mus musculus
gaaactgaaacaaaccatttcctct

SEQ ID NO: 428569 - DNA, 25 bp, Mus musculus
gaaactgaagcggagacctgagaaa

SEQ ID NO: 428570 - DNA, 25 bp, Mus musculus
gaaactgaagtgacaggacctcagg

SEQ ID NO: 428571 - DNA, 25 bp, Mus musculus
gaaactgacacctattctagggtgc

SEQ ID NO: 428572 - DNA, 25 bp, Mus musculus
gaaactgaccaaggaaccatctaac

SEQ ID NO: 428573 - DNA, 25 bp, Mus musculus
gaaactgactgatgtggaagcccaa

SEQ ID NO: 428574 - DNA, 25 bp, Mus musculus
gaaactgactgtctacctgtggaag

SEQ ID NO: 428575 - DNA, 25 bp, Mus musculus
gaaactgagcatggtattccaagct

SEQ ID NO: 428576 - DNA, 25 bp, Mus musculus
gaaactgagcgttctagcgcaggct

SEQ ID NO: 428577 - DNA, 25 bp, Mus musculus
gaaactgaggtcttggagccacgag

SEQ ID NO: 428578 - DNA, 25 bp, Mus musculus
gaaactgatgattcatatttggtgt

SEQ ID NO: 428579 - DNA, 25 bp, Mus musculus
gaaactgcactatgagctggaagct

SEQ ID NO: 428580 - DNA, 25 bp, Mus musculus
gaaactgcacttggcagacgcacag

SEQ ID NO: 428581 - DNA, 25 bp, Mus musculus
gaaactgccggtcgcagagctgtca

SEQ ID NO: 428582 - DNA, 25 bp, Mus musculus
gaaactgcctgctggtacatgggaa

SEQ ID NO: 428583 - DNA, 25 bp, Mus musculus
gaaactgccttgtaacaggtcccgc

SEQ ID NO: 428584 - DNA, 25 bp, Mus musculus
gaaactgcgcagattttctgagctg

SEQ ID NO: 428585 - DNA, 25 bp, Mus musculus
gaaactgctcttgaacttcagtgta

SEQ ID NO: 428586 - DNA, 25 bp, Mus musculus
gaaactgcttctgatatcgccagga

SEQ ID NO: 428587 - DNA, 25 bp, Mus musculus
gaaactgcttggaggcaatgcgcct

SEQ ID NO: 428588 - DNA, 25 bp, Mus musculus
gaaactggaagaccaactacagcgc

SEQ ID NO: 428589 - DNA, 25 bp, Mus musculus
gaaactggaccatcaaccggcttaa

SEQ ID NO: 428590 - DNA, 25 bp, Mus musculus
gaaactggcatctgctgacatcgag

SEQ ID NO: 428591 - DNA, 25 bp, Mus musculus
gaaactggccacttcaaagactgca

SEQ ID NO: 428592 - DNA, 25 bp, Mus musculus
gaaactggccccatgagaacaggtg

SEQ ID NO: 428593 - DNA, 25 bp, Mus musculus
gaaactgggaattagcttgtctgcc

SEQ ID NO: 428594 - DNA, 25 bp, Mus musculus
gaaactggtgactggagtttatctt

SEQ ID NO: 428595 - DNA, 25 bp, Mus musculus
gaaactggtttctctggcacacgtg

SEQ ID NO: 428596 - DNA, 25 bp, Mus musculus
gaaactgtagcctatcgtgccctga

SEQ ID NO: 428597 - DNA, 25 bp, Mus musculus
gaaactgtagcctcagtacctggga

SEQ ID NO: 428598 - DNA, 25 bp, Mus musculus
gaaactgtcagactaccacacgaga

SEQ ID NO: 428599 - DNA, 25 bp, Mus musculus
gaaactgtcagggagaagcctctac

SEQ ID NO: 428600 - DNA, 25 bp, Mus musculus
gaaactgtgaatggctcctggtaca

SEQ ID NO: 428601 - DNA, 25 bp, Mus musculus
gaaactgtgatcaaattcggcgaac

SEQ ID NO: 428602 - DNA, 25 bp, Mus musculus
gaaactgtgctgaggaagagcagtc

SEQ ID NO: 428603 - DNA, 25 bp, Mus musculus
gaaactgtggcggttggtacacgaa

SEQ ID NO: 428604 - DNA, 25 bp, Mus musculus
gaaactgtggcttcctctctgaggg

SEQ ID NO: 428605 - DNA, 25 bp, Mus musculus
gaaactgtgtctcctcgttcactgc

SEQ ID NO: 428606 - DNA, 25 bp, Mus musculus
gaaactgtttgctttgccggaggcc

SEQ ID NO: 428607 - DNA, 25 bp, Mus musculus
gaaacttaatgagtcaagcccgtgg

SEQ ID NO: 428608 - DNA, 25 bp, Mus musculus
gaaacttatatgtgcaccattccag

SEQ ID NO: 428609 - DNA, 25 bp, Mus musculus
gaaacttcaactacgtgtggctgcg

SEQ ID NO: 428610 - DNA, 25 bp, Mus musculus
gaaacttcagcggagggacaatact

SEQ ID NO: 428611 - DNA, 25 bp, Mus musculus
gaaacttcaggctgtactacgatgg

SEQ ID NO: 428612 - DNA, 25 bp, Mus musculus
gaaacttccaaagcattcatgaaag

SEQ ID NO: 428613 - DNA, 25 bp, Mus musculus
gaaacttcccagaaatgatgcccta

SEQ ID NO: 428614 - DNA, 25 bp, Mus musculus
gaaacttcccatagagaaccacaag

SEQ ID NO: 428615 - DNA, 25 bp, Mus musculus
gaaacttccttcacattcctttgag

SEQ ID NO: 428616 - DNA, 25 bp, Mus musculus
gaaacttcggaaacgcaagccagag

SEQ ID NO: 428617 - DNA, 25 bp, Mus musculus
gaaacttctatcgtggtgaatggcg

SEQ ID NO: 428618 - DNA, 25 bp, Mus musculus
gaaacttctcgaacaggaacgggct

SEQ ID NO: 428619 - DNA, 25 bp, Mus musculus
gaaacttctctttgccgtagatgga

SEQ ID NO: 428620 - DNA, 25 bp, Mus musculus
gaaacttctgcgctactacagcaag

SEQ ID NO: 428621 - DNA, 25 bp, Mus musculus
gaaacttgagccgtgatgaacagcg

SEQ ID NO: 428622 - DNA, 25 bp, Mus musculus
gaaacttgagtttgaacttgataaa

SEQ ID NO: 428623 - DNA, 25 bp, Mus musculus
gaaacttgcaggagaaaagcacaga

SEQ ID NO: 428624 - DNA, 25 bp, Mus musculus
gaaacttgcatatgtaccattagcg

SEQ ID NO: 428625 - DNA, 25 bp, Mus musculus
gaaacttgccagagaagcagtgcct

SEQ ID NO: 428626 - DNA, 25 bp, Mus musculus
gaaacttggacgtattgccttgggc

SEQ ID NO: 428627 - DNA, 25 bp, Mus musculus
gaaacttggcaacatgactgtgacc

SEQ ID NO: 428628 - DNA, 25 bp, Mus musculus
gaaacttgggcagttctccgaaccg

SEQ ID NO: 428629 - DNA, 25 bp, Mus musculus
gaaacttggtatggaagactcccgg

SEQ ID NO: 428630 - DNA, 25 bp, Mus musculus
gaaacttgtgtggagaatattgtta

SEQ ID NO: 428631 - DNA, 25 bp, Mus musculus
gaaacttgtgttggaaccagcccct

SEQ ID NO: 428632 - DNA, 25 bp, Mus musculus
gaaacttgtttcagggccaaatcct

SEQ ID NO: 428633 - DNA, 25 bp, Mus musculus
gaaactttcctgttactgccccaag

SEQ ID NO: 428634 - DNA, 25 bp, Mus musculus
gaaactttgacggtcatcatctcag

SEQ ID NO: 428635 - DNA, 25 bp, Mus musculus
gaaactttgcccattgcagcgggca

SEQ ID NO: 428636 - DNA, 25 bp, Mus musculus
gaaactttgttcaccgattgcacca

SEQ ID NO: 428637 - DNA, 25 bp, Mus musculus
gaaactttgttcctttcctagctag

SEQ ID NO: 428638 - DNA, 25 bp, Mus musculus
gaaacttttggaacagcgtgcccag

SEQ ID NO: 428639 - DNA, 25 bp, Mus musculus
gaaacttttggacatcgtagcccgt

SEQ ID NO: 428640 - DNA, 25 bp, Mus musculus
gaaagaaaaatcatggcgcctgccc

SEQ ID NO: 428641 - DNA, 25 bp, Mus musculus
gaaagaaaatgtctggatatgtcca

SEQ ID NO: 428642 - DNA, 25 bp, Mus musculus
gaaagaaaccaaccacactggtgtg

SEQ ID NO: 428643 - DNA, 25 bp, Mus musculus
gaaagaaagccgactctctctgctc

SEQ ID NO: 428644 - DNA, 25 bp, Mus musculus
gaaagaaagcctgaactgcccagtg

SEQ ID NO: 428645 - DNA, 25 bp, Mus musculus
gaaagaaagctactatcccagggtt

SEQ ID NO: 428646 - DNA, 25 bp, Mus musculus
gaaagaaagctgtatcccatgagtg

SEQ ID NO: 428647 - DNA, 25 bp, Mus musculus
gaaagaaatgcgaggctaatcccgc

SEQ ID NO: 428648 - DNA, 25 bp, Mus musculus
gaaagaacaaagatgggcaaggcct

SEQ ID NO: 428649 - DNA, 25 bp, Mus musculus
gaaagaacagaccacggaagatgca

SEQ ID NO: 428650 - DNA, 25 bp, Mus musculus
gaaagaacatagctgacctcagagc

SEQ ID NO: 428651 - DNA, 25 bp, Mus musculus
gaaagaacattctagtaggaggctg

SEQ ID NO: 428652 - DNA, 25 bp, Mus musculus
gaaagaaccagcaggctcctggaaa

SEQ ID NO: 428653 - DNA, 25 bp, Mus musculus
gaaagaacccctctgaagcccaggg

SEQ ID NO: 428654 - DNA, 25 bp, Mus musculus
gaaagaacctggagcctgaaaacct

SEQ ID NO: 428655 - DNA, 25 bp, Mus musculus
gaaagaacctgtgctaaacgacgac

SEQ ID NO: 428656 - DNA, 25 bp, Mus musculus
gaaagaacggtgaccatcagaagac

SEQ ID NO: 428657 - DNA, 25 bp, Mus musculus
gaaagaactccttggaaatgaaggt

SEQ ID NO: 428658 - DNA, 25 bp, Mus musculus
gaaagaactgtacgctgctgtcacg

SEQ ID NO: 428659 - DNA, 25 bp, Mus musculus
gaaagaactgtttgcccctcagcct

SEQ ID NO: 428660 - DNA, 25 bp, Mus musculus
gaaagaagaaacaagcatcgaggcc

SEQ ID NO: 428661 - DNA, 25 bp, Mus musculus
gaaagaagaatgctcacgtgcccct

SEQ ID NO: 428662 - DNA, 25 bp, Mus musculus
gaaagaagatcttatggaaaacctc

SEQ ID NO: 428663 - DNA, 25 bp, Mus musculus
gaaagaagattcaccctagagacag

SEQ ID NO: 428664 - DNA, 25 bp, Mus musculus
gaaagaagcgcgatgcagaactacg

SEQ ID NO: 428665 - DNA, 25 bp, Mus musculus
gaaagaagctgaaggttgtgtgacc

SEQ ID NO: 428666 - DNA, 25 bp, Mus musculus
gaaagaagtagctcctcagactctg

SEQ ID NO: 428667 - DNA, 25 bp, Mus musculus
gaaagaagtcatcctgaagataaac

SEQ ID NO: 428668 - DNA, 25 bp, Mus musculus
gaaagaatccctagaagtgacctgt

SEQ ID NO: 428669 - DNA, 25 bp, Mus musculus
gaaagaatctgtgtgcagttctagc

SEQ ID NO: 428670 - DNA, 25 bp, Mus musculus
gaaagaatgaaaccttcaccaggct

SEQ ID NO: 428671 - DNA, 25 bp, Mus musculus
gaaagaatgacaaatccgtggagct

SEQ ID NO: 428672 - DNA, 25 bp, Mus musculus
gaaagaatgcaaagtccccagactg

SEQ ID NO: 428673 - DNA, 25 bp, Mus musculus
gaaagaatgccagggtgttggatcc

SEQ ID NO: 428674 - DNA, 25 bp, Mus musculus
gaaagaattcaactcactgccctgc

SEQ ID NO: 428675 - DNA, 25 bp, Mus musculus
gaaagaattgagcaaggacctccct

SEQ ID NO: 428676 - DNA, 25 bp, Mus musculus
gaaagaattgcttctcatgatgaca

SEQ ID NO: 428677 - DNA, 25 bp, Mus musculus
gaaagaatttcaggcccatgcccca

SEQ ID NO: 428678 - DNA, 25 bp, Mus musculus
gaaagacaaagtgtatcacctggag

SEQ ID NO: 428679 - DNA, 25 bp, Mus musculus
gaaagacaactatgacctcctggaa

SEQ ID NO: 428680 - DNA, 25 bp, Mus musculus
gaaagacaaggcagattccactagg

SEQ ID NO: 428681 - DNA, 25 bp, Mus musculus
gaaagacaatgacaaacccagtgtc

SEQ ID NO: 428682 - DNA, 25 bp, Mus musculus
gaaagacacccgtagtgcctctcct

SEQ ID NO: 428683 - DNA, 25 bp, Mus musculus
gaaagacactatggcctgacgtcag

SEQ ID NO: 428684 - DNA, 25 bp, Mus musculus
gaaagacagaaccaatccctacggg

SEQ ID NO: 428685 - DNA, 25 bp, Mus musculus
gaaagacagactccatcgagaagcg

SEQ ID NO: 428686 - DNA, 25 bp, Mus musculus
gaaagacagtcttgagtgccgagaa

SEQ ID NO: 428687 - DNA, 25 bp, Mus musculus
gaaagacatagcagagtttttgttt

SEQ ID NO: 428688 - DNA, 25 bp, Mus musculus
gaaagacatcttgtctaccgcgcag

SEQ ID NO: 428689 - DNA, 25 bp, Mus musculus
gaaagacattggtccctcggagaat

SEQ ID NO: 428690 - DNA, 25 bp, Mus musculus
gaaagaccaaatcctgcccgtttga

SEQ ID NO: 428691 - DNA, 25 bp, Mus musculus
gaaagaccaagcctagagacatggg

SEQ ID NO: 428692 - DNA, 25 bp, Mus musculus
gaaagaccacagtaaaagacttaag

SEQ ID NO: 428693 - DNA, 25 bp, Mus musculus
gaaagaccatctcacggatttcaag

SEQ ID NO: 428694 - DNA, 25 bp, Mus musculus
gaaagacccctgatctcgtcaagtg

SEQ ID NO: 428695 - DNA, 25 bp, Mus musculus
gaaagaccgccagctagtggacaga

SEQ ID NO: 428696 - DNA, 25 bp, Mus musculus
gaaagaccggcaagggcatgtctag

SEQ ID NO: 428697 - DNA, 25 bp, Mus musculus
gaaagacctctctccaatcgctgag

SEQ ID NO: 428698 - DNA, 25 bp, Mus musculus
gaaagacgagtttgttctacctagc

SEQ ID NO: 428699 - DNA, 25 bp, Mus musculus
gaaagacgctactggatcggaacac

SEQ ID NO: 428700 - DNA, 25 bp, Mus musculus
gaaagacggcgacttcttgaacaga

SEQ ID NO: 428701 - DNA, 25 bp, Mus musculus
gaaagactaccacagtggtcctggg

SEQ ID NO: 428702 - DNA, 25 bp, Mus musculus
gaaagactcaatgcatgccacgtga

SEQ ID NO: 428703 - DNA, 25 bp, Mus musculus
gaaagactcagcctaaacacagtgg

SEQ ID NO: 428704 - DNA, 25 bp, Mus musculus
gaaagactccggctactgtatggct

SEQ ID NO: 428705 - DNA, 25 bp, Mus musculus
gaaagactgactccaatgacctggg

SEQ ID NO: 428706 - DNA, 25 bp, Mus musculus
gaaagactgactgttgatgaagatc

SEQ ID NO: 428707 - DNA, 25 bp, Mus musculus
gaaagactgcacctcaaagactggg

SEQ ID NO: 428708 - DNA, 25 bp, Mus musculus
gaaagactgcatgtgtctgcgacac

SEQ ID NO: 428709 - DNA, 25 bp, Mus musculus
gaaagactgggctaatcctccgtgc

SEQ ID NO: 428710 - DNA, 25 bp, Mus musculus
gaaagacttctttctgcaggctgct

SEQ ID NO: 428711 - DNA, 25 bp, Mus musculus
gaaagagaacctatagaatacatat

SEQ ID NO: 428712 - DNA, 25 bp, Mus musculus
gaaagagaccttgacacagctgtcc

SEQ ID NO: 428713 - DNA, 25 bp, Mus musculus
gaaagagactcactcctagaaggta

SEQ ID NO: 428714 - DNA, 25 bp, Mus musculus
gaaagagactgtgttgtcctagcac

SEQ ID NO: 428715 - DNA, 25 bp, Mus musculus
gaaagagagtggctatagcagcacc

SEQ ID NO: 428716 - DNA, 25 bp, Mus musculus
gaaagagatacccaagcttcgagtt

SEQ ID NO: 428717 - DNA, 25 bp, Mus musculus
gaaagagatcggattggtcagcgcc

SEQ ID NO: 428718 - DNA, 25 bp, Mus musculus
gaaagagatgaatgacgcggccatg

SEQ ID NO: 428719 - DNA, 25 bp, Mus musculus
gaaagagattggaagccctagggcc

SEQ ID NO: 428720 - DNA, 25 bp, Mus musculus
gaaagagcaaagcacaccagagcaa

SEQ ID NO: 428721 - DNA, 25 bp, Mus musculus
gaaagagcaaggatagtccacctgc

SEQ ID NO: 428722 - DNA, 25 bp, Mus musculus
gaaagagcatcaaaagtccttaatg

SEQ ID NO: 428723 - DNA, 25 bp, Mus musculus
gaaagagccacatgcttgcaggaag

SEQ ID NO: 428724 - DNA, 25 bp, Mus musculus
gaaagagcctaagctcaaaggagtg

SEQ ID NO: 428725 - DNA, 25 bp, Mus musculus
gaaagagcggaagagccaacatttg

SEQ ID NO: 428726 - DNA, 25 bp, Mus musculus
gaaagagctgtcatccagaagcctg

SEQ ID NO: 428727 - DNA, 25 bp, Mus musculus
gaaagagcttcgagacgttgacggc

SEQ ID NO: 428728 - DNA, 25 bp, Mus musculus
gaaagagcttgcgacttcgtcacag

SEQ ID NO: 428729 - DNA, 25 bp, Mus musculus
gaaagaggaacagtgtggtaaataa

SEQ ID NO: 428730 - DNA, 25 bp, Mus musculus
gaaagaggacaagaaatggatggat

SEQ ID NO: 428731 - DNA, 25 bp, Mus musculus
gaaagaggacttctgaaattcactc

SEQ ID NO: 428732 - DNA, 25 bp, Mus musculus
gaaagaggccgagaacgccatcgtt

SEQ ID NO: 428733 - DNA, 25 bp, Mus musculus
gaaagaggtctccaaattgctctga

SEQ ID NO: 428734 - DNA, 25 bp, Mus musculus
gaaagagtagctgaattacagcgct

SEQ ID NO: 428735 - DNA, 25 bp, Mus musculus
gaaagagtcacactagtcagtccgt

SEQ ID NO: 428736 - DNA, 25 bp, Mus musculus
gaaagagtcccacttgtgccaaaag

SEQ ID NO: 428737 - DNA, 25 bp, Mus musculus
gaaagagttccctggacgtgcggat

SEQ ID NO: 428738 - DNA, 25 bp, Mus musculus
gaaagagttcgacatcagtcagcag

SEQ ID NO: 428739 - DNA, 25 bp, Mus musculus
gaaagagttctcacttcctggagca

SEQ ID NO: 428740 - DNA, 25 bp, Mus musculus
gaaagagtttgtagccatgctcaca

SEQ ID NO: 428741 - DNA, 25 bp, Mus musculus
gaaagataacaaggcgccctgagga

SEQ ID NO: 428742 - DNA, 25 bp, Mus musculus
gaaagatacaactcaaagctacctg

SEQ ID NO: 428743 - DNA, 25 bp, Mus musculus
gaaagatatgcctaaagtccacgtg

SEQ ID NO: 428744 - DNA, 25 bp, Mus musculus
gaaagatatgttcacgaaacggccc

SEQ ID NO: 428745 - DNA, 25 bp, Mus musculus
gaaagatcacaacttggagaagctc

SEQ ID NO: 428746 - DNA, 25 bp, Mus musculus
gaaagatcagaaaccaactcacgta

SEQ ID NO: 428747 - DNA, 25 bp, Mus musculus
gaaagatcagttgctcgtcaaagcc

SEQ ID NO: 428748 - DNA, 25 bp, Mus musculus
gaaagatcccagctgcaagacctgc

SEQ ID NO: 428749 - DNA, 25 bp, Mus musculus
gaaagatccgtatttatccaagtga

SEQ ID NO: 428750 - DNA, 25 bp, Mus musculus
gaaagatcgtgcctcattgtcaagc

SEQ ID NO: 428751 - DNA, 25 bp, Mus musculus
gaaagatctacttcctacggcacag

SEQ ID NO: 428752 - DNA, 25 bp, Mus musculus
gaaagatctagtagtgtcggaccgt

SEQ ID NO: 428753 - DNA, 25 bp, Mus musculus
gaaagatctcattgcccgcagcgtc

SEQ ID NO: 428754 - DNA, 25 bp, Mus musculus
gaaagatctgcacctttggaccagc

SEQ ID NO: 428755 - DNA, 25 bp, Mus musculus
gaaagatgaactatggcgctcccag

SEQ ID NO: 428756 - DNA, 25 bp, Mus musculus
gaaagatgagatcggttcccagcca

SEQ ID NO: 428757 - DNA, 25 bp, Mus musculus
gaaagatgccctggtgtacagcacc

SEQ ID NO: 428758 - DNA, 25 bp, Mus musculus
gaaagatgcttcaggtagcccggca

SEQ ID NO: 428759 - DNA, 25 bp, Mus musculus
gaaagatggaaacatatactgtagc

SEQ ID NO: 428760 - DNA, 25 bp, Mus musculus
gaaagatggagttgggatgaaacaa

SEQ ID NO: 428761 - DNA, 25 bp, Mus musculus
gaaagatggcttctggcagcctttg

SEQ ID NO: 428762 - DNA, 25 bp, Mus musculus
gaaagatgtgctctggttccggccc

SEQ ID NO: 428763 - DNA, 25 bp, Mus musculus
gaaagatgtgtctcagggagtctcc

SEQ ID NO: 428764 - DNA, 25 bp, Mus musculus
gaaagatgttagcacctcagacctg

SEQ ID NO: 428765 - DNA, 25 bp, Mus musculus
gaaagattatcttcatcgatacaga

SEQ ID NO: 428766 - DNA, 25 bp, Mus musculus
gaaagattatgcctagccggtgtga

SEQ ID NO: 428767 - DNA, 25 bp, Mus musculus
gaaagattctgatgatgtccccatg

SEQ ID NO: 428768 - DNA, 25 bp, Mus musculus
gaaagatttgcccctgaggacttct

SEQ ID NO: 428769 - DNA, 25 bp, Mus musculus
gaaagatttgggtcggtgtaccaca

SEQ ID NO: 428770 - DNA, 25 bp, Mus musculus
gaaagatttggttccctgcaggcac

SEQ ID NO: 428771 - DNA, 25 bp, Mus musculus
gaaagatttgtgtggcgtcccctga

SEQ ID NO: 428772 - DNA, 25 bp, Mus musculus
gaaagcaaaaccattgcaggcgggc

SEQ ID NO: 428773 - DNA, 25 bp, Mus musculus
gaaagcaaacatccgagagaaggaa

SEQ ID NO: 428774 - DNA, 25 bp, Mus musculus
gaaagcaaccccatgatcaggagga

SEQ ID NO: 428775 - DNA, 25 bp, Mus musculus
gaaagcaactcagagggaacctcct

SEQ ID NO: 428776 - DNA, 25 bp, Mus musculus
gaaagcaagcatggctgaggcatcc

SEQ ID NO: 428777 - DNA, 25 bp, Mus musculus
gaaagcaagcgaagatgcacatctc

SEQ ID NO: 428778 - DNA, 25 bp, Mus musculus
gaaagcaagtatagagcctccagag

SEQ ID NO: 428779 - DNA, 25 bp, Mus musculus
gaaagcaagtgcagtccggcgtctt

SEQ ID NO: 428780 - DNA, 25 bp, Mus musculus
gaaagcacaaagacaccggctgcta

SEQ ID NO: 428781 - DNA, 25 bp, Mus musculus
gaaagcacaaggttcaaaaaggcaa

SEQ ID NO: 428782 - DNA, 25 bp, Mus musculus
gaaagcaccatggagaagaacttcc

SEQ ID NO: 428783 - DNA, 25 bp, Mus musculus
gaaagcaccgtctcctccgaaattg

SEQ ID NO: 428784 - DNA, 25 bp, Mus musculus
gaaagcacgcccagtcacattaaag

SEQ ID NO: 428785 - DNA, 25 bp, Mus musculus
gaaagcacgtatgtcctggtcacca

SEQ ID NO: 428786 - DNA, 25 bp, Mus musculus
gaaagcactgtcctgtgacctggca

SEQ ID NO: 428787 - DNA, 25 bp, Mus musculus
gaaagcagactcatggccaagacac

SEQ ID NO: 428788 - DNA, 25 bp, Mus musculus
gaaagcagagcctttgatctcaact

SEQ ID NO: 428789 - DNA, 25 bp, Mus musculus
gaaagcagattcaagttcaaactcg

SEQ ID NO: 428790 - DNA, 25 bp, Mus musculus
gaaagcagcaactacaccaagactg

SEQ ID NO: 428791 - DNA, 25 bp, Mus musculus
gaaagcagccattccagaccttgat

SEQ ID NO: 428792 - DNA, 25 bp, Mus musculus
gaaagcagctaacaaggttcagagc

SEQ ID NO: 428793 - DNA, 25 bp, Mus musculus
gaaagcaggtcgttccattctccag

SEQ ID NO: 428794 - DNA, 25 bp, Mus musculus
gaaagcaggtttacaagttgaagtc

SEQ ID NO: 428795 - DNA, 25 bp, Mus musculus
gaaagcagtgtccaaccaaaaatgt

SEQ ID NO: 428796 - DNA, 25 bp, Mus musculus
gaaagcagttaacctgtgtccatat

SEQ ID NO: 428797 - DNA, 25 bp, Mus musculus
gaaagcataaactacaatgctcagc

SEQ ID NO: 428798 - DNA, 25 bp, Mus musculus
gaaagcatacttcctgcccaaacag

SEQ ID NO: 428799 - DNA, 25 bp, Mus musculus
gaaagcatatcttcctgagagcctg

SEQ ID NO: 428800 - DNA, 25 bp, Mus musculus
gaaagcatccagaccaatctcaggc

SEQ ID NO: 428801 - DNA, 25 bp, Mus musculus
gaaagcatccatctaccagaaccag

SEQ ID NO: 428802 - DNA, 25 bp, Mus musculus
gaaagcatccctgacattgaagccc

SEQ ID NO: 428803 - DNA, 25 bp, Mus musculus
gaaagcatgagcgtgtgtaggcctt

SEQ ID NO: 428804 - DNA, 25 bp, Mus musculus
gaaagcattgtgtatttcagccttc

SEQ ID NO: 428805 - DNA, 25 bp, Mus musculus
gaaagcattttgagccgtggctgca

SEQ ID NO: 428806 - DNA, 25 bp, Mus musculus
gaaagccaaaatccgagtcgtcgag

SEQ ID NO: 428807 - DNA, 25 bp, Mus musculus
gaaagccaaagcacatcggtagaag

SEQ ID NO: 428808 - DNA, 25 bp, Mus musculus
gaaagccaacctacacaaaatcact

SEQ ID NO: 428809 - DNA, 25 bp, Mus musculus
gaaagccaagaactcacggtgcaga

SEQ ID NO: 428810 - DNA, 25 bp, Mus musculus
gaaagccaagctaaccctaggtgtg

SEQ ID NO: 428811 - DNA, 25 bp, Mus musculus
gaaagccaagtacgatagcctgcag

SEQ ID NO: 428812 - DNA, 25 bp, Mus musculus
gaaagccacagcagccctggttgta

SEQ ID NO: 428813 - DNA, 25 bp, Mus musculus
gaaagccacattgccgatcacagag

SEQ ID NO: 428814 - DNA, 25 bp, Mus musculus
gaaagccacattttgatcagcagat

SEQ ID NO: 428815 - DNA, 25 bp, Mus musculus
gaaagccactctgtaggaccaagca

SEQ ID NO: 428816 - DNA, 25 bp, Mus musculus
gaaagccagagtttcacagcccaga

SEQ ID NO: 428817 - DNA, 25 bp, Mus musculus
gaaagccagcccttcaagcttgcag

SEQ ID NO: 428818 - DNA, 25 bp, Mus musculus
gaaagccagctgttccttgtgaaaa

SEQ ID NO: 428819 - DNA, 25 bp, Mus musculus
gaaagccagtgctgtgggaaccact

SEQ ID NO: 428820 - DNA, 25 bp, Mus musculus
gaaagccatccacctacagttcgag

SEQ ID NO: 428821 - DNA, 25 bp, Mus musculus
gaaagccatggcagaccaagctgag

SEQ ID NO: 428822 - DNA, 25 bp, Mus musculus
gaaagccatggcgaagttaaacaca

SEQ ID NO: 428823 - DNA, 25 bp, Mus musculus
gaaagccatggtatctgcatagcct

SEQ ID NO: 428824 - DNA, 25 bp, Mus musculus
gaaagccattcgagtagagatccta

SEQ ID NO: 428825 - DNA, 25 bp, Mus musculus
gaaagcccagcggttactgaagcag

SEQ ID NO: 428826 - DNA, 25 bp, Mus musculus
gaaagcccagtgttaaagtccaagt

SEQ ID NO: 428827 - DNA, 25 bp, Mus musculus
gaaagccccgtgagattcttctgat

SEQ ID NO: 428828 - DNA, 25 bp, Mus musculus
gaaagcccctgtatagaatatgtga

SEQ ID NO: 428829 - DNA, 25 bp, Mus musculus
gaaagcccgactctacaagggactg

SEQ ID NO: 428830 - DNA, 25 bp, Mus musculus
gaaagcccgagactttacggatcgt

SEQ ID NO: 428831 - DNA, 25 bp, Mus musculus
gaaagcccgagtaaagacagtcttg

SEQ ID NO: 428832 - DNA, 25 bp, Mus musculus
gaaagccctaaggttagcaccggag

SEQ ID NO: 428833 - DNA, 25 bp, Mus musculus
gaaagccctatatcagagccaggcc

SEQ ID NO: 428834 - DNA, 25 bp, Mus musculus
gaaagccctcattcgagccaatgga

SEQ ID NO: 428835 - DNA, 25 bp, Mus musculus
gaaagccctgcgagaatttgaagaa

SEQ ID NO: 428836 - DNA, 25 bp, Mus musculus
gaaagccctttgacctgaggagttg

SEQ ID NO: 428837 - DNA, 25 bp, Mus musculus
gaaagcccttttgtgaccaggagca

SEQ ID NO: 428838 - DNA, 25 bp, Mus musculus
gaaagccggcagatcacacaagtgt

SEQ ID NO: 428839 - DNA, 25 bp, Mus musculus
gaaagccggccatttgctcaacagc

SEQ ID NO: 428840 - DNA, 25 bp, Mus musculus
gaaagccgtcctgaagaaaggcctg

SEQ ID NO: 428841 - DNA, 25 bp, Mus musculus
gaaagccgtccttcctctgaagaac

SEQ ID NO: 428842 - DNA, 25 bp, Mus musculus
gaaagccgtcttgtactccaggttg

SEQ ID NO: 428843 - DNA, 25 bp, Mus musculus
gaaagcctaagtcggagacagccgc

SEQ ID NO: 428844 - DNA, 25 bp, Mus musculus
gaaagcctagtgtttgagagccacg

SEQ ID NO: 428845 - DNA, 25 bp, Mus musculus
gaaagcctagttgtcttatagaaga

SEQ ID NO: 428846 - DNA, 25 bp, Mus musculus
gaaagcctcaggtacagtgccaaac

SEQ ID NO: 428847 - DNA, 25 bp, Mus musculus
gaaagcctcgctggaagatgcctga

SEQ ID NO: 428848 - DNA, 25 bp, Mus musculus
gaaagcctcggatgagctcaggagc

SEQ ID NO: 428849 - DNA, 25 bp, Mus musculus
gaaagcctctgcgaacaacagtctc

SEQ ID NO: 428850 - DNA, 25 bp, Mus musculus
gaaagcctctgcgtcttcttactca

SEQ ID NO: 428851 - DNA, 25 bp, Mus musculus
gaaagcctgaactggtttggagtca

SEQ ID NO: 428852 - DNA, 25 bp, Mus musculus
gaaagcctgcaacggtgtcaatgac

SEQ ID NO: 428853 - DNA, 25 bp, Mus musculus
gaaagcctggaatatgagcgcatct

SEQ ID NO: 428854 - DNA, 25 bp, Mus musculus
gaaagcctgtctgtatgctgaccta

SEQ ID NO: 428855 - DNA, 25 bp, Mus musculus
gaaagcctgttaattgccttgcccc

SEQ ID NO: 428856 - DNA, 25 bp, Mus musculus
gaaagccttcgctgacatgatgcag

SEQ ID NO: 428857 - DNA, 25 bp, Mus musculus
gaaagccttctgtctggacctagcc

SEQ ID NO: 428858 - DNA, 25 bp, Mus musculus
gaaagccttggctgaaccagatgga

SEQ ID NO: 428859 - DNA, 25 bp, Mus musculus
gaaagccttgtaccttcttgggaga

SEQ ID NO: 428860 - DNA, 25 bp, Mus musculus
gaaagcgattgcatgggccagtcct

SEQ ID NO: 428861 - DNA, 25 bp, Mus musculus
gaaagcgcctcttgttccagggcca

SEQ ID NO: 428862 - DNA, 25 bp, Mus musculus
gaaagcgcttgcagactacatcagg

SEQ ID NO: 428863 - DNA, 25 bp, Mus musculus
gaaagcgcttgggaaggtgtctcct

SEQ ID NO: 428864 - DNA, 25 bp, Mus musculus
gaaagcggactcaacgtgactctca

SEQ ID NO: 428865 - DNA, 25 bp, Mus musculus
gaaagcggcacaaggttattggcac

SEQ ID NO: 428866 - DNA, 25 bp, Mus musculus
gaaagcggtgccagtcacaggaatg

SEQ ID NO: 428867 - DNA, 25 bp, Mus musculus
gaaagcgtcatcatccaagatctga

SEQ ID NO: 428868 - DNA, 25 bp, Mus musculus
gaaagcgtgccctggggacctcgct

SEQ ID NO: 428869 - DNA, 25 bp, Mus musculus
gaaagcgttcaagctacccaggctg

SEQ ID NO: 428870 - DNA, 25 bp, Mus musculus
gaaagcgttccagcacagtgtcgtg

SEQ ID NO: 428871 - DNA, 25 bp, Mus musculus
gaaagctaacacagcagtgacggct

SEQ ID NO: 428872 - DNA, 25 bp, Mus musculus
gaaagctaacagagccacagtccac

SEQ ID NO: 428873 - DNA, 25 bp, Mus musculus
gaaagctaagcagcatgctacccca

SEQ ID NO: 428874 - DNA, 25 bp, Mus musculus
gaaagctaagcggaatgcactcgca

SEQ ID NO: 428875 - DNA, 25 bp, Mus musculus
gaaagctacattttgcacacctacc

SEQ ID NO: 428876 - DNA, 25 bp, Mus musculus
gaaagctacggcaatcctctaagag

SEQ ID NO: 428877 - DNA, 25 bp, Mus musculus
gaaagctactatgccaccgtgaatg

SEQ ID NO: 428878 - DNA, 25 bp, Mus musculus
gaaagctatgcaaaccactctgatg

SEQ ID NO: 428879 - DNA, 25 bp, Mus musculus
gaaagctcattcacgagactgcagg

SEQ ID NO: 428880 - DNA, 25 bp, Mus musculus
gaaagctcccctttttagcctgaga

SEQ ID NO: 428881 - DNA, 25 bp, Mus musculus
gaaagctccgaaagaaaagcacttg

SEQ ID NO: 428882 - DNA, 25 bp, Mus musculus
gaaagctcctggcttcgaaagggaa

SEQ ID NO: 428883 - DNA, 25 bp, Mus musculus
gaaagctctgatcccaacagttgca

SEQ ID NO: 428884 - DNA, 25 bp, Mus musculus
gaaagctctgcaagacgtggacaca

SEQ ID NO: 428885 - DNA, 25 bp, Mus musculus
gaaagctctgcagattacacctggt

SEQ ID NO: 428886 - DNA, 25 bp, Mus musculus
gaaagctctttgagactaggcccct

SEQ ID NO: 428887 - DNA, 25 bp, Mus musculus
gaaagctctttggatccgctggccg

SEQ ID NO: 428888 - DNA, 25 bp, Mus musculus
gaaagctgaccgatactgcaagtga

SEQ ID NO: 428889 - DNA, 25 bp, Mus musculus
gaaagctgatggtcgcccttgcaaa

SEQ ID NO: 428890 - DNA, 25 bp, Mus musculus
gaaagctgcaaaacaccgtggagtg

SEQ ID NO: 428891 - DNA, 25 bp, Mus musculus
gaaagctgcatggaagttgccaccg

SEQ ID NO: 428892 - DNA, 25 bp, Mus musculus
gaaagctgccatggatccagtcctg

SEQ ID NO: 428893 - DNA, 25 bp, Mus musculus
gaaagctgcccttctggaaagacag

SEQ ID NO: 428894 - DNA, 25 bp, Mus musculus
gaaagctgccgacacactcagcagt

SEQ ID NO: 428895 - DNA, 25 bp, Mus musculus
gaaagctgccggacaacaaatcaca

SEQ ID NO: 428896 - DNA, 25 bp, Mus musculus
gaaagctgcctctaactgatcccgg

SEQ ID NO: 428897 - DNA, 25 bp, Mus musculus
gaaagctgcgagaatgactccgggt

SEQ ID NO: 428898 - DNA, 25 bp, Mus musculus
gaaagctgcgctggagaacaaactg

SEQ ID NO: 428899 - DNA, 25 bp, Mus musculus
gaaagctgctctagtcctggctgaa

SEQ ID NO: 428900 - DNA, 25 bp, Mus musculus
gaaagctggaaaccctctggtagcc

SEQ ID NO: 428901 - DNA, 25 bp, Mus musculus
gaaagctggatcaggaactggccaa

SEQ ID NO: 428902 - DNA, 25 bp, Mus musculus
gaaagctggcagtccctcagagatg

SEQ ID NO: 428903 - DNA, 25 bp, Mus musculus
gaaagctggctttgcgttggcaccc

SEQ ID NO: 428904 - DNA, 25 bp, Mus musculus
gaaagctggttatatcactcccgtc

SEQ ID NO: 428905 - DNA, 25 bp, Mus musculus
gaaagctgtccaagcctgtcactag

SEQ ID NO: 428906 - DNA, 25 bp, Mus musculus
gaaagctgtgctcttgtacattatg

SEQ ID NO: 428907 - DNA, 25 bp, Mus musculus
gaaagctgtttccttatacctgacc

SEQ ID NO: 428908 - DNA, 25 bp, Mus musculus
gaaagcttacttcagcctgcatttt

SEQ ID NO: 428909 - DNA, 25 bp, Mus musculus
gaaagcttatgcctattgcacctga

SEQ ID NO: 428910 - DNA, 25 bp, Mus musculus
gaaagcttcactaactgcaccgaga

SEQ ID NO: 428911 - DNA, 25 bp, Mus musculus
gaaagcttccacacatcatcggagg

SEQ ID NO: 428912 - DNA, 25 bp, Mus musculus
gaaagcttcggataactcaggacgc

SEQ ID NO: 428913 - DNA, 25 bp, Mus musculus
gaaagcttctgaccaactaagggcg

SEQ ID NO: 428914 - DNA, 25 bp, Mus musculus
gaaagcttgatgtccatagggaaac

SEQ ID NO: 428915 - DNA, 25 bp, Mus musculus
gaaagcttgcaagccagcatctttt

SEQ ID NO: 428916 - DNA, 25 bp, Mus musculus
gaaagctttctgttacaagtcagcg

SEQ ID NO: 428917 - DNA, 25 bp, Mus musculus
gaaagctttgagaccacaccctatg

SEQ ID NO: 428918 - DNA, 25 bp, Mus musculus
gaaagctttgagatctcccatattc

SEQ ID NO: 428919 - DNA, 25 bp, Mus musculus
gaaaggaacctatctgccctggaga

SEQ ID NO: 428920 - DNA, 25 bp, Mus musculus
gaaaggaagactgggctccgaatcc

SEQ ID NO: 428921 - DNA, 25 bp, Mus musculus
gaaaggaagcgccttagcatccagg

SEQ ID NO: 428922 - DNA, 25 bp, Mus musculus
gaaaggaaggtttaggcaccagctc

SEQ ID NO: 428923 - DNA, 25 bp, Mus musculus
gaaaggacaaaggtgcagggcatct

SEQ ID NO: 428924 - DNA, 25 bp, Mus musculus
gaaaggacaagaacacgcgtgagct

SEQ ID NO: 428925 - DNA, 25 bp, Mus musculus
gaaaggacaatgcttggatcattac

SEQ ID NO: 428926 - DNA, 25 bp, Mus musculus
gaaaggacacagcatggcactcagt

SEQ ID NO: 428927 - DNA, 25 bp, Mus musculus
gaaaggacacattctctgcaggacc

SEQ ID NO: 428928 - DNA, 25 bp, Mus musculus
gaaaggacagatgcctctacaggca

SEQ ID NO: 428929 - DNA, 25 bp, Mus musculus
gaaaggacatgatcatccgggaagc

SEQ ID NO: 428930 - DNA, 25 bp, Mus musculus
gaaaggacattgaaaatccacaggc

SEQ ID NO: 428931 - DNA, 25 bp, Mus musculus
gaaaggacccttcagtggacatcac

SEQ ID NO: 428932 - DNA, 25 bp, Mus musculus
gaaaggacccttctgtgagccagcg

SEQ ID NO: 428933 - DNA, 25 bp, Mus musculus
gaaaggacctcctgtcaggttgtga

SEQ ID NO: 428934 - DNA, 25 bp, Mus musculus
gaaaggacctctcgaaagcatggaa

SEQ ID NO: 428935 - DNA, 25 bp, Mus musculus
gaaaggactccctctaaggaccagg

SEQ ID NO: 428936 - DNA, 25 bp, Mus musculus
gaaaggactcgctttgcctcaggat

SEQ ID NO: 428937 - DNA, 25 bp, Mus musculus
gaaaggactgctgctttacggcccc

SEQ ID NO: 428938 - DNA, 25 bp, Mus musculus
gaaaggacttgaactgttttcattg

SEQ ID NO: 428939 - DNA, 25 bp, Mus musculus
gaaaggagacgcatctatgacatcg

SEQ ID NO: 428940 - DNA, 25 bp, Mus musculus
gaaaggagacttgctaaatgcccat

SEQ ID NO: 428941 - DNA, 25 bp, Mus musculus
gaaaggagagcactcgaatcgcaga

SEQ ID NO: 428942 - DNA, 25 bp, Mus musculus
gaaaggagagtgttgcgcacagtcc

SEQ ID NO: 428943 - DNA, 25 bp, Mus musculus
gaaaggagccaatgaccatttggca

SEQ ID NO: 428944 - DNA, 25 bp, Mus musculus
gaaaggagctgattgctgtccgaga

SEQ ID NO: 428945 - DNA, 25 bp, Mus musculus
gaaaggagggcaaaccaagaggcta

SEQ ID NO: 428946 - DNA, 25 bp, Mus musculus
gaaaggaggtaacttctgtctcgaa

SEQ ID NO: 428947 - DNA, 25 bp, Mus musculus
gaaaggagtttccagagctacagca

SEQ ID NO: 428948 - DNA, 25 bp, Mus musculus
gaaaggatcatgcaacctccagtgg

SEQ ID NO: 428949 - DNA, 25 bp, Mus musculus
gaaaggatcattgcttcaggctacc

SEQ ID NO: 428950 - DNA, 25 bp, Mus musculus
gaaaggatccctaccctgaaggaag

SEQ ID NO: 428951 - DNA, 25 bp, Mus musculus
gaaaggcaacaacatatctctctga

SEQ ID NO: 428952 - DNA, 25 bp, Mus musculus
gaaaggcacacactccctgacaaaa

SEQ ID NO: 428953 - DNA, 25 bp, Mus musculus
gaaaggcaccatctacgactatgag

SEQ ID NO: 428954 - DNA, 25 bp, Mus musculus
gaaaggcactgctaatccatgtctg

SEQ ID NO: 428955 - DNA, 25 bp, Mus musculus
gaaaggcagacttcaacgtggccag

SEQ ID NO: 428956 - DNA, 25 bp, Mus musculus
gaaaggcagatgctacaggccctca

SEQ ID NO: 428957 - DNA, 25 bp, Mus musculus
gaaaggcagcaaaaaggtgacgccc

SEQ ID NO: 428958 - DNA, 25 bp, Mus musculus
gaaaggcagcaaagtcaagatgtct

SEQ ID NO: 428959 - DNA, 25 bp, Mus musculus
gaaaggcagctctaagtcaaaattg

SEQ ID NO: 428960 - DNA, 25 bp, Mus musculus
gaaaggcagctgtcctcgaaccagc

SEQ ID NO: 428961 - DNA, 25 bp, Mus musculus
gaaaggcagtgtcagctcagcctct

SEQ ID NO: 428962 - DNA, 25 bp, Mus musculus
gaaaggcatcagtgctacacctgga

SEQ ID NO: 428963 - DNA, 25 bp, Mus musculus
gaaaggcatgtgttggtccataccg

SEQ ID NO: 428964 - DNA, 25 bp, Mus musculus
gaaaggccaggatctcaccaaagtt

SEQ ID NO: 428965 - DNA, 25 bp, Mus musculus
gaaaggccagtccatgataaccaag

SEQ ID NO: 428966 - DNA, 25 bp, Mus musculus
gaaaggccatccctgcatactctag

SEQ ID NO: 428967 - DNA, 25 bp, Mus musculus
gaaaggcccaaaatagcagatccag

SEQ ID NO: 428968 - DNA, 25 bp, Mus musculus
gaaaggccctgtggcaacttgctga

SEQ ID NO: 428969 - DNA, 25 bp, Mus musculus
gaaaggccctttgctagttcctgca

SEQ ID NO: 428970 - DNA, 25 bp, Mus musculus
gaaaggccgctcatcagctacactt

SEQ ID NO: 428971 - DNA, 25 bp, Mus musculus
gaaaggccggttcatacttgcctgg

SEQ ID NO: 428972 - DNA, 25 bp, Mus musculus
gaaaggcctggctgtggaattcaca

SEQ ID NO: 428973 - DNA, 25 bp, Mus musculus
gaaaggcctggtttgtgtccccaag

SEQ ID NO: 428974 - DNA, 25 bp, Mus musculus
gaaaggcgactttccactggaggga

SEQ ID NO: 428975 - DNA, 25 bp, Mus musculus
gaaaggcgagtctggttctaaacac

SEQ ID NO: 428976 - DNA, 25 bp, Mus musculus
gaaaggcgcattagcagagactgga

SEQ ID NO: 428977 - DNA, 25 bp, Mus musculus
gaaaggcgctgcacacaactgcatc

SEQ ID NO: 428978 - DNA, 25 bp, Mus musculus
gaaaggctacactctgacagcactg

SEQ ID NO: 428979 - DNA, 25 bp, Mus musculus
gaaaggctaccgctgccgcacgtct

SEQ ID NO: 428980 - DNA, 25 bp, Mus musculus
gaaaggctatggtaagggaatcctc

SEQ ID NO: 428981 - DNA, 25 bp, Mus musculus
gaaaggctcacatcatactcgtggc

SEQ ID NO: 428982 - DNA, 25 bp, Mus musculus
gaaaggctcccagcaaagtactgca

SEQ ID NO: 428983 - DNA, 25 bp, Mus musculus
gaaaggctctcgtatctctcacagt

SEQ ID NO: 428984 - DNA, 25 bp, Mus musculus
gaaaggctctcgtgcagcagtgcag

SEQ ID NO: 428985 - DNA, 25 bp, Mus musculus
gaaaggctcttttctgtgggatgtg

SEQ ID NO: 428986 - DNA, 25 bp, Mus musculus
gaaaggctgccactctatatgatgc

SEQ ID NO: 428987 - DNA, 25 bp, Mus musculus
gaaaggcttagctcgggacttgcag

SEQ ID NO: 428988 - DNA, 25 bp, Mus musculus
gaaaggcttcctactcggctgtgag

SEQ ID NO: 428989 - DNA, 25 bp, Mus musculus
gaaaggcttgaagtcggtccacgcc

SEQ ID NO: 428990 - DNA, 25 bp, Mus musculus
gaaaggctttcactcaaagctcaca

SEQ ID NO: 428991 - DNA, 25 bp, Mus musculus
gaaaggctttccgagatggctcata

SEQ ID NO: 428992 - DNA, 25 bp, Mus musculus
gaaagggacagactccggttcactg

SEQ ID NO: 428993 - DNA, 25 bp, Mus musculus
gaaagggacgtcctctagccacgtt

SEQ ID NO: 428994 - DNA, 25 bp, Mus musculus
gaaagggagtaagaagtcagtcaaa

SEQ ID NO: 428995 - DNA, 25 bp, Mus musculus
gaaagggatcagacaagccttggag

SEQ ID NO: 428996 - DNA, 25 bp, Mus musculus
gaaagggatgaggtcattggccacc

SEQ ID NO: 428997 - DNA, 25 bp, Mus musculus
gaaagggattgttcagtcgcgcaga

SEQ ID NO: 428998 - DNA, 25 bp, Mus musculus
gaaagggcaaaagagtggaagagac

SEQ ID NO: 428999 - DNA, 25 bp, Mus musculus
gaaagggcatgtttggaaaggacca

SEQ ID NO: 429000 - DNA, 25 bp, Mus musculus
gaaagggccatccatcgatgtcaca

SEQ ID NO: 429001 - DNA, 25 bp, Mus musculus
gaaagggccccattagcctggaatg

SEQ ID NO: 429002 - DNA, 25 bp, Mus musculus
gaaagggcccgcttcattcgctgta

SEQ ID NO: 429003 - DNA, 25 bp, Mus musculus
gaaagggcctctaagcagaagctgg

SEQ ID NO: 429004 - DNA, 25 bp, Mus musculus
gaaagggcttggaaccatgcaatga

SEQ ID NO: 429005 - DNA, 25 bp, Mus musculus
gaaagggtaatttcagagaagcatg

SEQ ID NO: 429006 - DNA, 25 bp, Mus musculus
gaaagggtattcactaaccacctca

SEQ ID NO: 429007 - DNA, 25 bp, Mus musculus
gaaagggtcattctacaggctgcca

SEQ ID NO: 429008 - DNA, 25 bp, Mus musculus
gaaagggtcctctacatatactcca

SEQ ID NO: 429009 - DNA, 25 bp, Mus musculus
gaaagggtcttataattcacctagt

SEQ ID NO: 429010 - DNA, 25 bp, Mus musculus
gaaagggttggctgtcccctgaaga

SEQ ID NO: 429011 - DNA, 25 bp, Mus musculus
gaaagggtttccagagcagacctga

SEQ ID NO: 429012 - DNA, 25 bp, Mus musculus
gaaaggtaaagagcccatgcaccga

SEQ ID NO: 429013 - DNA, 25 bp, Mus musculus
gaaaggtactttgctgtcgccgacc

SEQ ID NO: 429014 - DNA, 25 bp, Mus musculus
gaaaggtcaatgcaaagacgcgcta

SEQ ID NO: 429015 - DNA, 25 bp, Mus musculus
gaaaggtcacaggtggagtaccaaa

SEQ ID NO: 429016 - DNA, 25 bp, Mus musculus
gaaaggtccttatcccgcactgatg

SEQ ID NO: 429017 - DNA, 25 bp, Mus musculus
gaaaggtctcagttcagtgccagag

SEQ ID NO: 429018 - DNA, 25 bp, Mus musculus
gaaaggtctccaatctcgtgccgta

SEQ ID NO: 429019 - DNA, 25 bp, Mus musculus
gaaaggtctgaggaatcgtgcccca

SEQ ID NO: 429020 - DNA, 25 bp, Mus musculus
gaaaggtctggaaaacctcaggcac

SEQ ID NO: 429021 - DNA, 25 bp, Mus musculus
gaaaggtgccttttgtaacggtcag

SEQ ID NO: 429022 - DNA, 25 bp, Mus musculus
gaaaggtggacgtctctaccaagga

SEQ ID NO: 429023 - DNA, 25 bp, Mus musculus
gaaaggtggccttgtgatcaacgaa

SEQ ID NO: 429024 - DNA, 25 bp, Mus musculus
gaaaggtgtcttaaggcatcgtctc

SEQ ID NO: 429025 - DNA, 25 bp, Mus musculus
gaaaggttccaagagctcggcaaca

SEQ ID NO: 429026 - DNA, 25 bp, Mus musculus
gaaaggttccttcaaacagcacgga

SEQ ID NO: 429027 - DNA, 25 bp, Mus musculus
gaaaggttcgccaattggaggccag

SEQ ID NO: 429028 - DNA, 25 bp, Mus musculus
gaaaggtttggaccgcaatgctcct

SEQ ID NO: 429029 - DNA, 25 bp, Mus musculus
gaaagtaaaaactcaagcttccatg

SEQ ID NO: 429030 - DNA, 25 bp, Mus musculus
gaaagtaaaactgtcctgcgccatg

SEQ ID NO: 429031 - DNA, 25 bp, Mus musculus
gaaagtaacacctagtgtgccagat

SEQ ID NO: 429032 - DNA, 25 bp, Mus musculus
gaaagtaactttacagggtcgctag

SEQ ID NO: 429033 - DNA, 25 bp, Mus musculus
gaaagtaagacacagcaaggcaaga

SEQ ID NO: 429034 - DNA, 25 bp, Mus musculus
gaaagtaagctgtcgtctggtgcca

SEQ ID NO: 429035 - DNA, 25 bp, Mus musculus
gaaagtacagcattcaagaccagct

SEQ ID NO: 429036 - DNA, 25 bp, Mus musculus
gaaagtaccctgcttagtctgccgg

SEQ ID NO: 429037 - DNA, 25 bp, Mus musculus
gaaagtacctacacagaccttcgag

SEQ ID NO: 429038 - DNA, 25 bp, Mus musculus
gaaagtacctgtcctctaagtgcac

SEQ ID NO: 429039 - DNA, 25 bp, Mus musculus
gaaagtactccaaccagagatgctg

SEQ ID NO: 429040 - DNA, 25 bp, Mus musculus
gaaagtactcctctaaccgttgagc

SEQ ID NO: 429041 - DNA, 25 bp, Mus musculus
gaaagtagatatcttgcccaatggg

SEQ ID NO: 429042 - DNA, 25 bp, Mus musculus
gaaagtagccaattcgccaacgatg

SEQ ID NO: 429043 - DNA, 25 bp, Mus musculus
gaaagtagcctttccagcccatgac

SEQ ID NO: 429044 - DNA, 25 bp, Mus musculus
gaaagtagctaccttcccatatgga

SEQ ID NO: 429045 - DNA, 25 bp, Mus musculus
gaaagtaggtgcttctaagccccgg

SEQ ID NO: 429046 - DNA, 25 bp, Mus musculus
gaaagtatctgggtccaagcgctga

SEQ ID NO: 429047 - DNA, 25 bp, Mus musculus
gaaagtattcacagtaccctcctga

SEQ ID NO: 429048 - DNA, 25 bp, Mus musculus
gaaagtcaacgaaagccaaatactg

SEQ ID NO: 429049 - DNA, 25 bp, Mus musculus
gaaagtcaagcaccagaaagggcag

SEQ ID NO: 429050 - DNA, 25 bp, Mus musculus
gaaagtcaaggtctgactccccaaa

SEQ ID NO: 429051 - DNA, 25 bp, Mus musculus
gaaagtcacaatcaagattccagag

SEQ ID NO: 429052 - DNA, 25 bp, Mus musculus
gaaagtcacagcaagtccaaggcca

SEQ ID NO: 429053 - DNA, 25 bp, Mus musculus
gaaagtcacctacgtggcactactg

SEQ ID NO: 429054 - DNA, 25 bp, Mus musculus
gaaagtcaggctccaaagtcatcag

SEQ ID NO: 429055 - DNA, 25 bp, Mus musculus
gaaagtcagttacaccagcaagtgg

SEQ ID NO: 429056 - DNA, 25 bp, Mus musculus
gaaagtcatccaagagctcaacgcg

SEQ ID NO: 429057 - DNA, 25 bp, Mus musculus
gaaagtccaggaccttcaaggcgag

SEQ ID NO: 429058 - DNA, 25 bp, Mus musculus
gaaagtccctttggaagcaccacga

SEQ ID NO: 429059 - DNA, 25 bp, Mus musculus
gaaagtccgatggagcagccagtct

SEQ ID NO: 429060 - DNA, 25 bp, Mus musculus
gaaagtccggccagggctactatgt

SEQ ID NO: 429061 - DNA, 25 bp, Mus musculus
gaaagtcctgaatgtcaacgaagcc

SEQ ID NO: 429062 - DNA, 25 bp, Mus musculus
gaaagtccttcctactatcagtcca

SEQ ID NO: 429063 - DNA, 25 bp, Mus musculus
gaaagtcggctgaatctcgcggcca

SEQ ID NO: 429064 - DNA, 25 bp, Mus musculus
gaaagtctaatctagagaaccgtga

SEQ ID NO: 429065 - DNA, 25 bp, Mus musculus
gaaagtctagatctgccctgtgggc

SEQ ID NO: 429066 - DNA, 25 bp, Mus musculus
gaaagtctcgtctgagggatctcac

SEQ ID NO: 429067 - DNA, 25 bp, Mus musculus
gaaagtctgaaactcgccagcttgg

SEQ ID NO: 429068 - DNA, 25 bp, Mus musculus
gaaagtctgcattgtcggctctggc

SEQ ID NO: 429069 - DNA, 25 bp, Mus musculus
gaaagtctgcttggatgacctcagg

SEQ ID NO: 429070 - DNA, 25 bp, Mus musculus
gaaagtctggctgaagtcactgcac

SEQ ID NO: 429071 - DNA, 25 bp, Mus musculus
gaaagtctgtcttcgaccgacacgt

SEQ ID NO: 429072 - DNA, 25 bp, Mus musculus
gaaagtcttcgaggaaaagccagtg

SEQ ID NO: 429073 - DNA, 25 bp, Mus musculus
gaaagtctttattcacggtgccaaa

SEQ ID NO: 429074 - DNA, 25 bp, Mus musculus
gaaagtctttgtctccgcgataatg

SEQ ID NO: 429075 - DNA, 25 bp, Mus musculus
gaaagtgaaccctgaagtccaaagc

SEQ ID NO: 429076 - DNA, 25 bp, Mus musculus
gaaagtgaacttctctgaccgagtc

SEQ ID NO: 429077 - DNA, 25 bp, Mus musculus
gaaagtgaagtcctatcccatacct

SEQ ID NO: 429078 - DNA, 25 bp, Mus musculus
gaaagtgacgaatttgacatgagtg

SEQ ID NO: 429079 - DNA, 25 bp, Mus musculus
gaaagtgattctccctcaaaggctg

SEQ ID NO: 429080 - DNA, 25 bp, Mus musculus
gaaagtgatttgtccatgaattgag

SEQ ID NO: 429081 - DNA, 25 bp, Mus musculus
gaaagtgccaacgtctcagataagg

SEQ ID NO: 429082 - DNA, 25 bp, Mus musculus
gaaagtgccctacagatacaccgtg

SEQ ID NO: 429083 - DNA, 25 bp, Mus musculus
gaaagtgcgaaacttcttggccagc

SEQ ID NO: 429084 - DNA, 25 bp, Mus musculus
gaaagtgcgagtttcatcctgaaca

SEQ ID NO: 429085 - DNA, 25 bp, Mus musculus
gaaagtgctacatatccgggacaag

SEQ ID NO: 429086 - DNA, 25 bp, Mus musculus
gaaagtgctcacagagaaatcgctc

SEQ ID NO: 429087 - DNA, 25 bp, Mus musculus
gaaagtgctgacatccttgggcttg

SEQ ID NO: 429088 - DNA, 25 bp, Mus musculus
gaaagtgctttcaggacagatcggc

SEQ ID NO: 429089 - DNA, 25 bp, Mus musculus
gaaagtggaatgtacgccgactccc

SEQ ID NO: 429090 - DNA, 25 bp, Mus musculus
gaaagtggcaacgaaaacaaggaca

SEQ ID NO: 429091 - DNA, 25 bp, Mus musculus
gaaagtggcatctcttgtctctgac

SEQ ID NO: 429092 - DNA, 25 bp, Mus musculus
gaaagtggccactccaaagaaggca

SEQ ID NO: 429093 - DNA, 25 bp, Mus musculus
gaaagtgtacttctcctagccagtg

SEQ ID NO: 429094 - DNA, 25 bp, Mus musculus
gaaagtgtctcaaagctaggctccg

SEQ ID NO: 429095 - DNA, 25 bp, Mus musculus
gaaagtgttcacaagcagctcggtg

SEQ ID NO: 429096 - DNA, 25 bp, Mus musculus
gaaagtgttggactgacaatggccc

SEQ ID NO: 429097 - DNA, 25 bp, Mus musculus
gaaagttaagatcggcccggcctct

SEQ ID NO: 429098 - DNA, 25 bp, Mus musculus
gaaagttcaccaaaaaggctcccag

SEQ ID NO: 429099 - DNA, 25 bp, Mus musculus
gaaagttcacgaggcactgtcccat

SEQ ID NO: 429100 - DNA, 25 bp, Mus musculus
gaaagttccacctcgcaatagtaga

SEQ ID NO: 429101 - DNA, 25 bp, Mus musculus
gaaagttcctaggtagttctggctc

SEQ ID NO: 429102 - DNA, 25 bp, Mus musculus
gaaagttcctgtgttgccagcagag

SEQ ID NO: 429103 - DNA, 25 bp, Mus musculus
gaaagttccttagccaggtatagcc

SEQ ID NO: 429104 - DNA, 25 bp, Mus musculus
gaaagttcgatccaacaattcctgt

SEQ ID NO: 429105 - DNA, 25 bp, Mus musculus
gaaagttcggaccatcagtgctctg

SEQ ID NO: 429106 - DNA, 25 bp, Mus musculus
gaaagttctgactaaaatacatatc

SEQ ID NO: 429107 - DNA, 25 bp, Mus musculus
gaaagttgctgccagaagccacaaa

SEQ ID NO: 429108 - DNA, 25 bp, Mus musculus
gaaagttgcttctgggcgaacatca

SEQ ID NO: 429109 - DNA, 25 bp, Mus musculus
gaaagttggaaagctggctgccaca

SEQ ID NO: 429110 - DNA, 25 bp, Mus musculus
gaaagttggtgtcacagttcaggcc

SEQ ID NO: 429111 - DNA, 25 bp, Mus musculus
gaaagttgtatttttacagcaagga

SEQ ID NO: 429112 - DNA, 25 bp, Mus musculus
gaaagttgtgatcggctccatcctg

SEQ ID NO: 429113 - DNA, 25 bp, Mus musculus
gaaagtttaatgtgatctcactcag

SEQ ID NO: 429114 - DNA, 25 bp, Mus musculus
gaaagtttacatcgacccactgaag

SEQ ID NO: 429115 - DNA, 25 bp, Mus musculus
gaaagtttaccttctggacaacttg

SEQ ID NO: 429116 - DNA, 25 bp, Mus musculus
gaaagtttcaggttagcctggacta

SEQ ID NO: 429117 - DNA, 25 bp, Mus musculus
gaaagtttccattcgctattggtaa

SEQ ID NO: 429118 - DNA, 25 bp, Mus musculus
gaaagtttcgagcacataatccaag

SEQ ID NO: 429119 - DNA, 25 bp, Mus musculus
gaaagtttctctcggcccactaaag

SEQ ID NO: 429120 - DNA, 25 bp, Mus musculus
gaaagtttgccaactcccgatccac

SEQ ID NO: 429121 - DNA, 25 bp, Mus musculus
gaaagtttgccaagcagctggacga

SEQ ID NO: 429122 - DNA, 25 bp, Mus musculus
gaaagtttgccagcatcgctcgtaa

SEQ ID NO: 429123 - DNA, 25 bp, Mus musculus
gaaagttttactcgatccgcggcga

SEQ ID NO: 429124 - DNA, 25 bp, Mus musculus
gaaagttttctgaattctacagcaa

SEQ ID NO: 429125 - DNA, 25 bp, Mus musculus
gaaagttttgctcatgccacgtgcc

SEQ ID NO: 429126 - DNA, 25 bp, Mus musculus
gaaataaaacagtgcaccgacgtgt

SEQ ID NO: 429127 - DNA, 25 bp, Mus musculus
gaaataaagacctcgggtgctccag

SEQ ID NO: 429128 - DNA, 25 bp, Mus musculus
gaaataaatataccttggacgccag

SEQ ID NO: 429129 - DNA, 25 bp, Mus musculus
gaaataaatgctgcctgtcacgtgg

SEQ ID NO: 429130 - DNA, 25 bp, Mus musculus
gaaataacagtattcagtctcggct

SEQ ID NO: 429131 - DNA, 25 bp, Mus musculus
gaaataagaaatagcccagccccta

SEQ ID NO: 429132 - DNA, 25 bp, Mus musculus
gaaataagagcacccttgtcagggc

SEQ ID NO: 429133 - DNA, 25 bp, Mus musculus
gaaataagagtggatccaaggaccg

SEQ ID NO: 429134 - DNA, 25 bp, Mus musculus
gaaataagatccacaggctcccagt

SEQ ID NO: 429135 - DNA, 25 bp, Mus musculus
gaaataagcaattccaccagagcct

SEQ ID NO: 429136 - DNA, 25 bp, Mus musculus
gaaataagtttcgatttccccagct

SEQ ID NO: 429137 - DNA, 25 bp, Mus musculus
gaaatacagagggactatggatgcc

SEQ ID NO: 429138 - DNA, 25 bp, Mus musculus
gaaatacagcgtaactattccctgg

SEQ ID NO: 429139 - DNA, 25 bp, Mus musculus
gaaatacatcagaagccttgacccg

SEQ ID NO: 429140 - DNA, 25 bp, Mus musculus
gaaatacatctttgagccaagggtg

SEQ ID NO: 429141 - DNA, 25 bp, Mus musculus
gaaataccagctacagcagtgcagt

SEQ ID NO: 429142 - DNA, 25 bp, Mus musculus
gaaatacccagcattggcttacagc

SEQ ID NO: 429143 - DNA, 25 bp, Mus musculus
gaaatacccgtcttatacgcacaga

SEQ ID NO: 429144 - DNA, 25 bp, Mus musculus
gaaatacctgcagacgacatcctag

SEQ ID NO: 429145 - DNA, 25 bp, Mus musculus
gaaatacctggcaccctacaagatg

SEQ ID NO: 429146 - DNA, 25 bp, Mus musculus
gaaatacctggtgacccgaagctct

SEQ ID NO: 429147 - DNA, 25 bp, Mus musculus
gaaatacgacacactggatgcactg

SEQ ID NO: 429148 - DNA, 25 bp, Mus musculus
gaaatacgattatgataacctgccc

SEQ ID NO: 429149 - DNA, 25 bp, Mus musculus
gaaatacggcttcatctacaagacg

SEQ ID NO: 429150 - DNA, 25 bp, Mus musculus
gaaatactacagagagccggccttg

SEQ ID NO: 429151 - DNA, 25 bp, Mus musculus
gaaatactcagtgttggacagccct

SEQ ID NO: 429152 - DNA, 25 bp, Mus musculus
gaaatactgcggcacaccagtgggc

SEQ ID NO: 429153 - DNA, 25 bp, Mus musculus
gaaatactgtctagtagtcccgtgg

SEQ ID NO: 429154 - DNA, 25 bp, Mus musculus
gaaatacttgcatgaactccgtggg

SEQ ID NO: 429155 - DNA, 25 bp, Mus musculus
gaaatagaaaagcacatccggcagc

SEQ ID NO: 429156 - DNA, 25 bp, Mus musculus
gaaatagaaggcctgtagtcacggt

SEQ ID NO: 429157 - DNA, 25 bp, Mus musculus
gaaatagagtaggtaaaaatgagcc

SEQ ID NO: 429158 - DNA, 25 bp, Mus musculus
gaaatagatcactaacactcctctt

SEQ ID NO: 429159 - DNA, 25 bp, Mus musculus
gaaatagcaagtcagtcgcagacgg

SEQ ID NO: 429160 - DNA, 25 bp, Mus musculus
gaaatagcagccattccctgacagg

SEQ ID NO: 429161 - DNA, 25 bp, Mus musculus
gaaatagcagctacaacatcctggg

SEQ ID NO: 429162 - DNA, 25 bp, Mus musculus
gaaatagcattcatctgtgggagag

SEQ ID NO: 429163 - DNA, 25 bp, Mus musculus
gaaataggacaagttcacaacggcc

SEQ ID NO: 429164 - DNA, 25 bp, Mus musculus
gaaataggccagaccattctacact

SEQ ID NO: 429165 - DNA, 25 bp, Mus musculus
gaaatagtaagtgcttcggcggtcc

SEQ ID NO: 429166 - DNA, 25 bp, Mus musculus
gaaatagtatctcctagcgacctag

SEQ ID NO: 429167 - DNA, 25 bp, Mus musculus
gaaatagtcacgcataacagtccaa

SEQ ID NO: 429168 - DNA, 25 bp, Mus musculus
gaaatagttcccgatctgccaacca

SEQ ID NO: 429169 - DNA, 25 bp, Mus musculus
gaaatatacaaagacagggacagcc

SEQ ID NO: 429170 - DNA, 25 bp, Mus musculus
gaaatatatctcacaaggctgctgg

SEQ ID NO: 429171 - DNA, 25 bp, Mus musculus
gaaatatatggaactggacccttgc

SEQ ID NO: 429172 - DNA, 25 bp, Mus musculus
gaaatatattttggacctgtctctc

SEQ ID NO: 429173 - DNA, 25 bp, Mus musculus
gaaatatgaaatccaccgagaccct

SEQ ID NO: 429174 - DNA, 25 bp, Mus musculus
gaaatatgaagaggcgtccatccct

SEQ ID NO: 429175 - DNA, 25 bp, Mus musculus
gaaatatgagaggtattccccgtcc

SEQ ID NO: 429176 - DNA, 25 bp, Mus musculus
gaaatatggataactcgctgctcag

SEQ ID NO: 429177 - DNA, 25 bp, Mus musculus
gaaatatgggttcacactgcgagcc

SEQ ID NO: 429178 - DNA, 25 bp, Mus musculus
gaaatattcaagagcatcacccgag

SEQ ID NO: 429179 - DNA, 25 bp, Mus musculus
gaaatattgcaaagttcaggctggt

SEQ ID NO: 429180 - DNA, 25 bp, Mus musculus
gaaatatttcatctcggcatcagga

SEQ ID NO: 429181 - DNA, 25 bp, Mus musculus
gaaatatttttatcctgagtccttc

SEQ ID NO: 429182 - DNA, 25 bp, Mus musculus
gaaatcaagcaacctgaagagtccc

SEQ ID NO: 429183 - DNA, 25 bp, Mus musculus
gaaatcaatagtcctgcactcgtag

SEQ ID NO: 429184 - DNA, 25 bp, Mus musculus
gaaatcaccttgaacttaggaactg

SEQ ID NO: 429185 - DNA, 25 bp, Mus musculus
gaaatcacctttctggttgcagtgt

SEQ ID NO: 429186 - DNA, 25 bp, Mus musculus
gaaatcacgataccttccgagtgga

SEQ ID NO: 429187 - DNA, 25 bp, Mus musculus
gaaatcacggccctcaaaaggatgg

SEQ ID NO: 429188 - DNA, 25 bp, Mus musculus
gaaatcactgcttgttcagcaccag

SEQ ID NO: 429189 - DNA, 25 bp, Mus musculus
gaaatcactgtaaggccccatccag

SEQ ID NO: 429190 - DNA, 25 bp, Mus musculus
gaaatcagagctacctcggaggtgt

SEQ ID NO: 429191 - DNA, 25 bp, Mus musculus
gaaatcagataaagcccgagttggg

SEQ ID NO: 429192 - DNA, 25 bp, Mus musculus
gaaatcagctgccttcctgatcact

SEQ ID NO: 429193 - DNA, 25 bp, Mus musculus
gaaatcagcttgtaagggcctctgc

SEQ ID NO: 429194 - DNA, 25 bp, Mus musculus
gaaatcaggaacgagaccagtggct

SEQ ID NO: 429195 - DNA, 25 bp, Mus musculus
gaaatcaggaccgtggcagttggaa

SEQ ID NO: 429196 - DNA, 25 bp, Mus musculus
gaaatcaggctggttgcacattact

SEQ ID NO: 429197 - DNA, 25 bp, Mus musculus
gaaatcaggcttggcaagatgactc

SEQ ID NO: 429198 - DNA, 25 bp, Mus musculus
gaaatcataaaccacgaggatccta

SEQ ID NO: 429199 - DNA, 25 bp, Mus musculus
gaaatcatagaaaccagagcctcct

SEQ ID NO: 429200 - DNA, 25 bp, Mus musculus
gaaatcatcctggatgtccaccatg

SEQ ID NO: 429201 - DNA, 25 bp, Mus musculus
gaaatcatggccacttcagagctga

SEQ ID NO: 429202 - DNA, 25 bp, Mus musculus
gaaatcattgcaacctgacctgagg

SEQ ID NO: 429203 - DNA, 25 bp, Mus musculus
gaaatcattgcggttcccagcgaca

SEQ ID NO: 429204 - DNA, 25 bp, Mus musculus
gaaatcatttctccagtacccggga

SEQ ID NO: 429205 - DNA, 25 bp, Mus musculus
gaaatccaaccctcaagcgcaaatg

SEQ ID NO: 429206 - DNA, 25 bp, Mus musculus
gaaatccaagcccaaaaagtgtgtg

SEQ ID NO: 429207 - DNA, 25 bp, Mus musculus
gaaatccaagtatcctcagggcagg

SEQ ID NO: 429208 - DNA, 25 bp, Mus musculus
gaaatccaatatggaagacagtgac

SEQ ID NO: 429209 - DNA, 25 bp, Mus musculus
gaaatccacccataagatcagcagg

SEQ ID NO: 429210 - DNA, 25 bp, Mus musculus
gaaatccagataggaccaaggcgct

SEQ ID NO: 429211 - DNA, 25 bp, Mus musculus
gaaatccaggatacacacacggtga

SEQ ID NO: 429212 - DNA, 25 bp, Mus musculus
gaaatccaggctgtctaagagggct

SEQ ID NO: 429213 - DNA, 25 bp, Mus musculus
gaaatccagggaactcctgagccgg

SEQ ID NO: 429214 - DNA, 25 bp, Mus musculus
gaaatccatcattttgtgttagaag

SEQ ID NO: 429215 - DNA, 25 bp, Mus musculus
gaaatcccaatggtgtagaccagtg

SEQ ID NO: 429216 - DNA, 25 bp, Mus musculus
gaaatcccagagctcgagatcgatg

SEQ ID NO: 429217 - DNA, 25 bp, Mus musculus
gaaatcccagtgagaataaggctac

SEQ ID NO: 429218 - DNA, 25 bp, Mus musculus
gaaatccccaaggtgatcgtcagca

SEQ ID NO: 429219 - DNA, 25 bp, Mus musculus
gaaatccctgaagtgtccgacatgg

SEQ ID NO: 429220 - DNA, 25 bp, Mus musculus
gaaatcccttattacagctcccacg

SEQ ID NO: 429221 - DNA, 25 bp, Mus musculus
gaaatccgaagatgcctgagcctgc

SEQ ID NO: 429222 - DNA, 25 bp, Mus musculus
gaaatccggagattgccaggaggct

SEQ ID NO: 429223 - DNA, 25 bp, Mus musculus
gaaatccggcacaacatccagaagg

SEQ ID NO: 429224 - DNA, 25 bp, Mus musculus
gaaatccggcgatggcttccaaaac

SEQ ID NO: 429225 - DNA, 25 bp, Mus musculus
gaaatcctaaatggccaagctactg

SEQ ID NO: 429226 - DNA, 25 bp, Mus musculus
gaaatcctgccattctcagggacag

SEQ ID NO: 429227 - DNA, 25 bp, Mus musculus
gaaatcctggacctcatctgccgga

SEQ ID NO: 429228 - DNA, 25 bp, Mus musculus
gaaatcctggtgacacactggcatt

SEQ ID NO: 429229 - DNA, 25 bp, Mus musculus
gaaatcctgtagagagcatagccaa

SEQ ID NO: 429230 - DNA, 25 bp, Mus musculus
gaaatcctgtgacatgccatctctg

SEQ ID NO: 429231 - DNA, 25 bp, Mus musculus
gaaatcctgtgtcaccctgttcagc

SEQ ID NO: 429232 - DNA, 25 bp, Mus musculus
gaaatccttgcacgatcccagtggg

SEQ ID NO: 429233 - DNA, 25 bp, Mus musculus
gaaatccttgtacaactgggtggga

SEQ ID NO: 429234 - DNA, 25 bp, Mus musculus
gaaatcctttatcgctgccagcaga

SEQ ID NO: 429235 - DNA, 25 bp, Mus musculus
gaaatcgaagcgtgcatggcaggct

SEQ ID NO: 429236 - DNA, 25 bp, Mus musculus
gaaatcgaatctttccagccttgca

SEQ ID NO: 429237 - DNA, 25 bp, Mus musculus
gaaatcgacggtctccaactggtga

SEQ ID NO: 429238 - DNA, 25 bp, Mus musculus
gaaatcgagacaagcgaactgcccc

SEQ ID NO: 429239 - DNA, 25 bp, Mus musculus
gaaatcgagcaagtcatgtaccacg

SEQ ID NO: 429240 - DNA, 25 bp, Mus musculus
gaaatcgcactggaactgggctcta

SEQ ID NO: 429241 - DNA, 25 bp, Mus musculus
gaaatcgctgcagaattccggaaga

SEQ ID NO: 429242 - DNA, 25 bp, Mus musculus
gaaatcggacctatgggaatcccag

SEQ ID NO: 429243 - DNA, 25 bp, Mus musculus
gaaatcgggaatagccagagtcacc

SEQ ID NO: 429244 - DNA, 25 bp, Mus musculus
gaaatcgggagaggtacccaagaca

SEQ ID NO: 429245 - DNA, 25 bp, Mus musculus
gaaatcgtggcaagatggcgtccct

SEQ ID NO: 429246 - DNA, 25 bp, Mus musculus
gaaatcgtgtcctcattatgcttct

SEQ ID NO: 429247 - DNA, 25 bp, Mus musculus
gaaatcgttctccaagactctcagc

SEQ ID NO: 429248 - DNA, 25 bp, Mus musculus
gaaatctacctggagggctcggctt

SEQ ID NO: 429249 - DNA, 25 bp, Mus musculus
gaaatctagggtggacccctgagtc

SEQ ID NO: 429250 - DNA, 25 bp, Mus musculus
gaaatctataggtgtgtatctcata

SEQ ID NO: 429251 - DNA, 25 bp, Mus musculus
gaaatctatggtgccgtgggctccc

SEQ ID NO: 429252 - DNA, 25 bp, Mus musculus
gaaatctcaagttaataacgtaacg

SEQ ID NO: 429253 - DNA, 25 bp, Mus musculus
gaaatctcacgatacactggccgct

SEQ ID NO: 429254 - DNA, 25 bp, Mus musculus
gaaatctcattgcaggaaaccacct

SEQ ID NO: 429255 - DNA, 25 bp, Mus musculus
gaaatctcctcaaacgtgttggcag

SEQ ID NO: 429256 - DNA, 25 bp, Mus musculus
gaaatctcgtgttgttaagcagcca

SEQ ID NO: 429257 - DNA, 25 bp, Mus musculus
gaaatctctgaaaaagccaaactgg

SEQ ID NO: 429258 - DNA, 25 bp, Mus musculus
gaaatctctggaagatgcagccgag

SEQ ID NO: 429259 - DNA, 25 bp, Mus musculus
gaaatctctgtggatataattctgg

SEQ ID NO: 429260 - DNA, 25 bp, Mus musculus
gaaatctcttcatcccacgttagca

SEQ ID NO: 429261 - DNA, 25 bp, Mus musculus
gaaatctcttgtttgcctcgctagg

SEQ ID NO: 429262 - DNA, 25 bp, Mus musculus
gaaatctctttaggctctggaggcc

SEQ ID NO: 429263 - DNA, 25 bp, Mus musculus
gaaatctgatcaacaagctgtcggt

SEQ ID NO: 429264 - DNA, 25 bp, Mus musculus
gaaatctgccgggaacagcttctcc

SEQ ID NO: 429265 - DNA, 25 bp, Mus musculus
gaaatctggcatagttgtccctgac

SEQ ID NO: 429266 - DNA, 25 bp, Mus musculus
gaaatctggcgtctggcttgcttga

SEQ ID NO: 429267 - DNA, 25 bp, Mus musculus
gaaatctgggagaacctgccttaca

SEQ ID NO: 429268 - DNA, 25 bp, Mus musculus
gaaatctgtactgaccttggaccca

SEQ ID NO: 429269 - DNA, 25 bp, Mus musculus
gaaatctgtgctcccgacaaacgta

SEQ ID NO: 429270 - DNA, 25 bp, Mus musculus
gaaatctgtgttccctgcaactgtt

SEQ ID NO: 429271 - DNA, 25 bp, Mus musculus
gaaatcttactaacttgccttctga

SEQ ID NO: 429272 - DNA, 25 bp, Mus musculus
gaaatcttagtatcagcctagccag

SEQ ID NO: 429273 - DNA, 25 bp, Mus musculus
gaaatcttcaaacaggcgtcagcgt

SEQ ID NO: 429274 - DNA, 25 bp, Mus musculus
gaaatcttgggtcgattctggccta

SEQ ID NO: 429275 - DNA, 25 bp, Mus musculus
gaaatcttgttctgctaccctgtag

SEQ ID NO: 429276 - DNA, 25 bp, Mus musculus
gaaatctttgacatgctcctggcga

SEQ ID NO: 429277 - DNA, 25 bp, Mus musculus
gaaatctttggttttggctggaaat

SEQ ID NO: 429278 - DNA, 25 bp, Mus musculus
gaaatgaaaaacttcctgaggctgt

SEQ ID NO: 429279 - DNA, 25 bp, Mus musculus
gaaatgaaaagtcaagctgctagcc

SEQ ID NO: 429280 - DNA, 25 bp, Mus musculus
gaaatgaaaatgttgccggtgctgg

SEQ ID NO: 429281 - DNA, 25 bp, Mus musculus
gaaatgaaagactaccacagtggtc

SEQ ID NO: 429282 - DNA, 25 bp, Mus musculus
gaaatgaaagactcggacccgtgac

SEQ ID NO: 429283 - DNA, 25 bp, Mus musculus
gaaatgaacaacctccagatcgcgg

SEQ ID NO: 429284 - DNA, 25 bp, Mus musculus
gaaatgaactgcataatcttctaga

SEQ ID NO: 429285 - DNA, 25 bp, Mus musculus
gaaatgaacttggatgctgctcaga

SEQ ID NO: 429286 - DNA, 25 bp, Mus musculus
gaaatgaagcatccaattggcccag

SEQ ID NO: 429287 - DNA, 25 bp, Mus musculus
gaaatgaagcccctttatcagcaaa

SEQ ID NO: 429288 - DNA, 25 bp, Mus musculus
gaaatgaagtccaagcaggctaccc

SEQ ID NO: 429289 - DNA, 25 bp, Mus musculus
gaaatgaagtcggtgtgctccacag

SEQ ID NO: 429290 - DNA, 25 bp, Mus musculus
gaaatgaatcagaaccagagggctc

SEQ ID NO: 429291 - DNA, 25 bp, Mus musculus
gaaatgaatgcgtccagagctctga

SEQ ID NO: 429292 - DNA, 25 bp, Mus musculus
gaaatgacacccagacaactgcagt

SEQ ID NO: 429293 - DNA, 25 bp, Mus musculus
gaaatgacagatgaaggcagtcccc

SEQ ID NO: 429294 - DNA, 25 bp, Mus musculus
gaaatgacagcatgtacgcaggcgc

SEQ ID NO: 429295 - DNA, 25 bp, Mus musculus
gaaatgacaggacattcccaggagg

SEQ ID NO: 429296 - DNA, 25 bp, Mus musculus
gaaatgacccttgaacttggctttg

SEQ ID NO: 429297 - DNA, 25 bp, Mus musculus
gaaatgaccgagttaggaacctgca

SEQ ID NO: 429298 - DNA, 25 bp, Mus musculus
gaaatgaccttagcacaaatgccag

SEQ ID NO: 429299 - DNA, 25 bp, Mus musculus
gaaatgactaaacatttgccactaa

SEQ ID NO: 429300 - DNA, 25 bp, Mus musculus
gaaatgactgtgaagcacctccgga

SEQ ID NO: 429301 - DNA, 25 bp, Mus musculus
gaaatgagacaaacccacaccatgg

SEQ ID NO: 429302 - DNA, 25 bp, Mus musculus
gaaatgagcatctctgctaaaggag

SEQ ID NO: 429303 - DNA, 25 bp, Mus musculus
gaaatgagccgtgtctgtagaccag

SEQ ID NO: 429304 - DNA, 25 bp, Mus musculus
gaaatgagcttcctgagccgacagc

SEQ ID NO: 429305 - DNA, 25 bp, Mus musculus
gaaatgagggcagggtcgcttttcc

SEQ ID NO: 429306 - DNA, 25 bp, Mus musculus
gaaatgagttgtttgtcagttctag

SEQ ID NO: 429307 - DNA, 25 bp, Mus musculus
gaaatgatactttcagtcagcgtca

SEQ ID NO: 429308 - DNA, 25 bp, Mus musculus
gaaatgatagccaaggatgccctct

SEQ ID NO: 429309 - DNA, 25 bp, Mus musculus
gaaatgatccgtcacagagagcagg

SEQ ID NO: 429310 - DNA, 25 bp, Mus musculus
gaaatgatcgatgacacagccgtct

SEQ ID NO: 429311 - DNA, 25 bp, Mus musculus
gaaatgatcgcagatgtagttcctg

SEQ ID NO: 429312 - DNA, 25 bp, Mus musculus
gaaatgatcgcgaccctctcagatg

SEQ ID NO: 429313 - DNA, 25 bp, Mus musculus
gaaatgatctcgagctgtacatcag

SEQ ID NO: 429314 - DNA, 25 bp, Mus musculus
gaaatgatgacaaaagctacccaga

SEQ ID NO: 429315 - DNA, 25 bp, Mus musculus
gaaatgatgaccctcttgtgcctga

SEQ ID NO: 429316 - DNA, 25 bp, Mus musculus
gaaatgatgcttgagtttactgtca

SEQ ID NO: 429317 - DNA, 25 bp, Mus musculus
gaaatgcaagagaaacttcagaatt

SEQ ID NO: 429318 - DNA, 25 bp, Mus musculus
gaaatgcacgcatttatggctggtg

SEQ ID NO: 429319 - DNA, 25 bp, Mus musculus
gaaatgcagattgaatggatggagg

SEQ ID NO: 429320 - DNA, 25 bp, Mus musculus
gaaatgcagcagctctcaggaggac

SEQ ID NO: 429321 - DNA, 25 bp, Mus musculus
gaaatgcagccgaaaaagcctgtgg

SEQ ID NO: 429322 - DNA, 25 bp, Mus musculus
gaaatgcagcgagagtattcccaag

SEQ ID NO: 429323 - DNA, 25 bp, Mus musculus
gaaatgcagcgcctctaaagctctg

SEQ ID NO: 429324 - DNA, 25 bp, Mus musculus
gaaatgcaggaagcctcaggtcagt

SEQ ID NO: 429325 - DNA, 25 bp, Mus musculus
gaaatgcagtcttccagggcaatgg

SEQ ID NO: 429326 - DNA, 25 bp, Mus musculus
gaaatgcatagatcacagagctggg

SEQ ID NO: 429327 - DNA, 25 bp, Mus musculus
gaaatgcatatacaatggttttgca

SEQ ID NO: 429328 - DNA, 25 bp, Mus musculus
gaaatgcatctttaccaggtagagc

SEQ ID NO: 429329 - DNA, 25 bp, Mus musculus
gaaatgccagctcaaaaatcagtct

SEQ ID NO: 429330 - DNA, 25 bp, Mus musculus
gaaatgccagctgctcttcagggtg

SEQ ID NO: 429331 - DNA, 25 bp, Mus musculus
gaaatgccagcttcctgagctcaga

SEQ ID NO: 429332 - DNA, 25 bp, Mus musculus
gaaatgccatgcgagatccctcaag

SEQ ID NO: 429333 - DNA, 25 bp, Mus musculus
gaaatgccatgggaaacaaggtgat

SEQ ID NO: 429334 - DNA, 25 bp, Mus musculus
gaaatgccattgatccgagggaact

SEQ ID NO: 429335 - DNA, 25 bp, Mus musculus
gaaatgccggctttgtcttagcaca

SEQ ID NO: 429336 - DNA, 25 bp, Mus musculus
gaaatgccgggttctggcgctcaaa

SEQ ID NO: 429337 - DNA, 25 bp, Mus musculus
gaaatgcctcattatgccggtggaa

SEQ ID NO: 429338 - DNA, 25 bp, Mus musculus
gaaatgcctgcgcaatgctggtcct

SEQ ID NO: 429339 - DNA, 25 bp, Mus musculus
gaaatgcctgtgtgagctgagctca

SEQ ID NO: 429340 - DNA, 25 bp, Mus musculus
gaaatgcgagggtatgtccaagact

SEQ ID NO: 429341 - DNA, 25 bp, Mus musculus
gaaatgcggatcctcatgctgggcc

SEQ ID NO: 429342 - DNA, 25 bp, Mus musculus
gaaatgcggtgtccatcaagaatcc

SEQ ID NO: 429343 - DNA, 25 bp, Mus musculus
gaaatgctccacacagatcagaggg

SEQ ID NO: 429344 - DNA, 25 bp, Mus musculus
gaaatgctccttgccaaactgaacg

SEQ ID NO: 429345 - DNA, 25 bp, Mus musculus
gaaatgctctctgtggctgaacact

SEQ ID NO: 429346 - DNA, 25 bp, Mus musculus
gaaatgctctgagttccgagcccga

SEQ ID NO: 429347 - DNA, 25 bp, Mus musculus
gaaatgctgaactaagaagagccca

SEQ ID NO: 429348 - DNA, 25 bp, Mus musculus
gaaatgctgacactccaatcctctg

SEQ ID NO: 429349 - DNA, 25 bp, Mus musculus
gaaatgctgagaacccacaggctga

SEQ ID NO: 429350 - DNA, 25 bp, Mus musculus
gaaatgctgcaacgtcgactgtgtc

SEQ ID NO: 429351 - DNA, 25 bp, Mus musculus
gaaatgctgctcgtggtccagtcct

SEQ ID NO: 429352 - DNA, 25 bp, Mus musculus
gaaatgctggctacaatcaccgacc

SEQ ID NO: 429353 - DNA, 25 bp, Mus musculus
gaaatgcttcgtgatccctcccatg

SEQ ID NO: 429354 - DNA, 25 bp, Mus musculus
gaaatgcttggaatttggacattgg

SEQ ID NO: 429355 - DNA, 25 bp, Mus musculus
gaaatggaacccagtttgggacagg

SEQ ID NO: 429356 - DNA, 25 bp, Mus musculus
gaaatggaacggagacgatggaccc

SEQ ID NO: 429357 - DNA, 25 bp, Mus musculus
gaaatggaagataaagtaactagtc

SEQ ID NO: 429358 - DNA, 25 bp, Mus musculus
gaaatggaatcttcgtcggaaccgt

SEQ ID NO: 429359 - DNA, 25 bp, Mus musculus
gaaatggaattgtgaggctgcaagc

SEQ ID NO: 429360 - DNA, 25 bp, Mus musculus
gaaatggacacagcaagtatctacc

SEQ ID NO: 429361 - DNA, 25 bp, Mus musculus
gaaatggacacagtgaacgtcttca

SEQ ID NO: 429362 - DNA, 25 bp, Mus musculus
gaaatggacagtgagtgggataatc

SEQ ID NO: 429363 - DNA, 25 bp, Mus musculus
gaaatggacctcaccatgaccgttg

SEQ ID NO: 429364 - DNA, 25 bp, Mus musculus
gaaatggacggagagatacagcaac

SEQ ID NO: 429365 - DNA, 25 bp, Mus musculus
gaaatggactccttggtgagaatgg

SEQ ID NO: 429366 - DNA, 25 bp, Mus musculus
gaaatggagagagtatttgtgctga

SEQ ID NO: 429367 - DNA, 25 bp, Mus musculus
gaaatggagccatcatctgtgcagt

SEQ ID NO: 429368 - DNA, 25 bp, Mus musculus
gaaatggatctactaccgcaacggc

SEQ ID NO: 429369 - DNA, 25 bp, Mus musculus
gaaatggatctcttcacccttgata

SEQ ID NO: 429370 - DNA, 25 bp, Mus musculus
gaaatggatgaccttcggccagaag

SEQ ID NO: 429371 - DNA, 25 bp, Mus musculus
gaaatggatttcaatactgtggaca

SEQ ID NO: 429372 - DNA, 25 bp, Mus musculus
gaaatggcaccaaaaccttctcggg

SEQ ID NO: 429373 - DNA, 25 bp, Mus musculus
gaaatggcagctggcttgtctgaca

SEQ ID NO: 429374 - DNA, 25 bp, Mus musculus
gaaatggcatcagctggagaacgtg

SEQ ID NO: 429375 - DNA, 25 bp, Mus musculus
gaaatggcatccctacctggaaccg

SEQ ID NO: 429376 - DNA, 25 bp, Mus musculus
gaaatggccctggtaccctatgagg

SEQ ID NO: 429377 - DNA, 25 bp, Mus musculus
gaaatggcgtcatccctgagaggct

SEQ ID NO: 429378 - DNA, 25 bp, Mus musculus
gaaatggcgtgagacagaggcactc

SEQ ID NO: 429379 - DNA, 25 bp, Mus musculus
gaaatggctcttaccactgcgagtg

SEQ ID NO: 429380 - DNA, 25 bp, Mus musculus
gaaatgggcggctctatcccgtcat

SEQ ID NO: 429381 - DNA, 25 bp, Mus musculus
gaaatgggctacaagtctcgaacag

SEQ ID NO: 429382 - DNA, 25 bp, Mus musculus
gaaatggtccatgggcactgggaaa

SEQ ID NO: 429383 - DNA, 25 bp, Mus musculus
gaaatggtccccaagtcctgagtgg

SEQ ID NO: 429384 - DNA, 25 bp, Mus musculus
gaaatggtccccatcactccagaga

SEQ ID NO: 429385 - DNA, 25 bp, Mus musculus
gaaatggtcttctctacaccccaag

SEQ ID NO: 429386 - DNA, 25 bp, Mus musculus
gaaatggtggccgttgtgacagaca

SEQ ID NO: 429387 - DNA, 25 bp, Mus musculus
gaaatggtgggtgtcagcactcctg

SEQ ID NO: 429388 - DNA, 25 bp, Mus musculus
gaaatggtttgccactggttggacc

SEQ ID NO: 429389 - DNA, 25 bp, Mus musculus
gaaatggttttagcgcctgcagcag

SEQ ID NO: 429390 - DNA, 25 bp, Mus musculus
gaaatgtaactttggttccaagagc

SEQ ID NO: 429391 - DNA, 25 bp, Mus musculus
gaaatgtacacgctaggaatcacca

SEQ ID NO: 429392 - DNA, 25 bp, Mus musculus
gaaatgtactagtgtggccagcctg

SEQ ID NO: 429393 - DNA, 25 bp, Mus musculus
gaaatgtaggcttctgtgcaccaca

SEQ ID NO: 429394 - DNA, 25 bp, Mus musculus
gaaatgtatcctgccacctagctgg

SEQ ID NO: 429395 - DNA, 25 bp, Mus musculus
gaaatgtatgtgacctgtgccaggg

SEQ ID NO: 429396 - DNA, 25 bp, Mus musculus
gaaatgtcacgtctcagcaaaccca

SEQ ID NO: 429397 - DNA, 25 bp, Mus musculus
gaaatgtcagacatcctcctggagc

SEQ ID NO: 429398 - DNA, 25 bp, Mus musculus
gaaatgtcagttaggacttccctta

SEQ ID NO: 429399 - DNA, 25 bp, Mus musculus
gaaatgtctatttgagctgcctgca

SEQ ID NO: 429400 - DNA, 25 bp, Mus musculus
gaaatgtctgaagcctgacctaagg

SEQ ID NO: 429401 - DNA, 25 bp, Mus musculus
gaaatgtctgttcatggcctgtgca

SEQ ID NO: 429402 - DNA, 25 bp, Mus musculus
gaaatgtgatcttggacttcctgct

SEQ ID NO: 429403 - DNA, 25 bp, Mus musculus
gaaatgtgatgatgtccctcggccc

SEQ ID NO: 429404 - DNA, 25 bp, Mus musculus
gaaatgtgcagaataaaagcacccc

SEQ ID NO: 429405 - DNA, 25 bp, Mus musculus
gaaatgtgcccaaatctacaagact

SEQ ID NO: 429406 - DNA, 25 bp, Mus musculus
gaaatgtgctcagtgccacacggtg

SEQ ID NO: 429407 - DNA, 25 bp, Mus musculus
gaaatgtgctgtcaccaaaagccgt

SEQ ID NO: 429408 - DNA, 25 bp, Mus musculus
gaaatgtggcagctgctattgcaga

SEQ ID NO: 429409 - DNA, 25 bp, Mus musculus
gaaatgtgggcccttgtttggataa

SEQ ID NO: 429410 - DNA, 25 bp, Mus musculus
gaaatgtgtcatccctatggcccag

SEQ ID NO: 429411 - DNA, 25 bp, Mus musculus
gaaatgtgtgcagacccctaggcac

SEQ ID NO: 429412 - DNA, 25 bp, Mus musculus
gaaatgtgttccctgagcacccgaa

SEQ ID NO: 429413 - DNA, 25 bp, Mus musculus
gaaatgtgttctcctcagatgcggc

SEQ ID NO: 429414 - DNA, 25 bp, Mus musculus
gaaatgttcagttgccctgtgtgcc

SEQ ID NO: 429415 - DNA, 25 bp, Mus musculus
gaaatgttcatcttgggcctgttgg

SEQ ID NO: 429416 - DNA, 25 bp, Mus musculus
gaaatgttcgcgtcagcgtggtgaa

SEQ ID NO: 429417 - DNA, 25 bp, Mus musculus
gaaatgttgcagattcccaaggctt

SEQ ID NO: 429418 - DNA, 25 bp, Mus musculus
gaaatgttgtcacggaatctgtgga

SEQ ID NO: 429419 - DNA, 25 bp, Mus musculus
gaaatgttgttttcatggttctcct

SEQ ID NO: 429420 - DNA, 25 bp, Mus musculus
gaaattaaaagcacactgggcgggc

SEQ ID NO: 429421 - DNA, 25 bp, Mus musculus
gaaattaaagctgcccgagaaaggg

SEQ ID NO: 429422 - DNA, 25 bp, Mus musculus
gaaattaaaggcacgggacatcact

SEQ ID NO: 429423 - DNA, 25 bp, Mus musculus
gaaattaaatgacctctgggcctca

SEQ ID NO: 429424 - DNA, 25 bp, Mus musculus
gaaattaagcgagagacagaaccca

SEQ ID NO: 429425 - DNA, 25 bp, Mus musculus
gaaattaatacacaagctgcaggag

SEQ ID NO: 429426 - DNA, 25 bp, Mus musculus
gaaattacctgacctagagacggtg

SEQ ID NO: 429427 - DNA, 25 bp, Mus musculus
gaaattacgtcaccaaagggtcagg

SEQ ID NO: 429428 - DNA, 25 bp, Mus musculus
gaaattacttaattcccgaggctga

SEQ ID NO: 429429 - DNA, 25 bp, Mus musculus
gaaattagcactcaccaaggacggt

SEQ ID NO: 429430 - DNA, 25 bp, Mus musculus
gaaattatccggcactacacagggc

SEQ ID NO: 429431 - DNA, 25 bp, Mus musculus
gaaattatctttgtgtcctctctgg

SEQ ID NO: 429432 - DNA, 25 bp, Mus musculus
gaaattattctgtgcgacacctgcc

SEQ ID NO: 429433 - DNA, 25 bp, Mus musculus
gaaattatttccaccgtctatcggg

SEQ ID NO: 429434 - DNA, 25 bp, Mus musculus
gaaattcaaccccaagagtagaggg

SEQ ID NO: 429435 - DNA, 25 bp, Mus musculus
gaaattcaagcacccaagtgctggg

SEQ ID NO: 429436 - DNA, 25 bp, Mus musculus
gaaattcaggcgcacatgctcacag

SEQ ID NO: 429437 - DNA, 25 bp, Mus musculus
gaaattcaggctggtactggatcct

SEQ ID NO: 429438 - DNA, 25 bp, Mus musculus
gaaattcatcacagagtgcggccat

SEQ ID NO: 429439 - DNA, 25 bp, Mus musculus
gaaattcatggaagcctaggtgggc

SEQ ID NO: 429440 - DNA, 25 bp, Mus musculus
gaaattcattgctcagaaaatggcc

SEQ ID NO: 429441 - DNA, 25 bp, Mus musculus
gaaattccaaccatcacagggtagc

SEQ ID NO: 429442 - DNA, 25 bp, Mus musculus
gaaattccacaggttttattcagat

SEQ ID NO: 429443 - DNA, 25 bp, Mus musculus
gaaattccaccctgtagatgggagg

SEQ ID NO: 429444 - DNA, 25 bp, Mus musculus
gaaattccagttgaagctacagggc

SEQ ID NO: 429445 - DNA, 25 bp, Mus musculus
gaaattccatcgctgaagagctgag

SEQ ID NO: 429446 - DNA, 25 bp, Mus musculus
gaaattccccttgataagggcctgc

SEQ ID NO: 429447 - DNA, 25 bp, Mus musculus
gaaattcccgatgctttggaaggca

SEQ ID NO: 429448 - DNA, 25 bp, Mus musculus
gaaattccgcaaggctgtgacagac

SEQ ID NO: 429449 - DNA, 25 bp, Mus musculus
gaaattccggctttcttgctcggag

SEQ ID NO: 429450 - DNA, 25 bp, Mus musculus
gaaattcctagagcataaagggcct

SEQ ID NO: 429451 - DNA, 25 bp, Mus musculus
gaaattcctcggctcactaagtagt

SEQ ID NO: 429452 - DNA, 25 bp, Mus musculus
gaaattcctgtagcgcaggctggcc

SEQ ID NO: 429453 - DNA, 25 bp, Mus musculus
gaaattcgacgatgaactggtagag

SEQ ID NO: 429454 - DNA, 25 bp, Mus musculus
gaaattcgccaagttgctagcattg

SEQ ID NO: 429455 - DNA, 25 bp, Mus musculus
gaaattcgctggtttcgggcccagg

SEQ ID NO: 429456 - DNA, 25 bp, Mus musculus
gaaattcggaggaatgaggcggctg

SEQ ID NO: 429457 - DNA, 25 bp, Mus musculus
gaaattctaaaacagcggaggctca

SEQ ID NO: 429458 - DNA, 25 bp, Mus musculus
gaaattctaatctccgggcacactg

SEQ ID NO: 429459 - DNA, 25 bp, Mus musculus
gaaattctcttgacccttctaaaag

SEQ ID NO: 429460 - DNA, 25 bp, Mus musculus
gaaattctgcctcaaatcaccactg

SEQ ID NO: 429461 - DNA, 25 bp, Mus musculus
gaaattctggtttccctggcctgaa

SEQ ID NO: 429462 - DNA, 25 bp, Mus musculus
gaaattcttcactcacggctgggcc

SEQ ID NO: 429463 - DNA, 25 bp, Mus musculus
gaaattgaacggcagcagtctcagg

SEQ ID NO: 429464 - DNA, 25 bp, Mus musculus
gaaattgaagcttcttgaccccagc

SEQ ID NO: 429465 - DNA, 25 bp, Mus musculus
gaaattgacctctatcagggcgcgg

SEQ ID NO: 429466 - DNA, 25 bp, Mus musculus
gaaattgagaatgcaacttgtcaca

SEQ ID NO: 429467 - DNA, 25 bp, Mus musculus
gaaattgaggagcaccacaccttgg

SEQ ID NO: 429468 - DNA, 25 bp, Mus musculus
gaaattgaggctcccacctatgtga

SEQ ID NO: 429469 - DNA, 25 bp, Mus musculus
gaaattgatggaaaatccctgctct

SEQ ID NO: 429470 - DNA, 25 bp, Mus musculus
gaaattgcaaaatggcccgagtcgc

SEQ ID NO: 429471 - DNA, 25 bp, Mus musculus
gaaattgcagcttgtcgggacagca

SEQ ID NO: 429472 - DNA, 25 bp, Mus musculus
gaaattgcccgacagaaaaacatga

SEQ ID NO: 429473 - DNA, 25 bp, Mus musculus
gaaattgcccgcttcctgtacaagg

SEQ ID NO: 429474 - DNA, 25 bp, Mus musculus
gaaattgccctccagaagtacacca

SEQ ID NO: 429475 - DNA, 25 bp, Mus musculus
gaaattgccgaggtcatccagctgg

SEQ ID NO: 429476 - DNA, 25 bp, Mus musculus
gaaattgctcgacttctaatggctg

SEQ ID NO: 429477 - DNA, 25 bp, Mus musculus
gaaattggacaaccaacggctcaag

SEQ ID NO: 429478 - DNA, 25 bp, Mus musculus
gaaattggactgtaagcctgaccag

SEQ ID NO: 429479 - DNA, 25 bp, Mus musculus
gaaattggatgcctagaatgccgca

SEQ ID NO: 429480 - DNA, 25 bp, Mus musculus
gaaattgggcaagaaaccatgactg

SEQ ID NO: 429481 - DNA, 25 bp, Mus musculus
gaaattggtggacagagcaaaatcc

SEQ ID NO: 429482 - DNA, 25 bp, Mus musculus
gaaattggtgtctcccctgaaggaa

SEQ ID NO: 429483 - DNA, 25 bp, Mus musculus
gaaattgtaggacaaggcccagcgc

SEQ ID NO: 429484 - DNA, 25 bp, Mus musculus
gaaattgtcacctatggccggatcc

SEQ ID NO: 429485 - DNA, 25 bp, Mus musculus
gaaattgtctcacctcaacgatggg

SEQ ID NO: 429486 - DNA, 25 bp, Mus musculus
gaaattgtgcataccctcctgagaa

SEQ ID NO: 429487 - DNA, 25 bp, Mus musculus
gaaattgttgcatgttgaattccaa

SEQ ID NO: 429488 - DNA, 25 bp, Mus musculus
gaaattgttgttcgccatgccaaga

SEQ ID NO: 429489 - DNA, 25 bp, Mus musculus
gaaattgtttgcttccagtggccca

SEQ ID NO: 429490 - DNA, 25 bp, Mus musculus
gaaatttacctgaagcgtccagccc

SEQ ID NO: 429491 - DNA, 25 bp, Mus musculus
gaaatttatcccacatttccatgga

SEQ ID NO: 429492 - DNA, 25 bp, Mus musculus
gaaatttcagagcttccaggaccac

SEQ ID NO: 429493 - DNA, 25 bp, Mus musculus
gaaatttcatcctaagtgctggcgt

SEQ ID NO: 429494 - DNA, 25 bp, Mus musculus
gaaatttctatagtacagcacctga

SEQ ID NO: 429495 - DNA, 25 bp, Mus musculus
gaaatttgagcaagctgccctgaag

SEQ ID NO: 429496 - DNA, 25 bp, Mus musculus
gaaatttgagtctcacaccgggaga

SEQ ID NO: 429497 - DNA, 25 bp, Mus musculus
gaaatttgatcaccattgcccatgg

SEQ ID NO: 429498 - DNA, 25 bp, Mus musculus
gaaatttgctatgcacctcccggag

SEQ ID NO: 429499 - DNA, 25 bp, Mus musculus
gaaatttggaaaccactggccgagg

SEQ ID NO: 429500 - DNA, 25 bp, Mus musculus
gaaatttgtgataagaaagacacac

SEQ ID NO: 429501 - DNA, 25 bp, Mus musculus
gaaattttaagaactcagcgcagct

SEQ ID NO: 429502 - DNA, 25 bp, Mus musculus
gaaattttccgtagcgacgacattg

SEQ ID NO: 429503 - DNA, 25 bp, Mus musculus
gaaattttcctagggcctctgggct

SEQ ID NO: 429504 - DNA, 25 bp, Mus musculus
gaaattttgaaatgctaagccctta

SEQ ID NO: 429505 - DNA, 25 bp, Mus musculus
gaaattttgtcacaggtgttgatgc

SEQ ID NO: 429506 - DNA, 25 bp, Mus musculus
gaacaaaaatgtccttatgccagag

SEQ ID NO: 429507 - DNA, 25 bp, Mus musculus
gaacaaaaatttaagcgctgcccgc

SEQ ID NO: 429508 - DNA, 25 bp, Mus musculus
gaacaaaacaaggaagccgaggagg

SEQ ID NO: 429509 - DNA, 25 bp, Mus musculus
gaacaaaacaccttccaaaccatct

SEQ ID NO: 429510 - DNA, 25 bp, Mus musculus
gaacaaaacctttcgggtggctgtg

SEQ ID NO: 429511 - DNA, 25 bp, Mus musculus
gaacaaaagatgagccttaccggcc

SEQ ID NO: 429512 - DNA, 25 bp, Mus musculus
gaacaaaatcggtgtgaagctttcc

SEQ ID NO: 429513 - DNA, 25 bp, Mus musculus
gaacaaaccgtctgataaggccacc

SEQ ID NO: 429514 - DNA, 25 bp, Mus musculus
gaacaaacgtgaatgagccagcctc

SEQ ID NO: 429515 - DNA, 25 bp, Mus musculus
gaacaaacgtttctactgaggccgg

SEQ ID NO: 429516 - DNA, 25 bp, Mus musculus
gaacaaactttctccaagcactgaa

SEQ ID NO: 429517 - DNA, 25 bp, Mus musculus
gaacaaacttttggcgacgaggagg

SEQ ID NO: 429518 - DNA, 25 bp, Mus musculus
gaacaaagcacactcaaactcacgg

SEQ ID NO: 429519 - DNA, 25 bp, Mus musculus
gaacaaagcatgtgtactcaaagca

SEQ ID NO: 429520 - DNA, 25 bp, Mus musculus
gaacaaagcctttctgaggccatgg

SEQ ID NO: 429521 - DNA, 25 bp, Mus musculus
gaacaaagtgatcggctccagaaac

SEQ ID NO: 429522 - DNA, 25 bp, Mus musculus
gaacaaataaagagatcctcctcct

SEQ ID NO: 429523 - DNA, 25 bp, Mus musculus
gaacaaatactgtcctatggcccgc

SEQ ID NO: 429524 - DNA, 25 bp, Mus musculus
gaacaaatagtcttaaccctctatg

SEQ ID NO: 429525 - DNA, 25 bp, Mus musculus
gaacaaatccccaaaggtgcagcag

SEQ ID NO: 429526 - DNA, 25 bp, Mus musculus
gaacaaatgaggaggcgatacaccc

SEQ ID NO: 429527 - DNA, 25 bp, Mus musculus
gaacaaatgtcctgactctgacgaa

SEQ ID NO: 429528 - DNA, 25 bp, Mus musculus
gaacaaattggcctaacactggaaa

SEQ ID NO: 429529 - DNA, 25 bp, Mus musculus
gaacaacacttcatggtgggacaca

SEQ ID NO: 429530 - DNA, 25 bp, Mus musculus
gaacaacagcaaactctagggacag

SEQ ID NO: 429531 - DNA, 25 bp, Mus musculus
gaacaacagtcctctctactctttg

SEQ ID NO: 429532 - DNA, 25 bp, Mus musculus
gaacaacatcacatctcttctccag

SEQ ID NO: 429533 - DNA, 25 bp, Mus musculus
gaacaacatgcgtgggaagtgcact

SEQ ID NO: 429534 - DNA, 25 bp, Mus musculus
gaacaacatgctctcgctggctgga

SEQ ID NO: 429535 - DNA, 25 bp, Mus musculus
gaacaaccattttcagctgagagca

SEQ ID NO: 429536 - DNA, 25 bp, Mus musculus
gaacaaccgtgtagtgagcaatctg

SEQ ID NO: 429537 - DNA, 25 bp, Mus musculus
gaacaacctggctgagatctatggc

SEQ ID NO: 429538 - DNA, 25 bp, Mus musculus
gaacaacgaagcctaccctggtgct

SEQ ID NO: 429539 - DNA, 25 bp, Mus musculus
gaacaacgcattctactcctatgag

SEQ ID NO: 429540 - DNA, 25 bp, Mus musculus
gaacaacgtgaagccctgagagagc

SEQ ID NO: 429541 - DNA, 25 bp, Mus musculus
gaacaacgtgaccacgatcgtgaga

SEQ ID NO: 429542 - DNA, 25 bp, Mus musculus
gaacaacgttcctttaatgtacgag

SEQ ID NO: 429543 - DNA, 25 bp, Mus musculus
gaacaactattttacagagcacagg

SEQ ID NO: 429544 - DNA, 25 bp, Mus musculus
gaacaactggattagcagaggcacc

SEQ ID NO: 429545 - DNA, 25 bp, Mus musculus
gaacaactgtagctctagtcaactg

SEQ ID NO: 429546 - DNA, 25 bp, Mus musculus
gaacaagactccgtagaggtgaccc

SEQ ID NO: 429547 - DNA, 25 bp, Mus musculus
gaacaagactttgggccgaaggcca

SEQ ID NO: 429548 - DNA, 25 bp, Mus musculus
gaacaagatagagaaaagcccaccg

SEQ ID NO: 429549 - DNA, 25 bp, Mus musculus
gaacaagcctctggttgataaggaa

SEQ ID NO: 429550 - DNA, 25 bp, Mus musculus
gaacaagcctgaatggtacccatgg

SEQ ID NO: 429551 - DNA, 25 bp, Mus musculus
gaacaagccttttccgacctgatgg

SEQ ID NO: 429552 - DNA, 25 bp, Mus musculus
gaacaagctggctgatcatctggcc

SEQ ID NO: 429553 - DNA, 25 bp, Mus musculus
gaacaaggacattgccccaagatgg

SEQ ID NO: 429554 - DNA, 25 bp, Mus musculus
gaacaaggacttgtcttcaaaatag

SEQ ID NO: 429555 - DNA, 25 bp, Mus musculus
gaacaaggagaaggcttttcccagg

SEQ ID NO: 429556 - DNA, 25 bp, Mus musculus
gaacaaggagtttctcttctctcct

SEQ ID NO: 429557 - DNA, 25 bp, Mus musculus
gaacaaggcagcttctggtctcttg

SEQ ID NO: 429558 - DNA, 25 bp, Mus musculus
gaacaagggcactaagtcggaacca

SEQ ID NO: 429559 - DNA, 25 bp, Mus musculus
gaacaagggctcctggtcaaagacc

SEQ ID NO: 429560 - DNA, 25 bp, Mus musculus
gaacaagggtttcctttggcacagt

SEQ ID NO: 429561 - DNA, 25 bp, Mus musculus
gaacaaggtcaggagtgagtcctcc

SEQ ID NO: 429562 - DNA, 25 bp, Mus musculus
gaacaaggttcatagcgtaggacca

SEQ ID NO: 429563 - DNA, 25 bp, Mus musculus
gaacaaggttttgagccatggagca

SEQ ID NO: 429564 - DNA, 25 bp, Mus musculus
gaacaagtcattaagggaattctcc

SEQ ID NO: 429565 - DNA, 25 bp, Mus musculus
gaacaagtctaaattcagagatgcg

SEQ ID NO: 429566 - DNA, 25 bp, Mus musculus
gaacaagtctgcagtgaacctcatg

SEQ ID NO: 429567 - DNA, 25 bp, Mus musculus
gaacaagtgcttcttcgtggacgag

SEQ ID NO: 429568 - DNA, 25 bp, Mus musculus
gaacaagtgtcactgggcccatctg

SEQ ID NO: 429569 - DNA, 25 bp, Mus musculus
gaacaagtgtctggtgaacggcaac

SEQ ID NO: 429570 - DNA, 25 bp, Mus musculus
gaacaagtgtgagagagcctatcca

SEQ ID NO: 429571 - DNA, 25 bp, Mus musculus
gaacaagttattttcagactccaaa

SEQ ID NO: 429572 - DNA, 25 bp, Mus musculus
gaacaagttgggacagcccagtttg

SEQ ID NO: 429573 - DNA, 25 bp, Mus musculus
gaacaagttgtcctttagcctcggt

SEQ ID NO: 429574 - DNA, 25 bp, Mus musculus
gaacaataaaccctggacttggctg

SEQ ID NO: 429575 - DNA, 25 bp, Mus musculus
gaacaataccctagagagaagtcat

SEQ ID NO: 429576 - DNA, 25 bp, Mus musculus
gaacaatagggtgtgagcagctcct

SEQ ID NO: 429577 - DNA, 25 bp, Mus musculus
gaacaatatagcaactgagacggag

SEQ ID NO: 429578 - DNA, 25 bp, Mus musculus
gaacaatcgcctgttgatggcagct

SEQ ID NO: 429579 - DNA, 25 bp, Mus musculus
gaacaatcttttgtggtttcttggg

SEQ ID NO: 429580 - DNA, 25 bp, Mus musculus
gaacaatgacctgactctcctgaag

SEQ ID NO: 429581 - DNA, 25 bp, Mus musculus
gaacaatgaccttctgtaccgggac

SEQ ID NO: 429582 - DNA, 25 bp, Mus musculus
gaacaatgactcaagtgcccaggag

SEQ ID NO: 429583 - DNA, 25 bp, Mus musculus
gaacaatgccacagagcactcgctg

SEQ ID NO: 429584 - DNA, 25 bp, Mus musculus
gaacaattacgtgttgcttctgagg

SEQ ID NO: 429585 - DNA, 25 bp, Mus musculus
gaacaattggttctctgccgtctgg

SEQ ID NO: 429586 - DNA, 25 bp, Mus musculus
gaacaattgtctgctccgtactcta

SEQ ID NO: 429587 - DNA, 25 bp, Mus musculus
gaacaatttaaagacagcaggctaa

SEQ ID NO: 429588 - DNA, 25 bp, Mus musculus
gaacacaaaaacagatgccgtggtg

SEQ ID NO: 429589 - DNA, 25 bp, Mus musculus
gaacacaactgtcctcaactctaag

SEQ ID NO: 429590 - DNA, 25 bp, Mus musculus
gaacacaacttcgtctacaggcctg

SEQ ID NO: 429591 - DNA, 25 bp, Mus musculus
gaacacaagcagagcttccctgagg

SEQ ID NO: 429592 - DNA, 25 bp, Mus musculus
gaacacaagcctaccgtttcttcag

SEQ ID NO: 429593 - DNA, 25 bp, Mus musculus
gaacacaagtgtccagcctatgcca

SEQ ID NO: 429594 - DNA, 25 bp, Mus musculus
gaacacaatggctacccttctgaag

SEQ ID NO: 429595 - DNA, 25 bp, Mus musculus
gaacacactgcactcaagggcaagt

SEQ ID NO: 429596 - DNA, 25 bp, Mus musculus
gaacacacttagtcctgggagcact

SEQ ID NO: 429597 - DNA, 25 bp, Mus musculus
gaacacacttgtgcacagtcttggg

SEQ ID NO: 429598 - DNA, 25 bp, Mus musculus
gaacacagatggaagtcggatgcat

SEQ ID NO: 429599 - DNA, 25 bp, Mus musculus
gaacacagattcacaaacgtcacgg

SEQ ID NO: 429600 - DNA, 25 bp, Mus musculus
gaacacagcgcttcttaaccacggt

SEQ ID NO: 429601 - DNA, 25 bp, Mus musculus
gaacacagcgggattctggctagtc

SEQ ID NO: 429602 - DNA, 25 bp, Mus musculus
gaacacagctcctgcaccttggact

SEQ ID NO: 429603 - DNA, 25 bp, Mus musculus
gaacacagtccggaatattacggcc

SEQ ID NO: 429604 - DNA, 25 bp, Mus musculus
gaacacagtgtacagagaagctcct

SEQ ID NO: 429605 - DNA, 25 bp, Mus musculus
gaacacagtgtatagtagttaccgg

SEQ ID NO: 429606 - DNA, 25 bp, Mus musculus
gaacacatactccttcccaagagcg

SEQ ID NO: 429607 - DNA, 25 bp, Mus musculus
gaacacatgaaggttccccgtcgtg

SEQ ID NO: 429608 - DNA, 25 bp, Mus musculus
gaacacatgactatttccctgggtg

SEQ ID NO: 429609 - DNA, 25 bp, Mus musculus
gaacaccacacatttgtaacaagag

SEQ ID NO: 429610 - DNA, 25 bp, Mus musculus
gaacaccactctcagtttgtagcag

SEQ ID NO: 429611 - DNA, 25 bp, Mus musculus
gaacaccagactgataagagtgcag

SEQ ID NO: 429612 - DNA, 25 bp, Mus musculus
gaacaccagagcttgtacacctgga

SEQ ID NO: 429613 - DNA, 25 bp, Mus musculus
gaacaccatcttactgggtctggga

SEQ ID NO: 429614 - DNA, 25 bp, Mus musculus
gaacacccaggttaatgcccgatga

SEQ ID NO: 429615 - DNA, 25 bp, Mus musculus
gaacaccctagctgaaagggctctg

SEQ ID NO: 429616 - DNA, 25 bp, Mus musculus
gaacaccgaaactgaagcagtccca

SEQ ID NO: 429617 - DNA, 25 bp, Mus musculus
gaacaccggatgtagttgctctcac

SEQ ID NO: 429618 - DNA, 25 bp, Mus musculus
gaacaccggcataaggagcacaaga

SEQ ID NO: 429619 - DNA, 25 bp, Mus musculus
gaacacctccaagcatttgtcagag

SEQ ID NO: 429620 - DNA, 25 bp, Mus musculus
gaacacctcctcgagtacagatgtg

SEQ ID NO: 429621 - DNA, 25 bp, Mus musculus
gaacacctgaaagaccctgatgcat

SEQ ID NO: 429622 - DNA, 25 bp, Mus musculus
gaacacctgcaagaaaatagccctg

SEQ ID NO: 429623 - DNA, 25 bp, Mus musculus
gaacacctggtttagagccaaatgg

SEQ ID NO: 429624 - DNA, 25 bp, Mus musculus
gaacacctgttgaatgctagccact

SEQ ID NO: 429625 - DNA, 25 bp, Mus musculus
gaacacctgttttatgatctctcaa

SEQ ID NO: 429626 - DNA, 25 bp, Mus musculus
gaacacctttgaccgctttgtggca

SEQ ID NO: 429627 - DNA, 25 bp, Mus musculus
gaacacgagaggaggaagcatcttc

SEQ ID NO: 429628 - DNA, 25 bp, Mus musculus
gaacacgatgtaagtctgcccctga

SEQ ID NO: 429629 - DNA, 25 bp, Mus musculus
gaacacgattctatcctggccgaaa

SEQ ID NO: 429630 - DNA, 25 bp, Mus musculus
gaacacgcagcttcttagcccatgg

SEQ ID NO: 429631 - DNA, 25 bp, Mus musculus
gaacacgcgtgagctaaatagcgac

SEQ ID NO: 429632 - DNA, 25 bp, Mus musculus
gaacacgctccgagtgaacgaagca

SEQ ID NO: 429633 - DNA, 25 bp, Mus musculus
gaacacgctgtgatagatgcagaca

SEQ ID NO: 429634 - DNA, 25 bp, Mus musculus
gaacacggatttggctgaccctgga

SEQ ID NO: 429635 - DNA, 25 bp, Mus musculus
gaacacgggtgtataattagcttac

SEQ ID NO: 429636 - DNA, 25 bp, Mus musculus
gaacacggtgtatgctgctctcgct

SEQ ID NO: 429637 - DNA, 25 bp, Mus musculus
gaacacgtgaaatgaaaccagcctg

SEQ ID NO: 429638 - DNA, 25 bp, Mus musculus
gaacacgtggaagaagacaagcagc

SEQ ID NO: 429639 - DNA, 25 bp, Mus musculus
gaacacgttgtatcctaattggtag

SEQ ID NO: 429640 - DNA, 25 bp, Mus musculus
gaacactaaagcaggcctgtgatct

SEQ ID NO: 429641 - DNA, 25 bp, Mus musculus
gaacactactgtgtctgggcaccag

SEQ ID NO: 429642 - DNA, 25 bp, Mus musculus
gaacactcctttgccaacagctgtg

SEQ ID NO: 429643 - DNA, 25 bp, Mus musculus
gaacactcgaccgtggtgggcaaga

SEQ ID NO: 429644 - DNA, 25 bp, Mus musculus
gaacactcggtgtgaaattaacgtg

SEQ ID NO: 429645 - DNA, 25 bp, Mus musculus
gaacactctaatgctgccatccgga

SEQ ID NO: 429646 - DNA, 25 bp, Mus musculus
gaacactctgtgcatggtcccatta

SEQ ID NO: 429647 - DNA, 25 bp, Mus musculus
gaacactgagaacgaaacaggccct

SEQ ID NO: 429648 - DNA, 25 bp, Mus musculus
gaacactgaggagttccgtgaccag

SEQ ID NO: 429649 - DNA, 25 bp, Mus musculus
gaacactgcacgagaagatcctgga

SEQ ID NO: 429650 - DNA, 25 bp, Mus musculus
gaacactggcaaagaccaacttagg

SEQ ID NO: 429651 - DNA, 25 bp, Mus musculus
gaacactgggatatggctgacaaac

SEQ ID NO: 429652 - DNA, 25 bp, Mus musculus
gaacactgtaggcatcccattctga

SEQ ID NO: 429653 - DNA, 25 bp, Mus musculus
gaacactgtcgtagtttctttcctg

SEQ ID NO: 429654 - DNA, 25 bp, Mus musculus
gaacacttccccaatgagtttactt

SEQ ID NO: 429655 - DNA, 25 bp, Mus musculus
gaacacttggtgttgcagggaccag

SEQ ID NO: 429656 - DNA, 25 bp, Mus musculus
gaacacttgtgggtaactggctctc

SEQ ID NO: 429657 - DNA, 25 bp, Mus musculus
gaacactttacctgttgggccgcct

SEQ ID NO: 429658 - DNA, 25 bp, Mus musculus
gaacactttccctgtgagaggtcgt

SEQ ID NO: 429659 - DNA, 25 bp, Mus musculus
gaacagaaatccgacctgcagtagg

SEQ ID NO: 429660 - DNA, 25 bp, Mus musculus
gaacagaacctgtgtgtgatatcca

SEQ ID NO: 429661 - DNA, 25 bp, Mus musculus
gaacagaactgcactctgagagcct

SEQ ID NO: 429662 - DNA, 25 bp, Mus musculus
gaacagaacttgagaccttgtcaca

SEQ ID NO: 429663 - DNA, 25 bp, Mus musculus
gaacagaagacacgtgccacttaag

SEQ ID NO: 429664 - DNA, 25 bp, Mus musculus
gaacagaagcccaacagggtcttca

SEQ ID NO: 429665 - DNA, 25 bp, Mus musculus
gaacagaattaaggcgctcactcag

SEQ ID NO: 429666 - DNA, 25 bp, Mus musculus
gaacagactacgagacaggcttcca

SEQ ID NO: 429667 - DNA, 25 bp, Mus musculus
gaacagactcattcggatgaactga

SEQ ID NO: 429668 - DNA, 25 bp, Mus musculus
gaacagactggttgctcagaaataa

SEQ ID NO: 429669 - DNA, 25 bp, Mus musculus
gaacagacttcttgtactcccacaa

SEQ ID NO: 429670 - DNA, 25 bp, Mus musculus
gaacagaggtgcttccactgggaca

SEQ ID NO: 429671 - DNA, 25 bp, Mus musculus
gaacagagtatgaggttttccccag

SEQ ID NO: 429672 - DNA, 25 bp, Mus musculus
gaacagagtcatagaaactgctcct

SEQ ID NO: 429673 - DNA, 25 bp, Mus musculus
gaacagagtctgatactgcagcacg

SEQ ID NO: 429674 - DNA, 25 bp, Mus musculus
gaacagatccagcttctgtgtaaga

SEQ ID NO: 429675 - DNA, 25 bp, Mus musculus
gaacagatcgacagcagcatgtacc

SEQ ID NO: 429676 - DNA, 25 bp, Mus musculus
gaacagatctttaggagagagtgca

SEQ ID NO: 429677 - DNA, 25 bp, Mus musculus
gaacagatggtatccagatgcctta

SEQ ID NO: 429678 - DNA, 25 bp, Mus musculus
gaacagattacgctggagcctgagc

SEQ ID NO: 429679 - DNA, 25 bp, Mus musculus
gaacagattcttcgccttgccaacg

SEQ ID NO: 429680 - DNA, 25 bp, Mus musculus
gaacagattgatccctccacgtcag

SEQ ID NO: 429681 - DNA, 25 bp, Mus musculus
gaacagcaagcagtctgaaggccag

SEQ ID NO: 429682 - DNA, 25 bp, Mus musculus
gaacagcaagtgttacccaacccag

SEQ ID NO: 429683 - DNA, 25 bp, Mus musculus
gaacagcaccttggacatcaccgtg

SEQ ID NO: 429684 - DNA, 25 bp, Mus musculus
gaacagcactgtttgacttggccca

SEQ ID NO: 429685 - DNA, 25 bp, Mus musculus
gaacagcagccgagaagataaacat

SEQ ID NO: 429686 - DNA, 25 bp, Mus musculus
gaacagcagcgctactgaggacggt

SEQ ID NO: 429687 - DNA, 25 bp, Mus musculus
gaacagcaggttcggctcatctacc

SEQ ID NO: 429688 - DNA, 25 bp, Mus musculus
gaacagcatggcttggtttccgctc

SEQ ID NO: 429689 - DNA, 25 bp, Mus musculus
gaacagcccactctactgagcatgg

SEQ ID NO: 429690 - DNA, 25 bp, Mus musculus
gaacagccccacagtttgcatcacg

SEQ ID NO: 429691 - DNA, 25 bp, Mus musculus
gaacagccctatttattcacgagac

SEQ ID NO: 429692 - DNA, 25 bp, Mus musculus
gaacagccctgaaacttttgactag

SEQ ID NO: 429693 - DNA, 25 bp, Mus musculus
gaacagcctgccctggtatcctggt

SEQ ID NO: 429694 - DNA, 25 bp, Mus musculus
gaacagcctggagtgaaggctcata

SEQ ID NO: 429695 - DNA, 25 bp, Mus musculus
gaacagccttgtcccagactcagag

SEQ ID NO: 429696 - DNA, 25 bp, Mus musculus
gaacagcgaaaactacggccttagg

SEQ ID NO: 429697 - DNA, 25 bp, Mus musculus
gaacagcgactcgaaagggtaccct

SEQ ID NO: 429698 - DNA, 25 bp, Mus musculus
gaacagcgagggatacttgtacacc

SEQ ID NO: 429699 - DNA, 25 bp, Mus musculus
gaacagcggctaccatttttgtgga

SEQ ID NO: 429700 - DNA, 25 bp, Mus musculus
gaacagcggcttcattctcggcagt

SEQ ID NO: 429701 - DNA, 25 bp, Mus musculus
gaacagctaaccatgatcagggcca

SEQ ID NO: 429702 - DNA, 25 bp, Mus musculus
gaacagctcacccactgggcagttg

SEQ ID NO: 429703 - DNA, 25 bp, Mus musculus
gaacagctctagagtaagtgctggt

SEQ ID NO: 429704 - DNA, 25 bp, Mus musculus
gaacagctgaactcaagtgtactct

SEQ ID NO: 429705 - DNA, 25 bp, Mus musculus
gaacagctgtgcacttcggaaaact

SEQ ID NO: 429706 - DNA, 25 bp, Mus musculus
gaacagcttcgagcaaagagaccag

SEQ ID NO: 429707 - DNA, 25 bp, Mus musculus
gaacaggaagaggacgagaaaaata

SEQ ID NO: 429708 - DNA, 25 bp, Mus musculus
gaacaggacccaggatgacatgcat

SEQ ID NO: 429709 - DNA, 25 bp, Mus musculus
gaacaggacgacatcctccccggtg

SEQ ID NO: 429710 - DNA, 25 bp, Mus musculus
gaacaggaggctggcagtgtccaaa

SEQ ID NO: 429711 - DNA, 25 bp, Mus musculus
gaacaggagtacatatcggccacca

SEQ ID NO: 429712 - DNA, 25 bp, Mus musculus
gaacaggagtccttgtcaacctcac

SEQ ID NO: 429713 - DNA, 25 bp, Mus musculus
gaacaggatcccaaatgcatgcagt

SEQ ID NO: 429714 - DNA, 25 bp, Mus musculus
gaacaggattttccaggcatgagga

SEQ ID NO: 429715 - DNA, 25 bp, Mus musculus
gaacaggcagccatggttcctcagg

SEQ ID NO: 429716 - DNA, 25 bp, Mus musculus
gaacaggcatttagtgacaacccac

SEQ ID NO: 429717 - DNA, 25 bp, Mus musculus
gaacaggccatttgcgaagacacac

SEQ ID NO: 429718 - DNA, 25 bp, Mus musculus
gaacaggctgcaacatcgtcatgga

SEQ ID NO: 429719 - DNA, 25 bp, Mus musculus
gaacagggaatacaaatggctcgtc

SEQ ID NO: 429720 - DNA, 25 bp, Mus musculus
gaacagggctactcgcaaaggcgat

SEQ ID NO: 429721 - DNA, 25 bp, Mus musculus
gaacagggctttccttgtgggacac

SEQ ID NO: 429722 - DNA, 25 bp, Mus musculus
gaacaggtaacgaatgggcctggca

SEQ ID NO: 429723 - DNA, 25 bp, Mus musculus
gaacaggtcattttcatacagtgac

SEQ ID NO: 429724 - DNA, 25 bp, Mus musculus
gaacaggttctgaaactccccaggc

SEQ ID NO: 429725 - DNA, 25 bp, Mus musculus
gaacagtaacctagccagctggaga

SEQ ID NO: 429726 - DNA, 25 bp, Mus musculus
gaacagtaactggatcgtgggcgcc

SEQ ID NO: 429727 - DNA, 25 bp, Mus musculus
gaacagtacaccagtagagctatct

SEQ ID NO: 429728 - DNA, 25 bp, Mus musculus
gaacagtacaggcaagaggaccaga

SEQ ID NO: 429729 - DNA, 25 bp, Mus musculus
gaacagtacctttccagattcgaag

SEQ ID NO: 429730 - DNA, 25 bp, Mus musculus
gaacagtacgctggcagaggtgcac

SEQ ID NO: 429731 - DNA, 25 bp, Mus musculus
gaacagtcaccatccggaatatcag

SEQ ID NO: 429732 - DNA, 25 bp, Mus musculus
gaacagtcacgcctccaccaggaga

SEQ ID NO: 429733 - DNA, 25 bp, Mus musculus
gaacagtcatgctaccagtttgctt

SEQ ID NO: 429734 - DNA, 25 bp, Mus musculus
gaacagtccgttatgcaagccttgg

SEQ ID NO: 429735 - DNA, 25 bp, Mus musculus
gaacagtgagctgttgcattccagc

SEQ ID NO: 429736 - DNA, 25 bp, Mus musculus
gaacagtgatttaaaggcccttgga

SEQ ID NO: 429737 - DNA, 25 bp, Mus musculus
gaacagtgccacataccagcttagt

SEQ ID NO: 429738 - DNA, 25 bp, Mus musculus
gaacagtgccaccagagcatccttg

SEQ ID NO: 429739 - DNA, 25 bp, Mus musculus
gaacagtgcttgcactcactgtgca

SEQ ID NO: 429740 - DNA, 25 bp, Mus musculus
gaacagttagacgtagccctctgcc

SEQ ID NO: 429741 - DNA, 25 bp, Mus musculus
gaacagttagtgagctgcttcccca

SEQ ID NO: 429742 - DNA, 25 bp, Mus musculus
gaacagttcaagatcaaacgcccgg

SEQ ID NO: 429743 - DNA, 25 bp, Mus musculus
gaacagttcccagttgtccataagg

SEQ ID NO: 429744 - DNA, 25 bp, Mus musculus
gaacagttctccaaagtggccgctt

SEQ ID NO: 429745 - DNA, 25 bp, Mus musculus
gaacagtttacatcgggcactggcc

SEQ ID NO: 429746 - DNA, 25 bp, Mus musculus
gaacagtttgagtgcccaggtggct

SEQ ID NO: 429747 - DNA, 25 bp, Mus musculus
gaacataactgtgaagccgcagctg

SEQ ID NO: 429748 - DNA, 25 bp, Mus musculus
gaacataatctgtgaggccactcag

SEQ ID NO: 429749 - DNA, 25 bp, Mus musculus
gaacatagacgttgctgagaacctc

SEQ ID NO: 429750 - DNA, 25 bp, Mus musculus
gaacatagagacaattcagagccag

SEQ ID NO: 429751 - DNA, 25 bp, Mus musculus
gaacatagccatgggacttctaggg

SEQ ID NO: 429752 - DNA, 25 bp, Mus musculus
gaacatagcggaaagaagtgaccac

SEQ ID NO: 429753 - DNA, 25 bp, Mus musculus
gaacatatacctggtgcagatccgt

SEQ ID NO: 429754 - DNA, 25 bp, Mus musculus
gaacatattaggtcccaaaccaagg

SEQ ID NO: 429755 - DNA, 25 bp, Mus musculus
gaacatattagttttgcttactact

SEQ ID NO: 429756 - DNA, 25 bp, Mus musculus
gaacatcaagaacaaaccgcgggtg

SEQ ID NO: 429757 - DNA, 25 bp, Mus musculus
gaacatcaagggtgaccacacaggg

SEQ ID NO: 429758 - DNA, 25 bp, Mus musculus
gaacatcacagcatggagacaggca

SEQ ID NO: 429759 - DNA, 25 bp, Mus musculus
gaacatcaggatctcattcggaacg

SEQ ID NO: 429760 - DNA, 25 bp, Mus musculus
gaacatcaggcacattgggctctca

SEQ ID NO: 429761 - DNA, 25 bp, Mus musculus
gaacatcagtcagtctaatctttcc

SEQ ID NO: 429762 - DNA, 25 bp, Mus musculus
gaacatcatccacaagacttcgggc

SEQ ID NO: 429763 - DNA, 25 bp, Mus musculus
gaacatcatcgctagggagtacaag

SEQ ID NO: 429764 - DNA, 25 bp, Mus musculus
gaacatcatggagctctacctcggg

SEQ ID NO: 429765 - DNA, 25 bp, Mus musculus
gaacatcatgggttcttggcctcag

SEQ ID NO: 429766 - DNA, 25 bp, Mus musculus
gaacatccaattgtacccggaggtg

SEQ ID NO: 429767 - DNA, 25 bp, Mus musculus
gaacatcccatttcgcattggcaac

SEQ ID NO: 429768 - DNA, 25 bp, Mus musculus
gaacatccgagagcaaggtcgcttc

SEQ ID NO: 429769 - DNA, 25 bp, Mus musculus
gaacatcctcggtttcatcgcagct

SEQ ID NO: 429770 - DNA, 25 bp, Mus musculus
gaacatcctctctaaggtagacagg

SEQ ID NO: 429771 - DNA, 25 bp, Mus musculus
gaacatcctgtgttggttatatttg

SEQ ID NO: 429772 - DNA, 25 bp, Mus musculus
gaacatcctttgctcttatgagcta

SEQ ID NO: 429773 - DNA, 25 bp, Mus musculus
gaacatcggttctgcattactgctg

SEQ ID NO: 429774 - DNA, 25 bp, Mus musculus
gaacatcggttggtactcaaaagca

SEQ ID NO: 429775 - DNA, 25 bp, Mus musculus
gaacatctccggtggacttgccagg

SEQ ID NO: 429776 - DNA, 25 bp, Mus musculus
gaacatctctgtgtccattgggaag

SEQ ID NO: 429777 - DNA, 25 bp, Mus musculus
gaacatctgcatggtcccgaagaaa

SEQ ID NO: 429778 - DNA, 25 bp, Mus musculus
gaacatctgccatggagaatctgaa

SEQ ID NO: 429779 - DNA, 25 bp, Mus musculus
gaacatctgcctctccattctggac

SEQ ID NO: 429780 - DNA, 25 bp, Mus musculus
gaacatctggacagcagcaccttaa

SEQ ID NO: 429781 - DNA, 25 bp, Mus musculus
gaacatctggatcgtgaagcccgga

SEQ ID NO: 429782 - DNA, 25 bp, Mus musculus
gaacatctttatcaagacaattgca

SEQ ID NO: 429783 - DNA, 25 bp, Mus musculus
gaacatgaacagagaactgggccta

SEQ ID NO: 429784 - DNA, 25 bp, Mus musculus
gaacatgaattgcttctagctaaaa

SEQ ID NO: 429785 - DNA, 25 bp, Mus musculus
gaacatgaccttgatgcagctattg

SEQ ID NO: 429786 - DNA, 25 bp, Mus musculus
gaacatgacttatggaacctctcct

SEQ ID NO: 429787 - DNA, 25 bp, Mus musculus
gaacatgatcaagaaggccgggtga

SEQ ID NO: 429788 - DNA, 25 bp, Mus musculus
gaacatgcaagccatccttgatgca

SEQ ID NO: 429789 - DNA, 25 bp, Mus musculus
gaacatgcagccacgtattaccagg

SEQ ID NO: 429790 - DNA, 25 bp, Mus musculus
gaacatgctccgttacaactgcgtg

SEQ ID NO: 429791 - DNA, 25 bp, Mus musculus
gaacatgctgtactatctggtcctg

SEQ ID NO: 429792 - DNA, 25 bp, Mus musculus
gaacatggccatttcatgtagccaa

SEQ ID NO: 429793 - DNA, 25 bp, Mus musculus
gaacatggcgcagcccagtattaac

SEQ ID NO: 429794 - DNA, 25 bp, Mus musculus
gaacatgggtgaaaagggattcttg

SEQ ID NO: 429795 - DNA, 25 bp, Mus musculus
gaacatggtctccaagcaaagagat

SEQ ID NO: 429796 - DNA, 25 bp, Mus musculus
gaacatgtagcaacactgggcctga

SEQ ID NO: 429797 - DNA, 25 bp, Mus musculus
gaacatgtctcacgtgaaggctggc

SEQ ID NO: 429798 - DNA, 25 bp, Mus musculus
gaacatgtggatgcgattgccctca

SEQ ID NO: 429799 - DNA, 25 bp, Mus musculus
gaacatgttagttgcactgccctga

SEQ ID NO: 429800 - DNA, 25 bp, Mus musculus
gaacattaacctgcggctcttcctg

SEQ ID NO: 429801 - DNA, 25 bp, Mus musculus
gaacattaagactatactcagccag

SEQ ID NO: 429802 - DNA, 25 bp, Mus musculus
gaacattaccaaatctcttcacgcc

SEQ ID NO: 429803 - DNA, 25 bp, Mus musculus
gaacattagcaatgcttctgcttgg

SEQ ID NO: 429804 - DNA, 25 bp, Mus musculus
gaacattcaagaagcgatgacgtca

SEQ ID NO: 429805 - DNA, 25 bp, Mus musculus
gaacattcatctcgaaacttccaaa

SEQ ID NO: 429806 - DNA, 25 bp, Mus musculus
gaacattcattgaactcttcagagc

SEQ ID NO: 429807 - DNA, 25 bp, Mus musculus
gaacattccaggcacccttctggta

SEQ ID NO: 429808 - DNA, 25 bp, Mus musculus
gaacattgacttagcgtccgttagg

SEQ ID NO: 429809 - DNA, 25 bp, Mus musculus
gaacattgcggtttgggatctgcac

SEQ ID NO: 429810 - DNA, 25 bp, Mus musculus
gaacattggactttgacattcaaga

SEQ ID NO: 429811 - DNA, 25 bp, Mus musculus
gaacattggtgttcgcagctgtttt

SEQ ID NO: 429812 - DNA, 25 bp, Mus musculus
gaacattgtggcatccgatcaccgg

SEQ ID NO: 429813 - DNA, 25 bp, Mus musculus
gaacatttatccctgtggctggctg

SEQ ID NO: 429814 - DNA, 25 bp, Mus musculus
gaacatttggcaacctgcagctgaa

SEQ ID NO: 429815 - DNA, 25 bp, Mus musculus
gaacattttaagtgcccagccctaa

SEQ ID NO: 429816 - DNA, 25 bp, Mus musculus
gaacattttccaggggagactgcca

SEQ ID NO: 429817 - DNA, 25 bp, Mus musculus
gaaccaaaacgctatgaggagccac

SEQ ID NO: 429818 - DNA, 25 bp, Mus musculus
gaaccaaagttcgaagatgcctcag

SEQ ID NO: 429819 - DNA, 25 bp, Mus musculus
gaaccaaagttgttttcagctaata

SEQ ID NO: 429820 - DNA, 25 bp, Mus musculus
gaaccaaatgcctatggaaacacac

SEQ ID NO: 429821 - DNA, 25 bp, Mus musculus
gaaccaacgagtttccgtacagtga

SEQ ID NO: 429822 - DNA, 25 bp, Mus musculus
gaaccaacttagaagctattttctg

SEQ ID NO: 429823 - DNA, 25 bp, Mus musculus
gaaccaagacaggagtgggctaccc

SEQ ID NO: 429824 - DNA, 25 bp, Mus musculus
gaaccaagagagtccagtcatttct

SEQ ID NO: 429825 - DNA, 25 bp, Mus musculus
gaaccaagagctagtcagggtcctt

SEQ ID NO: 429826 - DNA, 25 bp, Mus musculus
gaaccaagagtgttccaagtgcccc

SEQ ID NO: 429827 - DNA, 25 bp, Mus musculus
gaaccaagcccgtgatgagaagaag

SEQ ID NO: 429828 - DNA, 25 bp, Mus musculus
gaaccaagttagatgtttatcagta

SEQ ID NO: 429829 - DNA, 25 bp, Mus musculus
gaaccaagttttccacatgtggcgc

SEQ ID NO: 429830 - DNA, 25 bp, Mus musculus
gaaccaatcttacctacagggactg

SEQ ID NO: 429831 - DNA, 25 bp, Mus musculus
gaaccaatgctgcataggccaggct

SEQ ID NO: 429832 - DNA, 25 bp, Mus musculus
gaaccaatggcagctgtcggccgat

SEQ ID NO: 429833 - DNA, 25 bp, Mus musculus
gaaccaatgggtgaactggactcca

SEQ ID NO: 429834 - DNA, 25 bp, Mus musculus
gaaccacagcttcaagtgaactcag

SEQ ID NO: 429835 - DNA, 25 bp, Mus musculus
gaaccacaggttggcatggctcttc

SEQ ID NO: 429836 - DNA, 25 bp, Mus musculus
gaaccacatgaatgggccagccaag

SEQ ID NO: 429837 - DNA, 25 bp, Mus musculus
gaaccacatggtcactctagccagg

SEQ ID NO: 429838 - DNA, 25 bp, Mus musculus
gaaccactatctgaggaaaggcaaa

SEQ ID NO: 429839 - DNA, 25 bp, Mus musculus
gaaccactcatcagctgttgggcca

SEQ ID NO: 429840 - DNA, 25 bp, Mus musculus
gaaccactctctcggatctgtagga

SEQ ID NO: 429841 - DNA, 25 bp, Mus musculus
gaaccactgataaccaagagaggct

SEQ ID NO: 429842 - DNA, 25 bp, Mus musculus
gaaccactggcttaggacactaaaa

SEQ ID NO: 429843 - DNA, 25 bp, Mus musculus
gaaccactgtgcaggcccaagcgaa

SEQ ID NO: 429844 - DNA, 25 bp, Mus musculus
gaaccacttgaaagcaggagtctga

SEQ ID NO: 429845 - DNA, 25 bp, Mus musculus
gaaccactttggacgggagtacaga

SEQ ID NO: 429846 - DNA, 25 bp, Mus musculus
gaaccactttgggagagactttgcc

SEQ ID NO: 429847 - DNA, 25 bp, Mus musculus
gaaccagaaaatcctgtggccaagg

SEQ ID NO: 429848 - DNA, 25 bp, Mus musculus
gaaccagaagaaacccttgagcccg

SEQ ID NO: 429849 - DNA, 25 bp, Mus musculus
gaaccagaatctgcaagttattacc

SEQ ID NO: 429850 - DNA, 25 bp, Mus musculus
gaaccagacatacgatgagcgtcta

SEQ ID NO: 429851 - DNA, 25 bp, Mus musculus
gaaccagagggtaaagccggcgtct

SEQ ID NO: 429852 - DNA, 25 bp, Mus musculus
gaaccagagtacaatccctgtggaa

SEQ ID NO: 429853 - DNA, 25 bp, Mus musculus
gaaccagatctggaagcgcatccgg

SEQ ID NO: 429854 - DNA, 25 bp, Mus musculus
gaaccagcagattgagagctccaga

SEQ ID NO: 429855 - DNA, 25 bp, Mus musculus
gaaccagcagttcaggatccttggg

SEQ ID NO: 429856 - DNA, 25 bp, Mus musculus
gaaccagcctgcaagttggacaaag

SEQ ID NO: 429857 - DNA, 25 bp, Mus musculus
gaaccagcgccgattctccatggag

SEQ ID NO: 429858 - DNA, 25 bp, Mus musculus
gaaccagcgggttttacaggcctgc

SEQ ID NO: 429859 - DNA, 25 bp, Mus musculus
gaaccagctgtgttggccaaaggca

SEQ ID NO: 429860 - DNA, 25 bp, Mus musculus
gaaccagctttccaggacgatgcag

SEQ ID NO: 429861 - DNA, 25 bp, Mus musculus
gaaccaggaggaatagacatcacac

SEQ ID NO: 429862 - DNA, 25 bp, Mus musculus
gaaccaggcaagaatcaggaggact

SEQ ID NO: 429863 - DNA, 25 bp, Mus musculus
gaaccaggctcaaatgtccaggaag

SEQ ID NO: 429864 - DNA, 25 bp, Mus musculus
gaaccagggtcggagacctccgatg

SEQ ID NO: 429865 - DNA, 25 bp, Mus musculus
gaaccaggtagcagatcttcgtcca

SEQ ID NO: 429866 - DNA, 25 bp, Mus musculus
gaaccaggtctgaggtggaatcgct

SEQ ID NO: 429867 - DNA, 25 bp, Mus musculus
gaaccaggtggcaagacaacagtct

SEQ ID NO: 429868 - DNA, 25 bp, Mus musculus
gaaccagtactccacggcatttggg

SEQ ID NO: 429869 - DNA, 25 bp, Mus musculus
gaaccagtatttcacgtttcttgtc

SEQ ID NO: 429870 - DNA, 25 bp, Mus musculus
gaaccagtggtcagtatccaggcct

SEQ ID NO: 429871 - DNA, 25 bp, Mus musculus
gaaccagtgtagagttgacgtgccc

SEQ ID NO: 429872 - DNA, 25 bp, Mus musculus
gaaccagtgtccaagtatttccgtg

SEQ ID NO: 429873 - DNA, 25 bp, Mus musculus
gaaccagtgttatccaaggagcagc

SEQ ID NO: 429874 - DNA, 25 bp, Mus musculus
gaaccagttagccttgacaaacaca

SEQ ID NO: 429875 - DNA, 25 bp, Mus musculus
gaaccagttgccgaaaggatcagcc

SEQ ID NO: 429876 - DNA, 25 bp, Mus musculus
gaaccataccgacttttggccggcg

SEQ ID NO: 429877 - DNA, 25 bp, Mus musculus
gaaccatattagtgtgatctgccag

SEQ ID NO: 429878 - DNA, 25 bp, Mus musculus
gaaccatccccgagactgtgaagag

SEQ ID NO: 429879 - DNA, 25 bp, Mus musculus
gaaccatcgtgccaattcagcggag

SEQ ID NO: 429880 - DNA, 25 bp, Mus musculus
gaaccatcgtggaagacctctgcat

SEQ ID NO: 429881 - DNA, 25 bp, Mus musculus
gaaccatctggttttgggtccacat

SEQ ID NO: 429882 - DNA, 25 bp, Mus musculus
gaaccatgacttctgctgaggtgaa

SEQ ID NO: 429883 - DNA, 25 bp, Mus musculus
gaaccatgacttgaagccccacgat

SEQ ID NO: 429884 - DNA, 25 bp, Mus musculus
gaaccatggctgacgtttacccggc

SEQ ID NO: 429885 - DNA, 25 bp, Mus musculus
gaaccatgttgtagacctttacggc

SEQ ID NO: 429886 - DNA, 25 bp, Mus musculus
gaaccatgttgtgttggccagccct

SEQ ID NO: 429887 - DNA, 25 bp, Mus musculus
gaaccattcactcataggcagcaca

SEQ ID NO: 429888 - DNA, 25 bp, Mus musculus
gaaccattgactgaagcggaagcta

SEQ ID NO: 429889 - DNA, 25 bp, Mus musculus
gaaccattgaggttgtccctgggaa

SEQ ID NO: 429890 - DNA, 25 bp, Mus musculus
gaaccatttgtaaccctggacctcg

SEQ ID NO: 429891 - DNA, 25 bp, Mus musculus
gaacccaaaggagaatctcagacct

SEQ ID NO: 429892 - DNA, 25 bp, Mus musculus
gaacccaactgattaagcaggcagg

SEQ ID NO: 429893 - DNA, 25 bp, Mus musculus
gaacccaaggcctgttctcaaccta

SEQ ID NO: 429894 - DNA, 25 bp, Mus musculus
gaacccaagtgtgtgtctcctctga

SEQ ID NO: 429895 - DNA, 25 bp, Mus musculus
gaacccacacatgttttcggaagga

SEQ ID NO: 429896 - DNA, 25 bp, Mus musculus
gaacccacagtgcaagagaaaccct

SEQ ID NO: 429897 - DNA, 25 bp, Mus musculus
gaacccactgggaaaatgaagaact

SEQ ID NO: 429898 - DNA, 25 bp, Mus musculus
gaacccactgtgcttagagcctcat

SEQ ID NO: 429899 - DNA, 25 bp, Mus musculus
gaacccagccggctctgagtgttct

SEQ ID NO: 429900 - DNA, 25 bp, Mus musculus
gaacccagccttcagtgggcgcaag

SEQ ID NO: 429901 - DNA, 25 bp, Mus musculus
gaacccagcggtcttgactgttttg

SEQ ID NO: 429902 - DNA, 25 bp, Mus musculus
gaacccaggatttacgcagctaaaa

SEQ ID NO: 429903 - DNA, 25 bp, Mus musculus
gaacccagtgtccagcaagaattgc

SEQ ID NO: 429904 - DNA, 25 bp, Mus musculus
gaacccatcaggtatttaagatcat

SEQ ID NO: 429905 - DNA, 25 bp, Mus musculus
gaacccatggccttagtgtgactct

SEQ ID NO: 429906 - DNA, 25 bp, Mus musculus
gaacccatgtgctcagttgctaggc

SEQ ID NO: 429907 - DNA, 25 bp, Mus musculus
gaaccccaagctggtgattcactgg

SEQ ID NO: 429908 - DNA, 25 bp, Mus musculus
gaaccccataatctacacctttagg

SEQ ID NO: 429909 - DNA, 25 bp, Mus musculus
gaaccccatatccttctcatcttga

SEQ ID NO: 429910 - DNA, 25 bp, Mus musculus
gaaccccatttctgctgagtctgag

SEQ ID NO: 429911 - DNA, 25 bp, Mus musculus
gaaccccgctttgtacagaacctgg

SEQ ID NO: 429912 - DNA, 25 bp, Mus musculus
gaaccccggtggtttgctcactatg

SEQ ID NO: 429913 - DNA, 25 bp, Mus musculus
gaacccctggccttgaggtgtcacg

SEQ ID NO: 429914 - DNA, 25 bp, Mus musculus
gaacccctggtcatggataacctgg

SEQ ID NO: 429915 - DNA, 25 bp, Mus musculus
gaaccccttgaatgtgatacgcagg

SEQ ID NO: 429916 - DNA, 25 bp, Mus musculus
gaaccccttttcagcctagtcagtg

SEQ ID NO: 429917 - DNA, 25 bp, Mus musculus
gaacccgacgcaggcttcagtggct

SEQ ID NO: 429918 - DNA, 25 bp, Mus musculus
gaacccgaggatctgtgtcaaggcc

SEQ ID NO: 429919 - DNA, 25 bp, Mus musculus
gaacccgcgcgatgaagagagcgtt

SEQ ID NO: 429920 - DNA, 25 bp, Mus musculus
gaacccgcgctagtgtgctagtgcg

SEQ ID NO: 429921 - DNA, 25 bp, Mus musculus
gaacccgtgcagtatgacgagcagg

SEQ ID NO: 429922 - DNA, 25 bp, Mus musculus
gaacccgtgccattagatgagcctg

SEQ ID NO: 429923 - DNA, 25 bp, Mus musculus
gaaccctagtacttgggaccctgag

SEQ ID NO: 429924 - DNA, 25 bp, Mus musculus
gaaccctagtagaaaatgtgaccct

SEQ ID NO: 429925 - DNA, 25 bp, Mus musculus
gaaccctatgttgggtgaccaagta

SEQ ID NO: 429926 - DNA, 25 bp, Mus musculus
gaaccctcaggtgaggaacagccca

SEQ ID NO: 429927 - DNA, 25 bp, Mus musculus
gaaccctcggtgtgaactgaacata

SEQ ID NO: 429928 - DNA, 25 bp, Mus musculus
gaaccctgaagattagacccttagg

SEQ ID NO: 429929 - DNA, 25 bp, Mus musculus
gaaccctgagcacccatcgtgtaga

SEQ ID NO: 429930 - DNA, 25 bp, Mus musculus
gaaccctgagtgctaccagaggtga

SEQ ID NO: 429931 - DNA, 25 bp, Mus musculus
gaaccctgatcctatgcactgtagt

SEQ ID NO: 429932 - DNA, 25 bp, Mus musculus
gaaccctgctgtacagtgctgctgg

SEQ ID NO: 429933 - DNA, 25 bp, Mus musculus
gaaccctggcagctgactgcttgct

SEQ ID NO: 429934 - DNA, 25 bp, Mus musculus
gaaccctgtaacaccgtgaagccag

SEQ ID NO: 429935 - DNA, 25 bp, Mus musculus
gaaccctgtaatgtgacttgctatg

SEQ ID NO: 429936 - DNA, 25 bp, Mus musculus
gaaccctgttagtgatctcctggca

SEQ ID NO: 429937 - DNA, 25 bp, Mus musculus
gaacccttcgtacacttgctgacca

SEQ ID NO: 429938 - DNA, 25 bp, Mus musculus
gaacccttctgtcaacaccaagatc

SEQ ID NO: 429939 - DNA, 25 bp, Mus musculus
gaacccttcttgacctacgtggaag

SEQ ID NO: 429940 - DNA, 25 bp, Mus musculus
gaacccttgccttttctggtggaag

SEQ ID NO: 429941 - DNA, 25 bp, Mus musculus
gaacccttgcgcgatggacgcgtct

SEQ ID NO: 429942 - DNA, 25 bp, Mus musculus
gaacccttgtgcctcattgggagca

SEQ ID NO: 429943 - DNA, 25 bp, Mus musculus
gaacccttgtttgttggcagctgaa

SEQ ID NO: 429944 - DNA, 25 bp, Mus musculus
gaaccctttaagtgcggcctgtgcg

SEQ ID NO: 429945 - DNA, 25 bp, Mus musculus
gaaccctttcgagtcttcacagcaa

SEQ ID NO: 429946 - DNA, 25 bp, Mus musculus
gaaccctttgtgacggcagaagcca

SEQ ID NO: 429947 - DNA, 25 bp, Mus musculus
gaaccctttgtggagcatgtctgca

SEQ ID NO: 429948 - DNA, 25 bp, Mus musculus
gaaccgaagcagcaagggtcagcta

SEQ ID NO: 429949 - DNA, 25 bp, Mus musculus
gaaccgaatgaagcacctgggactg

SEQ ID NO: 429950 - DNA, 25 bp, Mus musculus
gaaccgagcacacctacaatgcagg

SEQ ID NO: 429951 - DNA, 25 bp, Mus musculus
gaaccgagccttgatcctgacctta

SEQ ID NO: 429952 - DNA, 25 bp, Mus musculus
gaaccgagcgagacaaatggagctg

SEQ ID NO: 429953 - DNA, 25 bp, Mus musculus
gaaccgagtgtatgtcattttcgac

SEQ ID NO: 429954 - DNA, 25 bp, Mus musculus
gaaccgatcgagtttacgcccagct

SEQ ID NO: 429955 - DNA, 25 bp, Mus musculus
gaaccgatgaaactgaagcccgata

SEQ ID NO: 429956 - DNA, 25 bp, Mus musculus
gaaccgcaatgatgagaaatgccac

SEQ ID NO: 429957 - DNA, 25 bp, Mus musculus
gaaccgcatgttcaccgaagagaga

SEQ ID NO: 429958 - DNA, 25 bp, Mus musculus
gaaccgccgatcttgtgacaccgga

SEQ ID NO: 429959 - DNA, 25 bp, Mus musculus
gaaccgccgttgactgaagcatcac

SEQ ID NO: 429960 - DNA, 25 bp, Mus musculus
gaaccgcctgctctactggctcagt

SEQ ID NO: 429961 - DNA, 25 bp, Mus musculus
gaaccgccttcaccatttattttat

SEQ ID NO: 429962 - DNA, 25 bp, Mus musculus
gaaccgcgaccatggaaagaccttg

SEQ ID NO: 429963 - DNA, 25 bp, Mus musculus
gaaccgcgccgaaagctggaaactt

SEQ ID NO: 429964 - DNA, 25 bp, Mus musculus
gaaccgcgtgctcatgtccaacatg

SEQ ID NO: 429965 - DNA, 25 bp, Mus musculus
gaaccgctacattgtcctggccaag

SEQ ID NO: 429966 - DNA, 25 bp, Mus musculus
gaaccgctctgatctctggagtgaa

SEQ ID NO: 429967 - DNA, 25 bp, Mus musculus
gaaccgctgttgtgaccatacctgc

SEQ ID NO: 429968 - DNA, 25 bp, Mus musculus
gaaccgcttcaatgggctctgcaaa

SEQ ID NO: 429969 - DNA, 25 bp, Mus musculus
gaaccggagattccgaagggcatcc

SEQ ID NO: 429970 - DNA, 25 bp, Mus musculus
gaaccggcaggaattgtgactcgtg

SEQ ID NO: 429971 - DNA, 25 bp, Mus musculus
gaaccggcagtgtaaatgtccaggg

SEQ ID NO: 429972 - DNA, 25 bp, Mus musculus
gaaccggccagcttttccacgatgg

SEQ ID NO: 429973 - DNA, 25 bp, Mus musculus
gaaccgggactttttcacaagcatg

SEQ ID NO: 429974 - DNA, 25 bp, Mus musculus
gaaccgggcccagaatgtgtcaatc

SEQ ID NO: 429975 - DNA, 25 bp, Mus musculus
gaaccggtcgtggaagtacaatcag

SEQ ID NO: 429976 - DNA, 25 bp, Mus musculus
gaaccgtcagaacaagcatccatgg

SEQ ID NO: 429977 - DNA, 25 bp, Mus musculus
gaaccgtccagagtgtgctatagtg

SEQ ID NO: 429978 - DNA, 25 bp, Mus musculus
gaaccgtcctgctctctagctctga

SEQ ID NO: 429979 - DNA, 25 bp, Mus musculus
gaaccgtctcgtagcttgaggtctg

SEQ ID NO: 429980 - DNA, 25 bp, Mus musculus
gaaccgtgagaaacacatgtgacca

SEQ ID NO: 429981 - DNA, 25 bp, Mus musculus
gaaccgtgaggtactttaatgctga

SEQ ID NO: 429982 - DNA, 25 bp, Mus musculus
gaaccgtgagtttggatccagccaa

SEQ ID NO: 429983 - DNA, 25 bp, Mus musculus
gaaccgtggtacatagctgtgggct

SEQ ID NO: 429984 - DNA, 25 bp, Mus musculus
gaaccgtgtaaagtatggccctgac

SEQ ID NO: 429985 - DNA, 25 bp, Mus musculus
gaaccgttcggtacattaaagatga

SEQ ID NO: 429986 - DNA, 25 bp, Mus musculus
gaacctaagactgcaaaagcgtgga

SEQ ID NO: 429987 - DNA, 25 bp, Mus musculus
gaacctaagacttcagcataatgtc

SEQ ID NO: 429988 - DNA, 25 bp, Mus musculus
gaacctaagctgagcaaagcagcct

SEQ ID NO: 429989 - DNA, 25 bp, Mus musculus
gaacctaatttactcctctgtgaaa

SEQ ID NO: 429990 - DNA, 25 bp, Mus musculus
gaacctacactttgatagggctgga

SEQ ID NO: 429991 - DNA, 25 bp, Mus musculus
gaacctacagatacggagtgtcccg

SEQ ID NO: 429992 - DNA, 25 bp, Mus musculus
gaacctacggagaagctctgcaaga

SEQ ID NO: 429993 - DNA, 25 bp, Mus musculus
gaacctacggaggacgtgcttccga

SEQ ID NO: 429994 - DNA, 25 bp, Mus musculus
gaacctacttcatcacaggtgcaga

SEQ ID NO: 429995 - DNA, 25 bp, Mus musculus
gaacctacttccgtcacattttgtg

SEQ ID NO: 429996 - DNA, 25 bp, Mus musculus
gaacctacttcctgtgcttatccta

SEQ ID NO: 429997 - DNA, 25 bp, Mus musculus
gaacctagctggtctccttcagagg

SEQ ID NO: 429998 - DNA, 25 bp, Mus musculus
gaacctagtctatacagagcatggg

SEQ ID NO: 429999 - DNA, 25 bp, Mus musculus
gaacctatgttgatcgccactgcca

SEQ ID NO: 430000 - DNA, 25 bp, Mus musculus
gaacctcaaacgtcatatgctgcga

SEQ ID NO: 430001 - DNA, 25 bp, Mus musculus
gaacctcagctagcatcagcaatgg

SEQ ID NO: 430002 - DNA, 25 bp, Mus musculus
gaacctcagctgacgctgctcagtg

SEQ ID NO: 430003 - DNA, 25 bp, Mus musculus
gaacctcagtcaacaagtttggaaa

SEQ ID NO: 430004 - DNA, 25 bp, Mus musculus
gaacctccaagaagacaaccgtgtg

SEQ ID NO: 430005 - DNA, 25 bp, Mus musculus
gaacctccatcgcagagcaagagta

SEQ ID NO: 430006 - DNA, 25 bp, Mus musculus
gaacctccggctgcaatggagctgt

SEQ ID NO: 430007 - DNA, 25 bp, Mus musculus
gaacctcctgttaggcaaaggcaca

SEQ ID NO: 430008 - DNA, 25 bp, Mus musculus
gaacctcgggattctatccaaagcc

SEQ ID NO: 430009 - DNA, 25 bp, Mus musculus
gaacctcgtaaggacttttctcctg

SEQ ID NO: 430010 - DNA, 25 bp, Mus musculus
gaacctctaccaggctctgatcagg

SEQ ID NO: 430011 - DNA, 25 bp, Mus musculus
gaacctctgctagtctgagaattgg

SEQ ID NO: 430012 - DNA, 25 bp, Mus musculus
gaacctctggaacatcgggaccagc

SEQ ID NO: 430013 - DNA, 25 bp, Mus musculus
gaacctctttcagcagtatgaccgg

SEQ ID NO: 430014 - DNA, 25 bp, Mus musculus
gaacctgacatcaacaataggctgg

SEQ ID NO: 430015 - DNA, 25 bp, Mus musculus
gaacctgacggaggactcaaaccat

SEQ ID NO: 430016 - DNA, 25 bp, Mus musculus
gaacctgagtatattccagaccctg

SEQ ID NO: 430017 - DNA, 25 bp, Mus musculus
gaacctgatcaagtcaaagtgcgcg

SEQ ID NO: 430018 - DNA, 25 bp, Mus musculus
gaacctgcacaactccaaatggatg

SEQ ID NO: 430019 - DNA, 25 bp, Mus musculus
gaacctgcaggaagataaagtcatg

SEQ ID NO: 430020 - DNA, 25 bp, Mus musculus
gaacctgcctgacttaatgaaataa

SEQ ID NO: 430021 - DNA, 25 bp, Mus musculus
gaacctgcctgctggtgtggactgt

SEQ ID NO: 430022 - DNA, 25 bp, Mus musculus
gaacctgcctgtaagcaaacctgag

SEQ ID NO: 430023 - DNA, 25 bp, Mus musculus
gaacctgcgcgaaactcatgaagct

SEQ ID NO: 430024 - DNA, 25 bp, Mus musculus
gaacctgcgtgttcagaggcgctga

SEQ ID NO: 430025 - DNA, 25 bp, Mus musculus
gaacctgcttatccgcacgctggaa

SEQ ID NO: 430026 - DNA, 25 bp, Mus musculus
gaacctgcttgcactatgctgtgaa

SEQ ID NO: 430027 - DNA, 25 bp, Mus musculus
gaacctggaattgcacgctgtgccg

SEQ ID NO: 430028 - DNA, 25 bp, Mus musculus
gaacctggacacaaaggattctgtc

SEQ ID NO: 430029 - DNA, 25 bp, Mus musculus
gaacctggacagaccccaggaactt

SEQ ID NO: 430030 - DNA, 25 bp, Mus musculus
gaacctggcagaagcattgctgacc

SEQ ID NO: 430031 - DNA, 25 bp, Mus musculus
gaacctggcctacgagaatgtcaag

SEQ ID NO: 430032 - DNA, 25 bp, Mus musculus
gaacctggctacatgaatgcctcag

SEQ ID NO: 430033 - DNA, 25 bp, Mus musculus
gaacctggctcacgtgaaaatggaa

SEQ ID NO: 430034 - DNA, 25 bp, Mus musculus
gaacctggctgcaagcaagtccctt

SEQ ID NO: 430035 - DNA, 25 bp, Mus musculus
gaacctggctgctgtatttgccatg

SEQ ID NO: 430036 - DNA, 25 bp, Mus musculus
gaacctggtgaatctgacgtggacg

SEQ ID NO: 430037 - DNA, 25 bp, Mus musculus
gaacctgtccgagtgaaatgtgccc

SEQ ID NO: 430038 - DNA, 25 bp, Mus musculus
gaacctgtctctggcttggctctat

SEQ ID NO: 430039 - DNA, 25 bp, Mus musculus
gaacctgtctggtgacctgctgcaa

SEQ ID NO: 430040 - DNA, 25 bp, Mus musculus
gaacctgtctgtcagcaaagggaag

SEQ ID NO: 430041 - DNA, 25 bp, Mus musculus
gaacctgtgtgtgatatccatgcag

SEQ ID NO: 430042 - DNA, 25 bp, Mus musculus
gaaccttacactgcagagctctcgt

SEQ ID NO: 430043 - DNA, 25 bp, Mus musculus
gaaccttatgaaaacgatggcgaga

SEQ ID NO: 430044 - DNA, 25 bp, Mus musculus
gaaccttcaactcgaggaacctctt

SEQ ID NO: 430045 - DNA, 25 bp, Mus musculus
gaaccttcaagtgcaaatctccagc

SEQ ID NO: 430046 - DNA, 25 bp, Mus musculus
gaaccttcagcggaaacatgcggca

SEQ ID NO: 430047 - DNA, 25 bp, Mus musculus
gaaccttcaggattgagacccggaa

SEQ ID NO: 430048 - DNA, 25 bp, Mus musculus
gaaccttcccaaaatgcatggtgac

SEQ ID NO: 430049 - DNA, 25 bp, Mus musculus
gaaccttcctatggatccgggtgca

SEQ ID NO: 430050 - DNA, 25 bp, Mus musculus
gaaccttccttcttgtgcgacctgg

SEQ ID NO: 430051 - DNA, 25 bp, Mus musculus
gaaccttcgcatgacagttttgtgg

SEQ ID NO: 430052 - DNA, 25 bp, Mus musculus
gaaccttcgggaagaccaggtgctt

SEQ ID NO: 430053 - DNA, 25 bp, Mus musculus
gaaccttcgtgggtacagcagcttg

SEQ ID NO: 430054 - DNA, 25 bp, Mus musculus
gaaccttctggactaatgatgatgc

SEQ ID NO: 430055 - DNA, 25 bp, Mus musculus
gaaccttctggtcatctgtacctgg

SEQ ID NO: 430056 - DNA, 25 bp, Mus musculus
gaaccttgaagctcgtggtagcccc

SEQ ID NO: 430057 - DNA, 25 bp, Mus musculus
gaaccttgactcttatgctggcatg

SEQ ID NO: 430058 - DNA, 25 bp, Mus musculus
gaaccttgaggctgtgaagggccat

SEQ ID NO: 430059 - DNA, 25 bp, Mus musculus
gaaccttggaatctctgaggcacat

SEQ ID NO: 430060 - DNA, 25 bp, Mus musculus
gaaccttggctagggccagttacgc

SEQ ID NO: 430061 - DNA, 25 bp, Mus musculus
gaaccttggtttgcacactcaggag

SEQ ID NO: 430062 - DNA, 25 bp, Mus musculus
gaaccttgtcattcttaccggcgaa

SEQ ID NO: 430063 - DNA, 25 bp, Mus musculus
gaaccttgtcctataaatgcctgtg

SEQ ID NO: 430064 - DNA, 25 bp, Mus musculus
gaaccttgtctgaacggaacactgg

SEQ ID NO: 430065 - DNA, 25 bp, Mus musculus
gaaccttgttctttaggactgtgca

SEQ ID NO: 430066 - DNA, 25 bp, Mus musculus
gaacctttagggatcatggagtaca

SEQ ID NO: 430067 - DNA, 25 bp, Mus musculus
gaacctttctgaccacgctgactgg

SEQ ID NO: 430068 - DNA, 25 bp, Mus musculus
gaacctttgaaacacatcgttcgag

SEQ ID NO: 430069 - DNA, 25 bp, Mus musculus
gaacctttgggtacaacagcagctg

SEQ ID NO: 430070 - DNA, 25 bp, Mus musculus
gaacctttttgccatggccgtggaa

SEQ ID NO: 430071 - DNA, 25 bp, Mus musculus
gaacctttttgggactggcagtgag

SEQ ID NO: 430072 - DNA, 25 bp, Mus musculus
gaacgaaaagactgtgcaaggccta

SEQ ID NO: 430073 - DNA, 25 bp, Mus musculus
gaacgaaaggagcttctagacacct

SEQ ID NO: 430074 - DNA, 25 bp, Mus musculus
gaacgaagagctggcctacctaaag

SEQ ID NO: 430075 - DNA, 25 bp, Mus musculus
gaacgaagccaagaaggtcctgagc

SEQ ID NO: 430076 - DNA, 25 bp, Mus musculus
gaacgaagctcactcctgaaggagg

SEQ ID NO: 430077 - DNA, 25 bp, Mus musculus
gaacgaagtcctggtatcactcaaa

SEQ ID NO: 430078 - DNA, 25 bp, Mus musculus
gaacgaattctgttttgactgaagc

SEQ ID NO: 430079 - DNA, 25 bp, Mus musculus
gaacgaattgatcacccatgagcag

SEQ ID NO: 430080 - DNA, 25 bp, Mus musculus
gaacgacacaggtttcagctgcgac

SEQ ID NO: 430081 - DNA, 25 bp, Mus musculus
gaacgacagccatcttgtaccaggt

SEQ ID NO: 430082 - DNA, 25 bp, Mus musculus
gaacgaccggacaaatctgaagaga

SEQ ID NO: 430083 - DNA, 25 bp, Mus musculus
gaacgacgggtctttcatttccaag

SEQ ID NO: 430084 - DNA, 25 bp, Mus musculus
gaacgactcccacctttaggagaag

SEQ ID NO: 430085 - DNA, 25 bp, Mus musculus
gaacgacttgctaggtcagtgggca

SEQ ID NO: 430086 - DNA, 25 bp, Mus musculus
gaacgacttgggttttcacggctcg

SEQ ID NO: 430087 - DNA, 25 bp, Mus musculus
gaacgagagcatctataaagtttgc

SEQ ID NO: 430088 - DNA, 25 bp, Mus musculus
gaacgagattcccttcacctatgag

SEQ ID NO: 430089 - DNA, 25 bp, Mus musculus
gaacgagcactgtaaggtccagacc

SEQ ID NO: 430090 - DNA, 25 bp, Mus musculus
gaacgagcccttcaaaatcccagag

SEQ ID NO: 430091 - DNA, 25 bp, Mus musculus
gaacgagcctctgaggtaagcccca

SEQ ID NO: 430092 - DNA, 25 bp, Mus musculus
gaacgagctaaaacgaccgcggatc

SEQ ID NO: 430093 - DNA, 25 bp, Mus musculus
gaacgagtacatcagcagcatggca

SEQ ID NO: 430094 - DNA, 25 bp, Mus musculus
gaacgagtcagaagagcaccgatct

SEQ ID NO: 430095 - DNA, 25 bp, Mus musculus
gaacgagtgcgtccagtaagtgcca

SEQ ID NO: 430096 - DNA, 25 bp, Mus musculus
gaacgagtgctttgccgccaagtct

SEQ ID NO: 430097 - DNA, 25 bp, Mus musculus
gaacgagttcctttaactgctgagc

SEQ ID NO: 430098 - DNA, 25 bp, Mus musculus
gaacgagttgtatagcagctccacc

SEQ ID NO: 430099 - DNA, 25 bp, Mus musculus
gaacgagtttctcaagacgctgaac

SEQ ID NO: 430100 - DNA, 25 bp, Mus musculus
gaacgatacccagcaaggacaagtg

SEQ ID NO: 430101 - DNA, 25 bp, Mus musculus
gaacgatggcggaagtgaatacgaa

SEQ ID NO: 430102 - DNA, 25 bp, Mus musculus
gaacgattcacttatgaagacactg

SEQ ID NO: 430103 - DNA, 25 bp, Mus musculus
gaacgcaaagctcaactcaacagtg

SEQ ID NO: 430104 - DNA, 25 bp, Mus musculus
gaacgcaatgcggtacataaacgga

SEQ ID NO: 430105 - DNA, 25 bp, Mus musculus
gaacgcacagttcaagaaagccatg

SEQ ID NO: 430106 - DNA, 25 bp, Mus musculus
gaacgcaccaccaatgtcgatcgag

SEQ ID NO: 430107 - DNA, 25 bp, Mus musculus
gaacgcactgtacccgagtcaagaa

SEQ ID NO: 430108 - DNA, 25 bp, Mus musculus
gaacgcagacggctacattgatgct

SEQ ID NO: 430109 - DNA, 25 bp, Mus musculus
gaacgcagagaagcgcgcaggatct

SEQ ID NO: 430110 - DNA, 25 bp, Mus musculus
gaacgccaggagatacaagcacttt

SEQ ID NO: 430111 - DNA, 25 bp, Mus musculus
gaacgcccggtgctgtagaacagaa

SEQ ID NO: 430112 - DNA, 25 bp, Mus musculus
gaacgccctcaacgtacttcagcga

SEQ ID NO: 430113 - DNA, 25 bp, Mus musculus
gaacgccttgcagggttaccagctc

SEQ ID NO: 430114 - DNA, 25 bp, Mus musculus
gaacgccttggtagagctgcagaca

SEQ ID NO: 430115 - DNA, 25 bp, Mus musculus
gaacgcgcaatgctcctttgagtct

SEQ ID NO: 430116 - DNA, 25 bp, Mus musculus
gaacgcggtccttgtcccaggagaa

SEQ ID NO: 430117 - DNA, 25 bp, Mus musculus
gaacgcgtgtgtctcttcaagccta

SEQ ID NO: 430118 - DNA, 25 bp, Mus musculus
gaacgctcctggtgttggaaggccc

SEQ ID NO: 430119 - DNA, 25 bp, Mus musculus
gaacgctggtgattccaaagctgct

SEQ ID NO: 430120 - DNA, 25 bp, Mus musculus
gaacgcttacgaaaatctcaggaga

SEQ ID NO: 430121 - DNA, 25 bp, Mus musculus
gaacgcttcctatctgtcatgtggc

SEQ ID NO: 430122 - DNA, 25 bp, Mus musculus
gaacgcttgtaattttcctgctctt

SEQ ID NO: 430123 - DNA, 25 bp, Mus musculus
gaacggaagcgataaccttggccca

SEQ ID NO: 430124 - DNA, 25 bp, Mus musculus
gaacggaataagatggctgcagcca

SEQ ID NO: 430125 - DNA, 25 bp, Mus musculus
gaacggacagcgttgctttaacaga

SEQ ID NO: 430126 - DNA, 25 bp, Mus musculus
gaacggacccatgcactatgtctag

SEQ ID NO: 430127 - DNA, 25 bp, Mus musculus
gaacggagaggtccctgcatcaaac

SEQ ID NO: 430128 - DNA, 25 bp, Mus musculus
gaacggagccactcgcttgctgatg

SEQ ID NO: 430129 - DNA, 25 bp, Mus musculus
gaacggagcctttacctactatggt

SEQ ID NO: 430130 - DNA, 25 bp, Mus musculus
gaacggatccatgagctgggctaca

SEQ ID NO: 430131 - DNA, 25 bp, Mus musculus
gaacggcacggaggctaaattattg

SEQ ID NO: 430132 - DNA, 25 bp, Mus musculus
gaacggcactcgacttgtactaaag

SEQ ID NO: 430133 - DNA, 25 bp, Mus musculus
gaacggcatcttgtacttgagctgg

SEQ ID NO: 430134 - DNA, 25 bp, Mus musculus
gaacggccgatctgtcatcatgtga

SEQ ID NO: 430135 - DNA, 25 bp, Mus musculus
gaacggcctacttgctacgcgtgga

SEQ ID NO: 430136 - DNA, 25 bp, Mus musculus
gaacggcgatcctggaactgtccaa

SEQ ID NO: 430137 - DNA, 25 bp, Mus musculus
gaacggcgtgtaatccttgactgcg

SEQ ID NO: 430138 - DNA, 25 bp, Mus musculus
gaacggcgtttcctggccagcaata

SEQ ID NO: 430139 - DNA, 25 bp, Mus musculus
gaacggctcaagatcctgccttgcg

SEQ ID NO: 430140 - DNA, 25 bp, Mus musculus
gaacggctgtactgtgagaatcacg

SEQ ID NO: 430141 - DNA, 25 bp, Mus musculus
gaacggcttcgcctgaaggaagaac

SEQ ID NO: 430142 - DNA, 25 bp, Mus musculus
gaacgggagggcatcactgtctatt

SEQ ID NO: 430143 - DNA, 25 bp, Mus musculus
gaacgggagtcatacagcagtcaga

SEQ ID NO: 430144 - DNA, 25 bp, Mus musculus
gaacgggatataaacctggccagct

SEQ ID NO: 430145 - DNA, 25 bp, Mus musculus
gaacgggattcctgacgagcagatc

SEQ ID NO: 430146 - DNA, 25 bp, Mus musculus
gaacgggcactcttcacagatcgga

SEQ ID NO: 430147 - DNA, 25 bp, Mus musculus
gaacgggcatgtttaaggaactctg

SEQ ID NO: 430148 - DNA, 25 bp, Mus musculus
gaacgggctatgaggcagttcgcca

SEQ ID NO: 430149 - DNA, 25 bp, Mus musculus
gaacgggtaccgactgcatgagaac

SEQ ID NO: 430150 - DNA, 25 bp, Mus musculus
gaacgggtgactttccgcgctaggg

SEQ ID NO: 430151 - DNA, 25 bp, Mus musculus
gaacggtctctttcgtaggtgctca

SEQ ID NO: 430152 - DNA, 25 bp, Mus musculus
gaacggtggaaataccaggatgccc

SEQ ID NO: 430153 - DNA, 25 bp, Mus musculus
gaacggtggcacagctctggatcta

SEQ ID NO: 430154 - DNA, 25 bp, Mus musculus
gaacgtacttctgtctgccatgtca

SEQ ID NO: 430155 - DNA, 25 bp, Mus musculus
gaacgtagggtatccctgctcagaa

SEQ ID NO: 430156 - DNA, 25 bp, Mus musculus
gaacgtcagaatgcgcatagtggcc

SEQ ID NO: 430157 - DNA, 25 bp, Mus musculus
gaacgtccagtgtaggaaaaagccg

SEQ ID NO: 430158 - DNA, 25 bp, Mus musculus
gaacgtccatcgtagttacccaaag

SEQ ID NO: 430159 - DNA, 25 bp, Mus musculus
gaacgtcccagtgacctcaagatag

SEQ ID NO: 430160 - DNA, 25 bp, Mus musculus
gaacgtccctctcggtggaatctgg

SEQ ID NO: 430161 - DNA, 25 bp, Mus musculus
gaacgtcgcggtgcttcggtgtcac

SEQ ID NO: 430162 - DNA, 25 bp, Mus musculus
gaacgtcttaataggctctccgaac

SEQ ID NO: 430163 - DNA, 25 bp, Mus musculus
gaacgtcttcaacttcacaactgga

SEQ ID NO: 430164 - DNA, 25 bp, Mus musculus
gaacgtcttcctcttgcaacacagg

SEQ ID NO: 430165 - DNA, 25 bp, Mus musculus
gaacgtctttcagatcccgtagggc

SEQ ID NO: 430166 - DNA, 25 bp, Mus musculus
gaacgtgaccttggaccactttgag

SEQ ID NO: 430167 - DNA, 25 bp, Mus musculus
gaacgtgagctcatatgcagataaa

SEQ ID NO: 430168 - DNA, 25 bp, Mus musculus
gaacgtgccccaagagacatctgta

SEQ ID NO: 430169 - DNA, 25 bp, Mus musculus
gaacgtgctgattgaagtgaacccc

SEQ ID NO: 430170 - DNA, 25 bp, Mus musculus
gaacgtgctgctgcccgacagcaaa

SEQ ID NO: 430171 - DNA, 25 bp, Mus musculus
gaacgtggaccaccaggctttctgt

SEQ ID NO: 430172 - DNA, 25 bp, Mus musculus
gaacgtggccctttggaaacatcct

SEQ ID NO: 430173 - DNA, 25 bp, Mus musculus
gaacgtggtacaaagtgtcacctca

SEQ ID NO: 430174 - DNA, 25 bp, Mus musculus
gaacgtggttaaggagacggcatcc

SEQ ID NO: 430175 - DNA, 25 bp, Mus musculus
gaacgtggttggacattccctagga

SEQ ID NO: 430176 - DNA, 25 bp, Mus musculus
gaacgtgtcatctggagaactccga

SEQ ID NO: 430177 - DNA, 25 bp, Mus musculus
gaacgtgtccaagaaatcagcccct

SEQ ID NO: 430178 - DNA, 25 bp, Mus musculus
gaacgtgtccgaggtactagccaac

SEQ ID NO: 430179 - DNA, 25 bp, Mus musculus
gaacgtgtgaggtagcctgtcgaac

SEQ ID NO: 430180 - DNA, 25 bp, Mus musculus
gaacgtgtggtgatctgaatcggac

SEQ ID NO: 430181 - DNA, 25 bp, Mus musculus
gaacgtgtgtaattaatctgcccag

SEQ ID NO: 430182 - DNA, 25 bp, Mus musculus
gaacgtgtgttctcgattcgtgaag

SEQ ID NO: 430183 - DNA, 25 bp, Mus musculus
gaacgtgttccggtcgagtactggt

SEQ ID NO: 430184 - DNA, 25 bp, Mus musculus
gaacgttccctagctcacgaggaga

SEQ ID NO: 430185 - DNA, 25 bp, Mus musculus
gaacgttcgcctctgctgtcagcat

SEQ ID NO: 430186 - DNA, 25 bp, Mus musculus
gaacgttctggagaggatcctctgg

SEQ ID NO: 430187 - DNA, 25 bp, Mus musculus
gaacgttgaaaaaagccgctgtgga

SEQ ID NO: 430188 - DNA, 25 bp, Mus musculus
gaacgttggcgttcacggaacagga

SEQ ID NO: 430189 - DNA, 25 bp, Mus musculus
gaacgtttccacattccatcaacag

SEQ ID NO: 430190 - DNA, 25 bp, Mus musculus
gaacgtttccctcggagccgccaag

SEQ ID NO: 430191 - DNA, 25 bp, Mus musculus
gaacgttttgtggatcagcgcctcc

SEQ ID NO: 430192 - DNA, 25 bp, Mus musculus
gaacgtttttctaagctggtgcagg

SEQ ID NO: 430193 - DNA, 25 bp, Mus musculus
gaactaaaccggctgagaactgcct

SEQ ID NO: 430194 - DNA, 25 bp, Mus musculus
gaactaaatggtaagccagcctggg

SEQ ID NO: 430195 - DNA, 25 bp, Mus musculus
gaactaacagtcctatgcacctcgg

SEQ ID NO: 430196 - DNA, 25 bp, Mus musculus
gaactaacattttcacactgcagga

SEQ ID NO: 430197 - DNA, 25 bp, Mus musculus
gaactaacggaattactggaggaag

SEQ ID NO: 430198 - DNA, 25 bp, Mus musculus
gaactaagagcaccgaagccatcag

SEQ ID NO: 430199 - DNA, 25 bp, Mus musculus
gaactaagcctgacaccccaatata

SEQ ID NO: 430200 - DNA, 25 bp, Mus musculus
gaactaagcggagagcggtaaacct

SEQ ID NO: 430201 - DNA, 25 bp, Mus musculus
gaactaagtccagccgggaaagtct

SEQ ID NO: 430202 - DNA, 25 bp, Mus musculus
gaactacacacggttctcatcatgt

SEQ ID NO: 430203 - DNA, 25 bp, Mus musculus
gaactacagaagaggctacaagcct

SEQ ID NO: 430204 - DNA, 25 bp, Mus musculus
gaactacaggagactggacatcgtc

SEQ ID NO: 430205 - DNA, 25 bp, Mus musculus
gaactacaggcaagagactggccct

SEQ ID NO: 430206 - DNA, 25 bp, Mus musculus
gaactacatcgagaccctgagagtg

SEQ ID NO: 430207 - DNA, 25 bp, Mus musculus
gaactacatgtacgaagtggagaga

SEQ ID NO: 430208 - DNA, 25 bp, Mus musculus
gaactaccacagaagatattgccgg

SEQ ID NO: 430209 - DNA, 25 bp, Mus musculus
gaactaccgacgagatgaccacgga

SEQ ID NO: 430210 - DNA, 25 bp, Mus musculus
gaactaccgtctggatgactggcca

SEQ ID NO: 430211 - DNA, 25 bp, Mus musculus
gaactacctatgctcagggagacga

SEQ ID NO: 430212 - DNA, 25 bp, Mus musculus
gaactacctgacacggacgctagga

SEQ ID NO: 430213 - DNA, 25 bp, Mus musculus
gaactacctttctgaacccgcggag

SEQ ID NO: 430214 - DNA, 25 bp, Mus musculus
gaactacggcatcttggagctcaca

SEQ ID NO: 430215 - DNA, 25 bp, Mus musculus
gaactacttcaatagccaattggga

SEQ ID NO: 430216 - DNA, 25 bp, Mus musculus
gaactagagagagccaggaggaact

SEQ ID NO: 430217 - DNA, 25 bp, Mus musculus
gaactagagttttaggtcacggcct

SEQ ID NO: 430218 - DNA, 25 bp, Mus musculus
gaactagattccatggcaaagcacg

SEQ ID NO: 430219 - DNA, 25 bp, Mus musculus
gaactagattctaagctggcagcag

SEQ ID NO: 430220 - DNA, 25 bp, Mus musculus
gaactagcccagcttcagtcctagg

SEQ ID NO: 430221 - DNA, 25 bp, Mus musculus
gaactaggcaaagtggttcctccct

SEQ ID NO: 430222 - DNA, 25 bp, Mus musculus
gaactaggctagttacctcccctcg

SEQ ID NO: 430223 - DNA, 25 bp, Mus musculus
gaactagggcactggttgtaccaaa

SEQ ID NO: 430224 - DNA, 25 bp, Mus musculus
gaactaggtttcttgttaagcaatg

SEQ ID NO: 430225 - DNA, 25 bp, Mus musculus
gaactagtggactgctttgagcgca

SEQ ID NO: 430226 - DNA, 25 bp, Mus musculus
gaactagtttgctctcatcaggtgg

SEQ ID NO: 430227 - DNA, 25 bp, Mus musculus
gaactatatcagcatcctcagaagg

SEQ ID NO: 430228 - DNA, 25 bp, Mus musculus
gaactatcactctgtcccgtctagg

SEQ ID NO: 430229 - DNA, 25 bp, Mus musculus
gaactatgatctcgaccaggatggc

SEQ ID NO: 430230 - DNA, 25 bp, Mus musculus
gaactatgattcctctgcagccagg

SEQ ID NO: 430231 - DNA, 25 bp, Mus musculus
gaactatggttcactgttaattaaa

SEQ ID NO: 430232 - DNA, 25 bp, Mus musculus
gaactatgtagataagggtgacccc

SEQ ID NO: 430233 - DNA, 25 bp, Mus musculus
gaactattaccgcaccggcaagctt

SEQ ID NO: 430234 - DNA, 25 bp, Mus musculus
gaactattcatactctgccgctggg

SEQ ID NO: 430235 - DNA, 25 bp, Mus musculus
gaactattctttgctccaactcgga

SEQ ID NO: 430236 - DNA, 25 bp, Mus musculus
gaactcaaagtgaaagggcccaagg

SEQ ID NO: 430237 - DNA, 25 bp, Mus musculus
gaactcaacaagtggacatcaagaa

SEQ ID NO: 430238 - DNA, 25 bp, Mus musculus
gaactcaagtcctcgtgctcaaaca

SEQ ID NO: 430239 - DNA, 25 bp, Mus musculus
gaactcaataaacatcagcccggtc

SEQ ID NO: 430240 - DNA, 25 bp, Mus musculus
gaactcaatgcgtccacagagtggg

SEQ ID NO: 430241 - DNA, 25 bp, Mus musculus
gaactcacaccagagaacagcttta

SEQ ID NO: 430242 - DNA, 25 bp, Mus musculus
gaactcacaggcagagcagtcagct

SEQ ID NO: 430243 - DNA, 25 bp, Mus musculus
gaactcacttgaagggaccctgcag

SEQ ID NO: 430244 - DNA, 25 bp, Mus musculus
gaactcagagtatccgagggtccaa

SEQ ID NO: 430245 - DNA, 25 bp, Mus musculus
gaactcagcctgtaagggagcctgg

SEQ ID NO: 430246 - DNA, 25 bp, Mus musculus
gaactcagctcactgacttcctagc

SEQ ID NO: 430247 - DNA, 25 bp, Mus musculus
gaactcaggcgcattgcaacccagt

SEQ ID NO: 430248 - DNA, 25 bp, Mus musculus
gaactcagttttgaccctgccagaa

SEQ ID NO: 430249 - DNA, 25 bp, Mus musculus
gaactcatagagaccgacacttctg

SEQ ID NO: 430250 - DNA, 25 bp, Mus musculus
gaactcatattcagacagcagcgta

SEQ ID NO: 430251 - DNA, 25 bp, Mus musculus
gaactcatctggaggcctgacatcg

SEQ ID NO: 430252 - DNA, 25 bp, Mus musculus
gaactcatctgtatgagttaaaacc

SEQ ID NO: 430253 - DNA, 25 bp, Mus musculus
gaactcattcatcatccggtgcgca

SEQ ID NO: 430254 - DNA, 25 bp, Mus musculus
gaactccaaaacaagtacacacccg

SEQ ID NO: 430255 - DNA, 25 bp, Mus musculus
gaactccaagagatggtgccaggtc

SEQ ID NO: 430256 - DNA, 25 bp, Mus musculus
gaactccaagcacctattcaagcaa

SEQ ID NO: 430257 - DNA, 25 bp, Mus musculus
gaactccagatcttccgggaacaga

SEQ ID NO: 430258 - DNA, 25 bp, Mus musculus
gaactccagcttgggtactccgtgc

SEQ ID NO: 430259 - DNA, 25 bp, Mus musculus
gaactccattgggaacacaacacgg

SEQ ID NO: 430260 - DNA, 25 bp, Mus musculus
gaactcccaggaggtggaagacgaa

SEQ ID NO: 430261 - DNA, 25 bp, Mus musculus
gaactcccagttggtcgggatcctg

SEQ ID NO: 430262 - DNA, 25 bp, Mus musculus
gaactcccatgctaggaatcaggac

SEQ ID NO: 430263 - DNA, 25 bp, Mus musculus
gaactccccgcagggtctgtacaag

SEQ ID NO: 430264 - DNA, 25 bp, Mus musculus
gaactccctgcaccactacttgatg

SEQ ID NO: 430265 - DNA, 25 bp, Mus musculus
gaactccctttaataacaaatcaga

SEQ ID NO: 430266 - DNA, 25 bp, Mus musculus
gaactccgaactactcctaagctga

SEQ ID NO: 430267 - DNA, 25 bp, Mus musculus
gaactcctaagaggccgaggctgaa

SEQ ID NO: 430268 - DNA, 25 bp, Mus musculus
gaactcctgactcctggaatgctgg

SEQ ID NO: 430269 - DNA, 25 bp, Mus musculus
gaactcctgggctagacttgaacgt

SEQ ID NO: 430270 - DNA, 25 bp, Mus musculus
gaactccttcacaacgccaaaatag

SEQ ID NO: 430271 - DNA, 25 bp, Mus musculus
gaactcgatagtaggaaacctcgca

SEQ ID NO: 430272 - DNA, 25 bp, Mus musculus
gaactcggatcataccctcagaagg

SEQ ID NO: 430273 - DNA, 25 bp, Mus musculus
gaactcgggccacatgtacagaggt

SEQ ID NO: 430274 - DNA, 25 bp, Mus musculus
gaactcggttcatccctgtcaggtg

SEQ ID NO: 430275 - DNA, 25 bp, Mus musculus
gaactctaatggagcaacttctcca

SEQ ID NO: 430276 - DNA, 25 bp, Mus musculus
gaactctacagagcatggcgggact

SEQ ID NO: 430277 - DNA, 25 bp, Mus musculus
gaactctatggagctcaccgctggg

SEQ ID NO: 430278 - DNA, 25 bp, Mus musculus
gaactctcaagcagacatgttgggc

SEQ ID NO: 430279 - DNA, 25 bp, Mus musculus
gaactctcacgtgaggaatcttgcg

SEQ ID NO: 430280 - DNA, 25 bp, Mus musculus
gaactctccggaaagagggtctgca

SEQ ID NO: 430281 - DNA, 25 bp, Mus musculus
gaactctcctggtaccgaaatggcg

SEQ ID NO: 430282 - DNA, 25 bp, Mus musculus
gaactctctggcattcgtgctggag

SEQ ID NO: 430283 - DNA, 25 bp, Mus musculus
gaactctgaaatacagtctgagcca

SEQ ID NO: 430284 - DNA, 25 bp, Mus musculus
gaactctgattctgtggcaaggccc

SEQ ID NO: 430285 - DNA, 25 bp, Mus musculus
gaactctgcaatggaaaggccagct

SEQ ID NO: 430286 - DNA, 25 bp, Mus musculus
gaactctgcagtgaagcccatgcca

SEQ ID NO: 430287 - DNA, 25 bp, Mus musculus
gaactctgcctatgagaagcggccc

SEQ ID NO: 430288 - DNA, 25 bp, Mus musculus
gaactctgcgggattggccctgact

SEQ ID NO: 430289 - DNA, 25 bp, Mus musculus
gaactctgctggataccgatgggcc

SEQ ID NO: 430290 - DNA, 25 bp, Mus musculus
gaactctggaaacagtacatccggg

SEQ ID NO: 430291 - DNA, 25 bp, Mus musculus
gaactctggctttgctcctaggaga

SEQ ID NO: 430292 - DNA, 25 bp, Mus musculus
gaactctgtgtcagtttgtgtcctt

SEQ ID NO: 430293 - DNA, 25 bp, Mus musculus
gaactctgttatggctaccgtaatg

SEQ ID NO: 430294 - DNA, 25 bp, Mus musculus
gaactctgttcacatcttctgctac

SEQ ID NO: 430295 - DNA, 25 bp, Mus musculus
gaactcttagaattggtgacagccc

SEQ ID NO: 430296 - DNA, 25 bp, Mus musculus
gaactcttccgggtctgtctggtcg

SEQ ID NO: 430297 - DNA, 25 bp, Mus musculus
gaactcttcgggatggggactatga

SEQ ID NO: 430298 - DNA, 25 bp, Mus musculus
gaactcttctcgcagatcgcgggcg

SEQ ID NO: 430299 - DNA, 25 bp, Mus musculus
gaactcttgcctggacaaggagtcc

SEQ ID NO: 430300 - DNA, 25 bp, Mus musculus
gaactcttgctggtatcaggaccct

SEQ ID NO: 430301 - DNA, 25 bp, Mus musculus
gaactcttttggatcacttatgaca

SEQ ID NO: 430302 - DNA, 25 bp, Mus musculus
gaactctttttcttaagcagataac

SEQ ID NO: 430303 - DNA, 25 bp, Mus musculus
gaactgaaaatgtttcccttcctag

SEQ ID NO: 430304 - DNA, 25 bp, Mus musculus
gaactgaacaaccaaatctagcgag

SEQ ID NO: 430305 - DNA, 25 bp, Mus musculus
gaactgaagctaaatgacagccctc

SEQ ID NO: 430306 - DNA, 25 bp, Mus musculus
gaactgacctcattcctgttgcctc

SEQ ID NO: 430307 - DNA, 25 bp, Mus musculus
gaactgacctgttgtccactcccag

SEQ ID NO: 430308 - DNA, 25 bp, Mus musculus
gaactgactcagaccaaccagagga

SEQ ID NO: 430309 - DNA, 25 bp, Mus musculus
gaactgactcctcacgtaatggtgc

SEQ ID NO: 430310 - DNA, 25 bp, Mus musculus
gaactgacttcacataaagtgtggg

SEQ ID NO: 430311 - DNA, 25 bp, Mus musculus
gaactgacttctggatatgccttgg

SEQ ID NO: 430312 - DNA, 25 bp, Mus musculus
gaactgagacaggagctggttttaa

SEQ ID NO: 430313 - DNA, 25 bp, Mus musculus
gaactgagagattgtgtggtgccca

SEQ ID NO: 430314 - DNA, 25 bp, Mus musculus
gaactgagcagaccgcaacctttgc

SEQ ID NO: 430315 - DNA, 25 bp, Mus musculus
gaactgagcagccaacatgtatgga

SEQ ID NO: 430316 - DNA, 25 bp, Mus musculus
gaactgagcttagaggacacctttc

SEQ ID NO: 430317 - DNA, 25 bp, Mus musculus
gaactgaggcagtcacagacatgct

SEQ ID NO: 430318 - DNA, 25 bp, Mus musculus
gaactgatcgcaaaagacacctgga

SEQ ID NO: 430319 - DNA, 25 bp, Mus musculus
gaactgatgagtggtctgcctcgca

SEQ ID NO: 430320 - DNA, 25 bp, Mus musculus
gaactgattcccgacgtctatggca

SEQ ID NO: 430321 - DNA, 25 bp, Mus musculus
gaactgattcgagaccccaagggtc

SEQ ID NO: 430322 - DNA, 25 bp, Mus musculus
gaactgcaaaaagctgatagtgtca

SEQ ID NO: 430323 - DNA, 25 bp, Mus musculus
gaactgcaagaccacactcgggtgg

SEQ ID NO: 430324 - DNA, 25 bp, Mus musculus
gaactgcacattctggaacaccggc

SEQ ID NO: 430325 - DNA, 25 bp, Mus musculus
gaactgcactggtggtaactgcgac

SEQ ID NO: 430326 - DNA, 25 bp, Mus musculus
gaactgcagaggtttcctgatcccc

SEQ ID NO: 430327 - DNA, 25 bp, Mus musculus
gaactgcagcatgggtgacttggaa

SEQ ID NO: 430328 - DNA, 25 bp, Mus musculus
gaactgcatgactgatctcctcgcc

SEQ ID NO: 430329 - DNA, 25 bp, Mus musculus
gaactgcattataaccaaaccaagg

SEQ ID NO: 430330 - DNA, 25 bp, Mus musculus
gaactgccaccgattacagagaaca

SEQ ID NO: 430331 - DNA, 25 bp, Mus musculus
gaactgccagtttgccgacgtgaaa

SEQ ID NO: 430332 - DNA, 25 bp, Mus musculus
gaactgccattgagtacgccactgg

SEQ ID NO: 430333 - DNA, 25 bp, Mus musculus
gaactgccgacaatgagaagaccct

SEQ ID NO: 430334 - DNA, 25 bp, Mus musculus
gaactgcctggaaatgggtgataag

SEQ ID NO: 430335 - DNA, 25 bp, Mus musculus
gaactgcgagcgctacctgaactgg

SEQ ID NO: 430336 - DNA, 25 bp, Mus musculus
gaactgcgtgaaccctgaacatgag

SEQ ID NO: 430337 - DNA, 25 bp, Mus musculus
gaactgctagcaagtatagcgcgaa

SEQ ID NO: 430338 - DNA, 25 bp, Mus musculus
gaactgctcagttatccctatctag

SEQ ID NO: 430339 - DNA, 25 bp, Mus musculus
gaactgctgcggacttcatgggacg

SEQ ID NO: 430340 - DNA, 25 bp, Mus musculus
gaactgctgctccagtctggcgctg

SEQ ID NO: 430341 - DNA, 25 bp, Mus musculus
gaactgcttccatgcactttgaatg

SEQ ID NO: 430342 - DNA, 25 bp, Mus musculus
gaactgcttcttcgcgctcagcgtg

SEQ ID NO: 430343 - DNA, 25 bp, Mus musculus
gaactgcttgcttgtggcacggaaa

SEQ ID NO: 430344 - DNA, 25 bp, Mus musculus
gaactggaaccctggcactttcttg

SEQ ID NO: 430345 - DNA, 25 bp, Mus musculus
gaactggacaccaaatcgtactgga

SEQ ID NO: 430346 - DNA, 25 bp, Mus musculus
gaactggaccagacacttgaggaat

SEQ ID NO: 430347 - DNA, 25 bp, Mus musculus
gaactggaccggtgactactctcga

SEQ ID NO: 430348 - DNA, 25 bp, Mus musculus
gaactggactcgtctgaaatgcacg

SEQ ID NO: 430349 - DNA, 25 bp, Mus musculus
gaactggagaaccaaaagatggaaa

SEQ ID NO: 430350 - DNA, 25 bp, Mus musculus
gaactggagaacttgagcaaatggg

SEQ ID NO: 430351 - DNA, 25 bp, Mus musculus
gaactggagaggctttcagagtccc

SEQ ID NO: 430352 - DNA, 25 bp, Mus musculus
gaactggagcaggtctgtctgcctg

SEQ ID NO: 430353 - DNA, 25 bp, Mus musculus
gaactggagtctagtcgcctgccta

SEQ ID NO: 430354 - DNA, 25 bp, Mus musculus
gaactggatagactgatggcctcgc

SEQ ID NO: 430355 - DNA, 25 bp, Mus musculus
gaactggatcctagaaccgccaggg

SEQ ID NO: 430356 - DNA, 25 bp, Mus musculus
gaactggattccctgtagagaccct

SEQ ID NO: 430357 - DNA, 25 bp, Mus musculus
gaactggcagacatgaacggcttca

SEQ ID NO: 430358 - DNA, 25 bp, Mus musculus
gaactggcaggaaaactcctctgca

SEQ ID NO: 430359 - DNA, 25 bp, Mus musculus
gaactggcatcaaagtaccatttcc

SEQ ID NO: 430360 - DNA, 25 bp, Mus musculus
gaactggcctccttcattggtgcaa

SEQ ID NO: 430361 - DNA, 25 bp, Mus musculus
gaactggcgaaggtcactatcaaga

SEQ ID NO: 430362 - DNA, 25 bp, Mus musculus
gaactggctcaacaggtattgatag

SEQ ID NO: 430363 - DNA, 25 bp, Mus musculus
gaactggctgacaccttgaaccgaa

SEQ ID NO: 430364 - DNA, 25 bp, Mus musculus
gaactgggaaaagaaggccctgcct

SEQ ID NO: 430365 - DNA, 25 bp, Mus musculus
gaactgggaactctgcttgagacac

SEQ ID NO: 430366 - DNA, 25 bp, Mus musculus
gaactgggagtacttctacagcctg

SEQ ID NO: 430367 - DNA, 25 bp, Mus musculus
gaactgggcaaagctcgaacatctg

SEQ ID NO: 430368 - DNA, 25 bp, Mus musculus
gaactgggcaacgagctcttctaca

SEQ ID NO: 430369 - DNA, 25 bp, Mus musculus
gaactgggcaatacttagtctcctc

SEQ ID NO: 430370 - DNA, 25 bp, Mus musculus
gaactgggcaccgacctggtgagca

SEQ ID NO: 430371 - DNA, 25 bp, Mus musculus
gaactggtacatgggtcctggctca

SEQ ID NO: 430372 - DNA, 25 bp, Mus musculus
gaactggtccgtgattgaaaaccca

SEQ ID NO: 430373 - DNA, 25 bp, Mus musculus
gaactggtcgtcttgtgtgcactgc

SEQ ID NO: 430374 - DNA, 25 bp, Mus musculus
gaactggtgattgtctggaagatac

SEQ ID NO: 430375 - DNA, 25 bp, Mus musculus
gaactggtgcagaaccatgctgacc

SEQ ID NO: 430376 - DNA, 25 bp, Mus musculus
gaactggtgcagtcacatgaaaaac

SEQ ID NO: 430377 - DNA, 25 bp, Mus musculus
gaactgtaagtaaatcttgggataa

SEQ ID NO: 430378 - DNA, 25 bp, Mus musculus
gaactgtaccgggtgtccctcagaa

SEQ ID NO: 430379 - DNA, 25 bp, Mus musculus
gaactgtagtttgtgaggcaattgc

SEQ ID NO: 430380 - DNA, 25 bp, Mus musculus
gaactgtatagaaaaccacaatgtg

SEQ ID NO: 430381 - DNA, 25 bp, Mus musculus
gaactgtatgaagacagccagctca

SEQ ID NO: 430382 - DNA, 25 bp, Mus musculus
gaactgtcagctgcatgtcatgatg

SEQ ID NO: 430383 - DNA, 25 bp, Mus musculus
gaactgtccaaagcgattactgcca

SEQ ID NO: 430384 - DNA, 25 bp, Mus musculus
gaactgtccagatgctgtgcccaga

SEQ ID NO: 430385 - DNA, 25 bp, Mus musculus
gaactgtccagtcaggtacgtgcag

SEQ ID NO: 430386 - DNA, 25 bp, Mus musculus
gaactgtccagtccttgtaacgtgt

SEQ ID NO: 430387 - DNA, 25 bp, Mus musculus
gaactgtcctgaaatatacctgcca

SEQ ID NO: 430388 - DNA, 25 bp, Mus musculus
gaactgtctaccttgaccatgcagg

SEQ ID NO: 430389 - DNA, 25 bp, Mus musculus
gaactgtctcttccgctcactggtg

SEQ ID NO: 430390 - DNA, 25 bp, Mus musculus
gaactgtgaagtaggacagagcccc

SEQ ID NO: 430391 - DNA, 25 bp, Mus musculus
gaactgtgaatggtggctcagatct

SEQ ID NO: 430392 - DNA, 25 bp, Mus musculus
gaactgtgacactgacatccaggag

SEQ ID NO: 430393 - DNA, 25 bp, Mus musculus
gaactgtgactaagctgcagagaag

SEQ ID NO: 430394 - DNA, 25 bp, Mus musculus
gaactgtgccatctcatctaccgga

SEQ ID NO: 430395 - DNA, 25 bp, Mus musculus
gaactgtgccgtgagccatgctggt

SEQ ID NO: 430396 - DNA, 25 bp, Mus musculus
gaactgtgcctatgagctgagaccg

SEQ ID NO: 430397 - DNA, 25 bp, Mus musculus
gaactgtgcctgttagcacctcaag

SEQ ID NO: 430398 - DNA, 25 bp, Mus musculus
gaactgtgctctcaactggcctgca

SEQ ID NO: 430399 - DNA, 25 bp, Mus musculus
gaactgtggcctgccttagtgctga

SEQ ID NO: 430400 - DNA, 25 bp, Mus musculus
gaactgtgggaatgtatgatttgcc

SEQ ID NO: 430401 - DNA, 25 bp, Mus musculus
gaactgtggtactacacgagaggac

SEQ ID NO: 430402 - DNA, 25 bp, Mus musculus
gaactgtgtattcaacaagagactc

SEQ ID NO: 430403 - DNA, 25 bp, Mus musculus
gaactgtgtctacgcctcagaaggg

SEQ ID NO: 430404 - DNA, 25 bp, Mus musculus
gaactgttcgtggagactatcgcaa

SEQ ID NO: 430405 - DNA, 25 bp, Mus musculus
gaactgttggaagtccgggcagcct

SEQ ID NO: 430406 - DNA, 25 bp, Mus musculus
gaactgtttttctttgctagccgga

SEQ ID NO: 430407 - DNA, 25 bp, Mus musculus
gaacttaacctaggcgtcgcacaag

SEQ ID NO: 430408 - DNA, 25 bp, Mus musculus
gaacttacccagcaggtcttcgatg

SEQ ID NO: 430409 - DNA, 25 bp, Mus musculus
gaacttaccggtcacagataacaga

SEQ ID NO: 430410 - DNA, 25 bp, Mus musculus
gaacttacgattccctgcttctacc

SEQ ID NO: 430411 - DNA, 25 bp, Mus musculus
gaacttactgaagaccagaaacagg

SEQ ID NO: 430412 - DNA, 25 bp, Mus musculus
gaacttactgttcccagagccaggg

SEQ ID NO: 430413 - DNA, 25 bp, Mus musculus
gaacttagctgcctgacacacgtga

SEQ ID NO: 430414 - DNA, 25 bp, Mus musculus
gaacttaggaggaccattgcccagg

SEQ ID NO: 430415 - DNA, 25 bp, Mus musculus
gaacttcacccggaactggtcaatc

SEQ ID NO: 430416 - DNA, 25 bp, Mus musculus
gaacttcagaactgcggtggccatg

SEQ ID NO: 430417 - DNA, 25 bp, Mus musculus
gaacttcagacgcagaggcggtcaa

SEQ ID NO: 430418 - DNA, 25 bp, Mus musculus
gaacttcagagctatggtgtcaacc

SEQ ID NO: 430419 - DNA, 25 bp, Mus musculus
gaacttcagcaactgcagccgacag

SEQ ID NO: 430420 - DNA, 25 bp, Mus musculus
gaacttcagctctgaaattgaagac

SEQ ID NO: 430421 - DNA, 25 bp, Mus musculus
gaacttcagggtaaacaggcaaccg

SEQ ID NO: 430422 - DNA, 25 bp, Mus musculus
gaacttccaaatccgagaggcacca

SEQ ID NO: 430423 - DNA, 25 bp, Mus musculus
gaacttccattgacagctgctgttt

SEQ ID NO: 430424 - DNA, 25 bp, Mus musculus
gaacttccccgtggtgatcaagctg

SEQ ID NO: 430425 - DNA, 25 bp, Mus musculus
gaacttccggaccttcttagaactg

SEQ ID NO: 430426 - DNA, 25 bp, Mus musculus
gaacttcctcatcatatcagcacag

SEQ ID NO: 430427 - DNA, 25 bp, Mus musculus
gaacttcctcggctgggacgacaat

SEQ ID NO: 430428 - DNA, 25 bp, Mus musculus
gaacttcctggctgaaaacgtcatc

SEQ ID NO: 430429 - DNA, 25 bp, Mus musculus
gaacttcctgttggcacaagctcgg

SEQ ID NO: 430430 - DNA, 25 bp, Mus musculus
gaacttcctttcgttgagcctaggc

SEQ ID NO: 430431 - DNA, 25 bp, Mus musculus
gaacttcgattggactgataggaga

SEQ ID NO: 430432 - DNA, 25 bp, Mus musculus
gaacttcgcccttcgtgtgctgctg

SEQ ID NO: 430433 - DNA, 25 bp, Mus musculus
gaacttcggtctgcctccttttgga

SEQ ID NO: 430434 - DNA, 25 bp, Mus musculus
gaacttcgtcctgccgctggttaga

SEQ ID NO: 430435 - DNA, 25 bp, Mus musculus
gaacttctcagtgtgctgtggcaga

SEQ ID NO: 430436 - DNA, 25 bp, Mus musculus
gaacttctcctgaaagccggtgctg

SEQ ID NO: 430437 - DNA, 25 bp, Mus musculus
gaacttctgagaaccttccaggcag

SEQ ID NO: 430438 - DNA, 25 bp, Mus musculus
gaacttctgcagaacacgcctgagg

SEQ ID NO: 430439 - DNA, 25 bp, Mus musculus
gaacttctggttggcaatggagctg

SEQ ID NO: 430440 - DNA, 25 bp, Mus musculus
gaacttcttgagtgggaaggccttg

SEQ ID NO: 430441 - DNA, 25 bp, Mus musculus
gaacttcttgggtaagaggccactg

SEQ ID NO: 430442 - DNA, 25 bp, Mus musculus
gaacttctttcccatcacagcggtg

SEQ ID NO: 430443 - DNA, 25 bp, Mus musculus
gaacttgaacctgcatccagcttgg

SEQ ID NO: 430444 - DNA, 25 bp, Mus musculus
gaacttgaaggaactagaggcagcc

SEQ ID NO: 430445 - DNA, 25 bp, Mus musculus
gaacttgaagtggtgaatctcctga

SEQ ID NO: 430446 - DNA, 25 bp, Mus musculus
gaacttgacccctgttcataccatc

SEQ ID NO: 430447 - DNA, 25 bp, Mus musculus
gaacttgaccgtgtccacgctgcgg

SEQ ID NO: 430448 - DNA, 25 bp, Mus musculus
gaacttgactacctgaatccgggca

SEQ ID NO: 430449 - DNA, 25 bp, Mus musculus
gaacttgagatgtagatgaagcccc

SEQ ID NO: 430450 - DNA, 25 bp, Mus musculus
gaacttgagcctaaagctgggccac

SEQ ID NO: 430451 - DNA, 25 bp, Mus musculus
gaacttgatcgctggaattgggccc

SEQ ID NO: 430452 - DNA, 25 bp, Mus musculus
gaacttgatctgtccagcatggtga

SEQ ID NO: 430453 - DNA, 25 bp, Mus musculus
gaacttgattccagctggcccgtga

SEQ ID NO: 430454 - DNA, 25 bp, Mus musculus
gaacttgcagcctgtcaataggccg

SEQ ID NO: 430455 - DNA, 25 bp, Mus musculus
gaacttgcagtgacctggacgagga

SEQ ID NO: 430456 - DNA, 25 bp, Mus musculus
gaacttgcatacctagagacagacg

SEQ ID NO: 430457 - DNA, 25 bp, Mus musculus
gaacttgcccaagccacagcagata

SEQ ID NO: 430458 - DNA, 25 bp, Mus musculus
gaacttgctccacccatatatgtag

SEQ ID NO: 430459 - DNA, 25 bp, Mus musculus
gaacttgctgcctagccagtaaggg

SEQ ID NO: 430460 - DNA, 25 bp, Mus musculus
gaacttgcttgccatcatcgttggg

SEQ ID NO: 430461 - DNA, 25 bp, Mus musculus
gaacttggaatcctcaggctcctga

SEQ ID NO: 430462 - DNA, 25 bp, Mus musculus
gaacttggcccgtcatctgatggag

SEQ ID NO: 430463 - DNA, 25 bp, Mus musculus
gaacttggctttggagaaaactgtg

SEQ ID NO: 430464 - DNA, 25 bp, Mus musculus
gaacttgggctcctcataactgaag

SEQ ID NO: 430465 - DNA, 25 bp, Mus musculus
gaacttgggttttccatttgatgca

SEQ ID NO: 430466 - DNA, 25 bp, Mus musculus
gaacttgtagttgcaggatgaccca

SEQ ID NO: 430467 - DNA, 25 bp, Mus musculus
gaacttgtcgccactgtgtgatcca

SEQ ID NO: 430468 - DNA, 25 bp, Mus musculus
gaacttgtgagagtctttttcccct

SEQ ID NO: 430469 - DNA, 25 bp, Mus musculus
gaacttgtgccaaataaccagggac

SEQ ID NO: 430470 - DNA, 25 bp, Mus musculus
gaacttgtgggtcctgtcacatgga

SEQ ID NO: 430471 - DNA, 25 bp, Mus musculus
gaacttgttcaagcagctgcccgag

SEQ ID NO: 430472 - DNA, 25 bp, Mus musculus
gaacttgttgcttgtcggtgtccca

SEQ ID NO: 430473 - DNA, 25 bp, Mus musculus
gaactttaaatcagctccaatggaa

SEQ ID NO: 430474 - DNA, 25 bp, Mus musculus
gaactttaaattccgctggcagctg

SEQ ID NO: 430475 - DNA, 25 bp, Mus musculus
gaactttaacctctcgggcagtgcg

SEQ ID NO: 430476 - DNA, 25 bp, Mus musculus
gaactttacctccacctttgacaag

SEQ ID NO: 430477 - DNA, 25 bp, Mus musculus
gaactttagaagctagggcctcaga

SEQ ID NO: 430478 - DNA, 25 bp, Mus musculus
gaactttagagggtagcacgctact

SEQ ID NO: 430479 - DNA, 25 bp, Mus musculus
gaactttatacaaacgaatcgtagg

SEQ ID NO: 430480 - DNA, 25 bp, Mus musculus
gaactttcaaaatttcagcctcgcc

SEQ ID NO: 430481 - DNA, 25 bp, Mus musculus
gaactttcagaagggtcaggtgtcc

SEQ ID NO: 430482 - DNA, 25 bp, Mus musculus
gaactttctaaacccagctgagctt

SEQ ID NO: 430483 - DNA, 25 bp, Mus musculus
gaactttctactgtgtgtctgcttg

SEQ ID NO: 430484 - DNA, 25 bp, Mus musculus
gaactttgaagagcagccggactcc

SEQ ID NO: 430485 - DNA, 25 bp, Mus musculus
gaactttgatagattatgctcccta

SEQ ID NO: 430486 - DNA, 25 bp, Mus musculus
gaactttgccaagaaacggtcctgt

SEQ ID NO: 430487 - DNA, 25 bp, Mus musculus
gaactttgcccagttaaccagatga

SEQ ID NO: 430488 - DNA, 25 bp, Mus musculus
gaactttgccttgaatatgtaatga

SEQ ID NO: 430489 - DNA, 25 bp, Mus musculus
gaactttgctcaaggcgcagactcg

SEQ ID NO: 430490 - DNA, 25 bp, Mus musculus
gaactttgcttttgtcgagccttaa

SEQ ID NO: 430491 - DNA, 25 bp, Mus musculus
gaactttggactcgtgcatctcatg

SEQ ID NO: 430492 - DNA, 25 bp, Mus musculus
gaactttgggcatcatcggaggacc

SEQ ID NO: 430493 - DNA, 25 bp, Mus musculus
gaactttgtgccgaagcactcccgg

SEQ ID NO: 430494 - DNA, 25 bp, Mus musculus
gaacttttagagtagagttcaacac

SEQ ID NO: 430495 - DNA, 25 bp, Mus musculus
gaacttttcacggaacagcctagga

SEQ ID NO: 430496 - DNA, 25 bp, Mus musculus
gaacttttctaagcaggccgggcac

SEQ ID NO: 430497 - DNA, 25 bp, Mus musculus
gaagaaaaacctgatggccttgtca

SEQ ID NO: 430498 - DNA, 25 bp, Mus musculus
gaagaaaaccttgcatgtatccctg

SEQ ID NO: 430499 - DNA, 25 bp, Mus musculus
gaagaaaacggatcctcactcgaca

SEQ ID NO: 430500 - DNA, 25 bp, Mus musculus
gaagaaaactttgtctggagactca

SEQ ID NO: 430501 - DNA, 25 bp, Mus musculus
gaagaaaagaggctgcacatgtagc

SEQ ID NO: 430502 - DNA, 25 bp, Mus musculus
gaagaaaagcaagcgggtaacctgg

SEQ ID NO: 430503 - DNA, 25 bp, Mus musculus
gaagaaaagcagcatcggatacgcc

SEQ ID NO: 430504 - DNA, 25 bp, Mus musculus
gaagaaaaggaactgtgcacacggt

SEQ ID NO: 430505 - DNA, 25 bp, Mus musculus
gaagaaaagggaaagcaacgtggct

SEQ ID NO: 430506 - DNA, 25 bp, Mus musculus
gaagaaaagtatgagtcctgtgctg

SEQ ID NO: 430507 - DNA, 25 bp, Mus musculus
gaagaaaatgagctccagtgacacg

SEQ ID NO: 430508 - DNA, 25 bp, Mus musculus
gaagaaaattccaaggtcaccgtgc

SEQ ID NO: 430509 - DNA, 25 bp, Mus musculus
gaagaaacccaacgctacggtcgag

SEQ ID NO: 430510 - DNA, 25 bp, Mus musculus
gaagaaacctcgatgtggcgtccct

SEQ ID NO: 430511 - DNA, 25 bp, Mus musculus
gaagaaaccttcacctggctacaga

SEQ ID NO: 430512 - DNA, 25 bp, Mus musculus
gaagaaacgctccaaggccaaagca

SEQ ID NO: 430513 - DNA, 25 bp, Mus musculus
gaagaaacggttaagctcactgcac

SEQ ID NO: 430514 - DNA, 25 bp, Mus musculus
gaagaaactactcaaagtgatcggg

SEQ ID NO: 430515 - DNA, 25 bp, Mus musculus
gaagaaactatatccctcgacccag

SEQ ID NO: 430516 - DNA, 25 bp, Mus musculus
gaagaaactctcaccctggagcggt

SEQ ID NO: 430517 - DNA, 25 bp, Mus musculus
gaagaaactgctggacaagacggta

SEQ ID NO: 430518 - DNA, 25 bp, Mus musculus
gaagaaactggatggtcacggaaca

SEQ ID NO: 430519 - DNA, 25 bp, Mus musculus
gaagaaagaaatggacagcggaaga

SEQ ID NO: 430520 - DNA, 25 bp, Mus musculus
gaagaaagacgcctggacaggaggg

SEQ ID NO: 430521 - DNA, 25 bp, Mus musculus
gaagaaagagtatttttagcgcatt

SEQ ID NO: 430522 - DNA, 25 bp, Mus musculus
gaagaaagcaggcaaccagatacgc

SEQ ID NO: 430523 - DNA, 25 bp, Mus musculus
gaagaaagccagaacagtcttgcct

SEQ ID NO: 430524 - DNA, 25 bp, Mus musculus
gaagaaagccttctacccagaggag

SEQ ID NO: 430525 - DNA, 25 bp, Mus musculus
gaagaaagcctttaccaaagcctgc

SEQ ID NO: 430526 - DNA, 25 bp, Mus musculus
gaagaaagcgtgttccaccaacgac

SEQ ID NO: 430527 - DNA, 25 bp, Mus musculus
gaagaaagctggatacagtaaacgg

SEQ ID NO: 430528 - DNA, 25 bp, Mus musculus
gaagaaagtactgagcccctgagtg

SEQ ID NO: 430529 - DNA, 25 bp, Mus musculus
gaagaaagtcaaatccaagaaaaag

SEQ ID NO: 430530 - DNA, 25 bp, Mus musculus
gaagaaagtcatctctaccagcaga

SEQ ID NO: 430531 - DNA, 25 bp, Mus musculus
gaagaaagtcctctgcctagcaaat

SEQ ID NO: 430532 - DNA, 25 bp, Mus musculus
gaagaaatccccaaagtccatggag

SEQ ID NO: 430533 - DNA, 25 bp, Mus musculus
gaagaaatcgtgcatcagctgccca

SEQ ID NO: 430534 - DNA, 25 bp, Mus musculus
gaagaaatgaacacattgctagttt

SEQ ID NO: 430535 - DNA, 25 bp, Mus musculus
gaagaaatgatgtcacacgagtggc

SEQ ID NO: 430536 - DNA, 25 bp, Mus musculus
gaagaaatgctggatacccagacta

SEQ ID NO: 430537 - DNA, 25 bp, Mus musculus
gaagaaatgcttcatcattagaaat

SEQ ID NO: 430538 - DNA, 25 bp, Mus musculus
gaagaaatgcttctgcgagccagag

SEQ ID NO: 430539 - DNA, 25 bp, Mus musculus
gaagaaatgttgacacctgaagaaa

SEQ ID NO: 430540 - DNA, 25 bp, Mus musculus
gaagaaattaggaatttgacccctg

SEQ ID NO: 430541 - DNA, 25 bp, Mus musculus
gaagaaattgagctccctggtacca

SEQ ID NO: 430542 - DNA, 25 bp, Mus musculus
gaagaaattgtactagagcccagga

SEQ ID NO: 430543 - DNA, 25 bp, Mus musculus
gaagaaatttcagacccgcgtgcac

SEQ ID NO: 430544 - DNA, 25 bp, Mus musculus
gaagaacaaggcttcagggagaaaa

SEQ ID NO: 430545 - DNA, 25 bp, Mus musculus
gaagaacaattgtggcatgtcctga

SEQ ID NO: 430546 - DNA, 25 bp, Mus musculus
gaagaacaccattattgccgcaaag

SEQ ID NO: 430547 - DNA, 25 bp, Mus musculus
gaagaacaccttttggaagctgaaa

SEQ ID NO: 430548 - DNA, 25 bp, Mus musculus
gaagaacacggctctctggatcgga

SEQ ID NO: 430549 - DNA, 25 bp, Mus musculus
gaagaacacgttcggctggatccgc

SEQ ID NO: 430550 - DNA, 25 bp, Mus musculus
gaagaacagcggtacagtggtgaac

SEQ ID NO: 430551 - DNA, 25 bp, Mus musculus
gaagaacatccttcctgtggattcg

SEQ ID NO: 430552 - DNA, 25 bp, Mus musculus
gaagaacatgtctgcctaccaggta

SEQ ID NO: 430553 - DNA, 25 bp, Mus musculus
gaagaacattgtcctgatccagctg

SEQ ID NO: 430554 - DNA, 25 bp, Mus musculus
gaagaacatttaggcctcgaggagg

SEQ ID NO: 430555 - DNA, 25 bp, Mus musculus
gaagaaccacggactagtacctcgg

SEQ ID NO: 430556 - DNA, 25 bp, Mus musculus
gaagaaccacttgggatcctatgag

SEQ ID NO: 430557 - DNA, 25 bp, Mus musculus
gaagaaccagactccagtgatgacg

SEQ ID NO: 430558 - DNA, 25 bp, Mus musculus
gaagaaccatgtggctcctgcacag

SEQ ID NO: 430559 - DNA, 25 bp, Mus musculus
gaagaacccctaattgagagcagcg

SEQ ID NO: 430560 - DNA, 25 bp, Mus musculus
gaagaacccgagtcaaacacagtag

SEQ ID NO: 430561 - DNA, 25 bp, Mus musculus
gaagaaccctgaggaacacagcatg

SEQ ID NO: 430562 - DNA, 25 bp, Mus musculus
gaagaaccgtccctatgaaatcagc

SEQ ID NO: 430563 - DNA, 25 bp, Mus musculus
gaagaacctccaaggcttcctggaa

SEQ ID NO: 430564 - DNA, 25 bp, Mus musculus
gaagaacctctcgaaacacacagtg

SEQ ID NO: 430565 - DNA, 25 bp, Mus musculus
gaagaacctgaggagcggcttcctc

SEQ ID NO: 430566 - DNA, 25 bp, Mus musculus
gaagaaccttatccggagactacag

SEQ ID NO: 430567 - DNA, 25 bp, Mus musculus
gaagaaccttcgctgccagatactt

SEQ ID NO: 430568 - DNA, 25 bp, Mus musculus
gaagaaccttctgggcctagaggca

SEQ ID NO: 430569 - DNA, 25 bp, Mus musculus
gaagaacgagacgatagcacacact

SEQ ID NO: 430570 - DNA, 25 bp, Mus musculus
gaagaacgccaccagcagaagactt

SEQ ID NO: 430571 - DNA, 25 bp, Mus musculus
gaagaacgcgttcagtttgagacac

SEQ ID NO: 430572 - DNA, 25 bp, Mus musculus
gaagaacgtgtcctccacatgtgct

SEQ ID NO: 430573 - DNA, 25 bp, Mus musculus
gaagaactaaagatgaatcctaaag

SEQ ID NO: 430574 - DNA, 25 bp, Mus musculus
gaagaactacgatatgcacccctga

SEQ ID NO: 430575 - DNA, 25 bp, Mus musculus
gaagaactactttaccgtggcacaa

SEQ ID NO: 430576 - DNA, 25 bp, Mus musculus
gaagaactagacaggaaagctgccg

SEQ ID NO: 430577 - DNA, 25 bp, Mus musculus
gaagaactatcatttcccgagggcg

SEQ ID NO: 430578 - DNA, 25 bp, Mus musculus
gaagaactattttggccctgtgcac

SEQ ID NO: 430579 - DNA, 25 bp, Mus musculus
gaagaactccattagctttgcgggc

SEQ ID NO: 430580 - DNA, 25 bp, Mus musculus
gaagaactcctgtccctcaagtatg

SEQ ID NO: 430581 - DNA, 25 bp, Mus musculus
gaagaactcgaagcatcatcctgag

SEQ ID NO: 430582 - DNA, 25 bp, Mus musculus
gaagaactctgtccaggaaactccg

SEQ ID NO: 430583 - DNA, 25 bp, Mus musculus
gaagaactgaatgtcactgagattg

SEQ ID NO: 430584 - DNA, 25 bp, Mus musculus
gaagaactggacgtttcctggaacg

SEQ ID NO: 430585 - DNA, 25 bp, Mus musculus
gaagaactggactcagaggccgtaa

SEQ ID NO: 430586 - DNA, 25 bp, Mus musculus
gaagaactgggtatcagccacccaa

SEQ ID NO: 430587 - DNA, 25 bp, Mus musculus
gaagaactgtctagaagtcacttgt

SEQ ID NO: 430588 - DNA, 25 bp, Mus musculus
gaagaacttagccttgtgtgtgtta

SEQ ID NO: 430589 - DNA, 25 bp, Mus musculus
gaagaacttcagtcggagctcacat

SEQ ID NO: 430590 - DNA, 25 bp, Mus musculus
gaagaacttcatcaacgggtcctca

SEQ ID NO: 430591 - DNA, 25 bp, Mus musculus
gaagaacttcgtgcccagatgctcg

SEQ ID NO: 430592 - DNA, 25 bp, Mus musculus
gaagaagaacatgctacagtgtctg

SEQ ID NO: 430593 - DNA, 25 bp, Mus musculus
gaagaagaacgccaaagccagtctg

SEQ ID NO: 430594 - DNA, 25 bp, Mus musculus
gaagaagaatttcagccgtggaacc

SEQ ID NO: 430595 - DNA, 25 bp, Mus musculus
gaagaagacaatgtacaagtgtccc

SEQ ID NO: 430596 - DNA, 25 bp, Mus musculus
gaagaagacgaggagacccaacttg

SEQ ID NO: 430597 - DNA, 25 bp, Mus musculus
gaagaagacggcctttcagaagcag

SEQ ID NO: 430598 - DNA, 25 bp, Mus musculus
gaagaagacttcactctcggcagga

SEQ ID NO: 430599 - DNA, 25 bp, Mus musculus
gaagaagacttctcccagattatgg

SEQ ID NO: 430600 - DNA, 25 bp, Mus musculus
gaagaagagagattcccaagaggct

SEQ ID NO: 430601 - DNA, 25 bp, Mus musculus
gaagaagagatacctacggcatgac

SEQ ID NO: 430602 - DNA, 25 bp, Mus musculus
gaagaagagtatgtactgaagatac

SEQ ID NO: 430603 - DNA, 25 bp, Mus musculus
gaagaagatataacacgtacctccc

SEQ ID NO: 430604 - DNA, 25 bp, Mus musculus
gaagaagatcccgatcaagcggacg

SEQ ID NO: 430605 - DNA, 25 bp, Mus musculus
gaagaagatgccatgcctccagcta

SEQ ID NO: 430606 - DNA, 25 bp, Mus musculus
gaagaagattcactaccacaaccca

SEQ ID NO: 430607 - DNA, 25 bp, Mus musculus
gaagaagattgagctgggctaccag

SEQ ID NO: 430608 - DNA, 25 bp, Mus musculus
gaagaagatttcatcctactgatcc

SEQ ID NO: 430609 - DNA, 25 bp, Mus musculus
gaagaagattttgaaggacaggcca

SEQ ID NO: 430610 - DNA, 25 bp, Mus musculus
gaagaagcaaactaccaggaacccg

SEQ ID NO: 430611 - DNA, 25 bp, Mus musculus
gaagaagccaagtctgcaatcgcca

SEQ ID NO: 430612 - DNA, 25 bp, Mus musculus
gaagaagcccactgatggcgacaag

SEQ ID NO: 430613 - DNA, 25 bp, Mus musculus
gaagaagccggttaccatacagtgg

SEQ ID NO: 430614 - DNA, 25 bp, Mus musculus
gaagaagcctcgatgcggtgtacca

SEQ ID NO: 430615 - DNA, 25 bp, Mus musculus
gaagaagcgctccaaatctgcagac

SEQ ID NO: 430616 - DNA, 25 bp, Mus musculus
gaagaagcgtcctacagtctccagg

SEQ ID NO: 430617 - DNA, 25 bp, Mus musculus
gaagaagctcatgcaaggtttcagc

SEQ ID NO: 430618 - DNA, 25 bp, Mus musculus
gaagaagctcttcgtgccgctgaag

SEQ ID NO: 430619 - DNA, 25 bp, Mus musculus
gaagaagctgaacctccatgaggaa

SEQ ID NO: 430620 - DNA, 25 bp, Mus musculus
gaagaagctgcctacatcggagacg

SEQ ID NO: 430621 - DNA, 25 bp, Mus musculus
gaagaagctgggttcacaggacgca

SEQ ID NO: 430622 - DNA, 25 bp, Mus musculus
gaagaagctgttgaatgttcatctt

SEQ ID NO: 430623 - DNA, 25 bp, Mus musculus
gaagaagcttttgcgttggagccca

SEQ ID NO: 430624 - DNA, 25 bp, Mus musculus
gaagaaggacgttagccaaggcaca

SEQ ID NO: 430625 - DNA, 25 bp, Mus musculus
gaagaaggagccgaaaacaaagact

SEQ ID NO: 430626 - DNA, 25 bp, Mus musculus
gaagaaggatcacatctccagggct

SEQ ID NO: 430627 - DNA, 25 bp, Mus musculus
gaagaaggatcagcgtgtagccatg

SEQ ID NO: 430628 - DNA, 25 bp, Mus musculus
gaagaaggcctaaacgagaaaccag

SEQ ID NO: 430629 - DNA, 25 bp, Mus musculus
gaagaagggagggaacacatgcctt

SEQ ID NO: 430630 - DNA, 25 bp, Mus musculus
gaagaagggaggtcataattccaca

SEQ ID NO: 430631 - DNA, 25 bp, Mus musculus
gaagaaggtcaatgagtcaactcag

SEQ ID NO: 430632 - DNA, 25 bp, Mus musculus
gaagaaggtcctggctgctcagcta

SEQ ID NO: 430633 - DNA, 25 bp, Mus musculus
gaagaagtacctacgagggcagcaa

SEQ ID NO: 430634 - DNA, 25 bp, Mus musculus
gaagaagtacctcctgaagtgcctg

SEQ ID NO: 430635 - DNA, 25 bp, Mus musculus
gaagaagtactggtttgtcctaaag

SEQ ID NO: 430636 - DNA, 25 bp, Mus musculus
gaagaagtaggccaactggagcact

SEQ ID NO: 430637 - DNA, 25 bp, Mus musculus
gaagaagtatgaggatggcaccatc

SEQ ID NO: 430638 - DNA, 25 bp, Mus musculus
gaagaagtcgccatgtaacagctaa

SEQ ID NO: 430639 - DNA, 25 bp, Mus musculus
gaagaagtctgttgctatgcacacc

SEQ ID NO: 430640 - DNA, 25 bp, Mus musculus
gaagaagtgcgtcaaacccagagtc

SEQ ID NO: 430641 - DNA, 25 bp, Mus musculus
gaagaagtgcttcacagaggccgcc

SEQ ID NO: 430642 - DNA, 25 bp, Mus musculus
gaagaagtgtctttccggccatcgg

SEQ ID NO: 430643 - DNA, 25 bp, Mus musculus
gaagaagttacacacgaagaggctg

SEQ ID NO: 430644 - DNA, 25 bp, Mus musculus
gaagaagttgtcacggatggctcct

SEQ ID NO: 430645 - DNA, 25 bp, Mus musculus
gaagaagtttgatgtgcgctcctac

SEQ ID NO: 430646 - DNA, 25 bp, Mus musculus
gaagaataagaagcgacatcggccc

SEQ ID NO: 430647 - DNA, 25 bp, Mus musculus
gaagaatatcaggagacctacgaca

SEQ ID NO: 430648 - DNA, 25 bp, Mus musculus
gaagaatattcatggagaggcgagc

SEQ ID NO: 430649 - DNA, 25 bp, Mus musculus
gaagaatcacgcctgcgagatgtgc

SEQ ID NO: 430650 - DNA, 25 bp, Mus musculus
gaagaatcatttccgcggttgaatc

SEQ ID NO: 430651 - DNA, 25 bp, Mus musculus
gaagaatccatatgcccacatcagc

SEQ ID NO: 430652 - DNA, 25 bp, Mus musculus
gaagaatccggccatcagcctagtg

SEQ ID NO: 430653 - DNA, 25 bp, Mus musculus
gaagaatccttcctacaacctggtg

SEQ ID NO: 430654 - DNA, 25 bp, Mus musculus
gaagaatctaacctacctgatgcag

SEQ ID NO: 430655 - DNA, 25 bp, Mus musculus
gaagaatctgctttcgggctcatag

SEQ ID NO: 430656 - DNA, 25 bp, Mus musculus
gaagaatcttcctgttaatgtgcgg

SEQ ID NO: 430657 - DNA, 25 bp, Mus musculus
gaagaatcttctagcctcctccagt

SEQ ID NO: 430658 - DNA, 25 bp, Mus musculus
gaagaatgaatgagaaaagagcccc

SEQ ID NO: 430659 - DNA, 25 bp, Mus musculus
gaagaatgacctgtagacctgtggg

SEQ ID NO: 430660 - DNA, 25 bp, Mus musculus
gaagaatgacgtctcaaggaagccc

SEQ ID NO: 430661 - DNA, 25 bp, Mus musculus
gaagaatgagaaagggttcactcct

SEQ ID NO: 430662 - DNA, 25 bp, Mus musculus
gaagaatgagcataaaggacgagcg

SEQ ID NO: 430663 - DNA, 25 bp, Mus musculus
gaagaatgcactccaactcagcttg

SEQ ID NO: 430664 - DNA, 25 bp, Mus musculus
gaagaatgccatgcgagtgtcactg

SEQ ID NO: 430665 - DNA, 25 bp, Mus musculus
gaagaatgccgcatcaccgagtggg

SEQ ID NO: 430666 - DNA, 25 bp, Mus musculus
gaagaatgctccttgtgtcactctg

SEQ ID NO: 430667 - DNA, 25 bp, Mus musculus
gaagaatggagctgtacaggccgcc

SEQ ID NO: 430668 - DNA, 25 bp, Mus musculus
gaagaatggcctgttacactcaagg

SEQ ID NO: 430669 - DNA, 25 bp, Mus musculus
gaagaatggtcgaagcctgggcatc

SEQ ID NO: 430670 - DNA, 25 bp, Mus musculus
gaagaatgtcggcaacacctgctgg

SEQ ID NO: 430671 - DNA, 25 bp, Mus musculus
gaagaatgtgctcccagatgcaggc

SEQ ID NO: 430672 - DNA, 25 bp, Mus musculus
gaagaatgtgctgcccgaagacaag

SEQ ID NO: 430673 - DNA, 25 bp, Mus musculus
gaagaatgtgtccagctacccaaaa

SEQ ID NO: 430674 - DNA, 25 bp, Mus musculus
gaagaattattgagccccatgagaa

SEQ ID NO: 430675 - DNA, 25 bp, Mus musculus
gaagaattcaaaggcgtggccccga

SEQ ID NO: 430676 - DNA, 25 bp, Mus musculus
gaagaattcatccagacagaggccc

SEQ ID NO: 430677 - DNA, 25 bp, Mus musculus
gaagaattcgtcaccctcaaagcaa

SEQ ID NO: 430678 - DNA, 25 bp, Mus musculus
gaagaattcttgatgatccagggca

SEQ ID NO: 430679 - DNA, 25 bp, Mus musculus
gaagaatttcctgcatgggaacatc

SEQ ID NO: 430680 - DNA, 25 bp, Mus musculus
gaagaatttgatttccaccaggcac

SEQ ID NO: 430681 - DNA, 25 bp, Mus musculus
gaagacaaccaggactggacccagt

SEQ ID NO: 430682 - DNA, 25 bp, Mus musculus
gaagacaaccttacatgaaaccagt

SEQ ID NO: 430683 - DNA, 25 bp, Mus musculus
gaagacaacttagccaggatccgcg

SEQ ID NO: 430684 - DNA, 25 bp, Mus musculus
gaagacaacttccttgtgcccatag

SEQ ID NO: 430685 - DNA, 25 bp, Mus musculus
gaagacaagttatgtagccacaata

SEQ ID NO: 430686 - DNA, 25 bp, Mus musculus
gaagacaatcagaggatccagtcag

SEQ ID NO: 430687 - DNA, 25 bp, Mus musculus
gaagacaatctaatgggccagtggg

SEQ ID NO: 430688 - DNA, 25 bp, Mus musculus
gaagacaatggaattgccagttaac

SEQ ID NO: 430689 - DNA, 25 bp, Mus musculus
gaagacacaatgagcagcacgacga

SEQ ID NO: 430690 - DNA, 25 bp, Mus musculus
gaagacacaggtgccacagtcaagg

SEQ ID NO: 430691 - DNA, 25 bp, Mus musculus
gaagacacatttagacaatcaccat

SEQ ID NO: 430692 - DNA, 25 bp, Mus musculus
gaagacaccagaagggagaattgga

SEQ ID NO: 430693 - DNA, 25 bp, Mus musculus
gaagacaccttattcccaagatgga

SEQ ID NO: 430694 - DNA, 25 bp, Mus musculus
gaagacacggtcagtacaatcagag

SEQ ID NO: 430695 - DNA, 25 bp, Mus musculus
gaagacactctgtatgccgatgtgg

SEQ ID NO: 430696 - DNA, 25 bp, Mus musculus
gaagacactgattttcagcacatga

SEQ ID NO: 430697 - DNA, 25 bp, Mus musculus
gaagacagaataggaagggcacacg

SEQ ID NO: 430698 - DNA, 25 bp, Mus musculus
gaagacagacataccagacggacag

SEQ ID NO: 430699 - DNA, 25 bp, Mus musculus
gaagacagagccgattttgaccaag

SEQ ID NO: 430700 - DNA, 25 bp, Mus musculus
gaagacagagggtggactatccagt

SEQ ID NO: 430701 - DNA, 25 bp, Mus musculus
gaagacagagtcctatatcagccac

SEQ ID NO: 430702 - DNA, 25 bp, Mus musculus
gaagacagccctttctctcagcgct

SEQ ID NO: 430703 - DNA, 25 bp, Mus musculus
gaagacagcgtttatgtgttcaaag

SEQ ID NO: 430704 - DNA, 25 bp, Mus musculus
gaagacagctcggaaatcatcctgg

SEQ ID NO: 430705 - DNA, 25 bp, Mus musculus
gaagacaggatatctccactttggg

SEQ ID NO: 430706 - DNA, 25 bp, Mus musculus
gaagacagtaatgcattggttttgg

SEQ ID NO: 430707 - DNA, 25 bp, Mus musculus
gaagacagtcacctaaaaccgcttg

SEQ ID NO: 430708 - DNA, 25 bp, Mus musculus
gaagacagtccgttgatctatcagc

SEQ ID NO: 430709 - DNA, 25 bp, Mus musculus
gaagacagtgctgatcaccggagca

SEQ ID NO: 430710 - DNA, 25 bp, Mus musculus
gaagacagtttagcatagacccaga

SEQ ID NO: 430711 - DNA, 25 bp, Mus musculus
gaagacatacccgatcagcatggat

SEQ ID NO: 430712 - DNA, 25 bp, Mus musculus
gaagacatcacactcaatccagctg

SEQ ID NO: 430713 - DNA, 25 bp, Mus musculus
gaagacatctactgtgaaggcccac

SEQ ID NO: 430714 - DNA, 25 bp, Mus musculus
gaagacatctactttgggctctggg

SEQ ID NO: 430715 - DNA, 25 bp, Mus musculus
gaagacatctggatgcccatcacca

SEQ ID NO: 430716 - DNA, 25 bp, Mus musculus
gaagacatgagtccatccagaactg

SEQ ID NO: 430717 - DNA, 25 bp, Mus musculus
gaagacatgctggtgcagtgaacat

SEQ ID NO: 430718 - DNA, 25 bp, Mus musculus
gaagacattccacgtgatcaggaca

SEQ ID NO: 430719 - DNA, 25 bp, Mus musculus
gaagacattcctctttggcccggat

SEQ ID NO: 430720 - DNA, 25 bp, Mus musculus
gaagacatttgaagcttcacccttt

SEQ ID NO: 430721 - DNA, 25 bp, Mus musculus
gaagaccaagacaatatgcaagagg

SEQ ID NO: 430722 - DNA, 25 bp, Mus musculus
gaagaccaagagaatgtcaaccccg

SEQ ID NO: 430723 - DNA, 25 bp, Mus musculus
gaagaccacggagaagaccaggttg

SEQ ID NO: 430724 - DNA, 25 bp, Mus musculus
gaagaccactgctttgctgacctgg

SEQ ID NO: 430725 - DNA, 25 bp, Mus musculus
gaagaccagagaggtgtagtaagcc

SEQ ID NO: 430726 - DNA, 25 bp, Mus musculus
gaagaccaggtgtacactcaagacc

SEQ ID NO: 430727 - DNA, 25 bp, Mus musculus
gaagaccaggttgagcttgtcacag

SEQ ID NO: 430728 - DNA, 25 bp, Mus musculus
gaagaccatccacctcggctttatg

SEQ ID NO: 430729 - DNA, 25 bp, Mus musculus
gaagaccatgttccgtatcccctgg

SEQ ID NO: 430730 - DNA, 25 bp, Mus musculus
gaagacccaaactgcatatcttgct

SEQ ID NO: 430731 - DNA, 25 bp, Mus musculus
gaagacccaactctgtgtgccatgg

SEQ ID NO: 430732 - DNA, 25 bp, Mus musculus
gaagacccaagtcagcattccggtg

SEQ ID NO: 430733 - DNA, 25 bp, Mus musculus
gaagacccacgtctcctgaacttag

SEQ ID NO: 430734 - DNA, 25 bp, Mus musculus
gaagacccagcatccttaggacagg

SEQ ID NO: 430735 - DNA, 25 bp, Mus musculus
gaagacccagcgcaaagtagaaact

SEQ ID NO: 430736 - DNA, 25 bp, Mus musculus
gaagacccagcttgcttcagtatag

SEQ ID NO: 430737 - DNA, 25 bp, Mus musculus
gaagacccattgagcaacagggcac

SEQ ID NO: 430738 - DNA, 25 bp, Mus musculus
gaagaccccaggttcgaaattgtgg

SEQ ID NO: 430739 - DNA, 25 bp, Mus musculus
gaagacccctgtgcttgtgagtcca

SEQ ID NO: 430740 - DNA, 25 bp, Mus musculus
gaagacccggcggttctggtctcat

SEQ ID NO: 430741 - DNA, 25 bp, Mus musculus
gaagacccggtgacttcgctctcca

SEQ ID NO: 430742 - DNA, 25 bp, Mus musculus
gaagacccgtctccagaaaagcaat

SEQ ID NO: 430743 - DNA, 25 bp, Mus musculus
gaagacccgtggagtgttaaccgag

SEQ ID NO: 430744 - DNA, 25 bp, Mus musculus
gaagacccttgtactggactgtcac

SEQ ID NO: 430745 - DNA, 25 bp, Mus musculus
gaagaccgaccagcttacctttgaa

SEQ ID NO: 430746 - DNA, 25 bp, Mus musculus
gaagaccgagccctttactacctgg

SEQ ID NO: 430747 - DNA, 25 bp, Mus musculus
gaagaccgcactggacaaaacactg

SEQ ID NO: 430748 - DNA, 25 bp, Mus musculus
gaagaccgtgtctatcagaagcccc

SEQ ID NO: 430749 - DNA, 25 bp, Mus musculus
gaagaccgttcttcgagagctgaag

SEQ ID NO: 430750 - DNA, 25 bp, Mus musculus
gaagacctactccaaaatccatcag

SEQ ID NO: 430751 - DNA, 25 bp, Mus musculus
gaagacctatgtgaaatgtcccgcc

SEQ ID NO: 430752 - DNA, 25 bp, Mus musculus
gaagacctatgtggcagtgaagaca

SEQ ID NO: 430753 - DNA, 25 bp, Mus musculus
gaagacctcaatggctgaaggcgag

SEQ ID NO: 430754 - DNA, 25 bp, Mus musculus
gaagacctcagaaagtggcagctca

SEQ ID NO: 430755 - DNA, 25 bp, Mus musculus
gaagacctctgtgactgatggcgca

SEQ ID NO: 430756 - DNA, 25 bp, Mus musculus
gaagacctgatcaccagatgctgag

SEQ ID NO: 430757 - DNA, 25 bp, Mus musculus
gaagacctgctgttcgaatagctgc

SEQ ID NO: 430758 - DNA, 25 bp, Mus musculus
gaagacctgggagactgtcgcagtt

SEQ ID NO: 430759 - DNA, 25 bp, Mus musculus
gaagacctgggcaatgtacaaagta

SEQ ID NO: 430760 - DNA, 25 bp, Mus musculus
gaagacctgggttgacatcctgcct

SEQ ID NO: 430761 - DNA, 25 bp, Mus musculus
gaagacctggttcacatcatggagc

SEQ ID NO: 430762 - DNA, 25 bp, Mus musculus
gaagaccttccatgaggcgagcgag

SEQ ID NO: 430763 - DNA, 25 bp, Mus musculus
gaagaccttgtgtcctgtttagctc

SEQ ID NO: 430764 - DNA, 25 bp, Mus musculus
gaagacgacttgaatgggatccaca

SEQ ID NO: 430765 - DNA, 25 bp, Mus musculus
gaagacgatgtctgctaatgaacta

SEQ ID NO: 430766 - DNA, 25 bp, Mus musculus
gaagacgattcctgggcactccctg

SEQ ID NO: 430767 - DNA, 25 bp, Mus musculus
gaagacgcaggcatatccggatcag

SEQ ID NO: 430768 - DNA, 25 bp, Mus musculus
gaagacgcgaccttcctaaacgagc

SEQ ID NO: 430769 - DNA, 25 bp, Mus musculus
gaagacgcgtttgcaactgaggcag

SEQ ID NO: 430770 - DNA, 25 bp, Mus musculus
gaagacgctcctctgggaacggtaa

SEQ ID NO: 430771 - DNA, 25 bp, Mus musculus
gaagacgctttgctctccacactac

SEQ ID NO: 430772 - DNA, 25 bp, Mus musculus
gaagacggaaacgtgcctgcactga

SEQ ID NO: 430773 - DNA, 25 bp, Mus musculus
gaagacgggtttgaggtccagccac

SEQ ID NO: 430774 - DNA, 25 bp, Mus musculus
gaagacggtcaactatatccagctg

SEQ ID NO: 430775 - DNA, 25 bp, Mus musculus
gaagacgtacttcctagctgcaagc

SEQ ID NO: 430776 - DNA, 25 bp, Mus musculus
gaagacgtcacattgttcgaaagcg

SEQ ID NO: 430777 - DNA, 25 bp, Mus musculus
gaagacgtgcgtccatatcgctgca

SEQ ID NO: 430778 - DNA, 25 bp, Mus musculus
gaagacgtggtatcaaaatcggagg

SEQ ID NO: 430779 - DNA, 25 bp, Mus musculus
gaagacgttccgagatgttccctga

SEQ ID NO: 430780 - DNA, 25 bp, Mus musculus
gaagactacagcatcacaaacacag

SEQ ID NO: 430781 - DNA, 25 bp, Mus musculus
gaagactacattgagcacgtgcacg

SEQ ID NO: 430782 - DNA, 25 bp, Mus musculus
gaagactaccctgcctggtcaggag

SEQ ID NO: 430783 - DNA, 25 bp, Mus musculus
gaagactacgacaaacagtcctgaa

SEQ ID NO: 430784 - DNA, 25 bp, Mus musculus
gaagactagagaagcttggcgcgat

SEQ ID NO: 430785 - DNA, 25 bp, Mus musculus
gaagactagtctattggctaccagt

SEQ ID NO: 430786 - DNA, 25 bp, Mus musculus
gaagactatctcgtgaccgctgacc

SEQ ID NO: 430787 - DNA, 25 bp, Mus musculus
gaagactatgtcgtggtccagtgca

SEQ ID NO: 430788 - DNA, 25 bp, Mus musculus
gaagactccactatgagcggctacc

SEQ ID NO: 430789 - DNA, 25 bp, Mus musculus
gaagactccatcacagattgctgca

SEQ ID NO: 430790 - DNA, 25 bp, Mus musculus
gaagactccctgatatagcaagccc

SEQ ID NO: 430791 - DNA, 25 bp, Mus musculus
gaagactccggccttgtgtgacaaa

SEQ ID NO: 430792 - DNA, 25 bp, Mus musculus
gaagactcctaagccgtgccggagt

SEQ ID NO: 430793 - DNA, 25 bp, Mus musculus
gaagactcgcctgatgaactccaag

SEQ ID NO: 430794 - DNA, 25 bp, Mus musculus
gaagactcggacgactatgatggag

SEQ ID NO: 430795 - DNA, 25 bp, Mus musculus
gaagactcgggcctacaatggacag

SEQ ID NO: 430796 - DNA, 25 bp, Mus musculus
gaagactctctcttgcactagtgtc

SEQ ID NO: 430797 - DNA, 25 bp, Mus musculus
gaagactctgcctctgtgaacttgc

SEQ ID NO: 430798 - DNA, 25 bp, Mus musculus
gaagactctgtggaggtcctggcca

SEQ ID NO: 430799 - DNA, 25 bp, Mus musculus
gaagactcttttctgtggacaggaa

SEQ ID NO: 430800 - DNA, 25 bp, Mus musculus
gaagactgagaagcatgcctcccag

SEQ ID NO: 430801 - DNA, 25 bp, Mus musculus
gaagactgagagttttggaccatcc

SEQ ID NO: 430802 - DNA, 25 bp, Mus musculus
gaagactgatattgtagccgcaact

SEQ ID NO: 430803 - DNA, 25 bp, Mus musculus
gaagactgcagagaataggacccac

SEQ ID NO: 430804 - DNA, 25 bp, Mus musculus
gaagactgcagagccttggcgtgcc

SEQ ID NO: 430805 - DNA, 25 bp, Mus musculus
gaagactggaacactggttgcagct

SEQ ID NO: 430806 - DNA, 25 bp, Mus musculus
gaagactggagtacataccctgggc

SEQ ID NO: 430807 - DNA, 25 bp, Mus musculus
gaagactggatacatgggcttccct

SEQ ID NO: 430808 - DNA, 25 bp, Mus musculus
gaagactggcgagaccttctacacc

SEQ ID NO: 430809 - DNA, 25 bp, Mus musculus
gaagactgtaataaaatgtttttgc

SEQ ID NO: 430810 - DNA, 25 bp, Mus musculus
gaagactgtatcagctgccccgtaa

SEQ ID NO: 430811 - DNA, 25 bp, Mus musculus
gaagactgtgagtgtcagttctcac

SEQ ID NO: 430812 - DNA, 25 bp, Mus musculus
gaagactgtgatcgactcccagaca

SEQ ID NO: 430813 - DNA, 25 bp, Mus musculus
gaagactgtgcttctcatctatgtg

SEQ ID NO: 430814 - DNA, 25 bp, Mus musculus
gaagactgtgtctgagaccccagca

SEQ ID NO: 430815 - DNA, 25 bp, Mus musculus
gaagactgtgttcacgtccggcagc

SEQ ID NO: 430816 - DNA, 25 bp, Mus musculus
gaagactgttacagattccagtgag

SEQ ID NO: 430817 - DNA, 25 bp, Mus musculus
gaagacttaccatgccatccagaga

SEQ ID NO: 430818 - DNA, 25 bp, Mus musculus
gaagacttagcattccctgcagaaa

SEQ ID NO: 430819 - DNA, 25 bp, Mus musculus
gaagacttatgctttcaagggcgac

SEQ ID NO: 430820 - DNA, 25 bp, Mus musculus
gaagacttcactagggccttgggca

SEQ ID NO: 430821 - DNA, 25 bp, Mus musculus
gaagacttccatttcgtccaggatg

SEQ ID NO: 430822 - DNA, 25 bp, Mus musculus
gaagacttccccagagtatgaagag

SEQ ID NO: 430823 - DNA, 25 bp, Mus musculus
gaagacttcgaactggccagcatgg

SEQ ID NO: 430824 - DNA, 25 bp, Mus musculus
gaagacttcgtactggctgtgactg

SEQ ID NO: 430825 - DNA, 25 bp, Mus musculus
gaagacttgaatgccacagactgag

SEQ ID NO: 430826 - DNA, 25 bp, Mus musculus
gaagacttgacaacgctgcgtgaca

SEQ ID NO: 430827 - DNA, 25 bp, Mus musculus
gaagacttgacaccccacctggggc

SEQ ID NO: 430828 - DNA, 25 bp, Mus musculus
gaagacttggtatcagaatcgcagg

SEQ ID NO: 430829 - DNA, 25 bp, Mus musculus
gaagacttgttcttgtttcatagtg

SEQ ID NO: 430830 - DNA, 25 bp, Mus musculus
gaagactttgaacgtgcgcctcaga

SEQ ID NO: 430831 - DNA, 25 bp, Mus musculus
gaagactttgtgtcaacctttgtca

SEQ ID NO: 430832 - DNA, 25 bp, Mus musculus
gaagactttgtgtggctgcatgaca

SEQ ID NO: 430833 - DNA, 25 bp, Mus musculus
gaagagaaaaatgggtcacgcatac

SEQ ID NO: 430834 - DNA, 25 bp, Mus musculus
gaagagaaaacgtattgccagccca

SEQ ID NO: 430835 - DNA, 25 bp, Mus musculus
gaagagaaagaacctttaagtgagc

SEQ ID NO: 430836 - DNA, 25 bp, Mus musculus
gaagagaaagctgaaatggctatct

SEQ ID NO: 430837 - DNA, 25 bp, Mus musculus
gaagagaacaacgagcacctggatg

SEQ ID NO: 430838 - DNA, 25 bp, Mus musculus
gaagagaacacaaaaagcttgactt

SEQ ID NO: 430839 - DNA, 25 bp, Mus musculus
gaagagaatggaagaaaaagcccca

SEQ ID NO: 430840 - DNA, 25 bp, Mus musculus
gaagagacaaagctccacgtttggg

SEQ ID NO: 430841 - DNA, 25 bp, Mus musculus
gaagagacaccttatctagcacaga

SEQ ID NO: 430842 - DNA, 25 bp, Mus musculus
gaagagaccctaaccaggcctgttg

SEQ ID NO: 430843 - DNA, 25 bp, Mus musculus
gaagagaccctgacacgcttagctg

SEQ ID NO: 430844 - DNA, 25 bp, Mus musculus
gaagagactcctgcagaatccgaaa

SEQ ID NO: 430845 - DNA, 25 bp, Mus musculus
gaagagactccttacctggtgaaga

SEQ ID NO: 430846 - DNA, 25 bp, Mus musculus
gaagagactgctagattccagccag

SEQ ID NO: 430847 - DNA, 25 bp, Mus musculus
gaagagagaaccttgtcgcgatcca

SEQ ID NO: 430848 - DNA, 25 bp, Mus musculus
gaagagagaattcgcatggaaaaca

SEQ ID NO: 430849 - DNA, 25 bp, Mus musculus
gaagagagagtcatgagcctcagag

SEQ ID NO: 430850 - DNA, 25 bp, Mus musculus
gaagagagcactaggcctgacatgg

SEQ ID NO: 430851 - DNA, 25 bp, Mus musculus
gaagagagcatctgcattcattcag

SEQ ID NO: 430852 - DNA, 25 bp, Mus musculus
gaagagaggagcaaaccctagcatc

SEQ ID NO: 430853 - DNA, 25 bp, Mus musculus
gaagagaggaggatctgacccaaac

SEQ ID NO: 430854 - DNA, 25 bp, Mus musculus
gaagagagggcttcattggtgacct

SEQ ID NO: 430855 - DNA, 25 bp, Mus musculus
gaagagaggtttccaccataagcga

SEQ ID NO: 430856 - DNA, 25 bp, Mus musculus
gaagagagtcatgcaacattgatca

SEQ ID NO: 430857 - DNA, 25 bp, Mus musculus
gaagagagtgtctctcagtccactc

SEQ ID NO: 430858 - DNA, 25 bp, Mus musculus
gaagagataacaccatgagctgcag

SEQ ID NO: 430859 - DNA, 25 bp, Mus musculus
gaagagatcaacgaatagggagcca

SEQ ID NO: 430860 - DNA, 25 bp, Mus musculus
gaagagatcaataccgtgcagctag

SEQ ID NO: 430861 - DNA, 25 bp, Mus musculus
gaagagatccagctcattagccagg

SEQ ID NO: 430862 - DNA, 25 bp, Mus musculus
gaagagatccgaggctgcatcgaga

SEQ ID NO: 430863 - DNA, 25 bp, Mus musculus
gaagagatggtcgacatagggcccc

SEQ ID NO: 430864 - DNA, 25 bp, Mus musculus
gaagagatgtaaggcctcacacggg

SEQ ID NO: 430865 - DNA, 25 bp, Mus musculus
gaagagattatagcgccctgcaaag

SEQ ID NO: 430866 - DNA, 25 bp, Mus musculus
gaagagattcgatttcctggaacta

SEQ ID NO: 430867 - DNA, 25 bp, Mus musculus
gaagagcaaagctgttctacaaagc

SEQ ID NO: 430868 - DNA, 25 bp, Mus musculus
gaagagcaacctccagttcgcaggg

SEQ ID NO: 430869 - DNA, 25 bp, Mus musculus
gaagagcaacttcaccctggagagg

SEQ ID NO: 430870 - DNA, 25 bp, Mus musculus
gaagagcaagaccacaacagaaaag

SEQ ID NO: 430871 - DNA, 25 bp, Mus musculus
gaagagcaagctccagcacttaccc

SEQ ID NO: 430872 - DNA, 25 bp, Mus musculus
gaagagcaatgtccactgtcaggtg

SEQ ID NO: 430873 - DNA, 25 bp, Mus musculus
gaagagcaccccagaaagctacatt

SEQ ID NO: 430874 - DNA, 25 bp, Mus musculus
gaagagcagatccaaggccaagtag

SEQ ID NO: 430875 - DNA, 25 bp, Mus musculus
gaagagcagctcattggaatcccag

SEQ ID NO: 430876 - DNA, 25 bp, Mus musculus
gaagagcaggaacccatacattgtt

SEQ ID NO: 430877 - DNA, 25 bp, Mus musculus
gaagagcaggttccctcatgagcac

SEQ ID NO: 430878 - DNA, 25 bp, Mus musculus
gaagagcagtctgtgttttaacccc

SEQ ID NO: 430879 - DNA, 25 bp, Mus musculus
gaagagcatccgacactgctgacag

SEQ ID NO: 430880 - DNA, 25 bp, Mus musculus
gaagagcatcttccttgtggcccac

SEQ ID NO: 430881 - DNA, 25 bp, Mus musculus
gaagagcatgaccatgcttcactag

SEQ ID NO: 430882 - DNA, 25 bp, Mus musculus
gaagagcatgcctttccagaagggc

SEQ ID NO: 430883 - DNA, 25 bp, Mus musculus
gaagagccaccttcatagcttacat

SEQ ID NO: 430884 - DNA, 25 bp, Mus musculus
gaagagcccactgatatcccggaaa

SEQ ID NO: 430885 - DNA, 25 bp, Mus musculus
gaagagccctatgttgtgcggacag

SEQ ID NO: 430886 - DNA, 25 bp, Mus musculus
gaagagcccttcctatgcggagcag

SEQ ID NO: 430887 - DNA, 25 bp, Mus musculus
gaagagccgagaagacacctcgagt

SEQ ID NO: 430888 - DNA, 25 bp, Mus musculus
gaagagccgcttgtttgacaccaaa

SEQ ID NO: 430889 - DNA, 25 bp, Mus musculus
gaagagccgggaactcatgcacatc

SEQ ID NO: 430890 - DNA, 25 bp, Mus musculus
gaagagcctaaatgtttctgtcagg

SEQ ID NO: 430891 - DNA, 25 bp, Mus musculus
gaagagcctcaacgattccatccag

SEQ ID NO: 430892 - DNA, 25 bp, Mus musculus
gaagagcctcttgagaatgccgaga

SEQ ID NO: 430893 - DNA, 25 bp, Mus musculus
gaagagcctgatgaatgccgttgcc

SEQ ID NO: 430894 - DNA, 25 bp, Mus musculus
gaagagcctgcaggcaccggatgct

SEQ ID NO: 430895 - DNA, 25 bp, Mus musculus
gaagagcctgctcctgactgtcaca

SEQ ID NO: 430896 - DNA, 25 bp, Mus musculus
gaagagccttgcgtgtcgatcgcag

SEQ ID NO: 430897 - DNA, 25 bp, Mus musculus
gaagagcgagagatctgtgccaaca

SEQ ID NO: 430898 - DNA, 25 bp, Mus musculus
gaagagcgcgtttcccagctgatga

SEQ ID NO: 430899 - DNA, 25 bp, Mus musculus
gaagagcggatccttcaggcatata

SEQ ID NO: 430900 - DNA, 25 bp, Mus musculus
gaagagcgggatctgtgtgtgtgac

SEQ ID NO: 430901 - DNA, 25 bp, Mus musculus
gaagagcgtataccacctgagctgc

SEQ ID NO: 430902 - DNA, 25 bp, Mus musculus
gaagagctaacccaaatgtcagatg

SEQ ID NO: 430903 - DNA, 25 bp, Mus musculus
gaagagctacaggaccatatggacc

SEQ ID NO: 430904 - DNA, 25 bp, Mus musculus
gaagagctactagcagctgcggagc

SEQ ID NO: 430905 - DNA, 25 bp, Mus musculus
gaagagctacttcccgctgcagaaa

SEQ ID NO: 430906 - DNA, 25 bp, Mus musculus
gaagagctcattgcagagatcagcc

SEQ ID NO: 430907 - DNA, 25 bp, Mus musculus
gaagagctgaccgttgcctacggct

SEQ ID NO: 430908 - DNA, 25 bp, Mus musculus
gaagagctgaccttctttagcgtcc

SEQ ID NO: 430909 - DNA, 25 bp, Mus musculus
gaagagctgagattcgccatccaga

SEQ ID NO: 430910 - DNA, 25 bp, Mus musculus
gaagagctgataacgaaggccacct

SEQ ID NO: 430911 - DNA, 25 bp, Mus musculus
gaagagctgcctgtctcaacagggc

SEQ ID NO: 430912 - DNA, 25 bp, Mus musculus
gaagagctgctgcaacctgctgaaa

SEQ ID NO: 430913 - DNA, 25 bp, Mus musculus
gaagagctggacatcagacccatct

SEQ ID NO: 430914 - DNA, 25 bp, Mus musculus
gaagagctgggctttgcactctgct

SEQ ID NO: 430915 - DNA, 25 bp, Mus musculus
gaagagcttactggtgcgcacatct

SEQ ID NO: 430916 - DNA, 25 bp, Mus musculus
gaagagcttccaaaatgcctgaggc

SEQ ID NO: 430917 - DNA, 25 bp, Mus musculus
gaagagcttgcagttgacagtgtcc

SEQ ID NO: 430918 - DNA, 25 bp, Mus musculus
gaagagcttgcctggattccgggat

SEQ ID NO: 430919 - DNA, 25 bp, Mus musculus
gaagagctttgctctgtagagcttc

SEQ ID NO: 430920 - DNA, 25 bp, Mus musculus
gaagagctttgtaaccgtgtttact

SEQ ID NO: 430921 - DNA, 25 bp, Mus musculus
gaagaggaaactgaaaactccagag

SEQ ID NO: 430922 - DNA, 25 bp, Mus musculus
gaagaggacatcgttaacccagcca

SEQ ID NO: 430923 - DNA, 25 bp, Mus musculus
gaagaggactcaatttgtaaacctc

SEQ ID NO: 430924 - DNA, 25 bp, Mus musculus
gaagaggactgtttctggagcccca

SEQ ID NO: 430925 - DNA, 25 bp, Mus musculus
gaagaggagcgctagccctatggat

SEQ ID NO: 430926 - DNA, 25 bp, Mus musculus
gaagaggagcttcctgacatcagcc

SEQ ID NO: 430927 - DNA, 25 bp, Mus musculus
gaagaggattattctaacccagact

SEQ ID NO: 430928 - DNA, 25 bp, Mus musculus
gaagaggcactaatgttccccagct

SEQ ID NO: 430929 - DNA, 25 bp, Mus musculus
gaagaggcaggattcagagtcagca

SEQ ID NO: 430930 - DNA, 25 bp, Mus musculus
gaagaggccaacgttctccaggaag

SEQ ID NO: 430931 - DNA, 25 bp, Mus musculus
gaagaggccaactccagctaggagg

SEQ ID NO: 430932 - DNA, 25 bp, Mus musculus
gaagaggccgcaggccagctgctca

SEQ ID NO: 430933 - DNA, 25 bp, Mus musculus
gaagaggccgtttcctccaaagcaa

SEQ ID NO: 430934 - DNA, 25 bp, Mus musculus
gaagaggcgcacataacggcagatg

SEQ ID NO: 430935 - DNA, 25 bp, Mus musculus
gaagaggctatacccgatctgggca

SEQ ID NO: 430936 - DNA, 25 bp, Mus musculus
gaagaggctgaaatccaggcggaac

SEQ ID NO: 430937 - DNA, 25 bp, Mus musculus
gaagaggctgtgattgcccgagatc

SEQ ID NO: 430938 - DNA, 25 bp, Mus musculus
gaagaggcttgaagagaggccacac

SEQ ID NO: 430939 - DNA, 25 bp, Mus musculus
gaagaggctttcatgcagtgtgcaa

SEQ ID NO: 430940 - DNA, 25 bp, Mus musculus
gaagagggaccttgctacctgatag

SEQ ID NO: 430941 - DNA, 25 bp, Mus musculus
gaagagggacgagttctccaccaag

SEQ ID NO: 430942 - DNA, 25 bp, Mus musculus
gaagagggactcttacccactggaa

SEQ ID NO: 430943 - DNA, 25 bp, Mus musculus
gaagagggcaatggaccccttggaa

SEQ ID NO: 430944 - DNA, 25 bp, Mus musculus
gaagagggctcttcattgcagaaga

SEQ ID NO: 430945 - DNA, 25 bp, Mus musculus
gaagagggttttgcgctccatccgt

SEQ ID NO: 430946 - DNA, 25 bp, Mus musculus
gaagaggtcagcttgtaacaactca

SEQ ID NO: 430947 - DNA, 25 bp, Mus musculus
gaagaggtcctatgtgctgcagcag

SEQ ID NO: 430948 - DNA, 25 bp, Mus musculus
gaagaggttcccatccgtacattga

SEQ ID NO: 430949 - DNA, 25 bp, Mus musculus
gaagaggttcttcatcttgcagagc

SEQ ID NO: 430950 - DNA, 25 bp, Mus musculus
gaagaggttgagcttttgcaaagaa

SEQ ID NO: 430951 - DNA, 25 bp, Mus musculus
gaagaggttggctttgctctgacca

SEQ ID NO: 430952 - DNA, 25 bp, Mus musculus
gaagagtaaacgacatgcagcgagc

SEQ ID NO: 430953 - DNA, 25 bp, Mus musculus
gaagagtaaatttgaacggcccagc

SEQ ID NO: 430954 - DNA, 25 bp, Mus musculus
gaagagtaatccaccgcacagatga

SEQ ID NO: 430955 - DNA, 25 bp, Mus musculus
gaagagtacaatgtccgcggctacc

SEQ ID NO: 430956 - DNA, 25 bp, Mus musculus
gaagagtacctgtcctcggatccct

SEQ ID NO: 430957 - DNA, 25 bp, Mus musculus
gaagagtactccatagtccacagga

SEQ ID NO: 430958 - DNA, 25 bp, Mus musculus
gaagagtataaagaccaggtgcact

SEQ ID NO: 430959 - DNA, 25 bp, Mus musculus
gaagagtatcttccagcaggccatt

SEQ ID NO: 430960 - DNA, 25 bp, Mus musculus
gaagagtcaaaccttgggcacagct

SEQ ID NO: 430961 - DNA, 25 bp, Mus musculus
gaagagtcaacacttaatgcaagct

SEQ ID NO: 430962 - DNA, 25 bp, Mus musculus
gaagagtcaccttaccccagtactg

SEQ ID NO: 430963 - DNA, 25 bp, Mus musculus
gaagagtcagctcctgttcgcactg

SEQ ID NO: 430964 - DNA, 25 bp, Mus musculus
gaagagtccagcattaggctccaca

SEQ ID NO: 430965 - DNA, 25 bp, Mus musculus
gaagagtccccttggccattctgag

SEQ ID NO: 430966 - DNA, 25 bp, Mus musculus
gaagagtccttctctgacctgaccg

SEQ ID NO: 430967 - DNA, 25 bp, Mus musculus
gaagagtctaagctgaagtgcccac

SEQ ID NO: 430968 - DNA, 25 bp, Mus musculus
gaagagtctcctcattggatgccag

SEQ ID NO: 430969 - DNA, 25 bp, Mus musculus
gaagagtctcctgccaataacactg

SEQ ID NO: 430970 - DNA, 25 bp, Mus musculus
gaagagtctgatcattgccaagcca

SEQ ID NO: 430971 - DNA, 25 bp, Mus musculus
gaagagtctggtcataacgctgccg

SEQ ID NO: 430972 - DNA, 25 bp, Mus musculus
gaagagtcttgcaggatctcctccc

SEQ ID NO: 430973 - DNA, 25 bp, Mus musculus
gaagagtctttagacctctgctggg

SEQ ID NO: 430974 - DNA, 25 bp, Mus musculus
gaagagtgactaagcttttgacaac

SEQ ID NO: 430975 - DNA, 25 bp, Mus musculus
gaagagtgccgtttctgcataagca

SEQ ID NO: 430976 - DNA, 25 bp, Mus musculus
gaagagtgcctatcatcagtacttg

SEQ ID NO: 430977 - DNA, 25 bp, Mus musculus
gaagagtggctaccttcggaccagc

SEQ ID NO: 430978 - DNA, 25 bp, Mus musculus
gaagagtggtatcctgctgctcaca

SEQ ID NO: 430979 - DNA, 25 bp, Mus musculus
gaagagtggttcaaatgccgctacg

SEQ ID NO: 430980 - DNA, 25 bp, Mus musculus
gaagagtgtgaaatcggactcgctg

SEQ ID NO: 430981 - DNA, 25 bp, Mus musculus
gaagagttcacccttaaattcggag

SEQ ID NO: 430982 - DNA, 25 bp, Mus musculus
gaagagttccgccatgtcatcgcct

SEQ ID NO: 430983 - DNA, 25 bp, Mus musculus
gaagagttctcgaggctgtcccatc

SEQ ID NO: 430984 - DNA, 25 bp, Mus musculus
gaagagttgatcaagacggccctca

SEQ ID NO: 430985 - DNA, 25 bp, Mus musculus
gaagagttgcagcagtctaccctgt

SEQ ID NO: 430986 - DNA, 25 bp, Mus musculus
gaagagttgccagtccttttagcca

SEQ ID NO: 430987 - DNA, 25 bp, Mus musculus
gaagagttgtttccccgctacacta

SEQ ID NO: 430988 - DNA, 25 bp, Mus musculus
gaagagtttcctagcatgatcaggc

SEQ ID NO: 430989 - DNA, 25 bp, Mus musculus
gaagagtttccttgagaaggcgact

SEQ ID NO: 430990 - DNA, 25 bp, Mus musculus
gaagagtttctgcacacgctgttga

SEQ ID NO: 430991 - DNA, 25 bp, Mus musculus
gaagagtttgattccctggccactg

SEQ ID NO: 430992 - DNA, 25 bp, Mus musculus
gaagataaagtctaccttgcaggac

SEQ ID NO: 430993 - DNA, 25 bp, Mus musculus
gaagataacgaaaaccctgattggg

SEQ ID NO: 430994 - DNA, 25 bp, Mus musculus
gaagataagatgtacaccggcagga

SEQ ID NO: 430995 - DNA, 25 bp, Mus musculus
gaagataagtggctgggtgcctgag

SEQ ID NO: 430996 - DNA, 25 bp, Mus musculus
gaagataagtttaggccagatatgg

SEQ ID NO: 430997 - DNA, 25 bp, Mus musculus
gaagataatgacagtgtgaccccac

SEQ ID NO: 430998 - DNA, 25 bp, Mus musculus
gaagataatgcaggatggtttggct

SEQ ID NO: 430999 - DNA, 25 bp, Mus musculus
gaagatacacacctgggctacgaag

SEQ ID NO: 431000 - DNA, 25 bp, Mus musculus
gaagatacctcagactgtggccgcg

SEQ ID NO: 431001 - DNA, 25 bp, Mus musculus
gaagatactcaagtcagggacaaag

SEQ ID NO: 431002 - DNA, 25 bp, Mus musculus
gaagatagcaacaccactgtgacgg

SEQ ID NO: 431003 - DNA, 25 bp, Mus musculus
gaagatatccccagaaaaggcctcc

SEQ ID NO: 431004 - DNA, 25 bp, Mus musculus
gaagatatccggacagaggctctag

SEQ ID NO: 431005 - DNA, 25 bp, Mus musculus
gaagatatcttgtcctcagcctgct

SEQ ID NO: 431006 - DNA, 25 bp, Mus musculus
gaagatattcccttggtccccagag

SEQ ID NO: 431007 - DNA, 25 bp, Mus musculus
gaagatcaagccagagttaccaggt

SEQ ID NO: 431008 - DNA, 25 bp, Mus musculus
gaagatcaagctagacactccagag

SEQ ID NO: 431009 - DNA, 25 bp, Mus musculus
gaagatcaccaatgtcaccaagcgg

SEQ ID NO: 431010 - DNA, 25 bp, Mus musculus
gaagatcacgacgttggctttccaa

SEQ ID NO: 431011 - DNA, 25 bp, Mus musculus
gaagatcacttccttgcagagccaa

SEQ ID NO: 431012 - DNA, 25 bp, Mus musculus
gaagatcagaccactgctcgtaaca

SEQ ID NO: 431013 - DNA, 25 bp, Mus musculus
gaagatcagcgtgtcagagtccctc

SEQ ID NO: 431014 - DNA, 25 bp, Mus musculus
gaagatcagcgtttccaggcagaca

SEQ ID NO: 431015 - DNA, 25 bp, Mus musculus
gaagatcaggagttagaagttcacc

SEQ ID NO: 431016 - DNA, 25 bp, Mus musculus
gaagatcataaactcgcggtgtgcc

SEQ ID NO: 431017 - DNA, 25 bp, Mus musculus
gaagatcatcaagcagccaggagcc

SEQ ID NO: 431018 - DNA, 25 bp, Mus musculus
gaagatcatcgtgcacaccgtgcag

SEQ ID NO: 431019 - DNA, 25 bp, Mus musculus
gaagatcatggcttacctccagcaa

SEQ ID NO: 431020 - DNA, 25 bp, Mus musculus
gaagatcatgtcacacctaacgagg

SEQ ID NO: 431021 - DNA, 25 bp, Mus musculus
gaagatcattggaggccgagaagcc

SEQ ID NO: 431022 - DNA, 25 bp, Mus musculus
gaagatccacattccggagccggat

SEQ ID NO: 431023 - DNA, 25 bp, Mus musculus
gaagatccagagagacgtggcccat

SEQ ID NO: 431024 - DNA, 25 bp, Mus musculus
gaagatccagcgtgggcagattccc

SEQ ID NO: 431025 - DNA, 25 bp, Mus musculus
gaagatccctctcctttgccaggtg

SEQ ID NO: 431026 - DNA, 25 bp, Mus musculus
gaagatccgacagcgctttggcaag

SEQ ID NO: 431027 - DNA, 25 bp, Mus musculus
gaagatcctagtttccaatggcaca

SEQ ID NO: 431028 - DNA, 25 bp, Mus musculus
gaagatcctgtgtgatcagcctcat

SEQ ID NO: 431029 - DNA, 25 bp, Mus musculus
gaagatccttcttctaggcctgagg

SEQ ID NO: 431030 - DNA, 25 bp, Mus musculus
gaagatccttgtagctgacctctgg

SEQ ID NO: 431031 - DNA, 25 bp, Mus musculus
gaagatcgtcgctataaccctccaa

SEQ ID NO: 431032 - DNA, 25 bp, Mus musculus
gaagatcgttctctgcctccgaaaa

SEQ ID NO: 431033 - DNA, 25 bp, Mus musculus
gaagatctatgtccggaagcctgct

SEQ ID NO: 431034 - DNA, 25 bp, Mus musculus
gaagatctccgctttgatggacaaa

SEQ ID NO: 431035 - DNA, 25 bp, Mus musculus
gaagatctcgatctcgaagccgtag

SEQ ID NO: 431036 - DNA, 25 bp, Mus musculus
gaagatctctctgccgagtgggacg

SEQ ID NO: 431037 - DNA, 25 bp, Mus musculus
gaagatctgaaggtgccagccatat

SEQ ID NO: 431038 - DNA, 25 bp, Mus musculus
gaagatctgaagtctacacaaggag

SEQ ID NO: 431039 - DNA, 25 bp, Mus musculus
gaagatctgcaactgggcgcaatca

SEQ ID NO: 431040 - DNA, 25 bp, Mus musculus
gaagatctgctatgatgccctggac

SEQ ID NO: 431041 - DNA, 25 bp, Mus musculus
gaagatctggcttttgagggaaccc

SEQ ID NO: 431042 - DNA, 25 bp, Mus musculus
gaagatctgtgctcccctagtcaca

SEQ ID NO: 431043 - DNA, 25 bp, Mus musculus
gaagatcttcaagggtcactcgcct

SEQ ID NO: 431044 - DNA, 25 bp, Mus musculus
gaagatcttcgatgggtccctccag

SEQ ID NO: 431045 - DNA, 25 bp, Mus musculus
gaagatgaacatacgcacaatagca

SEQ ID NO: 431046 - DNA, 25 bp, Mus musculus
gaagatgaagatcctcctgctactg

SEQ ID NO: 431047 - DNA, 25 bp, Mus musculus
gaagatgacaacctctcaggcggga

SEQ ID NO: 431048 - DNA, 25 bp, Mus musculus
gaagatgacatcacctggacctcag

SEQ ID NO: 431049 - DNA, 25 bp, Mus musculus
gaagatgacatcgttgccccaatca

SEQ ID NO: 431050 - DNA, 25 bp, Mus musculus
gaagatgacatgactttctctgcct

SEQ ID NO: 431051 - DNA, 25 bp, Mus musculus
gaagatgacgggactcagaatacct

SEQ ID NO: 431052 - DNA, 25 bp, Mus musculus
gaagatgactggttcctgctgggac

SEQ ID NO: 431053 - DNA, 25 bp, Mus musculus
gaagatgacttctctaaccagttac

SEQ ID NO: 431054 - DNA, 25 bp, Mus musculus
gaagatgagacctcgtggacagagc

SEQ ID NO: 431055 - DNA, 25 bp, Mus musculus
gaagatgagacctgctggctacctg

SEQ ID NO: 431056 - DNA, 25 bp, Mus musculus
gaagatgagccctccaaggagccaa

SEQ ID NO: 431057 - DNA, 25 bp, Mus musculus
gaagatgagtacctacctagtggcc

SEQ ID NO: 431058 - DNA, 25 bp, Mus musculus
gaagatgagttccagccgtttgacc

SEQ ID NO: 431059 - DNA, 25 bp, Mus musculus
gaagatgatcttggccatggctcac

SEQ ID NO: 431060 - DNA, 25 bp, Mus musculus
gaagatgatgaaggtatgcatgcct

SEQ ID NO: 431061 - DNA, 25 bp, Mus musculus
gaagatgatgctctcaatggtgcca

SEQ ID NO: 431062 - DNA, 25 bp, Mus musculus
gaagatgcacactctgcgatgaaga

SEQ ID NO: 431063 - DNA, 25 bp, Mus musculus
gaagatgcacatctccagatggcaa

SEQ ID NO: 431064 - DNA, 25 bp, Mus musculus
gaagatgcagaaggttccccagtgg

SEQ ID NO: 431065 - DNA, 25 bp, Mus musculus
gaagatgcagagaaacaggaccagc

SEQ ID NO: 431066 - DNA, 25 bp, Mus musculus
gaagatgccactgctcagagttcca

SEQ ID NO: 431067 - DNA, 25 bp, Mus musculus
gaagatgccatctatccctgaggag

SEQ ID NO: 431068 - DNA, 25 bp, Mus musculus
gaagatgccatcttacactcggaag

SEQ ID NO: 431069 - DNA, 25 bp, Mus musculus
gaagatgcccaggtgagactcctgc

SEQ ID NO: 431070 - DNA, 25 bp, Mus musculus
gaagatgccctcagccagtactgag

SEQ ID NO: 431071 - DNA, 25 bp, Mus musculus
gaagatgcccttctactacagccac

SEQ ID NO: 431072 - DNA, 25 bp, Mus musculus
gaagatgccgccttttattgcccaa

SEQ ID NO: 431073 - DNA, 25 bp, Mus musculus
gaagatgcgcctggatgtcaacaag

SEQ ID NO: 431074 - DNA, 25 bp, Mus musculus
gaagatgcgcttagccagtcgagcc

SEQ ID NO: 431075 - DNA, 25 bp, Mus musculus
gaagatgctactccagcagctctgg

SEQ ID NO: 431076 - DNA, 25 bp, Mus musculus
gaagatgctatctgtgacccagcaa

SEQ ID NO: 431077 - DNA, 25 bp, Mus musculus
gaagatgctcaaagtcacggtgccc

SEQ ID NO: 431078 - DNA, 25 bp, Mus musculus
gaagatgctctggtgaaggccgaaa

SEQ ID NO: 431079 - DNA, 25 bp, Mus musculus
gaagatgctgagaggcacaaatact

SEQ ID NO: 431080 - DNA, 25 bp, Mus musculus
gaagatgctgcaatgaagacccgag

SEQ ID NO: 431081 - DNA, 25 bp, Mus musculus
gaagatgctgtcagcctgtgcagtc

SEQ ID NO: 431082 - DNA, 25 bp, Mus musculus
gaagatgcttgctaacaccaggagg

SEQ ID NO: 431083 - DNA, 25 bp, Mus musculus
gaagatgcttttcttgaggctgcca

SEQ ID NO: 431084 - DNA, 25 bp, Mus musculus
gaagatggaagcctgcatggacagg

SEQ ID NO: 431085 - DNA, 25 bp, Mus musculus
gaagatggagacatgaagccggcca

SEQ ID NO: 431086 - DNA, 25 bp, Mus musculus
gaagatggagcctttcaagacagca

SEQ ID NO: 431087 - DNA, 25 bp, Mus musculus
gaagatggagctatagacctgtaaa

SEQ ID NO: 431088 - DNA, 25 bp, Mus musculus
gaagatggatcctcaacccaagggc

SEQ ID NO: 431089 - DNA, 25 bp, Mus musculus
gaagatggattccagtcaaccggaa

SEQ ID NO: 431090 - DNA, 25 bp, Mus musculus
gaagatggccgcgaaacccatgttg

SEQ ID NO: 431091 - DNA, 25 bp, Mus musculus
gaagatggcctcctgaagctctgga

SEQ ID NO: 431092 - DNA, 25 bp, Mus musculus
gaagatggctactaccggaagatgc

SEQ ID NO: 431093 - DNA, 25 bp, Mus musculus
gaagatggctctgcggatcctgaga

SEQ ID NO: 431094 - DNA, 25 bp, Mus musculus
gaagatggcttaccagtccaaggct

SEQ ID NO: 431095 - DNA, 25 bp, Mus musculus
gaagatgggctgtacaactaccgct

SEQ ID NO: 431096 - DNA, 25 bp, Mus musculus
gaagatggtgtctatggcccgaaac

SEQ ID NO: 431097 - DNA, 25 bp, Mus musculus
gaagatgtaaagttccgagcccacc

SEQ ID NO: 431098 - DNA, 25 bp, Mus musculus
gaagatgtcaggtatcaaagcaaca

SEQ ID NO: 431099 - DNA, 25 bp, Mus musculus
gaagatgtgcacttttcaccccagg

SEQ ID NO: 431100 - DNA, 25 bp, Mus musculus
gaagatgtgcccaagcgactctgaa

SEQ ID NO: 431101 - DNA, 25 bp, Mus musculus
gaagatgtgtcttgggcatggaacc

SEQ ID NO: 431102 - DNA, 25 bp, Mus musculus
gaagatgttccctatgctcgggcag

SEQ ID NO: 431103 - DNA, 25 bp, Mus musculus
gaagatgttgataatagagcccctc

SEQ ID NO: 431104 - DNA, 25 bp, Mus musculus
gaagatgtttgctacgaccctggag

SEQ ID NO: 431105 - DNA, 25 bp, Mus musculus
gaagatgttttcagactcctgggcc

SEQ ID NO: 431106 - DNA, 25 bp, Mus musculus
gaagattacgtgaatgttcctgaga

SEQ ID NO: 431107 - DNA, 25 bp, Mus musculus
gaagattagaaccatgcctcacagc

SEQ ID NO: 431108 - DNA, 25 bp, Mus musculus
gaagattagaccagactcatcgagg

SEQ ID NO: 431109 - DNA, 25 bp, Mus musculus
gaagattattgatcccaagctgggc

SEQ ID NO: 431110 - DNA, 25 bp, Mus musculus
gaagattcagcaatgtgtagccaac

SEQ ID NO: 431111 - DNA, 25 bp, Mus musculus
gaagattcaggaacaccaataggca

SEQ ID NO: 431112 - DNA, 25 bp, Mus musculus
gaagattccgctggtactgagccga

SEQ ID NO: 431113 - DNA, 25 bp, Mus musculus
gaagattctaaggttcctcgggcct

SEQ ID NO: 431114 - DNA, 25 bp, Mus musculus
gaagattctagtcttcctggcaggc

SEQ ID NO: 431115 - DNA, 25 bp, Mus musculus
gaagattctcatgctcaaggaggag

SEQ ID NO: 431116 - DNA, 25 bp, Mus musculus
gaagattcttcgttgtcaagccgcc

SEQ ID NO: 431117 - DNA, 25 bp, Mus musculus
gaagattgaccttgccattcctgga

SEQ ID NO: 431118 - DNA, 25 bp, Mus musculus
gaagattgaggactgcatccgcgct

SEQ ID NO: 431119 - DNA, 25 bp, Mus musculus
gaagattgcattcccgtgttctaaa

SEQ ID NO: 431120 - DNA, 25 bp, Mus musculus
gaagattgccaacatcacagacgtg

SEQ ID NO: 431121 - DNA, 25 bp, Mus musculus
gaagattgcgttacccacaaggagc

SEQ ID NO: 431122 - DNA, 25 bp, Mus musculus
gaagattggtgaacccatcgaggaa

SEQ ID NO: 431123 - DNA, 25 bp, Mus musculus
gaagattgtagttcagatcctgctt

SEQ ID NO: 431124 - DNA, 25 bp, Mus musculus
gaagattgtcactcccctggacgag

SEQ ID NO: 431125 - DNA, 25 bp, Mus musculus
gaagatttaactgcagagcgccagc

SEQ ID NO: 431126 - DNA, 25 bp, Mus musculus
gaagatttatgatctaaaccacacc

SEQ ID NO: 431127 - DNA, 25 bp, Mus musculus
gaagatttattggtgtgtgggtcta

SEQ ID NO: 431128 - DNA, 25 bp, Mus musculus
gaagatttcacctgcgggttacaaa

SEQ ID NO: 431129 - DNA, 25 bp, Mus musculus
gaagatttcctccagttgccccagg

SEQ ID NO: 431130 - DNA, 25 bp, Mus musculus
gaagatttcgttcagcgttaccagg

SEQ ID NO: 431131 - DNA, 25 bp, Mus musculus
gaagatttctcccaacgactcaaga

SEQ ID NO: 431132 - DNA, 25 bp, Mus musculus
gaagatttctgatagttactaccaa

SEQ ID NO: 431133 - DNA, 25 bp, Mus musculus
gaagatttgaaatgccgcggagaag

SEQ ID NO: 431134 - DNA, 25 bp, Mus musculus
gaagatttgcgactttggcctggcc

SEQ ID NO: 431135 - DNA, 25 bp, Mus musculus
gaagattttagaagcacctccagac

SEQ ID NO: 431136 - DNA, 25 bp, Mus musculus
gaagattttccagagttaccatgca

SEQ ID NO: 431137 - DNA, 25 bp, Mus musculus
gaagattttctggactactgcctag

SEQ ID NO: 431138 - DNA, 25 bp, Mus musculus
gaagcaaaaccatcgagatccagga

SEQ ID NO: 431139 - DNA, 25 bp, Mus musculus
gaagcaaaatttggaaaaggctgtt

SEQ ID NO: 431140 - DNA, 25 bp, Mus musculus
gaagcaaacctaagagtccccaggg

SEQ ID NO: 431141 - DNA, 25 bp, Mus musculus
gaagcaaataatcctgaaacgccag

SEQ ID NO: 431142 - DNA, 25 bp, Mus musculus
gaagcaacacttatcttcatctccc

SEQ ID NO: 431143 - DNA, 25 bp, Mus musculus
gaagcaacagtggttctgcaactcc

SEQ ID NO: 431144 - DNA, 25 bp, Mus musculus
gaagcaaccttctgtgcagcgccat

SEQ ID NO: 431145 - DNA, 25 bp, Mus musculus
gaagcaacgtttacacaggatggac

SEQ ID NO: 431146 - DNA, 25 bp, Mus musculus
gaagcaacttagtgccttgtaatct

SEQ ID NO: 431147 - DNA, 25 bp, Mus musculus
gaagcaacttctcactcctaaccaa

SEQ ID NO: 431148 - DNA, 25 bp, Mus musculus
gaagcaagaggtgttcatggccaac

SEQ ID NO: 431149 - DNA, 25 bp, Mus musculus
gaagcaagcctcagtgacacacatg

SEQ ID NO: 431150 - DNA, 25 bp, Mus musculus
gaagcaagccttaatgtccgagctg

SEQ ID NO: 431151 - DNA, 25 bp, Mus musculus
gaagcaagctgctaagatcaaagca

SEQ ID NO: 431152 - DNA, 25 bp, Mus musculus
gaagcaagggctgatcgattgaagt

SEQ ID NO: 431153 - DNA, 25 bp, Mus musculus
gaagcaaggtatatagatcccagga

SEQ ID NO: 431154 - DNA, 25 bp, Mus musculus
gaagcaagttcagctggacccactg

SEQ ID NO: 431155 - DNA, 25 bp, Mus musculus
gaagcaatacctctgaatgtccatg

SEQ ID NO: 431156 - DNA, 25 bp, Mus musculus
gaagcaatgcatacaggcctctgga

SEQ ID NO: 431157 - DNA, 25 bp, Mus musculus
gaagcaatggaaagcaaccgggagc

SEQ ID NO: 431158 - DNA, 25 bp, Mus musculus
gaagcaatggccacggctcatgtga

SEQ ID NO: 431159 - DNA, 25 bp, Mus musculus
gaagcaattgccgtgacaatgaggt

SEQ ID NO: 431160 - DNA, 25 bp, Mus musculus
gaagcaattggttatagtgaaacag

SEQ ID NO: 431161 - DNA, 25 bp, Mus musculus
gaagcacagcacaaagaattagagg

SEQ ID NO: 431162 - DNA, 25 bp, Mus musculus
gaagcacaggagagttttgcttaaa

SEQ ID NO: 431163 - DNA, 25 bp, Mus musculus
gaagcacagggttataacgaccacg

SEQ ID NO: 431164 - DNA, 25 bp, Mus musculus
gaagcacagtattcctgccttcctg

SEQ ID NO: 431165 - DNA, 25 bp, Mus musculus
gaagcacatgattgaccctacagaa

SEQ ID NO: 431166 - DNA, 25 bp, Mus musculus
gaagcacatgtgactttaaggacga

SEQ ID NO: 431167 - DNA, 25 bp, Mus musculus
gaagcacattcggacccatacagga

SEQ ID NO: 431168 - DNA, 25 bp, Mus musculus
gaagcaccaagtaagttaaacacct

SEQ ID NO: 431169 - DNA, 25 bp, Mus musculus
gaagcacccaaagcaagtcagctgg

SEQ ID NO: 431170 - DNA, 25 bp, Mus musculus
gaagcacccactctgttccctgtag

SEQ ID NO: 431171 - DNA, 25 bp, Mus musculus
gaagcacccagctgtcgttccttct

SEQ ID NO: 431172 - DNA, 25 bp, Mus musculus
gaagcacccgcacacgttgatgtgg

SEQ ID NO: 431173 - DNA, 25 bp, Mus musculus
gaagcacccgtggatcgtgaacaga

SEQ ID NO: 431174 - DNA, 25 bp, Mus musculus
gaagcaccgagagagagctagctcc

SEQ ID NO: 431175 - DNA, 25 bp, Mus musculus
gaagcacctctgcttgttgagccat

SEQ ID NO: 431176 - DNA, 25 bp, Mus musculus
gaagcacgctacagggagtggctca

SEQ ID NO: 431177 - DNA, 25 bp, Mus musculus
gaagcacggctacaagatggagaca

SEQ ID NO: 431178 - DNA, 25 bp, Mus musculus
gaagcacggtgtctctttacaagaa

SEQ ID NO: 431179 - DNA, 25 bp, Mus musculus
gaagcactacactttggacaccatg

SEQ ID NO: 431180 - DNA, 25 bp, Mus musculus
gaagcactactgctgagtgccagtg

SEQ ID NO: 431181 - DNA, 25 bp, Mus musculus
gaagcactagtgcagtttcgcggat

SEQ ID NO: 431182 - DNA, 25 bp, Mus musculus
gaagcactcagtggtatccagacga

SEQ ID NO: 431183 - DNA, 25 bp, Mus musculus
gaagcactgaagagtataaggcaga

SEQ ID NO: 431184 - DNA, 25 bp, Mus musculus
gaagcactgagcaagaatcctggct

SEQ ID NO: 431185 - DNA, 25 bp, Mus musculus
gaagcactgcagactgggcatctct

SEQ ID NO: 431186 - DNA, 25 bp, Mus musculus
gaagcactgcagtctctcaggcggt

SEQ ID NO: 431187 - DNA, 25 bp, Mus musculus
gaagcactggaacgatctggcattg

SEQ ID NO: 431188 - DNA, 25 bp, Mus musculus
gaagcacttcccatttgaccagcag

SEQ ID NO: 431189 - DNA, 25 bp, Mus musculus
gaagcacttcttctacgccaggaat

SEQ ID NO: 431190 - DNA, 25 bp, Mus musculus
gaagcacttgaaacttgttaatgga

SEQ ID NO: 431191 - DNA, 25 bp, Mus musculus
gaagcagaaaagctaactccttccg

SEQ ID NO: 431192 - DNA, 25 bp, Mus musculus
gaagcagaaacaagtactaccgtgg

SEQ ID NO: 431193 - DNA, 25 bp, Mus musculus
gaagcagaactaatgtcgtcatccc

SEQ ID NO: 431194 - DNA, 25 bp, Mus musculus
gaagcagaactcagacctgggacag

SEQ ID NO: 431195 - DNA, 25 bp, Mus musculus
gaagcagaacttgaccactgccaca

SEQ ID NO: 431196 - DNA, 25 bp, Mus musculus
gaagcagaagacttgttaccgtcct

SEQ ID NO: 431197 - DNA, 25 bp, Mus musculus
gaagcagaccctggtattcaacacc

SEQ ID NO: 431198 - DNA, 25 bp, Mus musculus
gaagcagacgattcattcactgtgc

SEQ ID NO: 431199 - DNA, 25 bp, Mus musculus
gaagcagagaggtaggcgtcaccca

SEQ ID NO: 431200 - DNA, 25 bp, Mus musculus
gaagcagaggataatggcgtctgca

SEQ ID NO: 431201 - DNA, 25 bp, Mus musculus
gaagcagaggatcaccacgctattc

SEQ ID NO: 431202 - DNA, 25 bp, Mus musculus
gaagcagagtcttcggtgcacccga

SEQ ID NO: 431203 - DNA, 25 bp, Mus musculus
gaagcagatccctcgacattgagtg

SEQ ID NO: 431204 - DNA, 25 bp, Mus musculus
gaagcagcagaagtggctctcagca

SEQ ID NO: 431205 - DNA, 25 bp, Mus musculus
gaagcagcagcacacgaagcattga

SEQ ID NO: 431206 - DNA, 25 bp, Mus musculus
gaagcagcaggatagtcagccagaa

SEQ ID NO: 431207 - DNA, 25 bp, Mus musculus
gaagcagccacagaacctactagga

SEQ ID NO: 431208 - DNA, 25 bp, Mus musculus
gaagcagccagttgaggttgaccgt

SEQ ID NO: 431209 - DNA, 25 bp, Mus musculus
gaagcagcccgatgaataaacccaa

SEQ ID NO: 431210 - DNA, 25 bp, Mus musculus
gaagcagcgattttacagcctcaag

SEQ ID NO: 431211 - DNA, 25 bp, Mus musculus
gaagcagcgtcaggaaaccattcag

SEQ ID NO: 431212 - DNA, 25 bp, Mus musculus
gaagcagctaagaaaacatctgtgg

SEQ ID NO: 431213 - DNA, 25 bp, Mus musculus
gaagcagctcaatgcctacaaccgg

SEQ ID NO: 431214 - DNA, 25 bp, Mus musculus
gaagcagctccatgtggtcagcctc

SEQ ID NO: 431215 - DNA, 25 bp, Mus musculus
gaagcagctcggtcgatccagaaga

SEQ ID NO: 431216 - DNA, 25 bp, Mus musculus
gaagcagctctaaggaacaagccaa

SEQ ID NO: 431217 - DNA, 25 bp, Mus musculus
gaagcagctctagttgacaacatta

SEQ ID NO: 431218 - DNA, 25 bp, Mus musculus
gaagcagctgacaagcatgcctcgg

SEQ ID NO: 431219 - DNA, 25 bp, Mus musculus
gaagcagctgatagactttgccaac

SEQ ID NO: 431220 - DNA, 25 bp, Mus musculus
gaagcagctgccacaaatagcctgt

SEQ ID NO: 431221 - DNA, 25 bp, Mus musculus
gaagcagctgctggaacatcgacga

SEQ ID NO: 431222 - DNA, 25 bp, Mus musculus
gaagcagcttcatcccagtgacgat

SEQ ID NO: 431223 - DNA, 25 bp, Mus musculus
gaagcagcttccagaaagcccgtcg

SEQ ID NO: 431224 - DNA, 25 bp, Mus musculus
gaagcagcttcctccaaggtcacag

SEQ ID NO: 431225 - DNA, 25 bp, Mus musculus
gaagcagcttctgtattgcgccggg

SEQ ID NO: 431226 - DNA, 25 bp, Mus musculus
gaagcaggcgctaaagaggtactaa

SEQ ID NO: 431227 - DNA, 25 bp, Mus musculus
gaagcaggcgctatggaaatggtca

SEQ ID NO: 431228 - DNA, 25 bp, Mus musculus
gaagcagggcctttcctcacaggta

SEQ ID NO: 431229 - DNA, 25 bp, Mus musculus
gaagcaggtcttcttatccagtggg

SEQ ID NO: 431230 - DNA, 25 bp, Mus musculus
gaagcaggtgccctgagtcagccaa

SEQ ID NO: 431231 - DNA, 25 bp, Mus musculus
gaagcaggtgtgcaacatgccttgc

SEQ ID NO: 431232 - DNA, 25 bp, Mus musculus
gaagcaggttcacaggacagttatg

SEQ ID NO: 431233 - DNA, 25 bp, Mus musculus
gaagcagtacttagccatctcagaa

SEQ ID NO: 431234 - DNA, 25 bp, Mus musculus
gaagcagtcacagcctagaacaggg

SEQ ID NO: 431235 - DNA, 25 bp, Mus musculus
gaagcagtcatgcactcagcggatg

SEQ ID NO: 431236 - DNA, 25 bp, Mus musculus
gaagcagtccctgggaggctctctg

SEQ ID NO: 431237 - DNA, 25 bp, Mus musculus
gaagcagtcccttactcaggcggaa

SEQ ID NO: 431238 - DNA, 25 bp, Mus musculus
gaagcagtcgctactacaaccatga

SEQ ID NO: 431239 - DNA, 25 bp, Mus musculus
gaagcagtctattccctgataccag

SEQ ID NO: 431240 - DNA, 25 bp, Mus musculus
gaagcagtgccgacaagaaatccgc

SEQ ID NO: 431241 - DNA, 25 bp, Mus musculus
gaagcagtgtggttcctctccaaca

SEQ ID NO: 431242 - DNA, 25 bp, Mus musculus
gaagcagttacagcacctaaaggcg

SEQ ID NO: 431243 - DNA, 25 bp, Mus musculus
gaagcagttatccagagccggtatc

SEQ ID NO: 431244 - DNA, 25 bp, Mus musculus
gaagcagttggccttccatgaagga

SEQ ID NO: 431245 - DNA, 25 bp, Mus musculus
gaagcataactgtcactaactgagg

SEQ ID NO: 431246 - DNA, 25 bp, Mus musculus
gaagcataccactacacatcctgtg

SEQ ID NO: 431247 - DNA, 25 bp, Mus musculus
gaagcatactggaatggctatcccc

SEQ ID NO: 431248 - DNA, 25 bp, Mus musculus
gaagcatagtgtgactcccagcaag

SEQ ID NO: 431249 - DNA, 25 bp, Mus musculus
gaagcatcagatcctgaggcccggt

SEQ ID NO: 431250 - DNA, 25 bp, Mus musculus
gaagcatcatcctgaggacaaaaga

SEQ ID NO: 431251 - DNA, 25 bp, Mus musculus
gaagcatcatgcatattctcgtcct

SEQ ID NO: 431252 - DNA, 25 bp, Mus musculus
gaagcatccagcaatcatgaatcaa

SEQ ID NO: 431253 - DNA, 25 bp, Mus musculus
gaagcatccatttctgggtccaaag

SEQ ID NO: 431254 - DNA, 25 bp, Mus musculus
gaagcatcctcgagagtcggactgg

SEQ ID NO: 431255 - DNA, 25 bp, Mus musculus
gaagcatccttccagaaaaagtgaa

SEQ ID NO: 431256 - DNA, 25 bp, Mus musculus
gaagcatcgggctccacagtcttga

SEQ ID NO: 431257 - DNA, 25 bp, Mus musculus
gaagcatcgtcaaaggaggatccca

SEQ ID NO: 431258 - DNA, 25 bp, Mus musculus
gaagcatcgtgacaaaggaaaggac

SEQ ID NO: 431259 - DNA, 25 bp, Mus musculus
gaagcatcgttatgcgcctcacctg

SEQ ID NO: 431260 - DNA, 25 bp, Mus musculus
gaagcatctccttcactctggttgc

SEQ ID NO: 431261 - DNA, 25 bp, Mus musculus
gaagcatgcattgcgggttctggac

SEQ ID NO: 431262 - DNA, 25 bp, Mus musculus
gaagcatggctgagttctaccccaa

SEQ ID NO: 431263 - DNA, 25 bp, Mus musculus
gaagcatggctttgttaaggaagtc

SEQ ID NO: 431264 - DNA, 25 bp, Mus musculus
gaagcatggtgctgatccaaaccga

SEQ ID NO: 431265 - DNA, 25 bp, Mus musculus
gaagcattctgcagaacgcagtgca

SEQ ID NO: 431266 - DNA, 25 bp, Mus musculus
gaagcattctgtacacacactggtg

SEQ ID NO: 431267 - DNA, 25 bp, Mus musculus
gaagcattcttgacagtggcctgga

SEQ ID NO: 431268 - DNA, 25 bp, Mus musculus
gaagcattgcaaagtcttgagactg

SEQ ID NO: 431269 - DNA, 25 bp, Mus musculus
gaagcattgccacccaaacaagatg

SEQ ID NO: 431270 - DNA, 25 bp, Mus musculus
gaagcattggagttagagcaaaagc

SEQ ID NO: 431271 - DNA, 25 bp, Mus musculus
gaagcatttacacagattgaccggt

SEQ ID NO: 431272 - DNA, 25 bp, Mus musculus
gaagcatttctaatatcagcatttg

SEQ ID NO: 431273 - DNA, 25 bp, Mus musculus
gaagccaaagactgttgaagccgca

SEQ ID NO: 431274 - DNA, 25 bp, Mus musculus
gaagccaagaagcttggctcagcac

SEQ ID NO: 431275 - DNA, 25 bp, Mus musculus
gaagccaagccacccttgtgcaggg

SEQ ID NO: 431276 - DNA, 25 bp, Mus musculus
gaagccaagccagctcacgagtatc

SEQ ID NO: 431277 - DNA, 25 bp, Mus musculus
gaagccaagcctaaatatgtgtgcc

SEQ ID NO: 431278 - DNA, 25 bp, Mus musculus
gaagccacatgctgtatccaggatg

SEQ ID NO: 431279 - DNA, 25 bp, Mus musculus
gaagccaccatctgcgagaagagct

SEQ ID NO: 431280 - DNA, 25 bp, Mus musculus
gaagccaccatttgaacagcccagt

SEQ ID NO: 431281 - DNA, 25 bp, Mus musculus
gaagccacgtggtacctagattcag

SEQ ID NO: 431282 - DNA, 25 bp, Mus musculus
gaagccacgtggtatgaactgcaga

SEQ ID NO: 431283 - DNA, 25 bp, Mus musculus
gaagccactctgtccgaggttccaa

SEQ ID NO: 431284 - DNA, 25 bp, Mus musculus
gaagccactggcaagatcacatttg

SEQ ID NO: 431285 - DNA, 25 bp, Mus musculus
gaagccagaatggatttataaagcg

SEQ ID NO: 431286 - DNA, 25 bp, Mus musculus
gaagccagagtgtcgaatatcagcc

SEQ ID NO: 431287 - DNA, 25 bp, Mus musculus
gaagccagatatcatccccaaggtg

SEQ ID NO: 431288 - DNA, 25 bp, Mus musculus
gaagccagatgtgatgtatgccgat

SEQ ID NO: 431289 - DNA, 25 bp, Mus musculus
gaagccagccgacctccttatggaa

SEQ ID NO: 431290 - DNA, 25 bp, Mus musculus
gaagccagcctgtgattcgctggaa

SEQ ID NO: 431291 - DNA, 25 bp, Mus musculus
gaagccagctctatcaggaggaagg

SEQ ID NO: 431292 - DNA, 25 bp, Mus musculus
gaagccagctctgttagtgccagtg

SEQ ID NO: 431293 - DNA, 25 bp, Mus musculus
gaagccagctgtgttctctagccat

SEQ ID NO: 431294 - DNA, 25 bp, Mus musculus
gaagccagcttatctgtcacatgca

SEQ ID NO: 431295 - DNA, 25 bp, Mus musculus
gaagccaggaagatgagatcaatcc

SEQ ID NO: 431296 - DNA, 25 bp, Mus musculus
gaagccaggcttctatcacggacac

SEQ ID NO: 431297 - DNA, 25 bp, Mus musculus
gaagccagggtgaaaaatactctgg

SEQ ID NO: 431298 - DNA, 25 bp, Mus musculus
gaagccagtatgagctgttagtacc

SEQ ID NO: 431299 - DNA, 25 bp, Mus musculus
gaagccatagctgacctctttgtga

SEQ ID NO: 431300 - DNA, 25 bp, Mus musculus
gaagccatatagacaggacagccct

SEQ ID NO: 431301 - DNA, 25 bp, Mus musculus
gaagccatcagggtctgtctatcag

SEQ ID NO: 431302 - DNA, 25 bp, Mus musculus
gaagccatccacacagacacggaca

SEQ ID NO: 431303 - DNA, 25 bp, Mus musculus
gaagccatctcaaggcaaaaggcct

SEQ ID NO: 431304 - DNA, 25 bp, Mus musculus
gaagccatctttatcctggcgcgtg

SEQ ID NO: 431305 - DNA, 25 bp, Mus musculus
gaagccatgaactccacagatctgt

SEQ ID NO: 431306 - DNA, 25 bp, Mus musculus
gaagccatggctagcaccttaagtc

SEQ ID NO: 431307 - DNA, 25 bp, Mus musculus
gaagccatggctgacggaatgcaca

SEQ ID NO: 431308 - DNA, 25 bp, Mus musculus
gaagccatggctgtcactcagaagt

SEQ ID NO: 431309 - DNA, 25 bp, Mus musculus
gaagccatggtgaccacaagtgggt

SEQ ID NO: 431310 - DNA, 25 bp, Mus musculus
gaagccatggtttgcatcattgcca

SEQ ID NO: 431311 - DNA, 25 bp, Mus musculus
gaagccatgtctgttctggaacgag

SEQ ID NO: 431312 - DNA, 25 bp, Mus musculus
gaagccatgttgtttgcctcaagcc

SEQ ID NO: 431313 - DNA, 25 bp, Mus musculus
gaagccattcagttggatggagaaa

SEQ ID NO: 431314 - DNA, 25 bp, Mus musculus
gaagccattgctcatttcctggtgg

SEQ ID NO: 431315 - DNA, 25 bp, Mus musculus
gaagccatttccaaattgtgggtgg

SEQ ID NO: 431316 - DNA, 25 bp, Mus musculus
gaagccatttctttgtctaggccgc

SEQ ID NO: 431317 - DNA, 25 bp, Mus musculus
gaagcccaaggctcaagccagcctg

SEQ ID NO: 431318 - DNA, 25 bp, Mus musculus
gaagcccaattgcttggacctgcgc

SEQ ID NO: 431319 - DNA, 25 bp, Mus musculus
gaagcccacacgcaagatctctaag

SEQ ID NO: 431320 - DNA, 25 bp, Mus musculus
gaagcccactgaagcagtctacagc

SEQ ID NO: 431321 - DNA, 25 bp, Mus musculus
gaagcccagcccataggtgaagact

SEQ ID NO: 431322 - DNA, 25 bp, Mus musculus
gaagcccagctggaaaatcaggcag

SEQ ID NO: 431323 - DNA, 25 bp, Mus musculus
gaagcccagctttggtcagatgtcc

SEQ ID NO: 431324 - DNA, 25 bp, Mus musculus
gaagcccaggaagagattatcttga

SEQ ID NO: 431325 - DNA, 25 bp, Mus musculus
gaagcccaggagtgtattttattgc

SEQ ID NO: 431326 - DNA, 25 bp, Mus musculus
gaagcccaggcttgttccactgaga

SEQ ID NO: 431327 - DNA, 25 bp, Mus musculus
gaagcccagggctcacttgtctgac

SEQ ID NO: 431328 - DNA, 25 bp, Mus musculus
gaagcccagtatgctgtggtccact

SEQ ID NO: 431329 - DNA, 25 bp, Mus musculus
gaagcccagtgtagttcagacacca

SEQ ID NO: 431330 - DNA, 25 bp, Mus musculus
gaagcccatccaggtatgccaagtg

SEQ ID NO: 431331 - DNA, 25 bp, Mus musculus
gaagcccatgtctatcttgttcagc

SEQ ID NO: 431332 - DNA, 25 bp, Mus musculus
gaagccccaaattctccagtggcag

SEQ ID NO: 431333 - DNA, 25 bp, Mus musculus
gaagccccgcttagaccagattcct

SEQ ID NO: 431334 - DNA, 25 bp, Mus musculus
gaagccccggagtgtagctttctct

SEQ ID NO: 431335 - DNA, 25 bp, Mus musculus
gaagcccctcaagtcaggcatgaag

SEQ ID NO: 431336 - DNA, 25 bp, Mus musculus
gaagcccctgcgagtctaaggccgc

SEQ ID NO: 431337 - DNA, 25 bp, Mus musculus
gaagcccctggttcttagtgcctcc

SEQ ID NO: 431338 - DNA, 25 bp, Mus musculus
gaagcccgaacaagttcggaccaag

SEQ ID NO: 431339 - DNA, 25 bp, Mus musculus
gaagcccgaccagcattgacaagat

SEQ ID NO: 431340 - DNA, 25 bp, Mus musculus
gaagcccgagcatcttgggcaccag

SEQ ID NO: 431341 - DNA, 25 bp, Mus musculus
gaagcccgatgctggtccatttaga

SEQ ID NO: 431342 - DNA, 25 bp, Mus musculus
gaagcccgcctggaaagatacagtg

SEQ ID NO: 431343 - DNA, 25 bp, Mus musculus
gaagcccggcctgatgacattttga

SEQ ID NO: 431344 - DNA, 25 bp, Mus musculus
gaagcccggtttgcgtccttctcgg

SEQ ID NO: 431345 - DNA, 25 bp, Mus musculus
gaagccctaatatctgttgaatgca

SEQ ID NO: 431346 - DNA, 25 bp, Mus musculus
gaagccctacatctcggtgcagaag

SEQ ID NO: 431347 - DNA, 25 bp, Mus musculus
gaagccctagggatctgctcaggaa

SEQ ID NO: 431348 - DNA, 25 bp, Mus musculus
gaagccctatgatgtgccaggcaaa

SEQ ID NO: 431349 - DNA, 25 bp, Mus musculus
gaagccctcacagatgccgatgact

SEQ ID NO: 431350 - DNA, 25 bp, Mus musculus
gaagccctcagatgctgcgttggag

SEQ ID NO: 431351 - DNA, 25 bp, Mus musculus
gaagccctccacaggtactctggaa

SEQ ID NO: 431352 - DNA, 25 bp, Mus musculus
gaagccctcggactgtaagaaatgt

SEQ ID NO: 431353 - DNA, 25 bp, Mus musculus
gaagccctcgttcctgacatagtga

SEQ ID NO: 431354 - DNA, 25 bp, Mus musculus
gaagccctcttgtttgatggccagc

SEQ ID NO: 431355 - DNA, 25 bp, Mus musculus
gaagccctgcagtccgtttgatata

SEQ ID NO: 431356 - DNA, 25 bp, Mus musculus
gaagccctgcgcctcatttcttctt

SEQ ID NO: 431357 - DNA, 25 bp, Mus musculus
gaagccctgcgctgtcgttatcgga

SEQ ID NO: 431358 - DNA, 25 bp, Mus musculus
gaagccctgctcaagttccgggagg

SEQ ID NO: 431359 - DNA, 25 bp, Mus musculus
gaagccctgggatctaactctagaa

SEQ ID NO: 431360 - DNA, 25 bp, Mus musculus
gaagcccttacagagaaaacttaag

SEQ ID NO: 431361 - DNA, 25 bp, Mus musculus
gaagcccttatggacgaaatttaag

SEQ ID NO: 431362 - DNA, 25 bp, Mus musculus
gaagcccttggatcgtgagaagcaa

SEQ ID NO: 431363 - DNA, 25 bp, Mus musculus
gaagcccttgtggagaaccgtcatg

SEQ ID NO: 431364 - DNA, 25 bp, Mus musculus
gaagcccttttacagccagaatgag

SEQ ID NO: 431365 - DNA, 25 bp, Mus musculus
gaagcccttttagtaatgtgacgtg

SEQ ID NO: 431366 - DNA, 25 bp, Mus musculus
gaagccgacactaaccggccaggtt

SEQ ID NO: 431367 - DNA, 25 bp, Mus musculus
gaagccgacatagtgaatctccagg

SEQ ID NO: 431368 - DNA, 25 bp, Mus musculus
gaagccgactccgagagaagctgag

SEQ ID NO: 431369 - DNA, 25 bp, Mus musculus
gaagccgcagtagtacccaggtctg

SEQ ID NO: 431370 - DNA, 25 bp, Mus musculus
gaagccgccacggaatctgtcagca

SEQ ID NO: 431371 - DNA, 25 bp, Mus musculus
gaagccgccagccaaagcttagaag

SEQ ID NO: 431372 - DNA, 25 bp, Mus musculus
gaagccgcctgtgatatcctttctc

SEQ ID NO: 431373 - DNA, 25 bp, Mus musculus
gaagccgctcctcattcacatgttt

SEQ ID NO: 431374 - DNA, 25 bp, Mus musculus
gaagccgctctctattggacacaag

SEQ ID NO: 431375 - DNA, 25 bp, Mus musculus
gaagccgctctgtccactcttggag

SEQ ID NO: 431376 - DNA, 25 bp, Mus musculus
gaagccggactttgcctatagtgac

SEQ ID NO: 431377 - DNA, 25 bp, Mus musculus
gaagccggagaagagatgaacagca

SEQ ID NO: 431378 - DNA, 25 bp, Mus musculus
gaagccggattcatctcgcagaagc

SEQ ID NO: 431379 - DNA, 25 bp, Mus musculus
gaagccggccatgtgagaactctac

SEQ ID NO: 431380 - DNA, 25 bp, Mus musculus
gaagccggccttcatgaagatgcgc

SEQ ID NO: 431381 - DNA, 25 bp, Mus musculus
gaagccggcgacttgtaggtgaccc

SEQ ID NO: 431382 - DNA, 25 bp, Mus musculus
gaagccgggcttccagtcttagcat

SEQ ID NO: 431383 - DNA, 25 bp, Mus musculus
gaagccgggtgctcactatcctaga

SEQ ID NO: 431384 - DNA, 25 bp, Mus musculus
gaagccggtttttgatcgcccacct

SEQ ID NO: 431385 - DNA, 25 bp, Mus musculus
gaagccgtaggtgtgattcatgaac

SEQ ID NO: 431386 - DNA, 25 bp, Mus musculus
gaagccgtaggtttcatcgtgagca

SEQ ID NO: 431387 - DNA, 25 bp, Mus musculus
gaagccgtagtcgtagcagaagccg

SEQ ID NO: 431388 - DNA, 25 bp, Mus musculus
gaagccgtcccaatctcagaaacaa

SEQ ID NO: 431389 - DNA, 25 bp, Mus musculus
gaagccgtcgcctatttcccatcaa

SEQ ID NO: 431390 - DNA, 25 bp, Mus musculus
gaagccgtgacctaaggagctgcca

SEQ ID NO: 431391 - DNA, 25 bp, Mus musculus
gaagccgttgattcccagaccgagt

SEQ ID NO: 431392 - DNA, 25 bp, Mus musculus
gaagcctaaggatagccttcgcctg

SEQ ID NO: 431393 - DNA, 25 bp, Mus musculus
gaagcctacctgagacagccgggct

SEQ ID NO: 431394 - DNA, 25 bp, Mus musculus
gaagcctataacattgctcatctgg

SEQ ID NO: 431395 - DNA, 25 bp, Mus musculus
gaagcctataatgtctgccctggta

SEQ ID NO: 431396 - DNA, 25 bp, Mus musculus
gaagcctatctcaggactccagagg

SEQ ID NO: 431397 - DNA, 25 bp, Mus musculus
gaagcctatgcagcgtgtcacaaga

SEQ ID NO: 431398 - DNA, 25 bp, Mus musculus
gaagcctcaatgacaggctgcggct

SEQ ID NO: 431399 - DNA, 25 bp, Mus musculus
gaagcctcactgcaggcgacgtcaa

SEQ ID NO: 431400 - DNA, 25 bp, Mus musculus
gaagcctcatctagctatcatcatt

SEQ ID NO: 431401 - DNA, 25 bp, Mus musculus
gaagcctcccgcactggcggcggaa

SEQ ID NO: 431402 - DNA, 25 bp, Mus musculus
gaagcctccctctgggttcaagcca

SEQ ID NO: 431403 - DNA, 25 bp, Mus musculus
gaagcctcttggtagtcactggaga

SEQ ID NO: 431404 - DNA, 25 bp, Mus musculus
gaagcctgagcgacacgcctgatta

SEQ ID NO: 431405 - DNA, 25 bp, Mus musculus
gaagcctgcaacatcacaaggaatg

SEQ ID NO: 431406 - DNA, 25 bp, Mus musculus
gaagcctgcactgaggacagctgct

SEQ ID NO: 431407 - DNA, 25 bp, Mus musculus
gaagcctgcagaatggacgagagaa

SEQ ID NO: 431408 - DNA, 25 bp, Mus musculus
gaagcctgcagcgttctcgaagtga

SEQ ID NO: 431409 - DNA, 25 bp, Mus musculus
gaagcctggaagactcatctgcgac

SEQ ID NO: 431410 - DNA, 25 bp, Mus musculus
gaagcctggactcgagaagcctgat

SEQ ID NO: 431411 - DNA, 25 bp, Mus musculus
gaagcctggagctctgggatagcta

SEQ ID NO: 431412 - DNA, 25 bp, Mus musculus
gaagcctggatcctgagagcatctt

SEQ ID NO: 431413 - DNA, 25 bp, Mus musculus
gaagcctggatctgaatgctgccga

SEQ ID NO: 431414 - DNA, 25 bp, Mus musculus
gaagcctggcaagaacgagggcatc

SEQ ID NO: 431415 - DNA, 25 bp, Mus musculus
gaagcctggcggaaatcgtgaagaa

SEQ ID NO: 431416 - DNA, 25 bp, Mus musculus
gaagcctggctacaatactgcacaa

SEQ ID NO: 431417 - DNA, 25 bp, Mus musculus
gaagcctgggaaagtcacctgtgaa

SEQ ID NO: 431418 - DNA, 25 bp, Mus musculus
gaagcctgggaagcggctcacaagt

SEQ ID NO: 431419 - DNA, 25 bp, Mus musculus
gaagcctggtgttcgatacagagaa

SEQ ID NO: 431420 - DNA, 25 bp, Mus musculus
gaagcctgtcagtattgccatgaga

SEQ ID NO: 431421 - DNA, 25 bp, Mus musculus
gaagcctgtcatactggcatcctga

SEQ ID NO: 431422 - DNA, 25 bp, Mus musculus
gaagcctgtctgcagttttcacaaa

SEQ ID NO: 431423 - DNA, 25 bp, Mus musculus
gaagcctgtgggaaccttacactgc

SEQ ID NO: 431424 - DNA, 25 bp, Mus musculus
gaagccttacttcagaccgggaaga

SEQ ID NO: 431425 - DNA, 25 bp, Mus musculus
gaagccttaggtcccattgtcggcg

SEQ ID NO: 431426 - DNA, 25 bp, Mus musculus
gaagccttcaaattgtgggtactgg

SEQ ID NO: 431427 - DNA, 25 bp, Mus musculus
gaagccttctctcatttactcacag

SEQ ID NO: 431428 - DNA, 25 bp, Mus musculus
gaagccttgcctagtgggtctctga

SEQ ID NO: 431429 - DNA, 25 bp, Mus musculus
gaagccttgcgacaccatgaaagtg

SEQ ID NO: 431430 - DNA, 25 bp, Mus musculus
gaagccttgctctttccctgggtag

SEQ ID NO: 431431 - DNA, 25 bp, Mus musculus
gaagccttggcaatctgcctcagct

SEQ ID NO: 431432 - DNA, 25 bp, Mus musculus
gaagcctttacaggtggccagagtg

SEQ ID NO: 431433 - DNA, 25 bp, Mus musculus
gaagcctttccagtgtgccgagtgt

SEQ ID NO: 431434 - DNA, 25 bp, Mus musculus
gaagcctttccctctgaagcactta

SEQ ID NO: 431435 - DNA, 25 bp, Mus musculus
gaagcctttgctactccaccaggga

SEQ ID NO: 431436 - DNA, 25 bp, Mus musculus
gaagcctttggtacccagagctcac

SEQ ID NO: 431437 - DNA, 25 bp, Mus musculus
gaagccttttggagatgtccctcgg

SEQ ID NO: 431438 - DNA, 25 bp, Mus musculus
gaagcgaactcctctttaggcaaag

SEQ ID NO: 431439 - DNA, 25 bp, Mus musculus
gaagcgaagcctctaggtaccacgg

SEQ ID NO: 431440 - DNA, 25 bp, Mus musculus
gaagcgaccgcgactagtagagaac

SEQ ID NO: 431441 - DNA, 25 bp, Mus musculus
gaagcgagctctgcacaatgctgac

SEQ ID NO: 431442 - DNA, 25 bp, Mus musculus
gaagcgaggccatgtcaagaagcca

SEQ ID NO: 431443 - DNA, 25 bp, Mus musculus
gaagcgagtcctgcctatcgatgtg

SEQ ID NO: 431444 - DNA, 25 bp, Mus musculus
gaagcgagtggtgctaaccctgaag

SEQ ID NO: 431445 - DNA, 25 bp, Mus musculus
gaagcgagttatagcctctccccag

SEQ ID NO: 431446 - DNA, 25 bp, Mus musculus
gaagcgatactgtttaatgcaaagc

SEQ ID NO: 431447 - DNA, 25 bp, Mus musculus
gaagcgatctacataagtgccctgt

SEQ ID NO: 431448 - DNA, 25 bp, Mus musculus
gaagcgcaatgtgctcatcggccat

SEQ ID NO: 431449 - DNA, 25 bp, Mus musculus
gaagcgcacgactttcatcctctgg

SEQ ID NO: 431450 - DNA, 25 bp, Mus musculus
gaagcgcacgcctaaatgctcggct

SEQ ID NO: 431451 - DNA, 25 bp, Mus musculus
gaagcgcatcctggccttgttggag

SEQ ID NO: 431452 - DNA, 25 bp, Mus musculus
gaagcgcatgcaggacctgaacttg

SEQ ID NO: 431453 - DNA, 25 bp, Mus musculus
gaagcgcattcccactagcaggaca

SEQ ID NO: 431454 - DNA, 25 bp, Mus musculus
gaagcgccaggcagaattactagag

SEQ ID NO: 431455 - DNA, 25 bp, Mus musculus
gaagcgcccgtttggactgaagtac

SEQ ID NO: 431456 - DNA, 25 bp, Mus musculus
gaagcgccgaatagaggatgccctt

SEQ ID NO: 431457 - DNA, 25 bp, Mus musculus
gaagcgccgctcaatcaagaaactg

SEQ ID NO: 431458 - DNA, 25 bp, Mus musculus
gaagcgcgccttttgaatccgtgaa

SEQ ID NO: 431459 - DNA, 25 bp, Mus musculus
gaagcgcggccatgctgtggaaaac

SEQ ID NO: 431460 - DNA, 25 bp, Mus musculus
gaagcgctccacgtttcctcagaga

SEQ ID NO: 431461 - DNA, 25 bp, Mus musculus
gaagcgctcgttcatgattatttca

SEQ ID NO: 431462 - DNA, 25 bp, Mus musculus
gaagcgctcttaggttttcatcctg

SEQ ID NO: 431463 - DNA, 25 bp, Mus musculus
gaagcgctggatcattgccacggaa

SEQ ID NO: 431464 - DNA, 25 bp, Mus musculus
gaagcgctgtcccatgctacagatg

SEQ ID NO: 431465 - DNA, 25 bp, Mus musculus
gaagcgcttcaagtatgcctcagac

SEQ ID NO: 431466 - DNA, 25 bp, Mus musculus
gaagcgcttgggagactttctgaac

SEQ ID NO: 431467 - DNA, 25 bp, Mus musculus
gaagcggaagtcgaggaaccgtctc

SEQ ID NO: 431468 - DNA, 25 bp, Mus musculus
gaagcggacattttacttaaatcgg

SEQ ID NO: 431469 - DNA, 25 bp, Mus musculus
gaagcggaccaatccagttgtggca

SEQ ID NO: 431470 - DNA, 25 bp, Mus musculus
gaagcggacgaagcggagttacaac

SEQ ID NO: 431471 - DNA, 25 bp, Mus musculus
gaagcggacgagtctctgttagcgc

SEQ ID NO: 431472 - DNA, 25 bp, Mus musculus
gaagcggagacaaagtgaaccctat

SEQ ID NO: 431473 - DNA, 25 bp, Mus musculus
gaagcggcatgctcagtgtatagcc

SEQ ID NO: 431474 - DNA, 25 bp, Mus musculus
gaagcggccgtgtcgcaatctacaa

SEQ ID NO: 431475 - DNA, 25 bp, Mus musculus
gaagcggcggaacacactgaaagat

SEQ ID NO: 431476 - DNA, 25 bp, Mus musculus
gaagcggctgctgctcagggtctct

SEQ ID NO: 431477 - DNA, 25 bp, Mus musculus
gaagcgggagagtaagaacatatct

SEQ ID NO: 431478 - DNA, 25 bp, Mus musculus
gaagcgggtccaacaagtcctctta

SEQ ID NO: 431479 - DNA, 25 bp, Mus musculus
gaagcgggtgcgtcttcagcaagcc

SEQ ID NO: 431480 - DNA, 25 bp, Mus musculus
gaagcggtgggtaccattgcaacac

SEQ ID NO: 431481 - DNA, 25 bp, Mus musculus
gaagcggttttctctcttctccagc

SEQ ID NO: 431482 - DNA, 25 bp, Mus musculus
gaagcggttttgttcctctgggctc

SEQ ID NO: 431483 - DNA, 25 bp, Mus musculus
gaagcgtagctttgggcgagtcact

SEQ ID NO: 431484 - DNA, 25 bp, Mus musculus
gaagcgtatcattgcccggaaggac

SEQ ID NO: 431485 - DNA, 25 bp, Mus musculus
gaagcgtattattggctccgtcaca

SEQ ID NO: 431486 - DNA, 25 bp, Mus musculus
gaagcgtccttctgaggcccaaagt

SEQ ID NO: 431487 - DNA, 25 bp, Mus musculus
gaagcgtcgccgtggcaaattggca

SEQ ID NO: 431488 - DNA, 25 bp, Mus musculus
gaagcgtctaacatccatggcaaga

SEQ ID NO: 431489 - DNA, 25 bp, Mus musculus
gaagcgtcttgtagctctgatcagt

SEQ ID NO: 431490 - DNA, 25 bp, Mus musculus
gaagcgtgacaacaatgtgactcca

SEQ ID NO: 431491 - DNA, 25 bp, Mus musculus
gaagcgtgcattacaggcctaccat

SEQ ID NO: 431492 - DNA, 25 bp, Mus musculus
gaagcgtgcggtttggattttgttt

SEQ ID NO: 431493 - DNA, 25 bp, Mus musculus
gaagcgtttgcctccctgatttgta

SEQ ID NO: 431494 - DNA, 25 bp, Mus musculus
gaagctaaacgttccaatggcccca

SEQ ID NO: 431495 - DNA, 25 bp, Mus musculus
gaagctaaattcaagtatccccagg

SEQ ID NO: 431496 - DNA, 25 bp, Mus musculus
gaagctaagacctgagcccatgcag

SEQ ID NO: 431497 - DNA, 25 bp, Mus musculus
gaagctaagcaaccattcctgctgg

SEQ ID NO: 431498 - DNA, 25 bp, Mus musculus
gaagctaagcgtcctggagtcctca

SEQ ID NO: 431499 - DNA, 25 bp, Mus musculus
gaagctacagattcagacgtgggca

SEQ ID NO: 431500 - DNA, 25 bp, Mus musculus
gaagctacagcttcaagactaatgg

SEQ ID NO: 431501 - DNA, 25 bp, Mus musculus
gaagctacagtgtcttgtaactgcc

SEQ ID NO: 431502 - DNA, 25 bp, Mus musculus
gaagctacctcgttgcctgtggcct

SEQ ID NO: 431503 - DNA, 25 bp, Mus musculus
gaagctactcctcagtaatcgagaa

SEQ ID NO: 431504 - DNA, 25 bp, Mus musculus
gaagctactcttggccttggcaggc

SEQ ID NO: 431505 - DNA, 25 bp, Mus musculus
gaagctactgtttcgggctcttgta

SEQ ID NO: 431506 - DNA, 25 bp, Mus musculus
gaagctagacaactggaattacagg

SEQ ID NO: 431507 - DNA, 25 bp, Mus musculus
gaagctaggcacacggatggctcct

SEQ ID NO: 431508 - DNA, 25 bp, Mus musculus
gaagctaggtgtttgaagcctcagc

SEQ ID NO: 431509 - DNA, 25 bp, Mus musculus
gaagctagtcagaattacgtacaag

SEQ ID NO: 431510 - DNA, 25 bp, Mus musculus
gaagctagtccagaccgaatcaggg

SEQ ID NO: 431511 - DNA, 25 bp, Mus musculus
gaagctatataagaccttaaggaag

SEQ ID NO: 431512 - DNA, 25 bp, Mus musculus
gaagctatcagtccccacctaactt

SEQ ID NO: 431513 - DNA, 25 bp, Mus musculus
gaagctatggaactcaagggtacac

SEQ ID NO: 431514 - DNA, 25 bp, Mus musculus
gaagctatggataagtgcctacgtg

SEQ ID NO: 431515 - DNA, 25 bp, Mus musculus
gaagctcaaacagcgcatcacagtg

SEQ ID NO: 431516 - DNA, 25 bp, Mus musculus
gaagctcaagcaactgaaggtgttg

SEQ ID NO: 431517 - DNA, 25 bp, Mus musculus
gaagctcaatgtgggacagccaaca

SEQ ID NO: 431518 - DNA, 25 bp, Mus musculus
gaagctcacagcctagtacagcact

SEQ ID NO: 431519 - DNA, 25 bp, Mus musculus
gaagctcacttactctagcgataag

SEQ ID NO: 431520 - DNA, 25 bp, Mus musculus
gaagctcactttgtttacctacctg

SEQ ID NO: 431521 - DNA, 25 bp, Mus musculus
gaagctcagatttgctcccttggga

SEQ ID NO: 431522 - DNA, 25 bp, Mus musculus
gaagctcatcgatgtcaaggacaca

SEQ ID NO: 431523 - DNA, 25 bp, Mus musculus
gaagctcatcttctgctcaggcctg

SEQ ID NO: 431524 - DNA, 25 bp, Mus musculus
gaagctccagccatcctagagttag

SEQ ID NO: 431525 - DNA, 25 bp, Mus musculus
gaagctccatcgttaacatccagaa

SEQ ID NO: 431526 - DNA, 25 bp, Mus musculus
gaagctcccggagatctcacataga

SEQ ID NO: 431527 - DNA, 25 bp, Mus musculus
gaagctcccttggttcagaaaattg

SEQ ID NO: 431528 - DNA, 25 bp, Mus musculus
gaagctccgcctctccttgttgtga

SEQ ID NO: 431529 - DNA, 25 bp, Mus musculus
gaagctcgaataccgacagcggcta

SEQ ID NO: 431530 - DNA, 25 bp, Mus musculus
gaagctcgagttccggatccatact

SEQ ID NO: 431531 - DNA, 25 bp, Mus musculus
gaagctcgccattccttgagtctca

SEQ ID NO: 431532 - DNA, 25 bp, Mus musculus
gaagctcgcggagaagagactcaca

SEQ ID NO: 431533 - DNA, 25 bp, Mus musculus
gaagctcgtgatgttttcgcccaag

SEQ ID NO: 431534 - DNA, 25 bp, Mus musculus
gaagctcgtgtactaccgtgcaaag

SEQ ID NO: 431535 - DNA, 25 bp, Mus musculus
gaagctcgttccatacgcgtcctgg

SEQ ID NO: 431536 - DNA, 25 bp, Mus musculus
gaagctctaccacaacctgcaggaa

SEQ ID NO: 431537 - DNA, 25 bp, Mus musculus
gaagctctacggtgcccaaataaag

SEQ ID NO: 431538 - DNA, 25 bp, Mus musculus
gaagctctagctgtgcgattatgat

SEQ ID NO: 431539 - DNA, 25 bp, Mus musculus
gaagctctcaagtgccgaattatcc

SEQ ID NO: 431540 - DNA, 25 bp, Mus musculus
gaagctctcatggacttgtcaacag

SEQ ID NO: 431541 - DNA, 25 bp, Mus musculus
gaagctctcgaggaacgccaaaata

SEQ ID NO: 431542 - DNA, 25 bp, Mus musculus
gaagctctggcattcgctctcaggg

SEQ ID NO: 431543 - DNA, 25 bp, Mus musculus
gaagctcttagagggatactcagca

SEQ ID NO: 431544 - DNA, 25 bp, Mus musculus
gaagctgaaacgaaagggagccgcc

SEQ ID NO: 431545 - DNA, 25 bp, Mus musculus
gaagctgaacaggtggtacaatccc

SEQ ID NO: 431546 - DNA, 25 bp, Mus musculus
gaagctgaactccattctgcagagg

SEQ ID NO: 431547 - DNA, 25 bp, Mus musculus
gaagctgacacacctattgaacgca

SEQ ID NO: 431548 - DNA, 25 bp, Mus musculus
gaagctgaccgaaagcgtgagctga

SEQ ID NO: 431549 - DNA, 25 bp, Mus musculus
gaagctgagaaggactaccccatag

SEQ ID NO: 431550 - DNA, 25 bp, Mus musculus
gaagctgagaccttttaccagagca

SEQ ID NO: 431551 - DNA, 25 bp, Mus musculus
gaagctgagagcctgaaggaaacct

SEQ ID NO: 431552 - DNA, 25 bp, Mus musculus
gaagctgagcttcccttcacgtgga

SEQ ID NO: 431553 - DNA, 25 bp, Mus musculus
gaagctgagcttcgtcaaggcacaa

SEQ ID NO: 431554 - DNA, 25 bp, Mus musculus
gaagctgatcttaactcggtggtgc

SEQ ID NO: 431555 - DNA, 25 bp, Mus musculus
gaagctgcacgagatcttccgcggc

SEQ ID NO: 431556 - DNA, 25 bp, Mus musculus
gaagctgccaaaagatctcgggaga

SEQ ID NO: 431557 - DNA, 25 bp, Mus musculus
gaagctgcccgctgtggtgactgct

SEQ ID NO: 431558 - DNA, 25 bp, Mus musculus
gaagctgccgccaagaatattctaa

SEQ ID NO: 431559 - DNA, 25 bp, Mus musculus
gaagctgcctacatgggttccaaga

SEQ ID NO: 431560 - DNA, 25 bp, Mus musculus
gaagctgcctgcttaacatcccgaa

SEQ ID NO: 431561 - DNA, 25 bp, Mus musculus
gaagctgccttacgactggtcaaac

SEQ ID NO: 431562 - DNA, 25 bp, Mus musculus
gaagctgcgactgcagctgagctct

SEQ ID NO: 431563 - DNA, 25 bp, Mus musculus
gaagctgcgatgctggtgaaacacc

SEQ ID NO: 431564 - DNA, 25 bp, Mus musculus
gaagctgcgcgcctaagtaacaata

SEQ ID NO: 431565 - DNA, 25 bp, Mus musculus
gaagctgcgctgcatggcacaagtc

SEQ ID NO: 431566 - DNA, 25 bp, Mus musculus
gaagctgcgggctcaatctccagca

SEQ ID NO: 431567 - DNA, 25 bp, Mus musculus
gaagctgctacctctgacatggata

SEQ ID NO: 431568 - DNA, 25 bp, Mus musculus
gaagctgctactccaatgccaggtg

SEQ ID NO: 431569 - DNA, 25 bp, Mus musculus
gaagctgctcaatggtgacacctgg

SEQ ID NO: 431570 - DNA, 25 bp, Mus musculus
gaagctgctgcccaacaagttccgc

SEQ ID NO: 431571 - DNA, 25 bp, Mus musculus
gaagctgctgctctattcgggccct

SEQ ID NO: 431572 - DNA, 25 bp, Mus musculus
gaagctgctttaccacttccagcgg

SEQ ID NO: 431573 - DNA, 25 bp, Mus musculus
gaagctgctttatacccgatgtctg

SEQ ID NO: 431574 - DNA, 25 bp, Mus musculus
gaagctggacccttcagtgccaagg

SEQ ID NO: 431575 - DNA, 25 bp, Mus musculus
gaagctggagactactacgtgccta

SEQ ID NO: 431576 - DNA, 25 bp, Mus musculus
gaagctggcactctgcacaggactg

SEQ ID NO: 431577 - DNA, 25 bp, Mus musculus
gaagctggccgtgtgtactgcatcg

SEQ ID NO: 431578 - DNA, 25 bp, Mus musculus
gaagctggcttcaactgcagtcccc

SEQ ID NO: 431579 - DNA, 25 bp, Mus musculus
gaagctggcttcagttccctggctg

SEQ ID NO: 431580 - DNA, 25 bp, Mus musculus
gaagctgggaccttgaaacatgaag

SEQ ID NO: 431581 - DNA, 25 bp, Mus musculus
gaagctgggagaatcgaatggttca

SEQ ID NO: 431582 - DNA, 25 bp, Mus musculus
gaagctgggctctagataagatgca

SEQ ID NO: 431583 - DNA, 25 bp, Mus musculus
gaagctggtccctctgaatgcctac

SEQ ID NO: 431584 - DNA, 25 bp, Mus musculus
gaagctggtcctgcatatgaagaac

SEQ ID NO: 431585 - DNA, 25 bp, Mus musculus
gaagctggtctcacttgtatttgaa

SEQ ID NO: 431586 - DNA, 25 bp, Mus musculus
gaagctgtacatctgacggtctcaa

SEQ ID NO: 431587 - DNA, 25 bp, Mus musculus
gaagctgtacctcgtggatctggcc

SEQ ID NO: 431588 - DNA, 25 bp, Mus musculus
gaagctgtcacaattaattaaccct

SEQ ID NO: 431589 - DNA, 25 bp, Mus musculus
gaagctgtcagtactcgttgggaga

SEQ ID NO: 431590 - DNA, 25 bp, Mus musculus
gaagctgtcagtggttgccttaaag

SEQ ID NO: 431591 - DNA, 25 bp, Mus musculus
gaagctgtccaaggagcgcaagtgc

SEQ ID NO: 431592 - DNA, 25 bp, Mus musculus
gaagctgtccatgctggagggccac

SEQ ID NO: 431593 - DNA, 25 bp, Mus musculus
gaagctgtctcacaaccctctgaag

SEQ ID NO: 431594 - DNA, 25 bp, Mus musculus
gaagctgtctctactccagcacgag

SEQ ID NO: 431595 - DNA, 25 bp, Mus musculus
gaagctgtctctgcgcattggtgag

SEQ ID NO: 431596 - DNA, 25 bp, Mus musculus
gaagctgtcttagcgtgggaccaga

SEQ ID NO: 431597 - DNA, 25 bp, Mus musculus
gaagctgtgtgagatctgcttcctg

SEQ ID NO: 431598 - DNA, 25 bp, Mus musculus
gaagctgtgtgattactgcaaacct

SEQ ID NO: 431599 - DNA, 25 bp, Mus musculus
gaagctgtgtgtgttagcagctgaa

SEQ ID NO: 431600 - DNA, 25 bp, Mus musculus
gaagctgttccgttcacctcgagac

SEQ ID NO: 431601 - DNA, 25 bp, Mus musculus
gaagctgttgagtgtaatgcaacga

SEQ ID NO: 431602 - DNA, 25 bp, Mus musculus
gaagctgttttctggacccaatgcg

SEQ ID NO: 431603 - DNA, 25 bp, Mus musculus
gaagctgtttttctcctgcgcccag

SEQ ID NO: 431604 - DNA, 25 bp, Mus musculus
gaagcttaaggacccatcctctgcg

SEQ ID NO: 431605 - DNA, 25 bp, Mus musculus
gaagcttaagtgttgtcgaccagac

SEQ ID NO: 431606 - DNA, 25 bp, Mus musculus
gaagcttaccctgtctttgagccag

SEQ ID NO: 431607 - DNA, 25 bp, Mus musculus
gaagcttaccttctatttaatctga

SEQ ID NO: 431608 - DNA, 25 bp, Mus musculus
gaagcttacgtttcattctcccgaa

SEQ ID NO: 431609 - DNA, 25 bp, Mus musculus
gaagcttagtaccaaagaggccctg

SEQ ID NO: 431610 - DNA, 25 bp, Mus musculus
gaagcttatgaacccgactacggag

SEQ ID NO: 431611 - DNA, 25 bp, Mus musculus
gaagcttatgctcttatggcccatg

SEQ ID NO: 431612 - DNA, 25 bp, Mus musculus
gaagcttcaatattgggcagcgccg

SEQ ID NO: 431613 - DNA, 25 bp, Mus musculus
gaagcttcacacagcactggctttt

SEQ ID NO: 431614 - DNA, 25 bp, Mus musculus
gaagcttcactcaacaagggcctgg

SEQ ID NO: 431615 - DNA, 25 bp, Mus musculus
gaagcttcagcttgtaggcacggct

SEQ ID NO: 431616 - DNA, 25 bp, Mus musculus
gaagcttcagggtctggtccactca

SEQ ID NO: 431617 - DNA, 25 bp, Mus musculus
gaagcttccaaaagcccagctctgg

SEQ ID NO: 431618 - DNA, 25 bp, Mus musculus
gaagcttccaccaaccaagtagagg

SEQ ID NO: 431619 - DNA, 25 bp, Mus musculus
gaagcttccagctctcagcgtagca

SEQ ID NO: 431620 - DNA, 25 bp, Mus musculus
gaagcttccctgttgccagaggtgc

SEQ ID NO: 431621 - DNA, 25 bp, Mus musculus
gaagcttcctgcttaagtccctgga

SEQ ID NO: 431622 - DNA, 25 bp, Mus musculus
gaagcttcctggtgttctggctgga

SEQ ID NO: 431623 - DNA, 25 bp, Mus musculus
gaagcttcgccctatgagcctgtga

SEQ ID NO: 431624 - DNA, 25 bp, Mus musculus
gaagcttcgcttcaaggaggacctt

SEQ ID NO: 431625 - DNA, 25 bp, Mus musculus
gaagcttctagctctttgtccaggg

SEQ ID NO: 431626 - DNA, 25 bp, Mus musculus
gaagcttggagctcatgacaatctg

SEQ ID NO: 431627 - DNA, 25 bp, Mus musculus
gaagcttgggtaagtcacataacct

SEQ ID NO: 431628 - DNA, 25 bp, Mus musculus
gaagcttgtccccacctctgaagct

SEQ ID NO: 431629 - DNA, 25 bp, Mus musculus
gaagcttgtcctcagtacagtcacg

SEQ ID NO: 431630 - DNA, 25 bp, Mus musculus
gaagcttgtgcacacctacgacgag

SEQ ID NO: 431631 - DNA, 25 bp, Mus musculus
gaagctttaggtatctctgtctccc

SEQ ID NO: 431632 - DNA, 25 bp, Mus musculus
gaagctttattgcaacctggctaag

SEQ ID NO: 431633 - DNA, 25 bp, Mus musculus
gaagctttgaccttcttgtctccgg

SEQ ID NO: 431634 - DNA, 25 bp, Mus musculus
gaagctttggaagacatggctccca

SEQ ID NO: 431635 - DNA, 25 bp, Mus musculus
gaagctttggacgaacgaatgccga

SEQ ID NO: 431636 - DNA, 25 bp, Mus musculus
gaagctttggccgactcagtgaaaa

SEQ ID NO: 431637 - DNA, 25 bp, Mus musculus
gaagcttttcgccatggacacggag

SEQ ID NO: 431638 - DNA, 25 bp, Mus musculus
gaagcttttcgcctcttggcccagt

SEQ ID NO: 431639 - DNA, 25 bp, Mus musculus
gaagcttttctgacactcacctcca

SEQ ID NO: 431640 - DNA, 25 bp, Mus musculus
gaagcttttgggtccgcgtggcaat

SEQ ID NO: 431641 - DNA, 25 bp, Mus musculus
gaaggaaaccagagatctggtgcag

SEQ ID NO: 431642 - DNA, 25 bp, Mus musculus
gaaggaaactaaagacccgtcagtg

SEQ ID NO: 431643 - DNA, 25 bp, Mus musculus
gaaggaaagcaatcaggcctccgct

SEQ ID NO: 431644 - DNA, 25 bp, Mus musculus
gaaggaaatactcacagcacctggg

SEQ ID NO: 431645 - DNA, 25 bp, Mus musculus
gaaggaaattcgcaggtcagccagc

SEQ ID NO: 431646 - DNA, 25 bp, Mus musculus
gaaggaacacctgtcccagttggat

SEQ ID NO: 431647 - DNA, 25 bp, Mus musculus
gaaggaacccatggctgtgaacacc

SEQ ID NO: 431648 - DNA, 25 bp, Mus musculus
gaaggaaccgccaagtgtgtgccaa

SEQ ID NO: 431649 - DNA, 25 bp, Mus musculus
gaaggaacctgaggactcatccagg

SEQ ID NO: 431650 - DNA, 25 bp, Mus musculus
gaaggaaccttactgaagcccaaca

SEQ ID NO: 431651 - DNA, 25 bp, Mus musculus
gaaggaaccttctcttaccgccatg

SEQ ID NO: 431652 - DNA, 25 bp, Mus musculus
gaaggaaccttggagctcaggcaca

SEQ ID NO: 431653 - DNA, 25 bp, Mus musculus
gaaggaactactgcgctaaaggccc

SEQ ID NO: 431654 - DNA, 25 bp, Mus musculus
gaaggaactcatatttcagaaagaa

SEQ ID NO: 431655 - DNA, 25 bp, Mus musculus
gaaggaagaactgtaagtccaccct

SEQ ID NO: 431656 - DNA, 25 bp, Mus musculus
gaaggaagaagaggtacacgtagca

SEQ ID NO: 431657 - DNA, 25 bp, Mus musculus
gaaggaagacactcccggatgagct

SEQ ID NO: 431658 - DNA, 25 bp, Mus musculus
gaaggaagagtcaacacagaatgca

SEQ ID NO: 431659 - DNA, 25 bp, Mus musculus
gaaggaagcaactgcacagcccagc

SEQ ID NO: 431660 - DNA, 25 bp, Mus musculus
gaaggaagcatctcgcagcgtggat

SEQ ID NO: 431661 - DNA, 25 bp, Mus musculus
gaaggaagcatgtattacccacggg

SEQ ID NO: 431662 - DNA, 25 bp, Mus musculus
gaaggaagccccatacagtaagatt

SEQ ID NO: 431663 - DNA, 25 bp, Mus musculus
gaaggaagtggccagacgttcacca

SEQ ID NO: 431664 - DNA, 25 bp, Mus musculus
gaaggaatcctactgctggtcagag

SEQ ID NO: 431665 - DNA, 25 bp, Mus musculus
gaaggaatctcatctctacggctgt

SEQ ID NO: 431666 - DNA, 25 bp, Mus musculus
gaaggaatgctctaacatcaaggaa

SEQ ID NO: 431667 - DNA, 25 bp, Mus musculus
gaaggacaaaggaaagctgaagccc

SEQ ID NO: 431668 - DNA, 25 bp, Mus musculus
gaaggacacagacagtatctttcag

SEQ ID NO: 431669 - DNA, 25 bp, Mus musculus
gaaggacactcgtcctcttggctgg

SEQ ID NO: 431670 - DNA, 25 bp, Mus musculus
gaaggacaggagtctcccgagcagt

SEQ ID NO: 431671 - DNA, 25 bp, Mus musculus
gaaggacaggtatgctgagcacgcc

SEQ ID NO: 431672 - DNA, 25 bp, Mus musculus
gaaggacaggttacacaaagccagc

SEQ ID NO: 431673 - DNA, 25 bp, Mus musculus
gaaggacagtctgctcatcgacagc

SEQ ID NO: 431674 - DNA, 25 bp, Mus musculus
gaaggacagtgtgtatgacccgcag

SEQ ID NO: 431675 - DNA, 25 bp, Mus musculus
gaaggacatctactttgcacaccgt

SEQ ID NO: 431676 - DNA, 25 bp, Mus musculus
gaaggacatgaatatctggcccaga

SEQ ID NO: 431677 - DNA, 25 bp, Mus musculus
gaaggacattatggcccggatcgcc

SEQ ID NO: 431678 - DNA, 25 bp, Mus musculus
gaaggacattattgacctgcccgcg

SEQ ID NO: 431679 - DNA, 25 bp, Mus musculus
gaaggacattccacctctgatgcag

SEQ ID NO: 431680 - DNA, 25 bp, Mus musculus
gaaggacattccagtagtgcaccaa

SEQ ID NO: 431681 - DNA, 25 bp, Mus musculus
gaaggacattgaccctgtggccatc

SEQ ID NO: 431682 - DNA, 25 bp, Mus musculus
gaaggacccactgaatgtaaagcaa

SEQ ID NO: 431683 - DNA, 25 bp, Mus musculus
gaaggacccgttgagctacttcgcg

SEQ ID NO: 431684 - DNA, 25 bp, Mus musculus
gaaggaccctgcatcttagcctggc

SEQ ID NO: 431685 - DNA, 25 bp, Mus musculus
gaaggacccttttactacagcacag

SEQ ID NO: 431686 - DNA, 25 bp, Mus musculus
gaaggaccgagatatgtccacatgg

SEQ ID NO: 431687 - DNA, 25 bp, Mus musculus
gaaggaccggtgtctaatcagctgc

SEQ ID NO: 431688 - DNA, 25 bp, Mus musculus
gaaggaccgtgctcgtggaaaacag

SEQ ID NO: 431689 - DNA, 25 bp, Mus musculus
gaaggacctccctctttgagactgc

SEQ ID NO: 431690 - DNA, 25 bp, Mus musculus
gaaggacctgctgacttgaaacact

SEQ ID NO: 431691 - DNA, 25 bp, Mus musculus
gaaggaccttcgtccttttgctgcg

SEQ ID NO: 431692 - DNA, 25 bp, Mus musculus
gaaggaccttgctaaactccaccgt

SEQ ID NO: 431693 - DNA, 25 bp, Mus musculus
gaaggacgagtctttcttgggcaag

SEQ ID NO: 431694 - DNA, 25 bp, Mus musculus
gaaggacgcctgagcccagatattg

SEQ ID NO: 431695 - DNA, 25 bp, Mus musculus
gaaggacgggcctgatcaccaggcc

SEQ ID NO: 431696 - DNA, 25 bp, Mus musculus
gaaggactaagtaagccaccctcag

SEQ ID NO: 431697 - DNA, 25 bp, Mus musculus
gaaggactacctattcaaggctggc

SEQ ID NO: 431698 - DNA, 25 bp, Mus musculus
gaaggactcccaagactctcaactg

SEQ ID NO: 431699 - DNA, 25 bp, Mus musculus
gaaggactccctgctgctgcttaat

SEQ ID NO: 431700 - DNA, 25 bp, Mus musculus
gaaggactcttgtgatctctgggcg

SEQ ID NO: 431701 - DNA, 25 bp, Mus musculus
gaaggactgcaccacttatatgaaa

SEQ ID NO: 431702 - DNA, 25 bp, Mus musculus
gaaggactgccctcatgagcaggac

SEQ ID NO: 431703 - DNA, 25 bp, Mus musculus
gaaggacttacaatccaccagagcc

SEQ ID NO: 431704 - DNA, 25 bp, Mus musculus
gaaggacttgggtcacctcacaaca

SEQ ID NO: 431705 - DNA, 25 bp, Mus musculus
gaaggagaaacactatgtgattact

SEQ ID NO: 431706 - DNA, 25 bp, Mus musculus
gaaggagaaatgaaggatgaccgcc

SEQ ID NO: 431707 - DNA, 25 bp, Mus musculus
gaaggagaacaatccaccaggagcg

SEQ ID NO: 431708 - DNA, 25 bp, Mus musculus
gaaggagaacacgaaggatgcccaa

SEQ ID NO: 431709 - DNA, 25 bp, Mus musculus
gaaggagacccagtactatgacatc

SEQ ID NO: 431710 - DNA, 25 bp, Mus musculus
gaaggagactccagtccatcctcag

SEQ ID NO: 431711 - DNA, 25 bp, Mus musculus
gaaggagactctgtccctgaagccc

SEQ ID NO: 431712 - DNA, 25 bp, Mus musculus
gaaggagacttctacagggctgacc

SEQ ID NO: 431713 - DNA, 25 bp, Mus musculus
gaaggagatcttcgagcagccagaa

SEQ ID NO: 431714 - DNA, 25 bp, Mus musculus
gaaggagcacggaaacttgttcaga

SEQ ID NO: 431715 - DNA, 25 bp, Mus musculus
gaaggagccaatcagtctacggtag

SEQ ID NO: 431716 - DNA, 25 bp, Mus musculus
gaaggagcctaagtctgagaaacac

SEQ ID NO: 431717 - DNA, 25 bp, Mus musculus
gaaggagcctcaatccactatccag

SEQ ID NO: 431718 - DNA, 25 bp, Mus musculus
gaaggagcgtctctttccaaagctg

SEQ ID NO: 431719 - DNA, 25 bp, Mus musculus
gaaggagctggataagcactgagcc

SEQ ID NO: 431720 - DNA, 25 bp, Mus musculus
gaaggaggaaaatatcgcaataaag

SEQ ID NO: 431721 - DNA, 25 bp, Mus musculus
gaaggaggaaatgtgacagctgtca

SEQ ID NO: 431722 - DNA, 25 bp, Mus musculus
gaaggaggaacattgtggctttcac

SEQ ID NO: 431723 - DNA, 25 bp, Mus musculus
gaaggaggacccaaaacagcctcca

SEQ ID NO: 431724 - DNA, 25 bp, Mus musculus
gaaggaggactttagatgacaggct

SEQ ID NO: 431725 - DNA, 25 bp, Mus musculus
gaaggaggcgagtgataagtcccca

SEQ ID NO: 431726 - DNA, 25 bp, Mus musculus
gaaggaggcgtctaaccatgcaagg

SEQ ID NO: 431727 - DNA, 25 bp, Mus musculus
gaaggaggctcacgtcagactgtac

SEQ ID NO: 431728 - DNA, 25 bp, Mus musculus
gaaggaggctgatatcatccacgga

SEQ ID NO: 431729 - DNA, 25 bp, Mus musculus
gaaggagggcacaaggatgaacacc

SEQ ID NO: 431730 - DNA, 25 bp, Mus musculus
gaaggaggtcactatagcaactgtc

SEQ ID NO: 431731 - DNA, 25 bp, Mus musculus
gaaggaggttcagttccgacagcca

SEQ ID NO: 431732 - DNA, 25 bp, Mus musculus
gaaggaggttccaagacgctatcac

SEQ ID NO: 431733 - DNA, 25 bp, Mus musculus
gaaggagtacaatctggtctaaccg

SEQ ID NO: 431734 - DNA, 25 bp, Mus musculus
gaaggagtattcacatataacagaa

SEQ ID NO: 431735 - DNA, 25 bp, Mus musculus
gaaggagtcatggatcaacgccctg

SEQ ID NO: 431736 - DNA, 25 bp, Mus musculus
gaaggagtgaagtcctgttccctca

SEQ ID NO: 431737 - DNA, 25 bp, Mus musculus
gaaggagttcaatcccaacgagcag

SEQ ID NO: 431738 - DNA, 25 bp, Mus musculus
gaaggagttcgctctccacatgaga

SEQ ID NO: 431739 - DNA, 25 bp, Mus musculus
gaaggagtttgcctcccacggtgca

SEQ ID NO: 431740 - DNA, 25 bp, Mus musculus
gaaggataaagagccgagtgctgcc

SEQ ID NO: 431741 - DNA, 25 bp, Mus musculus
gaaggatacagccttagccaagccc

SEQ ID NO: 431742 - DNA, 25 bp, Mus musculus
gaaggataccaagcagattctgcgc

SEQ ID NO: 431743 - DNA, 25 bp, Mus musculus
gaaggatagcctagtccgagaccat

SEQ ID NO: 431744 - DNA, 25 bp, Mus musculus
gaaggatcaagaagtctagacaagg

SEQ ID NO: 431745 - DNA, 25 bp, Mus musculus
gaaggatcattaagacccagcagcc

SEQ ID NO: 431746 - DNA, 25 bp, Mus musculus
gaaggatccacaagtcccagagatg

SEQ ID NO: 431747 - DNA, 25 bp, Mus musculus
gaaggatccatgttctcagccagaa

SEQ ID NO: 431748 - DNA, 25 bp, Mus musculus
gaaggatcccctttgagagtcattg

SEQ ID NO: 431749 - DNA, 25 bp, Mus musculus
gaaggatcctggtagtaagcagttc

SEQ ID NO: 431750 - DNA, 25 bp, Mus musculus
gaaggatcgaagaaccgcagtcgca

SEQ ID NO: 431751 - DNA, 25 bp, Mus musculus
gaaggatcgcaaggcagtgactgtc

SEQ ID NO: 431752 - DNA, 25 bp, Mus musculus
gaaggatcgcttgagccagtccaaa

SEQ ID NO: 431753 - DNA, 25 bp, Mus musculus
gaaggatcgtctgcaaaatgtggct

SEQ ID NO: 431754 - DNA, 25 bp, Mus musculus
gaaggatctccgatcccctggagag

SEQ ID NO: 431755 - DNA, 25 bp, Mus musculus
gaaggatctgccaaccctttatcca

SEQ ID NO: 431756 - DNA, 25 bp, Mus musculus
gaaggatcttaaggctacacccgac

SEQ ID NO: 431757 - DNA, 25 bp, Mus musculus
gaaggatgacaactgtgatgcccaa

SEQ ID NO: 431758 - DNA, 25 bp, Mus musculus
gaaggatgacagctacgcaccaaag

SEQ ID NO: 431759 - DNA, 25 bp, Mus musculus
gaaggatgactctcctgtggcctca

SEQ ID NO: 431760 - DNA, 25 bp, Mus musculus
gaaggatgagtacgcgttaaccacc

SEQ ID NO: 431761 - DNA, 25 bp, Mus musculus
gaaggatgcaacatttcagcggctc

SEQ ID NO: 431762 - DNA, 25 bp, Mus musculus
gaaggatgcatactttggcccagcc

SEQ ID NO: 431763 - DNA, 25 bp, Mus musculus
gaaggatggacctaactctcagcca

SEQ ID NO: 431764 - DNA, 25 bp, Mus musculus
gaaggatggtcaaccctcatgagga

SEQ ID NO: 431765 - DNA, 25 bp, Mus musculus
gaaggattatcaagtatgtgcatca

SEQ ID NO: 431766 - DNA, 25 bp, Mus musculus
gaaggattcaaattccgcctcggca

SEQ ID NO: 431767 - DNA, 25 bp, Mus musculus
gaaggattcagacccgttcatccga

SEQ ID NO: 431768 - DNA, 25 bp, Mus musculus
gaaggattcttgacccataacatgg

SEQ ID NO: 431769 - DNA, 25 bp, Mus musculus
gaaggattgagacagatcagctgcc

SEQ ID NO: 431770 - DNA, 25 bp, Mus musculus
gaaggattgccgaaactgtacagcg

SEQ ID NO: 431771 - DNA, 25 bp, Mus musculus
gaaggatttctgcttaagtataccc

SEQ ID NO: 431772 - DNA, 25 bp, Mus musculus
gaaggattttgactgcaacaccagg

SEQ ID NO: 431773 - DNA, 25 bp, Mus musculus
gaaggcaaacatcaagctgagccag

SEQ ID NO: 431774 - DNA, 25 bp, Mus musculus
gaaggcaaacgagagaagatctgct

SEQ ID NO: 431775 - DNA, 25 bp, Mus musculus
gaaggcaaagtccaaagtgcccaga

SEQ ID NO: 431776 - DNA, 25 bp, Mus musculus
gaaggcaaccaacccagtgatgatg

SEQ ID NO: 431777 - DNA, 25 bp, Mus musculus
gaaggcaagctctcactgtacaggc

SEQ ID NO: 431778 - DNA, 25 bp, Mus musculus
gaaggcaccctgaacttggcaaaga

SEQ ID NO: 431779 - DNA, 25 bp, Mus musculus
gaaggcacgttcttgctcagggact

SEQ ID NO: 431780 - DNA, 25 bp, Mus musculus
gaaggcactcttatctattggccga

SEQ ID NO: 431781 - DNA, 25 bp, Mus musculus
gaaggcactggtaatgaatagtcag

SEQ ID NO: 431782 - DNA, 25 bp, Mus musculus
gaaggcagaagctgctatctgattg

SEQ ID NO: 431783 - DNA, 25 bp, Mus musculus
gaaggcagcagatagcccttgcaca

SEQ ID NO: 431784 - DNA, 25 bp, Mus musculus
gaaggcagctacaccttggaagaac

SEQ ID NO: 431785 - DNA, 25 bp, Mus musculus
gaaggcagctatcacaagcatctgg

SEQ ID NO: 431786 - DNA, 25 bp, Mus musculus
gaaggcaggattctccccttccagt

SEQ ID NO: 431787 - DNA, 25 bp, Mus musculus
gaaggcaggccctggtccgttaaga

SEQ ID NO: 431788 - DNA, 25 bp, Mus musculus
gaaggcagtacttgctcagacccgg

SEQ ID NO: 431789 - DNA, 25 bp, Mus musculus
gaaggcagtgcagttcccaatgcct

SEQ ID NO: 431790 - DNA, 25 bp, Mus musculus
gaaggcatcgtgttaaatgtcacaa

SEQ ID NO: 431791 - DNA, 25 bp, Mus musculus
gaaggcatgccctctgttggccaat

SEQ ID NO: 431792 - DNA, 25 bp, Mus musculus
gaaggcatgtctaataacagcacca

SEQ ID NO: 431793 - DNA, 25 bp, Mus musculus
gaaggcattatttgtctgcccacat

SEQ ID NO: 431794 - DNA, 25 bp, Mus musculus
gaaggcattgtgtctcctcctctct

SEQ ID NO: 431795 - DNA, 25 bp, Mus musculus
gaaggccaaggctatcactccagca

SEQ ID NO: 431796 - DNA, 25 bp, Mus musculus
gaaggccaagtatctgcccaaactg

SEQ ID NO: 431797 - DNA, 25 bp, Mus musculus
gaaggccaagttaagacccacgatg

SEQ ID NO: 431798 - DNA, 25 bp, Mus musculus
gaaggccaatgaagtagaccgcatg

SEQ ID NO: 431799 - DNA, 25 bp, Mus musculus
gaaggccaatgctctttagtcacca

SEQ ID NO: 431800 - DNA, 25 bp, Mus musculus
gaaggccacatccaaaatgcaaggg

SEQ ID NO: 431801 - DNA, 25 bp, Mus musculus
gaaggccactcaagtaagctgcagc

SEQ ID NO: 431802 - DNA, 25 bp, Mus musculus
gaaggccacttcgaggacgatcgct

SEQ ID NO: 431803 - DNA, 25 bp, Mus musculus
gaaggccagcctactggtacctctg

SEQ ID NO: 431804 - DNA, 25 bp, Mus musculus
gaaggccagctgatacgtgtgaacc

SEQ ID NO: 431805 - DNA, 25 bp, Mus musculus
gaaggccagtagtgttctcccgagt

SEQ ID NO: 431806 - DNA, 25 bp, Mus musculus
gaaggccagtgttgtctgggtctca

SEQ ID NO: 431807 - DNA, 25 bp, Mus musculus
gaaggccatgcttccctggctagaa

SEQ ID NO: 431808 - DNA, 25 bp, Mus musculus
gaaggccatgtaccacactctggag

SEQ ID NO: 431809 - DNA, 25 bp, Mus musculus
gaaggcccacaacgttctgtaagac

SEQ ID NO: 431810 - DNA, 25 bp, Mus musculus
gaaggccccatgatccacagtggtg

SEQ ID NO: 431811 - DNA, 25 bp, Mus musculus
gaaggccccgaccattgttggcaag

SEQ ID NO: 431812 - DNA, 25 bp, Mus musculus
gaaggccccttagacctcactgtga

SEQ ID NO: 431813 - DNA, 25 bp, Mus musculus
gaaggcccgacatgagttcactgag

SEQ ID NO: 431814 - DNA, 25 bp, Mus musculus
gaaggcccgctttgccaagctcaaa

SEQ ID NO: 431815 - DNA, 25 bp, Mus musculus
gaaggcccgttgttccctgagtcct

SEQ ID NO: 431816 - DNA, 25 bp, Mus musculus
gaaggccctaataagcgtcggagat

SEQ ID NO: 431817 - DNA, 25 bp, Mus musculus
gaaggccctgcgtctatttggacag

SEQ ID NO: 431818 - DNA, 25 bp, Mus musculus
gaaggccctggaattctaaactaga

SEQ ID NO: 431819 - DNA, 25 bp, Mus musculus
gaaggccctggctgactgtgtcaaa

SEQ ID NO: 431820 - DNA, 25 bp, Mus musculus
gaaggccctgggatggacacagctt

SEQ ID NO: 431821 - DNA, 25 bp, Mus musculus
gaaggcccttccatcttgggtggag

SEQ ID NO: 431822 - DNA, 25 bp, Mus musculus
gaaggcccttttgcttactggatgg

SEQ ID NO: 431823 - DNA, 25 bp, Mus musculus
gaaggccctttttggagcgcagaga

SEQ ID NO: 431824 - DNA, 25 bp, Mus musculus
gaaggccgatgagggaatctacacc

SEQ ID NO: 431825 - DNA, 25 bp, Mus musculus
gaaggccgcaagaagatgttcgacg

SEQ ID NO: 431826 - DNA, 25 bp, Mus musculus
gaaggccgcacctatgccgattacg

SEQ ID NO: 431827 - DNA, 25 bp, Mus musculus
gaaggccgccatttcagagtgggta

SEQ ID NO: 431828 - DNA, 25 bp, Mus musculus
gaaggccggttccaaatgcgatcga

SEQ ID NO: 431829 - DNA, 25 bp, Mus musculus
gaaggccgtgccattcaaagacata

SEQ ID NO: 431830 - DNA, 25 bp, Mus musculus
gaaggcctagaaattcgaacctagg

SEQ ID NO: 431831 - DNA, 25 bp, Mus musculus
gaaggcctcaagtctctcaaactga

SEQ ID NO: 431832 - DNA, 25 bp, Mus musculus
gaaggcctcctgaagtactacacca

SEQ ID NO: 431833 - DNA, 25 bp, Mus musculus
gaaggcctcggacatgttatcgcag

SEQ ID NO: 431834 - DNA, 25 bp, Mus musculus
gaaggcctctgatagtccgcatagg

SEQ ID NO: 431835 - DNA, 25 bp, Mus musculus
gaaggcctctggctaatatgagtgc

SEQ ID NO: 431836 - DNA, 25 bp, Mus musculus
gaaggcctgccctgtgcatgccatt

SEQ ID NO: 431837 - DNA, 25 bp, Mus musculus
gaaggcctgcttgctgtccagatca

SEQ ID NO: 431838 - DNA, 25 bp, Mus musculus
gaaggccttcttggctgttctgtgc

SEQ ID NO: 431839 - DNA, 25 bp, Mus musculus
gaaggcctttacagcttgtgaccca

SEQ ID NO: 431840 - DNA, 25 bp, Mus musculus
gaaggcctttactcctgttgccctg

SEQ ID NO: 431841 - DNA, 25 bp, Mus musculus
gaaggcctttattcgaagctcacaa

SEQ ID NO: 431842 - DNA, 25 bp, Mus musculus
gaaggcctttcgagtccgtggacag

SEQ ID NO: 431843 - DNA, 25 bp, Mus musculus
gaaggcctttgagaacgtcacagac

SEQ ID NO: 431844 - DNA, 25 bp, Mus musculus
gaaggcgacctatatctgtgattgg

SEQ ID NO: 431845 - DNA, 25 bp, Mus musculus
gaaggcgacttccagactaatctga

SEQ ID NO: 431846 - DNA, 25 bp, Mus musculus
gaaggcgccctgaatatacacgaga

SEQ ID NO: 431847 - DNA, 25 bp, Mus musculus
gaaggcgcctgtgtctttcagcaaa

SEQ ID NO: 431848 - DNA, 25 bp, Mus musculus
gaaggcgccttctccgaaaacaatg

SEQ ID NO: 431849 - DNA, 25 bp, Mus musculus
gaaggcggcccagcctctgtggact

SEQ ID NO: 431850 - DNA, 25 bp, Mus musculus
gaaggcggctcttaatggagcacca

SEQ ID NO: 431851 - DNA, 25 bp, Mus musculus
gaaggcgtcctctcctgatagctaa

SEQ ID NO: 431852 - DNA, 25 bp, Mus musculus
gaaggcgtggtcacagtcaaaggca

SEQ ID NO: 431853 - DNA, 25 bp, Mus musculus
gaaggctaagcttcagcttgatcca

SEQ ID NO: 431854 - DNA, 25 bp, Mus musculus
gaaggctacggaaccatgagagacg

SEQ ID NO: 431855 - DNA, 25 bp, Mus musculus
gaaggctcagaaacacttcgtgaca

SEQ ID NO: 431856 - DNA, 25 bp, Mus musculus
gaaggctcatctgattctgcggcgg

SEQ ID NO: 431857 - DNA, 25 bp, Mus musculus
gaaggctcctggttctacatccatc

SEQ ID NO: 431858 - DNA, 25 bp, Mus musculus
gaaggctccttttggaagcctgaag

SEQ ID NO: 431859 - DNA, 25 bp, Mus musculus
gaaggctcgcactagctacggactg

SEQ ID NO: 431860 - DNA, 25 bp, Mus musculus
gaaggctctgatttaccatgcagca

SEQ ID NO: 431861 - DNA, 25 bp, Mus musculus
gaaggctgaagcagtaagattgttg

SEQ ID NO: 431862 - DNA, 25 bp, Mus musculus
gaaggctgagcattggcttccagtc

SEQ ID NO: 431863 - DNA, 25 bp, Mus musculus
gaaggctgatgtgctcaaggcccta

SEQ ID NO: 431864 - DNA, 25 bp, Mus musculus
gaaggctgcactctaggctgaacca

SEQ ID NO: 431865 - DNA, 25 bp, Mus musculus
gaaggctgcatactacgagaaccca

SEQ ID NO: 431866 - DNA, 25 bp, Mus musculus
gaaggctgcatctcgaaggactatc

SEQ ID NO: 431867 - DNA, 25 bp, Mus musculus
gaaggctgcccacgatctctgtgac

SEQ ID NO: 431868 - DNA, 25 bp, Mus musculus
gaaggctgccttgactcctgtctgc

SEQ ID NO: 431869 - DNA, 25 bp, Mus musculus
gaaggctgcgccagttttggagcaa

SEQ ID NO: 431870 - DNA, 25 bp, Mus musculus
gaaggctgctccatgaaggaactca

SEQ ID NO: 431871 - DNA, 25 bp, Mus musculus
gaaggctgctgctcatgaagcgtgt

SEQ ID NO: 431872 - DNA, 25 bp, Mus musculus
gaaggctggataccactccatgcag

SEQ ID NO: 431873 - DNA, 25 bp, Mus musculus
gaaggctggcaaaggccttgaccca

SEQ ID NO: 431874 - DNA, 25 bp, Mus musculus
gaaggctggtcacaactggaacctg

SEQ ID NO: 431875 - DNA, 25 bp, Mus musculus
gaaggctggtctccaaacccaaggt

SEQ ID NO: 431876 - DNA, 25 bp, Mus musculus
gaaggctgtccggttaaatccagaa

SEQ ID NO: 431877 - DNA, 25 bp, Mus musculus
gaaggctgtcggttcttgcaccagg

SEQ ID NO: 431878 - DNA, 25 bp, Mus musculus
gaaggctgttctgtggacgctgcca

SEQ ID NO: 431879 - DNA, 25 bp, Mus musculus
gaaggcttcacatggacgacttgga

SEQ ID NO: 431880 - DNA, 25 bp, Mus musculus
gaaggcttctacaccacaagtgcag

SEQ ID NO: 431881 - DNA, 25 bp, Mus musculus
gaaggcttctccactagccatggga

SEQ ID NO: 431882 - DNA, 25 bp, Mus musculus
gaaggcttctgtgaaattgaccggc

SEQ ID NO: 431883 - DNA, 25 bp, Mus musculus
gaaggcttgcatgttgaccggctcg

SEQ ID NO: 431884 - DNA, 25 bp, Mus musculus
gaaggcttgcctagattagcccagt

SEQ ID NO: 431885 - DNA, 25 bp, Mus musculus
gaaggcttgcgatgggaaacccctt

SEQ ID NO: 431886 - DNA, 25 bp, Mus musculus
gaaggcttggagaccttcccttatt

SEQ ID NO: 431887 - DNA, 25 bp, Mus musculus
gaaggcttgtcctacatctggatgc

SEQ ID NO: 431888 - DNA, 25 bp, Mus musculus
gaaggctttggttatagcacacccg

SEQ ID NO: 431889 - DNA, 25 bp, Mus musculus
gaaggctttgtgaaaattgctgact

SEQ ID NO: 431890 - DNA, 25 bp, Mus musculus
gaagggaaagcagagtagtgcaaat

SEQ ID NO: 431891 - DNA, 25 bp, Mus musculus
gaagggaaatccaacagacatgtcg

SEQ ID NO: 431892 - DNA, 25 bp, Mus musculus
gaagggaagacgacacacgccctta

SEQ ID NO: 431893 - DNA, 25 bp, Mus musculus
gaagggaagactccaggccatcact

SEQ ID NO: 431894 - DNA, 25 bp, Mus musculus
gaagggaagttgtcagctttgatca

SEQ ID NO: 431895 - DNA, 25 bp, Mus musculus
gaagggacaccaatcggttctctcg

SEQ ID NO: 431896 - DNA, 25 bp, Mus musculus
gaagggacaggcaaacagggcctca

SEQ ID NO: 431897 - DNA, 25 bp, Mus musculus
gaagggacccctgaagagaagacat

SEQ ID NO: 431898 - DNA, 25 bp, Mus musculus
gaagggacccctgtgctgattctaa

SEQ ID NO: 431899 - DNA, 25 bp, Mus musculus
gaagggacgcttttgactgcaggct

SEQ ID NO: 431900 - DNA, 25 bp, Mus musculus
gaagggacggatgcattcagacttg

SEQ ID NO: 431901 - DNA, 25 bp, Mus musculus
gaagggactactggcctctacacag

SEQ ID NO: 431902 - DNA, 25 bp, Mus musculus
gaagggactatttgcgctcccagag

SEQ ID NO: 431903 - DNA, 25 bp, Mus musculus
gaagggactgaaagacataagaaat

SEQ ID NO: 431904 - DNA, 25 bp, Mus musculus
gaagggactgcgctgccagaaccca

SEQ ID NO: 431905 - DNA, 25 bp, Mus musculus
gaagggactggattctagatgtctg

SEQ ID NO: 431906 - DNA, 25 bp, Mus musculus
gaagggacttccacagctatcagca

SEQ ID NO: 431907 - DNA, 25 bp, Mus musculus
gaagggagacacatctgacacctgc

SEQ ID NO: 431908 - DNA, 25 bp, Mus musculus
gaagggagcagctaaggttccccta

SEQ ID NO: 431909 - DNA, 25 bp, Mus musculus
gaagggaggattctcatggttttcc

SEQ ID NO: 431910 - DNA, 25 bp, Mus musculus
gaagggaggccagatcagtcgtact

SEQ ID NO: 431911 - DNA, 25 bp, Mus musculus
gaagggagtccgcatgatctttgtc

SEQ ID NO: 431912 - DNA, 25 bp, Mus musculus
gaagggagtcctgctcacatgcttg

SEQ ID NO: 431913 - DNA, 25 bp, Mus musculus
gaagggatatgcctcagccaggcca

SEQ ID NO: 431914 - DNA, 25 bp, Mus musculus
gaagggatcacagatgcagctacca

SEQ ID NO: 431915 - DNA, 25 bp, Mus musculus
gaagggatcctccagtctcgacaaa

SEQ ID NO: 431916 - DNA, 25 bp, Mus musculus
gaagggatcctttgatcttgcagct

SEQ ID NO: 431917 - DNA, 25 bp, Mus musculus
gaagggatggtcatctcccacatgg

SEQ ID NO: 431918 - DNA, 25 bp, Mus musculus
gaagggcaaccgcaagaagatgacc

SEQ ID NO: 431919 - DNA, 25 bp, Mus musculus
gaagggcaacctgatgcacgtgcta

SEQ ID NO: 431920 - DNA, 25 bp, Mus musculus
gaagggcaagtttgactacatactc

SEQ ID NO: 431921 - DNA, 25 bp, Mus musculus
gaagggcaataaccaccaagcaaag

SEQ ID NO: 431922 - DNA, 25 bp, Mus musculus
gaagggcaccgaaaaggatacacca

SEQ ID NO: 431923 - DNA, 25 bp, Mus musculus
gaagggcactgcaactttgtctcag

SEQ ID NO: 431924 - DNA, 25 bp, Mus musculus
gaagggcactggtatcctgaaaagc

SEQ ID NO: 431925 - DNA, 25 bp, Mus musculus
gaagggcagcgcatcaatttgaaga

SEQ ID NO: 431926 - DNA, 25 bp, Mus musculus
gaagggcaggatgtttctcacagaa

SEQ ID NO: 431927 - DNA, 25 bp, Mus musculus
gaagggcatctttaccacggtagaa

SEQ ID NO: 431928 - DNA, 25 bp, Mus musculus
gaagggcattcccttagtcccagca

SEQ ID NO: 431929 - DNA, 25 bp, Mus musculus
gaagggccaactactctcctcagtg

SEQ ID NO: 431930 - DNA, 25 bp, Mus musculus
gaagggccatcggagttagactgcc

SEQ ID NO: 431931 - DNA, 25 bp, Mus musculus
gaagggccattcttccctcaaggga

SEQ ID NO: 431932 - DNA, 25 bp, Mus musculus
gaagggcccttttcctgaacagcca

SEQ ID NO: 431933 - DNA, 25 bp, Mus musculus
gaagggccgctggagaaacaaaagc

SEQ ID NO: 431934 - DNA, 25 bp, Mus musculus
gaagggcctccaggaagtatggtcc

SEQ ID NO: 431935 - DNA, 25 bp, Mus musculus
gaagggcctcttggctactattcag

SEQ ID NO: 431936 - DNA, 25 bp, Mus musculus
gaagggcgcatcacacagacaagtt

SEQ ID NO: 431937 - DNA, 25 bp, Mus musculus
gaagggcgctggttccctcagacat

SEQ ID NO: 431938 - DNA, 25 bp, Mus musculus
gaagggctaagctcggaatctaatg

SEQ ID NO: 431939 - DNA, 25 bp, Mus musculus
gaagggctaatacacgccagtcaca

SEQ ID NO: 431940 - DNA, 25 bp, Mus musculus
gaagggctagaccaataaatatcct

SEQ ID NO: 431941 - DNA, 25 bp, Mus musculus
gaagggctcataaggctataggcaa

SEQ ID NO: 431942 - DNA, 25 bp, Mus musculus
gaagggctcccgactgagagccaga

SEQ ID NO: 431943 - DNA, 25 bp, Mus musculus
gaagggctcctatcctgtcctggga

SEQ ID NO: 431944 - DNA, 25 bp, Mus musculus
gaagggctcctggtatctccactgg

SEQ ID NO: 431945 - DNA, 25 bp, Mus musculus
gaagggctcgtgatgactgaagtcc

SEQ ID NO: 431946 - DNA, 25 bp, Mus musculus
gaagggctctacaccactgcatatg

SEQ ID NO: 431947 - DNA, 25 bp, Mus musculus
gaagggctctttcagaaccggcaac

SEQ ID NO: 431948 - DNA, 25 bp, Mus musculus
gaagggctgaaccatgagtgcaaac

SEQ ID NO: 431949 - DNA, 25 bp, Mus musculus
gaagggctgacttcttccaggcatg

SEQ ID NO: 431950 - DNA, 25 bp, Mus musculus
gaagggctgagtttttctccatctg

SEQ ID NO: 431951 - DNA, 25 bp, Mus musculus
gaagggctgcccaactttgataaca

SEQ ID NO: 431952 - DNA, 25 bp, Mus musculus
gaagggctgcgcacattctgattag

SEQ ID NO: 431953 - DNA, 25 bp, Mus musculus
gaagggcttctcctcagatgccaga

SEQ ID NO: 431954 - DNA, 25 bp, Mus musculus
gaagggctttacctcctcagcggtg

SEQ ID NO: 431955 - DNA, 25 bp, Mus musculus
gaagggtacccctcgccatggtcgg

SEQ ID NO: 431956 - DNA, 25 bp, Mus musculus
gaagggtactcatatctgccaagac

SEQ ID NO: 431957 - DNA, 25 bp, Mus musculus
gaagggtactctagagatgccacct

SEQ ID NO: 431958 - DNA, 25 bp, Mus musculus
gaagggtcaaccattactagccgta

SEQ ID NO: 431959 - DNA, 25 bp, Mus musculus
gaagggtcacactgaggatttggca

SEQ ID NO: 431960 - DNA, 25 bp, Mus musculus
gaagggtcactccataacgtttggt

SEQ ID NO: 431961 - DNA, 25 bp, Mus musculus
gaagggtctggtttcagccactctg

SEQ ID NO: 431962 - DNA, 25 bp, Mus musculus
gaagggtctttccagtatccggcca

SEQ ID NO: 431963 - DNA, 25 bp, Mus musculus
gaagggtgggctccaactcagacat

SEQ ID NO: 431964 - DNA, 25 bp, Mus musculus
gaagggtgtctcacccctaaagcca

SEQ ID NO: 431965 - DNA, 25 bp, Mus musculus
gaagggttaagagtcacacagctag

SEQ ID NO: 431966 - DNA, 25 bp, Mus musculus
gaagggttccttccagtatcatgaa

SEQ ID NO: 431967 - DNA, 25 bp, Mus musculus
gaagggtttataccactctgtggag

SEQ ID NO: 431968 - DNA, 25 bp, Mus musculus
gaagggtttcagcttagtcatccat

SEQ ID NO: 431969 - DNA, 25 bp, Mus musculus
gaagggtttgatttcgcgaatggca

SEQ ID NO: 431970 - DNA, 25 bp, Mus musculus
gaagggtttgtgtcctagctcccca

SEQ ID NO: 431971 - DNA, 25 bp, Mus musculus
gaagggttttatcctcagaggcagc

SEQ ID NO: 431972 - DNA, 25 bp, Mus musculus
gaagggttttcactcattggcagca

SEQ ID NO: 431973 - DNA, 25 bp, Mus musculus
gaaggtacaccgagtaccgctctct

SEQ ID NO: 431974 - DNA, 25 bp, Mus musculus
gaaggtactactgtggctaagcccg

SEQ ID NO: 431975 - DNA, 25 bp, Mus musculus
gaaggtagatagttgcctgggcact

SEQ ID NO: 431976 - DNA, 25 bp, Mus musculus
gaaggtagccatagctgggcaaaca

SEQ ID NO: 431977 - DNA, 25 bp, Mus musculus
gaaggtagcgaaaaacagtgtcatc

SEQ ID NO: 431978 - DNA, 25 bp, Mus musculus
gaaggtaggcaagactggttccctc

SEQ ID NO: 431979 - DNA, 25 bp, Mus musculus
gaaggtatccagcaagtggctagct

SEQ ID NO: 431980 - DNA, 25 bp, Mus musculus
gaaggtatccctaagccacgatggg

SEQ ID NO: 431981 - DNA, 25 bp, Mus musculus
gaaggtatccctctcttttggagca

SEQ ID NO: 431982 - DNA, 25 bp, Mus musculus
gaaggtattccgtgtgaaactccag

SEQ ID NO: 431983 - DNA, 25 bp, Mus musculus
gaaggtcaacatcactcaagcgaga

SEQ ID NO: 431984 - DNA, 25 bp, Mus musculus
gaaggtcaaccaagctttcgagacg

SEQ ID NO: 431985 - DNA, 25 bp, Mus musculus
gaaggtcaatcagctccagaaacaa

SEQ ID NO: 431986 - DNA, 25 bp, Mus musculus
gaaggtcaccctacctgtgccggat

SEQ ID NO: 431987 - DNA, 25 bp, Mus musculus
gaaggtcagttttatgcatgagtaa

SEQ ID NO: 431988 - DNA, 25 bp, Mus musculus
gaaggtccagcaggcttatctagaa

SEQ ID NO: 431989 - DNA, 25 bp, Mus musculus
gaaggtccctctgcagtatgtggcc

SEQ ID NO: 431990 - DNA, 25 bp, Mus musculus
gaaggtcctcgggaccaagaggctt

SEQ ID NO: 431991 - DNA, 25 bp, Mus musculus
gaaggtcctgttcacacaacagcag

SEQ ID NO: 431992 - DNA, 25 bp, Mus musculus
gaaggtcgctgttgatcttgacaag

SEQ ID NO: 431993 - DNA, 25 bp, Mus musculus
gaaggtctcatgctacctccacacg

SEQ ID NO: 431994 - DNA, 25 bp, Mus musculus
gaaggtctgcatcgactctgagcac

SEQ ID NO: 431995 - DNA, 25 bp, Mus musculus
gaaggtcttcgaggtctgcgtctgc

SEQ ID NO: 431996 - DNA, 25 bp, Mus musculus
gaaggtctttactcagctctcgcag

SEQ ID NO: 431997 - DNA, 25 bp, Mus musculus
gaaggtctttccatgcagggtctgt

SEQ ID NO: 431998 - DNA, 25 bp, Mus musculus
gaaggtgactttggatgggccccac

SEQ ID NO: 431999 - DNA, 25 bp, Mus musculus
gaaggtgagccttcctaagcctcta

SEQ ID NO: 432000 - DNA, 25 bp, Mus musculus
gaaggtgagctaaatcaattagagc

SEQ ID NO: 432001 - DNA, 25 bp, Mus musculus
gaaggtgatcttcctccatgtagcc

SEQ ID NO: 432002 - DNA, 25 bp, Mus musculus
gaaggtgcctgtcgcagattctcca

SEQ ID NO: 432003 - DNA, 25 bp, Mus musculus
gaaggtgcgcctgagacattcctcg

SEQ ID NO: 432004 - DNA, 25 bp, Mus musculus
gaaggtgcgggtttctgccatcgta

SEQ ID NO: 432005 - DNA, 25 bp, Mus musculus
gaaggtgctagaaccaatgcccagc

SEQ ID NO: 432006 - DNA, 25 bp, Mus musculus
gaaggtgctccatgctcagatccta

SEQ ID NO: 432007 - DNA, 25 bp, Mus musculus
gaaggtgctgcagtttgacccagga

SEQ ID NO: 432008 - DNA, 25 bp, Mus musculus
gaaggtgctgcggtataaatcactg

SEQ ID NO: 432009 - DNA, 25 bp, Mus musculus
gaaggtgctgtgtgggaactaccca

SEQ ID NO: 432010 - DNA, 25 bp, Mus musculus
gaaggtgcttcaaaatgctcgtggg

SEQ ID NO: 432011 - DNA, 25 bp, Mus musculus
gaaggtggcctacaacccatttggc

SEQ ID NO: 432012 - DNA, 25 bp, Mus musculus
gaaggtggctattcctgcttttgcc

SEQ ID NO: 432013 - DNA, 25 bp, Mus musculus
gaaggtggcttcttcctcaccagga

SEQ ID NO: 432014 - DNA, 25 bp, Mus musculus
gaaggtgggtcaatgatccaggtcc

SEQ ID NO: 432015 - DNA, 25 bp, Mus musculus
gaaggtgtcaagtcagaccaggcag

SEQ ID NO: 432016 - DNA, 25 bp, Mus musculus
gaaggtgtcaatcaggtttcccaga

SEQ ID NO: 432017 - DNA, 25 bp, Mus musculus
gaaggtgtcctgagccgagctctga

SEQ ID NO: 432018 - DNA, 25 bp, Mus musculus
gaaggtgtgaggtcaattctaagcc

SEQ ID NO: 432019 - DNA, 25 bp, Mus musculus
gaaggttaatgtgagcgaataccag

SEQ ID NO: 432020 - DNA, 25 bp, Mus musculus
gaaggttacacatctcccaagaggc

SEQ ID NO: 432021 - DNA, 25 bp, Mus musculus
gaaggttatcatctgccatcgaggc

SEQ ID NO: 432022 - DNA, 25 bp, Mus musculus
gaaggttcaaatggctacgagctcc

SEQ ID NO: 432023 - DNA, 25 bp, Mus musculus
gaaggttcacgtctcaatgcccacg

SEQ ID NO: 432024 - DNA, 25 bp, Mus musculus
gaaggttcccagcagaaactcagct

SEQ ID NO: 432025 - DNA, 25 bp, Mus musculus
gaaggttccgtagccatagccggtg

SEQ ID NO: 432026 - DNA, 25 bp, Mus musculus
gaaggttctccgctcaaagcatggg

SEQ ID NO: 432027 - DNA, 25 bp, Mus musculus
gaaggttctcggcacaaaagggcca

SEQ ID NO: 432028 - DNA, 25 bp, Mus musculus
gaaggttctctgaagggaacagcca

SEQ ID NO: 432029 - DNA, 25 bp, Mus musculus
gaaggttctgagcaggaatctccac

SEQ ID NO: 432030 - DNA, 25 bp, Mus musculus
gaaggttgactttccccaagaccag

SEQ ID NO: 432031 - DNA, 25 bp, Mus musculus
gaaggttgagaatccaggaaagatc

SEQ ID NO: 432032 - DNA, 25 bp, Mus musculus
gaaggttgagttaaccggactgcct

SEQ ID NO: 432033 - DNA, 25 bp, Mus musculus
gaaggttgccaagcatagctccgaa

SEQ ID NO: 432034 - DNA, 25 bp, Mus musculus
gaaggttgccatagcttctcggcca

SEQ ID NO: 432035 - DNA, 25 bp, Mus musculus
gaaggttgtcactagactcaggtaa

SEQ ID NO: 432036 - DNA, 25 bp, Mus musculus
gaaggttgtgtgaccacccaaggct

SEQ ID NO: 432037 - DNA, 25 bp, Mus musculus
gaaggtttaccagaagacccctgct

SEQ ID NO: 432038 - DNA, 25 bp, Mus musculus
gaaggtttagactatctgcacagaa

SEQ ID NO: 432039 - DNA, 25 bp, Mus musculus
gaaggtttcagtccgcagttgccac

SEQ ID NO: 432040 - DNA, 25 bp, Mus musculus
gaaggtttccgacagcagctcaact

SEQ ID NO: 432041 - DNA, 25 bp, Mus musculus
gaaggtttcgaccatgccactgtcc

SEQ ID NO: 432042 - DNA, 25 bp, Mus musculus
gaaggtttcgagcaagtaactacca

SEQ ID NO: 432043 - DNA, 25 bp, Mus musculus
gaaggttttatgtcctcagtccgca

SEQ ID NO: 432044 - DNA, 25 bp, Mus musculus
gaagtaaaaacagtcgacctcccat

SEQ ID NO: 432045 - DNA, 25 bp, Mus musculus
gaagtaaaaatgagggcaggagccc

SEQ ID NO: 432046 - DNA, 25 bp, Mus musculus
gaagtaaaggctgttcccgagggct

SEQ ID NO: 432047 - DNA, 25 bp, Mus musculus
gaagtaacgaacacatccgggagct

SEQ ID NO: 432048 - DNA, 25 bp, Mus musculus
gaagtaactgaaccaccatgaaggt

SEQ ID NO: 432049 - DNA, 25 bp, Mus musculus
gaagtaacttatcaggaggctccag

SEQ ID NO: 432050 - DNA, 25 bp, Mus musculus
gaagtaacttgtaaaccagcgcgct

SEQ ID NO: 432051 - DNA, 25 bp, Mus musculus
gaagtaagaacagatgagaggagtc

SEQ ID NO: 432052 - DNA, 25 bp, Mus musculus
gaagtaaggcatatcccaagaggga

SEQ ID NO: 432053 - DNA, 25 bp, Mus musculus
gaagtaagtaagagctctgaaaaga

SEQ ID NO: 432054 - DNA, 25 bp, Mus musculus
gaagtaatattgtccagagccatgc

SEQ ID NO: 432055 - DNA, 25 bp, Mus musculus
gaagtaatgcagtggtctcagtctc

SEQ ID NO: 432056 - DNA, 25 bp, Mus musculus
gaagtaattcccatatcagatcctg

SEQ ID NO: 432057 - DNA, 25 bp, Mus musculus
gaagtacacactatgcagcgacaat

SEQ ID NO: 432058 - DNA, 25 bp, Mus musculus
gaagtacagagagcccagtgcatct

SEQ ID NO: 432059 - DNA, 25 bp, Mus musculus
gaagtaccagcaaggaataaggccg

SEQ ID NO: 432060 - DNA, 25 bp, Mus musculus
gaagtaccagctcaaatcccagtca

SEQ ID NO: 432061 - DNA, 25 bp, Mus musculus
gaagtaccagtccatggaggccatg

SEQ ID NO: 432062 - DNA, 25 bp, Mus musculus
gaagtacccatgtatgggtgtgcac

SEQ ID NO: 432063 - DNA, 25 bp, Mus musculus
gaagtaccgagtcctttcgccagag

SEQ ID NO: 432064 - DNA, 25 bp, Mus musculus
gaagtaccgcttagtatgatccctt

SEQ ID NO: 432065 - DNA, 25 bp, Mus musculus
gaagtacctagtggacccagacgga

SEQ ID NO: 432066 - DNA, 25 bp, Mus musculus
gaagtacctgaacatgcgctccact

SEQ ID NO: 432067 - DNA, 25 bp, Mus musculus
gaagtacgcgagtttcagggccgct

SEQ ID NO: 432068 - DNA, 25 bp, Mus musculus
gaagtacgcgtacacgaagcaaacg

SEQ ID NO: 432069 - DNA, 25 bp, Mus musculus
gaagtacggcgatcagtccaaggtc

SEQ ID NO: 432070 - DNA, 25 bp, Mus musculus
gaagtactaacatcatggccagagg

SEQ ID NO: 432071 - DNA, 25 bp, Mus musculus
gaagtactaagctactccagtgaac

SEQ ID NO: 432072 - DNA, 25 bp, Mus musculus
gaagtactacagagtagcctgtgag

SEQ ID NO: 432073 - DNA, 25 bp, Mus musculus
gaagtactatgagggatcacatctt

SEQ ID NO: 432074 - DNA, 25 bp, Mus musculus
gaagtactgggaaatacaacctgca

SEQ ID NO: 432075 - DNA, 25 bp, Mus musculus
gaagtactgggagccatttgccttt

SEQ ID NO: 432076 - DNA, 25 bp, Mus musculus
gaagtactgtagaacactccgagga

SEQ ID NO: 432077 - DNA, 25 bp, Mus musculus
gaagtacttcagtagcctgttggag

SEQ ID NO: 432078 - DNA, 25 bp, Mus musculus
gaagtacttggagcccaggtgtcct

SEQ ID NO: 432079 - DNA, 25 bp, Mus musculus
gaagtacttggcacctcaggctacg

SEQ ID NO: 432080 - DNA, 25 bp, Mus musculus
gaagtagaccgctatcgagaggcca

SEQ ID NO: 432081 - DNA, 25 bp, Mus musculus
gaagtagcagataggctggacgcca

SEQ ID NO: 432082 - DNA, 25 bp, Mus musculus
gaagtagcagcttggaggctacccc

SEQ ID NO: 432083 - DNA, 25 bp, Mus musculus
gaagtagcgtgagaagactgtgcac

SEQ ID NO: 432084 - DNA, 25 bp, Mus musculus
gaagtagcttcactagcggcggcat

SEQ ID NO: 432085 - DNA, 25 bp, Mus musculus
gaagtagcttcccatcgccagaact

SEQ ID NO: 432086 - DNA, 25 bp, Mus musculus
gaagtaggaagtgaactgaccgccc

SEQ ID NO: 432087 - DNA, 25 bp, Mus musculus
gaagtaggcaccacttcggctggct

SEQ ID NO: 432088 - DNA, 25 bp, Mus musculus
gaagtaggctccattccaaagtggg

SEQ ID NO: 432089 - DNA, 25 bp, Mus musculus
gaagtagtgaagaccacaggaagga

SEQ ID NO: 432090 - DNA, 25 bp, Mus musculus
gaagtatatcacaaagtcacagcac

SEQ ID NO: 432091 - DNA, 25 bp, Mus musculus
gaagtatcatcagggcatcaaggca

SEQ ID NO: 432092 - DNA, 25 bp, Mus musculus
gaagtatcatctccatcgaaagagg

SEQ ID NO: 432093 - DNA, 25 bp, Mus musculus
gaagtatcatgacctggccaagctg

SEQ ID NO: 432094 - DNA, 25 bp, Mus musculus
gaagtatcctccaacgctgaaatga

SEQ ID NO: 432095 - DNA, 25 bp, Mus musculus
gaagtatctcttcggttgggaccga

SEQ ID NO: 432096 - DNA, 25 bp, Mus musculus
gaagtatgaactgcatgcagcgaca

SEQ ID NO: 432097 - DNA, 25 bp, Mus musculus
gaagtatgatttccagcctcgcaag

SEQ ID NO: 432098 - DNA, 25 bp, Mus musculus
gaagtatggctgctgtccaatgccc

SEQ ID NO: 432099 - DNA, 25 bp, Mus musculus
gaagtattacccgaccaaagagcag

SEQ ID NO: 432100 - DNA, 25 bp, Mus musculus
gaagtattccagttcaacaatatga

SEQ ID NO: 432101 - DNA, 25 bp, Mus musculus
gaagtatttgacctccacccaggct

SEQ ID NO: 432102 - DNA, 25 bp, Mus musculus
gaagtattttattctccacggtcat

SEQ ID NO: 432103 - DNA, 25 bp, Mus musculus
gaagtattttcagtacctgggcacc

SEQ ID NO: 432104 - DNA, 25 bp, Mus musculus
gaagtcaaaaaagccctacgtcgca

SEQ ID NO: 432105 - DNA, 25 bp, Mus musculus
gaagtcaaaaggcatcctccgaggc

SEQ ID NO: 432106 - DNA, 25 bp, Mus musculus
gaagtcaaaccacagaatgacagct

SEQ ID NO: 432107 - DNA, 25 bp, Mus musculus
gaagtcaagagtaacgcacacagcc

SEQ ID NO: 432108 - DNA, 25 bp, Mus musculus
gaagtcaataaacatgcagcctgag

SEQ ID NO: 432109 - DNA, 25 bp, Mus musculus
gaagtcacaaaggagtaatgcccag

SEQ ID NO: 432110 - DNA, 25 bp, Mus musculus
gaagtcacactctgacaggagcctg

SEQ ID NO: 432111 - DNA, 25 bp, Mus musculus
gaagtcacatacacgtctacgagcg

SEQ ID NO: 432112 - DNA, 25 bp, Mus musculus
gaagtcacatctgtagccacccagg

SEQ ID NO: 432113 - DNA, 25 bp, Mus musculus
gaagtcacccttggataagatccag

SEQ ID NO: 432114 - DNA, 25 bp, Mus musculus
gaagtcaccgagttgtgaggctgaa

SEQ ID NO: 432115 - DNA, 25 bp, Mus musculus
gaagtcaccgcccaagataggtcga

SEQ ID NO: 432116 - DNA, 25 bp, Mus musculus
gaagtcaccgtgtttcaaggatgca

SEQ ID NO: 432117 - DNA, 25 bp, Mus musculus
gaagtcacgcttcccagcaaacaag

SEQ ID NO: 432118 - DNA, 25 bp, Mus musculus
gaagtcacgttcagtgtccccgcta

SEQ ID NO: 432119 - DNA, 25 bp, Mus musculus
gaagtcactttgtcccacacctaga

SEQ ID NO: 432120 - DNA, 25 bp, Mus musculus
gaagtcagaactctagctacagcca

SEQ ID NO: 432121 - DNA, 25 bp, Mus musculus
gaagtcagacgaaagtaacttggct

SEQ ID NO: 432122 - DNA, 25 bp, Mus musculus
gaagtcagactaatcccagggtgca

SEQ ID NO: 432123 - DNA, 25 bp, Mus musculus
gaagtcagagttgcccacatgccaa

SEQ ID NO: 432124 - DNA, 25 bp, Mus musculus
gaagtcagcaacctaggagaggctc

SEQ ID NO: 432125 - DNA, 25 bp, Mus musculus
gaagtcagccactacaaggaggccc

SEQ ID NO: 432126 - DNA, 25 bp, Mus musculus
gaagtcagcccagatgaacaggagc

SEQ ID NO: 432127 - DNA, 25 bp, Mus musculus
gaagtcagcgctccgactgagcaag

SEQ ID NO: 432128 - DNA, 25 bp, Mus musculus
gaagtcaggcgcaggtcataagacc

SEQ ID NO: 432129 - DNA, 25 bp, Mus musculus
gaagtcaggtgagacgactctctct

SEQ ID NO: 432130 - DNA, 25 bp, Mus musculus
gaagtcagtcattttaaggccccta

SEQ ID NO: 432131 - DNA, 25 bp, Mus musculus
gaagtcagtccgtctggatgcctgg

SEQ ID NO: 432132 - DNA, 25 bp, Mus musculus
gaagtcatccaagtcaaatggcctg

SEQ ID NO: 432133 - DNA, 25 bp, Mus musculus
gaagtcatcgagctgaacaagtgca

SEQ ID NO: 432134 - DNA, 25 bp, Mus musculus
gaagtcatcgggacggctatctcct

SEQ ID NO: 432135 - DNA, 25 bp, Mus musculus
gaagtcatcgtttctttgctacaac

SEQ ID NO: 432136 - DNA, 25 bp, Mus musculus
gaagtcatctgccatgggattccag

SEQ ID NO: 432137 - DNA, 25 bp, Mus musculus
gaagtcattaaggaactggcccaga

SEQ ID NO: 432138 - DNA, 25 bp, Mus musculus
gaagtccaaaagtgagctacaggca

SEQ ID NO: 432139 - DNA, 25 bp, Mus musculus
gaagtccaccttgtacgctgctgtg

SEQ ID NO: 432140 - DNA, 25 bp, Mus musculus
gaagtccactcaactttctcaaaag

SEQ ID NO: 432141 - DNA, 25 bp, Mus musculus
gaagtccagctccactctttagcac

SEQ ID NO: 432142 - DNA, 25 bp, Mus musculus
gaagtccaggttgacaccagcaagc

SEQ ID NO: 432143 - DNA, 25 bp, Mus musculus
gaagtccagtggtgtctagagcagc

SEQ ID NO: 432144 - DNA, 25 bp, Mus musculus
gaagtccagttctctgcaggtagca

SEQ ID NO: 432145 - DNA, 25 bp, Mus musculus
gaagtccatatttgaggcccgcctg

SEQ ID NO: 432146 - DNA, 25 bp, Mus musculus
gaagtcccagaagatatcccagtac

SEQ ID NO: 432147 - DNA, 25 bp, Mus musculus
gaagtcccaggagtgcaaagatgtc

SEQ ID NO: 432148 - DNA, 25 bp, Mus musculus
gaagtccccagattgtgtgtagtca

SEQ ID NO: 432149 - DNA, 25 bp, Mus musculus
gaagtcccgagagttgactcgtgct

SEQ ID NO: 432150 - DNA, 25 bp, Mus musculus
gaagtccctgtcattaacttgtctt

SEQ ID NO: 432151 - DNA, 25 bp, Mus musculus
gaagtccctttctgatgccaccatg

SEQ ID NO: 432152 - DNA, 25 bp, Mus musculus
gaagtccgagaaattgaacagcgcc

SEQ ID NO: 432153 - DNA, 25 bp, Mus musculus
gaagtccgtgctcagagtgatcact

SEQ ID NO: 432154 - DNA, 25 bp, Mus musculus
gaagtccgtgtcttggctcgtgaaa

SEQ ID NO: 432155 - DNA, 25 bp, Mus musculus
gaagtcctaaagaacatcacgtgtc

SEQ ID NO: 432156 - DNA, 25 bp, Mus musculus
gaagtcctccgtccttggactgagt

SEQ ID NO: 432157 - DNA, 25 bp, Mus musculus
gaagtcctcggctttgcgactcagc

SEQ ID NO: 432158 - DNA, 25 bp, Mus musculus
gaagtcctctctgatcaacgggctg

SEQ ID NO: 432159 - DNA, 25 bp, Mus musculus
gaagtcctgcaaaatctctaccgaa

SEQ ID NO: 432160 - DNA, 25 bp, Mus musculus
gaagtcctggctgatctgggcagca

SEQ ID NO: 432161 - DNA, 25 bp, Mus musculus
gaagtccttccgagtcagacagtcc

SEQ ID NO: 432162 - DNA, 25 bp, Mus musculus
gaagtccttccttctaaaaagtgca

SEQ ID NO: 432163 - DNA, 25 bp, Mus musculus
gaagtccttcgagcagttttacaga

SEQ ID NO: 432164 - DNA, 25 bp, Mus musculus
gaagtcgaccctgattactgtgagg

SEQ ID NO: 432165 - DNA, 25 bp, Mus musculus
gaagtcgacctttgatgcagccagc

SEQ ID NO: 432166 - DNA, 25 bp, Mus musculus
gaagtcgaggctaacctgtgagacc

SEQ ID NO: 432167 - DNA, 25 bp, Mus musculus
gaagtcgctgaagaatgagggccct

SEQ ID NO: 432168 - DNA, 25 bp, Mus musculus
gaagtcggaactgtgaagggctccc

SEQ ID NO: 432169 - DNA, 25 bp, Mus musculus
gaagtcggacttcagaaaggacttt

SEQ ID NO: 432170 - DNA, 25 bp, Mus musculus
gaagtcggcaatacccaaaggagag

SEQ ID NO: 432171 - DNA, 25 bp, Mus musculus
gaagtcggctccctaaagaggctcg

SEQ ID NO: 432172 - DNA, 25 bp, Mus musculus
gaagtcggtgtgaagctgaacagac

SEQ ID NO: 432173 - DNA, 25 bp, Mus musculus
gaagtcgtacatccacgaggtggcc

SEQ ID NO: 432174 - DNA, 25 bp, Mus musculus
gaagtcgtccgagatgaatgtcctg

SEQ ID NO: 432175 - DNA, 25 bp, Mus musculus
gaagtcgtcctaatgtgtcaggcca

SEQ ID NO: 432176 - DNA, 25 bp, Mus musculus
gaagtcgtttaagcgtgtctccagc

SEQ ID NO: 432177 - DNA, 25 bp, Mus musculus
gaagtctaaggcttctcaggtcagc

SEQ ID NO: 432178 - DNA, 25 bp, Mus musculus
gaagtctacgcgaaggactacccgg

SEQ ID NO: 432179 - DNA, 25 bp, Mus musculus
gaagtctactaaactgcacctggga

SEQ ID NO: 432180 - DNA, 25 bp, Mus musculus
gaagtctactgacccaggatagcaa

SEQ ID NO: 432181 - DNA, 25 bp, Mus musculus
gaagtctatgccctactaatgctgg

SEQ ID NO: 432182 - DNA, 25 bp, Mus musculus
gaagtctattcggagcatacctgcc

SEQ ID NO: 432183 - DNA, 25 bp, Mus musculus
gaagtctcaaagtaccgatagtgct

SEQ ID NO: 432184 - DNA, 25 bp, Mus musculus
gaagtctcagacgtcaaaatggcca

SEQ ID NO: 432185 - DNA, 25 bp, Mus musculus
gaagtctccagattctcctgtctca

SEQ ID NO: 432186 - DNA, 25 bp, Mus musculus
gaagtctccgtgtaatcaagaagca

SEQ ID NO: 432187 - DNA, 25 bp, Mus musculus
gaagtctctagaacatgcatatggg

SEQ ID NO: 432188 - DNA, 25 bp, Mus musculus
gaagtctctcttggctgaggatagc

SEQ ID NO: 432189 - DNA, 25 bp, Mus musculus
gaagtctctgaatagcctggaaacg

SEQ ID NO: 432190 - DNA, 25 bp, Mus musculus
gaagtctctgatcacgaaggtggac

SEQ ID NO: 432191 - DNA, 25 bp, Mus musculus
gaagtctctgatctctcacagggaa

SEQ ID NO: 432192 - DNA, 25 bp, Mus musculus
gaagtctctgcgctcctactggagg

SEQ ID NO: 432193 - DNA, 25 bp, Mus musculus
gaagtctgacattaccggatatcct

SEQ ID NO: 432194 - DNA, 25 bp, Mus musculus
gaagtctgatctgaacaagtagcaa

SEQ ID NO: 432195 - DNA, 25 bp, Mus musculus
gaagtctgcaaagtactctcaatga

SEQ ID NO: 432196 - DNA, 25 bp, Mus musculus
gaagtctgctgatgacaatacccgc

SEQ ID NO: 432197 - DNA, 25 bp, Mus musculus
gaagtctgtattccatgccaaagaa

SEQ ID NO: 432198 - DNA, 25 bp, Mus musculus
gaagtctgtttgtcctcctaccacg

SEQ ID NO: 432199 - DNA, 25 bp, Mus musculus
gaagtcttatagaagagtcgggaga

SEQ ID NO: 432200 - DNA, 25 bp, Mus musculus
gaagtcttcacagaacaagctgacc

SEQ ID NO: 432201 - DNA, 25 bp, Mus musculus
gaagtcttccctcaactacgtgtga

SEQ ID NO: 432202 - DNA, 25 bp, Mus musculus
gaagtcttcgagcaacacctaggtg

SEQ ID NO: 432203 - DNA, 25 bp, Mus musculus
gaagtcttttgctgggtgtcacaca

SEQ ID NO: 432204 - DNA, 25 bp, Mus musculus
gaagtgaaatcagaagagagcccag

SEQ ID NO: 432205 - DNA, 25 bp, Mus musculus
gaagtgaaatccgatctggcccagc

SEQ ID NO: 432206 - DNA, 25 bp, Mus musculus
gaagtgaacaattccgtgaccggtc

SEQ ID NO: 432207 - DNA, 25 bp, Mus musculus
gaagtgaaccctgctttgaggctga

SEQ ID NO: 432208 - DNA, 25 bp, Mus musculus
gaagtgaacgctcgtgctccatcgg

SEQ ID NO: 432209 - DNA, 25 bp, Mus musculus
gaagtgaagaatgcactgagtcact

SEQ ID NO: 432210 - DNA, 25 bp, Mus musculus
gaagtgaagaattagagctgccagc

SEQ ID NO: 432211 - DNA, 25 bp, Mus musculus
gaagtgaagccctccccatttgtgg

SEQ ID NO: 432212 - DNA, 25 bp, Mus musculus
gaagtgaatcaacatccccggagat

SEQ ID NO: 432213 - DNA, 25 bp, Mus musculus
gaagtgaatccaccaagccaggtaa

SEQ ID NO: 432214 - DNA, 25 bp, Mus musculus
gaagtgacagttgttgccccattag

SEQ ID NO: 432215 - DNA, 25 bp, Mus musculus
gaagtgacatgaccatggacccaga

SEQ ID NO: 432216 - DNA, 25 bp, Mus musculus
gaagtgaccctcagtccattgtgct

SEQ ID NO: 432217 - DNA, 25 bp, Mus musculus
gaagtgacctactgtgtgaccacag

SEQ ID NO: 432218 - DNA, 25 bp, Mus musculus
gaagtgactttttgctggcattaac

SEQ ID NO: 432219 - DNA, 25 bp, Mus musculus
gaagtgagcacctctctcagtagcc

SEQ ID NO: 432220 - DNA, 25 bp, Mus musculus
gaagtgaggaagtgttcaaatggca

SEQ ID NO: 432221 - DNA, 25 bp, Mus musculus
gaagtgaggccttctgcatagccaa

SEQ ID NO: 432222 - DNA, 25 bp, Mus musculus
gaagtgagttggtcagatcatacca

SEQ ID NO: 432223 - DNA, 25 bp, Mus musculus
gaagtgagtttctagggactctacc

SEQ ID NO: 432224 - DNA, 25 bp, Mus musculus
gaagtgatccttaatactcctagcc

SEQ ID NO: 432225 - DNA, 25 bp, Mus musculus
gaagtgatgggctttcacttagtaa

SEQ ID NO: 432226 - DNA, 25 bp, Mus musculus
gaagtgcaaagtgatcccatcccag

SEQ ID NO: 432227 - DNA, 25 bp, Mus musculus
gaagtgcagagactcccattcatgg

SEQ ID NO: 432228 - DNA, 25 bp, Mus musculus
gaagtgcagtggttaccggagtcca

SEQ ID NO: 432229 - DNA, 25 bp, Mus musculus
gaagtgcatcttctcacaacgtcaa

SEQ ID NO: 432230 - DNA, 25 bp, Mus musculus
gaagtgccaggctagatctatgctc

SEQ ID NO: 432231 - DNA, 25 bp, Mus musculus
gaagtgcccaagaagtactcccagg

SEQ ID NO: 432232 - DNA, 25 bp, Mus musculus
gaagtgccccagttcgctgtacatg

SEQ ID NO: 432233 - DNA, 25 bp, Mus musculus
gaagtgccctatgcctacatccggg

SEQ ID NO: 432234 - DNA, 25 bp, Mus musculus
gaagtgcccttataaacccctgcag

SEQ ID NO: 432235 - DNA, 25 bp, Mus musculus
gaagtgccgctggagaaagaacata

SEQ ID NO: 432236 - DNA, 25 bp, Mus musculus
gaagtgccggcgaaccatcattcaa

SEQ ID NO: 432237 - DNA, 25 bp, Mus musculus
gaagtgccgtcttctaggcatgcca

SEQ ID NO: 432238 - DNA, 25 bp, Mus musculus
gaagtgcctcccacaacggttgtga

SEQ ID NO: 432239 - DNA, 25 bp, Mus musculus
gaagtgcgccatgctacagatgtcc

SEQ ID NO: 432240 - DNA, 25 bp, Mus musculus
gaagtgcgctccaaatagaatacag

SEQ ID NO: 432241 - DNA, 25 bp, Mus musculus
gaagtgcggacagccactcctggct

SEQ ID NO: 432242 - DNA, 25 bp, Mus musculus
gaagtgctaatcctgcctttggttg

SEQ ID NO: 432243 - DNA, 25 bp, Mus musculus
gaagtgctaatgagcccgtgtttcc

SEQ ID NO: 432244 - DNA, 25 bp, Mus musculus
gaagtgctaccctgcgcctagcgga

SEQ ID NO: 432245 - DNA, 25 bp, Mus musculus
gaagtgctcagcaaggctcggagtc

SEQ ID NO: 432246 - DNA, 25 bp, Mus musculus
gaagtgctccctatgaatgatcgct

SEQ ID NO: 432247 - DNA, 25 bp, Mus musculus
gaagtgctctcccttccacctgaag

SEQ ID NO: 432248 - DNA, 25 bp, Mus musculus
gaagtggaaatgacacagcacgggc

SEQ ID NO: 432249 - DNA, 25 bp, Mus musculus
gaagtggaagacaccatcgggaaac

SEQ ID NO: 432250 - DNA, 25 bp, Mus musculus
gaagtggaagcggaagcatcttcac

SEQ ID NO: 432251 - DNA, 25 bp, Mus musculus
gaagtggacacttatgactgctata

SEQ ID NO: 432252 - DNA, 25 bp, Mus musculus
gaagtggacccaaggagtcggcttt

SEQ ID NO: 432253 - DNA, 25 bp, Mus musculus
gaagtggacgatgctttctaaggcc

SEQ ID NO: 432254 - DNA, 25 bp, Mus musculus
gaagtggacgtgtcttttgggccct

SEQ ID NO: 432255 - DNA, 25 bp, Mus musculus
gaagtggacttcagacgacctgtcg

SEQ ID NO: 432256 - DNA, 25 bp, Mus musculus
gaagtggagcgtgcacatcgccatg

SEQ ID NO: 432257 - DNA, 25 bp, Mus musculus
gaagtggagtcaaaccgtctgtgtg

SEQ ID NO: 432258 - DNA, 25 bp, Mus musculus
gaagtggcagacactcatctgacat

SEQ ID NO: 432259 - DNA, 25 bp, Mus musculus
gaagtggcccaaccagctctagatg

SEQ ID NO: 432260 - DNA, 25 bp, Mus musculus
gaagtggccctcagtaacatcaaag

SEQ ID NO: 432261 - DNA, 25 bp, Mus musculus
gaagtggccttttcccgagatgcgg

SEQ ID NO: 432262 - DNA, 25 bp, Mus musculus
gaagtggcgccggattatccacaca

SEQ ID NO: 432263 - DNA, 25 bp, Mus musculus
gaagtggctgactccatttgacccc

SEQ ID NO: 432264 - DNA, 25 bp, Mus musculus
gaagtggctgcttaaccatgcaagg

SEQ ID NO: 432265 - DNA, 25 bp, Mus musculus
gaagtggcttcaccgtagagcttgc

SEQ ID NO: 432266 - DNA, 25 bp, Mus musculus
gaagtgggacaaccagaagcgctat

SEQ ID NO: 432267 - DNA, 25 bp, Mus musculus
gaagtgggtcatgcatcacgcacag

SEQ ID NO: 432268 - DNA, 25 bp, Mus musculus
gaagtgggttcaagaatacatcaac

SEQ ID NO: 432269 - DNA, 25 bp, Mus musculus
gaagtggtgttccagcacgcccttt

SEQ ID NO: 432270 - DNA, 25 bp, Mus musculus
gaagtggttcgctgcctcaacagtg

SEQ ID NO: 432271 - DNA, 25 bp, Mus musculus
gaagtggttcttattgcagagcagc

SEQ ID NO: 432272 - DNA, 25 bp, Mus musculus
gaagtggtttcagtagacacaacag

SEQ ID NO: 432273 - DNA, 25 bp, Mus musculus
gaagtgtaagatgcactgggagact

SEQ ID NO: 432274 - DNA, 25 bp, Mus musculus
gaagtgtacaccgtagacgtcggca

SEQ ID NO: 432275 - DNA, 25 bp, Mus musculus
gaagtgtactctaccatccggaagc

SEQ ID NO: 432276 - DNA, 25 bp, Mus musculus
gaagtgtagaactaagccccagtgg

SEQ ID NO: 432277 - DNA, 25 bp, Mus musculus
gaagtgtaggcttacagccgtccat

SEQ ID NO: 432278 - DNA, 25 bp, Mus musculus
gaagtgtagggattcccaggtgcta

SEQ ID NO: 432279 - DNA, 25 bp, Mus musculus
gaagtgtcacttttacagcgaggag

SEQ ID NO: 432280 - DNA, 25 bp, Mus musculus
gaagtgtccactgatatccctgaga

SEQ ID NO: 432281 - DNA, 25 bp, Mus musculus
gaagtgtccgcataactcctcagga

SEQ ID NO: 432282 - DNA, 25 bp, Mus musculus
gaagtgtccttctaccagggctaca

SEQ ID NO: 432283 - DNA, 25 bp, Mus musculus
gaagtgtcgggtagccaaactcacc

SEQ ID NO: 432284 - DNA, 25 bp, Mus musculus
gaagtgtcgtccatgaagctgcagg

SEQ ID NO: 432285 - DNA, 25 bp, Mus musculus
gaagtgtctgcaaggcgtcctgagt

SEQ ID NO: 432286 - DNA, 25 bp, Mus musculus
gaagtgtgatctcatcgctgccctg

SEQ ID NO: 432287 - DNA, 25 bp, Mus musculus
gaagtgtgatctccaagtcctccct

SEQ ID NO: 432288 - DNA, 25 bp, Mus musculus
gaagtgtgcagtgtgagctctgccc

SEQ ID NO: 432289 - DNA, 25 bp, Mus musculus
gaagtgtggcatcaccgtctctcag

SEQ ID NO: 432290 - DNA, 25 bp, Mus musculus
gaagtgtgtactggctactcccctg

SEQ ID NO: 432291 - DNA, 25 bp, Mus musculus
gaagtgtgtctcacggtgtccaaca

SEQ ID NO: 432292 - DNA, 25 bp, Mus musculus
gaagtgttattccatggcatgagtg

SEQ ID NO: 432293 - DNA, 25 bp, Mus musculus
gaagtgttcaccaagcatccacaga

SEQ ID NO: 432294 - DNA, 25 bp, Mus musculus
gaagtgttgcgccatccaaaggact

SEQ ID NO: 432295 - DNA, 25 bp, Mus musculus
gaagtgtttaccactaaagcatttg

SEQ ID NO: 432296 - DNA, 25 bp, Mus musculus
gaagtgtttcagctgtccaatcaaa

SEQ ID NO: 432297 - DNA, 25 bp, Mus musculus
gaagttaacactcaagccaagacag

SEQ ID NO: 432298 - DNA, 25 bp, Mus musculus
gaagttaactagcatttttcaagcc

SEQ ID NO: 432299 - DNA, 25 bp, Mus musculus
gaagttaagttctgggcgcgtccgt

SEQ ID NO: 432300 - DNA, 25 bp, Mus musculus
gaagttacagatgttttgaaccatt

SEQ ID NO: 432301 - DNA, 25 bp, Mus musculus
gaagttacatggtccaagccgggca

SEQ ID NO: 432302 - DNA, 25 bp, Mus musculus
gaagttagcccaggagtccatcatg

SEQ ID NO: 432303 - DNA, 25 bp, Mus musculus
gaagttagctttcaggccactggtg

SEQ ID NO: 432304 - DNA, 25 bp, Mus musculus
gaagttagttgcagagacgcctcca

SEQ ID NO: 432305 - DNA, 25 bp, Mus musculus
gaagttatcctaccctactcggcag

SEQ ID NO: 432306 - DNA, 25 bp, Mus musculus
gaagttatggaagagtactgcctac

SEQ ID NO: 432307 - DNA, 25 bp, Mus musculus
gaagttatgtaaggtcgagggcaaa

SEQ ID NO: 432308 - DNA, 25 bp, Mus musculus
gaagttcaaattttactcactagtc

SEQ ID NO: 432309 - DNA, 25 bp, Mus musculus
gaagttcaacatcaagagcagtagc

SEQ ID NO: 432310 - DNA, 25 bp, Mus musculus
gaagttcaacgtctacctggtctcg

SEQ ID NO: 432311 - DNA, 25 bp, Mus musculus
gaagttcaagccacagatcgagagg

SEQ ID NO: 432312 - DNA, 25 bp, Mus musculus
gaagttcaagtccagggtcacaaat

SEQ ID NO: 432313 - DNA, 25 bp, Mus musculus
gaagttcacaattccctgtcagaaa

SEQ ID NO: 432314 - DNA, 25 bp, Mus musculus
gaagttcacctgtgaagtgccgggc

SEQ ID NO: 432315 - DNA, 25 bp, Mus musculus
gaagttcacctttgtctgcatggcg

SEQ ID NO: 432316 - DNA, 25 bp, Mus musculus
gaagttcagggtgccagatctgtgt

SEQ ID NO: 432317 - DNA, 25 bp, Mus musculus
gaagttcatcatgacggcctccagt

SEQ ID NO: 432318 - DNA, 25 bp, Mus musculus
gaagttcatctaaggcatatacatg

SEQ ID NO: 432319 - DNA, 25 bp, Mus musculus
gaagttcatgtctgcagcaaccaag

SEQ ID NO: 432320 - DNA, 25 bp, Mus musculus
gaagttccacagaggaatgaagtat

SEQ ID NO: 432321 - DNA, 25 bp, Mus musculus
gaagttccactcagtgcacagtggg

SEQ ID NO: 432322 - DNA, 25 bp, Mus musculus
gaagttccagtccaagtatgagccc

SEQ ID NO: 432323 - DNA, 25 bp, Mus musculus
gaagttcccctgtatggcaacctgc

SEQ ID NO: 432324 - DNA, 25 bp, Mus musculus
gaagttcccggtcagtcttccctct

SEQ ID NO: 432325 - DNA, 25 bp, Mus musculus
gaagttccgaaggtatctctccata

SEQ ID NO: 432326 - DNA, 25 bp, Mus musculus
gaagttccggaaatgagcttggcat

SEQ ID NO: 432327 - DNA, 25 bp, Mus musculus
gaagttccggagttatctctcagtg

SEQ ID NO: 432328 - DNA, 25 bp, Mus musculus
gaagttcctaactggtgggaggcca

SEQ ID NO: 432329 - DNA, 25 bp, Mus musculus
gaagttcctagaaacgggtgacatc

SEQ ID NO: 432330 - DNA, 25 bp, Mus musculus
gaagttcctccggacaccagtcata

SEQ ID NO: 432331 - DNA, 25 bp, Mus musculus
gaagttcctgacaaagagcatggct

SEQ ID NO: 432332 - DNA, 25 bp, Mus musculus
gaagttcctgacgtcatcaacagca

SEQ ID NO: 432333 - DNA, 25 bp, Mus musculus
gaagttcgggaagcctttgacctct

SEQ ID NO: 432334 - DNA, 25 bp, Mus musculus
gaagttcggttggacccatcggatg

SEQ ID NO: 432335 - DNA, 25 bp, Mus musculus
gaagttcgtgcagtactgtccaggc

SEQ ID NO: 432336 - DNA, 25 bp, Mus musculus
gaagttcgtgctgaaaccaacctga

SEQ ID NO: 432337 - DNA, 25 bp, Mus musculus
gaagttctaccggagcatgacgctg

SEQ ID NO: 432338 - DNA, 25 bp, Mus musculus
gaagttctcactgtctctttcttcg

SEQ ID NO: 432339 - DNA, 25 bp, Mus musculus
gaagttctcagctacgtcgcaaagc

SEQ ID NO: 432340 - DNA, 25 bp, Mus musculus
gaagttctcagtatacaccacagtg

SEQ ID NO: 432341 - DNA, 25 bp, Mus musculus
gaagttctccaaggtgcctaccaag

SEQ ID NO: 432342 - DNA, 25 bp, Mus musculus
gaagttctcccactggcttcgaaga

SEQ ID NO: 432343 - DNA, 25 bp, Mus musculus
gaagttctcccctgaccttaagttg

SEQ ID NO: 432344 - DNA, 25 bp, Mus musculus
gaagttctgaccctcctgttaccag

SEQ ID NO: 432345 - DNA, 25 bp, Mus musculus
gaagttctgcccacacagggtagca

SEQ ID NO: 432346 - DNA, 25 bp, Mus musculus
gaagttctgcgatgcctccgaggat

SEQ ID NO: 432347 - DNA, 25 bp, Mus musculus
gaagttctggtgaggacgatgacct

SEQ ID NO: 432348 - DNA, 25 bp, Mus musculus
gaagttctgtacgtcccagggagcg

SEQ ID NO: 432349 - DNA, 25 bp, Mus musculus
gaagttcttcgtgtatgacctccat

SEQ ID NO: 432350 - DNA, 25 bp, Mus musculus
gaagttcttctgtgcgctcctctga

SEQ ID NO: 432351 - DNA, 25 bp, Mus musculus
gaagttgaaacctgcatactgccgg

SEQ ID NO: 432352 - DNA, 25 bp, Mus musculus
gaagttgaacggagctacgctggca

SEQ ID NO: 432353 - DNA, 25 bp, Mus musculus
gaagttgaactaatgtgaggctgct

SEQ ID NO: 432354 - DNA, 25 bp, Mus musculus
gaagttgagcaaaaggatcctacac

SEQ ID NO: 432355 - DNA, 25 bp, Mus musculus
gaagttgcagaagatcccatgggcc

SEQ ID NO: 432356 - DNA, 25 bp, Mus musculus
gaagttgccaagaaagatgccccat

SEQ ID NO: 432357 - DNA, 25 bp, Mus musculus
gaagttgccaaggtgcaggtgccaa

SEQ ID NO: 432358 - DNA, 25 bp, Mus musculus
gaagttgccatgatagtacctgaca

SEQ ID NO: 432359 - DNA, 25 bp, Mus musculus
gaagttgcctatctggaaccagcca

SEQ ID NO: 432360 - DNA, 25 bp, Mus musculus
gaagttgcctgcaggtattcagcct

SEQ ID NO: 432361 - DNA, 25 bp, Mus musculus
gaagttgcgcaaacagctgatcagc

SEQ ID NO: 432362 - DNA, 25 bp, Mus musculus
gaagttgctatcgaagacatgcaga

SEQ ID NO: 432363 - DNA, 25 bp, Mus musculus
gaagttgctcactagtggcgggctt

SEQ ID NO: 432364 - DNA, 25 bp, Mus musculus
gaagttgctcctttataacaacaac

SEQ ID NO: 432365 - DNA, 25 bp, Mus musculus
gaagttgcttcttctcatgttaagc

SEQ ID NO: 432366 - DNA, 25 bp, Mus musculus
gaagttgcttttaaacacagctttt

SEQ ID NO: 432367 - DNA, 25 bp, Mus musculus
gaagttggagaccataaggccagca

SEQ ID NO: 432368 - DNA, 25 bp, Mus musculus
gaagttggagcgtgcctggatccct

SEQ ID NO: 432369 - DNA, 25 bp, Mus musculus
gaagttggctccaccttagtcctca

SEQ ID NO: 432370 - DNA, 25 bp, Mus musculus
gaagttgtagcaatggaaccaggca

SEQ ID NO: 432371 - DNA, 25 bp, Mus musculus
gaagttgtatgcatctccagctagc

SEQ ID NO: 432372 - DNA, 25 bp, Mus musculus
gaagttgtgcctctccaccaggtag

SEQ ID NO: 432373 - DNA, 25 bp, Mus musculus
gaagtttactgcactccgctggagt

SEQ ID NO: 432374 - DNA, 25 bp, Mus musculus
gaagtttactgtgagccgggcgttt

SEQ ID NO: 432375 - DNA, 25 bp, Mus musculus
gaagtttatccttgcccagttctga

SEQ ID NO: 432376 - DNA, 25 bp, Mus musculus
gaagtttatggtgaatgtgtcctac

SEQ ID NO: 432377 - DNA, 25 bp, Mus musculus
gaagtttcagcgataaggagcaccc

SEQ ID NO: 432378 - DNA, 25 bp, Mus musculus
gaagtttcccgtttcagagcataga

SEQ ID NO: 432379 - DNA, 25 bp, Mus musculus
gaagtttccgagacacccaggttgc

SEQ ID NO: 432380 - DNA, 25 bp, Mus musculus
gaagtttctaacctctcaggcgcca

SEQ ID NO: 432381 - DNA, 25 bp, Mus musculus
gaagtttctaggctcgcgagtcccc

SEQ ID NO: 432382 - DNA, 25 bp, Mus musculus
gaagtttctgagtgatgcatccgtc

SEQ ID NO: 432383 - DNA, 25 bp, Mus musculus
gaagtttctggcatctacgggtacg

SEQ ID NO: 432384 - DNA, 25 bp, Mus musculus
gaagtttgaagtcagcactcctggc

SEQ ID NO: 432385 - DNA, 25 bp, Mus musculus
gaagtttgatgtctttaaagccata

SEQ ID NO: 432386 - DNA, 25 bp, Mus musculus
gaagtttgccgtttttgtccatgcc

SEQ ID NO: 432387 - DNA, 25 bp, Mus musculus
gaagtttgctaacgcgaagcctggc

SEQ ID NO: 432388 - DNA, 25 bp, Mus musculus
gaagtttggaatcccgttccgcaca

SEQ ID NO: 432389 - DNA, 25 bp, Mus musculus
gaagtttggagctgccgagtagcca

SEQ ID NO: 432390 - DNA, 25 bp, Mus musculus
gaagtttggcacctgcctatcggtg

SEQ ID NO: 432391 - DNA, 25 bp, Mus musculus
gaagtttgggcgaatgcgacgacac

SEQ ID NO: 432392 - DNA, 25 bp, Mus musculus
gaagtttggtcctgtggacagcaca

SEQ ID NO: 432393 - DNA, 25 bp, Mus musculus
gaagtttgttatcccactggaggaa

SEQ ID NO: 432394 - DNA, 25 bp, Mus musculus
gaagttttacagatggagcccgaca

SEQ ID NO: 432395 - DNA, 25 bp, Mus musculus
gaagttttacatgtcaggcactgga

SEQ ID NO: 432396 - DNA, 25 bp, Mus musculus
gaagttttatcctccgaccatgatg

SEQ ID NO: 432397 - DNA, 25 bp, Mus musculus
gaagtttttgatgtactggagaagc

SEQ ID NO: 432398 - DNA, 25 bp, Mus musculus
gaataaaataaatcgccgccggtgg

SEQ ID NO: 432399 - DNA, 25 bp, Mus musculus
gaataaacaaaaatttgcagaacct

SEQ ID NO: 432400 - DNA, 25 bp, Mus musculus
gaataaacacctctgccatcggatg

SEQ ID NO: 432401 - DNA, 25 bp, Mus musculus
gaataaacagcagtactccatggcc

SEQ ID NO: 432402 - DNA, 25 bp, Mus musculus
gaataaacaggacaatcactccagg

SEQ ID NO: 432403 - DNA, 25 bp, Mus musculus
gaataaaccatttgccttgtgctca

SEQ ID NO: 432404 - DNA, 25 bp, Mus musculus
gaataaaccgctcgccaatgtgtga

SEQ ID NO: 432405 - DNA, 25 bp, Mus musculus
gaataaactgtgtgataagcctgct

SEQ ID NO: 432406 - DNA, 25 bp, Mus musculus
gaataaagacatcagagggcacccc

SEQ ID NO: 432407 - DNA, 25 bp, Mus musculus
gaataaagactgaataaggccgtgt

SEQ ID NO: 432408 - DNA, 25 bp, Mus musculus
gaataaagactgtgccagctggtca

SEQ ID NO: 432409 - DNA, 25 bp, Mus musculus
gaataaaggactgcaaagactggct

SEQ ID NO: 432410 - DNA, 25 bp, Mus musculus
gaataaagtcctcgtgcgacaccgg

SEQ ID NO: 432411 - DNA, 25 bp, Mus musculus
gaataaagtctcgagcccttggcct

SEQ ID NO: 432412 - DNA, 25 bp, Mus musculus
gaataaatgctccagggctccacaa

SEQ ID NO: 432413 - DNA, 25 bp, Mus musculus
gaataaatgtgttgggttcccctca

SEQ ID NO: 432414 - DNA, 25 bp, Mus musculus
gaataacaaacacacactacttggg

SEQ ID NO: 432415 - DNA, 25 bp, Mus musculus
gaataacaacacagagtcaagagga

SEQ ID NO: 432416 - DNA, 25 bp, Mus musculus
gaataacaacttgagtgacgagctg

SEQ ID NO: 432417 - DNA, 25 bp, Mus musculus
gaataaccaaagtagcttgttccta

SEQ ID NO: 432418 - DNA, 25 bp, Mus musculus
gaataacggtgactcctctgtcggc

SEQ ID NO: 432419 - DNA, 25 bp, Mus musculus
gaataactacatgtgccgatgcctg

SEQ ID NO: 432420 - DNA, 25 bp, Mus musculus
gaataactaccattgccgctgcagg

SEQ ID NO: 432421 - DNA, 25 bp, Mus musculus
gaataactgggctgagacctacagg

SEQ ID NO: 432422 - DNA, 25 bp, Mus musculus
gaataacttcaaggcaggcactatg

SEQ ID NO: 432423 - DNA, 25 bp, Mus musculus
gaataagaatcatttcagtgggctg

SEQ ID NO: 432424 - DNA, 25 bp, Mus musculus
gaataagaccaagggctacgcaggg

SEQ ID NO: 432425 - DNA, 25 bp, Mus musculus
gaataagagtggaccttcccctggg

SEQ ID NO: 432426 - DNA, 25 bp, Mus musculus
gaataagccacagatgcaaaggact

SEQ ID NO: 432427 - DNA, 25 bp, Mus musculus
gaataagctggttcgagcacgacag

SEQ ID NO: 432428 - DNA, 25 bp, Mus musculus
gaataaggaagatcctgcgaggctc

SEQ ID NO: 432429 - DNA, 25 bp, Mus musculus
gaataaggattctgttagcccaaga

SEQ ID NO: 432430 - DNA, 25 bp, Mus musculus
gaataaggccgagtgtacgaagcag

SEQ ID NO: 432431 - DNA, 25 bp, Mus musculus
gaataagggcgttcctctgcaaggg

SEQ ID NO: 432432 - DNA, 25 bp, Mus musculus
gaataagtaagccttcactccggag

SEQ ID NO: 432433 - DNA, 25 bp, Mus musculus
gaataagtacagtgctcagggcgag

SEQ ID NO: 432434 - DNA, 25 bp, Mus musculus
gaataagtagaattcgtttcccgcg

SEQ ID NO: 432435 - DNA, 25 bp, Mus musculus
gaataagtgagataccaggtccagc

SEQ ID NO: 432436 - DNA, 25 bp, Mus musculus
gaataagtgccaatttttggtctcc

SEQ ID NO: 432437 - DNA, 25 bp, Mus musculus
gaataataatctgccaaagtctcta

SEQ ID NO: 432438 - DNA, 25 bp, Mus musculus
gaataatacaagtgtcgggaagagt

SEQ ID NO: 432439 - DNA, 25 bp, Mus musculus
gaataatactgcctaaacccgtgac

SEQ ID NO: 432440 - DNA, 25 bp, Mus musculus
gaataatcgattgtgcttttactgt

SEQ ID NO: 432441 - DNA, 25 bp, Mus musculus
gaataatggaattaacagacccgcg

SEQ ID NO: 432442 - DNA, 25 bp, Mus musculus
gaataattcgattgctttcaacaac

SEQ ID NO: 432443 - DNA, 25 bp, Mus musculus
gaataattctaggatccaacgcgtg

SEQ ID NO: 432444 - DNA, 25 bp, Mus musculus
gaatacaaaatcatcggccactgga

SEQ ID NO: 432445 - DNA, 25 bp, Mus musculus
gaatacaaagctctgccctaatgaa

SEQ ID NO: 432446 - DNA, 25 bp, Mus musculus
gaatacaactgtgcctctcctttat

SEQ ID NO: 432447 - DNA, 25 bp, Mus musculus
gaatacaccggatctagacatgccc

SEQ ID NO: 432448 - DNA, 25 bp, Mus musculus
gaatacacctggatccgaacatagg

SEQ ID NO: 432449 - DNA, 25 bp, Mus musculus
gaatacacggtccatcatgaagccc

SEQ ID NO: 432450 - DNA, 25 bp, Mus musculus
gaatacactcagctgatccgggaag

SEQ ID NO: 432451 - DNA, 25 bp, Mus musculus
gaatacagagtcctaatgatgcagt

SEQ ID NO: 432452 - DNA, 25 bp, Mus musculus
gaatacagcgaagagggccacaatg

SEQ ID NO: 432453 - DNA, 25 bp, Mus musculus
gaatacagttaagacagcccaacag

SEQ ID NO: 432454 - DNA, 25 bp, Mus musculus
gaatacatcatccaggtggcagcca

SEQ ID NO: 432455 - DNA, 25 bp, Mus musculus
gaatacatgacactgggcagagccc

SEQ ID NO: 432456 - DNA, 25 bp, Mus musculus
gaatacatgctctccctgtacagga

SEQ ID NO: 432457 - DNA, 25 bp, Mus musculus
gaatacatgctgtgcacctagactg

SEQ ID NO: 432458 - DNA, 25 bp, Mus musculus
gaatacatgggcaacgtaagtgcca

SEQ ID NO: 432459 - DNA, 25 bp, Mus musculus
gaatacattgtttgccacctggacc

SEQ ID NO: 432460 - DNA, 25 bp, Mus musculus
gaataccacccctctagaagtcatg

SEQ ID NO: 432461 - DNA, 25 bp, Mus musculus
gaataccagcgttggatgggcctta

SEQ ID NO: 432462 - DNA, 25 bp, Mus musculus
gaatacccaatgcttttcctgagat

SEQ ID NO: 432463 - DNA, 25 bp, Mus musculus
gaataccgtcaacctcacaagcagg

SEQ ID NO: 432464 - DNA, 25 bp, Mus musculus
gaataccgtgatccggccttctcga

SEQ ID NO: 432465 - DNA, 25 bp, Mus musculus
gaatacctacatggaagcctgcctg

SEQ ID NO: 432466 - DNA, 25 bp, Mus musculus
gaatacctcagttaccgtgtgccaa

SEQ ID NO: 432467 - DNA, 25 bp, Mus musculus
gaataccttccccatatacatggtg

SEQ ID NO: 432468 - DNA, 25 bp, Mus musculus
gaataccttgaaatagccagaccac

SEQ ID NO: 432469 - DNA, 25 bp, Mus musculus
gaataccttttcgaatccctgtgca

SEQ ID NO: 432470 - DNA, 25 bp, Mus musculus
gaatacgccatgaaacacttcggag

SEQ ID NO: 432471 - DNA, 25 bp, Mus musculus
gaatactagctgtaacatgtgggca

SEQ ID NO: 432472 - DNA, 25 bp, Mus musculus
gaatactcatggaggctgtcacccc

SEQ ID NO: 432473 - DNA, 25 bp, Mus musculus
gaatactcgcgatcctgaggctgcc

SEQ ID NO: 432474 - DNA, 25 bp, Mus musculus
gaatactcttgctctgaggcccttg

SEQ ID NO: 432475 - DNA, 25 bp, Mus musculus
gaatactgcccaatggtcttccgga

SEQ ID NO: 432476 - DNA, 25 bp, Mus musculus
gaatactgcctcattttggacacca

SEQ ID NO: 432477 - DNA, 25 bp, Mus musculus
gaatactgccttccatcagggtggg

SEQ ID NO: 432478 - DNA, 25 bp, Mus musculus
gaatactgcgtgttcgcgttaggga

SEQ ID NO: 432479 - DNA, 25 bp, Mus musculus
gaatactgctcagaagtaaaggact

SEQ ID NO: 432480 - DNA, 25 bp, Mus musculus
gaatactggaggcatgcgcttgcac

SEQ ID NO: 432481 - DNA, 25 bp, Mus musculus
gaatactggcagtccctcgaagttg

SEQ ID NO: 432482 - DNA, 25 bp, Mus musculus
gaatactggtttgctgttccccggg

SEQ ID NO: 432483 - DNA, 25 bp, Mus musculus
gaatacttaccagttcaggctgctg

SEQ ID NO: 432484 - DNA, 25 bp, Mus musculus
gaatacttgggaccctacctaggcg

SEQ ID NO: 432485 - DNA, 25 bp, Mus musculus
gaatacttgtcagccatctgggcag

SEQ ID NO: 432486 - DNA, 25 bp, Mus musculus
gaatacttgttaatttggaaatgca

SEQ ID NO: 432487 - DNA, 25 bp, Mus musculus
gaatactttaagactcgggagtggc

SEQ ID NO: 432488 - DNA, 25 bp, Mus musculus
gaatactttcagaagggcaccaccc

SEQ ID NO: 432489 - DNA, 25 bp, Mus musculus
gaatagaagacacaatcagacacct

SEQ ID NO: 432490 - DNA, 25 bp, Mus musculus
gaatagaagcaggatgaacatccca

SEQ ID NO: 432491 - DNA, 25 bp, Mus musculus
gaatagaatgtgtctgcttaggtgg

SEQ ID NO: 432492 - DNA, 25 bp, Mus musculus
gaatagacatgcgtacaggctggtc

SEQ ID NO: 432493 - DNA, 25 bp, Mus musculus
gaatagacctgaccatgtagaaagt

SEQ ID NO: 432494 - DNA, 25 bp, Mus musculus
gaatagagcccgtgtgtgtggacct

SEQ ID NO: 432495 - DNA, 25 bp, Mus musculus
gaatagagggttttttaatcaccag

SEQ ID NO: 432496 - DNA, 25 bp, Mus musculus
gaatagatttcagagcctgcacctg

SEQ ID NO: 432497 - DNA, 25 bp, Mus musculus
gaatagcaaactggccccagaagtc

SEQ ID NO: 432498 - DNA, 25 bp, Mus musculus
gaatagcaagatcttcacagccaag

SEQ ID NO: 432499 - DNA, 25 bp, Mus musculus
gaatagccagaacaggatggtgtac

SEQ ID NO: 432500 - DNA, 25 bp, Mus musculus
gaatagccatgtttgacacttggag

SEQ ID NO: 432501 - DNA, 25 bp, Mus musculus
gaatagcccagcaacacctgaagtg

SEQ ID NO: 432502 - DNA, 25 bp, Mus musculus
gaatagcctgcaaacgaaactctgg

SEQ ID NO: 432503 - DNA, 25 bp, Mus musculus
gaatagctaggcaactgtgagacca

SEQ ID NO: 432504 - DNA, 25 bp, Mus musculus
gaatagctgactacccagggagcca

SEQ ID NO: 432505 - DNA, 25 bp, Mus musculus
gaataggaaccggatcaacagtgca

SEQ ID NO: 432506 - DNA, 25 bp, Mus musculus
gaataggaggcagcgaatacagaag

SEQ ID NO: 432507 - DNA, 25 bp, Mus musculus
gaataggctcaaccaggctatccag

SEQ ID NO: 432508 - DNA, 25 bp, Mus musculus
gaatagggccatgcaggataccgac

SEQ ID NO: 432509 - DNA, 25 bp, Mus musculus
gaatagggttccagccactagccat

SEQ ID NO: 432510 - DNA, 25 bp, Mus musculus
gaatagggttccttgcagatcagca

SEQ ID NO: 432511 - DNA, 25 bp, Mus musculus
gaatagtaatcacacaggctacgat

SEQ ID NO: 432512 - DNA, 25 bp, Mus musculus
gaatagtaatctccacagtcctgaa

SEQ ID NO: 432513 - DNA, 25 bp, Mus musculus
gaatagtagccccttgatttggtgg

SEQ ID NO: 432514 - DNA, 25 bp, Mus musculus
gaatagtagctctgactcggaccct

SEQ ID NO: 432515 - DNA, 25 bp, Mus musculus
gaatagtcagtaaacattagcagct

SEQ ID NO: 432516 - DNA, 25 bp, Mus musculus
gaatagtccgaatactgggctcctg

SEQ ID NO: 432517 - DNA, 25 bp, Mus musculus
gaatagtctgtccatgatgcataac

SEQ ID NO: 432518 - DNA, 25 bp, Mus musculus
gaatagtgaatggtcatatgccgcc

SEQ ID NO: 432519 - DNA, 25 bp, Mus musculus
gaatagtgcagccagtgacaagcca

SEQ ID NO: 432520 - DNA, 25 bp, Mus musculus
gaatagtggccgtagcagcaaggta

SEQ ID NO: 432521 - DNA, 25 bp, Mus musculus
gaatagtggcctgggcagtccgtct

SEQ ID NO: 432522 - DNA, 25 bp, Mus musculus
gaatagtgttcagagtgccagcaag

SEQ ID NO: 432523 - DNA, 25 bp, Mus musculus
gaatataagatctagggacactgtg

SEQ ID NO: 432524 - DNA, 25 bp, Mus musculus
gaatataagatgaccagaagtgtcc

SEQ ID NO: 432525 - DNA, 25 bp, Mus musculus
gaatatacgttaacggctcaggcag

SEQ ID NO: 432526 - DNA, 25 bp, Mus musculus
gaatatatacttgacagggctctgc

SEQ ID NO: 432527 - DNA, 25 bp, Mus musculus
gaatatatcctcctagcccagctga

SEQ ID NO: 432528 - DNA, 25 bp, Mus musculus
gaatatatgccagaagagtcttccc

SEQ ID NO: 432529 - DNA, 25 bp, Mus musculus
gaatatcaacaagtcgctgtcggcc

SEQ ID NO: 432530 - DNA, 25 bp, Mus musculus
gaatatcaccggtgaggccatcgtt

SEQ ID NO: 432531 - DNA, 25 bp, Mus musculus
gaatatcacgtcttggattgtggcc

SEQ ID NO: 432532 - DNA, 25 bp, Mus musculus
gaatatcaggcccaatgccagggct

SEQ ID NO: 432533 - DNA, 25 bp, Mus musculus
gaatatccaaacacagagcaagtcc

SEQ ID NO: 432534 - DNA, 25 bp, Mus musculus
gaatatcctaaagcaagcctctgag

SEQ ID NO: 432535 - DNA, 25 bp, Mus musculus
gaatatcgaacctgaagtgatttga

SEQ ID NO: 432536 - DNA, 25 bp, Mus musculus
gaatatcgacctcaagtggcagtga

SEQ ID NO: 432537 - DNA, 25 bp, Mus musculus
gaatatgaacaagaatgccaatgga

SEQ ID NO: 432538 - DNA, 25 bp, Mus musculus
gaatatgaactggacaactaccgca

SEQ ID NO: 432539 - DNA, 25 bp, Mus musculus
gaatatgaagatgtgtccggaagtg

SEQ ID NO: 432540 - DNA, 25 bp, Mus musculus
gaatatgaaggctgatcacaccgag

SEQ ID NO: 432541 - DNA, 25 bp, Mus musculus
gaatatgacatcgtgcacctggagc

SEQ ID NO: 432542 - DNA, 25 bp, Mus musculus
gaatatgactgtctggccctgaacc

SEQ ID NO: 432543 - DNA, 25 bp, Mus musculus
gaatatgagtacagcccagtcgtct

SEQ ID NO: 432544 - DNA, 25 bp, Mus musculus
gaatatgatcagtacagcctggccc

SEQ ID NO: 432545 - DNA, 25 bp, Mus musculus
gaatatgccaaagccctcactatag

SEQ ID NO: 432546 - DNA, 25 bp, Mus musculus
gaatatgcctggtgcctggttcgaa

SEQ ID NO: 432547 - DNA, 25 bp, Mus musculus
gaatatgctacatctggtccggtca

SEQ ID NO: 432548 - DNA, 25 bp, Mus musculus
gaatatgctgtctgcgccctacatg

SEQ ID NO: 432549 - DNA, 25 bp, Mus musculus
gaatatgctgtggagggtcctgaat

SEQ ID NO: 432550 - DNA, 25 bp, Mus musculus
gaatatggccgagttccgtccggag

SEQ ID NO: 432551 - DNA, 25 bp, Mus musculus
gaatatgggcttgtgcaccgggcca

SEQ ID NO: 432552 - DNA, 25 bp, Mus musculus
gaatatgtataactggctactgcag

SEQ ID NO: 432553 - DNA, 25 bp, Mus musculus
gaatatgtccttacgcaacagggct

SEQ ID NO: 432554 - DNA, 25 bp, Mus musculus
gaatatgtgaagtggaagggctctc

SEQ ID NO: 432555 - DNA, 25 bp, Mus musculus
gaatatgtggctattaacgaccccg

SEQ ID NO: 432556 - DNA, 25 bp, Mus musculus
gaatattaacacctcatgccttggg

SEQ ID NO: 432557 - DNA, 25 bp, Mus musculus
gaatattacctctgcccctatcagg

SEQ ID NO: 432558 - DNA, 25 bp, Mus musculus
gaatattacggctctgccagggatc

SEQ ID NO: 432559 - DNA, 25 bp, Mus musculus
gaatattcactcaagacgaaaggag

SEQ ID NO: 432560 - DNA, 25 bp, Mus musculus
gaatattccacagaactgtgactat

SEQ ID NO: 432561 - DNA, 25 bp, Mus musculus
gaatattcctgagcccatgagtccc

SEQ ID NO: 432562 - DNA, 25 bp, Mus musculus
gaatattccttcaccgctcagcagt

SEQ ID NO: 432563 - DNA, 25 bp, Mus musculus
gaatattctgtggtgcaacacgcag

SEQ ID NO: 432564 - DNA, 25 bp, Mus musculus
gaatattgaagacatggaccctgag

SEQ ID NO: 432565 - DNA, 25 bp, Mus musculus
gaatattgatgttccaaacctcagt

SEQ ID NO: 432566 - DNA, 25 bp, Mus musculus
gaatattgccggtgcaacagcggcc

SEQ ID NO: 432567 - DNA, 25 bp, Mus musculus
gaatattgtgaacctgcttggcgca

SEQ ID NO: 432568 - DNA, 25 bp, Mus musculus
gaatatttcacctgggtctccagtg

SEQ ID NO: 432569 - DNA, 25 bp, Mus musculus
gaatatttctgcaagccgactgtga

SEQ ID NO: 432570 - DNA, 25 bp, Mus musculus
gaatatttgttcagccagcggcgga

SEQ ID NO: 432571 - DNA, 25 bp, Mus musculus
gaatattttgtgaaacgtcagcagg

SEQ ID NO: 432572 - DNA, 25 bp, Mus musculus
gaatcaaaagatagctcaggccctg

SEQ ID NO: 432573 - DNA, 25 bp, Mus musculus
gaatcaaacagcacgctgacgcggt

SEQ ID NO: 432574 - DNA, 25 bp, Mus musculus
gaatcaaagaagagtcctcccttct

SEQ ID NO: 432575 - DNA, 25 bp, Mus musculus
gaatcaaaggtgaaagcgggcttcc

SEQ ID NO: 432576 - DNA, 25 bp, Mus musculus
gaatcaaagtattctctttccctgc

SEQ ID NO: 432577 - DNA, 25 bp, Mus musculus
gaatcaaccggatcaggagcagtgg

SEQ ID NO: 432578 - DNA, 25 bp, Mus musculus
gaatcaagcaacagccatggaggcc

SEQ ID NO: 432579 - DNA, 25 bp, Mus musculus
gaatcaagcattacgcataccggac

SEQ ID NO: 432580 - DNA, 25 bp, Mus musculus
gaatcaaggtacagggaagtcccct

SEQ ID NO: 432581 - DNA, 25 bp, Mus musculus
gaatcaagttccgtacagcaatatg

SEQ ID NO: 432582 - DNA, 25 bp, Mus musculus
gaatcaagttgctagcagcaggcaa

SEQ ID NO: 432583 - DNA, 25 bp, Mus musculus
gaatcaatgaaaacacaagtgcctg

SEQ ID NO: 432584 - DNA, 25 bp, Mus musculus
gaatcaatgaagcataccttgggtg

SEQ ID NO: 432585 - DNA, 25 bp, Mus musculus
gaatcacaattcttggtgccaggca

SEQ ID NO: 432586 - DNA, 25 bp, Mus musculus
gaatcacacatctctgagcattctg

SEQ ID NO: 432587 - DNA, 25 bp, Mus musculus
gaatcacagatttagcagctcctag

SEQ ID NO: 432588 - DNA, 25 bp, Mus musculus
gaatcacagtcagaaaaaggcattg

SEQ ID NO: 432589 - DNA, 25 bp, Mus musculus
gaatcaccacagcatagaacacaag

SEQ ID NO: 432590 - DNA, 25 bp, Mus musculus
gaatcacccctaagcttgggcgcgg

SEQ ID NO: 432591 - DNA, 25 bp, Mus musculus
gaatcaccctgagaaagctggtacg

SEQ ID NO: 432592 - DNA, 25 bp, Mus musculus
gaatcaccgtgcgacagcttgagag

SEQ ID NO: 432593 - DNA, 25 bp, Mus musculus
gaatcaccgtggtcataagcatggg

SEQ ID NO: 432594 - DNA, 25 bp, Mus musculus
gaatcacgaatgtggtcaccaagcc

SEQ ID NO: 432595 - DNA, 25 bp, Mus musculus
gaatcacgcatcttcatctccgggc

SEQ ID NO: 432596 - DNA, 25 bp, Mus musculus
gaatcactaacagatgccgtgcaag

SEQ ID NO: 432597 - DNA, 25 bp, Mus musculus
gaatcactccgtattaactttggcc

SEQ ID NO: 432598 - DNA, 25 bp, Mus musculus
gaatcactcgggtcttcaggctcgg

SEQ ID NO: 432599 - DNA, 25 bp, Mus musculus
gaatcacttcctgctctgactagag

SEQ ID NO: 432600 - DNA, 25 bp, Mus musculus
gaatcactttctgataccagccctg

SEQ ID NO: 432601 - DNA, 25 bp, Mus musculus
gaatcagaagcaggttctctggaag

SEQ ID NO: 432602 - DNA, 25 bp, Mus musculus
gaatcagaattcacccaagggagga

SEQ ID NO: 432603 - DNA, 25 bp, Mus musculus
gaatcagacacaaatcaggaggact

SEQ ID NO: 432604 - DNA, 25 bp, Mus musculus
gaatcagacagcactgcacctggct

SEQ ID NO: 432605 - DNA, 25 bp, Mus musculus
gaatcagagccaggtatagcggtgc

SEQ ID NO: 432606 - DNA, 25 bp, Mus musculus
gaatcagaggactcttgctaggttc

SEQ ID NO: 432607 - DNA, 25 bp, Mus musculus
gaatcagaggccagcagtgtggccc

SEQ ID NO: 432608 - DNA, 25 bp, Mus musculus
gaatcagagtcagaggtccttagct

SEQ ID NO: 432609 - DNA, 25 bp, Mus musculus
gaatcagagtctgacatccccaggg

SEQ ID NO: 432610 - DNA, 25 bp, Mus musculus
gaatcagataatgaccaggctacca

SEQ ID NO: 432611 - DNA, 25 bp, Mus musculus
gaatcagcacttatggacttccagc

SEQ ID NO: 432612 - DNA, 25 bp, Mus musculus
gaatcagccactgttgcgtctccag

SEQ ID NO: 432613 - DNA, 25 bp, Mus musculus
gaatcagcttcgatgtcagggccac

SEQ ID NO: 432614 - DNA, 25 bp, Mus musculus
gaatcaggacgactattctacactc

SEQ ID NO: 432615 - DNA, 25 bp, Mus musculus
gaatcaggcaatccagttatcccag

SEQ ID NO: 432616 - DNA, 25 bp, Mus musculus
gaatcaggcctgtgctacaatagca

SEQ ID NO: 432617 - DNA, 25 bp, Mus musculus
gaatcagggcgctatggctttggcc

SEQ ID NO: 432618 - DNA, 25 bp, Mus musculus
gaatcaggtcatcaagggagtttat

SEQ ID NO: 432619 - DNA, 25 bp, Mus musculus
gaatcagtcactctaaaaagtccca

SEQ ID NO: 432620 - DNA, 25 bp, Mus musculus
gaatcagtgattggctcccagaggc

SEQ ID NO: 432621 - DNA, 25 bp, Mus musculus
gaatcagtggcgacctccaaaaccc

SEQ ID NO: 432622 - DNA, 25 bp, Mus musculus
gaatcagtttgtggctgtgaccagc

SEQ ID NO: 432623 - DNA, 25 bp, Mus musculus
gaatcatagctttggcacgtcgttg

SEQ ID NO: 432624 - DNA, 25 bp, Mus musculus
gaatcataggtactttgttttaaag

SEQ ID NO: 432625 - DNA, 25 bp, Mus musculus
gaatcatcatcccagtacttcgtgt

SEQ ID NO: 432626 - DNA, 25 bp, Mus musculus
gaatcatccatgacctggcccaggt

SEQ ID NO: 432627 - DNA, 25 bp, Mus musculus
gaatcatcgaaacgtgagaaccgcc

SEQ ID NO: 432628 - DNA, 25 bp, Mus musculus
gaatcatcggaggtcgcaatgctga

SEQ ID NO: 432629 - DNA, 25 bp, Mus musculus
gaatcatcgggcaggcatcttcagc

SEQ ID NO: 432630 - DNA, 25 bp, Mus musculus
gaatcatcttcattcccggactgag

SEQ ID NO: 432631 - DNA, 25 bp, Mus musculus
gaatcatgacatgccattaagtgca

SEQ ID NO: 432632 - DNA, 25 bp, Mus musculus
gaatcatgactcagggctgccaaga

SEQ ID NO: 432633 - DNA, 25 bp, Mus musculus
gaatcatgatgactactgcctggcc

SEQ ID NO: 432634 - DNA, 25 bp, Mus musculus
gaatcatgccacatttccagaaggc

SEQ ID NO: 432635 - DNA, 25 bp, Mus musculus
gaatcatgccgagggtaagcctgtg

SEQ ID NO: 432636 - DNA, 25 bp, Mus musculus
gaatcatgcttacctttgcgcggag

SEQ ID NO: 432637 - DNA, 25 bp, Mus musculus
gaatcattaggtatggctttgtgcc

SEQ ID NO: 432638 - DNA, 25 bp, Mus musculus
gaatcatttgaattgttctctgtct

SEQ ID NO: 432639 - DNA, 25 bp, Mus musculus
gaatccaaatgaagaggcaggtcca

SEQ ID NO: 432640 - DNA, 25 bp, Mus musculus
gaatccaatcgggtcacaggagacc

SEQ ID NO: 432641 - DNA, 25 bp, Mus musculus
gaatccaatctctacatgaaagccg

SEQ ID NO: 432642 - DNA, 25 bp, Mus musculus
gaatccaatggaagcgggagtcctt

SEQ ID NO: 432643 - DNA, 25 bp, Mus musculus
gaatccaattctatcagtacctggg

SEQ ID NO: 432644 - DNA, 25 bp, Mus musculus
gaatccacattttcatttccccagc

SEQ ID NO: 432645 - DNA, 25 bp, Mus musculus
gaatccaccaatagacctgagcaag

SEQ ID NO: 432646 - DNA, 25 bp, Mus musculus
gaatccacgtggctgaagtcaccta

SEQ ID NO: 432647 - DNA, 25 bp, Mus musculus
gaatccagacattgcttttgaactt

SEQ ID NO: 432648 - DNA, 25 bp, Mus musculus
gaatccagaggatagattgggctct

SEQ ID NO: 432649 - DNA, 25 bp, Mus musculus
gaatccagatggtgatgccagacct

SEQ ID NO: 432650 - DNA, 25 bp, Mus musculus
gaatccagctttgagtccacaggca

SEQ ID NO: 432651 - DNA, 25 bp, Mus musculus
gaatccaggatacgaaccagcaagc

SEQ ID NO: 432652 - DNA, 25 bp, Mus musculus
gaatccagggtcttttggaacttat

SEQ ID NO: 432653 - DNA, 25 bp, Mus musculus
gaatccagtggagcccaaagtccta

SEQ ID NO: 432654 - DNA, 25 bp, Mus musculus
gaatccatagaggtgccagacagct

SEQ ID NO: 432655 - DNA, 25 bp, Mus musculus
gaatccatgttaatgcttccgaggc

SEQ ID NO: 432656 - DNA, 25 bp, Mus musculus
gaatccatgttggaggcaagcccta

SEQ ID NO: 432657 - DNA, 25 bp, Mus musculus
gaatccattcacgacctggtgacag

SEQ ID NO: 432658 - DNA, 25 bp, Mus musculus
gaatccattcttctctagggcaacg

SEQ ID NO: 432659 - DNA, 25 bp, Mus musculus
gaatcccaaagtaggctctgacgcc

SEQ ID NO: 432660 - DNA, 25 bp, Mus musculus
gaatcccagacgtttccagagtact

SEQ ID NO: 432661 - DNA, 25 bp, Mus musculus
gaatcccagctcagtcatggtgcag

SEQ ID NO: 432662 - DNA, 25 bp, Mus musculus
gaatcccaggcccaccctgtgggtt

SEQ ID NO: 432663 - DNA, 25 bp, Mus musculus
gaatcccattatctacacccttagg

SEQ ID NO: 432664 - DNA, 25 bp, Mus musculus
gaatccccagactgaaacagcaacc

SEQ ID NO: 432665 - DNA, 25 bp, Mus musculus
gaatccccgagtttattgatccctt

SEQ ID NO: 432666 - DNA, 25 bp, Mus musculus
gaatccccggccacttgtcgtaagt

SEQ ID NO: 432667 - DNA, 25 bp, Mus musculus
gaatcccggataaagccaacatgta

SEQ ID NO: 432668 - DNA, 25 bp, Mus musculus
gaatcccgggcaggaactctgaaaa

SEQ ID NO: 432669 - DNA, 25 bp, Mus musculus
gaatcccgggtgtcagtattccagg

SEQ ID NO: 432670 - DNA, 25 bp, Mus musculus
gaatcccgtctatggcggagatgga

SEQ ID NO: 432671 - DNA, 25 bp, Mus musculus
gaatccctagaatgtgctctgtcac

SEQ ID NO: 432672 - DNA, 25 bp, Mus musculus
gaatccctcgggacgaagcttttgg

SEQ ID NO: 432673 - DNA, 25 bp, Mus musculus
gaatccctgagagtgcgacatgctt

SEQ ID NO: 432674 - DNA, 25 bp, Mus musculus
gaatccgaaacacatagggcctctg

SEQ ID NO: 432675 - DNA, 25 bp, Mus musculus
gaatccgaactcctcatctgggaag

SEQ ID NO: 432676 - DNA, 25 bp, Mus musculus
gaatccgaagcgtggcacagagtca

SEQ ID NO: 432677 - DNA, 25 bp, Mus musculus
gaatccgacccttagaaactacaca

SEQ ID NO: 432678 - DNA, 25 bp, Mus musculus
gaatccgagcaaaagagggcgagca

SEQ ID NO: 432679 - DNA, 25 bp, Mus musculus
gaatccgagtgtggacacggcatcc

SEQ ID NO: 432680 - DNA, 25 bp, Mus musculus
gaatccgagttctggtcatccgaaa

SEQ ID NO: 432681 - DNA, 25 bp, Mus musculus
gaatccgatgtcctgagaagtcctg

SEQ ID NO: 432682 - DNA, 25 bp, Mus musculus
gaatccgcggtgatatacggcagct

SEQ ID NO: 432683 - DNA, 25 bp, Mus musculus
gaatccgcttctcaagggtcagtgg

SEQ ID NO: 432684 - DNA, 25 bp, Mus musculus
gaatccggcaaatccaaactaccag

SEQ ID NO: 432685 - DNA, 25 bp, Mus musculus
gaatccgggagtcttgtcctcacga

SEQ ID NO: 432686 - DNA, 25 bp, Mus musculus
gaatccgtccaaccttccagacagg

SEQ ID NO: 432687 - DNA, 25 bp, Mus musculus
gaatccgttcagtcatcaagcagca

SEQ ID NO: 432688 - DNA, 25 bp, Mus musculus
gaatcctaaggtcaaaactggccca

SEQ ID NO: 432689 - DNA, 25 bp, Mus musculus
gaatcctacggagcctatgcggtca

SEQ ID NO: 432690 - DNA, 25 bp, Mus musculus
gaatcctcaaggctccaagtctgtg

SEQ ID NO: 432691 - DNA, 25 bp, Mus musculus
gaatcctcatgggaaagaggcctga

SEQ ID NO: 432692 - DNA, 25 bp, Mus musculus
gaatcctcattgacactggtgagcc

SEQ ID NO: 432693 - DNA, 25 bp, Mus musculus
gaatcctccgtagcgaaggttgacg

SEQ ID NO: 432694 - DNA, 25 bp, Mus musculus
gaatcctctgcctcgttcttctaga

SEQ ID NO: 432695 - DNA, 25 bp, Mus musculus
gaatcctgacaaccagtttgctgag

SEQ ID NO: 432696 - DNA, 25 bp, Mus musculus
gaatcctgcagaacatgtccgaatg

SEQ ID NO: 432697 - DNA, 25 bp, Mus musculus
gaatcctgcaggaatgactgaatga

SEQ ID NO: 432698 - DNA, 25 bp, Mus musculus
gaatcctgctactggctcgtgtcct

SEQ ID NO: 432699 - DNA, 25 bp, Mus musculus
gaatcctgctgagttagatgacctc

SEQ ID NO: 432700 - DNA, 25 bp, Mus musculus
gaatcctggaacatgtcctgtactg

SEQ ID NO: 432701 - DNA, 25 bp, Mus musculus
gaatcctgggttgcaacctctgaag

SEQ ID NO: 432702 - DNA, 25 bp, Mus musculus
gaatcctggttcagaagctacggcc

SEQ ID NO: 432703 - DNA, 25 bp, Mus musculus
gaatccttacaccaaagctcatggg

SEQ ID NO: 432704 - DNA, 25 bp, Mus musculus
gaatccttccttggtcctggtatgg

SEQ ID NO: 432705 - DNA, 25 bp, Mus musculus
gaatccttgcctatcaaatgcctgg

SEQ ID NO: 432706 - DNA, 25 bp, Mus musculus
gaatccttggaagctctaggaccca

SEQ ID NO: 432707 - DNA, 25 bp, Mus musculus
gaatcctttcactgagcctcgggca

SEQ ID NO: 432708 - DNA, 25 bp, Mus musculus
gaatcctttcagcttcgggaggcct

SEQ ID NO: 432709 - DNA, 25 bp, Mus musculus
gaatcctttcctgagctgtcctgtc

SEQ ID NO: 432710 - DNA, 25 bp, Mus musculus
gaatcctttcgagagagacagcatg

SEQ ID NO: 432711 - DNA, 25 bp, Mus musculus
gaatcctttctctagcctgcagcag

SEQ ID NO: 432712 - DNA, 25 bp, Mus musculus
gaatcgaagcctataacattgctca

SEQ ID NO: 432713 - DNA, 25 bp, Mus musculus
gaatcgaagtcctgaagaatgaacc

SEQ ID NO: 432714 - DNA, 25 bp, Mus musculus
gaatcgaatggttcatatacgcagt

SEQ ID NO: 432715 - DNA, 25 bp, Mus musculus
gaatcgacatgctagtgagagccac

SEQ ID NO: 432716 - DNA, 25 bp, Mus musculus
gaatcgaccatccttgaaatccctg

SEQ ID NO: 432717 - DNA, 25 bp, Mus musculus
gaatcgagaaagaacaaccctgaaa

SEQ ID NO: 432718 - DNA, 25 bp, Mus musculus
gaatcgagatcacctcctacctggg

SEQ ID NO: 432719 - DNA, 25 bp, Mus musculus
gaatcgatggccattatcaagctga

SEQ ID NO: 432720 - DNA, 25 bp, Mus musculus
gaatcgcaacaatcgcaagagccag

SEQ ID NO: 432721 - DNA, 25 bp, Mus musculus
gaatcgccagagctgtaaaacttca

SEQ ID NO: 432722 - DNA, 25 bp, Mus musculus
gaatcgccctgcctgtgcagacaag

SEQ ID NO: 432723 - DNA, 25 bp, Mus musculus
gaatcgctagtttctctccagcaag

SEQ ID NO: 432724 - DNA, 25 bp, Mus musculus
gaatcgctatctatttgttgccaaa

SEQ ID NO: 432725 - DNA, 25 bp, Mus musculus
gaatcgctcttttctcccgcattga

SEQ ID NO: 432726 - DNA, 25 bp, Mus musculus
gaatcgcttccccagcttgcgagta

SEQ ID NO: 432727 - DNA, 25 bp, Mus musculus
gaatcggaccctttcgaggtactga

SEQ ID NO: 432728 - DNA, 25 bp, Mus musculus
gaatcggacgtctctgttgcggcct

SEQ ID NO: 432729 - DNA, 25 bp, Mus musculus
gaatcggactacctcatcaatggga

SEQ ID NO: 432730 - DNA, 25 bp, Mus musculus
gaatcggcccctgaatggtggatca

SEQ ID NO: 432731 - DNA, 25 bp, Mus musculus
gaatcggccttttccgtccaggaca

SEQ ID NO: 432732 - DNA, 25 bp, Mus musculus
gaatcgggatgagcttcccagcgct

SEQ ID NO: 432733 - DNA, 25 bp, Mus musculus
gaatcggtcaaagagaacatggccc

SEQ ID NO: 432734 - DNA, 25 bp, Mus musculus
gaatcgtcacggatgcaacagtgga

SEQ ID NO: 432735 - DNA, 25 bp, Mus musculus
gaatcgtcctctaagtgttatgcaa

SEQ ID NO: 432736 - DNA, 25 bp, Mus musculus
gaatcgtcggcagcagctttccttc

SEQ ID NO: 432737 - DNA, 25 bp, Mus musculus
gaatcgtcttcgtcgtcatcgtcat

SEQ ID NO: 432738 - DNA, 25 bp, Mus musculus
gaatcgtgcacggaatctgctgcca

SEQ ID NO: 432739 - DNA, 25 bp, Mus musculus
gaatcgttacatcaaaccagagctg

SEQ ID NO: 432740 - DNA, 25 bp, Mus musculus
gaatcgttatcaggtccacagtgtg

SEQ ID NO: 432741 - DNA, 25 bp, Mus musculus
gaatcgttttgctgtgaccgtccag

SEQ ID NO: 432742 - DNA, 25 bp, Mus musculus
gaatctaaaatatttcccatgggct

SEQ ID NO: 432743 - DNA, 25 bp, Mus musculus
gaatctaaacaagaatggttacact

SEQ ID NO: 432744 - DNA, 25 bp, Mus musculus
gaatctaatagttgcaacagaaacc

SEQ ID NO: 432745 - DNA, 25 bp, Mus musculus
gaatctacaagatggaagtccctgg

SEQ ID NO: 432746 - DNA, 25 bp, Mus musculus
gaatctacaccaacgtctggaaggg

SEQ ID NO: 432747 - DNA, 25 bp, Mus musculus
gaatctactctgttgggcgttatgg

SEQ ID NO: 432748 - DNA, 25 bp, Mus musculus
gaatctagaaaagtggtgcagaaag

SEQ ID NO: 432749 - DNA, 25 bp, Mus musculus
gaatctagaagttcaaaagggccag

SEQ ID NO: 432750 - DNA, 25 bp, Mus musculus
gaatctagacaacctcaagtctgcc

SEQ ID NO: 432751 - DNA, 25 bp, Mus musculus
gaatctagatcttcagatagctctg

SEQ ID NO: 432752 - DNA, 25 bp, Mus musculus
gaatctagccgtgtctttagcagca

SEQ ID NO: 432753 - DNA, 25 bp, Mus musculus
gaatctatactagccactgggacac

SEQ ID NO: 432754 - DNA, 25 bp, Mus musculus
gaatctcaaagggtcacttcctacc

SEQ ID NO: 432755 - DNA, 25 bp, Mus musculus
gaatctcaagatgtagcccaggtta

SEQ ID NO: 432756 - DNA, 25 bp, Mus musculus
gaatctcaatatctctcccaaggga

SEQ ID NO: 432757 - DNA, 25 bp, Mus musculus
gaatctcagggtcgaactctctagg

SEQ ID NO: 432758 - DNA, 25 bp, Mus musculus
gaatctcagtggctggcaaccgagt

SEQ ID NO: 432759 - DNA, 25 bp, Mus musculus
gaatctccacgcagtgaaactaagg

SEQ ID NO: 432760 - DNA, 25 bp, Mus musculus
gaatctccagagcaccaaggtagcg

SEQ ID NO: 432761 - DNA, 25 bp, Mus musculus
gaatctccgtagactgcaggcacag

SEQ ID NO: 432762 - DNA, 25 bp, Mus musculus
gaatctccgtgcgtagtgtatgaag

SEQ ID NO: 432763 - DNA, 25 bp, Mus musculus
gaatctccttggaatgagcagccag

SEQ ID NO: 432764 - DNA, 25 bp, Mus musculus
gaatctcctttctcatttgtgcggc

SEQ ID NO: 432765 - DNA, 25 bp, Mus musculus
gaatctctgaatctctgctctactt

SEQ ID NO: 432766 - DNA, 25 bp, Mus musculus
gaatctcttcatgtcccggccagag

SEQ ID NO: 432767 - DNA, 25 bp, Mus musculus
gaatctcttcggcacgttagcactg

SEQ ID NO: 432768 - DNA, 25 bp, Mus musculus
gaatctcttgcgtgccttctccctt

SEQ ID NO: 432769 - DNA, 25 bp, Mus musculus
gaatctgaacccgaaagctgcctgt

SEQ ID NO: 432770 - DNA, 25 bp, Mus musculus
gaatctgaatatttggctgaggcca

SEQ ID NO: 432771 - DNA, 25 bp, Mus musculus
gaatctgacaagaaccaggcgacaa

SEQ ID NO: 432772 - DNA, 25 bp, Mus musculus
gaatctgaccatgacagccagtggg

SEQ ID NO: 432773 - DNA, 25 bp, Mus musculus
gaatctgacgtccacctttgcactg

SEQ ID NO: 432774 - DNA, 25 bp, Mus musculus
gaatctgagcactaggaaaacaggc

SEQ ID NO: 432775 - DNA, 25 bp, Mus musculus
gaatctgaggaaacgcttggaccaa

SEQ ID NO: 432776 - DNA, 25 bp, Mus musculus
gaatctgaggctgctatggctatgg

SEQ ID NO: 432777 - DNA, 25 bp, Mus musculus
gaatctgagggaagaacgagaaacc

SEQ ID NO: 432778 - DNA, 25 bp, Mus musculus
gaatctgagtgcctgagtccactgg

SEQ ID NO: 432779 - DNA, 25 bp, Mus musculus
gaatctgattaccagtcaaagcagg

SEQ ID NO: 432780 - DNA, 25 bp, Mus musculus
gaatctgcagagctctatgccgagg

SEQ ID NO: 432781 - DNA, 25 bp, Mus musculus
gaatctgcagccagggacagagact

SEQ ID NO: 432782 - DNA, 25 bp, Mus musculus
gaatctgcaggcaaggctcttcagc

SEQ ID NO: 432783 - DNA, 25 bp, Mus musculus
gaatctgcatatagaatctgtactc

SEQ ID NO: 432784 - DNA, 25 bp, Mus musculus
gaatctgcatcccagtcactgagag

SEQ ID NO: 432785 - DNA, 25 bp, Mus musculus
gaatctgcatctgttgaccaagcct

SEQ ID NO: 432786 - DNA, 25 bp, Mus musculus
gaatctgccatatggatttcaggga

SEQ ID NO: 432787 - DNA, 25 bp, Mus musculus
gaatctgccccactgcttcttgtga

SEQ ID NO: 432788 - DNA, 25 bp, Mus musculus
gaatctgcggacgatctttgcacag

SEQ ID NO: 432789 - DNA, 25 bp, Mus musculus
gaatctgcgtattatctttctatgg

SEQ ID NO: 432790 - DNA, 25 bp, Mus musculus
gaatctgcttcagctaaggccaagc

SEQ ID NO: 432791 - DNA, 25 bp, Mus musculus
gaatctggaacactgtcgtagtttc

SEQ ID NO: 432792 - DNA, 25 bp, Mus musculus
gaatctggaactccgacttgctcag

SEQ ID NO: 432793 - DNA, 25 bp, Mus musculus
gaatctggagatccttcagaatcag

SEQ ID NO: 432794 - DNA, 25 bp, Mus musculus
gaatctggcatacccataatcggag

SEQ ID NO: 432795 - DNA, 25 bp, Mus musculus
gaatctggctgctgacttggcacac

SEQ ID NO: 432796 - DNA, 25 bp, Mus musculus
gaatctgggcggcatttctcatgca

SEQ ID NO: 432797 - DNA, 25 bp, Mus musculus
gaatctggtgtccattcctcggcca

SEQ ID NO: 432798 - DNA, 25 bp, Mus musculus
gaatctgtaggacatcttcttgagg

SEQ ID NO: 432799 - DNA, 25 bp, Mus musculus
gaatctgtaggagctgccgctgctg

SEQ ID NO: 432800 - DNA, 25 bp, Mus musculus
gaatctgtagtatcacgctgtggca

SEQ ID NO: 432801 - DNA, 25 bp, Mus musculus
gaatctgtccatcgtggtctcgccg

SEQ ID NO: 432802 - DNA, 25 bp, Mus musculus
gaatctgtcgtatcactgaggcgag

SEQ ID NO: 432803 - DNA, 25 bp, Mus musculus
gaatctgtcgtcaaggtcacggtga

SEQ ID NO: 432804 - DNA, 25 bp, Mus musculus
gaatctgtctgaaactggcttggaa

SEQ ID NO: 432805 - DNA, 25 bp, Mus musculus
gaatctgtcttcatctagcacggag

SEQ ID NO: 432806 - DNA, 25 bp, Mus musculus
gaatctgtgaatgtaagcatcctgg

SEQ ID NO: 432807 - DNA, 25 bp, Mus musculus
gaatctgtggagaaagacattccaa

SEQ ID NO: 432808 - DNA, 25 bp, Mus musculus
gaatctgtggttgcaaaccctgagg

SEQ ID NO: 432809 - DNA, 25 bp, Mus musculus
gaatctgtgtaatcatggagccgaa

SEQ ID NO: 432810 - DNA, 25 bp, Mus musculus
gaatcttaacgctgcgccgtctgca

SEQ ID NO: 432811 - DNA, 25 bp, Mus musculus
gaatcttagtcattgaagcgccggt

SEQ ID NO: 432812 - DNA, 25 bp, Mus musculus
gaatcttatcttataactgtctcag

SEQ ID NO: 432813 - DNA, 25 bp, Mus musculus
gaatcttcatggcatccttcgggac

SEQ ID NO: 432814 - DNA, 25 bp, Mus musculus
gaatcttcctcgtccaaggcaaggg

SEQ ID NO: 432815 - DNA, 25 bp, Mus musculus
gaatcttcctctgacgccatgactg

SEQ ID NO: 432816 - DNA, 25 bp, Mus musculus
gaatcttctagatgacttcccacag

SEQ ID NO: 432817 - DNA, 25 bp, Mus musculus
gaatcttctgcttcaggccagggag

SEQ ID NO: 432818 - DNA, 25 bp, Mus musculus
gaatcttctggcaaatgctggcaga

SEQ ID NO: 432819 - DNA, 25 bp, Mus musculus
gaatcttgcatctggctttgcatag

SEQ ID NO: 432820 - DNA, 25 bp, Mus musculus
gaatcttgcgtgatcttagagcctg

SEQ ID NO: 432821 - DNA, 25 bp, Mus musculus
gaatcttgctccgttccgagagagg

SEQ ID NO: 432822 - DNA, 25 bp, Mus musculus
gaatcttgcttctggacatccacgg

SEQ ID NO: 432823 - DNA, 25 bp, Mus musculus
gaatcttggaagatgcttgactgct

SEQ ID NO: 432824 - DNA, 25 bp, Mus musculus
gaatcttgtttacctgatgcccgca

SEQ ID NO: 432825 - DNA, 25 bp, Mus musculus
gaatctttaccaccccaagtgtatg

SEQ ID NO: 432826 - DNA, 25 bp, Mus musculus
gaatctttacctccagggcaacagg

SEQ ID NO: 432827 - DNA, 25 bp, Mus musculus
gaatctttggaacactctgaacgct

SEQ ID NO: 432828 - DNA, 25 bp, Mus musculus
gaatcttttgtcaggccgaggcatg

SEQ ID NO: 432829 - DNA, 25 bp, Mus musculus
gaatgaaaacttagcagccccactg

SEQ ID NO: 432830 - DNA, 25 bp, Mus musculus
gaatgaaaccatgaacgaggcccct

SEQ ID NO: 432831 - DNA, 25 bp, Mus musculus
gaatgaaaccgaaggaaagagccgc

SEQ ID NO: 432832 - DNA, 25 bp, Mus musculus
gaatgaaacggatctcacaggaccc

SEQ ID NO: 432833 - DNA, 25 bp, Mus musculus
gaatgaaagccatgagccgtcagct

SEQ ID NO: 432834 - DNA, 25 bp, Mus musculus
gaatgaaaggtgatgacggcgtccc

SEQ ID NO: 432835 - DNA, 25 bp, Mus musculus
gaatgaaattacacttgacagccag

SEQ ID NO: 432836 - DNA, 25 bp, Mus musculus
gaatgaacaaacttggagggcacag

SEQ ID NO: 432837 - DNA, 25 bp, Mus musculus
gaatgaacatgcctttagttttagc

SEQ ID NO: 432838 - DNA, 25 bp, Mus musculus
gaatgaaccagagagctagaaacct

SEQ ID NO: 432839 - DNA, 25 bp, Mus musculus
gaatgaacccgaagtctccactgca

SEQ ID NO: 432840 - DNA, 25 bp, Mus musculus
gaatgaaccgtgtacctagaacctc

SEQ ID NO: 432841 - DNA, 25 bp, Mus musculus
gaatgaacctctcacgctacagctg

SEQ ID NO: 432842 - DNA, 25 bp, Mus musculus
gaatgaacctttccgagcacagagg

SEQ ID NO: 432843 - DNA, 25 bp, Mus musculus
gaatgaacggcgacaagttccggaa

SEQ ID NO: 432844 - DNA, 25 bp, Mus musculus
gaatgaactacgactcccagcatgc

SEQ ID NO: 432845 - DNA, 25 bp, Mus musculus
gaatgaactactgggcactgcctct

SEQ ID NO: 432846 - DNA, 25 bp, Mus musculus
gaatgaacttcctgtgcagccggcg

SEQ ID NO: 432847 - DNA, 25 bp, Mus musculus
gaatgaagaagatctaccccagact

SEQ ID NO: 432848 - DNA, 25 bp, Mus musculus
gaatgaagaaggctccgatgacccc

SEQ ID NO: 432849 - DNA, 25 bp, Mus musculus
gaatgaagactgctgttcagtggct

SEQ ID NO: 432850 - DNA, 25 bp, Mus musculus
gaatgaaggatgacagctacgcacc

SEQ ID NO: 432851 - DNA, 25 bp, Mus musculus
gaatgaaggtttttgcaaaggctaa

SEQ ID NO: 432852 - DNA, 25 bp, Mus musculus
gaatgaagtagaaggccgagatgct

SEQ ID NO: 432853 - DNA, 25 bp, Mus musculus
gaatgaagtctcagattactaatgg

SEQ ID NO: 432854 - DNA, 25 bp, Mus musculus
gaatgaagtgcaccctaacaagccg

SEQ ID NO: 432855 - DNA, 25 bp, Mus musculus
gaatgaagttaagaccagccaggat

SEQ ID NO: 432856 - DNA, 25 bp, Mus musculus
gaatgaatccccatcaccaaaaagc

SEQ ID NO: 432857 - DNA, 25 bp, Mus musculus
gaatgaatccgcaggtgcagccgga

SEQ ID NO: 432858 - DNA, 25 bp, Mus musculus
gaatgaatctcctctcctcagaaga

SEQ ID NO: 432859 - DNA, 25 bp, Mus musculus
gaatgaatgggctcctcgagcgcct

SEQ ID NO: 432860 - DNA, 25 bp, Mus musculus
gaatgaatggtttgggacccctggt

SEQ ID NO: 432861 - DNA, 25 bp, Mus musculus
gaatgacaaaggagatcagggcctc

SEQ ID NO: 432862 - DNA, 25 bp, Mus musculus
gaatgacaatgtagtgatccccgag

SEQ ID NO: 432863 - DNA, 25 bp, Mus musculus
gaatgacacagtaggcagccatcct

SEQ ID NO: 432864 - DNA, 25 bp, Mus musculus
gaatgacacgggttttcagcaagca

SEQ ID NO: 432865 - DNA, 25 bp, Mus musculus
gaatgacagctcagtgtctgctgag

SEQ ID NO: 432866 - DNA, 25 bp, Mus musculus
gaatgacaggacaactgagaaccta

SEQ ID NO: 432867 - DNA, 25 bp, Mus musculus
gaatgacatcatagctgttgggccc

SEQ ID NO: 432868 - DNA, 25 bp, Mus musculus
gaatgaccatttcacagaggttgcc

SEQ ID NO: 432869 - DNA, 25 bp, Mus musculus
gaatgaccccgcagtagggtatgga

SEQ ID NO: 432870 - DNA, 25 bp, Mus musculus
gaatgacgagccacccaaggtagtg

SEQ ID NO: 432871 - DNA, 25 bp, Mus musculus
gaatgactacctcccaattctagtg

SEQ ID NO: 432872 - DNA, 25 bp, Mus musculus
gaatgactacctgcaagactgcctg

SEQ ID NO: 432873 - DNA, 25 bp, Mus musculus
gaatgactactatactcctactggg

SEQ ID NO: 432874 - DNA, 25 bp, Mus musculus
gaatgactgagctgtacgactaccc

SEQ ID NO: 432875 - DNA, 25 bp, Mus musculus
gaatgactgcttacctggacttgct

SEQ ID NO: 432876 - DNA, 25 bp, Mus musculus
gaatgactgtcacctaaatacaaca

SEQ ID NO: 432877 - DNA, 25 bp, Mus musculus
gaatgacttagaaacagccctgcga

SEQ ID NO: 432878 - DNA, 25 bp, Mus musculus
gaatgacttgctgtctgccacggag

SEQ ID NO: 432879 - DNA, 25 bp, Mus musculus
gaatgacttggaccgtgtagccgac

SEQ ID NO: 432880 - DNA, 25 bp, Mus musculus
gaatgacttttcctgaagcggacat

SEQ ID NO: 432881 - DNA, 25 bp, Mus musculus
gaatgagaacgctgaatgcaggtca

SEQ ID NO: 432882 - DNA, 25 bp, Mus musculus
gaatgagaagtacacccctatggaa

SEQ ID NO: 432883 - DNA, 25 bp, Mus musculus
gaatgagacctcctgtaatgtcgca

SEQ ID NO: 432884 - DNA, 25 bp, Mus musculus
gaatgagagactagaacacacgcct

SEQ ID NO: 432885 - DNA, 25 bp, Mus musculus
gaatgagaggctgctctgtcagaca

SEQ ID NO: 432886 - DNA, 25 bp, Mus musculus
gaatgagatatctgcaccatcgcgg

SEQ ID NO: 432887 - DNA, 25 bp, Mus musculus
gaatgagatggccacagcagcttca

SEQ ID NO: 432888 - DNA, 25 bp, Mus musculus
gaatgagattactcagccgggcgga

SEQ ID NO: 432889 - DNA, 25 bp, Mus musculus
gaatgagattctcggccatgcgcca

SEQ ID NO: 432890 - DNA, 25 bp, Mus musculus
gaatgagcattgatctagcacagcc

SEQ ID NO: 432891 - DNA, 25 bp, Mus musculus
gaatgagccaaaaagatgatgcagg

SEQ ID NO: 432892 - DNA, 25 bp, Mus musculus
gaatgagccaaggagactcgaaccc

SEQ ID NO: 432893 - DNA, 25 bp, Mus musculus
gaatgagcccagtgcaatagcaaga

SEQ ID NO: 432894 - DNA, 25 bp, Mus musculus
gaatgagccttcgaaaaatggaact

SEQ ID NO: 432895 - DNA, 25 bp, Mus musculus
gaatgagctctacgtcgatgaccca

SEQ ID NO: 432896 - DNA, 25 bp, Mus musculus
gaatgagctcttgaatgtctgccag

SEQ ID NO: 432897 - DNA, 25 bp, Mus musculus
gaatgaggctcaggctcctcacgag

SEQ ID NO: 432898 - DNA, 25 bp, Mus musculus
gaatgaggtcattcctaaaagggcc

SEQ ID NO: 432899 - DNA, 25 bp, Mus musculus
gaatgagtatccacagcttagcacc

SEQ ID NO: 432900 - DNA, 25 bp, Mus musculus
gaatgagtcgcttctctacgctgag

SEQ ID NO: 432901 - DNA, 25 bp, Mus musculus
gaatgagtgctacctgaggcaagct

SEQ ID NO: 432902 - DNA, 25 bp, Mus musculus
gaatgagtgtggagtcaaaccccgg

SEQ ID NO: 432903 - DNA, 25 bp, Mus musculus
gaatgagttccagccgaactggcca

SEQ ID NO: 432904 - DNA, 25 bp, Mus musculus
gaatgagtttctgtgcaccgcgtcg

SEQ ID NO: 432905 - DNA, 25 bp, Mus musculus
gaatgatccatttcagcctttccca

SEQ ID NO: 432906 - DNA, 25 bp, Mus musculus
gaatgatcgcgacacgttttgaata

SEQ ID NO: 432907 - DNA, 25 bp, Mus musculus
gaatgatcggcacctattgtttagg

SEQ ID NO: 432908 - DNA, 25 bp, Mus musculus
gaatgatctccccttgcttcagagt

SEQ ID NO: 432909 - DNA, 25 bp, Mus musculus
gaatgatgaagtcgtctaccccacc

SEQ ID NO: 432910 - DNA, 25 bp, Mus musculus
gaatgatgagaacattacttgaatg

SEQ ID NO: 432911 - DNA, 25 bp, Mus musculus
gaatgatgagcaaggaaatttttct

SEQ ID NO: 432912 - DNA, 25 bp, Mus musculus
gaatgatgatcagaacctaggtgcc

SEQ ID NO: 432913 - DNA, 25 bp, Mus musculus
gaatgatgatctgagtcccactgaa

SEQ ID NO: 432914 - DNA, 25 bp, Mus musculus
gaatgatgggcgatttagaccctgc

SEQ ID NO: 432915 - DNA, 25 bp, Mus musculus
gaatgatgttgttcgggttctcccc

SEQ ID NO: 432916 - DNA, 25 bp, Mus musculus
gaatgattcacgtgttggccaggag

SEQ ID NO: 432917 - DNA, 25 bp, Mus musculus
gaatgattctggctccgctggcctg

SEQ ID NO: 432918 - DNA, 25 bp, Mus musculus
gaatgcaaaaaactctggtacacct

SEQ ID NO: 432919 - DNA, 25 bp, Mus musculus
gaatgcaaacttccgaatagttggg

SEQ ID NO: 432920 - DNA, 25 bp, Mus musculus
gaatgcaaaggtcttcccctggacg

SEQ ID NO: 432921 - DNA, 25 bp, Mus musculus
gaatgcaagcagtttctgaaagtct

SEQ ID NO: 432922 - DNA, 25 bp, Mus musculus
gaatgcaatgatgacggcacctaca

SEQ ID NO: 432923 - DNA, 25 bp, Mus musculus
gaatgcaatttgaagccagtccgtg

SEQ ID NO: 432924 - DNA, 25 bp, Mus musculus
gaatgcacatgggaaaatattgcca

SEQ ID NO: 432925 - DNA, 25 bp, Mus musculus
gaatgcaccatgtcccatgcagtgg

SEQ ID NO: 432926 - DNA, 25 bp, Mus musculus
gaatgcacctgaacagcaagacctg

SEQ ID NO: 432927 - DNA, 25 bp, Mus musculus
gaatgcacctgtctgaagtgactgg

SEQ ID NO: 432928 - DNA, 25 bp, Mus musculus
gaatgcacgtgcagttgtccaccag

SEQ ID NO: 432929 - DNA, 25 bp, Mus musculus
gaatgcactcgagcctaatcaaaca

SEQ ID NO: 432930 - DNA, 25 bp, Mus musculus
gaatgcagagtcttcctttctttag

SEQ ID NO: 432931 - DNA, 25 bp, Mus musculus
gaatgcagatacatcgagaacctgg

SEQ ID NO: 432932 - DNA, 25 bp, Mus musculus
gaatgcagcatgactctcgaatccc

SEQ ID NO: 432933 - DNA, 25 bp, Mus musculus
gaatgcaggcaatcaaaggtctaca

SEQ ID NO: 432934 - DNA, 25 bp, Mus musculus
gaatgcagtataacggctggtgacg

SEQ ID NO: 432935 - DNA, 25 bp, Mus musculus
gaatgcagtccgaagtcacagagag

SEQ ID NO: 432936 - DNA, 25 bp, Mus musculus
gaatgcagtgatgccagtttcagtc

SEQ ID NO: 432937 - DNA, 25 bp, Mus musculus
gaatgcatacccctataaatcaatg

SEQ ID NO: 432938 - DNA, 25 bp, Mus musculus
gaatgcatagagaagagactcaccg

SEQ ID NO: 432939 - DNA, 25 bp, Mus musculus
gaatgcatcttcagggaacaatttg

SEQ ID NO: 432940 - DNA, 25 bp, Mus musculus
gaatgcatgctacggaacagccctg

SEQ ID NO: 432941 - DNA, 25 bp, Mus musculus
gaatgcattcatcaaacggcccgaa

SEQ ID NO: 432942 - DNA, 25 bp, Mus musculus
gaatgcattccatgtattctgcgct

SEQ ID NO: 432943 - DNA, 25 bp, Mus musculus
gaatgccaaataagaagttcctgct

SEQ ID NO: 432944 - DNA, 25 bp, Mus musculus
gaatgccaatggagttagaaataag

SEQ ID NO: 432945 - DNA, 25 bp, Mus musculus
gaatgccacagaggtcacagacacc

SEQ ID NO: 432946 - DNA, 25 bp, Mus musculus
gaatgccacagcaatcccaaatggg

SEQ ID NO: 432947 - DNA, 25 bp, Mus musculus
gaatgccacgattcccgagaacgag

SEQ ID NO: 432948 - DNA, 25 bp, Mus musculus
gaatgccagactcgcggtttccggt

SEQ ID NO: 432949 - DNA, 25 bp, Mus musculus
gaatgccagcccctagcatggactg

SEQ ID NO: 432950 - DNA, 25 bp, Mus musculus
gaatgccagcgtggttccaggaaaa

SEQ ID NO: 432951 - DNA, 25 bp, Mus musculus
gaatgccagggattacttcaaggcc

SEQ ID NO: 432952 - DNA, 25 bp, Mus musculus
gaatgccatcggtctggttggaaag

SEQ ID NO: 432953 - DNA, 25 bp, Mus musculus
gaatgcccagaaacagcgaatgaag

SEQ ID NO: 432954 - DNA, 25 bp, Mus musculus
gaatgccccggacaagaagatcact

SEQ ID NO: 432955 - DNA, 25 bp, Mus musculus
gaatgcccctgctcatcaaggcttt

SEQ ID NO: 432956 - DNA, 25 bp, Mus musculus
gaatgccgccaaagaacttcagccg

SEQ ID NO: 432957 - DNA, 25 bp, Mus musculus
gaatgccgccttccttgtcgggtgt

SEQ ID NO: 432958 - DNA, 25 bp, Mus musculus
gaatgccgcgtatcgacttctggtg

SEQ ID NO: 432959 - DNA, 25 bp, Mus musculus
gaatgccgctcatcttgtaccagtg

SEQ ID NO: 432960 - DNA, 25 bp, Mus musculus
gaatgccgctgccttgggcttctgc

SEQ ID NO: 432961 - DNA, 25 bp, Mus musculus
gaatgccggcagtcagagtcaaaac

SEQ ID NO: 432962 - DNA, 25 bp, Mus musculus
gaatgccgtcaccaattcaacacga

SEQ ID NO: 432963 - DNA, 25 bp, Mus musculus
gaatgccgtgcagactgtggtccgc

SEQ ID NO: 432964 - DNA, 25 bp, Mus musculus
gaatgccgtttgaatctgccaggta

SEQ ID NO: 432965 - DNA, 25 bp, Mus musculus
gaatgcctatgaatgactgccagta

SEQ ID NO: 432966 - DNA, 25 bp, Mus musculus
gaatgcctccattagactcagctgt

SEQ ID NO: 432967 - DNA, 25 bp, Mus musculus
gaatgcctcccttggctgttcctgt

SEQ ID NO: 432968 - DNA, 25 bp, Mus musculus
gaatgcctcggtaagtgaacacatg

SEQ ID NO: 432969 - DNA, 25 bp, Mus musculus
gaatgcctgaaatgaagtgcctccc

SEQ ID NO: 432970 - DNA, 25 bp, Mus musculus
gaatgcctgtaaaggagcgcctaag

SEQ ID NO: 432971 - DNA, 25 bp, Mus musculus
gaatgccttataggaaacagatggg

SEQ ID NO: 432972 - DNA, 25 bp, Mus musculus
gaatgccttcatctacagtctgagg

SEQ ID NO: 432973 - DNA, 25 bp, Mus musculus
gaatgccttccatggacgtatgttt

SEQ ID NO: 432974 - DNA, 25 bp, Mus musculus
gaatgccttctgtgtaagcgtcaga

SEQ ID NO: 432975 - DNA, 25 bp, Mus musculus
gaatgcgaaaaaggaagccggctga

SEQ ID NO: 432976 - DNA, 25 bp, Mus musculus
gaatgcgaattcagccacgggctag

SEQ ID NO: 432977 - DNA, 25 bp, Mus musculus
gaatgcgaccggacatagttcccta

SEQ ID NO: 432978 - DNA, 25 bp, Mus musculus
gaatgcgattccacctgggaggacg

SEQ ID NO: 432979 - DNA, 25 bp, Mus musculus
gaatgcgcatattcttccgggaaaa

SEQ ID NO: 432980 - DNA, 25 bp, Mus musculus
gaatgcgccaccatccctggcttaa

SEQ ID NO: 432981 - DNA, 25 bp, Mus musculus
gaatgcgcccgaggttcctgtgaag

SEQ ID NO: 432982 - DNA, 25 bp, Mus musculus
gaatgcggacaccttgagctactgc

SEQ ID NO: 432983 - DNA, 25 bp, Mus musculus
gaatgcggatccacaacaacagggt

SEQ ID NO: 432984 - DNA, 25 bp, Mus musculus
gaatgcgtccgttccgatgggtcgc

SEQ ID NO: 432985 - DNA, 25 bp, Mus musculus
gaatgcgtgcttagtgcctgtgaag

SEQ ID NO: 432986 - DNA, 25 bp, Mus musculus
gaatgcgttccagctgacaccttga

SEQ ID NO: 432987 - DNA, 25 bp, Mus musculus
gaatgctaacattacaggctggacc

SEQ ID NO: 432988 - DNA, 25 bp, Mus musculus
gaatgctacctaagcatgaccggta

SEQ ID NO: 432989 - DNA, 25 bp, Mus musculus
gaatgctagcaagagttgccctggg

SEQ ID NO: 432990 - DNA, 25 bp, Mus musculus
gaatgctcacttacctcccaggaag

SEQ ID NO: 432991 - DNA, 25 bp, Mus musculus
gaatgctcagggactcgggtacagt

SEQ ID NO: 432992 - DNA, 25 bp, Mus musculus
gaatgctccaaaatagttccagagt

SEQ ID NO: 432993 - DNA, 25 bp, Mus musculus
gaatgctcctctgaaaggctggcag

SEQ ID NO: 432994 - DNA, 25 bp, Mus musculus
gaatgctcttattccctatgctctg

SEQ ID NO: 432995 - DNA, 25 bp, Mus musculus
gaatgctctttcagtctggagagga

SEQ ID NO: 432996 - DNA, 25 bp, Mus musculus
gaatgctgacatcctcaactactgc

SEQ ID NO: 432997 - DNA, 25 bp, Mus musculus
gaatgctgcacggatgcttgctcca

SEQ ID NO: 432998 - DNA, 25 bp, Mus musculus
gaatgctgcattgcacctcagctag

SEQ ID NO: 432999 - DNA, 25 bp, Mus musculus
gaatgctgcctgtgaagtctcgaca

SEQ ID NO: 433000 - DNA, 25 bp, Mus musculus
gaatgctgcgtgaggaaataaccct

SEQ ID NO: 433001 - DNA, 25 bp, Mus musculus
gaatgctgctcctataccgattaag

SEQ ID NO: 433002 - DNA, 25 bp, Mus musculus
gaatgctggctacttctagcactga

SEQ ID NO: 433003 - DNA, 25 bp, Mus musculus
gaatgctggtatgacatcacgtctg

SEQ ID NO: 433004 - DNA, 25 bp, Mus musculus
gaatgctgtcttggaagcggatttc

SEQ ID NO: 433005 - DNA, 25 bp, Mus musculus
gaatgctgtgccgagatctatcctg

SEQ ID NO: 433006 - DNA, 25 bp, Mus musculus
gaatgctgtttacttcaaggccaag

SEQ ID NO: 433007 - DNA, 25 bp, Mus musculus
gaatgcttcagacgtcagggacctg

SEQ ID NO: 433008 - DNA, 25 bp, Mus musculus
gaatgcttcatctccttgtgcctgt

SEQ ID NO: 433009 - DNA, 25 bp, Mus musculus
gaatgcttcctgatctccctgtgtg

SEQ ID NO: 433010 - DNA, 25 bp, Mus musculus
gaatgcttgctttggaaacctcaca

SEQ ID NO: 433011 - DNA, 25 bp, Mus musculus
gaatgcttgtggcacccatttgagg

SEQ ID NO: 433012 - DNA, 25 bp, Mus musculus
gaatgcttttccctcagtgtccctg

SEQ ID NO: 433013 - DNA, 25 bp, Mus musculus
gaatgcttttcccttgccttcctct

SEQ ID NO: 433014 - DNA, 25 bp, Mus musculus
gaatgcttttgaacagccctgaaac

SEQ ID NO: 433015 - DNA, 25 bp, Mus musculus
gaatggaactccgtggacctcagga

SEQ ID NO: 433016 - DNA, 25 bp, Mus musculus
gaatggaacttcaggctccgctcga

SEQ ID NO: 433017 - DNA, 25 bp, Mus musculus
gaatggaagctctatacggaactga

SEQ ID NO: 433018 - DNA, 25 bp, Mus musculus
gaatggaatttattgcctgttgaac

SEQ ID NO: 433019 - DNA, 25 bp, Mus musculus
gaatggacaaaaaacgtgcctggac

SEQ ID NO: 433020 - DNA, 25 bp, Mus musculus
gaatggacaagataactgcagccga

SEQ ID NO: 433021 - DNA, 25 bp, Mus musculus
gaatggacactgaccaccagcttgg

SEQ ID NO: 433022 - DNA, 25 bp, Mus musculus
gaatggacagctccatgcccgagag

SEQ ID NO: 433023 - DNA, 25 bp, Mus musculus
gaatggacaggaagaccgccctgtg

SEQ ID NO: 433024 - DNA, 25 bp, Mus musculus
gaatggaccaagattccctccagag

SEQ ID NO: 433025 - DNA, 25 bp, Mus musculus
gaatggaccctgatgcttcacggca

SEQ ID NO: 433026 - DNA, 25 bp, Mus musculus
gaatggaccgcatggctcatcttgg

SEQ ID NO: 433027 - DNA, 25 bp, Mus musculus
gaatggactcacaaactactagtgc

SEQ ID NO: 433028 - DNA, 25 bp, Mus musculus
gaatggactccgaaggttgtctccc

SEQ ID NO: 433029 - DNA, 25 bp, Mus musculus
gaatggagagtgtctatgcagcccc

SEQ ID NO: 433030 - DNA, 25 bp, Mus musculus
gaatggagcagagtggatgccacct

SEQ ID NO: 433031 - DNA, 25 bp, Mus musculus
gaatggagccataggagtttccacc

SEQ ID NO: 433032 - DNA, 25 bp, Mus musculus
gaatggagcgccctgtctcctcatg

SEQ ID NO: 433033 - DNA, 25 bp, Mus musculus
gaatggaggaaggaaacccaaggct

SEQ ID NO: 433034 - DNA, 25 bp, Mus musculus
gaatggaggcctgtcacagtgcaag

SEQ ID NO: 433035 - DNA, 25 bp, Mus musculus
gaatggagtcagacccacggttacc

SEQ ID NO: 433036 - DNA, 25 bp, Mus musculus
gaatggagttcccaaatcagccccg

SEQ ID NO: 433037 - DNA, 25 bp, Mus musculus
gaatggagttcctggcttcccgcaa

SEQ ID NO: 433038 - DNA, 25 bp, Mus musculus
gaatggatacgggagaagcacccag

SEQ ID NO: 433039 - DNA, 25 bp, Mus musculus
gaatggatcagcatggagaaaccct

SEQ ID NO: 433040 - DNA, 25 bp, Mus musculus
gaatggatccatgacctgcgttcag

SEQ ID NO: 433041 - DNA, 25 bp, Mus musculus
gaatggatcccttcaccttcgcgga

SEQ ID NO: 433042 - DNA, 25 bp, Mus musculus
gaatggattccgtagcaagctcaag

SEQ ID NO: 433043 - DNA, 25 bp, Mus musculus
gaatggcaagcgatcatacccagag

SEQ ID NO: 433044 - DNA, 25 bp, Mus musculus
gaatggcaatcctcccacactgtgg

SEQ ID NO: 433045 - DNA, 25 bp, Mus musculus
gaatggcaatctcctggtacccaaa

SEQ ID NO: 433046 - DNA, 25 bp, Mus musculus
gaatggcactgtcccaaatgctttt

SEQ ID NO: 433047 - DNA, 25 bp, Mus musculus
gaatggcagcagaatctcgtcgggt

SEQ ID NO: 433048 - DNA, 25 bp, Mus musculus
gaatggcataacctgatctctgaag

SEQ ID NO: 433049 - DNA, 25 bp, Mus musculus
gaatggcattggcatttcccttgat

SEQ ID NO: 433050 - DNA, 25 bp, Mus musculus
gaatggccaccaggcctgtgagcta

SEQ ID NO: 433051 - DNA, 25 bp, Mus musculus
gaatggccacgaggaacagaatcat

SEQ ID NO: 433052 - DNA, 25 bp, Mus musculus
gaatggccaggacaagacaaacgca

SEQ ID NO: 433053 - DNA, 25 bp, Mus musculus
gaatggccatgctggtcaacctggt

SEQ ID NO: 433054 - DNA, 25 bp, Mus musculus
gaatggcctatcttgagtcgcagaa

SEQ ID NO: 433055 - DNA, 25 bp, Mus musculus
gaatggccttctcttcccttaatgg

SEQ ID NO: 433056 - DNA, 25 bp, Mus musculus
gaatggcgacatgtaacctcgtggg

SEQ ID NO: 433057 - DNA, 25 bp, Mus musculus
gaatggctatttttgtactctggga

SEQ ID NO: 433058 - DNA, 25 bp, Mus musculus
gaatggctccctggcataacagggc

SEQ ID NO: 433059 - DNA, 25 bp, Mus musculus
gaatggctctctccccaagggtgta

SEQ ID NO: 433060 - DNA, 25 bp, Mus musculus
gaatggctctggaaccttgggcaaa

SEQ ID NO: 433061 - DNA, 25 bp, Mus musculus
gaatggctgcaacacatctccagag

SEQ ID NO: 433062 - DNA, 25 bp, Mus musculus
gaatggctgccccaaaactgaagtt

SEQ ID NO: 433063 - DNA, 25 bp, Mus musculus
gaatggcttcatgcttggctccagc

SEQ ID NO: 433064 - DNA, 25 bp, Mus musculus
gaatggctttactttagcgcgccgt

SEQ ID NO: 433065 - DNA, 25 bp, Mus musculus
gaatgggaacatcaccttgctacct

SEQ ID NO: 433066 - DNA, 25 bp, Mus musculus
gaatgggaacccagttgtgctgtcc

SEQ ID NO: 433067 - DNA, 25 bp, Mus musculus
gaatgggaactcttccacccaggga

SEQ ID NO: 433068 - DNA, 25 bp, Mus musculus
gaatgggaagcgtcacaagtcactg

SEQ ID NO: 433069 - DNA, 25 bp, Mus musculus
gaatgggacaccctcttcagtttgg

SEQ ID NO: 433070 - DNA, 25 bp, Mus musculus
gaatgggacattttggacctccaag

SEQ ID NO: 433071 - DNA, 25 bp, Mus musculus
gaatgggaccacgattacgacctca

SEQ ID NO: 433072 - DNA, 25 bp, Mus musculus
gaatgggaccacgtagagaagacct

SEQ ID NO: 433073 - DNA, 25 bp, Mus musculus
gaatgggaccttcttctgcaacgaa

SEQ ID NO: 433074 - DNA, 25 bp, Mus musculus
gaatgggagccgtcacttcgaggac

SEQ ID NO: 433075 - DNA, 25 bp, Mus musculus
gaatgggatccacctgtgtctcaag

SEQ ID NO: 433076 - DNA, 25 bp, Mus musculus
gaatgggatcctcgaaagccagaga

SEQ ID NO: 433077 - DNA, 25 bp, Mus musculus
gaatgggattacacctacgtccaca

SEQ ID NO: 433078 - DNA, 25 bp, Mus musculus
gaatgggcaccactcctgaaataca

SEQ ID NO: 433079 - DNA, 25 bp, Mus musculus
gaatgggcaccctttgcataaagcc

SEQ ID NO: 433080 - DNA, 25 bp, Mus musculus
gaatgggccgctatgcatccagatg

SEQ ID NO: 433081 - DNA, 25 bp, Mus musculus
gaatgggccgcttgtcatttctgct

SEQ ID NO: 433082 - DNA, 25 bp, Mus musculus
gaatgggctctagagatacacctga

SEQ ID NO: 433083 - DNA, 25 bp, Mus musculus
gaatgggtccatattgcctctccag

SEQ ID NO: 433084 - DNA, 25 bp, Mus musculus
gaatgggtcccaagatgaaatgacg

SEQ ID NO: 433085 - DNA, 25 bp, Mus musculus
gaatgggtcctaggttaagtaaatg

SEQ ID NO: 433086 - DNA, 25 bp, Mus musculus
gaatgggttaatggcctcgcatcca

SEQ ID NO: 433087 - DNA, 25 bp, Mus musculus
gaatgggttacgatacggcctaagc

SEQ ID NO: 433088 - DNA, 25 bp, Mus musculus
gaatggtacccgagcttagcgacca

SEQ ID NO: 433089 - DNA, 25 bp, Mus musculus
gaatggtatggtgtgccagatctag

SEQ ID NO: 433090 - DNA, 25 bp, Mus musculus
gaatggtcaggaagacagacggctc

SEQ ID NO: 433091 - DNA, 25 bp, Mus musculus
gaatggtcgacacttccagcagcag

SEQ ID NO: 433092 - DNA, 25 bp, Mus musculus
gaatggtcgtcattaacggatggca

SEQ ID NO: 433093 - DNA, 25 bp, Mus musculus
gaatggtgcgaaagtcaattgctct

SEQ ID NO: 433094 - DNA, 25 bp, Mus musculus
gaatggtgtaatctaactcaatgaa

SEQ ID NO: 433095 - DNA, 25 bp, Mus musculus
gaatggttcttctctgcagtgggca

SEQ ID NO: 433096 - DNA, 25 bp, Mus musculus
gaatgtaactcaataggctctaggg

SEQ ID NO: 433097 - DNA, 25 bp, Mus musculus
gaatgtaagctctctatgggcagga

SEQ ID NO: 433098 - DNA, 25 bp, Mus musculus
gaatgtaaggctatacagtgcagct

SEQ ID NO: 433099 - DNA, 25 bp, Mus musculus
gaatgtaatagctcctgccatcttg

SEQ ID NO: 433100 - DNA, 25 bp, Mus musculus
gaatgtaatgctcctgccctcatgg

SEQ ID NO: 433101 - DNA, 25 bp, Mus musculus
gaatgtaattcctctgcctcgtcct

SEQ ID NO: 433102 - DNA, 25 bp, Mus musculus
gaatgtaattctagctgagtgcaat

SEQ ID NO: 433103 - DNA, 25 bp, Mus musculus
gaatgtagacgtacttcatcaatag

SEQ ID NO: 433104 - DNA, 25 bp, Mus musculus
gaatgtagcaatggtcatggcccca

SEQ ID NO: 433105 - DNA, 25 bp, Mus musculus
gaatgtagcacagatttactaagga

SEQ ID NO: 433106 - DNA, 25 bp, Mus musculus
gaatgtagccccatgtctgttgcag

SEQ ID NO: 433107 - DNA, 25 bp, Mus musculus
gaatgtagtatgtgagcaaatcggg

SEQ ID NO: 433108 - DNA, 25 bp, Mus musculus
gaatgtatgagtctcagggccacca

SEQ ID NO: 433109 - DNA, 25 bp, Mus musculus
gaatgtcaacctgtgggacctgcgc

SEQ ID NO: 433110 - DNA, 25 bp, Mus musculus
gaatgtcaagtttgcagcttcagtc

SEQ ID NO: 433111 - DNA, 25 bp, Mus musculus
gaatgtcagccgtgaactctgacct

SEQ ID NO: 433112 - DNA, 25 bp, Mus musculus
gaatgtcagtgaagcccaagagatg

SEQ ID NO: 433113 - DNA, 25 bp, Mus musculus
gaatgtccaactgcttcacctggga

SEQ ID NO: 433114 - DNA, 25 bp, Mus musculus
gaatgtccacagctggcagagtgca

SEQ ID NO: 433115 - DNA, 25 bp, Mus musculus
gaatgtccagatttgaatagtcgac

SEQ ID NO: 433116 - DNA, 25 bp, Mus musculus
gaatgtccaggagtacttccagggc

SEQ ID NO: 433117 - DNA, 25 bp, Mus musculus
gaatgtccccagtcctttaaaagcg

SEQ ID NO: 433118 - DNA, 25 bp, Mus musculus
gaatgtccctactctggacggcagg

SEQ ID NO: 433119 - DNA, 25 bp, Mus musculus
gaatgtccctggctcccttgatgag

SEQ ID NO: 433120 - DNA, 25 bp, Mus musculus
gaatgtccgtgctcgtgctcgcact

SEQ ID NO: 433121 - DNA, 25 bp, Mus musculus
gaatgtcctaggtgtctggtgctca

SEQ ID NO: 433122 - DNA, 25 bp, Mus musculus
gaatgtcgaagaaaatgccacggcc

SEQ ID NO: 433123 - DNA, 25 bp, Mus musculus
gaatgtcgccttggactacggagcc

SEQ ID NO: 433124 - DNA, 25 bp, Mus musculus
gaatgtcgcgtctctctgaggcacc

SEQ ID NO: 433125 - DNA, 25 bp, Mus musculus
gaatgtctaaaggtctcccgcctgc

SEQ ID NO: 433126 - DNA, 25 bp, Mus musculus
gaatgtctagttgaggcagccagca

SEQ ID NO: 433127 - DNA, 25 bp, Mus musculus
gaatgtctctcggatttcagcctgg

SEQ ID NO: 433128 - DNA, 25 bp, Mus musculus
gaatgtctcttataggccctcagct

SEQ ID NO: 433129 - DNA, 25 bp, Mus musculus
gaatgtctcttcctggcagtaatgg

SEQ ID NO: 433130 - DNA, 25 bp, Mus musculus
gaatgtctgaatcggagcaggctct

SEQ ID NO: 433131 - DNA, 25 bp, Mus musculus
gaatgtcttgtggatgaggcctgca

SEQ ID NO: 433132 - DNA, 25 bp, Mus musculus
gaatgtctttccgtactgcacctgc

SEQ ID NO: 433133 - DNA, 25 bp, Mus musculus
gaatgtgaacaagagcccacctgtg

SEQ ID NO: 433134 - DNA, 25 bp, Mus musculus
gaatgtgaagaccaaaaagtaaagg

SEQ ID NO: 433135 - DNA, 25 bp, Mus musculus
gaatgtgaagctttgacccaccctg

SEQ ID NO: 433136 - DNA, 25 bp, Mus musculus
gaatgtgacaatggagaccgctggt

SEQ ID NO: 433137 - DNA, 25 bp, Mus musculus
gaatgtgactgagatgggctagcct

SEQ ID NO: 433138 - DNA, 25 bp, Mus musculus
gaatgtgagcctgtgagatatctag

SEQ ID NO: 433139 - DNA, 25 bp, Mus musculus
gaatgtgagtctgcgtcctcggaac

SEQ ID NO: 433140 - DNA, 25 bp, Mus musculus
gaatgtgatctgttgtctatcatcc

SEQ ID NO: 433141 - DNA, 25 bp, Mus musculus
gaatgtgatgcaagacgtccctgaa

SEQ ID NO: 433142 - DNA, 25 bp, Mus musculus
gaatgtgcccctcaactcagatgga

SEQ ID NO: 433143 - DNA, 25 bp, Mus musculus
gaatgtgctcaccttttactgccag

SEQ ID NO: 433144 - DNA, 25 bp, Mus musculus
gaatgtgctctcagctgccaggatg

SEQ ID NO: 433145 - DNA, 25 bp, Mus musculus
gaatgtgctttcaacagagccctct

SEQ ID NO: 433146 - DNA, 25 bp, Mus musculus
gaatgtggaactgaccacctcaggg

SEQ ID NO: 433147 - DNA, 25 bp, Mus musculus
gaatgtggacatcctctggcaagct

SEQ ID NO: 433148 - DNA, 25 bp, Mus musculus
gaatgtggagcctccgatccgaacc

SEQ ID NO: 433149 - DNA, 25 bp, Mus musculus
gaatgtggcctctgtacctttgagt

SEQ ID NO: 433150 - DNA, 25 bp, Mus musculus
gaatgtggcctgtctacctttaagc

SEQ ID NO: 433151 - DNA, 25 bp, Mus musculus
gaatgtgggcaaaggacagatttca

SEQ ID NO: 433152 - DNA, 25 bp, Mus musculus
gaatgtgggcacagcacacagtgag

SEQ ID NO: 433153 - DNA, 25 bp, Mus musculus
gaatgtgggctttccgcacagcgag

SEQ ID NO: 433154 - DNA, 25 bp, Mus musculus
gaatgtggttaacctcctgggagcc

SEQ ID NO: 433155 - DNA, 25 bp, Mus musculus
gaatgtgtaagtccatcagcttgtc

SEQ ID NO: 433156 - DNA, 25 bp, Mus musculus
gaatgtgtacaacagccccatgaag

SEQ ID NO: 433157 - DNA, 25 bp, Mus musculus
gaatgtgtacatgactcctgcagga

SEQ ID NO: 433158 - DNA, 25 bp, Mus musculus
gaatgtgtccctatcgcatcagctg

SEQ ID NO: 433159 - DNA, 25 bp, Mus musculus
gaatgtgtgattatgactacgtagc

SEQ ID NO: 433160 - DNA, 25 bp, Mus musculus
gaatgtgtgcaactccacggaggct

SEQ ID NO: 433161 - DNA, 25 bp, Mus musculus
gaatgtgtgtattactggcacccta

SEQ ID NO: 433162 - DNA, 25 bp, Mus musculus
gaatgtgtgtccatgaccctttaca

SEQ ID NO: 433163 - DNA, 25 bp, Mus musculus
gaatgttaaacttgggctcgcagca

SEQ ID NO: 433164 - DNA, 25 bp, Mus musculus
gaatgttaccgactttcgatatgca

SEQ ID NO: 433165 - DNA, 25 bp, Mus musculus
gaatgttatcagacatgggcccagc

SEQ ID NO: 433166 - DNA, 25 bp, Mus musculus
gaatgttcaacaggttaagttgagg

SEQ ID NO: 433167 - DNA, 25 bp, Mus musculus
gaatgttcacaggtgactgctcccc

SEQ ID NO: 433168 - DNA, 25 bp, Mus musculus
gaatgttccttttcccctatgtaag

SEQ ID NO: 433169 - DNA, 25 bp, Mus musculus
gaatgttcgaagcacgtggaacccg

SEQ ID NO: 433170 - DNA, 25 bp, Mus musculus
gaatgttcgcatatatcttggctac

SEQ ID NO: 433171 - DNA, 25 bp, Mus musculus
gaatgttctagatagtcactcgttg

SEQ ID NO: 433172 - DNA, 25 bp, Mus musculus
gaatgttctgaaaggcggccacctg

SEQ ID NO: 433173 - DNA, 25 bp, Mus musculus
gaatgttctgaatctgtgccacaca

SEQ ID NO: 433174 - DNA, 25 bp, Mus musculus
gaatgttgacttggcccatggaggc

SEQ ID NO: 433175 - DNA, 25 bp, Mus musculus
gaatgttgcaacacagaactcttag

SEQ ID NO: 433176 - DNA, 25 bp, Mus musculus
gaatgttgggcccataatccagcct

SEQ ID NO: 433177 - DNA, 25 bp, Mus musculus
gaatgttgtccaccagctgtcagta

SEQ ID NO: 433178 - DNA, 25 bp, Mus musculus
gaatgttgtctgtcctggctgtcca

SEQ ID NO: 433179 - DNA, 25 bp, Mus musculus
gaatgtttacacaggtcatccaccc

SEQ ID NO: 433180 - DNA, 25 bp, Mus musculus
gaatgtttgctctatcctcccaggg

SEQ ID NO: 433181 - DNA, 25 bp, Mus musculus
gaatgttttacgaagctaaggatga

SEQ ID NO: 433182 - DNA, 25 bp, Mus musculus
gaattaaaggacattgttctctacc

SEQ ID NO: 433183 - DNA, 25 bp, Mus musculus
gaattaaagtccgaagccggtcaca

SEQ ID NO: 433184 - DNA, 25 bp, Mus musculus
gaattaaagtgtctgtaggcatgga

SEQ ID NO: 433185 - DNA, 25 bp, Mus musculus
gaattaacacacacgaacaagctgc

SEQ ID NO: 433186 - DNA, 25 bp, Mus musculus
gaattaacgcttatgctgcatacag

SEQ ID NO: 433187 - DNA, 25 bp, Mus musculus
gaattaatattcctgggcaccctgg

SEQ ID NO: 433188 - DNA, 25 bp, Mus musculus
gaattacacctaggaaagcagcagc

SEQ ID NO: 433189 - DNA, 25 bp, Mus musculus
gaattacaggcttcagacccgtgag

SEQ ID NO: 433190 - DNA, 25 bp, Mus musculus
gaattacatgcagcattgcccgggc

SEQ ID NO: 433191 - DNA, 25 bp, Mus musculus
gaattacattaccaagcaggagctg

SEQ ID NO: 433192 - DNA, 25 bp, Mus musculus
gaattacctcagtggcattgctgcc

SEQ ID NO: 433193 - DNA, 25 bp, Mus musculus
gaattacctgagcaccctgaggagg

SEQ ID NO: 433194 - DNA, 25 bp, Mus musculus
gaattacctggcatccaagggcgag

SEQ ID NO: 433195 - DNA, 25 bp, Mus musculus
gaattacgaactgccaagggactga

SEQ ID NO: 433196 - DNA, 25 bp, Mus musculus
gaattacggagtctttagctttcct

SEQ ID NO: 433197 - DNA, 25 bp, Mus musculus
gaattactacgagtcccaccttggg

SEQ ID NO: 433198 - DNA, 25 bp, Mus musculus
gaattactcacgcagcatctgggtg

SEQ ID NO: 433199 - DNA, 25 bp, Mus musculus
gaattactctctactgtcctgtcat

SEQ ID NO: 433200 - DNA, 25 bp, Mus musculus
gaattactgtaatccgcagggccag

SEQ ID NO: 433201 - DNA, 25 bp, Mus musculus
gaattagaaccccaaaagctcaaga

SEQ ID NO: 433202 - DNA, 25 bp, Mus musculus
gaattagacgctcctgtggcctcct

SEQ ID NO: 433203 - DNA, 25 bp, Mus musculus
gaattagagaacaagtctggcccac

SEQ ID NO: 433204 - DNA, 25 bp, Mus musculus
gaattagagacgtcctacaaggcag

SEQ ID NO: 433205 - DNA, 25 bp, Mus musculus
gaattagagagggacggcctccgct

SEQ ID NO: 433206 - DNA, 25 bp, Mus musculus
gaattagatgctccttcgcagccag

SEQ ID NO: 433207 - DNA, 25 bp, Mus musculus
gaattagcatgcatgtccacccgag

SEQ ID NO: 433208 - DNA, 25 bp, Mus musculus
gaattagccctgttgagtaccagcc

SEQ ID NO: 433209 - DNA, 25 bp, Mus musculus
gaattagcctggtcacccgagttgg

SEQ ID NO: 433210 - DNA, 25 bp, Mus musculus
gaattagcttgtctgcctgaggatg

SEQ ID NO: 433211 - DNA, 25 bp, Mus musculus
gaattaggacttggacctgagcaca

SEQ ID NO: 433212 - DNA, 25 bp, Mus musculus
gaattagtgccacccatggttgccg

SEQ ID NO: 433213 - DNA, 25 bp, Mus musculus
gaattagtggtctccctgatgccca

SEQ ID NO: 433214 - DNA, 25 bp, Mus musculus
gaattatagtcctctcttagtaaac

SEQ ID NO: 433215 - DNA, 25 bp, Mus musculus
gaattatataaagacctgcccagct

SEQ ID NO: 433216 - DNA, 25 bp, Mus musculus
gaattatataaagccgcctctgagg

SEQ ID NO: 433217 - DNA, 25 bp, Mus musculus
gaattatattatgtctcccagcgtg

SEQ ID NO: 433218 - DNA, 25 bp, Mus musculus
gaattatcaccccagatccttgatt

SEQ ID NO: 433219 - DNA, 25 bp, Mus musculus
gaattatgaaatgacgcaccacttg

SEQ ID NO: 433220 - DNA, 25 bp, Mus musculus
gaattatgagcaaaagtgccgggac

SEQ ID NO: 433221 - DNA, 25 bp, Mus musculus
gaattatgcagcttttccttgttct

SEQ ID NO: 433222 - DNA, 25 bp, Mus musculus
gaattatgtcagaaacccagcctag

SEQ ID NO: 433223 - DNA, 25 bp, Mus musculus
gaattatgtcagcaacgtgtccaag

SEQ ID NO: 433224 - DNA, 25 bp, Mus musculus
gaattatgtgcctgcgtagctgcct

SEQ ID NO: 433225 - DNA, 25 bp, Mus musculus
gaattattaagtcagggctcaaggg

SEQ ID NO: 433226 - DNA, 25 bp, Mus musculus
gaattattctgggaacccctgtgga

SEQ ID NO: 433227 - DNA, 25 bp, Mus musculus
gaattattttccctgctgcatcaca

SEQ ID NO: 433228 - DNA, 25 bp, Mus musculus
gaattcaaaatctgtagaccgggct

SEQ ID NO: 433229 - DNA, 25 bp, Mus musculus
gaattcaaagagtgcccagggtctg

SEQ ID NO: 433230 - DNA, 25 bp, Mus musculus
gaattcaaagggtttggctgccctg

SEQ ID NO: 433231 - DNA, 25 bp, Mus musculus
gaattcaacacccatttggccatga

SEQ ID NO: 433232 - DNA, 25 bp, Mus musculus
gaattcaaccatcctttgatgtgca

SEQ ID NO: 433233 - DNA, 25 bp, Mus musculus
gaattcaactcactgccctgccagt

SEQ ID NO: 433234 - DNA, 25 bp, Mus musculus
gaattcaagcaccacaggctgtagg

SEQ ID NO: 433235 - DNA, 25 bp, Mus musculus
gaattcaaggaggctctggtgcatc

SEQ ID NO: 433236 - DNA, 25 bp, Mus musculus
gaattcaagtaaccaccagtgcctg

SEQ ID NO: 433237 - DNA, 25 bp, Mus musculus
gaattcacagctgagtgtcccagtg

SEQ ID NO: 433238 - DNA, 25 bp, Mus musculus
gaattcacagtcagcacctagaggt

SEQ ID NO: 433239 - DNA, 25 bp, Mus musculus
gaattcaccaattcggcgagtctga

SEQ ID NO: 433240 - DNA, 25 bp, Mus musculus
gaattcaccagctacacaaaggccc

SEQ ID NO: 433241 - DNA, 25 bp, Mus musculus
gaattcaccttcttggccaatggca

SEQ ID NO: 433242 - DNA, 25 bp, Mus musculus
gaattcactatagaggctgagcagt

SEQ ID NO: 433243 - DNA, 25 bp, Mus musculus
gaattcacttcaaggctcagcaggc

SEQ ID NO: 433244 - DNA, 25 bp, Mus musculus
gaattcacttcgaggcatagcttgg

SEQ ID NO: 433245 - DNA, 25 bp, Mus musculus
gaattcagacccagtagcaggtcag

SEQ ID NO: 433246 - DNA, 25 bp, Mus musculus
gaattcagcaaaccacagcagagag

SEQ ID NO: 433247 - DNA, 25 bp, Mus musculus
gaattcagtgtgtatcccaggctca

SEQ ID NO: 433248 - DNA, 25 bp, Mus musculus
gaattcataacagcacaagactcct

SEQ ID NO: 433249 - DNA, 25 bp, Mus musculus
gaattcatcagtgtggcagtgggac

SEQ ID NO: 433250 - DNA, 25 bp, Mus musculus
gaattcatccttgcatgccagcgga

SEQ ID NO: 433251 - DNA, 25 bp, Mus musculus
gaattcatctgtgtggcgctgcgga

SEQ ID NO: 433252 - DNA, 25 bp, Mus musculus
gaattcatggtcgtggaaaccccgc

SEQ ID NO: 433253 - DNA, 25 bp, Mus musculus
gaattcattcttagaggaaatgaag

SEQ ID NO: 433254 - DNA, 25 bp, Mus musculus
gaattcatttatgtgccagagacca

SEQ ID NO: 433255 - DNA, 25 bp, Mus musculus
gaattccacaaccttttggcccagg

SEQ ID NO: 433256 - DNA, 25 bp, Mus musculus
gaattccagacaacggtgagctgct

SEQ ID NO: 433257 - DNA, 25 bp, Mus musculus
gaattccagagacgaagtggcccag

SEQ ID NO: 433258 - DNA, 25 bp, Mus musculus
gaattccagcgctcaggtgcaagag

SEQ ID NO: 433259 - DNA, 25 bp, Mus musculus
gaattccaggaagagatcgctcgct

SEQ ID NO: 433260 - DNA, 25 bp, Mus musculus
gaattccagggagtatcgtgattcc

SEQ ID NO: 433261 - DNA, 25 bp, Mus musculus
gaattccaggtccaatgctagaggg

SEQ ID NO: 433262 - DNA, 25 bp, Mus musculus
gaattccagttttgagctgcaccaa

SEQ ID NO: 433263 - DNA, 25 bp, Mus musculus
gaattcccagggatcattgatgccg

SEQ ID NO: 433264 - DNA, 25 bp, Mus musculus
gaattcccagtgtgatgttaggtag

SEQ ID NO: 433265 - DNA, 25 bp, Mus musculus
gaattcccagtttgatgccacagac

SEQ ID NO: 433266 - DNA, 25 bp, Mus musculus
gaattcccgctagcaaaacagggca

SEQ ID NO: 433267 - DNA, 25 bp, Mus musculus
gaattccctggtgtcccgaaacctg

SEQ ID NO: 433268 - DNA, 25 bp, Mus musculus
gaattccgcacaaaagaggagccca

SEQ ID NO: 433269 - DNA, 25 bp, Mus musculus
gaattccgcaggagcagacacacta

SEQ ID NO: 433270 - DNA, 25 bp, Mus musculus
gaattccgcggttgctgtgagcgcc

SEQ ID NO: 433271 - DNA, 25 bp, Mus musculus
gaattccgggcatccctgtacaagg

SEQ ID NO: 433272 - DNA, 25 bp, Mus musculus
gaattcctaggtggcctgaagcgtg

SEQ ID NO: 433273 - DNA, 25 bp, Mus musculus
gaattcctggtttgcagtgaccaca

SEQ ID NO: 433274 - DNA, 25 bp, Mus musculus
gaattccttaatgtgcctgaccagg

SEQ ID NO: 433275 - DNA, 25 bp, Mus musculus
gaattccttcattggagctgcccga

SEQ ID NO: 433276 - DNA, 25 bp, Mus musculus
gaattcggctcacaggtgcacggct

SEQ ID NO: 433277 - DNA, 25 bp, Mus musculus
gaattcgtaccagcctttacctgca

SEQ ID NO: 433278 - DNA, 25 bp, Mus musculus
gaattcgtagaacatggtcccttgg

SEQ ID NO: 433279 - DNA, 25 bp, Mus musculus
gaattcgtcagccacgttgaaggcc

SEQ ID NO: 433280 - DNA, 25 bp, Mus musculus
gaattcgtgagtgaagccctgctag

SEQ ID NO: 433281 - DNA, 25 bp, Mus musculus
gaattcgtgtacattgcctgccagg

SEQ ID NO: 433282 - DNA, 25 bp, Mus musculus
gaattctacggaagcgcaacaaagc

SEQ ID NO: 433283 - DNA, 25 bp, Mus musculus
gaattctagcagctgtcacaaggag

SEQ ID NO: 433284 - DNA, 25 bp, Mus musculus
gaattctcacctgttcatgaaccgc

SEQ ID NO: 433285 - DNA, 25 bp, Mus musculus
gaattctccaaaagtaggtccagtg

SEQ ID NO: 433286 - DNA, 25 bp, Mus musculus
gaattctccacgaactgctggccaa

SEQ ID NO: 433287 - DNA, 25 bp, Mus musculus
gaattctccctaaatggtaagatag

SEQ ID NO: 433288 - DNA, 25 bp, Mus musculus
gaattctctaaggtacagcgatggg

SEQ ID NO: 433289 - DNA, 25 bp, Mus musculus
gaattctgaagtcacccatatctag

SEQ ID NO: 433290 - DNA, 25 bp, Mus musculus
gaattctgacccctgtgactgtgca

SEQ ID NO: 433291 - DNA, 25 bp, Mus musculus
gaattctgacgcttctgctgccctg

SEQ ID NO: 433292 - DNA, 25 bp, Mus musculus
gaattctgactctatccggttgcag

SEQ ID NO: 433293 - DNA, 25 bp, Mus musculus
gaattctgaggatcgtctgctgtga

SEQ ID NO: 433294 - DNA, 25 bp, Mus musculus
gaattctgccaggtaagtacatgat

SEQ ID NO: 433295 - DNA, 25 bp, Mus musculus
gaattctgctgctctcacacggtgg

SEQ ID NO: 433296 - DNA, 25 bp, Mus musculus
gaattctggaactctcttggaggga

SEQ ID NO: 433297 - DNA, 25 bp, Mus musculus
gaattctgggacagattcctcttta

SEQ ID NO: 433298 - DNA, 25 bp, Mus musculus
gaattctggtgcctctaaagcccct

SEQ ID NO: 433299 - DNA, 25 bp, Mus musculus
gaattctgtgatcactctcttcaga

SEQ ID NO: 433300 - DNA, 25 bp, Mus musculus
gaattcttacctgtgcttcagccca

SEQ ID NO: 433301 - DNA, 25 bp, Mus musculus
gaattcttactctgttgggaaacac

SEQ ID NO: 433302 - DNA, 25 bp, Mus musculus
gaattcttaggagcactttagtgaa

SEQ ID NO: 433303 - DNA, 25 bp, Mus musculus
gaattcttcgaatgtctgaccctga

SEQ ID NO: 433304 - DNA, 25 bp, Mus musculus
gaattctttatgaccagaccgggcg

SEQ ID NO: 433305 - DNA, 25 bp, Mus musculus
gaattcttttagttgggccaccagg

SEQ ID NO: 433306 - DNA, 25 bp, Mus musculus
gaattcttttatacttgccgaggcc

SEQ ID NO: 433307 - DNA, 25 bp, Mus musculus
gaattgaactcaaaataccaccaag

SEQ ID NO: 433308 - DNA, 25 bp, Mus musculus
gaattgaaggcctttgtccaacaac

SEQ ID NO: 433309 - DNA, 25 bp, Mus musculus
gaattgaagttggaagccctcaccc

SEQ ID NO: 433310 - DNA, 25 bp, Mus musculus
gaattgacaacgtctcagaagagcg

SEQ ID NO: 433311 - DNA, 25 bp, Mus musculus
gaattgacacagtgaagttcctaag

SEQ ID NO: 433312 - DNA, 25 bp, Mus musculus
gaattgacacggagaggcccatcat

SEQ ID NO: 433313 - DNA, 25 bp, Mus musculus
gaattgacctaatgacagactccag

SEQ ID NO: 433314 - DNA, 25 bp, Mus musculus
gaattgacctatctcgactgggaag

SEQ ID NO: 433315 - DNA, 25 bp, Mus musculus
gaattgactcggtcgcacagaggct

SEQ ID NO: 433316 - DNA, 25 bp, Mus musculus
gaattgattctgaaggccacgcagc

SEQ ID NO: 433317 - DNA, 25 bp, Mus musculus
gaattgcaaattcagggcctgcctg

SEQ ID NO: 433318 - DNA, 25 bp, Mus musculus
gaattgcacacccacgtctatcgaa

SEQ ID NO: 433319 - DNA, 25 bp, Mus musculus
gaattgcacagtcttgccaggagga

SEQ ID NO: 433320 - DNA, 25 bp, Mus musculus
gaattgcacatgtcaggaaagcgcc

SEQ ID NO: 433321 - DNA, 25 bp, Mus musculus
gaattgcacgtagctggtctccgat

SEQ ID NO: 433322 - DNA, 25 bp, Mus musculus
gaattgccacggatcactcacaaag

SEQ ID NO: 433323 - DNA, 25 bp, Mus musculus
gaattgccagctcgaaaactgagag

SEQ ID NO: 433324 - DNA, 25 bp, Mus musculus
gaattgcccagcctgtatgacgaca

SEQ ID NO: 433325 - DNA, 25 bp, Mus musculus
gaattgcctcccacaggctttcggg

SEQ ID NO: 433326 - DNA, 25 bp, Mus musculus
gaattgcgacgattggtccccactg

SEQ ID NO: 433327 - DNA, 25 bp, Mus musculus
gaattgctcagtactcaggagacca

SEQ ID NO: 433328 - DNA, 25 bp, Mus musculus
gaattgctcgatgccttttgcccct

SEQ ID NO: 433329 - DNA, 25 bp, Mus musculus
gaattgctgaggcacttctgaaagc

SEQ ID NO: 433330 - DNA, 25 bp, Mus musculus
gaattgctgattccaaggaccaggt

SEQ ID NO: 433331 - DNA, 25 bp, Mus musculus
gaattgctgcgagacaaacaagact

SEQ ID NO: 433332 - DNA, 25 bp, Mus musculus
gaattgctgctatggcctctgctga

SEQ ID NO: 433333 - DNA, 25 bp, Mus musculus
gaattgctttccatcttgtctaacc

SEQ ID NO: 433334 - DNA, 25 bp, Mus musculus
gaattggaactcttgcagtcaccca

SEQ ID NO: 433335 - DNA, 25 bp, Mus musculus
gaattggaagcttcatgccaggctg

SEQ ID NO: 433336 - DNA, 25 bp, Mus musculus
gaattggacaccttttacctattga

SEQ ID NO: 433337 - DNA, 25 bp, Mus musculus
gaattggagccttgcacaggacacc

SEQ ID NO: 433338 - DNA, 25 bp, Mus musculus
gaattggcaaatctgttaaaaaggc

SEQ ID NO: 433339 - DNA, 25 bp, Mus musculus
gaattggcatgaacgaaccgctggt

SEQ ID NO: 433340 - DNA, 25 bp, Mus musculus
gaattggcgctcacttcgagaggag

SEQ ID NO: 433341 - DNA, 25 bp, Mus musculus
gaattggctcatggactgtgtcggc

SEQ ID NO: 433342 - DNA, 25 bp, Mus musculus
gaattggctctctctgctctaggtg

SEQ ID NO: 433343 - DNA, 25 bp, Mus musculus
gaattggctggaagtctgcgctgtt

SEQ ID NO: 433344 - DNA, 25 bp, Mus musculus
gaattggcttctcgttgcactgctg

SEQ ID NO: 433345 - DNA, 25 bp, Mus musculus
gaattggcttgcatcctcagagaaa

SEQ ID NO: 433346 - DNA, 25 bp, Mus musculus
gaattggctttatcgacgagctgca

SEQ ID NO: 433347 - DNA, 25 bp, Mus musculus
gaattgggagtcacacagcactaag

SEQ ID NO: 433348 - DNA, 25 bp, Mus musculus
gaattggtcctggtaagctggttcc

SEQ ID NO: 433349 - DNA, 25 bp, Mus musculus
gaattggttaccagaagtccagcaa

SEQ ID NO: 433350 - DNA, 25 bp, Mus musculus
gaattggttccagtccgacagtaga

SEQ ID NO: 433351 - DNA, 25 bp, Mus musculus
gaattggttccatagatgctgttcg

SEQ ID NO: 433352 - DNA, 25 bp, Mus musculus
gaattgtaggtctacaccgccggct

SEQ ID NO: 433353 - DNA, 25 bp, Mus musculus
gaattgtaggttatttccccagcaa

SEQ ID NO: 433354 - DNA, 25 bp, Mus musculus
gaattgtagtctgagcaccctggaa

SEQ ID NO: 433355 - DNA, 25 bp, Mus musculus
gaattgtatgctataggctatcctg

SEQ ID NO: 433356 - DNA, 25 bp, Mus musculus
gaattgtatgtcacaaaggtggacc

SEQ ID NO: 433357 - DNA, 25 bp, Mus musculus
gaattgtccctgtgctgaggcctca

SEQ ID NO: 433358 - DNA, 25 bp, Mus musculus
gaattgtcctaagggtcaaggctga

SEQ ID NO: 433359 - DNA, 25 bp, Mus musculus
gaattgtcctacttgaacggagtac

SEQ ID NO: 433360 - DNA, 25 bp, Mus musculus
gaattgtctcagaatggtccccaag

SEQ ID NO: 433361 - DNA, 25 bp, Mus musculus
gaattgtgaccctgcattagctctg

SEQ ID NO: 433362 - DNA, 25 bp, Mus musculus
gaattgtgaccgagacacaccctgg

SEQ ID NO: 433363 - DNA, 25 bp, Mus musculus
gaattgtgagtctgcccctcaggga

SEQ ID NO: 433364 - DNA, 25 bp, Mus musculus
gaattgtgccagaatgccgaacggt

SEQ ID NO: 433365 - DNA, 25 bp, Mus musculus
gaattgtgtgtggagttaccgtacc

SEQ ID NO: 433366 - DNA, 25 bp, Mus musculus
gaattgttagtgtcctgtggtctct

SEQ ID NO: 433367 - DNA, 25 bp, Mus musculus
gaattgttcaagcaggctcctggag

SEQ ID NO: 433368 - DNA, 25 bp, Mus musculus
gaattgttcccttaacacgactagg

SEQ ID NO: 433369 - DNA, 25 bp, Mus musculus
gaattgttgccacatgccttggaag

SEQ ID NO: 433370 - DNA, 25 bp, Mus musculus
gaattgttgcttggccacctgactg

SEQ ID NO: 433371 - DNA, 25 bp, Mus musculus
gaatttaaacaagacatggcagccc

SEQ ID NO: 433372 - DNA, 25 bp, Mus musculus
gaatttaaaccccactgtgcactgg

SEQ ID NO: 433373 - DNA, 25 bp, Mus musculus
gaatttaaagccagcatcaacagag

SEQ ID NO: 433374 - DNA, 25 bp, Mus musculus
gaatttaacaccttgctccgggcag

SEQ ID NO: 433375 - DNA, 25 bp, Mus musculus
gaatttaagatggtcagctgccctg

SEQ ID NO: 433376 - DNA, 25 bp, Mus musculus
gaatttaagcacagaatcccagacc

SEQ ID NO: 433377 - DNA, 25 bp, Mus musculus
gaatttaagctagccctatccgtgt

SEQ ID NO: 433378 - DNA, 25 bp, Mus musculus
gaatttaaggaccagttgcctgctg

SEQ ID NO: 433379 - DNA, 25 bp, Mus musculus
gaatttacggtcagttcctcagtgg

SEQ ID NO: 433380 - DNA, 25 bp, Mus musculus
gaatttactcaaagccgccacagag

SEQ ID NO: 433381 - DNA, 25 bp, Mus musculus
gaatttagagctgccggtcaatccc

SEQ ID NO: 433382 - DNA, 25 bp, Mus musculus
gaatttagcaaaggatgtgcttgcc

SEQ ID NO: 433383 - DNA, 25 bp, Mus musculus
gaatttagtgctccttaccccatgg

SEQ ID NO: 433384 - DNA, 25 bp, Mus musculus
gaatttagtgttcagcctcctggga

SEQ ID NO: 433385 - DNA, 25 bp, Mus musculus
gaatttatatcccttcaggccatgg

SEQ ID NO: 433386 - DNA, 25 bp, Mus musculus
gaatttatcttcctgggcctcactg

SEQ ID NO: 433387 - DNA, 25 bp, Mus musculus
gaatttatgactatccgaggacaca

SEQ ID NO: 433388 - DNA, 25 bp, Mus musculus
gaatttatggaggtcaaaagcgccc

SEQ ID NO: 433389 - DNA, 25 bp, Mus musculus
gaatttcaccatcattcaccgccgt

SEQ ID NO: 433390 - DNA, 25 bp, Mus musculus
gaatttcaccgtgggtgcaccggca

SEQ ID NO: 433391 - DNA, 25 bp, Mus musculus
gaatttcactccagagacccaagag

SEQ ID NO: 433392 - DNA, 25 bp, Mus musculus
gaatttcagaagacggtgtccacca

SEQ ID NO: 433393 - DNA, 25 bp, Mus musculus
gaatttcagaagagagcaatgcaga

SEQ ID NO: 433394 - DNA, 25 bp, Mus musculus
gaatttcagcaagatcgccgaggag

SEQ ID NO: 433395 - DNA, 25 bp, Mus musculus
gaatttcagtcaacaccggagagct

SEQ ID NO: 433396 - DNA, 25 bp, Mus musculus
gaatttcattagtcaagggccaccc

SEQ ID NO: 433397 - DNA, 25 bp, Mus musculus
gaatttccaaaaatgcaccccgacg

SEQ ID NO: 433398 - DNA, 25 bp, Mus musculus
gaatttccagagatgaggctcagcg

SEQ ID NO: 433399 - DNA, 25 bp, Mus musculus
gaatttccagtccattctccacgtg

SEQ ID NO: 433400 - DNA, 25 bp, Mus musculus
gaatttccatacagacaagacggag

SEQ ID NO: 433401 - DNA, 25 bp, Mus musculus
gaatttcccagaaggcttagctcag

SEQ ID NO: 433402 - DNA, 25 bp, Mus musculus
gaatttcccagctgccactgacgag

SEQ ID NO: 433403 - DNA, 25 bp, Mus musculus
gaatttcccctcctggtgtttatgg

SEQ ID NO: 433404 - DNA, 25 bp, Mus musculus
gaatttccctacaaaccagaggtgg

SEQ ID NO: 433405 - DNA, 25 bp, Mus musculus
gaatttcctcatcaagtgcgacaga

SEQ ID NO: 433406 - DNA, 25 bp, Mus musculus
gaatttcctgccatggcttagacta

SEQ ID NO: 433407 - DNA, 25 bp, Mus musculus
gaatttcctgtgtatatgcctttag

SEQ ID NO: 433408 - DNA, 25 bp, Mus musculus
gaatttccttccttgtacttagttg

SEQ ID NO: 433409 - DNA, 25 bp, Mus musculus
gaatttcgacgagctcctcaaggcg

SEQ ID NO: 433410 - DNA, 25 bp, Mus musculus
gaatttcgagcgctgtatccgtctg

SEQ ID NO: 433411 - DNA, 25 bp, Mus musculus
gaatttcgatcccaactctgcgcct

SEQ ID NO: 433412 - DNA, 25 bp, Mus musculus
gaatttctctgctgtatccaaagga

SEQ ID NO: 433413 - DNA, 25 bp, Mus musculus
gaatttctctggatgccggcagcag

SEQ ID NO: 433414 - DNA, 25 bp, Mus musculus
gaatttgacaagttacctctttgga

SEQ ID NO: 433415 - DNA, 25 bp, Mus musculus
gaatttgaccctcagaatgccaggc

SEQ ID NO: 433416 - DNA, 25 bp, Mus musculus
gaatttgaccctcatggcagccttg

SEQ ID NO: 433417 - DNA, 25 bp, Mus musculus
gaatttgatctgctccgtgtgcgct

SEQ ID NO: 433418 - DNA, 25 bp, Mus musculus
gaatttgatgattcaaggccatcgt

SEQ ID NO: 433419 - DNA, 25 bp, Mus musculus
gaatttgattcaattgcccactgtg

SEQ ID NO: 433420 - DNA, 25 bp, Mus musculus
gaatttgcaagcctccacgccttgg

SEQ ID NO: 433421 - DNA, 25 bp, Mus musculus
gaatttgccaagaccgtgaagcgcc

SEQ ID NO: 433422 - DNA, 25 bp, Mus musculus
gaatttgcccaagccagcagctatg

SEQ ID NO: 433423 - DNA, 25 bp, Mus musculus
gaatttgccggatggtgctggccac

SEQ ID NO: 433424 - DNA, 25 bp, Mus musculus
gaatttgcttcggatgacggaccca

SEQ ID NO: 433425 - DNA, 25 bp, Mus musculus
gaatttggaccagaacgcagacctt

SEQ ID NO: 433426 - DNA, 25 bp, Mus musculus
gaatttggccactctctgggtctga

SEQ ID NO: 433427 - DNA, 25 bp, Mus musculus
gaatttgtcctgttgggcctctccg

SEQ ID NO: 433428 - DNA, 25 bp, Mus musculus
gaatttgtgcagaggttccgcagaa

SEQ ID NO: 433429 - DNA, 25 bp, Mus musculus
gaatttgtgttctgcagcaagaccc

SEQ ID NO: 433430 - DNA, 25 bp, Mus musculus
gaatttgttcctacctggaaacagc

SEQ ID NO: 433431 - DNA, 25 bp, Mus musculus
gaatttgttctgttggaatctggaa

SEQ ID NO: 433432 - DNA, 25 bp, Mus musculus
gaatttgttgtccagccccaaggtg

SEQ ID NO: 433433 - DNA, 25 bp, Mus musculus
gaattttacatcatctctggccctg

SEQ ID NO: 433434 - DNA, 25 bp, Mus musculus
gaattttaccctcgagactctgcaa

SEQ ID NO: 433435 - DNA, 25 bp, Mus musculus
gaattttactgtcgcagttgggccc

SEQ ID NO: 433436 - DNA, 25 bp, Mus musculus
gaattttaggtatttgaccgcatgg

SEQ ID NO: 433437 - DNA, 25 bp, Mus musculus
gaattttatagaagccaagttgtag

SEQ ID NO: 433438 - DNA, 25 bp, Mus musculus
gaattttattgtcttgttcctggac

SEQ ID NO: 433439 - DNA, 25 bp, Mus musculus
gaattttccaacatggacctccgag

SEQ ID NO: 433440 - DNA, 25 bp, Mus musculus
gaattttccccagcggacttcagtg

SEQ ID NO: 433441 - DNA, 25 bp, Mus musculus
gaattttctgctgccctacgtggga

SEQ ID NO: 433442 - DNA, 25 bp, Mus musculus
gaattttctggaagtccctacagcc

SEQ ID NO: 433443 - DNA, 25 bp, Mus musculus
gaattttgatcccatctgaagcccc

SEQ ID NO: 433444 - DNA, 25 bp, Mus musculus
gaattttgcacagaactgacaggga

SEQ ID NO: 433445 - DNA, 25 bp, Mus musculus
gaattttgcgagaagtgcctcacca

SEQ ID NO: 433446 - DNA, 25 bp, Mus musculus
gaattttgggtacacacttcggtca

SEQ ID NO: 433447 - DNA, 25 bp, Mus musculus
gaattttgtatgtggaaggctcgca

SEQ ID NO: 433448 - DNA, 25 bp, Mus musculus
gaatttttacctagtgaccacagtg

SEQ ID NO: 433449 - DNA, 25 bp, Mus musculus
gaatttttcatgctgggtctctccc

SEQ ID NO: 433450 - DNA, 25 bp, Mus musculus
gaatttttctgggagtgtgctacgt

SEQ ID NO: 433451 - DNA, 25 bp, Mus musculus
gaatttttgggttcccattgccaca

SEQ ID NO: 433452 - DNA, 25 bp, Mus musculus
gaatttttgtcactgagggaaagga

SEQ ID NO: 433453 - DNA, 25 bp, Mus musculus
gacaaaaaccgagatgagcagctga

SEQ ID NO: 433454 - DNA, 25 bp, Mus musculus
gacaaaagacaaataccgggtggtg

SEQ ID NO: 433455 - DNA, 25 bp, Mus musculus
gacaaaagccgagattacctgccgg

SEQ ID NO: 433456 - DNA, 25 bp, Mus musculus
gacaaaaggaactgcctggccaaag

SEQ ID NO: 433457 - DNA, 25 bp, Mus musculus
gacaaaatacctgtggccttgggcc

SEQ ID NO: 433458 - DNA, 25 bp, Mus musculus
gacaaaatccagatcctcaggcggg

SEQ ID NO: 433459 - DNA, 25 bp, Mus musculus
gacaaaatgtgcatggaaatcctct

SEQ ID NO: 433460 - DNA, 25 bp, Mus musculus
gacaaaattaaagtgtagtggagcc

SEQ ID NO: 433461 - DNA, 25 bp, Mus musculus
gacaaacaatccagaaaacgccaag

SEQ ID NO: 433462 - DNA, 25 bp, Mus musculus
gacaaacaccattagttacagtact

SEQ ID NO: 433463 - DNA, 25 bp, Mus musculus
gacaaacaggtatgggagaccacag

SEQ ID NO: 433464 - DNA, 25 bp, Mus musculus
gacaaaccaggcaggtgagcaaagc

SEQ ID NO: 433465 - DNA, 25 bp, Mus musculus
gacaaaccattcaggagaaagccat

SEQ ID NO: 433466 - DNA, 25 bp, Mus musculus
gacaaacccgtactgcctggtgatg

SEQ ID NO: 433467 - DNA, 25 bp, Mus musculus
gacaaacctatctctgtgtgccatg

SEQ ID NO: 433468 - DNA, 25 bp, Mus musculus
gacaaacctgtgttgcctctccaat

SEQ ID NO: 433469 - DNA, 25 bp, Mus musculus
gacaaactacccagcagacaaacct

SEQ ID NO: 433470 - DNA, 25 bp, Mus musculus
gacaaactagccaagcaggaacgca

SEQ ID NO: 433471 - DNA, 25 bp, Mus musculus
gacaaactagtcaggcaactgggtt

SEQ ID NO: 433472 - DNA, 25 bp, Mus musculus
gacaaactgtacatagcggacgcct

SEQ ID NO: 433473 - DNA, 25 bp, Mus musculus
gacaaacttttgcttgagagccagc

SEQ ID NO: 433474 - DNA, 25 bp, Mus musculus
gacaaagaaagcaacggcacagtca

SEQ ID NO: 433475 - DNA, 25 bp, Mus musculus
gacaaagatgaggatcgggaccgct

SEQ ID NO: 433476 - DNA, 25 bp, Mus musculus
gacaaagcagttccaattccagaga

SEQ ID NO: 433477 - DNA, 25 bp, Mus musculus
gacaaagccccgttgactaggagag

SEQ ID NO: 433478 - DNA, 25 bp, Mus musculus
gacaaagcccgtggtctgaagaaag

SEQ ID NO: 433479 - DNA, 25 bp, Mus musculus
gacaaagccgactacatgccagaga

SEQ ID NO: 433480 - DNA, 25 bp, Mus musculus
gacaaagccgtgaaatagatctcca

SEQ ID NO: 433481 - DNA, 25 bp, Mus musculus
gacaaagcctatgtacagaaagtca

SEQ ID NO: 433482 - DNA, 25 bp, Mus musculus
gacaaagcctgcgaaagtacctgcc

SEQ ID NO: 433483 - DNA, 25 bp, Mus musculus
gacaaagctgcatgccagtccgtgg

SEQ ID NO: 433484 - DNA, 25 bp, Mus musculus
gacaaaggcagcatgagcgacggac

SEQ ID NO: 433485 - DNA, 25 bp, Mus musculus
gacaaagggattcaaagccaccgac

SEQ ID NO: 433486 - DNA, 25 bp, Mus musculus
gacaaagggttctgacgactgggcc

SEQ ID NO: 433487 - DNA, 25 bp, Mus musculus
gacaaagtatgctacggaggaccac

SEQ ID NO: 433488 - DNA, 25 bp, Mus musculus
gacaaagtcccggaagaggaatact

SEQ ID NO: 433489 - DNA, 25 bp, Mus musculus
gacaaagttcctgaaaaacatggac

SEQ ID NO: 433490 - DNA, 25 bp, Mus musculus
gacaaatacgaggtctgcatccgcc

SEQ ID NO: 433491 - DNA, 25 bp, Mus musculus
gacaaatatgccttgctgcagaggg

SEQ ID NO: 433492 - DNA, 25 bp, Mus musculus
gacaaatgaattcctgcaggcccgg

SEQ ID NO: 433493 - DNA, 25 bp, Mus musculus
gacaaatgagaagcatgaccatggc

SEQ ID NO: 433494 - DNA, 25 bp, Mus musculus
gacaaatgatgccaacttccgagag

SEQ ID NO: 433495 - DNA, 25 bp, Mus musculus
gacaaatgggtcatgcaagcccgtg

SEQ ID NO: 433496 - DNA, 25 bp, Mus musculus
gacaaatggtccctgctcctgagtg

SEQ ID NO: 433497 - DNA, 25 bp, Mus musculus
gacaaatgtgtcaccagcgagctcc

SEQ ID NO: 433498 - DNA, 25 bp, Mus musculus
gacaaatgttgaatcgtgctgacta

SEQ ID NO: 433499 - DNA, 25 bp, Mus musculus
gacaaattggtgagtcccacggaca

SEQ ID NO: 433500 - DNA, 25 bp, Mus musculus
gacaacaaaggcatagagagattgg

SEQ ID NO: 433501 - DNA, 25 bp, Mus musculus
gacaacaaagtttacggacgctggg

SEQ ID NO: 433502 - DNA, 25 bp, Mus musculus
gacaacaactcaccaagcaaccatt

SEQ ID NO: 433503 - DNA, 25 bp, Mus musculus
gacaacaattcagaccccagatgga

SEQ ID NO: 433504 - DNA, 25 bp, Mus musculus
gacaacacacgatggctggaggcct

SEQ ID NO: 433505 - DNA, 25 bp, Mus musculus
gacaacacatttgagtgccaattcg

SEQ ID NO: 433506 - DNA, 25 bp, Mus musculus
gacaacaccatcatgcacatggcga

SEQ ID NO: 433507 - DNA, 25 bp, Mus musculus
gacaacacctttcgagacctgggca

SEQ ID NO: 433508 - DNA, 25 bp, Mus musculus
gacaacagacccatcttccgggaag

SEQ ID NO: 433509 - DNA, 25 bp, Mus musculus
gacaacagcgttgcaaacaatctat

SEQ ID NO: 433510 - DNA, 25 bp, Mus musculus
gacaacagtgcaattaaatgacaat

SEQ ID NO: 433511 - DNA, 25 bp, Mus musculus
gacaacatcatgacgtcgctgcggg

SEQ ID NO: 433512 - DNA, 25 bp, Mus musculus
gacaacatgacccatttaatggtgg

SEQ ID NO: 433513 - DNA, 25 bp, Mus musculus
gacaacatgtacagccaagagcctt

SEQ ID NO: 433514 - DNA, 25 bp, Mus musculus
gacaacattaaagcatataccacat

SEQ ID NO: 433515 - DNA, 25 bp, Mus musculus
gacaacattgtcatcggcgctggat

SEQ ID NO: 433516 - DNA, 25 bp, Mus musculus
gacaaccacagatcatttagcgaca

SEQ ID NO: 433517 - DNA, 25 bp, Mus musculus
gacaaccagtgtacagcagcctaaa

SEQ ID NO: 433518 - DNA, 25 bp, Mus musculus
gacaaccgtatgagctgcacagtga

SEQ ID NO: 433519 - DNA, 25 bp, Mus musculus
gacaacctaaaggaccgtaggcctg

SEQ ID NO: 433520 - DNA, 25 bp, Mus musculus
gacaacctcaagtacagcagcaagt

SEQ ID NO: 433521 - DNA, 25 bp, Mus musculus
gacaacctcctaaatgcctggcgga

SEQ ID NO: 433522 - DNA, 25 bp, Mus musculus
gacaacctgcaagagagagctgtgc

SEQ ID NO: 433523 - DNA, 25 bp, Mus musculus
gacaacctgctgagtccggaggact

SEQ ID NO: 433524 - DNA, 25 bp, Mus musculus
gacaaccttgctgctacggacgatg

SEQ ID NO: 433525 - DNA, 25 bp, Mus musculus
gacaacgagtgtatgaggaacccct

SEQ ID NO: 433526 - DNA, 25 bp, Mus musculus
gacaacggaacttctccaggaggag

SEQ ID NO: 433527 - DNA, 25 bp, Mus musculus
gacaacggcactttcacatgtgatg

SEQ ID NO: 433528 - DNA, 25 bp, Mus musculus
gacaacggccttctcgatgaggaca

SEQ ID NO: 433529 - DNA, 25 bp, Mus musculus
gacaacggctaagcagctactatag

SEQ ID NO: 433530 - DNA, 25 bp, Mus musculus
gacaacgtcctttcagccatgatgg

SEQ ID NO: 433531 - DNA, 25 bp, Mus musculus
gacaactaccatgctggcactgggt

SEQ ID NO: 433532 - DNA, 25 bp, Mus musculus
gacaactatcaagttcgcaccagca

SEQ ID NO: 433533 - DNA, 25 bp, Mus musculus
gacaactctgctgtgttttaggacc

SEQ ID NO: 433534 - DNA, 25 bp, Mus musculus
gacaactctggatctcacggacggt

SEQ ID NO: 433535 - DNA, 25 bp, Mus musculus
gacaactgatatcggaggagctaca

SEQ ID NO: 433536 - DNA, 25 bp, Mus musculus
gacaactgatggtcaacggcaaaga

SEQ ID NO: 433537 - DNA, 25 bp, Mus musculus
gacaactgcctgctggatccagaag

SEQ ID NO: 433538 - DNA, 25 bp, Mus musculus
gacaactgccttcaggatgagcaag

SEQ ID NO: 433539 - DNA, 25 bp, Mus musculus
gacaactggaaacgagtatctcccc

SEQ ID NO: 433540 - DNA, 25 bp, Mus musculus
gacaactgggatgagagctatgact

SEQ ID NO: 433541 - DNA, 25 bp, Mus musculus
gacaactgggtgtactgggccatgc

SEQ ID NO: 433542 - DNA, 25 bp, Mus musculus
gacaactgtgaagtaacccatagac

SEQ ID NO: 433543 - DNA, 25 bp, Mus musculus
gacaactgtgacttctcctggagag

SEQ ID NO: 433544 - DNA, 25 bp, Mus musculus
gacaactgttcagagagtcaccagc

SEQ ID NO: 433545 - DNA, 25 bp, Mus musculus
gacaacttcgcttggctctccaggg

SEQ ID NO: 433546 - DNA, 25 bp, Mus musculus
gacaacttcttgacagcccatcacg

SEQ ID NO: 433547 - DNA, 25 bp, Mus musculus
gacaacttgaaaagaaccggcgcgg

SEQ ID NO: 433548 - DNA, 25 bp, Mus musculus
gacaacttgaatgggaacggaaccg

SEQ ID NO: 433549 - DNA, 25 bp, Mus musculus
gacaacttgattgtggccccaggaa

SEQ ID NO: 433550 - DNA, 25 bp, Mus musculus
gacaactttcctgtgggcaccatgg

SEQ ID NO: 433551 - DNA, 25 bp, Mus musculus
gacaactttgcacaggacctcggca

SEQ ID NO: 433552 - DNA, 25 bp, Mus musculus
gacaactttggccatgtcatccgag

SEQ ID NO: 433553 - DNA, 25 bp, Mus musculus
gacaagaaacttgcacgatcgcgcc

SEQ ID NO: 433554 - DNA, 25 bp, Mus musculus
gacaagaaagtgaagcgcgtctacc

SEQ ID NO: 433555 - DNA, 25 bp, Mus musculus
gacaagaagattgagcgctggcacc

SEQ ID NO: 433556 - DNA, 25 bp, Mus musculus
gacaagaagccatactgccgaaagg

SEQ ID NO: 433557 - DNA, 25 bp, Mus musculus
gacaagaagggcgatgctactcccg

SEQ ID NO: 433558 - DNA, 25 bp, Mus musculus
gacaagacagtgacaaacatgtgca

SEQ ID NO: 433559 - DNA, 25 bp, Mus musculus
gacaagacatcaactgtgcctcata

SEQ ID NO: 433560 - DNA, 25 bp, Mus musculus
gacaagacatcatgggcacaccagt

SEQ ID NO: 433561 - DNA, 25 bp, Mus musculus
gacaagaccatgaacgcgaggagca

SEQ ID NO: 433562 - DNA, 25 bp, Mus musculus
gacaagacccattttggccgcctgg

SEQ ID NO: 433563 - DNA, 25 bp, Mus musculus
gacaagaccgatttgctggcctcca

SEQ ID NO: 433564 - DNA, 25 bp, Mus musculus
gacaagacctactcatgtagcctag

SEQ ID NO: 433565 - DNA, 25 bp, Mus musculus
gacaagacctgtaaactctggagtg

SEQ ID NO: 433566 - DNA, 25 bp, Mus musculus
gacaagactgccgtgctcacgttga

SEQ ID NO: 433567 - DNA, 25 bp, Mus musculus
gacaagagcaagcttacccttaaaa

SEQ ID NO: 433568 - DNA, 25 bp, Mus musculus
gacaagagcggcctggacaagtatc

SEQ ID NO: 433569 - DNA, 25 bp, Mus musculus
gacaagaggagcttttgccactgac

SEQ ID NO: 433570 - DNA, 25 bp, Mus musculus
gacaagagtcatgtcagccccatca

SEQ ID NO: 433571 - DNA, 25 bp, Mus musculus
gacaagagtctcatgttccaacaat

SEQ ID NO: 433572 - DNA, 25 bp, Mus musculus
gacaagagtgagaaggaagctgcta

SEQ ID NO: 433573 - DNA, 25 bp, Mus musculus
gacaagagttctgcgctgttcgacc

SEQ ID NO: 433574 - DNA, 25 bp, Mus musculus
gacaagagttcttcgtagacttccg

SEQ ID NO: 433575 - DNA, 25 bp, Mus musculus
gacaagagtttattaccgggaagct

SEQ ID NO: 433576 - DNA, 25 bp, Mus musculus
gacaagatacttttaccacggccga

SEQ ID NO: 433577 - DNA, 25 bp, Mus musculus
gacaagataggagcccagcttcgag

SEQ ID NO: 433578 - DNA, 25 bp, Mus musculus
gacaagatcaacagtctgcagctgg

SEQ ID NO: 433579 - DNA, 25 bp, Mus musculus
gacaagatccacaccttctgggaga

SEQ ID NO: 433580 - DNA, 25 bp, Mus musculus
gacaagatgaacaacaatatcggcg

SEQ ID NO: 433581 - DNA, 25 bp, Mus musculus
gacaagatgagcttcacaactcgct

SEQ ID NO: 433582 - DNA, 25 bp, Mus musculus
gacaagcaagagcatggccgagtta

SEQ ID NO: 433583 - DNA, 25 bp, Mus musculus
gacaagcactttcaagccagagcat

SEQ ID NO: 433584 - DNA, 25 bp, Mus musculus
gacaagcatccacagcattttccgg

SEQ ID NO: 433585 - DNA, 25 bp, Mus musculus
gacaagccattttgggagaccatcc

SEQ ID NO: 433586 - DNA, 25 bp, Mus musculus
gacaagcccctgatcaaggacttga

SEQ ID NO: 433587 - DNA, 25 bp, Mus musculus
gacaagcccggcactaagaagtctt

SEQ ID NO: 433588 - DNA, 25 bp, Mus musculus
gacaagccctggacaagactgtcag

SEQ ID NO: 433589 - DNA, 25 bp, Mus musculus
gacaagcccttctctgatcacgagg

SEQ ID NO: 433590 - DNA, 25 bp, Mus musculus
gacaagccggaacatgttacagccc

SEQ ID NO: 433591 - DNA, 25 bp, Mus musculus
gacaagcctgctggtagtacactgg

SEQ ID NO: 433592 - DNA, 25 bp, Mus musculus
gacaagccttagatggtgtttccat

SEQ ID NO: 433593 - DNA, 25 bp, Mus musculus
gacaagccttctactcatggaacca

SEQ ID NO: 433594 - DNA, 25 bp, Mus musculus
gacaagcctttacacctttggagag

SEQ ID NO: 433595 - DNA, 25 bp, Mus musculus
gacaagcggaggtcccagctgaaat

SEQ ID NO: 433596 - DNA, 25 bp, Mus musculus
gacaagctaactatccaagcagtga

SEQ ID NO: 433597 - DNA, 25 bp, Mus musculus
gacaagctagtggaaagatctcgga

SEQ ID NO: 433598 - DNA, 25 bp, Mus musculus
gacaagctgaacaacataatgcgcc

SEQ ID NO: 433599 - DNA, 25 bp, Mus musculus
gacaagctgagcgacgagtacaaga

SEQ ID NO: 433600 - DNA, 25 bp, Mus musculus
gacaagctgccacttaagagggaca

SEQ ID NO: 433601 - DNA, 25 bp, Mus musculus
gacaagctggctaacgagaagacgg

SEQ ID NO: 433602 - DNA, 25 bp, Mus musculus
gacaagctgggacctgactcagaga

SEQ ID NO: 433603 - DNA, 25 bp, Mus musculus
gacaagcttatcgaccaagtcaacg

SEQ ID NO: 433604 - DNA, 25 bp, Mus musculus
gacaagctttctcagattgagctaa

SEQ ID NO: 433605 - DNA, 25 bp, Mus musculus
gacaaggacatgaagtaaacaccac

SEQ ID NO: 433606 - DNA, 25 bp, Mus musculus
gacaaggagagatctctagccatca

SEQ ID NO: 433607 - DNA, 25 bp, Mus musculus
gacaaggaggatttatcccggcaaa

SEQ ID NO: 433608 - DNA, 25 bp, Mus musculus
gacaaggatgagattcgccactgga

SEQ ID NO: 433609 - DNA, 25 bp, Mus musculus
gacaaggattcctgcagctggctcc

SEQ ID NO: 433610 - DNA, 25 bp, Mus musculus
gacaaggcaatacgaagcagcgcat

SEQ ID NO: 433611 - DNA, 25 bp, Mus musculus
gacaaggcagaaggctgcctaccca

SEQ ID NO: 433612 - DNA, 25 bp, Mus musculus
gacaaggccatcatgatgtatcaca

SEQ ID NO: 433613 - DNA, 25 bp, Mus musculus
gacaaggccatgctgataatgacca

SEQ ID NO: 433614 - DNA, 25 bp, Mus musculus
gacaaggccgtctggttaaacagca

SEQ ID NO: 433615 - DNA, 25 bp, Mus musculus
gacaaggcctatgtgacttcccaga

SEQ ID NO: 433616 - DNA, 25 bp, Mus musculus
gacaaggcgctgcacttctacacgt

SEQ ID NO: 433617 - DNA, 25 bp, Mus musculus
gacaaggcggccattcagctaagtg

SEQ ID NO: 433618 - DNA, 25 bp, Mus musculus
gacaaggcggtagaactcaacatga

SEQ ID NO: 433619 - DNA, 25 bp, Mus musculus
gacaaggcgtccatcgtgcgtctta

SEQ ID NO: 433620 - DNA, 25 bp, Mus musculus
gacaaggctgctctgtagatctgaa

SEQ ID NO: 433621 - DNA, 25 bp, Mus musculus
gacaaggctgctgccgtctctggaa

SEQ ID NO: 433622 - DNA, 25 bp, Mus musculus
gacaaggctgtcattgagtttgaga

SEQ ID NO: 433623 - DNA, 25 bp, Mus musculus
gacaaggctgtttcgggtcatacca

SEQ ID NO: 433624 - DNA, 25 bp, Mus musculus
gacaaggctttcgaggtggccaaaa

SEQ ID NO: 433625 - DNA, 25 bp, Mus musculus
gacaagggccatgtaagtgagcaca

SEQ ID NO: 433626 - DNA, 25 bp, Mus musculus
gacaagggtccaaacatgaagtgct

SEQ ID NO: 433627 - DNA, 25 bp, Mus musculus
gacaaggtaccgaaactggcgtgct

SEQ ID NO: 433628 - DNA, 25 bp, Mus musculus
gacaaggtatatgagagatcccact

SEQ ID NO: 433629 - DNA, 25 bp, Mus musculus
gacaaggtcctcttgggtggcactg

SEQ ID NO: 433630 - DNA, 25 bp, Mus musculus
gacaaggtcttccaaagaggtctag

SEQ ID NO: 433631 - DNA, 25 bp, Mus musculus
gacaaggtcttccatatcccaggct

SEQ ID NO: 433632 - DNA, 25 bp, Mus musculus
gacaaggttcttcatgctgcattta

SEQ ID NO: 433633 - DNA, 25 bp, Mus musculus
gacaaggttgactttatcacacgac

SEQ ID NO: 433634 - DNA, 25 bp, Mus musculus
gacaagtatcgaaaccagctccagc

SEQ ID NO: 433635 - DNA, 25 bp, Mus musculus
gacaagtatcgctcggtgatccggc

SEQ ID NO: 433636 - DNA, 25 bp, Mus musculus
gacaagtccatcaccgtgcaggagc

SEQ ID NO: 433637 - DNA, 25 bp, Mus musculus
gacaagtccgtggtcagctgatgaa

SEQ ID NO: 433638 - DNA, 25 bp, Mus musculus
gacaagtcgaagagtgaggccatca

SEQ ID NO: 433639 - DNA, 25 bp, Mus musculus
gacaagtctcagctaggaagacacg

SEQ ID NO: 433640 - DNA, 25 bp, Mus musculus
gacaagtctcctaggaaagccggta

SEQ ID NO: 433641 - DNA, 25 bp, Mus musculus
gacaagtctgacgaggccgactgct

SEQ ID NO: 433642 - DNA, 25 bp, Mus musculus
gacaagtcttatgagcccgaggtga

SEQ ID NO: 433643 - DNA, 25 bp, Mus musculus
gacaagtgacaaagaagggccttca

SEQ ID NO: 433644 - DNA, 25 bp, Mus musculus
gacaagtgagcagaagattccggcc

SEQ ID NO: 433645 - DNA, 25 bp, Mus musculus
gacaagtgagtcatcctaggaacaa

SEQ ID NO: 433646 - DNA, 25 bp, Mus musculus
gacaagtgctacgtgattcctctga

SEQ ID NO: 433647 - DNA, 25 bp, Mus musculus
gacaagtgctctgcctggttacaca

SEQ ID NO: 433648 - DNA, 25 bp, Mus musculus
gacaagtggactttcacagctgtga

SEQ ID NO: 433649 - DNA, 25 bp, Mus musculus
gacaagtggcctcatactgcaacca

SEQ ID NO: 433650 - DNA, 25 bp, Mus musculus
gacaagtgtcctggctctaggagcc

SEQ ID NO: 433651 - DNA, 25 bp, Mus musculus
gacaagtgtctactcagcactgcca

SEQ ID NO: 433652 - DNA, 25 bp, Mus musculus
gacaagttctccaagtgtggcgtga

SEQ ID NO: 433653 - DNA, 25 bp, Mus musculus
gacaagttgtctgccggagtctagg

SEQ ID NO: 433654 - DNA, 25 bp, Mus musculus
gacaagtttgactgttacaagtgcc

SEQ ID NO: 433655 - DNA, 25 bp, Mus musculus
gacaagttttctgatcctctgacca

SEQ ID NO: 433656 - DNA, 25 bp, Mus musculus
gacaataaaggcaaagttctcctga

SEQ ID NO: 433657 - DNA, 25 bp, Mus musculus
gacaataagatgaccagctgcagct

SEQ ID NO: 433658 - DNA, 25 bp, Mus musculus
gacaataccttctgcagactggaga

SEQ ID NO: 433659 - DNA, 25 bp, Mus musculus
gacaatacgagctcaaccagtggga

SEQ ID NO: 433660 - DNA, 25 bp, Mus musculus
gacaatacttgcctgtgcgtgccca

SEQ ID NO: 433661 - DNA, 25 bp, Mus musculus
gacaatagcattcagtgttgattcc

SEQ ID NO: 433662 - DNA, 25 bp, Mus musculus
gacaatagtcttccttggctccgag

SEQ ID NO: 433663 - DNA, 25 bp, Mus musculus
gacaatatgaccttcacagagaggg

SEQ ID NO: 433664 - DNA, 25 bp, Mus musculus
gacaatatgcaagaggtctttaaga

SEQ ID NO: 433665 - DNA, 25 bp, Mus musculus
gacaatcaaaagtcacagtccgtgg

SEQ ID NO: 433666 - DNA, 25 bp, Mus musculus
gacaatcacctttgagagagcagga

SEQ ID NO: 433667 - DNA, 25 bp, Mus musculus
gacaatcacgtccttccatgagctg

SEQ ID NO: 433668 - DNA, 25 bp, Mus musculus
gacaatcagatctcgtttcagtaga

SEQ ID NO: 433669 - DNA, 25 bp, Mus musculus
gacaatccaaagaaatgccagcagg

SEQ ID NO: 433670 - DNA, 25 bp, Mus musculus
gacaatcccacgctggacgtggcca

SEQ ID NO: 433671 - DNA, 25 bp, Mus musculus
gacaatcctcttcatgggccaagtg

SEQ ID NO: 433672 - DNA, 25 bp, Mus musculus
gacaatcctgatcgtgcaagctcag

SEQ ID NO: 433673 - DNA, 25 bp, Mus musculus
gacaatcgcatcagtgggccttcaa

SEQ ID NO: 433674 - DNA, 25 bp, Mus musculus
gacaatctgtcttcatgccactgcc

SEQ ID NO: 433675 - DNA, 25 bp, Mus musculus
gacaatgaaggtcagttgctgctcc

SEQ ID NO: 433676 - DNA, 25 bp, Mus musculus
gacaatgactgggaggatttggact

SEQ ID NO: 433677 - DNA, 25 bp, Mus musculus
gacaatgagaagaggatccggctac

SEQ ID NO: 433678 - DNA, 25 bp, Mus musculus
gacaatgaggacgatggaagcgacc

SEQ ID NO: 433679 - DNA, 25 bp, Mus musculus
gacaatgaggagagttcaagctgac

SEQ ID NO: 433680 - DNA, 25 bp, Mus musculus
gacaatgaggtttctacgatctgtg

SEQ ID NO: 433681 - DNA, 25 bp, Mus musculus
gacaatgatgtctgggagcagagaa

SEQ ID NO: 433682 - DNA, 25 bp, Mus musculus
gacaatgcaattaacttcgaggagt

SEQ ID NO: 433683 - DNA, 25 bp, Mus musculus
gacaatgcacctggtcgaacctggg

SEQ ID NO: 433684 - DNA, 25 bp, Mus musculus
gacaatgccaaggagtacaccagga

SEQ ID NO: 433685 - DNA, 25 bp, Mus musculus
gacaatgccctgctgacaagaagag

SEQ ID NO: 433686 - DNA, 25 bp, Mus musculus
gacaatgccgttagcgaagagccct

SEQ ID NO: 433687 - DNA, 25 bp, Mus musculus
gacaatgcctggtggtaagaaccta

SEQ ID NO: 433688 - DNA, 25 bp, Mus musculus
gacaatgcctttaaagatccaggag

SEQ ID NO: 433689 - DNA, 25 bp, Mus musculus
gacaatgctaactgtccaagtctac

SEQ ID NO: 433690 - DNA, 25 bp, Mus musculus
gacaatgctcaccacgtacctggag

SEQ ID NO: 433691 - DNA, 25 bp, Mus musculus
gacaatggacttcatcccaccgagg

SEQ ID NO: 433692 - DNA, 25 bp, Mus musculus
gacaatggccctcctgtctactggg

SEQ ID NO: 433693 - DNA, 25 bp, Mus musculus
gacaatggccttccagatgttagca

SEQ ID NO: 433694 - DNA, 25 bp, Mus musculus
gacaatggctctggcctgtgcaagg

SEQ ID NO: 433695 - DNA, 25 bp, Mus musculus
gacaatggctgaccggattctgacc

SEQ ID NO: 433696 - DNA, 25 bp, Mus musculus
gacaatgggacatacacctgccagg

SEQ ID NO: 433697 - DNA, 25 bp, Mus musculus
gacaatgggatctctcagtgggcag

SEQ ID NO: 433698 - DNA, 25 bp, Mus musculus
gacaatgggcatctgttcatccgag

SEQ ID NO: 433699 - DNA, 25 bp, Mus musculus
gacaatgtactgctagactctgaag

SEQ ID NO: 433700 - DNA, 25 bp, Mus musculus
gacaatgtgattggcctaattcctg

SEQ ID NO: 433701 - DNA, 25 bp, Mus musculus
gacaattaaaattgcccttgggcgc

SEQ ID NO: 433702 - DNA, 25 bp, Mus musculus
gacaattccagctcaaaggttacct

SEQ ID NO: 433703 - DNA, 25 bp, Mus musculus
gacaattccatcaagacatcaaagt

SEQ ID NO: 433704 - DNA, 25 bp, Mus musculus
gacaattccatgaagatcccgctga

SEQ ID NO: 433705 - DNA, 25 bp, Mus musculus
gacaattctgcacttggtagcacac

SEQ ID NO: 433706 - DNA, 25 bp, Mus musculus
gacaattgcattcatggcgcctgag

SEQ ID NO: 433707 - DNA, 25 bp, Mus musculus
gacaattgcccgctggttcgaaacc

SEQ ID NO: 433708 - DNA, 25 bp, Mus musculus
gacaatttatgacttcgggttccca

SEQ ID NO: 433709 - DNA, 25 bp, Mus musculus
gacaatttggatctcgctggcctca

SEQ ID NO: 433710 - DNA, 25 bp, Mus musculus
gacaatttggcgactctcagagaaa

SEQ ID NO: 433711 - DNA, 25 bp, Mus musculus
gacaatttgtactgacttgctcgct

SEQ ID NO: 433712 - DNA, 25 bp, Mus musculus
gacacaaaatcagctacgttgcgag

SEQ ID NO: 433713 - DNA, 25 bp, Mus musculus
gacacaacagagatgcaaatgcgcc

SEQ ID NO: 433714 - DNA, 25 bp, Mus musculus
gacacaaggaagtagcatggctcca

SEQ ID NO: 433715 - DNA, 25 bp, Mus musculus
gacacaagtaaggacccatgggcac

SEQ ID NO: 433716 - DNA, 25 bp, Mus musculus
gacacaagtcgccataggaggatca

SEQ ID NO: 433717 - DNA, 25 bp, Mus musculus
gacacaataagtccctactcgcgga

SEQ ID NO: 433718 - DNA, 25 bp, Mus musculus
gacacaatatacctgttgattttga

SEQ ID NO: 433719 - DNA, 25 bp, Mus musculus
gacacaatctctgtccttggtgtgg

SEQ ID NO: 433720 - DNA, 25 bp, Mus musculus
gacacaatgccgagggttcaatctg

SEQ ID NO: 433721 - DNA, 25 bp, Mus musculus
gacacaatggaaaatgggactctct

SEQ ID NO: 433722 - DNA, 25 bp, Mus musculus
gacacaatggtttgccaggacagcc

SEQ ID NO: 433723 - DNA, 25 bp, Mus musculus
gacacaatttgtagagaccccggca

SEQ ID NO: 433724 - DNA, 25 bp, Mus musculus
gacacaattttgagaactcaagaga

SEQ ID NO: 433725 - DNA, 25 bp, Mus musculus
gacacacaacagacctcctacaagg

SEQ ID NO: 433726 - DNA, 25 bp, Mus musculus
gacacacaagggtacactctgagct

SEQ ID NO: 433727 - DNA, 25 bp, Mus musculus
gacacacacgctgaaataaagacca

SEQ ID NO: 433728 - DNA, 25 bp, Mus musculus
gacacacacgggttactggtacctg

SEQ ID NO: 433729 - DNA, 25 bp, Mus musculus
gacacacactccagaacagatggta

SEQ ID NO: 433730 - DNA, 25 bp, Mus musculus
gacacacactgcagctctagagagg

SEQ ID NO: 433731 - DNA, 25 bp, Mus musculus
gacacacagacgtagaaaatgagaa

SEQ ID NO: 433732 - DNA, 25 bp, Mus musculus
gacacacatatgtaagagagtcagc

SEQ ID NO: 433733 - DNA, 25 bp, Mus musculus
gacacacattggatgactgcagaga

SEQ ID NO: 433734 - DNA, 25 bp, Mus musculus
gacacacgcgtgctctcattaatga

SEQ ID NO: 433735 - DNA, 25 bp, Mus musculus
gacacactatcgactgcgggaggct

SEQ ID NO: 433736 - DNA, 25 bp, Mus musculus
gacacactctcacgagcatcagatg

SEQ ID NO: 433737 - DNA, 25 bp, Mus musculus
gacacactcttagagagcttgaagc

SEQ ID NO: 433738 - DNA, 25 bp, Mus musculus
gacacactgaacatgccccagtttg

SEQ ID NO: 433739 - DNA, 25 bp, Mus musculus
gacacactgcttgtcctgcctagag

SEQ ID NO: 433740 - DNA, 25 bp, Mus musculus
gacacactgtaaaatctggagacct

SEQ ID NO: 433741 - DNA, 25 bp, Mus musculus
gacacactgttgactggagacacca

SEQ ID NO: 433742 - DNA, 25 bp, Mus musculus
gacacacttctcctcaccgtgatgg

SEQ ID NO: 433743 - DNA, 25 bp, Mus musculus
gacacagacgtgttttccagggagc

SEQ ID NO: 433744 - DNA, 25 bp, Mus musculus
gacacagactggaccttagagcatt

SEQ ID NO: 433745 - DNA, 25 bp, Mus musculus
gacacagactgtggtgatgcaccgt

SEQ ID NO: 433746 - DNA, 25 bp, Mus musculus
gacacagagaagagtccgcacgaac

SEQ ID NO: 433747 - DNA, 25 bp, Mus musculus
gacacagagattagactagcaggac

SEQ ID NO: 433748 - DNA, 25 bp, Mus musculus
gacacagagctgattctgtacaccc

SEQ ID NO: 433749 - DNA, 25 bp, Mus musculus
gacacagagggaggcaaaacagcta

SEQ ID NO: 433750 - DNA, 25 bp, Mus musculus
gacacagagtctcataatctccttg

SEQ ID NO: 433751 - DNA, 25 bp, Mus musculus
gacacagatccccacagtgagagga

SEQ ID NO: 433752 - DNA, 25 bp, Mus musculus
gacacagcaaggactcactgtatgg

SEQ ID NO: 433753 - DNA, 25 bp, Mus musculus
gacacagcatggactcaagcccatg

SEQ ID NO: 433754 - DNA, 25 bp, Mus musculus
gacacagccatgaagaaacacgcag

SEQ ID NO: 433755 - DNA, 25 bp, Mus musculus
gacacagcccattgcgagaagtgag

SEQ ID NO: 433756 - DNA, 25 bp, Mus musculus
gacacagccgcagtgttggccataa

SEQ ID NO: 433757 - DNA, 25 bp, Mus musculus
gacacagcgttggaagcctcttcgg

SEQ ID NO: 433758 - DNA, 25 bp, Mus musculus
gacacagctatcagcgaggaggcca

SEQ ID NO: 433759 - DNA, 25 bp, Mus musculus
gacacagctgcttcgagccatagaa

SEQ ID NO: 433760 - DNA, 25 bp, Mus musculus
gacacaggacagctgtttgctcatc

SEQ ID NO: 433761 - DNA, 25 bp, Mus musculus
gacacaggctatctttttctcagct

SEQ ID NO: 433762 - DNA, 25 bp, Mus musculus
gacacaggctgcgtactctgcaaaa

SEQ ID NO: 433763 - DNA, 25 bp, Mus musculus
gacacagggaacttgagctggcact

SEQ ID NO: 433764 - DNA, 25 bp, Mus musculus
gacacagggccagtaggagcaatag

SEQ ID NO: 433765 - DNA, 25 bp, Mus musculus
gacacagggcctcttataacacagg

SEQ ID NO: 433766 - DNA, 25 bp, Mus musculus
gacacagggtgaagacagctcgtca

SEQ ID NO: 433767 - DNA, 25 bp, Mus musculus
gacacagggtgccatttccaaggaa

SEQ ID NO: 433768 - DNA, 25 bp, Mus musculus
gacacagggtttccgtaggcttcac

SEQ ID NO: 433769 - DNA, 25 bp, Mus musculus
gacacaggtctgcagcacatagcct

SEQ ID NO: 433770 - DNA, 25 bp, Mus musculus
gacacaggttctttctcgagagaga

SEQ ID NO: 433771 - DNA, 25 bp, Mus musculus
gacacagtaagctagaggaccactc

SEQ ID NO: 433772 - DNA, 25 bp, Mus musculus
gacacagtcaaaggctcagaccaac

SEQ ID NO: 433773 - DNA, 25 bp, Mus musculus
gacacagtccgctggaagatcacca

SEQ ID NO: 433774 - DNA, 25 bp, Mus musculus
gacacagtcctcaaaaactcctcag

SEQ ID NO: 433775 - DNA, 25 bp, Mus musculus
gacacagtgaagctataccaggaag

SEQ ID NO: 433776 - DNA, 25 bp, Mus musculus
gacacagtggagcaatacatctgcc

SEQ ID NO: 433777 - DNA, 25 bp, Mus musculus
gacacagtggctatcatcttctgct

SEQ ID NO: 433778 - DNA, 25 bp, Mus musculus
gacacataaaaacacacatctagag

SEQ ID NO: 433779 - DNA, 25 bp, Mus musculus
gacacatatactacacagggagagt

SEQ ID NO: 433780 - DNA, 25 bp, Mus musculus
gacacatatctgctggacaaaccca

SEQ ID NO: 433781 - DNA, 25 bp, Mus musculus
gacacatatgtcattggcctgctgg

SEQ ID NO: 433782 - DNA, 25 bp, Mus musculus
gacacatcaggtatatgctctcgta

SEQ ID NO: 433783 - DNA, 25 bp, Mus musculus
gacacatcataggacacacaggccg

SEQ ID NO: 433784 - DNA, 25 bp, Mus musculus
gacacatcatgaggctggatctgga

SEQ ID NO: 433785 - DNA, 25 bp, Mus musculus
gacacatccttctcatgggaaccga

SEQ ID NO: 433786 - DNA, 25 bp, Mus musculus
gacacatctgtagctgttgccgccg

SEQ ID NO: 433787 - DNA, 25 bp, Mus musculus
gacacatggagagctgaaacgctac

SEQ ID NO: 433788 - DNA, 25 bp, Mus musculus
gacacatggatactggctctgggaa

SEQ ID NO: 433789 - DNA, 25 bp, Mus musculus
gacacatggatcacttgctgccagg

SEQ ID NO: 433790 - DNA, 25 bp, Mus musculus
gacacatgggatgccctgaagggct

SEQ ID NO: 433791 - DNA, 25 bp, Mus musculus
gacaccaaaggacttgctggaccag

SEQ ID NO: 433792 - DNA, 25 bp, Mus musculus
gacaccaacgatgaagacggctcgg

SEQ ID NO: 433793 - DNA, 25 bp, Mus musculus
gacaccaagcctgtccaaagcgtgg

SEQ ID NO: 433794 - DNA, 25 bp, Mus musculus
gacaccacatacctttgagccgagg

SEQ ID NO: 433795 - DNA, 25 bp, Mus musculus
gacaccacttaacagcaggaaacct

SEQ ID NO: 433796 - DNA, 25 bp, Mus musculus
gacaccacttttggactagcagctg

SEQ ID NO: 433797 - DNA, 25 bp, Mus musculus
gacaccagaagaagcgtacagagct

SEQ ID NO: 433798 - DNA, 25 bp, Mus musculus
gacaccagagagtgggaagctgacc

SEQ ID NO: 433799 - DNA, 25 bp, Mus musculus
gacaccagccataaacgtcagcgtg

SEQ ID NO: 433800 - DNA, 25 bp, Mus musculus
gacaccaggctttggcgataagaca

SEQ ID NO: 433801 - DNA, 25 bp, Mus musculus
gacaccagtagaataggaagcagct

SEQ ID NO: 433802 - DNA, 25 bp, Mus musculus
gacaccatgaagtacagttggccat

SEQ ID NO: 433803 - DNA, 25 bp, Mus musculus
gacaccatgatgacagaagccacag

SEQ ID NO: 433804 - DNA, 25 bp, Mus musculus
gacaccatgattgtcaggagcaagt

SEQ ID NO: 433805 - DNA, 25 bp, Mus musculus
gacaccatgggtaaagtagccaacg

SEQ ID NO: 433806 - DNA, 25 bp, Mus musculus
gacaccatttccatggagtcctgtg

SEQ ID NO: 433807 - DNA, 25 bp, Mus musculus
gacacccaaatgtgcattctttata

SEQ ID NO: 433808 - DNA, 25 bp, Mus musculus
gacacccagacttgcgcgtcatgta

SEQ ID NO: 433809 - DNA, 25 bp, Mus musculus
gacacccagatggatgccaggctac

SEQ ID NO: 433810 - DNA, 25 bp, Mus musculus
gacacccagcaaggatagtaagact

SEQ ID NO: 433811 - DNA, 25 bp, Mus musculus
gacacccaggtctcactgtcacggt

SEQ ID NO: 433812 - DNA, 25 bp, Mus musculus
gacacccatctcctagcattaatcg

SEQ ID NO: 433813 - DNA, 25 bp, Mus musculus
gacaccccaatcagaggaccgtggg

SEQ ID NO: 433814 - DNA, 25 bp, Mus musculus
gacaccccaggtctctaaagatctg

SEQ ID NO: 433815 - DNA, 25 bp, Mus musculus
gacacccgctgatttgccacagaaa

SEQ ID NO: 433816 - DNA, 25 bp, Mus musculus
gacacccgtatcactgagattctcg

SEQ ID NO: 433817 - DNA, 25 bp, Mus musculus
gacacccgtcagtctatactgaatg

SEQ ID NO: 433818 - DNA, 25 bp, Mus musculus
gacacccgtgtggttgagctgaccc

SEQ ID NO: 433819 - DNA, 25 bp, Mus musculus
gacaccctaaaagttccagggctgg

SEQ ID NO: 433820 - DNA, 25 bp, Mus musculus
gacaccctgaatgttctagtttccc

SEQ ID NO: 433821 - DNA, 25 bp, Mus musculus
gacaccctggctgaaggaagacgcc

SEQ ID NO: 433822 - DNA, 25 bp, Mus musculus
gacaccctgttcctgtactgagtac

SEQ ID NO: 433823 - DNA, 25 bp, Mus musculus
gacaccgaagaggtgcagtccctga

SEQ ID NO: 433824 - DNA, 25 bp, Mus musculus
gacaccgagctcatcgacgaagagg

SEQ ID NO: 433825 - DNA, 25 bp, Mus musculus
gacaccgatttttcgaccagattag

SEQ ID NO: 433826 - DNA, 25 bp, Mus musculus
gacaccggacatgccgatgactgtg

SEQ ID NO: 433827 - DNA, 25 bp, Mus musculus
gacaccggcaaggatttacaaccag

SEQ ID NO: 433828 - DNA, 25 bp, Mus musculus
gacaccgggactgcgggacttatga

SEQ ID NO: 433829 - DNA, 25 bp, Mus musculus
gacaccgggagcgatcgtgggttga

SEQ ID NO: 433830 - DNA, 25 bp, Mus musculus
gacaccgtggtaactgtcccagcct

SEQ ID NO: 433831 - DNA, 25 bp, Mus musculus
gacacctactggatgcatttctgcg

SEQ ID NO: 433832 - DNA, 25 bp, Mus musculus
gacacctagaatgggaactcttcca

SEQ ID NO: 433833 - DNA, 25 bp, Mus musculus
gacacctcgagtgaaggcattagca

SEQ ID NO: 433834 - DNA, 25 bp, Mus musculus
gacacctcgttctgcagatcctgga

SEQ ID NO: 433835 - DNA, 25 bp, Mus musculus
gacacctgaggtagcaaacttggcc

SEQ ID NO: 433836 - DNA, 25 bp, Mus musculus
gacacctgcggcgtctgggatatga

SEQ ID NO: 433837 - DNA, 25 bp, Mus musculus
gacacctggcatttctgctcactta

SEQ ID NO: 433838 - DNA, 25 bp, Mus musculus
gacacctggcgtcgtggaggacagg

SEQ ID NO: 433839 - DNA, 25 bp, Mus musculus
gacacctgggatgagagttctggca

SEQ ID NO: 433840 - DNA, 25 bp, Mus musculus
gacacctgggctaccttctttctga

SEQ ID NO: 433841 - DNA, 25 bp, Mus musculus
gacaccttccacttggaaggacgtg

SEQ ID NO: 433842 - DNA, 25 bp, Mus musculus
gacaccttgatcttcgacttttgct

SEQ ID NO: 433843 - DNA, 25 bp, Mus musculus
gacaccttgcagacagactactttg

SEQ ID NO: 433844 - DNA, 25 bp, Mus musculus
gacaccttgcttgctgggatggaga

SEQ ID NO: 433845 - DNA, 25 bp, Mus musculus
gacaccttggaactttcattcggaa

SEQ ID NO: 433846 - DNA, 25 bp, Mus musculus
gacaccttggatcagctaagccagg

SEQ ID NO: 433847 - DNA, 25 bp, Mus musculus
gacacctttagagcaagacgatgag

SEQ ID NO: 433848 - DNA, 25 bp, Mus musculus
gacacctttttgacccagccatgag

SEQ ID NO: 433849 - DNA, 25 bp, Mus musculus
gacacgaaagatctcatgggcaaca

SEQ ID NO: 433850 - DNA, 25 bp, Mus musculus
gacacgaagctgtacgacatcctgg

SEQ ID NO: 433851 - DNA, 25 bp, Mus musculus
gacacgaatccctgggcttccttga

SEQ ID NO: 433852 - DNA, 25 bp, Mus musculus
gacacgagacacgatggatgctgat

SEQ ID NO: 433853 - DNA, 25 bp, Mus musculus
gacacgaggcttacattcttctgct

SEQ ID NO: 433854 - DNA, 25 bp, Mus musculus
gacacgagtccaaaagaacacgctg

SEQ ID NO: 433855 - DNA, 25 bp, Mus musculus
gacacgcctgcgaaatgttcctgtt

SEQ ID NO: 433856 - DNA, 25 bp, Mus musculus
gacacgctggtcaaagttcgaaaca

SEQ ID NO: 433857 - DNA, 25 bp, Mus musculus
gacacgctgtttgaccatgcaccag

SEQ ID NO: 433858 - DNA, 25 bp, Mus musculus
gacacgcttcgggttcacatgagtt

SEQ ID NO: 433859 - DNA, 25 bp, Mus musculus
gacacggaagtgactccgaacagga

SEQ ID NO: 433860 - DNA, 25 bp, Mus musculus
gacacggacgtgcacaagaatgcca

SEQ ID NO: 433861 - DNA, 25 bp, Mus musculus
gacacggagctcctggaacaatcag

SEQ ID NO: 433862 - DNA, 25 bp, Mus musculus
gacacggatctggtgacttctgaga

SEQ ID NO: 433863 - DNA, 25 bp, Mus musculus
gacacggccttcatgtactgcgacg

SEQ ID NO: 433864 - DNA, 25 bp, Mus musculus
gacacggcgcttcctttacagaaca

SEQ ID NO: 433865 - DNA, 25 bp, Mus musculus
gacacgggagcacttccactatggg

SEQ ID NO: 433866 - DNA, 25 bp, Mus musculus
gacacgggatgacctgttcaacacc

SEQ ID NO: 433867 - DNA, 25 bp, Mus musculus
gacacggtccctaagaactgaaagg

SEQ ID NO: 433868 - DNA, 25 bp, Mus musculus
gacacggtctggatagagcactact

SEQ ID NO: 433869 - DNA, 25 bp, Mus musculus
gacacgtacccatgttggctgaccg

SEQ ID NO: 433870 - DNA, 25 bp, Mus musculus
gacacgtcactggagttcctacagg

SEQ ID NO: 433871 - DNA, 25 bp, Mus musculus
gacacgtgccacttaagatcaacca

SEQ ID NO: 433872 - DNA, 25 bp, Mus musculus
gacacgtggagctacgctgcgaagt

SEQ ID NO: 433873 - DNA, 25 bp, Mus musculus
gacacgtgtcggtgaggaaccaaac

SEQ ID NO: 433874 - DNA, 25 bp, Mus musculus
gacacgtgtggttctgcctatgccc

SEQ ID NO: 433875 - DNA, 25 bp, Mus musculus
gacacgttagatattgacgccccag

SEQ ID NO: 433876 - DNA, 25 bp, Mus musculus
gacacgtttcgagagtttacggtcg

SEQ ID NO: 433877 - DNA, 25 bp, Mus musculus
gacactaaaacaaaggtgtggctct

SEQ ID NO: 433878 - DNA, 25 bp, Mus musculus
gacactaaaatcaatgcctcagatg

SEQ ID NO: 433879 - DNA, 25 bp, Mus musculus
gacactaaagctagcggcttgctgt

SEQ ID NO: 433880 - DNA, 25 bp, Mus musculus
gacactaaattccaggaggcacgca

SEQ ID NO: 433881 - DNA, 25 bp, Mus musculus
gacactaaccgaattgccttgctga

SEQ ID NO: 433882 - DNA, 25 bp, Mus musculus
gacactaactctgaaagcgccaatg

SEQ ID NO: 433883 - DNA, 25 bp, Mus musculus
gacactaagtttcaagcccagcgaa

SEQ ID NO: 433884 - DNA, 25 bp, Mus musculus
gacactaatcaagaaaggagtccag

SEQ ID NO: 433885 - DNA, 25 bp, Mus musculus
gacactacgggtagagcgctactct

SEQ ID NO: 433886 - DNA, 25 bp, Mus musculus
gacactactgcttttcagggaggga

SEQ ID NO: 433887 - DNA, 25 bp, Mus musculus
gacactagcgatgacaagttctgcc

SEQ ID NO: 433888 - DNA, 25 bp, Mus musculus
gacactatgtactctatctggatgc

SEQ ID NO: 433889 - DNA, 25 bp, Mus musculus
gacactatgtcccttaatacccgag

SEQ ID NO: 433890 - DNA, 25 bp, Mus musculus
gacactcaagttttcaagaaagcag

SEQ ID NO: 433891 - DNA, 25 bp, Mus musculus
gacactcactccagcaggaaaacag

SEQ ID NO: 433892 - DNA, 25 bp, Mus musculus
gacactcactggcttaaaatcagat

SEQ ID NO: 433893 - DNA, 25 bp, Mus musculus
gacactcaggaggtaggcaacatcc

SEQ ID NO: 433894 - DNA, 25 bp, Mus musculus
gacactcgccaaatgcttgcttaag

SEQ ID NO: 433895 - DNA, 25 bp, Mus musculus
gacactcggcagttcttagaccagg

SEQ ID NO: 433896 - DNA, 25 bp, Mus musculus
gacactcggtttagaccagatcaaa

SEQ ID NO: 433897 - DNA, 25 bp, Mus musculus
gacactcgtgagactgacttgcagg

SEQ ID NO: 433898 - DNA, 25 bp, Mus musculus
gacactcgttacattcgggagcgaa

SEQ ID NO: 433899 - DNA, 25 bp, Mus musculus
gacactctagccctgtggttctgca

SEQ ID NO: 433900 - DNA, 25 bp, Mus musculus
gacactctggtgcttaaggctgctg

SEQ ID NO: 433901 - DNA, 25 bp, Mus musculus
gacactcttgatgacctgatagcag

SEQ ID NO: 433902 - DNA, 25 bp, Mus musculus
gacactgacgctggtttgcctggct

SEQ ID NO: 433903 - DNA, 25 bp, Mus musculus
gacactgacttgttggacagaccag

SEQ ID NO: 433904 - DNA, 25 bp, Mus musculus
gacactgagaaaaagatgtcctgtg

SEQ ID NO: 433905 - DNA, 25 bp, Mus musculus
gacactgcgcctggcagatcaaggg

SEQ ID NO: 433906 - DNA, 25 bp, Mus musculus
gacactgctcatttggctaccaaaa

SEQ ID NO: 433907 - DNA, 25 bp, Mus musculus
gacactggagcttcgtgccttcctg

SEQ ID NO: 433908 - DNA, 25 bp, Mus musculus
gacactggagcttggtcgtcctacc

SEQ ID NO: 433909 - DNA, 25 bp, Mus musculus
gacactggatagacccacaagggca

SEQ ID NO: 433910 - DNA, 25 bp, Mus musculus
gacactggattgaggccactgggca

SEQ ID NO: 433911 - DNA, 25 bp, Mus musculus
gacactggccctagaaatacgatga

SEQ ID NO: 433912 - DNA, 25 bp, Mus musculus
gacactggctgtggaatttccggaa

SEQ ID NO: 433913 - DNA, 25 bp, Mus musculus
gacactgggacccagggtccttcct

SEQ ID NO: 433914 - DNA, 25 bp, Mus musculus
gacactgggtgaacttgcgattgct

SEQ ID NO: 433915 - DNA, 25 bp, Mus musculus
gacactggtgctggctttaaccgga

SEQ ID NO: 433916 - DNA, 25 bp, Mus musculus
gacactgtagagacccgttgttgct

SEQ ID NO: 433917 - DNA, 25 bp, Mus musculus
gacactgtcatgagggacatcaccc

SEQ ID NO: 433918 - DNA, 25 bp, Mus musculus
gacactgtcccagataaccatcgga

SEQ ID NO: 433919 - DNA, 25 bp, Mus musculus
gacactgtctccattgggtttcgga

SEQ ID NO: 433920 - DNA, 25 bp, Mus musculus
gacactgtgaatgctcaggccgaca

SEQ ID NO: 433921 - DNA, 25 bp, Mus musculus
gacactgtgacatcgaaagcaggca

SEQ ID NO: 433922 - DNA, 25 bp, Mus musculus
gacactgtgaccatagcatctctta

SEQ ID NO: 433923 - DNA, 25 bp, Mus musculus
gacactgtgagaattgattggccca

SEQ ID NO: 433924 - DNA, 25 bp, Mus musculus
gacactgtggaaaagatcaaatcta

SEQ ID NO: 433925 - DNA, 25 bp, Mus musculus
gacactgtggtctggaggtcaatga

SEQ ID NO: 433926 - DNA, 25 bp, Mus musculus
gacacttaacatactagctagaggg

SEQ ID NO: 433927 - DNA, 25 bp, Mus musculus
gacacttccaaacaagccataggga

SEQ ID NO: 433928 - DNA, 25 bp, Mus musculus
gacacttccgaggttgtcttcaaca

SEQ ID NO: 433929 - DNA, 25 bp, Mus musculus
gacacttccggtttctgagagatga

SEQ ID NO: 433930 - DNA, 25 bp, Mus musculus
gacacttcgctgtcagggctgcagc

SEQ ID NO: 433931 - DNA, 25 bp, Mus musculus
gacacttcggactgaggttctacgc

SEQ ID NO: 433932 - DNA, 25 bp, Mus musculus
gacacttctcaggagggacgctcta

SEQ ID NO: 433933 - DNA, 25 bp, Mus musculus
gacacttgagagaagtaacttgaac

SEQ ID NO: 433934 - DNA, 25 bp, Mus musculus
gacacttgctgtggcgcagggactc

SEQ ID NO: 433935 - DNA, 25 bp, Mus musculus
gacacttggacagctgcaaaagagg

SEQ ID NO: 433936 - DNA, 25 bp, Mus musculus
gacacttggacgatgctggccttgc

SEQ ID NO: 433937 - DNA, 25 bp, Mus musculus
gacacttggattcagtactgcagca

SEQ ID NO: 433938 - DNA, 25 bp, Mus musculus
gacactttaaggaaactccaacttg

SEQ ID NO: 433939 - DNA, 25 bp, Mus musculus
gacactttcaggagctgcatcggga

SEQ ID NO: 433940 - DNA, 25 bp, Mus musculus
gacactttcgagtacatggcgggct

SEQ ID NO: 433941 - DNA, 25 bp, Mus musculus
gacactttctgtggagggacatcag

SEQ ID NO: 433942 - DNA, 25 bp, Mus musculus
gacactttgaaatcgcagggccagg

SEQ ID NO: 433943 - DNA, 25 bp, Mus musculus
gacactttgcgcattggttccagga

SEQ ID NO: 433944 - DNA, 25 bp, Mus musculus
gacactttgctacacatcagcgaca

SEQ ID NO: 433945 - DNA, 25 bp, Mus musculus
gacacttttggagcagtactgccac

SEQ ID NO: 433946 - DNA, 25 bp, Mus musculus
gacacttttgtgtacatagccccgg

SEQ ID NO: 433947 - DNA, 25 bp, Mus musculus
gacagaaaaatttggtaccgcctca

SEQ ID NO: 433948 - DNA, 25 bp, Mus musculus
gacagaaacaagacagacacattta

SEQ ID NO: 433949 - DNA, 25 bp, Mus musculus
gacagaaactttcccagcgtgtgag

SEQ ID NO: 433950 - DNA, 25 bp, Mus musculus
gacagaaagtgcatcttactcagga

SEQ ID NO: 433951 - DNA, 25 bp, Mus musculus
gacagaaatcgaggcactcaaggaa

SEQ ID NO: 433952 - DNA, 25 bp, Mus musculus
gacagaaatcgtaggaactgcccct

SEQ ID NO: 433953 - DNA, 25 bp, Mus musculus
gacagaacaggtgaacacagaggag

SEQ ID NO: 433954 - DNA, 25 bp, Mus musculus
gacagaacccaaggatgacaatttg

SEQ ID NO: 433955 - DNA, 25 bp, Mus musculus
gacagaagaattccagtggccccag

SEQ ID NO: 433956 - DNA, 25 bp, Mus musculus
gacagaagactgcatcataagtggt

SEQ ID NO: 433957 - DNA, 25 bp, Mus musculus
gacagaagcacgatgtttattgaga

SEQ ID NO: 433958 - DNA, 25 bp, Mus musculus
gacagaagcgacaaatggtggctcc

SEQ ID NO: 433959 - DNA, 25 bp, Mus musculus
gacagaagttctccacaaagtgcat

SEQ ID NO: 433960 - DNA, 25 bp, Mus musculus
gacagaatacgattacagcaggact

SEQ ID NO: 433961 - DNA, 25 bp, Mus musculus
gacagaatcatcacagggtcctttg

SEQ ID NO: 433962 - DNA, 25 bp, Mus musculus
gacagaatggtggagctttaaaaca

SEQ ID NO: 433963 - DNA, 25 bp, Mus musculus
gacagaattggttctcgagcaagtt

SEQ ID NO: 433964 - DNA, 25 bp, Mus musculus
gacagaatttcagcctgtagccctg

SEQ ID NO: 433965 - DNA, 25 bp, Mus musculus
gacagacacctccaatttagacttg

SEQ ID NO: 433966 - DNA, 25 bp, Mus musculus
gacagacagattaggcccaggaagt

SEQ ID NO: 433967 - DNA, 25 bp, Mus musculus
gacagacagctgtttgacaccatct

SEQ ID NO: 433968 - DNA, 25 bp, Mus musculus
gacagacagtgtgatatttgacccc

SEQ ID NO: 433969 - DNA, 25 bp, Mus musculus
gacagacagtttctcatccgtgaac

SEQ ID NO: 433970 - DNA, 25 bp, Mus musculus
gacagacattgcctgcagcgaggcc

SEQ ID NO: 433971 - DNA, 25 bp, Mus musculus
gacagacccctgtgcaggtgcaaat

SEQ ID NO: 433972 - DNA, 25 bp, Mus musculus
gacagacccgagagcatggcctttt

SEQ ID NO: 433973 - DNA, 25 bp, Mus musculus
gacagacgagagacatgtgccagct

SEQ ID NO: 433974 - DNA, 25 bp, Mus musculus
gacagacgcaaggaatctcaccaat

SEQ ID NO: 433975 - DNA, 25 bp, Mus musculus
gacagacgctccctgaatgtaatag

SEQ ID NO: 433976 - DNA, 25 bp, Mus musculus
gacagacggctcttcgttgcgagcc

SEQ ID NO: 433977 - DNA, 25 bp, Mus musculus
gacagacgtcgtcggcatgacagac

SEQ ID NO: 433978 - DNA, 25 bp, Mus musculus
gacagactacattgctgttgccgta

SEQ ID NO: 433979 - DNA, 25 bp, Mus musculus
gacagactacggacacacatggtgc

SEQ ID NO: 433980 - DNA, 25 bp, Mus musculus
gacagactacttcaatgggtaaagg

SEQ ID NO: 433981 - DNA, 25 bp, Mus musculus
gacagactatgctttccgatttgcg

SEQ ID NO: 433982 - DNA, 25 bp, Mus musculus
gacagactcggcagaagcatcgact

SEQ ID NO: 433983 - DNA, 25 bp, Mus musculus
gacagactcgtgaagttccacagag

SEQ ID NO: 433984 - DNA, 25 bp, Mus musculus
gacagactgggcaagtagatatggt

SEQ ID NO: 433985 - DNA, 25 bp, Mus musculus
gacagactggtttgataagccccga

SEQ ID NO: 433986 - DNA, 25 bp, Mus musculus
gacagacttcacgtcagaggtcacc

SEQ ID NO: 433987 - DNA, 25 bp, Mus musculus
gacagacttctgcattgtcatggaa

SEQ ID NO: 433988 - DNA, 25 bp, Mus musculus
gacagacttcttagacttggaggag

SEQ ID NO: 433989 - DNA, 25 bp, Mus musculus
gacagagaacacaatcaccgtcagc

SEQ ID NO: 433990 - DNA, 25 bp, Mus musculus
gacagagacaacatgtacagccaag

SEQ ID NO: 433991 - DNA, 25 bp, Mus musculus
gacagagacaccgaacagtcaggct

SEQ ID NO: 433992 - DNA, 25 bp, Mus musculus
gacagagaccccagataattaagga

SEQ ID NO: 433993 - DNA, 25 bp, Mus musculus
gacagagacccttgctagtaccagc

SEQ ID NO: 433994 - DNA, 25 bp, Mus musculus
gacagagactttctgagtccccaga

SEQ ID NO: 433995 - DNA, 25 bp, Mus musculus
gacagagagccgagtaaggaacagc

SEQ ID NO: 433996 - DNA, 25 bp, Mus musculus
gacagagagctgaggccgcagaccc

SEQ ID NO: 433997 - DNA, 25 bp, Mus musculus
gacagagatgacctgtggctcacca

SEQ ID NO: 433998 - DNA, 25 bp, Mus musculus
gacagagattcgtggctttgagaaa

SEQ ID NO: 433999 - DNA, 25 bp, Mus musculus
gacagagcaaatcaggagacccagc

SEQ ID NO: 434000 - DNA, 25 bp, Mus musculus
gacagagcagtgacacctttggtgg

SEQ ID NO: 434001 - DNA, 25 bp, Mus musculus
gacagagccatgtaggccagacctg

SEQ ID NO: 434002 - DNA, 25 bp, Mus musculus
gacagagccgaaagagtccttcaca

SEQ ID NO: 434003 - DNA, 25 bp, Mus musculus
gacagagcctttagcactttattag

SEQ ID NO: 434004 - DNA, 25 bp, Mus musculus
gacagagcgcattctccagctagtg

SEQ ID NO: 434005 - DNA, 25 bp, Mus musculus
gacagagcggtctcctggtttgaaa

SEQ ID NO: 434006 - DNA, 25 bp, Mus musculus
gacagagctcctcccgttttgatgg

SEQ ID NO: 434007 - DNA, 25 bp, Mus musculus
gacagagctgaaatgacggtgttcg

SEQ ID NO: 434008 - DNA, 25 bp, Mus musculus
gacagagctggcgtcagacaaggtt

SEQ ID NO: 434009 - DNA, 25 bp, Mus musculus
gacagaggacaccactaaggtagga

SEQ ID NO: 434010 - DNA, 25 bp, Mus musculus
gacagaggaccaactagtgctcagg

SEQ ID NO: 434011 - DNA, 25 bp, Mus musculus
gacagaggacctcttggttgcttta

SEQ ID NO: 434012 - DNA, 25 bp, Mus musculus
gacagaggagatgtccttaaacctc

SEQ ID NO: 434013 - DNA, 25 bp, Mus musculus
gacagaggagtatccatgcccaaca

SEQ ID NO: 434014 - DNA, 25 bp, Mus musculus
gacagaggcatgagggaccatacta

SEQ ID NO: 434015 - DNA, 25 bp, Mus musculus
gacagaggctcatgcaagacagaaa

SEQ ID NO: 434016 - DNA, 25 bp, Mus musculus
gacagagggctggtcttcattctta

SEQ ID NO: 434017 - DNA, 25 bp, Mus musculus
gacagagtctcaaagctaccgggct

SEQ ID NO: 434018 - DNA, 25 bp, Mus musculus
gacagagtgatttgggctcagagta

SEQ ID NO: 434019 - DNA, 25 bp, Mus musculus
gacagagtgtacttccacccaggag

SEQ ID NO: 434020 - DNA, 25 bp, Mus musculus
gacagagttacctcaacagcactgg

SEQ ID NO: 434021 - DNA, 25 bp, Mus musculus
gacagagtttatcctcagagggcta

SEQ ID NO: 434022 - DNA, 25 bp, Mus musculus
gacagagtttttgtcgcctttaaga

SEQ ID NO: 434023 - DNA, 25 bp, Mus musculus
gacagatacagtgcccacggtggct

SEQ ID NO: 434024 - DNA, 25 bp, Mus musculus
gacagataccatgaaaagcttgcag

SEQ ID NO: 434025 - DNA, 25 bp, Mus musculus
gacagataccttactgcctgccaca

SEQ ID NO: 434026 - DNA, 25 bp, Mus musculus
gacagatattcactcaagctacaca

SEQ ID NO: 434027 - DNA, 25 bp, Mus musculus
gacagatcactgcttggcaatggct

SEQ ID NO: 434028 - DNA, 25 bp, Mus musculus
gacagatcaggtaagtttctagaga

SEQ ID NO: 434029 - DNA, 25 bp, Mus musculus
gacagatcattcaggactacgacag

SEQ ID NO: 434030 - DNA, 25 bp, Mus musculus
gacagatcctagaaatgagtgccga

SEQ ID NO: 434031 - DNA, 25 bp, Mus musculus
gacagatcgtcgcatcagggaagac

SEQ ID NO: 434032 - DNA, 25 bp, Mus musculus
gacagatcttggaacacatagccct

SEQ ID NO: 434033 - DNA, 25 bp, Mus musculus
gacagatgctcttgttgggcaccac

SEQ ID NO: 434034 - DNA, 25 bp, Mus musculus
gacagatggaatgaaactcgagccc

SEQ ID NO: 434035 - DNA, 25 bp, Mus musculus
gacagatggcctatggtgagccaag

SEQ ID NO: 434036 - DNA, 25 bp, Mus musculus
gacagatggtcttaaaacagcctgc

SEQ ID NO: 434037 - DNA, 25 bp, Mus musculus
gacagatgtctacacagagcagcca

SEQ ID NO: 434038 - DNA, 25 bp, Mus musculus
gacagatgtgcatcaccgtttttac

SEQ ID NO: 434039 - DNA, 25 bp, Mus musculus
gacagatgtttatccagcagcagca

SEQ ID NO: 434040 - DNA, 25 bp, Mus musculus
gacagattacaaccatctcacccat

SEQ ID NO: 434041 - DNA, 25 bp, Mus musculus
gacagattatgctattgccaggcgc

SEQ ID NO: 434042 - DNA, 25 bp, Mus musculus
gacagattatggacacacaccgagg

SEQ ID NO: 434043 - DNA, 25 bp, Mus musculus
gacagattccatttgacttcccagg

SEQ ID NO: 434044 - DNA, 25 bp, Mus musculus
gacagattcctagggttgctgccac

SEQ ID NO: 434045 - DNA, 25 bp, Mus musculus
gacagattggacagatacagactct

SEQ ID NO: 434046 - DNA, 25 bp, Mus musculus
gacagatttaccactctgagctaga

SEQ ID NO: 434047 - DNA, 25 bp, Mus musculus
gacagcaaaaggtcatggctcacca

SEQ ID NO: 434048 - DNA, 25 bp, Mus musculus
gacagcaaagctcgaggaaactcca

SEQ ID NO: 434049 - DNA, 25 bp, Mus musculus
gacagcaactgcgtgttctgccgcg

SEQ ID NO: 434050 - DNA, 25 bp, Mus musculus
gacagcaagcccctgagtactacta

SEQ ID NO: 434051 - DNA, 25 bp, Mus musculus
gacagcaagggatggtgttcactca

SEQ ID NO: 434052 - DNA, 25 bp, Mus musculus
gacagcaagtgtaggatcattttcc

SEQ ID NO: 434053 - DNA, 25 bp, Mus musculus
gacagcaatgccctacggtggatat

SEQ ID NO: 434054 - DNA, 25 bp, Mus musculus
gacagcaatgtggatttcaggccca

SEQ ID NO: 434055 - DNA, 25 bp, Mus musculus
gacagcaatgttctagtctatgagg

SEQ ID NO: 434056 - DNA, 25 bp, Mus musculus
gacagcaattgtctgggtaggacca

SEQ ID NO: 434057 - DNA, 25 bp, Mus musculus
gacagcacatttaaggcagttgcag

SEQ ID NO: 434058 - DNA, 25 bp, Mus musculus
gacagcacctgtaatagcactttgc

SEQ ID NO: 434059 - DNA, 25 bp, Mus musculus
gacagcactgctttgtgtacccggc

SEQ ID NO: 434060 - DNA, 25 bp, Mus musculus
gacagcacttttcctgacatgtgaa

SEQ ID NO: 434061 - DNA, 25 bp, Mus musculus
gacagcagatgtgctagagaaaact

SEQ ID NO: 434062 - DNA, 25 bp, Mus musculus
gacagcagatttcagaggtcaccct

SEQ ID NO: 434063 - DNA, 25 bp, Mus musculus
gacagcagcttgcatctctgggaga

SEQ ID NO: 434064 - DNA, 25 bp, Mus musculus
gacagcagggaccatacactccata

SEQ ID NO: 434065 - DNA, 25 bp, Mus musculus
gacagcagggatttcgacaacaaca

SEQ ID NO: 434066 - DNA, 25 bp, Mus musculus
gacagcagtctcgatgcctcaacag

SEQ ID NO: 434067 - DNA, 25 bp, Mus musculus
gacagcagtcttattgatcatcacc

SEQ ID NO: 434068 - DNA, 25 bp, Mus musculus
gacagcagtgacgtttctcagccga

SEQ ID NO: 434069 - DNA, 25 bp, Mus musculus
gacagcagtttgtactccctggagg

SEQ ID NO: 434070 - DNA, 25 bp, Mus musculus
gacagcatcaagttcactaccgtgg

SEQ ID NO: 434071 - DNA, 25 bp, Mus musculus
gacagcatcacaggcatgggctctc

SEQ ID NO: 434072 - DNA, 25 bp, Mus musculus
gacagcatccagcttttcagcggaa

SEQ ID NO: 434073 - DNA, 25 bp, Mus musculus
gacagcatcccagtcattttccttt

SEQ ID NO: 434074 - DNA, 25 bp, Mus musculus
gacagcatctccctccctgaagagt

SEQ ID NO: 434075 - DNA, 25 bp, Mus musculus
gacagcatgagtttcccgcgaggct

SEQ ID NO: 434076 - DNA, 25 bp, Mus musculus
gacagcatggctctgaagaactcac

SEQ ID NO: 434077 - DNA, 25 bp, Mus musculus
gacagcatgggtgaagtacaagact

SEQ ID NO: 434078 - DNA, 25 bp, Mus musculus
gacagcattaaggactccctggacg

SEQ ID NO: 434079 - DNA, 25 bp, Mus musculus
gacagcattagatctcccggttgga

SEQ ID NO: 434080 - DNA, 25 bp, Mus musculus
gacagcattgcagctcagttcatga

SEQ ID NO: 434081 - DNA, 25 bp, Mus musculus
gacagccaaagctggaagttctccc

SEQ ID NO: 434082 - DNA, 25 bp, Mus musculus
gacagccaagagcacaagatcatct

SEQ ID NO: 434083 - DNA, 25 bp, Mus musculus
gacagccacaaggagtagcagagct

SEQ ID NO: 434084 - DNA, 25 bp, Mus musculus
gacagccacaggtatagccacaggt

SEQ ID NO: 434085 - DNA, 25 bp, Mus musculus
gacagccacagtctttgttctggta

SEQ ID NO: 434086 - DNA, 25 bp, Mus musculus
gacagccagaggtagtcaggtcctg

SEQ ID NO: 434087 - DNA, 25 bp, Mus musculus
gacagccagggtttcattaggcaga

SEQ ID NO: 434088 - DNA, 25 bp, Mus musculus
gacagccagtcggagatgcatgata

SEQ ID NO: 434089 - DNA, 25 bp, Mus musculus
gacagcccaagctccgtgtttctca

SEQ ID NO: 434090 - DNA, 25 bp, Mus musculus
gacagcccagttcatcccaagtgct

SEQ ID NO: 434091 - DNA, 25 bp, Mus musculus
gacagcccagtttgctgagggtggg

SEQ ID NO: 434092 - DNA, 25 bp, Mus musculus
gacagccccggttccggagcatgtg

SEQ ID NO: 434093 - DNA, 25 bp, Mus musculus
gacagcccgaggttgcgttcttgca

SEQ ID NO: 434094 - DNA, 25 bp, Mus musculus
gacagccggactcagacatggtcca

SEQ ID NO: 434095 - DNA, 25 bp, Mus musculus
gacagccgtcgggatgaacatccag

SEQ ID NO: 434096 - DNA, 25 bp, Mus musculus
gacagccgtgtctgtgggagtccaa

SEQ ID NO: 434097 - DNA, 25 bp, Mus musculus
gacagccgttttccaccaatgacaa

SEQ ID NO: 434098 - DNA, 25 bp, Mus musculus
gacagcctacaagaagcgttgccag

SEQ ID NO: 434099 - DNA, 25 bp, Mus musculus
gacagcctagaaaactttgggagcc

SEQ ID NO: 434100 - DNA, 25 bp, Mus musculus
gacagcctagtgactaaggccctag

SEQ ID NO: 434101 - DNA, 25 bp, Mus musculus
gacagcctggacttgatggagcctc

SEQ ID NO: 434102 - DNA, 25 bp, Mus musculus
gacagccttgtgctctcacctggga

SEQ ID NO: 434103 - DNA, 25 bp, Mus musculus
gacagcgaccttttctcccaggaca

SEQ ID NO: 434104 - DNA, 25 bp, Mus musculus
gacagcgatgatttttctagcacag

SEQ ID NO: 434105 - DNA, 25 bp, Mus musculus
gacagcgattcagagacctatggag

SEQ ID NO: 434106 - DNA, 25 bp, Mus musculus
gacagcgccggacattggctatatg

SEQ ID NO: 434107 - DNA, 25 bp, Mus musculus
gacagcggaataaaaaatcttgatc

SEQ ID NO: 434108 - DNA, 25 bp, Mus musculus
gacagcggctgaaatggaagcatat

SEQ ID NO: 434109 - DNA, 25 bp, Mus musculus
gacagcgggcatggtcactatccag

SEQ ID NO: 434110 - DNA, 25 bp, Mus musculus
gacagcgtttgatgcagatgacccg

SEQ ID NO: 434111 - DNA, 25 bp, Mus musculus
gacagctaccaattctactgtggtg

SEQ ID NO: 434112 - DNA, 25 bp, Mus musculus
gacagctacgcccagtttgaggaga

SEQ ID NO: 434113 - DNA, 25 bp, Mus musculus
gacagctagagggatgatagacccc

SEQ ID NO: 434114 - DNA, 25 bp, Mus musculus
gacagctagccgcacagttcatgaa

SEQ ID NO: 434115 - DNA, 25 bp, Mus musculus
gacagctcaagtcaacctgctggga

SEQ ID NO: 434116 - DNA, 25 bp, Mus musculus
gacagctcaccgaagctcagatttg

SEQ ID NO: 434117 - DNA, 25 bp, Mus musculus
gacagctcccgactgcttcttgcag

SEQ ID NO: 434118 - DNA, 25 bp, Mus musculus
gacagctctaaggatgccaattttg

SEQ ID NO: 434119 - DNA, 25 bp, Mus musculus
gacagctctgtagatggccagacct

SEQ ID NO: 434120 - DNA, 25 bp, Mus musculus
gacagctgaatgtacctgcctatga

SEQ ID NO: 434121 - DNA, 25 bp, Mus musculus
gacagctgagttcctctatgacgag

SEQ ID NO: 434122 - DNA, 25 bp, Mus musculus
gacagctgcctacatctgaaacatg

SEQ ID NO: 434123 - DNA, 25 bp, Mus musculus
gacagctgcgggtttcgaactcttg

SEQ ID NO: 434124 - DNA, 25 bp, Mus musculus
gacagctgctcagtctcgtgggtgc

SEQ ID NO: 434125 - DNA, 25 bp, Mus musculus
gacagctggaaagagaaaaggccct

SEQ ID NO: 434126 - DNA, 25 bp, Mus musculus
gacagctggccagaatcgtatatgc

SEQ ID NO: 434127 - DNA, 25 bp, Mus musculus
gacagctggccagttatcgaacgct

SEQ ID NO: 434128 - DNA, 25 bp, Mus musculus
gacagctgtcaattctggtagaagc

SEQ ID NO: 434129 - DNA, 25 bp, Mus musculus
gacagctgtgctgctatctcaggag

SEQ ID NO: 434130 - DNA, 25 bp, Mus musculus
gacagcttcaacacacagtgcctga

SEQ ID NO: 434131 - DNA, 25 bp, Mus musculus
gacagcttgactgcctctcagagaa

SEQ ID NO: 434132 - DNA, 25 bp, Mus musculus
gacagcttgtcgtcctatagcccaa

SEQ ID NO: 434133 - DNA, 25 bp, Mus musculus
gacagctttggattgtgacacagca

SEQ ID NO: 434134 - DNA, 25 bp, Mus musculus
gacagctttgggaacttgtcctctg

SEQ ID NO: 434135 - DNA, 25 bp, Mus musculus
gacaggaaaaacagctggcatggaa

SEQ ID NO: 434136 - DNA, 25 bp, Mus musculus
gacaggaaactcgacctgaccgtgg

SEQ ID NO: 434137 - DNA, 25 bp, Mus musculus
gacaggaaagcagcttggtttgcca

SEQ ID NO: 434138 - DNA, 25 bp, Mus musculus
gacaggaacaattcaaactaagaca

SEQ ID NO: 434139 - DNA, 25 bp, Mus musculus
gacaggaaccctgtaacaccgtgaa

SEQ ID NO: 434140 - DNA, 25 bp, Mus musculus
gacaggaagtggcatcccagtaaat

SEQ ID NO: 434141 - DNA, 25 bp, Mus musculus
gacaggacacgtacgccttttaact

SEQ ID NO: 434142 - DNA, 25 bp, Mus musculus
gacaggaccccattagaagagcaag

SEQ ID NO: 434143 - DNA, 25 bp, Mus musculus
gacaggacccgagtctattacagga

SEQ ID NO: 434144 - DNA, 25 bp, Mus musculus
gacaggacccttgaaaaccagcttt

SEQ ID NO: 434145 - DNA, 25 bp, Mus musculus
gacaggacgccctaggttttcagcc

SEQ ID NO: 434146 - DNA, 25 bp, Mus musculus
gacaggagaacattgtgcgcaccct

SEQ ID NO: 434147 - DNA, 25 bp, Mus musculus
gacaggagccggaagcctagctctg

SEQ ID NO: 434148 - DNA, 25 bp, Mus musculus
gacaggagcgtatccctatccacaa

SEQ ID NO: 434149 - DNA, 25 bp, Mus musculus
gacaggatactctttcatgacagga

SEQ ID NO: 434150 - DNA, 25 bp, Mus musculus
gacaggatctgacatagcttggcat

SEQ ID NO: 434151 - DNA, 25 bp, Mus musculus
gacaggatggagttcgccagtcaag

SEQ ID NO: 434152 - DNA, 25 bp, Mus musculus
gacaggatggtgctcatgtctccag

SEQ ID NO: 434153 - DNA, 25 bp, Mus musculus
gacaggattagagtcccctgaactt

SEQ ID NO: 434154 - DNA, 25 bp, Mus musculus
gacaggattatcttcaccctggacc

SEQ ID NO: 434155 - DNA, 25 bp, Mus musculus
gacaggattctaccttcgtggaaga

SEQ ID NO: 434156 - DNA, 25 bp, Mus musculus
gacaggcaagagtcatggagagata

SEQ ID NO: 434157 - DNA, 25 bp, Mus musculus
gacaggcagatctactcactccatg

SEQ ID NO: 434158 - DNA, 25 bp, Mus musculus
gacaggcagccatatagaggcaaac

SEQ ID NO: 434159 - DNA, 25 bp, Mus musculus
gacaggcagcctgttgggagtttct

SEQ ID NO: 434160 - DNA, 25 bp, Mus musculus
gacaggcagctagggcgtcttcatg

SEQ ID NO: 434161 - DNA, 25 bp, Mus musculus
gacaggcaggacttagggtattgtt

SEQ ID NO: 434162 - DNA, 25 bp, Mus musculus
gacaggcagtttaccaacaatgggc

SEQ ID NO: 434163 - DNA, 25 bp, Mus musculus
gacaggcatcatttcctcagcctct

SEQ ID NO: 434164 - DNA, 25 bp, Mus musculus
gacaggccagttcccttacagttga

SEQ ID NO: 434165 - DNA, 25 bp, Mus musculus
gacaggccccttaactcttggctgg

SEQ ID NO: 434166 - DNA, 25 bp, Mus musculus
gacaggccgatgttccttttgcact

SEQ ID NO: 434167 - DNA, 25 bp, Mus musculus
gacaggcctatagggtcagcaccta

SEQ ID NO: 434168 - DNA, 25 bp, Mus musculus
gacaggcctgacctttgaatcccag

SEQ ID NO: 434169 - DNA, 25 bp, Mus musculus
gacaggccttggaccaagctgtggc

SEQ ID NO: 434170 - DNA, 25 bp, Mus musculus
gacaggcgacccaagcagattgcat

SEQ ID NO: 434171 - DNA, 25 bp, Mus musculus
gacaggcgcctagaaatgcttcagt

SEQ ID NO: 434172 - DNA, 25 bp, Mus musculus
gacaggcgctttgaaaaaccaggaa

SEQ ID NO: 434173 - DNA, 25 bp, Mus musculus
gacaggcggcaccagtttccatgga

SEQ ID NO: 434174 - DNA, 25 bp, Mus musculus
gacaggcggcacgttcaatgtgaca

SEQ ID NO: 434175 - DNA, 25 bp, Mus musculus
gacaggcggcttcggaacttctttc

SEQ ID NO: 434176 - DNA, 25 bp, Mus musculus
gacaggcgggtctcttctagttaga

SEQ ID NO: 434177 - DNA, 25 bp, Mus musculus
gacaggcggttctatactcggaagg

SEQ ID NO: 434178 - DNA, 25 bp, Mus musculus
gacaggctaacacacattattcgaa

SEQ ID NO: 434179 - DNA, 25 bp, Mus musculus
gacaggctacaagacgctgaccatg

SEQ ID NO: 434180 - DNA, 25 bp, Mus musculus
gacaggctaccatggatttcagcac

SEQ ID NO: 434181 - DNA, 25 bp, Mus musculus
gacaggctcctggaatgaagagatc

SEQ ID NO: 434182 - DNA, 25 bp, Mus musculus
gacaggctctcggtcttcgctgagt

SEQ ID NO: 434183 - DNA, 25 bp, Mus musculus
gacaggctggccatcggatttagca

SEQ ID NO: 434184 - DNA, 25 bp, Mus musculus
gacaggctgtgccagaactcttcag

SEQ ID NO: 434185 - DNA, 25 bp, Mus musculus
gacaggcttctggatgaatcagcac

SEQ ID NO: 434186 - DNA, 25 bp, Mus musculus
gacagggagcttgcgtgtacacata

SEQ ID NO: 434187 - DNA, 25 bp, Mus musculus
gacagggcatagtctcctccaataa

SEQ ID NO: 434188 - DNA, 25 bp, Mus musculus
gacagggccacatgagactttacag

SEQ ID NO: 434189 - DNA, 25 bp, Mus musculus
gacagggccctaacagcgatgatgg

SEQ ID NO: 434190 - DNA, 25 bp, Mus musculus
gacagggccctggaactgagtctgc

SEQ ID NO: 434191 - DNA, 25 bp, Mus musculus
gacagggtctttgacagcatcagcc

SEQ ID NO: 434192 - DNA, 25 bp, Mus musculus
gacagggttgtttactccagacatg

SEQ ID NO: 434193 - DNA, 25 bp, Mus musculus
gacaggtacatcagcgtgggaagcc

SEQ ID NO: 434194 - DNA, 25 bp, Mus musculus
gacaggtagccagtgggatgccact

SEQ ID NO: 434195 - DNA, 25 bp, Mus musculus
gacaggtgaatccttcgtggacata

SEQ ID NO: 434196 - DNA, 25 bp, Mus musculus
gacaggtgaccgcaagaaggaaatc

SEQ ID NO: 434197 - DNA, 25 bp, Mus musculus
gacaggtgctcccaagagaaatcca

SEQ ID NO: 434198 - DNA, 25 bp, Mus musculus
gacaggttccagacagtgcaagcac

SEQ ID NO: 434199 - DNA, 25 bp, Mus musculus
gacaggttggattttcaagtttctg

SEQ ID NO: 434200 - DNA, 25 bp, Mus musculus
gacaggtttctccttcaaccacaag

SEQ ID NO: 434201 - DNA, 25 bp, Mus musculus
gacaggtttctgcttcccttggaca

SEQ ID NO: 434202 - DNA, 25 bp, Mus musculus
gacagtaaccctgaagtggtgcaca

SEQ ID NO: 434203 - DNA, 25 bp, Mus musculus
gacagtaagctcaaggacatgcgag

SEQ ID NO: 434204 - DNA, 25 bp, Mus musculus
gacagtaagtaacctacccgactag

SEQ ID NO: 434205 - DNA, 25 bp, Mus musculus
gacagtacacacagctcgaaagccg

SEQ ID NO: 434206 - DNA, 25 bp, Mus musculus
gacagtacacacttggaaaagccaa

SEQ ID NO: 434207 - DNA, 25 bp, Mus musculus
gacagtacactttcacagcatcaag

SEQ ID NO: 434208 - DNA, 25 bp, Mus musculus
gacagtaccagatcgcatctcggaa

SEQ ID NO: 434209 - DNA, 25 bp, Mus musculus
gacagtactcggtgttaaaaagcag

SEQ ID NO: 434210 - DNA, 25 bp, Mus musculus
gacagtactcttctactcgtgcaga

SEQ ID NO: 434211 - DNA, 25 bp, Mus musculus
gacagtagccgggaagttggtccac

SEQ ID NO: 434212 - DNA, 25 bp, Mus musculus
gacagtatctccttctgcttttaaa

SEQ ID NO: 434213 - DNA, 25 bp, Mus musculus
gacagtatggctctgaccgtcatca

SEQ ID NO: 434214 - DNA, 25 bp, Mus musculus
gacagtcaacaagggcaccaggata

SEQ ID NO: 434215 - DNA, 25 bp, Mus musculus
gacagtcaatccaacctcttttagc

SEQ ID NO: 434216 - DNA, 25 bp, Mus musculus
gacagtcactagacctctctgtgcc

SEQ ID NO: 434217 - DNA, 25 bp, Mus musculus
gacagtcactattacgggagctgag

SEQ ID NO: 434218 - DNA, 25 bp, Mus musculus
gacagtcactcactcttcaggcggt

SEQ ID NO: 434219 - DNA, 25 bp, Mus musculus
gacagtcactgcgagtgtaacgagc

SEQ ID NO: 434220 - DNA, 25 bp, Mus musculus
gacagtcagaaaagcagtgaggtag

SEQ ID NO: 434221 - DNA, 25 bp, Mus musculus
gacagtcatggatcggtactccgcg

SEQ ID NO: 434222 - DNA, 25 bp, Mus musculus
gacagtccctgagaacgtgccagta

SEQ ID NO: 434223 - DNA, 25 bp, Mus musculus
gacagtccgatgttctgggcaacac

SEQ ID NO: 434224 - DNA, 25 bp, Mus musculus
gacagtccggtgcatctcagaagtt

SEQ ID NO: 434225 - DNA, 25 bp, Mus musculus
gacagtccgtcatggcagagaaaac

SEQ ID NO: 434226 - DNA, 25 bp, Mus musculus
gacagtcctgcatgtccatattcca

SEQ ID NO: 434227 - DNA, 25 bp, Mus musculus
gacagtctaaagaagcggccagcct

SEQ ID NO: 434228 - DNA, 25 bp, Mus musculus
gacagtctccgcgaagaataaagct

SEQ ID NO: 434229 - DNA, 25 bp, Mus musculus
gacagtctcttggtacatagggcat

SEQ ID NO: 434230 - DNA, 25 bp, Mus musculus
gacagtctgaagaaatcctgccagg

SEQ ID NO: 434231 - DNA, 25 bp, Mus musculus
gacagtctgacgttattcccttcat

SEQ ID NO: 434232 - DNA, 25 bp, Mus musculus
gacagtctgagtgcagcatccggga

SEQ ID NO: 434233 - DNA, 25 bp, Mus musculus
gacagtctggctggaatctgactca

SEQ ID NO: 434234 - DNA, 25 bp, Mus musculus
gacagtctgttgacatgagcaagaa

SEQ ID NO: 434235 - DNA, 25 bp, Mus musculus
gacagtcttgtggaactgggcgact

SEQ ID NO: 434236 - DNA, 25 bp, Mus musculus
gacagtgaacacctacatcgaccag

SEQ ID NO: 434237 - DNA, 25 bp, Mus musculus
gacagtgaactagtgtgactcggac

SEQ ID NO: 434238 - DNA, 25 bp, Mus musculus
gacagtgacactaacaaagttgcca

SEQ ID NO: 434239 - DNA, 25 bp, Mus musculus
gacagtgaccaaagtgtgaccccag

SEQ ID NO: 434240 - DNA, 25 bp, Mus musculus
gacagtgaccttatagacagcacca

SEQ ID NO: 434241 - DNA, 25 bp, Mus musculus
gacagtgactcagatctcagctcct

SEQ ID NO: 434242 - DNA, 25 bp, Mus musculus
gacagtgagtacaacgtggattcct

SEQ ID NO: 434243 - DNA, 25 bp, Mus musculus
gacagtgagtatgcagtcatgagca

SEQ ID NO: 434244 - DNA, 25 bp, Mus musculus
gacagtgataggttctggccctgga

SEQ ID NO: 434245 - DNA, 25 bp, Mus musculus
gacagtgatccaatgccagcacaca

SEQ ID NO: 434246 - DNA, 25 bp, Mus musculus
gacagtgattagcttgaccagtcaa

SEQ ID NO: 434247 - DNA, 25 bp, Mus musculus
gacagtgattcagagcctagtgcct

SEQ ID NO: 434248 - DNA, 25 bp, Mus musculus
gacagtgccctggagtctaaatcta

SEQ ID NO: 434249 - DNA, 25 bp, Mus musculus
gacagtgccttagtggaacctcgct

SEQ ID NO: 434250 - DNA, 25 bp, Mus musculus
gacagtggagctcctcaccaagaaa

SEQ ID NO: 434251 - DNA, 25 bp, Mus musculus
gacagtggcacagtgatgtcttcag

SEQ ID NO: 434252 - DNA, 25 bp, Mus musculus
gacagtggcactcaggtaattcgga

SEQ ID NO: 434253 - DNA, 25 bp, Mus musculus
gacagtggcacttctggcgtagcgc

SEQ ID NO: 434254 - DNA, 25 bp, Mus musculus
gacagtggccctcctatgagaggca

SEQ ID NO: 434255 - DNA, 25 bp, Mus musculus
gacagtggcctgtaccttgggatga

SEQ ID NO: 434256 - DNA, 25 bp, Mus musculus
gacagtggctacgtgagtgcctaca

SEQ ID NO: 434257 - DNA, 25 bp, Mus musculus
gacagtgggctctgctgtaggaaaa

SEQ ID NO: 434258 - DNA, 25 bp, Mus musculus
gacagtggtcctggcgatagcaacc

SEQ ID NO: 434259 - DNA, 25 bp, Mus musculus
gacagtggtttggacacctagacag

SEQ ID NO: 434260 - DNA, 25 bp, Mus musculus
gacagtgtacttgacttaccaggga

SEQ ID NO: 434261 - DNA, 25 bp, Mus musculus
gacagtgtcacaaagccagatcaag

SEQ ID NO: 434262 - DNA, 25 bp, Mus musculus
gacagtgtcactagcttgtctctta

SEQ ID NO: 434263 - DNA, 25 bp, Mus musculus
gacagtgtcatggtgagaccttgag

SEQ ID NO: 434264 - DNA, 25 bp, Mus musculus
gacagtgtccataccgctggcttga

SEQ ID NO: 434265 - DNA, 25 bp, Mus musculus
gacagtgtccattgagccagggcag

SEQ ID NO: 434266 - DNA, 25 bp, Mus musculus
gacagtgtctaagcgctcattccca

SEQ ID NO: 434267 - DNA, 25 bp, Mus musculus
gacagtgtctatgcagccagtcaga

SEQ ID NO: 434268 - DNA, 25 bp, Mus musculus
gacagtgttctgatgctggccaacg

SEQ ID NO: 434269 - DNA, 25 bp, Mus musculus
gacagtgttgacctcgagtggcatc

SEQ ID NO: 434270 - DNA, 25 bp, Mus musculus
gacagttaatgagctggccagcgct

SEQ ID NO: 434271 - DNA, 25 bp, Mus musculus
gacagttagagattgcccagggctg

SEQ ID NO: 434272 - DNA, 25 bp, Mus musculus
gacagttagcagtattaacaatggg

SEQ ID NO: 434273 - DNA, 25 bp, Mus musculus
gacagttatgatgacgtccacggct

SEQ ID NO: 434274 - DNA, 25 bp, Mus musculus
gacagttcagctccccgtgtggaga

SEQ ID NO: 434275 - DNA, 25 bp, Mus musculus
gacagttcatctggtctacctggaa

SEQ ID NO: 434276 - DNA, 25 bp, Mus musculus
gacagttcgtgtactgcggcaagaa

SEQ ID NO: 434277 - DNA, 25 bp, Mus musculus
gacagttctacagactacgggccga

SEQ ID NO: 434278 - DNA, 25 bp, Mus musculus
gacagttgctatggtcgtgacgccc

SEQ ID NO: 434279 - DNA, 25 bp, Mus musculus
gacagttgcttggacgagttttacc

SEQ ID NO: 434280 - DNA, 25 bp, Mus musculus
gacagttggatcgtccctctggaca

SEQ ID NO: 434281 - DNA, 25 bp, Mus musculus
gacagttggcatgggacacggccat

SEQ ID NO: 434282 - DNA, 25 bp, Mus musculus
gacagttgggtctcgcttctcatac

SEQ ID NO: 434283 - DNA, 25 bp, Mus musculus
gacagttgtcaataccaaagattag

SEQ ID NO: 434284 - DNA, 25 bp, Mus musculus
gacagttgtgttctacctattagaa

SEQ ID NO: 434285 - DNA, 25 bp, Mus musculus
gacagttgttccctgtacccatcaa

SEQ ID NO: 434286 - DNA, 25 bp, Mus musculus
gacagtttcaaattcgccagtggaa

SEQ ID NO: 434287 - DNA, 25 bp, Mus musculus
gacagtttcaagtgggcatcgtcca

SEQ ID NO: 434288 - DNA, 25 bp, Mus musculus
gacagtttcgcccaatagatgtgaa

SEQ ID NO: 434289 - DNA, 25 bp, Mus musculus
gacagtttgtctcagacgggacccc

SEQ ID NO: 434290 - DNA, 25 bp, Mus musculus
gacagtttgttttaggagagcctca

SEQ ID NO: 434291 - DNA, 25 bp, Mus musculus
gacagttttacttcacgcagggtgg

SEQ ID NO: 434292 - DNA, 25 bp, Mus musculus
gacagttttagcagacacagttttg

SEQ ID NO: 434293 - DNA, 25 bp, Mus musculus
gacataaaacccaaggtactgggca

SEQ ID NO: 434294 - DNA, 25 bp, Mus musculus
gacataaagtcaaatgccgccgaac

SEQ ID NO: 434295 - DNA, 25 bp, Mus musculus
gacataacatacttctcagatggag

SEQ ID NO: 434296 - DNA, 25 bp, Mus musculus
gacataacatcaccctggcggacat

SEQ ID NO: 434297 - DNA, 25 bp, Mus musculus
gacataacccagattgttcgccgat

SEQ ID NO: 434298 - DNA, 25 bp, Mus musculus
gacataactggcgatggcactacat

SEQ ID NO: 434299 - DNA, 25 bp, Mus musculus
gacataagccagatcttgaccagat

SEQ ID NO: 434300 - DNA, 25 bp, Mus musculus
gacataagctgtcgcattcggacga

SEQ ID NO: 434301 - DNA, 25 bp, Mus musculus
gacataagtatttgcccaggaccca

SEQ ID NO: 434302 - DNA, 25 bp, Mus musculus
gacataattgcctcctcacggcaga

SEQ ID NO: 434303 - DNA, 25 bp, Mus musculus
gacatacatgcaggtcaaataacca

SEQ ID NO: 434304 - DNA, 25 bp, Mus musculus
gacatacatgcatgtcactatgcag

SEQ ID NO: 434305 - DNA, 25 bp, Mus musculus
gacatacattaaaaacctggatcgg

SEQ ID NO: 434306 - DNA, 25 bp, Mus musculus
gacatacctacaagctgaggccgaa

SEQ ID NO: 434307 - DNA, 25 bp, Mus musculus
gacataccttatctatcccataggc

SEQ ID NO: 434308 - DNA, 25 bp, Mus musculus
gacatactacttagactggatccac

SEQ ID NO: 434309 - DNA, 25 bp, Mus musculus
gacatagaactacctgaatacccag

SEQ ID NO: 434310 - DNA, 25 bp, Mus musculus
gacatagaagcaggagatggcacca

SEQ ID NO: 434311 - DNA, 25 bp, Mus musculus
gacatagaccatctcggtggagccc

SEQ ID NO: 434312 - DNA, 25 bp, Mus musculus
gacatagcacgtcttttgcaagaga

SEQ ID NO: 434313 - DNA, 25 bp, Mus musculus
gacatagctttcattggcctcgggc

SEQ ID NO: 434314 - DNA, 25 bp, Mus musculus
gacatatcacgttctctgtcccaag

SEQ ID NO: 434315 - DNA, 25 bp, Mus musculus
gacatatctacacttcgcaccggag

SEQ ID NO: 434316 - DNA, 25 bp, Mus musculus
gacatattacgttactttctagcat

SEQ ID NO: 434317 - DNA, 25 bp, Mus musculus
gacatcaaagcagtccgagagctaa

SEQ ID NO: 434318 - DNA, 25 bp, Mus musculus
gacatcaaataatccattctcaagg

SEQ ID NO: 434319 - DNA, 25 bp, Mus musculus
gacatcaacatcctgcgggtcagca

SEQ ID NO: 434320 - DNA, 25 bp, Mus musculus
gacatcaagaaagaccagggctcca

SEQ ID NO: 434321 - DNA, 25 bp, Mus musculus
gacatcaaggagagcaaggaacacg

SEQ ID NO: 434322 - DNA, 25 bp, Mus musculus
gacatcaaggtgttgcagagcgcct

SEQ ID NO: 434323 - DNA, 25 bp, Mus musculus
gacatcaatgatggagcccgtcagc

SEQ ID NO: 434324 - DNA, 25 bp, Mus musculus
gacatcaatgcattggccccaggga

SEQ ID NO: 434325 - DNA, 25 bp, Mus musculus
gacatcacagatattcaaattcctc

SEQ ID NO: 434326 - DNA, 25 bp, Mus musculus
gacatcacgcatcttgctacgccag

SEQ ID NO: 434327 - DNA, 25 bp, Mus musculus
gacatcacggatgagcgcaaaggca

SEQ ID NO: 434328 - DNA, 25 bp, Mus musculus
gacatcactaatgggtaaaattatg

SEQ ID NO: 434329 - DNA, 25 bp, Mus musculus
gacatcagaagagttgccaaggaca

SEQ ID NO: 434330 - DNA, 25 bp, Mus musculus
gacatcagagcctctctctgagctg

SEQ ID NO: 434331 - DNA, 25 bp, Mus musculus
gacatcagagcttggtgaacactac

SEQ ID NO: 434332 - DNA, 25 bp, Mus musculus
gacatcaggaggttcacttacgtgg

SEQ ID NO: 434333 - DNA, 25 bp, Mus musculus
gacatcatagcgcagccaatcggta

SEQ ID NO: 434334 - DNA, 25 bp, Mus musculus
gacatcatcattctgcgccgacagg

SEQ ID NO: 434335 - DNA, 25 bp, Mus musculus
gacatcatcgtggaggacttcattg

SEQ ID NO: 434336 - DNA, 25 bp, Mus musculus
gacatcatgcttggactactggctg

SEQ ID NO: 434337 - DNA, 25 bp, Mus musculus
gacatcatggaggacctggacacaa

SEQ ID NO: 434338 - DNA, 25 bp, Mus musculus
gacatcatgtgaccacctgaaacct

SEQ ID NO: 434339 - DNA, 25 bp, Mus musculus
gacatcattgagttgagacgcactg

SEQ ID NO: 434340 - DNA, 25 bp, Mus musculus
gacatcattgcccttgtgataagga

SEQ ID NO: 434341 - DNA, 25 bp, Mus musculus
gacatccagcttcaggagtcatcct

SEQ ID NO: 434342 - DNA, 25 bp, Mus musculus
gacatccagttcacaggagccggaa

SEQ ID NO: 434343 - DNA, 25 bp, Mus musculus
gacatccccgaggttctaagggcag

SEQ ID NO: 434344 - DNA, 25 bp, Mus musculus
gacatcccgggtctcaagtaggcct

SEQ ID NO: 434345 - DNA, 25 bp, Mus musculus
gacatcccttttgtgttcaacatgg

SEQ ID NO: 434346 - DNA, 25 bp, Mus musculus
gacatccgatgcacaagcttcaagg

SEQ ID NO: 434347 - DNA, 25 bp, Mus musculus
gacatccgtaatgcctatgccgaag

SEQ ID NO: 434348 - DNA, 25 bp, Mus musculus
gacatcctgagatcacgaggccagg

SEQ ID NO: 434349 - DNA, 25 bp, Mus musculus
gacatcctgcctcgtgaactgaaca

SEQ ID NO: 434350 - DNA, 25 bp, Mus musculus
gacatcctggaaatgactgtgcgct

SEQ ID NO: 434351 - DNA, 25 bp, Mus musculus
gacatcctgggaacgtctgactgtg

SEQ ID NO: 434352 - DNA, 25 bp, Mus musculus
gacatcctgtggttatcgtaattat

SEQ ID NO: 434353 - DNA, 25 bp, Mus musculus
gacatcgagcatctcaccggtttgg

SEQ ID NO: 434354 - DNA, 25 bp, Mus musculus
gacatcgagtttatctacacggccc

SEQ ID NO: 434355 - DNA, 25 bp, Mus musculus
gacatcgctgatggtaagtctcctg

SEQ ID NO: 434356 - DNA, 25 bp, Mus musculus
gacatcgtaaacgtgctggagtcgc

SEQ ID NO: 434357 - DNA, 25 bp, Mus musculus
gacatcgtggccattatcttgaacg

SEQ ID NO: 434358 - DNA, 25 bp, Mus musculus
gacatctacagctcgtgcaggaact

SEQ ID NO: 434359 - DNA, 25 bp, Mus musculus
gacatctagcatcatgggaccagga

SEQ ID NO: 434360 - DNA, 25 bp, Mus musculus
gacatctagtatcaacaggcacata

SEQ ID NO: 434361 - DNA, 25 bp, Mus musculus
gacatctatggtctcatggtcttgt

SEQ ID NO: 434362 - DNA, 25 bp, Mus musculus
gacatctcagggacataagcccctg

SEQ ID NO: 434363 - DNA, 25 bp, Mus musculus
gacatctcagttaagcaaaggaaaa

SEQ ID NO: 434364 - DNA, 25 bp, Mus musculus
gacatctccaggcagcttcgggtca

SEQ ID NO: 434365 - DNA, 25 bp, Mus musculus
gacatctccttgatcttggccgtgg

SEQ ID NO: 434366 - DNA, 25 bp, Mus musculus
gacatctcgtggttatggctactct

SEQ ID NO: 434367 - DNA, 25 bp, Mus musculus
gacatctctgaaaggacagacgtgg

SEQ ID NO: 434368 - DNA, 25 bp, Mus musculus
gacatctctgacctagtgcgctgca

SEQ ID NO: 434369 - DNA, 25 bp, Mus musculus
gacatctcttcgaatgggaactggg

SEQ ID NO: 434370 - DNA, 25 bp, Mus musculus
gacatctgccacaaagctttccgga

SEQ ID NO: 434371 - DNA, 25 bp, Mus musculus
gacatctgcgacattctcctgggaa

SEQ ID NO: 434372 - DNA, 25 bp, Mus musculus
gacatctgctggcatgatagacaaa

SEQ ID NO: 434373 - DNA, 25 bp, Mus musculus
gacatctggccccacttcggaagtg

SEQ ID NO: 434374 - DNA, 25 bp, Mus musculus
gacatctggtcactgggccactcta

SEQ ID NO: 434375 - DNA, 25 bp, Mus musculus
gacatctgtatcactctgggcttgc

SEQ ID NO: 434376 - DNA, 25 bp, Mus musculus
gacatctgtggacatctggccagcg

SEQ ID NO: 434377 - DNA, 25 bp, Mus musculus
gacatctgtttccagctatttgctg

SEQ ID NO: 434378 - DNA, 25 bp, Mus musculus
gacatcttcaacctgctgcaggacc

SEQ ID NO: 434379 - DNA, 25 bp, Mus musculus
gacatcttccacgagcacatgcagg

SEQ ID NO: 434380 - DNA, 25 bp, Mus musculus
gacatcttgtgtcttttattactga

SEQ ID NO: 434381 - DNA, 25 bp, Mus musculus
gacatctttcctttggcctgccaaa

SEQ ID NO: 434382 - DNA, 25 bp, Mus musculus
gacatctttcttgggcactgggcgc

SEQ ID NO: 434383 - DNA, 25 bp, Mus musculus
gacatctttggcaatgcggctgccc

SEQ ID NO: 434384 - DNA, 25 bp, Mus musculus
gacatgaaaaacacctaaaactcta

SEQ ID NO: 434385 - DNA, 25 bp, Mus musculus
gacatgaaataaagtggcagccctt

SEQ ID NO: 434386 - DNA, 25 bp, Mus musculus
gacatgaaccagcaccatctgaatg

SEQ ID NO: 434387 - DNA, 25 bp, Mus musculus
gacatgaacggcatcctcctgggat

SEQ ID NO: 434388 - DNA, 25 bp, Mus musculus
gacatgaactgcaacgacgatggcc

SEQ ID NO: 434389 - DNA, 25 bp, Mus musculus
gacatgaatatcgaaggagcctgga

SEQ ID NO: 434390 - DNA, 25 bp, Mus musculus
gacatgaatcaaacagccggagctt

SEQ ID NO: 434391 - DNA, 25 bp, Mus musculus
gacatgaatgctgaccaactggcct

SEQ ID NO: 434392 - DNA, 25 bp, Mus musculus
gacatgactagtgagtgaggcccgc

SEQ ID NO: 434393 - DNA, 25 bp, Mus musculus
gacatgagaccaaggtgcatcggca

SEQ ID NO: 434394 - DNA, 25 bp, Mus musculus
gacatgagagacttctcccctgaag

SEQ ID NO: 434395 - DNA, 25 bp, Mus musculus
gacatgagagatgtgactctacccc

SEQ ID NO: 434396 - DNA, 25 bp, Mus musculus
gacatgagagggaaataccggtgcc

SEQ ID NO: 434397 - DNA, 25 bp, Mus musculus
gacatgagctgctgaagttggctcc

SEQ ID NO: 434398 - DNA, 25 bp, Mus musculus
gacatgagcttcagccagtagaaag

SEQ ID NO: 434399 - DNA, 25 bp, Mus musculus
gacatgaggattgccgctgttttcc

SEQ ID NO: 434400 - DNA, 25 bp, Mus musculus
gacatgaggcagtcagccagtacct

SEQ ID NO: 434401 - DNA, 25 bp, Mus musculus
gacatgagtagcaaagaggtcctga

SEQ ID NO: 434402 - DNA, 25 bp, Mus musculus
gacatgagtcgtgcccagggtataa

SEQ ID NO: 434403 - DNA, 25 bp, Mus musculus
gacatgatactacgagtcctggagc

SEQ ID NO: 434404 - DNA, 25 bp, Mus musculus
gacatgatagctacgaggtgcacct

SEQ ID NO: 434405 - DNA, 25 bp, Mus musculus
gacatgatcatgaagtacctgggac

SEQ ID NO: 434406 - DNA, 25 bp, Mus musculus
gacatgcaattctgtgggccaaaca

SEQ ID NO: 434407 - DNA, 25 bp, Mus musculus
gacatgcagcgtgaaatcctggcgg

SEQ ID NO: 434408 - DNA, 25 bp, Mus musculus
gacatgcaggaacaagagaacgcgc

SEQ ID NO: 434409 - DNA, 25 bp, Mus musculus
gacatgcattcactagtttatggta

SEQ ID NO: 434410 - DNA, 25 bp, Mus musculus
gacatgccacaggttctagaaggga

SEQ ID NO: 434411 - DNA, 25 bp, Mus musculus
gacatgccagaaggcacaggtgcgc

SEQ ID NO: 434412 - DNA, 25 bp, Mus musculus
gacatgccctgttcagtgcaccctg

SEQ ID NO: 434413 - DNA, 25 bp, Mus musculus
gacatgcgatcgcttgccaagtgac

SEQ ID NO: 434414 - DNA, 25 bp, Mus musculus
gacatgcgctggctacgaaaccaag

SEQ ID NO: 434415 - DNA, 25 bp, Mus musculus
gacatgcgggctcttcaggactttg

SEQ ID NO: 434416 - DNA, 25 bp, Mus musculus
gacatgctctaggtgcaaacaggca

SEQ ID NO: 434417 - DNA, 25 bp, Mus musculus
gacatgctgcaaggttggcctccct

SEQ ID NO: 434418 - DNA, 25 bp, Mus musculus
gacatgctgccggtcatcacaggaa

SEQ ID NO: 434419 - DNA, 25 bp, Mus musculus
gacatgcttttttagttataggtgc

SEQ ID NO: 434420 - DNA, 25 bp, Mus musculus
gacatggaacatgcccgagcttgga

SEQ ID NO: 434421 - DNA, 25 bp, Mus musculus
gacatggacagttctcttaagcagg

SEQ ID NO: 434422 - DNA, 25 bp, Mus musculus
gacatggacggtgaggtcttcatcc

SEQ ID NO: 434423 - DNA, 25 bp, Mus musculus
gacatggactatgagcgggctctcc

SEQ ID NO: 434424 - DNA, 25 bp, Mus musculus
gacatggactgaggaccagataccc

SEQ ID NO: 434425 - DNA, 25 bp, Mus musculus
gacatggagttggacgacttaccta

SEQ ID NO: 434426 - DNA, 25 bp, Mus musculus
gacatggatcagtgccctgggcaag

SEQ ID NO: 434427 - DNA, 25 bp, Mus musculus
gacatggatctggttgcggagcaca

SEQ ID NO: 434428 - DNA, 25 bp, Mus musculus
gacatggatgctgagcacagggccc

SEQ ID NO: 434429 - DNA, 25 bp, Mus musculus
gacatggcacatatcagtgggctcg

SEQ ID NO: 434430 - DNA, 25 bp, Mus musculus
gacatggcccagaacttgaaggact

SEQ ID NO: 434431 - DNA, 25 bp, Mus musculus
gacatggccggcctgcagtacagcc

SEQ ID NO: 434432 - DNA, 25 bp, Mus musculus
gacatggctcagtcaaacactctgg

SEQ ID NO: 434433 - DNA, 25 bp, Mus musculus
gacatggctggctagactctgagga

SEQ ID NO: 434434 - DNA, 25 bp, Mus musculus
gacatggcttctcttgcttgtatga

SEQ ID NO: 434435 - DNA, 25 bp, Mus musculus
gacatggcttcttggagcgcgcctt

SEQ ID NO: 434436 - DNA, 25 bp, Mus musculus
gacatgggaaattgcctagtttggc

SEQ ID NO: 434437 - DNA, 25 bp, Mus musculus
gacatgggagaaggatccacaagtc

SEQ ID NO: 434438 - DNA, 25 bp, Mus musculus
gacatgggccgcttgatatgagtcg

SEQ ID NO: 434439 - DNA, 25 bp, Mus musculus
gacatgggcgccgtgatttaattgg

SEQ ID NO: 434440 - DNA, 25 bp, Mus musculus
gacatgggtactagacttgaggcaa

SEQ ID NO: 434441 - DNA, 25 bp, Mus musculus
gacatgggttctgggcattcaagct

SEQ ID NO: 434442 - DNA, 25 bp, Mus musculus
gacatggtcatcactaggccggaca

SEQ ID NO: 434443 - DNA, 25 bp, Mus musculus
gacatggtctctcgttggcctggta

SEQ ID NO: 434444 - DNA, 25 bp, Mus musculus
gacatggtgctttatccggcacggg

SEQ ID NO: 434445 - DNA, 25 bp, Mus musculus
gacatggtgggcaagaatgacttcc

SEQ ID NO: 434446 - DNA, 25 bp, Mus musculus
gacatggtggtcctgaagcaaagcc

SEQ ID NO: 434447 - DNA, 25 bp, Mus musculus
gacatgtacaaagtggagcccctgg

SEQ ID NO: 434448 - DNA, 25 bp, Mus musculus
gacatgtatattgggtgggctgcac

SEQ ID NO: 434449 - DNA, 25 bp, Mus musculus
gacatgtattgggaggcagccagcc

SEQ ID NO: 434450 - DNA, 25 bp, Mus musculus
gacatgtcacaggtgttctgagcga

SEQ ID NO: 434451 - DNA, 25 bp, Mus musculus
gacatgtctcaggaaaacagctagc

SEQ ID NO: 434452 - DNA, 25 bp, Mus musculus
gacatgtgaaaagttctgggatccc

SEQ ID NO: 434453 - DNA, 25 bp, Mus musculus
gacatgtgcgaccactttaccagtg

SEQ ID NO: 434454 - DNA, 25 bp, Mus musculus
gacatgtggccaagggatctgagcc

SEQ ID NO: 434455 - DNA, 25 bp, Mus musculus
gacatgttccactatacatccacga

SEQ ID NO: 434456 - DNA, 25 bp, Mus musculus
gacatgttccgagaagtcttcgccg

SEQ ID NO: 434457 - DNA, 25 bp, Mus musculus
gacatgttgtacaaactgcggcgct

SEQ ID NO: 434458 - DNA, 25 bp, Mus musculus
gacatgtttagtgcaaccctggccg

SEQ ID NO: 434459 - DNA, 25 bp, Mus musculus
gacatgtttgccacgttcgctcaga

SEQ ID NO: 434460 - DNA, 25 bp, Mus musculus
gacatgtttgtacaaaaggagaaag

SEQ ID NO: 434461 - DNA, 25 bp, Mus musculus
gacattaagactgctgctaggttga

SEQ ID NO: 434462 - DNA, 25 bp, Mus musculus
gacattaaggaagaggttgacccca

SEQ ID NO: 434463 - DNA, 25 bp, Mus musculus
gacattaatgtcaggcagaggccta

SEQ ID NO: 434464 - DNA, 25 bp, Mus musculus
gacattacgtgtctcgttctatcac

SEQ ID NO: 434465 - DNA, 25 bp, Mus musculus
gacattactatgaggccttacctga

SEQ ID NO: 434466 - DNA, 25 bp, Mus musculus
gacattactgctgaagggacaccaa

SEQ ID NO: 434467 - DNA, 25 bp, Mus musculus
gacattagctgtccagttggcagac

SEQ ID NO: 434468 - DNA, 25 bp, Mus musculus
gacattatatacagagcccagctag

SEQ ID NO: 434469 - DNA, 25 bp, Mus musculus
gacattatgcgctccagtttcctga

SEQ ID NO: 434470 - DNA, 25 bp, Mus musculus
gacattatgtcaccggttgatcccg

SEQ ID NO: 434471 - DNA, 25 bp, Mus musculus
gacattattgttagacgacttcctg

SEQ ID NO: 434472 - DNA, 25 bp, Mus musculus
gacattcaaggtacagcagtgggac

SEQ ID NO: 434473 - DNA, 25 bp, Mus musculus
gacattcaaggtatgctgttgttag

SEQ ID NO: 434474 - DNA, 25 bp, Mus musculus
gacattcacaacaagacccggctta

SEQ ID NO: 434475 - DNA, 25 bp, Mus musculus
gacattcacaagatgaaccagtgcc

SEQ ID NO: 434476 - DNA, 25 bp, Mus musculus
gacattcagctggagttcgtgcgca

SEQ ID NO: 434477 - DNA, 25 bp, Mus musculus
gacattcagtgctagtcgcgtgcct

SEQ ID NO: 434478 - DNA, 25 bp, Mus musculus
gacattcataggtcacgagtcggac

SEQ ID NO: 434479 - DNA, 25 bp, Mus musculus
gacattcatgctgctgactttctag

SEQ ID NO: 434480 - DNA, 25 bp, Mus musculus
gacattcatttcaccctactgaaga

SEQ ID NO: 434481 - DNA, 25 bp, Mus musculus
gacattcctcttgacggtacagccg

SEQ ID NO: 434482 - DNA, 25 bp, Mus musculus
gacattcctgaaagctgcagtggag

SEQ ID NO: 434483 - DNA, 25 bp, Mus musculus
gacattcctgaagtctgcaatggga

SEQ ID NO: 434484 - DNA, 25 bp, Mus musculus
gacattccttcagtggccaagtggg

SEQ ID NO: 434485 - DNA, 25 bp, Mus musculus
gacattcgagagaagcaccggctat

SEQ ID NO: 434486 - DNA, 25 bp, Mus musculus
gacattcgagagttggtgcccagta

SEQ ID NO: 434487 - DNA, 25 bp, Mus musculus
gacattcgagcaggaacccttggga

SEQ ID NO: 434488 - DNA, 25 bp, Mus musculus
gacattcggagaaactgcaatccag

SEQ ID NO: 434489 - DNA, 25 bp, Mus musculus
gacattctagcactctggccgggag

SEQ ID NO: 434490 - DNA, 25 bp, Mus musculus
gacattctctgtgacgtgacgctga

SEQ ID NO: 434491 - DNA, 25 bp, Mus musculus
gacattcttccccacactcaggttg

SEQ ID NO: 434492 - DNA, 25 bp, Mus musculus
gacattcttggctgagcacgttcac

SEQ ID NO: 434493 - DNA, 25 bp, Mus musculus
gacattgaacttgctgcacggtgcc

SEQ ID NO: 434494 - DNA, 25 bp, Mus musculus
gacattgaagcatcagtctccgcca

SEQ ID NO: 434495 - DNA, 25 bp, Mus musculus
gacattgactgcaagggacacggac

SEQ ID NO: 434496 - DNA, 25 bp, Mus musculus
gacattgaggacttaaggaccagcc

SEQ ID NO: 434497 - DNA, 25 bp, Mus musculus
gacattgagtctgaccttgaccgag

SEQ ID NO: 434498 - DNA, 25 bp, Mus musculus
gacattgatgtgatgggcctgacct

SEQ ID NO: 434499 - DNA, 25 bp, Mus musculus
gacattgcactgtcagctgggatct

SEQ ID NO: 434500 - DNA, 25 bp, Mus musculus
gacattgccatctttatcagcgcag

SEQ ID NO: 434501 - DNA, 25 bp, Mus musculus
gacattgcccacatgacccgttgta

SEQ ID NO: 434502 - DNA, 25 bp, Mus musculus
gacattgcccaggaaatctcagaag

SEQ ID NO: 434503 - DNA, 25 bp, Mus musculus
gacattgcctaccaaaagctcagcg

SEQ ID NO: 434504 - DNA, 25 bp, Mus musculus
gacattgccttgttgctgctagcca

SEQ ID NO: 434505 - DNA, 25 bp, Mus musculus
gacattgctattgcgcaggcttaag

SEQ ID NO: 434506 - DNA, 25 bp, Mus musculus
gacattgctccaaatcagagggtgg

SEQ ID NO: 434507 - DNA, 25 bp, Mus musculus
gacattgctcggattctctaattaa

SEQ ID NO: 434508 - DNA, 25 bp, Mus musculus
gacattgggaagacagatccggcac

SEQ ID NO: 434509 - DNA, 25 bp, Mus musculus
gacattgggagcctataagcacgaa

SEQ ID NO: 434510 - DNA, 25 bp, Mus musculus
gacattggtacctgctgattcccgg

SEQ ID NO: 434511 - DNA, 25 bp, Mus musculus
gacattggtcagagaggcacgtaga

SEQ ID NO: 434512 - DNA, 25 bp, Mus musculus
gacattgtaggaggaactatggcca

SEQ ID NO: 434513 - DNA, 25 bp, Mus musculus
gacattgtcaccatgtaacggttaa

SEQ ID NO: 434514 - DNA, 25 bp, Mus musculus
gacattgtgaatcagtactctggaa

SEQ ID NO: 434515 - DNA, 25 bp, Mus musculus
gacattgtgaccaagcaggccttcg

SEQ ID NO: 434516 - DNA, 25 bp, Mus musculus
gacattgtgttgttgttcctgccca

SEQ ID NO: 434517 - DNA, 25 bp, Mus musculus
gacatttaaaactaggcatcacggt

SEQ ID NO: 434518 - DNA, 25 bp, Mus musculus
gacatttaagagtcccatccctgtg

SEQ ID NO: 434519 - DNA, 25 bp, Mus musculus
gacatttaagctcgactacagccgg

SEQ ID NO: 434520 - DNA, 25 bp, Mus musculus
gacatttacagagcacggcagcaga

SEQ ID NO: 434521 - DNA, 25 bp, Mus musculus
gacatttaccttggatgacggagcc

SEQ ID NO: 434522 - DNA, 25 bp, Mus musculus
gacatttacttttcacgcgatggaa

SEQ ID NO: 434523 - DNA, 25 bp, Mus musculus
gacatttattttactgtcgattaga

SEQ ID NO: 434524 - DNA, 25 bp, Mus musculus
gacatttcagaaagaataaccgctt

SEQ ID NO: 434525 - DNA, 25 bp, Mus musculus
gacatttccgttaatgcagctacgc

SEQ ID NO: 434526 - DNA, 25 bp, Mus musculus
gacatttctcatcctgatcatttgg

SEQ ID NO: 434527 - DNA, 25 bp, Mus musculus
gacatttctgaaacctcaagccggg

SEQ ID NO: 434528 - DNA, 25 bp, Mus musculus
gacatttctgtctcgaggttttctg

SEQ ID NO: 434529 - DNA, 25 bp, Mus musculus
gacatttgatgacagtgcgctcctc

SEQ ID NO: 434530 - DNA, 25 bp, Mus musculus
gacatttgcctatagccccagagct

SEQ ID NO: 434531 - DNA, 25 bp, Mus musculus
gacatttgctctgaaaactcagcga

SEQ ID NO: 434532 - DNA, 25 bp, Mus musculus
gacatttggatgaagttgcaagcac

SEQ ID NO: 434533 - DNA, 25 bp, Mus musculus
gacatttggcactgttcctggaacc

SEQ ID NO: 434534 - DNA, 25 bp, Mus musculus
gacatttgtacattcagcatggagc

SEQ ID NO: 434535 - DNA, 25 bp, Mus musculus
gacattttaaagaagactccggcct

SEQ ID NO: 434536 - DNA, 25 bp, Mus musculus
gacattttaggaggagaagcaaggc

SEQ ID NO: 434537 - DNA, 25 bp, Mus musculus
gacattttgaagaggctggcgcaca

SEQ ID NO: 434538 - DNA, 25 bp, Mus musculus
gacattttgctcctgacagacccgg

SEQ ID NO: 434539 - DNA, 25 bp, Mus musculus
gacatttttttctacccgggcagca

SEQ ID NO: 434540 - DNA, 25 bp, Mus musculus
gaccaaaacctacgtgaaatgccca

SEQ ID NO: 434541 - DNA, 25 bp, Mus musculus
gaccaaaagaccagtgtgtgccacc

SEQ ID NO: 434542 - DNA, 25 bp, Mus musculus
gaccaaaccgtttctctggcggtgg

SEQ ID NO: 434543 - DNA, 25 bp, Mus musculus
gaccaaactgaccttagactcagaa

SEQ ID NO: 434544 - DNA, 25 bp, Mus musculus
gaccaaagagtctaaaagaagagat

SEQ ID NO: 434545 - DNA, 25 bp, Mus musculus
gaccaaagtcagacctgtaagccat

SEQ ID NO: 434546 - DNA, 25 bp, Mus musculus
gaccaaagttgagcttcaggccaag

SEQ ID NO: 434547 - DNA, 25 bp, Mus musculus
gaccaaatgctagacgtggcccagg

SEQ ID NO: 434548 - DNA, 25 bp, Mus musculus
gaccaaatggacacttgtcagtctg

SEQ ID NO: 434549 - DNA, 25 bp, Mus musculus
gaccaaatggctcggaatcctgctg

SEQ ID NO: 434550 - DNA, 25 bp, Mus musculus
gaccaacaaggcatgtgtccccagg

SEQ ID NO: 434551 - DNA, 25 bp, Mus musculus
gaccaacatcaccatctcagtagag

SEQ ID NO: 434552 - DNA, 25 bp, Mus musculus
gaccaacccggtaagggcagcttct

SEQ ID NO: 434553 - DNA, 25 bp, Mus musculus
gaccaacctgctcatgatctctgtg

SEQ ID NO: 434554 - DNA, 25 bp, Mus musculus
gaccaacgactacatgcagcctgaa

SEQ ID NO: 434555 - DNA, 25 bp, Mus musculus
gaccaacggtctaaaaagcatctgc

SEQ ID NO: 434556 - DNA, 25 bp, Mus musculus
gaccaacttactgcctagaatataa

SEQ ID NO: 434557 - DNA, 25 bp, Mus musculus
gaccaacttttgtgcaattaaccat

SEQ ID NO: 434558 - DNA, 25 bp, Mus musculus
gaccaagacaatatgcaagaggtct

SEQ ID NO: 434559 - DNA, 25 bp, Mus musculus
gaccaagacggctgcttgccagaag

SEQ ID NO: 434560 - DNA, 25 bp, Mus musculus
gaccaagactttacgcgggaagagc

SEQ ID NO: 434561 - DNA, 25 bp, Mus musculus
gaccaagaggcacaaactgagatct

SEQ ID NO: 434562 - DNA, 25 bp, Mus musculus
gaccaagattctagagcgagctccc

SEQ ID NO: 434563 - DNA, 25 bp, Mus musculus
gaccaagatttgtcctccagcttta

SEQ ID NO: 434564 - DNA, 25 bp, Mus musculus
gaccaagctttggatgctcagcaca

SEQ ID NO: 434565 - DNA, 25 bp, Mus musculus
gaccaaggccatctcattttcaggg

SEQ ID NO: 434566 - DNA, 25 bp, Mus musculus
gaccaagggacgctcaaaacccatc

SEQ ID NO: 434567 - DNA, 25 bp, Mus musculus
gaccaagggtggactcagtgcttct

SEQ ID NO: 434568 - DNA, 25 bp, Mus musculus
gaccaaggtcagtacttagactcgg

SEQ ID NO: 434569 - DNA, 25 bp, Mus musculus
gaccaaggtccttgtccgtgtcttc

SEQ ID NO: 434570 - DNA, 25 bp, Mus musculus
gaccaaggtgtctacaaggccatga

SEQ ID NO: 434571 - DNA, 25 bp, Mus musculus
gaccaagtgacttccggtttcgtcg

SEQ ID NO: 434572 - DNA, 25 bp, Mus musculus
gaccaagtggtttcccaagtcgcca

SEQ ID NO: 434573 - DNA, 25 bp, Mus musculus
gaccaagtgtggcttgtccacgact

SEQ ID NO: 434574 - DNA, 25 bp, Mus musculus
gaccaagtttcacatccatcaccgt

SEQ ID NO: 434575 - DNA, 25 bp, Mus musculus
gaccaatcattctgtgtgtgaccaa

SEQ ID NO: 434576 - DNA, 25 bp, Mus musculus
gaccaatgaccaggttgacccttcg

SEQ ID NO: 434577 - DNA, 25 bp, Mus musculus
gaccaatggcttttctgatcgctct

SEQ ID NO: 434578 - DNA, 25 bp, Mus musculus
gaccaattcccatgaagcagcagct

SEQ ID NO: 434579 - DNA, 25 bp, Mus musculus
gaccaattgaagaaatgacttgtca

SEQ ID NO: 434580 - DNA, 25 bp, Mus musculus
gaccaattgggactcttaaccgctg

SEQ ID NO: 434581 - DNA, 25 bp, Mus musculus
gaccacaataaaagcttgtttttat

SEQ ID NO: 434582 - DNA, 25 bp, Mus musculus
gaccacacagaagaagggacaagca

SEQ ID NO: 434583 - DNA, 25 bp, Mus musculus
gaccacacctcaaagaaagaagatg

SEQ ID NO: 434584 - DNA, 25 bp, Mus musculus
gaccacactcagaagtattccagga

SEQ ID NO: 434585 - DNA, 25 bp, Mus musculus
gaccacagtttgacctaatagatga

SEQ ID NO: 434586 - DNA, 25 bp, Mus musculus
gaccacataaggaagaaacagcatt

SEQ ID NO: 434587 - DNA, 25 bp, Mus musculus
gaccacatcgtgtgaagcctggcca

SEQ ID NO: 434588 - DNA, 25 bp, Mus musculus
gaccacattcactggaagtctgtgg

SEQ ID NO: 434589 - DNA, 25 bp, Mus musculus
gaccaccatgtttcggatccctgag

SEQ ID NO: 434590 - DNA, 25 bp, Mus musculus
gaccaccccgtgaaagaagatttga

SEQ ID NO: 434591 - DNA, 25 bp, Mus musculus
gaccacctaaagtggattacggcac

SEQ ID NO: 434592 - DNA, 25 bp, Mus musculus
gaccacctaatgctgagcctggaca

SEQ ID NO: 434593 - DNA, 25 bp, Mus musculus
gaccacctacttttaaagacaatca

SEQ ID NO: 434594 - DNA, 25 bp, Mus musculus
gaccacctgaaacctgcattattag

SEQ ID NO: 434595 - DNA, 25 bp, Mus musculus
gaccacgagaagagagtcatgcaac

SEQ ID NO: 434596 - DNA, 25 bp, Mus musculus
gaccacgaggtgtaagggaaatctt

SEQ ID NO: 434597 - DNA, 25 bp, Mus musculus
gaccacgcccttgttctcagaagtg

SEQ ID NO: 434598 - DNA, 25 bp, Mus musculus
gaccacgcctaggaatgaagttttt

SEQ ID NO: 434599 - DNA, 25 bp, Mus musculus
gaccacggagggagcaaagtttcag

SEQ ID NO: 434600 - DNA, 25 bp, Mus musculus
gaccacggatctaagggaacacgag

SEQ ID NO: 434601 - DNA, 25 bp, Mus musculus
gaccacgtactaagtgctcaccaag

SEQ ID NO: 434602 - DNA, 25 bp, Mus musculus
gaccacgtggctgcttagcgttgga

SEQ ID NO: 434603 - DNA, 25 bp, Mus musculus
gaccacgtggtgatctagataatcc

SEQ ID NO: 434604 - DNA, 25 bp, Mus musculus
gaccacgtgtatcacttatgcccct

SEQ ID NO: 434605 - DNA, 25 bp, Mus musculus
gaccactacaacactctggcggagg

SEQ ID NO: 434606 - DNA, 25 bp, Mus musculus
gaccactatgtgctggagtaccgca

SEQ ID NO: 434607 - DNA, 25 bp, Mus musculus
gaccactcaatgaaaccttttcttg

SEQ ID NO: 434608 - DNA, 25 bp, Mus musculus
gaccactctgaggtattcggtgcag

SEQ ID NO: 434609 - DNA, 25 bp, Mus musculus
gaccactgaaactgcacctgaggag

SEQ ID NO: 434610 - DNA, 25 bp, Mus musculus
gaccactgagcagtaattgcccaag

SEQ ID NO: 434611 - DNA, 25 bp, Mus musculus
gaccactgatccatctctctgaaac

SEQ ID NO: 434612 - DNA, 25 bp, Mus musculus
gaccactgccaagtggcttctgcaa

SEQ ID NO: 434613 - DNA, 25 bp, Mus musculus
gaccactggctgacttaactctgag

SEQ ID NO: 434614 - DNA, 25 bp, Mus musculus
gaccactgtgggatacggtgacatg

SEQ ID NO: 434615 - DNA, 25 bp, Mus musculus
gaccacttcccctgaagaaatgcaa

SEQ ID NO: 434616 - DNA, 25 bp, Mus musculus
gaccacttgacaaaggaggacctga

SEQ ID NO: 434617 - DNA, 25 bp, Mus musculus
gaccacttgcgatgtgtgcggcaaa

SEQ ID NO: 434618 - DNA, 25 bp, Mus musculus
gaccacttggctttctcttctatca

SEQ ID NO: 434619 - DNA, 25 bp, Mus musculus
gaccactttcagtgtcgggcagttg

SEQ ID NO: 434620 - DNA, 25 bp, Mus musculus
gaccagaaaacccaaccagatggct

SEQ ID NO: 434621 - DNA, 25 bp, Mus musculus
gaccagaacttgtgaaaatcgccga

SEQ ID NO: 434622 - DNA, 25 bp, Mus musculus
gaccagaagtggacgatggcactag

SEQ ID NO: 434623 - DNA, 25 bp, Mus musculus
gaccagaatactaagctctcaagag

SEQ ID NO: 434624 - DNA, 25 bp, Mus musculus
gaccagactgtgttgggcgacagct

SEQ ID NO: 434625 - DNA, 25 bp, Mus musculus
gaccagagaaatttctgatcactct

SEQ ID NO: 434626 - DNA, 25 bp, Mus musculus
gaccagagaccctggtgaacccagg

SEQ ID NO: 434627 - DNA, 25 bp, Mus musculus
gaccagagccttatcccctgagaga

SEQ ID NO: 434628 - DNA, 25 bp, Mus musculus
gaccagagctggatacacacataca

SEQ ID NO: 434629 - DNA, 25 bp, Mus musculus
gaccagagtctgctacactctccag

SEQ ID NO: 434630 - DNA, 25 bp, Mus musculus
gaccagagtctttcatccgccagag

SEQ ID NO: 434631 - DNA, 25 bp, Mus musculus
gaccagagtgggacaagcattaccg

SEQ ID NO: 434632 - DNA, 25 bp, Mus musculus
gaccagatccttcgtctcagcgtag

SEQ ID NO: 434633 - DNA, 25 bp, Mus musculus
gaccagatttacagaggagccttgc

SEQ ID NO: 434634 - DNA, 25 bp, Mus musculus
gaccagcacatactatagtcactgt

SEQ ID NO: 434635 - DNA, 25 bp, Mus musculus
gaccagcaccgcgtggtagtcgctg

SEQ ID NO: 434636 - DNA, 25 bp, Mus musculus
gaccagcacgagatagaacgcaagg

SEQ ID NO: 434637 - DNA, 25 bp, Mus musculus
gaccagcatgcttgtcccaaagaac

SEQ ID NO: 434638 - DNA, 25 bp, Mus musculus
gaccagccactggatcaagcactag

SEQ ID NO: 434639 - DNA, 25 bp, Mus musculus
gaccagccagtgttagaggataccc

SEQ ID NO: 434640 - DNA, 25 bp, Mus musculus
gaccagcccagtagaagactatatg

SEQ ID NO: 434641 - DNA, 25 bp, Mus musculus
gaccagccccattttgacataaagg

SEQ ID NO: 434642 - DNA, 25 bp, Mus musculus
gaccagccgagcaggatgacttttc

SEQ ID NO: 434643 - DNA, 25 bp, Mus musculus
gaccagccgcaagctaaagactcat

SEQ ID NO: 434644 - DNA, 25 bp, Mus musculus
gaccagcctctgctgcatggataga

SEQ ID NO: 434645 - DNA, 25 bp, Mus musculus
gaccagcctgagacagattctccaa

SEQ ID NO: 434646 - DNA, 25 bp, Mus musculus
gaccagcctgcgctttcagtaaaga

SEQ ID NO: 434647 - DNA, 25 bp, Mus musculus
gaccagccttgttttgtacaagcag

SEQ ID NO: 434648 - DNA, 25 bp, Mus musculus
gaccagcgagggttctgtgtgccaa

SEQ ID NO: 434649 - DNA, 25 bp, Mus musculus
gaccagcgattctataggacagtga

SEQ ID NO: 434650 - DNA, 25 bp, Mus musculus
gaccagctcgagcaagtcctttgaa

SEQ ID NO: 434651 - DNA, 25 bp, Mus musculus
gaccagctcgatggaaatgctacct

SEQ ID NO: 434652 - DNA, 25 bp, Mus musculus
gaccagctgcaaactcgggatgctt

SEQ ID NO: 434653 - DNA, 25 bp, Mus musculus
gaccagctgggattggctttacctg

SEQ ID NO: 434654 - DNA, 25 bp, Mus musculus
gaccagcttgctacggaggattcga

SEQ ID NO: 434655 - DNA, 25 bp, Mus musculus
gaccaggaactctgcaagtgtgcat

SEQ ID NO: 434656 - DNA, 25 bp, Mus musculus
gaccaggaacttcaaaatagtgcct

SEQ ID NO: 434657 - DNA, 25 bp, Mus musculus
gaccaggaagcaccagtaacgtttc

SEQ ID NO: 434658 - DNA, 25 bp, Mus musculus
gaccaggacctggtgagaccctcag

SEQ ID NO: 434659 - DNA, 25 bp, Mus musculus
gaccaggactatgagcgaaggctcc

SEQ ID NO: 434660 - DNA, 25 bp, Mus musculus
gaccaggagcaggaatatcgacgac

SEQ ID NO: 434661 - DNA, 25 bp, Mus musculus
gaccaggatgagataatgaatcact

SEQ ID NO: 434662 - DNA, 25 bp, Mus musculus
gaccaggatgctcacaatgatacca

SEQ ID NO: 434663 - DNA, 25 bp, Mus musculus
gaccaggcttagctgagagttttca

SEQ ID NO: 434664 - DNA, 25 bp, Mus musculus
gaccaggctttgaatcgctacctag

SEQ ID NO: 434665 - DNA, 25 bp, Mus musculus
gaccagggacaataagaccatctcg

SEQ ID NO: 434666 - DNA, 25 bp, Mus musculus
gaccagggagatacaaaatagttag

SEQ ID NO: 434667 - DNA, 25 bp, Mus musculus
gaccagggcacatgttctcgggaac

SEQ ID NO: 434668 - DNA, 25 bp, Mus musculus
gaccagggcatattgcggaaccaca

SEQ ID NO: 434669 - DNA, 25 bp, Mus musculus
gaccagggctttctacgaaccaaga

SEQ ID NO: 434670 - DNA, 25 bp, Mus musculus
gaccagggtcagctaggaaacttcc

SEQ ID NO: 434671 - DNA, 25 bp, Mus musculus
gaccagggtggagggaacatactta

SEQ ID NO: 434672 - DNA, 25 bp, Mus musculus
gaccaggtactgtgtaagcagcacc

SEQ ID NO: 434673 - DNA, 25 bp, Mus musculus
gaccaggtctcctcagtagccggag

SEQ ID NO: 434674 - DNA, 25 bp, Mus musculus
gaccaggttaccagttctttgacag

SEQ ID NO: 434675 - DNA, 25 bp, Mus musculus
gaccagtcactgtgcaggaatttat

SEQ ID NO: 434676 - DNA, 25 bp, Mus musculus
gaccagtcattcaaagggccgtgta

SEQ ID NO: 434677 - DNA, 25 bp, Mus musculus
gaccagtcattgtgcaggacctcag

SEQ ID NO: 434678 - DNA, 25 bp, Mus musculus
gaccagtgaatctctcacttgaaca

SEQ ID NO: 434679 - DNA, 25 bp, Mus musculus
gaccagtgagattcccctataagcc

SEQ ID NO: 434680 - DNA, 25 bp, Mus musculus
gaccagtgctatgacgacatccgtg

SEQ ID NO: 434681 - DNA, 25 bp, Mus musculus
gaccagtggaaagactgggtctacc

SEQ ID NO: 434682 - DNA, 25 bp, Mus musculus
gaccagtgttccaagcagatccaat

SEQ ID NO: 434683 - DNA, 25 bp, Mus musculus
gaccagtgtttactcgcctctgaga

SEQ ID NO: 434684 - DNA, 25 bp, Mus musculus
gaccagttgagacaggacccatgaa

SEQ ID NO: 434685 - DNA, 25 bp, Mus musculus
gaccagttgttagcattcaagtcag

SEQ ID NO: 434686 - DNA, 25 bp, Mus musculus
gaccagtttaagacagtgcagaccg

SEQ ID NO: 434687 - DNA, 25 bp, Mus musculus
gaccagtttccctatgtccatcagg

SEQ ID NO: 434688 - DNA, 25 bp, Mus musculus
gaccatacccgaagaagacgctgat

SEQ ID NO: 434689 - DNA, 25 bp, Mus musculus
gaccataccgtgagaaagggagctt

SEQ ID NO: 434690 - DNA, 25 bp, Mus musculus
gaccatacctccagtggcacctggg

SEQ ID NO: 434691 - DNA, 25 bp, Mus musculus
gaccatagggcgtttcaagagctct

SEQ ID NO: 434692 - DNA, 25 bp, Mus musculus
gaccatatgactagggcactgtacg

SEQ ID NO: 434693 - DNA, 25 bp, Mus musculus
gaccatattgtcaagcagcagctga

SEQ ID NO: 434694 - DNA, 25 bp, Mus musculus
gaccatcaagctgccagacggacat

SEQ ID NO: 434695 - DNA, 25 bp, Mus musculus
gaccatcagtgacaggaagtacatt

SEQ ID NO: 434696 - DNA, 25 bp, Mus musculus
gaccatccggcgtgtgctttgggca

SEQ ID NO: 434697 - DNA, 25 bp, Mus musculus
gaccatctcttgacagtcctctatg

SEQ ID NO: 434698 - DNA, 25 bp, Mus musculus
gaccatctgcattgagccattctca

SEQ ID NO: 434699 - DNA, 25 bp, Mus musculus
gaccatcttcttgcagccagcagga

SEQ ID NO: 434700 - DNA, 25 bp, Mus musculus
gaccatcttgtactggaacactgcc

SEQ ID NO: 434701 - DNA, 25 bp, Mus musculus
gaccatcttgtcctgagtagcgcct

SEQ ID NO: 434702 - DNA, 25 bp, Mus musculus
gaccatgaactctgaaaattaaaca

SEQ ID NO: 434703 - DNA, 25 bp, Mus musculus
gaccatgaagcagtactggacaacg

SEQ ID NO: 434704 - DNA, 25 bp, Mus musculus
gaccatgaaggcacaacaaaggccc

SEQ ID NO: 434705 - DNA, 25 bp, Mus musculus
gaccatgaattgatccaagaatcag

SEQ ID NO: 434706 - DNA, 25 bp, Mus musculus
gaccatgacagaactggacatccag

SEQ ID NO: 434707 - DNA, 25 bp, Mus musculus
gaccatgatgaagctacggaacgag

SEQ ID NO: 434708 - DNA, 25 bp, Mus musculus
gaccatgatggtgacgatgctgaga

SEQ ID NO: 434709 - DNA, 25 bp, Mus musculus
gaccatgattctgacaataaaccaa

SEQ ID NO: 434710 - DNA, 25 bp, Mus musculus
gaccatgcaggcagactgagtccgt

SEQ ID NO: 434711 - DNA, 25 bp, Mus musculus
gaccatggcaggcaacacactgtca

SEQ ID NO: 434712 - DNA, 25 bp, Mus musculus
gaccatggcgttcatggtgaagtcc

SEQ ID NO: 434713 - DNA, 25 bp, Mus musculus
gaccatggctgggattcacctcaag

SEQ ID NO: 434714 - DNA, 25 bp, Mus musculus
gaccatgggcaagtgatgaacatca

SEQ ID NO: 434715 - DNA, 25 bp, Mus musculus
gaccatgggctatgcatctaccaga

SEQ ID NO: 434716 - DNA, 25 bp, Mus musculus
gaccatgggctcgtatcagctgctg

SEQ ID NO: 434717 - DNA, 25 bp, Mus musculus
gaccatggtcttgtgtgtagcactg

SEQ ID NO: 434718 - DNA, 25 bp, Mus musculus
gaccatggtgaaacgctgcaaacag

SEQ ID NO: 434719 - DNA, 25 bp, Mus musculus
gaccatgtaatcaaagctgaacagc

SEQ ID NO: 434720 - DNA, 25 bp, Mus musculus
gaccatgtaggcctcagattagctg

SEQ ID NO: 434721 - DNA, 25 bp, Mus musculus
gaccatgtccttaaattaattggta

SEQ ID NO: 434722 - DNA, 25 bp, Mus musculus
gaccatgtgctgatgaagttcttgc

SEQ ID NO: 434723 - DNA, 25 bp, Mus musculus
gaccatgtggataggttccctccct

SEQ ID NO: 434724 - DNA, 25 bp, Mus musculus
gaccatgtgtgtccgactcaggaga

SEQ ID NO: 434725 - DNA, 25 bp, Mus musculus
gaccatgtttacagggcctcctcaa

SEQ ID NO: 434726 - DNA, 25 bp, Mus musculus
gaccattagtgaaacagttccgtag

SEQ ID NO: 434727 - DNA, 25 bp, Mus musculus
gaccattatgttactgggcagctag

SEQ ID NO: 434728 - DNA, 25 bp, Mus musculus
gaccattccttaaaagagcattgct

SEQ ID NO: 434729 - DNA, 25 bp, Mus musculus
gaccattctagagttcgacctgcga

SEQ ID NO: 434730 - DNA, 25 bp, Mus musculus
gaccattgaaaaagaagctcacgtg

SEQ ID NO: 434731 - DNA, 25 bp, Mus musculus
gaccattgggaggttcagagcaaac

SEQ ID NO: 434732 - DNA, 25 bp, Mus musculus
gaccatttactgagatgagaacaca

SEQ ID NO: 434733 - DNA, 25 bp, Mus musculus
gaccatttagctacctctgcaccgt

SEQ ID NO: 434734 - DNA, 25 bp, Mus musculus
gaccatttcctgagctttctggaga

SEQ ID NO: 434735 - DNA, 25 bp, Mus musculus
gaccatttcgaatccgcctagcgga

SEQ ID NO: 434736 - DNA, 25 bp, Mus musculus
gaccatttggaagctgtacctgcgc

SEQ ID NO: 434737 - DNA, 25 bp, Mus musculus
gaccatttggagctagttctcaccg

SEQ ID NO: 434738 - DNA, 25 bp, Mus musculus
gacccaacagattgctactcacctg

SEQ ID NO: 434739 - DNA, 25 bp, Mus musculus
gacccaaccaagaaacctgagtgga

SEQ ID NO: 434740 - DNA, 25 bp, Mus musculus
gacccaagagataggcagacagctg

SEQ ID NO: 434741 - DNA, 25 bp, Mus musculus
gacccaagagtgaatcctagtgaca

SEQ ID NO: 434742 - DNA, 25 bp, Mus musculus
gacccaagcctatgaggcggcgtga

SEQ ID NO: 434743 - DNA, 25 bp, Mus musculus
gacccaagcgttttgaggtggctac

SEQ ID NO: 434744 - DNA, 25 bp, Mus musculus
gacccaagttggttgaagcctagga

SEQ ID NO: 434745 - DNA, 25 bp, Mus musculus
gacccacactatggagcatgaggac

SEQ ID NO: 434746 - DNA, 25 bp, Mus musculus
gacccacacttaggaagttggaagt

SEQ ID NO: 434747 - DNA, 25 bp, Mus musculus
gacccacagcattgcacagctagct

SEQ ID NO: 434748 - DNA, 25 bp, Mus musculus
gacccacattgcctttcaagaacaa

SEQ ID NO: 434749 - DNA, 25 bp, Mus musculus
gacccacggatttgctggagcgcaa

SEQ ID NO: 434750 - DNA, 25 bp, Mus musculus
gacccactggatcggctacgaacat

SEQ ID NO: 434751 - DNA, 25 bp, Mus musculus
gacccactgtgcatgttgtacaatg

SEQ ID NO: 434752 - DNA, 25 bp, Mus musculus
gacccactgtgggaacgtactgcag

SEQ ID NO: 434753 - DNA, 25 bp, Mus musculus
gacccacttctgtacctggaggaga

SEQ ID NO: 434754 - DNA, 25 bp, Mus musculus
gacccagaacccctgcatctgtggg

SEQ ID NO: 434755 - DNA, 25 bp, Mus musculus
gacccagaagcttgagaatagtgag

SEQ ID NO: 434756 - DNA, 25 bp, Mus musculus
gacccagaagttctgtacccctgtg

SEQ ID NO: 434757 - DNA, 25 bp, Mus musculus
gacccagagcatggtgccttcgctg

SEQ ID NO: 434758 - DNA, 25 bp, Mus musculus
gacccagagccttgcttattgtaag

SEQ ID NO: 434759 - DNA, 25 bp, Mus musculus
gacccagagctgagaacttgagcct

SEQ ID NO: 434760 - DNA, 25 bp, Mus musculus
gacccagagtttcgatttcagacaa

SEQ ID NO: 434761 - DNA, 25 bp, Mus musculus
gacccagatcatgaatgccgaccag

SEQ ID NO: 434762 - DNA, 25 bp, Mus musculus
gacccagatctatagatcctggatt

SEQ ID NO: 434763 - DNA, 25 bp, Mus musculus
gacccagatgcagaaaaaccccgtt

SEQ ID NO: 434764 - DNA, 25 bp, Mus musculus
gacccagatgcaggaaaggaacaat

SEQ ID NO: 434765 - DNA, 25 bp, Mus musculus
gacccagatgcccactattgagaga

SEQ ID NO: 434766 - DNA, 25 bp, Mus musculus
gacccagcacagctctgacggtagt

SEQ ID NO: 434767 - DNA, 25 bp, Mus musculus
gacccagcatctccaaaatatcgag

SEQ ID NO: 434768 - DNA, 25 bp, Mus musculus
gacccagccaactgaagatccgtgt

SEQ ID NO: 434769 - DNA, 25 bp, Mus musculus
gacccagcctagaatggagcattca

SEQ ID NO: 434770 - DNA, 25 bp, Mus musculus
gacccagcctagagttgagggcaag

SEQ ID NO: 434771 - DNA, 25 bp, Mus musculus
gacccagcggcgacaagaacgtttt

SEQ ID NO: 434772 - DNA, 25 bp, Mus musculus
gacccagctgtggaaatggcaccaa

SEQ ID NO: 434773 - DNA, 25 bp, Mus musculus
gacccagcttccgagagacatttag

SEQ ID NO: 434774 - DNA, 25 bp, Mus musculus
gacccaggcatagtagggcttctga

SEQ ID NO: 434775 - DNA, 25 bp, Mus musculus
gacccaggctcttcctaccagagga

SEQ ID NO: 434776 - DNA, 25 bp, Mus musculus
gacccaggctggtgggcagggcttc

SEQ ID NO: 434777 - DNA, 25 bp, Mus musculus
gacccaggctgtagataagaccgat

SEQ ID NO: 434778 - DNA, 25 bp, Mus musculus
gacccagggcgtgatcaagtacatg

SEQ ID NO: 434779 - DNA, 25 bp, Mus musculus
gacccagtaagtacctgtgtcttcc

SEQ ID NO: 434780 - DNA, 25 bp, Mus musculus
gacccagtccttgctagagaatgag

SEQ ID NO: 434781 - DNA, 25 bp, Mus musculus
gacccagtctatgtcaccaggatca

SEQ ID NO: 434782 - DNA, 25 bp, Mus musculus
gacccagtgcctttgtggcgcacag

SEQ ID NO: 434783 - DNA, 25 bp, Mus musculus
gacccagtgtaaagttcaggcccaa

SEQ ID NO: 434784 - DNA, 25 bp, Mus musculus
gacccataaccagacagcaagaaag

SEQ ID NO: 434785 - DNA, 25 bp, Mus musculus
gacccatagagtaacttgtataaaa

SEQ ID NO: 434786 - DNA, 25 bp, Mus musculus
gacccatcccacttgaaagggctca

SEQ ID NO: 434787 - DNA, 25 bp, Mus musculus
gacccatgctcagggacctggaaaa

SEQ ID NO: 434788 - DNA, 25 bp, Mus musculus
gacccatggctttgcgcatgctaaa

SEQ ID NO: 434789 - DNA, 25 bp, Mus musculus
gacccattatcagctcatgatgttg

SEQ ID NO: 434790 - DNA, 25 bp, Mus musculus
gacccattttggctcagacgctgtg

SEQ ID NO: 434791 - DNA, 25 bp, Mus musculus
gaccccaaagcatttttcagacctg

SEQ ID NO: 434792 - DNA, 25 bp, Mus musculus
gaccccacaggaatggatcctgatg

SEQ ID NO: 434793 - DNA, 25 bp, Mus musculus
gaccccactgctgagatgctagttc

SEQ ID NO: 434794 - DNA, 25 bp, Mus musculus
gaccccagaaggagttcattgtttg

SEQ ID NO: 434795 - DNA, 25 bp, Mus musculus
gaccccaggatcctagtgtgcacta

SEQ ID NO: 434796 - DNA, 25 bp, Mus musculus
gaccccagtgacaaacgtgacgaag

SEQ ID NO: 434797 - DNA, 25 bp, Mus musculus
gaccccatagataacagcagctttg

SEQ ID NO: 434798 - DNA, 25 bp, Mus musculus
gaccccatggttctggatgacttca

SEQ ID NO: 434799 - DNA, 25 bp, Mus musculus
gaccccgagaatatatacagctgca

SEQ ID NO: 434800 - DNA, 25 bp, Mus musculus
gaccccgcagagagcacgttgttct

SEQ ID NO: 434801 - DNA, 25 bp, Mus musculus
gaccccgtcgttaccatgaatcctg

SEQ ID NO: 434802 - DNA, 25 bp, Mus musculus
gaccccgtgtttgagtgagagcaca

SEQ ID NO: 434803 - DNA, 25 bp, Mus musculus
gacccctacgccaaggtgagcattg

SEQ ID NO: 434804 - DNA, 25 bp, Mus musculus
gacccctcggagaagtgtgctaatg

SEQ ID NO: 434805 - DNA, 25 bp, Mus musculus
gacccctctaaacaatatggcctga

SEQ ID NO: 434806 - DNA, 25 bp, Mus musculus
gacccctctgatggcgtttctcaga

SEQ ID NO: 434807 - DNA, 25 bp, Mus musculus
gacccctggaagatgacgtttcaca

SEQ ID NO: 434808 - DNA, 25 bp, Mus musculus
gacccctggagaacggatcaaatgc

SEQ ID NO: 434809 - DNA, 25 bp, Mus musculus
gacccctggagatgtcagtcaccaa

SEQ ID NO: 434810 - DNA, 25 bp, Mus musculus
gacccctgtcaccttggagcttgga

SEQ ID NO: 434811 - DNA, 25 bp, Mus musculus
gacccctgttcataccatctctaga

SEQ ID NO: 434812 - DNA, 25 bp, Mus musculus
gaccccttcattcattaggacattg

SEQ ID NO: 434813 - DNA, 25 bp, Mus musculus
gaccccttgaagatcctggctaatg

SEQ ID NO: 434814 - DNA, 25 bp, Mus musculus
gaccccttgctggaggacaggtgca

SEQ ID NO: 434815 - DNA, 25 bp, Mus musculus
gaccccttggttcaccaatagattg

SEQ ID NO: 434816 - DNA, 25 bp, Mus musculus
gaccccttggttggcggattcacaa

SEQ ID NO: 434817 - DNA, 25 bp, Mus musculus
gaccccttgtggtggttgcagaacc

SEQ ID NO: 434818 - DNA, 25 bp, Mus musculus
gacccgaaccccagatgaagtgtta

SEQ ID NO: 434819 - DNA, 25 bp, Mus musculus
gacccgaaggagttgccaatatcaa

SEQ ID NO: 434820 - DNA, 25 bp, Mus musculus
gacccgaccgaaaagatctacttgg

SEQ ID NO: 434821 - DNA, 25 bp, Mus musculus
gacccgactattgcaagttgtcctc

SEQ ID NO: 434822 - DNA, 25 bp, Mus musculus
gacccgagaccgtgggattgctctt

SEQ ID NO: 434823 - DNA, 25 bp, Mus musculus
gacccgagccctggatgaatctgat

SEQ ID NO: 434824 - DNA, 25 bp, Mus musculus
gacccgcagacagaacctgaaactg

SEQ ID NO: 434825 - DNA, 25 bp, Mus musculus
gacccgcaggtctcagaactctggg

SEQ ID NO: 434826 - DNA, 25 bp, Mus musculus
gacccgcctgagagagaccagttac

SEQ ID NO: 434827 - DNA, 25 bp, Mus musculus
gacccgcgcaaggagcagggcaaac

SEQ ID NO: 434828 - DNA, 25 bp, Mus musculus
gacccgcttgttctgatgataccga

SEQ ID NO: 434829 - DNA, 25 bp, Mus musculus
gacccggaagcctggataaggccag

SEQ ID NO: 434830 - DNA, 25 bp, Mus musculus
gacccggaggagatcatcgtgcttt

SEQ ID NO: 434831 - DNA, 25 bp, Mus musculus
gacccggaggcatctgtaaccttgg

SEQ ID NO: 434832 - DNA, 25 bp, Mus musculus
gacccggaggtgctgtccctcttaa

SEQ ID NO: 434833 - DNA, 25 bp, Mus musculus
gacccggatattttctcagacttgg

SEQ ID NO: 434834 - DNA, 25 bp, Mus musculus
gacccggatccaagggagacctgga

SEQ ID NO: 434835 - DNA, 25 bp, Mus musculus
gacccggccagcgaattcatgtttg

SEQ ID NO: 434836 - DNA, 25 bp, Mus musculus
gacccggcgctatctgtgggatgcc

SEQ ID NO: 434837 - DNA, 25 bp, Mus musculus
gacccggcggaaagaaatgactcaa

SEQ ID NO: 434838 - DNA, 25 bp, Mus musculus
gacccggttaagcaaaggagacatt

SEQ ID NO: 434839 - DNA, 25 bp, Mus musculus
gacccgtaaatctgaagctaatgca

SEQ ID NO: 434840 - DNA, 25 bp, Mus musculus
gacccgtgagaacccaatggtgcct

SEQ ID NO: 434841 - DNA, 25 bp, Mus musculus
gacccgtggcctgacttctggaaga

SEQ ID NO: 434842 - DNA, 25 bp, Mus musculus
gacccgtggtcatgtaggctcaaga

SEQ ID NO: 434843 - DNA, 25 bp, Mus musculus
gacccgttacgtcatgccttggaaa

SEQ ID NO: 434844 - DNA, 25 bp, Mus musculus
gacccgttgctaatcctgtcgcaga

SEQ ID NO: 434845 - DNA, 25 bp, Mus musculus
gacccgttgctcgaatctgtggaca

SEQ ID NO: 434846 - DNA, 25 bp, Mus musculus
gacccgtttgagctacttcttgcag

SEQ ID NO: 434847 - DNA, 25 bp, Mus musculus
gaccctaaagaatggccgagccttg

SEQ ID NO: 434848 - DNA, 25 bp, Mus musculus
gaccctaaatccgaaggccgaggtg

SEQ ID NO: 434849 - DNA, 25 bp, Mus musculus
gaccctaagaaatacgacgtgtgga

SEQ ID NO: 434850 - DNA, 25 bp, Mus musculus
gaccctaagcggcagttgactatga

SEQ ID NO: 434851 - DNA, 25 bp, Mus musculus
gaccctaagctgagctggagagcct

SEQ ID NO: 434852 - DNA, 25 bp, Mus musculus
gaccctacaggctcacatattgaaa

SEQ ID NO: 434853 - DNA, 25 bp, Mus musculus
gaccctagtattttcagcagcctga

SEQ ID NO: 434854 - DNA, 25 bp, Mus musculus
gaccctagtgtcattagctatctag

SEQ ID NO: 434855 - DNA, 25 bp, Mus musculus
gaccctatctttgaccctaaggaga

SEQ ID NO: 434856 - DNA, 25 bp, Mus musculus
gaccctatggataccccagtgctgg

SEQ ID NO: 434857 - DNA, 25 bp, Mus musculus
gaccctcaagacctcaggcacaatg

SEQ ID NO: 434858 - DNA, 25 bp, Mus musculus
gaccctcagatggtagtaggagaga

SEQ ID NO: 434859 - DNA, 25 bp, Mus musculus
gaccctcataagtaccagactctgg

SEQ ID NO: 434860 - DNA, 25 bp, Mus musculus
gaccctcattgccttacctggaaag

SEQ ID NO: 434861 - DNA, 25 bp, Mus musculus
gaccctccataaaaccttcattcag

SEQ ID NO: 434862 - DNA, 25 bp, Mus musculus
gaccctcccgagtagatatgcttgc

SEQ ID NO: 434863 - DNA, 25 bp, Mus musculus
gaccctcccttgatgcagaactgaa

SEQ ID NO: 434864 - DNA, 25 bp, Mus musculus
gaccctccggaatcatctcacgtgt

SEQ ID NO: 434865 - DNA, 25 bp, Mus musculus
gaccctcctcggatggcataggttg

SEQ ID NO: 434866 - DNA, 25 bp, Mus musculus
gaccctcgaaggcacaaaacgatgt

SEQ ID NO: 434867 - DNA, 25 bp, Mus musculus
gaccctcgcagacacaagattacta

SEQ ID NO: 434868 - DNA, 25 bp, Mus musculus
gaccctctacttcgctgcggctttg

SEQ ID NO: 434869 - DNA, 25 bp, Mus musculus
gaccctctcacctggatgctttctt

SEQ ID NO: 434870 - DNA, 25 bp, Mus musculus
gaccctctcactgaagttaaatgac

SEQ ID NO: 434871 - DNA, 25 bp, Mus musculus
gaccctctctgagcctttatgcaaa

SEQ ID NO: 434872 - DNA, 25 bp, Mus musculus
gaccctctgccacatcagactgtga

SEQ ID NO: 434873 - DNA, 25 bp, Mus musculus
gaccctgaaaagttgcaccagctga

SEQ ID NO: 434874 - DNA, 25 bp, Mus musculus
gaccctgaagacacgttcctgggaa

SEQ ID NO: 434875 - DNA, 25 bp, Mus musculus
gaccctgaaggaagactcgtagccg

SEQ ID NO: 434876 - DNA, 25 bp, Mus musculus
gaccctgaagttgagcctagtgctg

SEQ ID NO: 434877 - DNA, 25 bp, Mus musculus
gaccctgagcaacagctggagctga

SEQ ID NO: 434878 - DNA, 25 bp, Mus musculus
gaccctgagcttaagtgacaaactg

SEQ ID NO: 434879 - DNA, 25 bp, Mus musculus
gaccctgagtagtcttgaagcccta

SEQ ID NO: 434880 - DNA, 25 bp, Mus musculus
gaccctgatgcatatacttagaccc

SEQ ID NO: 434881 - DNA, 25 bp, Mus musculus
gaccctgatgctaagaagcctgagg

SEQ ID NO: 434882 - DNA, 25 bp, Mus musculus
gaccctgattagtgacaaatgttga

SEQ ID NO: 434883 - DNA, 25 bp, Mus musculus
gaccctgcaggtaccgtagtgagaa

SEQ ID NO: 434884 - DNA, 25 bp, Mus musculus
gaccctgccaagcttatgtcacagt

SEQ ID NO: 434885 - DNA, 25 bp, Mus musculus
gaccctgcccaaagcaaaaagtcgg

SEQ ID NO: 434886 - DNA, 25 bp, Mus musculus
gaccctgcccatctttgagcttgag

SEQ ID NO: 434887 - DNA, 25 bp, Mus musculus
gaccctgccttggagtgatactggg

SEQ ID NO: 434888 - DNA, 25 bp, Mus musculus
gaccctgcgggacctgatacatgga

SEQ ID NO: 434889 - DNA, 25 bp, Mus musculus
gaccctgcggtctcctgtgggactt

SEQ ID NO: 434890 - DNA, 25 bp, Mus musculus
gaccctgctggagctagctcggaca

SEQ ID NO: 434891 - DNA, 25 bp, Mus musculus
gaccctgctgggaaggattcgaacc

SEQ ID NO: 434892 - DNA, 25 bp, Mus musculus
gaccctggagcagactcagtttgac

SEQ ID NO: 434893 - DNA, 25 bp, Mus musculus
gaccctggcaacatacctgagcaaa

SEQ ID NO: 434894 - DNA, 25 bp, Mus musculus
gaccctggctttggtgtttgccacc

SEQ ID NO: 434895 - DNA, 25 bp, Mus musculus
gaccctgggtatccgcaactcttaa

SEQ ID NO: 434896 - DNA, 25 bp, Mus musculus
gaccctggtatatgcccgactgctg

SEQ ID NO: 434897 - DNA, 25 bp, Mus musculus
gaccctggtcacatgcactttcttt

SEQ ID NO: 434898 - DNA, 25 bp, Mus musculus
gaccctgtctgcgattgctggctaa

SEQ ID NO: 434899 - DNA, 25 bp, Mus musculus
gaccctgtctggctacatgcctgaa

SEQ ID NO: 434900 - DNA, 25 bp, Mus musculus
gaccctgtgagtcatcctctgtggg

SEQ ID NO: 434901 - DNA, 25 bp, Mus musculus
gaccctgtggactcatatccgatgt

SEQ ID NO: 434902 - DNA, 25 bp, Mus musculus
gaccctgtggtgtctaatgcatcca

SEQ ID NO: 434903 - DNA, 25 bp, Mus musculus
gaccctgttgtgttagtggctagac

SEQ ID NO: 434904 - DNA, 25 bp, Mus musculus
gaccctgtttctgaccaggtactag

SEQ ID NO: 434905 - DNA, 25 bp, Mus musculus
gacccttaaaagattcctgtttcat

SEQ ID NO: 434906 - DNA, 25 bp, Mus musculus
gacccttatctgcaggagactcgct

SEQ ID NO: 434907 - DNA, 25 bp, Mus musculus
gacccttcaagctctctatgagaat

SEQ ID NO: 434908 - DNA, 25 bp, Mus musculus
gacccttccggagaggacgatgaga

SEQ ID NO: 434909 - DNA, 25 bp, Mus musculus
gacccttgcttttgcatcgatcgat

SEQ ID NO: 434910 - DNA, 25 bp, Mus musculus
gacccttgtgtcctaaaccatgagg

SEQ ID NO: 434911 - DNA, 25 bp, Mus musculus
gaccctttatatctgcctgacccgg

SEQ ID NO: 434912 - DNA, 25 bp, Mus musculus
gaccctttcggtgcatcagcaacga

SEQ ID NO: 434913 - DNA, 25 bp, Mus musculus
gaccctttgacacggagtatccacg

SEQ ID NO: 434914 - DNA, 25 bp, Mus musculus
gaccctttgtggcatcagcttggag

SEQ ID NO: 434915 - DNA, 25 bp, Mus musculus
gacccttttaggagatggttctatg

SEQ ID NO: 434916 - DNA, 25 bp, Mus musculus
gacccttttggacgaccacattgtg

SEQ ID NO: 434917 - DNA, 25 bp, Mus musculus
gacccttttgtttagctgatcgcac

SEQ ID NO: 434918 - DNA, 25 bp, Mus musculus
gaccgaaacccatcaaaatcttctt

SEQ ID NO: 434919 - DNA, 25 bp, Mus musculus
gaccgaaattttcaaggccgccgct

SEQ ID NO: 434920 - DNA, 25 bp, Mus musculus
gaccgaatatgtggctaatgagaca

SEQ ID NO: 434921 - DNA, 25 bp, Mus musculus
gaccgacatgctctccaattttggg

SEQ ID NO: 434922 - DNA, 25 bp, Mus musculus
gaccgacgtgctgtgcgagttcgac

SEQ ID NO: 434923 - DNA, 25 bp, Mus musculus
gaccgactgaagttaagaacgcccg

SEQ ID NO: 434924 - DNA, 25 bp, Mus musculus
gaccgactgcgttgtgtagcctgtg

SEQ ID NO: 434925 - DNA, 25 bp, Mus musculus
gaccgacttatggtgggcgcacatc

SEQ ID NO: 434926 - DNA, 25 bp, Mus musculus
gaccgagaggctgacgtcttcacca

SEQ ID NO: 434927 - DNA, 25 bp, Mus musculus
gaccgagcaaaagacgagtgagcct

SEQ ID NO: 434928 - DNA, 25 bp, Mus musculus
gaccgaggcaactgcaggatattct

SEQ ID NO: 434929 - DNA, 25 bp, Mus musculus
gaccgagtacctgtttccacagtga

SEQ ID NO: 434930 - DNA, 25 bp, Mus musculus
gaccgagtactcttccctgttcagg

SEQ ID NO: 434931 - DNA, 25 bp, Mus musculus
gaccgagtcgctgagaagagtgcca

SEQ ID NO: 434932 - DNA, 25 bp, Mus musculus
gaccgatactacaggaattactacg

SEQ ID NO: 434933 - DNA, 25 bp, Mus musculus
gaccgatattacacagctttataca

SEQ ID NO: 434934 - DNA, 25 bp, Mus musculus
gaccgatccaccgagtttagctttg

SEQ ID NO: 434935 - DNA, 25 bp, Mus musculus
gaccgatcccagagcttacactgaa

SEQ ID NO: 434936 - DNA, 25 bp, Mus musculus
gaccgatgatgacacgctaggcaga

SEQ ID NO: 434937 - DNA, 25 bp, Mus musculus
gaccgatggtaatcactactggctg

SEQ ID NO: 434938 - DNA, 25 bp, Mus musculus
gaccgattgtatgggcaccctgcca

SEQ ID NO: 434939 - DNA, 25 bp, Mus musculus
gaccgcacctgaggacatcactgaa

SEQ ID NO: 434940 - DNA, 25 bp, Mus musculus
gaccgcacgggcaagagtcatgtct

SEQ ID NO: 434941 - DNA, 25 bp, Mus musculus
gaccgcagcggtttccgctaaccag

SEQ ID NO: 434942 - DNA, 25 bp, Mus musculus
gaccgcaggaaagctcagtggtacc

SEQ ID NO: 434943 - DNA, 25 bp, Mus musculus
gaccgcatgaatccctgtgtgaaag

SEQ ID NO: 434944 - DNA, 25 bp, Mus musculus
gaccgccagtgcacatacaggaaga

SEQ ID NO: 434945 - DNA, 25 bp, Mus musculus
gaccgccgatgagtttgttaaagaa

SEQ ID NO: 434946 - DNA, 25 bp, Mus musculus
gaccgcctcgctgaggtacgctgtg

SEQ ID NO: 434947 - DNA, 25 bp, Mus musculus
gaccgcctgactaggactttctagg

SEQ ID NO: 434948 - DNA, 25 bp, Mus musculus
gaccgcgatggctacagctacggaa

SEQ ID NO: 434949 - DNA, 25 bp, Mus musculus
gaccgcgctttcacatgtagtacaa

SEQ ID NO: 434950 - DNA, 25 bp, Mus musculus
gaccgcgtaagagagaataatactg

SEQ ID NO: 434951 - DNA, 25 bp, Mus musculus
gaccgctctgagcttgtcaggatgc

SEQ ID NO: 434952 - DNA, 25 bp, Mus musculus
gaccgctctgcctaaagctgctcgg

SEQ ID NO: 434953 - DNA, 25 bp, Mus musculus
gaccgcttgcaggtgtcggttgtct

SEQ ID NO: 434954 - DNA, 25 bp, Mus musculus
gaccgctttatagtgcctcatccag

SEQ ID NO: 434955 - DNA, 25 bp, Mus musculus
gaccgcttttgtctggaaccagtcc

SEQ ID NO: 434956 - DNA, 25 bp, Mus musculus
gaccggacggaatatggaccatgca

SEQ ID NO: 434957 - DNA, 25 bp, Mus musculus
gaccggagagttcgcatctgtccct

SEQ ID NO: 434958 - DNA, 25 bp, Mus musculus
gaccggagccaagcactggactatg

SEQ ID NO: 434959 - DNA, 25 bp, Mus musculus
gaccggatctttgccatgatggaca

SEQ ID NO: 434960 - DNA, 25 bp, Mus musculus
gaccggattaacgagtgcattgccc

SEQ ID NO: 434961 - DNA, 25 bp, Mus musculus
gaccggattgtttttgagaacccag

SEQ ID NO: 434962 - DNA, 25 bp, Mus musculus
gaccggcaaaagaatcccagcaagg

SEQ ID NO: 434963 - DNA, 25 bp, Mus musculus
gaccggcaagcacccctatataaga

SEQ ID NO: 434964 - DNA, 25 bp, Mus musculus
gaccggcactaaggtggctgtagtt

SEQ ID NO: 434965 - DNA, 25 bp, Mus musculus
gaccggcctgagacagggctcctga

SEQ ID NO: 434966 - DNA, 25 bp, Mus musculus
gaccggcgccatctcatttgttcag

SEQ ID NO: 434967 - DNA, 25 bp, Mus musculus
gaccggctccataagactgggctga

SEQ ID NO: 434968 - DNA, 25 bp, Mus musculus
gaccggctccctttgacttccagat

SEQ ID NO: 434969 - DNA, 25 bp, Mus musculus
gaccgggaatatgaccagtacagcc

SEQ ID NO: 434970 - DNA, 25 bp, Mus musculus
gaccgggacctgatcaacaaatgcg

SEQ ID NO: 434971 - DNA, 25 bp, Mus musculus
gaccgggccaatggcttttcatctg

SEQ ID NO: 434972 - DNA, 25 bp, Mus musculus
gaccgggcgacaaatgctgcctgaa

SEQ ID NO: 434973 - DNA, 25 bp, Mus musculus
gaccgggttatcctaagcagctcca

SEQ ID NO: 434974 - DNA, 25 bp, Mus musculus
gaccggtgactgttcagcttctaag

SEQ ID NO: 434975 - DNA, 25 bp, Mus musculus
gaccggtgcactgtaaagtggcata

SEQ ID NO: 434976 - DNA, 25 bp, Mus musculus
gaccgtaactaccaccgctttagca

SEQ ID NO: 434977 - DNA, 25 bp, Mus musculus
gaccgtacgtaaagaagatcctctg

SEQ ID NO: 434978 - DNA, 25 bp, Mus musculus
gaccgtagctttctgtgtcccgagg

SEQ ID NO: 434979 - DNA, 25 bp, Mus musculus
gaccgtattccaaaagatgggccat

SEQ ID NO: 434980 - DNA, 25 bp, Mus musculus
gaccgtcagttcttgcgcctgctgg

SEQ ID NO: 434981 - DNA, 25 bp, Mus musculus
gaccgtccggtctaacagatttcac

SEQ ID NO: 434982 - DNA, 25 bp, Mus musculus
gaccgtcgattctcacccagtcaag

SEQ ID NO: 434983 - DNA, 25 bp, Mus musculus
gaccgtgacagcatcaaggttggat

SEQ ID NO: 434984 - DNA, 25 bp, Mus musculus
gaccgtgacttctctcctggtggca

SEQ ID NO: 434985 - DNA, 25 bp, Mus musculus
gaccgtgccaaacttcttactgaaa

SEQ ID NO: 434986 - DNA, 25 bp, Mus musculus
gaccgtgccccgagtacttcaatgg

SEQ ID NO: 434987 - DNA, 25 bp, Mus musculus
gaccgtgctgtatgaccccagtgaa

SEQ ID NO: 434988 - DNA, 25 bp, Mus musculus
gaccgtggcctttattaaaacacag

SEQ ID NO: 434989 - DNA, 25 bp, Mus musculus
gaccgtggctaaacctgcaggatct

SEQ ID NO: 434990 - DNA, 25 bp, Mus musculus
gaccgtggtcactttcagaacacag

SEQ ID NO: 434991 - DNA, 25 bp, Mus musculus
gaccgtggtcagtcctgcaggaagc

SEQ ID NO: 434992 - DNA, 25 bp, Mus musculus
gaccgtggtctctgttcatgaccta

SEQ ID NO: 434993 - DNA, 25 bp, Mus musculus
gaccgtggtgtcaaaccttctgtca

SEQ ID NO: 434994 - DNA, 25 bp, Mus musculus
gaccgtgtcagcaagccttccctga

SEQ ID NO: 434995 - DNA, 25 bp, Mus musculus
gaccgtgtggtgtgctttggtaaca

SEQ ID NO: 434996 - DNA, 25 bp, Mus musculus
gaccgttgatgcttagccgttagcg

SEQ ID NO: 434997 - DNA, 25 bp, Mus musculus
gaccgttgctgcacatataatgagg

SEQ ID NO: 434998 - DNA, 25 bp, Mus musculus
gacctaacattccagtatttttgaa

SEQ ID NO: 434999 - DNA, 25 bp, Mus musculus
gacctaagacatgcactactttgac

SEQ ID NO: 435000 - DNA, 25 bp, Mus musculus
gacctaagagacttcgcggatgcca

SEQ ID NO: 435001 - DNA, 25 bp, Mus musculus
gacctaaggaatggctacgtctcca

SEQ ID NO: 435002 - DNA, 25 bp, Mus musculus
gacctaaggctggagtgcttctgca

SEQ ID NO: 435003 - DNA, 25 bp, Mus musculus
gacctaaggctttaaagaccagagt

SEQ ID NO: 435004 - DNA, 25 bp, Mus musculus
gacctaatgaatggactgtgcccaa

SEQ ID NO: 435005 - DNA, 25 bp, Mus musculus
gacctaatgtggattgccagcgccc

SEQ ID NO: 435006 - DNA, 25 bp, Mus musculus
gacctacaatggtaagactgtgtct

SEQ ID NO: 435007 - DNA, 25 bp, Mus musculus
gacctacaatgtagattcttatgtt

SEQ ID NO: 435008 - DNA, 25 bp, Mus musculus
gacctacaccgtttacctagagctg

SEQ ID NO: 435009 - DNA, 25 bp, Mus musculus
gacctacagctatatattacacaga

SEQ ID NO: 435010 - DNA, 25 bp, Mus musculus
gacctacaggaggtaatggtttctg

SEQ ID NO: 435011 - DNA, 25 bp, Mus musculus
gacctacagtcacaggtctgtgtgt

SEQ ID NO: 435012 - DNA, 25 bp, Mus musculus
gacctacatgagatgtatcacttga

SEQ ID NO: 435013 - DNA, 25 bp, Mus musculus
gacctacatgtagagcgggcactgg

SEQ ID NO: 435014 - DNA, 25 bp, Mus musculus
gacctaccagagagcagaatgcttg

SEQ ID NO: 435015 - DNA, 25 bp, Mus musculus
gacctacgaccgcactgagattgac

SEQ ID NO: 435016 - DNA, 25 bp, Mus musculus
gacctactaggctttggatggctaa

SEQ ID NO: 435017 - DNA, 25 bp, Mus musculus
gacctactatgaagatcacctgaaa

SEQ ID NO: 435018 - DNA, 25 bp, Mus musculus
gacctactcagaaagcgggcgttgt

SEQ ID NO: 435019 - DNA, 25 bp, Mus musculus
gacctactgaaacatgaagccctga

SEQ ID NO: 435020 - DNA, 25 bp, Mus musculus
gacctactgctttcaaccgggtgtt

SEQ ID NO: 435021 - DNA, 25 bp, Mus musculus
gacctagaagtatccaacaaaagtg

SEQ ID NO: 435022 - DNA, 25 bp, Mus musculus
gacctagaggagcagctggtttcct

SEQ ID NO: 435023 - DNA, 25 bp, Mus musculus
gacctagcaaaactgtataaacggg

SEQ ID NO: 435024 - DNA, 25 bp, Mus musculus
gacctagcaggcaggctggtctcca

SEQ ID NO: 435025 - DNA, 25 bp, Mus musculus
gacctagcattgtacttgttcaaag

SEQ ID NO: 435026 - DNA, 25 bp, Mus musculus
gacctagtgacacagaaacccctgg

SEQ ID NO: 435027 - DNA, 25 bp, Mus musculus
gacctagtggaggaacctttcctct

SEQ ID NO: 435028 - DNA, 25 bp, Mus musculus
gacctatactatcagcggctgggaa

SEQ ID NO: 435029 - DNA, 25 bp, Mus musculus
gacctatctcgactgggaagacaag

SEQ ID NO: 435030 - DNA, 25 bp, Mus musculus
gacctatgcgtttcttgtgaacaca

SEQ ID NO: 435031 - DNA, 25 bp, Mus musculus
gacctatggaatgcaaacctgtgga

SEQ ID NO: 435032 - DNA, 25 bp, Mus musculus
gacctatggtggcttcaactggaag

SEQ ID NO: 435033 - DNA, 25 bp, Mus musculus
gacctattttctatgttgcctggag

SEQ ID NO: 435034 - DNA, 25 bp, Mus musculus
gacctcaagaatcttctagatgact

SEQ ID NO: 435035 - DNA, 25 bp, Mus musculus
gacctcaagccgctgttcgagcagt

SEQ ID NO: 435036 - DNA, 25 bp, Mus musculus
gacctcacacaaacggatcgccttg

SEQ ID NO: 435037 - DNA, 25 bp, Mus musculus
gacctcacagttgcagcagagcgct

SEQ ID NO: 435038 - DNA, 25 bp, Mus musculus
gacctcactcggacttacagacatg

SEQ ID NO: 435039 - DNA, 25 bp, Mus musculus
gacctcactgggatagaatgcccct

SEQ ID NO: 435040 - DNA, 25 bp, Mus musculus
gacctcagaagctcagtgcttaaaa

SEQ ID NO: 435041 - DNA, 25 bp, Mus musculus
gacctcagagaccaacaaaccttag

SEQ ID NO: 435042 - DNA, 25 bp, Mus musculus
gacctcagaggagggtaacatctct

SEQ ID NO: 435043 - DNA, 25 bp, Mus musculus
gacctcagagtagcatctttatcca

SEQ ID NO: 435044 - DNA, 25 bp, Mus musculus
gacctcagccgcattctgaatgaga

SEQ ID NO: 435045 - DNA, 25 bp, Mus musculus
gacctcagcgcttcgggtgtttccg

SEQ ID NO: 435046 - DNA, 25 bp, Mus musculus
gacctcagctggatctctggacgga

SEQ ID NO: 435047 - DNA, 25 bp, Mus musculus
gacctcaggcaggatatggtgcaga

SEQ ID NO: 435048 - DNA, 25 bp, Mus musculus
gacctcaggcgtcagtatgaaacag

SEQ ID NO: 435049 - DNA, 25 bp, Mus musculus
gacctcaggttggactgggcctagt

SEQ ID NO: 435050 - DNA, 25 bp, Mus musculus
gacctcagtccaaatacatattcgg

SEQ ID NO: 435051 - DNA, 25 bp, Mus musculus
gacctcagtggagggctttctgcga

SEQ ID NO: 435052 - DNA, 25 bp, Mus musculus
gacctccaaacctgacgtgctcgga

SEQ ID NO: 435053 - DNA, 25 bp, Mus musculus
gacctccagcttcaactaggtgttg

SEQ ID NO: 435054 - DNA, 25 bp, Mus musculus
gacctccaggagacactttgaaaag

SEQ ID NO: 435055 - DNA, 25 bp, Mus musculus
gacctccgaggctggcaaaaactgt

SEQ ID NO: 435056 - DNA, 25 bp, Mus musculus
gacctccgaggtttagtacagcagc

SEQ ID NO: 435057 - DNA, 25 bp, Mus musculus
gacctcctaggtcctcaaatgccag

SEQ ID NO: 435058 - DNA, 25 bp, Mus musculus
gacctcctcgcaagtgacagcacag

SEQ ID NO: 435059 - DNA, 25 bp, Mus musculus
gacctcctggtcacctcgggaatga

SEQ ID NO: 435060 - DNA, 25 bp, Mus musculus
gacctcgaggttctccggcctcaag

SEQ ID NO: 435061 - DNA, 25 bp, Mus musculus
gacctcgatgggaaaggcatttgcc

SEQ ID NO: 435062 - DNA, 25 bp, Mus musculus
gacctcgccgctgatagattctgag

SEQ ID NO: 435063 - DNA, 25 bp, Mus musculus
gacctcgctgctgtggttgtacacc

SEQ ID NO: 435064 - DNA, 25 bp, Mus musculus
gacctcgcttggagagggcagtttt

SEQ ID NO: 435065 - DNA, 25 bp, Mus musculus
gacctcgcttgggatctggctagaa

SEQ ID NO: 435066 - DNA, 25 bp, Mus musculus
gacctcgggtatgtgactcattagc

SEQ ID NO: 435067 - DNA, 25 bp, Mus musculus
gacctcggttaatgagatggaatca

SEQ ID NO: 435068 - DNA, 25 bp, Mus musculus
gacctcggttctggtggccattttg

SEQ ID NO: 435069 - DNA, 25 bp, Mus musculus
gacctctaggtatgtgtgtaagcca

SEQ ID NO: 435070 - DNA, 25 bp, Mus musculus
gacctctagtcccttacagtcctgt

SEQ ID NO: 435071 - DNA, 25 bp, Mus musculus
gacctctctaagctttgcctccgga

SEQ ID NO: 435072 - DNA, 25 bp, Mus musculus
gacctctgaccttagacaggcctat

SEQ ID NO: 435073 - DNA, 25 bp, Mus musculus
gacctctggaccacactctgcatgg

SEQ ID NO: 435074 - DNA, 25 bp, Mus musculus
gacctctgtgtttagcgtgttccct

SEQ ID NO: 435075 - DNA, 25 bp, Mus musculus
gacctcttaaggatcaggcttgaag

SEQ ID NO: 435076 - DNA, 25 bp, Mus musculus
gacctcttggttgctttatgggcac

SEQ ID NO: 435077 - DNA, 25 bp, Mus musculus
gacctgaacatgtccatctctgaga

SEQ ID NO: 435078 - DNA, 25 bp, Mus musculus
gacctgaagggcacagacttttgtt

SEQ ID NO: 435079 - DNA, 25 bp, Mus musculus
gacctgaatcacctcatgggatttt

SEQ ID NO: 435080 - DNA, 25 bp, Mus musculus
gacctgacggctagcgctgctttgg

SEQ ID NO: 435081 - DNA, 25 bp, Mus musculus
gacctgactccagaagactcttggg

SEQ ID NO: 435082 - DNA, 25 bp, Mus musculus
gacctgactgaaagcagcctcggag

SEQ ID NO: 435083 - DNA, 25 bp, Mus musculus
gacctgagagcttttatgccacaaa

SEQ ID NO: 435084 - DNA, 25 bp, Mus musculus
gacctgagatggaaggcatcccgaa

SEQ ID NO: 435085 - DNA, 25 bp, Mus musculus
gacctgagcgctgccctgggtgttt

SEQ ID NO: 435086 - DNA, 25 bp, Mus musculus
gacctgagctgtagacactggctta

SEQ ID NO: 435087 - DNA, 25 bp, Mus musculus
gacctgagtacttctataaacccga

SEQ ID NO: 435088 - DNA, 25 bp, Mus musculus
gacctgagtccccaggagattatta

SEQ ID NO: 435089 - DNA, 25 bp, Mus musculus
gacctgagtgatactccaacttcag

SEQ ID NO: 435090 - DNA, 25 bp, Mus musculus
gacctgatcagctatgggcaagact

SEQ ID NO: 435091 - DNA, 25 bp, Mus musculus
gacctgatccagagtaagtgcctat

SEQ ID NO: 435092 - DNA, 25 bp, Mus musculus
gacctgatcggtcctaacttccggg

SEQ ID NO: 435093 - DNA, 25 bp, Mus musculus
gacctgatggattggccctgcctaa

SEQ ID NO: 435094 - DNA, 25 bp, Mus musculus
gacctgatgtctctgtccaaggaga

SEQ ID NO: 435095 - DNA, 25 bp, Mus musculus
gacctgattgagaaggaactatccg

SEQ ID NO: 435096 - DNA, 25 bp, Mus musculus
gacctgattttcataagcatgtgta

SEQ ID NO: 435097 - DNA, 25 bp, Mus musculus
gacctgcaagccctaggaagcaata

SEQ ID NO: 435098 - DNA, 25 bp, Mus musculus
gacctgcaaggcctcactgtggaac

SEQ ID NO: 435099 - DNA, 25 bp, Mus musculus
gacctgcaatcagcgaaccgtggta

SEQ ID NO: 435100 - DNA, 25 bp, Mus musculus
gacctgcactgattggaatctcaaa

SEQ ID NO: 435101 - DNA, 25 bp, Mus musculus
gacctgcagctggaccgaatctctg

SEQ ID NO: 435102 - DNA, 25 bp, Mus musculus
gacctgcaggaccagttgagtcact

SEQ ID NO: 435103 - DNA, 25 bp, Mus musculus
gacctgcaggttgaaggccaagctg

SEQ ID NO: 435104 - DNA, 25 bp, Mus musculus
gacctgcagtgttgtgggcttaatc

SEQ ID NO: 435105 - DNA, 25 bp, Mus musculus
gacctgcatctggtgttggagcgca

SEQ ID NO: 435106 - DNA, 25 bp, Mus musculus
gacctgccagtcaagctgcgattga

SEQ ID NO: 435107 - DNA, 25 bp, Mus musculus
gacctgcccaccactgtgtcaatga

SEQ ID NO: 435108 - DNA, 25 bp, Mus musculus
gacctgcctgctggacatactggac

SEQ ID NO: 435109 - DNA, 25 bp, Mus musculus
gacctgcgcttcagcacttctcaaa

SEQ ID NO: 435110 - DNA, 25 bp, Mus musculus
gacctgctaaaacaccagagggaaa

SEQ ID NO: 435111 - DNA, 25 bp, Mus musculus
gacctgctgcgtacatatgaggcga

SEQ ID NO: 435112 - DNA, 25 bp, Mus musculus
gacctgctgggttcatcagacccta

SEQ ID NO: 435113 - DNA, 25 bp, Mus musculus
gacctgctgtctgtcatagaggaga

SEQ ID NO: 435114 - DNA, 25 bp, Mus musculus
gacctgcttcttggcctcctggtga

SEQ ID NO: 435115 - DNA, 25 bp, Mus musculus
gacctgcttgtcgaaagaccgtcaa

SEQ ID NO: 435116 - DNA, 25 bp, Mus musculus
gacctggacatgatgggagtcgcca

SEQ ID NO: 435117 - DNA, 25 bp, Mus musculus
gacctggacctgaccggagctttgt

SEQ ID NO: 435118 - DNA, 25 bp, Mus musculus
gacctggacgacatagtgcgctaca

SEQ ID NO: 435119 - DNA, 25 bp, Mus musculus
gacctggactctctctttgaaatga

SEQ ID NO: 435120 - DNA, 25 bp, Mus musculus
gacctggactgactagaaagcatct

SEQ ID NO: 435121 - DNA, 25 bp, Mus musculus
gacctggacttcacgtactctggcc

SEQ ID NO: 435122 - DNA, 25 bp, Mus musculus
gacctggagatctcagagcccgtga

SEQ ID NO: 435123 - DNA, 25 bp, Mus musculus
gacctggaggattctctatccggga

SEQ ID NO: 435124 - DNA, 25 bp, Mus musculus
gacctggagtctgagctagagccca

SEQ ID NO: 435125 - DNA, 25 bp, Mus musculus
gacctggagttcaacaagcggagcc

SEQ ID NO: 435126 - DNA, 25 bp, Mus musculus
gacctggatacggatacactgatgg

SEQ ID NO: 435127 - DNA, 25 bp, Mus musculus
gacctggatgctctcaatctgtcgg

SEQ ID NO: 435128 - DNA, 25 bp, Mus musculus
gacctggatggcaaacgtatctaca

SEQ ID NO: 435129 - DNA, 25 bp, Mus musculus
gacctggcagcgagaaacatccttt

SEQ ID NO: 435130 - DNA, 25 bp, Mus musculus
gacctggcatttgagttcaagttga

SEQ ID NO: 435131 - DNA, 25 bp, Mus musculus
gacctggcccgtgggaagacgattc

SEQ ID NO: 435132 - DNA, 25 bp, Mus musculus
gacctggccggcaacattgactaca

SEQ ID NO: 435133 - DNA, 25 bp, Mus musculus
gacctggctcaagtcatccttcgag

SEQ ID NO: 435134 - DNA, 25 bp, Mus musculus
gacctggctttgacatctgctggaa

SEQ ID NO: 435135 - DNA, 25 bp, Mus musculus
gacctggcttttggactaacagaca

SEQ ID NO: 435136 - DNA, 25 bp, Mus musculus
gacctgggaaagtcactgtgaaaca

SEQ ID NO: 435137 - DNA, 25 bp, Mus musculus
gacctgggacaatgcaagctgtgga

SEQ ID NO: 435138 - DNA, 25 bp, Mus musculus
gacctgggacccgagttactacttg

SEQ ID NO: 435139 - DNA, 25 bp, Mus musculus
gacctgggaggatctgtcagttgct

SEQ ID NO: 435140 - DNA, 25 bp, Mus musculus
gacctggtacactgaacttgataga

SEQ ID NO: 435141 - DNA, 25 bp, Mus musculus
gacctggtaggtgatagcatgctat

SEQ ID NO: 435142 - DNA, 25 bp, Mus musculus
gacctggtcagatttggactccctg

SEQ ID NO: 435143 - DNA, 25 bp, Mus musculus
gacctggtgaaagactgccattccg

SEQ ID NO: 435144 - DNA, 25 bp, Mus musculus
gacctggtgaagagcactgagttca

SEQ ID NO: 435145 - DNA, 25 bp, Mus musculus
gacctggtgcacacggcatcttgga

SEQ ID NO: 435146 - DNA, 25 bp, Mus musculus
gacctggtttctagggatgctggaa

SEQ ID NO: 435147 - DNA, 25 bp, Mus musculus
gacctgtaaaatgagtagagaaccc

SEQ ID NO: 435148 - DNA, 25 bp, Mus musculus
gacctgtaccagaagacatacccga

SEQ ID NO: 435149 - DNA, 25 bp, Mus musculus
gacctgtagagaagtaagactcgaa

SEQ ID NO: 435150 - DNA, 25 bp, Mus musculus
gacctgtatgatgaggatactgaca

SEQ ID NO: 435151 - DNA, 25 bp, Mus musculus
gacctgtattctcagggacaaagta

SEQ ID NO: 435152 - DNA, 25 bp, Mus musculus
gacctgtcatgttccatcccttggg

SEQ ID NO: 435153 - DNA, 25 bp, Mus musculus
gacctgtcattccagcgctcaggaa

SEQ ID NO: 435154 - DNA, 25 bp, Mus musculus
gacctgtctccacgatgtagtacga

SEQ ID NO: 435155 - DNA, 25 bp, Mus musculus
gacctgtctctaacctcaaagcctg

SEQ ID NO: 435156 - DNA, 25 bp, Mus musculus
gacctgtgaccttttacagatggaa

SEQ ID NO: 435157 - DNA, 25 bp, Mus musculus
gacctgtgagatttactaacattgc

SEQ ID NO: 435158 - DNA, 25 bp, Mus musculus
gacctgtgagcatgttgatgagcct

SEQ ID NO: 435159 - DNA, 25 bp, Mus musculus
gacctgtgaggagttaagtctgaca

SEQ ID NO: 435160 - DNA, 25 bp, Mus musculus
gacctgtgctctacaaggagagtcg

SEQ ID NO: 435161 - DNA, 25 bp, Mus musculus
gacctgtggcttgatgctactcagt

SEQ ID NO: 435162 - DNA, 25 bp, Mus musculus
gacctgttagccgtgaagtgcgcca

SEQ ID NO: 435163 - DNA, 25 bp, Mus musculus
gacctgttctcagtcgtaagctgac

SEQ ID NO: 435164 - DNA, 25 bp, Mus musculus
gacctgttgatgtcatgagctcaga

SEQ ID NO: 435165 - DNA, 25 bp, Mus musculus
gacctgtttcaatgaccgggagccc

SEQ ID NO: 435166 - DNA, 25 bp, Mus musculus
gacctgtttgtagacttggctgcta

SEQ ID NO: 435167 - DNA, 25 bp, Mus musculus
gaccttaacttttgagagccctttg

SEQ ID NO: 435168 - DNA, 25 bp, Mus musculus
gaccttacaactgggagtgaccgct

SEQ ID NO: 435169 - DNA, 25 bp, Mus musculus
gaccttaccctgctactcgcgggag

SEQ ID NO: 435170 - DNA, 25 bp, Mus musculus
gaccttagagacgaaagaaagttgg

SEQ ID NO: 435171 - DNA, 25 bp, Mus musculus
gaccttagcaactgaaactgtgcgg

SEQ ID NO: 435172 - DNA, 25 bp, Mus musculus
gaccttagcccagttgtagatgcca

SEQ ID NO: 435173 - DNA, 25 bp, Mus musculus
gaccttatcatggaactggacgact

SEQ ID NO: 435174 - DNA, 25 bp, Mus musculus
gaccttcaaagagcgcatccagtgg

SEQ ID NO: 435175 - DNA, 25 bp, Mus musculus
gaccttcaatgactctgccttatga

SEQ ID NO: 435176 - DNA, 25 bp, Mus musculus
gaccttcaggagcttgatctagctg

SEQ ID NO: 435177 - DNA, 25 bp, Mus musculus
gaccttcagttttccctgggtatca

SEQ ID NO: 435178 - DNA, 25 bp, Mus musculus
gaccttcatgaccttgcagaacttc

SEQ ID NO: 435179 - DNA, 25 bp, Mus musculus
gaccttccggtgtgggagtatgccc

SEQ ID NO: 435180 - DNA, 25 bp, Mus musculus
gaccttcgagaacggcagagctgaa

SEQ ID NO: 435181 - DNA, 25 bp, Mus musculus
gaccttcgattcgtgggccgcagtg

SEQ ID NO: 435182 - DNA, 25 bp, Mus musculus
gaccttcgcgatgacaaggacacca

SEQ ID NO: 435183 - DNA, 25 bp, Mus musculus
gaccttctattaccgaggagcctaa

SEQ ID NO: 435184 - DNA, 25 bp, Mus musculus
gaccttctgacttggaggccgggaa

SEQ ID NO: 435185 - DNA, 25 bp, Mus musculus
gaccttctgagttcgtcgaaattga

SEQ ID NO: 435186 - DNA, 25 bp, Mus musculus
gaccttctgcatgtggctcgggaca

SEQ ID NO: 435187 - DNA, 25 bp, Mus musculus
gaccttctgggagcatccagtccga

SEQ ID NO: 435188 - DNA, 25 bp, Mus musculus
gaccttgaagctcggccccttgctg

SEQ ID NO: 435189 - DNA, 25 bp, Mus musculus
gaccttgacttgtgtggcagagctg

SEQ ID NO: 435190 - DNA, 25 bp, Mus musculus
gaccttgagatcacctctggatcac

SEQ ID NO: 435191 - DNA, 25 bp, Mus musculus
gaccttgagcctgtgaagaccttga

SEQ ID NO: 435192 - DNA, 25 bp, Mus musculus
gaccttgaggctgtgtctttaatca

SEQ ID NO: 435193 - DNA, 25 bp, Mus musculus
gaccttgagtcatgcccagttttat

SEQ ID NO: 435194 - DNA, 25 bp, Mus musculus
gaccttgagtcttcccagttgtggg

SEQ ID NO: 435195 - DNA, 25 bp, Mus musculus
gaccttgattccatagtaaattata

SEQ ID NO: 435196 - DNA, 25 bp, Mus musculus
gaccttgcacccagtactctgcgga

SEQ ID NO: 435197 - DNA, 25 bp, Mus musculus
gaccttgccaggtaggctgatactg

SEQ ID NO: 435198 - DNA, 25 bp, Mus musculus
gaccttgcggcagctcaaagcgttg

SEQ ID NO: 435199 - DNA, 25 bp, Mus musculus
gaccttggagaactatgacctggag

SEQ ID NO: 435200 - DNA, 25 bp, Mus musculus
gaccttgggtttgtgagccccagag

SEQ ID NO: 435201 - DNA, 25 bp, Mus musculus
gaccttggtccgctgcagtactctg

SEQ ID NO: 435202 - DNA, 25 bp, Mus musculus
gaccttgtgttcagaattggatccc

SEQ ID NO: 435203 - DNA, 25 bp, Mus musculus
gaccttgttcacagacagacagcga

SEQ ID NO: 435204 - DNA, 25 bp, Mus musculus
gaccttgttgacttgggccctgaca

SEQ ID NO: 435205 - DNA, 25 bp, Mus musculus
gacctttaccaaggctagtgatttt

SEQ ID NO: 435206 - DNA, 25 bp, Mus musculus
gacctttcaaaagtggcagcctttc

SEQ ID NO: 435207 - DNA, 25 bp, Mus musculus
gacctttccagagtgagggagaatt

SEQ ID NO: 435208 - DNA, 25 bp, Mus musculus
gacctttctaatcagcaccagagca

SEQ ID NO: 435209 - DNA, 25 bp, Mus musculus
gacctttctccagagcagatcagga

SEQ ID NO: 435210 - DNA, 25 bp, Mus musculus
gacctttcttctgagcttcgtggga

SEQ ID NO: 435211 - DNA, 25 bp, Mus musculus
gacctttgaaggacaatcggctgcg

SEQ ID NO: 435212 - DNA, 25 bp, Mus musculus
gacctttgcccctgtgactgatgga

SEQ ID NO: 435213 - DNA, 25 bp, Mus musculus
gacctttggcctttgtaagacacac

SEQ ID NO: 435214 - DNA, 25 bp, Mus musculus
gaccttttgcagacggaagcacctc

SEQ ID NO: 435215 - DNA, 25 bp, Mus musculus
gaccttttgcgtgctggctgccgat

SEQ ID NO: 435216 - DNA, 25 bp, Mus musculus
gacctttttcagacaagcgaggaga

SEQ ID NO: 435217 - DNA, 25 bp, Mus musculus
gaccttttttgaacaacaaagctag

SEQ ID NO: 435218 - DNA, 25 bp, Mus musculus
gacgaaaaattcctgagtgtcacat

SEQ ID NO: 435219 - DNA, 25 bp, Mus musculus
gacgaaatctcagtgcatggagtca

SEQ ID NO: 435220 - DNA, 25 bp, Mus musculus
gacgaacactttgccattgccgcgg

SEQ ID NO: 435221 - DNA, 25 bp, Mus musculus
gacgaaccacttgagactgagactg

SEQ ID NO: 435222 - DNA, 25 bp, Mus musculus
gacgaacggctatctcaacggctac

SEQ ID NO: 435223 - DNA, 25 bp, Mus musculus
gacgaacgtggtacattcacatcca

SEQ ID NO: 435224 - DNA, 25 bp, Mus musculus
gacgaacgtgtgacagcaggaacct

SEQ ID NO: 435225 - DNA, 25 bp, Mus musculus
gacgaacttctctaccaggagctga

SEQ ID NO: 435226 - DNA, 25 bp, Mus musculus
gacgaagacaccctgacacaaaatg

SEQ ID NO: 435227 - DNA, 25 bp, Mus musculus
gacgaagatcatcactcaagacggt

SEQ ID NO: 435228 - DNA, 25 bp, Mus musculus
gacgaagatgctctgattgctgatg

SEQ ID NO: 435229 - DNA, 25 bp, Mus musculus
gacgaagatgggaattctcagctcc

SEQ ID NO: 435230 - DNA, 25 bp, Mus musculus
gacgaagattttaaggacctgctgc

SEQ ID NO: 435231 - DNA, 25 bp, Mus musculus
gacgaagtaaggtatccaaggttct

SEQ ID NO: 435232 - DNA, 25 bp, Mus musculus
gacgaatcaatacagctgccgtgtt

SEQ ID NO: 435233 - DNA, 25 bp, Mus musculus
gacgaatgctcataggatattggtc

SEQ ID NO: 435234 - DNA, 25 bp, Mus musculus
gacgacaaccctgatagcctagtga

SEQ ID NO: 435235 - DNA, 25 bp, Mus musculus
gacgacaagccagacgggaggttgg

SEQ ID NO: 435236 - DNA, 25 bp, Mus musculus
gacgacacatttccctccgtgaagg

SEQ ID NO: 435237 - DNA, 25 bp, Mus musculus
gacgacactcggttacaggctacgg

SEQ ID NO: 435238 - DNA, 25 bp, Mus musculus
gacgacatcgtctatatgggccaag

SEQ ID NO: 435239 - DNA, 25 bp, Mus musculus
gacgacattcatgaagcgccgactt

SEQ ID NO: 435240 - DNA, 25 bp, Mus musculus
gacgaccatgcagccttatcaacgg

SEQ ID NO: 435241 - DNA, 25 bp, Mus musculus
gacgacccattcaacttctacggag

SEQ ID NO: 435242 - DNA, 25 bp, Mus musculus
gacgaccgcgtgtgcaaaaagtgcc

SEQ ID NO: 435243 - DNA, 25 bp, Mus musculus
gacgacctcagcagtgatgcgggaa

SEQ ID NO: 435244 - DNA, 25 bp, Mus musculus
gacgacctgcacactcaaaagcaag

SEQ ID NO: 435245 - DNA, 25 bp, Mus musculus
gacgacctgcacgtgctcattgaag

SEQ ID NO: 435246 - DNA, 25 bp, Mus musculus
gacgacctgcggaggcaaaaaactg

SEQ ID NO: 435247 - DNA, 25 bp, Mus musculus
gacgacctggctttattgaaggaca

SEQ ID NO: 435248 - DNA, 25 bp, Mus musculus
gacgacgagttcgaggagtttcccg

SEQ ID NO: 435249 - DNA, 25 bp, Mus musculus
gacgacgcgctgctcaaaaactatg

SEQ ID NO: 435250 - DNA, 25 bp, Mus musculus
gacgacgcgtagtttcaagggtgac

SEQ ID NO: 435251 - DNA, 25 bp, Mus musculus
gacgacggcctcagacttcttgggt

SEQ ID NO: 435252 - DNA, 25 bp, Mus musculus
gacgacgtttctaaaggctgacctg

SEQ ID NO: 435253 - DNA, 25 bp, Mus musculus
gacgactacgtgctctacttgctag

SEQ ID NO: 435254 - DNA, 25 bp, Mus musculus
gacgactatgaacatctgtgcactg

SEQ ID NO: 435255 - DNA, 25 bp, Mus musculus
gacgactatttctgcccgggagagc

SEQ ID NO: 435256 - DNA, 25 bp, Mus musculus
gacgacttctatcaagtgcactgca

SEQ ID NO: 435257 - DNA, 25 bp, Mus musculus
gacgagaacctggagaaggacgcct

SEQ ID NO: 435258 - DNA, 25 bp, Mus musculus
gacgagaacctgtacactggcgagc

SEQ ID NO: 435259 - DNA, 25 bp, Mus musculus
gacgagaagttgttcaccaaggagc

SEQ ID NO: 435260 - DNA, 25 bp, Mus musculus
gacgagacaaatacaagaccctgcg

SEQ ID NO: 435261 - DNA, 25 bp, Mus musculus
gacgagaggtcctactgagaacctt

SEQ ID NO: 435262 - DNA, 25 bp, Mus musculus
gacgagatctgcaagctctgtgctg

SEQ ID NO: 435263 - DNA, 25 bp, Mus musculus
gacgagattcttactggccgataac

SEQ ID NO: 435264 - DNA, 25 bp, Mus musculus
gacgagcagagatcacagaatagaa

SEQ ID NO: 435265 - DNA, 25 bp, Mus musculus
gacgagccggacgatgataacctgg

SEQ ID NO: 435266 - DNA, 25 bp, Mus musculus
gacgagcctgcagaccaatggtaaa

SEQ ID NO: 435267 - DNA, 25 bp, Mus musculus
gacgagcgactagaaaatgacccca

SEQ ID NO: 435268 - DNA, 25 bp, Mus musculus
gacgagcggcagacatgtgcgattc

SEQ ID NO: 435269 - DNA, 25 bp, Mus musculus
gacgagcgtacatgagtctttgtct

SEQ ID NO: 435270 - DNA, 25 bp, Mus musculus
gacgagctgaaatacaacttttcac

SEQ ID NO: 435271 - DNA, 25 bp, Mus musculus
gacgagctgatcaagtcggaccagg

SEQ ID NO: 435272 - DNA, 25 bp, Mus musculus
gacgagctgcgcacctggaaagtta

SEQ ID NO: 435273 - DNA, 25 bp, Mus musculus
gacgagcttcgtgatcaggatgcag

SEQ ID NO: 435274 - DNA, 25 bp, Mus musculus
gacgagggaccctgttcagaagcca

SEQ ID NO: 435275 - DNA, 25 bp, Mus musculus
gacgagggtgcctttcaactgccac

SEQ ID NO: 435276 - DNA, 25 bp, Mus musculus
gacgagtactgctacaattgaccca

SEQ ID NO: 435277 - DNA, 25 bp, Mus musculus
gacgagtccctgaagacagacgaga

SEQ ID NO: 435278 - DNA, 25 bp, Mus musculus
gacgagtccgtctgaaatgcctgat

SEQ ID NO: 435279 - DNA, 25 bp, Mus musculus
gacgagtctgtaaccggctactgga

SEQ ID NO: 435280 - DNA, 25 bp, Mus musculus
gacgagtctttcttgggcaagttgg

SEQ ID NO: 435281 - DNA, 25 bp, Mus musculus
gacgagtgccagctgtgagtaccac

SEQ ID NO: 435282 - DNA, 25 bp, Mus musculus
gacgagtgcctttgactgtgctaga

SEQ ID NO: 435283 - DNA, 25 bp, Mus musculus
gacgagtggctgaaagtggctctcc

SEQ ID NO: 435284 - DNA, 25 bp, Mus musculus
gacgagtgtcagtttcagttccgaa

SEQ ID NO: 435285 - DNA, 25 bp, Mus musculus
gacgagttcccattctgcgctctgg

SEQ ID NO: 435286 - DNA, 25 bp, Mus musculus
gacgagttctggtggtttcctcaca

SEQ ID NO: 435287 - DNA, 25 bp, Mus musculus
gacgagttttgttcagagtctccaa

SEQ ID NO: 435288 - DNA, 25 bp, Mus musculus
gacgataatctgaggaccttttgga

SEQ ID NO: 435289 - DNA, 25 bp, Mus musculus
gacgataatggtgaagaaacggctt

SEQ ID NO: 435290 - DNA, 25 bp, Mus musculus
gacgatacagagaaagctacggcca

SEQ ID NO: 435291 - DNA, 25 bp, Mus musculus
gacgatacctattccaagaagcagg

SEQ ID NO: 435292 - DNA, 25 bp, Mus musculus
gacgatagaccttgcagtgactcct

SEQ ID NO: 435293 - DNA, 25 bp, Mus musculus
gacgatatgaccaagaatcttcctg

SEQ ID NO: 435294 - DNA, 25 bp, Mus musculus
gacgatattcttgacatcccgctgg

SEQ ID NO: 435295 - DNA, 25 bp, Mus musculus
gacgatctccatggccaaaaccttg

SEQ ID NO: 435296 - DNA, 25 bp, Mus musculus
gacgatgaacatgacagcctggacc

SEQ ID NO: 435297 - DNA, 25 bp, Mus musculus
gacgatgagaaagctgactgcgcct

SEQ ID NO: 435298 - DNA, 25 bp, Mus musculus
gacgatgagaacgtgaagagccgca

SEQ ID NO: 435299 - DNA, 25 bp, Mus musculus
gacgatgcgacactcagcctgaaaa

SEQ ID NO: 435300 - DNA, 25 bp, Mus musculus
gacgatgctcctccaggatgccttt

SEQ ID NO: 435301 - DNA, 25 bp, Mus musculus
gacgatggctttggcatggaccctt

SEQ ID NO: 435302 - DNA, 25 bp, Mus musculus
gacgatggtgatgctcttctccgga

SEQ ID NO: 435303 - DNA, 25 bp, Mus musculus
gacgatgttaccacaggcttgccca

SEQ ID NO: 435304 - DNA, 25 bp, Mus musculus
gacgattaaagtgcatctgagccaa

SEQ ID NO: 435305 - DNA, 25 bp, Mus musculus
gacgattacgaacctgagctgctgt

SEQ ID NO: 435306 - DNA, 25 bp, Mus musculus
gacgattacgaggatggcgccatca

SEQ ID NO: 435307 - DNA, 25 bp, Mus musculus
gacgattagcatatagtctatgagc

SEQ ID NO: 435308 - DNA, 25 bp, Mus musculus
gacgattgaaagtgaagctgctgcc

SEQ ID NO: 435309 - DNA, 25 bp, Mus musculus
gacgatttacactcatgaccctgcg

SEQ ID NO: 435310 - DNA, 25 bp, Mus musculus
gacgcacactttactctggccaaga

SEQ ID NO: 435311 - DNA, 25 bp, Mus musculus
gacgcacctgctggagaatctcaaa

SEQ ID NO: 435312 - DNA, 25 bp, Mus musculus
gacgcacgtgatcaaccaaggcatg

SEQ ID NO: 435313 - DNA, 25 bp, Mus musculus
gacgcactgcattaaggtgcccatg

SEQ ID NO: 435314 - DNA, 25 bp, Mus musculus
gacgcactggctagaattgaaattg

SEQ ID NO: 435315 - DNA, 25 bp, Mus musculus
gacgcactgtcaactctctggagat

SEQ ID NO: 435316 - DNA, 25 bp, Mus musculus
gacgcagaaggacactatccaccaa

SEQ ID NO: 435317 - DNA, 25 bp, Mus musculus
gacgcagagtggacgaacgtcacgt

SEQ ID NO: 435318 - DNA, 25 bp, Mus musculus
gacgcagagtttgtcttcaagggcg

SEQ ID NO: 435319 - DNA, 25 bp, Mus musculus
gacgcagcgcatcttccaggaagcg

SEQ ID NO: 435320 - DNA, 25 bp, Mus musculus
gacgcagcgctaagagtagaccggt

SEQ ID NO: 435321 - DNA, 25 bp, Mus musculus
gacgcatccgccaggtggattttaa

SEQ ID NO: 435322 - DNA, 25 bp, Mus musculus
gacgcattggccatcggtagtgaga

SEQ ID NO: 435323 - DNA, 25 bp, Mus musculus
gacgcatttgaagtgttcgaccatg

SEQ ID NO: 435324 - DNA, 25 bp, Mus musculus
gacgccaatttcagtccgccagtga

SEQ ID NO: 435325 - DNA, 25 bp, Mus musculus
gacgccactcctgattacgctgtag

SEQ ID NO: 435326 - DNA, 25 bp, Mus musculus
gacgccactgatgatagctgctgaa

SEQ ID NO: 435327 - DNA, 25 bp, Mus musculus
gacgccagatggatagtgaccgcag

SEQ ID NO: 435328 - DNA, 25 bp, Mus musculus
gacgccaggtggatcttaagccaaa

SEQ ID NO: 435329 - DNA, 25 bp, Mus musculus
gacgccagtcctacagagctaagaa

SEQ ID NO: 435330 - DNA, 25 bp, Mus musculus
gacgccatagtgtagctccagcttg

SEQ ID NO: 435331 - DNA, 25 bp, Mus musculus
gacgccatgagcaaaagatccaagt

SEQ ID NO: 435332 - DNA, 25 bp, Mus musculus
gacgccattcagtttcagagaggtg

SEQ ID NO: 435333 - DNA, 25 bp, Mus musculus
gacgccattggagtagatcaccgca

SEQ ID NO: 435334 - DNA, 25 bp, Mus musculus
gacgccccggtatatgctatgcagg

SEQ ID NO: 435335 - DNA, 25 bp, Mus musculus
gacgcccctgcttattttctgtgta

SEQ ID NO: 435336 - DNA, 25 bp, Mus musculus
gacgcccggatggtgattctgaaca

SEQ ID NO: 435337 - DNA, 25 bp, Mus musculus
gacgccctgctggaaaagaagaaac

SEQ ID NO: 435338 - DNA, 25 bp, Mus musculus
gacgccggtgactgtcccattctga

SEQ ID NO: 435339 - DNA, 25 bp, Mus musculus
gacgcctatggtaagagcctttctg

SEQ ID NO: 435340 - DNA, 25 bp, Mus musculus
gacgcctcaaggtactggatgcaag

SEQ ID NO: 435341 - DNA, 25 bp, Mus musculus
gacgcctcggaaaatggcaccaaga

SEQ ID NO: 435342 - DNA, 25 bp, Mus musculus
gacgcctctctgaaaacagtcacgc

SEQ ID NO: 435343 - DNA, 25 bp, Mus musculus
gacgcctctggaaagaagaccacgg

SEQ ID NO: 435344 - DNA, 25 bp, Mus musculus
gacgcctgtaatggaagacgctaga

SEQ ID NO: 435345 - DNA, 25 bp, Mus musculus
gacgccttcagagcagattcacagc

SEQ ID NO: 435346 - DNA, 25 bp, Mus musculus
gacgccttctccaaggggtctgatt

SEQ ID NO: 435347 - DNA, 25 bp, Mus musculus
gacgccttgccactgtaggcacaga

SEQ ID NO: 435348 - DNA, 25 bp, Mus musculus
gacgcgaagcgggaaagacgcttcc

SEQ ID NO: 435349 - DNA, 25 bp, Mus musculus
gacgcgacgaccgagtgaactaggt

SEQ ID NO: 435350 - DNA, 25 bp, Mus musculus
gacgcgaggaccgaagaactgcttt

SEQ ID NO: 435351 - DNA, 25 bp, Mus musculus
gacgcgctactctctgacttctgtg

SEQ ID NO: 435352 - DNA, 25 bp, Mus musculus
gacgcgctgcgcgaagttatcctac

SEQ ID NO: 435353 - DNA, 25 bp, Mus musculus
gacgcggcttacgaagtggctgaac

SEQ ID NO: 435354 - DNA, 25 bp, Mus musculus
gacgcgggctgagaagtcacgttct

SEQ ID NO: 435355 - DNA, 25 bp, Mus musculus
gacgcgtaatcacacatgctggctt

SEQ ID NO: 435356 - DNA, 25 bp, Mus musculus
gacgcgtatctcaccgaggaggact

SEQ ID NO: 435357 - DNA, 25 bp, Mus musculus
gacgctaacccaggtgagacgctaa

SEQ ID NO: 435358 - DNA, 25 bp, Mus musculus
gacgctaactggcaaagccctggag

SEQ ID NO: 435359 - DNA, 25 bp, Mus musculus
gacgctcaagtgatggcagctgccc

SEQ ID NO: 435360 - DNA, 25 bp, Mus musculus
gacgctcaggaattcagtgccttaa

SEQ ID NO: 435361 - DNA, 25 bp, Mus musculus
gacgctccaataggaacgtgagttt

SEQ ID NO: 435362 - DNA, 25 bp, Mus musculus
gacgctcccgtttccgagtcttttg

SEQ ID NO: 435363 - DNA, 25 bp, Mus musculus
gacgctccgagcaatttactggtac

SEQ ID NO: 435364 - DNA, 25 bp, Mus musculus
gacgctctccttgtaccaggtgcaa

SEQ ID NO: 435365 - DNA, 25 bp, Mus musculus
gacgctcttcgattccaacaaggac

SEQ ID NO: 435366 - DNA, 25 bp, Mus musculus
gacgctgaaccataacacccatctt

SEQ ID NO: 435367 - DNA, 25 bp, Mus musculus
gacgctgagaacagaagggtctcta

SEQ ID NO: 435368 - DNA, 25 bp, Mus musculus
gacgctgagcctgggagtttcctga

SEQ ID NO: 435369 - DNA, 25 bp, Mus musculus
gacgctgagtgaccctttgtgagaa

SEQ ID NO: 435370 - DNA, 25 bp, Mus musculus
gacgctggggaaacactcacatgtg

SEQ ID NO: 435371 - DNA, 25 bp, Mus musculus
gacgctggtcatccccaagaatgcg

SEQ ID NO: 435372 - DNA, 25 bp, Mus musculus
gacgctgtctagttgaaagggcatt

SEQ ID NO: 435373 - DNA, 25 bp, Mus musculus
gacgctgtcttcctgtacttaatgc

SEQ ID NO: 435374 - DNA, 25 bp, Mus musculus
gacgctgtgtctagtggtgctatgc

SEQ ID NO: 435375 - DNA, 25 bp, Mus musculus
gacgcttaaaggagaggaggaccac

SEQ ID NO: 435376 - DNA, 25 bp, Mus musculus
gacgcttagaagctcaaattgagtc

SEQ ID NO: 435377 - DNA, 25 bp, Mus musculus
gacgcttcatgaaaattctccccga

SEQ ID NO: 435378 - DNA, 25 bp, Mus musculus
gacgcttgggataggtatgtctgac

SEQ ID NO: 435379 - DNA, 25 bp, Mus musculus
gacgcttgtttcaattcccggacgg

SEQ ID NO: 435380 - DNA, 25 bp, Mus musculus
gacgctttatatgagccaccgggaa

SEQ ID NO: 435381 - DNA, 25 bp, Mus musculus
gacgctttctgtagtggtcttctca

SEQ ID NO: 435382 - DNA, 25 bp, Mus musculus
gacgctttgcaccaagatatcagag

SEQ ID NO: 435383 - DNA, 25 bp, Mus musculus
gacgctttgcccaacgaaatgtagg

SEQ ID NO: 435384 - DNA, 25 bp, Mus musculus
gacgctttgcgagagatgaacgaca

SEQ ID NO: 435385 - DNA, 25 bp, Mus musculus
gacggaaatcctgagctgtgactgg

SEQ ID NO: 435386 - DNA, 25 bp, Mus musculus
gacggaaatcttcgagtactgccag

SEQ ID NO: 435387 - DNA, 25 bp, Mus musculus
gacggaagagtctgcctagtccaca

SEQ ID NO: 435388 - DNA, 25 bp, Mus musculus
gacggaagcggattccccaggaact

SEQ ID NO: 435389 - DNA, 25 bp, Mus musculus
gacggaatccgtccaaccttccaga

SEQ ID NO: 435390 - DNA, 25 bp, Mus musculus
gacggaatgatgtatggcccaccag

SEQ ID NO: 435391 - DNA, 25 bp, Mus musculus
gacggaatggcacaaacccaagctg

SEQ ID NO: 435392 - DNA, 25 bp, Mus musculus
gacggacaaaaccaaggagagacat

SEQ ID NO: 435393 - DNA, 25 bp, Mus musculus
gacggacattcgcttctacactggg

SEQ ID NO: 435394 - DNA, 25 bp, Mus musculus
gacggacctgccaagaaagctagtg

SEQ ID NO: 435395 - DNA, 25 bp, Mus musculus
gacggacctggtgtacatcgagaag

SEQ ID NO: 435396 - DNA, 25 bp, Mus musculus
gacggacctttacaagctcttgaag

SEQ ID NO: 435397 - DNA, 25 bp, Mus musculus
gacggacgttaatgtgacctgctca

SEQ ID NO: 435398 - DNA, 25 bp, Mus musculus
gacggacgttcttgtgagaccaaag

SEQ ID NO: 435399 - DNA, 25 bp, Mus musculus
gacggactgttcatcattggctgga

SEQ ID NO: 435400 - DNA, 25 bp, Mus musculus
gacggactttcctcaggctgagcaa

SEQ ID NO: 435401 - DNA, 25 bp, Mus musculus
gacggagacaagtctgcagccgaag

SEQ ID NO: 435402 - DNA, 25 bp, Mus musculus
gacggagatcctgcacctgtacagt

SEQ ID NO: 435403 - DNA, 25 bp, Mus musculus
gacggagcccgagtgaacttctacg

SEQ ID NO: 435404 - DNA, 25 bp, Mus musculus
gacggagtccatggcttaatgggca

SEQ ID NO: 435405 - DNA, 25 bp, Mus musculus
gacggataactgaccccactgttga

SEQ ID NO: 435406 - DNA, 25 bp, Mus musculus
gacggatacggcacctgtactggaa

SEQ ID NO: 435407 - DNA, 25 bp, Mus musculus
gacggatcatagcttggaaacccac

SEQ ID NO: 435408 - DNA, 25 bp, Mus musculus
gacggatcccattcgaccttctgag

SEQ ID NO: 435409 - DNA, 25 bp, Mus musculus
gacggatgattctctgaagattgga

SEQ ID NO: 435410 - DNA, 25 bp, Mus musculus
gacggattccacactaggaccggga

SEQ ID NO: 435411 - DNA, 25 bp, Mus musculus
gacggattcccaaagcaagatgtat

SEQ ID NO: 435412 - DNA, 25 bp, Mus musculus
gacggattctaagtgggtggaacaa

SEQ ID NO: 435413 - DNA, 25 bp, Mus musculus
gacggattctcccatcgcgcaatct

SEQ ID NO: 435414 - DNA, 25 bp, Mus musculus
gacggcaagatcacccgagtggaga

SEQ ID NO: 435415 - DNA, 25 bp, Mus musculus
gacggcaaggctccatagaggacct

SEQ ID NO: 435416 - DNA, 25 bp, Mus musculus
gacggcacaactgttactctaggga

SEQ ID NO: 435417 - DNA, 25 bp, Mus musculus
gacggcagaacttctcaggaatggg

SEQ ID NO: 435418 - DNA, 25 bp, Mus musculus
gacggcagaagtacaaacggcggcc

SEQ ID NO: 435419 - DNA, 25 bp, Mus musculus
gacggcagacagacctatgattaca

SEQ ID NO: 435420 - DNA, 25 bp, Mus musculus
gacggcagccttttcaagtcgctgg

SEQ ID NO: 435421 - DNA, 25 bp, Mus musculus
gacggcagtaatggacacccttaat

SEQ ID NO: 435422 - DNA, 25 bp, Mus musculus
gacggcagtctgaatccaggaggaa

SEQ ID NO: 435423 - DNA, 25 bp, Mus musculus
gacggcatcacggacaagaagctga

SEQ ID NO: 435424 - DNA, 25 bp, Mus musculus
gacggcatcgtaatgttcccaggcg

SEQ ID NO: 435425 - DNA, 25 bp, Mus musculus
gacggcatttgtttgcatcgccctg

SEQ ID NO: 435426 - DNA, 25 bp, Mus musculus
gacggccaactttgaccggcttgtg

SEQ ID NO: 435427 - DNA, 25 bp, Mus musculus
gacggccagcagaggtgctaattgt

SEQ ID NO: 435428 - DNA, 25 bp, Mus musculus
gacggccctgttttccactatgcaa

SEQ ID NO: 435429 - DNA, 25 bp, Mus musculus
gacggccctttctcagtatcatgaa

SEQ ID NO: 435430 - DNA, 25 bp, Mus musculus
gacggccgaaaacttgaagacttgt

SEQ ID NO: 435431 - DNA, 25 bp, Mus musculus
gacggccggtatatcctgctgctga

SEQ ID NO: 435432 - DNA, 25 bp, Mus musculus
gacggcctcatcctccatagtgact

SEQ ID NO: 435433 - DNA, 25 bp, Mus musculus
gacggcctggtaccatcttatgcag

SEQ ID NO: 435434 - DNA, 25 bp, Mus musculus
gacggcgagacccatcattagaaga

SEQ ID NO: 435435 - DNA, 25 bp, Mus musculus
gacggcgccacgtttgagtgcactg

SEQ ID NO: 435436 - DNA, 25 bp, Mus musculus
gacggctacatttgctgcccctggg

SEQ ID NO: 435437 - DNA, 25 bp, Mus musculus
gacggctactttccagaggagcgct

SEQ ID NO: 435438 - DNA, 25 bp, Mus musculus
gacggctagagaaactgcgatgcca

SEQ ID NO: 435439 - DNA, 25 bp, Mus musculus
gacggctcatttctgcttcatcata

SEQ ID NO: 435440 - DNA, 25 bp, Mus musculus
gacggctcctcaggttccttcggaa

SEQ ID NO: 435441 - DNA, 25 bp, Mus musculus
gacggctcctgtgactagaagatta

SEQ ID NO: 435442 - DNA, 25 bp, Mus musculus
gacggctccttagctcaggatcgca

SEQ ID NO: 435443 - DNA, 25 bp, Mus musculus
gacggctctatgttcttctcgcaag

SEQ ID NO: 435444 - DNA, 25 bp, Mus musculus
gacggctcttttctgtcattccaac

SEQ ID NO: 435445 - DNA, 25 bp, Mus musculus
gacggctggattgcggatgactacc

SEQ ID NO: 435446 - DNA, 25 bp, Mus musculus
gacggctggcatactctgtgaatct

SEQ ID NO: 435447 - DNA, 25 bp, Mus musculus
gacggctggtacaaagggacatcga

SEQ ID NO: 435448 - DNA, 25 bp, Mus musculus
gacggcttcattaacaaggcgctag

SEQ ID NO: 435449 - DNA, 25 bp, Mus musculus
gacggcttcccaggctttctcaggg

SEQ ID NO: 435450 - DNA, 25 bp, Mus musculus
gacggctttattgacctgatggagc

SEQ ID NO: 435451 - DNA, 25 bp, Mus musculus
gacgggaacagatgaaagagcaagc

SEQ ID NO: 435452 - DNA, 25 bp, Mus musculus
gacgggaatgaaggatgtcagttct

SEQ ID NO: 435453 - DNA, 25 bp, Mus musculus
gacgggacaacgcacagttcctgag

SEQ ID NO: 435454 - DNA, 25 bp, Mus musculus
gacgggagccacgaaggtactatgt

SEQ ID NO: 435455 - DNA, 25 bp, Mus musculus
gacgggagctcggaggtctggagag

SEQ ID NO: 435456 - DNA, 25 bp, Mus musculus
gacgggaggatttgcagacagacca

SEQ ID NO: 435457 - DNA, 25 bp, Mus musculus
gacgggaggccagcagactatttat

SEQ ID NO: 435458 - DNA, 25 bp, Mus musculus
gacgggagtgacctaaatttcacag

SEQ ID NO: 435459 - DNA, 25 bp, Mus musculus
gacgggatggaaaagacacagcaca

SEQ ID NO: 435460 - DNA, 25 bp, Mus musculus
gacgggatttcttagctatggcaca

SEQ ID NO: 435461 - DNA, 25 bp, Mus musculus
gacgggcaaccagacgatacagatg

SEQ ID NO: 435462 - DNA, 25 bp, Mus musculus
gacgggcagcatcactacaaaaacc

SEQ ID NO: 435463 - DNA, 25 bp, Mus musculus
gacgggcaggtataccagggttcct

SEQ ID NO: 435464 - DNA, 25 bp, Mus musculus
gacgggcagtgtgacggcaaataca

SEQ ID NO: 435465 - DNA, 25 bp, Mus musculus
gacgggccatgagtcacattcggga

SEQ ID NO: 435466 - DNA, 25 bp, Mus musculus
gacgggccttggcaaacaatttact

SEQ ID NO: 435467 - DNA, 25 bp, Mus musculus
gacgggcgccttctcgtactatgga

SEQ ID NO: 435468 - DNA, 25 bp, Mus musculus
gacgggcgcctttctaatcagagag

SEQ ID NO: 435469 - DNA, 25 bp, Mus musculus
gacgggctctctctgcatacgaaaa

SEQ ID NO: 435470 - DNA, 25 bp, Mus musculus
gacgggtaccgaagcagaagttatg

SEQ ID NO: 435471 - DNA, 25 bp, Mus musculus
gacgggtacgggagtccgcaccaca

SEQ ID NO: 435472 - DNA, 25 bp, Mus musculus
gacgggttcgaataaatttcagcca

SEQ ID NO: 435473 - DNA, 25 bp, Mus musculus
gacgggttgctataatggtctgcac

SEQ ID NO: 435474 - DNA, 25 bp, Mus musculus
gacgggtttcgccatgtccagaaga

SEQ ID NO: 435475 - DNA, 25 bp, Mus musculus
gacggtatatgcagccagtgcaccg

SEQ ID NO: 435476 - DNA, 25 bp, Mus musculus
gacggtcacactccgcttttacttg

SEQ ID NO: 435477 - DNA, 25 bp, Mus musculus
gacggtcctgactgctcctgtggaa

SEQ ID NO: 435478 - DNA, 25 bp, Mus musculus
gacggtcgagttatcatctttcttt

SEQ ID NO: 435479 - DNA, 25 bp, Mus musculus
gacggtctatgatacccggagagga

SEQ ID NO: 435480 - DNA, 25 bp, Mus musculus
gacggtctttgttcgtgtccatcca

SEQ ID NO: 435481 - DNA, 25 bp, Mus musculus
gacggtgacacacatactgaagagc

SEQ ID NO: 435482 - DNA, 25 bp, Mus musculus
gacggtgagtgtcccacacttctct

SEQ ID NO: 435483 - DNA, 25 bp, Mus musculus
gacggtgatttgagcttccatggcc

SEQ ID NO: 435484 - DNA, 25 bp, Mus musculus
gacggtgcagcgcatcaagaagacc

SEQ ID NO: 435485 - DNA, 25 bp, Mus musculus
gacggtgcgatctctcaaagtcctg

SEQ ID NO: 435486 - DNA, 25 bp, Mus musculus
gacggtggcctcgacttgctgttgc

SEQ ID NO: 435487 - DNA, 25 bp, Mus musculus
gacggtggtctcaatacatcagcag

SEQ ID NO: 435488 - DNA, 25 bp, Mus musculus
gacggttcaagctctttccaggaaa

SEQ ID NO: 435489 - DNA, 25 bp, Mus musculus
gacggttctggcagggagacacctt

SEQ ID NO: 435490 - DNA, 25 bp, Mus musculus
gacggtttcaaagactccgacgaag

SEQ ID NO: 435491 - DNA, 25 bp, Mus musculus
gacggttttgacgagagctcatccc

SEQ ID NO: 435492 - DNA, 25 bp, Mus musculus
gacggttttgagtaggctttctgca

SEQ ID NO: 435493 - DNA, 25 bp, Mus musculus
gacgtaacaattcgctctctaagag

SEQ ID NO: 435494 - DNA, 25 bp, Mus musculus
gacgtaaccgacttccgcttctgga

SEQ ID NO: 435495 - DNA, 25 bp, Mus musculus
gacgtaataacggagctggagccca

SEQ ID NO: 435496 - DNA, 25 bp, Mus musculus
gacgtagacggcaatgggaccatca

SEQ ID NO: 435497 - DNA, 25 bp, Mus musculus
gacgtagcaaatttaacagccagtg

SEQ ID NO: 435498 - DNA, 25 bp, Mus musculus
gacgtagcctggtgtctcggacctg

SEQ ID NO: 435499 - DNA, 25 bp, Mus musculus
gacgtagtgattgatgaccgcctgc

SEQ ID NO: 435500 - DNA, 25 bp, Mus musculus
gacgtattatccattactcacagag

SEQ ID NO: 435501 - DNA, 25 bp, Mus musculus
gacgtattgcacgacctgagctgct

SEQ ID NO: 435502 - DNA, 25 bp, Mus musculus
gacgtattgccttgggctctcagca

SEQ ID NO: 435503 - DNA, 25 bp, Mus musculus
gacgtcaaaaagaatgagtcaacct

SEQ ID NO: 435504 - DNA, 25 bp, Mus musculus
gacgtcaccaaaagctactaccaga

SEQ ID NO: 435505 - DNA, 25 bp, Mus musculus
gacgtcattcaggaaaagtggccag

SEQ ID NO: 435506 - DNA, 25 bp, Mus musculus
gacgtcattcaggagctcaggttca

SEQ ID NO: 435507 - DNA, 25 bp, Mus musculus
gacgtcattggcgatgctggcagca

SEQ ID NO: 435508 - DNA, 25 bp, Mus musculus
gacgtccacttggatcggtcggcga

SEQ ID NO: 435509 - DNA, 25 bp, Mus musculus
gacgtccagtatgtgacagccggga

SEQ ID NO: 435510 - DNA, 25 bp, Mus musculus
gacgtccctgccacaagaactgagg

SEQ ID NO: 435511 - DNA, 25 bp, Mus musculus
gacgtccgactctctggctatgtgg

SEQ ID NO: 435512 - DNA, 25 bp, Mus musculus
gacgtccggcgttacggaaagtctg

SEQ ID NO: 435513 - DNA, 25 bp, Mus musculus
gacgtcctagaggtgaagccctccg

SEQ ID NO: 435514 - DNA, 25 bp, Mus musculus
gacgtcggcttctcaggcggagcct

SEQ ID NO: 435515 - DNA, 25 bp, Mus musculus
gacgtcgggtctctggattccttgt

SEQ ID NO: 435516 - DNA, 25 bp, Mus musculus
gacgtctacatcgagagcggcatca

SEQ ID NO: 435517 - DNA, 25 bp, Mus musculus
gacgtctcaaggaagcccttgtatg

SEQ ID NO: 435518 - DNA, 25 bp, Mus musculus
gacgtctcgccagctgacattggga

SEQ ID NO: 435519 - DNA, 25 bp, Mus musculus
gacgtctctgttgcggcctgcgttg

SEQ ID NO: 435520 - DNA, 25 bp, Mus musculus
gacgtctgtaagttttcgccctgag

SEQ ID NO: 435521 - DNA, 25 bp, Mus musculus
gacgtcttaataaagcccagcaggg

SEQ ID NO: 435522 - DNA, 25 bp, Mus musculus
gacgtgaaataactcatctatgggc

SEQ ID NO: 435523 - DNA, 25 bp, Mus musculus
gacgtgaacgttacagaccggaaga

SEQ ID NO: 435524 - DNA, 25 bp, Mus musculus
gacgtgaccgccgaggaggcagcgg

SEQ ID NO: 435525 - DNA, 25 bp, Mus musculus
gacgtgactggtgcattctgtgcta

SEQ ID NO: 435526 - DNA, 25 bp, Mus musculus
gacgtgagaaactcgcactagcact

SEQ ID NO: 435527 - DNA, 25 bp, Mus musculus
gacgtgatcacctgcaaagcgctgt

SEQ ID NO: 435528 - DNA, 25 bp, Mus musculus
gacgtgatcagttcgcacgcggacc

SEQ ID NO: 435529 - DNA, 25 bp, Mus musculus
gacgtgcagtttcagcgctgtgata

SEQ ID NO: 435530 - DNA, 25 bp, Mus musculus
gacgtgcatcttcgtgactccacag

SEQ ID NO: 435531 - DNA, 25 bp, Mus musculus
gacgtgcatgcttgtccctttggcg

SEQ ID NO: 435532 - DNA, 25 bp, Mus musculus
gacgtgccctctagacagtgacgag

SEQ ID NO: 435533 - DNA, 25 bp, Mus musculus
gacgtgctcaagtctcgattccaga

SEQ ID NO: 435534 - DNA, 25 bp, Mus musculus
gacgtgctcggtgtcacttcctgga

SEQ ID NO: 435535 - DNA, 25 bp, Mus musculus
gacgtgctgaggaatctgataccca

SEQ ID NO: 435536 - DNA, 25 bp, Mus musculus
gacgtggatgaagaatagttctgca

SEQ ID NO: 435537 - DNA, 25 bp, Mus musculus
gacgtggcaagagccgacctgcaga

SEQ ID NO: 435538 - DNA, 25 bp, Mus musculus
gacgtggcaagtttcctggacaaga

SEQ ID NO: 435539 - DNA, 25 bp, Mus musculus
gacgtggcagtgtctttcacccagg

SEQ ID NO: 435540 - DNA, 25 bp, Mus musculus
gacgtggctgcaatatcttgctgct

SEQ ID NO: 435541 - DNA, 25 bp, Mus musculus
gacgtggtcaccaacctaggcaaca

SEQ ID NO: 435542 - DNA, 25 bp, Mus musculus
gacgtggtgctcttcgaagggatcc

SEQ ID NO: 435543 - DNA, 25 bp, Mus musculus
gacgtggtggaatgggcgctggaga

SEQ ID NO: 435544 - DNA, 25 bp, Mus musculus
gacgtgtaccccaaccttctgaagc

SEQ ID NO: 435545 - DNA, 25 bp, Mus musculus
gacgtgtccagaagagtcaccgaag

SEQ ID NO: 435546 - DNA, 25 bp, Mus musculus
gacgtgtgcttcattctcagtgccc

SEQ ID NO: 435547 - DNA, 25 bp, Mus musculus
gacgttactgcatcactctgctctc

SEQ ID NO: 435548 - DNA, 25 bp, Mus musculus
gacgttcacttttccggagactcag

SEQ ID NO: 435549 - DNA, 25 bp, Mus musculus
gacgttcagtctcagaaccacggga

SEQ ID NO: 435550 - DNA, 25 bp, Mus musculus
gacgttcgtctctgcgatgtcggtg

SEQ ID NO: 435551 - DNA, 25 bp, Mus musculus
gacgttgcagcagggacggaatcaa

SEQ ID NO: 435552 - DNA, 25 bp, Mus musculus
gacgttgctcctacccataatgtgg

SEQ ID NO: 435553 - DNA, 25 bp, Mus musculus
gacgttggctttccaagttcatgat

SEQ ID NO: 435554 - DNA, 25 bp, Mus musculus
gacgttgggcctattgttcagcaca

SEQ ID NO: 435555 - DNA, 25 bp, Mus musculus
gacgttgtctccatgaagctaaaag

SEQ ID NO: 435556 - DNA, 25 bp, Mus musculus
gacgtttaatccagagcccttgcgg

SEQ ID NO: 435557 - DNA, 25 bp, Mus musculus
gacgtttcaagcaacagaagtacct

SEQ ID NO: 435558 - DNA, 25 bp, Mus musculus
gacgtttcacccacttggcagaatg

SEQ ID NO: 435559 - DNA, 25 bp, Mus musculus
gacgtttcttgaaatgagccccggg

SEQ ID NO: 435560 - DNA, 25 bp, Mus musculus
gacgttttcgacagtggtgtagcca

SEQ ID NO: 435561 - DNA, 25 bp, Mus musculus
gactaaaagctctactcctgcaggg

SEQ ID NO: 435562 - DNA, 25 bp, Mus musculus
gactaaaatattctcctgtgatcag

SEQ ID NO: 435563 - DNA, 25 bp, Mus musculus
gactaaacccaattgctaatctgct

SEQ ID NO: 435564 - DNA, 25 bp, Mus musculus
gactaaagaaatagcccagtaactg

SEQ ID NO: 435565 - DNA, 25 bp, Mus musculus
gactaaagctagaagactcataagg

SEQ ID NO: 435566 - DNA, 25 bp, Mus musculus
gactaaaggactgtggatgcccctg

SEQ ID NO: 435567 - DNA, 25 bp, Mus musculus
gactaaaggccatgtgacgtgtgac

SEQ ID NO: 435568 - DNA, 25 bp, Mus musculus
gactaaataaagctgtccgctcctg

SEQ ID NO: 435569 - DNA, 25 bp, Mus musculus
gactaaatagagctgcagtgccctg

SEQ ID NO: 435570 - DNA, 25 bp, Mus musculus
gactaaatatagaaatgcatgcagt

SEQ ID NO: 435571 - DNA, 25 bp, Mus musculus
gactaaatattttgctgctctgctg

SEQ ID NO: 435572 - DNA, 25 bp, Mus musculus
gactaaatttgctggcacagagcac

SEQ ID NO: 435573 - DNA, 25 bp, Mus musculus
gactaacacttagccctggcaggca

SEQ ID NO: 435574 - DNA, 25 bp, Mus musculus
gactaaccgggtaaagctggacgag

SEQ ID NO: 435575 - DNA, 25 bp, Mus musculus
gactaaccgtgtggaggtacccatt

SEQ ID NO: 435576 - DNA, 25 bp, Mus musculus
gactaacggcaacgaagacggtatg

SEQ ID NO: 435577 - DNA, 25 bp, Mus musculus
gactaacgtacatcgcagagtggaa

SEQ ID NO: 435578 - DNA, 25 bp, Mus musculus
gactaacgtcgttgactgcccaagg

SEQ ID NO: 435579 - DNA, 25 bp, Mus musculus
gactaagagaagttgttactgaaca

SEQ ID NO: 435580 - DNA, 25 bp, Mus musculus
gactaagcaaactacaggaagcagg

SEQ ID NO: 435581 - DNA, 25 bp, Mus musculus
gactaagcagcctgaagaagttttt

SEQ ID NO: 435582 - DNA, 25 bp, Mus musculus
gactaaggacggagctacgacatgg

SEQ ID NO: 435583 - DNA, 25 bp, Mus musculus
gactaaggccctaggatctcctcct

SEQ ID NO: 435584 - DNA, 25 bp, Mus musculus
gactaaggcggcatcagtcaccaca

SEQ ID NO: 435585 - DNA, 25 bp, Mus musculus
gactaaggcttgtgatttgcccgga

SEQ ID NO: 435586 - DNA, 25 bp, Mus musculus
gactaagtcttctcctacagaggcc

SEQ ID NO: 435587 - DNA, 25 bp, Mus musculus
gactaagtggtctgcggtgtctcct

SEQ ID NO: 435588 - DNA, 25 bp, Mus musculus
gactaagttggcctcctgtgacagg

SEQ ID NO: 435589 - DNA, 25 bp, Mus musculus
gactaataaagtggttgccgcaaca

SEQ ID NO: 435590 - DNA, 25 bp, Mus musculus
gactaatcgcttagcaaccgggagg

SEQ ID NO: 435591 - DNA, 25 bp, Mus musculus
gactaatctattctctgtatgccag

SEQ ID NO: 435592 - DNA, 25 bp, Mus musculus
gactaatgcctttgctctcaaatga

SEQ ID NO: 435593 - DNA, 25 bp, Mus musculus
gactaatttctcaccagatcaggag

SEQ ID NO: 435594 - DNA, 25 bp, Mus musculus
gactacaacatggacggctacccag

SEQ ID NO: 435595 - DNA, 25 bp, Mus musculus
gactacaactatggtggcggctcca

SEQ ID NO: 435596 - DNA, 25 bp, Mus musculus
gactacaagtatgcggtttacccag

SEQ ID NO: 435597 - DNA, 25 bp, Mus musculus
gactacaatgtagagatccgcctct

SEQ ID NO: 435598 - DNA, 25 bp, Mus musculus
gactacaccgagatgaacgatctgc

SEQ ID NO: 435599 - DNA, 25 bp, Mus musculus
gactacacgattcattttatcgaag

SEQ ID NO: 435600 - DNA, 25 bp, Mus musculus
gactacacggatgaaggaattctct

SEQ ID NO: 435601 - DNA, 25 bp, Mus musculus
gactacagcgacctatggagtgccg

SEQ ID NO: 435602 - DNA, 25 bp, Mus musculus
gactacagggattgtggccattcac

SEQ ID NO: 435603 - DNA, 25 bp, Mus musculus
gactacagggttatggctgacaacc

SEQ ID NO: 435604 - DNA, 25 bp, Mus musculus
gactacagtccccaggaggctttca

SEQ ID NO: 435605 - DNA, 25 bp, Mus musculus
gactacagtgtaaaggaaatctaga

SEQ ID NO: 435606 - DNA, 25 bp, Mus musculus
gactacatagacaaccctagcctgg

SEQ ID NO: 435607 - DNA, 25 bp, Mus musculus
gactacatagcaccaggccgtgtgg

SEQ ID NO: 435608 - DNA, 25 bp, Mus musculus
gactacatattcttctgcgcacggg

SEQ ID NO: 435609 - DNA, 25 bp, Mus musculus
gactacatattgcttgcctgcccca

SEQ ID NO: 435610 - DNA, 25 bp, Mus musculus
gactacatgcccatcgctgtgctga

SEQ ID NO: 435611 - DNA, 25 bp, Mus musculus
gactacatgtggatctcagacctaa

SEQ ID NO: 435612 - DNA, 25 bp, Mus musculus
gactacattacctcttcaacgccag

SEQ ID NO: 435613 - DNA, 25 bp, Mus musculus
gactacattgctgttgccgtagccg

SEQ ID NO: 435614 - DNA, 25 bp, Mus musculus
gactaccagtttgagatctacaggc

SEQ ID NO: 435615 - DNA, 25 bp, Mus musculus
gactaccataagacccagagcctgt

SEQ ID NO: 435616 - DNA, 25 bp, Mus musculus
gactaccatacctcacacagcgttg

SEQ ID NO: 435617 - DNA, 25 bp, Mus musculus
gactacccggggactgactgatcga

SEQ ID NO: 435618 - DNA, 25 bp, Mus musculus
gactacctcagttccacaaaagaag

SEQ ID NO: 435619 - DNA, 25 bp, Mus musculus
gactacctgatgctgagatccgcca

SEQ ID NO: 435620 - DNA, 25 bp, Mus musculus
gactacctgccctatgcggaagatg

SEQ ID NO: 435621 - DNA, 25 bp, Mus musculus
gactacctggatgaactcgccttgg

SEQ ID NO: 435622 - DNA, 25 bp, Mus musculus
gactacctgtacaaagacagactta

SEQ ID NO: 435623 - DNA, 25 bp, Mus musculus
gactacgaccgagactatgagcgct

SEQ ID NO: 435624 - DNA, 25 bp, Mus musculus
gactacgagtgagcttttacacaac

SEQ ID NO: 435625 - DNA, 25 bp, Mus musculus
gactacgatggtcaccgaaggtttg

SEQ ID NO: 435626 - DNA, 25 bp, Mus musculus
gactacgctgcgcaatgggacatta

SEQ ID NO: 435627 - DNA, 25 bp, Mus musculus
gactacggcggaggagctgtactca

SEQ ID NO: 435628 - DNA, 25 bp, Mus musculus
gactacgtgcaacacctgagcggtt

SEQ ID NO: 435629 - DNA, 25 bp, Mus musculus
gactactacagaagaagctccgaca

SEQ ID NO: 435630 - DNA, 25 bp, Mus musculus
gactactatgtggtgcgccagctct

SEQ ID NO: 435631 - DNA, 25 bp, Mus musculus
gactactctctaaatgctaccagga

SEQ ID NO: 435632 - DNA, 25 bp, Mus musculus
gactactgatgcaaacctaattggc

SEQ ID NO: 435633 - DNA, 25 bp, Mus musculus
gactactgcagctgggccaaggtga

SEQ ID NO: 435634 - DNA, 25 bp, Mus musculus
gactacttgcatacagtggagtcaa

SEQ ID NO: 435635 - DNA, 25 bp, Mus musculus
gactactttaatggacgggatctca

SEQ ID NO: 435636 - DNA, 25 bp, Mus musculus
gactagaagctatttagaccagagg

SEQ ID NO: 435637 - DNA, 25 bp, Mus musculus
gactagagagctttgggcaagagct

SEQ ID NO: 435638 - DNA, 25 bp, Mus musculus
gactagcacgtatttcatcacaggg

SEQ ID NO: 435639 - DNA, 25 bp, Mus musculus
gactagccactcttggaggaagcca

SEQ ID NO: 435640 - DNA, 25 bp, Mus musculus
gactaggactttctaggagctccgg

SEQ ID NO: 435641 - DNA, 25 bp, Mus musculus
gactaggagaaggatgtgcaacgct

SEQ ID NO: 435642 - DNA, 25 bp, Mus musculus
gactaggatgtggaggccttctgac

SEQ ID NO: 435643 - DNA, 25 bp, Mus musculus
gactaggcacgttttaggttagagg

SEQ ID NO: 435644 - DNA, 25 bp, Mus musculus
gactaggcagctaaccagtgtcacc

SEQ ID NO: 435645 - DNA, 25 bp, Mus musculus
gactaggcaggcttgggtagctaaa

SEQ ID NO: 435646 - DNA, 25 bp, Mus musculus
gactaggcataatggccaccttgcc

SEQ ID NO: 435647 - DNA, 25 bp, Mus musculus
gactaggcggttgctttccgtgcct

SEQ ID NO: 435648 - DNA, 25 bp, Mus musculus
gactagggacactgcaagaagggac

SEQ ID NO: 435649 - DNA, 25 bp, Mus musculus
gactagggctgctcttgctggttaa

SEQ ID NO: 435650 - DNA, 25 bp, Mus musculus
gactaggtatctctgcaagggcgaa

SEQ ID NO: 435651 - DNA, 25 bp, Mus musculus
gactagtaacttagcagccaggccc

SEQ ID NO: 435652 - DNA, 25 bp, Mus musculus
gactagtagagcagctcagaagctg

SEQ ID NO: 435653 - DNA, 25 bp, Mus musculus
gactagtcatggacagacgcgcaga

SEQ ID NO: 435654 - DNA, 25 bp, Mus musculus
gactagtgattagatacaggaagga

SEQ ID NO: 435655 - DNA, 25 bp, Mus musculus
gactagtggcttcccagcaaagagg

SEQ ID NO: 435656 - DNA, 25 bp, Mus musculus
gactataatcttgctgctgtaaagg

SEQ ID NO: 435657 - DNA, 25 bp, Mus musculus
gactatacagcatgtgcccagccag

SEQ ID NO: 435658 - DNA, 25 bp, Mus musculus
gactatacagcgagttcaagactag

SEQ ID NO: 435659 - DNA, 25 bp, Mus musculus
gactatacataaggactacttgcat

SEQ ID NO: 435660 - DNA, 25 bp, Mus musculus
gactataccccaaaagccaattact

SEQ ID NO: 435661 - DNA, 25 bp, Mus musculus
gactatacccgcaagaagagggctg

SEQ ID NO: 435662 - DNA, 25 bp, Mus musculus
gactatacgttgcaggtgacagaga

SEQ ID NO: 435663 - DNA, 25 bp, Mus musculus
gactatagaaggaaggcgccgactg

SEQ ID NO: 435664 - DNA, 25 bp, Mus musculus
gactatagcaagctcagccgtctgg

SEQ ID NO: 435665 - DNA, 25 bp, Mus musculus
gactatagcagcaaatgtactagag

SEQ ID NO: 435666 - DNA, 25 bp, Mus musculus
gactatagccagataaccagccttg

SEQ ID NO: 435667 - DNA, 25 bp, Mus musculus
gactatagcgtagaaaaacaaggct

SEQ ID NO: 435668 - DNA, 25 bp, Mus musculus
gactatagttcagtccatgagggct

SEQ ID NO: 435669 - DNA, 25 bp, Mus musculus
gactatatcctgttccgaagagacc

SEQ ID NO: 435670 - DNA, 25 bp, Mus musculus
gactatcacctacctttccttggga

SEQ ID NO: 435671 - DNA, 25 bp, Mus musculus
gactatcacgaattagggcgctcca

SEQ ID NO: 435672 - DNA, 25 bp, Mus musculus
gactatcaggatggagacacagacg

SEQ ID NO: 435673 - DNA, 25 bp, Mus musculus
gactatcatgtttgccactgagccg

SEQ ID NO: 435674 - DNA, 25 bp, Mus musculus
gactatcctgctcattcttgcatgg

SEQ ID NO: 435675 - DNA, 25 bp, Mus musculus
gactatccttgctggagtgcctgga

SEQ ID NO: 435676 - DNA, 25 bp, Mus musculus
gactatcgcaaaagatgcctactgc

SEQ ID NO: 435677 - DNA, 25 bp, Mus musculus
gactatcggtctctgggctgctaga

SEQ ID NO: 435678 - DNA, 25 bp, Mus musculus
gactatcgtgggaaatacttggttt

SEQ ID NO: 435679 - DNA, 25 bp, Mus musculus
gactatctgcagagattgtgccaaa

SEQ ID NO: 435680 - DNA, 25 bp, Mus musculus
gactatctgcaggtgagcacctcag

SEQ ID NO: 435681 - DNA, 25 bp, Mus musculus
gactatgaatttaaagccatgaaac

SEQ ID NO: 435682 - DNA, 25 bp, Mus musculus
gactatgacaacatccctactgtgg

SEQ ID NO: 435683 - DNA, 25 bp, Mus musculus
gactatgacttgaatgcagtgcgcc

SEQ ID NO: 435684 - DNA, 25 bp, Mus musculus
gactatgagaaagaacgggagctgc

SEQ ID NO: 435685 - DNA, 25 bp, Mus musculus
gactatgcagtaatcctcgcgaggc

SEQ ID NO: 435686 - DNA, 25 bp, Mus musculus
gactatggcccttgtgttgggctcc

SEQ ID NO: 435687 - DNA, 25 bp, Mus musculus
gactatgggactttgaattgggaca

SEQ ID NO: 435688 - DNA, 25 bp, Mus musculus
gactatgggcttagctttctcctct

SEQ ID NO: 435689 - DNA, 25 bp, Mus musculus
gactatggttacacccagaggcaac

SEQ ID NO: 435690 - DNA, 25 bp, Mus musculus
gactatgtccaagaacaggcagcct

SEQ ID NO: 435691 - DNA, 25 bp, Mus musculus
gactatgtcttctacctggccgtgg

SEQ ID NO: 435692 - DNA, 25 bp, Mus musculus
gactatgtgcgtgaccgtgctgacc

SEQ ID NO: 435693 - DNA, 25 bp, Mus musculus
gactattgaacctccagggctgtgc

SEQ ID NO: 435694 - DNA, 25 bp, Mus musculus
gactatttctgcaagtgccccgagg

SEQ ID NO: 435695 - DNA, 25 bp, Mus musculus
gactatttgcgtctgggtgccctac

SEQ ID NO: 435696 - DNA, 25 bp, Mus musculus
gactcaaactgtcttgagcagcaca

SEQ ID NO: 435697 - DNA, 25 bp, Mus musculus
gactcaaagcattggccgatgccac

SEQ ID NO: 435698 - DNA, 25 bp, Mus musculus
gactcaaagtgaccttggagaccaa

SEQ ID NO: 435699 - DNA, 25 bp, Mus musculus
gactcaaatgagtaccctggcagcc

SEQ ID NO: 435700 - DNA, 25 bp, Mus musculus
gactcaaatgatatgaactcccttt

SEQ ID NO: 435701 - DNA, 25 bp, Mus musculus
gactcaacagttaaaaaagcactgc

SEQ ID NO: 435702 - DNA, 25 bp, Mus musculus
gactcaaggcggagttccaggcaaa

SEQ ID NO: 435703 - DNA, 25 bp, Mus musculus
gactcaaggtcagtggcccaaatcg

SEQ ID NO: 435704 - DNA, 25 bp, Mus musculus
gactcaattccaagtctttccacaa

SEQ ID NO: 435705 - DNA, 25 bp, Mus musculus
gactcacacacacctcgggttaagc

SEQ ID NO: 435706 - DNA, 25 bp, Mus musculus
gactcacacaggaactcatcgagcg

SEQ ID NO: 435707 - DNA, 25 bp, Mus musculus
gactcacacccaaacatcagatgaa

SEQ ID NO: 435708 - DNA, 25 bp, Mus musculus
gactcacagcgaggatgacaaggac

SEQ ID NO: 435709 - DNA, 25 bp, Mus musculus
gactcacagtggacgacatccgaaa

SEQ ID NO: 435710 - DNA, 25 bp, Mus musculus
gactcacatgtagactgaagatggg

SEQ ID NO: 435711 - DNA, 25 bp, Mus musculus
gactcacccaggagacaaacctgct

SEQ ID NO: 435712 - DNA, 25 bp, Mus musculus
gactcaccctggctgacaaggagaa

SEQ ID NO: 435713 - DNA, 25 bp, Mus musculus
gactcacctggacttagattaaata

SEQ ID NO: 435714 - DNA, 25 bp, Mus musculus
gactcacggctgtgatagacatcag

SEQ ID NO: 435715 - DNA, 25 bp, Mus musculus
gactcacggtccttggagacgactg

SEQ ID NO: 435716 - DNA, 25 bp, Mus musculus
gactcacgtcctgactgggcagtgt

SEQ ID NO: 435717 - DNA, 25 bp, Mus musculus
gactcactgaaattgaaaagttact

SEQ ID NO: 435718 - DNA, 25 bp, Mus musculus
gactcactgcttcaaggagcgcacg

SEQ ID NO: 435719 - DNA, 25 bp, Mus musculus
gactcactggaggattcacccgaag

SEQ ID NO: 435720 - DNA, 25 bp, Mus musculus
gactcacttgatgggatgttcagct

SEQ ID NO: 435721 - DNA, 25 bp, Mus musculus
gactcagaaggagggaaacacacac

SEQ ID NO: 435722 - DNA, 25 bp, Mus musculus
gactcagaagtcaaaccacagaatg

SEQ ID NO: 435723 - DNA, 25 bp, Mus musculus
gactcagacataacctttcaatgtt

SEQ ID NO: 435724 - DNA, 25 bp, Mus musculus
gactcagagaccgtaattgaccaga

SEQ ID NO: 435725 - DNA, 25 bp, Mus musculus
gactcagagggctgttggacaacct

SEQ ID NO: 435726 - DNA, 25 bp, Mus musculus
gactcagatacagagtatgctgaaa

SEQ ID NO: 435727 - DNA, 25 bp, Mus musculus
gactcagatctgtgtgggaaacccg

SEQ ID NO: 435728 - DNA, 25 bp, Mus musculus
gactcagcagtgtctggtgaaccca

SEQ ID NO: 435729 - DNA, 25 bp, Mus musculus
gactcagcatcgtgatacacctgga

SEQ ID NO: 435730 - DNA, 25 bp, Mus musculus
gactcagccccaaggagatgaagaa

SEQ ID NO: 435731 - DNA, 25 bp, Mus musculus
gactcagcgtctaaaagtacttgcc

SEQ ID NO: 435732 - DNA, 25 bp, Mus musculus
gactcagctattgtagactctcagt

SEQ ID NO: 435733 - DNA, 25 bp, Mus musculus
gactcagctctacctcagccttaag

SEQ ID NO: 435734 - DNA, 25 bp, Mus musculus
gactcagcttttaaccagggacacg

SEQ ID NO: 435735 - DNA, 25 bp, Mus musculus
gactcaggaagaaaccatggtgctc

SEQ ID NO: 435736 - DNA, 25 bp, Mus musculus
gactcaggaagcaacaaaagctgtg

SEQ ID NO: 435737 - DNA, 25 bp, Mus musculus
gactcaggacaaacggatccaggac

SEQ ID NO: 435738 - DNA, 25 bp, Mus musculus
gactcaggcactttggacacggtgg

SEQ ID NO: 435739 - DNA, 25 bp, Mus musculus
gactcaggccctgtaaaagctccag

SEQ ID NO: 435740 - DNA, 25 bp, Mus musculus
gactcaggcttgtggatgcccagca

SEQ ID NO: 435741 - DNA, 25 bp, Mus musculus
gactcagggacggatcgattctcct

SEQ ID NO: 435742 - DNA, 25 bp, Mus musculus
gactcagggagtacacacttaccag

SEQ ID NO: 435743 - DNA, 25 bp, Mus musculus
gactcaggtgttctatcatgcaacg

SEQ ID NO: 435744 - DNA, 25 bp, Mus musculus
gactcaggttgttagaaatggccac

SEQ ID NO: 435745 - DNA, 25 bp, Mus musculus
gactcagtagtcaccagagcagttg

SEQ ID NO: 435746 - DNA, 25 bp, Mus musculus
gactcagtgtagactgtgagtggac

SEQ ID NO: 435747 - DNA, 25 bp, Mus musculus
gactcagtgttgcagtatgcggcct

SEQ ID NO: 435748 - DNA, 25 bp, Mus musculus
gactcagttacttccccaagaggca

SEQ ID NO: 435749 - DNA, 25 bp, Mus musculus
gactcataaggccagagtgacctgg

SEQ ID NO: 435750 - DNA, 25 bp, Mus musculus
gactcataagtcatattcctaggca

SEQ ID NO: 435751 - DNA, 25 bp, Mus musculus
gactcatacctgagatggctgaact

SEQ ID NO: 435752 - DNA, 25 bp, Mus musculus
gactcatatagtccatgtggtagca

SEQ ID NO: 435753 - DNA, 25 bp, Mus musculus
gactcatcatcagacgctgctgcag

SEQ ID NO: 435754 - DNA, 25 bp, Mus musculus
gactcatccgctgtaaatggacgcg

SEQ ID NO: 435755 - DNA, 25 bp, Mus musculus
gactcatgagacaaatgcatctatg

SEQ ID NO: 435756 - DNA, 25 bp, Mus musculus
gactcatggaagagagcaacgccaa

SEQ ID NO: 435757 - DNA, 25 bp, Mus musculus
gactcatggagatcctcaaccggga

SEQ ID NO: 435758 - DNA, 25 bp, Mus musculus
gactcattcccagacaaagcaatag

SEQ ID NO: 435759 - DNA, 25 bp, Mus musculus
gactcatttacttacagccttatgg

SEQ ID NO: 435760 - DNA, 25 bp, Mus musculus
gactccaagtcaggtggtagcggca

SEQ ID NO: 435761 - DNA, 25 bp, Mus musculus
gactccaatgagagactggcacttg

SEQ ID NO: 435762 - DNA, 25 bp, Mus musculus
gactccacattagtgagatcccatc

SEQ ID NO: 435763 - DNA, 25 bp, Mus musculus
gactccagaggcaaagaattccgtg

SEQ ID NO: 435764 - DNA, 25 bp, Mus musculus
gactccagattgtgaacctcgggct

SEQ ID NO: 435765 - DNA, 25 bp, Mus musculus
gactccagcagtgatctattttcct

SEQ ID NO: 435766 - DNA, 25 bp, Mus musculus
gactccagccacaagggcagattga

SEQ ID NO: 435767 - DNA, 25 bp, Mus musculus
gactccagcggcttctcgggcttca

SEQ ID NO: 435768 - DNA, 25 bp, Mus musculus
gactccagtcttcttgctcacgatg

SEQ ID NO: 435769 - DNA, 25 bp, Mus musculus
gactccatcaaccttacatgaccag

SEQ ID NO: 435770 - DNA, 25 bp, Mus musculus
gactcccaaacaaatagatgagctg

SEQ ID NO: 435771 - DNA, 25 bp, Mus musculus
gactcccagagtctaacataccatg

SEQ ID NO: 435772 - DNA, 25 bp, Mus musculus
gactcccagtgtactggagcccggg

SEQ ID NO: 435773 - DNA, 25 bp, Mus musculus
gactccccagagtaggcagatacag

SEQ ID NO: 435774 - DNA, 25 bp, Mus musculus
gactccccggctggaaagcactggg

SEQ ID NO: 435775 - DNA, 25 bp, Mus musculus
gactcccctggagcaatttaattaa

SEQ ID NO: 435776 - DNA, 25 bp, Mus musculus
gactcccgagacatttgataaggct

SEQ ID NO: 435777 - DNA, 25 bp, Mus musculus
gactcccggcttggaaaaactgaag

SEQ ID NO: 435778 - DNA, 25 bp, Mus musculus
gactcccggtggcataagctcatga

SEQ ID NO: 435779 - DNA, 25 bp, Mus musculus
gactccctacattatcatgttacag

SEQ ID NO: 435780 - DNA, 25 bp, Mus musculus
gactccctactggatggcaccaaag

SEQ ID NO: 435781 - DNA, 25 bp, Mus musculus
gactccctcagatgctttcaagaca

SEQ ID NO: 435782 - DNA, 25 bp, Mus musculus
gactccctgagccattaacttaacc

SEQ ID NO: 435783 - DNA, 25 bp, Mus musculus
gactccctggtatgctgatattccc

SEQ ID NO: 435784 - DNA, 25 bp, Mus musculus
gactccctggtgctagcagtgcaga

SEQ ID NO: 435785 - DNA, 25 bp, Mus musculus
gactccgaggttaacccatgcttgt

SEQ ID NO: 435786 - DNA, 25 bp, Mus musculus
gactccgcctctatgtggaaaccga

SEQ ID NO: 435787 - DNA, 25 bp, Mus musculus
gactccgcctttgaggatccgcaga

SEQ ID NO: 435788 - DNA, 25 bp, Mus musculus
gactccgggttataaggagccgagt

SEQ ID NO: 435789 - DNA, 25 bp, Mus musculus
gactccggtgagattcgaagacttc

SEQ ID NO: 435790 - DNA, 25 bp, Mus musculus
gactccggttctgcttccatggcaa

SEQ ID NO: 435791 - DNA, 25 bp, Mus musculus
gactccgtgtcaaacgccgtctgtg

SEQ ID NO: 435792 - DNA, 25 bp, Mus musculus
gactcctaaatttctgcatccgtga

SEQ ID NO: 435793 - DNA, 25 bp, Mus musculus
gactcctatttctggcgataccttg

SEQ ID NO: 435794 - DNA, 25 bp, Mus musculus
gactcctcaggagaacaggtgatgc

SEQ ID NO: 435795 - DNA, 25 bp, Mus musculus
gactcctccaggctcactgacattg

SEQ ID NO: 435796 - DNA, 25 bp, Mus musculus
gactcctgagctggttgtgtagaaa

SEQ ID NO: 435797 - DNA, 25 bp, Mus musculus
gactcctgctaactggacactttta

SEQ ID NO: 435798 - DNA, 25 bp, Mus musculus
gactcctggagtggtgggcaaatac

SEQ ID NO: 435799 - DNA, 25 bp, Mus musculus
gactcctgtgaagctgtgaatccca

SEQ ID NO: 435800 - DNA, 25 bp, Mus musculus
gactccttggagacctccggctctg

SEQ ID NO: 435801 - DNA, 25 bp, Mus musculus
gactcctttcttatcgtttgctgga

SEQ ID NO: 435802 - DNA, 25 bp, Mus musculus
gactcgaaatgatgtggctcccacc

SEQ ID NO: 435803 - DNA, 25 bp, Mus musculus
gactcgaacgcaagagcaaactgct

SEQ ID NO: 435804 - DNA, 25 bp, Mus musculus
gactcgacatatctccggtggtgtg

SEQ ID NO: 435805 - DNA, 25 bp, Mus musculus
gactcgacccgcaggtctcagaact

SEQ ID NO: 435806 - DNA, 25 bp, Mus musculus
gactcgagcttcctccaagtttgga

SEQ ID NO: 435807 - DNA, 25 bp, Mus musculus
gactcgattgtgtgggacttaacct

SEQ ID NO: 435808 - DNA, 25 bp, Mus musculus
gactcgctagctttgggaccatgaa

SEQ ID NO: 435809 - DNA, 25 bp, Mus musculus
gactcgctatcgtgtggaccagaac

SEQ ID NO: 435810 - DNA, 25 bp, Mus musculus
gactcgctcatcagctcaggcagag

SEQ ID NO: 435811 - DNA, 25 bp, Mus musculus
gactcgctgaatctgtaaacagcac

SEQ ID NO: 435812 - DNA, 25 bp, Mus musculus
gactcgctgctgaggtcctggaaca

SEQ ID NO: 435813 - DNA, 25 bp, Mus musculus
gactcgcttcccaccctgggagatg

SEQ ID NO: 435814 - DNA, 25 bp, Mus musculus
gactcggaaaggaggatcgcaaatt

SEQ ID NO: 435815 - DNA, 25 bp, Mus musculus
gactcggaccaaactgacagtagaa

SEQ ID NO: 435816 - DNA, 25 bp, Mus musculus
gactcggacgagtgaaactagaaga

SEQ ID NO: 435817 - DNA, 25 bp, Mus musculus
gactcggacgtgttctatgaggaca

SEQ ID NO: 435818 - DNA, 25 bp, Mus musculus
gactcggactgtgatgccttaatta

SEQ ID NO: 435819 - DNA, 25 bp, Mus musculus
gactcggagaagacatgaggccgtt

SEQ ID NO: 435820 - DNA, 25 bp, Mus musculus
gactcggatgtcttcgtgccctatg

SEQ ID NO: 435821 - DNA, 25 bp, Mus musculus
gactcggcctggatcgctgagaaga

SEQ ID NO: 435822 - DNA, 25 bp, Mus musculus
gactcgggaagagatcctgcctcag

SEQ ID NO: 435823 - DNA, 25 bp, Mus musculus
gactcgggacacacagcttataaca

SEQ ID NO: 435824 - DNA, 25 bp, Mus musculus
gactcgggatcctgaaaagttggct

SEQ ID NO: 435825 - DNA, 25 bp, Mus musculus
gactcgggcaagtacagcatcaacg

SEQ ID NO: 435826 - DNA, 25 bp, Mus musculus
gactcgggccgcctacaaactttgg

SEQ ID NO: 435827 - DNA, 25 bp, Mus musculus
gactcggtagcccattacaatcaga

SEQ ID NO: 435828 - DNA, 25 bp, Mus musculus
gactcgtaagcacctgtcttccctt

SEQ ID NO: 435829 - DNA, 25 bp, Mus musculus
gactcgtcccgattcagcgtgcgat

SEQ ID NO: 435830 - DNA, 25 bp, Mus musculus
gactcgtccgttttgccagttgcaa

SEQ ID NO: 435831 - DNA, 25 bp, Mus musculus
gactcgtcgaggtgttcaaataaaa

SEQ ID NO: 435832 - DNA, 25 bp, Mus musculus
gactcgtgaaaactagaacaattgg

SEQ ID NO: 435833 - DNA, 25 bp, Mus musculus
gactcgtgaatctgcatggaccaag

SEQ ID NO: 435834 - DNA, 25 bp, Mus musculus
gactcgtgctcggtgtgctctggaa

SEQ ID NO: 435835 - DNA, 25 bp, Mus musculus
gactcgtgctggttggatccgagcc

SEQ ID NO: 435836 - DNA, 25 bp, Mus musculus
gactcgtgggcacattcactgtgtc

SEQ ID NO: 435837 - DNA, 25 bp, Mus musculus
gactcgtttctaccgggaagcctcg

SEQ ID NO: 435838 - DNA, 25 bp, Mus musculus
gactctaaacgatgctcaaggcaga

SEQ ID NO: 435839 - DNA, 25 bp, Mus musculus
gactctaaagatcagattccgcctg

SEQ ID NO: 435840 - DNA, 25 bp, Mus musculus
gactctaatgaagactctaaccaga

SEQ ID NO: 435841 - DNA, 25 bp, Mus musculus
gactctacagccaggagaacccttg

SEQ ID NO: 435842 - DNA, 25 bp, Mus musculus
gactctacagtcaacgggcaagtga

SEQ ID NO: 435843 - DNA, 25 bp, Mus musculus
gactctacccgctacaaattgaaat

SEQ ID NO: 435844 - DNA, 25 bp, Mus musculus
gactctaccctgagccaacagggtg

SEQ ID NO: 435845 - DNA, 25 bp, Mus musculus
gactctacttatccaggctctgcag

SEQ ID NO: 435846 - DNA, 25 bp, Mus musculus
gactctatcatgtcacacattgctg

SEQ ID NO: 435847 - DNA, 25 bp, Mus musculus
gactctatccggaaacctcctggag

SEQ ID NO: 435848 - DNA, 25 bp, Mus musculus
gactctatgagctaccacagtggca

SEQ ID NO: 435849 - DNA, 25 bp, Mus musculus
gactctatgctcaaccagctgatgg

SEQ ID NO: 435850 - DNA, 25 bp, Mus musculus
gactctcaaggccagacgaaggtag

SEQ ID NO: 435851 - DNA, 25 bp, Mus musculus
gactctcacctcacttgatacttgg

SEQ ID NO: 435852 - DNA, 25 bp, Mus musculus
gactctcagacacagaattgcccca

SEQ ID NO: 435853 - DNA, 25 bp, Mus musculus
gactctcagcccagatgtggttctg

SEQ ID NO: 435854 - DNA, 25 bp, Mus musculus
gactctcagcggtgcatttacagag

SEQ ID NO: 435855 - DNA, 25 bp, Mus musculus
gactctccaggaagcaagggcatga

SEQ ID NO: 435856 - DNA, 25 bp, Mus musculus
gactctcccagctccgtgatgtgat

SEQ ID NO: 435857 - DNA, 25 bp, Mus musculus
gactctccttgatgtgggccttgaa

SEQ ID NO: 435858 - DNA, 25 bp, Mus musculus
gactctcgccatgaagctgcgcgtg

SEQ ID NO: 435859 - DNA, 25 bp, Mus musculus
gactctcggctctggttaaggcgtg

SEQ ID NO: 435860 - DNA, 25 bp, Mus musculus
gactctcgggagcactgaattttgg

SEQ ID NO: 435861 - DNA, 25 bp, Mus musculus
gactctcgggtgatgccggtcacat

SEQ ID NO: 435862 - DNA, 25 bp, Mus musculus
gactctctagcaaaggaagcatggg

SEQ ID NO: 435863 - DNA, 25 bp, Mus musculus
gactctctctaccaggcagccagag

SEQ ID NO: 435864 - DNA, 25 bp, Mus musculus
gactctctctggcaacaaagcacgg

SEQ ID NO: 435865 - DNA, 25 bp, Mus musculus
gactctctgagaagtggctcccata

SEQ ID NO: 435866 - DNA, 25 bp, Mus musculus
gactctctggtgttcggcgggaaca

SEQ ID NO: 435867 - DNA, 25 bp, Mus musculus
gactctcttcagtgggtggaccaga

SEQ ID NO: 435868 - DNA, 25 bp, Mus musculus
gactctgaacctgatttaccgctga

SEQ ID NO: 435869 - DNA, 25 bp, Mus musculus
gactctgaattgacacagtgaagtt

SEQ ID NO: 435870 - DNA, 25 bp, Mus musculus
gactctgacaatagtgctggtgagg

SEQ ID NO: 435871 - DNA, 25 bp, Mus musculus
gactctgacagtgaggactcgcctg

SEQ ID NO: 435872 - DNA, 25 bp, Mus musculus
gactctgacatggaggtcccaggaa

SEQ ID NO: 435873 - DNA, 25 bp, Mus musculus
gactctgaccccagtgaagataaga

SEQ ID NO: 435874 - DNA, 25 bp, Mus musculus
gactctgaccttgtacgctaccgaa

SEQ ID NO: 435875 - DNA, 25 bp, Mus musculus
gactctgagaaaggtcaagatacga

SEQ ID NO: 435876 - DNA, 25 bp, Mus musculus
gactctgcaggtgtccaattgactt

SEQ ID NO: 435877 - DNA, 25 bp, Mus musculus
gactctgcagttcatgtacgacgag

SEQ ID NO: 435878 - DNA, 25 bp, Mus musculus
gactctgccgaggtttctgacacgc

SEQ ID NO: 435879 - DNA, 25 bp, Mus musculus
gactctgcctcctcgctgcagagat

SEQ ID NO: 435880 - DNA, 25 bp, Mus musculus
gactctgccttatgagaagattctc

SEQ ID NO: 435881 - DNA, 25 bp, Mus musculus
gactctgcggcaactcacctgcttt

SEQ ID NO: 435882 - DNA, 25 bp, Mus musculus
gactctgcgtgagaagacctggaga

SEQ ID NO: 435883 - DNA, 25 bp, Mus musculus
gactctgctaaaggagctccctggg

SEQ ID NO: 435884 - DNA, 25 bp, Mus musculus
gactctggaactcaagcatcacctt

SEQ ID NO: 435885 - DNA, 25 bp, Mus musculus
gactctggaccctaactgtgagaag

SEQ ID NO: 435886 - DNA, 25 bp, Mus musculus
gactctggactcaggaggacaggca

SEQ ID NO: 435887 - DNA, 25 bp, Mus musculus
gactctggagtctcatccgcgaagc

SEQ ID NO: 435888 - DNA, 25 bp, Mus musculus
gactctggatgcaagacctgtcgct

SEQ ID NO: 435889 - DNA, 25 bp, Mus musculus
gactctgggacacctacaagaattg

SEQ ID NO: 435890 - DNA, 25 bp, Mus musculus
gactctgggactgagaccacgtcgt

SEQ ID NO: 435891 - DNA, 25 bp, Mus musculus
gactctggtacctacatttgcacat

SEQ ID NO: 435892 - DNA, 25 bp, Mus musculus
gactctggtcatctccgagctggag

SEQ ID NO: 435893 - DNA, 25 bp, Mus musculus
gactctggtccagttttcaagaaga

SEQ ID NO: 435894 - DNA, 25 bp, Mus musculus
gactctgtacaacaagctgaggtaa

SEQ ID NO: 435895 - DNA, 25 bp, Mus musculus
gactctgtcagttaatgagacagca

SEQ ID NO: 435896 - DNA, 25 bp, Mus musculus
gactctgtccgtgcaatgtggcgct

SEQ ID NO: 435897 - DNA, 25 bp, Mus musculus
gactctgtggcccaggatgccatgc

SEQ ID NO: 435898 - DNA, 25 bp, Mus musculus
gactctgtgtaatatgtgacatccg

SEQ ID NO: 435899 - DNA, 25 bp, Mus musculus
gactctgttctgcagccctgattga

SEQ ID NO: 435900 - DNA, 25 bp, Mus musculus
gactctgttggtgtgtgctaccctt

SEQ ID NO: 435901 - DNA, 25 bp, Mus musculus
gactctgttgttcccatctctgcag

SEQ ID NO: 435902 - DNA, 25 bp, Mus musculus
gactctgtttcaggcaggccagcca

SEQ ID NO: 435903 - DNA, 25 bp, Mus musculus
gactcttcaaagcagggtacagggc

SEQ ID NO: 435904 - DNA, 25 bp, Mus musculus
gactcttcagtattctggttctaga

SEQ ID NO: 435905 - DNA, 25 bp, Mus musculus
gactcttcagtgacaggccttgtgt

SEQ ID NO: 435906 - DNA, 25 bp, Mus musculus
gactcttcctcagtgggtggcgaca

SEQ ID NO: 435907 - DNA, 25 bp, Mus musculus
gactcttcgagcagcagtagcgact

SEQ ID NO: 435908 - DNA, 25 bp, Mus musculus
gactcttcgcagatgttagttcaca

SEQ ID NO: 435909 - DNA, 25 bp, Mus musculus
gactcttcgcttgtctagatgtagg

SEQ ID NO: 435910 - DNA, 25 bp, Mus musculus
gactcttctcaaggtgctcatgtga

SEQ ID NO: 435911 - DNA, 25 bp, Mus musculus
gactcttctgacagcaggcggctaa

SEQ ID NO: 435912 - DNA, 25 bp, Mus musculus
gactcttctgaggactgctgccagg

SEQ ID NO: 435913 - DNA, 25 bp, Mus musculus
gactcttctggcagggtgaccttca

SEQ ID NO: 435914 - DNA, 25 bp, Mus musculus
gactcttgacccctgacctattatc

SEQ ID NO: 435915 - DNA, 25 bp, Mus musculus
gactcttgagagacgtgcgcttgga

SEQ ID NO: 435916 - DNA, 25 bp, Mus musculus
gactcttgcaggaataagcgttagg

SEQ ID NO: 435917 - DNA, 25 bp, Mus musculus
gactcttgctaggttctctcgcaga

SEQ ID NO: 435918 - DNA, 25 bp, Mus musculus
gactcttggatgtgcgcatgtcaat

SEQ ID NO: 435919 - DNA, 25 bp, Mus musculus
gactcttggcagtggttctctcaaa

SEQ ID NO: 435920 - DNA, 25 bp, Mus musculus
gactcttgggacaatggacatcatg

SEQ ID NO: 435921 - DNA, 25 bp, Mus musculus
gactcttgtgtgtttcccgtgggcc

SEQ ID NO: 435922 - DNA, 25 bp, Mus musculus
gactcttgttcctgcttgggttgct

SEQ ID NO: 435923 - DNA, 25 bp, Mus musculus
gactctttatggatgcgcagcacaa

SEQ ID NO: 435924 - DNA, 25 bp, Mus musculus
gactctttgcgttgtctggccctgc

SEQ ID NO: 435925 - DNA, 25 bp, Mus musculus
gactcttttacggaggtctatgcca

SEQ ID NO: 435926 - DNA, 25 bp, Mus musculus
gactcttttgggagccatccacctg

SEQ ID NO: 435927 - DNA, 25 bp, Mus musculus
gactgaaaagcgactatctggaggg

SEQ ID NO: 435928 - DNA, 25 bp, Mus musculus
gactgaaaagtcatggcctcccaac

SEQ ID NO: 435929 - DNA, 25 bp, Mus musculus
gactgaaactcagggttggagacct

SEQ ID NO: 435930 - DNA, 25 bp, Mus musculus
gactgaaagtcgcaagatctctccc

SEQ ID NO: 435931 - DNA, 25 bp, Mus musculus
gactgaaatactgcagagactcctg

SEQ ID NO: 435932 - DNA, 25 bp, Mus musculus
gactgaaatagtgacatcccgtgca

SEQ ID NO: 435933 - DNA, 25 bp, Mus musculus
gactgaaatctgtgagatcaagagt

SEQ ID NO: 435934 - DNA, 25 bp, Mus musculus
gactgaaattgcatacgggaccctg

SEQ ID NO: 435935 - DNA, 25 bp, Mus musculus
gactgaaatttaaaggccctgctga

SEQ ID NO: 435936 - DNA, 25 bp, Mus musculus
gactgaagacccgttggaagccagg

SEQ ID NO: 435937 - DNA, 25 bp, Mus musculus
gactgaagactgtacacgaaacagg

SEQ ID NO: 435938 - DNA, 25 bp, Mus musculus
gactgaagatgagcaggcaacctgg

SEQ ID NO: 435939 - DNA, 25 bp, Mus musculus
gactgaagcacttgaagccactgtg

SEQ ID NO: 435940 - DNA, 25 bp, Mus musculus
gactgaagcatgaaaagaatgaatt

SEQ ID NO: 435941 - DNA, 25 bp, Mus musculus
gactgaagccacattggcacccctg

SEQ ID NO: 435942 - DNA, 25 bp, Mus musculus
gactgaagctctcaagccttactcg

SEQ ID NO: 435943 - DNA, 25 bp, Mus musculus
gactgaagggcgtgaaaggcaatcc

SEQ ID NO: 435944 - DNA, 25 bp, Mus musculus
gactgaagtcagtaagtttctacca

SEQ ID NO: 435945 - DNA, 25 bp, Mus musculus
gactgaagttaagaacgcccgagct

SEQ ID NO: 435946 - DNA, 25 bp, Mus musculus
gactgaatcctgactgactgtcgca

SEQ ID NO: 435947 - DNA, 25 bp, Mus musculus
gactgaatcgtctatgcgacctagg

SEQ ID NO: 435948 - DNA, 25 bp, Mus musculus
gactgaatgccattgactagagggc

SEQ ID NO: 435949 - DNA, 25 bp, Mus musculus
gactgaatgcgccattacaatttgg

SEQ ID NO: 435950 - DNA, 25 bp, Mus musculus
gactgaattactctcgaacagggag

SEQ ID NO: 435951 - DNA, 25 bp, Mus musculus
gactgaattatgtgcagaggtcccc

SEQ ID NO: 435952 - DNA, 25 bp, Mus musculus
gactgaattgatcctcctgaccgag

SEQ ID NO: 435953 - DNA, 25 bp, Mus musculus
gactgacaagatcccagacggtgaa

SEQ ID NO: 435954 - DNA, 25 bp, Mus musculus
gactgacaatagagaagaccgggcc

SEQ ID NO: 435955 - DNA, 25 bp, Mus musculus
gactgacacctccatgtgagcagca

SEQ ID NO: 435956 - DNA, 25 bp, Mus musculus
gactgacagctgccaacacatctgc

SEQ ID NO: 435957 - DNA, 25 bp, Mus musculus
gactgacagggcagctggacaacat

SEQ ID NO: 435958 - DNA, 25 bp, Mus musculus
gactgacaggtttaaatagcaccca

SEQ ID NO: 435959 - DNA, 25 bp, Mus musculus
gactgacagtgagccttcccaaaaa

SEQ ID NO: 435960 - DNA, 25 bp, Mus musculus
gactgacagtttttagggcacctct

SEQ ID NO: 435961 - DNA, 25 bp, Mus musculus
gactgaccacggatctaagggaaca

SEQ ID NO: 435962 - DNA, 25 bp, Mus musculus
gactgaccactttgactgtacctgg

SEQ ID NO: 435963 - DNA, 25 bp, Mus musculus
gactgaccagtgctttcgagagtgt

SEQ ID NO: 435964 - DNA, 25 bp, Mus musculus
gactgaccctcagatggtagtagga

SEQ ID NO: 435965 - DNA, 25 bp, Mus musculus
gactgacctgcctaccagagacttg

SEQ ID NO: 435966 - DNA, 25 bp, Mus musculus
gactgacctgctgcctaaactgaag

SEQ ID NO: 435967 - DNA, 25 bp, Mus musculus
gactgactagctggcccttgattta

SEQ ID NO: 435968 - DNA, 25 bp, Mus musculus
gactgactatcgtgggaaatacttg

SEQ ID NO: 435969 - DNA, 25 bp, Mus musculus
gactgactttggctgaaaaatcctg

SEQ ID NO: 435970 - DNA, 25 bp, Mus musculus
gactgagaaaatctcgcactgagga

SEQ ID NO: 435971 - DNA, 25 bp, Mus musculus
gactgagactaggagcgtgcctgaa

SEQ ID NO: 435972 - DNA, 25 bp, Mus musculus
gactgagagtcaggaaacccatggg

SEQ ID NO: 435973 - DNA, 25 bp, Mus musculus
gactgagatcatgtgttgccctagg

SEQ ID NO: 435974 - DNA, 25 bp, Mus musculus
gactgagcatggacgtgctgttaga

SEQ ID NO: 435975 - DNA, 25 bp, Mus musculus
gactgagccccaagttaacattgct

SEQ ID NO: 435976 - DNA, 25 bp, Mus musculus
gactgagcccctaacatacaaggag

SEQ ID NO: 435977 - DNA, 25 bp, Mus musculus
gactgagctaactccagctgaagtt

SEQ ID NO: 435978 - DNA, 25 bp, Mus musculus
gactgagctcagcttaagcccggaa

SEQ ID NO: 435979 - DNA, 25 bp, Mus musculus
gactgagctggaagcatccgacaga

SEQ ID NO: 435980 - DNA, 25 bp, Mus musculus
gactgagctggctagactgtgccat

SEQ ID NO: 435981 - DNA, 25 bp, Mus musculus
gactgaggaaaggtctggccgcaaa

SEQ ID NO: 435982 - DNA, 25 bp, Mus musculus
gactgaggaaccaaaaaggctgacc

SEQ ID NO: 435983 - DNA, 25 bp, Mus musculus
gactgaggccttgggaatccgatcc

SEQ ID NO: 435984 - DNA, 25 bp, Mus musculus
gactgaggctcagggaatatccagg

SEQ ID NO: 435985 - DNA, 25 bp, Mus musculus
gactgaggcttctcgcggttcctaa

SEQ ID NO: 435986 - DNA, 25 bp, Mus musculus
gactgagggacataaagctttgggc

SEQ ID NO: 435987 - DNA, 25 bp, Mus musculus
gactgaggtgggagtcaccgcaggg

SEQ ID NO: 435988 - DNA, 25 bp, Mus musculus
gactgagtgatatgacttctaggat

SEQ ID NO: 435989 - DNA, 25 bp, Mus musculus
gactgagtggtagtagcgaatcccc

SEQ ID NO: 435990 - DNA, 25 bp, Mus musculus
gactgagttctcgagcgatgcggca

SEQ ID NO: 435991 - DNA, 25 bp, Mus musculus
gactgagtttggaagcctctgggca

SEQ ID NO: 435992 - DNA, 25 bp, Mus musculus
gactgatagcgaacactgaggactg

SEQ ID NO: 435993 - DNA, 25 bp, Mus musculus
gactgatcgatggatagtgactgag

SEQ ID NO: 435994 - DNA, 25 bp, Mus musculus
gactgatcgcgtgcgtttcggaaga

SEQ ID NO: 435995 - DNA, 25 bp, Mus musculus
gactgatggaagagcaaaatactgg

SEQ ID NO: 435996 - DNA, 25 bp, Mus musculus
gactgatggacgtgtccgaactctg

SEQ ID NO: 435997 - DNA, 25 bp, Mus musculus
gactgatggcaagcatgacttccga

SEQ ID NO: 435998 - DNA, 25 bp, Mus musculus
gactgatggcccaggatctccgttg

SEQ ID NO: 435999 - DNA, 25 bp, Mus musculus
gactgatggctgttgaccttaaacc

SEQ ID NO: 436000 - DNA, 25 bp, Mus musculus
gactgatgtatggagaacctgaagg

SEQ ID NO: 436001 - DNA, 25 bp, Mus musculus
gactgatgtgggaaagtcacctcca

SEQ ID NO: 436002 - DNA, 25 bp, Mus musculus
gactgattagttgctagcctcaaac

SEQ ID NO: 436003 - DNA, 25 bp, Mus musculus
gactgattccgtggaggagatcccc

SEQ ID NO: 436004 - DNA, 25 bp, Mus musculus
gactgattgtcttggtcagcctttc

SEQ ID NO: 436005 - DNA, 25 bp, Mus musculus
gactgatttactacagcttgtgcaa

SEQ ID NO: 436006 - DNA, 25 bp, Mus musculus
gactgatttggtttcctctttctcc

SEQ ID NO: 436007 - DNA, 25 bp, Mus musculus
gactgcaaaactagcgactcggacg

SEQ ID NO: 436008 - DNA, 25 bp, Mus musculus
gactgcaaacagagcaaactagttt

SEQ ID NO: 436009 - DNA, 25 bp, Mus musculus
gactgcaaattcaatgagtgccaat

SEQ ID NO: 436010 - DNA, 25 bp, Mus musculus
gactgcaagctaagaagtaagaaca

SEQ ID NO: 436011 - DNA, 25 bp, Mus musculus
gactgcaaggccctgtactgccggt

SEQ ID NO: 436012 - DNA, 25 bp, Mus musculus
gactgcaattcacctggcatgcgag

SEQ ID NO: 436013 - DNA, 25 bp, Mus musculus
gactgcaccctcctatatgaagctc

SEQ ID NO: 436014 - DNA, 25 bp, Mus musculus
gactgcacctgtgttgtcctaggaa

SEQ ID NO: 436015 - DNA, 25 bp, Mus musculus
gactgcacggtgtccaaggactacc

SEQ ID NO: 436016 - DNA, 25 bp, Mus musculus
gactgcagcccctacaaagaagttg

SEQ ID NO: 436017 - DNA, 25 bp, Mus musculus
gactgcagcctgctagaagccatct

SEQ ID NO: 436018 - DNA, 25 bp, Mus musculus
gactgcagcctttaaaccacatggg

SEQ ID NO: 436019 - DNA, 25 bp, Mus musculus
gactgcagctatggccatggaactc

SEQ ID NO: 436020 - DNA, 25 bp, Mus musculus
gactgcaggaccagaatcgaactcg

SEQ ID NO: 436021 - DNA, 25 bp, Mus musculus
gactgcagggaacatctcgacacaa

SEQ ID NO: 436022 - DNA, 25 bp, Mus musculus
gactgcagtcctattctgtcctcag

SEQ ID NO: 436023 - DNA, 25 bp, Mus musculus
gactgcatacctgtggtgaccttgc

SEQ ID NO: 436024 - DNA, 25 bp, Mus musculus
gactgcatcagcactatccatggaa

SEQ ID NO: 436025 - DNA, 25 bp, Mus musculus
gactgcatcatgaccctggaagagc

SEQ ID NO: 436026 - DNA, 25 bp, Mus musculus
gactgcatcatggaggcgcgtttca

SEQ ID NO: 436027 - DNA, 25 bp, Mus musculus
gactgcatgcaagcacgcactataa

SEQ ID NO: 436028 - DNA, 25 bp, Mus musculus
gactgcatggaatcgtttgtcccgg

SEQ ID NO: 436029 - DNA, 25 bp, Mus musculus
gactgccaagactgctcactgaaga

SEQ ID NO: 436030 - DNA, 25 bp, Mus musculus
gactgccacccttaggaaacatgtg

SEQ ID NO: 436031 - DNA, 25 bp, Mus musculus
gactgccactgcagatctatgaaga

SEQ ID NO: 436032 - DNA, 25 bp, Mus musculus
gactgccagcatgtacgaatacacg

SEQ ID NO: 436033 - DNA, 25 bp, Mus musculus
gactgccaggcgctaagtaagacct

SEQ ID NO: 436034 - DNA, 25 bp, Mus musculus
gactgccagtcaggttcacaggtat

SEQ ID NO: 436035 - DNA, 25 bp, Mus musculus
gactgccagtctggtcctttcaacg

SEQ ID NO: 436036 - DNA, 25 bp, Mus musculus
gactgccatggaacacttgctcaaa

SEQ ID NO: 436037 - DNA, 25 bp, Mus musculus
gactgcccaaaggtactgctgcttg

SEQ ID NO: 436038 - DNA, 25 bp, Mus musculus
gactgcccaaggtggagattctgcg

SEQ ID NO: 436039 - DNA, 25 bp, Mus musculus
gactgccccactgaacacttaaatg

SEQ ID NO: 436040 - DNA, 25 bp, Mus musculus
gactgccccgtgtgcaacaaaaagt

SEQ ID NO: 436041 - DNA, 25 bp, Mus musculus
gactgccctaccttacatgctctgg

SEQ ID NO: 436042 - DNA, 25 bp, Mus musculus
gactgccctggaatgtgggtccctg

SEQ ID NO: 436043 - DNA, 25 bp, Mus musculus
gactgccgggcagattcaaagctga

SEQ ID NO: 436044 - DNA, 25 bp, Mus musculus
gactgcctatggactccaggaggaa

SEQ ID NO: 436045 - DNA, 25 bp, Mus musculus
gactgcctggtgaacacatctcaga

SEQ ID NO: 436046 - DNA, 25 bp, Mus musculus
gactgcctgtccctagtcatggaag

SEQ ID NO: 436047 - DNA, 25 bp, Mus musculus
gactgccttcggaatacatcggaga

SEQ ID NO: 436048 - DNA, 25 bp, Mus musculus
gactgccttctgatgctcaagcaaa

SEQ ID NO: 436049 - DNA, 25 bp, Mus musculus
gactgcgaatgcgtacatgctccga

SEQ ID NO: 436050 - DNA, 25 bp, Mus musculus
gactgcgacagtcacagacaatggt

SEQ ID NO: 436051 - DNA, 25 bp, Mus musculus
gactgcgcctggaagttgatccgaa

SEQ ID NO: 436052 - DNA, 25 bp, Mus musculus
gactgcggatcaggaaggttaccaa

SEQ ID NO: 436053 - DNA, 25 bp, Mus musculus
gactgcggcgatctgagtaactcct

SEQ ID NO: 436054 - DNA, 25 bp, Mus musculus
gactgcgggacttatgactgcccaa

SEQ ID NO: 436055 - DNA, 25 bp, Mus musculus
gactgcggggctgcatcagctcttc

SEQ ID NO: 436056 - DNA, 25 bp, Mus musculus
gactgcgtacccatggacaagagtg

SEQ ID NO: 436057 - DNA, 25 bp, Mus musculus
gactgcgtgacagaggctccctaca

SEQ ID NO: 436058 - DNA, 25 bp, Mus musculus
gactgcgttcacaacggctaacggg

SEQ ID NO: 436059 - DNA, 25 bp, Mus musculus
gactgctaaatatcgggctgcgcat

SEQ ID NO: 436060 - DNA, 25 bp, Mus musculus
gactgctacaaaagcctggatggcc

SEQ ID NO: 436061 - DNA, 25 bp, Mus musculus
gactgctacagtcaccgtgctggtg

SEQ ID NO: 436062 - DNA, 25 bp, Mus musculus
gactgctacccaggtcagattggac

SEQ ID NO: 436063 - DNA, 25 bp, Mus musculus
gactgctacggctgtgtggacatcc

SEQ ID NO: 436064 - DNA, 25 bp, Mus musculus
gactgctagttgtgaacgcctccga

SEQ ID NO: 436065 - DNA, 25 bp, Mus musculus
gactgctcagatggtttcaacggcg

SEQ ID NO: 436066 - DNA, 25 bp, Mus musculus
gactgctcgccttgtttgttgctga

SEQ ID NO: 436067 - DNA, 25 bp, Mus musculus
gactgctctgaggtgctgttcatcc

SEQ ID NO: 436068 - DNA, 25 bp, Mus musculus
gactgctgaagactatgtggcctta

SEQ ID NO: 436069 - DNA, 25 bp, Mus musculus
gactgctgacagtggctagcttggt

SEQ ID NO: 436070 - DNA, 25 bp, Mus musculus
gactgctgcagcttgagacatccct

SEQ ID NO: 436071 - DNA, 25 bp, Mus musculus
gactgctgcgagaaagatttgtgca

SEQ ID NO: 436072 - DNA, 25 bp, Mus musculus
gactgctgcgagttttcttcagatg

SEQ ID NO: 436073 - DNA, 25 bp, Mus musculus
gactgctggcagtacaaaacgggcc

SEQ ID NO: 436074 - DNA, 25 bp, Mus musculus
gactgctggggctgatctccctctt

SEQ ID NO: 436075 - DNA, 25 bp, Mus musculus
gactgctgtaaaactccctcgggac

SEQ ID NO: 436076 - DNA, 25 bp, Mus musculus
gactgctgtggatcaagcgctgcaa

SEQ ID NO: 436077 - DNA, 25 bp, Mus musculus
gactgcttcaactcagacaaaaggt

SEQ ID NO: 436078 - DNA, 25 bp, Mus musculus
gactgcttccaacaggtttctggcc

SEQ ID NO: 436079 - DNA, 25 bp, Mus musculus
gactggaaaggctgacgctgtccac

SEQ ID NO: 436080 - DNA, 25 bp, Mus musculus
gactggaacacaaccatagcctgct

SEQ ID NO: 436081 - DNA, 25 bp, Mus musculus
gactggaacagctactacgcggaca

SEQ ID NO: 436082 - DNA, 25 bp, Mus musculus
gactggacaaacatcaggactggct

SEQ ID NO: 436083 - DNA, 25 bp, Mus musculus
gactggacagaagcatttacagaag

SEQ ID NO: 436084 - DNA, 25 bp, Mus musculus
gactggacatttttacactgtttgc

SEQ ID NO: 436085 - DNA, 25 bp, Mus musculus
gactggacctggactgggaataccc

SEQ ID NO: 436086 - DNA, 25 bp, Mus musculus
gactggagaataagcctgtggccga

SEQ ID NO: 436087 - DNA, 25 bp, Mus musculus
gactggagacccgttccgatggaaa

SEQ ID NO: 436088 - DNA, 25 bp, Mus musculus
gactggagagggtggcttgcttcaa

SEQ ID NO: 436089 - DNA, 25 bp, Mus musculus
gactggagatagtgctcagaccctg

SEQ ID NO: 436090 - DNA, 25 bp, Mus musculus
gactggagccctggtaacgtgcaga

SEQ ID NO: 436091 - DNA, 25 bp, Mus musculus
gactggagcctggataaccactgag

SEQ ID NO: 436092 - DNA, 25 bp, Mus musculus
gactggagcttctcgtcttccggga

SEQ ID NO: 436093 - DNA, 25 bp, Mus musculus
gactggagtccaggtatcaccatgg

SEQ ID NO: 436094 - DNA, 25 bp, Mus musculus
gactggagtccccaagtcatagctc

SEQ ID NO: 436095 - DNA, 25 bp, Mus musculus
gactggagtctgcaacaccgtgtta

SEQ ID NO: 436096 - DNA, 25 bp, Mus musculus
gactggagtgccttcgactgctgaa

SEQ ID NO: 436097 - DNA, 25 bp, Mus musculus
gactggagtgtgtagctgcagcaca

SEQ ID NO: 436098 - DNA, 25 bp, Mus musculus
gactggagttgttgaatatctggag

SEQ ID NO: 436099 - DNA, 25 bp, Mus musculus
gactggatatgcacaggactgccct

SEQ ID NO: 436100 - DNA, 25 bp, Mus musculus
gactggatccagtgcttctcaaggc

SEQ ID NO: 436101 - DNA, 25 bp, Mus musculus
gactggatccttgaagatggctcta

SEQ ID NO: 436102 - DNA, 25 bp, Mus musculus
gactggatgacagcaaaccgtcgtg

SEQ ID NO: 436103 - DNA, 25 bp, Mus musculus
gactggatggcctcaacaacctgaa

SEQ ID NO: 436104 - DNA, 25 bp, Mus musculus
gactggatgtcagaggagtactccc

SEQ ID NO: 436105 - DNA, 25 bp, Mus musculus
gactggcaaggaactacatctgggc

SEQ ID NO: 436106 - DNA, 25 bp, Mus musculus
gactggccacactcaagatcgagag

SEQ ID NO: 436107 - DNA, 25 bp, Mus musculus
gactggccccttgagtggagactaa

SEQ ID NO: 436108 - DNA, 25 bp, Mus musculus
gactggccgggaactcagcatgtag

SEQ ID NO: 436109 - DNA, 25 bp, Mus musculus
gactggcctctaagtctctttgtag

SEQ ID NO: 436110 - DNA, 25 bp, Mus musculus
gactggcctgtggtagttctcccag

SEQ ID NO: 436111 - DNA, 25 bp, Mus musculus
gactggcctttgactgcgtggacaa

SEQ ID NO: 436112 - DNA, 25 bp, Mus musculus
gactggcgacggttacacactgttt

SEQ ID NO: 436113 - DNA, 25 bp, Mus musculus
gactggcgcaacaaaatccggatct

SEQ ID NO: 436114 - DNA, 25 bp, Mus musculus
gactggcgcttcctgaaagtactcg

SEQ ID NO: 436115 - DNA, 25 bp, Mus musculus
gactggcgtctgtgggaaccatcag

SEQ ID NO: 436116 - DNA, 25 bp, Mus musculus
gactggctcttacttgacctggaac

SEQ ID NO: 436117 - DNA, 25 bp, Mus musculus
gactggctgtgatgcgtcacgtagc

SEQ ID NO: 436118 - DNA, 25 bp, Mus musculus
gactggcttcaagaaggagtatcag

SEQ ID NO: 436119 - DNA, 25 bp, Mus musculus
gactggcttccttctcatcggctta

SEQ ID NO: 436120 - DNA, 25 bp, Mus musculus
gactggctttctgagaaggtccctc

SEQ ID NO: 436121 - DNA, 25 bp, Mus musculus
gactgggaatcaggatttaaacttc

SEQ ID NO: 436122 - DNA, 25 bp, Mus musculus
gactgggaccatgtaatcaaagctg

SEQ ID NO: 436123 - DNA, 25 bp, Mus musculus
gactgggactaggatacttgctgca

SEQ ID NO: 436124 - DNA, 25 bp, Mus musculus
gactgggagacttacatgcatcgga

SEQ ID NO: 436125 - DNA, 25 bp, Mus musculus
gactgggagccctatagatctgttg

SEQ ID NO: 436126 - DNA, 25 bp, Mus musculus
gactgggagcctatgtgcgtgctac

SEQ ID NO: 436127 - DNA, 25 bp, Mus musculus
gactgggaggatttggactatgcaa

SEQ ID NO: 436128 - DNA, 25 bp, Mus musculus
gactgggatcttgttagccggaatg

SEQ ID NO: 436129 - DNA, 25 bp, Mus musculus
gactgggccacctctattctgggac

SEQ ID NO: 436130 - DNA, 25 bp, Mus musculus
gactgggccatcattagctaatagc

SEQ ID NO: 436131 - DNA, 25 bp, Mus musculus
gactgggcccctgtatcagaggaca

SEQ ID NO: 436132 - DNA, 25 bp, Mus musculus
gactgggcctcctgtaattgctctg

SEQ ID NO: 436133 - DNA, 25 bp, Mus musculus
gactgggcttcatctggctgtgacc

SEQ ID NO: 436134 - DNA, 25 bp, Mus musculus
gactgggtgaaagctttttctgcag

SEQ ID NO: 436135 - DNA, 25 bp, Mus musculus
gactgggtgactacctggagctgca

SEQ ID NO: 436136 - DNA, 25 bp, Mus musculus
gactggtactgatttcctctgggta

SEQ ID NO: 436137 - DNA, 25 bp, Mus musculus
gactggtactgcatcctgagctcag

SEQ ID NO: 436138 - DNA, 25 bp, Mus musculus
gactggtagataatgggaccctcct

SEQ ID NO: 436139 - DNA, 25 bp, Mus musculus
gactggtcactctaatgccacggag

SEQ ID NO: 436140 - DNA, 25 bp, Mus musculus
gactggtcagaaactcaccttatgt

SEQ ID NO: 436141 - DNA, 25 bp, Mus musculus
gactggtccactagttcagaactgg

SEQ ID NO: 436142 - DNA, 25 bp, Mus musculus
gactggtctgagtgtctccaatgga

SEQ ID NO: 436143 - DNA, 25 bp, Mus musculus
gactggtgacattacggctgcctgc

SEQ ID NO: 436144 - DNA, 25 bp, Mus musculus
gactggtgagtctagccagccctct

SEQ ID NO: 436145 - DNA, 25 bp, Mus musculus
gactggtgctcgtagtccacgcttg

SEQ ID NO: 436146 - DNA, 25 bp, Mus musculus
gactggtggcctaaaactgaagcct

SEQ ID NO: 436147 - DNA, 25 bp, Mus musculus
gactggtggtctaagctgcagcaaa

SEQ ID NO: 436148 - DNA, 25 bp, Mus musculus
gactggtgtaacaggtgagcactgc

SEQ ID NO: 436149 - DNA, 25 bp, Mus musculus
gactggtgtgtaggcagaggcgtct

SEQ ID NO: 436150 - DNA, 25 bp, Mus musculus
gactggttaccccagactcttcgca

SEQ ID NO: 436151 - DNA, 25 bp, Mus musculus
gactggttccagctccttcgtgaga

SEQ ID NO: 436152 - DNA, 25 bp, Mus musculus
gactggttcctgtttgggtcgccta

SEQ ID NO: 436153 - DNA, 25 bp, Mus musculus
gactggttgcatagaaaaattgaaa

SEQ ID NO: 436154 - DNA, 25 bp, Mus musculus
gactggtttcacagccaaaatgcaa

SEQ ID NO: 436155 - DNA, 25 bp, Mus musculus
gactggtttcttgagtgtggactaa

SEQ ID NO: 436156 - DNA, 25 bp, Mus musculus
gactgtaaagaccagcacctttgga

SEQ ID NO: 436157 - DNA, 25 bp, Mus musculus
gactgtaactgaactggctgcaccc

SEQ ID NO: 436158 - DNA, 25 bp, Mus musculus
gactgtaaggaccacaaagctggaa

SEQ ID NO: 436159 - DNA, 25 bp, Mus musculus
gactgtaagtcctgcaacgttctgg

SEQ ID NO: 436160 - DNA, 25 bp, Mus musculus
gactgtaatttctgtcacagttgga

SEQ ID NO: 436161 - DNA, 25 bp, Mus musculus
gactgtacacctaatgtttgccaag

SEQ ID NO: 436162 - DNA, 25 bp, Mus musculus
gactgtacagaagctctgccccggt

SEQ ID NO: 436163 - DNA, 25 bp, Mus musculus
gactgtagctttctaaccttgtaga

SEQ ID NO: 436164 - DNA, 25 bp, Mus musculus
gactgtaggaaaacttgatttcatc

SEQ ID NO: 436165 - DNA, 25 bp, Mus musculus
gactgtagtcaggtggctgtttgct

SEQ ID NO: 436166 - DNA, 25 bp, Mus musculus
gactgtatcgacctttgccaggagc

SEQ ID NO: 436167 - DNA, 25 bp, Mus musculus
gactgtattaaaggccctctggtgg

SEQ ID NO: 436168 - DNA, 25 bp, Mus musculus
gactgtcaagctagaggtgtccccg

SEQ ID NO: 436169 - DNA, 25 bp, Mus musculus
gactgtcaatctgccgtccctggaa

SEQ ID NO: 436170 - DNA, 25 bp, Mus musculus
gactgtcaccggaggccttgttgca

SEQ ID NO: 436171 - DNA, 25 bp, Mus musculus
gactgtcagctggtatttgggcaaa

SEQ ID NO: 436172 - DNA, 25 bp, Mus musculus
gactgtcagtgatgactcgccctca

SEQ ID NO: 436173 - DNA, 25 bp, Mus musculus
gactgtccaatcttccaactgtaga

SEQ ID NO: 436174 - DNA, 25 bp, Mus musculus
gactgtccagcaggttaaccaggaa

SEQ ID NO: 436175 - DNA, 25 bp, Mus musculus
gactgtccaggtggcacagagactc

SEQ ID NO: 436176 - DNA, 25 bp, Mus musculus
gactgtcccaggtatatgctatgat

SEQ ID NO: 436177 - DNA, 25 bp, Mus musculus
gactgtccctcctcgttgttagcaa

SEQ ID NO: 436178 - DNA, 25 bp, Mus musculus
gactgtcctgctggccttgtacctg

SEQ ID NO: 436179 - DNA, 25 bp, Mus musculus
gactgtcgaggatcgagaccctccg

SEQ ID NO: 436180 - DNA, 25 bp, Mus musculus
gactgtcggtgcttggtggcctctt

SEQ ID NO: 436181 - DNA, 25 bp, Mus musculus
gactgtctacccagtttgtgcccaa

SEQ ID NO: 436182 - DNA, 25 bp, Mus musculus
gactgtctacctgtggaagcgttat

SEQ ID NO: 436183 - DNA, 25 bp, Mus musculus
gactgtctactttggccatatttta

SEQ ID NO: 436184 - DNA, 25 bp, Mus musculus
gactgtctcaggctgtttgtgaaac

SEQ ID NO: 436185 - DNA, 25 bp, Mus musculus
gactgtctcctaacacaagatgggt

SEQ ID NO: 436186 - DNA, 25 bp, Mus musculus
gactgtctgcatagcgaaacgccaa

SEQ ID NO: 436187 - DNA, 25 bp, Mus musculus
gactgtctggagagaagcggcaaca

SEQ ID NO: 436188 - DNA, 25 bp, Mus musculus
gactgtctggtacttcgatgctgaa

SEQ ID NO: 436189 - DNA, 25 bp, Mus musculus
gactgtcttcacttctgctcccatg

SEQ ID NO: 436190 - DNA, 25 bp, Mus musculus
gactgtcttccagagcaggtcagaa

SEQ ID NO: 436191 - DNA, 25 bp, Mus musculus
gactgtcttgatgtgcgctaatgcc

SEQ ID NO: 436192 - DNA, 25 bp, Mus musculus
gactgtctttctgattctaagtggc

SEQ ID NO: 436193 - DNA, 25 bp, Mus musculus
gactgtgaatcacctgactgtctgg

SEQ ID NO: 436194 - DNA, 25 bp, Mus musculus
gactgtgacaaatctaaccctgggt

SEQ ID NO: 436195 - DNA, 25 bp, Mus musculus
gactgtgacagcttttaccctagtg

SEQ ID NO: 436196 - DNA, 25 bp, Mus musculus
gactgtgacctcctcatgtacttga

SEQ ID NO: 436197 - DNA, 25 bp, Mus musculus
gactgtgactccctgaaagtggact

SEQ ID NO: 436198 - DNA, 25 bp, Mus musculus
gactgtgagcgagagcagctgaacc

SEQ ID NO: 436199 - DNA, 25 bp, Mus musculus
gactgtgatccccagaaaggtggtc

SEQ ID NO: 436200 - DNA, 25 bp, Mus musculus
gactgtgatctcctggcccagggaa

SEQ ID NO: 436201 - DNA, 25 bp, Mus musculus
gactgtgatttttgccccgtggaag

SEQ ID NO: 436202 - DNA, 25 bp, Mus musculus
gactgtgcacactcagcttctgggt

SEQ ID NO: 436203 - DNA, 25 bp, Mus musculus
gactgtgcacgtcttgtgtacctca

SEQ ID NO: 436204 - DNA, 25 bp, Mus musculus
gactgtgcacttatctctgcatcaa

SEQ ID NO: 436205 - DNA, 25 bp, Mus musculus
gactgtgccagtcgaaactgctgct

SEQ ID NO: 436206 - DNA, 25 bp, Mus musculus
gactgtgcccacttcacgacggatg

SEQ ID NO: 436207 - DNA, 25 bp, Mus musculus
gactgtgcgctaccatgttggagct

SEQ ID NO: 436208 - DNA, 25 bp, Mus musculus
gactgtgcgcttcctacaggagcag

SEQ ID NO: 436209 - DNA, 25 bp, Mus musculus
gactgtgcggaagtctttatgaccc

SEQ ID NO: 436210 - DNA, 25 bp, Mus musculus
gactgtgcgtcccagttcagaaccc

SEQ ID NO: 436211 - DNA, 25 bp, Mus musculus
gactgtgctggcttcgagaaacttt

SEQ ID NO: 436212 - DNA, 25 bp, Mus musculus
gactgtggaccatacgacgagagaa

SEQ ID NO: 436213 - DNA, 25 bp, Mus musculus
gactgtggagaacgctgtccactct

SEQ ID NO: 436214 - DNA, 25 bp, Mus musculus
gactgtggaggtctcagctgactca

SEQ ID NO: 436215 - DNA, 25 bp, Mus musculus
gactgtggagtgtcctgattcaccc

SEQ ID NO: 436216 - DNA, 25 bp, Mus musculus
gactgtggccacttgctgctgctac

SEQ ID NO: 436217 - DNA, 25 bp, Mus musculus
gactgtggccatcacaacagatgta

SEQ ID NO: 436218 - DNA, 25 bp, Mus musculus
gactgtggccctgagagcattaaaa

SEQ ID NO: 436219 - DNA, 25 bp, Mus musculus
gactgtgggagacacttcccttcga

SEQ ID NO: 436220 - DNA, 25 bp, Mus musculus
gactgtgggcaactactgcgagacc

SEQ ID NO: 436221 - DNA, 25 bp, Mus musculus
gactgtgggcatcaatctcctctgg

SEQ ID NO: 436222 - DNA, 25 bp, Mus musculus
gactgtgggtgcttccgaatgcctg

SEQ ID NO: 436223 - DNA, 25 bp, Mus musculus
gactgtggtataagactagccggct

SEQ ID NO: 436224 - DNA, 25 bp, Mus musculus
gactgtggtcatcctgtgcttcaca

SEQ ID NO: 436225 - DNA, 25 bp, Mus musculus
gactgtgtcactgttaggtgactag

SEQ ID NO: 436226 - DNA, 25 bp, Mus musculus
gactgtgtctcgaaagagcaaccct

SEQ ID NO: 436227 - DNA, 25 bp, Mus musculus
gactgtgtcttaaatccaaagcacg

SEQ ID NO: 436228 - DNA, 25 bp, Mus musculus
gactgtgtgattctcgccttgggac

SEQ ID NO: 436229 - DNA, 25 bp, Mus musculus
gactgtgtgttcatctactgccaag

SEQ ID NO: 436230 - DNA, 25 bp, Mus musculus
gactgtgtgttgtagcttggtccca

SEQ ID NO: 436231 - DNA, 25 bp, Mus musculus
gactgttacagacctgcctgggatg

SEQ ID NO: 436232 - DNA, 25 bp, Mus musculus
gactgttacagctgaccaatgccac

SEQ ID NO: 436233 - DNA, 25 bp, Mus musculus
gactgttccagagcgaagcacttta

SEQ ID NO: 436234 - DNA, 25 bp, Mus musculus
gactgttccccgttcttatcgggag

SEQ ID NO: 436235 - DNA, 25 bp, Mus musculus
gactgttcctgcatccacgatcgct

SEQ ID NO: 436236 - DNA, 25 bp, Mus musculus
gactgtttacactgggagctccaca

SEQ ID NO: 436237 - DNA, 25 bp, Mus musculus
gactgtttcgacagagcccggtgaa

SEQ ID NO: 436238 - DNA, 25 bp, Mus musculus
gactgtttctaagtccagggagccc

SEQ ID NO: 436239 - DNA, 25 bp, Mus musculus
gactgtttgcaaatagctcggcccc

SEQ ID NO: 436240 - DNA, 25 bp, Mus musculus
gacttaaaagcacgcacactggaaa

SEQ ID NO: 436241 - DNA, 25 bp, Mus musculus
gacttaaactctaggcagggaaacg

SEQ ID NO: 436242 - DNA, 25 bp, Mus musculus
gacttaaagacacttcctgacaaag

SEQ ID NO: 436243 - DNA, 25 bp, Mus musculus
gacttaaagcagaaggcagggcacg

SEQ ID NO: 436244 - DNA, 25 bp, Mus musculus
gacttaaaggcgatgctgacctggc

SEQ ID NO: 436245 - DNA, 25 bp, Mus musculus
gacttaacagcaacgcagacctgag

SEQ ID NO: 436246 - DNA, 25 bp, Mus musculus
gacttaagcagtccatgaaagtgga

SEQ ID NO: 436247 - DNA, 25 bp, Mus musculus
gacttaagcttactgcagactggct

SEQ ID NO: 436248 - DNA, 25 bp, Mus musculus
gacttaaggaatgtgcgacagcctg

SEQ ID NO: 436249 - DNA, 25 bp, Mus musculus
gacttaagtttctcatatatcattg

SEQ ID NO: 436250 - DNA, 25 bp, Mus musculus
gacttaatgatccttctactctaac

SEQ ID NO: 436251 - DNA, 25 bp, Mus musculus
gacttaattaaaacttctgtgtcag

SEQ ID NO: 436252 - DNA, 25 bp, Mus musculus
gacttacaccaaggcgtacgccagg

SEQ ID NO: 436253 - DNA, 25 bp, Mus musculus
gacttacagtatgagctggcccggg

SEQ ID NO: 436254 - DNA, 25 bp, Mus musculus
gacttacattgtcagcgacgcccag

SEQ ID NO: 436255 - DNA, 25 bp, Mus musculus
gacttacattttacccagggctggc

SEQ ID NO: 436256 - DNA, 25 bp, Mus musculus
gacttaccagagacagacatctcat

SEQ ID NO: 436257 - DNA, 25 bp, Mus musculus
gacttaccatgacctgatcgctgag

SEQ ID NO: 436258 - DNA, 25 bp, Mus musculus
gacttaccttgaatcaacgaaacca

SEQ ID NO: 436259 - DNA, 25 bp, Mus musculus
gacttacggagaaacatcacagatt

SEQ ID NO: 436260 - DNA, 25 bp, Mus musculus
gacttactgaaatgaggagccggag

SEQ ID NO: 436261 - DNA, 25 bp, Mus musculus
gacttactgcgtagaagacacccca

SEQ ID NO: 436262 - DNA, 25 bp, Mus musculus
gacttactggtgaacaatgcagcgc

SEQ ID NO: 436263 - DNA, 25 bp, Mus musculus
gacttagaccatccccacgttgtaa

SEQ ID NO: 436264 - DNA, 25 bp, Mus musculus
gacttagatggagctgggcaccact

SEQ ID NO: 436265 - DNA, 25 bp, Mus musculus
gacttagcaaaaagcgctccgggac

SEQ ID NO: 436266 - DNA, 25 bp, Mus musculus
gacttagcatcaaaatcgtccatgt

SEQ ID NO: 436267 - DNA, 25 bp, Mus musculus
gacttagccgcagaccataggacct

SEQ ID NO: 436268 - DNA, 25 bp, Mus musculus
gacttagctgcgtcctgagcctgga

SEQ ID NO: 436269 - DNA, 25 bp, Mus musculus
gacttaggagttgtggatggccacc

SEQ ID NO: 436270 - DNA, 25 bp, Mus musculus
gacttaggcaaccacaacacactgg

SEQ ID NO: 436271 - DNA, 25 bp, Mus musculus
gacttagtaggccaccatgctcgaa

SEQ ID NO: 436272 - DNA, 25 bp, Mus musculus
gacttagtcagattttaacttagtt

SEQ ID NO: 436273 - DNA, 25 bp, Mus musculus
gacttatatgaggagtgcagagccc

SEQ ID NO: 436274 - DNA, 25 bp, Mus musculus
gacttatcaggattgctgaaaggca

SEQ ID NO: 436275 - DNA, 25 bp, Mus musculus
gacttatgacaaataccgggccaac

SEQ ID NO: 436276 - DNA, 25 bp, Mus musculus
gacttatggacagctacctcaggga

SEQ ID NO: 436277 - DNA, 25 bp, Mus musculus
gacttatggcaaacacggaggtgat

SEQ ID NO: 436278 - DNA, 25 bp, Mus musculus
gacttatggtctgaggcgtacccct

SEQ ID NO: 436279 - DNA, 25 bp, Mus musculus
gacttattgaggaaacgacgagaac

SEQ ID NO: 436280 - DNA, 25 bp, Mus musculus
gacttcaacacggaggttcatccca

SEQ ID NO: 436281 - DNA, 25 bp, Mus musculus
gacttcaacactgcaaaggcgctag

SEQ ID NO: 436282 - DNA, 25 bp, Mus musculus
gacttcaactgcaacatctgggatg

SEQ ID NO: 436283 - DNA, 25 bp, Mus musculus
gacttcaagattaagtgcgtggcct

SEQ ID NO: 436284 - DNA, 25 bp, Mus musculus
gacttcaaggatgttctgctgcgac

SEQ ID NO: 436285 - DNA, 25 bp, Mus musculus
gacttcaataggaggcgcacaaatg

SEQ ID NO: 436286 - DNA, 25 bp, Mus musculus
gacttcaatggaggactgggtaaca

SEQ ID NO: 436287 - DNA, 25 bp, Mus musculus
gacttcacagacagccaactgcagg

SEQ ID NO: 436288 - DNA, 25 bp, Mus musculus
gacttcacaggagggtctgacacgg

SEQ ID NO: 436289 - DNA, 25 bp, Mus musculus
gacttcaccatgaggccagcctttg

SEQ ID NO: 436290 - DNA, 25 bp, Mus musculus
gacttcacgcggatcctgcagatgg

SEQ ID NO: 436291 - DNA, 25 bp, Mus musculus
gacttcactagttcccaagcagctg

SEQ ID NO: 436292 - DNA, 25 bp, Mus musculus
gacttcagagccaagacgcgtggaa

SEQ ID NO: 436293 - DNA, 25 bp, Mus musculus
gacttcagctactactcacaggctg

SEQ ID NO: 436294 - DNA, 25 bp, Mus musculus
gacttcagctcacgctgccttcagg

SEQ ID NO: 436295 - DNA, 25 bp, Mus musculus
gacttcagctggagccaactggtga

SEQ ID NO: 436296 - DNA, 25 bp, Mus musculus
gacttcaggaacagggacatacatt

SEQ ID NO: 436297 - DNA, 25 bp, Mus musculus
gacttcaggactcaacacctcggtg

SEQ ID NO: 436298 - DNA, 25 bp, Mus musculus
gacttcaggtacacatcaaagcagg

SEQ ID NO: 436299 - DNA, 25 bp, Mus musculus
gacttcagtagcagtctaagactag

SEQ ID NO: 436300 - DNA, 25 bp, Mus musculus
gacttcagtgaacagtatggcccag

SEQ ID NO: 436301 - DNA, 25 bp, Mus musculus
gacttcagtgagttgcaagctggct

SEQ ID NO: 436302 - DNA, 25 bp, Mus musculus
gacttcagtggccaaggcttcagcg

SEQ ID NO: 436303 - DNA, 25 bp, Mus musculus
gacttcatactttggagcaagctcg

SEQ ID NO: 436304 - DNA, 25 bp, Mus musculus
gacttcatagtctcaagagccttaa

SEQ ID NO: 436305 - DNA, 25 bp, Mus musculus
gacttcatcatggtctccagtggca

SEQ ID NO: 436306 - DNA, 25 bp, Mus musculus
gacttcatcgtcaagggcagctgct

SEQ ID NO: 436307 - DNA, 25 bp, Mus musculus
gacttcatggtcatgacattcttct

SEQ ID NO: 436308 - DNA, 25 bp, Mus musculus
gacttcattcacaggtgtttcccca

SEQ ID NO: 436309 - DNA, 25 bp, Mus musculus
gacttcattcgcgagggctacagct

SEQ ID NO: 436310 - DNA, 25 bp, Mus musculus
gacttccacccactagagcacaggg

SEQ ID NO: 436311 - DNA, 25 bp, Mus musculus
gacttccagcaaggtgcagcctctg

SEQ ID NO: 436312 - DNA, 25 bp, Mus musculus
gacttccagccgattgatatagcaa

SEQ ID NO: 436313 - DNA, 25 bp, Mus musculus
gacttccagggacagcagttcattc

SEQ ID NO: 436314 - DNA, 25 bp, Mus musculus
gacttccatatagaggacacctaag

SEQ ID NO: 436315 - DNA, 25 bp, Mus musculus
gacttccatggagacttcagaccgg

SEQ ID NO: 436316 - DNA, 25 bp, Mus musculus
gacttcccaggtctactccgaggct

SEQ ID NO: 436317 - DNA, 25 bp, Mus musculus
gacttccccgctgtcatttggtgca

SEQ ID NO: 436318 - DNA, 25 bp, Mus musculus
gacttcccgcttctaagataaccga

SEQ ID NO: 436319 - DNA, 25 bp, Mus musculus
gacttccgccgtgcctttcgaagga

SEQ ID NO: 436320 - DNA, 25 bp, Mus musculus
gacttccgctttctgaggacagcag

SEQ ID NO: 436321 - DNA, 25 bp, Mus musculus
gacttccggcaggatctaggctgga

SEQ ID NO: 436322 - DNA, 25 bp, Mus musculus
gacttccgggaaaagctcaagcacc

SEQ ID NO: 436323 - DNA, 25 bp, Mus musculus
gacttccgggataaaagaaactgca

SEQ ID NO: 436324 - DNA, 25 bp, Mus musculus
gacttccgggcctatcagactgtga

SEQ ID NO: 436325 - DNA, 25 bp, Mus musculus
gacttccggttttgtccgctccagg

SEQ ID NO: 436326 - DNA, 25 bp, Mus musculus
gacttcctcccttgtgctacataga

SEQ ID NO: 436327 - DNA, 25 bp, Mus musculus
gacttcctgagtatatgaccccgat

SEQ ID NO: 436328 - DNA, 25 bp, Mus musculus
gacttcctgatgaataggagtgtcg

SEQ ID NO: 436329 - DNA, 25 bp, Mus musculus
gacttcctggagtaagccccatggg

SEQ ID NO: 436330 - DNA, 25 bp, Mus musculus
gacttcctggctgctttctgggcca

SEQ ID NO: 436331 - DNA, 25 bp, Mus musculus
gacttcctgggcacatggttagttg

SEQ ID NO: 436332 - DNA, 25 bp, Mus musculus
gacttcctgggcagttcagcagacg

SEQ ID NO: 436333 - DNA, 25 bp, Mus musculus
gacttcctggtgcactatggtcaca

SEQ ID NO: 436334 - DNA, 25 bp, Mus musculus
gacttccttgagcttccgaagcgga

SEQ ID NO: 436335 - DNA, 25 bp, Mus musculus
gacttcgaacaacctctcgccattt

SEQ ID NO: 436336 - DNA, 25 bp, Mus musculus
gacttcgaacttgcaatgattatcc

SEQ ID NO: 436337 - DNA, 25 bp, Mus musculus
gacttcgaatctgagcgtgctgcgg

SEQ ID NO: 436338 - DNA, 25 bp, Mus musculus
gacttcgagattcaccaagtgcaat

SEQ ID NO: 436339 - DNA, 25 bp, Mus musculus
gacttcgatgggagcttgatggacc

SEQ ID NO: 436340 - DNA, 25 bp, Mus musculus
gacttcgcactgatcaagggctgga

SEQ ID NO: 436341 - DNA, 25 bp, Mus musculus
gacttcgccaatatgaccagcctgg

SEQ ID NO: 436342 - DNA, 25 bp, Mus musculus
gacttcgctcaggaacacctaatgg

SEQ ID NO: 436343 - DNA, 25 bp, Mus musculus
gacttcggataacaatgcactgact

SEQ ID NO: 436344 - DNA, 25 bp, Mus musculus
gacttcgggaactaccacttgggtg

SEQ ID NO: 436345 - DNA, 25 bp, Mus musculus
gacttcgggataaggccctggacca

SEQ ID NO: 436346 - DNA, 25 bp, Mus musculus
gacttcgggcagcagcataaaaatt

SEQ ID NO: 436347 - DNA, 25 bp, Mus musculus
gacttcgggcaggagtccacatcaa

SEQ ID NO: 436348 - DNA, 25 bp, Mus musculus
gacttcggtttaagtcttcaaggtg

SEQ ID NO: 436349 - DNA, 25 bp, Mus musculus
gacttcgtaatgtctagggtggcag

SEQ ID NO: 436350 - DNA, 25 bp, Mus musculus
gacttcgtccaccagggatctcttc

SEQ ID NO: 436351 - DNA, 25 bp, Mus musculus
gacttcgtccaggagctactggcca

SEQ ID NO: 436352 - DNA, 25 bp, Mus musculus
gacttcgtgctggaacaaaccctta

SEQ ID NO: 436353 - DNA, 25 bp, Mus musculus
gacttcgtgtcatccatcccggtgg

SEQ ID NO: 436354 - DNA, 25 bp, Mus musculus
gacttctaagagtttctcagaaggg

SEQ ID NO: 436355 - DNA, 25 bp, Mus musculus
gacttctacttctgcgcgacggttg

SEQ ID NO: 436356 - DNA, 25 bp, Mus musculus
gacttctagtcaggtagcagcaccc

SEQ ID NO: 436357 - DNA, 25 bp, Mus musculus
gacttctatagcttctgcaatccta

SEQ ID NO: 436358 - DNA, 25 bp, Mus musculus
gacttctcaagtgccattcaggaca

SEQ ID NO: 436359 - DNA, 25 bp, Mus musculus
gacttctccatgaataaccgctgag

SEQ ID NO: 436360 - DNA, 25 bp, Mus musculus
gacttctcgcacctaccaggttgta

SEQ ID NO: 436361 - DNA, 25 bp, Mus musculus
gacttctcgcgtttggaaccactgg

SEQ ID NO: 436362 - DNA, 25 bp, Mus musculus
gacttctcggttagagctgcagccg

SEQ ID NO: 436363 - DNA, 25 bp, Mus musculus
gacttctcggtttctgttctgctta

SEQ ID NO: 436364 - DNA, 25 bp, Mus musculus
gacttctctctgtggttgcgcccag

SEQ ID NO: 436365 - DNA, 25 bp, Mus musculus
gacttctctgaaatcctggacctgg

SEQ ID NO: 436366 - DNA, 25 bp, Mus musculus
gacttctctggccttccaaatctgg

SEQ ID NO: 436367 - DNA, 25 bp, Mus musculus
gacttctctgtagcggagctcgagt

SEQ ID NO: 436368 - DNA, 25 bp, Mus musculus
gacttctctttctggcaaaagcaaa

SEQ ID NO: 436369 - DNA, 25 bp, Mus musculus
gacttctgaccactggattggcctg

SEQ ID NO: 436370 - DNA, 25 bp, Mus musculus
gacttctgattccagacctgttgga

SEQ ID NO: 436371 - DNA, 25 bp, Mus musculus
gacttctgccgagagagaactccag

SEQ ID NO: 436372 - DNA, 25 bp, Mus musculus
gacttctgcgatgtcctcacgggac

SEQ ID NO: 436373 - DNA, 25 bp, Mus musculus
gacttctgcttaaagagtgtgaaca

SEQ ID NO: 436374 - DNA, 25 bp, Mus musculus
gacttctggtgcgtcagtgagcaga

SEQ ID NO: 436375 - DNA, 25 bp, Mus musculus
gacttcttcgcaaagaggacctggt

SEQ ID NO: 436376 - DNA, 25 bp, Mus musculus
gacttcttgagctgggctttgagca

SEQ ID NO: 436377 - DNA, 25 bp, Mus musculus
gacttcttggcacgctatcggcagg

SEQ ID NO: 436378 - DNA, 25 bp, Mus musculus
gacttctttggccactatacctgcg

SEQ ID NO: 436379 - DNA, 25 bp, Mus musculus
gacttcttttgcgtactatcccatg

SEQ ID NO: 436380 - DNA, 25 bp, Mus musculus
gacttgaacagctatggattaacag

SEQ ID NO: 436381 - DNA, 25 bp, Mus musculus
gacttgaaggcaacggacaatgggc

SEQ ID NO: 436382 - DNA, 25 bp, Mus musculus
gacttgaaggcagaagctcgttgaa

SEQ ID NO: 436383 - DNA, 25 bp, Mus musculus
gacttgaagtcaaagaacatcctgg

SEQ ID NO: 436384 - DNA, 25 bp, Mus musculus
gacttgaatctggtgatgtacccca

SEQ ID NO: 436385 - DNA, 25 bp, Mus musculus
gacttgacatagagacctttgggca

SEQ ID NO: 436386 - DNA, 25 bp, Mus musculus
gacttgacccctctggacattgaca

SEQ ID NO: 436387 - DNA, 25 bp, Mus musculus
gacttgaccttctacagcagcgagc

SEQ ID NO: 436388 - DNA, 25 bp, Mus musculus
gacttgactgacgtgaactccatag

SEQ ID NO: 436389 - DNA, 25 bp, Mus musculus
gacttgatctcctgagtcccagaag

SEQ ID NO: 436390 - DNA, 25 bp, Mus musculus
gacttgattaccagacaacctgaga

SEQ ID NO: 436391 - DNA, 25 bp, Mus musculus
gacttgattgacaagctttcaactg

SEQ ID NO: 436392 - DNA, 25 bp, Mus musculus
gacttgcaaaggagtctctcccacg

SEQ ID NO: 436393 - DNA, 25 bp, Mus musculus
gacttgcaacgggactcggtcttga

SEQ ID NO: 436394 - DNA, 25 bp, Mus musculus
gacttgcaagagctacgctgtgccc

SEQ ID NO: 436395 - DNA, 25 bp, Mus musculus
gacttgcaagtcagatcagctgcta

SEQ ID NO: 436396 - DNA, 25 bp, Mus musculus
gacttgcactacaggatggctttga

SEQ ID NO: 436397 - DNA, 25 bp, Mus musculus
gacttgcagaggtaccacaacaggg

SEQ ID NO: 436398 - DNA, 25 bp, Mus musculus
gacttgcatctcattatggtcctga

SEQ ID NO: 436399 - DNA, 25 bp, Mus musculus
gacttgccacagacgctgcggtgtt

SEQ ID NO: 436400 - DNA, 25 bp, Mus musculus
gacttgccatgtggtgcctcagtga

SEQ ID NO: 436401 - DNA, 25 bp, Mus musculus
gacttgccgggtggagcgtttcatt

SEQ ID NO: 436402 - DNA, 25 bp, Mus musculus
gacttgcctgtttagtcctcaccct

SEQ ID NO: 436403 - DNA, 25 bp, Mus musculus
gacttgctcaggacaaactaggcca

SEQ ID NO: 436404 - DNA, 25 bp, Mus musculus
gacttgctcctgaccgtcaagatgg

SEQ ID NO: 436405 - DNA, 25 bp, Mus musculus
gacttgctgtatcattaataactgg

SEQ ID NO: 436406 - DNA, 25 bp, Mus musculus
gacttgctgtccaacgggcgtatga

SEQ ID NO: 436407 - DNA, 25 bp, Mus musculus
gacttggaaaaagccactgctgatt

SEQ ID NO: 436408 - DNA, 25 bp, Mus musculus
gacttggaaatgacccgttctgctc

SEQ ID NO: 436409 - DNA, 25 bp, Mus musculus
gacttggaacgggttctgctccgcc

SEQ ID NO: 436410 - DNA, 25 bp, Mus musculus
gacttggaaggatacagcagctcag

SEQ ID NO: 436411 - DNA, 25 bp, Mus musculus
gacttggaggagtgcacctgtgcca

SEQ ID NO: 436412 - DNA, 25 bp, Mus musculus
gacttggaggtagccagtgaccctt

SEQ ID NO: 436413 - DNA, 25 bp, Mus musculus
gacttggatgacttcaagggttcct

SEQ ID NO: 436414 - DNA, 25 bp, Mus musculus
gacttggcatcaacacatggcacga

SEQ ID NO: 436415 - DNA, 25 bp, Mus musculus
gacttggccatctagaggttcataa

SEQ ID NO: 436416 - DNA, 25 bp, Mus musculus
gacttggcccagaaaaggatctatg

SEQ ID NO: 436417 - DNA, 25 bp, Mus musculus
gacttggctgcttaagacacactgg

SEQ ID NO: 436418 - DNA, 25 bp, Mus musculus
gacttggcttcaggacagtgtcaca

SEQ ID NO: 436419 - DNA, 25 bp, Mus musculus
gacttgggaagtcagccccaggtta

SEQ ID NO: 436420 - DNA, 25 bp, Mus musculus
gacttgggatccgaatgctggctac

SEQ ID NO: 436421 - DNA, 25 bp, Mus musculus
gacttgggcagtatcaacactcctg

SEQ ID NO: 436422 - DNA, 25 bp, Mus musculus
gacttgggtgaaaccgcggcttagc

SEQ ID NO: 436423 - DNA, 25 bp, Mus musculus
gacttgggtttacactgttgccacc

SEQ ID NO: 436424 - DNA, 25 bp, Mus musculus
gacttggtacaatggaccgatctga

SEQ ID NO: 436425 - DNA, 25 bp, Mus musculus
gacttggtcccacagagctgacggt

SEQ ID NO: 436426 - DNA, 25 bp, Mus musculus
gacttggtgacactctagcgcgctg

SEQ ID NO: 436427 - DNA, 25 bp, Mus musculus
gacttggtgccctacactggcgaga

SEQ ID NO: 436428 - DNA, 25 bp, Mus musculus
gacttggttatctattggttagccc

SEQ ID NO: 436429 - DNA, 25 bp, Mus musculus
gacttggttcctattggctcctgac

SEQ ID NO: 436430 - DNA, 25 bp, Mus musculus
gacttgtaccaatttagctgaggcc

SEQ ID NO: 436431 - DNA, 25 bp, Mus musculus
gacttgtactgatgtctcgggccaa

SEQ ID NO: 436432 - DNA, 25 bp, Mus musculus
gacttgtcagacacagtgggccgtt

SEQ ID NO: 436433 - DNA, 25 bp, Mus musculus
gacttgtccttttggcatctcccca

SEQ ID NO: 436434 - DNA, 25 bp, Mus musculus
gacttgtcgattctctgatgcccac

SEQ ID NO: 436435 - DNA, 25 bp, Mus musculus
gacttgtctgcgtccatcgtgtgat

SEQ ID NO: 436436 - DNA, 25 bp, Mus musculus
gacttgtctgctacttggaatgcaa

SEQ ID NO: 436437 - DNA, 25 bp, Mus musculus
gacttgtgcagcaattgtctctact

SEQ ID NO: 436438 - DNA, 25 bp, Mus musculus
gacttgtgcctgagaacttccggga

SEQ ID NO: 436439 - DNA, 25 bp, Mus musculus
gacttgtgctatgagttccggcgag

SEQ ID NO: 436440 - DNA, 25 bp, Mus musculus
gacttgtggacaaccgtcatcgaca

SEQ ID NO: 436441 - DNA, 25 bp, Mus musculus
gacttgtgtttccttattcctaagg

SEQ ID NO: 436442 - DNA, 25 bp, Mus musculus
gacttgttaacatgctttgagctga

SEQ ID NO: 436443 - DNA, 25 bp, Mus musculus
gacttgttggccgagcatgcagaga

SEQ ID NO: 436444 - DNA, 25 bp, Mus musculus
gacttgtttagatcccatgagctag

SEQ ID NO: 436445 - DNA, 25 bp, Mus musculus
gacttgtttgcctcgtcctctgcca

SEQ ID NO: 436446 - DNA, 25 bp, Mus musculus
gactttaagagttctaatcccaagg

SEQ ID NO: 436447 - DNA, 25 bp, Mus musculus
gactttaagggcgttctgcagcggc

SEQ ID NO: 436448 - DNA, 25 bp, Mus musculus
gactttaatgactatctgcccagga

SEQ ID NO: 436449 - DNA, 25 bp, Mus musculus
gactttacaaacatccttcatagag

SEQ ID NO: 436450 - DNA, 25 bp, Mus musculus
gactttacaccagctacaaggaccg

SEQ ID NO: 436451 - DNA, 25 bp, Mus musculus
gactttacccaggaagagtggacct

SEQ ID NO: 436452 - DNA, 25 bp, Mus musculus
gactttaccgtatgtgcctgaaccg

SEQ ID NO: 436453 - DNA, 25 bp, Mus musculus
gactttacctcttttccagtgctag

SEQ ID NO: 436454 - DNA, 25 bp, Mus musculus
gactttacggctccaagaatgcact

SEQ ID NO: 436455 - DNA, 25 bp, Mus musculus
gactttacttctgtgagtcctccaa

SEQ ID NO: 436456 - DNA, 25 bp, Mus musculus
gactttagcaaggaagtgcagccga

SEQ ID NO: 436457 - DNA, 25 bp, Mus musculus
gactttagcaccagaggataccttg

SEQ ID NO: 436458 - DNA, 25 bp, Mus musculus
gactttagctgtaatctgttttgca

SEQ ID NO: 436459 - DNA, 25 bp, Mus musculus
gactttaggagcagggatacaccac

SEQ ID NO: 436460 - DNA, 25 bp, Mus musculus
gactttatcaccgaacgaggagccc

SEQ ID NO: 436461 - DNA, 25 bp, Mus musculus
gactttatcctgtcgcagcagaagg

SEQ ID NO: 436462 - DNA, 25 bp, Mus musculus
gactttattgcacagatgagcactt

SEQ ID NO: 436463 - DNA, 25 bp, Mus musculus
gactttcaaaagtcctagcatgaca

SEQ ID NO: 436464 - DNA, 25 bp, Mus musculus
gactttcaaacgctgccggtaggca

SEQ ID NO: 436465 - DNA, 25 bp, Mus musculus
gactttcaacaactggaactggccc

SEQ ID NO: 436466 - DNA, 25 bp, Mus musculus
gactttcaagcaccccattaagagg

SEQ ID NO: 436467 - DNA, 25 bp, Mus musculus
gactttcaagtccatctccagtaaa

SEQ ID NO: 436468 - DNA, 25 bp, Mus musculus
gactttcaattgttccacctcccat

SEQ ID NO: 436469 - DNA, 25 bp, Mus musculus
gactttcacgatgagcctgagctgg

SEQ ID NO: 436470 - DNA, 25 bp, Mus musculus
gactttcaggaagggactttggcca

SEQ ID NO: 436471 - DNA, 25 bp, Mus musculus
gactttcattgatccgagcacctta

SEQ ID NO: 436472 - DNA, 25 bp, Mus musculus
gactttccaagagctcgagtgatca

SEQ ID NO: 436473 - DNA, 25 bp, Mus musculus
gactttccaggtgttgactcaaggg

SEQ ID NO: 436474 - DNA, 25 bp, Mus musculus
gactttcccacagttggctttaaca

SEQ ID NO: 436475 - DNA, 25 bp, Mus musculus
gactttccccgttgcattgagaccc

SEQ ID NO: 436476 - DNA, 25 bp, Mus musculus
gactttcgaagtaagatgcaatcca

SEQ ID NO: 436477 - DNA, 25 bp, Mus musculus
gactttcgcagagcggaatccggga

SEQ ID NO: 436478 - DNA, 25 bp, Mus musculus
gactttcggcacctggacaaccttg

SEQ ID NO: 436479 - DNA, 25 bp, Mus musculus
gactttcgtactcgcgagctttcct

SEQ ID NO: 436480 - DNA, 25 bp, Mus musculus
gactttcgtgatgagcaaattggac

SEQ ID NO: 436481 - DNA, 25 bp, Mus musculus
gactttctaatggaggcagccgtgg

SEQ ID NO: 436482 - DNA, 25 bp, Mus musculus
gactttctactaaaatcatcgatat

SEQ ID NO: 436483 - DNA, 25 bp, Mus musculus
gactttctagcacaaccaagctgag

SEQ ID NO: 436484 - DNA, 25 bp, Mus musculus
gactttctcacatcaagcacctgac

SEQ ID NO: 436485 - DNA, 25 bp, Mus musculus
gactttctcagagggcgtccagggt

SEQ ID NO: 436486 - DNA, 25 bp, Mus musculus
gactttctgatggacttgcattcag

SEQ ID NO: 436487 - DNA, 25 bp, Mus musculus
gactttgaagtgctccatgatgccg

SEQ ID NO: 436488 - DNA, 25 bp, Mus musculus
gactttgaccggaatgtgcctcgga

SEQ ID NO: 436489 - DNA, 25 bp, Mus musculus
gactttgacctgtcagaaggtgacg

SEQ ID NO: 436490 - DNA, 25 bp, Mus musculus
gactttgactacaagaagaagcgcc

SEQ ID NO: 436491 - DNA, 25 bp, Mus musculus
gactttgacttctgatagccatgga

SEQ ID NO: 436492 - DNA, 25 bp, Mus musculus
gactttgagacgacgcgtagtttca

SEQ ID NO: 436493 - DNA, 25 bp, Mus musculus
gactttgaggagttcacgggccatg

SEQ ID NO: 436494 - DNA, 25 bp, Mus musculus
gactttgatatcgacgtgaacgcct

SEQ ID NO: 436495 - DNA, 25 bp, Mus musculus
gactttgccagaagccaattagtag

SEQ ID NO: 436496 - DNA, 25 bp, Mus musculus
gactttgcccaggacagctaagcgg

SEQ ID NO: 436497 - DNA, 25 bp, Mus musculus
gactttgcctaggagggagccttct

SEQ ID NO: 436498 - DNA, 25 bp, Mus musculus
gactttgcctcttgagatgtacagg

SEQ ID NO: 436499 - DNA, 25 bp, Mus musculus
gactttgctctactccctacaggca

SEQ ID NO: 436500 - DNA, 25 bp, Mus musculus
gactttgctggatgcactgaacacg

SEQ ID NO: 436501 - DNA, 25 bp, Mus musculus
gactttggacaaccgagtggcagac

SEQ ID NO: 436502 - DNA, 25 bp, Mus musculus
gactttggacaatggagcatccctg

SEQ ID NO: 436503 - DNA, 25 bp, Mus musculus
gactttggacttctcagtgccgcag

SEQ ID NO: 436504 - DNA, 25 bp, Mus musculus
gactttggagagagcagactaggca

SEQ ID NO: 436505 - DNA, 25 bp, Mus musculus
gactttggagtcacatggcaccatg

SEQ ID NO: 436506 - DNA, 25 bp, Mus musculus
gactttggcaaataactggagcggc

SEQ ID NO: 436507 - DNA, 25 bp, Mus musculus
gactttggcaacttcgtggtgcgca

SEQ ID NO: 436508 - DNA, 25 bp, Mus musculus
gactttggccaaagcgtgctgccct

SEQ ID NO: 436509 - DNA, 25 bp, Mus musculus
gactttggccagtagcctgcaggaa

SEQ ID NO: 436510 - DNA, 25 bp, Mus musculus
gactttggccttgcaacagccctgg

SEQ ID NO: 436511 - DNA, 25 bp, Mus musculus
gactttggctacttccgtccggaga

SEQ ID NO: 436512 - DNA, 25 bp, Mus musculus
gactttgggcattaaagagtcttca

SEQ ID NO: 436513 - DNA, 25 bp, Mus musculus
gactttgggcctcttagaactggag

SEQ ID NO: 436514 - DNA, 25 bp, Mus musculus
gactttgggtgctgatgtcaacgct

SEQ ID NO: 436515 - DNA, 25 bp, Mus musculus
gactttggtgacctgtgtcccctgc

SEQ ID NO: 436516 - DNA, 25 bp, Mus musculus
gactttgtaccactctgtgcacgag

SEQ ID NO: 436517 - DNA, 25 bp, Mus musculus
gactttgtcaccatggaggaagcag

SEQ ID NO: 436518 - DNA, 25 bp, Mus musculus
gactttgtgaccgagaaaatgacca

SEQ ID NO: 436519 - DNA, 25 bp, Mus musculus
gactttgtgcctgcaaggaaacagc

SEQ ID NO: 436520 - DNA, 25 bp, Mus musculus
gactttgtgttctatgctccccggc

SEQ ID NO: 436521 - DNA, 25 bp, Mus musculus
gactttgttcactcggttggactaa

SEQ ID NO: 436522 - DNA, 25 bp, Mus musculus
gactttgttggaaccatggtcccca

SEQ ID NO: 436523 - DNA, 25 bp, Mus musculus
gacttttacactagcagtagacggg

SEQ ID NO: 436524 - DNA, 25 bp, Mus musculus
gacttttacatcctcagtgagcact

SEQ ID NO: 436525 - DNA, 25 bp, Mus musculus
gacttttacctagaacttcactggg

SEQ ID NO: 436526 - DNA, 25 bp, Mus musculus
gacttttagccaggacaatacccca

SEQ ID NO: 436527 - DNA, 25 bp, Mus musculus
gacttttcaaagctcggcatcgcgc

SEQ ID NO: 436528 - DNA, 25 bp, Mus musculus
gacttttcaactgttgctaccagga

SEQ ID NO: 436529 - DNA, 25 bp, Mus musculus
gacttttcagcaaggaggtgcgcag

SEQ ID NO: 436530 - DNA, 25 bp, Mus musculus
gacttttcagtctgttataagccag

SEQ ID NO: 436531 - DNA, 25 bp, Mus musculus
gacttttgagccaaagcctgtgaga

SEQ ID NO: 436532 - DNA, 25 bp, Mus musculus
gacttttgcacatgaccatccaagg

SEQ ID NO: 436533 - DNA, 25 bp, Mus musculus
gacttttgctaactgcggccggaga

SEQ ID NO: 436534 - DNA, 25 bp, Mus musculus
gacttttggctccaggcgtaggaac

SEQ ID NO: 436535 - DNA, 25 bp, Mus musculus
gacttttgtaccactttgcagagaa

SEQ ID NO: 436536 - DNA, 25 bp, Mus musculus
gactttttcagttggctggctctca

SEQ ID NO: 436537 - DNA, 25 bp, Mus musculus
gactttttcatcgtgagccaggcag

SEQ ID NO: 436538 - DNA, 25 bp, Mus musculus
gactttttgaaagcgtccctggcct

SEQ ID NO: 436539 - DNA, 25 bp, Mus musculus
gactttttgacagtgatgactcaga

SEQ ID NO: 436540 - DNA, 25 bp, Mus musculus
gacttttttgggtgctccggatcgc

SEQ ID NO: 436541 - DNA, 25 bp, Mus musculus
gagaaaaaccctacgcgtgcaagga

SEQ ID NO: 436542 - DNA, 25 bp, Mus musculus
gagaaaaaggcaattctgaagatct

SEQ ID NO: 436543 - DNA, 25 bp, Mus musculus
gagaaaaaggctgtgctcaccaaca

SEQ ID NO: 436544 - DNA, 25 bp, Mus musculus
gagaaaaatcctctgccttcaaaag

SEQ ID NO: 436545 - DNA, 25 bp, Mus musculus
gagaaaacatggcagaggactccat

SEQ ID NO: 436546 - DNA, 25 bp, Mus musculus
gagaaaacattcattaagctcccct

SEQ ID NO: 436547 - DNA, 25 bp, Mus musculus
gagaaaaccaccatctccctagatg

SEQ ID NO: 436548 - DNA, 25 bp, Mus musculus
gagaaaaccagctttgttatagaag

SEQ ID NO: 436549 - DNA, 25 bp, Mus musculus
gagaaaacgagatggtgacaagctg

SEQ ID NO: 436550 - DNA, 25 bp, Mus musculus
gagaaaacgcttcaccatctggaga

SEQ ID NO: 436551 - DNA, 25 bp, Mus musculus
gagaaaacgttcagggttgccacca

SEQ ID NO: 436552 - DNA, 25 bp, Mus musculus
gagaaaacgttgaacctgccctatg

SEQ ID NO: 436553 - DNA, 25 bp, Mus musculus
gagaaaactcatttaaagctccgag

SEQ ID NO: 436554 - DNA, 25 bp, Mus musculus
gagaaaactccaagggatcccctgt

SEQ ID NO: 436555 - DNA, 25 bp, Mus musculus
gagaaaactggagctcctacttgga

SEQ ID NO: 436556 - DNA, 25 bp, Mus musculus
gagaaaactttgttaccactaatgc

SEQ ID NO: 436557 - DNA, 25 bp, Mus musculus
gagaaaagaaccatgctgcggagcg

SEQ ID NO: 436558 - DNA, 25 bp, Mus musculus
gagaaaagacgaggccatccagccc

SEQ ID NO: 436559 - DNA, 25 bp, Mus musculus
gagaaaagcatccagcgcagaaggt

SEQ ID NO: 436560 - DNA, 25 bp, Mus musculus
gagaaaagcccttacaggccacctg

SEQ ID NO: 436561 - DNA, 25 bp, Mus musculus
gagaaaagccttatgtgtgcgacac

SEQ ID NO: 436562 - DNA, 25 bp, Mus musculus
gagaaaaggctgcagtacgctacca

SEQ ID NO: 436563 - DNA, 25 bp, Mus musculus
gagaaaagtcggaggaaatggccca

SEQ ID NO: 436564 - DNA, 25 bp, Mus musculus
gagaaaagtgcctctacaactattg

SEQ ID NO: 436565 - DNA, 25 bp, Mus musculus
gagaaaagtgtacgccacctgattg

SEQ ID NO: 436566 - DNA, 25 bp, Mus musculus
gagaaaagtttacccctgagcagca

SEQ ID NO: 436567 - DNA, 25 bp, Mus musculus
gagaaaatgaaactctgcatctact

SEQ ID NO: 436568 - DNA, 25 bp, Mus musculus
gagaaacaaaagatatccacctgga

SEQ ID NO: 436569 - DNA, 25 bp, Mus musculus
gagaaacaagaagggcacagcctgt

SEQ ID NO: 436570 - DNA, 25 bp, Mus musculus
gagaaacaagctcctgccaacctga

SEQ ID NO: 436571 - DNA, 25 bp, Mus musculus
gagaaacaccggtctaagccatgag

SEQ ID NO: 436572 - DNA, 25 bp, Mus musculus
gagaaacagcttcgcgctgccaata

SEQ ID NO: 436573 - DNA, 25 bp, Mus musculus
gagaaacatacacatatagttaggc

SEQ ID NO: 436574 - DNA, 25 bp, Mus musculus
gagaaaccacctcgcatctgggatg

SEQ ID NO: 436575 - DNA, 25 bp, Mus musculus
gagaaaccaggtacagccaaaagtg

SEQ ID NO: 436576 - DNA, 25 bp, Mus musculus
gagaaaccatcactttcagcaaaat

SEQ ID NO: 436577 - DNA, 25 bp, Mus musculus
gagaaacccaactgctagaatcgaa

SEQ ID NO: 436578 - DNA, 25 bp, Mus musculus
gagaaacccatcacatcaagcagcg

SEQ ID NO: 436579 - DNA, 25 bp, Mus musculus
gagaaacccattaacgaccaggcag

SEQ ID NO: 436580 - DNA, 25 bp, Mus musculus
gagaaaccgaatgaaggctacctgg

SEQ ID NO: 436581 - DNA, 25 bp, Mus musculus
gagaaaccgtactttatggacccag

SEQ ID NO: 436582 - DNA, 25 bp, Mus musculus
gagaaacctcatcctcgcactgtgg

SEQ ID NO: 436583 - DNA, 25 bp, Mus musculus
gagaaacgctttgagtccatccacg

SEQ ID NO: 436584 - DNA, 25 bp, Mus musculus
gagaaactagatcggaccccgtgga

SEQ ID NO: 436585 - DNA, 25 bp, Mus musculus
gagaaactattcagatggtgtacct

SEQ ID NO: 436586 - DNA, 25 bp, Mus musculus
gagaaactatttctcacactagttc

SEQ ID NO: 436587 - DNA, 25 bp, Mus musculus
gagaaactcaaggacacctctttcc

SEQ ID NO: 436588 - DNA, 25 bp, Mus musculus
gagaaactcaggatgcggaccttag

SEQ ID NO: 436589 - DNA, 25 bp, Mus musculus
gagaaactcgtctctccagctgtcg

SEQ ID NO: 436590 - DNA, 25 bp, Mus musculus
gagaaactcgtggaactgctgtgtc

SEQ ID NO: 436591 - DNA, 25 bp, Mus musculus
gagaaactctgatggacaccggaca

SEQ ID NO: 436592 - DNA, 25 bp, Mus musculus
gagaaactgaaggttgtgaacgagc

SEQ ID NO: 436593 - DNA, 25 bp, Mus musculus
gagaaactgcattggttccctgtga

SEQ ID NO: 436594 - DNA, 25 bp, Mus musculus
gagaaactgcctacatccgggttaa

SEQ ID NO: 436595 - DNA, 25 bp, Mus musculus
gagaaactgctacccttacaggaat

SEQ ID NO: 436596 - DNA, 25 bp, Mus musculus
gagaaactgctctaagtcctttacc

SEQ ID NO: 436597 - DNA, 25 bp, Mus musculus
gagaaacttagtgtaatggctgcaa

SEQ ID NO: 436598 - DNA, 25 bp, Mus musculus
gagaaacttttcacggctcagtctg

SEQ ID NO: 436599 - DNA, 25 bp, Mus musculus
gagaaagaaacgtgtctgccgctcg

SEQ ID NO: 436600 - DNA, 25 bp, Mus musculus
gagaaagaactcgaacccgttgccg

SEQ ID NO: 436601 - DNA, 25 bp, Mus musculus
gagaaagaagaccttagggcaaaga

SEQ ID NO: 436602 - DNA, 25 bp, Mus musculus
gagaaagaagccgtcagctcagatt

SEQ ID NO: 436603 - DNA, 25 bp, Mus musculus
gagaaagacctgcaaatcgagcgag

SEQ ID NO: 436604 - DNA, 25 bp, Mus musculus
gagaaagagaccactctgacacagt

SEQ ID NO: 436605 - DNA, 25 bp, Mus musculus
gagaaagagcattgttaaacggcta

SEQ ID NO: 436606 - DNA, 25 bp, Mus musculus
gagaaagataaagcccaacccggtg

SEQ ID NO: 436607 - DNA, 25 bp, Mus musculus
gagaaagatcgagccaactgtccgt

SEQ ID NO: 436608 - DNA, 25 bp, Mus musculus
gagaaagattctccatttaaaccga

SEQ ID NO: 436609 - DNA, 25 bp, Mus musculus
gagaaagcaactataccaagcctgg

SEQ ID NO: 436610 - DNA, 25 bp, Mus musculus
gagaaagcaagtgaagtaagtctct

SEQ ID NO: 436611 - DNA, 25 bp, Mus musculus
gagaaagcaatcctccgagtggaca

SEQ ID NO: 436612 - DNA, 25 bp, Mus musculus
gagaaagcatagagatagccgccag

SEQ ID NO: 436613 - DNA, 25 bp, Mus musculus
gagaaagcatcgtacctttggagaa

SEQ ID NO: 436614 - DNA, 25 bp, Mus musculus
gagaaagcccatctggtcacactga

SEQ ID NO: 436615 - DNA, 25 bp, Mus musculus
gagaaagcctatggagcctttgagg

SEQ ID NO: 436616 - DNA, 25 bp, Mus musculus
gagaaagctcttcacacgctcagaa

SEQ ID NO: 436617 - DNA, 25 bp, Mus musculus
gagaaagctgcggtccttagatgcc

SEQ ID NO: 436618 - DNA, 25 bp, Mus musculus
gagaaagcttactgccttagacgag

SEQ ID NO: 436619 - DNA, 25 bp, Mus musculus
gagaaagcttgtgagttccacacaa

SEQ ID NO: 436620 - DNA, 25 bp, Mus musculus
gagaaaggcatctcggtaccggacc

SEQ ID NO: 436621 - DNA, 25 bp, Mus musculus
gagaaaggctcgtcatgggctttgc

SEQ ID NO: 436622 - DNA, 25 bp, Mus musculus
gagaaagggaacctgagagaggtac

SEQ ID NO: 436623 - DNA, 25 bp, Mus musculus
gagaaaggtgcttccgattccagag

SEQ ID NO: 436624 - DNA, 25 bp, Mus musculus
gagaaagtattgtgtcactccgacc

SEQ ID NO: 436625 - DNA, 25 bp, Mus musculus
gagaaagtcatccacaggctcttag

SEQ ID NO: 436626 - DNA, 25 bp, Mus musculus
gagaaagtctaggatccattcccag

SEQ ID NO: 436627 - DNA, 25 bp, Mus musculus
gagaaagtgatgaagccgtgctctg

SEQ ID NO: 436628 - DNA, 25 bp, Mus musculus
gagaaagttcccaaccacctgaagg

SEQ ID NO: 436629 - DNA, 25 bp, Mus musculus
gagaaataaaagacagaggccggtg

SEQ ID NO: 436630 - DNA, 25 bp, Mus musculus
gagaaataacctttttagccactgg

SEQ ID NO: 436631 - DNA, 25 bp, Mus musculus
gagaaatacactcactgctggcgtg

SEQ ID NO: 436632 - DNA, 25 bp, Mus musculus
gagaaatatccctcttacgcacaga

SEQ ID NO: 436633 - DNA, 25 bp, Mus musculus
gagaaatattgaacctcacctgaag

SEQ ID NO: 436634 - DNA, 25 bp, Mus musculus
gagaaatatttcaccagcagccatg

SEQ ID NO: 436635 - DNA, 25 bp, Mus musculus
gagaaatcacagtgtgccctggagg

SEQ ID NO: 436636 - DNA, 25 bp, Mus musculus
gagaaatcccgctacctggaaaagc

SEQ ID NO: 436637 - DNA, 25 bp, Mus musculus
gagaaatcgccctttgtggaaggcc

SEQ ID NO: 436638 - DNA, 25 bp, Mus musculus
gagaaatctcctgaaccatccctgg

SEQ ID NO: 436639 - DNA, 25 bp, Mus musculus
gagaaatcttagtccccagctgtga

SEQ ID NO: 436640 - DNA, 25 bp, Mus musculus
gagaaatgacacacttactacttgg

SEQ ID NO: 436641 - DNA, 25 bp, Mus musculus
gagaaatgacgccttcttctgatgt

SEQ ID NO: 436642 - DNA, 25 bp, Mus musculus
gagaaatgagatgtaccttggtacc

SEQ ID NO: 436643 - DNA, 25 bp, Mus musculus
gagaaatgatctcagcccatgtggg

SEQ ID NO: 436644 - DNA, 25 bp, Mus musculus
gagaaatgcattttcccaccagaaa

SEQ ID NO: 436645 - DNA, 25 bp, Mus musculus
gagaaatgccttagcctcaaggtgg

SEQ ID NO: 436646 - DNA, 25 bp, Mus musculus
gagaaatggacacttgcaccctcag

SEQ ID NO: 436647 - DNA, 25 bp, Mus musculus
gagaaatggcccaatcacagtgagt

SEQ ID NO: 436648 - DNA, 25 bp, Mus musculus
gagaaatgtaccgaagctggcaccc

SEQ ID NO: 436649 - DNA, 25 bp, Mus musculus
gagaaatgtagccttggaccgagac

SEQ ID NO: 436650 - DNA, 25 bp, Mus musculus
gagaaattaccatcgccttaaagag

SEQ ID NO: 436651 - DNA, 25 bp, Mus musculus
gagaaattcaccttccaggaggcag

SEQ ID NO: 436652 - DNA, 25 bp, Mus musculus
gagaaattccaggtgtgccctcaag

SEQ ID NO: 436653 - DNA, 25 bp, Mus musculus
gagaaatttaacgtgcctgccttgt

SEQ ID NO: 436654 - DNA, 25 bp, Mus musculus
gagaacaaacgcgacactgggcttt

SEQ ID NO: 436655 - DNA, 25 bp, Mus musculus
gagaacaacatcacaggcaagcggt

SEQ ID NO: 436656 - DNA, 25 bp, Mus musculus
gagaacaacggggttctgtccttca

SEQ ID NO: 436657 - DNA, 25 bp, Mus musculus
gagaacaactgtacccatggcgagg

SEQ ID NO: 436658 - DNA, 25 bp, Mus musculus
gagaacaacttcgtcgtgagcgcca

SEQ ID NO: 436659 - DNA, 25 bp, Mus musculus
gagaacaacttggacggctacgtgc

SEQ ID NO: 436660 - DNA, 25 bp, Mus musculus
gagaacaagtaattgcagccctgag

SEQ ID NO: 436661 - DNA, 25 bp, Mus musculus
gagaacaatgacaagccacctctct

SEQ ID NO: 436662 - DNA, 25 bp, Mus musculus
gagaacacatctcagtaccagggag

SEQ ID NO: 436663 - DNA, 25 bp, Mus musculus
gagaacaccaggaaagagagcagcc

SEQ ID NO: 436664 - DNA, 25 bp, Mus musculus
gagaacacgtactattgggccgggc

SEQ ID NO: 436665 - DNA, 25 bp, Mus musculus
gagaacactgcaaacggaaccttag

SEQ ID NO: 436666 - DNA, 25 bp, Mus musculus
gagaacactgtgctgtaaccctgga

SEQ ID NO: 436667 - DNA, 25 bp, Mus musculus
gagaacactttcttacgggcacagt

SEQ ID NO: 436668 - DNA, 25 bp, Mus musculus
gagaacagcgttttaggctcaatcc

SEQ ID NO: 436669 - DNA, 25 bp, Mus musculus
gagaacagctttgtgagggtcacga

SEQ ID NO: 436670 - DNA, 25 bp, Mus musculus
gagaacaggcatcaaaaccccagtg

SEQ ID NO: 436671 - DNA, 25 bp, Mus musculus
gagaacagtctaagatgcatgaggt

SEQ ID NO: 436672 - DNA, 25 bp, Mus musculus
gagaacatccgccacaaatttggga

SEQ ID NO: 436673 - DNA, 25 bp, Mus musculus
gagaacatcttgctgctgcgaaggc

SEQ ID NO: 436674 - DNA, 25 bp, Mus musculus
gagaacatgcgaaatggaaggagcc

SEQ ID NO: 436675 - DNA, 25 bp, Mus musculus
gagaacatggagtcccaggacacta

SEQ ID NO: 436676 - DNA, 25 bp, Mus musculus
gagaacattactagaccctgggaga

SEQ ID NO: 436677 - DNA, 25 bp, Mus musculus
gagaacattcctcccaagagccaga

SEQ ID NO: 436678 - DNA, 25 bp, Mus musculus
gagaacattgacacatcccatggtg

SEQ ID NO: 436679 - DNA, 25 bp, Mus musculus
gagaaccacgtggatgggaccatga

SEQ ID NO: 436680 - DNA, 25 bp, Mus musculus
gagaaccactatgtgtcacggctca

SEQ ID NO: 436681 - DNA, 25 bp, Mus musculus
gagaaccacttctttcagagggaga

SEQ ID NO: 436682 - DNA, 25 bp, Mus musculus
gagaaccagtgtagcgtataccatg

SEQ ID NO: 436683 - DNA, 25 bp, Mus musculus
gagaacccaggttgctaaacaattg

SEQ ID NO: 436684 - DNA, 25 bp, Mus musculus
gagaacccattggactacggcagcg

SEQ ID NO: 436685 - DNA, 25 bp, Mus musculus
gagaaccccaactttactggcaaga

SEQ ID NO: 436686 - DNA, 25 bp, Mus musculus
gagaaccccatgctgtacctccatg

SEQ ID NO: 436687 - DNA, 25 bp, Mus musculus
gagaacccgaagaaatatatccctg

SEQ ID NO: 436688 - DNA, 25 bp, Mus musculus
gagaaccgcatgtcacgtcgcattg

SEQ ID NO: 436689 - DNA, 25 bp, Mus musculus
gagaaccggactctgaggaaagaca

SEQ ID NO: 436690 - DNA, 25 bp, Mus musculus
gagaaccgtgatttatttccaagca

SEQ ID NO: 436691 - DNA, 25 bp, Mus musculus
gagaacctcaacactgacaagctga

SEQ ID NO: 436692 - DNA, 25 bp, Mus musculus
gagaacctcagtacctatgccctgg

SEQ ID NO: 436693 - DNA, 25 bp, Mus musculus
gagaacctcagttccgggatgccga

SEQ ID NO: 436694 - DNA, 25 bp, Mus musculus
gagaacctgaaaaccgagctgaaga

SEQ ID NO: 436695 - DNA, 25 bp, Mus musculus
gagaacctgcacgttatataactaa

SEQ ID NO: 436696 - DNA, 25 bp, Mus musculus
gagaacctgcagaatgtcgggtaga

SEQ ID NO: 436697 - DNA, 25 bp, Mus musculus
gagaacctgcgcttccatgtggagg

SEQ ID NO: 436698 - DNA, 25 bp, Mus musculus
gagaacctggtctgagctccttgga

SEQ ID NO: 436699 - DNA, 25 bp, Mus musculus
gagaacctgttttgaaagcattgtg

SEQ ID NO: 436700 - DNA, 25 bp, Mus musculus
gagaaccttagctggcaccttgatg

SEQ ID NO: 436701 - DNA, 25 bp, Mus musculus
gagaacctttaagccacgaggaaag

SEQ ID NO: 436702 - DNA, 25 bp, Mus musculus
gagaacgagagttacagacgcagac

SEQ ID NO: 436703 - DNA, 25 bp, Mus musculus
gagaacgatcatgaatacccaccag

SEQ ID NO: 436704 - DNA, 25 bp, Mus musculus
gagaacgctatacccagagtcctgg

SEQ ID NO: 436705 - DNA, 25 bp, Mus musculus
gagaacggctttttcgctggcagca

SEQ ID NO: 436706 - DNA, 25 bp, Mus musculus
gagaacggtctctgggccatcatga

SEQ ID NO: 436707 - DNA, 25 bp, Mus musculus
gagaacggttctgtcttacccatgg

SEQ ID NO: 436708 - DNA, 25 bp, Mus musculus
gagaacgtagctaccacagaagtcg

SEQ ID NO: 436709 - DNA, 25 bp, Mus musculus
gagaacgtcccatgcaataatgcga

SEQ ID NO: 436710 - DNA, 25 bp, Mus musculus
gagaacgtgttcttcctggtaacca

SEQ ID NO: 436711 - DNA, 25 bp, Mus musculus
gagaactacatctgttggacacaaa

SEQ ID NO: 436712 - DNA, 25 bp, Mus musculus
gagaactcacaggtcttggcctaaa

SEQ ID NO: 436713 - DNA, 25 bp, Mus musculus
gagaactcagactacagcagcgatg

SEQ ID NO: 436714 - DNA, 25 bp, Mus musculus
gagaactcgggtaaaaatgaagcca

SEQ ID NO: 436715 - DNA, 25 bp, Mus musculus
gagaactctttggtatcaagcccga

SEQ ID NO: 436716 - DNA, 25 bp, Mus musculus
gagaactgcagttttcgtgaccata

SEQ ID NO: 436717 - DNA, 25 bp, Mus musculus
gagaactgccaacgatgctgtggaa

SEQ ID NO: 436718 - DNA, 25 bp, Mus musculus
gagaactgcgtggacacactgctgg

SEQ ID NO: 436719 - DNA, 25 bp, Mus musculus
gagaactgcttgtccctgcgggacg

SEQ ID NO: 436720 - DNA, 25 bp, Mus musculus
gagaactgtgaggacaagagcccac

SEQ ID NO: 436721 - DNA, 25 bp, Mus musculus
gagaacttccgcagggctattgggt

SEQ ID NO: 436722 - DNA, 25 bp, Mus musculus
gagaacttcctctcactgctgttcg

SEQ ID NO: 436723 - DNA, 25 bp, Mus musculus
gagaacttgtttgccatcacggacg

SEQ ID NO: 436724 - DNA, 25 bp, Mus musculus
gagaactttctctttgggacaagaa

SEQ ID NO: 436725 - DNA, 25 bp, Mus musculus
gagaagaaacagcaatcgcgcaacc

SEQ ID NO: 436726 - DNA, 25 bp, Mus musculus
gagaagaaagccttgagctccccag

SEQ ID NO: 436727 - DNA, 25 bp, Mus musculus
gagaagaaatctatgcagacaacag

SEQ ID NO: 436728 - DNA, 25 bp, Mus musculus
gagaagaacttccagtaccgccaag

SEQ ID NO: 436729 - DNA, 25 bp, Mus musculus
gagaagaagataagcctctgccgcc

SEQ ID NO: 436730 - DNA, 25 bp, Mus musculus
gagaagaagcaagctgctctaaggg

SEQ ID NO: 436731 - DNA, 25 bp, Mus musculus
gagaagaaggcatactgcgagccct

SEQ ID NO: 436732 - DNA, 25 bp, Mus musculus
gagaagaatcatcccgacctagcag

SEQ ID NO: 436733 - DNA, 25 bp, Mus musculus
gagaagaatccatacatgaccatgc

SEQ ID NO: 436734 - DNA, 25 bp, Mus musculus
gagaagacagacatcctggcagtga

SEQ ID NO: 436735 - DNA, 25 bp, Mus musculus
gagaagacagatgccagcctgctga

SEQ ID NO: 436736 - DNA, 25 bp, Mus musculus
gagaagacagcagctacaagctgcc

SEQ ID NO: 436737 - DNA, 25 bp, Mus musculus
gagaagacatgattgtcacgccctt

SEQ ID NO: 436738 - DNA, 25 bp, Mus musculus
gagaagaccaagatcccgttaaaca

SEQ ID NO: 436739 - DNA, 25 bp, Mus musculus
gagaagaccagagaatgcagcagct

SEQ ID NO: 436740 - DNA, 25 bp, Mus musculus
gagaagaccagctacatggcggtgc

SEQ ID NO: 436741 - DNA, 25 bp, Mus musculus
gagaagacccttctagaagttggag

SEQ ID NO: 436742 - DNA, 25 bp, Mus musculus
gagaagacctcgttgcactcaagct

SEQ ID NO: 436743 - DNA, 25 bp, Mus musculus
gagaagacgcacctattacagcagc

SEQ ID NO: 436744 - DNA, 25 bp, Mus musculus
gagaagactagaaggctgccagcca

SEQ ID NO: 436745 - DNA, 25 bp, Mus musculus
gagaagactgcgcattgaagccaag

SEQ ID NO: 436746 - DNA, 25 bp, Mus musculus
gagaagactgttctgtcgcacccag

SEQ ID NO: 436747 - DNA, 25 bp, Mus musculus
gagaagacttcaacctcagctagta

SEQ ID NO: 436748 - DNA, 25 bp, Mus musculus
gagaagagaagctttgccagggccc

SEQ ID NO: 436749 - DNA, 25 bp, Mus musculus
gagaagagaattccctgagactcat

SEQ ID NO: 436750 - DNA, 25 bp, Mus musculus
gagaagagacactggaagcgctaca

SEQ ID NO: 436751 - DNA, 25 bp, Mus musculus
gagaagagactcaaatctcccaggg

SEQ ID NO: 436752 - DNA, 25 bp, Mus musculus
gagaagagagaaagctgcagttgaa

SEQ ID NO: 436753 - DNA, 25 bp, Mus musculus
gagaagagcatgtcggcttccttaa

SEQ ID NO: 436754 - DNA, 25 bp, Mus musculus
gagaagagccctttcgaccagctag

SEQ ID NO: 436755 - DNA, 25 bp, Mus musculus
gagaagagccggaggaattccgcca

SEQ ID NO: 436756 - DNA, 25 bp, Mus musculus
gagaagagccttccctgctttcgcg

SEQ ID NO: 436757 - DNA, 25 bp, Mus musculus
gagaagaggctcgaggagatcaatc

SEQ ID NO: 436758 - DNA, 25 bp, Mus musculus
gagaagagtgctccataactgccat

SEQ ID NO: 436759 - DNA, 25 bp, Mus musculus
gagaagatacccagcttcccgccgg

SEQ ID NO: 436760 - DNA, 25 bp, Mus musculus
gagaagatatgcttcactcggcatg

SEQ ID NO: 436761 - DNA, 25 bp, Mus musculus
gagaagatcattggctcaggagcac

SEQ ID NO: 436762 - DNA, 25 bp, Mus musculus
gagaagatctttcagcggcagagcc

SEQ ID NO: 436763 - DNA, 25 bp, Mus musculus
gagaagatgcattaccagaacgggc

SEQ ID NO: 436764 - DNA, 25 bp, Mus musculus
gagaagatggcctgagcactgtcaa

SEQ ID NO: 436765 - DNA, 25 bp, Mus musculus
gagaagattaaactttccagccggg

SEQ ID NO: 436766 - DNA, 25 bp, Mus musculus
gagaagattacttggaaccatcaaa

SEQ ID NO: 436767 - DNA, 25 bp, Mus musculus
gagaagattagtatggcccctgcat

SEQ ID NO: 436768 - DNA, 25 bp, Mus musculus
gagaagcaacggtggatttcagcct

SEQ ID NO: 436769 - DNA, 25 bp, Mus musculus
gagaagcaaggctggaccacgtgta

SEQ ID NO: 436770 - DNA, 25 bp, Mus musculus
gagaagcactcactacctcctggtg

SEQ ID NO: 436771 - DNA, 25 bp, Mus musculus
gagaagcagctcaagatcaaccggc

SEQ ID NO: 436772 - DNA, 25 bp, Mus musculus
gagaagcagtacgatgcctcggcag

SEQ ID NO: 436773 - DNA, 25 bp, Mus musculus
gagaagcagtattccctggcagcca

SEQ ID NO: 436774 - DNA, 25 bp, Mus musculus
gagaagcagtccagctccttctgag

SEQ ID NO: 436775 - DNA, 25 bp, Mus musculus
gagaagcatcctccacagacaggta

SEQ ID NO: 436776 - DNA, 25 bp, Mus musculus
gagaagcatggctatcagacacaga

SEQ ID NO: 436777 - DNA, 25 bp, Mus musculus
gagaagccaccttcaaggcgtgacc

SEQ ID NO: 436778 - DNA, 25 bp, Mus musculus
gagaagccacgtctgtagtcctatg

SEQ ID NO: 436779 - DNA, 25 bp, Mus musculus
gagaagccacgtgtaactctgctct

SEQ ID NO: 436780 - DNA, 25 bp, Mus musculus
gagaagccagccatgaaccatcctt

SEQ ID NO: 436781 - DNA, 25 bp, Mus musculus
gagaagccatatgcatgcccagaat

SEQ ID NO: 436782 - DNA, 25 bp, Mus musculus
gagaagcccactgtatattgtaacg

SEQ ID NO: 436783 - DNA, 25 bp, Mus musculus
gagaagcccatcaggaagttctgag

SEQ ID NO: 436784 - DNA, 25 bp, Mus musculus
gagaagccccttggttttacagagc

SEQ ID NO: 436785 - DNA, 25 bp, Mus musculus
gagaagcccgggaagcagcgctctt

SEQ ID NO: 436786 - DNA, 25 bp, Mus musculus
gagaagcctgcaaagtatcctgaga

SEQ ID NO: 436787 - DNA, 25 bp, Mus musculus
gagaagcgaaacatccatgcggcag

SEQ ID NO: 436788 - DNA, 25 bp, Mus musculus
gagaagcgcatgaacaagctgggca

SEQ ID NO: 436789 - DNA, 25 bp, Mus musculus
gagaagcggcaggataaaccaagcc

SEQ ID NO: 436790 - DNA, 25 bp, Mus musculus
gagaagcgtccttgctcctcacgtt

SEQ ID NO: 436791 - DNA, 25 bp, Mus musculus
gagaagcgtgaacatggcctcgcca

SEQ ID NO: 436792 - DNA, 25 bp, Mus musculus
gagaagctcaaggaagtcgtccact

SEQ ID NO: 436793 - DNA, 25 bp, Mus musculus
gagaagctccaagtgaagatcgcag

SEQ ID NO: 436794 - DNA, 25 bp, Mus musculus
gagaagctcgctcccaagagcagcc

SEQ ID NO: 436795 - DNA, 25 bp, Mus musculus
gagaagctctatcggctccagcaga

SEQ ID NO: 436796 - DNA, 25 bp, Mus musculus
gagaagctctgtacaggatccctac

SEQ ID NO: 436797 - DNA, 25 bp, Mus musculus
gagaagctcttactcgctaccgggc

SEQ ID NO: 436798 - DNA, 25 bp, Mus musculus
gagaagctgagtcgtcataccgcca

SEQ ID NO: 436799 - DNA, 25 bp, Mus musculus
gagaagctgcaccagcaggacatga

SEQ ID NO: 436800 - DNA, 25 bp, Mus musculus
gagaagctgccccttgaatccggca

SEQ ID NO: 436801 - DNA, 25 bp, Mus musculus
gagaagctggacaaggcactaggac

SEQ ID NO: 436802 - DNA, 25 bp, Mus musculus
gagaagctgggaggccacttcttta

SEQ ID NO: 436803 - DNA, 25 bp, Mus musculus
gagaagctgttgtggtgtagctccc

SEQ ID NO: 436804 - DNA, 25 bp, Mus musculus
gagaagcttactgcatggtttgtag

SEQ ID NO: 436805 - DNA, 25 bp, Mus musculus
gagaagcttattgtgggcatcctgt

SEQ ID NO: 436806 - DNA, 25 bp, Mus musculus
gagaagcttcccacagagtttgatg

SEQ ID NO: 436807 - DNA, 25 bp, Mus musculus
gagaagcttcctgcgtgcctacgtt

SEQ ID NO: 436808 - DNA, 25 bp, Mus musculus
gagaagcttgttgctcgtcgccgca

SEQ ID NO: 436809 - DNA, 25 bp, Mus musculus
gagaaggaagcattgcaaagtcttg

SEQ ID NO: 436810 - DNA, 25 bp, Mus musculus
gagaaggacctcaaagacaaccgga

SEQ ID NO: 436811 - DNA, 25 bp, Mus musculus
gagaaggagatgtttgcccaagacc

SEQ ID NO: 436812 - DNA, 25 bp, Mus musculus
gagaaggagccagtacaagactatg

SEQ ID NO: 436813 - DNA, 25 bp, Mus musculus
gagaaggagtgggatccctcctcct

SEQ ID NO: 436814 - DNA, 25 bp, Mus musculus
gagaaggattctctgccccgctttg

SEQ ID NO: 436815 - DNA, 25 bp, Mus musculus
gagaaggatttcttatcgtgcagca

SEQ ID NO: 436816 - DNA, 25 bp, Mus musculus
gagaaggcaccaagtttaagagagc

SEQ ID NO: 436817 - DNA, 25 bp, Mus musculus
gagaaggccgatatcctggagctga

SEQ ID NO: 436818 - DNA, 25 bp, Mus musculus
gagaaggccgctttccgggaactga

SEQ ID NO: 436819 - DNA, 25 bp, Mus musculus
gagaaggcctacctacctgggcact

SEQ ID NO: 436820 - DNA, 25 bp, Mus musculus
gagaaggcgtgctggcataaaccaa

SEQ ID NO: 436821 - DNA, 25 bp, Mus musculus
gagaaggctccgtgttccgggaact

SEQ ID NO: 436822 - DNA, 25 bp, Mus musculus
gagaaggctcttcggctcagcttag

SEQ ID NO: 436823 - DNA, 25 bp, Mus musculus
gagaaggctgctaacatcgccaggg

SEQ ID NO: 436824 - DNA, 25 bp, Mus musculus
gagaagggaaactctttatttgttg

SEQ ID NO: 436825 - DNA, 25 bp, Mus musculus
gagaagggcaactgtacgtaccatg

SEQ ID NO: 436826 - DNA, 25 bp, Mus musculus
gagaagggtgtgaactgccagctac

SEQ ID NO: 436827 - DNA, 25 bp, Mus musculus
gagaaggtcattctccccaagctga

SEQ ID NO: 436828 - DNA, 25 bp, Mus musculus
gagaaggtcgtcacagaaatatgca

SEQ ID NO: 436829 - DNA, 25 bp, Mus musculus
gagaaggtgcctgtggaacaagcca

SEQ ID NO: 436830 - DNA, 25 bp, Mus musculus
gagaaggtgtctaacagcatggcga

SEQ ID NO: 436831 - DNA, 25 bp, Mus musculus
gagaaggttgtgagaatcgagccca

SEQ ID NO: 436832 - DNA, 25 bp, Mus musculus
gagaagtaaccgtaaccctgcacag

SEQ ID NO: 436833 - DNA, 25 bp, Mus musculus
gagaagtaactcagccagcatttgg

SEQ ID NO: 436834 - DNA, 25 bp, Mus musculus
gagaagtaactgaagacaccctggt

SEQ ID NO: 436835 - DNA, 25 bp, Mus musculus
gagaagtacagcatagacctggcca

SEQ ID NO: 436836 - DNA, 25 bp, Mus musculus
gagaagtacgctgaggaagaccgca

SEQ ID NO: 436837 - DNA, 25 bp, Mus musculus
gagaagtagctttctgcagctgtgg

SEQ ID NO: 436838 - DNA, 25 bp, Mus musculus
gagaagtcatccagcgtccagaaac

SEQ ID NO: 436839 - DNA, 25 bp, Mus musculus
gagaagtccaaccaccatacagagt

SEQ ID NO: 436840 - DNA, 25 bp, Mus musculus
gagaagtcccgcatccgatttgaga

SEQ ID NO: 436841 - DNA, 25 bp, Mus musculus
gagaagtcctaaagaacctgcctgc

SEQ ID NO: 436842 - DNA, 25 bp, Mus musculus
gagaagtctgcttccaggcgggacc

SEQ ID NO: 436843 - DNA, 25 bp, Mus musculus
gagaagtgtgccctattcaacagcg

SEQ ID NO: 436844 - DNA, 25 bp, Mus musculus
gagaagttccttaagtacccaagtg

SEQ ID NO: 436845 - DNA, 25 bp, Mus musculus
gagaagttctaaaccgccacatagg

SEQ ID NO: 436846 - DNA, 25 bp, Mus musculus
gagaagttctggaagccacccagca

SEQ ID NO: 436847 - DNA, 25 bp, Mus musculus
gagaagttctggaggacagccacaa

SEQ ID NO: 436848 - DNA, 25 bp, Mus musculus
gagaagttcttttgattcccaccgg

SEQ ID NO: 436849 - DNA, 25 bp, Mus musculus
gagaagttgctagaccaggtccagg

SEQ ID NO: 436850 - DNA, 25 bp, Mus musculus
gagaagttggaaagaaactgagatt

SEQ ID NO: 436851 - DNA, 25 bp, Mus musculus
gagaagttgttggtccctggtccta

SEQ ID NO: 436852 - DNA, 25 bp, Mus musculus
gagaataacaccactccgccagatg

SEQ ID NO: 436853 - DNA, 25 bp, Mus musculus
gagaataatgccagcaacccgtgcc

SEQ ID NO: 436854 - DNA, 25 bp, Mus musculus
gagaataccctgatgtccctgagga

SEQ ID NO: 436855 - DNA, 25 bp, Mus musculus
gagaatacgccttctgacccagcag

SEQ ID NO: 436856 - DNA, 25 bp, Mus musculus
gagaatagatgaagccaaccaggag

SEQ ID NO: 436857 - DNA, 25 bp, Mus musculus
gagaatagtccttcctcagcgcttc

SEQ ID NO: 436858 - DNA, 25 bp, Mus musculus
gagaatataaaatgcaccggacccc

SEQ ID NO: 436859 - DNA, 25 bp, Mus musculus
gagaatatatcatcaggcagggtgc

SEQ ID NO: 436860 - DNA, 25 bp, Mus musculus
gagaatatctccttcaacagatcca

SEQ ID NO: 436861 - DNA, 25 bp, Mus musculus
gagaatattcctgctctgaaagccc

SEQ ID NO: 436862 - DNA, 25 bp, Mus musculus
gagaatcacaccgatgagcacctgg

SEQ ID NO: 436863 - DNA, 25 bp, Mus musculus
gagaatcagaccataccagcattag

SEQ ID NO: 436864 - DNA, 25 bp, Mus musculus
gagaatcaggtaacattgcacagcc

SEQ ID NO: 436865 - DNA, 25 bp, Mus musculus
gagaatccactctggcgagaagccg

SEQ ID NO: 436866 - DNA, 25 bp, Mus musculus
gagaatccaggccatttccagcttg

SEQ ID NO: 436867 - DNA, 25 bp, Mus musculus
gagaatccccattggatttggaggg

SEQ ID NO: 436868 - DNA, 25 bp, Mus musculus
gagaatcctcttacgacactggtgg

SEQ ID NO: 436869 - DNA, 25 bp, Mus musculus
gagaatcctgacagctagagtgttg

SEQ ID NO: 436870 - DNA, 25 bp, Mus musculus
gagaatccttcctctatcgctcaga

SEQ ID NO: 436871 - DNA, 25 bp, Mus musculus
gagaatctagaccataacagcacga

SEQ ID NO: 436872 - DNA, 25 bp, Mus musculus
gagaatctcgaaaggtcaaagccaa

SEQ ID NO: 436873 - DNA, 25 bp, Mus musculus
gagaatctgatgcaaaagaagggca

SEQ ID NO: 436874 - DNA, 25 bp, Mus musculus
gagaatctgggctttctcaggccta

SEQ ID NO: 436875 - DNA, 25 bp, Mus musculus
gagaatctggttgtttgacccctga

SEQ ID NO: 436876 - DNA, 25 bp, Mus musculus
gagaatcttcatgacgtaggaggca

SEQ ID NO: 436877 - DNA, 25 bp, Mus musculus
gagaatcttgtcagagaagcacggc

SEQ ID NO: 436878 - DNA, 25 bp, Mus musculus
gagaatgaaaaacggaagcgtccaa

SEQ ID NO: 436879 - DNA, 25 bp, Mus musculus
gagaatgaaagctgaatggtaggta

SEQ ID NO: 436880 - DNA, 25 bp, Mus musculus
gagaatgaaccaacctttagggctg

SEQ ID NO: 436881 - DNA, 25 bp, Mus musculus
gagaatgacatgcttgacctggctt

SEQ ID NO: 436882 - DNA, 25 bp, Mus musculus
gagaatgacattgaccttctagaca

SEQ ID NO: 436883 - DNA, 25 bp, Mus musculus
gagaatgagccctactccttgaagg

SEQ ID NO: 436884 - DNA, 25 bp, Mus musculus
gagaatgatgcagactgtagccacc

SEQ ID NO: 436885 - DNA, 25 bp, Mus musculus
gagaatgattcttggtcctgctctg

SEQ ID NO: 436886 - DNA, 25 bp, Mus musculus
gagaatgcagttttagagcagttgc

SEQ ID NO: 436887 - DNA, 25 bp, Mus musculus
gagaatgcgactctctaaaaccctt

SEQ ID NO: 436888 - DNA, 25 bp, Mus musculus
gagaatgcgcatgaagtactgtcag

SEQ ID NO: 436889 - DNA, 25 bp, Mus musculus
gagaatggacattatcgagcccctg

SEQ ID NO: 436890 - DNA, 25 bp, Mus musculus
gagaatggtgtttcagagccccaag

SEQ ID NO: 436891 - DNA, 25 bp, Mus musculus
gagaatgtacaacttgcaccttgaa

SEQ ID NO: 436892 - DNA, 25 bp, Mus musculus
gagaatgtcacatcatgcatcctga

SEQ ID NO: 436893 - DNA, 25 bp, Mus musculus
gagaatgttaaatacctgccagggc

SEQ ID NO: 436894 - DNA, 25 bp, Mus musculus
gagaattaaacaccatgccctaagg

SEQ ID NO: 436895 - DNA, 25 bp, Mus musculus
gagaattacctatacagcccactag

SEQ ID NO: 436896 - DNA, 25 bp, Mus musculus
gagaattccaccctgagtgaagagg

SEQ ID NO: 436897 - DNA, 25 bp, Mus musculus
gagaattccgtacactcctggtgag

SEQ ID NO: 436898 - DNA, 25 bp, Mus musculus
gagaattccgtcaagaggcatgcca

SEQ ID NO: 436899 - DNA, 25 bp, Mus musculus
gagaattctcaagcacagcccagag

SEQ ID NO: 436900 - DNA, 25 bp, Mus musculus
gagaattgaaccttggcgtgtgacc

SEQ ID NO: 436901 - DNA, 25 bp, Mus musculus
gagaattgaggccttacagtgaccc

SEQ ID NO: 436902 - DNA, 25 bp, Mus musculus
gagaatttctcaggctcccgtagag

SEQ ID NO: 436903 - DNA, 25 bp, Mus musculus
gagaatttgggtttgcctggcccga

SEQ ID NO: 436904 - DNA, 25 bp, Mus musculus
gagaatttgtcaggcagaacttagc

SEQ ID NO: 436905 - DNA, 25 bp, Mus musculus
gagaattttgaggacgtcgggcact

SEQ ID NO: 436906 - DNA, 25 bp, Mus musculus
gagacaaaaatgcagtgggcctccg

SEQ ID NO: 436907 - DNA, 25 bp, Mus musculus
gagacaaacccaagtagccctagag

SEQ ID NO: 436908 - DNA, 25 bp, Mus musculus
gagacaaatatacagggagccaagc

SEQ ID NO: 436909 - DNA, 25 bp, Mus musculus
gagacaaatcgtgctgcaaatcagg

SEQ ID NO: 436910 - DNA, 25 bp, Mus musculus
gagacaaattcgtgctaacagctgc

SEQ ID NO: 436911 - DNA, 25 bp, Mus musculus
gagacaagctagtgaggtccccgaa

SEQ ID NO: 436912 - DNA, 25 bp, Mus musculus
gagacaagctctaccatccggagtg

SEQ ID NO: 436913 - DNA, 25 bp, Mus musculus
gagacaaggcagacaaagcttcact

SEQ ID NO: 436914 - DNA, 25 bp, Mus musculus
gagacaagtacatggctgagccctg

SEQ ID NO: 436915 - DNA, 25 bp, Mus musculus
gagacaatagctgcccatgatggag

SEQ ID NO: 436916 - DNA, 25 bp, Mus musculus
gagacaatccgcgaatctaaccact

SEQ ID NO: 436917 - DNA, 25 bp, Mus musculus
gagacaatgcccctccagggatgca

SEQ ID NO: 436918 - DNA, 25 bp, Mus musculus
gagacaatggccttaacacgctgga

SEQ ID NO: 436919 - DNA, 25 bp, Mus musculus
gagacacaaagtttccacagctgag

SEQ ID NO: 436920 - DNA, 25 bp, Mus musculus
gagacacaagcttccgcctgatgaa

SEQ ID NO: 436921 - DNA, 25 bp, Mus musculus
gagacacacagtctaacagaggctg

SEQ ID NO: 436922 - DNA, 25 bp, Mus musculus
gagacacagatcatgacccaggtgg

SEQ ID NO: 436923 - DNA, 25 bp, Mus musculus
gagacacagcacttagacatcggac

SEQ ID NO: 436924 - DNA, 25 bp, Mus musculus
gagacacagggttttactacatagc

SEQ ID NO: 436925 - DNA, 25 bp, Mus musculus
gagacacatctatgacttgagcaga

SEQ ID NO: 436926 - DNA, 25 bp, Mus musculus
gagacaccaacttttctatctgtac

SEQ ID NO: 436927 - DNA, 25 bp, Mus musculus
gagacaccagctttctatgaaggca

SEQ ID NO: 436928 - DNA, 25 bp, Mus musculus
gagacaccaggctcttgtactccct

SEQ ID NO: 436929 - DNA, 25 bp, Mus musculus
gagacaccattgagacttgaccagg

SEQ ID NO: 436930 - DNA, 25 bp, Mus musculus
gagacacctcatgaagcagagcagt

SEQ ID NO: 436931 - DNA, 25 bp, Mus musculus
gagacacctccaacttcgacaaaga

SEQ ID NO: 436932 - DNA, 25 bp, Mus musculus
gagacacgcctcctgaaatatcagt

SEQ ID NO: 436933 - DNA, 25 bp, Mus musculus
gagacacggtgaccctgactaaggc

SEQ ID NO: 436934 - DNA, 25 bp, Mus musculus
gagacacgtaggattctgggacttg

SEQ ID NO: 436935 - DNA, 25 bp, Mus musculus
gagacactcaagtagcagagaggac

SEQ ID NO: 436936 - DNA, 25 bp, Mus musculus
gagacactctccatgtacaaacgct

SEQ ID NO: 436937 - DNA, 25 bp, Mus musculus
gagacactctggatttgctccttag

SEQ ID NO: 436938 - DNA, 25 bp, Mus musculus
gagacactgactgcatggaggacgt

SEQ ID NO: 436939 - DNA, 25 bp, Mus musculus
gagacactgcctcgtgggcttcaag

SEQ ID NO: 436940 - DNA, 25 bp, Mus musculus
gagacactgtctgcatcgacctggt

SEQ ID NO: 436941 - DNA, 25 bp, Mus musculus
gagacacttcgagttccagcagaca

SEQ ID NO: 436942 - DNA, 25 bp, Mus musculus
gagacactttctgctaactattggc

SEQ ID NO: 436943 - DNA, 25 bp, Mus musculus
gagacagacatctcatccaagccac

SEQ ID NO: 436944 - DNA, 25 bp, Mus musculus
gagacagacggtccagggaacaaaa

SEQ ID NO: 436945 - DNA, 25 bp, Mus musculus
gagacagactgaaacgaggcttgaa

SEQ ID NO: 436946 - DNA, 25 bp, Mus musculus
gagacagactgaccccatgattatg

SEQ ID NO: 436947 - DNA, 25 bp, Mus musculus
gagacagagatgacgatttgcccaa

SEQ ID NO: 436948 - DNA, 25 bp, Mus musculus
gagacagagcccatcgtactggagg

SEQ ID NO: 436949 - DNA, 25 bp, Mus musculus
gagacagatagccagactcttgccg

SEQ ID NO: 436950 - DNA, 25 bp, Mus musculus
gagacagatggagacccacagtggc

SEQ ID NO: 436951 - DNA, 25 bp, Mus musculus
gagacagatttcctgttctcacacc

SEQ ID NO: 436952 - DNA, 25 bp, Mus musculus
gagacagattttcagaactggagga

SEQ ID NO: 436953 - DNA, 25 bp, Mus musculus
gagacagcacagagagactcctgct

SEQ ID NO: 436954 - DNA, 25 bp, Mus musculus
gagacagccctccatgtttgagcaa

SEQ ID NO: 436955 - DNA, 25 bp, Mus musculus
gagacagcgagaaggactgacctct

SEQ ID NO: 436956 - DNA, 25 bp, Mus musculus
gagacagcgagcaccatggcattag

SEQ ID NO: 436957 - DNA, 25 bp, Mus musculus
gagacagcgggttactacatctgca

SEQ ID NO: 436958 - DNA, 25 bp, Mus musculus
gagacagctaagctaggcagaccca

SEQ ID NO: 436959 - DNA, 25 bp, Mus musculus
gagacagctcttgaaggaccaaggc

SEQ ID NO: 436960 - DNA, 25 bp, Mus musculus
gagacagctgctagatgaccacaag

SEQ ID NO: 436961 - DNA, 25 bp, Mus musculus
gagacagctgctcaccatgatgatg

SEQ ID NO: 436962 - DNA, 25 bp, Mus musculus
gagacagctgtgaaagagcaaggat

SEQ ID NO: 436963 - DNA, 25 bp, Mus musculus
gagacaggacaagcattaaacatgc

SEQ ID NO: 436964 - DNA, 25 bp, Mus musculus
gagacaggagtctggagtcagttca

SEQ ID NO: 436965 - DNA, 25 bp, Mus musculus
gagacaggcaaaccatgaaacgggc

SEQ ID NO: 436966 - DNA, 25 bp, Mus musculus
gagacaggccttggtaggagactaa

SEQ ID NO: 436967 - DNA, 25 bp, Mus musculus
gagacagtagtagctcatcacagga

SEQ ID NO: 436968 - DNA, 25 bp, Mus musculus
gagacagtcacacccatggagatag

SEQ ID NO: 436969 - DNA, 25 bp, Mus musculus
gagacagtcgctcacacatgatgag

SEQ ID NO: 436970 - DNA, 25 bp, Mus musculus
gagacagtctcctccggctttctgg

SEQ ID NO: 436971 - DNA, 25 bp, Mus musculus
gagacagtctgctacttgggaccca

SEQ ID NO: 436972 - DNA, 25 bp, Mus musculus
gagacagtgtttagtgccttccacc

SEQ ID NO: 436973 - DNA, 25 bp, Mus musculus
gagacatacacagtgttttacacag

SEQ ID NO: 436974 - DNA, 25 bp, Mus musculus
gagacataccttgcttgcttccaaa

SEQ ID NO: 436975 - DNA, 25 bp, Mus musculus
gagacatactatgagaaaataaaat

SEQ ID NO: 436976 - DNA, 25 bp, Mus musculus
gagacatacttgaacctacactggg

SEQ ID NO: 436977 - DNA, 25 bp, Mus musculus
gagacatagctcagatcaagctcaa

SEQ ID NO: 436978 - DNA, 25 bp, Mus musculus
gagacatagtcgctttgagtcagga

SEQ ID NO: 436979 - DNA, 25 bp, Mus musculus
gagacatatgaaaacccactgatga

SEQ ID NO: 436980 - DNA, 25 bp, Mus musculus
gagacatcccgcataggactgaaag

SEQ ID NO: 436981 - DNA, 25 bp, Mus musculus
gagacatccttacagccagactctg

SEQ ID NO: 436982 - DNA, 25 bp, Mus musculus
gagacatcgggtgatcatgcctacg

SEQ ID NO: 436983 - DNA, 25 bp, Mus musculus
gagacatctacgaaatccctctggg

SEQ ID NO: 436984 - DNA, 25 bp, Mus musculus
gagacatctcaaggtaaggccacag

SEQ ID NO: 436985 - DNA, 25 bp, Mus musculus
gagacatctgcaaggtggccaaacg

SEQ ID NO: 436986 - DNA, 25 bp, Mus musculus
gagacatctggtctacctggaatgc

SEQ ID NO: 436987 - DNA, 25 bp, Mus musculus
gagacatgacaaaggcccagagaca

SEQ ID NO: 436988 - DNA, 25 bp, Mus musculus
gagacatggctgaacctgcaaagga

SEQ ID NO: 436989 - DNA, 25 bp, Mus musculus
gagacatggtttgcgctggcactcc

SEQ ID NO: 436990 - DNA, 25 bp, Mus musculus
gagacattcattatcagcgcggcgg

SEQ ID NO: 436991 - DNA, 25 bp, Mus musculus
gagacattctacacttccttggaga

SEQ ID NO: 436992 - DNA, 25 bp, Mus musculus
gagacattgcagtttttcccggaac

SEQ ID NO: 436993 - DNA, 25 bp, Mus musculus
gagacattggccagtacacatttga

SEQ ID NO: 436994 - DNA, 25 bp, Mus musculus
gagacatttaatgccgaggagcccc

SEQ ID NO: 436995 - DNA, 25 bp, Mus musculus
gagacatttccagacgcccatggtg

SEQ ID NO: 436996 - DNA, 25 bp, Mus musculus
gagacattttctcagcccgcgatgc

SEQ ID NO: 436997 - DNA, 25 bp, Mus musculus
gagaccaaatatagggcctcatgca

SEQ ID NO: 436998 - DNA, 25 bp, Mus musculus
gagaccaaatctgcaactaaggatg

SEQ ID NO: 436999 - DNA, 25 bp, Mus musculus
gagaccaagagctctcctttgcaga

SEQ ID NO: 437000 - DNA, 25 bp, Mus musculus
gagaccaatagacgccccagaggga

SEQ ID NO: 437001 - DNA, 25 bp, Mus musculus
gagaccacacttacaagccttactg

SEQ ID NO: 437002 - DNA, 25 bp, Mus musculus
gagaccactggaccactctggaaag

SEQ ID NO: 437003 - DNA, 25 bp, Mus musculus
gagaccagcacaactacaattcggg

SEQ ID NO: 437004 - DNA, 25 bp, Mus musculus
gagaccagcatagggccacttagta

SEQ ID NO: 437005 - DNA, 25 bp, Mus musculus
gagaccagcgatggcattcatcgag

SEQ ID NO: 437006 - DNA, 25 bp, Mus musculus
gagaccagcttcttcgtcaaccgtg

SEQ ID NO: 437007 - DNA, 25 bp, Mus musculus
gagaccaggagtacgagagctgccc

SEQ ID NO: 437008 - DNA, 25 bp, Mus musculus
gagaccaggttctgactcatccagg

SEQ ID NO: 437009 - DNA, 25 bp, Mus musculus
gagaccagtgtaaagggaccacctg

SEQ ID NO: 437010 - DNA, 25 bp, Mus musculus
gagaccatccgattgccttatgaag

SEQ ID NO: 437011 - DNA, 25 bp, Mus musculus
gagaccatgcgtaacacagatcaag

SEQ ID NO: 437012 - DNA, 25 bp, Mus musculus
gagaccatggctttaccccaaggaa

SEQ ID NO: 437013 - DNA, 25 bp, Mus musculus
gagaccattagcaccatcctgaagg

SEQ ID NO: 437014 - DNA, 25 bp, Mus musculus
gagacccaagggatcacagacactt

SEQ ID NO: 437015 - DNA, 25 bp, Mus musculus
gagacccacagctactatgcagacg

SEQ ID NO: 437016 - DNA, 25 bp, Mus musculus
gagacccacagttgtctaacccagg

SEQ ID NO: 437017 - DNA, 25 bp, Mus musculus
gagacccactgctctgccttatgag

SEQ ID NO: 437018 - DNA, 25 bp, Mus musculus
gagacccagcgctaattcgtctgag

SEQ ID NO: 437019 - DNA, 25 bp, Mus musculus
gagacccagggaagtacatcataga

SEQ ID NO: 437020 - DNA, 25 bp, Mus musculus
gagaccccagataattaaggacgtc

SEQ ID NO: 437021 - DNA, 25 bp, Mus musculus
gagaccccaggagctccattttaga

SEQ ID NO: 437022 - DNA, 25 bp, Mus musculus
gagaccccatagttcgggaccacct

SEQ ID NO: 437023 - DNA, 25 bp, Mus musculus
gagaccccggaccagtgtatgacag

SEQ ID NO: 437024 - DNA, 25 bp, Mus musculus
gagacccctgtgtcggttcctgtgg

SEQ ID NO: 437025 - DNA, 25 bp, Mus musculus
gagaccccttgcagagagttcagag

SEQ ID NO: 437026 - DNA, 25 bp, Mus musculus
gagacccgaaaggaatgactgtgat

SEQ ID NO: 437027 - DNA, 25 bp, Mus musculus
gagacccgacaatgagtgcacaagt

SEQ ID NO: 437028 - DNA, 25 bp, Mus musculus
gagacccgtgggagcgtcttcgtct

SEQ ID NO: 437029 - DNA, 25 bp, Mus musculus
gagacccgttgttgctcattcttaa

SEQ ID NO: 437030 - DNA, 25 bp, Mus musculus
gagaccctcattaaacaagatctgg

SEQ ID NO: 437031 - DNA, 25 bp, Mus musculus
gagaccctccttccataattactga

SEQ ID NO: 437032 - DNA, 25 bp, Mus musculus
gagaccctctgtacaatgccgtggt

SEQ ID NO: 437033 - DNA, 25 bp, Mus musculus
gagaccctgatactgcaattgatga

SEQ ID NO: 437034 - DNA, 25 bp, Mus musculus
gagaccctggaataatcacaaagtg

SEQ ID NO: 437035 - DNA, 25 bp, Mus musculus
gagaccgcgagcaggatcctggctt

SEQ ID NO: 437036 - DNA, 25 bp, Mus musculus
gagaccggaatcttcttcaggagga

SEQ ID NO: 437037 - DNA, 25 bp, Mus musculus
gagaccggatgctgggtgctgggcg

SEQ ID NO: 437038 - DNA, 25 bp, Mus musculus
gagaccggatggctcccactttgat

SEQ ID NO: 437039 - DNA, 25 bp, Mus musculus
gagaccggcgggaagctgctggtgt

SEQ ID NO: 437040 - DNA, 25 bp, Mus musculus
gagaccgggaagctcatcgacaaga

SEQ ID NO: 437041 - DNA, 25 bp, Mus musculus
gagaccggttggaacttttgcagtg

SEQ ID NO: 437042 - DNA, 25 bp, Mus musculus
gagaccgtgctcttcttcagtggga

SEQ ID NO: 437043 - DNA, 25 bp, Mus musculus
gagaccgttaataaatcacccagtg

SEQ ID NO: 437044 - DNA, 25 bp, Mus musculus
gagacctaagtggttcctgccacca

SEQ ID NO: 437045 - DNA, 25 bp, Mus musculus
gagacctacccatggatgccttctt

SEQ ID NO: 437046 - DNA, 25 bp, Mus musculus
gagacctaccggctgtggaagatcc

SEQ ID NO: 437047 - DNA, 25 bp, Mus musculus
gagacctacctgatgaagcacatgt

SEQ ID NO: 437048 - DNA, 25 bp, Mus musculus
gagacctacttccacgagttcgggc

SEQ ID NO: 437049 - DNA, 25 bp, Mus musculus
gagacctactttgacttccggctgt

SEQ ID NO: 437050 - DNA, 25 bp, Mus musculus
gagacctatagatttattcaacaag

SEQ ID NO: 437051 - DNA, 25 bp, Mus musculus
gagacctcaacacagaagctcatgt

SEQ ID NO: 437052 - DNA, 25 bp, Mus musculus
gagacctcagtcacgatcgatggca

SEQ ID NO: 437053 - DNA, 25 bp, Mus musculus
gagacctcatttgtcacagtggaca

SEQ ID NO: 437054 - DNA, 25 bp, Mus musculus
gagacctccaaattggttgtggata

SEQ ID NO: 437055 - DNA, 25 bp, Mus musculus
gagacctcctgatgatcgaccgtga

SEQ ID NO: 437056 - DNA, 25 bp, Mus musculus
gagacctcctggatctagagttgga

SEQ ID NO: 437057 - DNA, 25 bp, Mus musculus
gagacctcggttttgcacaagccgg

SEQ ID NO: 437058 - DNA, 25 bp, Mus musculus
gagacctcgttgaagtgcggagcac

SEQ ID NO: 437059 - DNA, 25 bp, Mus musculus
gagacctcttccagggatgcaccgt

SEQ ID NO: 437060 - DNA, 25 bp, Mus musculus
gagacctctttgtcgcgtgaggcac

SEQ ID NO: 437061 - DNA, 25 bp, Mus musculus
gagacctgaagacctcccaaaaggc

SEQ ID NO: 437062 - DNA, 25 bp, Mus musculus
gagacctgagccgaccttgagggct

SEQ ID NO: 437063 - DNA, 25 bp, Mus musculus
gagacctgaggctaatttgctgggc

SEQ ID NO: 437064 - DNA, 25 bp, Mus musculus
gagacctgctcgatcgctcttgtgg

SEQ ID NO: 437065 - DNA, 25 bp, Mus musculus
gagacctggaagatgaaaacgacct

SEQ ID NO: 437066 - DNA, 25 bp, Mus musculus
gagacctgggtccaagaatacatca

SEQ ID NO: 437067 - DNA, 25 bp, Mus musculus
gagacctggtaagggccactactgg

SEQ ID NO: 437068 - DNA, 25 bp, Mus musculus
gagacctggtctggttatgccctca

SEQ ID NO: 437069 - DNA, 25 bp, Mus musculus
gagacctgtattgccctcagagcaa

SEQ ID NO: 437070 - DNA, 25 bp, Mus musculus
gagaccttctctgtggacctagcca

SEQ ID NO: 437071 - DNA, 25 bp, Mus musculus
gagaccttctttggagttcagtgga

SEQ ID NO: 437072 - DNA, 25 bp, Mus musculus
gagaccttgctgaaacatggagcca

SEQ ID NO: 437073 - DNA, 25 bp, Mus musculus
gagaccttgggaactctgatcattc

SEQ ID NO: 437074 - DNA, 25 bp, Mus musculus
gagacgaacttgacctgcggaggaa

SEQ ID NO: 437075 - DNA, 25 bp, Mus musculus
gagacgagtcctgcgtattccagag

SEQ ID NO: 437076 - DNA, 25 bp, Mus musculus
gagacgagtttctgggacggatcaa

SEQ ID NO: 437077 - DNA, 25 bp, Mus musculus
gagacgatgtaagcttgtctcaggg

SEQ ID NO: 437078 - DNA, 25 bp, Mus musculus
gagacgcacgcaacaaacggaagaa

SEQ ID NO: 437079 - DNA, 25 bp, Mus musculus
gagacgcagcgaatcacatgggaca

SEQ ID NO: 437080 - DNA, 25 bp, Mus musculus
gagacgctaccaggaaatggctaga

SEQ ID NO: 437081 - DNA, 25 bp, Mus musculus
gagacgctcacacgaatcctgatag

SEQ ID NO: 437082 - DNA, 25 bp, Mus musculus
gagacgctcatttccatgctgcaga

SEQ ID NO: 437083 - DNA, 25 bp, Mus musculus
gagacgctcttgagatccgatgcaa

SEQ ID NO: 437084 - DNA, 25 bp, Mus musculus
gagacgctgagcaaggacacttcct

SEQ ID NO: 437085 - DNA, 25 bp, Mus musculus
gagacggactcccacatgttgtttt

SEQ ID NO: 437086 - DNA, 25 bp, Mus musculus
gagacgggtcatggatttgtactaa

SEQ ID NO: 437087 - DNA, 25 bp, Mus musculus
gagacgtacggttgtcaatggagaa

SEQ ID NO: 437088 - DNA, 25 bp, Mus musculus
gagacgtcagtttgggcttcccgag

SEQ ID NO: 437089 - DNA, 25 bp, Mus musculus
gagacgtcgttatatggacctttca

SEQ ID NO: 437090 - DNA, 25 bp, Mus musculus
gagacgtctcatagccaccttggaa

SEQ ID NO: 437091 - DNA, 25 bp, Mus musculus
gagacgtgactttcacaacccagaa

SEQ ID NO: 437092 - DNA, 25 bp, Mus musculus
gagacgttcgtcagaagctgctccc

SEQ ID NO: 437093 - DNA, 25 bp, Mus musculus
gagacgttgcgatacacagcgatgc

SEQ ID NO: 437094 - DNA, 25 bp, Mus musculus
gagactaacgtgtcgtgtccgcagt

SEQ ID NO: 437095 - DNA, 25 bp, Mus musculus
gagactacaaaggagagcaaacccc

SEQ ID NO: 437096 - DNA, 25 bp, Mus musculus
gagactacaattgctggatgaggga

SEQ ID NO: 437097 - DNA, 25 bp, Mus musculus
gagactacggcaagtacctgcgcag

SEQ ID NO: 437098 - DNA, 25 bp, Mus musculus
gagactactatcatcctgctgctgg

SEQ ID NO: 437099 - DNA, 25 bp, Mus musculus
gagactactcaacctcgtcttggct

SEQ ID NO: 437100 - DNA, 25 bp, Mus musculus
gagactactgtaccaaccctttgga

SEQ ID NO: 437101 - DNA, 25 bp, Mus musculus
gagactacttactactggtgatgtg

SEQ ID NO: 437102 - DNA, 25 bp, Mus musculus
gagactagaaagagccactgggagc

SEQ ID NO: 437103 - DNA, 25 bp, Mus musculus
gagactagaactccccaagtgttga

SEQ ID NO: 437104 - DNA, 25 bp, Mus musculus
gagactagacactcacggaagggaa

SEQ ID NO: 437105 - DNA, 25 bp, Mus musculus
gagactagtacaccacacagcagaa

SEQ ID NO: 437106 - DNA, 25 bp, Mus musculus
gagactatagacctgcttctccagt

SEQ ID NO: 437107 - DNA, 25 bp, Mus musculus
gagactatagccagggtccgttcca

SEQ ID NO: 437108 - DNA, 25 bp, Mus musculus
gagactatcctccactggtgacggt

SEQ ID NO: 437109 - DNA, 25 bp, Mus musculus
gagactatctggaggtgatgcccaa

SEQ ID NO: 437110 - DNA, 25 bp, Mus musculus
gagactatgtccaaaggcccctgaa

SEQ ID NO: 437111 - DNA, 25 bp, Mus musculus
gagactcaaagagcccagaactagg

SEQ ID NO: 437112 - DNA, 25 bp, Mus musculus
gagactcagaaatcactccagctct

SEQ ID NO: 437113 - DNA, 25 bp, Mus musculus
gagactcagttttcaaacaaaatat

SEQ ID NO: 437114 - DNA, 25 bp, Mus musculus
gagactccactgaaaccaaggtatg

SEQ ID NO: 437115 - DNA, 25 bp, Mus musculus
gagactccctcttcagatgactata

SEQ ID NO: 437116 - DNA, 25 bp, Mus musculus
gagactcccttgtttttctggtggc

SEQ ID NO: 437117 - DNA, 25 bp, Mus musculus
gagactcctcgtagccaaaccggag

SEQ ID NO: 437118 - DNA, 25 bp, Mus musculus
gagactcctgacgtggaccctgagc

SEQ ID NO: 437119 - DNA, 25 bp, Mus musculus
gagactccttacactgcccctattg

SEQ ID NO: 437120 - DNA, 25 bp, Mus musculus
gagactccttctgaagacactggaa

SEQ ID NO: 437121 - DNA, 25 bp, Mus musculus
gagactcgccggaaaactgtgagct

SEQ ID NO: 437122 - DNA, 25 bp, Mus musculus
gagactcgcttcgagggtccacttc

SEQ ID NO: 437123 - DNA, 25 bp, Mus musculus
gagactcggcccatggaaactgagg

SEQ ID NO: 437124 - DNA, 25 bp, Mus musculus
gagactcgggagtgcatctactaca

SEQ ID NO: 437125 - DNA, 25 bp, Mus musculus
gagactctccagaacgacatgggta

SEQ ID NO: 437126 - DNA, 25 bp, Mus musculus
gagactctcccacaacaggatacgg

SEQ ID NO: 437127 - DNA, 25 bp, Mus musculus
gagactctggagctggataactaaa

SEQ ID NO: 437128 - DNA, 25 bp, Mus musculus
gagactctggtccaaacaaggcctg

SEQ ID NO: 437129 - DNA, 25 bp, Mus musculus
gagactctgttcaagtgcccggtgt

SEQ ID NO: 437130 - DNA, 25 bp, Mus musculus
gagactcttcctaatgtccgggtgg

SEQ ID NO: 437131 - DNA, 25 bp, Mus musculus
gagactcttctcagcgacactgcag

SEQ ID NO: 437132 - DNA, 25 bp, Mus musculus
gagactgaagaagctgtagcccttt

SEQ ID NO: 437133 - DNA, 25 bp, Mus musculus
gagactgattttcctcgcccggtga

SEQ ID NO: 437134 - DNA, 25 bp, Mus musculus
gagactgccagtgcagccaccttgg

SEQ ID NO: 437135 - DNA, 25 bp, Mus musculus
gagactgcgacaagtgttggcccgt

SEQ ID NO: 437136 - DNA, 25 bp, Mus musculus
gagactgcggaggattcactgcaca

SEQ ID NO: 437137 - DNA, 25 bp, Mus musculus
gagactgcggataccttgagaggac

SEQ ID NO: 437138 - DNA, 25 bp, Mus musculus
gagactgcgtgaccacctcttagag

SEQ ID NO: 437139 - DNA, 25 bp, Mus musculus
gagactgctactgaaggcgacactg

SEQ ID NO: 437140 - DNA, 25 bp, Mus musculus
gagactgctcaagaacctgtggtgg

SEQ ID NO: 437141 - DNA, 25 bp, Mus musculus
gagactgctctacaaaatccaaggc

SEQ ID NO: 437142 - DNA, 25 bp, Mus musculus
gagactgctgatagtggcctgcaaa

SEQ ID NO: 437143 - DNA, 25 bp, Mus musculus
gagactggaaccgttcttgaccggc

SEQ ID NO: 437144 - DNA, 25 bp, Mus musculus
gagactggcactctgatgctccaga

SEQ ID NO: 437145 - DNA, 25 bp, Mus musculus
gagactggcctcaacatgcgtgtta

SEQ ID NO: 437146 - DNA, 25 bp, Mus musculus
gagactggcctgatagactgcagca

SEQ ID NO: 437147 - DNA, 25 bp, Mus musculus
gagactggctggagcctctgactct

SEQ ID NO: 437148 - DNA, 25 bp, Mus musculus
gagactgggccaacaaaaatttccg

SEQ ID NO: 437149 - DNA, 25 bp, Mus musculus
gagactgggttacaaatcctggcct

SEQ ID NO: 437150 - DNA, 25 bp, Mus musculus
gagactggtggataccctcccacaa

SEQ ID NO: 437151 - DNA, 25 bp, Mus musculus
gagactggtttagtagagcaagccc

SEQ ID NO: 437152 - DNA, 25 bp, Mus musculus
gagactgtccctgaacatgggcagt

SEQ ID NO: 437153 - DNA, 25 bp, Mus musculus
gagactgtctccaggccttattgag

SEQ ID NO: 437154 - DNA, 25 bp, Mus musculus
gagactgtctgcatgcctcactggg

SEQ ID NO: 437155 - DNA, 25 bp, Mus musculus
gagactgtctggtgaatctccaagc

SEQ ID NO: 437156 - DNA, 25 bp, Mus musculus
gagactgtgatcgagaactgggaac

SEQ ID NO: 437157 - DNA, 25 bp, Mus musculus
gagactgttctagactatgggactt

SEQ ID NO: 437158 - DNA, 25 bp, Mus musculus
gagacttaaaacctgcaacattctg

SEQ ID NO: 437159 - DNA, 25 bp, Mus musculus
gagacttaccaggataaaagaaaag

SEQ ID NO: 437160 - DNA, 25 bp, Mus musculus
gagacttagacacgaactcctggcc

SEQ ID NO: 437161 - DNA, 25 bp, Mus musculus
gagacttaggaagcttgtagcgccc

SEQ ID NO: 437162 - DNA, 25 bp, Mus musculus
gagacttagtgaatgctgacctcat

SEQ ID NO: 437163 - DNA, 25 bp, Mus musculus
gagacttcaaaaggaatgtgtgttg

SEQ ID NO: 437164 - DNA, 25 bp, Mus musculus
gagacttcacttttgcagaccagcc

SEQ ID NO: 437165 - DNA, 25 bp, Mus musculus
gagacttcagctggcacactgggac

SEQ ID NO: 437166 - DNA, 25 bp, Mus musculus
gagacttcatctacagaacggtgga

SEQ ID NO: 437167 - DNA, 25 bp, Mus musculus
gagacttcatgggtgcagctccgga

SEQ ID NO: 437168 - DNA, 25 bp, Mus musculus
gagacttccctctttataatcgcct

SEQ ID NO: 437169 - DNA, 25 bp, Mus musculus
gagacttcctgttggtctacaatcg

SEQ ID NO: 437170 - DNA, 25 bp, Mus musculus
gagacttctcttttagccctggtgg

SEQ ID NO: 437171 - DNA, 25 bp, Mus musculus
gagacttctgccattctcagcgcct

SEQ ID NO: 437172 - DNA, 25 bp, Mus musculus
gagacttcttgaacttgccgggaga

SEQ ID NO: 437173 - DNA, 25 bp, Mus musculus
gagacttgaccttcctattgagaga

SEQ ID NO: 437174 - DNA, 25 bp, Mus musculus
gagacttgatagcacacaccatgga

SEQ ID NO: 437175 - DNA, 25 bp, Mus musculus
gagacttgcaaacgaactggccaga

SEQ ID NO: 437176 - DNA, 25 bp, Mus musculus
gagacttgcaattgccagtcgggca

SEQ ID NO: 437177 - DNA, 25 bp, Mus musculus
gagacttgccggctgctgtatgacc

SEQ ID NO: 437178 - DNA, 25 bp, Mus musculus
gagacttgcgtccactctgagggca

SEQ ID NO: 437179 - DNA, 25 bp, Mus musculus
gagacttgctcttgcactaccaaag

SEQ ID NO: 437180 - DNA, 25 bp, Mus musculus
gagacttgcttcagtgggatcccaa

SEQ ID NO: 437181 - DNA, 25 bp, Mus musculus
gagacttgtacagacggaatccgtc

SEQ ID NO: 437182 - DNA, 25 bp, Mus musculus
gagactttccaaacctctaactgga

SEQ ID NO: 437183 - DNA, 25 bp, Mus musculus
gagactttccaactgttgctttgca

SEQ ID NO: 437184 - DNA, 25 bp, Mus musculus
gagactttccagcatccgtacaaca

SEQ ID NO: 437185 - DNA, 25 bp, Mus musculus
gagactttcctttcttgactcctta

SEQ ID NO: 437186 - DNA, 25 bp, Mus musculus
gagactttctgaatctccctcacaa

SEQ ID NO: 437187 - DNA, 25 bp, Mus musculus
gagactttgaatacgccatgaacca

SEQ ID NO: 437188 - DNA, 25 bp, Mus musculus
gagactttgagtttaaaggctcaga

SEQ ID NO: 437189 - DNA, 25 bp, Mus musculus
gagacttttccgctgctactgcaag

SEQ ID NO: 437190 - DNA, 25 bp, Mus musculus
gagagaaaatctccggaagcccagc

SEQ ID NO: 437191 - DNA, 25 bp, Mus musculus
gagagaaacctgtcatgagctgcca

SEQ ID NO: 437192 - DNA, 25 bp, Mus musculus
gagagaaactcttctggcccgggac

SEQ ID NO: 437193 - DNA, 25 bp, Mus musculus
gagagaaagccctcggcagagcttg

SEQ ID NO: 437194 - DNA, 25 bp, Mus musculus
gagagaaatcccaggctataaagga

SEQ ID NO: 437195 - DNA, 25 bp, Mus musculus
gagagaacaacaccatccctatggg

SEQ ID NO: 437196 - DNA, 25 bp, Mus musculus
gagagaaccaaccaactccggaaca

SEQ ID NO: 437197 - DNA, 25 bp, Mus musculus
gagagaaccacttctgtagacgctc

SEQ ID NO: 437198 - DNA, 25 bp, Mus musculus
gagagaacgtcctcagaactgactg

SEQ ID NO: 437199 - DNA, 25 bp, Mus musculus
gagagaacttgcttttcaatctcag

SEQ ID NO: 437200 - DNA, 25 bp, Mus musculus
gagagaagatccttccaggtcccag

SEQ ID NO: 437201 - DNA, 25 bp, Mus musculus
gagagaagcagctccatgtggtcag

SEQ ID NO: 437202 - DNA, 25 bp, Mus musculus
gagagaaggcacaaacactaggaaa

SEQ ID NO: 437203 - DNA, 25 bp, Mus musculus
gagagaaggccctagaaacctgtag

SEQ ID NO: 437204 - DNA, 25 bp, Mus musculus
gagagaataggaatccccacggagc

SEQ ID NO: 437205 - DNA, 25 bp, Mus musculus
gagagaatcacaactgcagtgggca

SEQ ID NO: 437206 - DNA, 25 bp, Mus musculus
gagagaatcctgtaggcacctggac

SEQ ID NO: 437207 - DNA, 25 bp, Mus musculus
gagagaatcttactcaaggcggcaa

SEQ ID NO: 437208 - DNA, 25 bp, Mus musculus
gagagaatgacgctcttcaggcagt

SEQ ID NO: 437209 - DNA, 25 bp, Mus musculus
gagagaattccctggtgccagcagc

SEQ ID NO: 437210 - DNA, 25 bp, Mus musculus
gagagacaaacaatccagaaaacgc

SEQ ID NO: 437211 - DNA, 25 bp, Mus musculus
gagagacaagtcttcctcttcatcc

SEQ ID NO: 437212 - DNA, 25 bp, Mus musculus
gagagacacttgtatagcccacact

SEQ ID NO: 437213 - DNA, 25 bp, Mus musculus
gagagacagagagggctcaacacta

SEQ ID NO: 437214 - DNA, 25 bp, Mus musculus
gagagaccatctttttctgtcacaa

SEQ ID NO: 437215 - DNA, 25 bp, Mus musculus
gagagaccccaaatttagaccggat

SEQ ID NO: 437216 - DNA, 25 bp, Mus musculus
gagagacccgactattgcaagttgt

SEQ ID NO: 437217 - DNA, 25 bp, Mus musculus
gagagaccgccgtacagaagaagaa

SEQ ID NO: 437218 - DNA, 25 bp, Mus musculus
gagagaccttgagacctagtgagaa

SEQ ID NO: 437219 - DNA, 25 bp, Mus musculus
gagagacgacgcattcaggaaaaga

SEQ ID NO: 437220 - DNA, 25 bp, Mus musculus
gagagacggtctcacgatatacctc

SEQ ID NO: 437221 - DNA, 25 bp, Mus musculus
gagagacgttctacttggcacagga

SEQ ID NO: 437222 - DNA, 25 bp, Mus musculus
gagagactacgtatttgccaaagcc

SEQ ID NO: 437223 - DNA, 25 bp, Mus musculus
gagagactatcaatggtggcagcca

SEQ ID NO: 437224 - DNA, 25 bp, Mus musculus
gagagactcagctgcttggccaaga

SEQ ID NO: 437225 - DNA, 25 bp, Mus musculus
gagagactccaagcacacttcggtg

SEQ ID NO: 437226 - DNA, 25 bp, Mus musculus
gagagactccagtacaaaaccccac

SEQ ID NO: 437227 - DNA, 25 bp, Mus musculus
gagagactctaaacgctgagccctt

SEQ ID NO: 437228 - DNA, 25 bp, Mus musculus
gagagactctggctatacaagtctg

SEQ ID NO: 437229 - DNA, 25 bp, Mus musculus
gagagactctgtggccttgcattgg

SEQ ID NO: 437230 - DNA, 25 bp, Mus musculus
gagagactcttgaaacaggcgcacg

SEQ ID NO: 437231 - DNA, 25 bp, Mus musculus
gagagactgactcccaatggctgga

SEQ ID NO: 437232 - DNA, 25 bp, Mus musculus
gagagactgtcgttagagccaaagc

SEQ ID NO: 437233 - DNA, 25 bp, Mus musculus
gagagactgtgcttgcctcaccata

SEQ ID NO: 437234 - DNA, 25 bp, Mus musculus
gagagacttgagatgcagagacaca

SEQ ID NO: 437235 - DNA, 25 bp, Mus musculus
gagagacttgcaccttaacactgga

SEQ ID NO: 437236 - DNA, 25 bp, Mus musculus
gagagacttgccttcctgatgataa

SEQ ID NO: 437237 - DNA, 25 bp, Mus musculus
gagagacttgtggtttgcaagctaa

SEQ ID NO: 437238 - DNA, 25 bp, Mus musculus
gagagactttgctcccgggatgcct

SEQ ID NO: 437239 - DNA, 25 bp, Mus musculus
gagagagaaaagtgtacgccacctg

SEQ ID NO: 437240 - DNA, 25 bp, Mus musculus
gagagagaatacacaacacttgtct

SEQ ID NO: 437241 - DNA, 25 bp, Mus musculus
gagagagacagagcactccagctat

SEQ ID NO: 437242 - DNA, 25 bp, Mus musculus
gagagagaccagttacccttctctg

SEQ ID NO: 437243 - DNA, 25 bp, Mus musculus
gagagagactgtgaatgccatcggt

SEQ ID NO: 437244 - DNA, 25 bp, Mus musculus
gagagagagctcttcagactgaacc

SEQ ID NO: 437245 - DNA, 25 bp, Mus musculus
gagagagagctgagacataaggacc

SEQ ID NO: 437246 - DNA, 25 bp, Mus musculus
gagagagcaccacctgacctgagat

SEQ ID NO: 437247 - DNA, 25 bp, Mus musculus
gagagagccgagaaaccatgcattg

SEQ ID NO: 437248 - DNA, 25 bp, Mus musculus
gagagagcctccttgcagatgagaa

SEQ ID NO: 437249 - DNA, 25 bp, Mus musculus
gagagagcgtctgcgccaattggcc

SEQ ID NO: 437250 - DNA, 25 bp, Mus musculus
gagagagggccaccccttttctaag

SEQ ID NO: 437251 - DNA, 25 bp, Mus musculus
gagagagtaacaagcctagaaggct

SEQ ID NO: 437252 - DNA, 25 bp, Mus musculus
gagagagtatggaaaagcattccct

SEQ ID NO: 437253 - DNA, 25 bp, Mus musculus
gagagagtcctggtcccaagaggaa

SEQ ID NO: 437254 - DNA, 25 bp, Mus musculus
gagagagtccttctaaccgggctgc

SEQ ID NO: 437255 - DNA, 25 bp, Mus musculus
gagagagtctgtccctgaccttgca

SEQ ID NO: 437256 - DNA, 25 bp, Mus musculus
gagagagtgtgcctactgcctgacc

SEQ ID NO: 437257 - DNA, 25 bp, Mus musculus
gagagagtgttaccatcgaggccca

SEQ ID NO: 437258 - DNA, 25 bp, Mus musculus
gagagagtttctagccacacagagg

SEQ ID NO: 437259 - DNA, 25 bp, Mus musculus
gagagataatcaccaacgccgttag

SEQ ID NO: 437260 - DNA, 25 bp, Mus musculus
gagagatagttccattctgtaatgc

SEQ ID NO: 437261 - DNA, 25 bp, Mus musculus
gagagatcagtttttactcacacag

SEQ ID NO: 437262 - DNA, 25 bp, Mus musculus
gagagatccgaattatccagctagg

SEQ ID NO: 437263 - DNA, 25 bp, Mus musculus
gagagatctcgaaaggcaattgtga

SEQ ID NO: 437264 - DNA, 25 bp, Mus musculus
gagagatctctagccatcatccagg

SEQ ID NO: 437265 - DNA, 25 bp, Mus musculus
gagagatctgtgttcgccatggccc

SEQ ID NO: 437266 - DNA, 25 bp, Mus musculus
gagagatcttcctgacagtggtgcc

SEQ ID NO: 437267 - DNA, 25 bp, Mus musculus
gagagatcttctgctgggacacaca

SEQ ID NO: 437268 - DNA, 25 bp, Mus musculus
gagagatgaggtttcacctaccagc

SEQ ID NO: 437269 - DNA, 25 bp, Mus musculus
gagagatggacagcgccagcagctc

SEQ ID NO: 437270 - DNA, 25 bp, Mus musculus
gagagatgtcagctacccctaatgg

SEQ ID NO: 437271 - DNA, 25 bp, Mus musculus
gagagatgtgaccttacccttccgc

SEQ ID NO: 437272 - DNA, 25 bp, Mus musculus
gagagattcaagaagtagccacggg

SEQ ID NO: 437273 - DNA, 25 bp, Mus musculus
gagagattgcaaaacacacgcctga

SEQ ID NO: 437274 - DNA, 25 bp, Mus musculus
gagagatttaaaaggcaaaattggc

SEQ ID NO: 437275 - DNA, 25 bp, Mus musculus
gagagatttgacagacacctccaat

SEQ ID NO: 437276 - DNA, 25 bp, Mus musculus
gagagcaaaccggtcagatggcaga

SEQ ID NO: 437277 - DNA, 25 bp, Mus musculus
gagagcaagacgatccctgatggcc

SEQ ID NO: 437278 - DNA, 25 bp, Mus musculus
gagagcaagcctgtccttgatgagg

SEQ ID NO: 437279 - DNA, 25 bp, Mus musculus
gagagcaattgtctatcaaaactac

SEQ ID NO: 437280 - DNA, 25 bp, Mus musculus
gagagcacagtgatcaagtcccagc

SEQ ID NO: 437281 - DNA, 25 bp, Mus musculus
gagagcacattttgacctgcactga

SEQ ID NO: 437282 - DNA, 25 bp, Mus musculus
gagagcaccttggagagcactggac

SEQ ID NO: 437283 - DNA, 25 bp, Mus musculus
gagagcagaacagcaaagaggactt

SEQ ID NO: 437284 - DNA, 25 bp, Mus musculus
gagagcagagacatcccaatctggg

SEQ ID NO: 437285 - DNA, 25 bp, Mus musculus
gagagcagccattatttgtccccag

SEQ ID NO: 437286 - DNA, 25 bp, Mus musculus
gagagcagcgattgcccaggcttta

SEQ ID NO: 437287 - DNA, 25 bp, Mus musculus
gagagcagctttgtatccaacgagg

SEQ ID NO: 437288 - DNA, 25 bp, Mus musculus
gagagcaggcttcattgttcctgac

SEQ ID NO: 437289 - DNA, 25 bp, Mus musculus
gagagcagtgacttgccacacacat

SEQ ID NO: 437290 - DNA, 25 bp, Mus musculus
gagagcagtgtaaacctcacagggc

SEQ ID NO: 437291 - DNA, 25 bp, Mus musculus
gagagcatagaaatgctagggcccc

SEQ ID NO: 437292 - DNA, 25 bp, Mus musculus
gagagcatcaagtctttgccacgat

SEQ ID NO: 437293 - DNA, 25 bp, Mus musculus
gagagcatgagacttccacgggaac

SEQ ID NO: 437294 - DNA, 25 bp, Mus musculus
gagagcattaacagcgcgttcgcgg

SEQ ID NO: 437295 - DNA, 25 bp, Mus musculus
gagagccaactcgtctgtctgggag

SEQ ID NO: 437296 - DNA, 25 bp, Mus musculus
gagagccaaggcacaggatcaaacc

SEQ ID NO: 437297 - DNA, 25 bp, Mus musculus
gagagccatcggagatactgccaag

SEQ ID NO: 437298 - DNA, 25 bp, Mus musculus
gagagccatctgaagccaactgaga

SEQ ID NO: 437299 - DNA, 25 bp, Mus musculus
gagagcccaattgcctgctccaatg

SEQ ID NO: 437300 - DNA, 25 bp, Mus musculus
gagagcccagggactattggtcact

SEQ ID NO: 437301 - DNA, 25 bp, Mus musculus
gagagcccatgcatcttcgcgctaa

SEQ ID NO: 437302 - DNA, 25 bp, Mus musculus
gagagccccgtctccattagagagg

SEQ ID NO: 437303 - DNA, 25 bp, Mus musculus
gagagcccctgaggttccagtggac

SEQ ID NO: 437304 - DNA, 25 bp, Mus musculus
gagagccctccgagttatgctagaa

SEQ ID NO: 437305 - DNA, 25 bp, Mus musculus
gagagccctctgtttcttccctgaa

SEQ ID NO: 437306 - DNA, 25 bp, Mus musculus
gagagccctgcttcctctcaaaggg

SEQ ID NO: 437307 - DNA, 25 bp, Mus musculus
gagagccctgttgaagcctttccct

SEQ ID NO: 437308 - DNA, 25 bp, Mus musculus
gagagccctttgatagcagacttgg

SEQ ID NO: 437309 - DNA, 25 bp, Mus musculus
gagagccctttgttgctaacattag

SEQ ID NO: 437310 - DNA, 25 bp, Mus musculus
gagagccgaaaggacatggttatgt

SEQ ID NO: 437311 - DNA, 25 bp, Mus musculus
gagagccgcaagaagcctagtcatt

SEQ ID NO: 437312 - DNA, 25 bp, Mus musculus
gagagccgggcttctaacagagcag

SEQ ID NO: 437313 - DNA, 25 bp, Mus musculus
gagagccgtttcatgcgtatcccca

SEQ ID NO: 437314 - DNA, 25 bp, Mus musculus
gagagccgttttatctcgtacccaa

SEQ ID NO: 437315 - DNA, 25 bp, Mus musculus
gagagcctcaccagggagctgaaag

SEQ ID NO: 437316 - DNA, 25 bp, Mus musculus
gagagcctcactggtttcctggaca

SEQ ID NO: 437317 - DNA, 25 bp, Mus musculus
gagagcctccgaattctgacatgca

SEQ ID NO: 437318 - DNA, 25 bp, Mus musculus
gagagcctcggaaacgccgctgccg

SEQ ID NO: 437319 - DNA, 25 bp, Mus musculus
gagagcctcttggtgtccctggtga

SEQ ID NO: 437320 - DNA, 25 bp, Mus musculus
gagagcctgctcaagaaactgggag

SEQ ID NO: 437321 - DNA, 25 bp, Mus musculus
gagagcctgctctgttgctgatctg

SEQ ID NO: 437322 - DNA, 25 bp, Mus musculus
gagagcctgtcagccatcgaggcag

SEQ ID NO: 437323 - DNA, 25 bp, Mus musculus
gagagcctgtccagtatgtgcgccg

SEQ ID NO: 437324 - DNA, 25 bp, Mus musculus
gagagccttctccagcgtttgcaaa

SEQ ID NO: 437325 - DNA, 25 bp, Mus musculus
gagagcctttggaatatcaggttgg

SEQ ID NO: 437326 - DNA, 25 bp, Mus musculus
gagagcgagcgcatcgtgatcaacg

SEQ ID NO: 437327 - DNA, 25 bp, Mus musculus
gagagcgaggtctacaaatgtgcca

SEQ ID NO: 437328 - DNA, 25 bp, Mus musculus
gagagcgcagctttaaccggcagta

SEQ ID NO: 437329 - DNA, 25 bp, Mus musculus
gagagcgccctgacgggacatgttt

SEQ ID NO: 437330 - DNA, 25 bp, Mus musculus
gagagcgctcacagtcatcatgcag

SEQ ID NO: 437331 - DNA, 25 bp, Mus musculus
gagagcgctcactgaccgagaaggt

SEQ ID NO: 437332 - DNA, 25 bp, Mus musculus
gagagcgcttctgttctgcagcaga

SEQ ID NO: 437333 - DNA, 25 bp, Mus musculus
gagagcgctttggaacatacatgga

SEQ ID NO: 437334 - DNA, 25 bp, Mus musculus
gagagcggactagcagctgcttgaa

SEQ ID NO: 437335 - DNA, 25 bp, Mus musculus
gagagcgtcacttttgcccaggaca

SEQ ID NO: 437336 - DNA, 25 bp, Mus musculus
gagagcgtcattttaccctgccagg

SEQ ID NO: 437337 - DNA, 25 bp, Mus musculus
gagagcgtgctcttcaacctgacca

SEQ ID NO: 437338 - DNA, 25 bp, Mus musculus
gagagctaagcggagcatcacgtat

SEQ ID NO: 437339 - DNA, 25 bp, Mus musculus
gagagctagctttggacacggagac

SEQ ID NO: 437340 - DNA, 25 bp, Mus musculus
gagagctagtacaaggccacagcac

SEQ ID NO: 437341 - DNA, 25 bp, Mus musculus
gagagctcagccaccactttgaagg

SEQ ID NO: 437342 - DNA, 25 bp, Mus musculus
gagagctcggagagagtatcctact

SEQ ID NO: 437343 - DNA, 25 bp, Mus musculus
gagagctcgtcagttccttgggata

SEQ ID NO: 437344 - DNA, 25 bp, Mus musculus
gagagctctagccttggcctcagtg

SEQ ID NO: 437345 - DNA, 25 bp, Mus musculus
gagagctctcagatgcactgggcca

SEQ ID NO: 437346 - DNA, 25 bp, Mus musculus
gagagctcttacagccggaccgcta

SEQ ID NO: 437347 - DNA, 25 bp, Mus musculus
gagagctgagcttcaatttcctgtt

SEQ ID NO: 437348 - DNA, 25 bp, Mus musculus
gagagctgatcctggtgagccctgc

SEQ ID NO: 437349 - DNA, 25 bp, Mus musculus
gagagctgcacccttctgtaaacac

SEQ ID NO: 437350 - DNA, 25 bp, Mus musculus
gagagctgctccaggcctatggtga

SEQ ID NO: 437351 - DNA, 25 bp, Mus musculus
gagagctgggagactaaaatattct

SEQ ID NO: 437352 - DNA, 25 bp, Mus musculus
gagagctgtatcttgatgacggcca

SEQ ID NO: 437353 - DNA, 25 bp, Mus musculus
gagagcttccgcatgtacagcaagg

SEQ ID NO: 437354 - DNA, 25 bp, Mus musculus
gagagcttcgacaacatcctggact

SEQ ID NO: 437355 - DNA, 25 bp, Mus musculus
gagagcttgcccaattccgtgaaat

SEQ ID NO: 437356 - DNA, 25 bp, Mus musculus
gagaggaaaagagccggcttaccag

SEQ ID NO: 437357 - DNA, 25 bp, Mus musculus
gagaggaaccatagaagtgtgaaca

SEQ ID NO: 437358 - DNA, 25 bp, Mus musculus
gagaggaacccatctactgccttag

SEQ ID NO: 437359 - DNA, 25 bp, Mus musculus
gagaggaaccgcctgctaccgactt

SEQ ID NO: 437360 - DNA, 25 bp, Mus musculus
gagaggaacctctttatccaacaga

SEQ ID NO: 437361 - DNA, 25 bp, Mus musculus
gagaggacagacactttgtcagact

SEQ ID NO: 437362 - DNA, 25 bp, Mus musculus
gagaggactatgtagcatttatcac

SEQ ID NO: 437363 - DNA, 25 bp, Mus musculus
gagaggacttcctgttgcagcgaag

SEQ ID NO: 437364 - DNA, 25 bp, Mus musculus
gagaggagaaaatcggagaataagc

SEQ ID NO: 437365 - DNA, 25 bp, Mus musculus
gagaggagacttcacagaggatacc

SEQ ID NO: 437366 - DNA, 25 bp, Mus musculus
gagaggagcctcagcagccatattt

SEQ ID NO: 437367 - DNA, 25 bp, Mus musculus
gagaggagctctacgtgatcgacga

SEQ ID NO: 437368 - DNA, 25 bp, Mus musculus
gagaggaggaattccgctccagagt

SEQ ID NO: 437369 - DNA, 25 bp, Mus musculus
gagaggaggcggaattctttccccg

SEQ ID NO: 437370 - DNA, 25 bp, Mus musculus
gagaggaggtccttcccgagaagtt

SEQ ID NO: 437371 - DNA, 25 bp, Mus musculus
gagaggagtcaacttctgtttagga

SEQ ID NO: 437372 - DNA, 25 bp, Mus musculus
gagaggagtccttttttgtgccaaa

SEQ ID NO: 437373 - DNA, 25 bp, Mus musculus
gagaggagttcttcattcagccagc

SEQ ID NO: 437374 - DNA, 25 bp, Mus musculus
gagaggatcaagctttctccccgca

SEQ ID NO: 437375 - DNA, 25 bp, Mus musculus
gagaggatcatcacgctgactgggc

SEQ ID NO: 437376 - DNA, 25 bp, Mus musculus
gagaggatcccattgtcccagaaca

SEQ ID NO: 437377 - DNA, 25 bp, Mus musculus
gagaggatccttctccacgaagatt

SEQ ID NO: 437378 - DNA, 25 bp, Mus musculus
gagaggatcgaatactgcacccagg

SEQ ID NO: 437379 - DNA, 25 bp, Mus musculus
gagaggatgattgctcacaaacaga

SEQ ID NO: 437380 - DNA, 25 bp, Mus musculus
gagaggattccccaatgtaaggtag

SEQ ID NO: 437381 - DNA, 25 bp, Mus musculus
gagaggattctatccggcggcagtc

SEQ ID NO: 437382 - DNA, 25 bp, Mus musculus
gagaggcaagccagatactattaaa

SEQ ID NO: 437383 - DNA, 25 bp, Mus musculus
gagaggcacattgcacggagcagct

SEQ ID NO: 437384 - DNA, 25 bp, Mus musculus
gagaggcactggtgacatgtatgtc

SEQ ID NO: 437385 - DNA, 25 bp, Mus musculus
gagaggcatgttactgagtgtccaa

SEQ ID NO: 437386 - DNA, 25 bp, Mus musculus
gagaggccagaattacagctaagga

SEQ ID NO: 437387 - DNA, 25 bp, Mus musculus
gagaggccagatccagttacgacat

SEQ ID NO: 437388 - DNA, 25 bp, Mus musculus
gagaggcccgtgtcctatgtgcaga

SEQ ID NO: 437389 - DNA, 25 bp, Mus musculus
gagaggccgcatccaagacttgtac

SEQ ID NO: 437390 - DNA, 25 bp, Mus musculus
gagaggccggtttctactggagaac

SEQ ID NO: 437391 - DNA, 25 bp, Mus musculus
gagaggcctctctggaagttgtccc

SEQ ID NO: 437392 - DNA, 25 bp, Mus musculus
gagaggcctgcgatgactacaagct

SEQ ID NO: 437393 - DNA, 25 bp, Mus musculus
gagaggccttgacttcttccagacg

SEQ ID NO: 437394 - DNA, 25 bp, Mus musculus
gagaggcctttacctatgagcgccg

SEQ ID NO: 437395 - DNA, 25 bp, Mus musculus
gagaggctcaggctactatgaccaa

SEQ ID NO: 437396 - DNA, 25 bp, Mus musculus
gagaggctccatccaagtagacggt

SEQ ID NO: 437397 - DNA, 25 bp, Mus musculus
gagaggctctaccaggaacaggact

SEQ ID NO: 437398 - DNA, 25 bp, Mus musculus
gagaggctgctaagaagctcctccg

SEQ ID NO: 437399 - DNA, 25 bp, Mus musculus
gagaggctggatgaactacaggaca

SEQ ID NO: 437400 - DNA, 25 bp, Mus musculus
gagaggctgtacttggaccacaaca

SEQ ID NO: 437401 - DNA, 25 bp, Mus musculus
gagagggaaggagcaacacttaacc

SEQ ID NO: 437402 - DNA, 25 bp, Mus musculus
gagagggaccagtcctcagaaaggt

SEQ ID NO: 437403 - DNA, 25 bp, Mus musculus
gagagggacgccatcagatccatgc

SEQ ID NO: 437404 - DNA, 25 bp, Mus musculus
gagagggagcatgtgtaacagcctc

SEQ ID NO: 437405 - DNA, 25 bp, Mus musculus
gagagggaggaatgtactcatcaca

SEQ ID NO: 437406 - DNA, 25 bp, Mus musculus
gagagggatcctgacgctgaagtat

SEQ ID NO: 437407 - DNA, 25 bp, Mus musculus
gagagggcctgcgtgtttctattcc

SEQ ID NO: 437408 - DNA, 25 bp, Mus musculus
gagaggtactctctgtatgaggaca

SEQ ID NO: 437409 - DNA, 25 bp, Mus musculus
gagaggtaggcgtcacccagtatct

SEQ ID NO: 437410 - DNA, 25 bp, Mus musculus
gagaggtcagaacccttcaaggcaa

SEQ ID NO: 437411 - DNA, 25 bp, Mus musculus
gagaggtcatttcaagtgagtactt

SEQ ID NO: 437412 - DNA, 25 bp, Mus musculus
gagaggtccattctgctcaaaggaa

SEQ ID NO: 437413 - DNA, 25 bp, Mus musculus
gagaggtctacacaagcagtgctag

SEQ ID NO: 437414 - DNA, 25 bp, Mus musculus
gagaggtctacacctgtcacgtgga

SEQ ID NO: 437415 - DNA, 25 bp, Mus musculus
gagaggtctatcctagcctggcaaa

SEQ ID NO: 437416 - DNA, 25 bp, Mus musculus
gagaggttccgcatcttcagggcag

SEQ ID NO: 437417 - DNA, 25 bp, Mus musculus
gagagtaacgcatccagagggtcaa

SEQ ID NO: 437418 - DNA, 25 bp, Mus musculus
gagagtacggctacgtgggtcaacc

SEQ ID NO: 437419 - DNA, 25 bp, Mus musculus
gagagtactggcgactacttcgcaa

SEQ ID NO: 437420 - DNA, 25 bp, Mus musculus
gagagtactgtgtccttagtcacaa

SEQ ID NO: 437421 - DNA, 25 bp, Mus musculus
gagagtacttgcagaggcaggaccc

SEQ ID NO: 437422 - DNA, 25 bp, Mus musculus
gagagtagagtaagccccaatttta

SEQ ID NO: 437423 - DNA, 25 bp, Mus musculus
gagagtagtacaacaaaacttctga

SEQ ID NO: 437424 - DNA, 25 bp, Mus musculus
gagagtatacctgtctggcgggcaa

SEQ ID NO: 437425 - DNA, 25 bp, Mus musculus
gagagtattactgcgaagcccggaa

SEQ ID NO: 437426 - DNA, 25 bp, Mus musculus
gagagtatttctagtcaatggcatg

SEQ ID NO: 437427 - DNA, 25 bp, Mus musculus
gagagtcaagcgttccctcacgaga

SEQ ID NO: 437428 - DNA, 25 bp, Mus musculus
gagagtcactacttccacagcgtgg

SEQ ID NO: 437429 - DNA, 25 bp, Mus musculus
gagagtcattggaaaccttccagga

SEQ ID NO: 437430 - DNA, 25 bp, Mus musculus
gagagtcattggaggcctcctcgca

SEQ ID NO: 437431 - DNA, 25 bp, Mus musculus
gagagtccaaaggtttgaccccagt

SEQ ID NO: 437432 - DNA, 25 bp, Mus musculus
gagagtccactgaaattcggtaccg

SEQ ID NO: 437433 - DNA, 25 bp, Mus musculus
gagagtccagcacctcacattggag

SEQ ID NO: 437434 - DNA, 25 bp, Mus musculus
gagagtcctcctattagttcagaag

SEQ ID NO: 437435 - DNA, 25 bp, Mus musculus
gagagtcggctttctggtaaatcgc

SEQ ID NO: 437436 - DNA, 25 bp, Mus musculus
gagagtcgtctcttacctttgggag

SEQ ID NO: 437437 - DNA, 25 bp, Mus musculus
gagagtctactcttggtcttctcca

SEQ ID NO: 437438 - DNA, 25 bp, Mus musculus
gagagtctccactgtccctagctga

SEQ ID NO: 437439 - DNA, 25 bp, Mus musculus
gagagtctgacatctgcccaaaagg

SEQ ID NO: 437440 - DNA, 25 bp, Mus musculus
gagagtctgccacctatcagcagga

SEQ ID NO: 437441 - DNA, 25 bp, Mus musculus
gagagtctgggctgaaaatctgaaa

SEQ ID NO: 437442 - DNA, 25 bp, Mus musculus
gagagtctgtcctccattgttgata

SEQ ID NO: 437443 - DNA, 25 bp, Mus musculus
gagagtcttcaatcaggcagctgga

SEQ ID NO: 437444 - DNA, 25 bp, Mus musculus
gagagtcttctctatccaaaggcag

SEQ ID NO: 437445 - DNA, 25 bp, Mus musculus
gagagtgaacccagaaggaatccac

SEQ ID NO: 437446 - DNA, 25 bp, Mus musculus
gagagtgaaggatccgctgttgccc

SEQ ID NO: 437447 - DNA, 25 bp, Mus musculus
gagagtgacctccattgcagaccgg

SEQ ID NO: 437448 - DNA, 25 bp, Mus musculus
gagagtgacctctgccttctcggaa

SEQ ID NO: 437449 - DNA, 25 bp, Mus musculus
gagagtgagcattgtgtgttagtaa

SEQ ID NO: 437450 - DNA, 25 bp, Mus musculus
gagagtgctccggttaatccggtag

SEQ ID NO: 437451 - DNA, 25 bp, Mus musculus
gagagtgctcgtcctgtcaagttcc

SEQ ID NO: 437452 - DNA, 25 bp, Mus musculus
gagagtggaggtatacccagtgccc

SEQ ID NO: 437453 - DNA, 25 bp, Mus musculus
gagagtggccctactggccaggaca

SEQ ID NO: 437454 - DNA, 25 bp, Mus musculus
gagagtggctctgcattaagctgaa

SEQ ID NO: 437455 - DNA, 25 bp, Mus musculus
gagagtgtccactcttcgcaatgag

SEQ ID NO: 437456 - DNA, 25 bp, Mus musculus
gagagtgttgctgtttcgcagaccc

SEQ ID NO: 437457 - DNA, 25 bp, Mus musculus
gagagttaccactccttcatgtgga

SEQ ID NO: 437458 - DNA, 25 bp, Mus musculus
gagagttactgctttgttcacggcc

SEQ ID NO: 437459 - DNA, 25 bp, Mus musculus
gagagttatcaacaggtccttggaa

SEQ ID NO: 437460 - DNA, 25 bp, Mus musculus
gagagttcaaccaggaggcatcagg

SEQ ID NO: 437461 - DNA, 25 bp, Mus musculus
gagagttcaccacctcctcactgtg

SEQ ID NO: 437462 - DNA, 25 bp, Mus musculus
gagagttcatctgtgccctgtccat

SEQ ID NO: 437463 - DNA, 25 bp, Mus musculus
gagagttccgcatatggaggcgccc

SEQ ID NO: 437464 - DNA, 25 bp, Mus musculus
gagagttcgcctccaacatgtacct

SEQ ID NO: 437465 - DNA, 25 bp, Mus musculus
gagagttgcaactgcgcagaccaga

SEQ ID NO: 437466 - DNA, 25 bp, Mus musculus
gagagttggctctgactcaagagac

SEQ ID NO: 437467 - DNA, 25 bp, Mus musculus
gagagttgtaacagcacatgtccaa

SEQ ID NO: 437468 - DNA, 25 bp, Mus musculus
gagagtttatctccccacaagatga

SEQ ID NO: 437469 - DNA, 25 bp, Mus musculus
gagagtttctatctctacctaacaa

SEQ ID NO: 437470 - DNA, 25 bp, Mus musculus
gagagtttgtgccttcccgagatga

SEQ ID NO: 437471 - DNA, 25 bp, Mus musculus
gagataaaacactggaaccatccgc

SEQ ID NO: 437472 - DNA, 25 bp, Mus musculus
gagataaaaggaccaacgcagcgct

SEQ ID NO: 437473 - DNA, 25 bp, Mus musculus
gagataacaactagtctcccgctgg

SEQ ID NO: 437474 - DNA, 25 bp, Mus musculus
gagataacccagactctccatggca

SEQ ID NO: 437475 - DNA, 25 bp, Mus musculus
gagataacccttctgagctgtgctg

SEQ ID NO: 437476 - DNA, 25 bp, Mus musculus
gagataactcttcgctgcccttggt

SEQ ID NO: 437477 - DNA, 25 bp, Mus musculus
gagataagcccctgagtgctctgga

SEQ ID NO: 437478 - DNA, 25 bp, Mus musculus
gagataagctttcatcatgcctctg

SEQ ID NO: 437479 - DNA, 25 bp, Mus musculus
gagataagggaaggcatggcacaca

SEQ ID NO: 437480 - DNA, 25 bp, Mus musculus
gagataagtgggagtttacagccag

SEQ ID NO: 437481 - DNA, 25 bp, Mus musculus
gagataataacagaggagccttccg

SEQ ID NO: 437482 - DNA, 25 bp, Mus musculus
gagataattaacagcacccaggccc

SEQ ID NO: 437483 - DNA, 25 bp, Mus musculus
gagataattcctctgctgagaaggg

SEQ ID NO: 437484 - DNA, 25 bp, Mus musculus
gagatacaaacggtcagtaaacact

SEQ ID NO: 437485 - DNA, 25 bp, Mus musculus
gagatacatgacctagagcagacca

SEQ ID NO: 437486 - DNA, 25 bp, Mus musculus
gagataccacatggatcaccaccgg

SEQ ID NO: 437487 - DNA, 25 bp, Mus musculus
gagatactgctacttgctgcgccaa

SEQ ID NO: 437488 - DNA, 25 bp, Mus musculus
gagatactgtcctcgaagggcatcg

SEQ ID NO: 437489 - DNA, 25 bp, Mus musculus
gagatagctctcagtgcccgtctga

SEQ ID NO: 437490 - DNA, 25 bp, Mus musculus
gagataggtatcgtgcagcccaggc

SEQ ID NO: 437491 - DNA, 25 bp, Mus musculus
gagatatagcttctaaaatcaccac

SEQ ID NO: 437492 - DNA, 25 bp, Mus musculus
gagatatatcgtactgccagctgcc

SEQ ID NO: 437493 - DNA, 25 bp, Mus musculus
gagatatccccgtgctactgatggg

SEQ ID NO: 437494 - DNA, 25 bp, Mus musculus
gagatattctactgctaaagccttg

SEQ ID NO: 437495 - DNA, 25 bp, Mus musculus
gagatattggagtccttaagcccca

SEQ ID NO: 437496 - DNA, 25 bp, Mus musculus
gagatatttgtcattaatcctggac

SEQ ID NO: 437497 - DNA, 25 bp, Mus musculus
gagatcaagttttcattgtaatcac

SEQ ID NO: 437498 - DNA, 25 bp, Mus musculus
gagatcaatcttcaacatacaaaca

SEQ ID NO: 437499 - DNA, 25 bp, Mus musculus
gagatcacaaagcaacaagccaagg

SEQ ID NO: 437500 - DNA, 25 bp, Mus musculus
gagatcaccagtttgtaccgacagc

SEQ ID NO: 437501 - DNA, 25 bp, Mus musculus
gagatcaccttcgagtgcatcgagg

SEQ ID NO: 437502 - DNA, 25 bp, Mus musculus
gagatcacctttccagcaagcagtg

SEQ ID NO: 437503 - DNA, 25 bp, Mus musculus
gagatcacgactttgaggtcttgcc

SEQ ID NO: 437504 - DNA, 25 bp, Mus musculus
gagatcactggtttaagatcacgca

SEQ ID NO: 437505 - DNA, 25 bp, Mus musculus
gagatcagagagtaggcgcttgctt

SEQ ID NO: 437506 - DNA, 25 bp, Mus musculus
gagatcagcaccacaaggtctttgg

SEQ ID NO: 437507 - DNA, 25 bp, Mus musculus
gagatcagcctccaagaccagatgg

SEQ ID NO: 437508 - DNA, 25 bp, Mus musculus
gagatcagtatcactcgcgctctgg

SEQ ID NO: 437509 - DNA, 25 bp, Mus musculus
gagatcagtgttgtcccaaatcggg

SEQ ID NO: 437510 - DNA, 25 bp, Mus musculus
gagatcataattcggtaacacgtac

SEQ ID NO: 437511 - DNA, 25 bp, Mus musculus
gagatcatccgtgccagcgtctgta

SEQ ID NO: 437512 - DNA, 25 bp, Mus musculus
gagatcatcctcagtggcacacgaa

SEQ ID NO: 437513 - DNA, 25 bp, Mus musculus
gagatcatctgtgagcaggctgcca

SEQ ID NO: 437514 - DNA, 25 bp, Mus musculus
gagatcatggcattcgacggcacgt

SEQ ID NO: 437515 - DNA, 25 bp, Mus musculus
gagatcatggccgagaagaaccgga

SEQ ID NO: 437516 - DNA, 25 bp, Mus musculus
gagatcatgtcccttcgagctgctg

SEQ ID NO: 437517 - DNA, 25 bp, Mus musculus
gagatccacaatgtacgtgaggaac

SEQ ID NO: 437518 - DNA, 25 bp, Mus musculus
gagatccacacagccgaaatcagag

SEQ ID NO: 437519 - DNA, 25 bp, Mus musculus
gagatccagctcaccagggacttag

SEQ ID NO: 437520 - DNA, 25 bp, Mus musculus
gagatccatactgtgactcccgctg

SEQ ID NO: 437521 - DNA, 25 bp, Mus musculus
gagatcccacaccaagagtcaagag

SEQ ID NO: 437522 - DNA, 25 bp, Mus musculus
gagatcccaggtccagaatcagagg

SEQ ID NO: 437523 - DNA, 25 bp, Mus musculus
gagatcccattatgaccacggaggg

SEQ ID NO: 437524 - DNA, 25 bp, Mus musculus
gagatccccaaggtaggtgtttctc

SEQ ID NO: 437525 - DNA, 25 bp, Mus musculus
gagatccccagagcacaaataagaa

SEQ ID NO: 437526 - DNA, 25 bp, Mus musculus
gagatccccgaggattagatgcacg

SEQ ID NO: 437527 - DNA, 25 bp, Mus musculus
gagatcccgtctaaaactgcaaagg

SEQ ID NO: 437528 - DNA, 25 bp, Mus musculus
gagatccctatggaggtcttcgacc

SEQ ID NO: 437529 - DNA, 25 bp, Mus musculus
gagatccctcaactgctggacgctg

SEQ ID NO: 437530 - DNA, 25 bp, Mus musculus
gagatccgcatggaagctgctcgca

SEQ ID NO: 437531 - DNA, 25 bp, Mus musculus
gagatcctgtgtatctgctttcaat

SEQ ID NO: 437532 - DNA, 25 bp, Mus musculus
gagatcctttactgacacctcatgg

SEQ ID NO: 437533 - DNA, 25 bp, Mus musculus
gagatcgaccttcacaatgcttggc

SEQ ID NO: 437534 - DNA, 25 bp, Mus musculus
gagatcgactttaccgggctcggaa

SEQ ID NO: 437535 - DNA, 25 bp, Mus musculus
gagatcgactttgtccagcccgaag

SEQ ID NO: 437536 - DNA, 25 bp, Mus musculus
gagatcgagtttgcccacatgtaca

SEQ ID NO: 437537 - DNA, 25 bp, Mus musculus
gagatcggaagttgcgcaatcggct

SEQ ID NO: 437538 - DNA, 25 bp, Mus musculus
gagatcgtatcctccatcagccagg

SEQ ID NO: 437539 - DNA, 25 bp, Mus musculus
gagatcgtgcccatctgcttcacgg

SEQ ID NO: 437540 - DNA, 25 bp, Mus musculus
gagatctactccctcaatgtgctag

SEQ ID NO: 437541 - DNA, 25 bp, Mus musculus
gagatctaggtgttccaggcccatt

SEQ ID NO: 437542 - DNA, 25 bp, Mus musculus
gagatctcaattcaccgcagcctag

SEQ ID NO: 437543 - DNA, 25 bp, Mus musculus
gagatctcatacatgttaaagcagg

SEQ ID NO: 437544 - DNA, 25 bp, Mus musculus
gagatctccaagaggctgggcaagc

SEQ ID NO: 437545 - DNA, 25 bp, Mus musculus
gagatctctataactacttctcaag

SEQ ID NO: 437546 - DNA, 25 bp, Mus musculus
gagatctgaccctgaaacctggata

SEQ ID NO: 437547 - DNA, 25 bp, Mus musculus
gagatctgatcaacctgaagccagt

SEQ ID NO: 437548 - DNA, 25 bp, Mus musculus
gagatctggctcctacaggcatccg

SEQ ID NO: 437549 - DNA, 25 bp, Mus musculus
gagatctgtcatgtgttattaataa

SEQ ID NO: 437550 - DNA, 25 bp, Mus musculus
gagatctgtccccacacaggagtga

SEQ ID NO: 437551 - DNA, 25 bp, Mus musculus
gagatctgtgacttccccaggagac

SEQ ID NO: 437552 - DNA, 25 bp, Mus musculus
gagatctgtgtcacccgcagggata

SEQ ID NO: 437553 - DNA, 25 bp, Mus musculus
gagatcttcaacgagctccggcttg

SEQ ID NO: 437554 - DNA, 25 bp, Mus musculus
gagatcttccggcacttacagacaa

SEQ ID NO: 437555 - DNA, 25 bp, Mus musculus
gagatcttcctgaccacgcctagga

SEQ ID NO: 437556 - DNA, 25 bp, Mus musculus
gagatcttccttgtgaccctgaaag

SEQ ID NO: 437557 - DNA, 25 bp, Mus musculus
gagatctttgaaggcgcaccagtgc

SEQ ID NO: 437558 - DNA, 25 bp, Mus musculus
gagatgaaatacaccagcgagggcg

SEQ ID NO: 437559 - DNA, 25 bp, Mus musculus
gagatgaaccccaacagatgtccgt

SEQ ID NO: 437560 - DNA, 25 bp, Mus musculus
gagatgacaccaaccagattcgctg

SEQ ID NO: 437561 - DNA, 25 bp, Mus musculus
gagatgacatctgatgagggtgaca

SEQ ID NO: 437562 - DNA, 25 bp, Mus musculus
gagatgacctcatgcgctgtgtgga

SEQ ID NO: 437563 - DNA, 25 bp, Mus musculus
gagatgacggcttggcagttgtaaa

SEQ ID NO: 437564 - DNA, 25 bp, Mus musculus
gagatgacgtgtatgctctacctgg

SEQ ID NO: 437565 - DNA, 25 bp, Mus musculus
gagatgactcactcactccgtgtgt

SEQ ID NO: 437566 - DNA, 25 bp, Mus musculus
gagatgactgcagtctagcgttgga

SEQ ID NO: 437567 - DNA, 25 bp, Mus musculus
gagatgactggaacccatgctgtgg

SEQ ID NO: 437568 - DNA, 25 bp, Mus musculus
gagatgacttctagctggaccaaag

SEQ ID NO: 437569 - DNA, 25 bp, Mus musculus
gagatgagacttaccctctagccag

SEQ ID NO: 437570 - DNA, 25 bp, Mus musculus
gagatgagcatctccgtcttcatgc

SEQ ID NO: 437571 - DNA, 25 bp, Mus musculus
gagatgagccgtgtgtccatccgca

SEQ ID NO: 437572 - DNA, 25 bp, Mus musculus
gagatgagctctttggatccacaga

SEQ ID NO: 437573 - DNA, 25 bp, Mus musculus
gagatgagctggagcagatccgtcc

SEQ ID NO: 437574 - DNA, 25 bp, Mus musculus
gagatgagctttttgccctggccag

SEQ ID NO: 437575 - DNA, 25 bp, Mus musculus
gagatgatcattcagctcctggcca

SEQ ID NO: 437576 - DNA, 25 bp, Mus musculus
gagatgatccggcaactagaacaga

SEQ ID NO: 437577 - DNA, 25 bp, Mus musculus
gagatgatctacacctggaccaaag

SEQ ID NO: 437578 - DNA, 25 bp, Mus musculus
gagatgatgagtcacgtgaagccca

SEQ ID NO: 437579 - DNA, 25 bp, Mus musculus
gagatgatgctcacaccttacggcg

SEQ ID NO: 437580 - DNA, 25 bp, Mus musculus
gagatgatggacacagaaatgcagc

SEQ ID NO: 437581 - DNA, 25 bp, Mus musculus
gagatgattcttctttcctacatta

SEQ ID NO: 437582 - DNA, 25 bp, Mus musculus
gagatgcagctccttttgccataga

SEQ ID NO: 437583 - DNA, 25 bp, Mus musculus
gagatgcatattatcacaacggtcc

SEQ ID NO: 437584 - DNA, 25 bp, Mus musculus
gagatgcatcaggtcttccgggagc

SEQ ID NO: 437585 - DNA, 25 bp, Mus musculus
gagatgcccatttcgacgacgacga

SEQ ID NO: 437586 - DNA, 25 bp, Mus musculus
gagatgccccttgccgtgaagttca

SEQ ID NO: 437587 - DNA, 25 bp, Mus musculus
gagatgccctgacgatcctccaggt

SEQ ID NO: 437588 - DNA, 25 bp, Mus musculus
gagatgcctactctactgttctggg

SEQ ID NO: 437589 - DNA, 25 bp, Mus musculus
gagatgcctcccacttctggctgga

SEQ ID NO: 437590 - DNA, 25 bp, Mus musculus
gagatgcctctattctccgtgatga

SEQ ID NO: 437591 - DNA, 25 bp, Mus musculus
gagatgcctgcggaatgatcgcccc

SEQ ID NO: 437592 - DNA, 25 bp, Mus musculus
gagatgcgagttttcacgaggagat

SEQ ID NO: 437593 - DNA, 25 bp, Mus musculus
gagatgcgcagtgaaagtgaaccct

SEQ ID NO: 437594 - DNA, 25 bp, Mus musculus
gagatgcgctccatcattctgacag

SEQ ID NO: 437595 - DNA, 25 bp, Mus musculus
gagatgctacaaaggcccaaggcta

SEQ ID NO: 437596 - DNA, 25 bp, Mus musculus
gagatgctactgtgtaacgcttgag

SEQ ID NO: 437597 - DNA, 25 bp, Mus musculus
gagatgctcaacagccagcaggtgc

SEQ ID NO: 437598 - DNA, 25 bp, Mus musculus
gagatgctcctcaaactgtacggcc

SEQ ID NO: 437599 - DNA, 25 bp, Mus musculus
gagatgctcgacatagtggacgcca

SEQ ID NO: 437600 - DNA, 25 bp, Mus musculus
gagatgctgactttggccctgcaaa

SEQ ID NO: 437601 - DNA, 25 bp, Mus musculus
gagatgctgcacgttctgacaaggg

SEQ ID NO: 437602 - DNA, 25 bp, Mus musculus
gagatgctgcatgcgtgtcttcccc

SEQ ID NO: 437603 - DNA, 25 bp, Mus musculus
gagatgctgctttcccactcagaag

SEQ ID NO: 437604 - DNA, 25 bp, Mus musculus
gagatgctggatctaccatctgcag

SEQ ID NO: 437605 - DNA, 25 bp, Mus musculus
gagatgctttatccctccgctgaga

SEQ ID NO: 437606 - DNA, 25 bp, Mus musculus
gagatgctttgactgactctaagac

SEQ ID NO: 437607 - DNA, 25 bp, Mus musculus
gagatggaaccctaacctcagcctg

SEQ ID NO: 437608 - DNA, 25 bp, Mus musculus
gagatggaagacacggcactccttg

SEQ ID NO: 437609 - DNA, 25 bp, Mus musculus
gagatggatcacttgcagggctgct

SEQ ID NO: 437610 - DNA, 25 bp, Mus musculus
gagatggcaacttcggccctggtcc

SEQ ID NO: 437611 - DNA, 25 bp, Mus musculus
gagatggcaccattcccagaattac

SEQ ID NO: 437612 - DNA, 25 bp, Mus musculus
gagatggcatcggtgcatggtccac

SEQ ID NO: 437613 - DNA, 25 bp, Mus musculus
gagatggccacatccttaggagaca

SEQ ID NO: 437614 - DNA, 25 bp, Mus musculus
gagatggccactaaacagtcgctgg

SEQ ID NO: 437615 - DNA, 25 bp, Mus musculus
gagatggccgctttgcagacatgga

SEQ ID NO: 437616 - DNA, 25 bp, Mus musculus
gagatggcctctgcttgttccagac

SEQ ID NO: 437617 - DNA, 25 bp, Mus musculus
gagatgggacgagtctcctaggaaa

SEQ ID NO: 437618 - DNA, 25 bp, Mus musculus
gagatggtcccagctcttcttgcaa

SEQ ID NO: 437619 - DNA, 25 bp, Mus musculus
gagatggtcctaactcctgcagagc

SEQ ID NO: 437620 - DNA, 25 bp, Mus musculus
gagatggtcctatgtgtcgcccaga

SEQ ID NO: 437621 - DNA, 25 bp, Mus musculus
gagatgtactacacgcaaggatcgg

SEQ ID NO: 437622 - DNA, 25 bp, Mus musculus
gagatgtagaacgagatttcggcaa

SEQ ID NO: 437623 - DNA, 25 bp, Mus musculus
gagatgtaggctgcaaattgacccg

SEQ ID NO: 437624 - DNA, 25 bp, Mus musculus
gagatgtcaccagttcctgaagcaa

SEQ ID NO: 437625 - DNA, 25 bp, Mus musculus
gagatgtccaggaggcctttgcaca

SEQ ID NO: 437626 - DNA, 25 bp, Mus musculus
gagatgtccctgaacccagatacgg

SEQ ID NO: 437627 - DNA, 25 bp, Mus musculus
gagatgtccggaaactcttgaggcc

SEQ ID NO: 437628 - DNA, 25 bp, Mus musculus
gagatgtctcctttggccccagtaa

SEQ ID NO: 437629 - DNA, 25 bp, Mus musculus
gagatgtgaagaaacctctacttac

SEQ ID NO: 437630 - DNA, 25 bp, Mus musculus
gagatgtgacactggaaaattatac

SEQ ID NO: 437631 - DNA, 25 bp, Mus musculus
gagatgtgaccgcaactactggtac

SEQ ID NO: 437632 - DNA, 25 bp, Mus musculus
gagatgtgatgaatagcccctacca

SEQ ID NO: 437633 - DNA, 25 bp, Mus musculus
gagatgttcaactcgcaccggctag

SEQ ID NO: 437634 - DNA, 25 bp, Mus musculus
gagatgttcacctatggccaggagc

SEQ ID NO: 437635 - DNA, 25 bp, Mus musculus
gagatgttccatttccgaggcccgt

SEQ ID NO: 437636 - DNA, 25 bp, Mus musculus
gagatgttctatgcctttccccggg

SEQ ID NO: 437637 - DNA, 25 bp, Mus musculus
gagatgttgcctctgcacggttctg

SEQ ID NO: 437638 - DNA, 25 bp, Mus musculus
gagatgttggtgctctagctcctag

SEQ ID NO: 437639 - DNA, 25 bp, Mus musculus
gagatgtttcgtccagcccaaagag

SEQ ID NO: 437640 - DNA, 25 bp, Mus musculus
gagatgtttctagaacggccccgag

SEQ ID NO: 437641 - DNA, 25 bp, Mus musculus
gagatgtttgcctttcttacataca

SEQ ID NO: 437642 - DNA, 25 bp, Mus musculus
gagatgtttttaagcctggccccgg

SEQ ID NO: 437643 - DNA, 25 bp, Mus musculus
gagattaaaaagtaggatttccagc

SEQ ID NO: 437644 - DNA, 25 bp, Mus musculus
gagattaactaaagccggcatgcca

SEQ ID NO: 437645 - DNA, 25 bp, Mus musculus
gagattaccaggtgagaaggcccct

SEQ ID NO: 437646 - DNA, 25 bp, Mus musculus
gagattacctgaacttgaccttggg

SEQ ID NO: 437647 - DNA, 25 bp, Mus musculus
gagattagaacagtgaccgtggtgt

SEQ ID NO: 437648 - DNA, 25 bp, Mus musculus
gagattagcaccacacgctccttag

SEQ ID NO: 437649 - DNA, 25 bp, Mus musculus
gagattagcataactccctttgcag

SEQ ID NO: 437650 - DNA, 25 bp, Mus musculus
gagattagctccttctccgcaaaag

SEQ ID NO: 437651 - DNA, 25 bp, Mus musculus
gagattattaacttcacctgccggg

SEQ ID NO: 437652 - DNA, 25 bp, Mus musculus
gagattcaaggcacaaaggatgctg

SEQ ID NO: 437653 - DNA, 25 bp, Mus musculus
gagattcagagcctgcaccaagagc

SEQ ID NO: 437654 - DNA, 25 bp, Mus musculus
gagattccagaatccgagcttgcag

SEQ ID NO: 437655 - DNA, 25 bp, Mus musculus
gagattcccggctgtactggtagga

SEQ ID NO: 437656 - DNA, 25 bp, Mus musculus
gagattcctcaacgaccctaagcat

SEQ ID NO: 437657 - DNA, 25 bp, Mus musculus
gagattcctcctaagtccatatgag

SEQ ID NO: 437658 - DNA, 25 bp, Mus musculus
gagattcgaatctgaccgggaccac

SEQ ID NO: 437659 - DNA, 25 bp, Mus musculus
gagattcgcgttcacttatgccagc

SEQ ID NO: 437660 - DNA, 25 bp, Mus musculus
gagattctatgacccctgcgaaggc

SEQ ID NO: 437661 - DNA, 25 bp, Mus musculus
gagattctcctgttgacccagagca

SEQ ID NO: 437662 - DNA, 25 bp, Mus musculus
gagattcttctggattgtgcggcga

SEQ ID NO: 437663 - DNA, 25 bp, Mus musculus
gagattcttgcccagacagcctcag

SEQ ID NO: 437664 - DNA, 25 bp, Mus musculus
gagattgaacatgccctgggacttg

SEQ ID NO: 437665 - DNA, 25 bp, Mus musculus
gagattgacatgaaacgacagcagc

SEQ ID NO: 437666 - DNA, 25 bp, Mus musculus
gagattgagatcttcggcgagccag

SEQ ID NO: 437667 - DNA, 25 bp, Mus musculus
gagattgcaagtcacttcagcagca

SEQ ID NO: 437668 - DNA, 25 bp, Mus musculus
gagattgcagacctcaacgtgcgca

SEQ ID NO: 437669 - DNA, 25 bp, Mus musculus
gagattgcccagttcctctgtgaca

SEQ ID NO: 437670 - DNA, 25 bp, Mus musculus
gagattgccgccaagcacgagaaaa

SEQ ID NO: 437671 - DNA, 25 bp, Mus musculus
gagattgctaacaccctctaccgga

SEQ ID NO: 437672 - DNA, 25 bp, Mus musculus
gagattggaagtcctgctaccgcca

SEQ ID NO: 437673 - DNA, 25 bp, Mus musculus
gagattggcagttacaccacgcaga

SEQ ID NO: 437674 - DNA, 25 bp, Mus musculus
gagattgggccaaagctgcctcact

SEQ ID NO: 437675 - DNA, 25 bp, Mus musculus
gagattgggtcacacacatgtagtc

SEQ ID NO: 437676 - DNA, 25 bp, Mus musculus
gagattgtacaagtcaccgtgggtc

SEQ ID NO: 437677 - DNA, 25 bp, Mus musculus
gagattgtcatagaggaacgcccca

SEQ ID NO: 437678 - DNA, 25 bp, Mus musculus
gagattgtcatgctgaaccctgcca

SEQ ID NO: 437679 - DNA, 25 bp, Mus musculus
gagattgtgccttgcctgagtgagc

SEQ ID NO: 437680 - DNA, 25 bp, Mus musculus
gagattgtgtctgaaccgtcctgct

SEQ ID NO: 437681 - DNA, 25 bp, Mus musculus
gagatttatccgtggtccccagcag

SEQ ID NO: 437682 - DNA, 25 bp, Mus musculus
gagatttcactgttccttacagaga

SEQ ID NO: 437683 - DNA, 25 bp, Mus musculus
gagatttccattccaaagccaacag

SEQ ID NO: 437684 - DNA, 25 bp, Mus musculus
gagatttccttcaaactgggcgtgg

SEQ ID NO: 437685 - DNA, 25 bp, Mus musculus
gagatttgaggtgttccagcccgga

SEQ ID NO: 437686 - DNA, 25 bp, Mus musculus
gagatttgcaaaacctgcccagcaa

SEQ ID NO: 437687 - DNA, 25 bp, Mus musculus
gagatttggccgcaaggatcacctg

SEQ ID NO: 437688 - DNA, 25 bp, Mus musculus
gagatttggtcagagaaaacagtac

SEQ ID NO: 437689 - DNA, 25 bp, Mus musculus
gagatttggttctggccttggactg

SEQ ID NO: 437690 - DNA, 25 bp, Mus musculus
gagattttaacaccagatacccgga

SEQ ID NO: 437691 - DNA, 25 bp, Mus musculus
gagattttcattcaaggcctagccc

SEQ ID NO: 437692 - DNA, 25 bp, Mus musculus
gagattttcgataagggccaggtcc

SEQ ID NO: 437693 - DNA, 25 bp, Mus musculus
gagcaaaaatgccttggcattcaag

SEQ ID NO: 437694 - DNA, 25 bp, Mus musculus
gagcaaaacagacatggctcatggc

SEQ ID NO: 437695 - DNA, 25 bp, Mus musculus
gagcaaaagttttacctctgcgagt

SEQ ID NO: 437696 - DNA, 25 bp, Mus musculus
gagcaaacagcttactgactgagca

SEQ ID NO: 437697 - DNA, 25 bp, Mus musculus
gagcaaacatctagcaccaaagtaa

SEQ ID NO: 437698 - DNA, 25 bp, Mus musculus
gagcaaaccacaatacaggccactg

SEQ ID NO: 437699 - DNA, 25 bp, Mus musculus
gagcaaaccatctggtccctgaggc

SEQ ID NO: 437700 - DNA, 25 bp, Mus musculus
gagcaaaccctagcatcacaaaatg

SEQ ID NO: 437701 - DNA, 25 bp, Mus musculus
gagcaaacggctacgagtgtgaact

SEQ ID NO: 437702 - DNA, 25 bp, Mus musculus
gagcaaacttttacgggagtcggag

SEQ ID NO: 437703 - DNA, 25 bp, Mus musculus
gagcaaagagcatccagaactgtcc

SEQ ID NO: 437704 - DNA, 25 bp, Mus musculus
gagcaaagcagccttgatctgagtg

SEQ ID NO: 437705 - DNA, 25 bp, Mus musculus
gagcaaagcaggacagatatggctg

SEQ ID NO: 437706 - DNA, 25 bp, Mus musculus
gagcaaataatgagccagcaccctg

SEQ ID NO: 437707 - DNA, 25 bp, Mus musculus
gagcaaatatgcagctaaccctggg

SEQ ID NO: 437708 - DNA, 25 bp, Mus musculus
gagcaaatcaaaggcagagaccttg

SEQ ID NO: 437709 - DNA, 25 bp, Mus musculus
gagcaaatcccaaagcaaatagtcc

SEQ ID NO: 437710 - DNA, 25 bp, Mus musculus
gagcaaattgcgtaacctgtcaagg

SEQ ID NO: 437711 - DNA, 25 bp, Mus musculus
gagcaaatttaaccaaggtcgtcct

SEQ ID NO: 437712 - DNA, 25 bp, Mus musculus
gagcaacagcacgtgatccagaggt

SEQ ID NO: 437713 - DNA, 25 bp, Mus musculus
gagcaacagggcaccggattccctg

SEQ ID NO: 437714 - DNA, 25 bp, Mus musculus
gagcaacccaagagatccacaggga

SEQ ID NO: 437715 - DNA, 25 bp, Mus musculus
gagcaacctcttgagaagaccgcag

SEQ ID NO: 437716 - DNA, 25 bp, Mus musculus
gagcaacgatggagctagagtattt

SEQ ID NO: 437717 - DNA, 25 bp, Mus musculus
gagcaacgcaaacctgtcggagtca

SEQ ID NO: 437718 - DNA, 25 bp, Mus musculus
gagcaactgcaatgtaacattccaa

SEQ ID NO: 437719 - DNA, 25 bp, Mus musculus
gagcaactgctgtgtgatcctgtag

SEQ ID NO: 437720 - DNA, 25 bp, Mus musculus
gagcaactggctggtcaaacaagaa

SEQ ID NO: 437721 - DNA, 25 bp, Mus musculus
gagcaagaatccagtctccaccttt

SEQ ID NO: 437722 - DNA, 25 bp, Mus musculus
gagcaagaatgatagctgtctcttt

SEQ ID NO: 437723 - DNA, 25 bp, Mus musculus
gagcaagacgccacatctaaatgga

SEQ ID NO: 437724 - DNA, 25 bp, Mus musculus
gagcaagaggctggatattacccat

SEQ ID NO: 437725 - DNA, 25 bp, Mus musculus
gagcaagagttcctgcgcatcatga

SEQ ID NO: 437726 - DNA, 25 bp, Mus musculus
gagcaagcagaacgcagttccacag

SEQ ID NO: 437727 - DNA, 25 bp, Mus musculus
gagcaagccagtagctgacttgctg

SEQ ID NO: 437728 - DNA, 25 bp, Mus musculus
gagcaagcccagtacatgcacgtgg

SEQ ID NO: 437729 - DNA, 25 bp, Mus musculus
gagcaagctagctcaacaagcagct

SEQ ID NO: 437730 - DNA, 25 bp, Mus musculus
gagcaagcttgttcggcaaaaccag

SEQ ID NO: 437731 - DNA, 25 bp, Mus musculus
gagcaaggcatcaccctgcgtggga

SEQ ID NO: 437732 - DNA, 25 bp, Mus musculus
gagcaaggcctcgttgtaatcgcgg

SEQ ID NO: 437733 - DNA, 25 bp, Mus musculus
gagcaaggctctcagcctaagccac

SEQ ID NO: 437734 - DNA, 25 bp, Mus musculus
gagcaagtaacaccgctgacacatt

SEQ ID NO: 437735 - DNA, 25 bp, Mus musculus
gagcaagtccatctcctatgcagaa

SEQ ID NO: 437736 - DNA, 25 bp, Mus musculus
gagcaagtggctcatgatcttcagg

SEQ ID NO: 437737 - DNA, 25 bp, Mus musculus
gagcaagtgttcaaaaggattagca

SEQ ID NO: 437738 - DNA, 25 bp, Mus musculus
gagcaagttctgatacaccacatac

SEQ ID NO: 437739 - DNA, 25 bp, Mus musculus
gagcaataaatgtccccaaggcccg

SEQ ID NO: 437740 - DNA, 25 bp, Mus musculus
gagcaatcagatttggttcaccgga

SEQ ID NO: 437741 - DNA, 25 bp, Mus musculus
gagcaatctgctgccatagctgtga

SEQ ID NO: 437742 - DNA, 25 bp, Mus musculus
gagcaatctgtgtgtccaaagtata

SEQ ID NO: 437743 - DNA, 25 bp, Mus musculus
gagcaatcttgccagctctggaaca

SEQ ID NO: 437744 - DNA, 25 bp, Mus musculus
gagcaatggcaaggcgaagctcccg

SEQ ID NO: 437745 - DNA, 25 bp, Mus musculus
gagcaatgtttcagtggcttaccca

SEQ ID NO: 437746 - DNA, 25 bp, Mus musculus
gagcacaaattggtgtaagaccgta

SEQ ID NO: 437747 - DNA, 25 bp, Mus musculus
gagcacaagaggatccataccggag

SEQ ID NO: 437748 - DNA, 25 bp, Mus musculus
gagcacaagcctgtcttcctgggaa

SEQ ID NO: 437749 - DNA, 25 bp, Mus musculus
gagcacacaagcctggccgctgtag

SEQ ID NO: 437750 - DNA, 25 bp, Mus musculus
gagcacaccgtgttgtacgtcactg

SEQ ID NO: 437751 - DNA, 25 bp, Mus musculus
gagcacactttctacagcaacggcg

SEQ ID NO: 437752 - DNA, 25 bp, Mus musculus
gagcacagagtgtgtcttcacccta

SEQ ID NO: 437753 - DNA, 25 bp, Mus musculus
gagcacagcaacaggaatcatcagt

SEQ ID NO: 437754 - DNA, 25 bp, Mus musculus
gagcacagccgagcctaagtatacg

SEQ ID NO: 437755 - DNA, 25 bp, Mus musculus
gagcacagtctctgtaggtaaggag

SEQ ID NO: 437756 - DNA, 25 bp, Mus musculus
gagcacatattttaccccatggatg

SEQ ID NO: 437757 - DNA, 25 bp, Mus musculus
gagcacatcataatctagcaagcga

SEQ ID NO: 437758 - DNA, 25 bp, Mus musculus
gagcacatcctgagcttggagcaga

SEQ ID NO: 437759 - DNA, 25 bp, Mus musculus
gagcacatgcctaagtgctaggccc

SEQ ID NO: 437760 - DNA, 25 bp, Mus musculus
gagcacatgtcttagtctcagagct

SEQ ID NO: 437761 - DNA, 25 bp, Mus musculus
gagcaccacgtgtctgttcttggag

SEQ ID NO: 437762 - DNA, 25 bp, Mus musculus
gagcaccatcttcagcggctgagaa

SEQ ID NO: 437763 - DNA, 25 bp, Mus musculus
gagcaccgaggttaaaactttgtag

SEQ ID NO: 437764 - DNA, 25 bp, Mus musculus
gagcaccggaaactcagaaacgcct

SEQ ID NO: 437765 - DNA, 25 bp, Mus musculus
gagcacctggctgagtacttggtaa

SEQ ID NO: 437766 - DNA, 25 bp, Mus musculus
gagcaccttgatgcagactgctgct

SEQ ID NO: 437767 - DNA, 25 bp, Mus musculus
gagcacgactttcatggatcctggg

SEQ ID NO: 437768 - DNA, 25 bp, Mus musculus
gagcacgagaagatgtgcccgctgc

SEQ ID NO: 437769 - DNA, 25 bp, Mus musculus
gagcacggcccagaaaacattgtga

SEQ ID NO: 437770 - DNA, 25 bp, Mus musculus
gagcactattaccttccgcacagag

SEQ ID NO: 437771 - DNA, 25 bp, Mus musculus
gagcactcacattgctcctactaca

SEQ ID NO: 437772 - DNA, 25 bp, Mus musculus
gagcactgacgattttcccataaga

SEQ ID NO: 437773 - DNA, 25 bp, Mus musculus
gagcactgccaggtcattagtacta

SEQ ID NO: 437774 - DNA, 25 bp, Mus musculus
gagcactgccgacagccaataggaa

SEQ ID NO: 437775 - DNA, 25 bp, Mus musculus
gagcactgcgtttggatctctgaca

SEQ ID NO: 437776 - DNA, 25 bp, Mus musculus
gagcactgctctgggtctcacactg

SEQ ID NO: 437777 - DNA, 25 bp, Mus musculus
gagcactggacaaaagaagcacctg

SEQ ID NO: 437778 - DNA, 25 bp, Mus musculus
gagcactggccgaacaactaatggg

SEQ ID NO: 437779 - DNA, 25 bp, Mus musculus
gagcactgggctagtacgtgtttgt

SEQ ID NO: 437780 - DNA, 25 bp, Mus musculus
gagcactgtgtttagaacttctggt

SEQ ID NO: 437781 - DNA, 25 bp, Mus musculus
gagcacttattgttcctccggagga

SEQ ID NO: 437782 - DNA, 25 bp, Mus musculus
gagcacttttcctgtgccgcaccag

SEQ ID NO: 437783 - DNA, 25 bp, Mus musculus
gagcagaaccatctacaagaacctg

SEQ ID NO: 437784 - DNA, 25 bp, Mus musculus
gagcagaaccgcatcatattcgatt

SEQ ID NO: 437785 - DNA, 25 bp, Mus musculus
gagcagaagaactactgtggtccca

SEQ ID NO: 437786 - DNA, 25 bp, Mus musculus
gagcagacactcctaacctacgtaa

SEQ ID NO: 437787 - DNA, 25 bp, Mus musculus
gagcagacactttaacgacccgaat

SEQ ID NO: 437788 - DNA, 25 bp, Mus musculus
gagcagacagatcttcaggtctccc

SEQ ID NO: 437789 - DNA, 25 bp, Mus musculus
gagcagacagctttggactgaggac

SEQ ID NO: 437790 - DNA, 25 bp, Mus musculus
gagcagactaccaggaaaacgcgga

SEQ ID NO: 437791 - DNA, 25 bp, Mus musculus
gagcagagactatactacattgaac

SEQ ID NO: 437792 - DNA, 25 bp, Mus musculus
gagcagagagcagaggccgcactct

SEQ ID NO: 437793 - DNA, 25 bp, Mus musculus
gagcagagatgggtcactcctcacg

SEQ ID NO: 437794 - DNA, 25 bp, Mus musculus
gagcagagatttcagcttggcctca

SEQ ID NO: 437795 - DNA, 25 bp, Mus musculus
gagcagagcccctacggaagtagcg

SEQ ID NO: 437796 - DNA, 25 bp, Mus musculus
gagcagagcccctgtgtacactttg

SEQ ID NO: 437797 - DNA, 25 bp, Mus musculus
gagcagagctacttgcaccagaacg

SEQ ID NO: 437798 - DNA, 25 bp, Mus musculus
gagcagagctgtgcacggcaccttt

SEQ ID NO: 437799 - DNA, 25 bp, Mus musculus
gagcagagctgttaacctcttggca

SEQ ID NO: 437800 - DNA, 25 bp, Mus musculus
gagcagaggacaggtttctgttttg

SEQ ID NO: 437801 - DNA, 25 bp, Mus musculus
gagcagaggtgcagtttatggaaaa

SEQ ID NO: 437802 - DNA, 25 bp, Mus musculus
gagcagagtctgtcaatcccaggca

SEQ ID NO: 437803 - DNA, 25 bp, Mus musculus
gagcagataaaaagcctggagcgag

SEQ ID NO: 437804 - DNA, 25 bp, Mus musculus
gagcagatcaataggcgaacgcgga

SEQ ID NO: 437805 - DNA, 25 bp, Mus musculus
gagcagatcatggacttcacgccag

SEQ ID NO: 437806 - DNA, 25 bp, Mus musculus
gagcagatgatagcccttaccgagg

SEQ ID NO: 437807 - DNA, 25 bp, Mus musculus
gagcagattgactcgcacaggagga

SEQ ID NO: 437808 - DNA, 25 bp, Mus musculus
gagcagatttacaagcggaacccga

SEQ ID NO: 437809 - DNA, 25 bp, Mus musculus
gagcagcacccacttaagacagcag

SEQ ID NO: 437810 - DNA, 25 bp, Mus musculus
gagcagcacctgctagaccagctgg

SEQ ID NO: 437811 - DNA, 25 bp, Mus musculus
gagcagcactttgcctcggacggat

SEQ ID NO: 437812 - DNA, 25 bp, Mus musculus
gagcagcaggtgaactctggactca

SEQ ID NO: 437813 - DNA, 25 bp, Mus musculus
gagcagccaaacttttcccaggaag

SEQ ID NO: 437814 - DNA, 25 bp, Mus musculus
gagcagccaagaagcagcattgata

SEQ ID NO: 437815 - DNA, 25 bp, Mus musculus
gagcagccactacagtcagaggctc

SEQ ID NO: 437816 - DNA, 25 bp, Mus musculus
gagcagcccctcgaagaactatgtg

SEQ ID NO: 437817 - DNA, 25 bp, Mus musculus
gagcagcccgcctttctggtgtgcc

SEQ ID NO: 437818 - DNA, 25 bp, Mus musculus
gagcagccgctagcattttccacag

SEQ ID NO: 437819 - DNA, 25 bp, Mus musculus
gagcagcctcaggagatttcccaga

SEQ ID NO: 437820 - DNA, 25 bp, Mus musculus
gagcagcctcctcaacaatgggaaa

SEQ ID NO: 437821 - DNA, 25 bp, Mus musculus
gagcagcgcaaccacttagccatgg

SEQ ID NO: 437822 - DNA, 25 bp, Mus musculus
gagcagcgggagtccttcctaggaa

SEQ ID NO: 437823 - DNA, 25 bp, Mus musculus
gagcagcggtcgtgtaaacctcaat

SEQ ID NO: 437824 - DNA, 25 bp, Mus musculus
gagcagctcaggttgcccaggatga

SEQ ID NO: 437825 - DNA, 25 bp, Mus musculus
gagcagctcatcctcaccatgggtg

SEQ ID NO: 437826 - DNA, 25 bp, Mus musculus
gagcagctctctcatgtgaatttgg

SEQ ID NO: 437827 - DNA, 25 bp, Mus musculus
gagcagctcttaccaggagttttgg

SEQ ID NO: 437828 - DNA, 25 bp, Mus musculus
gagcagctgagtccgcgtgggagtg

SEQ ID NO: 437829 - DNA, 25 bp, Mus musculus
gagcagctgcaaacgactaaagaag

SEQ ID NO: 437830 - DNA, 25 bp, Mus musculus
gagcagctgcccttgaggcaggcat

SEQ ID NO: 437831 - DNA, 25 bp, Mus musculus
gagcagctgctccatcaaagaacca

SEQ ID NO: 437832 - DNA, 25 bp, Mus musculus
gagcagctggctaaactaaagcgga

SEQ ID NO: 437833 - DNA, 25 bp, Mus musculus
gagcagctgggttactcctgtgtga

SEQ ID NO: 437834 - DNA, 25 bp, Mus musculus
gagcagctgtcgtcggctgctcccg

SEQ ID NO: 437835 - DNA, 25 bp, Mus musculus
gagcaggagttgttctgagcccaca

SEQ ID NO: 437836 - DNA, 25 bp, Mus musculus
gagcaggatctagctgactctaaga

SEQ ID NO: 437837 - DNA, 25 bp, Mus musculus
gagcaggatgttccgctgtttccag

SEQ ID NO: 437838 - DNA, 25 bp, Mus musculus
gagcaggcagagcatttatcttaga

SEQ ID NO: 437839 - DNA, 25 bp, Mus musculus
gagcaggcagtgtgtacttggtact

SEQ ID NO: 437840 - DNA, 25 bp, Mus musculus
gagcaggccactggctttccagagt

SEQ ID NO: 437841 - DNA, 25 bp, Mus musculus
gagcaggccatagtcctaacaggca

SEQ ID NO: 437842 - DNA, 25 bp, Mus musculus
gagcaggcccttcgagacattctaa

SEQ ID NO: 437843 - DNA, 25 bp, Mus musculus
gagcagggaccaaggtgagtcacca

SEQ ID NO: 437844 - DNA, 25 bp, Mus musculus
gagcagggcatcagagattttaaga

SEQ ID NO: 437845 - DNA, 25 bp, Mus musculus
gagcagggctatccttccaaggtcc

SEQ ID NO: 437846 - DNA, 25 bp, Mus musculus
gagcagggtagcttctctggtagaa

SEQ ID NO: 437847 - DNA, 25 bp, Mus musculus
gagcaggtccgcaggggctacctct

SEQ ID NO: 437848 - DNA, 25 bp, Mus musculus
gagcaggtctcaggaatctcttcgc

SEQ ID NO: 437849 - DNA, 25 bp, Mus musculus
gagcaggtctgctgcccggcaaagt

SEQ ID NO: 437850 - DNA, 25 bp, Mus musculus
gagcaggtcttcatcaagccggagg

SEQ ID NO: 437851 - DNA, 25 bp, Mus musculus
gagcaggtggtgatgatccccagcc

SEQ ID NO: 437852 - DNA, 25 bp, Mus musculus
gagcaggtgttcacatggacccaga

SEQ ID NO: 437853 - DNA, 25 bp, Mus musculus
gagcagtaagagaattaccaacggg

SEQ ID NO: 437854 - DNA, 25 bp, Mus musculus
gagcagtacatagggaggtttctcc

SEQ ID NO: 437855 - DNA, 25 bp, Mus musculus
gagcagtacatcttccgggtcaagg

SEQ ID NO: 437856 - DNA, 25 bp, Mus musculus
gagcagtacgttcccttaaggtcaa

SEQ ID NO: 437857 - DNA, 25 bp, Mus musculus
gagcagtactgtgacatgatccagc

SEQ ID NO: 437858 - DNA, 25 bp, Mus musculus
gagcagtagcatgttgggatcacca

SEQ ID NO: 437859 - DNA, 25 bp, Mus musculus
gagcagtcactaatgtccccatgag

SEQ ID NO: 437860 - DNA, 25 bp, Mus musculus
gagcagtcagctcaaagaatctcag

SEQ ID NO: 437861 - DNA, 25 bp, Mus musculus
gagcagtcagtgttatttcttatca

SEQ ID NO: 437862 - DNA, 25 bp, Mus musculus
gagcagtcatgatccagcctaagag

SEQ ID NO: 437863 - DNA, 25 bp, Mus musculus
gagcagtcattccttctcacctggc

SEQ ID NO: 437864 - DNA, 25 bp, Mus musculus
gagcagtcgccgctttgtaaaggac

SEQ ID NO: 437865 - DNA, 25 bp, Mus musculus
gagcagtctggctggtggtttaaca

SEQ ID NO: 437866 - DNA, 25 bp, Mus musculus
gagcagtgaggccagctctctctga

SEQ ID NO: 437867 - DNA, 25 bp, Mus musculus
gagcagtgtctgaaggataaccacg

SEQ ID NO: 437868 - DNA, 25 bp, Mus musculus
gagcagtgttccatcagttgaccag

SEQ ID NO: 437869 - DNA, 25 bp, Mus musculus
gagcagttagactcttaacatggca

SEQ ID NO: 437870 - DNA, 25 bp, Mus musculus
gagcagttcaacgaccacatgagga

SEQ ID NO: 437871 - DNA, 25 bp, Mus musculus
gagcagtttgcacttaagcccatga

SEQ ID NO: 437872 - DNA, 25 bp, Mus musculus
gagcataaagaatatagaacatctt

SEQ ID NO: 437873 - DNA, 25 bp, Mus musculus
gagcataaagctactcgggctggag

SEQ ID NO: 437874 - DNA, 25 bp, Mus musculus
gagcatacccttactcccagatagg

SEQ ID NO: 437875 - DNA, 25 bp, Mus musculus
gagcatacctgagcctctctgtagg

SEQ ID NO: 437876 - DNA, 25 bp, Mus musculus
gagcatatctacaaggtcacctgag

SEQ ID NO: 437877 - DNA, 25 bp, Mus musculus
gagcatattgaaagaacaggacgaa

SEQ ID NO: 437878 - DNA, 25 bp, Mus musculus
gagcatcatggtaacgggtaggaca

SEQ ID NO: 437879 - DNA, 25 bp, Mus musculus
gagcatccccttggtcatcggtcag

SEQ ID NO: 437880 - DNA, 25 bp, Mus musculus
gagcatcccggttgtctcatgaagg

SEQ ID NO: 437881 - DNA, 25 bp, Mus musculus
gagcatcgcctgtttgattccagag

SEQ ID NO: 437882 - DNA, 25 bp, Mus musculus
gagcatcgctttccttgacccggga

SEQ ID NO: 437883 - DNA, 25 bp, Mus musculus
gagcatcggaatcccagaggctcct

SEQ ID NO: 437884 - DNA, 25 bp, Mus musculus
gagcatcggttcacacttacggaaa

SEQ ID NO: 437885 - DNA, 25 bp, Mus musculus
gagcatcgtccatctgcaggcagga

SEQ ID NO: 437886 - DNA, 25 bp, Mus musculus
gagcatctagataccaccatgtgag

SEQ ID NO: 437887 - DNA, 25 bp, Mus musculus
gagcatctcaggatgttcttccggg

SEQ ID NO: 437888 - DNA, 25 bp, Mus musculus
gagcatctccgtcttcatgcgtcaa

SEQ ID NO: 437889 - DNA, 25 bp, Mus musculus
gagcatctgagaccccggtggaaaa

SEQ ID NO: 437890 - DNA, 25 bp, Mus musculus
gagcatctgagattcttgatggaca

SEQ ID NO: 437891 - DNA, 25 bp, Mus musculus
gagcatctgctactcaaagtcctgg

SEQ ID NO: 437892 - DNA, 25 bp, Mus musculus
gagcatcttctcagggcttccctaa

SEQ ID NO: 437893 - DNA, 25 bp, Mus musculus
gagcatcttctcatatcactgtcaa

SEQ ID NO: 437894 - DNA, 25 bp, Mus musculus
gagcatcttgttgtggccctccaga

SEQ ID NO: 437895 - DNA, 25 bp, Mus musculus
gagcatgaatggagacagagacccc

SEQ ID NO: 437896 - DNA, 25 bp, Mus musculus
gagcatgagatcctgagacaccctt

SEQ ID NO: 437897 - DNA, 25 bp, Mus musculus
gagcatgatcgtggacaagctgctg

SEQ ID NO: 437898 - DNA, 25 bp, Mus musculus
gagcatgcagcttaccttgtggaca

SEQ ID NO: 437899 - DNA, 25 bp, Mus musculus
gagcatgccctgcaggttgttagaa

SEQ ID NO: 437900 - DNA, 25 bp, Mus musculus
gagcatgctgggataattacgccca

SEQ ID NO: 437901 - DNA, 25 bp, Mus musculus
gagcatggcgggactcttcagtgac

SEQ ID NO: 437902 - DNA, 25 bp, Mus musculus
gagcatgggaatcctgagtacattg

SEQ ID NO: 437903 - DNA, 25 bp, Mus musculus
gagcatggtccagcactactacagg

SEQ ID NO: 437904 - DNA, 25 bp, Mus musculus
gagcatgtccggaacgggccttaga

SEQ ID NO: 437905 - DNA, 25 bp, Mus musculus
gagcatgtccttgtcacctgtagtg

SEQ ID NO: 437906 - DNA, 25 bp, Mus musculus
gagcatgtcttgaaccgatccacag

SEQ ID NO: 437907 - DNA, 25 bp, Mus musculus
gagcatgtgcaccagcgggcttctt

SEQ ID NO: 437908 - DNA, 25 bp, Mus musculus
gagcatgtgcataatccaggcccag

SEQ ID NO: 437909 - DNA, 25 bp, Mus musculus
gagcatgtgtcctccactagatgag

SEQ ID NO: 437910 - DNA, 25 bp, Mus musculus
gagcatgtttcccagtggccggaca

SEQ ID NO: 437911 - DNA, 25 bp, Mus musculus
gagcattaaccaaagcctgcaggat

SEQ ID NO: 437912 - DNA, 25 bp, Mus musculus
gagcattaagaaacctccaccaggg

SEQ ID NO: 437913 - DNA, 25 bp, Mus musculus
gagcattactcctacaaggcactga

SEQ ID NO: 437914 - DNA, 25 bp, Mus musculus
gagcattatgtcgagctgcgcgaga

SEQ ID NO: 437915 - DNA, 25 bp, Mus musculus
gagcattcaacagaagatcgccacc

SEQ ID NO: 437916 - DNA, 25 bp, Mus musculus
gagcattctccatttgccctccaga

SEQ ID NO: 437917 - DNA, 25 bp, Mus musculus
gagcattggagtctacattgagttc

SEQ ID NO: 437918 - DNA, 25 bp, Mus musculus
gagcattgggaagcttctagagcca

SEQ ID NO: 437919 - DNA, 25 bp, Mus musculus
gagcattgtcattcgcccgctggag

SEQ ID NO: 437920 - DNA, 25 bp, Mus musculus
gagcatttctggtccgggtcagtga

SEQ ID NO: 437921 - DNA, 25 bp, Mus musculus
gagcatttctgtacaaggtcctgag

SEQ ID NO: 437922 - DNA, 25 bp, Mus musculus
gagccaaagtttcgctcctcttcag

SEQ ID NO: 437923 - DNA, 25 bp, Mus musculus
gagccaacatctagaggaagtcagc

SEQ ID NO: 437924 - DNA, 25 bp, Mus musculus
gagccaacgtccatgttctgtgggc

SEQ ID NO: 437925 - DNA, 25 bp, Mus musculus
gagccaagacagaaaacccatcgtg

SEQ ID NO: 437926 - DNA, 25 bp, Mus musculus
gagccaagagttgccaccagatggg

SEQ ID NO: 437927 - DNA, 25 bp, Mus musculus
gagccaagcgcggatttctcgtaac

SEQ ID NO: 437928 - DNA, 25 bp, Mus musculus
gagccaataaggaagcggatttgcc

SEQ ID NO: 437929 - DNA, 25 bp, Mus musculus
gagccaatcagtgtcgcatcctagg

SEQ ID NO: 437930 - DNA, 25 bp, Mus musculus
gagccaatgcatgtaccgagggaat

SEQ ID NO: 437931 - DNA, 25 bp, Mus musculus
gagccaatgggcacttgagagacca

SEQ ID NO: 437932 - DNA, 25 bp, Mus musculus
gagccaatgggcttgttcaccgccg

SEQ ID NO: 437933 - DNA, 25 bp, Mus musculus
gagccacaaagttcccacgagttat

SEQ ID NO: 437934 - DNA, 25 bp, Mus musculus
gagccacactttcaagtagaccgag

SEQ ID NO: 437935 - DNA, 25 bp, Mus musculus
gagccacagaaacaggattccacgt

SEQ ID NO: 437936 - DNA, 25 bp, Mus musculus
gagccacagggagacgaaaaacccg

SEQ ID NO: 437937 - DNA, 25 bp, Mus musculus
gagccacatccctagatatacacaa

SEQ ID NO: 437938 - DNA, 25 bp, Mus musculus
gagccaccagcaacgacaggaagtg

SEQ ID NO: 437939 - DNA, 25 bp, Mus musculus
gagccaccccagtgctatttagcta

SEQ ID NO: 437940 - DNA, 25 bp, Mus musculus
gagccacccctgaatatttgatccg

SEQ ID NO: 437941 - DNA, 25 bp, Mus musculus
gagccaccgcgtttttaggcgccca

SEQ ID NO: 437942 - DNA, 25 bp, Mus musculus
gagccacgagtgcaagaagccgata

SEQ ID NO: 437943 - DNA, 25 bp, Mus musculus
gagccacgggcaatgaaaagcgacc

SEQ ID NO: 437944 - DNA, 25 bp, Mus musculus
gagccacgttcaaatccctgtcatg

SEQ ID NO: 437945 - DNA, 25 bp, Mus musculus
gagccactgagcgtgccaaagggta

SEQ ID NO: 437946 - DNA, 25 bp, Mus musculus
gagccacttccccaaggtccaagta

SEQ ID NO: 437947 - DNA, 25 bp, Mus musculus
gagccactttgcatcatgtcccggt

SEQ ID NO: 437948 - DNA, 25 bp, Mus musculus
gagccagacattgggatgcacgcat

SEQ ID NO: 437949 - DNA, 25 bp, Mus musculus
gagccagactctgacaatagtgctg

SEQ ID NO: 437950 - DNA, 25 bp, Mus musculus
gagccagagtacagccatcgaaggt

SEQ ID NO: 437951 - DNA, 25 bp, Mus musculus
gagccagatgtcaatgccgttcgag

SEQ ID NO: 437952 - DNA, 25 bp, Mus musculus
gagccagcagatagtcggacatgta

SEQ ID NO: 437953 - DNA, 25 bp, Mus musculus
gagccagcatacaaacagcacatgg

SEQ ID NO: 437954 - DNA, 25 bp, Mus musculus
gagccagccacgaaggcatctaaag

SEQ ID NO: 437955 - DNA, 25 bp, Mus musculus
gagccagccatgaaagaccttcttc

SEQ ID NO: 437956 - DNA, 25 bp, Mus musculus
gagccagccttctgttcatgatgac

SEQ ID NO: 437957 - DNA, 25 bp, Mus musculus
gagccagcgcgcttcagacttgaga

SEQ ID NO: 437958 - DNA, 25 bp, Mus musculus
gagccagcttttccccttttataag

SEQ ID NO: 437959 - DNA, 25 bp, Mus musculus
gagccaggacatttgattatcttaa

SEQ ID NO: 437960 - DNA, 25 bp, Mus musculus
gagccaggagtgtatgagcccagtc

SEQ ID NO: 437961 - DNA, 25 bp, Mus musculus
gagccaggctaggtcatatatgttg

SEQ ID NO: 437962 - DNA, 25 bp, Mus musculus
gagccagtgcccctatctatgtgtg

SEQ ID NO: 437963 - DNA, 25 bp, Mus musculus
gagccagtgcgtgtcacaccagata

SEQ ID NO: 437964 - DNA, 25 bp, Mus musculus
gagccagtgctttctggagcgaaca

SEQ ID NO: 437965 - DNA, 25 bp, Mus musculus
gagccagtgggagttaggtacacac

SEQ ID NO: 437966 - DNA, 25 bp, Mus musculus
gagccagtgggcctcttacaaacta

SEQ ID NO: 437967 - DNA, 25 bp, Mus musculus
gagccagtgttaccagcatacccac

SEQ ID NO: 437968 - DNA, 25 bp, Mus musculus
gagccagtttctgaaggtccacagc

SEQ ID NO: 437969 - DNA, 25 bp, Mus musculus
gagccatactttctgcctgtgactg

SEQ ID NO: 437970 - DNA, 25 bp, Mus musculus
gagccatagtatagacccttaaaag

SEQ ID NO: 437971 - DNA, 25 bp, Mus musculus
gagccatatcttgagccctgggtga

SEQ ID NO: 437972 - DNA, 25 bp, Mus musculus
gagccatcagagctgatcagaattt

SEQ ID NO: 437973 - DNA, 25 bp, Mus musculus
gagccatcatcaagagcaccagtgt

SEQ ID NO: 437974 - DNA, 25 bp, Mus musculus
gagccatccaagagcagcatcatgc

SEQ ID NO: 437975 - DNA, 25 bp, Mus musculus
gagccatctcagtgggacacacgga

SEQ ID NO: 437976 - DNA, 25 bp, Mus musculus
gagccatgaggtactccctggtcac

SEQ ID NO: 437977 - DNA, 25 bp, Mus musculus
gagccatgcatgctggaacccagtg

SEQ ID NO: 437978 - DNA, 25 bp, Mus musculus
gagccatgggacatcttcggactga

SEQ ID NO: 437979 - DNA, 25 bp, Mus musculus
gagccatggtctgggtcctggactt

SEQ ID NO: 437980 - DNA, 25 bp, Mus musculus
gagccatgtcgatctccgagagcag

SEQ ID NO: 437981 - DNA, 25 bp, Mus musculus
gagccatgtcgcgtctgatcgtgaa

SEQ ID NO: 437982 - DNA, 25 bp, Mus musculus
gagccatgtctacagcttgaccctg

SEQ ID NO: 437983 - DNA, 25 bp, Mus musculus
gagccattacactgacacttgattt

SEQ ID NO: 437984 - DNA, 25 bp, Mus musculus
gagccattggtattcatctaacgca

SEQ ID NO: 437985 - DNA, 25 bp, Mus musculus
gagccatttatggatgagcccaacg

SEQ ID NO: 437986 - DNA, 25 bp, Mus musculus
gagccatttctgtaagtctgccgtg

SEQ ID NO: 437987 - DNA, 25 bp, Mus musculus
gagccatttgctcagctggacctga

SEQ ID NO: 437988 - DNA, 25 bp, Mus musculus
gagccatttgtgctgcttaaggaga

SEQ ID NO: 437989 - DNA, 25 bp, Mus musculus
gagcccaattaactctgaggtgagg

SEQ ID NO: 437990 - DNA, 25 bp, Mus musculus
gagcccacagaagagttctccttca

SEQ ID NO: 437991 - DNA, 25 bp, Mus musculus
gagcccacagagtgcctttctattg

SEQ ID NO: 437992 - DNA, 25 bp, Mus musculus
gagcccacagtagacaggaccttct

SEQ ID NO: 437993 - DNA, 25 bp, Mus musculus
gagcccacagtttacctttccgcaa

SEQ ID NO: 437994 - DNA, 25 bp, Mus musculus
gagcccacattctgcccttgaagga

SEQ ID NO: 437995 - DNA, 25 bp, Mus musculus
gagcccagaaagtccacagagacgt

SEQ ID NO: 437996 - DNA, 25 bp, Mus musculus
gagcccagagctcagtaactaaacg

SEQ ID NO: 437997 - DNA, 25 bp, Mus musculus
gagcccagcagatgccctgaggcac

SEQ ID NO: 437998 - DNA, 25 bp, Mus musculus
gagcccagcatctgtcttccctagg

SEQ ID NO: 437999 - DNA, 25 bp, Mus musculus
gagcccaggcatgtgcttcaggata

SEQ ID NO: 438000 - DNA, 25 bp, Mus musculus
gagcccaggcgttttgcagaatgaa

SEQ ID NO: 438001 - DNA, 25 bp, Mus musculus
gagcccaggctgagcataaacaact

SEQ ID NO: 438002 - DNA, 25 bp, Mus musculus
gagcccaggctgatttgcatatcgg

SEQ ID NO: 438003 - DNA, 25 bp, Mus musculus
gagcccaggctggataatgaggtcc

SEQ ID NO: 438004 - DNA, 25 bp, Mus musculus
gagcccagggaaccatgagcaactg

SEQ ID NO: 438005 - DNA, 25 bp, Mus musculus
gagcccagtagagagattttcaacc

SEQ ID NO: 438006 - DNA, 25 bp, Mus musculus
gagcccagttttaggcaccatcgag

SEQ ID NO: 438007 - DNA, 25 bp, Mus musculus
gagcccatatagagccatctgtaat

SEQ ID NO: 438008 - DNA, 25 bp, Mus musculus
gagcccatcacactcagtgaataag

SEQ ID NO: 438009 - DNA, 25 bp, Mus musculus
gagcccatctagagacctgagttct

SEQ ID NO: 438010 - DNA, 25 bp, Mus musculus
gagcccatgcaaaactgggtcaccg

SEQ ID NO: 438011 - DNA, 25 bp, Mus musculus
gagcccatgggagagatgttcaaca

SEQ ID NO: 438012 - DNA, 25 bp, Mus musculus
gagccccagggtgtgaccaagtttg

SEQ ID NO: 438013 - DNA, 25 bp, Mus musculus
gagccccgaactattgaagattttg

SEQ ID NO: 438014 - DNA, 25 bp, Mus musculus
gagccccggaaagtcgcatgtttaa

SEQ ID NO: 438015 - DNA, 25 bp, Mus musculus
gagccccggctgtttctacatgaaa

SEQ ID NO: 438016 - DNA, 25 bp, Mus musculus
gagccccgtaaagagtaggaaactg

SEQ ID NO: 438017 - DNA, 25 bp, Mus musculus
gagcccctacaactaggatgcccag

SEQ ID NO: 438018 - DNA, 25 bp, Mus musculus
gagcccctctgaaagtccctggaga

SEQ ID NO: 438019 - DNA, 25 bp, Mus musculus
gagcccctgccacaggaaactgctg

SEQ ID NO: 438020 - DNA, 25 bp, Mus musculus
gagcccctggtgtacttgtgccaaa

SEQ ID NO: 438021 - DNA, 25 bp, Mus musculus
gagcccctgtgtacactttgccaga

SEQ ID NO: 438022 - DNA, 25 bp, Mus musculus
gagccccttccagcaaacaggtgaa

SEQ ID NO: 438023 - DNA, 25 bp, Mus musculus
gagcccgaagcggactactatgcta

SEQ ID NO: 438024 - DNA, 25 bp, Mus musculus
gagcccgaggctgaacgactttgtg

SEQ ID NO: 438025 - DNA, 25 bp, Mus musculus
gagcccgagtgccacgacggttttt

SEQ ID NO: 438026 - DNA, 25 bp, Mus musculus
gagcccgggctcttggcagattgct

SEQ ID NO: 438027 - DNA, 25 bp, Mus musculus
gagcccgtgtttccatgaagtgtaa

SEQ ID NO: 438028 - DNA, 25 bp, Mus musculus
gagccctacaagtttctgcagttcg

SEQ ID NO: 438029 - DNA, 25 bp, Mus musculus
gagccctacctcgtgtctgtgttaa

SEQ ID NO: 438030 - DNA, 25 bp, Mus musculus
gagccctcatccttgatgggaaatt

SEQ ID NO: 438031 - DNA, 25 bp, Mus musculus
gagccctcgccgctttaagctatag

SEQ ID NO: 438032 - DNA, 25 bp, Mus musculus
gagccctctatccttggaacttgga

SEQ ID NO: 438033 - DNA, 25 bp, Mus musculus
gagccctctctaaaggacagcctgg

SEQ ID NO: 438034 - DNA, 25 bp, Mus musculus
gagccctgacttcagcctgtggtat

SEQ ID NO: 438035 - DNA, 25 bp, Mus musculus
gagccctgagccgaaccgttcggta

SEQ ID NO: 438036 - DNA, 25 bp, Mus musculus
gagccctgagctcaagttgcagttc

SEQ ID NO: 438037 - DNA, 25 bp, Mus musculus
gagccctgccaagatgacgaatttc

SEQ ID NO: 438038 - DNA, 25 bp, Mus musculus
gagccctgccgcttctcttgttttc

SEQ ID NO: 438039 - DNA, 25 bp, Mus musculus
gagccctggaaaccctatatgctgg

SEQ ID NO: 438040 - DNA, 25 bp, Mus musculus
gagccctggtgaggaaactccgaag

SEQ ID NO: 438041 - DNA, 25 bp, Mus musculus
gagccctgtctgtttcgtaatagta

SEQ ID NO: 438042 - DNA, 25 bp, Mus musculus
gagccctgttaccttgtgagaatgg

SEQ ID NO: 438043 - DNA, 25 bp, Mus musculus
gagcccttaagtaagcagtttacct

SEQ ID NO: 438044 - DNA, 25 bp, Mus musculus
gagcccttaggctactgcgatggaa

SEQ ID NO: 438045 - DNA, 25 bp, Mus musculus
gagcccttcccttctgtaagctgct

SEQ ID NO: 438046 - DNA, 25 bp, Mus musculus
gagcccttgggactaggaacaacct

SEQ ID NO: 438047 - DNA, 25 bp, Mus musculus
gagcccttgtgattgagtcaggcca

SEQ ID NO: 438048 - DNA, 25 bp, Mus musculus
gagccctttctagtccttcttacaa

SEQ ID NO: 438049 - DNA, 25 bp, Mus musculus
gagccctttggctgtttggaggaaa

SEQ ID NO: 438050 - DNA, 25 bp, Mus musculus
gagccgacatcggtcctcgacttag

SEQ ID NO: 438051 - DNA, 25 bp, Mus musculus
gagccgaccgaaggaagtgacctga

SEQ ID NO: 438052 - DNA, 25 bp, Mus musculus
gagccgacctttgatcctaacggag

SEQ ID NO: 438053 - DNA, 25 bp, Mus musculus
gagccgactgtttgaggagcctgaa

SEQ ID NO: 438054 - DNA, 25 bp, Mus musculus
gagccgagcaggatttgaaacagaa

SEQ ID NO: 438055 - DNA, 25 bp, Mus musculus
gagccgaggattactgggtacccca

SEQ ID NO: 438056 - DNA, 25 bp, Mus musculus
gagccgagtttgaagtgtgttgacc

SEQ ID NO: 438057 - DNA, 25 bp, Mus musculus
gagccgcagggcacagcatgagctc

SEQ ID NO: 438058 - DNA, 25 bp, Mus musculus
gagccgcatcttgctgacagccgga

SEQ ID NO: 438059 - DNA, 25 bp, Mus musculus
gagccgcggcgcagcttttgtccgt

SEQ ID NO: 438060 - DNA, 25 bp, Mus musculus
gagccgctccagcttagagaaagag

SEQ ID NO: 438061 - DNA, 25 bp, Mus musculus
gagccggaacgatgctacccgccga

SEQ ID NO: 438062 - DNA, 25 bp, Mus musculus
gagccggaatcggacgtctctgttg

SEQ ID NO: 438063 - DNA, 25 bp, Mus musculus
gagccggacatggagccactgtgaa

SEQ ID NO: 438064 - DNA, 25 bp, Mus musculus
gagccggagccagtcttcatggaaa

SEQ ID NO: 438065 - DNA, 25 bp, Mus musculus
gagccggagttctctcaagtgctag

SEQ ID NO: 438066 - DNA, 25 bp, Mus musculus
gagccggatcacctctgctgacaaa

SEQ ID NO: 438067 - DNA, 25 bp, Mus musculus
gagccggcctccaaaagctggtgga

SEQ ID NO: 438068 - DNA, 25 bp, Mus musculus
gagccgggatttgaaggaaaaaatg

SEQ ID NO: 438069 - DNA, 25 bp, Mus musculus
gagccgggcccgagtgactcaaccg

SEQ ID NO: 438070 - DNA, 25 bp, Mus musculus
gagccgggtcccatcactgtgaatg

SEQ ID NO: 438071 - DNA, 25 bp, Mus musculus
gagccgtattttaccactgaggaag

SEQ ID NO: 438072 - DNA, 25 bp, Mus musculus
gagccgtcctgtgcattttgagatg

SEQ ID NO: 438073 - DNA, 25 bp, Mus musculus
gagccgtgatagaacatgtggacca

SEQ ID NO: 438074 - DNA, 25 bp, Mus musculus
gagcctaaaacatatgggcacttgg

SEQ ID NO: 438075 - DNA, 25 bp, Mus musculus
gagcctaaaaggcaagagattctct

SEQ ID NO: 438076 - DNA, 25 bp, Mus musculus
gagcctaaaggtgacggtctggaac

SEQ ID NO: 438077 - DNA, 25 bp, Mus musculus
gagcctaacctccagtgacactgat

SEQ ID NO: 438078 - DNA, 25 bp, Mus musculus
gagcctacagactcgcgtgcttgag

SEQ ID NO: 438079 - DNA, 25 bp, Mus musculus
gagcctacggttgaatgagctgcca

SEQ ID NO: 438080 - DNA, 25 bp, Mus musculus
gagcctacgtcgtcgggagaccccg

SEQ ID NO: 438081 - DNA, 25 bp, Mus musculus
gagcctactgtggttgaattcattc

SEQ ID NO: 438082 - DNA, 25 bp, Mus musculus
gagcctagcgttgtgggttaaccct

SEQ ID NO: 438083 - DNA, 25 bp, Mus musculus
gagcctaggaacaagactggacact

SEQ ID NO: 438084 - DNA, 25 bp, Mus musculus
gagcctatggagctggcagaacatc

SEQ ID NO: 438085 - DNA, 25 bp, Mus musculus
gagcctattgacatctgagcacctg

SEQ ID NO: 438086 - DNA, 25 bp, Mus musculus
gagcctcaagaagctgctatccacg

SEQ ID NO: 438087 - DNA, 25 bp, Mus musculus
gagcctcaattcctgggtcgcgcag

SEQ ID NO: 438088 - DNA, 25 bp, Mus musculus
gagcctcactctgagagcaaggaga

SEQ ID NO: 438089 - DNA, 25 bp, Mus musculus
gagcctcagaggtacagacagaagt

SEQ ID NO: 438090 - DNA, 25 bp, Mus musculus
gagcctcataagtgtctgcctggga

SEQ ID NO: 438091 - DNA, 25 bp, Mus musculus
gagcctcccaagagcactcctttag

SEQ ID NO: 438092 - DNA, 25 bp, Mus musculus
gagcctccgcgtcctgtcagagagt

SEQ ID NO: 438093 - DNA, 25 bp, Mus musculus
gagcctcgaggaattgggcacccct

SEQ ID NO: 438094 - DNA, 25 bp, Mus musculus
gagcctcgattttgtcttctgcaag

SEQ ID NO: 438095 - DNA, 25 bp, Mus musculus
gagcctcgtatagcagccagcatgg

SEQ ID NO: 438096 - DNA, 25 bp, Mus musculus
gagcctcgtttctggagccctggga

SEQ ID NO: 438097 - DNA, 25 bp, Mus musculus
gagcctctgaaacatctagtgacag

SEQ ID NO: 438098 - DNA, 25 bp, Mus musculus
gagcctctggcttctgaactggaac

SEQ ID NO: 438099 - DNA, 25 bp, Mus musculus
gagcctctgtgacattccagccgga

SEQ ID NO: 438100 - DNA, 25 bp, Mus musculus
gagcctcttagcctcttggacgaca

SEQ ID NO: 438101 - DNA, 25 bp, Mus musculus
gagcctcttcttactgtcctcagca

SEQ ID NO: 438102 - DNA, 25 bp, Mus musculus
gagcctcttgactccttggcaggga

SEQ ID NO: 438103 - DNA, 25 bp, Mus musculus
gagcctgaaaatcacttagaagtcc

SEQ ID NO: 438104 - DNA, 25 bp, Mus musculus
gagcctgaacttttcccaactgcaa

SEQ ID NO: 438105 - DNA, 25 bp, Mus musculus
gagcctgaagtgaggtgctgcccat

SEQ ID NO: 438106 - DNA, 25 bp, Mus musculus
gagcctgactcagtgatggctgagc

SEQ ID NO: 438107 - DNA, 25 bp, Mus musculus
gagcctgactctgcagacagccatg

SEQ ID NO: 438108 - DNA, 25 bp, Mus musculus
gagcctgaggaattccgccctgaaa

SEQ ID NO: 438109 - DNA, 25 bp, Mus musculus
gagcctgatcggtagatggagttca

SEQ ID NO: 438110 - DNA, 25 bp, Mus musculus
gagcctgcctgtgtccttgaacctt

SEQ ID NO: 438111 - DNA, 25 bp, Mus musculus
gagcctgcgaagcaagcccttaaga

SEQ ID NO: 438112 - DNA, 25 bp, Mus musculus
gagcctgcgcgcttgaccgtacgcg

SEQ ID NO: 438113 - DNA, 25 bp, Mus musculus
gagcctgctctttgaaaagaccaaa

SEQ ID NO: 438114 - DNA, 25 bp, Mus musculus
gagcctgctgccactgttattcaag

SEQ ID NO: 438115 - DNA, 25 bp, Mus musculus
gagcctgcttggaaatcaccagcct

SEQ ID NO: 438116 - DNA, 25 bp, Mus musculus
gagcctggatctacgtgtcaaactg

SEQ ID NO: 438117 - DNA, 25 bp, Mus musculus
gagcctggcctatctgtggcttgac

SEQ ID NO: 438118 - DNA, 25 bp, Mus musculus
gagcctggcggcttagcgcgcttct

SEQ ID NO: 438119 - DNA, 25 bp, Mus musculus
gagcctgggagttttattagcacac

SEQ ID NO: 438120 - DNA, 25 bp, Mus musculus
gagcctgtatctacccctgctgatg

SEQ ID NO: 438121 - DNA, 25 bp, Mus musculus
gagcctgtgccctagtgtccagcct

SEQ ID NO: 438122 - DNA, 25 bp, Mus musculus
gagcctgtgctacaagacatgaacg

SEQ ID NO: 438123 - DNA, 25 bp, Mus musculus
gagcctgttacgtcatcaagatgga

SEQ ID NO: 438124 - DNA, 25 bp, Mus musculus
gagcctgttccagaattgctagaag

SEQ ID NO: 438125 - DNA, 25 bp, Mus musculus
gagcctgttgtgtgatgctgctaca

SEQ ID NO: 438126 - DNA, 25 bp, Mus musculus
gagccttaagcatcaaaacagtggg

SEQ ID NO: 438127 - DNA, 25 bp, Mus musculus
gagccttaggcccaaccttgaggag

SEQ ID NO: 438128 - DNA, 25 bp, Mus musculus
gagccttagtgacccagtgagtgaa

SEQ ID NO: 438129 - DNA, 25 bp, Mus musculus
gagccttcacgtaaatgggtccagt

SEQ ID NO: 438130 - DNA, 25 bp, Mus musculus
gagccttcaggaaaggagtcccagg

SEQ ID NO: 438131 - DNA, 25 bp, Mus musculus
gagccttcatagtcaccagagtgtg

SEQ ID NO: 438132 - DNA, 25 bp, Mus musculus
gagccttccattgtcaccagtgcga

SEQ ID NO: 438133 - DNA, 25 bp, Mus musculus
gagccttctccagcgtttgcaaaac

SEQ ID NO: 438134 - DNA, 25 bp, Mus musculus
gagccttctccccagtgcaatgtga

SEQ ID NO: 438135 - DNA, 25 bp, Mus musculus
gagccttgactcacaaggtcacaca

SEQ ID NO: 438136 - DNA, 25 bp, Mus musculus
gagccttgcgcttgtaatcattctg

SEQ ID NO: 438137 - DNA, 25 bp, Mus musculus
gagccttgcttgtctctacctcagg

SEQ ID NO: 438138 - DNA, 25 bp, Mus musculus
gagccttggccatgagtgaacccaa

SEQ ID NO: 438139 - DNA, 25 bp, Mus musculus
gagccttggtctctttattcgtgga

SEQ ID NO: 438140 - DNA, 25 bp, Mus musculus
gagccttgtcgggaggtcttcaacg

SEQ ID NO: 438141 - DNA, 25 bp, Mus musculus
gagccttgtggatcctgcacctgaa

SEQ ID NO: 438142 - DNA, 25 bp, Mus musculus
gagcctttcatctctggcggcagaa

SEQ ID NO: 438143 - DNA, 25 bp, Mus musculus
gagcgaaactccaatgatgtcacag

SEQ ID NO: 438144 - DNA, 25 bp, Mus musculus
gagcgaagcctgcacactgtgagaa

SEQ ID NO: 438145 - DNA, 25 bp, Mus musculus
gagcgaaggaggattactgtgcccc

SEQ ID NO: 438146 - DNA, 25 bp, Mus musculus
gagcgaatatataagaaggaaacca

SEQ ID NO: 438147 - DNA, 25 bp, Mus musculus
gagcgacaagccctacctttgcaag

SEQ ID NO: 438148 - DNA, 25 bp, Mus musculus
gagcgacacggctacattaaaggca

SEQ ID NO: 438149 - DNA, 25 bp, Mus musculus
gagcgacccagaagacgatgatgtt

SEQ ID NO: 438150 - DNA, 25 bp, Mus musculus
gagcgaccctaactttgcagccgag

SEQ ID NO: 438151 - DNA, 25 bp, Mus musculus
gagcgactcatcaagaagctgggcg

SEQ ID NO: 438152 - DNA, 25 bp, Mus musculus
gagcgactgcaactggagattgacc

SEQ ID NO: 438153 - DNA, 25 bp, Mus musculus
gagcgagagcgcagaatgtccaatg

SEQ ID NO: 438154 - DNA, 25 bp, Mus musculus
gagcgagattgtctataaaaggccc

SEQ ID NO: 438155 - DNA, 25 bp, Mus musculus
gagcgagcactgagtttagagcgaa

SEQ ID NO: 438156 - DNA, 25 bp, Mus musculus
gagcgagcgcataggcttcttgcaa

SEQ ID NO: 438157 - DNA, 25 bp, Mus musculus
gagcgagcgcatttatttgttctaa

SEQ ID NO: 438158 - DNA, 25 bp, Mus musculus
gagcgagctgagatttgcttgaaca

SEQ ID NO: 438159 - DNA, 25 bp, Mus musculus
gagcgaggcgagaaccagccgaatc

SEQ ID NO: 438160 - DNA, 25 bp, Mus musculus
gagcgatgatcttttcacagaggga

SEQ ID NO: 438161 - DNA, 25 bp, Mus musculus
gagcgatttcttcttagcagacagg

SEQ ID NO: 438162 - DNA, 25 bp, Mus musculus
gagcgcaaccgcgtaaagctggtaa

SEQ ID NO: 438163 - DNA, 25 bp, Mus musculus
gagcgcagcacaggttttgaatcac

SEQ ID NO: 438164 - DNA, 25 bp, Mus musculus
gagcgcatgaagcacagcatcaagc

SEQ ID NO: 438165 - DNA, 25 bp, Mus musculus
gagcgccaagtcaggactcctggag

SEQ ID NO: 438166 - DNA, 25 bp, Mus musculus
gagcgccccatacatcgatcaggtg

SEQ ID NO: 438167 - DNA, 25 bp, Mus musculus
gagcgcccctctgaaggttcttgag

SEQ ID NO: 438168 - DNA, 25 bp, Mus musculus
gagcgcccttccagagaatccaggt

SEQ ID NO: 438169 - DNA, 25 bp, Mus musculus
gagcgccgccaatatgcactgtaca

SEQ ID NO: 438170 - DNA, 25 bp, Mus musculus
gagcgccgcctagagatcagtaaga

SEQ ID NO: 438171 - DNA, 25 bp, Mus musculus
gagcgcctagcctgggagcatgatc

SEQ ID NO: 438172 - DNA, 25 bp, Mus musculus
gagcgcctccagaatttgtccgaga

SEQ ID NO: 438173 - DNA, 25 bp, Mus musculus
gagcgcctctgcagcggatacaggc

SEQ ID NO: 438174 - DNA, 25 bp, Mus musculus
gagcgcctctgctgctttcggcaaa

SEQ ID NO: 438175 - DNA, 25 bp, Mus musculus
gagcgcctgcgcattgaaattgtga

SEQ ID NO: 438176 - DNA, 25 bp, Mus musculus
gagcgccttgaaaatgcactaccgg

SEQ ID NO: 438177 - DNA, 25 bp, Mus musculus
gagcgcctttctgatctggccaaga

SEQ ID NO: 438178 - DNA, 25 bp, Mus musculus
gagcgcgcaagggttaaagtgtacc

SEQ ID NO: 438179 - DNA, 25 bp, Mus musculus
gagcgctccgttccgtggtattacg

SEQ ID NO: 438180 - DNA, 25 bp, Mus musculus
gagcgctccttctacagtggtgcag

SEQ ID NO: 438181 - DNA, 25 bp, Mus musculus
gagcgctgcaggagtctcgactgct

SEQ ID NO: 438182 - DNA, 25 bp, Mus musculus
gagcgctgccaattcacactcaagc

SEQ ID NO: 438183 - DNA, 25 bp, Mus musculus
gagcgctgggattaaggctgaacat

SEQ ID NO: 438184 - DNA, 25 bp, Mus musculus
gagcggaagacatgggcgttcattc

SEQ ID NO: 438185 - DNA, 25 bp, Mus musculus
gagcggattatcttgactagggaca

SEQ ID NO: 438186 - DNA, 25 bp, Mus musculus
gagcggattcaggaggaagcccaat

SEQ ID NO: 438187 - DNA, 25 bp, Mus musculus
gagcggattgaaaacgacgtggcca

SEQ ID NO: 438188 - DNA, 25 bp, Mus musculus
gagcggcagcgttcattgctctcca

SEQ ID NO: 438189 - DNA, 25 bp, Mus musculus
gagcggcatactccaacttctggtg

SEQ ID NO: 438190 - DNA, 25 bp, Mus musculus
gagcggccccgagtcatagtctcgt

SEQ ID NO: 438191 - DNA, 25 bp, Mus musculus
gagcggcccctgcttatcttcggca

SEQ ID NO: 438192 - DNA, 25 bp, Mus musculus
gagcggctttatgcacaagtcaaca

SEQ ID NO: 438193 - DNA, 25 bp, Mus musculus
gagcgggagaccgagaccctgatct

SEQ ID NO: 438194 - DNA, 25 bp, Mus musculus
gagcgggctatgtcctaagcaagga

SEQ ID NO: 438195 - DNA, 25 bp, Mus musculus
gagcgggtttccttcatgagtacca

SEQ ID NO: 438196 - DNA, 25 bp, Mus musculus
gagcggtccccttcagatacatcgg

SEQ ID NO: 438197 - DNA, 25 bp, Mus musculus
gagcggtcggatccctctgctcctg

SEQ ID NO: 438198 - DNA, 25 bp, Mus musculus
gagcggtctggatttacaacggcaa

SEQ ID NO: 438199 - DNA, 25 bp, Mus musculus
gagcggtgctcaaaggcagtctcct

SEQ ID NO: 438200 - DNA, 25 bp, Mus musculus
gagcggtgtcaccacatcactgcgt

SEQ ID NO: 438201 - DNA, 25 bp, Mus musculus
gagcggtttcctcacgcgttcggaa

SEQ ID NO: 438202 - DNA, 25 bp, Mus musculus
gagcgtccctgagaatgtcccttta

SEQ ID NO: 438203 - DNA, 25 bp, Mus musculus
gagcgtccttacacatagttcagtg

SEQ ID NO: 438204 - DNA, 25 bp, Mus musculus
gagcgtcggcttacttcagactgaa

SEQ ID NO: 438205 - DNA, 25 bp, Mus musculus
gagcgtcgtctaagcacccttggat

SEQ ID NO: 438206 - DNA, 25 bp, Mus musculus
gagcgtctattgttacttcccggcg

SEQ ID NO: 438207 - DNA, 25 bp, Mus musculus
gagcgtctcacggtgtgtgactgaa

SEQ ID NO: 438208 - DNA, 25 bp, Mus musculus
gagcgtctgcactttatcaccaggg

SEQ ID NO: 438209 - DNA, 25 bp, Mus musculus
gagcgtgcaccgtattttacaccgg

SEQ ID NO: 438210 - DNA, 25 bp, Mus musculus
gagcgtgcacctggtctcgcgagat

SEQ ID NO: 438211 - DNA, 25 bp, Mus musculus
gagcgtggccgggtgtataactaca

SEQ ID NO: 438212 - DNA, 25 bp, Mus musculus
gagcgtgtgccaagatattaagccc

SEQ ID NO: 438213 - DNA, 25 bp, Mus musculus
gagcgttacaatgctttgcctccag

SEQ ID NO: 438214 - DNA, 25 bp, Mus musculus
gagcgttcagaaggataattccagg

SEQ ID NO: 438215 - DNA, 25 bp, Mus musculus
gagcgttcagtgctcatcccggaga

SEQ ID NO: 438216 - DNA, 25 bp, Mus musculus
gagcgttctcatcggattgccacag

SEQ ID NO: 438217 - DNA, 25 bp, Mus musculus
gagcgttctccgtctcctatctgta

SEQ ID NO: 438218 - DNA, 25 bp, Mus musculus
gagcgttgtaaggtgtctctacccc

SEQ ID NO: 438219 - DNA, 25 bp, Mus musculus
gagcgtttgaaacgcacgtctcaga

SEQ ID NO: 438220 - DNA, 25 bp, Mus musculus
gagcgtttttcccatgttgccatga

SEQ ID NO: 438221 - DNA, 25 bp, Mus musculus
gagctaaaacacagtgtattcccag

SEQ ID NO: 438222 - DNA, 25 bp, Mus musculus
gagctaaaacatgactgcaacaggg

SEQ ID NO: 438223 - DNA, 25 bp, Mus musculus
gagctaaagaaatttattcacacag

SEQ ID NO: 438224 - DNA, 25 bp, Mus musculus
gagctaaaggtctcttctttgtgta

SEQ ID NO: 438225 - DNA, 25 bp, Mus musculus
gagctaaatccccacttaatgtgtg

SEQ ID NO: 438226 - DNA, 25 bp, Mus musculus
gagctaacctcagagtagtcaaggc

SEQ ID NO: 438227 - DNA, 25 bp, Mus musculus
gagctaagaaagagtgccaattccc

SEQ ID NO: 438228 - DNA, 25 bp, Mus musculus
gagctaaggacaaagtgggagccca

SEQ ID NO: 438229 - DNA, 25 bp, Mus musculus
gagctaattcccttctgttcacgga

SEQ ID NO: 438230 - DNA, 25 bp, Mus musculus
gagctacaccagattgcccggaatg

SEQ ID NO: 438231 - DNA, 25 bp, Mus musculus
gagctacagaccttccacggagggt

SEQ ID NO: 438232 - DNA, 25 bp, Mus musculus
gagctacaggattcatataacagga

SEQ ID NO: 438233 - DNA, 25 bp, Mus musculus
gagctacaggccacctatgagaggg

SEQ ID NO: 438234 - DNA, 25 bp, Mus musculus
gagctacatattgtgtaccaaggag

SEQ ID NO: 438235 - DNA, 25 bp, Mus musculus
gagctacatctgagacagcaccagg

SEQ ID NO: 438236 - DNA, 25 bp, Mus musculus
gagctaccatgtactgatgagtccc

SEQ ID NO: 438237 - DNA, 25 bp, Mus musculus
gagctaccccttgtcaacggagaaa

SEQ ID NO: 438238 - DNA, 25 bp, Mus musculus
gagctacctgtagccaggcatgaca

SEQ ID NO: 438239 - DNA, 25 bp, Mus musculus
gagctaccttcctagcctgtttgtt

SEQ ID NO: 438240 - DNA, 25 bp, Mus musculus
gagctacgtgatgcttgggtccaac

SEQ ID NO: 438241 - DNA, 25 bp, Mus musculus
gagctactcgtttcaggcactggcc

SEQ ID NO: 438242 - DNA, 25 bp, Mus musculus
gagctactgaaagcagcccaaggga

SEQ ID NO: 438243 - DNA, 25 bp, Mus musculus
gagctactgaatgaagactctccac

SEQ ID NO: 438244 - DNA, 25 bp, Mus musculus
gagctactgagcaaccgcaggtcgt

SEQ ID NO: 438245 - DNA, 25 bp, Mus musculus
gagctactgcatctgggactgtgtc

SEQ ID NO: 438246 - DNA, 25 bp, Mus musculus
gagctactgcgatggctgagccaga

SEQ ID NO: 438247 - DNA, 25 bp, Mus musculus
gagctactgctgtgatatccctggc

SEQ ID NO: 438248 - DNA, 25 bp, Mus musculus
gagctacttacattctagagatggg

SEQ ID NO: 438249 - DNA, 25 bp, Mus musculus
gagctacttcatccttcagaaagag

SEQ ID NO: 438250 - DNA, 25 bp, Mus musculus
gagctacttgtacgaccacctgaaa

SEQ ID NO: 438251 - DNA, 25 bp, Mus musculus
gagctactttagaccctgccttgaa

SEQ ID NO: 438252 - DNA, 25 bp, Mus musculus
gagctagaagatatcaccgtcaccg

SEQ ID NO: 438253 - DNA, 25 bp, Mus musculus
gagctagacttaaattactcgatag

SEQ ID NO: 438254 - DNA, 25 bp, Mus musculus
gagctagagtacatccatgccctga

SEQ ID NO: 438255 - DNA, 25 bp, Mus musculus
gagctagatctcaggcctcttcctt

SEQ ID NO: 438256 - DNA, 25 bp, Mus musculus
gagctagcaggtatggtgccagcct

SEQ ID NO: 438257 - DNA, 25 bp, Mus musculus
gagctagcgacctgacctgtaagag

SEQ ID NO: 438258 - DNA, 25 bp, Mus musculus
gagctaggcacctcatcagaagttg

SEQ ID NO: 438259 - DNA, 25 bp, Mus musculus
gagctaggtcttcccacattgacag

SEQ ID NO: 438260 - DNA, 25 bp, Mus musculus
gagctagttctcaccgacctttcag

SEQ ID NO: 438261 - DNA, 25 bp, Mus musculus
gagctatcaggacttcaccatggga

SEQ ID NO: 438262 - DNA, 25 bp, Mus musculus
gagctatcgcttcagcccaagattg

SEQ ID NO: 438263 - DNA, 25 bp, Mus musculus
gagctatgaagaccaaaaaccggcc

SEQ ID NO: 438264 - DNA, 25 bp, Mus musculus
gagctatggcgttcgtgaccaggca

SEQ ID NO: 438265 - DNA, 25 bp, Mus musculus
gagctatggctgttcttaatagacc

SEQ ID NO: 438266 - DNA, 25 bp, Mus musculus
gagctatgggttttctgtccagagg

SEQ ID NO: 438267 - DNA, 25 bp, Mus musculus
gagctatggtgtcaaccctgctgta

SEQ ID NO: 438268 - DNA, 25 bp, Mus musculus
gagctatggttactccagtggaaag

SEQ ID NO: 438269 - DNA, 25 bp, Mus musculus
gagctattcccatgacgtgttgcca

SEQ ID NO: 438270 - DNA, 25 bp, Mus musculus
gagctcaaaacaaatggaccccgga

SEQ ID NO: 438271 - DNA, 25 bp, Mus musculus
gagctcaaacactcccaggatcata

SEQ ID NO: 438272 - DNA, 25 bp, Mus musculus
gagctcaaactgactgactatcgtg

SEQ ID NO: 438273 - DNA, 25 bp, Mus musculus
gagctcaaggccagggagtctgaac

SEQ ID NO: 438274 - DNA, 25 bp, Mus musculus
gagctcaagttaatgcccgggtaga

SEQ ID NO: 438275 - DNA, 25 bp, Mus musculus
gagctcaattacgtggccaggcaga

SEQ ID NO: 438276 - DNA, 25 bp, Mus musculus
gagctcacctgctttgccaaggacg

SEQ ID NO: 438277 - DNA, 25 bp, Mus musculus
gagctcactggagacttctgccatt

SEQ ID NO: 438278 - DNA, 25 bp, Mus musculus
gagctcagagtgctccacgctgttc

SEQ ID NO: 438279 - DNA, 25 bp, Mus musculus
gagctcagcaccctgcggaacttgt

SEQ ID NO: 438280 - DNA, 25 bp, Mus musculus
gagctcagcagtagtttccttcgta

SEQ ID NO: 438281 - DNA, 25 bp, Mus musculus
gagctcagctccaagaaaacacggc

SEQ ID NO: 438282 - DNA, 25 bp, Mus musculus
gagctcagctgccattaagtcccca

SEQ ID NO: 438283 - DNA, 25 bp, Mus musculus
gagctcaggaggctcacctagagcc

SEQ ID NO: 438284 - DNA, 25 bp, Mus musculus
gagctcaggagtcccctcagtagaa

SEQ ID NO: 438285 - DNA, 25 bp, Mus musculus
gagctcaggccgaaatcaagttgca

SEQ ID NO: 438286 - DNA, 25 bp, Mus musculus
gagctcagtatgctacttagctgcc

SEQ ID NO: 438287 - DNA, 25 bp, Mus musculus
gagctcatcgtttcaaaggcccctg

SEQ ID NO: 438288 - DNA, 25 bp, Mus musculus
gagctcatggtctctgatggctggc

SEQ ID NO: 438289 - DNA, 25 bp, Mus musculus
gagctccaaatcacaacacccgtgg

SEQ ID NO: 438290 - DNA, 25 bp, Mus musculus
gagctccatctttacctcggaatga

SEQ ID NO: 438291 - DNA, 25 bp, Mus musculus
gagctcccacaaagccaagggcaat

SEQ ID NO: 438292 - DNA, 25 bp, Mus musculus
gagctccgaggaagatcaggcctta

SEQ ID NO: 438293 - DNA, 25 bp, Mus musculus
gagctcctacctgggtgtcgattgg

SEQ ID NO: 438294 - DNA, 25 bp, Mus musculus
gagctcctaggttctggtaacacca

SEQ ID NO: 438295 - DNA, 25 bp, Mus musculus
gagctcctcacaagggcgtcaagag

SEQ ID NO: 438296 - DNA, 25 bp, Mus musculus
gagctcctggtctagcaagccatga

SEQ ID NO: 438297 - DNA, 25 bp, Mus musculus
gagctccttgtggatagaacttccc

SEQ ID NO: 438298 - DNA, 25 bp, Mus musculus
gagctcctttcccagatgcagtatt

SEQ ID NO: 438299 - DNA, 25 bp, Mus musculus
gagctcgagtcagaatcaggcccga

SEQ ID NO: 438300 - DNA, 25 bp, Mus musculus
gagctcgcacgtgtcacccattggt

SEQ ID NO: 438301 - DNA, 25 bp, Mus musculus
gagctcgcagtgagtggccattccc

SEQ ID NO: 438302 - DNA, 25 bp, Mus musculus
gagctcgccagcaagacctttaagg

SEQ ID NO: 438303 - DNA, 25 bp, Mus musculus
gagctcggcatcctgatatgaagaa

SEQ ID NO: 438304 - DNA, 25 bp, Mus musculus
gagctcggtcgtcactattcaaggc

SEQ ID NO: 438305 - DNA, 25 bp, Mus musculus
gagctcggtggctgcgcgcttccca

SEQ ID NO: 438306 - DNA, 25 bp, Mus musculus
gagctctacaaaacgacctactggg

SEQ ID NO: 438307 - DNA, 25 bp, Mus musculus
gagctctactgtctctgagtgcaac

SEQ ID NO: 438308 - DNA, 25 bp, Mus musculus
gagctctagctgtaggtgggaccca

SEQ ID NO: 438309 - DNA, 25 bp, Mus musculus
gagctctatgctgtaccctggataa

SEQ ID NO: 438310 - DNA, 25 bp, Mus musculus
gagctctccatggtgcggattccca

SEQ ID NO: 438311 - DNA, 25 bp, Mus musculus
gagctctcggaggacattctgaaag

SEQ ID NO: 438312 - DNA, 25 bp, Mus musculus
gagctctcggatgtgcactgcctta

SEQ ID NO: 438313 - DNA, 25 bp, Mus musculus
gagctctctaaatctgatccaggga

SEQ ID NO: 438314 - DNA, 25 bp, Mus musculus
gagctctgccaagaaaactccactg

SEQ ID NO: 438315 - DNA, 25 bp, Mus musculus
gagctctgctccactgggcatgtga

SEQ ID NO: 438316 - DNA, 25 bp, Mus musculus
gagctctgtcagagtcgctgagaaa

SEQ ID NO: 438317 - DNA, 25 bp, Mus musculus
gagctctgtccagccacaagtttga

SEQ ID NO: 438318 - DNA, 25 bp, Mus musculus
gagctcttaaaactacctgtgtgga

SEQ ID NO: 438319 - DNA, 25 bp, Mus musculus
gagctcttccggtcagtaccaaccg

SEQ ID NO: 438320 - DNA, 25 bp, Mus musculus
gagctcttggcctacttcgttgtaa

SEQ ID NO: 438321 - DNA, 25 bp, Mus musculus
gagctgaaccctaaagatgctactt

SEQ ID NO: 438322 - DNA, 25 bp, Mus musculus
gagctgaagtacaggattggcatcc

SEQ ID NO: 438323 - DNA, 25 bp, Mus musculus
gagctgaagttccattccgtgtatt

SEQ ID NO: 438324 - DNA, 25 bp, Mus musculus
gagctgaataacgatgcgcaccgca

SEQ ID NO: 438325 - DNA, 25 bp, Mus musculus
gagctgacagagagggatccaaatt

SEQ ID NO: 438326 - DNA, 25 bp, Mus musculus
gagctgacagatgcacaaggccgtg

SEQ ID NO: 438327 - DNA, 25 bp, Mus musculus
gagctgaccatgagaaagccctgga

SEQ ID NO: 438328 - DNA, 25 bp, Mus musculus
gagctgagcagtcacccaccacggg

SEQ ID NO: 438329 - DNA, 25 bp, Mus musculus
gagctgagccggtgttcaaatgcct

SEQ ID NO: 438330 - DNA, 25 bp, Mus musculus
gagctgagcgtctgtgacgaagaca

SEQ ID NO: 438331 - DNA, 25 bp, Mus musculus
gagctgaggaaactaataaacatta

SEQ ID NO: 438332 - DNA, 25 bp, Mus musculus
gagctgagtactggctgcttttcct

SEQ ID NO: 438333 - DNA, 25 bp, Mus musculus
gagctgagttcgatccctgagacct

SEQ ID NO: 438334 - DNA, 25 bp, Mus musculus
gagctgatacttttgaccttcaacg

SEQ ID NO: 438335 - DNA, 25 bp, Mus musculus
gagctgatgctgtacactcaatgcc

SEQ ID NO: 438336 - DNA, 25 bp, Mus musculus
gagctgattggatgtcccacccaaa

SEQ ID NO: 438337 - DNA, 25 bp, Mus musculus
gagctgcaagcagccggtactctta

SEQ ID NO: 438338 - DNA, 25 bp, Mus musculus
gagctgcagccggtttgtgtccctg

SEQ ID NO: 438339 - DNA, 25 bp, Mus musculus
gagctgcagctcatgggcctagaga

SEQ ID NO: 438340 - DNA, 25 bp, Mus musculus
gagctgcagctctaggtaactgtga

SEQ ID NO: 438341 - DNA, 25 bp, Mus musculus
gagctgccaagtgtctgaggagaac

SEQ ID NO: 438342 - DNA, 25 bp, Mus musculus
gagctgccaccttcgatggaacgca

SEQ ID NO: 438343 - DNA, 25 bp, Mus musculus
gagctgccacggaaactgctgctga

SEQ ID NO: 438344 - DNA, 25 bp, Mus musculus
gagctgccacttccaaacactgaga

SEQ ID NO: 438345 - DNA, 25 bp, Mus musculus
gagctgcccgcttggaaagtaaaca

SEQ ID NO: 438346 - DNA, 25 bp, Mus musculus
gagctgccggataaaggtacccttg

SEQ ID NO: 438347 - DNA, 25 bp, Mus musculus
gagctgcctggatctggaagtcaac

SEQ ID NO: 438348 - DNA, 25 bp, Mus musculus
gagctgccttctacgtggctgccca

SEQ ID NO: 438349 - DNA, 25 bp, Mus musculus
gagctgcctttgcacggacacatga

SEQ ID NO: 438350 - DNA, 25 bp, Mus musculus
gagctgcgaatccaagtcactgatg

SEQ ID NO: 438351 - DNA, 25 bp, Mus musculus
gagctgcggactgacttcaagaacc

SEQ ID NO: 438352 - DNA, 25 bp, Mus musculus
gagctgcgggctgtgttcaatgtcc

SEQ ID NO: 438353 - DNA, 25 bp, Mus musculus
gagctgcgtccctttcaggatccag

SEQ ID NO: 438354 - DNA, 25 bp, Mus musculus
gagctgctacacaacatcgatcagg

SEQ ID NO: 438355 - DNA, 25 bp, Mus musculus
gagctgctccaatcagatccgtgga

SEQ ID NO: 438356 - DNA, 25 bp, Mus musculus
gagctgctgacatgtgtaccccgga

SEQ ID NO: 438357 - DNA, 25 bp, Mus musculus
gagctgctgacctttgggctcaggc

SEQ ID NO: 438358 - DNA, 25 bp, Mus musculus
gagctgctgcaccagatcgaaccaa

SEQ ID NO: 438359 - DNA, 25 bp, Mus musculus
gagctgctgccctatgactttgaga

SEQ ID NO: 438360 - DNA, 25 bp, Mus musculus
gagctgctgctcaaggactacctaa

SEQ ID NO: 438361 - DNA, 25 bp, Mus musculus
gagctgctggcatccggactggtat

SEQ ID NO: 438362 - DNA, 25 bp, Mus musculus
gagctgctggccttgttagaccgtg

SEQ ID NO: 438363 - DNA, 25 bp, Mus musculus
gagctgcttatcctacaacgagaag

SEQ ID NO: 438364 - DNA, 25 bp, Mus musculus
gagctgcttccgactttagatcaag

SEQ ID NO: 438365 - DNA, 25 bp, Mus musculus
gagctgcttctcgatttggccaaga

SEQ ID NO: 438366 - DNA, 25 bp, Mus musculus
gagctggacagcaacgtggatgact

SEQ ID NO: 438367 - DNA, 25 bp, Mus musculus
gagctggaccctggcgatgtgataa

SEQ ID NO: 438368 - DNA, 25 bp, Mus musculus
gagctggagaacgaattcctggtca

SEQ ID NO: 438369 - DNA, 25 bp, Mus musculus
gagctggagcccgaattcatgcctg

SEQ ID NO: 438370 - DNA, 25 bp, Mus musculus
gagctggccctgacacaaggcatga

SEQ ID NO: 438371 - DNA, 25 bp, Mus musculus
gagctggccggcaaggttaacctac

SEQ ID NO: 438372 - DNA, 25 bp, Mus musculus
gagctggctaagtgcaagatcgaca

SEQ ID NO: 438373 - DNA, 25 bp, Mus musculus
gagctgggcgtgagcacaaatgcca

SEQ ID NO: 438374 - DNA, 25 bp, Mus musculus
gagctgggttctgaggtcttacctt

SEQ ID NO: 438375 - DNA, 25 bp, Mus musculus
gagctggttatacctttggccaaga

SEQ ID NO: 438376 - DNA, 25 bp, Mus musculus
gagctggttcatgcacaacaactcg

SEQ ID NO: 438377 - DNA, 25 bp, Mus musculus
gagctggttgccttctacgtggaga

SEQ ID NO: 438378 - DNA, 25 bp, Mus musculus
gagctgtactactgtgtgaaggaca

SEQ ID NO: 438379 - DNA, 25 bp, Mus musculus
gagctgtactgcttactcaggacaa

SEQ ID NO: 438380 - DNA, 25 bp, Mus musculus
gagctgtagtcagtcctggtacctg

SEQ ID NO: 438381 - DNA, 25 bp, Mus musculus
gagctgtatacttgagcgttcctag

SEQ ID NO: 438382 - DNA, 25 bp, Mus musculus
gagctgtatcgctaccctagtggag

SEQ ID NO: 438383 - DNA, 25 bp, Mus musculus
gagctgtccaagtccctgaatgaac

SEQ ID NO: 438384 - DNA, 25 bp, Mus musculus
gagctgtcggctggaatccctcatg

SEQ ID NO: 438385 - DNA, 25 bp, Mus musculus
gagctgtctcactcctcttctggac

SEQ ID NO: 438386 - DNA, 25 bp, Mus musculus
gagctgtctcttgttcaccgctgaa

SEQ ID NO: 438387 - DNA, 25 bp, Mus musculus
gagctgtcttagtgtaggcacgcct

SEQ ID NO: 438388 - DNA, 25 bp, Mus musculus
gagctgtgaaaaccctcctcaagcg

SEQ ID NO: 438389 - DNA, 25 bp, Mus musculus
gagctgtgacaatgcaccatattga

SEQ ID NO: 438390 - DNA, 25 bp, Mus musculus
gagctgtgcatatccggaaagtcct

SEQ ID NO: 438391 - DNA, 25 bp, Mus musculus
gagctgtgccccaagtaaaaaagct

SEQ ID NO: 438392 - DNA, 25 bp, Mus musculus
gagctgtgccgagtctcccaaatca

SEQ ID NO: 438393 - DNA, 25 bp, Mus musculus
gagctgtgcctactgcacagacgag

SEQ ID NO: 438394 - DNA, 25 bp, Mus musculus
gagctgtggatttggatacccgaaa

SEQ ID NO: 438395 - DNA, 25 bp, Mus musculus
gagctgtgggcagaaacacttctta

SEQ ID NO: 438396 - DNA, 25 bp, Mus musculus
gagctgtgtgatacctgcacggaga

SEQ ID NO: 438397 - DNA, 25 bp, Mus musculus
gagctgttctgctacgagttgggat

SEQ ID NO: 438398 - DNA, 25 bp, Mus musculus
gagctgttctgtgagaatgctggac

SEQ ID NO: 438399 - DNA, 25 bp, Mus musculus
gagctgttctttgtttaaggactga

SEQ ID NO: 438400 - DNA, 25 bp, Mus musculus
gagctgttgagctgatcaggctgct

SEQ ID NO: 438401 - DNA, 25 bp, Mus musculus
gagctgttgctctgaccttggagga

SEQ ID NO: 438402 - DNA, 25 bp, Mus musculus
gagctgtttggtacagacgacacgg

SEQ ID NO: 438403 - DNA, 25 bp, Mus musculus
gagctgtttgtcatggcccgagaac

SEQ ID NO: 438404 - DNA, 25 bp, Mus musculus
gagcttaaagtgcatcgccaatggg

SEQ ID NO: 438405 - DNA, 25 bp, Mus musculus
gagcttaactgctgaggtgccggct

SEQ ID NO: 438406 - DNA, 25 bp, Mus musculus
gagcttaagatgtcttgatttacaa

SEQ ID NO: 438407 - DNA, 25 bp, Mus musculus
gagcttaaggctttgacccctgagg

SEQ ID NO: 438408 - DNA, 25 bp, Mus musculus
gagcttaccagctcaggatccctga

SEQ ID NO: 438409 - DNA, 25 bp, Mus musculus
gagcttaccggatttcacctgtgga

SEQ ID NO: 438410 - DNA, 25 bp, Mus musculus
gagcttacggctgggtgttccactt

SEQ ID NO: 438411 - DNA, 25 bp, Mus musculus
gagcttagaacgttatgccctggtg

SEQ ID NO: 438412 - DNA, 25 bp, Mus musculus
gagcttagaggatacagaaatcttc

SEQ ID NO: 438413 - DNA, 25 bp, Mus musculus
gagcttagattctctgaaggccctg

SEQ ID NO: 438414 - DNA, 25 bp, Mus musculus
gagcttatcctagaagacagacaga

SEQ ID NO: 438415 - DNA, 25 bp, Mus musculus
gagcttattcatccatccactgata

SEQ ID NO: 438416 - DNA, 25 bp, Mus musculus
gagcttattcggctacaccaaggac

SEQ ID NO: 438417 - DNA, 25 bp, Mus musculus
gagcttcaacgcaacctgggtctgg

SEQ ID NO: 438418 - DNA, 25 bp, Mus musculus
gagcttcaactttctggtgctgcag

SEQ ID NO: 438419 - DNA, 25 bp, Mus musculus
gagcttcaagaacaggtagatggca

SEQ ID NO: 438420 - DNA, 25 bp, Mus musculus
gagcttcacatctggcccaaaggtg

SEQ ID NO: 438421 - DNA, 25 bp, Mus musculus
gagcttcaggccgagtgtgcatcct

SEQ ID NO: 438422 - DNA, 25 bp, Mus musculus
gagcttcagtctcgtgtgcccgtgc

SEQ ID NO: 438423 - DNA, 25 bp, Mus musculus
gagcttcagttaagagatagagatc

SEQ ID NO: 438424 - DNA, 25 bp, Mus musculus
gagcttcatctggaagtgctggtcc

SEQ ID NO: 438425 - DNA, 25 bp, Mus musculus
gagcttcatgcttctgactttcatc

SEQ ID NO: 438426 - DNA, 25 bp, Mus musculus
gagcttccagtacgatcatgaggcc

SEQ ID NO: 438427 - DNA, 25 bp, Mus musculus
gagcttccctcaggactctagagaa

SEQ ID NO: 438428 - DNA, 25 bp, Mus musculus
gagcttccgagtatcagacctgcag

SEQ ID NO: 438429 - DNA, 25 bp, Mus musculus
gagcttcctactctgccaagatctg

SEQ ID NO: 438430 - DNA, 25 bp, Mus musculus
gagcttcctgcagggtgtgaataaa

SEQ ID NO: 438431 - DNA, 25 bp, Mus musculus
gagcttcgagagtcaactatgcctg

SEQ ID NO: 438432 - DNA, 25 bp, Mus musculus
gagcttcgagggtttaggagcctca

SEQ ID NO: 438433 - DNA, 25 bp, Mus musculus
gagcttcggaataaactggcctgca

SEQ ID NO: 438434 - DNA, 25 bp, Mus musculus
gagcttcggcgcttctcaatcatga

SEQ ID NO: 438435 - DNA, 25 bp, Mus musculus
gagcttctcagcaaggtccttaacg

SEQ ID NO: 438436 - DNA, 25 bp, Mus musculus
gagcttctgcggcacagggattaca

SEQ ID NO: 438437 - DNA, 25 bp, Mus musculus
gagcttctgtaagatcctgggacca

SEQ ID NO: 438438 - DNA, 25 bp, Mus musculus
gagcttcttcttgttttgcccttga

SEQ ID NO: 438439 - DNA, 25 bp, Mus musculus
gagcttgaagctcgagtgtttccac

SEQ ID NO: 438440 - DNA, 25 bp, Mus musculus
gagcttgacctgctggatatccgag

SEQ ID NO: 438441 - DNA, 25 bp, Mus musculus
gagcttgagaaatgctcgcactcag

SEQ ID NO: 438442 - DNA, 25 bp, Mus musculus
gagcttgagacccttcattcgttca

SEQ ID NO: 438443 - DNA, 25 bp, Mus musculus
gagcttgagagtcccttacaacagg

SEQ ID NO: 438444 - DNA, 25 bp, Mus musculus
gagcttgcagactgagccagaggct

SEQ ID NO: 438445 - DNA, 25 bp, Mus musculus
gagcttgcataacgccaggcgagaa

SEQ ID NO: 438446 - DNA, 25 bp, Mus musculus
gagcttgcgcacttgttctcacggg

SEQ ID NO: 438447 - DNA, 25 bp, Mus musculus
gagcttgctccactcctgcagctgg

SEQ ID NO: 438448 - DNA, 25 bp, Mus musculus
gagcttgctcctgctactgtgggct

SEQ ID NO: 438449 - DNA, 25 bp, Mus musculus
gagcttgctcttcaaacaggaaaag

SEQ ID NO: 438450 - DNA, 25 bp, Mus musculus
gagcttggtaggttctgggctccta

SEQ ID NO: 438451 - DNA, 25 bp, Mus musculus
gagcttgtgagccttccctctggct

SEQ ID NO: 438452 - DNA, 25 bp, Mus musculus
gagcttgtgcctccatagacttcca

SEQ ID NO: 438453 - DNA, 25 bp, Mus musculus
gagcttgtggaactcatgcaacgga

SEQ ID NO: 438454 - DNA, 25 bp, Mus musculus
gagcttgtggatacaagtcaccggg

SEQ ID NO: 438455 - DNA, 25 bp, Mus musculus
gagcttgttacctttctcggaggat

SEQ ID NO: 438456 - DNA, 25 bp, Mus musculus
gagctttaactgttcgccggagaca

SEQ ID NO: 438457 - DNA, 25 bp, Mus musculus
gagctttacccgagagatcgaggca

SEQ ID NO: 438458 - DNA, 25 bp, Mus musculus
gagctttccagactcagtttaccga

SEQ ID NO: 438459 - DNA, 25 bp, Mus musculus
gagctttccttgtcttatgtactga

SEQ ID NO: 438460 - DNA, 25 bp, Mus musculus
gagctttcggagagtaaacctgtcc

SEQ ID NO: 438461 - DNA, 25 bp, Mus musculus
gagctttgctctgtctccggaggaa

SEQ ID NO: 438462 - DNA, 25 bp, Mus musculus
gagctttgcttcagcccagcgctgc

SEQ ID NO: 438463 - DNA, 25 bp, Mus musculus
gagctttggctactcgctgtacgca

SEQ ID NO: 438464 - DNA, 25 bp, Mus musculus
gagctttgtagtgagccatccgtga

SEQ ID NO: 438465 - DNA, 25 bp, Mus musculus
gagctttgtgcagcctgggaagccc

SEQ ID NO: 438466 - DNA, 25 bp, Mus musculus
gagctttgtgcagcttcgtcactga

SEQ ID NO: 438467 - DNA, 25 bp, Mus musculus
gagcttttaagataaactgagagag

SEQ ID NO: 438468 - DNA, 25 bp, Mus musculus
gagcttttcctccagcaggtcagtc

SEQ ID NO: 438469 - DNA, 25 bp, Mus musculus
gagcttttgagctggcaccttggag

SEQ ID NO: 438470 - DNA, 25 bp, Mus musculus
gagctttttgcgaaggactgcccgc

SEQ ID NO: 438471 - DNA, 25 bp, Mus musculus
gaggaaaaacatcaacgtgcaggtg

SEQ ID NO: 438472 - DNA, 25 bp, Mus musculus
gaggaaaagagctcgtctcagactt

SEQ ID NO: 438473 - DNA, 25 bp, Mus musculus
gaggaaacacagcatcgcctttaga

SEQ ID NO: 438474 - DNA, 25 bp, Mus musculus
gaggaaacagcactcagcatgactg

SEQ ID NO: 438475 - DNA, 25 bp, Mus musculus
gaggaaaccctacacaaagcagcag

SEQ ID NO: 438476 - DNA, 25 bp, Mus musculus
gaggaaactcctcagacgcatgaag

SEQ ID NO: 438477 - DNA, 25 bp, Mus musculus
gaggaaactccttggctgaacagcg

SEQ ID NO: 438478 - DNA, 25 bp, Mus musculus
gaggaaagaccccattgctgtgcgc

SEQ ID NO: 438479 - DNA, 25 bp, Mus musculus
gaggaaagccctcaccttgatcggg

SEQ ID NO: 438480 - DNA, 25 bp, Mus musculus
gaggaaagccgaagactactgtcag

SEQ ID NO: 438481 - DNA, 25 bp, Mus musculus
gaggaaagcgtgaatgttgtcacta

SEQ ID NO: 438482 - DNA, 25 bp, Mus musculus
gaggaaagctgagaaggcccattac

SEQ ID NO: 438483 - DNA, 25 bp, Mus musculus
gaggaaaggcaaggaacgcctgctc

SEQ ID NO: 438484 - DNA, 25 bp, Mus musculus
gaggaaagggtctgaaatctggcct

SEQ ID NO: 438485 - DNA, 25 bp, Mus musculus
gaggaaatcctctccatcctggaag

SEQ ID NO: 438486 - DNA, 25 bp, Mus musculus
gaggaaatccttctgcacgatagct

SEQ ID NO: 438487 - DNA, 25 bp, Mus musculus
gaggaaatctctccccatttggcag

SEQ ID NO: 438488 - DNA, 25 bp, Mus musculus
gaggaaatgcactacaaggccgtcc

SEQ ID NO: 438489 - DNA, 25 bp, Mus musculus
gaggaaattgttgcccttatgcata

SEQ ID NO: 438490 - DNA, 25 bp, Mus musculus
gaggaaatttcgcagacagcgcccc

SEQ ID NO: 438491 - DNA, 25 bp, Mus musculus
gaggaacaaatctgccctcctgtgt

SEQ ID NO: 438492 - DNA, 25 bp, Mus musculus
gaggaacaatacaccagcatacttg

SEQ ID NO: 438493 - DNA, 25 bp, Mus musculus
gaggaacacactatttgatcatggc

SEQ ID NO: 438494 - DNA, 25 bp, Mus musculus
gaggaacagcatcatttggagacat

SEQ ID NO: 438495 - DNA, 25 bp, Mus musculus
gaggaacaggctttgataagtgtcc

SEQ ID NO: 438496 - DNA, 25 bp, Mus musculus
gaggaacaggtcttcacggcaacat

SEQ ID NO: 438497 - DNA, 25 bp, Mus musculus
gaggaacagtatctcagccctgatg

SEQ ID NO: 438498 - DNA, 25 bp, Mus musculus
gaggaacattctagatctactggaa

SEQ ID NO: 438499 - DNA, 25 bp, Mus musculus
gaggaaccaagcctacaggtacaga

SEQ ID NO: 438500 - DNA, 25 bp, Mus musculus
gaggaaccaagctacggcggctgct

SEQ ID NO: 438501 - DNA, 25 bp, Mus musculus
gaggaaccactttagtcgtcaagaa

SEQ ID NO: 438502 - DNA, 25 bp, Mus musculus
gaggaaccagtcgactactatgcca

SEQ ID NO: 438503 - DNA, 25 bp, Mus musculus
gaggaaccttttggcaccctatgag

SEQ ID NO: 438504 - DNA, 25 bp, Mus musculus
gaggaacgcagggtcaaggtctcca

SEQ ID NO: 438505 - DNA, 25 bp, Mus musculus
gaggaacgtcccgtgcgctggactt

SEQ ID NO: 438506 - DNA, 25 bp, Mus musculus
gaggaactaatctgttctgcccacc

SEQ ID NO: 438507 - DNA, 25 bp, Mus musculus
gaggaactacctcgtccagactgag

SEQ ID NO: 438508 - DNA, 25 bp, Mus musculus
gaggaactagcagccactgggcagt

SEQ ID NO: 438509 - DNA, 25 bp, Mus musculus
gaggaactcagttgcagagaggcat

SEQ ID NO: 438510 - DNA, 25 bp, Mus musculus
gaggaactcttacctagctcctgag

SEQ ID NO: 438511 - DNA, 25 bp, Mus musculus
gaggaactgccgctctgaagactga

SEQ ID NO: 438512 - DNA, 25 bp, Mus musculus
gaggaactggctgagtgcttccgca

SEQ ID NO: 438513 - DNA, 25 bp, Mus musculus
gaggaagaaacagcgcctctcgtcc

SEQ ID NO: 438514 - DNA, 25 bp, Mus musculus
gaggaagaaagtcatctctaccagc

SEQ ID NO: 438515 - DNA, 25 bp, Mus musculus
gaggaagaagaacccactggctaca

SEQ ID NO: 438516 - DNA, 25 bp, Mus musculus
gaggaagaaggcaccgctcgtttct

SEQ ID NO: 438517 - DNA, 25 bp, Mus musculus
gaggaagaatctacccggtgtctgt

SEQ ID NO: 438518 - DNA, 25 bp, Mus musculus
gaggaagaccactaccagcgtgtga

SEQ ID NO: 438519 - DNA, 25 bp, Mus musculus
gaggaagactttgcgaagattctca

SEQ ID NO: 438520 - DNA, 25 bp, Mus musculus
gaggaagagccaccttcatagctta

SEQ ID NO: 438521 - DNA, 25 bp, Mus musculus
gaggaagagcccctggactactatg

SEQ ID NO: 438522 - DNA, 25 bp, Mus musculus
gaggaagaggcaacctgacctagtc

SEQ ID NO: 438523 - DNA, 25 bp, Mus musculus
gaggaagaggtgacctgctccatct

SEQ ID NO: 438524 - DNA, 25 bp, Mus musculus
gaggaagatgtctcccaggctatcc

SEQ ID NO: 438525 - DNA, 25 bp, Mus musculus
gaggaagcacagcacaaaagcagaa

SEQ ID NO: 438526 - DNA, 25 bp, Mus musculus
gaggaagcactggtaactccgaccg

SEQ ID NO: 438527 - DNA, 25 bp, Mus musculus
gaggaagccacctcccgagaaaaca

SEQ ID NO: 438528 - DNA, 25 bp, Mus musculus
gaggaagccaggatggcgactccga

SEQ ID NO: 438529 - DNA, 25 bp, Mus musculus
gaggaagcgtataccacagaacact

SEQ ID NO: 438530 - DNA, 25 bp, Mus musculus
gaggaagctcctgactatgagaatc

SEQ ID NO: 438531 - DNA, 25 bp, Mus musculus
gaggaagctgcttgacgaggcgtga

SEQ ID NO: 438532 - DNA, 25 bp, Mus musculus
gaggaagctgtcgagccttgaagtc

SEQ ID NO: 438533 - DNA, 25 bp, Mus musculus
gaggaagctttccaatggctgaaaa

SEQ ID NO: 438534 - DNA, 25 bp, Mus musculus
gaggaaggaatgagccactgttgct

SEQ ID NO: 438535 - DNA, 25 bp, Mus musculus
gaggaaggagacttaagatccacac

SEQ ID NO: 438536 - DNA, 25 bp, Mus musculus
gaggaaggataagactctgctccaa

SEQ ID NO: 438537 - DNA, 25 bp, Mus musculus
gaggaaggatgtctcaaagtaagaa

SEQ ID NO: 438538 - DNA, 25 bp, Mus musculus
gaggaaggatttatggtggccaaca

SEQ ID NO: 438539 - DNA, 25 bp, Mus musculus
gaggaagggcagactctagagcacc

SEQ ID NO: 438540 - DNA, 25 bp, Mus musculus
gaggaagtattctcccagcagccaa

SEQ ID NO: 438541 - DNA, 25 bp, Mus musculus
gaggaagtccccattcatgcatgtg

SEQ ID NO: 438542 - DNA, 25 bp, Mus musculus
gaggaagtcgttcctaccgcccctg

SEQ ID NO: 438543 - DNA, 25 bp, Mus musculus
gaggaagtctccctcctgatggcag

SEQ ID NO: 438544 - DNA, 25 bp, Mus musculus
gaggaagtctctcgctggttgccaa

SEQ ID NO: 438545 - DNA, 25 bp, Mus musculus
gaggaagtctctgccagtcccttga

SEQ ID NO: 438546 - DNA, 25 bp, Mus musculus
gaggaagtgcgtctggttttcaccc

SEQ ID NO: 438547 - DNA, 25 bp, Mus musculus
gaggaagttcttgggcccagtgcca

SEQ ID NO: 438548 - DNA, 25 bp, Mus musculus
gaggaataccccatgatgcggcgtg

SEQ ID NO: 438549 - DNA, 25 bp, Mus musculus
gaggaatcacttggcacgacacttg

SEQ ID NO: 438550 - DNA, 25 bp, Mus musculus
gaggaatcctgtcgagcagctatga

SEQ ID NO: 438551 - DNA, 25 bp, Mus musculus
gaggaatcgctaccctgacatgagc

SEQ ID NO: 438552 - DNA, 25 bp, Mus musculus
gaggaatcttcatgtacccagccaa

SEQ ID NO: 438553 - DNA, 25 bp, Mus musculus
gaggaatggctttcccagggagaca

SEQ ID NO: 438554 - DNA, 25 bp, Mus musculus
gaggaattccagaatggcattgcca

SEQ ID NO: 438555 - DNA, 25 bp, Mus musculus
gaggaattcttagccaatgcccgcg

SEQ ID NO: 438556 - DNA, 25 bp, Mus musculus
gaggaatttaaattatccctggcac

SEQ ID NO: 438557 - DNA, 25 bp, Mus musculus
gaggacaacaccattagcagctgct

SEQ ID NO: 438558 - DNA, 25 bp, Mus musculus
gaggacaactttcgctactttctgg

SEQ ID NO: 438559 - DNA, 25 bp, Mus musculus
gaggacaagccggatcaccattgga

SEQ ID NO: 438560 - DNA, 25 bp, Mus musculus
gaggacaagctgcactatcgtagcg

SEQ ID NO: 438561 - DNA, 25 bp, Mus musculus
gaggacaccaccaactggctacgat

SEQ ID NO: 438562 - DNA, 25 bp, Mus musculus
gaggacaccgcgcaggtaaggtaag

SEQ ID NO: 438563 - DNA, 25 bp, Mus musculus
gaggacacgtcgtggtcgccgttcc

SEQ ID NO: 438564 - DNA, 25 bp, Mus musculus
gaggacactgccaccatggctgcta

SEQ ID NO: 438565 - DNA, 25 bp, Mus musculus
gaggacactgctaacagaccacaca

SEQ ID NO: 438566 - DNA, 25 bp, Mus musculus
gaggacactggatagacttcgaaca

SEQ ID NO: 438567 - DNA, 25 bp, Mus musculus
gaggacactgggtgcttaccatgcc

SEQ ID NO: 438568 - DNA, 25 bp, Mus musculus
gaggacactgtacaacattgactta

SEQ ID NO: 438569 - DNA, 25 bp, Mus musculus
gaggacagatggagatcccggttca

SEQ ID NO: 438570 - DNA, 25 bp, Mus musculus
gaggacagcaagatcgaccactatg

SEQ ID NO: 438571 - DNA, 25 bp, Mus musculus
gaggacagggaacacctctgcactg

SEQ ID NO: 438572 - DNA, 25 bp, Mus musculus
gaggacagtaccacggcgcctgcga

SEQ ID NO: 438573 - DNA, 25 bp, Mus musculus
gaggacagtcgagcctcagtgccag

SEQ ID NO: 438574 - DNA, 25 bp, Mus musculus
gaggacagtgttgatgcctaactag

SEQ ID NO: 438575 - DNA, 25 bp, Mus musculus
gaggacatcaccaccgtgggctcta

SEQ ID NO: 438576 - DNA, 25 bp, Mus musculus
gaggacatcttctctgaggcccaga

SEQ ID NO: 438577 - DNA, 25 bp, Mus musculus
gaggacatgcacaccattggcttcg

SEQ ID NO: 438578 - DNA, 25 bp, Mus musculus
gaggacattccataggcccacttga

SEQ ID NO: 438579 - DNA, 25 bp, Mus musculus
gaggacatttaaaggtccaggactg

SEQ ID NO: 438580 - DNA, 25 bp, Mus musculus
gaggaccacctcagccgtttcgtgt

SEQ ID NO: 438581 - DNA, 25 bp, Mus musculus
gaggaccacgcccttctctgtgact

SEQ ID NO: 438582 - DNA, 25 bp, Mus musculus
gaggaccactaccacgctgacgtgg

SEQ ID NO: 438583 - DNA, 25 bp, Mus musculus
gaggaccagaaagctttgcccacta

SEQ ID NO: 438584 - DNA, 25 bp, Mus musculus
gaggaccagcatctaactacttggg

SEQ ID NO: 438585 - DNA, 25 bp, Mus musculus
gaggaccagtcagccaaaagttgaa

SEQ ID NO: 438586 - DNA, 25 bp, Mus musculus
gaggaccagttaaagtggcagcaag

SEQ ID NO: 438587 - DNA, 25 bp, Mus musculus
gaggaccagtttatccagcacatgg

SEQ ID NO: 438588 - DNA, 25 bp, Mus musculus
gaggaccatgactttgaccccactg

SEQ ID NO: 438589 - DNA, 25 bp, Mus musculus
gaggacccaagagtatgatatcacc

SEQ ID NO: 438590 - DNA, 25 bp, Mus musculus
gaggacccattatcagctcatgatg

SEQ ID NO: 438591 - DNA, 25 bp, Mus musculus
gaggacccgttgcaccattaagaca

SEQ ID NO: 438592 - DNA, 25 bp, Mus musculus
gaggaccctctacaagcaagtgatg

SEQ ID NO: 438593 - DNA, 25 bp, Mus musculus
gaggacccttctgcaagaacttagg

SEQ ID NO: 438594 - DNA, 25 bp, Mus musculus
gaggaccgacgtgagagatgagaca

SEQ ID NO: 438595 - DNA, 25 bp, Mus musculus
gaggaccgcacacgtttctatggtg

SEQ ID NO: 438596 - DNA, 25 bp, Mus musculus
gaggaccgcttctataacaaccacg

SEQ ID NO: 438597 - DNA, 25 bp, Mus musculus
gaggacctaaccctgaagtttctgg

SEQ ID NO: 438598 - DNA, 25 bp, Mus musculus
gaggacctacgtgaccgcatgatgc

SEQ ID NO: 438599 - DNA, 25 bp, Mus musculus
gaggacctagacttggaacacagct

SEQ ID NO: 438600 - DNA, 25 bp, Mus musculus
gaggacctcagttcgttttccagcc

SEQ ID NO: 438601 - DNA, 25 bp, Mus musculus
gaggacctcggcagtagaggctctc

SEQ ID NO: 438602 - DNA, 25 bp, Mus musculus
gaggacctctctgacaagactttga

SEQ ID NO: 438603 - DNA, 25 bp, Mus musculus
gaggacctggcaaatcggctactag

SEQ ID NO: 438604 - DNA, 25 bp, Mus musculus
gaggacgagctaaggctgctaacca

SEQ ID NO: 438605 - DNA, 25 bp, Mus musculus
gaggacgatcgctccgacagctcct

SEQ ID NO: 438606 - DNA, 25 bp, Mus musculus
gaggacgcgcccatcagcgctgagc

SEQ ID NO: 438607 - DNA, 25 bp, Mus musculus
gaggacgcgggatcttacagtgtca

SEQ ID NO: 438608 - DNA, 25 bp, Mus musculus
gaggacggccatcagatactttgtg

SEQ ID NO: 438609 - DNA, 25 bp, Mus musculus
gaggacgggctctgccagtacaagt

SEQ ID NO: 438610 - DNA, 25 bp, Mus musculus
gaggacgtcagtaccttcagtaccg

SEQ ID NO: 438611 - DNA, 25 bp, Mus musculus
gaggacgtcctcatccttggataac

SEQ ID NO: 438612 - DNA, 25 bp, Mus musculus
gaggactcagcccttagctctggag

SEQ ID NO: 438613 - DNA, 25 bp, Mus musculus
gaggactcagtactgtgagctctga

SEQ ID NO: 438614 - DNA, 25 bp, Mus musculus
gaggactcctactactgcaagctga

SEQ ID NO: 438615 - DNA, 25 bp, Mus musculus
gaggactcggactggaactttctgt

SEQ ID NO: 438616 - DNA, 25 bp, Mus musculus
gaggactctccctgaccaaggacta

SEQ ID NO: 438617 - DNA, 25 bp, Mus musculus
gaggactctgctatggccaggacag

SEQ ID NO: 438618 - DNA, 25 bp, Mus musculus
gaggactctggcagtgccacgctga

SEQ ID NO: 438619 - DNA, 25 bp, Mus musculus
gaggactgaatcttctacgactgaa

SEQ ID NO: 438620 - DNA, 25 bp, Mus musculus
gaggactgaatgctagcccaagcca

SEQ ID NO: 438621 - DNA, 25 bp, Mus musculus
gaggactgacttaacacacttgagc

SEQ ID NO: 438622 - DNA, 25 bp, Mus musculus
gaggactgcagccatcatagcaggt

SEQ ID NO: 438623 - DNA, 25 bp, Mus musculus
gaggactggtcagcacctttacgca

SEQ ID NO: 438624 - DNA, 25 bp, Mus musculus
gaggactgtgctcttctcacagcca

SEQ ID NO: 438625 - DNA, 25 bp, Mus musculus
gaggactgttcctgccattcagaca

SEQ ID NO: 438626 - DNA, 25 bp, Mus musculus
gaggacttaacaccacatgactgag

SEQ ID NO: 438627 - DNA, 25 bp, Mus musculus
gaggacttcagtacccagatgggaa

SEQ ID NO: 438628 - DNA, 25 bp, Mus musculus
gaggacttcgtgttggcctcagaga

SEQ ID NO: 438629 - DNA, 25 bp, Mus musculus
gaggactttacagaatgaccagccc

SEQ ID NO: 438630 - DNA, 25 bp, Mus musculus
gaggactttatcacttgagcctgga

SEQ ID NO: 438631 - DNA, 25 bp, Mus musculus
gaggactttcctttcacagcccaga

SEQ ID NO: 438632 - DNA, 25 bp, Mus musculus
gaggactttcttttgcttatttcac

SEQ ID NO: 438633 - DNA, 25 bp, Mus musculus
gaggactttgcgtatagccctgccc

SEQ ID NO: 438634 - DNA, 25 bp, Mus musculus
gaggactttgtcttcggccacttct

SEQ ID NO: 438635 - DNA, 25 bp, Mus musculus
gaggagaacccatgtaactgtccac

SEQ ID NO: 438636 - DNA, 25 bp, Mus musculus
gaggagaacccttccttcaggacag

SEQ ID NO: 438637 - DNA, 25 bp, Mus musculus
gaggagaaggttaagaagagaacac

SEQ ID NO: 438638 - DNA, 25 bp, Mus musculus
gaggagaatgctctttcagtctgga

SEQ ID NO: 438639 - DNA, 25 bp, Mus musculus
gaggagacccctgtgaatgacaact

SEQ ID NO: 438640 - DNA, 25 bp, Mus musculus
gaggagaccttcacagccttacgaa

SEQ ID NO: 438641 - DNA, 25 bp, Mus musculus
gaggagacgacacagaaatgagaca

SEQ ID NO: 438642 - DNA, 25 bp, Mus musculus
gaggagactcgggaaacgccctctg

SEQ ID NO: 438643 - DNA, 25 bp, Mus musculus
gaggagactctcacctatcatggct

SEQ ID NO: 438644 - DNA, 25 bp, Mus musculus
gaggagactgatagagcctcttggt

SEQ ID NO: 438645 - DNA, 25 bp, Mus musculus
gaggagagagcccttacaagacagc

SEQ ID NO: 438646 - DNA, 25 bp, Mus musculus
gaggagagcccctgttcagctgatg

SEQ ID NO: 438647 - DNA, 25 bp, Mus musculus
gaggagagttaatattgcccattat

SEQ ID NO: 438648 - DNA, 25 bp, Mus musculus
gaggagatcacagctcgcctgcatt

SEQ ID NO: 438649 - DNA, 25 bp, Mus musculus
gaggagatcatgctggaaacacgcc

SEQ ID NO: 438650 - DNA, 25 bp, Mus musculus
gaggagatcgaatccctgatgaagg

SEQ ID NO: 438651 - DNA, 25 bp, Mus musculus
gaggagatctccctatgtggctaga

SEQ ID NO: 438652 - DNA, 25 bp, Mus musculus
gaggagcaacatcctttggccacag

SEQ ID NO: 438653 - DNA, 25 bp, Mus musculus
gaggagcaaccaaggtaagcagctg

SEQ ID NO: 438654 - DNA, 25 bp, Mus musculus
gaggagcaacccatgtctaccgtta

SEQ ID NO: 438655 - DNA, 25 bp, Mus musculus
gaggagcacagctccaggagcaccc

SEQ ID NO: 438656 - DNA, 25 bp, Mus musculus
gaggagcacatgctccgaagactcc

SEQ ID NO: 438657 - DNA, 25 bp, Mus musculus
gaggagcacgccacacaaggatgcc

SEQ ID NO: 438658 - DNA, 25 bp, Mus musculus
gaggagcactatcgcttccacgagt

SEQ ID NO: 438659 - DNA, 25 bp, Mus musculus
gaggagccaaatcaccaaacaggac

SEQ ID NO: 438660 - DNA, 25 bp, Mus musculus
gaggagccaacgtgccaaatctgta

SEQ ID NO: 438661 - DNA, 25 bp, Mus musculus
gaggagccagcatcttaaatatgaa

SEQ ID NO: 438662 - DNA, 25 bp, Mus musculus
gaggagccagccaatcgatgatgag

SEQ ID NO: 438663 - DNA, 25 bp, Mus musculus
gaggagccatcacaatagactgccc

SEQ ID NO: 438664 - DNA, 25 bp, Mus musculus
gaggagcccaagctgcagttcagtt

SEQ ID NO: 438665 - DNA, 25 bp, Mus musculus
gaggagccctaccagcatgtctgct

SEQ ID NO: 438666 - DNA, 25 bp, Mus musculus
gaggagccctttgagaaacagcaga

SEQ ID NO: 438667 - DNA, 25 bp, Mus musculus
gaggagcctaaacaagccgatgtgc

SEQ ID NO: 438668 - DNA, 25 bp, Mus musculus
gaggagcctccaaatatctgtcagc

SEQ ID NO: 438669 - DNA, 25 bp, Mus musculus
gaggagcgcacgtacaaagagctgc

SEQ ID NO: 438670 - DNA, 25 bp, Mus musculus
gaggagcggcctgcgcatgctccat

SEQ ID NO: 438671 - DNA, 25 bp, Mus musculus
gaggagcgtcttgcaaaacctgcca

SEQ ID NO: 438672 - DNA, 25 bp, Mus musculus
gaggagctatattggctggccaccc

SEQ ID NO: 438673 - DNA, 25 bp, Mus musculus
gaggagctcgacttggccatctata

SEQ ID NO: 438674 - DNA, 25 bp, Mus musculus
gaggagctctttgtgtttataacag

SEQ ID NO: 438675 - DNA, 25 bp, Mus musculus
gaggagctgaaacttccaaaattac

SEQ ID NO: 438676 - DNA, 25 bp, Mus musculus
gaggagctgaagcaacatctgagcc

SEQ ID NO: 438677 - DNA, 25 bp, Mus musculus
gaggagctgcgcaacattatcggca

SEQ ID NO: 438678 - DNA, 25 bp, Mus musculus
gaggagctgcgtgccatattccagg

SEQ ID NO: 438679 - DNA, 25 bp, Mus musculus
gaggagctggtgtccaaccttggca

SEQ ID NO: 438680 - DNA, 25 bp, Mus musculus
gaggagcttcctgtaattccgaaag

SEQ ID NO: 438681 - DNA, 25 bp, Mus musculus
gaggagcttctagtgcaaccaggaa

SEQ ID NO: 438682 - DNA, 25 bp, Mus musculus
gaggagcttggtgacgcctagagtg

SEQ ID NO: 438683 - DNA, 25 bp, Mus musculus
gaggaggacagttccaaggtccccg

SEQ ID NO: 438684 - DNA, 25 bp, Mus musculus
gaggaggactcaacctcaaacccaa

SEQ ID NO: 438685 - DNA, 25 bp, Mus musculus
gaggaggccctgcagtcgattttta

SEQ ID NO: 438686 - DNA, 25 bp, Mus musculus
gaggaggcgaacatctatgctgtga

SEQ ID NO: 438687 - DNA, 25 bp, Mus musculus
gaggagggtacattcctgagccaga

SEQ ID NO: 438688 - DNA, 25 bp, Mus musculus
gaggagggtttctgcacacaaccca

SEQ ID NO: 438689 - DNA, 25 bp, Mus musculus
gaggaggtttttactgagcagcccc

SEQ ID NO: 438690 - DNA, 25 bp, Mus musculus
gaggagtacatccatcagctgtgtg

SEQ ID NO: 438691 - DNA, 25 bp, Mus musculus
gaggagtcaccactgaccgggtcat

SEQ ID NO: 438692 - DNA, 25 bp, Mus musculus
gaggagtccaaatgcctggtccgaa

SEQ ID NO: 438693 - DNA, 25 bp, Mus musculus
gaggagtccagtaaggttgccgcac

SEQ ID NO: 438694 - DNA, 25 bp, Mus musculus
gaggagtcccaaaatacagttctga

SEQ ID NO: 438695 - DNA, 25 bp, Mus musculus
gaggagtccgacgatgccaatagtt

SEQ ID NO: 438696 - DNA, 25 bp, Mus musculus
gaggagtccggatcagcacggctta

SEQ ID NO: 438697 - DNA, 25 bp, Mus musculus
gaggagtccttcaatgctgtccagg

SEQ ID NO: 438698 - DNA, 25 bp, Mus musculus
gaggagtcgtctcaacagaacacag

SEQ ID NO: 438699 - DNA, 25 bp, Mus musculus
gaggagtctgcatggaatccccagc

SEQ ID NO: 438700 - DNA, 25 bp, Mus musculus
gaggagtgaggcaaagctgaaccct

SEQ ID NO: 438701 - DNA, 25 bp, Mus musculus
gaggagtgtctatcttcatcaaggg

SEQ ID NO: 438702 - DNA, 25 bp, Mus musculus
gaggagtgttctccgtctactgtcc

SEQ ID NO: 438703 - DNA, 25 bp, Mus musculus
gaggagttccagtcagtggtctatg

SEQ ID NO: 438704 - DNA, 25 bp, Mus musculus
gaggagttccttgcgatggtgataa

SEQ ID NO: 438705 - DNA, 25 bp, Mus musculus
gaggagttcgacaactttctgccag

SEQ ID NO: 438706 - DNA, 25 bp, Mus musculus
gaggagtttgtgaccatgctgtgct

SEQ ID NO: 438707 - DNA, 25 bp, Mus musculus
gaggagttttgctaccagcccatgg
